United States Patent 8,461,315 (MICRORNAS AND USES THEREOF) - sequence listing, part 22

SEQ ID NO: 626438 - RNA, 64 nt, Homo Sapiens
ggcccuggaccccucuguacaguccguaggaaaaagucggaaugcucucgacggccucguccca

SEQ ID NO: 626439 - RNA, 64 nt, Homo Sapiens
ccaaagucguugccccucccugggccugggaaccagucggaacuggguuccaguccagcugugc

SEQ ID NO: 626440 - RNA, 64 nt, Homo Sapiens
gaugcaggggaaauguauuugcagccaaaggugcagucggaaaauaaaggaauuuguaggaaau

SEQ ID NO: 626441 - RNA, 64 nt, Homo Sapiens
gagggagcagaacagccagccccuuccagguggcagucggaaggguuuuuguuuuuguuucugu

SEQ ID NO: 626442 - RNA, 64 nt, Homo Sapiens
uuccuuuuccgugggagggacccugacaugcugcagucggaaguuugucucauugugccagaag

SEQ ID NO: 626443 - RNA, 64 nt, Homo Sapiens
cagcggcuucugaaagugccaguggcacagccccagucggaaucagcagaggcaccggcgauga

SEQ ID NO: 626444 - RNA, 64 nt, Homo Sapiens; identical to SEQ ID NO: 73453

SEQ ID NO: 626445 - RNA, 64 nt, Homo Sapiens; identical to SEQ ID NO: 73454

SEQ ID NO: 626446 - RNA, 64 nt, Homo Sapiens; identical to SEQ ID NO: 73455

SEQ ID NO: 626447 - RNA, 64 nt, Homo Sapiens; identical to SEQ ID NO: 73456

SEQ ID NO: 626448 - RNA, 64 nt, Homo Sapiens; identical to SEQ ID NO: 73457

SEQ ID NO: 626449 - RNA, 64 nt, Homo Sapiens; identical to SEQ ID NO: 73458

SEQ ID NO: 626450 - RNA, 64 nt, Homo Sapiens; identical to SEQ ID NO: 73459

SEQ ID NO: 626451 - RNA, 64 nt, Homo Sapiens; identical to SEQ ID NO: 73460

SEQ ID NO: 626452 - RNA, 64 nt, Homo Sapiens; identical to SEQ ID NO: 73461

SEQ ID NO: 626453 - RNA, 64 nt, Homo Sapiens; identical to SEQ ID NO: 73462

SEQ ID NO: 626454 - RNA, 64 nt, Homo Sapiens; identical to SEQ ID NO: 73463

SEQ ID NO: 626455 - RNA, 64 nt, Homo Sapiens; identical to SEQ ID NO: 73464

SEQ ID NO: 626456 - RNA, 64 nt, Homo Sapiens; identical to SEQ ID NO: 73465

SEQ ID NO: 626457 - RNA, 64 nt, Homo Sapiens; identical to SEQ ID NO: 73466

SEQ ID NO: 626458 - RNA, 64 nt, Homo Sapiens; identical to SEQ ID NO: 73467

SEQ ID NO: 626459 - RNA, 64 nt, Homo Sapiens; identical to SEQ ID NO: 73468

SEQ ID NO: 626460 - RNA, 64 nt, Homo Sapiens; identical to SEQ ID NO: 73469

SEQ ID NO: 626461 - RNA, 64 nt, Homo Sapiens; identical to SEQ ID NO: 73470

SEQ ID NO: 626462 - RNA, 64 nt, Homo Sapiens; identical to SEQ ID NO: 73471

SEQ ID NO: 626463 - RNA, 64 nt, Homo Sapiens; identical to SEQ ID NO: 73472

SEQ ID NO: 626464 - RNA, 64 nt, Homo Sapiens; identical to SEQ ID NO: 73473

SEQ ID NO: 626465 - RNA, 64 nt, Homo Sapiens; identical to SEQ ID NO: 73474

SEQ ID NO: 626466 - RNA, 64 nt, Homo Sapiens; identical to SEQ ID NO: 73475

SEQ ID NO: 626467 - RNA, 64 nt, Homo Sapiens; identical to SEQ ID NO: 73476

SEQ ID NO: 626468 - RNA, 64 nt, Homo Sapiens; identical to SEQ ID NO: 73477

SEQ ID NO: 626469 - RNA, 64 nt, Homo Sapiens; identical to SEQ ID NO: 73478

SEQ ID NO: 626470 - RNA, 64 nt, Homo Sapiens; identical to SEQ ID NO: 73479

SEQ ID NO: 626471 - RNA, 64 nt, Homo Sapiens; identical to SEQ ID NO: 73480

SEQ ID NO: 626472 - RNA, 64 nt, Homo Sapiens; identical to SEQ ID NO: 73481

SEQ ID NO: 626473 - RNA, 64 nt, Homo Sapiens; identical to SEQ ID NO: 73482

SEQ ID NO: 626474 - RNA, 64 nt, Homo Sapiens; identical to SEQ ID NO: 73483

SEQ ID NO: 626475 - RNA, 64 nt, Homo Sapiens; identical to SEQ ID NO: 73484

SEQ ID NO: 626476 - RNA, 64 nt, Homo Sapiens; identical to SEQ ID NO: 73485

SEQ ID NO: 626477 - RNA, 64 nt, Homo Sapiens; identical to SEQ ID NO: 73486

SEQ ID NO: 626478 - RNA, 64 nt, Homo Sapiens; identical to SEQ ID NO: 73487

SEQ ID NO: 626479 - RNA, 64 nt, Homo Sapiens; identical to SEQ ID NO: 73488

SEQ ID NO: 626480 - RNA, 64 nt, Homo Sapiens; identical to SEQ ID NO: 73489

SEQ ID NO: 626481 - RNA, 64 nt, Homo Sapiens; identical to SEQ ID NO: 73490

SEQ ID NO: 626482 - RNA, 64 nt, Homo Sapiens; identical to SEQ ID NO: 73491

SEQ ID NO: 626483 - RNA, 64 nt, Homo Sapiens; identical to SEQ ID NO: 73492

SEQ ID NO: 626484 - RNA, 64 nt, Homo Sapiens; identical to SEQ ID NO: 73493

SEQ ID NO: 626485 - RNA, 64 nt, Homo Sapiens; identical to SEQ ID NO: 73494

SEQ ID NO: 626486 - RNA, 64 nt, Homo Sapiens; identical to SEQ ID NO: 73495

SEQ ID NO: 626487 - RNA, 64 nt, Homo Sapiens; identical to SEQ ID NO: 73496

SEQ ID NO: 626488 - RNA, 64 nt, Homo Sapiens; identical to SEQ ID NO: 73497

SEQ ID NO: 626489 - RNA, 64 nt, Homo Sapiens; identical to SEQ ID NO: 73498

SEQ ID NO: 626490 - RNA, 64 nt, Homo Sapiens; identical to SEQ ID NO: 73499

SEQ ID NO: 626491 - RNA, 64 nt, Homo Sapiens; identical to SEQ ID NO: 73500

SEQ ID NO: 626492 - RNA, 64 nt, Homo Sapiens; identical to SEQ ID NO: 73501

SEQ ID NO: 626493 - RNA, 64 nt, Homo Sapiens; identical to SEQ ID NO: 73502

SEQ ID NO: 626494 - RNA, 64 nt, Homo Sapiens; identical to SEQ ID NO: 73503

SEQ ID NO: 626495 - RNA, 64 nt, Homo Sapiens; identical to SEQ ID NO: 73504

SEQ ID NO: 626496 - RNA, 64 nt, Homo Sapiens; identical to SEQ ID NO: 73505

SEQ ID NO: 626497 - RNA, 64 nt, Homo Sapiens; identical to SEQ ID NO: 73506

SEQ ID NO: 626498 - RNA, 64 nt, Homo Sapiens; identical to SEQ ID NO: 73507

SEQ ID NO: 626499 - RNA, 64 nt, Homo Sapiens; identical to SEQ ID NO: 73508

SEQ ID NO: 626500 - RNA, 64 nt, Homo Sapiens; identical to SEQ ID NO: 73509

SEQ ID NO: 626501 - RNA, 64 nt, Homo Sapiens; identical to SEQ ID NO: 73510

SEQ ID NO: 626502 - RNA, 64 nt, Homo Sapiens; identical to SEQ ID NO: 73511

SEQ ID NO: 626503 - RNA, 64 nt, Homo Sapiens; identical to SEQ ID NO: 73512

SEQ ID NO: 626504 - RNA, 64 nt, Homo Sapiens; identical to SEQ ID NO: 73513

SEQ ID NO: 626505 - RNA, 64 nt, Homo Sapiens; identical to SEQ ID NO: 211620

SEQ ID NO: 626506 - RNA, 64 nt, Homo Sapiens; identical to SEQ ID NO: 211621

SEQ ID NO: 626507 - RNA, 64 nt, Homo Sapiens; identical to SEQ ID NO: 211622

SEQ ID NO: 626508 - RNA, 64 nt, Homo Sapiens; identical to SEQ ID NO: 211623

SEQ ID NO: 626509 - RNA, 64 nt, Homo Sapiens; identical to SEQ ID NO: 211624

SEQ ID NO: 626510 - RNA, 64 nt, Homo Sapiens; identical to SEQ ID NO: 211625

SEQ ID NO: 626511 - RNA, 64 nt, Homo Sapiens; identical to SEQ ID NO: 211626

SEQ ID NO: 626512 - RNA, 64 nt, Homo Sapiens; identical to SEQ ID NO: 211627

SEQ ID NO: 626513 - RNA, 64 nt, Homo Sapiens; identical to SEQ ID NO: 211628

SEQ ID NO: 626514 - RNA, 64 nt, Homo Sapiens; identical to SEQ ID NO: 211629

SEQ ID NO: 626515 - RNA, 64 nt, Homo Sapiens; identical to SEQ ID NO: 211630

SEQ ID NO: 626516 - RNA, 64 nt, Homo Sapiens; identical to SEQ ID NO: 211631

SEQ ID NO: 626517 - RNA, 64 nt, Homo Sapiens; identical to SEQ ID NO: 211632

SEQ ID NO: 626518 - RNA, 64 nt, Homo Sapiens; identical to SEQ ID NO: 211633

SEQ ID NO: 626519 - RNA, 64 nt, Homo Sapiens; identical to SEQ ID NO: 211634

SEQ ID NO: 626520 - RNA, 64 nt, Homo Sapiens; identical to SEQ ID NO: 211635

SEQ ID NO: 626521 - RNA, 64 nt, Homo Sapiens; identical to SEQ ID NO: 211636

SEQ ID NO: 626522 - RNA, 64 nt, Homo Sapiens; identical to SEQ ID NO: 211637

SEQ ID NO: 626523 - RNA, 64 nt, Homo Sapiens; identical to SEQ ID NO: 211638

SEQ ID NO: 626524 - RNA, 64 nt, Homo Sapiens; identical to SEQ ID NO: 593177

SEQ ID NO: 626525 - RNA, 64 nt, Homo Sapiens; identical to SEQ ID NO: 593178

SEQ ID NO: 626526 - RNA, 64 nt, Homo Sapiens; identical to SEQ ID NO: 593179

SEQ ID NO: 626527 - RNA, 64 nt, Homo Sapiens; identical to SEQ ID NO: 593180

SEQ ID NO: 626528 - RNA, 64 nt, Homo Sapiens; identical to SEQ ID NO: 593181

SEQ ID NO: 626529 - RNA, 64 nt, Homo Sapiens; identical to SEQ ID NO: 593182

SEQ ID NO: 626530 - RNA, 64 nt, Homo Sapiens; identical to SEQ ID NO: 593183

SEQ ID NO: 626531 - RNA, 64 nt, Homo Sapiens; identical to SEQ ID NO: 593184

SEQ ID NO: 626532 - RNA, 64 nt, Homo Sapiens; identical to SEQ ID NO: 157838

SEQ ID NO: 626533 - RNA, 64 nt, Homo Sapiens; identical to SEQ ID NO: 157839

SEQ ID NO: 626534 - RNA, 64 nt, Homo Sapiens; identical to SEQ ID NO: 157840

SEQ ID NO: 626535 - RNA, 64 nt, Homo Sapiens; identical to SEQ ID NO: 157841

SEQ ID NO: 626536 - RNA, 64 nt, Homo Sapiens; identical to SEQ ID NO: 157842

SEQ ID NO: 626537 - RNA, 64 nt, Homo Sapiens; identical to SEQ ID NO: 157843

SEQ ID NO: 626538 - RNA, 64 nt, Homo Sapiens; identical to SEQ ID NO: 157844

SEQ ID NO: 626539 - RNA, 64 nt, Homo Sapiens; identical to SEQ ID NO: 157845

SEQ ID NO: 626540 - RNA, 64 nt, Homo Sapiens; identical to SEQ ID NO: 157846

SEQ ID NO: 626541 - RNA, 64 nt, Homo Sapiens; identical to SEQ ID NO: 157847

SEQ ID NO: 626542 - RNA, 64 nt, Homo Sapiens; identical to SEQ ID NO: 157848

SEQ ID NO: 626543 - RNA, 64 nt, Homo Sapiens; identical to SEQ ID NO: 157849

SEQ ID NO: 626544 - RNA, 64 nt, Homo Sapiens; identical to SEQ ID NO: 157850

SEQ ID NO: 626545 - RNA, 64 nt, Homo Sapiens; identical to SEQ ID NO: 157851

SEQ ID NO: 626546 - RNA, 64 nt, Homo Sapiens; identical to SEQ ID NO: 157852

SEQ ID NO: 626547 - RNA, 64 nt, Homo Sapiens; identical to SEQ ID NO: 157853

SEQ ID NO: 626548 - RNA, 64 nt, Homo Sapiens; identical to SEQ ID NO: 157854

SEQ ID NO: 626549 - RNA, 64 nt, Homo Sapiens; identical to SEQ ID NO: 157855

SEQ ID NO: 626550 - RNA, 64 nt, Homo Sapiens; identical to SEQ ID NO: 157856

SEQ ID NO: 626551 - RNA, 64 nt, Homo Sapiens; identical to SEQ ID NO: 157857

SEQ ID NO: 626552 - RNA, 64 nt, Homo Sapiens; identical to SEQ ID NO: 157858

SEQ ID NO: 626553 - RNA, 64 nt, Homo Sapiens; identical to SEQ ID NO: 157859

SEQ ID NO: 626554 - RNA, 64 nt, Homo Sapiens; identical to SEQ ID NO: 157860

SEQ ID NO: 626555 - RNA, 64 nt, Homo Sapiens; identical to SEQ ID NO: 157861

SEQ ID NO: 626556 - RNA, 64 nt, Homo Sapiens; identical to SEQ ID NO: 157862

SEQ ID NO: 626557 - RNA, 64 nt, Homo Sapiens; identical to SEQ ID NO: 157863

SEQ ID NO: 626558 - RNA, 64 nt, Homo Sapiens; identical to SEQ ID NO: 157864

SEQ ID NO: 626559 - RNA, 64 nt, Homo Sapiens; identical to SEQ ID NO: 157865

SEQ ID NO: 626560 - RNA, 64 nt, Homo Sapiens; identical to SEQ ID NO: 157866

SEQ ID NO: 626561 - RNA, 64 nt, Homo Sapiens; identical to SEQ ID NO: 157867

SEQ ID NO: 626562 - RNA, 64 nt, Homo Sapiens; identical to SEQ ID NO: 157868

SEQ ID NO: 626563 - RNA, 64 nt, Homo Sapiens; identical to SEQ ID NO: 157869

SEQ ID NO: 626564 - RNA, 64 nt, Homo Sapiens; identical to SEQ ID NO: 157870

SEQ ID NO: 626565 - RNA, 64 nt, Homo Sapiens; identical to SEQ ID NO: 157871

SEQ ID NO: 626566 - RNA, 64 nt, Homo Sapiens; identical to SEQ ID NO: 157872

SEQ ID NO: 626567 - RNA, 64 nt, Homo Sapiens; identical to SEQ ID NO: 157873

SEQ ID NO: 626568 - RNA, 64 nt, Homo Sapiens; identical to SEQ ID NO: 157874

SEQ ID NO: 626569 - RNA, 64 nt, Homo Sapiens; identical to SEQ ID NO: 157875

SEQ ID NO: 626570 - RNA, 64 nt, Homo Sapiens; identical to SEQ ID NO: 157876

SEQ ID NO: 626571 - RNA, 64 nt, Homo Sapiens; identical to SEQ ID NO: 157877

SEQ ID NO: 626572 - RNA, 64 nt, Homo Sapiens; identical to SEQ ID NO: 157878

SEQ ID NO: 626573 - RNA, 64 nt, Homo Sapiens; identical to SEQ ID NO: 157879

SEQ ID NO: 626574 - RNA, 64 nt, Homo Sapiens; identical to SEQ ID NO: 157880

SEQ ID NO: 626575 - RNA, 64 nt, Homo Sapiens; identical to SEQ ID NO: 157881

SEQ ID NO: 626576 - RNA, 64 nt, Homo Sapiens; identical to SEQ ID NO: 157882

SEQ ID NO: 626577 - RNA, 64 nt, Homo Sapiens; identical to SEQ ID NO: 157883

SEQ ID NO: 626578 - RNA, 64 nt, Homo Sapiens; identical to SEQ ID NO: 157884

SEQ ID NO: 626579 - RNA, 64 nt, Homo Sapiens; identical to SEQ ID NO: 157885

SEQ ID NO: 626580 - RNA, 64 nt, Homo Sapiens; identical to SEQ ID NO: 157886

SEQ ID NO: 626581 - RNA, 64 nt, Homo Sapiens; identical to SEQ ID NO: 157887

SEQ ID NO: 626582 - RNA, 64 nt, Homo Sapiens; identical to SEQ ID NO: 157888

SEQ ID NO: 626583 - RNA, 64 nt, Homo Sapiens; identical to SEQ ID NO: 157889

SEQ ID NO: 626584 - RNA, 64 nt, Homo Sapiens
aauugccuauuuagcuccucuuuucuuccuuuuuauuucauaagacugcuaggaagugauuuuu

SEQ ID NO: 626585 - RNA, 64 nt, Homo Sapiens
aaguauucacugaguaggggugucccaugacacuauuucauauucuacagaaguaaaucagguu

SEQ ID NO: 626586 - RNA, 64 nt, Homo Sapiens
cgugggauugguguaggguuaaaucaucaacauuauuucauaaaauaagaauuuguucuguguu

SEQ ID NO: 626587 - RNA, 64 nt, Homo Sapiens
ucaacaauguguaauuaauauuuuugauacagugauuucauauuggaaucauuauuugugcaaa

SEQ ID NO: 626588 - RNA, 64 nt, Homo Sapiens
ucauguaaaugugauggauuucuuaaucauauuuauuucauauuaauccaaguuuaucaaacuu

SEQ ID NO: 626589 - RNA, 64 nt, Homo Sapiens
ugccuuguauuuagucagagggcuagaggugcagauuucauauuuucuuaaugaaaauauuuuc

SEQ ID NO: 626590 - RNA, 64 nt, Homo Sapiens
gaaaugauacuguagacaaaagcuguacuaguucauuucauaaggauuucauuugguuuaacua

SEQ ID NO: 626591 - RNA, 64 nt, Homo Sapiens
caaaccaaacaaaaauauaucgacauuuuaagauauuucauagaugcaauuuaaauaaaaauua

SEQ ID NO: 626592 - RNA, 64 nt, Homo Sapiens
cagucggcccaagaaaucaaaauaaaggaaacacauuucauauacugcagguaacaaaagucaa

SEQ ID NO: 626593 - RNA, 64 nt, Homo Sapiens
uuguugaaggagaaaaacuaaauaaauacgaguaauuucauagaaacgaauacacuaguguaca

SEQ ID NO: 626594 - RNA, 64 nt, Homo Sapiens
guccucccuccaaacugaaacuaauuugauuuugauuucauauucaauaugcaauaauuauguu

SEQ ID NO: 626595 - RNA, 64 nt, Homo Sapiens
uaggauuaaucugugaacaauggguuuacggucuauuucauaauugaaauauuuauuuuaaaaa

SEQ ID NO: 626596 - RNA, 64 nt, Homo Sapiens
gccacagccugccuccaucagcuucuuauuuaguauuucauaugcccauuagcccuaugcuuca

SEQ ID NO: 626597 - RNA, 64 nt, Homo Sapiens
uucuucugaaaaacauuuaucagaaacuuaaaauauuucauaccguuugauccaguagcuucuu

SEQ ID NO: 626598 - RNA, 64 nt, Homo Sapiens
ucuagauaauucugaauuuuacacccuguacuucauuucauauuuaugaagugaacugagcguc

SEQ ID NO: 626599 - RNA, 64 nt, Homo Sapiens
cauuuuacugagaaaugaccuaauucagguacccauuucauagauguugucauuuguauaucag

SEQ ID NO: 626600 - RNA, 64 nt, Homo Sapiens
aagauggcuauaauuacauauuuguuguuuggauauuucauauaucuuuauauuauuaaauaua

SEQ ID NO: 626601 - RNA, 64 nt, Homo Sapiens
uuucugaguaaauaugauugaaaauuuuauaaauauuucauauuaaacuuacuagauauaaauu

SEQ ID NO: 626602 - RNA, 64 nt, Homo Sapiens
uccaagugguggcugacuguugcagggaaugagaauuucauaauacacugcuauuucagaccuc

SEQ ID NO: 626603 - RNA, 64 nt, Homo Sapiens
aguguacuugauuacugggcauccuuguaauauaauuucauaccacugacacauuauacuugua

SEQ ID NO: 626604 - RNA, 64 nt, Homo Sapiens
ugauauuacaaucauuuauuacucaacagacaauauuucauauuuuugaaauuaaagauauucc

SEQ ID NO: 626605 - RNA, 64 nt, Homo Sapiens
uaacugagaauaauuaaaaccuuacuaaauccauauuucauaaauuuuuugucucucuccugau

SEQ ID NO: 626606 - RNA, 64 nt, Homo Sapiens
cuaggaaagaaguggaugggaauuguaggcauagauuucauaucaagggcauuucaagacagaa

SEQ ID NO: 626607 - RNA, 64 nt, Homo Sapiens
uguuuuuguuauaagccauuugaauuuuuaaaaaauuucauacaugcaauggaauauagauaug

SEQ ID NO: 626608 - RNA, 64 nt, Homo Sapiens
augauaguauugguuauuuucuuaucuuguaaagauuucauaaauuaaauauuguacuacugug

SEQ ID NO: 626609 - RNA, 64 nt, Homo Sapiens
uaauuuaaaaaucacuggauuuauuuuugccuuuauuucauaaguauaaauaguauuuuacauc

SEQ ID NO: 626610 - RNA, 64 nt, Homo Sapiens
guuuugcacaacuguaacccuguuguuacuuuauauuucauaaucaggcaaaaauacuuacagu

SEQ ID NO: 626611 - RNA, 64 nt, Homo Sapiens
uuaauucuucuaaauuaccacuugccauuaagcuauuucauaauaaauucuguacaguuucccc

SEQ ID NO: 626612 - RNA, 64 nt, Homo Sapiens
aggaccaguacaagaaugucgaaaucauguuugaauuucauaguuaaaauauugugacagauuu

SEQ ID NO: 626613 - RNA, 64 nt, Homo Sapiens
aucucugccuuauaaguggucuacaguccuuuauauuucauaccuuuuucucuuacuguuuucu

SEQ ID NO: 626614 - RNA, 64 nt, Homo Sapiens
ccauuuacuguagguaguauucucuuccuacuauauuucauaucuaccuacuacauuucauauc

SEQ ID NO: 626615 - RNA, 64 nt, Homo Sapiens
ucucuuccuacuauauuucauaucuaccuacuacauuucauaucauuccuacuacauuucauau

SEQ ID NO: 626616 - RNA, 64 nt, Homo Sapiens
aucuaccuacuacauuucauaucauuccuacuacauuucauaucuaccuacauuuacauguagg

SEQ ID NO: 626617 - RNA, 64 nt, Homo Sapiens
gacagaguggggaaaaaaagcaauucacaaaaccauuucauauuuuuuaaaauauugugcuuaa

SEQ ID NO: 626618 - RNA, 64 nt, Homo Sapiens
auuuuaaauaaaauagaauuacuacaauucugcaauuucauacuaccuaaaaaagacuagauuu

SEQ ID NO: 626619 - RNA, 64 nt, Homo Sapiens
aaaaagacgggauuuuaguuccuggccuuauaucauuucauauaauaaguuugggcugaagaaa

SEQ ID NO: 626620 - RNA, 64 nt, Homo Sapiens
gcccugucuuauucaacuuuuggucucuauugauauuucauaggcugcugaauuaaugugauuu

SEQ ID NO: 626621 - RNA, 64 nt, Homo Sapiens
uccuauggcuguacaauuacaucgauucuuccaaauuucauauuucauacauggcacuuuggca

SEQ ID NO: 626622 - RNA, 64 nt, Homo Sapiens
gcuguacaauuacaucgauucuuccaaauuucauauuucauacauggcacuuuggcauaccgaa

SEQ ID NO: 626623 - RNA, 64 nt, Homo Sapiens
cuuaauucuuuguaaaucugauuggguuugcuuuauuucauagguaaauaugacuagagaauau

SEQ ID NO: 626624 - RNA, 64 nt, Homo Sapiens
cugaaaagugucucauaggaaggauuauaguaauauuucauauaccuugcauguaaaucauuca

SEQ ID NO: 626625 - RNA, 64 nt, Homo Sapiens
uacaaauuuuccuucauauuacuacaaaggacuuauuucauaauugauuugggaaauauucuuu

SEQ ID NO: 626626 - RNA, 64 nt, Homo Sapiens
aaagcauaauuuuguccacauugauuuauuuuacauuucauaugagcacauagcccuguuauau

SEQ ID NO: 626627 - RNA, 64 nt, Homo Sapiens
gcugaguuugcacgcuuggaugccuuauucuaagauuucauaaguugguguugagaacaucagu

SEQ ID NO: 626628 - RNA, 64 nt, Homo Sapiens
auuuugauaaaaugccacaagaaaauggacucugauuucauagcugguaacuucuagaaagcca

SEQ ID NO: 626629 - RNA, 64 nt, Homo Sapiens
aaaacuacguuaauuuuaccgauuuuuuuuuauuauuucauaaggcccauuguagcauauguuu

SEQ ID NO: 626630 - RNA, 64 nt, Homo Sapiens
uccuuggaaagcuucuuauaucuggucuacaaagauuucauaacugaggugaugauaguuggcc

SEQ ID NO: 626631 - RNA, 64 nt, Homo Sapiens
uacuuuuucauauauaauuagaucuuucuuuguaauuucauauguaguucuucauagggucuca

SEQ ID NO: 626632 - RNA, 64 nt, Homo Sapiens
guaaacugagaucuuaagucuccuagucuacugaauuucauaugguguauaauacagauuuaua

SEQ ID NO: 626633 - RNA, 64 nt, Homo Sapiens
cacucacuuuuacacucacucugccauaugguuuauuucauauaggcuuauaaucauuuuuauu

SEQ ID NO: 626634 - RNA, 64 nt, Homo Sapiens
uuacaaaggaggaacggaagucuaaacaauaaauauuucauaauuuucaugucauauuacucag

SEQ ID NO: 626635 - RNA, 64 nt, Homo Sapiens
uuguauuuuugaccugccuuuuauauguaugaauauuucauaguuuugcauaucagauguaggc

SEQ ID NO: 626636 - RNA, 64 nt, Homo Sapiens
caauaaaacuuuauuuauggacacuaaaauuugaauuucauaaaauuuucccaugucaagaaua

SEQ ID NO: 626637 - RNA, 64 nt, Homo Sapiens
gcaaaaaacaaaaacaaaaaacagugcauuagcaauuucauagcaagugcaugcacuaggaaaa

SEQ ID NO: 626638 - RNA, 64 nt, Homo Sapiens
auuuuacacaaaaauauuuaugcagauuuucagaauuucauaucaggaaaugaccuuuuuaugu

SEQ ID NO: 626639 - RNA, 64 nt, Homo Sapiens
ggugaugguagagaagcugcccggaauaaacugaauuucauauguucuaaaaugacuagcaaug

SEQ ID NO: 626640 - RNA, 64 nt, Homo Sapiens
auuauuaagcugacuaagcaaugaucuaauacacauuucauauuuucuuuauaauaauuucuua

SEQ ID NO: 626641 - RNA, 64 nt, Homo Sapiens
cgucauuuccagucacaguaggcgaucuuucguaauuucauaaaagcaguucguuugcaguaug

SEQ ID NO: 626642 - RNA, 64 nt, Homo Sapiens
ucuaaaaaucuauagcagaguuucucuauuuuauauuucauagauuuaaaaaacccaaauaaag

SEQ ID NO: 626643 - RNA, 64 nt, Homo Sapiens
aauggaauucuacaauauucugcuuauucuggucauuucauauauauuucucucucuguagauu

SEQ ID NO: 626644 - RNA, 64 nt, Homo Sapiens
aaacuagugaauaagugaaauucaaacucuguuuauuucauacuucauuagccaguuuaacuga

SEQ ID NO: 626645 - RNA, 64 nt, Homo Sapiens
ggaauuauuuuuuuuuucauaaugagucuuugguauuucauauagcaguguaaguuauauguga

SEQ ID NO: 626646 - RNA, 64 nt, Homo Sapiens
caagaagagccaaauugacucucuaaaucugguguauggguauuaaauaaaauucauucucaag

SEQ ID NO: 626647 - RNA, 64 nt, Homo Sapiens
aaacugucaaccuaccaaaaacgauauuguggcuuauggguauugcugucucauucuugguaua

SEQ ID NO: 626648 - RNA, 64 nt, Homo Sapiens
aucuuuuuucacuguaagagguaaccuuuaacaauauggguauuaccuuugucucuucauaccg

SEQ ID NO: 626649 - RNA, 64 nt, Homo Sapiens
gacuccguauuaugacuccauuagugagcugugguauggguaggauuuuccuacuucuucugua

SEQ ID NO: 626650 - RNA, 64 nt, Homo Sapiens
uuguauaauucucugaaauacucagcuuuugucauauggguaaaaauuaaagaugucauugaac

SEQ ID NO: 626651 - RNA, 64 nt, Homo Sapiens
uuccuuccacucuggagcagggugaggggaauguuauggguaacagacaugcaggcauggcucu

SEQ ID NO: 626652 - RNA, 64 nt, Homo Sapiens
gacaaccaguccuccacaucacagcauuuagacauauggguaaaauguuauuucuagugaauug

SEQ ID NO: 626653 - RNA, 64 nt, Homo Sapiens
aguucagaauuuuaaaguacauuuucgaugcuuuuauggguauuuuuguaguuucuuuguagag

SEQ ID NO: 626654 - RNA, 64 nt, Homo Sapiens
aaaugaaugcuggucagugggacauuuugucaacuauggguauugggugcuuaacugucuaaua

SEQ ID NO: 626655 - RNA, 64 nt, Homo Sapiens
ugggcccaauaaaacaacacacauuuuuaaaaaauauggguauugauguccggcugaagguaag

SEQ ID NO: 626656 - RNA, 64 nt, Homo Sapiens
aaaauuuauaucuggguuaaguguuuaucauauauauggguacuuuguaauaucuaaaaacuua

SEQ ID NO: 626657 - RNA, 64 nt, Homo Sapiens
cacccuggguuauaaggaggcuuaggagagagguuauggguauuggugucucuauccccaggaa

SEQ ID NO: 626658 - RNA, 64 nt, Homo Sapiens
gccuucccuucaauuuuaaacugaagcauuuuaauauggguagaaacucuacaccaaauacacu

SEQ ID NO: 626659 - RNA, 64 nt, Homo Sapiens
uuaagcacuucuuaacauugagucgaagugguaguauggguaagcuuuucagauauuugagagc

SEQ ID NO: 626660 - RNA, 64 nt, Homo Sapiens
gggguauccuacugauacacacguauucaaaguuuauggguacaacaaagacauaguacaugua

SEQ ID NO: 626661 - RNA, 64 nt, Homo Sapiens
uucauguuuuugaucaaaaacuauuugggauauguauggguaggguaaaucaguaagagguguu

SEQ ID NO: 626662 - RNA, 64 nt, Homo Sapiens
ccacuccaccaugcuauuaagacucuggcagaguuauggguaggauauggaucccuacaugaau

SEQ ID NO: 626663 - RNA, 64 nt, Homo Sapiens
uauugggcuuuugucuuuuaaagaauaugucuacuauggguauuuuuuuuuuaaauguuaaaau

SEQ ID NO: 626664 - RNA, 64 nt, Homo Sapiens
uguguguauguguauguauaugacuuuaaauagcuauggguacaauauuaaaaaccacuggaac

SEQ ID NO: 626665 - RNA, 64 nt, Homo Sapiens
cuuuuuaccaauuauaaggaaaugugaauucuauuauggguagcuaaacuauaaauucauugaa

SEQ ID NO: 626666 - RNA, 64 nt, Homo Sapiens
uauguccaauuuccuggcucauuucauugugcucuauggguacguauaaaaagcaagaauucug

SEQ ID NO: 626667 - RNA, 64 nt, Homo Sapiens
auuggcaaaauuuauucucauuauaccugcuucauauggguauauuacuauuaaaacagaauac

SEQ ID NO: 626668 - RNA, 64 nt, Homo Sapiens
uaauuaauuuauuucauagaccuagaaacuacacuauggguaaugaguguguguacacaugccu

SEQ ID NO: 626669 - RNA, 64 nt, Homo Sapiens
caaggcuauuugccagcauagaaaaaguauaucauauggguacauuacauaacuuggugaaacu

SEQ ID NO: 626670 - RNA, 64 nt, Homo Sapiens
uuucuguacaugugaaauuauuuggguaaagguauauggguauuagauuucuuggugguagcua

SEQ ID NO: 626671 - RNA, 64 nt, Homo Sapiens
uuccacagugcccagcuaauugaguagcuaggacuauggguacaaucuuccugccucaggcuuc

SEQ ID NO: 626672 - RNA, 64 nt, Homo Sapiens
aauuauggaaacagaugaaaagccucuguuuugauauggguaguauuuuuuacauuuuacacac

SEQ ID NO: 626673 - RNA, 64 nt, Homo Sapiens
uauuggccaaaauauggacacaaauauagacuaauauggguaauuacccuuugguuuaucuaaa

SEQ ID NO: 626674 - RNA, 64 nt, Homo Sapiens
uauaucuuauucuuaacuuuuguaaaccauguuuuauggguaacuuuuuaguuuucccaaaagg

SEQ ID NO: 626675 - RNA, 64 nt, Homo Sapiens
uggggaauaaaugggucacugaacuauuuuucauuauggguaacguaaggcucaguaaaugaca

SEQ ID NO: 626676 - RNA, 64 nt, Homo Sapiens
aguuuagguggcuucuguuuuaccacuggaaacguauggguaggagucacauagagcuugggag

SEQ ID NO: 626677 - RNA, 64 nt, Homo Sapiens
acaaaagugaacauugcaugacuguguauccuuuuauggguaaaucugguauuuacagcaaaau

SEQ ID NO: 626678 - RNA, 64 nt, Homo Sapiens
gugagcccugaaauacaugcuuuguuguuguuaauauggguaaaaguauuccugugucuacugu

SEQ ID NO: 626679 - RNA, 64 nt, Homo Sapiens
gaugaggucaugguaucauauauuacauaugguguauggguauuaaucguaacaccuccauuug

SEQ ID NO: 626680 - RNA, 64 nt, Homo Sapiens
ggaagccagggcggcaaauguuccagaaacuuuauauggguagaguucucucuacucagauccc

SEQ ID NO: 626681 - RNA, 64 nt, Homo Sapiens
augcagugcaccuaaucugggucaauaaaucgaguauggguauuccaguaaauugcuaaguaau

SEQ ID NO: 626682 - RNA, 64 nt, Homo Sapiens
gcuuccccaggcauuaugaaccucugcuuaggaauauggguaggagugaaaggccuggcagaua

SEQ ID NO: 626683 - RNA, 64 nt, Homo Sapiens
cuuuggucuucuauuccaaggguaagguugcgauuauggguaagauuggccagagguaggaaug

SEQ ID NO: 626684 - RNA, 64 nt, Homo Sapiens
ccaagauauuauguguaaauuguguuauuauguauauggguaaagauguacaaauauauguccu

SEQ ID NO: 626685 - RNA, 64 nt, Homo Sapiens
aagaucagaaaugcuagaauucuugacuuuuguguauggguaguaaaucuagcucacugaaaau

SEQ ID NO: 626686 - RNA, 64 nt, Homo Sapiens
auguuacaaaguauugaauaccacaguguugauauauggguaggcauuuucuuagcaucauugc

SEQ ID NO: 626687 - RNA, 64 nt, Homo Sapiens
uucacauuuaauuuauaaagaggccuuguuuauauauggguagcgauggaaaucaaugaaaaag

SEQ ID NO: 626688 - RNA, 64 nt, Homo Sapiens
uaaacuuaauuuacccaauaacccuuuugcaucauauggguaucgggaagcuuauauaaaagug

SEQ ID NO: 626689 - RNA, 64 nt, Homo Sapiens
accuauuggcuuucaguaacaaugguauaauaauuauggguaugaaaaugacucuucauaugac

SEQ ID NO: 626690 - RNA, 64 nt, Homo Sapiens
uaaacccaaaguccccacuuuaaccaaguccuccuauggguacauaaaaugucuuucccaucca

SEQ ID NO: 626691 - RNA, 64 nt, Homo Sapiens
gaguauauuuucugcuguauucauacuaugaacauauggguagagcacuuguuugucagcccuc

SEQ ID NO: 626692 - RNA, 64 nt, Homo Sapiens
ggaauaaauccaaggaccaguuuuuacccaaauauauggguagcacaguuuaucacauagaaac

SEQ ID NO: 626693 - RNA, 64 nt, Homo Sapiens
uuacugauuuugcucauccacuucccuacacaucuauggguaucacacccaagacuacccacca

SEQ ID NO: 626694 - RNA, 64 nt, Homo Sapiens
uuuuuucgaaguuauuaagccacccuuguccauuuauggguauucacccagaaagggggcccaa

SEQ ID NO: 626695 - RNA, 64 nt, Homo Sapiens
aaaggcuagucagaacccuauuugaaaacaaacuuauggguaaucagauuacugguaaaaauua

SEQ ID NO: 626696 - RNA, 64 nt, Homo Sapiens
uuuucagaaaauauugucauuauagagagugaauuauggguauuccaagaauuacagcuuuauu

SEQ ID NO: 626697 - RNA, 64 nt, Homo Sapiens
caucuuauuggcugugggcagagacuaggacccuuauggguacauuucaguaaucucucacugc

SEQ ID NO: 626698 - RNA, 64 nt, Homo Sapiens
ugaauacuguugugaaagugaaaaacaaugauuguauggguacucaaaguauaauuucuacuga

SEQ ID NO: 626699 - RNA, 64 nt, Homo Sapiens
uuuagaugaucuaagaaaucuagugacagguuuuuauggguacuuaagccaucacaccuggccc

SEQ ID NO: 626700 - RNA, 64 nt, Homo Sapiens
aaggcaagucacuaguuugauacauguguauaaguauggguaaaauguaccacuagaaagguau

SEQ ID NO: 626701 - RNA, 64 nt, Homo Sapiens
uguugccaaagcuggcuuuuaaaaugacuuuuauuauggguauggguguuugggccacgauuuu

SEQ ID NO: 626702 - RNA, 64 nt, Homo Sapiens
uuaugguauaaaaguuaugagggauaaaaaagguuauggguaacaugggauuaaaaaaaguuau

SEQ ID NO: 626703 - RNA, 64 nt, Homo Sapiens
guauuugaaagcuguuagcuggaaaugucucggauauggguacucgagaaagaauuuuuuccaa

SEQ ID NO: 626704 - RNA, 64 nt, Homo Sapiens
ggcaaaacacuuuuuucacccuuuggaaucauaguauggguagaaguuaugauuuaucuugaaa

SEQ ID NO: 626705 - RNA, 64 nt, Homo Sapiens
gauaaccgacccagacugcuuugugacaugaagcuauggguaagcguuuuguaaacuucuguuc

SEQ ID NO: 626706 - RNA, 64 nt, Homo Sapiens
ccaaaccugaccugaacuuacacugauaggaagcuauggguaauuaugauguguuccuuuuagu

SEQ ID NO: 626707 - RNA, 64 nt, Homo Sapiens
uuuuauuuuguguaauuuuaauuauauguaaacauauggguauuaaaggaaaauuguuuaaagu

SEQ ID NO: 626708 - RNA, 64 nt, Homo Sapiens
gaaaguuaccuaaucccuccuaaagacacagcaguauggguauaacauccuugccuucccauuu

SEQ ID NO: 626709 - RNA, 64 nt, Homo Sapiens
ccuuaauguuguuacaaagauaugguaacuguaauauggguaaaaguuuauucaagaaaagagu

SEQ ID NO: 626710 - RNA, 64 nt, Homo Sapiens
uauacuaauguuuuuauaugcauuuucuagaaaguauggguaucuuugaaagggucuguauaau

SEQ ID NO: 626711 - RNA, 64 nt, Homo Sapiens
uuuuucuuguguccuugcagugggggcuucaagguauggguauaaaacuuggucuugaauguac

SEQ ID NO: 626712 - RNA, 64 nt, Homo Sapiens
ugguuaagucacaacgacgaagugcugagaagguuauggguaccaggaagaaacaaacagaagu

SEQ ID NO: 626713 - RNA, 64 nt, Homo Sapiens
aaugcaccaagcaauuaugguggaccuauuacccuauggguaagaaauaaauggaaauaugaca

SEQ ID NO: 626714 - RNA, 64 nt, Homo Sapiens
accgggaugaacccaccaccuuuacugauucguuuauggguaguagguuggaaacuaagucuca

SEQ ID NO: 626715 - RNA, 64 nt, Homo Sapiens
auaaugccaguaauucagcuagauugaaauaagcuauggguaaaacaacaauaucaacaacaag

SEQ ID NO: 626716 - RNA, 64 nt, Homo Sapiens
gguuacagagggaggugauagaugaacuuugccauauggguagauggaauauuuuugaggccug

SEQ ID NO: 626717 - RNA, 64 nt, Homo Sapiens
ggcuuucuuuuucacuuugaaaagcacuguugaauauggguaucuucaaaaaauguuguaacug

SEQ ID NO: 626718 - RNA, 64 nt, Homo Sapiens
uucuaagacuaaauagguaguaauauuuuauuuguauggguaucuuguuuucauuugguccaaa

SEQ ID NO: 626719 - RNA, 64 nt, Homo Sapiens
ucguggccgcacauccuacagcagccuggguggcuauggguacuuauccaccuccaucuucuuu

SEQ ID NO: 626720 - RNA, 64 nt, Homo Sapiens
auuguagucaggaaaacagaauuuuuaaauuuuuuauggguagagcaacuuauuuguaagaagg

SEQ ID NO: 626721 - RNA, 64 nt, Homo Sapiens
gcucuuuuacuggguucuuaaccagaugguuguguauggguagcacuacuaaaaguuuagaacu

SEQ ID NO: 626722 - RNA, 64 nt, Homo Sapiens
uuccagacacagaauacaugauaaauacugauauuauggguaaucugcuuuccauauuuaccua

SEQ ID NO: 626723 - RNA, 64 nt, Homo Sapiens
cuuuuccugagcuuugaauauuagaucugaccaauauggguaaccaaugcccuuagguaaggua

SEQ ID NO: 626724 - RNA, 64 nt, Homo Sapiens
aucugccauaaauucuuccuauuuauucaucuguuauggguaaggaaauaagugacccaacaaa

SEQ ID NO: 626725 - RNA, 64 nt, Homo Sapiens
agauuaaauggacucaucaggguaagaggaauaauauggguaaaacaagaaauggcccgauagu

SEQ ID NO: 626726 - RNA, 64 nt, Homo Sapiens
aaggaguuauaugucugcuauugguagucaagaguauggguaauuaaaaguuuggcuuccuuuc

SEQ ID NO: 626727 - RNA, 64 nt, Homo Sapiens
cuaaccacuuuuaucagagaagacaguagaaauguauggguaguaaggggaucagcaugaguau

SEQ ID NO: 626728 - RNA, 64 nt, Homo Sapiens
acguauguucauuauuuguauggaaaguagaauuuauggguacauuuuaaaaagcuccuguuuu

SEQ ID NO: 626729 - RNA, 64 nt, Homo Sapiens
gggcugcuucaaacucaaacacagagagaaacucuauggguaucaaacagcucaggcuguuuuu

SEQ ID NO: 626730 - RNA, 64 nt, Homo Sapiens
ccaaagcugccugugccaugcccaaggccuagguuauggguacggcaaccacaugucccagauc

SEQ ID NO: 626731 - RNA, 64 nt, Homo Sapiens
ggguuugcaguuuucugaguaggugaguuuugaauauggguaaaucagaauaaugagacaacuu

SEQ ID NO: 626732 - RNA, 64 nt, Homo Sapiens
gaagagaugcagagaaauguggaauuuguggaccuauggguaauuuaugcuuuccuccuaaaaa

SEQ ID NO: 626733 - RNA, 64 nt, Homo Sapiens
aaaccacuauggagaacugcuuagauucauugucuauggguacauuuuauaaaaaggcagauuc

SEQ ID NO: 626734 - RNA, 64 nt, Homo Sapiens
aaauuauuuuauaucauacaguuuucauugauuauauggguauauauucaucuaauaaaucagu

SEQ ID NO: 626735 - RNA, 64 nt, Homo Sapiens
ugagccauaauaugaugggccaccgcaaggaaauuauggguaugaauccccacuuggaauucag

SEQ ID NO: 626736 - RNA, 64 nt, Homo Sapiens
aguaaauauuuaccagcaacuuauaaaaucaaaauauggguaaacaccgccuugguaaacagua

SEQ ID NO: 626737 - RNA, 64 nt, Homo Sapiens
uauguuuauuccuacauuuuauucauuuuuaauguauggguaauugguggcacaugacuuuaca

SEQ ID NO: 626738 - RNA, 64 nt, Homo Sapiens
ggugacacugcuccucuagaagcagguuugaaauuauggguauguuuucuugucacagugacug

SEQ ID NO: 626739 - RNA, 64 nt, Homo Sapiens
ugaauauauauguauacacauacuuacauacuuauauggguaucuguauagauaauuuguauua

SEQ ID NO: 626740 - RNA, 64 nt, Homo Sapiens
ccuucguagugucaguuuuuguuucagccuuccuuauggguaugcuguggcauaucccugagau

SEQ ID NO: 626741 - RNA, 64 nt, Homo Sapiens
uguuuguuuguuuguuuaaaacauaaccuucuucuauggguauuauuuuuaucaaccagucaac

SEQ ID NO: 626742 - RNA, 64 nt, Homo Sapiens
auauuguggucugaauggcgaaauuguaggaauuuauggguauaccaccaaggccuccuaggaa

SEQ ID NO: 626743 - RNA, 64 nt, Homo Sapiens
gaccugaaagauccauggaaucuaaaaaaauguauauggguaaguacauacuuacuguaacaca

SEQ ID NO: 626744 - RNA, 64 nt, Homo Sapiens
ucaggaaggagagaagcgacaucaugauacauccuauggguauuaaaaagccaauagaauauua

SEQ ID NO: 626745 - RNA, 64 nt, Homo Sapiens
uuguugugucccaaaccaaagcuaaguccuaaucuauggguacaagguuaggaauggguagaua

SEQ ID NO: 626746 - RNA, 64 nt, Homo Sapiens
acugagacguccccgugagcuguccccuucugcauauggguaaagucucaggcaagcaaaagau

SEQ ID NO: 626747 - RNA, 64 nt, Homo Sapiens
gguccuucucucauucuccgaacuuacuccuuuuuauggguaagucaacuagguuuacaguccc

SEQ ID NO: 626748 - RNA, 64 nt, Homo Sapiens
ugaacaugauugcucucugucucuuuuuucagcuuauggguauuuaucuucuauuaguauuugu

SEQ ID NO: 626749 - RNA, 64 nt, Homo Sapiens
uuuuuaaaacuucaaauaucucaccacagugaauuauggguaaggugauaauauguuuaauuag

SEQ ID NO: 626750 - RNA, 64 nt, Homo Sapiens
aaugugagcaguguuugccuucagguggugggguuauggguaguuuuuauuuucuuccuucuac

SEQ ID NO: 626751 - RNA, 64 nt, Homo Sapiens
gagagaacacagugcuauuugcauuucuguuccauauggguaguuaugggguuuaccuguuuua

SEQ ID NO: 626752 - RNA, 64 nt, Homo Sapiens
agaccaugucuacuaauuacaauguaauggagcuuauggguagauaagcccacuuuguucuuuu

SEQ ID NO: 626753 - RNA, 64 nt, Homo Sapiens
uuuacauuggugguauugcauguuuuaacuuagguauggguaaaacuguguuacacaaaguccu

SEQ ID NO: 626754 - RNA, 64 nt, Homo Sapiens
gcucugacaaagcuucccgauugucucuucuccuuauggguaggaacaagaauaaaggcagcug

SEQ ID NO: 626755 - RNA, 64 nt, Homo Sapiens
gccuuuaugguugucauggcaaauucaggugauauauggguaugagguuugaacacugaggacu

SEQ ID NO: 626756 - RNA, 64 nt, Homo Sapiens; identical to SEQ ID NO: 145614

SEQ ID NO: 626757 - RNA, 64 nt, Homo Sapiens; identical to SEQ ID NO: 145615

SEQ ID NO: 626758 - RNA, 64 nt, Homo Sapiens; identical to SEQ ID NO: 145616

SEQ ID NO: 626759 - RNA, 64 nt, Homo Sapiens; identical to SEQ ID NO: 145617

SEQ ID NO: 626760 - RNA, 64 nt, Homo Sapiens; identical to SEQ ID NO: 145618

SEQ ID NO: 626761 - RNA, 64 nt, Homo Sapiens; identical to SEQ ID NO: 145619

SEQ ID NO: 626762 - RNA, 64 nt, Homo Sapiens; identical to SEQ ID NO: 145620

SEQ ID NO: 626763 - RNA, 64 nt, Homo Sapiens; identical to SEQ ID NO: 145621

SEQ ID NO: 626764 - RNA, 64 nt, Homo Sapiens; identical to SEQ ID NO: 145622

SEQ ID NO: 626765 - RNA, 64 nt, Homo Sapiens; identical to SEQ ID NO: 145623

SEQ ID NO: 626766 - RNA, 50 nt, Homo Sapiens; identical to SEQ ID NO: 145624

SEQ ID NO: 626767 - RNA, 54 nt, Homo Sapiens; identical to SEQ ID NO: 145625

SEQ ID NO: 626768 - RNA, 64 nt, Homo Sapiens; identical to SEQ ID NO: 145626

SEQ ID NO: 626769 - RNA, 64 nt, Homo Sapiens; identical to SEQ ID NO: 145627

SEQ ID NO: 626770 - RNA, 64 nt, Homo Sapiens; identical to SEQ ID NO: 145628

SEQ ID NO: 626771 - RNA, 64 nt, Homo Sapiens; identical to SEQ ID NO: 145629

SEQ ID NO: 626772 - RNA, 64 nt, Homo Sapiens; identical to SEQ ID NO: 145630

SEQ ID NO: 626773 - RNA, 64 nt, Homo Sapiens; identical to SEQ ID NO: 145631

SEQ ID NO: 626774 - RNA, 64 nt, Homo Sapiens; identical to SEQ ID NO: 145632

SEQ ID NO: 626775 - RNA, 64 nt, Homo Sapiens; identical to SEQ ID NO: 145633

SEQ ID NO: 626776 - RNA, 64 nt, Homo Sapiens; identical to SEQ ID NO: 145634

SEQ ID NO: 626777 - RNA, 64 nt, Homo Sapiens; identical to SEQ ID NO: 145635

SEQ ID NO: 626778 - RNA, 64 nt, Homo Sapiens; identical to SEQ ID NO: 145636

SEQ ID NO: 626779 - RNA, 64 nt, Homo Sapiens; identical to SEQ ID NO: 145637

SEQ ID NO: 626780 - RNA, 64 nt, Homo Sapiens; identical to SEQ ID NO: 145638

SEQ ID NO: 626781 - RNA, 64 nt, Homo Sapiens; identical to SEQ ID NO: 145639

SEQ ID NO: 626782 - RNA, 64 nt, Homo Sapiens; identical to SEQ ID NO: 145640

SEQ ID NO: 626783 - RNA, 64 nt, Homo Sapiens; identical to SEQ ID NO: 145641

SEQ ID NO: 626784 - RNA, 64 nt, Homo Sapiens; identical to SEQ ID NO: 145642

SEQ ID NO: 626785 - RNA, 64 nt, Homo Sapiens; identical to SEQ ID NO: 145643

SEQ ID NO: 626786 - RNA, 64 nt, Homo Sapiens; identical to SEQ ID NO: 145644

SEQ ID NO: 626787 - RNA, 64 nt, Homo Sapiens; identical to SEQ ID NO: 145645

SEQ ID NO: 626788 - RNA, 64 nt, Homo Sapiens; identical to SEQ ID NO: 145646

SEQ ID NO: 626789 - RNA, 64 nt, Homo Sapiens; identical to SEQ ID NO: 145647

SEQ ID NO: 626790 - RNA, 64 nt, Homo Sapiens; identical to SEQ ID NO: 145648

SEQ ID NO: 626791 - RNA, 64 nt, Homo Sapiens; identical to SEQ ID NO: 145649

SEQ ID NO: 626792 - RNA, 64 nt, Homo Sapiens; identical to SEQ ID NO: 145650

SEQ ID NO: 626793 - RNA, 64 nt, Homo Sapiens; identical to SEQ ID NO: 145651

SEQ ID NO: 626794 - RNA, 64 nt, Homo Sapiens; identical to SEQ ID NO: 145652

SEQ ID NO: 626795 - RNA, 64 nt, Homo Sapiens; identical to SEQ ID NO: 145653

SEQ ID NO: 626796 - RNA, 64 nt, Homo Sapiens; identical to SEQ ID NO: 145654

SEQ ID NO: 626797 - RNA, 64 nt, Homo Sapiens; identical to SEQ ID NO: 145655

SEQ ID NO: 626798 - RNA, 64 nt, Homo Sapiens; identical to SEQ ID NO: 145656

SEQ ID NO: 626799 - RNA, 64 nt, Homo Sapiens; identical to SEQ ID NO: 145657

SEQ ID NO: 626800 - RNA, 64 nt, Homo Sapiens; identical to SEQ ID NO: 145658

SEQ ID NO: 626801 - RNA, 64 nt, Homo Sapiens; identical to SEQ ID NO: 145659

SEQ ID NO: 626802 - RNA, 64 nt, Homo Sapiens; identical to SEQ ID NO: 145660

SEQ ID NO: 626803 - RNA, 64 nt, Homo Sapiens; identical to SEQ ID NO: 145661

SEQ ID NO: 626804 - RNA, 64 nt, Homo Sapiens; identical to SEQ ID NO: 145662

SEQ ID NO: 626805 - RNA, 64 nt, Homo Sapiens; identical to SEQ ID NO: 145663

SEQ ID NO: 626806 - RNA, 64 nt, Homo Sapiens; identical to SEQ ID NO: 145664

SEQ ID NO: 626807 - RNA, 64 nt, Homo Sapiens; identical to SEQ ID NO: 145665

SEQ ID NO: 626808 - RNA, 64 nt, Homo Sapiens; identical to SEQ ID NO: 145666

SEQ ID NO: 626809 - RNA, 64 nt, Homo Sapiens; identical to SEQ ID NO: 145667

SEQ ID NO: 626810 - RNA, 64 nt, Homo Sapiens; identical to SEQ ID NO: 145668

SEQ ID NO: 626811 - RNA, 64 nt, Homo Sapiens; identical to SEQ ID NO: 145669

SEQ ID NO: 626812 - RNA, 64 nt, Homo Sapiens; identical to SEQ ID NO: 145670

SEQ ID NO: 626813 - RNA, 64 nt, Homo Sapiens; identical to SEQ ID NO: 145671

SEQ ID NO: 626814 - RNA, 64 nt, Homo Sapiens; identical to SEQ ID NO: 145672

SEQ ID NO: 626815 - RNA, 64 nt, Homo Sapiens; identical to SEQ ID NO: 145673

SEQ ID NO: 626816 - RNA, 64 nt, Homo Sapiens; identical to SEQ ID NO: 145674

SEQ ID NO: 626817 - RNA, 64 nt, Homo Sapiens; identical to SEQ ID NO: 145675

SEQ ID NO: 626818 - RNA, 64 nt, Homo Sapiens; identical to SEQ ID NO: 145676

SEQ ID NO: 626819 - RNA, 64 nt, Homo Sapiens; identical to SEQ ID NO: 145677

SEQ ID NO: 626820 - RNA, 64 nt, Homo Sapiens; identical to SEQ ID NO: 145678

SEQ ID NO: 626821 - RNA, 64 nt, Homo Sapiens; identical to SEQ ID NO: 145679

SEQ ID NO: 626822 - RNA, 64 nt, Homo Sapiens; identical to SEQ ID NO: 145680

SEQ ID NO: 626823 - RNA, 64 nt, Homo Sapiens; identical to SEQ ID NO: 145681

SEQ ID NO: 626824 - RNA, 64 nt, Homo Sapiens; identical to SEQ ID NO: 145682

SEQ ID NO: 626825 - RNA, 64 nt, Homo Sapiens; identical to SEQ ID NO: 145683

SEQ ID NO: 626826 - RNA, 64 nt, Homo Sapiens; identical to SEQ ID NO: 145684

SEQ ID NO: 626827 - RNA, 64 nt, Homo Sapiens; identical to SEQ ID NO: 145685

SEQ ID NO: 626828 - RNA, 64 nt, Homo Sapiens; identical to SEQ ID NO: 145686

SEQ ID NO: 626829 - RNA, 64 nt, Homo Sapiens; identical to SEQ ID NO: 145687

SEQ ID NO: 626830 - RNA, 51 nt, Homo Sapiens; identical to SEQ ID NO: 145688

SEQ ID NO: 626831 - RNA, 64 nt, Homo Sapiens; identical to SEQ ID NO: 145689

SEQ ID NO: 626832 - RNA, 64 nt, Homo Sapiens; identical to SEQ ID NO: 145690

SEQ ID NO: 626833 - RNA, 64 nt, Homo Sapiens; identical to SEQ ID NO: 145691

SEQ ID NO: 626834 - RNA, 64 nt, Homo Sapiens; identical to SEQ ID NO: 145692

SEQ ID NO: 626835 - RNA, 64 nt, Homo Sapiens; identical to SEQ ID NO: 145693

SEQ ID NO: 626836 - RNA, 64 nt, Homo Sapiens; identical to SEQ ID NO: 145694

SEQ ID NO: 626837 - RNA, 64 nt, Homo Sapiens; identical to SEQ ID NO: 145695

SEQ ID NO: 626838 - RNA, 64 nt, Homo Sapiens; identical to SEQ ID NO: 145696

SEQ ID NO: 626839 - RNA, 64 nt, Homo Sapiens; identical to SEQ ID NO: 145697

SEQ ID NO: 626840 - RNA, 64 nt, Homo Sapiens; identical to SEQ ID NO: 145698

SEQ ID NO: 626841 - RNA, 64 nt, Homo Sapiens; identical to SEQ ID NO: 145699

SEQ ID NO: 626842 - RNA, 64 nt, Homo Sapiens; identical to SEQ ID NO: 145700

SEQ ID NO: 626843 - RNA, 63 nt, Homo Sapiens; identical to SEQ ID NO: 145701

SEQ ID NO: 626844 - RNA, 59 nt, Homo Sapiens; identical to SEQ ID NO: 145702

SEQ ID NO: 626845 - RNA, 64 nt, Homo Sapiens; identical to SEQ ID NO: 145703

SEQ ID NO: 626846 - RNA, 64 nt, Homo Sapiens; identical to SEQ ID NO: 145704

SEQ ID NO: 626847 - RNA, 64 nt, Homo Sapiens; identical to SEQ ID NO: 145705

SEQ ID NO: 626848 - RNA, 64 nt, Homo Sapiens; identical to SEQ ID NO: 145706

SEQ ID NO: 626849 - RNA, 64 nt, Homo Sapiens; identical to SEQ ID NO: 145707

SEQ ID NO: 626850 - RNA, 64 nt, Homo Sapiens; identical to SEQ ID NO: 145708

SEQ ID NO: 626851 - RNA, 64 nt, Homo Sapiens; identical to SEQ ID NO: 145709

SEQ ID NO: 626852 - RNA, 64 nt, Homo Sapiens; identical to SEQ ID NO: 145710

SEQ ID NO: 626853 - RNA, 64 nt, Homo Sapiens; identical to SEQ ID NO: 145711

SEQ ID NO: 626854 - RNA, 64 nt, Homo Sapiens; identical to SEQ ID NO: 145712

SEQ ID NO: 626855 - RNA, 64 nt, Homo Sapiens; identical to SEQ ID NO: 145713

SEQ ID NO: 626856 - RNA, 64 nt, Homo Sapiens; identical to SEQ ID NO: 145714

SEQ ID NO: 626857 - RNA, 64 nt, Homo Sapiens; identical to SEQ ID NO: 145715

SEQ ID NO: 626858 - RNA, 64 nt, Homo Sapiens; identical to SEQ ID NO: 145716

SEQ ID NO: 626859 - RNA, 64 nt, Homo Sapiens; identical to SEQ ID NO: 145717

SEQ ID NO: 626860 - RNA, 64 nt, Homo Sapiens; identical to SEQ ID NO: 145718

SEQ ID NO: 626861 - RNA, 64 nt, Homo Sapiens; identical to SEQ ID NO: 145719

SEQ ID NO: 626862 - RNA, 64 nt, Homo Sapiens; identical to SEQ ID NO: 145720

SEQ ID NO: 626863 - RNA, 64 nt, Homo Sapiens; identical to SEQ ID NO: 145721

SEQ ID NO: 626864 - RNA, 64 nt, Homo Sapiens; identical to SEQ ID NO: 145722

SEQ ID NO: 626865 - RNA, 64 nt, Homo Sapiens; identical to SEQ ID NO: 145723

SEQ ID NO: 626866 - RNA, 64 nt, Homo Sapiens; identical to SEQ ID NO: 145724

SEQ ID NO: 626867 - RNA, 64 nt, Homo Sapiens; identical to SEQ ID NO: 145725

SEQ ID NO: 626868 - RNA, 64 nt, Homo Sapiens; identical to SEQ ID NO: 145726

SEQ ID NO: 626869 - RNA, 64 nt, Homo Sapiens; identical to SEQ ID NO: 145727

SEQ ID NO: 626870 - RNA, 64 nt, Homo Sapiens; identical to SEQ ID NO: 145728

SEQ ID NO: 626871 - RNA, 64 nt, Homo Sapiens; identical to SEQ ID NO: 145729

SEQ ID NO: 626872 - RNA, 64 nt, Homo Sapiens; identical to SEQ ID NO: 145730

SEQ ID NO: 626873 - RNA, 64 nt, Homo Sapiens; identical to SEQ ID NO: 145731

SEQ ID NO: 626874 - RNA, 64 nt, Homo Sapiens; identical to SEQ ID NO: 145732

SEQ ID NO: 626875 - RNA, 64 nt, Homo Sapiens; identical to SEQ ID NO: 145733

SEQ ID NO: 626876 - RNA, 64 nt, Homo Sapiens; identical to SEQ ID NO: 145734

SEQ ID NO: 626877 - RNA, 64 nt, Homo Sapiens; identical to SEQ ID NO: 145735

SEQ ID NO: 626878 - RNA, 64 nt, Homo Sapiens; identical to SEQ ID NO: 145736

SEQ ID NO: 626879 - RNA, 64 nt, Homo Sapiens; identical to SEQ ID NO: 145737

SEQ ID NO: 626880 - RNA, 64 nt, Homo Sapiens; identical to SEQ ID NO: 145738

SEQ ID NO: 626881 - RNA, 64 nt, Homo Sapiens; identical to SEQ ID NO: 145739

SEQ ID NO: 626882 - RNA, 64 nt, Homo Sapiens; identical to SEQ ID NO: 145740

SEQ ID NO: 626883 - RNA, 64 nt, Homo Sapiens; identical to SEQ ID NO: 145741

SEQ ID NO: 626884 - RNA, 64 nt, Homo Sapiens; identical to SEQ ID NO: 145742

SEQ ID NO: 626885 - RNA, 64 nt, Homo Sapiens; identical to SEQ ID NO: 145743

SEQ ID NO: 626886 - RNA, 64 nt, Homo Sapiens; identical to SEQ ID NO: 145744

SEQ ID NO: 626887 - RNA, 64 nt, Homo Sapiens; identical to SEQ ID NO: 145745

SEQ ID NO: 626888 - RNA, 64 nt, Homo Sapiens; identical to SEQ ID NO: 145746

SEQ ID NO: 626889 - RNA, 64 nt, Homo Sapiens; identical to SEQ ID NO: 145747

SEQ ID NO: 626890 - RNA, 64 nt, Homo Sapiens; identical to SEQ ID NO: 145748

SEQ ID NO: 626891 - RNA, 64 nt, Homo Sapiens; identical to SEQ ID NO: 145749

SEQ ID NO: 626892 - RNA, 64 nt, Homo Sapiens; identical to SEQ ID NO: 145750

SEQ ID NO: 626893 - RNA, 64 nt, Homo Sapiens; identical to SEQ ID NO: 145751

SEQ ID NO: 626894 - RNA, 64 nt, Homo Sapiens; identical to SEQ ID NO: 145752

SEQ ID NO: 626895 - RNA, 64 nt, Homo Sapiens; identical to SEQ ID NO: 145753

SEQ ID NO: 626896 - RNA, 64 nt, Homo Sapiens; identical to SEQ ID NO: 145754

SEQ ID NO: 626897 - RNA, 64 nt, Homo Sapiens; identical to SEQ ID NO: 145755

SEQ ID NO: 626898 - RNA, 64 nt, Homo Sapiens; identical to SEQ ID NO: 145756

SEQ ID NO: 626899 - RNA, 64 nt, Homo Sapiens; identical to SEQ ID NO: 145757

SEQ ID NO: 626900 - RNA, 64 nt, Homo Sapiens; identical to SEQ ID NO: 145758

SEQ ID NO: 626901 - RNA, 64 nt, Homo Sapiens; identical to SEQ ID NO: 145759

SEQ ID NO: 626902 - RNA, 64 nt, Homo Sapiens; identical to SEQ ID NO: 145760

SEQ ID NO: 626903 - RNA, 64 nt, Homo Sapiens; identical to SEQ ID NO: 145761

SEQ ID NO: 626904 - RNA, 64 nt, Homo Sapiens; identical to SEQ ID NO: 145762

SEQ ID NO: 626905 - RNA, 64 nt, Homo Sapiens; identical to SEQ ID NO: 145763

SEQ ID NO: 626906 - RNA, 64 nt, Homo Sapiens; identical to SEQ ID NO: 145764

SEQ ID NO: 626907 - RNA, 64 nt, Homo Sapiens; identical to SEQ ID NO: 145765

SEQ ID NO: 626908 - RNA, 64 nt, Homo Sapiens; identical to SEQ ID NO: 145766

SEQ ID NO: 626909 - RNA, 64 nt, Homo Sapiens; identical to SEQ ID NO: 145767

SEQ ID NO: 626910 - RNA, 64 nt, Homo Sapiens; identical to SEQ ID NO: 145768

SEQ ID NO: 626911 - RNA, 64 nt, Homo Sapiens; identical to SEQ ID NO: 145769

SEQ ID NO: 626912 - RNA, 64 nt, Homo Sapiens; identical to SEQ ID NO: 145770

SEQ ID NO: 626913 - RNA, 64 nt, Homo Sapiens; identical to SEQ ID NO: 145771

SEQ ID NO: 626914 - RNA, 64 nt, Homo Sapiens; identical to SEQ ID NO: 145772

SEQ ID NO: 626915 - RNA, 64 nt, Homo Sapiens; identical to SEQ ID NO: 145773

SEQ ID NO: 626916 - RNA, 64 nt, Homo Sapiens; identical to SEQ ID NO: 145774

SEQ ID NO: 626917 - RNA, 64 nt, Homo Sapiens; identical to SEQ ID NO: 145775

SEQ ID NO: 626918 - RNA, 64 nt, Homo Sapiens; identical to SEQ ID NO: 145776

SEQ ID NO: 626919 - RNA, 64 nt, Homo Sapiens; identical to SEQ ID NO: 145777

SEQ ID NO: 626920 - RNA, 64 nt, Homo Sapiens; identical to SEQ ID NO: 145778

SEQ ID NO: 626921 - RNA, 64 nt, Homo Sapiens; identical to SEQ ID NO: 145779

SEQ ID NO: 626922 - RNA, 64 nt, Homo Sapiens; identical to SEQ ID NO: 145780

SEQ ID NO: 626923 - RNA, 64 nt, Homo Sapiens; identical to SEQ ID NO: 145781

SEQ ID NO: 626924 - RNA, 64 nt, Homo Sapiens; identical to SEQ ID NO: 145782

SEQ ID NO: 626925 - RNA, 64 nt, Homo Sapiens; identical to SEQ ID NO: 145783

SEQ ID NO: 626926 - RNA, 64 nt, Homo Sapiens; identical to SEQ ID NO: 145784

SEQ ID NO: 626927 - RNA, 64 nt, Homo Sapiens; identical to SEQ ID NO: 145785

SEQ ID NO: 626928 - RNA, 64 nt, Homo Sapiens; identical to SEQ ID NO: 145786

SEQ ID NO: 626929 - RNA, 64 nt, Homo Sapiens; identical to SEQ ID NO: 145787

SEQ ID NO: 626930 - RNA, 64 nt, Homo Sapiens; identical to SEQ ID NO: 145788

SEQ ID NO: 626931 - RNA, 64 nt, Homo Sapiens; identical to SEQ ID NO: 145789

SEQ ID NO: 626932 - RNA, 64 nt, Homo Sapiens; identical to SEQ ID NO: 145790

SEQ ID NO: 626933 - RNA, 64 nt, Homo Sapiens; identical to SEQ ID NO: 145791

SEQ ID NO: 626934 - RNA, 64 nt, Homo Sapiens; identical to SEQ ID NO: 145792

SEQ ID NO: 626935 - RNA, 64 nt, Homo Sapiens; identical to SEQ ID NO: 145793

SEQ ID NO: 626936 - RNA, 64 nt, Homo Sapiens; identical to SEQ ID NO: 145794

SEQ ID NO: 626937 - RNA, 64 nt, Homo Sapiens; identical to SEQ ID NO: 145795

SEQ ID NO: 626938 - RNA, 64 nt, Homo Sapiens; identical to SEQ ID NO: 145796

SEQ ID NO: 626939 - RNA, 64 nt, Homo Sapiens; identical to SEQ ID NO: 145797

SEQ ID NO: 626940 - RNA, 64 nt, Homo Sapiens; identical to SEQ ID NO: 145798

SEQ ID NO: 626941 - RNA, 64 nt, Homo Sapiens; identical to SEQ ID NO: 145799

SEQ ID NO: 626942 - RNA, 64 nt, Homo Sapiens; identical to SEQ ID NO: 145800

SEQ ID NO: 626943 - RNA, 64 nt, Homo Sapiens; identical to SEQ ID NO: 145801

SEQ ID NO: 626944 - RNA, 64 nt, Homo Sapiens; identical to SEQ ID NO: 145802

SEQ ID NO: 626945 - RNA, 64 nt, Homo Sapiens; identical to SEQ ID NO: 145803

SEQ ID NO: 626946 - RNA, 64 nt, Homo Sapiens; identical to SEQ ID NO: 145804

SEQ ID NO: 626947 - RNA, 64 nt, Homo Sapiens; identical to SEQ ID NO: 145805

SEQ ID NO: 626948 - RNA, 64 nt, Homo Sapiens; identical to SEQ ID NO: 145806

SEQ ID NO: 626949 - RNA, 55 nt, Homo Sapiens; identical to SEQ ID NO: 145807

SEQ ID NO: 626950 - RNA, 64 nt, Homo Sapiens; identical to SEQ ID NO: 145808

SEQ ID NO: 626951 - RNA, 64 nt, Homo Sapiens; identical to SEQ ID NO: 145809

SEQ ID NO: 626952 - RNA, 64 nt, Homo Sapiens; identical to SEQ ID NO: 145810

SEQ ID NO: 626953 - RNA, 64 nt, Homo Sapiens; identical to SEQ ID NO: 145811

SEQ ID NO: 626954 - RNA, 64 nt, Homo Sapiens; identical to SEQ ID NO: 145812

SEQ ID NO: 626955 - RNA, 64 nt, Homo Sapiens; identical to SEQ ID NO: 145813

SEQ ID NO: 626956 - RNA, 64 nt, Homo Sapiens; identical to SEQ ID NO: 145814

SEQ ID NO: 626957 - RNA, 64 nt, Homo Sapiens; identical to SEQ ID NO: 145815

SEQ ID NO: 626958 - RNA, 64 nt, Homo Sapiens; identical to SEQ ID NO: 145816

SEQ ID NO: 626959 - RNA, 64 nt, Homo Sapiens; identical to SEQ ID NO: 145817

SEQ ID NO: 626960 - RNA, 64 nt, Homo Sapiens; identical to SEQ ID NO: 145818

SEQ ID NO: 626961 - RNA, 64 nt, Homo Sapiens; identical to SEQ ID NO: 145819

SEQ ID NO: 626962 - RNA, 64 nt, Homo Sapiens; identical to SEQ ID NO: 145820

SEQ ID NO: 626963 - RNA, 64 nt, Homo Sapiens; identical to SEQ ID NO: 145821

SEQ ID NO: 626964 - RNA, 64 nt, Homo Sapiens; identical to SEQ ID NO: 145822

SEQ ID NO: 626965 - RNA, 64 nt, Homo Sapiens; identical to SEQ ID NO: 145823

SEQ ID NO: 626966 - RNA, 64 nt, Homo Sapiens; identical to SEQ ID NO: 145824

SEQ ID NO: 626967 - RNA, 64 nt, Homo Sapiens; identical to SEQ ID NO: 145825

SEQ ID NO: 626968 - RNA, 64 nt, Homo Sapiens; identical to SEQ ID NO: 145826

SEQ ID NO: 626969 - RNA, 64 nt, Homo Sapiens; identical to SEQ ID NO: 145827

SEQ ID NO: 626970 - RNA, 64 nt, Homo Sapiens; identical to SEQ ID NO: 145828

SEQ ID NO: 626971 - RNA, 64 nt, Homo Sapiens; identical to SEQ ID NO: 145829

SEQ ID NO: 626972 - RNA, 64 nt, Homo Sapiens; identical to SEQ ID NO: 145830

SEQ ID NO: 626973 - RNA, 64 nt, Homo Sapiens; identical to SEQ ID NO: 145831

SEQ ID NO: 626974 - RNA, 64 nt, Homo Sapiens; identical to SEQ ID NO: 145832

SEQ ID NO: 626975 - RNA, 64 nt, Homo Sapiens; identical to SEQ ID NO: 145833

SEQ ID NO: 626976 - RNA, 64 nt, Homo Sapiens; identical to SEQ ID NO: 145834

SEQ ID NO: 626977 - RNA, 64 nt, Homo Sapiens; identical to SEQ ID NO: 145835

SEQ ID NO: 626978 - RNA, 64 nt, Homo Sapiens; identical to SEQ ID NO: 145836

SEQ ID NO: 626979 - RNA, 63 nt, Homo Sapiens; identical to SEQ ID NO: 145837

SEQ ID NO: 626980 - RNA, 64 nt, Homo Sapiens; identical to SEQ ID NO: 145838

SEQ ID NO: 626981 - RNA, 64 nt, Homo Sapiens; identical to SEQ ID NO: 145839

SEQ ID NO: 626982 - RNA, 64 nt, Homo Sapiens; identical to SEQ ID NO: 145840

SEQ ID NO: 626983 - RNA, 64 nt, Homo Sapiens; identical to SEQ ID NO: 145841

SEQ ID NO: 626984 - RNA, 64 nt, Homo Sapiens; identical to SEQ ID NO: 145842

SEQ ID NO: 626985 - RNA, 64 nt, Homo Sapiens; identical to SEQ ID NO: 145843

SEQ ID NO: 626986 - RNA, 64 nt, Homo Sapiens; identical to SEQ ID NO: 145844

SEQ ID NO: 626987 - RNA, 64 nt, Homo Sapiens; identical to SEQ ID NO: 145845

SEQ ID NO: 626988 - RNA, 64 nt, Homo Sapiens; identical to SEQ ID NO: 145846

SEQ ID NO: 626989 - RNA, 64 nt, Homo Sapiens; identical to SEQ ID NO: 145847

SEQ ID NO: 626990 - RNA, 64 nt, Homo Sapiens; identical to SEQ ID NO: 145848

SEQ ID NO: 626991 - RNA, 64 nt, Homo Sapiens; identical to SEQ ID NO: 145849

SEQ ID NO: 626992 - RNA, 64 nt, Homo Sapiens; identical to SEQ ID NO: 145850

SEQ ID NO: 626993 - RNA, 64 nt, Homo Sapiens; identical to SEQ ID NO: 145851

SEQ ID NO: 626994 - RNA, 64 nt, Homo Sapiens; identical to SEQ ID NO: 145852

SEQ ID NO: 626995 - RNA, 64 nt, Homo Sapiens; identical to SEQ ID NO: 145853

SEQ ID NO: 626996 - RNA, 64 nt, Homo Sapiens; identical to SEQ ID NO: 145854

SEQ ID NO: 626997 - RNA, 64 nt, Homo Sapiens; identical to SEQ ID NO: 145855

SEQ ID NO: 626998 - RNA, 64 nt, Homo Sapiens; identical to SEQ ID NO: 145856

SEQ ID NO: 626999 - RNA, 64 nt, Homo Sapiens; identical to SEQ ID NO: 145857

SEQ ID NO: 627000 - RNA, 64 nt, Homo Sapiens; identical to SEQ ID NO: 145858

SEQ ID NO: 627001 - RNA, 64 nt, Homo Sapiens; identical to SEQ ID NO: 145859

SEQ ID NO: 627002 - RNA, 64 nt, Homo Sapiens; identical to SEQ ID NO: 145860

SEQ ID NO: 627003 - RNA, 64 nt, Homo Sapiens; identical to SEQ ID NO: 145861

SEQ ID NO: 627004 - RNA, 64 nt, Homo Sapiens; identical to SEQ ID NO: 145862

SEQ ID NO: 627005 - RNA, 64 nt, Homo Sapiens; identical to SEQ ID NO: 145863

SEQ ID NO: 627006 - RNA, 64 nt, Homo Sapiens; identical to SEQ ID NO: 145864

SEQ ID NO: 627007 - RNA, 64 nt, Homo Sapiens; identical to SEQ ID NO: 145865

SEQ ID NO: 627008 - RNA, 64 nt, Homo Sapiens; identical to SEQ ID NO: 145866

SEQ ID NO: 627009 - RNA, 64 nt, Homo Sapiens; identical to SEQ ID NO: 145867

SEQ ID NO: 627010 - RNA, 64 nt, Homo Sapiens; identical to SEQ ID NO: 145868

SEQ ID NO: 627011 - RNA, 64 nt, Homo Sapiens; identical to SEQ ID NO: 145869

SEQ ID NO: 627012 - RNA, 64 nt, Homo Sapiens; identical to SEQ ID NO: 145870

SEQ ID NO: 627013 - RNA, 64 nt, Homo Sapiens; identical to SEQ ID NO: 145871

SEQ ID NO: 627014 - RNA, 64 nt, Homo Sapiens; identical to SEQ ID NO: 145872

SEQ ID NO: 627015 - RNA, 64 nt, Homo Sapiens; identical to SEQ ID NO: 145873

SEQ ID NO: 627016 - RNA, 64 nt, Homo Sapiens; identical to SEQ ID NO: 145874

SEQ ID NO: 627017 - RNA, 64 nt, Homo Sapiens; identical to SEQ ID NO: 145875

SEQ ID NO: 627018 - RNA, 64 nt, Homo Sapiens; identical to SEQ ID NO: 145876

SEQ ID NO: 627019 - RNA, 64 nt, Homo Sapiens; identical to SEQ ID NO: 145877

SEQ ID NO: 627020 - RNA, 64 nt, Homo Sapiens; identical to SEQ ID NO: 145878

SEQ ID NO: 627021 - RNA, 64 nt, Homo Sapiens; identical to SEQ ID NO: 145879

SEQ ID NO: 627022 - RNA, 64 nt, Homo Sapiens; identical to SEQ ID NO: 145880

SEQ ID NO: 627023 - RNA, 64 nt, Homo Sapiens; identical to SEQ ID NO: 145881

SEQ ID NO: 627024 - RNA, 64 nt, Homo Sapiens; identical to SEQ ID NO: 145882

SEQ ID NO: 627025 - RNA, 64 nt, Homo Sapiens; identical to SEQ ID NO: 145883

SEQ ID NO: 627026 - RNA, 64 nt, Homo Sapiens; identical to SEQ ID NO: 145884

SEQ ID NO: 627027 - RNA, 64 nt, Homo Sapiens; identical to SEQ ID NO: 145885

SEQ ID NO: 627028 - RNA, 64 nt, Homo Sapiens; identical to SEQ ID NO: 145886

SEQ ID NO: 627029 - RNA, 64 nt, Homo Sapiens; identical to SEQ ID NO: 145887

SEQ ID NO: 627030 - RNA, 64 nt, Homo Sapiens; identical to SEQ ID NO: 145888

SEQ ID NO: 627031 - RNA, 64 nt, Homo Sapiens; identical to SEQ ID NO: 145889

SEQ ID NO: 627032 - RNA, 64 nt, Homo Sapiens; identical to SEQ ID NO: 119656

SEQ ID NO: 627033 - RNA, 64 nt, Homo Sapiens; identical to SEQ ID NO: 119657

SEQ ID NO: 627034 - RNA, 64 nt, Homo Sapiens; identical to SEQ ID NO: 119658

SEQ ID NO: 627035 - RNA, 64 nt, Homo Sapiens; identical to SEQ ID NO: 119659

SEQ ID NO: 627036 - RNA, 64 nt, Homo Sapiens; identical to SEQ ID NO: 119660

SEQ ID NO: 627037 - RNA, 64 nt, Homo Sapiens; identical to SEQ ID NO: 119661

SEQ ID NO: 627038 - RNA, 64 nt, Homo Sapiens; identical to SEQ ID NO: 119662

SEQ ID NO: 627039 - RNA, 64 nt, Homo Sapiens; identical to SEQ ID NO: 119663

SEQ ID NO: 627040 - RNA, 64 nt, Homo Sapiens; identical to SEQ ID NO: 119664

SEQ ID NO: 627041 - RNA, 64 nt, Homo Sapiens; identical to SEQ ID NO: 119665

SEQ ID NO: 627042 - RNA, 64 nt, Homo Sapiens; identical to SEQ ID NO: 119666

SEQ ID NO: 627043 - RNA, 64 nt, Homo Sapiens; identical to SEQ ID NO: 119667

SEQ ID NO: 627044 - RNA, 64 nt, Homo Sapiens; identical to SEQ ID NO: 119668

SEQ ID NO: 627045 - RNA, 64 nt, Homo Sapiens; identical to SEQ ID NO: 119669

SEQ ID NO: 627046 - RNA, 64 nt, Homo Sapiens; identical to SEQ ID NO: 119670

SEQ ID NO: 627047 - RNA, 64 nt, Homo Sapiens; identical to SEQ ID NO: 119671

SEQ ID NO: 627048 - RNA, 64 nt, Homo Sapiens; identical to SEQ ID NO: 119672

SEQ ID NO: 627049 - RNA, 64 nt, Homo Sapiens; identical to SEQ ID NO: 119673

SEQ ID NO: 627050 - RNA, 64 nt, Homo Sapiens; identical to SEQ ID NO: 119674

SEQ ID NO: 627051 - RNA, 64 nt, Homo Sapiens; identical to SEQ ID NO: 119675

SEQ ID NO: 627052 - RNA, 64 nt, Homo Sapiens; identical to SEQ ID NO: 119676

SEQ ID NO: 627053 - RNA, 64 nt, Homo Sapiens; identical to SEQ ID NO: 119677

SEQ ID NO: 627054 - RNA, 64 nt, Homo Sapiens; identical to SEQ ID NO: 119678

SEQ ID NO: 627055 - RNA, 64 nt, Homo Sapiens; identical to SEQ ID NO: 119679

SEQ ID NO: 627056 - RNA, 58 nt, Homo Sapiens; identical to SEQ ID NO: 144416

SEQ ID NO: 627057 - RNA, 64 nt, Homo Sapiens; identical to SEQ ID NO: 144417

SEQ ID NO: 627058 - RNA, 64 nt, Homo Sapiens; identical to SEQ ID NO: 144418

SEQ ID NO: 627059 - RNA, 64 nt, Homo Sapiens; identical to SEQ ID NO: 144419

SEQ ID NO: 627060 - RNA, 64 nt, Homo Sapiens; identical to SEQ ID NO: 144420

SEQ ID NO: 627061 - RNA, 64 nt, Homo Sapiens; identical to SEQ ID NO: 144421

SEQ ID NO: 627062 - RNA, 64 nt, Homo Sapiens; identical to SEQ ID NO: 144422

SEQ ID NO: 627063 - RNA, 64 nt, Homo Sapiens; identical to SEQ ID NO: 144423

SEQ ID NO: 627064 - RNA, 64 nt, Homo Sapiens; identical to SEQ ID NO: 144424

SEQ ID NO: 627065 - RNA, 64 nt, Homo Sapiens; identical to SEQ ID NO: 144425

SEQ ID NO: 627066 - RNA, 64 nt, Homo Sapiens; identical to SEQ ID NO: 144426

SEQ ID NO: 627067 - RNA, 64 nt, Homo Sapiens; identical to SEQ ID NO: 144427

SEQ ID NO: 627068 - RNA, 64 nt, Homo Sapiens; identical to SEQ ID NO: 144428

SEQ ID NO: 627069 - RNA, 64 nt, Homo Sapiens; identical to SEQ ID NO: 144429

SEQ ID NO: 627070 - RNA, 64 nt, Homo Sapiens; identical to SEQ ID NO: 144430

SEQ ID NO: 627071 - RNA, 64 nt, Homo Sapiens; identical to SEQ ID NO: 144431

SEQ ID NO: 627072 - RNA, 64 nt, Homo Sapiens; identical to SEQ ID NO: 144432

SEQ ID NO: 627073 - RNA, 64 nt, Homo Sapiens; identical to SEQ ID NO: 144433

SEQ ID NO: 627074 - RNA, 64 nt, Homo Sapiens; identical to SEQ ID NO: 144434

SEQ ID NO: 627075 - RNA, 64 nt, Homo Sapiens; identical to SEQ ID NO: 144435

SEQ ID NO: 627076 - RNA, 64 nt, Homo Sapiens; identical to SEQ ID NO: 144436

SEQ ID NO: 627077 - RNA, 64 nt, Homo Sapiens; identical to SEQ ID NO: 144437

SEQ ID NO: 627078 - RNA, 64 nt, Homo Sapiens; identical to SEQ ID NO: 144438

SEQ ID NO: 627079 - RNA, 64 nt, Homo Sapiens; identical to SEQ ID NO: 144439

SEQ ID NO: 627080 - RNA, 64 nt, Homo Sapiens; identical to SEQ ID NO: 144440

SEQ ID NO: 627081 - RNA, 64 nt, Homo Sapiens; identical to SEQ ID NO: 144441

SEQ ID NO: 627082 - RNA, 64 nt, Homo Sapiens; identical to SEQ ID NO: 144442

SEQ ID NO: 627083 - RNA, 64 nt, Homo Sapiens; identical to SEQ ID NO: 144443

SEQ ID NO: 627084 - RNA, 64 nt, Homo Sapiens; identical to SEQ ID NO: 144444

SEQ ID NO: 627085 - RNA, 64 nt, Homo Sapiens; identical to SEQ ID NO: 144445

SEQ ID NO: 627086 - RNA, 64 nt, Homo Sapiens; identical to SEQ ID NO: 144446

SEQ ID NO: 627087 - RNA, 64 nt, Homo Sapiens; identical to SEQ ID NO: 144447

SEQ ID NO: 627088 - RNA, 64 nt, Homo Sapiens
aaauaguagcagagucauuguuacagguguacuauggcuguauuuuuagagauuaauuugugua

SEQ ID NO: 627089 - RNA, 64 nt, Homo Sapiens
aaauagcaucugcucuucucuuacgcucucugucuggcuguacgucugguguucucaaugcuuu

SEQ ID NO: 627090 - RNA, 64 nt, Homo Sapiens
cuacuaaaaaauacaaaaaauuagccgggcgugguggcuguagucgcagcuacucaggaggcug

SEQ ID NO: 627091 - RNA, 64 nt, Homo Sapiens
ugcgcccguguguaugugcauaugugaguguguguggcuguaaccugcacgucucuucugucau

SEQ ID NO: 627092 - RNA, 64 nt, Homo Sapiens
ugaaguguuaggauuacaggcgugagccugcgccuggcuguaauuacuauacccaguuuuuaca

SEQ ID NO: 627093 - RNA, 64 nt, Homo Sapiens
uaaguaguagaaccaggaguuggauuuagcagucuggcuguagagucaucaauaguuugcacau

SEQ ID NO: 627094 - RNA, 64 nt, Homo Sapiens
aauaauuuagccucauucauauauaaauccaugauggcuguacauacuuuggcuguauugaaaa

SEQ ID NO: 627095 - RNA, 64 nt, Homo Sapiens
gaaaaauauaaauccaugauguaaacauauacuuuggcuguauuaaaguaggcauuuuaauauu

SEQ ID NO: 627096 - RNA, 64 nt, Homo Sapiens
uuuuccauguuagaaggaucauuuuaauggacaauggcuguauugaguacccaaauuggauugu

SEQ ID NO: 627097 - RNA, 64 nt, Homo Sapiens
cuggguugccagaaaagauguaggaagauggcaguggcuguaggcagcuuaggaggcugcuagu

SEQ ID NO: 627098 - RNA, 64 nt, Homo Sapiens
cuaccugggaggagugaguuccuccaguuaaauguggcuguagauguuggaggcuagggaggcu

SEQ ID NO: 627099 - RNA, 64 nt, Homo Sapiens
cuaaaaaaaagguuuuuuuuuuccuuuuggaauauggcuguaagaagcagcauuuugucuuauu

SEQ ID NO: 627100 - RNA, 64 nt, Homo Sapiens
gcagcugcugguuuugguuuccaccuuacccuacuggcuguaaaaacacaaauguguacuuuau

SEQ ID NO: 627101 - RNA, 64 nt, Homo Sapiens
gguuuauaaucugacaaagucaugaagcucaguuuggcuguaauuuaauuccccuucccuuauu

SEQ ID NO: 627102 - RNA, 64 nt, Homo Sapiens
uuaagaguucuugauauuagauaacuccaacuucuggcuguagagcacccagccaagagaauaa

SEQ ID NO: 627103 - RNA, 64 nt, Homo Sapiens
cauucuagaauguccaaagggaaucaggauucuguggcuguagacugaucacagagucaaggaa

SEQ ID NO: 627104 - RNA, 64 nt, Homo Sapiens
cguguaaaauucuuaauuauguuuuugggaggauuaagucaaucaaucacaucuaauuuauagg

SEQ ID NO: 627105 - RNA, 64 nt, Homo Sapiens
acuaugcuuuaaaggaauuaaaauauuuaauuuuuaagucaaaaauuuaaaaauguaauaggga

SEQ ID NO: 627106 - RNA, 64 nt, Homo Sapiens
aacacuguaaaauagauugaugugucagcuauauuaagucaacguacaguuugcuugaguuaua

SEQ ID NO: 627107 - RNA, 64 nt, Homo Sapiens
uauuuccuuuccucuggguuuaagugauuuuauuuaagucaacuaaggggauuuaacaguggac

SEQ ID NO: 627108 - RNA, 64 nt, Homo Sapiens; identical to SEQ ID NO: 282609

SEQ ID NO: 627109 - RNA, 64 nt, Homo Sapiens; identical to SEQ ID NO: 282610

SEQ ID NO: 627110 - RNA, 64 nt, Homo Sapiens; identical to SEQ ID NO: 282611

SEQ ID NO: 627111 - RNA, 64 nt, Homo Sapiens; identical to SEQ ID NO: 282612

SEQ ID NO: 627112 - RNA, 64 nt, Homo Sapiens; identical to SEQ ID NO: 282613

SEQ ID NO: 627113 - RNA, 64 nt, Homo Sapiens; identical to SEQ ID NO: 282614

SEQ ID NO: 627114 - RNA, 64 nt, Homo Sapiens; identical to SEQ ID NO: 282615

SEQ ID NO: 627115 - RNA, 64 nt, Homo Sapiens; identical to SEQ ID NO: 282616

SEQ ID NO: 627116 - RNA, 64 nt, Homo Sapiens; identical to SEQ ID NO: 282617

SEQ ID NO: 627117 - RNA, 64 nt, Homo Sapiens; identical to SEQ ID NO: 282618

SEQ ID NO: 627118 - RNA, 64 nt, Homo Sapiens; identical to SEQ ID NO: 126433

SEQ ID NO: 627119 - RNA, 64 nt, Homo Sapiens; identical to SEQ ID NO: 126434

SEQ ID NO: 627120 - RNA, 64 nt, Homo Sapiens; identical to SEQ ID NO: 126435

SEQ ID NO: 627121 - RNA, 64 nt, Homo Sapiens; identical to SEQ ID NO: 126436

SEQ ID NO: 627122 - RNA, 64 nt, Homo Sapiens; identical to SEQ ID NO: 126437

SEQ ID NO: 627123 - RNA, 64 nt, Homo Sapiens; identical to SEQ ID NO: 126438

SEQ ID NO: 627124 - RNA, 64 nt, Homo Sapiens; identical to SEQ ID NO: 126439

SEQ ID NO: 627125 - RNA, 64 nt, Homo Sapiens; identical to SEQ ID NO: 126440

SEQ ID NO: 627126 - RNA, 64 nt, Homo Sapiens; identical to SEQ ID NO: 126441

SEQ ID NO: 627127 - RNA, 64 nt, Homo Sapiens; identical to SEQ ID NO: 126442

SEQ ID NO: 627128 - RNA, 64 nt, Homo Sapiens; identical to SEQ ID NO: 126443

SEQ ID NO: 627129 - RNA, 64 nt, Homo Sapiens; identical to SEQ ID NO: 126444

SEQ ID NO: 627130 - RNA, 64 nt, Homo Sapiens; identical to SEQ ID NO: 126445

SEQ ID NO: 627131 - RNA, 64 nt, Homo Sapiens; identical to SEQ ID NO: 126446

SEQ ID NO: 627132 - RNA, 64 nt, Homo Sapiens; identical to SEQ ID NO: 126447

SEQ ID NO: 627133 - RNA, 64 nt, Homo Sapiens; identical to SEQ ID NO: 126448

SEQ ID NO: 627134 - RNA, 64 nt, Homo Sapiens; identical to SEQ ID NO: 126449

SEQ ID NO: 627135 - RNA, 64 nt, Homo Sapiens; identical to SEQ ID NO: 126450

SEQ ID NO: 627136 - RNA, 64 nt, Homo Sapiens; identical to SEQ ID NO: 126451

SEQ ID NO: 627137 - RNA, 64 nt, Homo Sapiens; identical to SEQ ID NO: 126452

SEQ ID NO: 627138 - RNA, 64 nt, Homo Sapiens; identical to SEQ ID NO: 126453

SEQ ID NO: 627139 - RNA, 64 nt, Homo Sapiens; identical to SEQ ID NO: 126454

SEQ ID NO: 627140 - RNA, 64 nt, Homo Sapiens; identical to SEQ ID NO: 126455

SEQ ID NO: 627141 - RNA, 64 nt, Homo Sapiens; identical to SEQ ID NO: 126456

SEQ ID NO: 627142 - RNA, 64 nt, Homo Sapiens; identical to SEQ ID NO: 126457

SEQ ID NO: 627143 - RNA, 64 nt, Homo Sapiens; identical to SEQ ID NO: 126458

SEQ ID NO: 627144 - RNA, 64 nt, Homo Sapiens; identical to SEQ ID NO: 201795

SEQ ID NO: 627145 - RNA, 64 nt, Homo Sapiens; identical to SEQ ID NO: 201796

SEQ ID NO: 627146 - RNA, 64 nt, Homo Sapiens
aaggaagaagcaaaauaucacaucucuagaaguguugggaaaaauauaauuucuuucuuuacuu

SEQ ID NO: 627147 - RNA, 64 nt, Homo Sapiens
cuagcauaauuuaaaaaaucaguguuuuuaggauuugggaaaauaaacuguaaauguuuauuug

SEQ ID NO: 627148 - RNA, 64 nt, Homo Sapiens
auggauucuuucaagccacuugaauuuguuuggcuugggaaauuaaaaagaacagaccuagcuc

SEQ ID NO: 627149 - RNA, 64 nt, Homo Sapiens
aauuacaguuuguuaauuugaaaaaaauguaucuuugggaaaacguguaugauggauguguaug

SEQ ID NO: 627150 - RNA, 64 nt, Homo Sapiens
ugguuuuaagguaaguuuuagaaaaggaaaagaguugggaaaaucaaaacguuggacuauuugg

SEQ ID NO: 627151 - RNA, 64 nt, Homo Sapiens
gaaaagaguugggaaaauugaaacguuggacuauuugggaaaaggccucauauauuucuccuca

SEQ ID NO: 627152 - RNA, 64 nt, Homo Sapiens
ucuucauugugcacacaggacaaaucugaucucuuugggaaaaaauagaaauaaaacaaucucc

SEQ ID NO: 627153 - RNA, 64 nt, Homo Sapiens
aaucuuaaaacuacaaguuguaaguauucugaaauugggaaacauuuauuuuaaaugcaaucag

SEQ ID NO: 627154 - RNA, 64 nt, Homo Sapiens
aaagcucaggcugcauuagaguaugaauuuagcauugggaaaagcccuuauucuugaaucuaga

SEQ ID NO: 627155 - RNA, 64 nt, Homo Sapiens
ugauuuuccuauuuuaacaguaccaacuaguuaauugggaaauguaaguucugaauguucacau

SEQ ID NO: 627156 - RNA, 64 nt, Homo Sapiens
aguagaaaaagcaguaacuguauuagccacaaaauugggaaagguauuagggugguauuuaguc

SEQ ID NO: 627157 - RNA, 64 nt, Homo Sapiens
agaaguuaagcaacaucuagagaaugaggguccuuugggaaaggacacccaaaguaucaggacg

SEQ ID NO: 627158 - RNA, 64 nt, Homo Sapiens
ucugggcaaacaggugggacuguuagugacccauuugggaaaauagagcaucucagagaaggag

SEQ ID NO: 627159 - RNA, 64 nt, Homo Sapiens
uucuagugccucuucccugcagggcagggaccccuugggaaaucgaggaggugggacgggcugg

SEQ ID NO: 627160 - RNA, 64 nt, Homo Sapiens
auaauaacuacuuccaucccugcuuauuuuuaauuugggaaaauaaauacauucgaaggaaccu

SEQ ID NO: 627161 - RNA, 64 nt, Homo Sapiens
uguugaucucaguauugucaggggaacagagaaguugggaaaagauuacugaaauauaccuuuu

SEQ ID NO: 627162 - RNA, 64 nt, Homo Sapiens
uaaauugguaauagaagaugcugcuugcuuagaauugggaaauucggcugggugcagugacuca

SEQ ID NO: 627163 - RNA, 64 nt, Homo Sapiens
agugagugagacucggucucaaacaaaaaccaaauugggaaauucuucuugaguuaaaaaagac

SEQ ID NO: 627164 - RNA, 64 nt, Homo Sapiens
auuuaauaccagauaccuuaucuuacaauauugauugggaaaacauuugcugccauuacagagg

SEQ ID NO: 627165 - RNA, 64 nt, Homo Sapiens
uuaaaccacuuaaacgaagaguucccuugaaacuuugggaaaacauguuaaugacaauauucca

SEQ ID NO: 627166 - RNA, 64 nt, Homo Sapiens
gcugaugaguucacauuuaguuuuuuuuuuuccauugggaaauguguuuucuuuaagcaccuuu

SEQ ID NO: 627167 - RNA, 64 nt, Homo Sapiens
uaaaaauacagugguguggaaguauuacaugugguugggaaaaaccuaagccccaucguagcac

SEQ ID NO: 627168 - RNA, 64 nt, Homo Sapiens
auaauuuaaaaggaaaacuaaaaacuauuuugauuugggaaaaugagccuuaauuuguuaaacc

SEQ ID NO: 627169 - RNA, 64 nt, Homo Sapiens
caacuccuaugaguggcaacugaaguucuuauuguugggaaagaacacuaguccuaccucugcc

SEQ ID NO: 627170 - RNA, 64 nt, Homo Sapiens
auguuccuggguauuaccaagugcugaucuucauuugggaaagguuggccuggccagagcagca

SEQ ID NO: 627171 - RNA, 64 nt, Homo Sapiens
uauuauguaaaauaauaagauuccauaaaaguaguugggaaaauauuuucuuucuuuugaggua

SEQ ID NO: 627172 - RNA, 64 nt, Homo Sapiens
aguguauuuuauaaaaauuuuaauauucuuuauuuugggaaauuaaguugacaccaauguguca

SEQ ID NO: 627173 - RNA, 64 nt, Homo Sapiens
aaacauacaaaugaaucaguuuugguuuucuucuuugggaaaccuagaaaucccaguucucuaa

SEQ ID NO: 627174 - RNA, 64 nt, Homo Sapiens
cuuuucuccuuguuauuugcccuucagaaugcacuugggaaaggcugguuccuuagccuccugg

SEQ ID NO: 627175 - RNA, 64 nt, Homo Sapiens
acaaacauguuuuugugaaagcuacugaagugccuugggaaaugagaaaguuuuaauaaguaaa

SEQ ID NO: 627176 - RNA, 64 nt, Homo Sapiens
uguuuagguuauaugggaaacagucuacuauuauuugggaaaaucuuaauguguauagagaccc

SEQ ID NO: 627177 - RNA, 64 nt, Homo Sapiens
gaucuauucuaacucauuaaauugugugcuaaauuugggaaacauucucuaauccacugaaauu

SEQ ID NO: 627178 - RNA, 64 nt, Homo Sapiens
uaaugucauuguaaccaucacuuaucuccucucauugggaaagcuacaugauaguauuuuuaug

SEQ ID NO: 627179 - RNA, 64 nt, Homo Sapiens
aaauugaaacaaccauugcaauacagccaaagauuugggaaaaugugcaacugugauugucuug

SEQ ID NO: 627180 - RNA, 64 nt, Homo Sapiens
uccagaagaauuccaccagauugcaugaguuagauugggaaaugggagugggagauaauauugg

SEQ ID NO: 627181 - RNA, 64 nt, Homo Sapiens
caaauauaaucuuuaauaaacuugauuuaguuucuugggaaauuuauuuucuacgcuauucaaa

SEQ ID NO: 627182 - RNA, 64 nt, Homo Sapiens
acggggacagaggaggaauugaagcauccauucauugggaaauccaggcacuuggugagaaugg

SEQ ID NO: 627183 - RNA, 64 nt, Homo Sapiens
cuuggaggguuuggcuuauagcagugagagggccuugggaaagaccagcagcagcucagcagca

SEQ ID NO: 627184 - RNA, 64 nt, Homo Sapiens
aauuaguuuauuaaacauuaauuuuguuuacacauugggaaaaaggcacaaauuuagucugguc

SEQ ID NO: 627185 - RNA, 64 nt, Homo Sapiens
augcaauacaaacugguaucugcuugaugcauuguugggaaaauugacaucuggacuggauuua

SEQ ID NO: 627186 - RNA, 64 nt, Homo Sapiens
auaagugcuaccguugagaaguucucugacuguguugggaaaggaguagccgguggagauacaa

SEQ ID NO: 627187 - RNA, 64 nt, Homo Sapiens
gagcuucuuucuucugcacucgguccuugcccauuugggaaacuaccuaucugucuaccaguag

SEQ ID NO: 627188 - RNA, 64 nt, Homo Sapiens
agcagaaugguccgcuucuugagucccuuugucuuugggaaaguuuuuucaguuacccuuuaag

SEQ ID NO: 627189 - RNA, 64 nt, Homo Sapiens
uuagaauaaagaacgagaacugauauuacaaauuuugggaaaucaauaaacuaaagccuggauu

SEQ ID NO: 627190 - RNA, 64 nt, Homo Sapiens
uuccccagcagaaucuggauaauugguaguggacuugggaaaucuuuuuaaaccaaguugagug

SEQ ID NO: 627191 - RNA, 64 nt, Homo Sapiens
cugaacacuucauucuucuuguggucagaugaguuugggaaaugugggggaaaaaggggauucu

SEQ ID NO: 627192 - RNA, 64 nt, Homo Sapiens
ucuuagauaguacagugagugucagaugguuuuuuugggaaaacagagcacacacucccuaauu

SEQ ID NO: 627193 - RNA, 64 nt, Homo Sapiens
uuaaaguaaaaguuucaaagcuuucauuuuaauuuugggaaauucuacucuccuucuuuuucug

SEQ ID NO: 627194 - RNA, 64 nt, Homo Sapiens
uaaaacucuagcaguuguuguucugguauauuuguugggaaagauuugcaacagcacacauagu

SEQ ID NO: 627195 - RNA, 64 nt, Homo Sapiens
ucuugucucuucuucccccaagaccacacacccuuugggaaagcaucuggagcuggcacugugg

SEQ ID NO: 627196 - RNA, 64 nt, Homo Sapiens
uguugcuucggggcauaagcugaucaccgucuaguugggaaaguaacccuacaggguuuguagg

SEQ ID NO: 627197 - RNA, 64 nt, Homo Sapiens
ucucauuccaccucuucucagagcaacucuuccuuugggaaaagaguucuucagaucauagacc

SEQ ID NO: 627198 - RNA, 64 nt, Homo Sapiens
ggcuaguggagggcuguugaacaagggaacacccuugggaaauguccagagucauucaggaagg

SEQ ID NO: 627199 - RNA, 64 nt, Homo Sapiens
ucuuuaucuuaugaggcuguuuucacuuugagcuuugggaaaacgcuagauaucuuucccucuu

SEQ ID NO: 627200 - RNA, 64 nt, Homo Sapiens
ugcacagcuagcuaugcaucagauaggaagagcauugggaaacuuuucugugugacuuauuagg

SEQ ID NO: 627201 - RNA, 64 nt, Homo Sapiens
ugggcauaaucagguaguuuaaaaaucaagguauuugggaaacaagaugaaaugucaauauaag

SEQ ID NO: 627202 - RNA, 64 nt, Homo Sapiens
ccacaucugcguccucaagaccuguuucauccauuugggaaaagauguugggaaaggccacuuu

SEQ ID NO: 627203 - RNA, 64 nt, Homo Sapiens
cucaagaccuguuucauccauuugggaaaagauguugggaaaggccacuuugcucgcaggggug

SEQ ID NO: 627204 - RNA, 64 nt, Homo Sapiens
cauuuacuggguccaccaaauuggagcaaagugguugggaaacuuaucuagucaagaagcccuu

SEQ ID NO: 627205 - RNA, 64 nt, Homo Sapiens
gagcaaacacacagcguguuuacacuccagggacuugggaaaauacaugaguaaagcagugugg

SEQ ID NO: 627206 - RNA, 64 nt, Homo Sapiens
uuccucauuguuggggaugaugagaagaaaugauuugggaaaauuaaguaacaacgaccuagaa

SEQ ID NO: 627207 - RNA, 64 nt, Homo Sapiens
agagcagcaccaccccacuggggcauccccagacuugggaaacgugacucuuucuuaaugccac

SEQ ID NO: 627208 - RNA, 64 nt, Homo Sapiens
uccauccucugccccucccccuggcuucuuucucuugggaaaacgggcaaaauaauugugcugg

SEQ ID NO: 627209 - RNA, 64 nt, Homo Sapiens
auaagggccuccccaguccucuccgggagaugauuugggaaauuuuauaaugcuuguucuguua

SEQ ID NO: 627210 - RNA, 64 nt, Homo Sapiens
uuuuaguaaauucagcuuaaauauaaguugaaauuugggaaauaauuuccaagcucuuggaagg

SEQ ID NO: 627211 - RNA, 64 nt, Homo Sapiens
agggaaauuauuuuaaguuauuacauuuacuguauugggaaacuugaggagaacucuuuaguuc

SEQ ID NO: 627212 - RNA, 64 nt, Homo Sapiens
ugaaguucguaucuuuaaggcucccaggagauauuugggaaaugcugauuucuugccaagaggu

SEQ ID NO: 627213 - RNA, 64 nt, Homo Sapiens
agcugauuucuugccaagagaugaccucucaaaguugggaaacaucuccagcuucucauucaug

SEQ ID NO: 627214 - RNA, 64 nt, Homo Sapiens
uauuucuuugguacuaccauguauuguguaacuuuugggaaaguaagguggcuucccugcucuc

SEQ ID NO: 627215 - RNA, 64 nt, Homo Sapiens
gaaaacagaggcuuuaaauuaaaucaucuauuccuugggaaagguauuuuguaccauaugggac

SEQ ID NO: 627216 - RNA, 64 nt, Homo Sapiens
uaaauacagcuuuaucccaaaagcuuuaacuguauugggaaaacuuaaaaaauagcauccucaa

SEQ ID NO: 627217 - RNA, 64 nt, Homo Sapiens
uuuuuacugggggggauuugugauaggaaaguccuugggaaacauuuccaaucuuucaaaauau

SEQ ID NO: 627218 - RNA, 64 nt, Homo Sapiens
acgccucuuuccgaggugaaggugggaccauuccuugggaaaggauucacaguaagguuuuuug

SEQ ID NO: 627219 - RNA, 64 nt, Homo Sapiens
auccaaaugaugaugugcaauuucauguuuuaacuugggaaacugaaaguguucccauauagcu

SEQ ID NO: 627220 - RNA, 64 nt, Homo Sapiens
auacuuuuaugguuacuaacuaguacuuuccuaauugggaaaguagugcuuaaguuugcaaauu

SEQ ID NO: 627221 - RNA, 64 nt, Homo Sapiens
gauuauguaggaauaauguuaaaacaaauuugacuugggaaaggaaaccaacuggcucauggag

SEQ ID NO: 627222 - RNA, 64 nt, Homo Sapiens
uucagaaacugauguaucaaaugguuauuucccuuugggaaaacaucaggacccucauguuuaa

SEQ ID NO: 627223 - RNA, 64 nt, Homo Sapiens
ccccucacccauuccuagugcucuugguauacacuugggaaaauaauguccuccaggagaaagu

SEQ ID NO: 627224 - RNA, 64 nt, Homo Sapiens
gucuauacaguauaaacuaccucacuugccuuucuugggaaaaaaaaaaugaauggacuuuaac

SEQ ID NO: 627225 - RNA, 64 nt, Homo Sapiens
aaucagagagcugcccuucaaaucugcuaggaacuugggaaaggaaccagcuucugauaaacac

SEQ ID NO: 627226 - RNA, 64 nt, Homo Sapiens
gggaccagaacuuccccuccuggcaaagcugacuuugggaaagaaccuucuugucauugaaauu

SEQ ID NO: 627227 - RNA, 64 nt, Homo Sapiens
acucacaugaggauggaggaacagaacagaggacuugggaaaagucucaacuugaugggguagc

SEQ ID NO: 627228 - RNA, 64 nt, Homo Sapiens
caagcugcuggcuuuaagcuuaugcaagugguaguugggaaaguaggagguguggaagaggguu

SEQ ID NO: 627229 - RNA, 64 nt, Homo Sapiens
uaaaaaaaaggucagaaggacaaagcugguuuguuugggaaauggacugaucgaaagaaaacuu

SEQ ID NO: 627230 - RNA, 64 nt, Homo Sapiens
cagccauaccucuuaacaccucauagaacacacuuugggaaacaguggggguaggaaaacucgg

SEQ ID NO: 627231 - RNA, 64 nt, Homo Sapiens
cuucauauuugcaacuuugaccugucaggucuccuugggaaaggcagagagaugcugaguuagg

SEQ ID NO: 627232 - RNA, 64 nt, Homo Sapiens
ucaaguuacaguggaguauucacaagccaguuucuugggaaaauugaaggugaugcugccaaag

SEQ ID NO: 627233 - RNA, 64 nt, Homo Sapiens
accuucaugcagagauuuuauuucaccuuuaguuuugggaaaagcgagaaacagaugaucuaua

SEQ ID NO: 627234 - RNA, 64 nt, Homo Sapiens
uuaugcagaauaauccaggcgugagaguguucucuugggaaaugacuggggagacaccugaaag

SEQ ID NO: 627235 - RNA, 64 nt, Homo Sapiens; identical to SEQ ID NO: 126265

SEQ ID NO: 627236 - RNA, 64 nt, Homo Sapiens; identical to SEQ ID NO: 126266

SEQ ID NO: 627237 - RNA, 64 nt, Homo Sapiens; identical to SEQ ID NO: 126267

SEQ ID NO: 627238 - RNA, 64 nt, Homo Sapiens; identical to SEQ ID NO: 126268

SEQ ID NO: 627239 - RNA, 64 nt, Homo Sapiens; identical to SEQ ID NO: 126269

SEQ ID NO: 627240 - RNA, 64 nt, Homo Sapiens; identical to SEQ ID NO: 126270

SEQ ID NO: 627241 - RNA, 64 nt, Homo Sapiens; identical to SEQ ID NO: 126271

SEQ ID NO: 627242 - RNA, 64 nt, Homo Sapiens; identical to SEQ ID NO: 126272

SEQ ID NO: 627243 - RNA, 64 nt, Homo Sapiens; identical to SEQ ID NO: 126273

SEQ ID NO: 627244 - RNA, 64 nt, Homo Sapiens; identical to SEQ ID NO: 126274

SEQ ID NO: 627245 - RNA, 64 nt, Homo Sapiens; identical to SEQ ID NO: 126275

SEQ ID NO: 627246 - RNA, 64 nt, Homo Sapiens; identical to SEQ ID NO: 126276

SEQ ID NO: 627247 - RNA, 64 nt, Homo Sapiens; identical to SEQ ID NO: 126277

SEQ ID NO: 627248 - RNA, 64 nt, Homo Sapiens; identical to SEQ ID NO: 126278

SEQ ID NO: 627249 - RNA, 64 nt, Homo Sapiens; identical to SEQ ID NO: 126279

SEQ ID NO: 627250 - RNA, 64 nt, Homo Sapiens; identical to SEQ ID NO: 126280

SEQ ID NO: 627251 - RNA, 64 nt, Homo Sapiens; identical to SEQ ID NO: 225698

SEQ ID NO: 627252 - RNA, 64 nt, Homo Sapiens; identical to SEQ ID NO: 225699

SEQ ID NO: 627253 - RNA, 64 nt, Homo Sapiens; identical to SEQ ID NO: 225700

SEQ ID NO: 627254 - RNA, 64 nt, Homo Sapiens; identical to SEQ ID NO: 225701

SEQ ID NO: 627255 - RNA, 64 nt, Homo Sapiens; identical to SEQ ID NO: 225702

SEQ ID NO: 627256 - RNA, 64 nt, Homo Sapiens; identical to SEQ ID NO: 225703

SEQ ID NO: 627257 - RNA, 64 nt, Homo Sapiens; identical to SEQ ID NO: 225704

SEQ ID NO: 627258 - RNA, 64 nt, Homo Sapiens; identical to SEQ ID NO: 225705

SEQ ID NO: 627259 - RNA, 64 nt, Homo Sapiens; identical to SEQ ID NO: 225706

SEQ ID NO: 627260 - RNA, 64 nt, Homo Sapiens; identical to SEQ ID NO: 225707

SEQ ID NO: 627261 - RNA, 64 nt, Homo Sapiens; identical to SEQ ID NO: 225708

SEQ ID NO: 627262 - RNA, 64 nt, Homo Sapiens; identical to SEQ ID NO: 225709

SEQ ID NO: 627263 - RNA, 64 nt, Homo Sapiens; identical to SEQ ID NO: 225710

SEQ ID NO: 627264 - RNA, 64 nt, Homo Sapiens; identical to SEQ ID NO: 225711

SEQ ID NO: 627265 - RNA, 64 nt, Homo Sapiens; identical to SEQ ID NO: 225712

SEQ ID NO: 627266 - RNA, 64 nt, Homo Sapiens; identical to SEQ ID NO: 225713

SEQ ID NO: 627267 - RNA, 64 nt, Homo Sapiens; identical to SEQ ID NO: 225714

SEQ ID NO: 627268 - RNA, 64 nt, Homo Sapiens; identical to SEQ ID NO: 225715

SEQ ID NO: 627269 - RNA, 64 nt, Homo Sapiens; identical to SEQ ID NO: 225716

SEQ ID NO: 627270 - RNA, 64 nt, Homo Sapiens; identical to SEQ ID NO: 225717

SEQ ID NO: 627271 - RNA, 64 nt, Homo Sapiens; identical to SEQ ID NO: 225718

SEQ ID NO: 627272 - RNA, 64 nt, Homo Sapiens; identical to SEQ ID NO: 225719

SEQ ID NO: 627273 - RNA, 64 nt, Homo Sapiens; identical to SEQ ID NO: 225720

SEQ ID NO: 627274 - RNA, 64 nt, Homo Sapiens; identical to SEQ ID NO: 225721

SEQ ID NO: 627275 - RNA, 64 nt, Homo Sapiens; identical to SEQ ID NO: 225722

SEQ ID NO: 627276 - RNA, 64 nt, Homo Sapiens; identical to SEQ ID NO: 225723

SEQ ID NO: 627277 - RNA, 64 nt, Homo Sapiens; identical to SEQ ID NO: 225724

SEQ ID NO: 627278 - RNA, 64 nt, Homo Sapiens; identical to SEQ ID NO: 225725

SEQ ID NO: 627279 - RNA, 64 nt, Homo Sapiens; identical to SEQ ID NO: 225726

SEQ ID NO: 627280 - RNA, 64 nt, Homo Sapiens; identical to SEQ ID NO: 225727

SEQ ID NO: 627281 - RNA, 64 nt, Homo Sapiens; identical to SEQ ID NO: 225728

SEQ ID NO: 627282 - RNA, 64 nt, Homo Sapiens; identical to SEQ ID NO: 225729

SEQ ID NO: 627283 - RNA, 64 nt, Homo Sapiens; identical to SEQ ID NO: 225730

SEQ ID NO: 627284 - RNA, 64 nt, Homo Sapiens; identical to SEQ ID NO: 225731

SEQ ID NO: 627285 - RNA, 64 nt, Homo Sapiens; identical to SEQ ID NO: 225732

SEQ ID NO: 627286 - RNA, 64 nt, Homo Sapiens; identical to SEQ ID NO: 225733

SEQ ID NO: 627287 - RNA, 64 nt, Homo Sapiens; identical to SEQ ID NO: 225734

SEQ ID NO: 627288 - RNA, 64 nt, Homo Sapiens; identical to SEQ ID NO: 225735

SEQ ID NO: 627289 - RNA, 64 nt, Homo Sapiens; identical to SEQ ID NO: 225736

SEQ ID NO: 627290 - RNA, 64 nt, Homo Sapiens; identical to SEQ ID NO: 225737

SEQ ID NO: 627291 - RNA, 64 nt, Homo Sapiens; identical to SEQ ID NO: 225738

SEQ ID NO: 627292 - RNA, 64 nt, Homo Sapiens; identical to SEQ ID NO: 225739

SEQ ID NO: 627293 - RNA, 64 nt, Homo Sapiens; identical to SEQ ID NO: 225740

SEQ ID NO: 627294 - RNA, 64 nt, Homo Sapiens; identical to SEQ ID NO: 225741

SEQ ID NO: 627295 - RNA, 64 nt, Homo Sapiens; identical to SEQ ID NO: 225742

SEQ ID NO: 627296 - RNA, 64 nt, Homo Sapiens; identical to SEQ ID NO: 225743

SEQ ID NO: 627297 - RNA, 64 nt, Homo Sapiens; identical to SEQ ID NO: 225744

SEQ ID NO: 627298 - RNA, 64 nt, Homo Sapiens; identical to SEQ ID NO: 225745

SEQ ID NO: 627299 - RNA, 64 nt, Homo Sapiens; identical to SEQ ID NO: 225746

SEQ ID NO: 627300 - RNA, 64 nt, Homo Sapiens; identical to SEQ ID NO: 225747

SEQ ID NO: 627301 - RNA, 64 nt, Homo Sapiens
guacaauguuaaacuucaaucaguaacuuauugccgcuuauauuuggaauuugucagcagauau

SEQ ID NO: 627302 - RNA, 64 nt, Homo Sapiens
gaaguauuagauuaaagcuuauauucacuuucagcgcuuauacuguuuuuauaaaagcaaaagg

SEQ ID NO: 627303 - RNA, 64 nt, Homo Sapiens
caagcuaaaauacuaagaccagcauucuuaguggcgcuuauaaauuagcucucaccugguuucc

SEQ ID NO: 627304 - RNA, 64 nt, Homo Sapiens
aauuaaaugggggcucuuacugacuuuaaauuagcgcuuauaaaauaaaaauguuuaguucaag

SEQ ID NO: 627305 - RNA, 64 nt, Homo Sapiens
uugugaauaaaaugaucaaaagggauguaagucucgcuuauauuuuugaaaacuuucaccagaa

SEQ ID NO: 627306 - RNA, 64 nt, Homo Sapiens
uuaugaugauuaauagcagcagcauguucaguuucgcuuauaugagaaacauguuuaggcaacu

SEQ ID NO: 627307 - RNA, 64 nt, Homo Sapiens
accagaggcccucugagaucggggccagaaaaaacgcuuauaaaggaaucccugagggguagaa

SEQ ID NO: 627308 - RNA, 64 nt, Homo Sapiens
aaaauucuccaacaaaaauaacuucccucuaucccgcuuauaaaucuucugagugucuauguua

SEQ ID NO: 627309 - RNA, 64 nt, Homo Sapiens
uuuuuguauuuuuuuuuaaaguaaauucaacuuacgcuuauauaagccuuucacaaauccaaua

SEQ ID NO: 627310 - RNA, 64 nt, Homo Sapiens
ccuuauuaaaugaaaccucacggauccuuuguuccgcuuauauuccaugcauaccacauaaaag

SEQ ID NO: 627311 - RNA, 64 nt, Homo Sapiens
uucacagaacuacccuguuuuuaaauaguucuuacgcuuauacaauacuuuauaagcagcauug

SEQ ID NO: 627312 - RNA, 64 nt, Homo Sapiens
auuucuugcugaauuugauaaaguaaaagcauaucgcuuauaucaacuggacuuuuuagaagua

SEQ ID NO: 627313 - RNA, 64 nt, Homo Sapiens
acauaacuaagccaagagugccuuccauaccccacgcuuauaaacacaccaggggcgcccucug

SEQ ID NO: 627314 - RNA, 64 nt, Homo Sapiens
uguaguguuucauuggauuucaaguuuguccuaucgcuuauaaacaaaaguugcaaauuauaug

SEQ ID NO: 627315 - RNA, 64 nt, Homo Sapiens
cauggaugguuuacuugcucaaaauucauucuugcgcuuauauggcuuuuuugaguuuauguuu

SEQ ID NO: 627316 - RNA, 64 nt, Homo Sapiens
accuucagaucucaugagacguggaaaugccagacgcuuauaaagaugaaaaugacugccagca

SEQ ID NO: 627317 - RNA, 64 nt, Homo Sapiens
uccuuggguugcugguuggagcaauaguggaaaucgcuuauauguuccugccgagugcucugau

SEQ ID NO: 627318 - RNA, 64 nt, Homo Sapiens
ucagagcccuagagcuggcuaguguaacacugacuaugaguaggugggcccacacuugaguuga

SEQ ID NO: 627319 - RNA, 64 nt, Homo Sapiens
aagaguuuaguuuuuuuacuuuauaaacugugaauaugaguaugccagcugcauacgauguaac

SEQ ID NO: 627320 - RNA, 64 nt, Homo Sapiens
ccagcugcauuagauguaacuuauaaacugugaauaugaguaugaagaguuuaguuuuuuuacu

SEQ ID NO: 627321 - RNA, 64 nt, Homo Sapiens
ugggcccaccacuugaguugaguguaacacugacuaugaguaggucagagcccuagagcuggcu

SEQ ID NO: 627322 - RNA, 64 nt, Homo Sapiens
aguccaugcaugacagccucuauccuacaaggccuaugaguauggauugggggggccaaaagga

SEQ ID NO: 627323 - RNA, 64 nt, Homo Sapiens
ccuggguuuguuuuccuuggggugguguagauuguaugaguaagaaguauuaauuuuuuaaaag

SEQ ID NO: 627324 - RNA, 64 nt, Homo Sapiens
cccuaacccuacaugcauguuuuaugugcacucauaugaguaucuuuaaauauaaucccuuuac

SEQ ID NO: 627325 - RNA, 64 nt, Homo Sapiens
accaccuuauuagcuaaaaauauauauaacacaauaugaguaauguuuaagaucuguuuuaaau

SEQ ID NO: 627326 - RNA, 64 nt, Homo Sapiens
ugaguaaaucagauguugaauucuuuugccaagggaauuauagcugcagguucucucucacugc

SEQ ID NO: 627327 - RNA, 64 nt, Homo Sapiens
ugcuuugcuuugucuggaagaaagauaaaauagugaauuauaaauaagucaggccgggcguggu

SEQ ID NO: 627328 - RNA, 64 nt, Homo Sapiens
ccuuauuuuuuuccuuugcguagagauguauauagaauuauagucccauagcacaacagguuua

SEQ ID NO: 627329 - RNA, 64 nt, Homo Sapiens
uuauauucagcccugaguggggggggugggggaugaauuauaaauaagguucuuguguauauuu

SEQ ID NO: 627330 - RNA, 64 nt, Homo Sapiens
cgaggaacauguagcgucuacacaggaaaguaaagaauuauagaauuaacuaauucuacuugaa

SEQ ID NO: 627331 - RNA, 64 nt, Homo Sapiens
ccucuguguggcacauaggaaaaugugagaccuagaauuauagcaacuuuuuuuuucuguuaaa

SEQ ID NO: 627332 - RNA, 64 nt, Homo Sapiens
ucaauaaaguuguuaguaaaauuauaugguaugugaauuauaucuguauauuuuaaguggguga

SEQ ID NO: 627333 - RNA, 64 nt, Homo Sapiens
guaugugaauuauaucucaauauuuuaagugggugaauuauauguuaaaaaccauugaguugua

SEQ ID NO: 627334 - RNA, 64 nt, Homo Sapiens
aauaugacauaagcaaucauuuuaugcuguuuaugaauuauaaauguguuuauagcucauuugu

SEQ ID NO: 627335 - RNA, 64 nt, Homo Sapiens
caggugcauauuaauuuucuugguucuuucagcugaauuauauugguccagaaguucaaaauca

SEQ ID NO: 627336 - RNA, 64 nt, Homo Sapiens
gaaaaaaaaagauaaagguuguacgguggucuuugaauuauaugucuaauucuauguguuuugu

SEQ ID NO: 627337 - RNA, 64 nt, Homo Sapiens
uuaaauauuaugugaaaucaaagcgccauauguagaauuauaucuucaggacuauuucacuaau

SEQ ID NO: 627338 - RNA, 64 nt, Homo Sapiens
caccuaacagucagaggucaguaucucagcgugugaauuauagaggaaauacagagagaaccuc

SEQ ID NO: 627339 - RNA, 64 nt, Homo Sapiens
uuuucaguagcuuuaucacaauauucacaauggagaauuauaugacaugguagcagaaauaggc

SEQ ID NO: 627340 - RNA, 64 nt, Homo Sapiens
uuaaaaaaaccaacagcagcacaggauguauuaagaauuauaugaagucagguuuguuuuuuuu

SEQ ID NO: 627341 - RNA, 64 nt, Homo Sapiens
gaauaaccuuuaaaggguuguuuuguuuuguuuugaauuauaggaguuauaaucuuuggagaug

SEQ ID NO: 627342 - RNA, 64 nt, Homo Sapiens
ugaugcauccaauccuaaaacuuacauuccaaaggaauuauaucauuauguuccuaaggaguaa

SEQ ID NO: 627343 - RNA, 64 nt, Homo Sapiens
guguguuuuauucagguuguguaaugcucccguagaauuauagaacaauuaaauaugguuaguu

SEQ ID NO: 627344 - RNA, 64 nt, Homo Sapiens
aaaagggaugcuuuuauauacuggaaaaaauauggaauuauauaguaucuugauucuauguugu

SEQ ID NO: 627345 - RNA, 64 nt, Homo Sapiens
gaucuacaguuguaucuugauaauauuaaguuuagaauuauaauaauuuucauguuugaaguuc

SEQ ID NO: 627346 - RNA, 64 nt, Homo Sapiens
agcuacuuuuuauaaagccaacucuucauuuugugaauuauagagauacucaaauuauaauaaa

SEQ ID NO: 627347 - RNA, 64 nt, Homo Sapiens
ccacuggcauuuuaguguauaagauguuuugaaugaauuauaguaucuuugggaaggaacacua

SEQ ID NO: 627348 - RNA, 64 nt, Homo Sapiens
uguuugaaucaaggcaacucuugugauaacuugagaauuauacuguaaauuuuugugggaaauu

SEQ ID NO: 627349 - RNA, 64 nt, Homo Sapiens
aaaaugauacaugagaaauauuagugaaaccauggaauuauauggcuuauuguaacauauaaua

SEQ ID NO: 627350 - RNA, 64 nt, Homo Sapiens
gcaccucucuaaagaaucuuuaguuuccgacguugaauuauagaccaguuugaguaaguacugc

SEQ ID NO: 627351 - RNA, 64 nt, Homo Sapiens
uacagcagugcaguccagagguuaagauguauuagaauuauacaauaucaguuuaaaaaucugu

SEQ ID NO: 627352 - RNA, 64 nt, Homo Sapiens
gaaucagaaaucccccuucuacagaggcaacacagaauuauaaggcucacccaagcucucccuu

SEQ ID NO: 627353 - RNA, 64 nt, Homo Sapiens
auuuccucugcauaauugaauuuuucaaauaaaggaauuauauuaucucugagguucaguauca

SEQ ID NO: 627354 - RNA, 64 nt, Homo Sapiens
cugccauauuccaagucacauuauuuuaccaauggaauuauagaauuaacaguauuuuaaauua

SEQ ID NO: 627355 - RNA, 64 nt, Homo Sapiens
gcagauauagugaacacuggaaagauuuauuaaagaauuauauuuguguauacuuuauaaauua

SEQ ID NO: 627356 - RNA, 64 nt, Homo Sapiens
aacaacagaaaugcuccuggaacuucaaguugcugaauuauaaguuuauuuuuuaucaauaaau

SEQ ID NO: 627357 - RNA, 64 nt, Homo Sapiens
auauauuuuuacauaaaagcuugaacauacagaugaauuauaaccuaugugaagaaaucuuaga

SEQ ID NO: 627358 - RNA, 64 nt, Homo Sapiens
auagauauaaauaauucuaaacuuaaaaucacuagaauuauagcuuaaauauuaugaaauguac

SEQ ID NO: 627359 - RNA, 64 nt, Homo Sapiens
cuuaaauuuugacuguacuaacuauaaauguaaugaauuauaauaauuauaaaugguauaaaug

SEQ ID NO: 627360 - RNA, 64 nt, Homo Sapiens; identical to SEQ ID NO: 364007

SEQ ID NO: 627361 - RNA, 64 nt, Homo Sapiens; identical to SEQ ID NO: 364008

SEQ ID NO: 627362 - RNA, 64 nt, Homo Sapiens; identical to SEQ ID NO: 364009

SEQ ID NO: 627363 - RNA, 64 nt, Homo Sapiens; identical to SEQ ID NO: 364010

SEQ ID NO: 627364 - RNA, 64 nt, Homo Sapiens; identical to SEQ ID NO: 364011

SEQ ID NO: 627365 - RNA, 64 nt, Homo Sapiens; identical to SEQ ID NO: 364012

SEQ ID NO: 627366 - RNA, 64 nt, Homo Sapiens; identical to SEQ ID NO: 364013

SEQ ID NO: 627367 - RNA, 64 nt, Homo Sapiens; identical to SEQ ID NO: 364014

SEQ ID NO: 627368 - RNA, 64 nt, Homo Sapiens; identical to SEQ ID NO: 364015

SEQ ID NO: 627369 - RNA, 64 nt, Homo Sapiens; identical to SEQ ID NO: 364016

SEQ ID NO: 627370 - RNA, 64 nt, Homo Sapiens; identical to SEQ ID NO: 364017

SEQ ID NO: 627371 - RNA, 64 nt, Homo Sapiens; identical to SEQ ID NO: 364018

SEQ ID NO: 627372 - RNA, 64 nt, Homo Sapiens; identical to SEQ ID NO: 364019

SEQ ID NO: 627373 - RNA, 64 nt, Homo Sapiens; identical to SEQ ID NO: 364020

SEQ ID NO: 627374 - RNA, 64 nt, Homo Sapiens; identical to SEQ ID NO: 364021

SEQ ID NO: 627375 - RNA, 64 nt, Homo Sapiens; identical to SEQ ID NO: 364022

SEQ ID NO: 627376 - RNA, 64 nt, Homo Sapiens; identical to SEQ ID NO: 364023

SEQ ID NO: 627377 - RNA, 64 nt, Homo Sapiens; identical to SEQ ID NO: 364024

SEQ ID NO: 627378 - RNA, 64 nt, Homo Sapiens; identical to SEQ ID NO: 364025

SEQ ID NO: 627379 - RNA, 64 nt, Homo Sapiens; identical to SEQ ID NO: 364026

SEQ ID NO: 627380 - RNA, 64 nt, Homo Sapiens; identical to SEQ ID NO: 364027

SEQ ID NO: 627381 - RNA, 64 nt, Homo Sapiens; identical to SEQ ID NO: 364028

SEQ ID NO: 627382 - RNA, 64 nt, Homo Sapiens; identical to SEQ ID NO: 364029

SEQ ID NO: 627383 - RNA, 64 nt, Homo Sapiens; identical to SEQ ID NO: 364030

SEQ ID NO: 627384 - RNA, 64 nt, Homo Sapiens; identical to SEQ ID NO: 364031

SEQ ID NO: 627385 - RNA, 64 nt, Homo Sapiens; identical to SEQ ID NO: 364032

SEQ ID NO: 627386 - RNA, 64 nt, Homo Sapiens; identical to SEQ ID NO: 364033

SEQ ID NO: 627387 - RNA, 64 nt, Homo Sapiens; identical to SEQ ID NO: 364034

SEQ ID NO: 627388 - RNA, 64 nt, Homo Sapiens; identical to SEQ ID NO: 364035

SEQ ID NO: 627389 - RNA, 64 nt, Homo Sapiens; identical to SEQ ID NO: 364036

SEQ ID NO: 627390 - RNA, 64 nt, Homo Sapiens; identical to SEQ ID NO: 364037

SEQ ID NO: 627391 - RNA, 64 nt, Homo Sapiens; identical to SEQ ID NO: 364038

SEQ ID NO: 627392 - RNA, 64 nt, Homo Sapiens; identical to SEQ ID NO: 364039

SEQ ID NO: 627393 - RNA, 64 nt, Homo Sapiens; identical to SEQ ID NO: 364040

SEQ ID NO: 627394 - RNA, 64 nt, Homo Sapiens; identical to SEQ ID NO: 364041

SEQ ID NO: 627395 - RNA, 64 nt, Homo Sapiens; identical to SEQ ID NO: 364042

SEQ ID NO: 627396 - RNA, 64 nt, Homo Sapiens; identical to SEQ ID NO: 364043

SEQ ID NO: 627397 - RNA, 64 nt, Homo Sapiens; identical to SEQ ID NO: 364044

SEQ ID NO: 627398 - RNA, 64 nt, Homo Sapiens; identical to SEQ ID NO: 364045

SEQ ID NO: 627399 - RNA, 64 nt, Homo Sapiens; identical to SEQ ID NO: 364046

SEQ ID NO: 627400 - RNA, 64 nt, Homo Sapiens; identical to SEQ ID NO: 364047

SEQ ID NO: 627401 - RNA, 64 nt, Homo Sapiens; identical to SEQ ID NO: 364048

SEQ ID NO: 627402 - RNA, 64 nt, Homo Sapiens; identical to SEQ ID NO: 364049

SEQ ID NO: 627403 - RNA, 64 nt, Homo Sapiens; identical to SEQ ID NO: 364050

SEQ ID NO: 627404 - RNA, 64 nt, Homo Sapiens; identical to SEQ ID NO: 364051

SEQ ID NO: 627405 - RNA, 64 nt, Homo Sapiens; identical to SEQ ID NO: 364052

SEQ ID NO: 627406 - RNA, 64 nt, Homo Sapiens; identical to SEQ ID NO: 364053

SEQ ID NO: 627407 - RNA, 64 nt, Homo Sapiens; identical to SEQ ID NO: 364054

SEQ ID NO: 627408 - RNA, 64 nt, Homo Sapiens; identical to SEQ ID NO: 364055

SEQ ID NO: 627409 - RNA, 64 nt, Homo Sapiens; identical to SEQ ID NO: 364056

SEQ ID NO: 627410 - RNA, 64 nt, Homo Sapiens; identical to SEQ ID NO: 364057

SEQ ID NO: 627411 - RNA, 64 nt, Homo Sapiens; identical to SEQ ID NO: 364058

SEQ ID NO: 627412 - RNA, 64 nt, Homo Sapiens; identical to SEQ ID NO: 364059

SEQ ID NO: 627413 - RNA, 64 nt, Homo Sapiens; identical to SEQ ID NO: 364060

SEQ ID NO: 627414 - RNA, 64 nt, Homo Sapiens; identical to SEQ ID NO: 364061

SEQ ID NO: 627415 - RNA, 64 nt, Homo Sapiens; identical to SEQ ID NO: 364062

SEQ ID NO: 627416 - RNA, 64 nt, Homo Sapiens; identical to SEQ ID NO: 364063

SEQ ID NO: 627417 - RNA, 64 nt, Homo Sapiens; identical to SEQ ID NO: 364064

SEQ ID NO: 627418 - RNA, 64 nt, Homo Sapiens; identical to SEQ ID NO: 364065

SEQ ID NO: 627419 - RNA, 64 nt, Homo Sapiens; identical to SEQ ID NO: 364066

SEQ ID NO: 627420 - RNA, 64 nt, Homo Sapiens; identical to SEQ ID NO: 364067

SEQ ID NO: 627421 - RNA, 64 nt, Homo Sapiens; identical to SEQ ID NO: 364068

SEQ ID NO: 627422 - RNA, 64 nt, Homo Sapiens; identical to SEQ ID NO: 364069

SEQ ID NO: 627423 - RNA, 64 nt, Homo Sapiens; identical to SEQ ID NO: 364070

SEQ ID NO: 627424 - RNA, 64 nt, Homo Sapiens; identical to SEQ ID NO: 364071

SEQ ID NO: 627425 - RNA, 64 nt, Homo Sapiens; identical to SEQ ID NO: 364072

SEQ ID NO: 627426 - RNA, 64 nt, Homo Sapiens; identical to SEQ ID NO: 364073

SEQ ID NO: 627427 - RNA, 64 nt, Homo Sapiens; identical to SEQ ID NO: 364074

SEQ ID NO: 627428 - RNA, 64 nt, Homo Sapiens; identical to SEQ ID NO: 364075

SEQ ID NO: 627429 - RNA, 64 nt, Homo Sapiens; identical to SEQ ID NO: 364076

SEQ ID NO: 627430 - RNA, 64 nt, Homo Sapiens; identical to SEQ ID NO: 364077

SEQ ID NO: 627431 - RNA, 64 nt, Homo Sapiens; identical to SEQ ID NO: 364078

SEQ ID NO: 627432 - RNA, 64 nt, Homo Sapiens; identical to SEQ ID NO: 364079

SEQ ID NO: 627433 - RNA, 64 nt, Homo Sapiens; identical to SEQ ID NO: 364080

SEQ ID NO: 627434 - RNA, 64 nt, Homo Sapiens; identical to SEQ ID NO: 364081

SEQ ID NO: 627435 - RNA, 64 nt, Homo Sapiens; identical to SEQ ID NO: 364082

SEQ ID NO: 627436 - RNA, 64 nt, Homo Sapiens; identical to SEQ ID NO: 364083

SEQ ID NO: 627437 - RNA, 64 nt, Homo Sapiens; identical to SEQ ID NO: 364084

SEQ ID NO: 627438 - RNA, 64 nt, Homo Sapiens; identical to SEQ ID NO: 364085

SEQ ID NO: 627439 - RNA, 64 nt, Homo Sapiens; identical to SEQ ID NO: 364086

SEQ ID NO: 627440 - RNA, 64 nt, Homo Sapiens; identical to SEQ ID NO: 364087

SEQ ID NO: 627441 - RNA, 64 nt, Homo Sapiens; identical to SEQ ID NO: 364088

SEQ ID NO: 627442 - RNA, 64 nt, Homo Sapiens; identical to SEQ ID NO: 364089

SEQ ID NO: 627443 - RNA, 64 nt, Homo Sapiens; identical to SEQ ID NO: 364090

SEQ ID NO: 627444 - RNA, 64 nt, Homo Sapiens; identical to SEQ ID NO: 364091

SEQ ID NO: 627445 - RNA, 64 nt, Homo Sapiens; identical to SEQ ID NO: 364092

SEQ ID NO: 627446 - RNA, 64 nt, Homo Sapiens; identical to SEQ ID NO: 364093

SEQ ID NO: 627447 - RNA, 64 nt, Homo Sapiens; identical to SEQ ID NO: 364094

SEQ ID NO: 627448 - RNA, 64 nt, Homo Sapiens; identical to SEQ ID NO: 364095

SEQ ID NO: 627449 - RNA, 64 nt, Homo Sapiens; identical to SEQ ID NO: 364096

SEQ ID NO: 627450 - RNA, 64 nt, Homo Sapiens; identical to SEQ ID NO: 364097

SEQ ID NO: 627451 - RNA, 64 nt, Homo Sapiens; identical to SEQ ID NO: 364098

SEQ ID NO: 627452 - RNA, 64 nt, Homo Sapiens; identical to SEQ ID NO: 364099

SEQ ID NO: 627453 - RNA, 64 nt, Homo Sapiens; identical to SEQ ID NO: 364100

SEQ ID NO: 627454 - RNA, 64 nt, Homo Sapiens; identical to SEQ ID NO: 364101

SEQ ID NO: 627455 - RNA, 64 nt, Homo Sapiens; identical to SEQ ID NO: 364102

SEQ ID NO: 627456 - RNA, 64 nt, Homo Sapiens; identical to SEQ ID NO: 364103

SEQ ID NO: 627457 - RNA, 64 nt, Homo Sapiens; identical to SEQ ID NO: 364104

SEQ ID NO: 627458 - RNA, 64 nt, Homo Sapiens; identical to SEQ ID NO: 364105

SEQ ID NO: 627459 - RNA, 64 nt, Homo Sapiens; identical to SEQ ID NO: 364106

SEQ ID NO: 627460 - RNA, 64 nt, Homo Sapiens; identical to SEQ ID NO: 364107

SEQ ID NO: 627461 - RNA, 64 nt, Homo Sapiens; identical to SEQ ID NO: 364108

SEQ ID NO: 627462 - RNA, 64 nt, Homo Sapiens; identical to SEQ ID NO: 364109

SEQ ID NO: 627463 - RNA, 64 nt, Homo Sapiens; identical to SEQ ID NO: 364110

SEQ ID NO: 627464 - RNA, 64 nt, Homo Sapiens; identical to SEQ ID NO: 364111

SEQ ID NO: 627465 - RNA, 64 nt, Homo Sapiens; identical to SEQ ID NO: 364112

SEQ ID NO: 627466 - RNA, 64 nt, Homo Sapiens; identical to SEQ ID NO: 355376

SEQ ID NO: 627467 - RNA, 64 nt, Homo Sapiens; identical to SEQ ID NO: 355377

SEQ ID NO: 627468 - RNA, 64 nt, Homo Sapiens; identical to SEQ ID NO: 355378

SEQ ID NO: 627469 - RNA, 64 nt, Homo Sapiens; identical to SEQ ID NO: 355379

SEQ ID NO: 627470 - RNA, 64 nt, Homo Sapiens; identical to SEQ ID NO: 355380

SEQ ID NO: 627471 - RNA, 64 nt, Homo Sapiens; identical to SEQ ID NO: 355381

SEQ ID NO: 627472 - RNA, 64 nt, Homo Sapiens; identical to SEQ ID NO: 355382

SEQ ID NO: 627473 - RNA, 64 nt, Homo Sapiens; identical to SEQ ID NO: 355383

SEQ ID NO: 627474 - RNA, 64 nt, Homo Sapiens; identical to SEQ ID NO: 355384

SEQ ID NO: 627475 - RNA, 64 nt, Homo Sapiens; identical to SEQ ID NO: 355385

SEQ ID NO: 627476 - RNA, 64 nt, Homo Sapiens; identical to SEQ ID NO: 496529

SEQ ID NO: 627477 - RNA, 64 nt, Homo Sapiens; identical to SEQ ID NO: 496530

SEQ ID NO: 627478 - RNA, 62 nt, Homo Sapiens; identical to SEQ ID NO: 496531

SEQ ID NO: 627479 - RNA, 64 nt, Homo Sapiens; identical to SEQ ID NO: 496532

SEQ ID NO: 627480 - RNA, 64 nt, Homo Sapiens; identical to SEQ ID NO: 496533

SEQ ID NO: 627481 - RNA, 64 nt, Homo Sapiens; identical to SEQ ID NO: 496534

SEQ ID NO: 627482 - RNA, 59 nt, Homo Sapiens
agguguuucuagacccccgacuccgcaagagugaggaugaugggagcuggucaugggag

SEQ ID NO: 627483 - RNA, 59 nt, Homo Sapiens
uuaacugacuucuguccacucuggagagcagugaggaauuaaucuugcuuuugcuuguc

SEQ ID NO: 627484 - RNA, 59 nt, Homo Sapiens
uucaagcuggaagaagugagcaguguuggagugaggaccuguaaggcaggcccauucag

SEQ ID NO: 627485 - RNA, 59 nt, Homo Sapiens
agucucugcccucauagaguugauugucuagugaggaagacaagcauuuuuaaaaaaua

SEQ ID NO: 627486 - RNA, 59 nt, Homo Sapiens
ccucugcccggccgccaccccgucugggaagugaggagcgucucugccuggcugcccau

SEQ ID NO: 627487 - RNA, 59 nt, Homo Sapiens
gccccucugccuggcugcccagucuggaaagugaggagcgucucugcccggccgccauc

SEQ ID NO: 627488 - RNA, 59 nt, Homo Sapiens
ucucugcccggccgccaucccaucuaggaagugaggagcgccucuucccacccgccauc

SEQ ID NO: 627489 - RNA, 59 nt, Homo Sapiens
ccucuucccacccgccaucccaucuaggaagugaggagcuucucugccuggccgcccau

SEQ ID NO: 627490 - RNA, 59 nt, Homo Sapiens
gcaacucugcccagccgccccgucugagaagugaggagacccuccgccuggcaaccgcc

SEQ ID NO: 627491 - RNA, 59 nt, Homo Sapiens
ccucugcccagcagccgccccgucugagaagugaggagccccucugcccagcagccacc

SEQ ID NO: 627492 - RNA, 59 nt, Homo Sapiens
ccucugcccagcagccacccugucugggaagugaggagcgucuccgcccggcagccacc

SEQ ID NO: 627493 - RNA, 59 nt, Homo Sapiens
gcgccucugcccagcugccccuacugggaagugaggagccccucugccccgccagccac

SEQ ID NO: 627494 - RNA, 59 nt, Homo Sapiens
gcgccucugcccggcugccccuacugggaagugaggagccccucugcccggccagccgc

SEQ ID NO: 627495 - RNA, 59 nt, Homo Sapiens
gcgccucugcccggccgccccuacugggaagugaggagccccucugcccggccaccacc

SEQ ID NO: 627496 - RNA, 59 nt, Homo Sapiens
gccuaagccaggacccagaagccugcucuagugaggagucgccgacucccuccuuccgg

SEQ ID NO: 627497 - RNA, 59 nt, Homo Sapiens
ugucuggaccaguggggcacgaaggccgcagugaggagcgggcagggacagccaccuug

SEQ ID NO: 627498 - RNA, 59 nt, Homo Sapiens
ugggauuucugugcuauaaaugcugggaaagugaggauuccaucagcaggucaacccua

SEQ ID NO: 627499 - RNA, 59 nt, Homo Sapiens
cuggauccaagucuugauugugcguaugaagugaggaggcaaguuagcuaaaaaugaga

SEQ ID NO: 627500 - RNA, 59 nt, Homo Sapiens
aaacagaugcagacauguguguugguaguagugaggagauugguauuagcaucaagucu

SEQ ID NO: 627501 - RNA, 59 nt, Homo Sapiens
caugucaaguacuuagcuaaaaucaacaaagugaggacugugaagauaacuuucaugua

SEQ ID NO: 627502 - RNA, 59 nt, Homo Sapiens
guucauuuuuaaauguuccuggcuguuauagugaggaauagguuguuggguuuugagca

SEQ ID NO: 627503 - RNA, 59 nt, Homo Sapiens
agagguuuuaucagaacacagaugugaacagugaggaucggaccgagcccuguuacaug

SEQ ID NO: 627504 - RNA, 59 nt, Homo Sapiens
augcuaaguguagauuauugagguuuguuagugaggaaaagaauaagaguucagaagcc

SEQ ID NO: 627505 - RNA, 59 nt, Homo Sapiens
uuuguuaucagauagcgaaaucagggccuagugaggagcacaggucgacuacauaaugg

SEQ ID NO: 627506 - RNA, 59 nt, Homo Sapiens
gaggauuuggggugggggugacggggguuagugaggaaggcuuuacgagaccaugcaag

SEQ ID NO: 627507 - RNA, 59 nt, Homo Sapiens
gucccagcugagucccaucgcacccggugagugaggacaucuucauggaccagacucug

SEQ ID NO: 627508 - RNA, 59 nt, Homo Sapiens
ccuaagcauugacuucucuagugucucccagugaggagccagacuuuuaaaaugcccuu

SEQ ID NO: 627509 - RNA, 59 nt, Homo Sapiens
ccuauuugaacuacuuaaaccaaauuaauagugaggaagagcugaagaguuuacugaag

SEQ ID NO: 627510 - RNA, 59 nt, Homo Sapiens
agugccuaauacaauuagaacaucuaacuagugaggaaaaguuuuagaggaaaagucaa

SEQ ID NO: 627511 - RNA, 59 nt, Homo Sapiens
auaagguuguccaugagauuaggagguucagugaggaaaaaggcaaaggaaacuaagga

SEQ ID NO: 627512 - RNA, 59 nt, Homo Sapiens
auaucugggucuuuucgucacugacuaugagugaggaaaaaggggugagacacaacagu

SEQ ID NO: 627513 - RNA, 59 nt, Homo Sapiens
caguuucucacguugcaaccuuucaaagaagugaggaugcuuucuaaaaggcauauauu

SEQ ID NO: 627514 - RNA, 59 nt, Homo Sapiens
ccggccccucuggcccuucccucaagcccagugaggagguggguggaggcaugcagggg

SEQ ID NO: 627515 - RNA, 59 nt, Homo Sapiens
gcagagaagggcaucugggacguggugccagugaggagcccaguuggcuggcacugggc

SEQ ID NO: 627516 - RNA, 59 nt, Homo Sapiens
gcaguggugcuggcccaagugaaggccagagugaggacugaugcagcucuuuacggguc

SEQ ID NO: 627517 - RNA, 59 nt, Homo Sapiens
aagauuaaguuaccggcccaaggugacacagugaggagguggcagagcuaggauuugaa

SEQ ID NO: 627518 - RNA, 59 nt, Homo Sapiens
ccucugcccggccgccaccccgucuggaaagugaggagcgccucugcccggccgccauc

SEQ ID NO: 627519 - RNA, 59 nt, Homo Sapiens
ccucugcccggccgccaucccaucuaggaagugaggagcgccucuucccagccgccauc

SEQ ID NO: 627520 - RNA, 59 nt, Homo Sapiens
ccucuucccagccgccaucccaucuaggaagugaggagcgucucugcccggccgcccau

SEQ ID NO: 627521 - RNA, 59 nt, Homo Sapiens
gcgucucugucuggccaccccgucugagaagugaggagaccuccgcccggcagccgccc

SEQ ID NO: 627522 - RNA, 59 nt, Homo Sapiens
ccuccgcccggcagccgcccugucugagaagugaggagccccuccgcccggcagccacc

SEQ ID NO: 627523 - RNA, 59 nt, Homo Sapiens
ccuccgcccggcagccaccccaucugggaagugaggagcgucuacgcccgggcagcugc

SEQ ID NO: 627524 - RNA, 59 nt, Homo Sapiens
ccgccccugcccggccgccccuacugggaagugaggagccccucugccuggccaccacc

SEQ ID NO: 627525 - RNA, 59 nt, Homo Sapiens
agaucugcagcuagcauaguuucaugcucagugaggaugauggucaccguguuuguugu

SEQ ID NO: 627526 - RNA, 59 nt, Homo Sapiens
agccuccugaccaaugcccgcucuuggggagugaggauucugcacguggaugguacccu

SEQ ID NO: 627527 - RNA, 59 nt, Homo Sapiens
caaaauguucugcuagcuugcaucaccuuagugaggaaauggcaaaggcaucucaggaa

SEQ ID NO: 627528 - RNA, 59 nt, Homo Sapiens
aagagcuucccugcuuccaaaacuuaucuagugaggaugaauuagaguccucagaagag

SEQ ID NO: 627529 - RNA, 59 nt, Homo Sapiens
cagcccagagacagagaagcuuaugaggaagugaggagguggcgucacaagggugggga

SEQ ID NO: 627530 - RNA, 59 nt, Homo Sapiens
ggacggcaccugguaugcgggaggaacagagugaggagaggagggcagggcgugcaggg

SEQ ID NO: 627531 - RNA, 59 nt, Homo Sapiens
ucaggacugaaugugaaagggaaguauugagugaggacauucccaaaaccaaaggacaa

SEQ ID NO: 627532 - RNA, 59 nt, Homo Sapiens
ccagcacauaaugaauaaauaagaaaaugagugaggaguuauuaacaucauuuggaaaa

SEQ ID NO: 627533 - RNA, 59 nt, Homo Sapiens
gggccugagacuggaccuggccuccagagagugaggaggccugaagacaccccugcccc

SEQ ID NO: 627534 - RNA, 59 nt, Homo Sapiens
cacggggagccugggccccucagggguguagugaggaccgccaggaugcuucugccauc

SEQ ID NO: 627535 - RNA, 59 nt, Homo Sapiens
gagaacuuggaagggugcagccccaggggagugaggagggugaggaggagcccagagga

SEQ ID NO: 627536 - RNA, 59 nt, Homo Sapiens
agcccagaggaccccagggggggaaguguagugaggaggcacgcaccagcucuauuugg

SEQ ID NO: 627537 - RNA, 59 nt, Homo Sapiens
caggccaacuggcugagugauucgaagaaagugaggaauccucccuggacacuguaucg

SEQ ID NO: 627538 - RNA, 59 nt, Homo Sapiens
cuccagcuccagccaccaccaggcugagcagugaggagagaaaguuucugccuggcccu

SEQ ID NO: 627539 - RNA, 59 nt, Homo Sapiens
auuaaccucugagcagugauaggauaguuagugaggauucugccaguugcaaauuugau

SEQ ID NO: 627540 - RNA, 59 nt, Homo Sapiens
ggcuggugcagggaaagcaagcaaggcaaagugaggaagaagugguguuagcuuugagg

SEQ ID NO: 627541 - RNA, 59 nt, Homo Sapiens
aaaaggggaaguuggggauacaaauguucagugaggaaagugaggaaaaaacauucaga

SEQ ID NO: 627542 - RNA, 59 nt, Homo Sapiens
aaacauucagacaaauguucaacauguucagugaggaaauguucagugugagugaggaa

SEQ ID NO: 627543 - RNA, 59 nt, Homo Sapiens
acauguucagugaggaaaaauucagugugagugaggaaagccacaguuucagacaaaug

SEQ ID NO: 627544 - RNA, 64 nt, Homo Sapiens; identical to SEQ ID NO: 503392

SEQ ID NO: 627545 - RNA, 64 nt, Homo Sapiens; identical to SEQ ID NO: 503393

SEQ ID NO: 627546 - RNA, 64 nt, Homo Sapiens; identical to SEQ ID NO: 503394

SEQ ID NO: 627547 - RNA, 64 nt, Homo Sapiens; identical to SEQ ID NO: 503395

SEQ ID NO: 627548 - RNA, 64 nt, Homo Sapiens; identical to SEQ ID NO: 503396

SEQ ID NO: 627549 - RNA, 64 nt, Homo Sapiens; identical to SEQ ID NO: 503397

SEQ ID NO: 627550 - RNA, 64 nt, Homo Sapiens; identical to SEQ ID NO: 503398

SEQ ID NO: 627551 - RNA, 64 nt, Homo Sapiens; identical to SEQ ID NO: 503399

SEQ ID NO: 627552 - RNA, 64 nt, Homo Sapiens; identical to SEQ ID NO: 503400

SEQ ID NO: 627553 - RNA, 64 nt, Homo Sapiens; identical to SEQ ID NO: 503401

SEQ ID NO: 627554 - RNA, 64 nt, Homo Sapiens; identical to SEQ ID NO: 503402

SEQ ID NO: 627555 - RNA, 64 nt, Homo Sapiens; identical to SEQ ID NO: 503403

SEQ ID NO: 627556 - RNA, 64 nt, Homo Sapiens; identical to SEQ ID NO: 503404

SEQ ID NO: 627557 - RNA, 64 nt, Homo Sapiens; identical to SEQ ID NO: 503405

SEQ ID NO: 627558 - RNA, 64 nt, Homo Sapiens; identical to SEQ ID NO: 503406

SEQ ID NO: 627559 - RNA, 64 nt, Homo Sapiens; identical to SEQ ID NO: 503407

SEQ ID NO: 627560 - RNA, 64 nt, Homo Sapiens; identical to SEQ ID NO: 156143

SEQ ID NO: 627561 - RNA, 64 nt, Homo Sapiens; identical to SEQ ID NO: 156144

SEQ ID NO: 627562 - RNA, 64 nt, Homo Sapiens; identical to SEQ ID NO: 156145

SEQ ID NO: 627563 - RNA, 64 nt, Homo Sapiens; identical to SEQ ID NO: 156146

SEQ ID NO: 627564 - RNA, 64 nt, Homo Sapiens; identical to SEQ ID NO: 156147

SEQ ID NO: 627565 - RNA, 64 nt, Homo Sapiens; identical to SEQ ID NO: 156148

SEQ ID NO: 627566 - RNA, 64 nt, Homo Sapiens; identical to SEQ ID NO: 156149

SEQ ID NO: 627567 - RNA, 64 nt, Homo Sapiens; identical to SEQ ID NO: 156150

SEQ ID NO: 627568 - RNA, 64 nt, Homo Sapiens; identical to SEQ ID NO: 156151

SEQ ID NO: 627569 - RNA, 64 nt, Homo Sapiens; identical to SEQ ID NO: 156152

SEQ ID NO: 627570 - RNA, 64 nt, Homo Sapiens; identical to SEQ ID NO: 156153

SEQ ID NO: 627571 - RNA, 64 nt, Homo Sapiens; identical to SEQ ID NO: 156154

SEQ ID NO: 627572 - RNA, 64 nt, Homo Sapiens; identical to SEQ ID NO: 156155

SEQ ID NO: 627573 - RNA, 64 nt, Homo Sapiens; identical to SEQ ID NO: 156156

SEQ ID NO: 627574 - RNA, 64 nt, Homo Sapiens; identical to SEQ ID NO: 156157

SEQ ID NO: 627575 - RNA, 64 nt, Homo Sapiens; identical to SEQ ID NO: 156158

SEQ ID NO: 627576 - RNA, 64 nt, Homo Sapiens; identical to SEQ ID NO: 156159

SEQ ID NO: 627577 - RNA, 64 nt, Homo Sapiens; identical to SEQ ID NO: 156160

SEQ ID NO: 627578 - RNA, 64 nt, Homo Sapiens; identical to SEQ ID NO: 156161

SEQ ID NO: 627579 - RNA, 64 nt, Homo Sapiens; identical to SEQ ID NO: 156162

SEQ ID NO: 627580 - RNA, 64 nt, Homo Sapiens; identical to SEQ ID NO: 156163

SEQ ID NO: 627581 - RNA, 64 nt, Homo Sapiens; identical to SEQ ID NO: 156164

SEQ ID NO: 627582 - RNA, 64 nt, Homo Sapiens; identical to SEQ ID NO: 156165

SEQ ID NO: 627583 - RNA, 64 nt, Homo Sapiens; identical to SEQ ID NO: 156166

SEQ ID NO: 627584 - RNA, 64 nt, Homo Sapiens; identical to SEQ ID NO: 156167

SEQ ID NO: 627585 - RNA, 64 nt, Homo Sapiens; identical to SEQ ID NO: 156168

SEQ ID NO: 627586 - RNA, 64 nt, Homo Sapiens; identical to SEQ ID NO: 156169

SEQ ID NO: 627587 - RNA, 64 nt, Homo Sapiens; identical to SEQ ID NO: 156170

SEQ ID NO: 627588 - RNA, 64 nt, Homo Sapiens; identical to SEQ ID NO: 156171

SEQ ID NO: 627589 - RNA, 64 nt, Homo Sapiens; identical to SEQ ID NO: 156172

SEQ ID NO: 627590 - RNA, 64 nt, Homo Sapiens; identical to SEQ ID NO: 156173

SEQ ID NO: 627591 - RNA, 64 nt, Homo Sapiens; identical to SEQ ID NO: 156174

SEQ ID NO: 627592 - RNA, 64 nt, Homo Sapiens; identical to SEQ ID NO: 156175

SEQ ID NO: 627593 - RNA, 64 nt, Homo Sapiens; identical to SEQ ID NO: 156176

SEQ ID NO: 627594 - RNA, 64 nt, Homo Sapiens; identical to SEQ ID NO: 156177

SEQ ID NO: 627595 - RNA, 64 nt, Homo Sapiens; identical to SEQ ID NO: 156178

SEQ ID NO: 627596 - RNA, 64 nt, Homo Sapiens; identical to SEQ ID NO: 156179

SEQ ID NO: 627597 - RNA, 64 nt, Homo Sapiens; identical to SEQ ID NO: 156180

SEQ ID NO: 627598 - RNA, 64 nt, Homo Sapiens; identical to SEQ ID NO: 156181

SEQ ID NO: 627599 - RNA, 64 nt, Homo Sapiens; identical to SEQ ID NO: 156182

SEQ ID NO: 627600 - RNA, 64 nt, Homo Sapiens; identical to SEQ ID NO: 156183

SEQ ID NO: 627601 - RNA, 64 nt, Homo Sapiens; identical to SEQ ID NO: 156184

SEQ ID NO: 627602 - RNA, 64 nt, Homo Sapiens; identical to SEQ ID NO: 156185

SEQ ID NO: 627603 - RNA, 64 nt, Homo Sapiens; identical to SEQ ID NO: 156186

SEQ ID NO: 627604 - RNA, 64 nt, Homo Sapiens; identical to SEQ ID NO: 156187

SEQ ID NO: 627605 - RNA, 64 nt, Homo Sapiens; identical to SEQ ID NO: 156188

SEQ ID NO: 627606 - RNA, 64 nt, Homo Sapiens; identical to SEQ ID NO: 156189

SEQ ID NO: 627607 - RNA, 64 nt, Homo Sapiens; identical to SEQ ID NO: 156190

SEQ ID NO: 627608 - RNA, 64 nt, Homo Sapiens; identical to SEQ ID NO: 156191

SEQ ID NO: 627609 - RNA, 64 nt, Homo Sapiens; identical to SEQ ID NO: 156192

SEQ ID NO: 627610 - RNA, 64 nt, Homo Sapiens; identical to SEQ ID NO: 156193

SEQ ID NO: 627611 - RNA, 64 nt, Homo Sapiens; identical to SEQ ID NO: 156194

SEQ ID NO: 627612 - RNA, 64 nt, Homo Sapiens; identical to SEQ ID NO: 156195

SEQ ID NO: 627613 - RNA, 64 nt, Homo Sapiens; identical to SEQ ID NO: 156196

SEQ ID NO: 627614 - RNA, 64 nt, Homo Sapiens; identical to SEQ ID NO: 156197

SEQ ID NO: 627615 - RNA, 64 nt, Homo Sapiens; identical to SEQ ID NO: 156198

SEQ ID NO: 627616 - RNA, 64 nt, Homo Sapiens; identical to SEQ ID NO: 156199

SEQ ID NO: 627617 - RNA, 64 nt, Homo Sapiens; identical to SEQ ID NO: 156200

SEQ ID NO: 627618 - RNA, 64 nt, Homo Sapiens; identical to SEQ ID NO: 156201

SEQ ID NO: 627619 - RNA, 64 nt, Homo Sapiens; identical to SEQ ID NO: 156202

SEQ ID NO: 627620 - RNA, 64 nt, Homo Sapiens; identical to SEQ ID NO: 156203

SEQ ID NO: 627621 - RNA, 64 nt, Homo Sapiens; identical to SEQ ID NO: 156204

SEQ ID NO: 627622 - RNA, 64 nt, Homo Sapiens; identical to SEQ ID NO: 156205

SEQ ID NO: 627623 - RNA, 64 nt, Homo Sapiens; identical to SEQ ID NO: 156206

SEQ ID NO: 627624 - RNA, 64 nt, Homo Sapiens; identical to SEQ ID NO: 156207

SEQ ID NO: 627625 - RNA, 64 nt, Homo Sapiens; identical to SEQ ID NO: 156208

SEQ ID NO: 627626 - RNA, 64 nt, Homo Sapiens; identical to SEQ ID NO: 156209

SEQ ID NO: 627627 - RNA, 53 nt, Homo Sapiens; identical to SEQ ID NO: 156210

SEQ ID NO: 627628 - RNA, 64 nt, Homo Sapiens; identical to SEQ ID NO: 156211

SEQ ID NO: 627629 - RNA, 64 nt, Homo Sapiens; identical to SEQ ID NO: 156212

SEQ ID NO: 627630 - RNA, 64 nt, Homo Sapiens; identical to SEQ ID NO: 156213

SEQ ID NO: 627631 - RNA, 64 nt, Homo Sapiens; identical to SEQ ID NO: 156214

SEQ ID NO: 627632 - RNA, 64 nt, Homo Sapiens; identical to SEQ ID NO: 156215

SEQ ID NO: 627633 - RNA, 64 nt, Homo Sapiens; identical to SEQ ID NO: 156216

SEQ ID NO: 627634 - RNA, 64 nt, Homo Sapiens; identical to SEQ ID NO: 156217

SEQ ID NO: 627635 - RNA, 64 nt, Homo Sapiens; identical to SEQ ID NO: 156218

SEQ ID NO: 627636 - RNA, 64 nt, Homo Sapiens; identical to SEQ ID NO: 156219

SEQ ID NO: 627637 - RNA, 64 nt, Homo Sapiens; identical to SEQ ID NO: 156220

SEQ ID NO: 627638 - RNA, 64 nt, Homo Sapiens; identical to SEQ ID NO: 156221

SEQ ID NO: 627639 - RNA, 64 nt, Homo Sapiens; identical to SEQ ID NO: 156222

SEQ ID NO: 627640 - RNA, 64 nt, Homo Sapiens; identical to SEQ ID NO: 156223

SEQ ID NO: 627641 - RNA, 64 nt, Homo Sapiens; identical to SEQ ID NO: 156224

SEQ ID NO: 627642 - RNA, 64 nt, Homo Sapiens; identical to SEQ ID NO: 156225

SEQ ID NO: 627643 - RNA, 64 nt, Homo Sapiens; identical to SEQ ID NO: 156226

SEQ ID NO: 627644 - RNA, 64 nt, Homo Sapiens; identical to SEQ ID NO: 156227

SEQ ID NO: 627645 - RNA, 64 nt, Homo Sapiens; identical to SEQ ID NO: 156228

SEQ ID NO: 627646 - RNA, 64 nt, Homo Sapiens; identical to SEQ ID NO: 156229

SEQ ID NO: 627647 - RNA, 64 nt, Homo Sapiens; identical to SEQ ID NO: 156230

SEQ ID NO: 627648 - RNA, 64 nt, Homo Sapiens; identical to SEQ ID NO: 156231

SEQ ID NO: 627649 - RNA, 64 nt, Homo Sapiens; identical to SEQ ID NO: 156232

SEQ ID NO: 627650 - RNA, 64 nt, Homo Sapiens; identical to SEQ ID NO: 156233

SEQ ID NO: 627651 - RNA, 64 nt, Homo Sapiens; identical to SEQ ID NO: 156234

SEQ ID NO: 627652 - RNA, 64 nt, Homo Sapiens; identical to SEQ ID NO: 156235

SEQ ID NO: 627653 - RNA, 64 nt, Homo Sapiens; identical to SEQ ID NO: 156236

SEQ ID NO: 627654 - RNA, 64 nt, Homo Sapiens; identical to SEQ ID NO: 156237

SEQ ID NO: 627655 - RNA, 64 nt, Homo Sapiens; identical to SEQ ID NO: 156238

SEQ ID NO: 627656 - RNA, 64 nt, Homo Sapiens; identical to SEQ ID NO: 156239

SEQ ID NO: 627657 - RNA, 64 nt, Homo Sapiens; identical to SEQ ID NO: 156240

SEQ ID NO: 627658 - RNA, 64 nt, Homo Sapiens; identical to SEQ ID NO: 156241

SEQ ID NO: 627659 - RNA, 64 nt, Homo Sapiens; identical to SEQ ID NO: 156242

SEQ ID NO: 627660 - RNA, 64 nt, Homo Sapiens; identical to SEQ ID NO: 156243

SEQ ID NO: 627661 - RNA, 64 nt, Homo Sapiens; identical to SEQ ID NO: 156244

SEQ ID NO: 627662 - RNA, 64 nt, Homo Sapiens; identical to SEQ ID NO: 156245

SEQ ID NO: 627663 - RNA, 64 nt, Homo Sapiens; identical to SEQ ID NO: 156246

SEQ ID NO: 627664 - RNA, 64 nt, Homo Sapiens; identical to SEQ ID NO: 156247

SEQ ID NO: 627665 - RNA, 64 nt, Homo Sapiens; identical to SEQ ID NO: 156248

SEQ ID NO: 627666 - RNA, 64 nt, Homo Sapiens; identical to SEQ ID NO: 156249

SEQ ID NO: 627667 - RNA, 64 nt, Homo Sapiens; identical to SEQ ID NO: 156250

SEQ ID NO: 627668 - RNA, 64 nt, Homo Sapiens; identical to SEQ ID NO: 156251

SEQ ID NO: 627669 - RNA, 64 nt, Homo Sapiens; identical to SEQ ID NO: 156252

SEQ ID NO: 627670 - RNA, 64 nt, Homo Sapiens; identical to SEQ ID NO: 156253

SEQ ID NO: 627671 - RNA, 64 nt, Homo Sapiens; identical to SEQ ID NO: 156254

SEQ ID NO: 627672 - RNA, 64 nt, Homo Sapiens; identical to SEQ ID NO: 156255

SEQ ID NO: 627673 - RNA, 64 nt, Homo Sapiens; identical to SEQ ID NO: 156256

SEQ ID NO: 627674 - RNA, 64 nt, Homo Sapiens; identical to SEQ ID NO: 156257

SEQ ID NO: 627675 - RNA, 64 nt, Homo Sapiens; identical to SEQ ID NO: 156258

SEQ ID NO: 627676 - RNA, 64 nt, Homo Sapiens; identical to SEQ ID NO: 156259

SEQ ID NO: 627677 - RNA, 64 nt, Homo Sapiens; identical to SEQ ID NO: 156260

SEQ ID NO: 627678 - RNA, 64 nt, Homo Sapiens; identical to SEQ ID NO: 156261

SEQ ID NO: 627679 - RNA, 64 nt, Homo Sapiens; identical to SEQ ID NO: 156262

SEQ ID NO: 627680 - RNA, 64 nt, Homo Sapiens; identical to SEQ ID NO: 156263

SEQ ID NO: 627681 - RNA, 64 nt, Homo Sapiens; identical to SEQ ID NO: 156264

SEQ ID NO: 627682 - RNA, 64 nt, Homo Sapiens; identical to SEQ ID NO: 156265

SEQ ID NO: 627683 - RNA, 64 nt, Homo Sapiens; identical to SEQ ID NO: 156266

SEQ ID NO: 627684 - RNA, 64 nt, Homo Sapiens; identical to SEQ ID NO: 156267

SEQ ID NO: 627685 - RNA, 64 nt, Homo Sapiens; identical to SEQ ID NO: 156268

SEQ ID NO: 627686 - RNA, 64 nt, Homo Sapiens; identical to SEQ ID NO: 156269

SEQ ID NO: 627687 - RNA, 64 nt, Homo Sapiens; identical to SEQ ID NO: 156270

SEQ ID NO: 627688 - RNA, 64 nt, Homo Sapiens; identical to SEQ ID NO: 156271

SEQ ID NO: 627689 - RNA, 64 nt, Homo Sapiens; identical to SEQ ID NO: 156272

SEQ ID NO: 627690 - RNA, 64 nt, Homo Sapiens; identical to SEQ ID NO: 156273

SEQ ID NO: 627691 - RNA, 64 nt, Homo Sapiens; identical to SEQ ID NO: 156274

SEQ ID NO: 627692 - RNA, 64 nt, Homo Sapiens; identical to SEQ ID NO: 156275

SEQ ID NO: 627693 - RNA, 64 nt, Homo Sapiens; identical to SEQ ID NO: 156276

SEQ ID NO: 627694 - RNA, 64 nt, Homo Sapiens; identical to SEQ ID NO: 156277

SEQ ID NO: 627695 - RNA, 64 nt, Homo Sapiens; identical to SEQ ID NO: 156278

SEQ ID NO: 627696 - RNA, 64 nt, Homo Sapiens; identical to SEQ ID NO: 156279

SEQ ID NO: 627697 - RNA, 64 nt, Homo Sapiens; identical to SEQ ID NO: 156280

SEQ ID NO: 627698 - RNA, 64 nt, Homo Sapiens; identical to SEQ ID NO: 156281

SEQ ID NO: 627699 - RNA, 64 nt, Homo Sapiens; identical to SEQ ID NO: 156282

SEQ ID NO: 627700 - RNA, 64 nt, Homo Sapiens; identical to SEQ ID NO: 156283

SEQ ID NO: 627701 - RNA, 64 nt, Homo Sapiens; identical to SEQ ID NO: 156284

SEQ ID NO: 627702 - RNA, 64 nt, Homo Sapiens; identical to SEQ ID NO: 156285

SEQ ID NO: 627703 - RNA, 64 nt, Homo Sapiens; identical to SEQ ID NO: 156286

SEQ ID NO: 627704 - RNA, 64 nt, Homo Sapiens; identical to SEQ ID NO: 156287

SEQ ID NO: 627705 - RNA, 64 nt, Homo Sapiens; identical to SEQ ID NO: 60934

SEQ ID NO: 627706 - RNA, 64 nt, Homo Sapiens; identical to SEQ ID NO: 60935

SEQ ID NO: 627707 - RNA, 64 nt, Homo Sapiens; identical to SEQ ID NO: 60936

SEQ ID NO: 627708 - RNA, 64 nt, Homo Sapiens; identical to SEQ ID NO: 60937

SEQ ID NO: 627709 - RNA, 64 nt, Homo Sapiens; identical to SEQ ID NO: 60938

SEQ ID NO: 627710 - RNA, 64 nt, Homo Sapiens; identical to SEQ ID NO: 60939

SEQ ID NO: 627711 - RNA, 64 nt, Homo Sapiens; identical to SEQ ID NO: 60940

SEQ ID NO: 627712 - RNA, 64 nt, Homo Sapiens; identical to SEQ ID NO: 60941

SEQ ID NO: 627713 - RNA, 64 nt, Homo Sapiens; identical to SEQ ID NO: 60942

SEQ ID NO: 627714 - RNA, 64 nt, Homo Sapiens; identical to SEQ ID NO: 60943

SEQ ID NO: 627715 - RNA, 64 nt, Homo Sapiens; identical to SEQ ID NO: 60944

SEQ ID NO: 627716 - RNA, 64 nt, Homo Sapiens; identical to SEQ ID NO: 60945

SEQ ID NO: 627717 - RNA, 64 nt, Homo Sapiens; identical to SEQ ID NO: 60946

SEQ ID NO: 627718 - RNA, 64 nt, Homo Sapiens; identical to SEQ ID NO: 60947

SEQ ID NO: 627719 - RNA, 64 nt, Homo Sapiens; identical to SEQ ID NO: 60948

SEQ ID NO: 627720 - RNA, 64 nt, Homo Sapiens; identical to SEQ ID NO: 60949

SEQ ID NO: 627721 - RNA, 64 nt, Homo Sapiens; identical to SEQ ID NO: 60950

SEQ ID NO: 627722 - RNA, 64 nt, Homo Sapiens; identical to SEQ ID NO: 60951

SEQ ID NO: 627723 - RNA, 64 nt, Homo Sapiens; identical to SEQ ID NO: 60952

SEQ ID NO: 627724 - RNA, 64 nt, Homo Sapiens; identical to SEQ ID NO: 60953

SEQ ID NO: 627725 - RNA, 64 nt, Homo Sapiens; identical to SEQ ID NO: 60954

SEQ ID NO: 627726 - RNA, 64 nt, Homo Sapiens; identical to SEQ ID NO: 60955

SEQ ID NO: 627727 - RNA, 64 nt, Homo Sapiens; identical to SEQ ID NO: 60956

SEQ ID NO: 627728 - RNA, 64 nt, Homo Sapiens; identical to SEQ ID NO: 60957

SEQ ID NO: 627729 - RNA, 64 nt, Homo Sapiens; identical to SEQ ID NO: 60958

SEQ ID NO: 627730 - RNA, 64 nt, Homo Sapiens; identical to SEQ ID NO: 60959

SEQ ID NO: 627731 - RNA, 64 nt, Homo Sapiens; identical to SEQ ID NO: 60960

SEQ ID NO: 627732 - RNA, 64 nt, Homo Sapiens; identical to SEQ ID NO: 60961

SEQ ID NO: 627733 - RNA, 64 nt, Homo Sapiens; identical to SEQ ID NO: 60962

SEQ ID NO: 627734 - RNA, 64 nt, Homo Sapiens; identical to SEQ ID NO: 60963

SEQ ID NO: 627735 - RNA, 64 nt, Homo Sapiens; identical to SEQ ID NO: 60964

SEQ ID NO: 627736 - RNA, 64 nt, Homo Sapiens; identical to SEQ ID NO: 60965

SEQ ID NO: 627737 - RNA, 64 nt, Homo Sapiens; identical to SEQ ID NO: 60966

SEQ ID NO: 627738 - RNA, 64 nt, Homo Sapiens; identical to SEQ ID NO: 60967

SEQ ID NO: 627739 - RNA, 64 nt, Homo Sapiens; identical to SEQ ID NO: 60968

SEQ ID NO: 627740 - RNA, 64 nt, Homo Sapiens; identical to SEQ ID NO: 60969

SEQ ID NO: 627741 - RNA, 64 nt, Homo Sapiens; identical to SEQ ID NO: 60970

SEQ ID NO: 627742 - RNA, 64 nt, Homo Sapiens; identical to SEQ ID NO: 60971

SEQ ID NO: 627743 - RNA, 64 nt, Homo Sapiens; identical to SEQ ID NO: 60972

SEQ ID NO: 627744 - RNA, 64 nt, Homo Sapiens; identical to SEQ ID NO: 60973

SEQ ID NO: 627745 - RNA, 64 nt, Homo Sapiens; identical to SEQ ID NO: 60974

SEQ ID NO: 627746 - RNA, 64 nt, Homo Sapiens; identical to SEQ ID NO: 60975

SEQ ID NO: 627747 - RNA, 64 nt, Homo Sapiens; identical to SEQ ID NO: 60976

SEQ ID NO: 627748 - RNA, 64 nt, Homo Sapiens; identical to SEQ ID NO: 60977

SEQ ID NO: 627749 - RNA, 64 nt, Homo Sapiens; identical to SEQ ID NO: 60978

SEQ ID NO: 627750 - RNA, 64 nt, Homo Sapiens; identical to SEQ ID NO: 60979

SEQ ID NO: 627751 - RNA, 64 nt, Homo Sapiens; identical to SEQ ID NO: 60980

SEQ ID NO: 627752 - RNA, 64 nt, Homo Sapiens; identical to SEQ ID NO: 60981

SEQ ID NO: 627753 - RNA, 64 nt, Homo Sapiens; identical to SEQ ID NO: 60982

SEQ ID NO: 627754 - RNA, 64 nt, Homo Sapiens; identical to SEQ ID NO: 60983

SEQ ID NO: 627755 - RNA, 64 nt, Homo Sapiens; identical to SEQ ID NO: 60984

SEQ ID NO: 627756 - RNA, 64 nt, Homo Sapiens; identical to SEQ ID NO: 60985

SEQ ID NO: 627757 - RNA, 64 nt, Homo Sapiens; identical to SEQ ID NO: 60986

SEQ ID NO: 627758 - RNA, 64 nt, Homo Sapiens; identical to SEQ ID NO: 60987

SEQ ID NO: 627759 - RNA, 64 nt, Homo Sapiens; identical to SEQ ID NO: 60988

SEQ ID NO: 627760 - RNA, 64 nt, Homo Sapiens; identical to SEQ ID NO: 60989

SEQ ID NO: 627761 - RNA, 64 nt, Homo Sapiens; identical to SEQ ID NO: 60990

SEQ ID NO: 627762 - RNA, 64 nt, Homo Sapiens; identical to SEQ ID NO: 60991

SEQ ID NO: 627763 - RNA, 64 nt, Homo Sapiens; identical to SEQ ID NO: 60992

SEQ ID NO: 627764 - RNA, 64 nt, Homo Sapiens; identical to SEQ ID NO: 60993

SEQ ID NO: 627765 - RNA, 64 nt, Homo Sapiens; identical to SEQ ID NO: 60994

SEQ ID NO: 627766 - RNA, 64 nt, Homo Sapiens; identical to SEQ ID NO: 60995

SEQ ID NO: 627767 - RNA, 64 nt, Homo Sapiens; identical to SEQ ID NO: 60996

SEQ ID NO: 627768 - RNA, 64 nt, Homo Sapiens; identical to SEQ ID NO: 60997

SEQ ID NO: 627769 - RNA, 64 nt, Homo Sapiens; identical to SEQ ID NO: 60998

SEQ ID NO: 627770 - RNA, 64 nt, Homo Sapiens; identical to SEQ ID NO: 60999

SEQ ID NO: 627771 - RNA, 64 nt, Homo Sapiens; identical to SEQ ID NO: 61000

SEQ ID NO: 627772 - RNA, 64 nt, Homo Sapiens; identical to SEQ ID NO: 61001

SEQ ID NO: 627773 - RNA, 64 nt, Homo Sapiens; identical to SEQ ID NO: 61002

SEQ ID NO: 627774 - RNA, 64 nt, Homo Sapiens; identical to SEQ ID NO: 61003

SEQ ID NO: 627775 - RNA, 64 nt, Homo Sapiens; identical to SEQ ID NO: 61004

SEQ ID NO: 627776 - RNA, 64 nt, Homo Sapiens; identical to SEQ ID NO: 61005

SEQ ID NO: 627777 - RNA, 64 nt, Homo Sapiens; identical to SEQ ID NO: 61006

SEQ ID NO: 627778 - RNA, 64 nt, Homo Sapiens; identical to SEQ ID NO: 61007

SEQ ID NO: 627779 - RNA, 64 nt, Homo Sapiens; identical to SEQ ID NO: 61008

SEQ ID NO: 627780 - RNA, 64 nt, Homo Sapiens; identical to SEQ ID NO: 61009

SEQ ID NO: 627781 - RNA, 64 nt, Homo Sapiens; identical to SEQ ID NO: 61010

SEQ ID NO: 627782 - RNA, 64 nt, Homo Sapiens; identical to SEQ ID NO: 61011

SEQ ID NO: 627783 - RNA, 64 nt, Homo Sapiens; identical to SEQ ID NO: 61012

SEQ ID NO: 627784 - RNA, 64 nt, Homo Sapiens; identical to SEQ ID NO: 61013

SEQ ID NO: 627785 - RNA, 64 nt, Homo Sapiens; identical to SEQ ID NO: 61014

SEQ ID NO: 627786 - RNA, 64 nt, Homo Sapiens; identical to SEQ ID NO: 61015

SEQ ID NO: 627787 - RNA, 64 nt, Homo Sapiens; identical to SEQ ID NO: 61016

SEQ ID NO: 627788 - RNA, 64 nt, Homo Sapiens; identical to SEQ ID NO: 61017

SEQ ID NO: 627789 - RNA, 64 nt, Homo Sapiens; identical to SEQ ID NO: 61018

SEQ ID NO: 627790 - RNA, 64 nt, Homo Sapiens; identical to SEQ ID NO: 61019

SEQ ID NO: 627791 - RNA, 64 nt, Homo Sapiens; identical to SEQ ID NO: 61020

SEQ ID NO: 627792 - RNA, 64 nt, Homo Sapiens; identical to SEQ ID NO: 61021

SEQ ID NO: 627793 - RNA, 64 nt, Homo Sapiens; identical to SEQ ID NO: 61022

SEQ ID NO: 627794 - RNA, 64 nt, Homo Sapiens; identical to SEQ ID NO: 61023

SEQ ID NO: 627795 - RNA, 64 nt, Homo Sapiens; identical to SEQ ID NO: 61024

SEQ ID NO: 627796 - RNA, 64 nt, Homo Sapiens; identical to SEQ ID NO: 61025

SEQ ID NO: 627797 - RNA, 64 nt, Homo Sapiens; identical to SEQ ID NO: 61026

SEQ ID NO: 627798 - RNA, 64 nt, Homo Sapiens; identical to SEQ ID NO: 61027

SEQ ID NO: 627799 - RNA, 64 nt, Homo Sapiens; identical to SEQ ID NO: 61028

SEQ ID NO: 627800 - RNA, 64 nt, Homo Sapiens; identical to SEQ ID NO: 61029

SEQ ID NO: 627801 - RNA, 64 nt, Homo Sapiens; identical to SEQ ID NO: 61030

SEQ ID NO: 627802 - RNA, 64 nt, Homo Sapiens; identical to SEQ ID NO: 61031

SEQ ID NO: 627803 - RNA, 64 nt, Homo Sapiens; identical to SEQ ID NO: 61032

SEQ ID NO: 627804 - RNA, 64 nt, Homo Sapiens; identical to SEQ ID NO: 61033

SEQ ID NO: 627805 - RNA, 64 nt, Homo Sapiens; identical to SEQ ID NO: 61034

SEQ ID NO: 627806 - RNA, 64 nt, Homo Sapiens; identical to SEQ ID NO: 120942

SEQ ID NO: 627807 - RNA, 64 nt, Homo Sapiens; identical to SEQ ID NO: 120943

SEQ ID NO: 627808 - RNA, 64 nt, Homo Sapiens; identical to SEQ ID NO: 120944

SEQ ID NO: 627809 - RNA, 64 nt, Homo Sapiens; identical to SEQ ID NO: 120945

SEQ ID NO: 627810 - RNA, 64 nt, Homo Sapiens; identical to SEQ ID NO: 120946

SEQ ID NO: 627811 - RNA, 64 nt, Homo Sapiens; identical to SEQ ID NO: 120947

SEQ ID NO: 627812 - RNA, 64 nt, Homo Sapiens; identical to SEQ ID NO: 120948

SEQ ID NO: 627813 - RNA, 64 nt, Homo Sapiens; identical to SEQ ID NO: 120949

SEQ ID NO: 627814 - RNA, 64 nt, Homo Sapiens; identical to SEQ ID NO: 120950

SEQ ID NO: 627815 - RNA, 64 nt, Homo Sapiens; identical to SEQ ID NO: 120951

SEQ ID NO: 627816 - RNA, 64 nt, Homo Sapiens; identical to SEQ ID NO: 120952

SEQ ID NO: 627817 - RNA, 64 nt, Homo Sapiens; identical to SEQ ID NO: 120953

SEQ ID NO: 627818 - RNA, 64 nt, Homo Sapiens; identical to SEQ ID NO: 120954

SEQ ID NO: 627819 - RNA, 64 nt, Homo Sapiens; identical to SEQ ID NO: 120955

SEQ ID NO: 627820 - RNA, 64 nt, Homo Sapiens; identical to SEQ ID NO: 120956

SEQ ID NO: 627821 - RNA, 64 nt, Homo Sapiens; identical to SEQ ID NO: 120957

SEQ ID NO: 627822 - RNA, 64 nt, Homo Sapiens; identical to SEQ ID NO: 120958

SEQ ID NO: 627823 - RNA, 64 nt, Homo Sapiens; identical to SEQ ID NO: 120959

SEQ ID NO: 627824 - RNA, 64 nt, Homo Sapiens; identical to SEQ ID NO: 120960

SEQ ID NO: 627825 - RNA, 64 nt, Homo Sapiens; identical to SEQ ID NO: 120961

SEQ ID NO: 627826 - RNA, 64 nt, Homo Sapiens; identical to SEQ ID NO: 120962

SEQ ID NO: 627827 - RNA, 64 nt, Homo Sapiens; identical to SEQ ID NO: 120963

SEQ ID NO: 627828 - RNA, 64 nt, Homo Sapiens; identical to SEQ ID NO: 120964

SEQ ID NO: 627829 - RNA, 62 nt, Homo Sapiens; identical to SEQ ID NO: 120965

SEQ ID NO: 627830 - RNA, 64 nt, Homo Sapiens; identical to SEQ ID NO: 120966

SEQ ID NO: 627831 - RNA, 64 nt, Homo Sapiens; identical to SEQ ID NO: 120967

SEQ ID NO: 627832 - RNA, 64 nt, Homo Sapiens; identical to SEQ ID NO: 120968

SEQ ID NO: 627833 - RNA, 64 nt, Homo Sapiens; identical to SEQ ID NO: 120969

SEQ ID NO: 627834 - RNA, 64 nt, Homo Sapiens; identical to SEQ ID NO: 120970

SEQ ID NO: 627835 - RNA, 64 nt, Homo Sapiens; identical to SEQ ID NO: 120971

SEQ ID NO: 627836 - RNA, 64 nt, Homo Sapiens; identical to SEQ ID NO: 96939

SEQ ID NO: 627837 - RNA, 64 nt, Homo Sapiens; identical to SEQ ID NO: 96940

SEQ ID NO: 627838 - RNA, 64 nt, Homo Sapiens; identical to SEQ ID NO: 96941

SEQ ID NO: 627839 - RNA, 64 nt, Homo Sapiens; identical to SEQ ID NO: 96942

SEQ ID NO: 627840 - RNA, 64 nt, Homo Sapiens; identical to SEQ ID NO: 96943

SEQ ID NO: 627841 - RNA, 64 nt, Homo Sapiens; identical to SEQ ID NO: 96944

SEQ ID NO: 627842 - RNA, 64 nt, Homo Sapiens; identical to SEQ ID NO: 96945

SEQ ID NO: 627843 - RNA, 64 nt, Homo Sapiens; identical to SEQ ID NO: 96946

SEQ ID NO: 627844 - RNA, 64 nt, Homo Sapiens; identical to SEQ ID NO: 96947

SEQ ID NO: 627845 - RNA, 64 nt, Homo Sapiens; identical to SEQ ID NO: 96948

SEQ ID NO: 627846 - RNA, 64 nt, Homo Sapiens; identical to SEQ ID NO: 96949

SEQ ID NO: 627847 - RNA, 64 nt, Homo Sapiens; identical to SEQ ID NO: 96950

SEQ ID NO: 627848 - RNA, 64 nt, Homo Sapiens; identical to SEQ ID NO: 96951

SEQ ID NO: 627849 - RNA, 64 nt, Homo Sapiens; identical to SEQ ID NO: 96952

SEQ ID NO: 627850 - RNA, 64 nt, Homo Sapiens; identical to SEQ ID NO: 96953

SEQ ID NO: 627851 - RNA, 64 nt, Homo Sapiens; identical to SEQ ID NO: 96954

SEQ ID NO: 627852 - RNA, 64 nt, Homo Sapiens; identical to SEQ ID NO: 96955

SEQ ID NO: 627853 - RNA, 64 nt, Homo Sapiens; identical to SEQ ID NO: 96956

SEQ ID NO: 627854 - RNA, 64 nt, Homo Sapiens
aaguaagugcugaguugauuuucuagguucuuacguauuugaaaaauaaaauugcaauucgaga

SEQ ID NO: 627855 - RNA, 64 nt, Homo Sapiens
ccuuuguacagcagccaaaucaugaacucaaaauguauuugaucacaguucuauaauguuuuua

SEQ ID NO: 627856 - RNA, 64 nt, Homo Sapiens
uuuuuuguuguuguucuuugaagaacagucuguaguauuugaaggguuugggggagggagaaaa

SEQ ID NO: 627857 - RNA, 64 nt, Homo Sapiens
uuuuuuugucuuuaaaaaauaauuggcagcaacuguauuugaauaaaaugauuucuuaguauga

SEQ ID NO: 627858 - RNA, 64 nt, Homo Sapiens
cacugguuuuaaauauuuugagcugugauuuuugguauuugaaagaguuacugaacaguaacau

SEQ ID NO: 627859 - RNA, 64 nt, Homo Sapiens
cuguaacaaaguuguggacaugaaaaauugugauguauuugaucuccauauggucaaaaaggac

SEQ ID NO: 627860 - RNA, 64 nt, Homo Sapiens
cuggcuuuuucuuuuaaugaauacuuuuuaguuuguauuugacuuuauuuccuuuauucaaauc

SEQ ID NO: 627861 - RNA, 64 nt, Homo Sapiens
cucaaaguaaagccugagcaguguucucaguaauguauuugaaggaaaaauacccugauuugaa

SEQ ID NO: 627862 - RNA, 64 nt, Homo Sapiens
auuuguagcauucuuuaaaucuaucuacugaaauguauuugacauucaagcaguuauauucggu

SEQ ID NO: 627863 - RNA, 64 nt, Homo Sapiens
uauggaauagaauuuauugcugaaucaugcuccaguauuugagugauguuuuaaauauccuaug

SEQ ID NO: 627864 - RNA, 64 nt, Homo Sapiens
uguugcuauuugcccagugagaaaacagauucugguauuugauuugguuuuucucuuuguuucc

SEQ ID NO: 627865 - RNA, 64 nt, Homo Sapiens
uuaguuuugccuucauagguuauaugccaagauaguauuugauaagucaaugacauuuggaugu

SEQ ID NO: 627866 - RNA, 64 nt, Homo Sapiens
uacccacgaacuguuaaauauaaaaaaauucaaaguauuugacaucuuaagcaaauauccagaa

SEQ ID NO: 627867 - RNA, 64 nt, Homo Sapiens
uuaacauuuccacuucuguuuaucacaaaagacuguauuugaaauaugcauacggaaaauugaa

SEQ ID NO: 627868 - RNA, 64 nt, Homo Sapiens
aauguguccaaaauaucacugcauacaauaucugguauuugaagagaaaaacugacuuuuguau

SEQ ID NO: 627869 - RNA, 64 nt, Homo Sapiens
gcugaauaaaccacaucaaaggaaagggaccacaguauuugaauguuugaaagucuguaaagcu

SEQ ID NO: 627870 - RNA, 64 nt, Homo Sapiens
cacugugccuggccaaguuucaguucuauaugaaguauuugauguuuuguuugaaacaauacag

SEQ ID NO: 627871 - RNA, 64 nt, Homo Sapiens
ggaaaauuaacucaucuaaaaagaaucuuauuagguauuugaacucuaaaacuaacagauaaga

SEQ ID NO: 627872 - RNA, 64 nt, Homo Sapiens
ucuggugaggugaccacagcaccaggucggugcaguauuugauuggaauagacucagggauuuc

SEQ ID NO: 627873 - RNA, 64 nt, Homo Sapiens
agaaguggccauuuggauuauuucagggcaaaguguauuugaucuuuccacaaaucucuugccu

SEQ ID NO: 627874 - RNA, 64 nt, Homo Sapiens
guuuaaagcagggcacauuguugcagcaaaauguguauuugacaaauuauacuugcaauuuugg

SEQ ID NO: 627875 - RNA, 64 nt, Homo Sapiens
cugcaagacagaugggaauguguauaauaacuagguauuugagaaguucugaaguuugauguaa

SEQ ID NO: 627876 - RNA, 64 nt, Homo Sapiens
acauccugaauucucaguuugcuuuuaaaaauuuguauuugauaauuuaugcuuuaauggucaa

SEQ ID NO: 627877 - RNA, 64 nt, Homo Sapiens
uaaauacuuuuacauucuaaugaguuugauuuuaguauuugagacagcauuguuugauuuuucu

SEQ ID NO: 627878 - RNA, 64 nt, Homo Sapiens
cauuuugccaggucauuucuucucacgcucugugguauuugaauugagcuuuacugaggaauau

SEQ ID NO: 627879 - RNA, 64 nt, Homo Sapiens
auguuccauuuguguuuuaugucuagcuuaaaagguauuugaaagcuauccuguugauuuuuau

SEQ ID NO: 627880 - RNA, 64 nt, Homo Sapiens
uacauacagguauguuguuaacaguugugccuguguauuugaacaaaucaauaauaauaugcaa

SEQ ID NO: 627881 - RNA, 64 nt, Homo Sapiens
cguaauuguuucaauuuuccaugaaaggcaaaaaguauuugaaaccuaaggaaaaaacagcauc

SEQ ID NO: 627882 - RNA, 64 nt, Homo Sapiens
uuuuaaaucacuucaacauuauguaaauauaugaguauuugaguguuuuuuuucuuacucucca

SEQ ID NO: 627883 - RNA, 64 nt, Homo Sapiens
uauauauauaaaaauauauauguauaagaguuauguauuugaaaaaaauauauaaaagaauaua

SEQ ID NO: 627884 - RNA, 64 nt, Homo Sapiens
acagcaaauccuaggcucagaggcacagugcuuuguauuugauauacaaagucucuagacuuuc

SEQ ID NO: 627885 - RNA, 64 nt, Homo Sapiens
cuuugacuugguauuauaagcuggaguuauauauguauuugaaaacagaguaaauacuuaagag

SEQ ID NO: 627886 - RNA, 64 nt, Homo Sapiens
uccuuucugagggaggcuggugccgcucugcaggguauuugaaccuguggaauuggaggaggcc

SEQ ID NO: 627887 - RNA, 64 nt, Homo Sapiens
uucuaaaucuuuaugguuauuaaaguucuuugauguauuugauucuaaaaaaguaauuuagauu

SEQ ID NO: 627888 - RNA, 64 nt, Homo Sapiens
uuuaagcccuaucucaguuguuccagaaugucauguauuugacuuucuaaauaaacuuaaccug

SEQ ID NO: 627889 - RNA, 64 nt, Homo Sapiens
uuuaguuuuuaacuuauuuuugcagguuuuuuguguauuugauuguuuuuuaaugguuuauugc

SEQ ID NO: 627890 - RNA, 64 nt, Homo Sapiens
uuagaaauugagguugagagucuuucugaaauguguauuugagacuggcuauucuuuaaucaug

SEQ ID NO: 627891 - RNA, 64 nt, Homo Sapiens
acagacuuugagguuucaucauauauuuuaauaaguauuugaguaagaaaucauauauguaugg

SEQ ID NO: 627892 - RNA, 64 nt, Homo Sapiens
aagaaugaugcauuuugacaauauuuuuguuuuuguauuugaagaugguuuuaggaaagugaaa

SEQ ID NO: 627893 - RNA, 64 nt, Homo Sapiens; identical to SEQ ID NO: 306996

SEQ ID NO: 627894 - RNA, 64 nt, Homo Sapiens; identical to SEQ ID NO: 306997

SEQ ID NO: 627895 - RNA, 64 nt, Homo Sapiens; identical to SEQ ID NO: 306998

SEQ ID NO: 627896 - RNA, 64 nt, Homo Sapiens; identical to SEQ ID NO: 306999

SEQ ID NO: 627897 - RNA, 64 nt, Homo Sapiens; identical to SEQ ID NO: 307000

SEQ ID NO: 627898 - RNA, 64 nt, Homo Sapiens; identical to SEQ ID NO: 307001

SEQ ID NO: 627899 - RNA, 64 nt, Homo Sapiens; identical to SEQ ID NO: 307002

SEQ ID NO: 627900 - RNA, 64 nt, Homo Sapiens; identical to SEQ ID NO: 307003

SEQ ID NO: 627901 - RNA, 64 nt, Homo Sapiens; identical to SEQ ID NO: 307004

SEQ ID NO: 627902 - RNA, 64 nt, Homo Sapiens; identical to SEQ ID NO: 307005

SEQ ID NO: 627903 - RNA, 64 nt, Homo Sapiens; identical to SEQ ID NO: 307006

SEQ ID NO: 627904 - RNA, 64 nt, Homo Sapiens; identical to SEQ ID NO: 307007

SEQ ID NO: 627905 - RNA, 64 nt, Homo Sapiens
aucucuaaauaaaaaaagguaugguauaucuccuuaccagaaaagccagugaaauugcuuuccu

SEQ ID NO: 627906 - RNA, 64 nt, Homo Sapiens
aaggcucuguuuauuccccaguuuuuugcaguguuaccagaauccagacuuauuggacaauuau

SEQ ID NO: 627907 - RNA, 64 nt, Homo Sapiens
cuuguaaacauuugccaaauccaacuguaauuaguaccagaacuuagaaggaaagucacaaagc

SEQ ID NO: 627908 - RNA, 64 nt, Homo Sapiens
agaacuuagaaggaaagucacaaagcaugccuuuuaccagaauauugcuuugccuuuucuuaua

SEQ ID NO: 627909 - RNA, 64 nt, Homo Sapiens
acucaaaaugcuguuggaauaugcagagaauugcuaccagaauauucaguaagguuucagggag

SEQ ID NO: 627910 - RNA, 64 nt, Homo Sapiens
auaauguuucuccauaacagagaauguuaauggauaccagaauuuuauuuuuguauuuauguuc

SEQ ID NO: 627911 - RNA, 64 nt, Homo Sapiens
ugcggucuagggaccagugaauugccuuagaagauaccagaaggagacacagugcgguaccaga

SEQ ID NO: 627912 - RNA, 64 nt, Homo Sapiens
gccuuagaagauaccagaagcagacacagugcgguaccagaauugacauuuaaauaggccaacc

SEQ ID NO: 627913 - RNA, 64 nt, Homo Sapiens
cuauuuuguaaacauaucugcuuuaauggggauguaccagaaacccaccucaccccggcucaca

SEQ ID NO: 627914 - RNA, 64 nt, Homo Sapiens
ucaguagggacauugcagaagcuugaaaggccaauaccagaacacaggcugaugcuucugagaa

SEQ ID NO: 627915 - RNA, 64 nt, Homo Sapiens; identical to SEQ ID NO: 103765

SEQ ID NO: 627916 - RNA, 64 nt, Homo Sapiens; identical to SEQ ID NO: 103766

SEQ ID NO: 627917 - RNA, 53 nt, Homo Sapiens; identical to SEQ ID NO: 103767

SEQ ID NO: 627918 - RNA, 64 nt, Homo Sapiens; identical to SEQ ID NO: 103768

SEQ ID NO: 627919 - RNA, 64 nt, Homo Sapiens; identical to SEQ ID NO: 103769

SEQ ID NO: 627920 - RNA, 64 nt, Homo Sapiens; identical to SEQ ID NO: 103770

SEQ ID NO: 627921 - RNA, 53 nt, Homo Sapiens; identical to SEQ ID NO: 103771

SEQ ID NO: 627922 - RNA, 64 nt, Homo Sapiens; identical to SEQ ID NO: 103772

SEQ ID NO: 627923 - RNA, 64 nt, Homo Sapiens; identical to SEQ ID NO: 103773

SEQ ID NO: 627924 - RNA, 64 nt, Homo Sapiens; identical to SEQ ID NO: 103774

SEQ ID NO: 627925 - RNA, 64 nt, Homo Sapiens; identical to SEQ ID NO: 103775

SEQ ID NO: 627926 - RNA, 64 nt, Homo Sapiens; identical to SEQ ID NO: 103776

SEQ ID NO: 627927 - RNA, 64 nt, Homo Sapiens
auauuaaauccacaauauuuuauuacauuuuuaacuuguauaaauuuuaggucaaauccuucaa

SEQ ID NO: 627928 - RNA, 64 nt, Homo Sapiens
aucucaaugucaccuuguuugcauucuuggauagcuuguauauguaguaguuugaugaauaauu

SEQ ID NO: 627929 - RNA, 64 nt, Homo Sapiens
ugggagccaccaugccugacccacacacuuuuuacuuguauagaugauuuuuggcuuggacaua

SEQ ID NO: 627930 - RNA, 64 nt, Homo Sapiens
ccaagccuguccauggauauaucaaaugucuucacuuguauauuuucauggcuagguauuucua

SEQ ID NO: 627931 - RNA, 64 nt, Homo Sapiens
gagauaauaaaccuauuaccucaauaaaugcuuacuuguauauaucucuuauuuuugacaaaca

SEQ ID NO: 627932 - RNA, 64 nt, Homo Sapiens
ugacuucauugucuggauaacauguguugcuugccuuguauaguuguugaugguguuuuauugu

SEQ ID NO: 627933 - RNA, 64 nt, Homo Sapiens
ugggauuuucuuuucuuuucucugguaauauugacuuguauauuuuaagaaauaacagaaagcc

SEQ ID NO: 627934 - RNA, 64 nt, Homo Sapiens
aaaaaguuuuaguuuugaugaguugugaguuuaccuuguauacuguaggcacacuuugcacuga

SEQ ID NO: 627935 - RNA, 64 nt, Homo Sapiens
cagagaaauguguggucguauuuuuuacuuuugucuuguauauguauguauauuggguccucug

SEQ ID NO: 627936 - RNA, 64 nt, Homo Sapiens
acaguuuugauaaagaggcucucauuuccugugucuuguauauucaguccuuucaauacgucca

SEQ ID NO: 627937 - RNA, 64 nt, Homo Sapiens
uuuuugcagguacaaauucaaaaugcucucauaacuuguauacauaacacuuaucuucuuaagu

SEQ ID NO: 627938 - RNA, 64 nt, Homo Sapiens
aaauauaggcauauaccucaauauauucauguaucuuguauauaacauauguacaugaauauau

SEQ ID NO: 627939 - RNA, 64 nt, Homo Sapiens
aguuacauucucaaguuuuuaaaaucaaggggaacuuguauacugggccuguuuuucagccugu

SEQ ID NO: 627940 - RNA, 64 nt, Homo Sapiens
uuaaauagucaucaauaugaagccaugauuaaugcuuguauaaugugaugcaauaaaauuuaaa

SEQ ID NO: 627941 - RNA, 64 nt, Homo Sapiens
aaacaauauuuuccaguguuuuuuuucuugaucacuuguauagguggguuuucuuuuucuuugu

SEQ ID NO: 627942 - RNA, 64 nt, Homo Sapiens
uucugcccagaucucuccacaaauuaaacuucuucuuguauaaaugagaugauuuuuaagugau

SEQ ID NO: 627943 - RNA, 64 nt, Homo Sapiens
cuucaaaaauuauuguagacucauuugcaaugcacuuguauacagacuuuaaauuuuaaagagc

SEQ ID NO: 627944 - RNA, 64 nt, Homo Sapiens
gcacuuuacuaccuaccacuguauauaguauuuccuuguauaaauaaauggaaccucuccaugu

SEQ ID NO: 627945 - RNA, 64 nt, Homo Sapiens
uuauuuaaaagggauacuuuuguaaaaguaaaaccuuguauaaagaacaaaauguuucuuaauu

SEQ ID NO: 627946 - RNA, 64 nt, Homo Sapiens
agaaagggggcuuagggaugagguccugguuuuucuuguauaaauaggagucaugggcguuagu

SEQ ID NO: 627947 - RNA, 64 nt, Homo Sapiens
uguaccaacagaaauauuauuguaagaugccuuucuuguauaagauaugccaauauuugcuuua

SEQ ID NO: 627948 - RNA, 64 nt, Homo Sapiens
ccuaaguggcuuagcugggucuuucauagccaaacuuguauauuuaaauucuuuguaauaauaa

SEQ ID NO: 627949 - RNA, 64 nt, Homo Sapiens; identical to SEQ ID NO: 352993

SEQ ID NO: 627950 - RNA, 64 nt, Homo Sapiens; identical to SEQ ID NO: 352994

SEQ ID NO: 627951 - RNA, 64 nt, Homo Sapiens; identical to SEQ ID NO: 352995

SEQ ID NO: 627952 - RNA, 64 nt, Homo Sapiens; identical to SEQ ID NO: 352996

SEQ ID NO: 627953 - RNA, 64 nt, Homo Sapiens; identical to SEQ ID NO: 352997

SEQ ID NO: 627954 - RNA, 64 nt, Homo Sapiens; identical to SEQ ID NO: 352998

SEQ ID NO: 627955 - RNA, 64 nt, Homo Sapiens; identical to SEQ ID NO: 352999

SEQ ID NO: 627956 - RNA, 64 nt, Homo Sapiens; identical to SEQ ID NO: 353000

SEQ ID NO: 627957 - RNA, 64 nt, Homo Sapiens; identical to SEQ ID NO: 353001

SEQ ID NO: 627958 - RNA, 64 nt, Homo Sapiens; identical to SEQ ID NO: 353002

SEQ ID NO: 627959 - RNA, 64 nt, Homo Sapiens; identical to SEQ ID NO: 353003

SEQ ID NO: 627960 - RNA, 64 nt, Homo Sapiens; identical to SEQ ID NO: 353004

SEQ ID NO: 627961 - RNA, 64 nt, Homo Sapiens; identical to SEQ ID NO: 353005

SEQ ID NO: 627962 - RNA, 64 nt, Homo Sapiens; identical to SEQ ID NO: 353006

SEQ ID NO: 627963 - RNA, 64 nt, Homo Sapiens; identical to SEQ ID NO: 353007

SEQ ID NO: 627964 - RNA, 64 nt, Homo Sapiens; identical to SEQ ID NO: 353008

SEQ ID NO: 627965 - RNA, 64 nt, Homo Sapiens; identical to SEQ ID NO: 353009

SEQ ID NO: 627966 - RNA, 64 nt, Homo Sapiens; identical to SEQ ID NO: 353010

SEQ ID NO: 627967 - RNA, 64 nt, Homo Sapiens; identical to SEQ ID NO: 353011

SEQ ID NO: 627968 - RNA, 64 nt, Homo Sapiens; identical to SEQ ID NO: 353012

SEQ ID NO: 627969 - RNA, 64 nt, Homo Sapiens; identical to SEQ ID NO: 353013

SEQ ID NO: 627970 - RNA, 64 nt, Homo Sapiens; identical to SEQ ID NO: 353014

SEQ ID NO: 627971 - RNA, 64 nt, Homo Sapiens; identical to SEQ ID NO: 353015

SEQ ID NO: 627972 - RNA, 64 nt, Homo Sapiens; identical to SEQ ID NO: 353016

SEQ ID NO: 627973 - RNA, 64 nt, Homo Sapiens; identical to SEQ ID NO: 353017

SEQ ID NO: 627974 - RNA, 64 nt, Homo Sapiens; identical to SEQ ID NO: 353018

SEQ ID NO: 627975 - RNA, 64 nt, Homo Sapiens; identical to SEQ ID NO: 353019

SEQ ID NO: 627976 - RNA, 64 nt, Homo Sapiens; identical to SEQ ID NO: 353020

SEQ ID NO: 627977 - RNA, 64 nt, Homo Sapiens; identical to SEQ ID NO: 353021

SEQ ID NO: 627978 - RNA, 64 nt, Homo Sapiens; identical to SEQ ID NO: 353022

SEQ ID NO: 627979 - RNA, 64 nt, Homo Sapiens; identical to SEQ ID NO: 353023

SEQ ID NO: 627980 - RNA, 64 nt, Homo Sapiens; identical to SEQ ID NO: 353024

SEQ ID NO: 627981 - RNA, 64 nt, Homo Sapiens; identical to SEQ ID NO: 353025

SEQ ID NO: 627982 - RNA, 64 nt, Homo Sapiens; identical to SEQ ID NO: 353026

SEQ ID NO: 627983 - RNA, 64 nt, Homo Sapiens; identical to SEQ ID NO: 353027

SEQ ID NO: 627984 - RNA, 64 nt, Homo Sapiens; identical to SEQ ID NO: 353028

SEQ ID NO: 627985 - RNA, 64 nt, Homo Sapiens; identical to SEQ ID NO: 353029

SEQ ID NO: 627986 - RNA, 64 nt, Homo Sapiens; identical to SEQ ID NO: 353030

SEQ ID NO: 627987 - RNA, 64 nt, Homo Sapiens; identical to SEQ ID NO: 353031

SEQ ID NO: 627988 - RNA, 64 nt, Homo Sapiens; identical to SEQ ID NO: 353032

SEQ ID NO: 627989 - RNA, 64 nt, Homo Sapiens; identical to SEQ ID NO: 353033

SEQ ID NO: 627990 - RNA, 64 nt, Homo Sapiens; identical to SEQ ID NO: 353034

SEQ ID NO: 627991 - RNA, 64 nt, Homo Sapiens; identical to SEQ ID NO: 353035

SEQ ID NO: 627992 - RNA, 64 nt, Homo Sapiens; identical to SEQ ID NO: 353036

SEQ ID NO: 627993 - RNA, 64 nt, Homo Sapiens; identical to SEQ ID NO: 353037

SEQ ID NO: 627994 - RNA, 64 nt, Homo Sapiens; identical to SEQ ID NO: 353038

SEQ ID NO: 627995 - RNA, 64 nt, Homo Sapiens; identical to SEQ ID NO: 353039

SEQ ID NO: 627996 - RNA, 64 nt, Homo Sapiens; identical to SEQ ID NO: 353040

SEQ ID NO: 627997 - RNA, 64 nt, Homo Sapiens; identical to SEQ ID NO: 353041

SEQ ID NO: 627998 - RNA, 64 nt, Homo Sapiens; identical to SEQ ID NO: 353042

SEQ ID NO: 627999 - RNA, 64 nt, Homo Sapiens; identical to SEQ ID NO: 353043

SEQ ID NO: 628000 - RNA, 64 nt, Homo Sapiens; identical to SEQ ID NO: 353044

SEQ ID NO: 628001 - RNA, 64 nt, Homo Sapiens; identical to SEQ ID NO: 353045

SEQ ID NO: 628002 - RNA, 64 nt, Homo Sapiens; identical to SEQ ID NO: 353046

SEQ ID NO: 628003 - RNA, 64 nt, Homo Sapiens; identical to SEQ ID NO: 353047

SEQ ID NO: 628004 - RNA, 64 nt, Homo Sapiens; identical to SEQ ID NO: 353048

SEQ ID NO: 628005 - RNA, 64 nt, Homo Sapiens; identical to SEQ ID NO: 353049

SEQ ID NO: 628006 - RNA, 64 nt, Homo Sapiens; identical to SEQ ID NO: 353050

SEQ ID NO: 628007 - RNA, 64 nt, Homo Sapiens; identical to SEQ ID NO: 353051

SEQ ID NO: 628008 - RNA, 64 nt, Homo Sapiens; identical to SEQ ID NO: 353052

SEQ ID NO: 628009 - RNA, 64 nt, Homo Sapiens; identical to SEQ ID NO: 353053

SEQ ID NO: 628010 - RNA, 64 nt, Homo Sapiens; identical to SEQ ID NO: 353054

SEQ ID NO: 628011 - RNA, 64 nt, Homo Sapiens; identical to SEQ ID NO: 353055

SEQ ID NO: 628012 - RNA, 64 nt, Homo Sapiens; identical to SEQ ID NO: 353056

SEQ ID NO: 628013 - RNA, 64 nt, Homo Sapiens; identical to SEQ ID NO: 353057

SEQ ID NO: 628014 - RNA, 64 nt, Homo Sapiens; identical to SEQ ID NO: 353058

SEQ ID NO: 628015 - RNA, 64 nt, Homo Sapiens; identical to SEQ ID NO: 353059

SEQ ID NO: 628016 - RNA, 64 nt, Homo Sapiens; identical to SEQ ID NO: 353060

SEQ ID NO: 628017 - RNA, 64 nt, Homo Sapiens; identical to SEQ ID NO: 353061

SEQ ID NO: 628018 - RNA, 64 nt, Homo Sapiens; identical to SEQ ID NO: 353062

SEQ ID NO: 628019 - RNA, 64 nt, Homo Sapiens; identical to SEQ ID NO: 353063

SEQ ID NO: 628020 - RNA, 64 nt, Homo Sapiens; identical to SEQ ID NO: 353064

SEQ ID NO: 628021 - RNA, 64 nt, Homo Sapiens; identical to SEQ ID NO: 353065

SEQ ID NO: 628022 - RNA, 64 nt, Homo Sapiens; identical to SEQ ID NO: 353066

SEQ ID NO: 628023 - RNA, 64 nt, Homo Sapiens; identical to SEQ ID NO: 353067

SEQ ID NO: 628024 - RNA, 64 nt, Homo Sapiens; identical to SEQ ID NO: 353068

SEQ ID NO: 628025 - RNA, 64 nt, Homo Sapiens; identical to SEQ ID NO: 353069

SEQ ID NO: 628026 - RNA, 64 nt, Homo Sapiens; identical to SEQ ID NO: 353070

SEQ ID NO: 628027 - RNA, 64 nt, Homo Sapiens; identical to SEQ ID NO: 353071

SEQ ID NO: 628028 - RNA, 64 nt, Homo Sapiens; identical to SEQ ID NO: 353072

SEQ ID NO: 628029 - RNA, 64 nt, Homo Sapiens; identical to SEQ ID NO: 353073

SEQ ID NO: 628030 - RNA, 64 nt, Homo Sapiens; identical to SEQ ID NO: 353074

SEQ ID NO: 628031 - RNA, 64 nt, Homo Sapiens; identical to SEQ ID NO: 353075

SEQ ID NO: 628032 - RNA, 64 nt, Homo Sapiens; identical to SEQ ID NO: 353076

SEQ ID NO: 628033 - RNA, 64 nt, Homo Sapiens; identical to SEQ ID NO: 353077

SEQ ID NO: 628034 - RNA, 64 nt, Homo Sapiens; identical to SEQ ID NO: 353078

SEQ ID NO: 628035 - RNA, 64 nt, Homo Sapiens; identical to SEQ ID NO: 353079

SEQ ID NO: 628036 - RNA, 64 nt, Homo Sapiens; identical to SEQ ID NO: 353080

SEQ ID NO: 628037 - RNA, 64 nt, Homo Sapiens; identical to SEQ ID NO: 353081

SEQ ID NO: 628038 - RNA, 64 nt, Homo Sapiens; identical to SEQ ID NO: 353082

SEQ ID NO: 628039 - RNA, 64 nt, Homo Sapiens; identical to SEQ ID NO: 353083

SEQ ID NO: 628040 - RNA, 64 nt, Homo Sapiens; identical to SEQ ID NO: 353084

SEQ ID NO: 628041 - RNA, 64 nt, Homo Sapiens; identical to SEQ ID NO: 353085

SEQ ID NO: 628042 - RNA, 64 nt, Homo Sapiens; identical to SEQ ID NO: 353086

SEQ ID NO: 628043 - RNA, 64 nt, Homo Sapiens; identical to SEQ ID NO: 353087

SEQ ID NO: 628044 - RNA, 64 nt, Homo Sapiens; identical to SEQ ID NO: 353088

SEQ ID NO: 628045 - RNA, 64 nt, Homo Sapiens; identical to SEQ ID NO: 353089

SEQ ID NO: 628046 - RNA, 64 nt, Homo Sapiens; identical to SEQ ID NO: 353090

SEQ ID NO: 628047 - RNA, 64 nt, Homo Sapiens; identical to SEQ ID NO: 353091

SEQ ID NO: 628048 - RNA, 64 nt, Homo Sapiens; identical to SEQ ID NO: 353092

SEQ ID NO: 628049 - RNA, 64 nt, Homo Sapiens; identical to SEQ ID NO: 353093

SEQ ID NO: 628050 - RNA, 64 nt, Homo Sapiens; identical to SEQ ID NO: 353094

SEQ ID NO: 628051 - RNA, 64 nt, Homo Sapiens; identical to SEQ ID NO: 353095

SEQ ID NO: 628052 - RNA, 64 nt, Homo Sapiens; identical to SEQ ID NO: 353096

SEQ ID NO: 628053 - RNA, 64 nt, Homo Sapiens; identical to SEQ ID NO: 353097

SEQ ID NO: 628054 - RNA, 64 nt, Homo Sapiens; identical to SEQ ID NO: 353098

SEQ ID NO: 628055 - RNA, 64 nt, Homo Sapiens; identical to SEQ ID NO: 353099

SEQ ID NO: 628056 - RNA, 64 nt, Homo Sapiens; identical to SEQ ID NO: 353100

SEQ ID NO: 628057 - RNA, 64 nt, Homo Sapiens; identical to SEQ ID NO: 353101

SEQ ID NO: 628058 - RNA, 64 nt, Homo Sapiens; identical to SEQ ID NO: 353102

SEQ ID NO: 628059 - RNA, 64 nt, Homo Sapiens; identical to SEQ ID NO: 353103

SEQ ID NO: 628060 - RNA, 64 nt, Homo Sapiens; identical to SEQ ID NO: 353104

SEQ ID NO: 628061 - RNA, 64 nt, Homo Sapiens; identical to SEQ ID NO: 353105

SEQ ID NO: 628062 - RNA, 64 nt, Homo Sapiens; identical to SEQ ID NO: 353106

SEQ ID NO: 628063 - RNA, 64 nt, Homo Sapiens; identical to SEQ ID NO: 353107

SEQ ID NO: 628064 - RNA, 64 nt, Homo Sapiens; identical to SEQ ID NO: 353108

SEQ ID NO: 628065 - RNA, 64 nt, Homo Sapiens; identical to SEQ ID NO: 353109

SEQ ID NO: 628066 - RNA, 64 nt, Homo Sapiens; identical to SEQ ID NO: 353110

SEQ ID NO: 628067 - RNA, 64 nt, Homo Sapiens; identical to SEQ ID NO: 353111

SEQ ID NO: 628068 - RNA, 64 nt, Homo Sapiens; identical to SEQ ID NO: 353112

SEQ ID NO: 628069 - RNA, 64 nt, Homo Sapiens; identical to SEQ ID NO: 353113

SEQ ID NO: 628070 - RNA, 64 nt, Homo Sapiens; identical to SEQ ID NO: 353114

SEQ ID NO: 628071 - RNA, 64 nt, Homo Sapiens; identical to SEQ ID NO: 353115

SEQ ID NO: 628072 - RNA, 64 nt, Homo Sapiens; identical to SEQ ID NO: 353116

SEQ ID NO: 628073 - RNA, 64 nt, Homo Sapiens; identical to SEQ ID NO: 353117

SEQ ID NO: 628074 - RNA, 64 nt, Homo Sapiens; identical to SEQ ID NO: 353118

SEQ ID NO: 628075 - RNA, 64 nt, Homo Sapiens; identical to SEQ ID NO: 353119

SEQ ID NO: 628076 - RNA, 64 nt, Homo Sapiens; identical to SEQ ID NO: 353120

SEQ ID NO: 628077 - RNA, 64 nt, Homo Sapiens; identical to SEQ ID NO: 353121

SEQ ID NO: 628078 - RNA, 64 nt, Homo Sapiens; identical to SEQ ID NO: 353122

SEQ ID NO: 628079 - RNA, 64 nt, Homo Sapiens; identical to SEQ ID NO: 353123

SEQ ID NO: 628080 - RNA, 64 nt, Homo Sapiens; identical to SEQ ID NO: 353124

SEQ ID NO: 628081 - RNA, 64 nt, Homo Sapiens; identical to SEQ ID NO: 353125

SEQ ID NO: 628082 - RNA, 64 nt, Homo Sapiens; identical to SEQ ID NO: 353126

SEQ ID NO: 628083 - RNA, 64 nt, Homo Sapiens; identical to SEQ ID NO: 353127

SEQ ID NO: 628084 - RNA, 64 nt, Homo Sapiens; identical to SEQ ID NO: 353128

SEQ ID NO: 628085 - RNA, 64 nt, Homo Sapiens; identical to SEQ ID NO: 353129

SEQ ID NO: 628086 - RNA, 64 nt, Homo Sapiens; identical to SEQ ID NO: 353130

SEQ ID NO: 628087 - RNA, 64 nt, Homo Sapiens; identical to SEQ ID NO: 353131

SEQ ID NO: 628088 - RNA, 64 nt, Homo Sapiens; identical to SEQ ID NO: 353132

SEQ ID NO: 628089 - RNA, 64 nt, Homo Sapiens; identical to SEQ ID NO: 353133

SEQ ID NO: 628090 - RNA, 64 nt, Homo Sapiens; identical to SEQ ID NO: 353134

SEQ ID NO: 628091 - RNA, 64 nt, Homo Sapiens; identical to SEQ ID NO: 353135

SEQ ID NO: 628092 - RNA, 64 nt, Homo Sapiens; identical to SEQ ID NO: 353136

SEQ ID NO: 628093 - RNA, 64 nt, Homo Sapiens; identical to SEQ ID NO: 353137

SEQ ID NO: 628094 - RNA, 64 nt, Homo Sapiens; identical to SEQ ID NO: 353138

SEQ ID NO: 628095 - RNA, 64 nt, Homo Sapiens; identical to SEQ ID NO: 353139

SEQ ID NO: 628096 - RNA, 64 nt, Homo Sapiens; identical to SEQ ID NO: 353140

SEQ ID NO: 628097 - RNA, 64 nt, Homo Sapiens; identical to SEQ ID NO: 353141

SEQ ID NO: 628098 - RNA, 64 nt, Homo Sapiens; identical to SEQ ID NO: 353142

SEQ ID NO: 628099 - RNA, 64 nt, Homo Sapiens; identical to SEQ ID NO: 353143

SEQ ID NO: 628100 - RNA, 64 nt, Homo Sapiens; identical to SEQ ID NO: 353144

SEQ ID NO: 628101 - RNA, 64 nt, Homo Sapiens; identical to SEQ ID NO: 353145

SEQ ID NO: 628102 - RNA, 64 nt, Homo Sapiens; identical to SEQ ID NO: 353146

SEQ ID NO: 628103 - RNA, 64 nt, Homo Sapiens; identical to SEQ ID NO: 353147

SEQ ID NO: 628104 - RNA, 64 nt, Homo Sapiens; identical to SEQ ID NO: 353148

SEQ ID NO: 628105 - RNA, 64 nt, Homo Sapiens; identical to SEQ ID NO: 353149

SEQ ID NO: 628106 - RNA, 64 nt, Homo Sapiens; identical to SEQ ID NO: 353150

SEQ ID NO: 628107 - RNA, 64 nt, Homo Sapiens; identical to SEQ ID NO: 353151

SEQ ID NO: 628108 - RNA, 64 nt, Homo Sapiens; identical to SEQ ID NO: 353152

SEQ ID NO: 628109 - RNA, 64 nt, Homo Sapiens; identical to SEQ ID NO: 353153

SEQ ID NO: 628110 - RNA, 64 nt, Homo Sapiens; identical to SEQ ID NO: 353154

SEQ ID NO: 628111 - RNA, 64 nt, Homo Sapiens; identical to SEQ ID NO: 353155

SEQ ID NO: 628112 - RNA, 64 nt, Homo Sapiens; identical to SEQ ID NO: 353156

SEQ ID NO: 628113 - RNA, 64 nt, Homo Sapiens; identical to SEQ ID NO: 353157

SEQ ID NO: 628114 - RNA, 64 nt, Homo Sapiens; identical to SEQ ID NO: 353158

SEQ ID NO: 628115 - RNA, 64 nt, Homo Sapiens; identical to SEQ ID NO: 353159

SEQ ID NO: 628116 - RNA, 64 nt, Homo Sapiens; identical to SEQ ID NO: 353160

SEQ ID NO: 628117 - RNA, 64 nt, Homo Sapiens; identical to SEQ ID NO: 353161

SEQ ID NO: 628118 - RNA, 64 nt, Homo Sapiens; identical to SEQ ID NO: 353162

SEQ ID NO: 628119 - RNA, 64 nt, Homo Sapiens; identical to SEQ ID NO: 353163

SEQ ID NO: 628120 - RNA, 64 nt, Homo Sapiens; identical to SEQ ID NO: 353164

SEQ ID NO: 628121 - RNA, 64 nt, Homo Sapiens; identical to SEQ ID NO: 353165

SEQ ID NO: 628122 - RNA, 64 nt, Homo Sapiens; identical to SEQ ID NO: 78063

SEQ ID NO: 628123 - RNA, 64 nt, Homo Sapiens; identical to SEQ ID NO: 78064

SEQ ID NO: 628124 - RNA, 64 nt, Homo Sapiens; identical to SEQ ID NO: 78065

SEQ ID NO: 628125 - RNA, 64 nt, Homo Sapiens; identical to SEQ ID NO: 78066

SEQ ID NO: 628126 - RNA, 64 nt, Homo Sapiens; identical to SEQ ID NO: 78067

SEQ ID NO: 628127 - RNA, 64 nt, Homo Sapiens; identical to SEQ ID NO: 78068

SEQ ID NO: 628128 - RNA, 64 nt, Homo Sapiens; identical to SEQ ID NO: 78069

SEQ ID NO: 628129 - RNA, 64 nt, Homo Sapiens; identical to SEQ ID NO: 78070

SEQ ID NO: 628130 - RNA, 64 nt, Homo Sapiens; identical to SEQ ID NO: 78071

SEQ ID NO: 628131 - RNA, 64 nt, Homo Sapiens; identical to SEQ ID NO: 78072

SEQ ID NO: 628132 - RNA, 62 nt, Homo Sapiens
uuaaucagaaauagcaacgaaucauuuuguuaaaggucuacugaaaugaagguuucauaaug

SEQ ID NO: 628133 - RNA, 62 nt, Homo Sapiens
ccauucuccauauccuggguggauaagaaauuaaggucuauuuggucuucagcuaaaaaaua

SEQ ID NO: 628134 - RNA, 62 nt, Homo Sapiens
caucuacucuuuuaauucuuuggaugguaacuaaggucuauaaggucuagagugauuuguau

SEQ ID NO: 628135 - RNA, 62 nt, Homo Sapiens
gugauuuguauuggaugguauaaguggaauuaaaggucuagaguaaggacaguuucgguagu

SEQ ID NO: 628136 - RNA, 64 nt, Homo Sapiens; identical to SEQ ID NO: 413778

SEQ ID NO: 628137 - RNA, 64 nt, Homo Sapiens; identical to SEQ ID NO: 413779

SEQ ID NO: 628138 - RNA, 64 nt, Homo Sapiens; identical to SEQ ID NO: 413780

SEQ ID NO: 628139 - RNA, 64 nt, Homo Sapiens; identical to SEQ ID NO: 413781

SEQ ID NO: 628140 - RNA, 64 nt, Homo Sapiens; identical to SEQ ID NO: 413782

SEQ ID NO: 628141 - RNA, 64 nt, Homo Sapiens; identical to SEQ ID NO: 413783

SEQ ID NO: 628142 - RNA, 64 nt, Homo Sapiens; identical to SEQ ID NO: 413784

SEQ ID NO: 628143 - RNA, 64 nt, Homo Sapiens; identical to SEQ ID NO: 413785

SEQ ID NO: 628144 - RNA, 64 nt, Homo Sapiens
ccacagacuggguaacgugacguuugggcugcuauaacagaauaagagaguauguauuuaaguc

SEQ ID NO: 628145 - RNA, 64 nt, Homo Sapiens
agugacauuuagagguuuuaguuuccuuucuaguuaacagaaauugguacuuuuauucagacuu

SEQ ID NO: 628146 - RNA, 64 nt, Homo Sapiens
gaaauaagagaugccagaacacagaaguaauggauaacagaaugugucugcugccauuaacaga

SEQ ID NO: 628147 - RNA, 64 nt, Homo Sapiens
gaaguaauggauaacagaaugugucugcugccauuaacagaacaaaaucucaguaguuaaucaa

SEQ ID NO: 628148 - RNA, 64 nt, Homo Sapiens
cgacagacuggguaauuuaaauuuucugcuacuauaacagaauaauauaugaaugucuuagcca

SEQ ID NO: 628149 - RNA, 64 nt, Homo Sapiens
uuaccuuuuaauaaauuaaaauuuucaggcaugguaacagaaauaaauguuuucuauuuugcau

SEQ ID NO: 628150 - RNA, 64 nt, Homo Sapiens
ucaacucuaaauucaacaagacgaccuuucuuuauaacagaaacccggagaaggaaaagaacuu

SEQ ID NO: 628151 - RNA, 64 nt, Homo Sapiens
uagcuccugaaggaaacacuuuaccucaauugaguaacagaauaaucuucauugucacuuuguc

SEQ ID NO: 628152 - RNA, 64 nt, Homo Sapiens
ucuuagguggaauguuucuggccgaaguauuuucuaacagaaaccagcacacuugaugguuguu

SEQ ID NO: 628153 - RNA, 64 nt, Homo Sapiens
aagaaacaaauacauuuuaaaauuaaacaaucuguaacagaaucagaaucaagaaacaaauuuu

SEQ ID NO: 628154 - RNA, 64 nt, Homo Sapiens
aagaaacaaauuuuaauuaauuucuccauguauauaacagaaucuagcaucccuuuucacaugg

SEQ ID NO: 628155 - RNA, 64 nt, Homo Sapiens
caaccagaaauaauugauaauuguaauuggcuucuaacagaauucaccaagugcuacugucccu

SEQ ID NO: 628156 - RNA, 64 nt, Homo Sapiens
aaaaaaaaaagucuuguugggcauauuuaagaguuaacagaaugcuccauuuuugccuucgaau

SEQ ID NO: 628157 - RNA, 64 nt, Homo Sapiens
uucuacagauacauuuuuuaacauauuuucuguuuaacagaacuuagaugaaucagugcccaag

SEQ ID NO: 628158 - RNA, 64 nt, Homo Sapiens
gaguggcagcugccugccaaaaucuguuccgcuguaacagaacugaauuuggaccccagcacag

SEQ ID NO: 628159 - RNA, 64 nt, Homo Sapiens
gaccucugauugcaccacugcacuccaggcuggguaacagaaugagaccuuaucucaaaaauaa

SEQ ID NO: 628160 - RNA, 64 nt, Homo Sapiens; identical to SEQ ID NO: 413778

SEQ ID NO: 628161 - RNA, 64 nt, Homo Sapiens; identical to SEQ ID NO: 413779

SEQ ID NO: 628162 - RNA, 64 nt, Homo Sapiens; identical to SEQ ID NO: 413780

SEQ ID NO: 628163 - RNA, 64 nt, Homo Sapiens; identical to SEQ ID NO: 413781

SEQ ID NO: 628164 - RNA, 64 nt, Homo Sapiens; identical to SEQ ID NO: 413782

SEQ ID NO: 628165 - RNA, 64 nt, Homo Sapiens; identical to SEQ ID NO: 413783

SEQ ID NO: 628166 - RNA, 64 nt, Homo Sapiens; identical to SEQ ID NO: 413784

SEQ ID NO: 628167 - RNA, 64 nt, Homo Sapiens; identical to SEQ ID NO: 413785

SEQ ID NO: 628168 - RNA, 64 nt, Homo Sapiens; identical to SEQ ID NO: 628144

SEQ ID NO: 628169 - RNA, 64 nt, Homo Sapiens; identical to SEQ ID NO: 628145

SEQ ID NO: 628170 - RNA, 64 nt, Homo Sapiens; identical to SEQ ID NO: 628146

SEQ ID NO: 628171 - RNA, 64 nt, Homo Sapiens; identical to SEQ ID NO: 628147

SEQ ID NO: 628172 - RNA, 64 nt, Homo Sapiens; identical to SEQ ID NO: 628148

SEQ ID NO: 628173 - RNA, 64 nt, Homo Sapiens; identical to SEQ ID NO: 628149

SEQ ID NO: 628174 - RNA, 64 nt, Homo Sapiens; identical to SEQ ID NO: 628150

SEQ ID NO: 628175 - RNA, 64 nt, Homo Sapiens; identical to SEQ ID NO: 628151

SEQ ID NO: 628176 - RNA, 64 nt, Homo Sapiens; identical to SEQ ID NO: 628152

SEQ ID NO: 628177 - RNA, 64 nt, Homo Sapiens; identical to SEQ ID NO: 628153

SEQ ID NO: 628178 - RNA, 64 nt, Homo Sapiens; identical to SEQ ID NO: 628154

SEQ ID NO: 628179 - RNA, 64 nt, Homo Sapiens; identical to SEQ ID NO: 628155

SEQ ID NO: 628180 - RNA, 64 nt, Homo Sapiens; identical to SEQ ID NO: 628156

SEQ ID NO: 628181 - RNA, 64 nt, Homo Sapiens; identical to SEQ ID NO: 628157

SEQ ID NO: 628182 - RNA, 64 nt, Homo Sapiens; identical to SEQ ID NO: 628158

SEQ ID NO: 628183 - RNA, 64 nt, Homo Sapiens; identical to SEQ ID NO: 628159

SEQ ID NO: 628184 - RNA, 64 nt, Homo Sapiens; identical to SEQ ID NO: 98228

SEQ ID NO: 628185 - RNA, 64 nt, Homo Sapiens; identical to SEQ ID NO: 98229

SEQ ID NO: 628186 - RNA, 64 nt, Homo Sapiens; identical to SEQ ID NO: 98230

SEQ ID NO: 628187 - RNA, 64 nt, Homo Sapiens; identical to SEQ ID NO: 98231

SEQ ID NO: 628188 - RNA, 64 nt, Homo Sapiens; identical to SEQ ID NO: 98232

SEQ ID NO: 628189 - RNA, 64 nt, Homo Sapiens; identical to SEQ ID NO: 98233

SEQ ID NO: 628190 - RNA, 64 nt, Homo Sapiens; identical to SEQ ID NO: 98234

SEQ ID NO: 628191 - RNA, 64 nt, Homo Sapiens; identical to SEQ ID NO: 98235

SEQ ID NO: 628192 - RNA, 64 nt, Homo Sapiens; identical to SEQ ID NO: 98236

SEQ ID NO: 628193 - RNA, 64 nt, Homo Sapiens; identical to SEQ ID NO: 98237

SEQ ID NO: 628194 - RNA, 64 nt, Homo Sapiens; identical to SEQ ID NO: 98238

SEQ ID NO: 628195 - RNA, 64 nt, Homo Sapiens; identical to SEQ ID NO: 98239

SEQ ID NO: 628196 - RNA, 64 nt, Homo Sapiens; identical to SEQ ID NO: 98240

SEQ ID NO: 628197 - RNA, 64 nt, Homo Sapiens; identical to SEQ ID NO: 98241

SEQ ID NO: 628198 - RNA, 64 nt, Homo Sapiens; identical to SEQ ID NO: 98242

SEQ ID NO: 628199 - RNA, 64 nt, Homo Sapiens; identical to SEQ ID NO: 98243

SEQ ID NO: 628200 - RNA, 64 nt, Homo Sapiens; identical to SEQ ID NO: 98244

SEQ ID NO: 628201 - RNA, 64 nt, Homo Sapiens; identical to SEQ ID NO: 98245

SEQ ID NO: 628202 - RNA, 64 nt, Homo Sapiens; identical to SEQ ID NO: 98246

SEQ ID NO: 628203 - RNA, 64 nt, Homo Sapiens; identical to SEQ ID NO: 98247

SEQ ID NO: 628204 - RNA, 64 nt, Homo Sapiens; identical to SEQ ID NO: 98248

SEQ ID NO: 628205 - RNA, 64 nt, Homo Sapiens; identical to SEQ ID NO: 98249

SEQ ID NO: 628206 - RNA, 64 nt, Homo Sapiens; identical to SEQ ID NO: 98250

SEQ ID NO: 628207 - RNA, 64 nt, Homo Sapiens; identical to SEQ ID NO: 98251

SEQ ID NO: 628208 - RNA, 64 nt, Homo Sapiens; identical to SEQ ID NO: 98252

SEQ ID NO: 628209 - RNA, 64 nt, Homo Sapiens; identical to SEQ ID NO: 98253

SEQ ID NO: 628210 - RNA, 64 nt, Homo Sapiens; identical to SEQ ID NO: 98254

SEQ ID NO: 628211 - RNA, 64 nt, Homo Sapiens; identical to SEQ ID NO: 98255

SEQ ID NO: 628212 - RNA, 64 nt, Homo Sapiens; identical to SEQ ID NO: 98256

SEQ ID NO: 628213 - RNA, 64 nt, Homo Sapiens; identical to SEQ ID NO: 98257

SEQ ID NO: 628214 - RNA, 64 nt, Homo Sapiens; identical to SEQ ID NO: 98258

SEQ ID NO: 628215 - RNA, 64 nt, Homo Sapiens; identical to SEQ ID NO: 98259

SEQ ID NO: 628216 - RNA, 64 nt, Homo Sapiens; identical to SEQ ID NO: 98260

SEQ ID NO: 628217 - RNA, 64 nt, Homo Sapiens; identical to SEQ ID NO: 98261

SEQ ID NO: 628218 - RNA, 64 nt, Homo Sapiens; identical to SEQ ID NO: 98262

SEQ ID NO: 628219 - RNA, 64 nt, Homo Sapiens; identical to SEQ ID NO: 98263

SEQ ID NO: 628220 - RNA, 64 nt, Homo Sapiens; identical to SEQ ID NO: 98264

SEQ ID NO: 628221 - RNA, 63 nt, Homo Sapiens
gaauaagagauacaaggucuguguaaagauuugagggaagaauccuucucuuaagcaaucagu

SEQ ID NO: 628222 - RNA, 63 nt, Homo Sapiens
aacagcaaggauggggcaucuggaggaaucagaagggaagaucugugaagaaaucauaacacu

SEQ ID NO: 628223 - RNA, 63 nt, Homo Sapiens
uuaaaaaguaagugcucagaaagaaaggggagaagggaagaggauagucaugaaaagaaaggg

SEQ ID NO: 628224 - RNA, 63 nt, Homo Sapiens
ggggagaagggaagagguuagucaugaaaagaaagggaagaaaagcaaguuuaggagagaaua

SEQ ID NO: 628225 - RNA, 63 nt, Homo Sapiens
gggcugagguuggaggccuacuaauuucccuguagggaagacucccagcacuucuggaacugu

SEQ ID NO: 628226 - RNA, 63 nt, Homo Sapiens
agcugacccguguaugugcagaugcaguuccgaagggaagaacaguccucgggugauucagag

SEQ ID NO: 628227 - RNA, 63 nt, Homo Sapiens
cacaguucucuggaugcccagacaccucucuucagggaagaugagucugacugguuugcccca

SEQ ID NO: 628228 - RNA, 63 nt, Homo Sapiens
cuucagggaagaugagucugacugguuugccccagggaagagcauauccuuaccauuauuuua

SEQ ID NO: 628229 - RNA, 63 nt, Homo Sapiens
ugcaggggagacuggggccccuaucaaucaaucagggaagaaaaguggcagcccagccaccuc

SEQ ID NO: 628230 - RNA, 63 nt, Homo Sapiens
auaguuaauaacgucucucaucccgguagcuucagggaagaucgaagacacugaccuuuccca

SEQ ID NO: 628231 - RNA, 63 nt, Homo Sapiens
ccugucggguuuuuagcacagagcggggagggcagggaagaugggauugcagaagacgagcgg

SEQ ID NO: 628232 - RNA, 63 nt, Homo Sapiens
agaaggaaagauuuuguuguggucucugaacccagggaagacacagcagagaaguuuucugga

SEQ ID NO: 628233 - RNA, 63 nt, Homo Sapiens
ucucucugaaagcagaaaaaggcacugauauaaagggaagagaaggaggcucaccggagggaa

SEQ ID NO: 628234 - RNA, 63 nt, Homo Sapiens
cugauauaaagggaagagaaggaggcucaccggagggaagagaacauagugaagauucccgcc

SEQ ID NO: 628235 - RNA, 63 nt, Homo Sapiens
uagaagggaaccauggguccuaauuuauaaaggagggaagagguagaguaaauggacuugccu

SEQ ID NO: 628236 - RNA, 63 nt, Homo Sapiens
aaugacacagcuugagcguuaguccgggucuacagggaagaacucugcaaccuaacguuuaau

SEQ ID NO: 628237 - RNA, 63 nt, Homo Sapiens
uuagugguaaagagugaauggugauuagacagcagggaagauaagacaggagggaagauauua

SEQ ID NO: 628238 - RNA, 63 nt, Homo Sapiens
uuagugauuagacagcaggggugauuagacaggagggaagauaagacaggaaggaagacauua

SEQ ID NO: 628239 - RNA, 63 nt, Homo Sapiens
aaagacuuauuuugaaaguuggaaggagaagggagggaagagagcagaagggaagaaggugua

SEQ ID NO: 628240 - RNA, 63 nt, Homo Sapiens
aaguuggaaggagaagggagggaagagagcagaagggaagaagguguaagucaagcucuugaa

SEQ ID NO: 628241 - RNA, 63 nt, Homo Sapiens
ucagggacagggaccaggaugaggaggagcccuagggaagaagccucugagugagaugcccag

SEQ ID NO: 628242 - RNA, 63 nt, Homo Sapiens
gaggcugaagaauugacggcgagagggcaauagagggaagacucacuucuucccuauguccag

SEQ ID NO: 628243 - RNA, 63 nt, Homo Sapiens
gaaucgggcucacgaaugccuuccccuaagguuagggaagaaaucccuccguucugcuucagc

SEQ ID NO: 628244 - RNA, 63 nt, Homo Sapiens
ccuauacuugguuugcuaccaauugcucccaucagggaagaacaaacccggaagaucagaugc

SEQ ID NO: 628245 - RNA, 63 nt, Homo Sapiens
uuaugccuuuucuuuucuguugacagcuuggaaagggaagaucaggagcugcuuguuguuugu

SEQ ID NO: 628246 - RNA, 63 nt, Homo Sapiens
uagguuugaauugcuuuuuuggaggaggaagaaagggaagaauagaagcaggcggguugggug

SEQ ID NO: 628247 - RNA, 63 nt, Homo Sapiens
uagguuugaauugcuuuuuaggaggaggaagaaagggaagaauagaagcaggcggguugggug

SEQ ID NO: 628248 - RNA, 63 nt, Homo Sapiens
uugguuugguuuaugugucaugccgcagcagccagggaagacccaacuuagagcaauaacggc

SEQ ID NO: 628249 - RNA, 63 nt, Homo Sapiens
cuaggccuuagcuugcccucucugggagguuggagggaagaauuguggcucccuccuucccug

SEQ ID NO: 628250 - RNA, 63 nt, Homo Sapiens
ugaggaaggcccaccccuggacugaaaaucaagagggaagagggaggggacuggaaagcugag

SEQ ID NO: 628251 - RNA, 63 nt, Homo Sapiens
cgggaggagucauggggauggccucugggguguagggaagagguuguggccucugggcuguau

SEQ ID NO: 628252 - RNA, 63 nt, Homo Sapiens
acagggauuuccccucucuacccugaaaugggcagggaagaaacaguacaucuuuuguaaaaa

SEQ ID NO: 628253 - RNA, 63 nt, Homo Sapiens
ucaaagguuuauugcuuagccauaugaaaaauaagggaagauuuuuuagcaaggggacccaca

SEQ ID NO: 628254 - RNA, 63 nt, Homo Sapiens
gcagcucugggggcccuuuccacuucuggcuauagggaagaaccugaauacugaacuugauuc

SEQ ID NO: 628255 - RNA, 63 nt, Homo Sapiens
aaaacguuuaugauauuaagaucaaagggaggaagggaagacagcaguauuaauucacccuag

SEQ ID NO: 628256 - RNA, 63 nt, Homo Sapiens
augcugcauacuugccuaguagcaaaacaauacagggaagagucaaaagggcuucuccaacug

SEQ ID NO: 628257 - RNA, 63 nt, Homo Sapiens
uccagguuauaaccugguaccagcagacuuugcagggaagaaagaguuguuccaaucauguaa

SEQ ID NO: 628258 - RNA, 63 nt, Homo Sapiens
aucauguaaccuucuguaggggauuacugagacagggaagagaagugcaagaauugguugcug

SEQ ID NO: 628259 - RNA, 63 nt, Homo Sapiens
uuucuccccucccgcuaguaucuuuacaggagcagggaagagcaguagaggauguauaauuuu

SEQ ID NO: 628260 - RNA, 63 nt, Homo Sapiens
aggcuaaauaggaguuacagaaaacuguuaaauagggaagaacuacauuaaauuuaaauauuc

SEQ ID NO: 628261 - RNA, 63 nt, Homo Sapiens
gaggugcccuucacucuaagcuuaacacuuaguagggaagagauucucaaaugagaaaaaggg

SEQ ID NO: 628262 - RNA, 63 nt, Homo Sapiens
agaaaaagggcuccggcuauaugggcaacaaagagggaagauacagguugccaguuauacauu

SEQ ID NO: 628263 - RNA, 63 nt, Homo Sapiens
agacuguugaagcucucaauagguggcaguuuuagggaagauuuccauucaguguagggaaga

SEQ ID NO: 628264 - RNA, 63 nt, Homo Sapiens
guggcaguuuuagggaagauuuccauucaguguagggaagacauuuguaauaaugaaaacuga

SEQ ID NO: 628265 - RNA, 63 nt, Homo Sapiens
cccccagcuuguuugccaugaacugauuccuggagggaagaccauuccuguuacaaaugaaaa

SEQ ID NO: 628266 - RNA, 63 nt, Homo Sapiens
ugcauacaugcggggaccccagacugucagcacagggaagauggaucccauccuaauuuuuau

SEQ ID NO: 628267 - RNA, 63 nt, Homo Sapiens
agcaccuuuuugacagugaacauggucuaaaaaagggaagauauuguagaagauuucacacac

SEQ ID NO: 628268 - RNA, 63 nt, Homo Sapiens
aguguggcugaugguagccucuaguuugaagugagggaagaaugaguagucaggaacugguca

SEQ ID NO: 628269 - RNA, 63 nt, Homo Sapiens
gaguagucaggaacuggucacuuugaaugugggagggaagauauucacgacaagguuuucuac

SEQ ID NO: 628270 - RNA, 63 nt, Homo Sapiens
uaggaugggaaagcuaacaaaauaacaaauagaagggaagagaauucaccaugaaaaaacaag

SEQ ID NO: 628271 - RNA, 63 nt, Homo Sapiens
gagcugaauuuguagcauacuguagggggagguagggaagaauuuucugucaaacaaugaggu

SEQ ID NO: 628272 - RNA, 63 nt, Homo Sapiens
aaaaaacaauuccaaaugugaaacuagaaugagagggaagagauagcauggcaugcagcacac

SEQ ID NO: 628273 - RNA, 63 nt, Homo Sapiens
uucgugacaauguacgccuuucccucagaauucagggaagagacugucgccugccuuccuccg

SEQ ID NO: 628274 - RNA, 63 nt, Homo Sapiens
ugugcaggagccuucauuucagcuucaauuaauagggaagaauuuaugauagcucuauagaug

SEQ ID NO: 628275 - RNA, 63 nt, Homo Sapiens
cuaccucacaguguccauacaaauuaguuccagagggaagauauaccacaaaauuacucaaaa

SEQ ID NO: 628276 - RNA, 63 nt, Homo Sapiens
gaggaaugcuggacuggaggccccacccaaucaagggaagaagccuggcugcccaucaugugg

SEQ ID NO: 628277 - RNA, 63 nt, Homo Sapiens
aucaacgccucacugaaacaagguugggacaccagggaagaagggcuguaacguggcacuggu

SEQ ID NO: 628278 - RNA, 63 nt, Homo Sapiens
ccugucggguuuuuagcacaguggggggagggcagggaagauguagaggauugcagaagacga

SEQ ID NO: 628279 - RNA, 63 nt, Homo Sapiens
acugggccugaccuaccugaggggucugucgggagggaagagacuucggugcuucccgggccc

SEQ ID NO: 628280 - RNA, 63 nt, Homo Sapiens
uucacaccauaacuagguaacaguuugauaacuagggaagaaagcagaacaguuaagcagccg

SEQ ID NO: 628281 - RNA, 63 nt, Homo Sapiens
ggccaccugcaggucacugaaacuucaagcaccagggaagaucuaacauuugagucccuucca

SEQ ID NO: 628282 - RNA, 63 nt, Homo Sapiens
ucaaaaucuguagagcagggcaaguaacauggaagggaagaaaaggugaaaaauuagaaaugu

SEQ ID NO: 628283 - RNA, 63 nt, Homo Sapiens
agccugugugcagggaaagaguuagaggccuuuagggaagaaauggucccuaucuuccagcag

SEQ ID NO: 628284 - RNA, 63 nt, Homo Sapiens
gcuguaggggagcaugguuucuucuguaacuguagggaagaaacuuacgaggauuucuggaag

SEQ ID NO: 628285 - RNA, 63 nt, Homo Sapiens
gaagagucuauuaugagcuguucagggaagagaagggaagagaauggggagugagaugaguaa

SEQ ID NO: 628286 - RNA, 63 nt, Homo Sapiens
agggaagagagaagagucuaagaugaguaauucagggaagagagacauacaagauggggagug

SEQ ID NO: 628287 - RNA, 63 nt, Homo Sapiens
guaaaauuuuuuuagaagagauggcuuauuaacagggaagaagcuuguuauauuccaguugua

SEQ ID NO: 628288 - RNA, 63 nt, Homo Sapiens
agaauagccuuaguguuuagauuuuuuuaugauagggaagaugcggccaucacugggauauuu

SEQ ID NO: 628289 - RNA, 63 nt, Homo Sapiens
uccuaauggaggcgccuccacucuggguggaagagggaagagagccacugacugggggcagag

SEQ ID NO: 628290 - RNA, 63 nt, Homo Sapiens
cacagcagggccaccauuccuaagcgugaucggagggaagacaggugggaccauggugcucuu

SEQ ID NO: 628291 - RNA, 63 nt, Homo Sapiens
gacuuugauacuaccagggucucucagggauggagggaagaccugaaagagaggacugguucu

SEQ ID NO: 628292 - RNA, 63 nt, Homo Sapiens
cccuguuacuuauguagaaacugaggcccagagagggaagaugaccugccccaaguggugagc

SEQ ID NO: 628293 - RNA, 63 nt, Homo Sapiens
auaauccuagacuggaagaguagaauaucauauagggaagaaaccuuaaacaccacaguguuc

SEQ ID NO: 628294 - RNA, 63 nt, Homo Sapiens
gaaucaggcagucgcccacuucucuccagaugaagggaagacauucauaggucccaaaucugc

SEQ ID NO: 628295 - RNA, 63 nt, Homo Sapiens
agaaagcaaaggaacagaagggcagaaggaaggagggaagaaagggagaagaaggaagggaag

SEQ ID NO: 628296 - RNA, 63 nt, Homo Sapiens
gcagagaaaagcaaggagagucaccuggccuccagggaagaauuuuccugucaguuggacccc

SEQ ID NO: 628297 - RNA, 64 nt, Homo Sapiens; identical to SEQ ID NO: 98228

SEQ ID NO: 628298 - RNA, 64 nt, Homo Sapiens; identical to SEQ ID NO: 98229

SEQ ID NO: 628299 - RNA, 64 nt, Homo Sapiens; identical to SEQ ID NO: 98230

SEQ ID NO: 628300 - RNA, 64 nt, Homo Sapiens; identical to SEQ ID NO: 98231

SEQ ID NO: 628301 - RNA, 64 nt, Homo Sapiens; identical to SEQ ID NO: 98232

SEQ ID NO: 628302 - RNA, 64 nt, Homo Sapiens; identical to SEQ ID NO: 98233

SEQ ID NO: 628303 - RNA, 64 nt, Homo Sapiens; identical to SEQ ID NO: 98234

SEQ ID NO: 628304 - RNA, 64 nt, Homo Sapiens; identical to SEQ ID NO: 98235

SEQ ID NO: 628305 - RNA, 64 nt, Homo Sapiens; identical to SEQ ID NO: 98236

SEQ ID NO: 628306 - RNA, 64 nt, Homo Sapiens; identical to SEQ ID NO: 98237

SEQ ID NO: 628307 - RNA, 64 nt, Homo Sapiens; identical to SEQ ID NO: 98238

SEQ ID NO: 628308 - RNA, 64 nt, Homo Sapiens; identical to SEQ ID NO: 98239

SEQ ID NO: 628309 - RNA, 64 nt, Homo Sapiens; identical to SEQ ID NO: 98240

SEQ ID NO: 628310 - RNA, 64 nt, Homo Sapiens; identical to SEQ ID NO: 98241

SEQ ID NO: 628311 - RNA, 64 nt, Homo Sapiens; identical to SEQ ID NO: 98242

SEQ ID NO: 628312 - RNA, 64 nt, Homo Sapiens; identical to SEQ ID NO: 98243

SEQ ID NO: 628313 - RNA, 64 nt, Homo Sapiens; identical to SEQ ID NO: 98244

SEQ ID NO: 628314 - RNA, 64 nt, Homo Sapiens; identical to SEQ ID NO: 98245

SEQ ID NO: 628315 - RNA, 64 nt, Homo Sapiens; identical to SEQ ID NO: 98246

SEQ ID NO: 628316 - RNA, 64 nt, Homo Sapiens; identical to SEQ ID NO: 98247

SEQ ID NO: 628317 - RNA, 64 nt, Homo Sapiens; identical to SEQ ID NO: 98248

SEQ ID NO: 628318 - RNA, 64 nt, Homo Sapiens; identical to SEQ ID NO: 98249

SEQ ID NO: 628319 - RNA, 64 nt, Homo Sapiens; identical to SEQ ID NO: 98250

SEQ ID NO: 628320 - RNA, 64 nt, Homo Sapiens; identical to SEQ ID NO: 98251

SEQ ID NO: 628321 - RNA, 64 nt, Homo Sapiens; identical to SEQ ID NO: 98252

SEQ ID NO: 628322 - RNA, 64 nt, Homo Sapiens; identical to SEQ ID NO: 98253

SEQ ID NO: 628323 - RNA, 64 nt, Homo Sapiens; identical to SEQ ID NO: 98254

SEQ ID NO: 628324 - RNA, 64 nt, Homo Sapiens; identical to SEQ ID NO: 98255

SEQ ID NO: 628325 - RNA, 64 nt, Homo Sapiens; identical to SEQ ID NO: 98256

SEQ ID NO: 628326 - RNA, 64 nt, Homo Sapiens; identical to SEQ ID NO: 98257

SEQ ID NO: 628327 - RNA, 64 nt, Homo Sapiens; identical to SEQ ID NO: 98258

SEQ ID NO: 628328 - RNA, 64 nt, Homo Sapiens; identical to SEQ ID NO: 98259

SEQ ID NO: 628329 - RNA, 64 nt, Homo Sapiens; identical to SEQ ID NO: 98260

SEQ ID NO: 628330 - RNA, 64 nt, Homo Sapiens; identical to SEQ ID NO: 98261

SEQ ID NO: 628331 - RNA, 64 nt, Homo Sapiens; identical to SEQ ID NO: 98262

SEQ ID NO: 628332 - RNA, 64 nt, Homo Sapiens; identical to SEQ ID NO: 98263

SEQ ID NO: 628333 - RNA, 64 nt, Homo Sapiens; identical to SEQ ID NO: 98264

SEQ ID NO: 628334 - RNA, 63 nt, Homo Sapiens; identical to SEQ ID NO: 628221

SEQ ID NO: 628335 - RNA, 63 nt, Homo Sapiens; identical to SEQ ID NO: 628222

SEQ ID NO: 628336 - RNA, 63 nt, Homo Sapiens; identical to SEQ ID NO: 628223

SEQ ID NO: 628337 - RNA, 63 nt, Homo Sapiens; identical to SEQ ID NO: 628224

SEQ ID NO: 628338 - RNA, 63 nt, Homo Sapiens; identical to SEQ ID NO: 628225

SEQ ID NO: 628339 - RNA, 63 nt, Homo Sapiens; identical to SEQ ID NO: 628226

SEQ ID NO: 628340 - RNA, 63 nt, Homo Sapiens; identical to SEQ ID NO: 628227

SEQ ID NO: 628341 - RNA, 63 nt, Homo Sapiens; identical to SEQ ID NO: 628228

SEQ ID NO: 628342 - RNA, 63 nt, Homo Sapiens; identical to SEQ ID NO: 628229

SEQ ID NO: 628343 - RNA, 63 nt, Homo Sapiens; identical to SEQ ID NO: 628230

SEQ ID NO: 628344 - RNA, 63 nt, Homo Sapiens; identical to SEQ ID NO: 628231

SEQ ID NO: 628345 - RNA, 63 nt, Homo Sapiens; identical to SEQ ID NO: 628232

SEQ ID NO: 628346 - RNA, 63 nt, Homo Sapiens; identical to SEQ ID NO: 628233

SEQ ID NO: 628347 - RNA, 63 nt, Homo Sapiens; identical to SEQ ID NO: 628234

SEQ ID NO: 628348 - RNA, 63 nt, Homo Sapiens; identical to SEQ ID NO: 628235

SEQ ID NO: 628349 - RNA, 63 nt, Homo Sapiens; identical to SEQ ID NO: 628236

SEQ ID NO: 628350 - RNA, 63 nt, Homo Sapiens; identical to SEQ ID NO: 628237

SEQ ID NO: 628351 - RNA, 63 nt, Homo Sapiens; identical to SEQ ID NO: 628238

SEQ ID NO: 628352 - RNA, 63 nt, Homo Sapiens; identical to SEQ ID NO: 628239

SEQ ID NO: 628353 - RNA, 63 nt, Homo Sapiens; identical to SEQ ID NO: 628240

SEQ ID NO: 628354 - RNA, 63 nt, Homo Sapiens; identical to SEQ ID NO: 628241

SEQ ID NO: 628355 - RNA, 63 nt, Homo Sapiens; identical to SEQ ID NO: 628242

SEQ ID NO: 628356 - RNA, 63 nt, Homo Sapiens; identical to SEQ ID NO: 628243

SEQ ID NO: 628357 - RNA, 63 nt, Homo Sapiens; identical to SEQ ID NO: 628244

SEQ ID NO: 628358 - RNA, 63 nt, Homo Sapiens; identical to SEQ ID NO: 628245

SEQ ID NO: 628359 - RNA, 63 nt, Homo Sapiens; identical to SEQ ID NO: 628246

SEQ ID NO: 628360 - RNA, 63 nt, Homo Sapiens; identical to SEQ ID NO: 628247

SEQ ID NO: 628361 - RNA, 63 nt, Homo Sapiens; identical to SEQ ID NO: 628248

SEQ ID NO: 628362 - RNA, 63 nt, Homo Sapiens; identical to SEQ ID NO: 628249

SEQ ID NO: 628363 - RNA, 63 nt, Homo Sapiens; identical to SEQ ID NO: 628250

SEQ ID NO: 628364 - RNA, 63 nt, Homo Sapiens; identical to SEQ ID NO: 628251

SEQ ID NO: 628365 - RNA, 63 nt, Homo Sapiens; identical to SEQ ID NO: 628252

SEQ ID NO: 628366 - RNA, 63 nt, Homo Sapiens; identical to SEQ ID NO: 628253

SEQ ID NO: 628367 - RNA, 63 nt, Homo Sapiens; identical to SEQ ID NO: 628254

SEQ ID NO: 628368 - RNA, 63 nt, Homo Sapiens; identical to SEQ ID NO: 628255

SEQ ID NO: 628369 - RNA, 63 nt, Homo Sapiens; identical to SEQ ID NO: 628256

SEQ ID NO: 628370 - RNA, 63 nt, Homo Sapiens; identical to SEQ ID NO: 628257

SEQ ID NO: 628371 - RNA, 63 nt, Homo Sapiens; identical to SEQ ID NO: 628258

SEQ ID NO: 628372 - RNA, 63 nt, Homo Sapiens; identical to SEQ ID NO: 628259

SEQ ID NO: 628373 - RNA, 63 nt, Homo Sapiens; identical to SEQ ID NO: 628260

SEQ ID NO: 628374 - RNA, 63 nt, Homo Sapiens; identical to SEQ ID NO: 628261

SEQ ID NO: 628375 - RNA, 63 nt, Homo Sapiens; identical to SEQ ID NO: 628262

SEQ ID NO: 628376 - RNA, 63 nt, Homo Sapiens; identical to SEQ ID NO: 628263

SEQ ID NO: 628377 - RNA, 63 nt, Homo Sapiens; identical to SEQ ID NO: 628264

SEQ ID NO: 628378 - RNA, 63 nt, Homo Sapiens; identical to SEQ ID NO: 628265

SEQ ID NO: 628379 - RNA, 63 nt, Homo Sapiens; identical to SEQ ID NO: 628266

SEQ ID NO: 628380 - RNA, 63 nt, Homo Sapiens; identical to SEQ ID NO: 628267

SEQ ID NO: 628381 - RNA, 63 nt, Homo Sapiens; identical to SEQ ID NO: 628268

SEQ ID NO: 628382 - RNA, 63 nt, Homo Sapiens; identical to SEQ ID NO: 628269

SEQ ID NO: 628383 - RNA, 63 nt, Homo Sapiens; identical to SEQ ID NO: 628270

SEQ ID NO: 628384 - RNA, 63 nt, Homo Sapiens; identical to SEQ ID NO: 628271

SEQ ID NO: 628385 - RNA, 63 nt, Homo Sapiens; identical to SEQ ID NO: 628272

SEQ ID NO: 628386 - RNA, 63 nt, Homo Sapiens; identical to SEQ ID NO: 628273

SEQ ID NO: 628387 - RNA, 63 nt, Homo Sapiens; identical to SEQ ID NO: 628274

SEQ ID NO: 628388 - RNA, 63 nt, Homo Sapiens; identical to SEQ ID NO: 628275

SEQ ID NO: 628389 - RNA, 63 nt, Homo Sapiens; identical to SEQ ID NO: 628276

SEQ ID NO: 628390 - RNA, 63 nt, Homo Sapiens; identical to SEQ ID NO: 628277

SEQ ID NO: 628391 - RNA, 63 nt, Homo Sapiens; identical to SEQ ID NO: 628278

SEQ ID NO: 628392 - RNA, 63 nt, Homo Sapiens; identical to SEQ ID NO: 628279

SEQ ID NO: 628393 - RNA, 63 nt, Homo Sapiens; identical to SEQ ID NO: 628280

SEQ ID NO: 628394 - RNA, 63 nt, Homo Sapiens; identical to SEQ ID NO: 628281

SEQ ID NO: 628395 - RNA, 63 nt, Homo Sapiens; identical to SEQ ID NO: 628282

SEQ ID NO: 628396 - RNA, 63 nt, Homo Sapiens; identical to SEQ ID NO: 628283

SEQ ID NO: 628397 - RNA, 63 nt, Homo Sapiens; identical to SEQ ID NO: 628284

SEQ ID NO: 628398 - RNA, 63 nt, Homo Sapiens; identical to SEQ ID NO: 628285

SEQ ID NO: 628399 - RNA, 63 nt, Homo Sapiens; identical to SEQ ID NO: 628286

SEQ ID NO: 628400 - RNA, 63 nt, Homo Sapiens; identical to SEQ ID NO: 628287

SEQ ID NO: 628401 - RNA, 63 nt, Homo Sapiens; identical to SEQ ID NO: 628288

SEQ ID NO: 628402 - RNA, 63 nt, Homo Sapiens; identical to SEQ ID NO: 628289

SEQ ID NO: 628403 - RNA, 63 nt, Homo Sapiens; identical to SEQ ID NO: 628290

SEQ ID NO: 628404 - RNA, 63 nt, Homo Sapiens; identical to SEQ ID NO: 628291

SEQ ID NO: 628405 - RNA, 63 nt, Homo Sapiens; identical to SEQ ID NO: 628292

SEQ ID NO: 628406 - RNA, 63 nt, Homo Sapiens; identical to SEQ ID NO: 628293

SEQ ID NO: 628407 - RNA, 63 nt, Homo Sapiens; identical to SEQ ID NO: 628294

SEQ ID NO: 628408 - RNA, 63 nt, Homo Sapiens; identical to SEQ ID NO: 628295

SEQ ID NO: 628409 - RNA, 63 nt, Homo Sapiens; identical to SEQ ID NO: 628296

SEQ ID NO: 628410 - RNA, 64 nt, Homo Sapiens
ggcaucuccaccugacuucacuuccauccagggccacuggcagcaucuggaacggcugaauucc

SEQ ID NO: 628411 - RNA, 64 nt, Homo Sapiens
agccuuccaaguaacugggacuacaggugugcaucacuggcagugggaauuguggcuuguggcu

SEQ ID NO: 628412 - RNA, 64 nt, Homo Sapiens
aacaaagccaacagucaaaaaaguucuggcugaacacuggcaacuugaaaaaaaaguuucagag

SEQ ID NO: 628413 - RNA, 64 nt, Homo Sapiens
gaaaaauucucagucaguaaaguuuucaguugaucacuggcaauacaauuccaaaggaaucucc

SEQ ID NO: 628414 - RNA, 56 nt, Homo Sapiens
gccccaagaagaagcugugaccugcccacuggcacacagcuggcacuggcacacac

SEQ ID NO: 628415 - RNA, 64 nt, Homo Sapiens
agaagcugugaccugcccacuggcacacagcuggcacuggcacacaccugucccaugcccaccc

SEQ ID NO: 628416 - RNA, 64 nt, Homo Sapiens
agggagggcagccuucugccaccugugucgccuccacuggcagucacgccaccagagccacccu

SEQ ID NO: 628417 - RNA, 64 nt, Homo Sapiens
cuagacggccaccugcaggaccccacacucacugcacuggcagcgugcacuggcguauuuguaa

SEQ ID NO: 628418 - RNA, 64 nt, Homo Sapiens
ucuggacgcguuuuguuggcugggcuucuggaggcacuggcaaggucaaacugcauuucuuuaa

SEQ ID NO: 628419 - RNA, 64 nt, Homo Sapiens
ggguuuuggggaagccaguuagcugcugcuuuggcacuggcauggaggugagcagucaaggaug

SEQ ID NO: 628420 - RNA, 60 nt, Homo Sapiens
gggcagggugggauggggaagaccaggagcagagucgagccucacagaagccagcgcggg

SEQ ID NO: 628421 - RNA, 60 nt, Homo Sapiens
ucagccuaaacguuucaucaagaacacuacagagucgauacugugaguuuccaaccucag

SEQ ID NO: 628422 - RNA, 60 nt, Homo Sapiens
ccucugaggucugugcuugauuuccaaagaagagucgagucuccuccuuuggcauccauu

SEQ ID NO: 628423 - RNA, 60 nt, Homo Sapiens
ucuucucuucccuaaccaauaacuuaccugagagucgaauuuuaagaggagucucuucuc

SEQ ID NO: 628424 - RNA, 60 nt, Homo Sapiens
gaggaaccagcucucugguuguggcugugcagagucgagguugcaaucuuuaaacuuuca

SEQ ID NO: 628425 - RNA, 60 nt, Homo Sapiens
aaauauucucucuaguuaaaaaugauuuaaagagucgacuauacaaaaaucaaucaccac

SEQ ID NO: 628426 - RNA, 60 nt, Homo Sapiens
ugcugugccaguugcucuggucaaaaguggagagucgaaagaacaaugaucuucccauaa

SEQ ID NO: 628427 - RNA, 60 nt, Homo Sapiens
uggggaggaacagagggcuggguuccggccagagucgaugaggagaacaguaagauggau

SEQ ID NO: 628428 - RNA, 60 nt, Homo Sapiens
cacugccacuguccuguggcucggggaaggagagucgaugcuguucccgcugcacggccc

SEQ ID NO: 628429 - RNA, 60 nt, Homo Sapiens
uggacucuuuaaguuuuaccacugaaaaccagagucgauuuuucuccuaaauuuuuggca

SEQ ID NO: 628430 - RNA, 60 nt, Homo Sapiens
guccccaguagucacuuuaggaguugggacagagucgagcacccugugaaagucucccuu

SEQ ID NO: 628431 - RNA, 60 nt, Homo Sapiens
uuuggauacauuucaagugccugaggcuucagagucgaagccccaugacugcccauguuu

SEQ ID NO: 628432 - RNA, 60 nt, Homo Sapiens
cggcagagcaaggggcgcggccgccgugcaagagucgagcaacagcccccuccucaccgc

SEQ ID NO: 628433 - RNA, 60 nt, Homo Sapiens
uacauaagcuguguauacaccguucuguggagagucgauuaucuugguggucuacacacc

SEQ ID NO: 628434 - RNA, 60 nt, Homo Sapiens
cuagaucucaucugucauccagcaguucccagagucgaauaugaggaaaccaaggcaugg

SEQ ID NO: 628435 - RNA, 60 nt, Homo Sapiens
gacaguggggacauuguggguuuggggcucagagucgagggacgggguguagccucggca

SEQ ID NO: 628436 - RNA, 60 nt, Homo Sapiens
uauagguagaucucuuuaguuggggucuucagagucgauaauaguaauaguguauggcau

SEQ ID NO: 628437 - RNA, 60 nt, Homo Sapiens
acucauuuccaaggcccuaaauacaguaaaagagucgaacccgcuacggaacaaagauga

SEQ ID NO: 628438 - RNA, 60 nt, Homo Sapiens
cacagguggauccacggcuuuccagugcggagagucgagaugcucccugcagcccaggcc

SEQ ID NO: 628439 - RNA, 60 nt, Homo Sapiens
ugacccuaaaguuaguguggugcuccaagcagagucgacaucauggaaugaaccaaaucu

SEQ ID NO: 628440 - RNA, 60 nt, Homo Sapiens
uggggcacacacacaccugggagaccaccgagagucgagcauuccuucugcugcagccug

SEQ ID NO: 628441 - RNA, 60 nt, Homo Sapiens
uguguguuaggcccucauauagggaaggggagagucgagauuuuuuuuugagggaucaga

SEQ ID NO: 628442 - RNA, 60 nt, Homo Sapiens
cgaguggaauuugaguccuaaagaaauaaaagagucgaugcaugguccgugagucagugc

SEQ ID NO: 628443 - RNA, 60 nt, Homo Sapiens
cagcaugcaaaaaauaauaaccagauauuuagagucgaagaaccaaaaagacagggaaaa

SEQ ID NO: 628444 - RNA, 60 nt, Homo Sapiens
ccccuggugcucucugcccccccaaucugcagagucgagaaacaggaauccucugcaaag

SEQ ID NO: 628445 - RNA, 60 nt, Homo Sapiens
agcccccugugcccacccagggcccggcacagagucgaugcucaauaaauguguguugac

SEQ ID NO: 628446 - RNA, 60 nt, Homo Sapiens
auuuccaguguucuaugaacaaacucuugaagagucgauuuugguguugucauuguaaac

SEQ ID NO: 628447 - RNA, 60 nt, Homo Sapiens
ggccugacauugcuuuugcucugcaacagcagagucgagucauugcaacaaagagcauau

SEQ ID NO: 628448 - RNA, 60 nt, Homo Sapiens
gguuauauacucccacuucauacauuaccaagagucgaucacugauuuaaaauuuuuaau

SEQ ID NO: 628449 - RNA, 60 nt, Homo Sapiens
gcaggaggggguuuugggugugggagggagagagucgaugagccacgucaugucuucuuu

SEQ ID NO: 628450 - RNA, 60 nt, Homo Sapiens
caauuuaucagaaauuauuucguauguuaaagagucgaaagacuauagcaucacucaguc

SEQ ID NO: 628451 - RNA, 60 nt, Homo Sapiens
ucuggacucaguuuccccgucugagaaaugagagucgaaugcuacaguaucugcagucgc

SEQ ID NO: 628452 - RNA, 60 nt, Homo Sapiens
ccugaaagagaaaccauuucuuuugauaaaagagucgaugacugagcaggauggauuuuc

SEQ ID NO: 628453 - RNA, 60 nt, Homo Sapiens
aucaccaagcaggaaagggauugggucagaagagucgaugugguuuagcaggucaccuag

SEQ ID NO: 628454 - RNA, 60 nt, Homo Sapiens
gauauggcuuguagggugaguggccugagaagagucgagugcuacgacuugggacggaag

SEQ ID NO: 628455 - RNA, 60 nt, Homo Sapiens
ggauucugucaguucaaaaauggguaaaugagagucgacucugaaagcaagauuauccag

SEQ ID NO: 628456 - RNA, 64 nt, Homo Sapiens
aaaagcagggacugccacugcauuucauaucacacuguuaaaaguuguguuuugaaauuuuaug

SEQ ID NO: 628457 - RNA, 64 nt, Homo Sapiens
auugcucauuuuuuaaaaaauggacucuugaaaucuguuaaaauaaaauuguacauuuggagau

SEQ ID NO: 628458 - RNA, 64 nt, Homo Sapiens
aaagagaaaaagagagggaugcaaaaaauauuuccuguuaaaaguuucacugccaugacacuag

SEQ ID NO: 628459 - RNA, 64 nt, Homo Sapiens
guauuauagaccuauucauguauauuguaaagagcuguuaaaaagcugguuuuauaagugaccg

SEQ ID NO: 628460 - RNA, 64 nt, Homo Sapiens
gguuaguaggaugaaaacagugauaaauuguguucuguuaaagagaaguuuaagcuuugugcuc

SEQ ID NO: 628461 - RNA, 64 nt, Homo Sapiens
uuaaaauaaaugauucuauugcuuuauuuuaccucuguuaaaaauuaucccuuuggauaaguau

SEQ ID NO: 628462 - RNA, 64 nt, Homo Sapiens
auauuuauuuuucuuguaaaaaccacauugaagucuguuaaaagccucagcuagcuugcuguua

SEQ ID NO: 628463 - RNA, 64 nt, Homo Sapiens
acauugaagucuguuaaaagccucagcuagcuugcuguuaaaccaauaacaacaaaauacaacu

SEQ ID NO: 628464 - RNA, 64 nt, Homo Sapiens
auuguauugaauucuuuuuauguaguuuuauguacuguuaaagacugccauuuucuuuugcaau

SEQ ID NO: 628465 - RNA, 64 nt, Homo Sapiens
auuguacugaauucuuuuuauuuaguuuuauguacuguuaaagaguuucauuuucuuuugcaau

SEQ ID NO: 628466 - RNA, 64 nt, Homo Sapiens
aaauuaaaguuugucuauuuuuaaauuaauauuccuguuaaaggugauggcuuauggaaggcug

SEQ ID NO: 628467 - RNA, 64 nt, Homo Sapiens
aauauuccuguuaaaggaaauggcuuauggaaggcuguuaaauuuuaugcuuacaaaaugguga

SEQ ID NO: 628468 - RNA, 64 nt, Homo Sapiens
uaaaguuuuuuauauaugaauauuacauguaaagcuguuaaaauacauaacuucagugcaagag

SEQ ID NO: 628469 - RNA, 64 nt, Homo Sapiens
ggccauuuguuacaguuucuucaugcauuacuuacuguuaaaacuguaccuuuugcgauuucac

SEQ ID NO: 628470 - RNA, 64 nt, Homo Sapiens
caucccaucuucugccuccaguuggagcuuucagcuguuaaaacagucagaaacuauugauucu

SEQ ID NO: 628471 - RNA, 64 nt, Homo Sapiens
ugugacauucgguccaggagagaaagagcaguuucuguuaaagauguaacaaauggauuuccaa

SEQ ID NO: 628472 - RNA, 64 nt, Homo Sapiens
gcauuuuaacaagaugcccaggugaucugcaugccuguuaaagucugagcucuguugcagauaa

SEQ ID NO: 628473 - RNA, 64 nt, Homo Sapiens
uccucauacuugcuggcaucccucaucugguggucuguuaaagcacagauugcugggccgcacc

SEQ ID NO: 628474 - RNA, 64 nt, Homo Sapiens
auuuuguacuacguggcuuuguacaugugaugcucuguuaaaacauaaguggguaugaaggucc

SEQ ID NO: 628475 - RNA, 64 nt, Homo Sapiens
caauauuuucauuuucgcaguauaauaauugcaccuguuaaauaaaguuuuguaaacauuuaau

SEQ ID NO: 628476 - RNA, 64 nt, Homo Sapiens
uuauauaaaauaauccuuuaauauccaaaugaaucuguuaaaauguuugauuccuugggaaugg

SEQ ID NO: 628477 - RNA, 64 nt, Homo Sapiens
ggguuaagcauggacagccagagcuuucuauguacuguuaaaauugaggucacauauuuucuuu

SEQ ID NO: 628478 - RNA, 64 nt, Homo Sapiens
cagucugcuagaacuuuaaaaugaaggacaaauccuguuaaagaaauauuguuaaaaaucuuua

SEQ ID NO: 628479 - RNA, 64 nt, Homo Sapiens
ucagaagcaguaggaauggccguauacaaccauccuguuaaacauuuaaauuuagcucugauag

SEQ ID NO: 628480 - RNA, 64 nt, Homo Sapiens
cuuuuuuuaauggcagcuaaagauauacagauuacuguuaaauugcaguccuuuuuuuuuuaaa

SEQ ID NO: 628481 - RNA, 64 nt, Homo Sapiens
aaaagacuggugaaucuuuuauuacaaaauguuucuguuaaaaugggaucaucaucuuugaaag

SEQ ID NO: 628482 - RNA, 64 nt, Homo Sapiens
ugccuuugcuagugcaguguauuuuuucaaggugcuguuaaaagaaagucauguugucguuuac

SEQ ID NO: 628483 - RNA, 64 nt, Homo Sapiens
cgaacaaggagaauuuucaaugaaauacuugauucuguuaaaaugcagaggugcuauaacauuc

SEQ ID NO: 628484 - RNA, 64 nt, Homo Sapiens
aaaugccauucugcagaauugaaguccaugcugucuguuaaauacacugauaauggauauguau

SEQ ID NO: 628485 - RNA, 64 nt, Homo Sapiens
gugaucaaaccauggcaucacaauuacacaaaugcuguuaaaauccacaacaacuguccuuucu

SEQ ID NO: 628486 - RNA, 64 nt, Homo Sapiens
uacuaugccaucauccaccacauuuucuuuuuagcuguuaaaugguaauaauuauucacaugug

SEQ ID NO: 628487 - RNA, 64 nt, Homo Sapiens
cauuugcaaagcacucagcuaauucaauacacuacuguuaaaauauggaauaauagacauaauu

SEQ ID NO: 628488 - RNA, 64 nt, Homo Sapiens
gaaaaggcaaucuaugacuccccaggccaggagacuguuaaaguggcaccaagaccccaaaggg

SEQ ID NO: 628489 - RNA, 64 nt, Homo Sapiens
aauuuugacaaauaaguuacccaaaguuuuaaaccuguuaaauuuugcccucugcaguugaucu

SEQ ID NO: 628490 - RNA, 64 nt, Homo Sapiens
ucuuuuauuuuacuguuuucuuuuuagaaacccacuguuaaaauuuaaaaaggugcuuuaaaau

SEQ ID NO: 628491 - RNA, 64 nt, Homo Sapiens
auuuuggcccuuacgaaauacgucuuuuucagaacuguuaaaguuuugauguacaucgagcuga

SEQ ID NO: 628492 - RNA, 64 nt, Homo Sapiens
gaaaauuaaauauuacugaagauuucgacuuccacuguuaaauguacaagauacaugaaauauu

SEQ ID NO: 628493 - RNA, 64 nt, Homo Sapiens
ccaguuuaccaauacaugaguaacugaaguguaacuguuaaaugcuuguauacuaguuuuucuu

SEQ ID NO: 628494 - RNA, 64 nt, Homo Sapiens
auuuuuaucuguuugccaccaauaauauuuuucucuguuaaacaaacaucauucugaacccuga

SEQ ID NO: 628495 - RNA, 64 nt, Homo Sapiens
gauugauuugcuuuuauaguacuguguucuuguucuguuaaaaguuaaugugguagcaccugua

SEQ ID NO: 628496 - RNA, 64 nt, Homo Sapiens
gggagacaaaggggugguggagaaucucuaugcccuguuaaaugcugcaugaguggacgucaga

SEQ ID NO: 628497 - RNA, 64 nt, Homo Sapiens
guaacaagcaauaaacaacugugucguauuuugccuguuaaaucuuguagguauuacaucccug

SEQ ID NO: 628498 - RNA, 64 nt, Homo Sapiens
ugaugucaggucaacauuuuauuuauuaauacuucuguuaaauugagucuaacauaugguccca

SEQ ID NO: 628499 - RNA, 64 nt, Homo Sapiens
gugcuuaccaauacuguguuaaaagaaaagcauacuguuaaaaugccauaucuccuuucccuac

SEQ ID NO: 628500 - RNA, 64 nt, Homo Sapiens
gccuaaaugaauauuuaugugcaaacauaggcaacuguuaaaggcuggaauuuucaaaagaucc

SEQ ID NO: 628501 - RNA, 64 nt, Homo Sapiens
uaaaagguguuuugguuauuuaauauaauaagagcuguuaaacuucuguuuaaauuuccaguuc

SEQ ID NO: 628502 - RNA, 64 nt, Homo Sapiens
aaauaccugauuucuugucaucgagauucuuguacuguuaaaugaauauugccuuuuacugcuc

SEQ ID NO: 628503 - RNA, 64 nt, Homo Sapiens
cuugguuccaugaaaaguaugcuuuguguuuuaacuguuaaaauaauuuaaaaauuaauuauuu

SEQ ID NO: 628504 - RNA, 64 nt, Homo Sapiens
cuaaaaaucaauauaauuuaaaggguuuuuucagcuguuaaaucuugccuccaguggaagcaga

SEQ ID NO: 628505 - RNA, 64 nt, Homo Sapiens
augacugaaaaaaaucaauccaucucaaagaagucuguuaaaucuauguaaauguuaaaaugag

SEQ ID NO: 628506 - RNA, 64 nt, Homo Sapiens
agcaggcuuuaauuuaauguagauucauacugcucuguuaaagcugcauugaaauguuaaaaug

SEQ ID NO: 628507 - RNA, 64 nt, Homo Sapiens
uauuuugggguagugugagcuuuuaauguuaagucuguuaaacuugagucaaauuaagcagacc

SEQ ID NO: 628508 - RNA, 64 nt, Homo Sapiens
auucuguaaaauauccuguacaaaacaagacuauugccaguaauguauacaaauugucuuuuug

SEQ ID NO: 628509 - RNA, 64 nt, Homo Sapiens
gcaaguuggcauuaacauuuaugcuuuaauuaaaugccaguauaccuaugugugcagcaguaaa

SEQ ID NO: 628510 - RNA, 64 nt, Homo Sapiens
augagcuccacagccacagcugguuaggggcggcugccaguagaacagggcagaugccuggacu

SEQ ID NO: 628511 - RNA, 64 nt, Homo Sapiens
uaaagguauaccaguuaaaguaguguguggcuggugccaguagaggucagucaagggaucccug

SEQ ID NO: 628512 - RNA, 64 nt, Homo Sapiens
acagcuauuaagugcuaccuccaggaccacuguccggcucuaaccugcuuggcugaccccacac

SEQ ID NO: 628513 - RNA, 64 nt, Homo Sapiens
cucacccuucuggccaggaugccugacggcuucucggcucuaccuccuguucuugggaagcguu

SEQ ID NO: 628514 - RNA, 64 nt, Homo Sapiens; identical to SEQ ID NO: 561075

SEQ ID NO: 628515 - RNA, 64 nt, Homo Sapiens; identical to SEQ ID NO: 561076

SEQ ID NO: 628516 - RNA, 64 nt, Homo Sapiens; identical to SEQ ID NO: 561077

SEQ ID NO: 628517 - RNA, 64 nt, Homo Sapiens; identical to SEQ ID NO: 561078

SEQ ID NO: 628518 - RNA, 64 nt, Homo Sapiens; identical to SEQ ID NO: 561079

SEQ ID NO: 628519 - RNA, 64 nt, Homo Sapiens; identical to SEQ ID NO: 561080

SEQ ID NO: 628520 - RNA, 64 nt, Homo Sapiens
cguccaccucagccucccaaagugcugggauuacaggugugagccaccacgcccggcuauguuu

SEQ ID NO: 628521 - RNA, 64 nt, Homo Sapiens
cuccugccucggccucccaaagugcugagacuacaggugugagccaccgugcucagccacuagc

SEQ ID NO: 628522 - RNA, 64 nt, Homo Sapiens
cacccgccucagcuucccaaagugcugggauuacaggugugagucacugcacccagccgaguug

SEQ ID NO: 628523 - RNA, 64 nt, Homo Sapiens
gccaaguuaacaaaucaacuuccauuuggauuguaggugugaaggcacaacucuaauugcuauu

SEQ ID NO: 628524 - RNA, 64 nt, Homo Sapiens
ugugugugacaagccaguucuacaggcauuaccuaggugugagacuaaaagcuuuucuuauuga

SEQ ID NO: 628525 - RNA, 64 nt, Homo Sapiens
gcuuuucuuauugacuuaaauuuggauaacagcaaggugugaggggggugguggguauggugug

SEQ ID NO: 628526 - RNA, 64 nt, Homo Sapiens
ccgcccgccuuggccuccaaagugcugggauuacaggugugagcuaccgcgcccggccuauuau

SEQ ID NO: 628527 - RNA, 64 nt, Homo Sapiens
ggccucagaaguaggacugaauucuacuauugcuaggugugagaaagugguggugagaaccuua

SEQ ID NO: 628528 - RNA, 64 nt, Homo Sapiens
uuaauguggaauuuuccagcaaaauguuuaacucaggugugauuuuugaaaaugucucuguaau

SEQ ID NO: 628529 - RNA, 64 nt, Homo Sapiens
cacccaccucagcgucccgaagugcugggauuacaggugugagccaccgcgccuggccugggcu

SEQ ID NO: 628530 - RNA, 64 nt, Homo Sapiens
caccugccuuggcuucccaaaguccugggauuacaggugugagccaccacauccagccuaacuu

SEQ ID NO: 628531 - RNA, 64 nt, Homo Sapiens
cccgccucgaccucucucaaagugcuggcauuacaggugugagccacggugcccggcccacaau

SEQ ID NO: 628532 - RNA, 64 nt, Homo Sapiens
cucccaccucagccucccgaauagcugggacuacaggugugagucaccaagcccaguuaaucuu

SEQ ID NO: 628533 - RNA, 64 nt, Homo Sapiens
cuccugccucagccucccaaagugcugggauuacaggugugaaccaccacacccagcccacuuc

SEQ ID NO: 628534 - RNA, 64 nt, Homo Sapiens
cucccaccucagccuccuaaagcacugggauuacaggugugaaccaccguacccagccuaucuu

SEQ ID NO: 628535 - RNA, 64 nt, Homo Sapiens
gcaaucaccuugaucuugggcuuucagcccccaaaggugugagaaaauaaacuucgguugauaa

SEQ ID NO: 628536 - RNA, 64 nt, Homo Sapiens
cgcugcgcucggccuucuuuagugcugggauuacaggugugagcugcccgccuuggccucccaa

SEQ ID NO: 628537 - RNA, 64 nt, Homo Sapiens
cuccacaccuggcuguuuucagugcugggauuacaggugugagccgcccaccucggccucccaa

SEQ ID NO: 628538 - RNA, 64 nt, Homo Sapiens
cucauggcucagccgccugaguagcugggauuacaggugugagccaacaagcccggcuaauuuu

SEQ ID NO: 628539 - RNA, 64 nt, Homo Sapiens
cgccugccucggccucccaaagugcugggauuacaggugugagcugccgcacccagccaagaaa

SEQ ID NO: 628540 - RNA, 64 nt, Homo Sapiens
auguuggccaggcuggucucgaacuccuggccucaggugugauccgcccgccuccgccucccca

SEQ ID NO: 628541 - RNA, 64 nt, Homo Sapiens
cgcccgccuccgccuccccaagcgcugagauuacaggugugagccaccgugcccagccccucag

SEQ ID NO: 628542 - RNA, 64 nt, Homo Sapiens
ugcgccugccucagccucccagugcugggauuauaggugugagccacugcgccuggcuaaguua

SEQ ID NO: 628543 - RNA, 64 nt, Homo Sapiens
caccugccuugaccucccaaagugcuaggauaacaggugugagccaccgcacccugccaaguua

SEQ ID NO: 628544 - RNA, 64 nt, Homo Sapiens
ccaccugcucuuuccucccuuuccuccccugccgaggugugaccgguguggccccaccuguucu

SEQ ID NO: 628545 - RNA, 64 nt, Homo Sapiens
ccgccugcucuuuccuccccgugugucccccugcaggugugacccaguggagggaggcugugcu

SEQ ID NO: 628546 - RNA, 64 nt, Homo Sapiens
cacugugcccagcaguuuccagugcugagauuacaggugugagccuccugucuuggccucccaa

SEQ ID NO: 628547 - RNA, 64 nt, Homo Sapiens
caccacacccagccucuguaagugcugggauuacaggugugagccacccgccuuggccucccaa

SEQ ID NO: 628548 - RNA, 64 nt, Homo Sapiens
ugucuaccucggccuccuaaagugcugagauuacaggugugagccaccgugcccggcccauucu

SEQ ID NO: 628549 - RNA, 64 nt, Homo Sapiens
gggcauauuaaaugaaagaauaucuaauugggggaggugugaagggaaagaaauucuuuucaaa

SEQ ID NO: 628550 - RNA, 64 nt, Homo Sapiens; identical to SEQ ID NO: 475408

SEQ ID NO: 628551 - RNA, 57 nt, Homo Sapiens; identical to SEQ ID NO: 475409

SEQ ID NO: 628552 - RNA, 64 nt, Homo Sapiens; identical to SEQ ID NO: 489215

SEQ ID NO: 628553 - RNA, 64 nt, Homo Sapiens; identical to SEQ ID NO: 489216

SEQ ID NO: 628554 - RNA, 64 nt, Homo Sapiens; identical to SEQ ID NO: 489217

SEQ ID NO: 628555 - RNA, 64 nt, Homo Sapiens; identical to SEQ ID NO: 489218

SEQ ID NO: 628556 - RNA, 64 nt, Homo Sapiens; identical to SEQ ID NO: 489219

SEQ ID NO: 628557 - RNA, 64 nt, Homo Sapiens; identical to SEQ ID NO: 489220

SEQ ID NO: 628558 - RNA, 64 nt, Homo Sapiens; identical to SEQ ID NO: 489221

SEQ ID NO: 628559 - RNA, 64 nt, Homo Sapiens; identical to SEQ ID NO: 489222

SEQ ID NO: 628560 - RNA, 64 nt, Homo Sapiens; identical to SEQ ID NO: 489223

SEQ ID NO: 628561 - RNA, 64 nt, Homo Sapiens; identical to SEQ ID NO: 489224

SEQ ID NO: 628562 - RNA, 64 nt, Homo Sapiens; identical to SEQ ID NO: 489225

SEQ ID NO: 628563 - RNA, 64 nt, Homo Sapiens; identical to SEQ ID NO: 489226

SEQ ID NO: 628564 - RNA, 64 nt, Homo Sapiens; identical to SEQ ID NO: 489227

SEQ ID NO: 628565 - RNA, 64 nt, Homo Sapiens; identical to SEQ ID NO: 489228

SEQ ID NO: 628566 - RNA, 64 nt, Homo Sapiens; identical to SEQ ID NO: 489229

SEQ ID NO: 628567 - RNA, 64 nt, Homo Sapiens; identical to SEQ ID NO: 489230

SEQ ID NO: 628568 - RNA, 64 nt, Homo Sapiens; identical to SEQ ID NO: 489231

SEQ ID NO: 628569 - RNA, 64 nt, Homo Sapiens; identical to SEQ ID NO: 489232

SEQ ID NO: 628570 - RNA, 64 nt, Homo Sapiens; identical to SEQ ID NO: 489233

SEQ ID NO: 628571 - RNA, 64 nt, Homo Sapiens; identical to SEQ ID NO: 489234

SEQ ID NO: 628572 - RNA, 64 nt, Homo Sapiens; identical to SEQ ID NO: 489235

SEQ ID NO: 628573 - RNA, 64 nt, Homo Sapiens; identical to SEQ ID NO: 489236

SEQ ID NO: 628574 - RNA, 64 nt, Homo Sapiens; identical to SEQ ID NO: 489237

SEQ ID NO: 628575 - RNA, 64 nt, Homo Sapiens; identical to SEQ ID NO: 489238

SEQ ID NO: 628576 - RNA, 64 nt, Homo Sapiens; identical to SEQ ID NO: 489239

SEQ ID NO: 628577 - RNA, 64 nt, Homo Sapiens; identical to SEQ ID NO: 489240

SEQ ID NO: 628578 - RNA, 64 nt, Homo Sapiens; identical to SEQ ID NO: 489241

SEQ ID NO: 628579 - RNA, 64 nt, Homo Sapiens; identical to SEQ ID NO: 489242

SEQ ID NO: 628580 - RNA, 64 nt, Homo Sapiens; identical to SEQ ID NO: 489243

SEQ ID NO: 628581 - RNA, 53 nt, Homo Sapiens; identical to SEQ ID NO: 489244

SEQ ID NO: 628582 - RNA, 64 nt, Homo Sapiens; identical to SEQ ID NO: 489245

SEQ ID NO: 628583 - RNA, 64 nt, Homo Sapiens; identical to SEQ ID NO: 489246

SEQ ID NO: 628584 - RNA, 64 nt, Homo Sapiens; identical to SEQ ID NO: 489247

SEQ ID NO: 628585 - RNA, 64 nt, Homo Sapiens; identical to SEQ ID NO: 489248

SEQ ID NO: 628586 - RNA, 64 nt, Homo Sapiens; identical to SEQ ID NO: 511888

SEQ ID NO: 628587 - RNA, 64 nt, Homo Sapiens; identical to SEQ ID NO: 511889

SEQ ID NO: 628588 - RNA, 64 nt, Homo Sapiens; identical to SEQ ID NO: 511890

SEQ ID NO: 628589 - RNA, 64 nt, Homo Sapiens; identical to SEQ ID NO: 511891

SEQ ID NO: 628590 - RNA, 64 nt, Homo Sapiens; identical to SEQ ID NO: 511892

SEQ ID NO: 628591 - RNA, 64 nt, Homo Sapiens; identical to SEQ ID NO: 511893

SEQ ID NO: 628592 - RNA, 64 nt, Homo Sapiens; identical to SEQ ID NO: 511894

SEQ ID NO: 628593 - RNA, 64 nt, Homo Sapiens; identical to SEQ ID NO: 511895

SEQ ID NO: 628594 - RNA, 64 nt, Homo Sapiens; identical to SEQ ID NO: 511896

SEQ ID NO: 628595 - RNA, 64 nt, Homo Sapiens; identical to SEQ ID NO: 511897

SEQ ID NO: 628596 - RNA, 64 nt, Homo Sapiens; identical to SEQ ID NO: 511898

SEQ ID NO: 628597 - RNA, 64 nt, Homo Sapiens; identical to SEQ ID NO: 511899

SEQ ID NO: 628598 - RNA, 64 nt, Homo Sapiens; identical to SEQ ID NO: 511900

SEQ ID NO: 628599 - RNA, 64 nt, Homo Sapiens; identical to SEQ ID NO: 511901

SEQ ID NO: 628600 - RNA, 64 nt, Homo Sapiens; identical to SEQ ID NO: 511902

SEQ ID NO: 628601 - RNA, 64 nt, Homo Sapiens; identical to SEQ ID NO: 410642

SEQ ID NO: 628602 - RNA, 64 nt, Homo Sapiens; identical to SEQ ID NO: 410643

SEQ ID NO: 628603 - RNA, 64 nt, Homo Sapiens; identical to SEQ ID NO: 410644

SEQ ID NO: 628604 - RNA, 64 nt, Homo Sapiens; identical to SEQ ID NO: 410645

SEQ ID NO: 628605 - RNA, 64 nt, Homo Sapiens; identical to SEQ ID NO: 410646

SEQ ID NO: 628606 - RNA, 64 nt, Homo Sapiens; identical to SEQ ID NO: 410647

SEQ ID NO: 628607 - RNA, 64 nt, Homo Sapiens; identical to SEQ ID NO: 410648

SEQ ID NO: 628608 - RNA, 64 nt, Homo Sapiens; identical to SEQ ID NO: 410649

SEQ ID NO: 628609 - RNA, 64 nt, Homo Sapiens; identical to SEQ ID NO: 410650

SEQ ID NO: 628610 - RNA, 64 nt, Homo Sapiens; identical to SEQ ID NO: 410651

SEQ ID NO: 628611 - RNA, 64 nt, Homo Sapiens; identical to SEQ ID NO: 410652

SEQ ID NO: 628612 - RNA, 64 nt, Homo Sapiens; identical to SEQ ID NO: 410653

SEQ ID NO: 628613 - RNA, 64 nt, Homo Sapiens; identical to SEQ ID NO: 410654

SEQ ID NO: 628614 - RNA, 64 nt, Homo Sapiens; identical to SEQ ID NO: 410655

SEQ ID NO: 628615 - RNA, 64 nt, Homo Sapiens; identical to SEQ ID NO: 410656

SEQ ID NO: 628616 - RNA, 64 nt, Homo Sapiens; identical to SEQ ID NO: 410657

SEQ ID NO: 628617 - RNA, 64 nt, Homo Sapiens; identical to SEQ ID NO: 410658

SEQ ID NO: 628618 - RNA, 64 nt, Homo Sapiens; identical to SEQ ID NO: 410659

SEQ ID NO: 628619 - RNA, 64 nt, Homo Sapiens; identical to SEQ ID NO: 410660

SEQ ID NO: 628620 - RNA, 64 nt, Homo Sapiens; identical to SEQ ID NO: 410661

SEQ ID NO: 628621 - RNA, 64 nt, Homo Sapiens; identical to SEQ ID NO: 410662

SEQ ID NO: 628622 - RNA, 64 nt, Homo Sapiens; identical to SEQ ID NO: 410663

SEQ ID NO: 628623 - RNA, 64 nt, Homo Sapiens; identical to SEQ ID NO: 410664

SEQ ID NO: 628624 - RNA, 64 nt, Homo Sapiens; identical to SEQ ID NO: 410665

SEQ ID NO: 628625 - RNA, 64 nt, Homo Sapiens; identical to SEQ ID NO: 410666

SEQ ID NO: 628626 - RNA, 64 nt, Homo Sapiens; identical to SEQ ID NO: 410667

SEQ ID NO: 628627 - RNA, 64 nt, Homo Sapiens; identical to SEQ ID NO: 410668

SEQ ID NO: 628628 - RNA, 64 nt, Homo Sapiens; identical to SEQ ID NO: 410669

SEQ ID NO: 628629 - RNA, 64 nt, Homo Sapiens; identical to SEQ ID NO: 410670

SEQ ID NO: 628630 - RNA, 64 nt, Homo Sapiens; identical to SEQ ID NO: 410671

SEQ ID NO: 628631 - RNA, 64 nt, Homo Sapiens; identical to SEQ ID NO: 410672

SEQ ID NO: 628632 - RNA, 64 nt, Homo Sapiens; identical to SEQ ID NO: 410673

SEQ ID NO: 628633 - RNA, 64 nt, Homo Sapiens; identical to SEQ ID NO: 410674

SEQ ID NO: 628634 - RNA, 64 nt, Homo Sapiens; identical to SEQ ID NO: 410675

SEQ ID NO: 628635 - RNA, 64 nt, Homo Sapiens; identical to SEQ ID NO: 410676

SEQ ID NO: 628636 - RNA, 64 nt, Homo Sapiens; identical to SEQ ID NO: 410677

SEQ ID NO: 628637 - RNA, 63 nt, Homo Sapiens
ucggcaugucugcagccuguucuccuagccugcugcuuggagucagguugagcaucagugaga

SEQ ID NO: 628638 - RNA, 63 nt, Homo Sapiens
uaaaaaaauaauugaaguguaagcuaaauaaaaugcuuggaguuuugccugggcuagugagag

SEQ ID NO: 628639 - RNA, 63 nt, Homo Sapiens
ucaggggaccuaggacaaauggagauagcacugugcuuggaguacaaggcagcuuggucuagu

SEQ ID NO: 628640 - RNA, 63 nt, Homo Sapiens
guggggguagaaauagacacuuaaaaaacaccaugcuuggaggguaagggaaaaauuaauuuu

SEQ ID NO: 628641 - RNA, 63 nt, Homo Sapiens
cucaagugaucuaccugccucugccucccgaagugcuuggauuacaggugugagccacugugu

SEQ ID NO: 628642 - RNA, 63 nt, Homo Sapiens
agugaauauacuuaauauauucuaguacagguaugcuuggaaauagggcguuuccuuuucaug

SEQ ID NO: 628643 - RNA, 63 nt, Homo Sapiens
agacuugggacugggacaguguuaaggcuguuuugcuuggagaaagguuuuuaaaacauggau

SEQ ID NO: 628644 - RNA, 63 nt, Homo Sapiens
aaaggacagcguggauaaaacacuaagcucaagugcuuggaugugccuaauuuuauaaaaagu

SEQ ID NO: 628645 - RNA, 63 nt, Homo Sapiens
aucugcuguaugucaacuuuaauauguaaggaaugcuuggaauuuaucuuuguaauuauuuuu

SEQ ID NO: 628646 - RNA, 63 nt, Homo Sapiens
ucgugcuuuaagugccuacaacaugugucaagcugcuuggaccucagagguggcucuggaaug

SEQ ID NO: 628647 - RNA, 63 nt, Homo Sapiens
aaagggugcauuucagggugauagggcgcuggcugcuuggagcguuugguaaaugccagguug

SEQ ID NO: 628648 - RNA, 63 nt, Homo Sapiens
uaggcccaggggcucugccaugggagggguggcugcuuggaaaagaggcaccucugcucuugu

SEQ ID NO: 628649 - RNA, 63 nt, Homo Sapiens
augaccauuuauuugccccuuucuccauccuguugcuuggaauguggaucugguagugagcca

SEQ ID NO: 628650 - RNA, 62 nt, Homo Sapiens
uuucucuugcuauuuauauauauaugauaaaaaugcuuggaagaguccuuuaauuuaugguu

SEQ ID NO: 628651 - RNA, 63 nt, Homo Sapiens
acagaaacgccugagagucacuuacccggccacugcuuggaagguuucccuccggggaaugcc

SEQ ID NO: 628652 - RNA, 63 nt, Homo Sapiens
ccggcuguggcugacaguggcucuggccaggguugcuuggagaaggcucagugugccugggac

SEQ ID NO: 628653 - RNA, 63 nt, Homo Sapiens
uugaaauuuacuguaacuguugauucaaauugcugcuuggauuuguguuuguuuuucaagaaa

SEQ ID NO: 628654 - RNA, 63 nt, Homo Sapiens
ugcauauuuauugcauugcucuuggucuuucugugcuuggauugugcgcccguggggucugcg

SEQ ID NO: 628655 - RNA, 63 nt, Homo Sapiens
cccuuuguagccauccaaugggcauugugugggugcuuggaacccgggaugacugagggggac

SEQ ID NO: 628656 - RNA, 63 nt, Homo Sapiens
gaccaggggucccggaggaacccauuugugcucugcuuggacagcaggccuggcacugggagg

SEQ ID NO: 628657 - RNA, 64 nt, Homo Sapiens
aaaaguaauuuugcauugcuuugaaauuugagcucauuugcaaacccgagucugccugggaacc

SEQ ID NO: 628658 - RNA, 64 nt, Homo Sapiens
aucauauguuuuuguuaaauuugcguuucaguuacauuugcauuuaagacaaguguucuauuua

SEQ ID NO: 628659 - RNA, 64 nt, Homo Sapiens
agaucacaaccucaagaugguuaaaauccauugacauuugcacuuucaaacaugacaagucucg

SEQ ID NO: 628660 - RNA, 64 nt, Homo Sapiens
ggcacuauuccuggaggguccagucauucaccagcauuugcaaauguccauagggagcaggugg

SEQ ID NO: 628661 - RNA, 64 nt, Homo Sapiens
gaagcuuguauuaucagugaauauaaauguacuacauuugcaugccuuuuggguuugccuuaau

SEQ ID NO: 628662 - RNA, 64 nt, Homo Sapiens
ugcaugccuuuuggguuugccuuaauucuuaccucauuugcauccuaucgaucuggaaagagcu

SEQ ID NO: 628663 - RNA, 64 nt, Homo Sapiens
aggacuugaccaucuuuccaaccccuggggaagacauuugcaacugacuuggggaggacacagc

SEQ ID NO: 628664 - RNA, 64 nt, Homo Sapiens
aauuguuucauuguuugacacuuaaugcacucgucauuugcauacgacaguagcauucugacca

SEQ ID NO: 628665 - RNA, 64 nt, Homo Sapiens
uuucccauuguuuuaacagcgcauuauauauuugcauuugcaaauaaaugugauagcugugcau

SEQ ID NO: 628666 - RNA, 64 nt, Homo Sapiens
uugacauuacuuuauuauacaaaccguacaguuucauuugcauuaaaugacuguacugaauuua

SEQ ID NO: 628667 - RNA, 64 nt, Homo Sapiens
caugauucuaagaacuggaagaaccuggugguuccauuugcaaaggcugugugugaaaugagua

SEQ ID NO: 628668 - RNA, 64 nt, Homo Sapiens
acacuggccugugauugguccauuccaggaccuucauuugcauaagguaucaaaccacaucagc

SEQ ID NO: 628669 - RNA, 64 nt, Homo Sapiens
acucuggccaaugauugguucauuccaggacauucauuugcauaaggagucaaaccacaccagu

SEQ ID NO: 628670 - RNA, 64 nt, Homo Sapiens
uagcuggaucaaguugggaggccuccaugcuccccauuugcaccggacaggugccauuuaaauu

SEQ ID NO: 628671 - RNA, 64 nt, Homo Sapiens
augguuuuuaaaauuuauuaguguauuuaucugccauuugcaucucuacuccaggcucuguuuu

SEQ ID NO: 628672 - RNA, 64 nt, Homo Sapiens
ccauuuuuacauuaauucgcgcauucuguagucgcauuugcacuugcaacgcugauuuuuuuuu

SEQ ID NO: 628673 - RNA, 64 nt, Homo Sapiens
uguagcaaacaagguaaugaugccuagcuguuuacauuugcaaaauuagagucaguucuggcuc

SEQ ID NO: 628674 - RNA, 64 nt, Homo Sapiens
ugucccauuauaggugcaaggcaccccauccacacauuugcaccacuacuccaagauaguauuu

SEQ ID NO: 628675 - RNA, 64 nt, Homo Sapiens
cagaggcugguuauaaauuugaacucccucagcccauuugcaacucugccucuguucucuugca

SEQ ID NO: 628676 - RNA, 64 nt, Homo Sapiens
ucggggugagaauaaaacacccccacauaacaugcauuugcaugggcccgaaccugugaaaugu

SEQ ID NO: 628677 - RNA, 64 nt, Homo Sapiens
gaggcugauacacaaggccucucuuccacaugaucauuugcaaaccucccccagccccuaccau

SEQ ID NO: 628678 - RNA, 64 nt, Homo Sapiens
uugcaauaaaacacauuuuagaucaccugcaauucauuugcaaacucaauuggcuuauuuuuua

SEQ ID NO: 628679 - RNA, 64 nt, Homo Sapiens
ucagagcaagagcucuuucuuuuguuuaucacgccauuugcaaagugagaugaucacgguuucu

SEQ ID NO: 628680 - RNA, 64 nt, Homo Sapiens
acaccuugagccuuaaaacggugcugcugggaaacauuugcacucuuuuagugcauuuccuccu

SEQ ID NO: 628681 - RNA, 64 nt, Homo Sapiens
aaugagagauugcaaauguaguguaucacugagucauuugcaguguuuucugccacagaccuuu

SEQ ID NO: 628682 - RNA, 64 nt, Homo Sapiens
acauuacucgcagguggugguuguaucacauuuucauuugcacggaguuaguccccauuaguuc

SEQ ID NO: 628683 - RNA, 64 nt, Homo Sapiens
ugcuaugcaauagucccucugccccaagucccuucauuugcaucuuucccuuucuuccugacua

SEQ ID NO: 628684 - RNA, 64 nt, Homo Sapiens
gacuauacacaugggguggaaggaaucucauuugcauuugcauauagaauauauuucuuauacu

SEQ ID NO: 628685 - RNA, 64 nt, Homo Sapiens
ugcauagacuauacacaugguauacuaggaaucucauuugcauuaaauguuagaauauauuucu

SEQ ID NO: 628686 - RNA, 64 nt, Homo Sapiens
cugugauaauccugggccuuugauuuuccuagugcauuugcauaaaaggggacuaaauagguaa

SEQ ID NO: 628687 - RNA, 64 nt, Homo Sapiens
auuucauuauuuuugccucuuccuauuaacuguacauuugcaaggaaguuaguguccacuaggg

SEQ ID NO: 628688 - RNA, 64 nt, Homo Sapiens
uauuucucccuaugauaaugcauuuuaaaaguuacauuugcaaaagccauuuaaauuauauccu

SEQ ID NO: 628689 - RNA, 64 nt, Homo Sapiens
ccuccauuucgccagcacaagaaacauuucuuuacauuugcauuaagggaacauguucggacug

SEQ ID NO: 628690 - RNA, 64 nt, Homo Sapiens
acaacuaagguggcugaagaccuuucuggcagggcauuugcaaggacccaaauccauucaacaa

SEQ ID NO: 628691 - RNA, 64 nt, Homo Sapiens
gggcgcuccaggucuggagcagguauaauuggagcauuugcacugagaccccugccagagagga

SEQ ID NO: 628692 - RNA, 61 nt, Homo Sapiens
aaggagaacagcuauauuguccuuucuauaagcuugucacugcaaaaaguugccuuuugcu

SEQ ID NO: 628693 - RNA, 61 nt, Homo Sapiens
auaagcuugucacugcaaaaaguugccuuuugcuugucagguuuggauagaauauaauuga

SEQ ID NO: 628694 - RNA, 64 nt, Homo Sapiens; identical to SEQ ID NO: 544158

SEQ ID NO: 628695 - RNA, 64 nt, Homo Sapiens; identical to SEQ ID NO: 544159

SEQ ID NO: 628696 - RNA, 64 nt, Homo Sapiens; identical to SEQ ID NO: 544160

SEQ ID NO: 628697 - RNA, 64 nt, Homo Sapiens; identical to SEQ ID NO: 544161

SEQ ID NO: 628698 - RNA, 64 nt, Homo Sapiens; identical to SEQ ID NO: 544162

SEQ ID NO: 628699 - RNA, 64 nt, Homo Sapiens; identical to SEQ ID NO: 544163

SEQ ID NO: 628700 - RNA, 64 nt, Homo Sapiens; identical to SEQ ID NO: 544164

SEQ ID NO: 628701 - RNA, 64 nt, Homo Sapiens; identical to SEQ ID NO: 544165

SEQ ID NO: 628702 - RNA, 64 nt, Homo Sapiens; identical to SEQ ID NO: 544166

SEQ ID NO: 628703 - RNA, 64 nt, Homo Sapiens; identical to SEQ ID NO: 544167

SEQ ID NO: 628704 - RNA, 64 nt, Homo Sapiens; identical to SEQ ID NO: 544168

SEQ ID NO: 628705 - RNA, 64 nt, Homo Sapiens; identical to SEQ ID NO: 544169

SEQ ID NO: 628706 - RNA, 64 nt, Homo Sapiens; identical to SEQ ID NO: 544170

SEQ ID NO: 628707 - RNA, 64 nt, Homo Sapiens; identical to SEQ ID NO: 544171

SEQ ID NO: 628708 - RNA, 64 nt, Homo Sapiens; identical to SEQ ID NO: 544172

SEQ ID NO: 628709 - RNA, 64 nt, Homo Sapiens; identical to SEQ ID NO: 544173

SEQ ID NO: 628710 - RNA, 64 nt, Homo Sapiens; identical to SEQ ID NO: 544174

SEQ ID NO: 628711 - RNA, 64 nt, Homo Sapiens; identical to SEQ ID NO: 544175

SEQ ID NO: 628712 - RNA, 64 nt, Homo Sapiens; identical to SEQ ID NO: 544176

SEQ ID NO: 628713 - RNA, 64 nt, Homo Sapiens; identical to SEQ ID NO: 544177

SEQ ID NO: 628714 - RNA, 64 nt, Homo Sapiens; identical to SEQ ID NO: 544178

SEQ ID NO: 628715 - RNA, 64 nt, Homo Sapiens; identical to SEQ ID NO: 544179

SEQ ID NO: 628716 - RNA, 64 nt, Homo Sapiens; identical to SEQ ID NO: 544180

SEQ ID NO: 628717 - RNA, 64 nt, Homo Sapiens; identical to SEQ ID NO: 544181

SEQ ID NO: 628718 - RNA, 64 nt, Homo Sapiens; identical to SEQ ID NO: 544182

SEQ ID NO: 628719 - RNA, 64 nt, Homo Sapiens; identical to SEQ ID NO: 544183

SEQ ID NO: 628720 - RNA, 64 nt, Homo Sapiens; identical to SEQ ID NO: 544184

SEQ ID NO: 628721 - RNA, 64 nt, Homo Sapiens; identical to SEQ ID NO: 544185

SEQ ID NO: 628722 - RNA, 64 nt, Homo Sapiens; identical to SEQ ID NO: 544186

SEQ ID NO: 628723 - RNA, 64 nt, Homo Sapiens; identical to SEQ ID NO: 544187

SEQ ID NO: 628724 - RNA, 64 nt, Homo Sapiens
uggcacagcaguaucccuuguuguauccuucugcccucgagaccguggcccuggugucucacac

SEQ ID NO: 628725 - RNA, 64 nt, Homo Sapiens
guucugaaggccaugacaccucaauaaauaugaaccucgagaaacaaggacucuaggucaaaug

SEQ ID NO: 628726 - RNA, 55 nt, Homo Sapiens
aaccccaacaaaguucuuaaaauauccucgagagagcugcuaucauguauuauau

SEQ ID NO: 628727 - RNA, 64 nt, Homo Sapiens
aaaaggugcugagggauuggacagcucugacuuuccucgagacuauggauauaguccuucucag

SEQ ID NO: 628728 - RNA, 64 nt, Homo Sapiens
cagcuggagccagcacccucugcccuucucugugcucuuagaccgguucuugaagccuguuccc

SEQ ID NO: 628729 - RNA, 64 nt, Homo Sapiens
caggugucucugcccccacaggaugucuguuugccucuuagagacagcuagggcagagggguca

SEQ ID NO: 628730 - RNA, 64 nt, Homo Sapiens
aagaaaaaagguuagggaagcuuuggauuuuaaccucuuagagguacaguugucagugaaacua

SEQ ID NO: 628731 - RNA, 64 nt, Homo Sapiens
gcccagaaagucuuugggcauugauccacuguugcucuuagaaguguugauggggguuaccagc

SEQ ID NO: 628732 - RNA, 64 nt, Homo Sapiens
uaaaaguagaagaaagacagcugaaccucuuagacucuuagaaaccuguguguuccuaccuuuu

SEQ ID NO: 628733 - RNA, 64 nt, Homo Sapiens
cuuagaaauaaaaguagaaguaccuuuucugaaccucuuagacuugaccuccccuguguguucc

SEQ ID NO: 628734 - RNA, 64 nt, Homo Sapiens
auauuaccccuucauguccuaaagaagacauuuucucuuagagauuuucauuuuaguguaucuu

SEQ ID NO: 628735 - RNA, 64 nt, Homo Sapiens
acaggguuacuguauacugaaggucugacaguagcucuuagacucgccuaucuuagguagucau

SEQ ID NO: 628736 - RNA, 64 nt, Homo Sapiens; identical to SEQ ID NO: 532114

SEQ ID NO: 628737 - RNA, 64 nt, Homo Sapiens; identical to SEQ ID NO: 532115

SEQ ID NO: 628738 - RNA, 64 nt, Homo Sapiens; identical to SEQ ID NO: 532116

SEQ ID NO: 628739 - RNA, 64 nt, Homo Sapiens; identical to SEQ ID NO: 532117

SEQ ID NO: 628740 - RNA, 64 nt, Homo Sapiens; identical to SEQ ID NO: 532118

SEQ ID NO: 628741 - RNA, 64 nt, Homo Sapiens; identical to SEQ ID NO: 532119

SEQ ID NO: 628742 - RNA, 64 nt, Homo Sapiens; identical to SEQ ID NO: 532120

SEQ ID NO: 628743 - RNA, 64 nt, Homo Sapiens; identical to SEQ ID NO: 532121

SEQ ID NO: 628744 - RNA, 64 nt, Homo Sapiens; identical to SEQ ID NO: 532122

SEQ ID NO: 628745 - RNA, 64 nt, Homo Sapiens; identical to SEQ ID NO: 532123

SEQ ID NO: 628746 - RNA, 64 nt, Homo Sapiens; identical to SEQ ID NO: 532124

SEQ ID NO: 628747 - RNA, 64 nt, Homo Sapiens; identical to SEQ ID NO: 532125

SEQ ID NO: 628748 - RNA, 64 nt, Homo Sapiens; identical to SEQ ID NO: 532126

SEQ ID NO: 628749 - RNA, 64 nt, Homo Sapiens; identical to SEQ ID NO: 532127

SEQ ID NO: 628750 - RNA, 64 nt, Homo Sapiens; identical to SEQ ID NO: 532128

SEQ ID NO: 628751 - RNA, 64 nt, Homo Sapiens; identical to SEQ ID NO: 532129

SEQ ID NO: 628752 - RNA, 64 nt, Homo Sapiens; identical to SEQ ID NO: 532130

SEQ ID NO: 628753 - RNA, 64 nt, Homo Sapiens; identical to SEQ ID NO: 532131

SEQ ID NO: 628754 - RNA, 64 nt, Homo Sapiens; identical to SEQ ID NO: 532132

SEQ ID NO: 628755 - RNA, 64 nt, Homo Sapiens; identical to SEQ ID NO: 532133

SEQ ID NO: 628756 - RNA, 64 nt, Homo Sapiens; identical to SEQ ID NO: 532134

SEQ ID NO: 628757 - RNA, 64 nt, Homo Sapiens; identical to SEQ ID NO: 532135

SEQ ID NO: 628758 - RNA, 64 nt, Homo Sapiens; identical to SEQ ID NO: 532136

SEQ ID NO: 628759 - RNA, 64 nt, Homo Sapiens; identical to SEQ ID NO: 532137

SEQ ID NO: 628760 - RNA, 64 nt, Homo Sapiens; identical to SEQ ID NO: 532138

SEQ ID NO: 628761 - RNA, 64 nt, Homo Sapiens; identical to SEQ ID NO: 532139

SEQ ID NO: 628762 - RNA, 64 nt, Homo Sapiens; identical to SEQ ID NO: 532140

SEQ ID NO: 628763 - RNA, 64 nt, Homo Sapiens; identical to SEQ ID NO: 532141

SEQ ID NO: 628764 - RNA, 64 nt, Homo Sapiens; identical to SEQ ID NO: 532142

SEQ ID NO: 628765 - RNA, 64 nt, Homo Sapiens; identical to SEQ ID NO: 532143

SEQ ID NO: 628766 - RNA, 64 nt, Homo Sapiens; identical to SEQ ID NO: 532144

SEQ ID NO: 628767 - RNA, 64 nt, Homo Sapiens; identical to SEQ ID NO: 532145

SEQ ID NO: 628768 - RNA, 64 nt, Homo Sapiens; identical to SEQ ID NO: 532146

SEQ ID NO: 628769 - RNA, 64 nt, Homo Sapiens; identical to SEQ ID NO: 532147

SEQ ID NO: 628770 - RNA, 64 nt, Homo Sapiens; identical to SEQ ID NO: 532148

SEQ ID NO: 628771 - RNA, 64 nt, Homo Sapiens; identical to SEQ ID NO: 532149

SEQ ID NO: 628772 - RNA, 64 nt, Homo Sapiens; identical to SEQ ID NO: 532150

SEQ ID NO: 628773 - RNA, 64 nt, Homo Sapiens; identical to SEQ ID NO: 532151

SEQ ID NO: 628774 - RNA, 64 nt, Homo Sapiens; identical to SEQ ID NO: 532152

SEQ ID NO: 628775 - RNA, 64 nt, Homo Sapiens; identical to SEQ ID NO: 532153

SEQ ID NO: 628776 - RNA, 64 nt, Homo Sapiens; identical to SEQ ID NO: 532154

SEQ ID NO: 628777 - RNA, 64 nt, Homo Sapiens; identical to SEQ ID NO: 532155

SEQ ID NO: 628778 - RNA, 64 nt, Homo Sapiens; identical to SEQ ID NO: 532156

SEQ ID NO: 628779 - RNA, 64 nt, Homo Sapiens; identical to SEQ ID NO: 532157

SEQ ID NO: 628780 - RNA, 64 nt, Homo Sapiens; identical to SEQ ID NO: 532158

SEQ ID NO: 628781 - RNA, 64 nt, Homo Sapiens; identical to SEQ ID NO: 532159

SEQ ID NO: 628782 - RNA, 64 nt, Homo Sapiens; identical to SEQ ID NO: 532160

SEQ ID NO: 628783 - RNA, 64 nt, Homo Sapiens; identical to SEQ ID NO: 532161

SEQ ID NO: 628784 - RNA, 64 nt, Homo Sapiens; identical to SEQ ID NO: 532162

SEQ ID NO: 628785 - RNA, 64 nt, Homo Sapiens; identical to SEQ ID NO: 532163

SEQ ID NO: 628786 - RNA, 64 nt, Homo Sapiens
aacugcaaaaagcuagguaagcuauuuuguugcagcucauaagguggugaaaaggacucuccug

SEQ ID NO: 628787 - RNA, 64 nt, Homo Sapiens
auaggcaaggacaacaugugcuuuuuggugagcugcucauaauuccugaaauguguggugccag

SEQ ID NO: 628788 - RNA, 64 nt, Homo Sapiens
guuaacugugcguuaaauaagcaaauaaacaguggcucauaaaaauaaaagucgcauuccauau

SEQ ID NO: 628789 - RNA, 64 nt, Homo Sapiens
cuuuggaugggccuuuuagaaaccucauuggccagcucauaaaauggaagcaauugcucauguu

SEQ ID NO: 628790 - RNA, 64 nt, Homo Sapiens
cgcguggcccagauaagaauagguguuccuuugugcucauaaaacagaaugcggcgaugguugc

SEQ ID NO: 628791 - RNA, 64 nt, Homo Sapiens
agggcugugcuacacuucccaguuacauucugaagcucauaaauguaugagaagguuugugauu

SEQ ID NO: 628792 - RNA, 64 nt, Homo Sapiens
uguucuaagaauuccauuugccucuaugaucuuagcucauaaaaauauaauaugacuugauaaa

SEQ ID NO: 628793 - RNA, 64 nt, Homo Sapiens
gcugaaguuauaaguuuaaaacucaauuucagaugcucauaaaaguuacuuagcuaaaauuuua

SEQ ID NO: 628794 - RNA, 64 nt, Homo Sapiens
ggagauauuuuuuuuucuuaagagaacuuaaagaacuggugauuuuuuuuuaacaaaaaaaggg

SEQ ID NO: 628795 - RNA, 64 nt, Homo Sapiens
ucgcggucuccggggugccugggagggccgaaccacuggugagggcguggggagcagggggugg

SEQ ID NO: 628796 - RNA, 64 nt, Homo Sapiens
gggaacuagccacacaggaggccgggagacagggacuggugagaauggggcugaguggaggagg

SEQ ID NO: 628797 - RNA, 64 nt, Homo Sapiens
ccuaaucccuggcucaggguuauugccaguggagacuggugagcugggccuacucucagcugcc

SEQ ID NO: 628798 - RNA, 64 nt, Homo Sapiens
cuucaacuuuuucugcacacacgagguauuuuauacuggugagaaaccuuacaauguaaagaau

SEQ ID NO: 628799 - RNA, 64 nt, Homo Sapiens
uugacaacaccucgaacuuucuaacauaaaucauacuggugaaaaauccuagaaaugugaaaaa

SEQ ID NO: 628800 - RNA, 64 nt, Homo Sapiens
acacauacaucagacuauguguuucagccagaagacuggugaaaaugcguaaaagaaauugccu

SEQ ID NO: 628801 - RNA, 64 nt, Homo Sapiens
ccagggugcagaagggauucccaugcauggcuggacuggugauuagggccugcuuuccccagcu

SEQ ID NO: 628802 - RNA, 64 nt, Homo Sapiens
aacccuaugaauguaaugaaaucaaagaauuccuacuggugagagagggcgcaucuuacucaac

SEQ ID NO: 628803 - RNA, 64 nt, Homo Sapiens
aacccuuugaaugucaggaaaccagagaauucacacuggugagauugauuguucaacucuuaac

SEQ ID NO: 628804 - RNA, 64 nt, Homo Sapiens
aacccuaugaguuuaaggaaaucaaaauauucauacuggugagagagagcccaucuuagucaac

SEQ ID NO: 628805 - RNA, 64 nt, Homo Sapiens
aacccuaugaauguaaagauaucagacaauucacacuggugacagcuuucaaacuugaauaaac

SEQ ID NO: 628806 - RNA, 64 nt, Homo Sapiens
guauauauuuuauauauauauuacagaagaguaaacuggugagauguuuauucucugcugcauc

SEQ ID NO: 628807 - RNA, 64 nt, Homo Sapiens
uugaaauaugcauacuaauugaaaaguauugguuacuggugaugauugaaacuuuuuucauuuu

SEQ ID NO: 628808 - RNA, 64 nt, Homo Sapiens
ugcacugugauaccuaccagucuccagggacuaugacccuaaaccagggccugcggcacuugcg

SEQ ID NO: 628809 - RNA, 64 nt, Homo Sapiens
caccaagaugccuucuaaaggcugacauaccuuggacccuaauggggcagagaguauagcccua

SEQ ID NO: 628810 - RNA, 64 nt, Homo Sapiens
ucacucggaaucaaaggugccaauuccaaaucaagacccuaaugauuucucccaagcaaaucag

SEQ ID NO: 628811 - RNA, 64 nt, Homo Sapiens
agcugccgaagcagccacuggaaagaacccuggggacccuaauguuggacucucggcgcgacac

SEQ ID NO: 628812 - RNA, 64 nt, Homo Sapiens; identical to SEQ ID NO: 107011

SEQ ID NO: 628813 - RNA, 64 nt, Homo Sapiens; identical to SEQ ID NO: 107012

SEQ ID NO: 628814 - RNA, 64 nt, Homo Sapiens; identical to SEQ ID NO: 107013

SEQ ID NO: 628815 - RNA, 64 nt, Homo Sapiens; identical to SEQ ID NO: 107014

SEQ ID NO: 628816 - RNA, 64 nt, Homo Sapiens; identical to SEQ ID NO: 107015

SEQ ID NO: 628817 - RNA, 64 nt, Homo Sapiens; identical to SEQ ID NO: 107016

SEQ ID NO: 628818 - RNA, 64 nt, Homo Sapiens; identical to SEQ ID NO: 107017

SEQ ID NO: 628819 - RNA, 64 nt, Homo Sapiens; identical to SEQ ID NO: 107018

SEQ ID NO: 628820 - RNA, 64 nt, Homo Sapiens; identical to SEQ ID NO: 107019

SEQ ID NO: 628821 - RNA, 64 nt, Homo Sapiens; identical to SEQ ID NO: 107020

SEQ ID NO: 628822 - RNA, 64 nt, Homo Sapiens; identical to SEQ ID NO: 107021

SEQ ID NO: 628823 - RNA, 64 nt, Homo Sapiens; identical to SEQ ID NO: 107022

SEQ ID NO: 628824 - RNA, 64 nt, Homo Sapiens; identical to SEQ ID NO: 107023

SEQ ID NO: 628825 - RNA, 64 nt, Homo Sapiens; identical to SEQ ID NO: 107024

SEQ ID NO: 628826 - RNA, 64 nt, Homo Sapiens; identical to SEQ ID NO: 107025

SEQ ID NO: 628827 - RNA, 64 nt, Homo Sapiens; identical to SEQ ID NO: 107026

SEQ ID NO: 628828 - RNA, 64 nt, Homo Sapiens; identical to SEQ ID NO: 107027

SEQ ID NO: 628829 - RNA, 64 nt, Homo Sapiens; identical to SEQ ID NO: 107028

SEQ ID NO: 628830 - RNA, 64 nt, Homo Sapiens; identical to SEQ ID NO: 107029

SEQ ID NO: 628831 - RNA, 64 nt, Homo Sapiens; identical to SEQ ID NO: 107030

SEQ ID NO: 628832 - RNA, 64 nt, Homo Sapiens; identical to SEQ ID NO: 107031

SEQ ID NO: 628833 - RNA, 64 nt, Homo Sapiens; identical to SEQ ID NO: 107032

SEQ ID NO: 628834 - RNA, 64 nt, Homo Sapiens; identical to SEQ ID NO: 436956

SEQ ID NO: 628835 - RNA, 64 nt, Homo Sapiens; identical to SEQ ID NO: 436957

SEQ ID NO: 628836 - RNA, 63 nt, Homo Sapiens
aggaaacuuugaaggguuaaauagagauuuaaaaaaauaaaauaaaaaggcugggcuagggug

SEQ ID NO: 628837 - RNA, 63 nt, Homo Sapiens
acuuugaaggguuaaauagagauuuaaaaaaauaaaauaaaaaggcugggcuagggugcuuuu

SEQ ID NO: 628838 - RNA, 63 nt, Homo Sapiens
uauuuguguucuaacaggaggaugaacuugcugaaaauaaaacuuugcuauguauuuacucuu

SEQ ID NO: 628839 - RNA, 63 nt, Homo Sapiens
gcaccaguauauugcuggcagcuauuguauuaaaaaauaaaguauauuuucacuaucauaaag

SEQ ID NO: 628840 - RNA, 63 nt, Homo Sapiens
aguuacuguuguuuacagugaguuuggggaaaaaaaauaaaauaaaaauggcuuucccagucc

SEQ ID NO: 628841 - RNA, 63 nt, Homo Sapiens
cuguuguuuacagugaguuuggggaaaaaaaauaaaauaaaaauggcuuucccaguccuugca

SEQ ID NO: 628842 - RNA, 63 nt, Homo Sapiens
augcuaucagaaacaguauuuucuucccaaaucaaaauaaaagaaauaugaucagagcuugaa

SEQ ID NO: 628843 - RNA, 63 nt, Homo Sapiens
auaugaucagagcuugaacacaggcuuauuuuuaaaauaaaaauauuuuuaacauggguuucc

SEQ ID NO: 628844 - RNA, 63 nt, Homo Sapiens
ugcuagcaugauuuuuuuauauauagaaguuuaaaaauaaaccaggucagguuuguauaugua

SEQ ID NO: 628845 - RNA, 63 nt, Homo Sapiens
uucagccaucaguucaagagccaaugccuuuuuaaaauaaagcuucuguggucuuguuuuuaa

SEQ ID NO: 628846 - RNA, 63 nt, Homo Sapiens
uuguaguggaguucauaucacauuauguuuugcaaaauaaaacuuguuuugucacaauauuuu

SEQ ID NO: 628847 - RNA, 63 nt, Homo Sapiens
aauuuuaauaaauuauauaauuauacauauuguaaaauaaagaccgguauuuuauuuucugcu

SEQ ID NO: 628848 - RNA, 63 nt, Homo Sapiens
ggauagaacccauacaugaauuaaaugaugcacaaaauaaauggcuguugaaauuuggaaaug

SEQ ID NO: 628849 - RNA, 63 nt, Homo Sapiens
agcuaaugauagauagaaaugcccacucaaagaaaaauaaacagagacaaauguuaaaauugc

SEQ ID NO: 628850 - RNA, 63 nt, Homo Sapiens
uacagacuguuuuucccccuguuguuucacuuuaaaauaaaaagaaauccuugauuaaucaga

SEQ ID NO: 628851 - RNA, 63 nt, Homo Sapiens
auggacugccuuauugcuguugcuuaucauuugaaaauaaaauccagcucagguuguaacuug

SEQ ID NO: 628852 - RNA, 63 nt, Homo Sapiens
ccauagaaacauucucguuuaaacaacaacaacaaaauaaauuuaucagcacuagauauuaga

SEQ ID NO: 628853 - RNA, 63 nt, Homo Sapiens
cucuguagcuaacccuuauaaacuaggcucaguaaaauaaagcacucuuauuuuuugaucugg

SEQ ID NO: 628854 - RNA, 63 nt, Homo Sapiens
guguauuuuuucagguuucuggaaauaaauaguaaaauaaauggcacaaauaguuucaauaaa

SEQ ID NO: 628855 - RNA, 63 nt, Homo Sapiens
uaaagaaauuauauuuuguucuauugcuaggguaaaauaaauacauuuguguccaacugaaau

SEQ ID NO: 628856 - RNA, 63 nt, Homo Sapiens
cuagugaacaaaaggugccuauucuuuuuuaaaaaaauaaaauaaaacauaaauauuacucuu

SEQ ID NO: 628857 - RNA, 63 nt, Homo Sapiens
gaacaaaaggugccuauucuuuuuuaaaaaaauaaaauaaaacauaaauauuacucuuccaua

SEQ ID NO: 628858 - RNA, 63 nt, Homo Sapiens
aauagccuagggcugaauuuuugucagauaaauaaaauaaaucauucauccuuuuuuuugauu

SEQ ID NO: 628859 - RNA, 63 nt, Homo Sapiens
uaaauguauuuuagacuuccuguagggggcgauaaaauaaaaugcuaaacaacuggguauaca

SEQ ID NO: 628860 - RNA, 63 nt, Homo Sapiens
aaaaucaugucaucuucuauuuguacagaaaugaaaauaaaauaugaaaauaaugaaagaaau

SEQ ID NO: 628861 - RNA, 63 nt, Homo Sapiens
gggcaaaugucauuguuaccucuguguguuaagaaaauaaaaauauuuucuaaaggucuguau

SEQ ID NO: 628862 - RNA, 63 nt, Homo Sapiens
gaacauuuuucuuuuauuguuuuaucuucacagaaaauaaaagguguuaauuugcuuuuuaaa

SEQ ID NO: 628863 - RNA, 63 nt, Homo Sapiens
cugaguugauuuucuagguucuuacguauuugaaaaauaaaauugcaauucgagauaagugcu

SEQ ID NO: 628864 - RNA, 63 nt, Homo Sapiens
auccugucucaaaaauuaauuaauuaauuaauuaaaauaaacuagguaaacuuggauaggcag

SEQ ID NO: 628865 - RNA, 63 nt, Homo Sapiens
accuugugucuucucuuguaaaaaugaaacucaaaaauaaaauaaaugugucaaauuuugaaa

SEQ ID NO: 628866 - RNA, 63 nt, Homo Sapiens
gugucuucucuuguaaaaaugaaacucaaaaauaaaauaaaugugucaaauuuugaaaaaaaa

SEQ ID NO: 628867 - RNA, 63 nt, Homo Sapiens
gcuucccucaguucaccaaaguuaccaaaauguaaaauaaaauaagacuggcucagguaagua

SEQ ID NO: 628868 - RNA, 63 nt, Homo Sapiens
uaaaucuagaaaccauuaguuugagaucucucaaaaauaaaaauaaaaauugcuuucagagag

SEQ ID NO: 628869 - RNA, 63 nt, Homo Sapiens
uagaaaccauuaguuugagaucucucaaaaauaaaaauaaaaauugcuuucagagaguagccc

SEQ ID NO: 628870 - RNA, 63 nt, Homo Sapiens
aaagcuaaauauggcacacuuguucuuuacagaaaaauaaagauauuuuaaacaaaauacuag

SEQ ID NO: 628871 - RNA, 63 nt, Homo Sapiens
gguagcugugcagauguggaucaacauuuguuuaaaauaaaguauuaauacuuuaaagucaaa

SEQ ID NO: 628872 - RNA, 63 nt, Homo Sapiens
aucggcggcacaaucacuuuguagaaacuguaaaaaauaaaaguaucuccuagucccuuaauu

SEQ ID NO: 628873 - RNA, 63 nt, Homo Sapiens
uuauuuauucacacuugaauugcauuugugaucaaaauaaauguuuaaaucgcuaaaggaaaa

SEQ ID NO: 628874 - RNA, 63 nt, Homo Sapiens
cacuggaagaguuuaguguuucuuguaugcuugaaaauaaaguauguacuguuuugaaugugu

SEQ ID NO: 628875 - RNA, 63 nt, Homo Sapiens
agccuaggagacaaaacgagacuucauuuaaaaaaaauaaaaauaaaaauaaaaauaaaguca

SEQ ID NO: 628876 - RNA, 63 nt, Homo Sapiens
ggagacaaaacgagacuucauuuaaaaaaaauaaaaauaaaaauaaaaauaaagucaucuugc

SEQ ID NO: 628877 - RNA, 63 nt, Homo Sapiens
aaaacgagacuucauuuaaaaaaaauaaaaauaaaaauaaaaauaaagucaucuugccaccca

SEQ ID NO: 628878 - RNA, 63 nt, Homo Sapiens
agacuucauuuaaaaaaaauaaaaauaaaaauaaaaauaaagucaucuugccacccacccccu

SEQ ID NO: 628879 - RNA, 63 nt, Homo Sapiens
uugaaguauauucaaccaaauacuuuaauguauaaaauaaauauuauacaauauacuuguaua

SEQ ID NO: 628880 - RNA, 63 nt, Homo Sapiens
cauuuuuuaaaaaauggacucuugaaaucuguuaaaauaaaauuguacauuuggagauguuuc

SEQ ID NO: 628881 - RNA, 63 nt, Homo Sapiens
ccacccugggcaacagagcaagaccccaucucaaaaauaaauaaauauauauaaaaaauaaaa

SEQ ID NO: 628882 - RNA, 63 nt, Homo Sapiens
gaccccaucucaaaaauaaauaaauauauauaaaaaauaaaaagcuauuucuaguuuauuuca

SEQ ID NO: 628883 - RNA, 63 nt, Homo Sapiens
cuagagucauauaagaaauaaaaauugggcaauaaaauaaaaugauucaguguuucuuuucua

SEQ ID NO: 628884 - RNA, 63 nt, Homo Sapiens
cugcaaaagggaucuucgaaacugggcagagaaaaaauaaaguggaauauuaaguaaaaguug

SEQ ID NO: 628885 - RNA, 63 nt, Homo Sapiens
gauaauagaacuagugacuaucacacaucuugaaaaauaaaaccauauugucaccuguaccug

SEQ ID NO: 628886 - RNA, 63 nt, Homo Sapiens
aguugaacucucugucuucaucccuuagauugcaaaauaaaaugauugaagugcagagaaaaa

SEQ ID NO: 628887 - RNA, 63 nt, Homo Sapiens
aaaauaaaauaaaauaaaauaauaaaauaaaauaaaauaaaaucaaaaaauaaaauaaaauaa

SEQ ID NO: 628888 - RNA, 63 nt, Homo Sapiens
aaaauaaaauaaaauaaaauaauaaaauaaaauaaaauaaaauugucucaaaaaauaaaauaa

SEQ ID NO: 628889 - RNA, 63 nt, Homo Sapiens
aaaauaaaauaaaauaaaauaauaaaauaaaauaaaauaaaaucacucugucucaaaaaauaa

SEQ ID NO: 628890 - RNA, 63 nt, Homo Sapiens
aaaauaaaauaaaauaaaauaauaaaauaaaauaaaauaaaauagugacacucugucucaaaa

SEQ ID NO: 628891 - RNA, 63 nt, Homo Sapiens
aaaauaaaauaaaauaaaaucaaaaaauaaaauaaaauaaaauaacagagugacacucugucu

SEQ ID NO: 628892 - RNA, 63 nt, Homo Sapiens
aaaauaaaauaaaauaaaauugucucaaaaaauaaaauaaaauugggcaacagagugacacuc

SEQ ID NO: 628893 - RNA, 63 nt, Homo Sapiens
aaaauaaaauaaaauaaaaucacucugucucaaaaaauaaaaucagccugggcaacagaguga

SEQ ID NO: 628894 - RNA, 63 nt, Homo Sapiens
guauuucccuccuugccuguaaauaaaaauuaaaaaauaaaggaaugagacucagucuccgaa

SEQ ID NO: 628895 - RNA, 63 nt, Homo Sapiens
uuaaaaaauaaaggguauuuacucagucuccgaaaaauaaaaaagucuaagcaacauaaugag

SEQ ID NO: 628896 - RNA, 63 nt, Homo Sapiens
gacaaaugaaaaggcacaucacuuuuuaaauguaaaauaaaaaauccacuuagagcaauaacc

SEQ ID NO: 628897 - RNA, 63 nt, Homo Sapiens
uaagccacaaaacuaaaaggcaaauucugcaaaaaaauaaaaaaggaggcugcacuacaaacc

SEQ ID NO: 628898 - RNA, 63 nt, Homo Sapiens
uacaacaugaagauucagauaagguaaaaaaauaaaauaaaauuagugccaaaaacuuuuuaa

SEQ ID NO: 628899 - RNA, 63 nt, Homo Sapiens
aaaauuacaacaugaagauuuuuaaaagguaaaaaaauaaaauccuuguagugccaaaaacuu

SEQ ID NO: 628900 - RNA, 63 nt, Homo Sapiens
aguugugccugaaaugaaucaacaaaacaaaaaaaaauaaaaaguuucuuuuacugauuuaaa

SEQ ID NO: 628901 - RNA, 63 nt, Homo Sapiens
aauuuaagaaaaccauuuuauguuauguuuaaaaaaauaaauacaguuuuaacaccuuccucg

SEQ ID NO: 628902 - RNA, 63 nt, Homo Sapiens
uuucaauguuuuuuuggucucaaauccccugugaaaauaaaauaaaauaauguucuuuuuaug

SEQ ID NO: 628903 - RNA, 63 nt, Homo Sapiens
aaagcaucuucuccuaguugcuuuggccaaaccaaaauaaagacauaauuuaaccauuagcau

SEQ ID NO: 628904 - RNA, 63 nt, Homo Sapiens
agucuuccucuggaaagagauuccuagaauuuaaaaauaaaaacaauuugaauaagucaugcu

SEQ ID NO: 628905 - RNA, 63 nt, Homo Sapiens
uggaauuuuuuacccauacacccuacauuaguaaaaauaaaaaagaaggaaacauauguucuc

SEQ ID NO: 628906 - RNA, 63 nt, Homo Sapiens
agaaacuauccaggagugguccuugucuccacaaaaauaaaaagccuggacaacauagugaga

SEQ ID NO: 628907 - RNA, 63 nt, Homo Sapiens
accauuuuguuucccuuucaaaauaaauaaaauaaaauaaagcgccacuguagcgccuuuuua

SEQ ID NO: 628908 - RNA, 63 nt, Homo Sapiens
aaagcaccauuuuguuucccuuuuaaaauaaauaaaauaaaauguccugccacuguagcgccu

SEQ ID NO: 628909 - RNA, 63 nt, Homo Sapiens
aaauaaaauaaagcaccauuguagcgccuuuuuaaaauaaauacccagcagcguccugccacu

SEQ ID NO: 628910 - RNA, 63 nt, Homo Sapiens
gaaauagaucuuauuauucuaaaauaaauaaauaaaauaaaauagagugagacucugucucaa

SEQ ID NO: 628911 - RNA, 63 nt, Homo Sapiens
aauaaaauaaaaugaaauaggacucugucucaaaaaauaaauacagucugggugacagaguga

SEQ ID NO: 628912 - RNA, 63 nt, Homo Sapiens
uucuggugaaacaaauuaaaucugccacaucucaaaauaaaacaacaugaccaauguuuuuca

SEQ ID NO: 628913 - RNA, 63 nt, Homo Sapiens
aaaacccaaaaauaaugcaucauaucauuuuuaaaaauaaaaaaugacccauaguauuaaaua

SEQ ID NO: 628914 - RNA, 63 nt, Homo Sapiens
auaaaauuauuucuaaugauauugaacugcuuuaaaauaaauaaccauuuugcuaccaguuac

SEQ ID NO: 628915 - RNA, 63 nt, Homo Sapiens
auaaagucaauaauaguccuauacuugcacaugaaaauaaaauguugccuuuuuaaaauaauu

SEQ ID NO: 628916 - RNA, 52 nt, Homo Sapiens; identical to SEQ ID NO: 61813

SEQ ID NO: 628917 - RNA, 63 nt, Homo Sapiens
accaguuuuguguuggggggaaugacaacaaaaaaaauaaauguuuuuuugcuuccuaauaac

SEQ ID NO: 628918 - RNA, 63 nt, Homo Sapiens
gccccccauucugguccccucuguuuuuauuguaaaauaaauuuucugcugagguuugaacuc

SEQ ID NO: 628919 - RNA, 63 nt, Homo Sapiens
auaacaauaauacgggggaauuuguaaaaaauaaaaauaaauagauucacucuuuucuccugu

SEQ ID NO: 628920 - RNA, 63 nt, Homo Sapiens
uaaauaauaacaauaauacguccuguuuuguaaaaaauaaaaacaacccgauucacucuuuuc

SEQ ID NO: 628921 - RNA, 63 nt, Homo Sapiens
ugguucuaauagaacucaguaaaaauaaaaauaaaaauaaauucagagcaagacucugucuca

SEQ ID NO: 628922 - RNA, 63 nt, Homo Sapiens
uaaauuugguucuaauagaagucucaaaaaauaaaaauaaaaagggugacagagcaagacucu

SEQ ID NO: 628923 - RNA, 63 nt, Homo Sapiens
uaaaaauaaauuugguucuagacucugucucaaaaaauaaaaacagccugggugacagagcaa

SEQ ID NO: 628924 - RNA, 63 nt, Homo Sapiens
cuauaaaaacccauccccuacccuauaguuacaaaaauaaaaaagcuauuguuauaguagcug

SEQ ID NO: 628925 - RNA, 63 nt, Homo Sapiens
aagaaguauuuauaggauuagcacaauuuuuuaaaaauaaauugccccguaaaaggguuaaca

SEQ ID NO: 628926 - RNA, 63 nt, Homo Sapiens
gcuaaaucuuaaaagaaacuaagauaagagacuaaaauaaaauggguacaagugguccaaacu

SEQ ID NO: 628927 - RNA, 63 nt, Homo Sapiens
ggagaaaggcuuaggaaguuacaauacauugcuaaaauaaagagauaaagucgcacauuuucc

SEQ ID NO: 628928 - RNA, 63 nt, Homo Sapiens
uuuaaaaagcaggcacuaauguauuuaaaauguaaaauaaacuuuuuuuaugagaaaaauacu

SEQ ID NO: 628929 - RNA, 63 nt, Homo Sapiens
accccaacguugaccuuaccauuuaaagucuccaaaauaaaacacaugagcuacauguuaaau

SEQ ID NO: 628930 - RNA, 63 nt, Homo Sapiens
ucuauuuagauguugauucuaacaaguaaaauaaaaauaaaagugaauuuucuuuucugucca

SEQ ID NO: 628931 - RNA, 63 nt, Homo Sapiens
uaaaagucuauuuagauguuuguccaaacaaguaaaauaaaaaagcugaugaauuuucuuuuc

SEQ ID NO: 628932 - RNA, 63 nt, Homo Sapiens
uuaauuuggggggauuauuuauauuuuuauguaaaaauaaaaacuuguuaagagugcaauauu

SEQ ID NO: 628933 - RNA, 63 nt, Homo Sapiens
augaaugaaucucaaaauuaauaucuaaauacuaaaauaaacuuguaccaaauauuuuaugga

SEQ ID NO: 628934 - RNA, 63 nt, Homo Sapiens
ggaaaacagacuuaaauuuuaaaauacauuuauaaaauaaaaaggauuaaacaaguauaaaau

SEQ ID NO: 628935 - RNA, 63 nt, Homo Sapiens
acauuuauaaaauaaaaaggauuaaacaaguauaaaauaaaauaugugcuaggucuaagaugg

SEQ ID NO: 628936 - RNA, 63 nt, Homo Sapiens
uguauaaaauuuaaaaaaacuaaauuuauaaugaaaauaaacauggguccaaagugauuuaca

SEQ ID NO: 628937 - RNA, 63 nt, Homo Sapiens
auuggcaaacaauacagcaaagaugcaaaaugcaaaauaaaauagaaggauuuuauucucaac

SEQ ID NO: 628938 - RNA, 63 nt, Homo Sapiens
uugauuuagaaaugaagaaagaaaaauuagucgaaaauaaagggccgaauauaauggaaauag

SEQ ID NO: 628939 - RNA, 63 nt, Homo Sapiens
uccagcuuggcgacagagcaagacccccucucaaaaauaaauaaaauaaaguaaaauaaauau

SEQ ID NO: 628940 - RNA, 63 nt, Homo Sapiens
gcgacagagcaagacccccucucaaaaauaaauaaaauaaaguaaaauaaauauaaauaauug

SEQ ID NO: 628941 - RNA, 63 nt, Homo Sapiens
aagacccccucucaaaaauaaauaaaauaaaguaaaauaaauauaaauaauuguggccgggug

SEQ ID NO: 628942 - RNA, 63 nt, Homo Sapiens
ugagaccccugucuauauauuuuuuuaauuuaaaaaauaaaagaauaaaauuguguagcucag

SEQ ID NO: 628943 - RNA, 63 nt, Homo Sapiens
uauuguagauacaauuuucugauuaaaucuggaaaaauaaaaggcagccuguuuuuucugcuu

SEQ ID NO: 628944 - RNA, 63 nt, Homo Sapiens
uuguauuaacagcugagguagcuaaaguuauuuaaaauaaaauuaaauuuaugauccaaguag

SEQ ID NO: 628945 - RNA, 63 nt, Homo Sapiens
auguacagauuaaaauuauugcuacauuugaggaaaauaaaauugcuugcuucuauguaauuc

SEQ ID NO: 628946 - RNA, 63 nt, Homo Sapiens
uaccauuuauugguuuggggaccaucuuaauuaaaaauaaaugcccaaaauguagaacuuuaa

SEQ ID NO: 628947 - RNA, 63 nt, Homo Sapiens
gggucuuuuuucuugagcuuauaauguaccuggaaaauaaaccucuugagaaaaagaaaaguu

SEQ ID NO: 628948 - RNA, 63 nt, Homo Sapiens
auaguaccauacaugaguuauuucuaaguuugaaaaauaaaaagaaauugcaucacacuaauu

SEQ ID NO: 628949 - RNA, 63 nt, Homo Sapiens
uaaauuaacaugaaauacuucauuuugauugagaaaauaaaaucagauuuuuucaaagucaau

SEQ ID NO: 628950 - RNA, 63 nt, Homo Sapiens
gggagcaucuguauuuuuauguuaaaagcccacaaaauaaaaauaaaaaguaacugagaugaa

SEQ ID NO: 628951 - RNA, 63 nt, Homo Sapiens
aucuguauuuuuauguuaaaagcccacaaaauaaaaauaaaaaguaacugagaugaauuuacc

SEQ ID NO: 628952 - RNA, 63 nt, Homo Sapiens
ggcgcaauauuuaugggagugggagggauggggaaaauaaacuuaacucuacaaaagcaaacu

SEQ ID NO: 628953 - RNA, 63 nt, Homo Sapiens
aucuaauauaccauuguauucacuaacuaacucaaaauaaacacauuuaaucuugacaucuca

SEQ ID NO: 628954 - RNA, 63 nt, Homo Sapiens
uuuuaaaugcuacuuuguaaaggugaccuuuaaaaaauaaaaggaaaauaaagaauguuaguu

SEQ ID NO: 628955 - RNA, 63 nt, Homo Sapiens
acuuuguaaaggugaccuuuaaaaaauaaaaggaaaauaaagaauguuaguuucauucugccg

SEQ ID NO: 628956 - RNA, 63 nt, Homo Sapiens
acauagugaauuuuaaaauguagaagaaagcaaaaaauaaaauaaguccuaaagugaagaagc

SEQ ID NO: 628957 - RNA, 63 nt, Homo Sapiens
aacaaaaugaaguuaacuuaguguuuagcauuaaaaauaaaaguuguaccuugacccuagaau

SEQ ID NO: 628958 - RNA, 63 nt, Homo Sapiens
guagaccugauuuucaaaaucugcccucagaugaaaauaaaauaaacgaaacauuuagacaau

SEQ ID NO: 628959 - RNA, 63 nt, Homo Sapiens
ccugauuuucaaaaucugcccucagaugaaaauaaaauaaacgaaacauuuagacaauggcua

SEQ ID NO: 628960 - RNA, 63 nt, Homo Sapiens
gagcgagaccuugucucuaaaaauaauaguaauaaaauaaaaauaacguuuuaugacuauuua

SEQ ID NO: 628961 - RNA, 63 nt, Homo Sapiens
gcuaaguuaaaauacaguuuaguuauuugcuuuaaaauaaacucuucuuuuuuucuuuaaagu

SEQ ID NO: 628962 - RNA, 63 nt, Homo Sapiens
ggugaauuggcucucauggaaauuuggaauuacaaaauaaacguccuggggguuacccagaau

SEQ ID NO: 628963 - RNA, 63 nt, Homo Sapiens
cagaauacagauuuaaaaguuugccuguagagcaaaauaaaacagucaguuguagucauuaau

SEQ ID NO: 628964 - RNA, 63 nt, Homo Sapiens
gaauaaaguuauguucugauaguuuguacagaaaaaauaaaauggaugcccauguuuuauugc

SEQ ID NO: 628965 - RNA, 63 nt, Homo Sapiens
cacuucacugccauuuucuauucacauaaaagaaaaauaaauguggaaauuucauccuuggaa

SEQ ID NO: 628966 - RNA, 63 nt, Homo Sapiens
aaccagauaaaaguagcacaugugcuuuuguuaaaaauaaaguuaaaaguuaaaguuaaaaaa

SEQ ID NO: 628967 - RNA, 63 nt, Homo Sapiens
uggaugucucgcuucacaauaaaacacagcuuaaaaauaaaauaacugaaagaaauagaauuc

SEQ ID NO: 628968 - RNA, 63 nt, Homo Sapiens
uaaaagcaauagcuggaauauacucccaguuuuaaaauaaaugccugauugauuuaaagcaag

SEQ ID NO: 628969 - RNA, 63 nt, Homo Sapiens
uauguauguuccuaaugcuuauggaacuccuccaaaauaaaguuacucaaagagagcaaauau

SEQ ID NO: 628970 - RNA, 63 nt, Homo Sapiens
uuuugcaucauuuaaacaugcagaagauguuuaaaaauaaaaaaaaaacugcuuuauccuccu

SEQ ID NO: 628971 - RNA, 63 nt, Homo Sapiens
ucuuuucaaauauuuguaggacaacuuugaaucaaaauaaauuauguuccuucuccaauuuga

SEQ ID NO: 628972 - RNA, 63 nt, Homo Sapiens
ccccucaggggaauucggagcuagaggacauggaaaauaaagccaggaaagucaaaaaaacga

SEQ ID NO: 628973 - RNA, 63 nt, Homo Sapiens
aagcgcaaagaggagaaugaagauccagaaaggaaaauaaagaagaagggcuucggcgccaug

SEQ ID NO: 628974 - RNA, 63 nt, Homo Sapiens
aauaauuauuaaugaaagauuuuugaaauauaaaaaauaaauuaggcccaauccaagaaauug

SEQ ID NO: 628975 - RNA, 63 nt, Homo Sapiens
uucaauauaaccagcaauuuagguggcaucuauaaaauaaaaaauuucuacuguggacauccc

SEQ ID NO: 628976 - RNA, 63 nt, Homo Sapiens
caaagacuauuaaaggagcuguacagagguaaaaaaauaaauguggaacauuauuaacuuacu

SEQ ID NO: 628977 - RNA, 63 nt, Homo Sapiens
uuuuaaaaugacuugacuauaaaaaaaaauuaaaaaauaaaaauaaaugacuuggcuguaaua

SEQ ID NO: 628978 - RNA, 63 nt, Homo Sapiens
aaugacuugacuauaaaaaaaaauuaaaaaauaaaaauaaaugacuuggcuguaauaaggcau

SEQ ID NO: 628979 - RNA, 63 nt, Homo Sapiens
ugaucauguuuugcuacaguuugcaggugaaaaaaaauaaauauuauaaaauaugcuauuguu

SEQ ID NO: 628980 - RNA, 63 nt, Homo Sapiens
gggggcucuuacugacuuuaaauuagcgcuuauaaaauaaaaauguuuaguucaagaagagac

SEQ ID NO: 628981 - RNA, 63 nt, Homo Sapiens
gcagccugggcgacagagcgagauucugccucaaaaauaaacaaauaaauuuuaaaaauaaau

SEQ ID NO: 628982 - RNA, 63 nt, Homo Sapiens
gauucugccucaaaaauaaacaaauaaauuuuaaaaauaaauaaauaauaaaaggaaguguua

SEQ ID NO: 628983 - RNA, 63 nt, Homo Sapiens
cauaagauaugagauacaugaaccugaacuauuaaaauaaaauauuauauuuaacccuuaguu

SEQ ID NO: 628984 - RNA, 63 nt, Homo Sapiens
ccuggccaacauggcaaaaccacaucucuacuaaaaauaaaaaaauuagcugggugugguggu

SEQ ID NO: 628985 - RNA, 63 nt, Homo Sapiens
uccagccggggugacagagugagacuccgacugaaaauaaauaaauaaauaaauaaauaaaua

SEQ ID NO: 628986 - RNA, 63 nt, Homo Sapiens
aaaaauauuuuuagcagaacgauggguuuuguaaaaauaaaaauuguuaugaaauaaaaaaaa

SEQ ID NO: 628987 - RNA, 63 nt, Homo Sapiens
gaguguaaauucuuuuuaauagguaagcugaucaaaauaaauaggguauaucuauuucugaag

SEQ ID NO: 628988 - RNA, 63 nt, Homo Sapiens
uuaaaauuuauauguauuaauguguaacuucuaaaaauaaaacgaaauuguucuuuuaaaaua

SEQ ID NO: 628989 - RNA, 63 nt, Homo Sapiens
uuugagcaccugauuauauuaacauuuuguaagaaaauaaaaguaguuuggguucauuucuau

SEQ ID NO: 628990 - RNA, 63 nt, Homo Sapiens
accguaggaaugggcucaacuuuacugaggauuaaaauaaaaagcuacagagcacccagugau

SEQ ID NO: 628991 - RNA, 63 nt, Homo Sapiens
guuucaaggauuccugaccaaaaggauuaggcaaaaauaaaauaaaauauguuuacauuggau

SEQ ID NO: 628992 - RNA, 63 nt, Homo Sapiens
uuccuuuagaagaucacucuauauuuuuaaauaaaaauaaauacugcuuuacuuugauguauc

SEQ ID NO: 628993 - RNA, 63 nt, Homo Sapiens
ccuucuaaaccacauuggaagggaggauaugagaaaauaaauuauacuauugagaaaucuaug

SEQ ID NO: 628994 - RNA, 63 nt, Homo Sapiens
aaauuaaaguacacauuguaucccuuuauugaaaaaauaaaaacuguucauacacccauuuug

SEQ ID NO: 628995 - RNA, 63 nt, Homo Sapiens
ugcucagauaggacaauuaaagagguugaguauaaaauaaaccuuuucucuaaucagagauac

SEQ ID NO: 628996 - RNA, 63 nt, Homo Sapiens
caaaaaaguuugauugagacuuuuaaauuuaaaaaaauaaaaacucucugagagaaaagggug

SEQ ID NO: 628997 - RNA, 63 nt, Homo Sapiens
aaaagccaaacaagccuuagcaccaaaaaccuaaaaauaaacaaugagguuaggucaugagga

SEQ ID NO: 628998 - RNA, 63 nt, Homo Sapiens
augaggaaaaguuuaaccuaaggauuccaugugaaaauaaaaucuuaucggggcgaaccuuuu

SEQ ID NO: 628999 - RNA, 63 nt, Homo Sapiens
uuuauaaggaauacuguuauuuuuuaaaaccauaaaauaaauuuuauacaauaauuuaaauau

SEQ ID NO: 629000 - RNA, 63 nt, Homo Sapiens
gcaaacauuaaaaacaagagauuaaguauuuuaaaaauaaaugguacuccacaaguauguaca

SEQ ID NO: 629001 - RNA, 63 nt, Homo Sapiens
aacuuguucugaaguugucugcuuuuauucaucaaaauaaaauuuuuucaauugccagcuacu

SEQ ID NO: 629002 - RNA, 63 nt, Homo Sapiens
ugacagcuuuagcacaauuuguuaaagucauuaaaaauaaaaaauaaaaucuugucuagcaca

SEQ ID NO: 629003 - RNA, 63 nt, Homo Sapiens
cuugucuagcacaguuaaagauuucuguggcugaaaauaaaaugaguuauguuggauaguuuu

SEQ ID NO: 629004 - RNA, 63 nt, Homo Sapiens
ggcaacuuuauuaaugccuagaacacuguaccuaaaauaaagaaaccuaaaugaccuaaauaa

SEQ ID NO: 629005 - RNA, 63 nt, Homo Sapiens
caaacaauaacauguuuaucucccagaacaccaaaaauaaaaaccuuuugucuuuuaaaauaa

SEQ ID NO: 629006 - RNA, 63 nt, Homo Sapiens
gcacaccaaaauguauacauaugauuccagucaaaaauaaaaucaauuucccuucauauggau

SEQ ID NO: 629007 - RNA, 63 nt, Homo Sapiens
uauuaaaauuaaauucauucuaagaaucacacaaaaauaaaugauguuuugaaaguguuuuau

SEQ ID NO: 629008 - RNA, 63 nt, Homo Sapiens
agcuggguuugacuuuugagacacuguggugauaaaauaaaaguuauuuuaagcuuguaaaau

SEQ ID NO: 629009 - RNA, 63 nt, Homo Sapiens
uuaaaaauguuuaauuugguucauuaggggcugaaaauaaauguaguuuugagguaacugcau

SEQ ID NO: 629010 - RNA, 63 nt, Homo Sapiens
aauuaauaaaaugguguaguaauaaaauaaaauaaaauaaaaugagcaagacucuaucucaaa

SEQ ID NO: 629011 - RNA, 63 nt, Homo Sapiens
aaaauaauuaauaaaaugguucaaaaauaaaauaaaauaaaaucaacagagcaagacucuauc

SEQ ID NO: 629012 - RNA, 63 nt, Homo Sapiens
aaaauaaaauaauuaauaaacuaucucaaaaauaaaauaaaaucugagcaacagagcaagacu

SEQ ID NO: 629013 - RNA, 63 nt, Homo Sapiens
aaaauaaaauaaaauaauuaagacucuaucucaaaaauaaaauccagccugagcaacagagca

SEQ ID NO: 629014 - RNA, 63 nt, Homo Sapiens
aagcuaucugcaccucaaaaagauaguaacaacaaaauaaagcauaauuguuggaccuccuug

SEQ ID NO: 629015 - RNA, 63 nt, Homo Sapiens
uguuguuaaauuuuaaacaaaaagaacaacaacaaaauaaagcaaugagccacagcaaaaagu

SEQ ID NO: 629016 - RNA, 63 nt, Homo Sapiens
ccagaaucauaauuuucaaguuuccgucucccuaaaauaaaaaauucauuucacuuuaaaguc

SEQ ID NO: 629017 - RNA, 63 nt, Homo Sapiens
aauacaguaaaguuuaaaaacucuucuauuuaaaaaauaaaaauuauguauuauuuucuauag

SEQ ID NO: 629018 - RNA, 63 nt, Homo Sapiens
gcugggaccaucccaaaagaauuuuuuucuuuuaaaauaaacacauuuguuggcucuauuuua

SEQ ID NO: 629019 - RNA, 63 nt, Homo Sapiens
ugguuuaaucacuaccauugauaaaauuccuuaaaaauaaagaauggugcuaaaauucuuccu

SEQ ID NO: 629020 - RNA, 63 nt, Homo Sapiens
cauucaauaaauaugacuuuuuuuuugguuguuaaaauaaacggcauuguuaggcuguuagaa

SEQ ID NO: 629021 - RNA, 63 nt, Homo Sapiens
acacugccgaaaaaaaaaaaguauguauuuaacaaaauaaacgcuuaauggguaauuuuugag

SEQ ID NO: 629022 - RNA, 63 nt, Homo Sapiens
acaucugccuucuugauauuccuaauguaaaauaaaauaaaacugagauugugguuuuuucuu

SEQ ID NO: 629023 - RNA, 63 nt, Homo Sapiens
aaaacacaucugccuucuuguucuuccuaauguaaaauaaaauugcuuugagauugugguuuu

SEQ ID NO: 629024 - RNA, 63 nt, Homo Sapiens
aagcaaauuugagucaaauaguuuacuccuaacaaaauaaagccuaaacacaggcuacuuucu

SEQ ID NO: 629025 - RNA, 63 nt, Homo Sapiens
uacacacacacacacaccccaauauguguguauaaaauaaacaguaauauauuagaauauaca

SEQ ID NO: 629026 - RNA, 63 nt, Homo Sapiens
guuaugaguaguaaaaauaauuuguacaaaguaaaaauaaacuuuggauuugcauuuuuguau

SEQ ID NO: 629027 - RNA, 63 nt, Homo Sapiens
uuaaaaaacuccugucuugcgcauguauucacuaaaauaaaauuuguuguuguuuuauauaau

SEQ ID NO: 629028 - RNA, 63 nt, Homo Sapiens
aguauugaagacuuacauggcaccuaaccuuugaaaauaaaguuauaauaaauuaacaagauu

SEQ ID NO: 629029 - RNA, 63 nt, Homo Sapiens
agaacucuggaguggucuaaccaaaaggaaaagaaaauaaagacacauuuuucuacuauuuga

SEQ ID NO: 629030 - RNA, 63 nt, Homo Sapiens
cccaccuuguugcaaaagcugucaugcaccaaaaaaauaaaacgucucguuagaguauuugau

SEQ ID NO: 629031 - RNA, 63 nt, Homo Sapiens
aaaaaaaagacgaacuauugaauaaaaauaaaaaaaauaaaaacauuaucacacaaagagacc

SEQ ID NO: 629032 - RNA, 63 nt, Homo Sapiens
aaauaaaaaaaaaaaaagacaaagagaccaauaaaaauaaaaauguguaggucauuaucacac

SEQ ID NO: 629033 - RNA, 63 nt, Homo Sapiens
gugaaaugucaaagacauguggauaugguacuaaaaauaaaauuucugaugagcacugacaaa

SEQ ID NO: 629034 - RNA, 63 nt, Homo Sapiens
cauuuuaaugugcauucugacaguaauaugcauaaaauaaaccguaauaaauuuauuguggua

SEQ ID NO: 629035 - RNA, 63 nt, Homo Sapiens
uacgagaaggcaaugugaggccuucuugugauaaaaauaaaauucaggaaucacuauguauuu

SEQ ID NO: 629036 - RNA, 63 nt, Homo Sapiens
uuuguucuuguauugcuuucuuucaacaguuucaaaauaaaauaucauauaaauauugaggga

SEQ ID NO: 629037 - RNA, 63 nt, Homo Sapiens
cauauauuuuaugaaucagaauaaccuucaaauaaaauaaaucuaagucgguuaaaauggauu

SEQ ID NO: 629038 - RNA, 63 nt, Homo Sapiens
uaaauauauuuuuauagaaaaacaaaucuacauaaaauaaaucuacuguuuagugagcaguau

SEQ ID NO: 629039 - RNA, 63 nt, Homo Sapiens
gcauaaucaaggcacuguaaaucuuauaauuuuaaaauaaauuacuuaagaacaguugucauu

SEQ ID NO: 629040 - RNA, 63 nt, Homo Sapiens
auaauucuugcauuuuuuccccauaaccugguuaaaauaaauacgccauuggcaauacuucau

SEQ ID NO: 629041 - RNA, 63 nt, Homo Sapiens
ugugucugauguuucuucucauguaagaaauaaaaaauaaaaauaaaauaaaauauauuggua

SEQ ID NO: 629042 - RNA, 63 nt, Homo Sapiens
ugauguuucuucucauguaagaaauaaaaaauaaaaauaaaauaaaauauauugguauguaac

SEQ ID NO: 629043 - RNA, 63 nt, Homo Sapiens
uuucuucucauguaagaaauaaaaaauaaaaauaaaauaaaauauauugguauguaacuacag

SEQ ID NO: 629044 - RNA, 63 nt, Homo Sapiens
aaauaaaauauauugguauguaacuacaggaaaaaaauaaaaaauauauaguggacaguaacc

SEQ ID NO: 629045 - RNA, 63 nt, Homo Sapiens
aaaaaaagauguuauacaaccaucaaaguggcaaaaauaaaaaaaaucaaguauuggcaaaga

SEQ ID NO: 629046 - RNA, 63 nt, Homo Sapiens
auaaaaaugacaacaaaguaaaaggguaucccaaaaauaaaacuauccuuuuggaaaaaaaaa

SEQ ID NO: 629047 - RNA, 63 nt, Homo Sapiens
aaucaccaagaaaaacagcuucucaguuaagugaaaauaaaccaguuaaaacagaaccuuuaa

SEQ ID NO: 629048 - RNA, 63 nt, Homo Sapiens
aaccacaaggcuugagaauagaaauuaaaagcaaaaauaaaguucggccugggucucucuuug

SEQ ID NO: 629049 - RNA, 63 nt, Homo Sapiens
gccugggcaacaagagcgaaacucuugucugaaaaaauaaaguucaucccaacuuucaagucu

SEQ ID NO: 629050 - RNA, 63 nt, Homo Sapiens
ggguaacacggggagacccgucuuuaguaaauaaaaauaaauuuauuaauaaaacuaaaaauu

SEQ ID NO: 629051 - RNA, 63 nt, Homo Sapiens
caggcauagaguucagacuuuuuuuaaauaguaaaaauaaaauuaaagcugaaaacugcaacu

SEQ ID NO: 629052 - RNA, 63 nt, Homo Sapiens
auguaaauacuguuuuuaacaacuaugauuuggaaaauaaaucaaugcuauaacuauguugau

SEQ ID NO: 629053 - RNA, 63 nt, Homo Sapiens
auggaucacacgauuucuuuaagggaauuaaaaaaaauaaaagaauuacggcuuuuacagcaa

SEQ ID NO: 629054 - RNA, 63 nt, Homo Sapiens
ucuggacggacuuauuaaaauacaaacagacaaaaaauaaaacaaaacuugaguucuauuuac

SEQ ID NO: 629055 - RNA, 63 nt, Homo Sapiens
uuuaaauuacaaccacaguugaauaauaaccuaaaaauaaauuuuaguuugcuaaaaauuuac

SEQ ID NO: 629056 - RNA, 63 nt, Homo Sapiens
caguuaaucuaaagucuuauuauuucuucuaguaaaauaaaauauuguuagauuaguucucau

SEQ ID NO: 629057 - RNA, 63 nt, Homo Sapiens
gauaauuacuuauuuguguuuuucaugguuaaaaaaauaaaagaagcacaaugaccaguacau

SEQ ID NO: 629058 - RNA, 63 nt, Homo Sapiens
uuacuauaguguagcuacuggcuucauuuaauaaaaauaaaugauuuugaaauuaaauauaau

SEQ ID NO: 629059 - RNA, 63 nt, Homo Sapiens
aacuccuuucauaucaagacaaguuauuuguaaaaaauaaagaagggguuuuaauacaaaccu

SEQ ID NO: 629060 - RNA, 63 nt, Homo Sapiens
uuggauuaaaauguugacaugauuucacauuugaaaauaaacucaucucuuauuuugaaguua

SEQ ID NO: 629061 - RNA, 63 nt, Homo Sapiens
uugaaggugagaugauaaacuugcaaaacucacaaaauaaagagucaaacuuuuagaaugaca

SEQ ID NO: 629062 - RNA, 63 nt, Homo Sapiens
cuggacaacagagcaagacucugucucaaaaaaaaaauaaaaaauaaaaaauaaaaaauaaaa

SEQ ID NO: 629063 - RNA, 63 nt, Homo Sapiens
acagagcaagacucugucucaaaaaaaaaauaaaaaauaaaaaauaaaaaauaaaagaaacau

SEQ ID NO: 629064 - RNA, 63 nt, Homo Sapiens
aagacucugucucaaaaaaaaaauaaaaaauaaaaaauaaaaaauaaaagaaacauaagauaa

SEQ ID NO: 629065 - RNA, 63 nt, Homo Sapiens
ugucucaaaaaaaaaauaaaaaauaaaaaauaaaaaauaaaagaaacauaagauaaguaccuc

SEQ ID NO: 629066 - RNA, 63 nt, Homo Sapiens
ucugagcaacauggcaaaacccugugucuacaaaaaauaaaaaauuagcugggcaugacggcc

SEQ ID NO: 629067 - RNA, 63 nt, Homo Sapiens
uuuuuaguucuuaaaaauuuauuuuuaaguucuaaaauaaaauaaaaauaaguucuuaaaauu

SEQ ID NO: 629068 - RNA, 63 nt, Homo Sapiens
aguucuuaaaaauuuauuuuuaaguucuaaaauaaaauaaaaauaaguucuuaaaauuuauuu

SEQ ID NO: 629069 - RNA, 63 nt, Homo Sapiens
aacucauccauagauaauucaagauuuguauucaaaauaaacauaguuuucacaguuacaaaa

SEQ ID NO: 629070 - RNA, 63 nt, Homo Sapiens
uguauucaaaauaaacauaguuuucacaguuacaaaauaaaucaccuauuuuaucuuuuccuu

SEQ ID NO: 629071 - RNA, 63 nt, Homo Sapiens
uuauuuuuuuuaauuuaaguccuaaauauaguuaaaauaaauaauguuuuaguaaaaugauac

SEQ ID NO: 629072 - RNA, 63 nt, Homo Sapiens
ccagccaggugacauagcgagauccugucuaaaaaaauaaaaaauaaauaauggaacacagca

SEQ ID NO: 629073 - RNA, 63 nt, Homo Sapiens
ggugacauagcgagauccugucuaaaaaaauaaaaaauaaauaauggaacacagcaaguccua

SEQ ID NO: 629074 - RNA, 63 nt, Homo Sapiens
auugcuguaggauccuguucuuucagcaggugaaaaauaaaacgcaguucaaauuucaugguu

SEQ ID NO: 629075 - RNA, 63 nt, Homo Sapiens
uuauuacugcaguaguugacuuugcuguauggaaaaauaaagugaaauugcccuaauaaaacu

SEQ ID NO: 629076 - RNA, 63 nt, Homo Sapiens
auagguaaucaaugaauauugaaguuucagcuuaaaauaaacaguugugaaccaagaucuaua

SEQ ID NO: 629077 - RNA, 63 nt, Homo Sapiens
gaaauuuuuaucaguuuccagucucaaaaauacaaaauaaaaacaaacguuuuuaauacuauu

SEQ ID NO: 629078 - RNA, 63 nt, Homo Sapiens
aagccccauggaucaauacauaaacuaugcauaaaaauaaaauuucauauuuucgcucguaaa

SEQ ID NO: 629079 - RNA, 63 nt, Homo Sapiens
guaagccucucuuacuccuguuaugcacuuuuuaaaauaaauacugaauuccagaaagaauuu

SEQ ID NO: 629080 - RNA, 63 nt, Homo Sapiens
uaccucucugugccucaguuuucccaugcaugaaaaauaaaauaaaauaaaacggggauucua

SEQ ID NO: 629081 - RNA, 63 nt, Homo Sapiens
cucugugccucaguuuucccaugcaugaaaaauaaaauaaaauaaaacggggauucuaauguu

SEQ ID NO: 629082 - RNA, 63 nt, Homo Sapiens
ugccucaguuuucccaugcaugaaaaauaaaauaaaauaaaacggggauucuaauguuuguaa

SEQ ID NO: 629083 - RNA, 63 nt, Homo Sapiens
uaacuauauauauugccaucacacacgaacaauaaaauaaaguguucuauuaaccugaucucu

SEQ ID NO: 629084 - RNA, 63 nt, Homo Sapiens
accaaacaggaaagaacuaugucugaaauauaaaaaauaaaaauaaaaaaacaacuaugaaua

SEQ ID NO: 629085 - RNA, 63 nt, Homo Sapiens
caggaaagaacuaugucugaaauauaaaaaauaaaaauaaaaaaacaacuaugaauaugcaca

SEQ ID NO: 629086 - RNA, 63 nt, Homo Sapiens
cauuuugccugacaauugcaaaucagagcauacaaaauaaaacugugcaguuuuguuugguuu

SEQ ID NO: 629087 - RNA, 63 nt, Homo Sapiens
ccugggcaacauagugagaccuugucucuacaaaaaauaaaauaaaauaaaaaccaaauuagc

SEQ ID NO: 629088 - RNA, 63 nt, Homo Sapiens
gcaacauagugagaccuugucucuacaaaaaauaaaauaaaauaaaaaccaaauuagccagac

SEQ ID NO: 629089 - RNA, 63 nt, Homo Sapiens
auagugagaccuugucucuacaaaaaauaaaauaaaauaaaaaccaaauuagccagacauggu

SEQ ID NO: 629090 - RNA, 63 nt, Homo Sapiens
aaaaaaauucaacagaugaaacuuuaaaaaauaaaaauaaacaaauguacuaaaaaccaauga

SEQ ID NO: 629091 - RNA, 63 nt, Homo Sapiens
uaaacaaaaaaaauucaacacaaugaacuuuaaaaaauaaaaauuugagaauguacuaaaaac

SEQ ID NO: 629092 - RNA, 63 nt, Homo Sapiens
aauuuaaaaaaugggcuaacaacaauaaggagaaaaauaaaucauaaauaacucuuauaacac

SEQ ID NO: 629093 - RNA, 63 nt, Homo Sapiens
uuuaaaaugacauuuuacagaauugugcaaaauaaaauaaacacaaaauuacucuacuguuaa

SEQ ID NO: 629094 - RNA, 63 nt, Homo Sapiens
aaacauuuaaaaugacauuuguuaaaauugugcaaaauaaaaucacagcaaaauuacucuacu

SEQ ID NO: 629095 - RNA, 63 nt, Homo Sapiens
ccauuauucuuaauauggccuccuauuucucuuaaaauaaaaucucuuaaaauaaaauccauu

SEQ ID NO: 629096 - RNA, 63 nt, Homo Sapiens
ccauuuccuauuucucuuaauccuguuucucuuaaaauaaaaugauuaugcuuaacagcuguu

SEQ ID NO: 629097 - RNA, 63 nt, Homo Sapiens
auaaaggguuuucuucuguucuuuuuguugaccaaaauaaaaugcugcugaguuaugcacaga

SEQ ID NO: 629098 - RNA, 63 nt, Homo Sapiens
auagcauuguuaaagauaguuuccccauggguaaaaauaaauaacaauguuuguacuuaugca

SEQ ID NO: 629099 - RNA, 63 nt, Homo Sapiens
caauuaaagaacuuggcaugcuuuuuauguaaaaaaauaaaauuuuauccaauuuuuacugaa

SEQ ID NO: 629100 - RNA, 63 nt, Homo Sapiens
gaaaaggaaacgaagaagcugacaagcaaacucaaaauaaagaggucaagagagagagaccca

SEQ ID NO: 629101 - RNA, 63 nt, Homo Sapiens
ccucuuuguuuaaaccauugaauucuuguaaauaaaauaaauccagccgccauccuucuccag

SEQ ID NO: 629102 - RNA, 63 nt, Homo Sapiens
ucaccacuuccccaaagaagaugcacaaucccuaaaauaaagaaggugaggguuacacugaag

SEQ ID NO: 629103 - RNA, 63 nt, Homo Sapiens
aauauuuaaauuccaaggagcaccuucuaacaaaaaauaaauaucuuauucuucauguaaucc

SEQ ID NO: 629104 - RNA, 63 nt, Homo Sapiens
ucccuaccuugcuucaguuaugcuguuuauaguaaaauaaaacaugaagacauuuaacgguug

SEQ ID NO: 629105 - RNA, 63 nt, Homo Sapiens
cagagguuauauacaauuuaaugccacaauuuaaaaauaaaacguauauuaggauuuaaauuu

SEQ ID NO: 629106 - RNA, 63 nt, Homo Sapiens
guauauuaggauuuaaauuuagaaauuuagggcaaaauaaagugauuuaauuccuuuuuagaa

SEQ ID NO: 629107 - RNA, 63 nt, Homo Sapiens
caguaucugccuucuggcucccuccccccacacaaaauaaaaacuaguacugugccgcuuccc

SEQ ID NO: 629108 - RNA, 63 nt, Homo Sapiens
uuucaggcuuugugguccugguguuucugcauuaaaauaaaugaaucaguguaacuaggggcu

SEQ ID NO: 629109 - RNA, 63 nt, Homo Sapiens
auucuauucauauuugucagucuguuaaaaauuaaaauaaauguaaguaugcuuuauuuuacc

SEQ ID NO: 629110 - RNA, 63 nt, Homo Sapiens
uguuacuuuuuuccuucuuuuagcaaauauuaaaaaauaaaacaacuaaggcauuaaagaaaa

SEQ ID NO: 629111 - RNA, 63 nt, Homo Sapiens
cugaccccaaagacaaauaauauuuaaaaaauaaaaauaaaagacccugucucaaaaaauaua

SEQ ID NO: 629112 - RNA, 63 nt, Homo Sapiens
uaaaagcugaccccaaagacaauauauauuuaaaaaauaaaaaagagagacccugucucaaaa

SEQ ID NO: 629113 - RNA, 63 nt, Homo Sapiens
auuauuugacaacaauccaauugagauuuuuuuaaaauaaauuugaauguguuugaacauguu

SEQ ID NO: 629114 - RNA, 63 nt, Homo Sapiens
ucuucuugaggugggguggaaaaauaaaaacaaaaaauaaauuaccgagugagacuguuucua

SEQ ID NO: 629115 - RNA, 63 nt, Homo Sapiens
caaaaaauaaauuucuucuugagacuguuucuaaaaauaaaaauccagccugggugaccgagu

SEQ ID NO: 629116 - RNA, 63 nt, Homo Sapiens
uuguuugacugaaagugauuaugaacuaacuugaaaauaaaagucuuuagugucaguuaaauu

SEQ ID NO: 629117 - RNA, 63 nt, Homo Sapiens
cagugaaaaaaaaaaucaaaagugaauaggggaaaaauaaacauuauuuuauccaaguacccc

SEQ ID NO: 629118 - RNA, 63 nt, Homo Sapiens
ucacaauguaauacuacuacuugaucaaauuugaaaauaaaauuuuuauuauuuucaucuuua

SEQ ID NO: 629119 - RNA, 63 nt, Homo Sapiens
aguaaucagaagcuaaaguauaaaguaaaaauaaaaauaaaaaaaaaauaauaauaauaauaa

SEQ ID NO: 629120 - RNA, 63 nt, Homo Sapiens
uaaaaaaguaaucagaagcuuaauaauaaaguaaaaauaaaaacaucucaaaaauaauaauaa

SEQ ID NO: 629121 - RNA, 63 nt, Homo Sapiens
acuguuucccuuuggaacuagaaaguacuccuuaaaauaaaacagcccucauauaauagguuu

SEQ ID NO: 629122 - RNA, 63 nt, Homo Sapiens
uaaaauauaggcuuuaaaaaaaaauuaaaaaauaaaauaaauaagugagacccugucacuaac

SEQ ID NO: 629123 - RNA, 63 nt, Homo Sapiens
aaauauaaaauauaggcuuucuaacaaaauuaaaaaauaaaauaauaaagugagacccuguca

SEQ ID NO: 629124 - RNA, 63 nt, Homo Sapiens
gucuguguucuaaacaauucacaauaaaugcaaaaaauaaaaauauguuauguauauuuuacc

SEQ ID NO: 629125 - RNA, 63 nt, Homo Sapiens
guuaaaagguuuuauguuaucuuaaaauguuuaaaaauaaauguguuauauuucaauaagaag

SEQ ID NO: 629126 - RNA, 63 nt, Homo Sapiens
agaacuccauaaauauuaaaaaaagcaaaggaaaaaauaaaucgcacaaagauuagcacacuu

SEQ ID NO: 629127 - RNA, 63 nt, Homo Sapiens
gacaacgcaagaccuaguggacccaaggagaggaaaauaaaaucauuuccuuccaguaaaucc

SEQ ID NO: 629128 - RNA, 63 nt, Homo Sapiens
aaaagugggagaauuccuugacagcaguauuugaaaauaaauaccacuugcagguuuauggaa

SEQ ID NO: 629129 - RNA, 63 nt, Homo Sapiens
uucuaauguagcuaucucgcgcaguuuuuuaaaaaaauaaauauacacugggcagacuucaga

SEQ ID NO: 629130 - RNA, 63 nt, Homo Sapiens
uguuuguuaguaugaaaaguuaacuuuuuuuccaaaauaaaagagugaauuuuucauguuaag

SEQ ID NO: 629131 - RNA, 63 nt, Homo Sapiens
uuaaguuaaaaaucuuugucuuguacuauuucaaaaauaaaaagacagcaaugacuuuauauc

SEQ ID NO: 629132 - RNA, 63 nt, Homo Sapiens
cugauguucuucacuaaauggauggccacaagaaaaauaaaguaaaugucuuaaauaauuuaa

SEQ ID NO: 629133 - RNA, 63 nt, Homo Sapiens
guauggauacauccauucacugugguacauuuuaaaauaaaauauuuuagcagugaauaugga

SEQ ID NO: 629134 - RNA, 63 nt, Homo Sapiens
gaauucaccacagcuggaauagcuguggaaaacaaaauaaaacaacaaaauuaauaaugaaau

SEQ ID NO: 629135 - RNA, 63 nt, Homo Sapiens
ugccuuuuauuccuuuaaaauuucgccuggcaaaaaauaaauaaauggaacuaucacuuuaua

SEQ ID NO: 629136 - RNA, 63 nt, Homo Sapiens
guaaugcaaacaaauuauuuuuuacaaaaaaacaaaauaaauaaaauuagacuuccuucccuc

SEQ ID NO: 629137 - RNA, 63 nt, Homo Sapiens
gaaauauugaaaauauugaaaauauuauuauugaaaauaaaaucuugaucucaacuauccccc

SEQ ID NO: 629138 - RNA, 63 nt, Homo Sapiens
auuugguuaguaccuucacugagcaauaguggaaaaauaaaaaaauaaguaaacagaaaaaac

SEQ ID NO: 629139 - RNA, 63 nt, Homo Sapiens
cccauauuaugaagaaauacucugcaacucuuaaaaauaaauguaaugugccaggcgcaaugg

SEQ ID NO: 629140 - RNA, 63 nt, Homo Sapiens
auagugagacuuggucucuaaaaaagaaaaaaaaaaauaaaacugauguaaugaauauauaau

SEQ ID NO: 629141 - RNA, 63 nt, Homo Sapiens
cuacaaugaacauguuuuauuuuuacuuuuguuaaaauaaauaacauuuaauuugacggaaaa

SEQ ID NO: 629142 - RNA, 63 nt, Homo Sapiens
aaagaaacaagagagaaaaaaaucaaaauaauuaaaauaaauuguuagagaaaaguuacuuua

SEQ ID NO: 629143 - RNA, 63 nt, Homo Sapiens
ugucaacugaagaucugacuguacuaaauaugaaaaauaaagcagcacauacuuucucuacug

SEQ ID NO: 629144 - RNA, 63 nt, Homo Sapiens
ccuuaaccuccagcagacuccugcucucuauccaaaauaaagaucacagagcagcaaguucau

SEQ ID NO: 629145 - RNA, 63 nt, Homo Sapiens
guucuccucuaucuuagagggguauucuucuugaaaauaaaaaauauugaaaugcuguauuuu

SEQ ID NO: 629146 - RNA, 63 nt, Homo Sapiens
uauauuuuagaaauuuguuaaugagaguaaaagaaaauaaauguguauagcucaguuuggaua

SEQ ID NO: 629147 - RNA, 63 nt, Homo Sapiens
uguuuaaauguccauuuuuauucuuuauguuugaaaauaaauuauggggauccuauuuagcuc

SEQ ID NO: 629148 - RNA, 63 nt, Homo Sapiens
augacuuuagugacauuauaaaacugaaacuggaaaauaaaauggcuuaucugcugauguuua

SEQ ID NO: 629149 - RNA, 63 nt, Homo Sapiens
aauaaaauggcuuaucugcugauguuuaucuuuaaaauaaauaaaaucuugcuagugugaaua

SEQ ID NO: 629150 - RNA, 63 nt, Homo Sapiens
uuaaauggaugcauacaguccacaucauacaauaaaauaaaagguaauucagggucccaaaga

SEQ ID NO: 629151 - RNA, 63 nt, Homo Sapiens
agaauaacuauaaaauaugaaagcucuaaauuuaaaauaaauuuagagauagaaucaugguac

SEQ ID NO: 629152 - RNA, 63 nt, Homo Sapiens
uuuauggucacaaguuaucccuccucaguaugaaaaauaaauuagauauugaaaaaugucuaa

SEQ ID NO: 629153 - RNA, 63 nt, Homo Sapiens
uguagaauuuauuuuaacuaugaccuuuaauugaaaauaaauaauuaaaauaucagacauguu

SEQ ID NO: 629154 - RNA, 63 nt, Homo Sapiens
uauauauuuaugauaaaucuuuuccauuuguacaaaauaaaauuccauuucauugugaccuac

SEQ ID NO: 629155 - RNA, 63 nt, Homo Sapiens
cuauauuuauguaacuguauacugaauucugacaaaauaaaaaaagauaccuuauugacgaaa

SEQ ID NO: 629156 - RNA, 57 nt, Homo Sapiens; identical to SEQ ID NO: 62053

SEQ ID NO: 629157 - RNA, 63 nt, Homo Sapiens
ucaucucuagggauguuuaacauuuauaauugcaaaauaaaccaacuauaaaaaaagaaacua

SEQ ID NO: 629158 - RNA, 63 nt, Homo Sapiens
cuuaauucuggguugcuuguuuuuuaggugacaaaaauaaaauauuguauuuuaauucauggg

SEQ ID NO: 629159 - RNA, 63 nt, Homo Sapiens
accuuuccucugccugaaagacgugucucaagaaaaauaaauucuauuuuagaugcagguacu

SEQ ID NO: 629160 - RNA, 63 nt, Homo Sapiens
aaaucaggagauggcugauucauaauggguaauaaaauaaauagcacuuucgagcugaugucg

SEQ ID NO: 629161 - RNA, 63 nt, Homo Sapiens
cuaggguuuuaaaaguaucuuggaaaauaaauaaaaauaaaaaacauucuaguaacuggccac

SEQ ID NO: 629162 - RNA, 63 nt, Homo Sapiens
aaaauaaaaacuaggguuuuaacuggccacuggaaaauaaauaaaaaauaaaaacauucuagu

SEQ ID NO: 629163 - RNA, 63 nt, Homo Sapiens
cauucuaguaacuggccacuuuauaacaugcaaaaaauaaaaaucaaaccacagagaaaauau

SEQ ID NO: 629164 - RNA, 63 nt, Homo Sapiens
aguaauaaagaauaaaauacuaaggauaaauaaaaaauaaaguuuugaaagugagcauucauu

SEQ ID NO: 629165 - RNA, 63 nt, Homo Sapiens
uauugaggaacauugcuuguuguugcagucccuaaaauaaaaauucuuuauguuuuaugaaag

SEQ ID NO: 629166 - RNA, 63 nt, Homo Sapiens
auuucauuugcacacaaugaaaacauuauuauuaaaauaaauuacacauuaaccagaaagcuu

SEQ ID NO: 629167 - RNA, 63 nt, Homo Sapiens
cucuguguaauuuuuccauuaauauucuuuacuaaaauaaaaaaauguuuuuaaauauaaaca

SEQ ID NO: 629168 - RNA, 63 nt, Homo Sapiens
uugugugauaauuuugaugauugugaaaaaaacaaaauaaauuuuauuugucuucuuuuugca

SEQ ID NO: 629169 - RNA, 63 nt, Homo Sapiens
ucaugucagacccagaaaggucuaguuaaaaagaaaauaaaucaacaaaacagauaugcuuac

SEQ ID NO: 629170 - RNA, 63 nt, Homo Sapiens
uuaauuuaaaaaguaucugauuaugucgcucaaaaaauaaaaucucccaaauauguucaauuc

SEQ ID NO: 629171 - RNA, 63 nt, Homo Sapiens
agaggauacuacaggcugggaucauagaaguaaaaaauaaaacuggaagcuaaaaaaauugau

SEQ ID NO: 629172 - RNA, 63 nt, Homo Sapiens
uaacauauuggugaagaugcacugucucaaaauaaaauaaaaaagccugggugacagagugag

SEQ ID NO: 629173 - RNA, 63 nt, Homo Sapiens
aaaaauaacauauuggugaagugagacugucucaaaauaaaauacuccagccugggugacaga

SEQ ID NO: 629174 - RNA, 63 nt, Homo Sapiens
aaaaaaguacucauuucuucacuuaaaggcauuaaaauaaacuaaauguaaaagucaccaaaa

SEQ ID NO: 629175 - RNA, 63 nt, Homo Sapiens
auaaauuuugaaacuaugagccagaaucaaaagaaaauaaaauaauugaccuuaauuuguuuu

SEQ ID NO: 629176 - RNA, 63 nt, Homo Sapiens
aggcuaauauauaauuuuucaaaaggagagaagaaaauaaagagucucaaaaaaaaaaaaaaa

SEQ ID NO: 629177 - RNA, 63 nt, Homo Sapiens
guuugacuucuaaacucugucucuuguaguuauaaaauaaaacuugugcuuuaaaaaaauaac

SEQ ID NO: 629178 - RNA, 63 nt, Homo Sapiens
ugucauugugcuuuaaaaaaaaacaauucacuaaaaauaaauagauuuuuuuaaaagucacaa

SEQ ID NO: 629179 - RNA, 63 nt, Homo Sapiens
augauguaaacaaaaaaaauuauugacuguaauaaaauaaaauuucauauauaaaaguauauu

SEQ ID NO: 629180 - RNA, 63 nt, Homo Sapiens
ggcagauuuaccucucauguagcuugcaaacucaaaauaaauuauuuauucuauuaaauugua

SEQ ID NO: 629181 - RNA, 63 nt, Homo Sapiens
cauauuguucauguuuuucuuaaaugagucuuaaaaauaaaggguuuugucgacaguaucuuu

SEQ ID NO: 629182 - RNA, 63 nt, Homo Sapiens
ucuuuacuaauaggcaauugucauugguccuaaaaaauaaaaaaacuucuagcuaaaauugua

SEQ ID NO: 629183 - RNA, 63 nt, Homo Sapiens
gucuucacuauguagcauacugccaacaaaauaaaaauaaaaaaauguugaaaccaacugaac

SEQ ID NO: 629184 - RNA, 63 nt, Homo Sapiens
uaaaaagucuucacuauguacugaacugccaacaaaauaaaaaucaauaaauguugaaaccaa

SEQ ID NO: 629185 - RNA, 63 nt, Homo Sapiens
aauuuuuaaugaccuggguccuaagugaaauuuaaaauaaauauaauuuucugaaagauaauu

SEQ ID NO: 629186 - RNA, 63 nt, Homo Sapiens
uuugaagugcuacuauaauaagucuagucagacaaaauaaagucaaaaagaaaauacauaugc

SEQ ID NO: 629187 - RNA, 63 nt, Homo Sapiens
uucacugcuccacuccagguucuugaaagagguaaaauaaaccugguggaauauauggagaga

SEQ ID NO: 629188 - RNA, 63 nt, Homo Sapiens
aauaugcaauaacauuaaauugaauaagcauaaaaaauaaauaagaaaguaauaaauucugua

SEQ ID NO: 629189 - RNA, 63 nt, Homo Sapiens
uauguugaauuggcacuuucuaaaauaaacacaaaaauaaauuuguguucuaaagucuuuuug

SEQ ID NO: 629190 - RNA, 63 nt, Homo Sapiens
caaaaauaaauuuauguugaaaagucuuuuuguaaaauaaacauaguguuccucauguguucu

SEQ ID NO: 629191 - RNA, 63 nt, Homo Sapiens
uuuuuacuuaaauaaugcauacacugagggaaaaaaauaaagcaaacaauaaagaagauucag

SEQ ID NO: 629192 - RNA, 63 nt, Homo Sapiens
aaucacuaaggauuggagaaaccaaucaaucaaaaaauaaauagacguaacuuagcauggauc

SEQ ID NO: 629193 - RNA, 63 nt, Homo Sapiens
uuucugcauuucaggugaguaaugaaggaaaccaaaauaaauaaaaacaaaauuuccaaaaac

SEQ ID NO: 629194 - RNA, 63 nt, Homo Sapiens
cucaggcaagcauuucuuuaccuuuuuccccaaaaaauaaacuaucauguugggauuaacuug

SEQ ID NO: 629195 - RNA, 63 nt, Homo Sapiens
caauaaaaucuucacaauaagaaaucuuugguaaaaauaaagauuugaaugcucaaacuaugg

SEQ ID NO: 629196 - RNA, 63 nt, Homo Sapiens
gaaucuuaaaauaggaacauuccaucucaaaaaaaaauaaaaacucggugacaagagcgagac

SEQ ID NO: 629197 - RNA, 63 nt, Homo Sapiens
cauuucuaaugaggauucacauuaauauaauauaaaauaaauaggucaguuacuggucucuuu

SEQ ID NO: 629198 - RNA, 63 nt, Homo Sapiens
uccgaauguuauguuuugcuuuuaucucacaguaaaauaaauauaauuaaugguuugcaugug

SEQ ID NO: 629199 - RNA, 63 nt, Homo Sapiens
cugaagggaaagggcucuuuuccugcuguuucaaaaauaaaagaacacauuagauguuacugu

SEQ ID NO: 629200 - RNA, 63 nt, Homo Sapiens
uagcuaaucucgguagaugucauuacaaccuggaaaauaaaucacccuaagugacacaaauug

SEQ ID NO: 629201 - RNA, 63 nt, Homo Sapiens
auuugaagugauauauuugguuaaacauuucuaaaaauaaacuaccaauacuaaauaguaaga

SEQ ID NO: 629202 - RNA, 63 nt, Homo Sapiens
uaaaaccacuaauuguuccguuaagcuucacagaaaauaaaaccucuauuacuagacauuuau

SEQ ID NO: 629203 - RNA, 63 nt, Homo Sapiens
gagauugcaccacugcacuccagcuugggugauaaaauaaaauaaaauagucgugaaucuugu

SEQ ID NO: 629204 - RNA, 63 nt, Homo Sapiens
ugcaccacugcacuccagcuugggugauaaaauaaaauaaaauagucgugaaucuuguucaaa

SEQ ID NO: 629205 - RNA, 63 nt, Homo Sapiens
gaugcacaacaaaagaaacaucagaaguuuauaaaaauaaaucugacuauaugcauccucauu

SEQ ID NO: 629206 - RNA, 63 nt, Homo Sapiens
ugucuucgagauguagaaauaaggaauauucugaaaauaaaaauuauacaguaguaaagauaa

SEQ ID NO: 629207 - RNA, 63 nt, Homo Sapiens
accaucuuuauuauggucauauuucacagcaccaaaauaaaucaucuuuauuaaguagaugaa

SEQ ID NO: 629208 - RNA, 63 nt, Homo Sapiens
agggauucacugacuagauuuuacugaacuaugaaaauaaauacacauaauuuuucacaaaau

SEQ ID NO: 629209 - RNA, 63 nt, Homo Sapiens
cuccagccugggcgacagagugagacuaucucaaaaauaaauaaauaaauaaauaaauaguau

SEQ ID NO: 629210 - RNA, 63 nt, Homo Sapiens
uucauucuuuaaauauuauugacuuacaguuuaaaaauaaauaaauaaaagcauacuauaguu

SEQ ID NO: 629211 - RNA, 63 nt, Homo Sapiens
ugaauauuugcucauguuuucuaaauuccuuauaaaauaaaauuaauucgaauucaaucugca

SEQ ID NO: 629212 - RNA, 63 nt, Homo Sapiens
uucuauuuucccuguauugguaucuccuuaaauaaaauaaaauauuccuauuguaagugauau

SEQ ID NO: 629213 - RNA, 63 nt, Homo Sapiens
gugauaugagaaaucuuuaaccagccuuaucuaaaaauaaaaagagaagccauuguaagacau

SEQ ID NO: 629214 - RNA, 63 nt, Homo Sapiens
cuccagccugggcaauaagagcaaaacuccaucaaaauaaaauaaaauaaaauauaaaauaac

SEQ ID NO: 629215 - RNA, 63 nt, Homo Sapiens
gccugggcaauaagagcaaaacuccaucaaaauaaaauaaaauaaaauauaaaauaacuuaaa

SEQ ID NO: 629216 - RNA, 63 nt, Homo Sapiens
ggcaauaagagcaaaacuccaucaaaauaaaauaaaauaaaauauaaaauaacuuaaaaagaa

SEQ ID NO: 629217 - RNA, 63 nt, Homo Sapiens
uauguaacuuaaaucuagacaccaucaaagcauaaaauaaaaauaaaaagcguugcugaaucu

SEQ ID NO: 629218 - RNA, 63 nt, Homo Sapiens
acuuaaaucuagacaccaucaaagcauaaaauaaaaauaaaaagcguugcugaaucugggucg

SEQ ID NO: 629219 - RNA, 63 nt, Homo Sapiens
guuuuuggauugucaaagaggaugcuuagucuuaaaauaaaaauaaauuuaaaaaucaucuua

SEQ ID NO: 629220 - RNA, 63 nt, Homo Sapiens
ggauugucaaagaggaugcuuagucuuaaaauaaaaauaaauuuaaaaaucaucuuauaauua

SEQ ID NO: 629221 - RNA, 63 nt, Homo Sapiens
ugucuagauuauauagguuuagguugaaguuauaaaauaaaauaaaauucauuuuccacugga

SEQ ID NO: 629222 - RNA, 63 nt, Homo Sapiens
agauuauauagguuuagguugaaguuauaaaauaaaauaaaauucauuuuccacuggaacucu

SEQ ID NO: 629223 - RNA, 63 nt, Homo Sapiens
uccaccaauaucauguguagauauuauguauagaaaauaaaauaaauuauggcucuaacuucu

SEQ ID NO: 629224 - RNA, 63 nt, Homo Sapiens
caauaucauguguagauauuauguauagaaaauaaaauaaauuauggcucuaacuucuguguu

SEQ ID NO: 629225 - RNA, 63 nt, Homo Sapiens
auuaucccucaaaaaguuaccaccacaucagaaaaaauaaaaaaaaaauaguaaaguaggcag

SEQ ID NO: 629226 - RNA, 63 nt, Homo Sapiens
uacagaguaauuacauggugauuuuugcaauguaaaauaaaguguuucugauuauuuucuaug

SEQ ID NO: 629227 - RNA, 63 nt, Homo Sapiens
auacuucuccauacacagaccucugcagaaugcaaaauaaaacuugcagugaaugaauuuagc

SEQ ID NO: 629228 - RNA, 63 nt, Homo Sapiens
uguauuugugaauaacaaaccacgguucaacagaaaauaaauggccaauuagcuucuacuaac

SEQ ID NO: 629229 - RNA, 63 nt, Homo Sapiens
cacgaggacauaguggucacaggagggguagcaaaaauaaagucccaucucugucaccuagcc

SEQ ID NO: 629230 - RNA, 63 nt, Homo Sapiens
caucaguaacaaaagaaauuacuguucuuggaaaaaauaaaaauaggugccuaguaaauguua

SEQ ID NO: 629231 - RNA, 63 nt, Homo Sapiens
acaauugaucugucauccauacaguguuaaaagaaaauaaauuccaguuuucuuuaugaugau

SEQ ID NO: 629232 - RNA, 63 nt, Homo Sapiens
aaaaaggaaaaucauucaggccuucaaaaaauaaaaauaaaaggaccaccaguaaauaauccu

SEQ ID NO: 629233 - RNA, 63 nt, Homo Sapiens
uaaaagaaaaaggaaaaucaaauccuccuucaaaaaauaaaaacuuuuagaccaccaguaaau

SEQ ID NO: 629234 - RNA, 63 nt, Homo Sapiens
uuaaauaguuguuuccucuaaaauuagacuuugaaaauaaagcuguuuguucagucugaauua

SEQ ID NO: 629235 - RNA, 63 nt, Homo Sapiens
uuauucccuauaacuuaaaaaacacuaucugccaaaauaaacuaugcaacuuuaauuuuguuu

SEQ ID NO: 629236 - RNA, 63 nt, Homo Sapiens
gcagcaauaugucauuaacacuuaauaaugaauaaaauaaaaaccccacagagugccuagaau

SEQ ID NO: 629237 - RNA, 63 nt, Homo Sapiens
cguauguuugaccaaguaguuucaaauaagaaaaaaauaaagauaaagaucagaugguaaucu

SEQ ID NO: 629238 - RNA, 63 nt, Homo Sapiens
cauuuucaguaugugauauaaauguaaauggauaaaauaaaaugacaaguuuauaucaaguua

SEQ ID NO: 629239 - RNA, 63 nt, Homo Sapiens
uguaagcaaaauuuucuuuuuauaaggaagaauaaaauaaacggacccauuuugauaagucuu

SEQ ID NO: 629240 - RNA, 63 nt, Homo Sapiens
uaaucuuuuaaaaugugucaagauuugggggacaaaauaaaauuuuguuacuuuugucccccc

SEQ ID NO: 629241 - RNA, 63 nt, Homo Sapiens
aauguguuuuuaucguaauugacuguggcuuuuaaaauaaagacagcaaaaugccugcaccau

SEQ ID NO: 629242 - RNA, 63 nt, Homo Sapiens
uuuuuauucuuuacucuugaaaaugguauuuuuaaaauaaaugaacuuggggcaauugaugcu

SEQ ID NO: 629243 - RNA, 63 nt, Homo Sapiens
uuuauagagauccuugaguaucaggcuuucuuaaaaauaaauuaaaaaaauauacaugcuuac

SEQ ID NO: 629244 - RNA, 63 nt, Homo Sapiens
auagaaagguguaaguauaucuguuugauguaaaaaauaaaaauuacagcaucaucacauuac

SEQ ID NO: 629245 - RNA, 63 nt, Homo Sapiens
uauuucuuaaaaauaaguguaguaacuacaaguaaaauaaauuaaaauuauuucuaggguuua

SEQ ID NO: 629246 - RNA, 63 nt, Homo Sapiens
cuauaauauagauaucaaaugggaauauuuuucaaaauaaauaaauuguuuuacccucaagcu

SEQ ID NO: 629247 - RNA, 63 nt, Homo Sapiens
uacauaaagaaccaaaaagguuaucaaguaauuaaaauaaauccuaaucaacuacccuuucuu

SEQ ID NO: 629248 - RNA, 63 nt, Homo Sapiens
uauuaucgaggaguuuuaaaguacuguaacuuuaaaauaaauaacuacaaagcuucuuugucc

SEQ ID NO: 629249 - RNA, 63 nt, Homo Sapiens
uucuguuugcagauaugauugauguauuucaccaaaauaaaauauuuuuauguuuauaaagug

SEQ ID NO: 629250 - RNA, 63 nt, Homo Sapiens
ugagcaugcauggauauacccaauaguacacacaaaauaaauguuuacuuaagagccauucua

SEQ ID NO: 629251 - RNA, 63 nt, Homo Sapiens
gaagaggucccaaauuuggaguaaagaugggagaaaauaaauaugugcuauuuccuuggcgag

SEQ ID NO: 629252 - RNA, 63 nt, Homo Sapiens
cuuuugcugucuuucucuaaauaugauuacuuuaaaauaaaaaaguaacaaggugucuuuucc

SEQ ID NO: 629253 - RNA, 63 nt, Homo Sapiens
ugccguauaggaugucagacaauaccacugguuaaaauaaagccuauuuuucaaauuuaguga

SEQ ID NO: 629254 - RNA, 63 nt, Homo Sapiens
uuaauaguaugaucuuuaaaguuuugacaauauaaaauaaacuugguaacuguuuuacaaaua

SEQ ID NO: 629255 - RNA, 63 nt, Homo Sapiens
uguuggucauaaguuaacuguauuaagaacaguaaaauaaauaaaaaccaauaguacuaauuu

SEQ ID NO: 629256 - RNA, 63 nt, Homo Sapiens
ccaaagaauuugcuuuauguuuuuagcuauuuaaaaauaaauccaucaaaaauaaaguaugca

SEQ ID NO: 629257 - RNA, 63 nt, Homo Sapiens
uauguuuuuagcuauuuaaaaauaaauccaucaaaaauaaaguaugcaaauguaucuuuuaaa

SEQ ID NO: 629258 - RNA, 63 nt, Homo Sapiens
ucauguugugacaaauugaucacuuguguacgaaaaauaaaucuccuuaaaaacuaaauaaaa

SEQ ID NO: 629259 - RNA, 63 nt, Homo Sapiens
auuaauacaguaguaguaaucauuuucuaggggaaaauaaaagaauaaaucacuauacugaua

SEQ ID NO: 629260 - RNA, 63 nt, Homo Sapiens
aaaguguaggugaaaaaacuuguaacuguauugaaaauaaauaccauuaaacugugaucaguu

SEQ ID NO: 629261 - RNA, 63 nt, Homo Sapiens
uuuguuuugguacauuugguugugcuuguggggaaaauaaaaacgcagagauccuuauauauu

SEQ ID NO: 629262 - RNA, 63 nt, Homo Sapiens
uccagccugggugacaaagcaagacugugucucaaaauaaauaaauaaaauaaaauaaaauga

SEQ ID NO: 629263 - RNA, 63 nt, Homo Sapiens
acaaagcaagacugugucucaaaauaaauaaauaaaauaaaauaaaaugacguacagagauuc

SEQ ID NO: 629264 - RNA, 63 nt, Homo Sapiens
gcaagacugugucucaaaauaaauaaauaaaauaaaauaaaaugacguacagagauucuauau

SEQ ID NO: 629265 - RNA, 63 nt, Homo Sapiens
guuuuaugcuauuccuguguucuccaaaacaagaaaauaaaaagacaugacuuauucucuguu

SEQ ID NO: 629266 - RNA, 63 nt, Homo Sapiens
uguaugcuuuaaauagagaauuuauuucuuuuaaaaauaaagcuaucuuuccuuauccauguu

SEQ ID NO: 629267 - RNA, 63 nt, Homo Sapiens
uucuuggauuucacccaacuaaaaggauuuuuaaaaauaaauaacagucuuaccuaaauuauu

SEQ ID NO: 629268 - RNA, 63 nt, Homo Sapiens
ugagauaugacgguguacuuacugccuuguagcaaaauaaagaugugcccuuauuuuaccuac

SEQ ID NO: 629269 - RNA, 63 nt, Homo Sapiens
auaaguuuacacacugugcaaucucacaaucugaaaauaaaguugaguuggcuguguuuucuc

SEQ ID NO: 629270 - RNA, 63 nt, Homo Sapiens
aaauauauauggaacugaaacauuaacuuagcuaaaauaaaagcaaucuguguuugagaugaa

SEQ ID NO: 629271 - RNA, 63 nt, Homo Sapiens
agguaaacauuuuaaccuguaucuuagccacaaaaaauaaaucauuaaaaaaauaguuaugaa

SEQ ID NO: 629272 - RNA, 63 nt, Homo Sapiens
uuguuagcuucgaugaagucauuuauacccuauaaaauaaaacgaagauuuuuuugaagauua

SEQ ID NO: 629273 - RNA, 63 nt, Homo Sapiens
ccauauauuaauaaaaaccuucuugagcaccagaaaauaaaaugucaguuuagcauuacauug

SEQ ID NO: 629274 - RNA, 63 nt, Homo Sapiens
aaaaaucccuaaaaacucuccaguuucacuucaaaaauaaaaaaugcuauaaguauguacaua

SEQ ID NO: 629275 - RNA, 63 nt, Homo Sapiens
guuuacuugucugcagaauacuauuugugguuuaaaauaaaaguaguuguggccaccugcuga

SEQ ID NO: 629276 - RNA, 63 nt, Homo Sapiens
ucaguuaaauauuggaagcuaucauccucaaguaaaauaaauacaugcuuuuuggaaauuuac

SEQ ID NO: 629277 - RNA, 63 nt, Homo Sapiens
cuuaauuacauauacaggaaguuaaaauuucugaaaauaaauggagaaucaauugcugaaagu

SEQ ID NO: 629278 - RNA, 63 nt, Homo Sapiens
ucucagaauugugauuuuagguuuguaugauuaaaaauaaauucugcaguuaaaucauauaau

SEQ ID NO: 629279 - RNA, 63 nt, Homo Sapiens
aggaauuauguggucagugcuguauaacuguguaaaauaaaaaaaauguguauuuagaauauu

SEQ ID NO: 629280 - RNA, 63 nt, Homo Sapiens
auuuuauuccauuugcuuguuugcaauacuuuaaaaauaaaaaguuacaaaccugugggccug

SEQ ID NO: 629281 - RNA, 63 nt, Homo Sapiens
uaauuuaaaaaauucuguguuuguuuucaucaaaaaauaaaaaaagugucacuaccguauuuc

SEQ ID NO: 629282 - RNA, 63 nt, Homo Sapiens
gucacuaccguauuucuuguugugcuugaaggaaaaauaaaguaguacuuuugucuucuccca

SEQ ID NO: 629283 - RNA, 63 nt, Homo Sapiens
uuuggauuaaauuaguuugugaaggauuauggaaaaauaaaacugucacuguuggacgucagc

SEQ ID NO: 629284 - RNA, 63 nt, Homo Sapiens
auauucucuauuugaauuauuucugucacaguaaaaauaaaauacuuugaguuuugagcuacu

SEQ ID NO: 629285 - RNA, 63 nt, Homo Sapiens
aucauguuaaccucugcuuuuaucucagauguuaaaauaaaugguuuggugcuuuuuauaaaa

SEQ ID NO: 629286 - RNA, 63 nt, Homo Sapiens
aaaaaaaaaacaaaaaaaaaaaaacaaaagaaaaaaauaaaaauacgguggcaauauuaugua

SEQ ID NO: 629287 - RNA, 63 nt, Homo Sapiens
acauuauguguaacagauugauuuucucagcacaaaauaaaaagcaucuguauuaauguaaag

SEQ ID NO: 629288 - RNA, 63 nt, Homo Sapiens
uaucuugguacauaccuauuugaaaaugcuacuaaaauaaaaauaaaucuuugccaaaaauuu

SEQ ID NO: 629289 - RNA, 63 nt, Homo Sapiens
gguacauaccuauuugaaaaugcuacuaaaauaaaaauaaaucuuugccaaaaauuuuuuuuc

SEQ ID NO: 629290 - RNA, 63 nt, Homo Sapiens
guuauggaaaaugucaaccuuuguaagaaaaccaaaauaaaaauugaaaaauaaaaaccauaa

SEQ ID NO: 629291 - RNA, 63 nt, Homo Sapiens
caaccuuuguaagaaaaccaaaauaaaaauugaaaaauaaaaaccauaaacauuugcaccacu

SEQ ID NO: 629292 - RNA, 63 nt, Homo Sapiens
agccuggauaacagagcgagacccugucucaaaaaaauaaaauaaaaaauaaaaacacccuug

SEQ ID NO: 629293 - RNA, 63 nt, Homo Sapiens
ggauaacagagcgagacccugucucaaaaaaauaaaauaaaaaauaaaaacacccuugccugc

SEQ ID NO: 629294 - RNA, 63 nt, Homo Sapiens
agagcgagacccugucucaaaaaaauaaaauaaaaaauaaaaacacccuugccugcgcuccau

SEQ ID NO: 629295 - RNA, 63 nt, Homo Sapiens
gaagcacuaagacugcuucuaggcuuuauuuauaaaauaaacaccuuaucccuaacaugggca

SEQ ID NO: 629296 - RNA, 63 nt, Homo Sapiens
ucauguacauuugaaaauauuugcacacauuuaaaaauaaauguaaaguugucuuuuaaacua

SEQ ID NO: 629297 - RNA, 63 nt, Homo Sapiens
gucugcauuucuacuguaaaaugcaauuugaaaaaaauaaaacgcaaaaaaagaaacuguaaa

SEQ ID NO: 629298 - RNA, 63 nt, Homo Sapiens
aauuaaauggaaugaaugauauguauauuacucaaaauaaaguuucuuucacuuuaauaauca

SEQ ID NO: 629299 - RNA, 63 nt, Homo Sapiens
uauuugcuggugucguguaaauauugguauuuuaaaauaaaaacuguuacaucacuauuuuaa

SEQ ID NO: 629300 - RNA, 63 nt, Homo Sapiens
ucacaacaauuugacacccuucauucauuuauaaaaauaaaugagcuaguucuuuaguaguua

SEQ ID NO: 629301 - RNA, 63 nt, Homo Sapiens
acuuucucuaguuuuggagcauuuuauaucaauaaaauaaaauaccuuuaaacccauaaauua

SEQ ID NO: 629302 - RNA, 63 nt, Homo Sapiens
uaguaggcaagaccccucaguguaaaguucuacaaaauaaagcuuuauuuauauuucacauaa

SEQ ID NO: 629303 - RNA, 63 nt, Homo Sapiens
augaaaaaagaacuauaauaguguacauauaugaaaauaaaugagauuccuaauucuaugaca

SEQ ID NO: 629304 - RNA, 63 nt, Homo Sapiens
caaucaaacacagaauuugauaaagcugaguauaaaauaaaacuacaguuuugugauauaaaa

SEQ ID NO: 629305 - RNA, 63 nt, Homo Sapiens
ugaguauaaaauaaaaccaaaguuuugugauauaaaauaaagcuaaccuuauaccugaauuac

SEQ ID NO: 629306 - RNA, 61 nt, Homo Sapiens
uauggcucuuuauuuuccuuugccucugacccaaaaauaaaaaaucacauuuaaaauaaac

SEQ ID NO: 629307 - RNA, 63 nt, Homo Sapiens
gccucugacccaaaaauaaaugaaaucacauuuaaaauaaacuaagcugcuuauaaauguaaa

SEQ ID NO: 629308 - RNA, 63 nt, Homo Sapiens
ugagggcauguugcauauuguuucccccaaaacaaaauaaaaugcucuagguucuucagcaca

SEQ ID NO: 629309 - RNA, 63 nt, Homo Sapiens
aaaaggagaggcagacaaugauaauaauaaagaaaaauaaauauagaaacucuaaaaacaaaa

SEQ ID NO: 629310 - RNA, 63 nt, Homo Sapiens
ccauauuucaaacaaaacacauaugugcauuguaaaauaaauggcuuguuacaauucgaccua

SEQ ID NO: 629311 - RNA, 63 nt, Homo Sapiens
gugucacugugguaggcauuaagcuuucuuguuaaaauaaaagcccuucccaguauacuugaa

SEQ ID NO: 629312 - RNA, 63 nt, Homo Sapiens
ggaaugaucaucuuggcuugcagcggaaaguugaaaauaaacuuggggagggcauggaagauc

SEQ ID NO: 629313 - RNA, 63 nt, Homo Sapiens
uucacugcccuaucaaaauaccucacauacuauaaaauaaaucaacacacacacacacacacc

SEQ ID NO: 629314 - RNA, 63 nt, Homo Sapiens
aaacccaaagaaaguuuauuaauuuauuauaggaaaauaaauccauuuuacauaaaaugcuaa

SEQ ID NO: 629315 - RNA, 63 nt, Homo Sapiens
gacuauuaaccagaaaagaaagagcguuugauuaaaauaaaguauaagaaguccauauacuga

SEQ ID NO: 629316 - RNA, 63 nt, Homo Sapiens
auccaacuucuuugcauuacguaaaaaaguaaaaaaauaaaucgaagaauuuauauuuggaaa

SEQ ID NO: 629317 - RNA, 63 nt, Homo Sapiens
cgauucccagauuccauacauuacaagucagguaaaauaaaauacaauuuuaaauaauucauc

SEQ ID NO: 629318 - RNA, 63 nt, Homo Sapiens
uucacacaauaaaaaacaacaaauauuauuaguaaaauaaaauaauuaguuaaaauauauuaa

SEQ ID NO: 629319 - RNA, 63 nt, Homo Sapiens
uuauuucuauccaaauuugaggauugacuuaugaaaauaaauuuacaugaagcucaaguguua

SEQ ID NO: 629320 - RNA, 63 nt, Homo Sapiens
ccugcuucagugucuuaaugguaguaaucauacaaaauaaaaauuguaacucaacugguaaca

SEQ ID NO: 629321 - RNA, 63 nt, Homo Sapiens
aaauguuaucaaaagauguugaaaucauuaucuaaaauaaaggaauaaagucuccuugguacu

SEQ ID NO: 629322 - RNA, 63 nt, Homo Sapiens
aaugaaauguuucaaugauaaauauaaauaaggaaaauaaaucacuucuguaaagagaauauc

SEQ ID NO: 629323 - RNA, 63 nt, Homo Sapiens
gacuuuucaaauuauaaugauuuuuauuaugaaaaaauaaaauugcaucagaucauggaugca

SEQ ID NO: 629324 - RNA, 63 nt, Homo Sapiens
uuugcuuuuuuuuuuuuuuuaaagacaaagcaaaaaauaaacccucaugcuaaaaauacaaca

SEQ ID NO: 629325 - RNA, 63 nt, Homo Sapiens
auuuaaaaucaaaucaaaaaauuacaaaacagaaaaauaaaugagaaugaaaacugcugacgu

SEQ ID NO: 629326 - RNA, 63 nt, Homo Sapiens
gauguagaaaucuaaaugaaaugucauauguuaaaaauaaagaucuuaguucagaaauacaua

SEQ ID NO: 629327 - RNA, 63 nt, Homo Sapiens
guuauuagcugauuuuacucauuuuauauuugcaaaauaaauuucuaauauuuauugaaauug

SEQ ID NO: 629328 - RNA, 63 nt, Homo Sapiens
agaaaaggguguguuuggaugaaaguaaaaaaaaaaauaaaaucuuucacugucucuaauggc

SEQ ID NO: 629329 - RNA, 63 nt, Homo Sapiens
uuuauuauuucaaaagaauaugucuuaaaagggaaaauaaaaacuuucuguugaaucacaaca

SEQ ID NO: 629330 - RNA, 63 nt, Homo Sapiens
aaagcaaccugucuuacauucuuacauuaucuuaaaauaaauauuucugcccuugaaucaaga

SEQ ID NO: 629331 - RNA, 63 nt, Homo Sapiens
uagccugggcaacggugagacccugccucaaaaaaaauaaaaauaaaaauaaaacacuuuaau

SEQ ID NO: 629332 - RNA, 63 nt, Homo Sapiens
gggcaacggugagacccugccucaaaaaaaauaaaaauaaaaauaaaacacuuuaauuagaau

SEQ ID NO: 629333 - RNA, 63 nt, Homo Sapiens
cggugagacccugccucaaaaaaaauaaaaauaaaaauaaaacacuuuaauuagaaucuauuu

SEQ ID NO: 629334 - RNA, 60 nt, Homo Sapiens; identical to SEQ ID NO: 62231

SEQ ID NO: 629335 - RNA, 63 nt, Homo Sapiens
aaagaaacauaaggacacauuuucaaauuaauaaaaauaaaggcauuuuaaggauggccugug

SEQ ID NO: 629336 - RNA, 63 nt, Homo Sapiens
gagcacaauggucuuacauuggauuuuuguaaaaaaauaaaaauaaauggagacuuuaacuca

SEQ ID NO: 629337 - RNA, 63 nt, Homo Sapiens
aauggucuuacauuggauuuuuguaaaaaaauaaaaauaaauggagacuuuaacucaagcagc

SEQ ID NO: 629338 - RNA, 63 nt, Homo Sapiens
aaaccaaaguuuauuaauaauuuuuauauaacuaaaauaaaauagauguggagggaucuguga

SEQ ID NO: 629339 - RNA, 63 nt, Homo Sapiens
ccagacuagugaguuaaguacaagaucucucuaaaaauaaacagaugaaaaucuauccccauu

SEQ ID NO: 629340 - RNA, 63 nt, Homo Sapiens
gcagaaugaaguauguuuguuuauuuuucuuuaaaaauaaaggauuuuggaacucuggagagu

SEQ ID NO: 629341 - RNA, 63 nt, Homo Sapiens
accuaggcaacauggugaaaccuugucucuaccaaaauaaaaauuagcugggcaugguggcac

SEQ ID NO: 629342 - RNA, 63 nt, Homo Sapiens
gcuauaguggaaucuuugguuuugcaucauaguaaaauaaaauaaacccaucacauuuggaac

SEQ ID NO: 629343 - RNA, 63 nt, Homo Sapiens
aguggaaucuuugguuuugcaucauaguaaaauaaaauaaacccaucacauuuggaacauaac

SEQ ID NO: 629344 - RNA, 63 nt, Homo Sapiens
auauucauucagacaaaucagaaagggcacuugaaaauaaauuuugauucugagccaggagaa

SEQ ID NO: 629345 - RNA, 63 nt, Homo Sapiens
cuauggugugaaauccuuuguuauuuuucuaaaaaaauaaaauuuaaaaagaaagaaaacuaa

SEQ ID NO: 629346 - RNA, 63 nt, Homo Sapiens
guauuucaaagcucuuuuccuaacugguuaaguaaaauaaaaaauugagcuuucuagaauauu

SEQ ID NO: 629347 - RNA, 63 nt, Homo Sapiens
aaaaaagagagaguaacuacagaagaacuuuaaaaaauaaaaaauaagcuuaccuuggauucu

SEQ ID NO: 629348 - RNA, 63 nt, Homo Sapiens
guuuuguuuuucacaaagcucuuauuaugaagcaaaauaaaaauucuaguuucuuguaugauu

SEQ ID NO: 629349 - RNA, 63 nt, Homo Sapiens
gaguauuugcacugcugaagagucacuaugagcaaaauaaaacaaauaagacucaaacugcuc

SEQ ID NO: 629350 - RNA, 63 nt, Homo Sapiens
agcagaaaggcauggcuaauaauguugguggugaaaauaaauaaauaaguaaacaaaaugaag

SEQ ID NO: 629351 - RNA, 63 nt, Homo Sapiens
aaaugcauauaaaucuugauaaacaaagucuauaaaauaaaacaugggacauuagcuuuggga

SEQ ID NO: 629352 - RNA, 63 nt, Homo Sapiens
guuaaaauguuugauuccuugggaauggccuuaaaaauaaauguaauaaagucagaguggugg

SEQ ID NO: 629353 - RNA, 63 nt, Homo Sapiens
ucucaguuuaauauaaaaugagcuaaguuuuuaaaaauaaauuauaaacuuggagauuagaaa

SEQ ID NO: 629354 - RNA, 63 nt, Homo Sapiens
uuuuaaaaauaaauuauaaacuuggagauuagaaaaauaaagcaguugcuguagaauaggcug

SEQ ID NO: 629355 - RNA, 63 nt, Homo Sapiens
uuuuaaccagacuuucucuuaaaaacauuagauaaaauaaaagauucaccggauggauucuga

SEQ ID NO: 629356 - RNA, 63 nt, Homo Sapiens
guguaggagugaagacaggaucccgugcuuaaaaaaauaaaaaauaaaaaaauaaaaaaaaaa

SEQ ID NO: 629357 - RNA, 63 nt, Homo Sapiens
agugaagacaggaucccgugcuuaaaaaaauaaaaaauaaaaaaauaaaaaaaaaauaagacu

SEQ ID NO: 629358 - RNA, 63 nt, Homo Sapiens
caggaucccgugcuuaaaaaaauaaaaaauaaaaaaauaaaaaaaaaauaagacuuuaacugc

SEQ ID NO: 629359 - RNA, 63 nt, Homo Sapiens
uugcuucucgggaaagcaaagaagcugcuuuaaaaaauaaaaaggggacuaaaaauuuguuuu

SEQ ID NO: 629360 - RNA, 63 nt, Homo Sapiens
auauugugaaaaugaaucuguuaugauaaagaaaaaauaaaguggaaacuuuuagaguauuac

SEQ ID NO: 629361 - RNA, 63 nt, Homo Sapiens
uuugcauguaaacaaugauuucaaaauacuugaaaaauaaaauuuuaacccaaaugaauaacu

SEQ ID NO: 629362 - RNA, 63 nt, Homo Sapiens
uuaaaaccccauuuuccuaaagaacaaaguaguaaaauaaaaaaaaauuuaaaaaauuaaaaa

SEQ ID NO: 629363 - RNA, 63 nt, Homo Sapiens
aguaguaaaauaaaaaaaaauuuaaaaaauuaaaaaauaaaaaaaagaggucacuaaaagacc

SEQ ID NO: 629364 - RNA, 63 nt, Homo Sapiens
agugucucuauuuaugagaucacugaacuuuucaaaauaaagcuuuugcauagaauaaugaag

SEQ ID NO: 629365 - RNA, 63 nt, Homo Sapiens
acugcuguaaagcaaaauauuugugaaagugccaaaauaaagucugucaugccaaaaguaaau

SEQ ID NO: 629366 - RNA, 63 nt, Homo Sapiens
auuuacacaggguuuauacagauucugauaaaaaaaauaaauuaguguguuaugaaugacuaa

SEQ ID NO: 629367 - RNA, 63 nt, Homo Sapiens
gcuuucuggaagaagacaccgaauacucugaaaaaaauaaaaauuuuaaacccccaugaacac

SEQ ID NO: 629368 - RNA, 63 nt, Homo Sapiens
uuaggauauagugguaauggggaauaccuugcuaaaauaaaaccaauauacuauauguaauag

SEQ ID NO: 629369 - RNA, 63 nt, Homo Sapiens
aaguguaauuaauucuuucaacuguuaauguaaaaaauaaagcgagaacugugauuuaaaagu

SEQ ID NO: 629370 - RNA, 63 nt, Homo Sapiens
caguuaacauagagugguuuaaacuauuuuuuaaaaauaaauauugcauuuuauuaccauuuc

SEQ ID NO: 629371 - RNA, 63 nt, Homo Sapiens
ggaccagaaaagaaaagaaagaguacauuaaguaaaauaaaauaggcuuauuaugauacuagu

SEQ ID NO: 629372 - RNA, 63 nt, Homo Sapiens
uaugcuaauaaaauccugagaaugugaaguuauaaaauaaauaauacaaaguaaaauguuaua

SEQ ID NO: 629373 - RNA, 63 nt, Homo Sapiens
uguuugacuugucagguguuuuguaauguuugaaaaauaaagcgucaaaaaaaaaaauaccuu

SEQ ID NO: 629374 - RNA, 63 nt, Homo Sapiens
uggauagguggugacccacuaaauaaaauaaauaaaauaaaaagguaaacaaagaaaugacaa

SEQ ID NO: 629375 - RNA, 63 nt, Homo Sapiens
aaauaaaaauggauagguggaaaugacaaaaauaaaauaaauaaaaaggauagguaaacaaag

SEQ ID NO: 629376 - RNA, 63 nt, Homo Sapiens
aaauaaaauaaaaauggauacaaagaaaugacaaaaauaaaauuuuaaaaaaggauagguaaa

SEQ ID NO: 629377 - RNA, 63 nt, Homo Sapiens
agcuauguauuaacacugccuuucuccuuugauaaaauaaaugauugcuuacuuuggaauaca

SEQ ID NO: 629378 - RNA, 63 nt, Homo Sapiens
caccuagucuaaggaugcuaauaaaauaaaauaaaaauaaauuaaaaggacaauuucaaaaaa

SEQ ID NO: 629379 - RNA, 63 nt, Homo Sapiens
uaaauucaccuagucuaaggaaaaaaauaaaauaaaauaaaaacaugaaaaaaggacaauuuc

SEQ ID NO: 629380 - RNA, 63 nt, Homo Sapiens
aaaaauaaauucaccuagucauuucaaaaaaauaaaauaaaauuuugacaugaaaaaaggaca

SEQ ID NO: 629381 - RNA, 63 nt, Homo Sapiens
aaaauaaaaauaaauucaccggacaauuucaaaaaaauaaaauaauguuuugacaugaaaaaa

SEQ ID NO: 629382 - RNA, 63 nt, Homo Sapiens
cccaauuccauugggaaaaauugagaaaaaaauaaaauaaauuaaaaauaaauaacaagauaa

SEQ ID NO: 629383 - RNA, 63 nt, Homo Sapiens
aaauucccaauuccauuggggauaauugagaaaaaaauaaaauuugagaaaaauaaauaacaa

SEQ ID NO: 629384 - RNA, 63 nt, Homo Sapiens
acaagauaauugagaaaaaaaaaauaauugagaaaaauaaauaacuugagccaaucugagagc

SEQ ID NO: 629385 - RNA, 63 nt, Homo Sapiens
aagcacaaguacgaacuuagcuauuuauaaaauaaaauaaaccuggaaccaugcgagugauac

SEQ ID NO: 629386 - RNA, 63 nt, Homo Sapiens
aaaccaagcacaaguacgaagauaccuauuuauaaaauaaaaugcauuuggaaccaugcgagu

SEQ ID NO: 629387 - RNA, 63 nt, Homo Sapiens
uaugaaaacaguacacuguuauauaauaccucaaaaauaaaaagucuauacacuucacacuuu

SEQ ID NO: 629388 - RNA, 63 nt, Homo Sapiens
aaaacugcuuacaccagaagauuggcaaaaacuaaaauaaauucacuuuucuaaggacugaag

SEQ ID NO: 629389 - RNA, 63 nt, Homo Sapiens
aauaaaaaaagaaagcaugaauauuacaaaaacaaaauaaaauagaauacuauuuccaaacuc

SEQ ID NO: 629390 - RNA, 63 nt, Homo Sapiens
uauucacauuguuaagaaaauccuccauuugagaaaauaaagcuccacuaugccuuaaugguu

SEQ ID NO: 629391 - RNA, 63 nt, Homo Sapiens
aauuauaaauaucauuguacuugaagucuauaaaaaauaaaaugugucuauaaaagaaacacu

SEQ ID NO: 629392 - RNA, 63 nt, Homo Sapiens
aaguucuuaaaaaauuuauauucuuccuuuuuuaaaauaaaauuuucugccaaaauaaaccug

SEQ ID NO: 629393 - RNA, 63 nt, Homo Sapiens
uguucuuccuuuuuuaaaauuuacuuuucugccaaaauaaaccaauuuugcauauucucuauu

SEQ ID NO: 629394 - RNA, 63 nt, Homo Sapiens
cugucaaguucuuuucaaaaacuaugucuuauuaaaauaaaacuuuuaagccauuuccucuuc

SEQ ID NO: 629395 - RNA, 63 nt, Homo Sapiens
uauuuaauaauuuuuguuucugacacuuuagaaaaaauaaacagcccuggcaguggcuacauu

SEQ ID NO: 629396 - RNA, 63 nt, Homo Sapiens
ugugaaaaaguaaagauaacuaaaaaauuuagaaaaauaaauccaguauuuguaaagugaaua

SEQ ID NO: 629397 - RNA, 63 nt, Homo Sapiens
auuguucugucaauaauuguuaccaaagagauaaaaauaaaagcagaauguauaucaucccau

SEQ ID NO: 629398 - RNA, 63 nt, Homo Sapiens
gccugggugacagagugagacucugucucaaaaaaaauaaaauaaaaagucaauuuagaaugu

SEQ ID NO: 629399 - RNA, 63 nt, Homo Sapiens
ggugacagagugagacucugucucaaaaaaaauaaaauaaaaagucaauuuagaaugugaaau

SEQ ID NO: 629400 - RNA, 63 nt, Homo Sapiens
gaauugaugguuguauaagaacuagcucauguaaaaauaaaauaacauuauuacauugccuca

SEQ ID NO: 629401 - RNA, 63 nt, Homo Sapiens
gucgauugaauuggaccuuuucaguuguucagaaaaauaaaaauaauuucucauauuaaauac

SEQ ID NO: 629402 - RNA, 63 nt, Homo Sapiens
acgauuuuuaaguaaguuggggaccaucaguuuaaaauaaaugcaauacuauuucaugauaaa

SEQ ID NO: 629403 - RNA, 63 nt, Homo Sapiens
guuuuugucgugucuauaaaggaagaacaaaacaaaauaaaaacagagcccuagagaaaugcu

SEQ ID NO: 629404 - RNA, 63 nt, Homo Sapiens
cuuuuuuaguaauagguccagauaugagugcuaaaaauaaagaugauagcauguucuucuguc

SEQ ID NO: 629405 - RNA, 63 nt, Homo Sapiens
gucauuuaccaggauucccguagggcguuuuguaaaauaaacuauaauauuaaugaaaaguau

SEQ ID NO: 629406 - RNA, 63 nt, Homo Sapiens
acuguaaauacauuuguaccucucuuguauucuaaaauaaaaauuacuuggaacauuuaucau

SEQ ID NO: 629407 - RNA, 63 nt, Homo Sapiens
aguaacacuuuaaaacaagacaacaaaagaaaaaaaauaaaaccaguaaaacaaauguguauu

SEQ ID NO: 629408 - RNA, 63 nt, Homo Sapiens
uuuacuauuuccuuuauauauuuaucuucugccaaaauaaaaaaggcauuuuaaucugcacag

SEQ ID NO: 629409 - RNA, 63 nt, Homo Sapiens
ugugccuaaaaccuccaguuuauuaaaaaaaauaaaauaaauaaauguacucuuuuacuuuua

SEQ ID NO: 629410 - RNA, 63 nt, Homo Sapiens
aaauaugugccuaaaaccucuuuuauauuaaaaaaaauaaaauucaacaauguacucuuuuac

SEQ ID NO: 629411 - RNA, 63 nt, Homo Sapiens
agccagcguacacaaugagauaaauugcaaaauaaaauaaaauagaguuguaggaugcagggc

SEQ ID NO: 629412 - RNA, 63 nt, Homo Sapiens
aaaauagccagcguacacaaagggcuaaauugcaaaauaaaauuaucaagaguuguaggaugc

SEQ ID NO: 629413 - RNA, 63 nt, Homo Sapiens
ccaucuaaauagaaggguucuaauaaauauugcaaaauaaaauguacauuugaauugaauaua

SEQ ID NO: 629414 - RNA, 63 nt, Homo Sapiens
uuauucucugauaaagagcuaaacuuuccaaauaaaauaaaugagauagucucauauuuagga

SEQ ID NO: 629415 - RNA, 63 nt, Homo Sapiens
gacaugaaacugcaaaaaugauauggcuggaccaaaauaaaauuuuuuuucuccuacaaggag

SEQ ID NO: 629416 - RNA, 63 nt, Homo Sapiens
uuaaagagggcauaaaggaguagauguaaagacaaaauaaaggacaaugacuguaacguguua

SEQ ID NO: 629417 - RNA, 63 nt, Homo Sapiens
uaauauuuauaauggauauuuuccaauucuuuuaaaauaaaauuauguaauauauguaacauc

SEQ ID NO: 629418 - RNA, 63 nt, Homo Sapiens
ucagaggccuaucuccacuucugcuaggauuuaaaaauaaaaagccucuuaaaaaaaaaaaac

SEQ ID NO: 629419 - RNA, 63 nt, Homo Sapiens
uagaaacacaacucuacuaguuaauaaaaguaaaaaauaaaaaaaucuguauuaaaaauaaaa

SEQ ID NO: 629420 - RNA, 63 nt, Homo Sapiens
uaauaaaaguaaaaaauaaaaaaaucuguauuaaaaauaaaauguugaaaaugccccuuacug

SEQ ID NO: 629421 - RNA, 63 nt, Homo Sapiens
agcaaaucucuuuaccgggauagauauuccuagaaaauaaagaccagucaacucuaagaagac

SEQ ID NO: 629422 - RNA, 63 nt, Homo Sapiens
ccugccaccaaauuauuucuaaaauaaaugaauaaaauaaaaacacagcaagacucugucuca

SEQ ID NO: 629423 - RNA, 63 nt, Homo Sapiens
aauaaaauaaaaaccugccaagacucugucucaaaaauaaaugccagccugggcaacacagca

SEQ ID NO: 629424 - RNA, 63 nt, Homo Sapiens
cagucugggugacagagcaagacuccaucucaaaaaauaaauaaauagaaagagagagagagg

SEQ ID NO: 629425 - RNA, 63 nt, Homo Sapiens
auuuaccaauguuguuuuuuuuuaacaagaaaaaaaauaaaagcacauugucauuuuuuuucc

SEQ ID NO: 629426 - RNA, 63 nt, Homo Sapiens
agacaaaugaagccuaaucguuuuucuagaaggaaaauaaauucuaauugauaaugaauuucg

SEQ ID NO: 629427 - RNA, 63 nt, Homo Sapiens
cacacacacacacacacacacacacacacacacaaaauaaauccgggugugccugaaccucag

SEQ ID NO: 629428 - RNA, 63 nt, Homo Sapiens
gcuuuuugacagcuuuuugagaccucuuaagaaaaaauaaaaaguaaaaaaugaaaggaaucu

SEQ ID NO: 629429 - RNA, 63 nt, Homo Sapiens
cgguuucugcuguauuaaugacaauuauucaugaaaauaaaaaaugaaauauuuuguauacua

SEQ ID NO: 629430 - RNA, 63 nt, Homo Sapiens
cucaaacugaggcuuaaaguauucccuuuuauaaaaauaaaugcuugggguaggguggagugg

SEQ ID NO: 629431 - RNA, 63 nt, Homo Sapiens
ggguggaguggggagggauuaaaacccauccaaaaaauaaauaaaaacuauauaggugcuaug

SEQ ID NO: 629432 - RNA, 63 nt, Homo Sapiens
caguacagaggaaaacaggaaccugauuuuuuuaaaauaaauuuuaaauaaaauagaauuacu

SEQ ID NO: 629433 - RNA, 63 nt, Homo Sapiens
guauaaaaaagcaaauacuuggugagugauuuaaaaauaaaaccaaaacaaaacacaaaaaga

SEQ ID NO: 629434 - RNA, 63 nt, Homo Sapiens
aguuugaagcaguucuucaugccacuuaguuugaaaauaaaauucuagauaugcaaaugauuu

SEQ ID NO: 629435 - RNA, 63 nt, Homo Sapiens
agauaugcaaaugauuuucuuagaaaacuucacaaaauaaaagaucuuguuuuuuuuuccaua

SEQ ID NO: 629436 - RNA, 63 nt, Homo Sapiens
uugacaauugguagaaggugcacauuuuaagcaaaaauaaaaguuuuauaguuuuaaauacau

SEQ ID NO: 629437 - RNA, 63 nt, Homo Sapiens
aauguuuucucucuuaaaauauuucuccuguguaaaauaaaucauuguuguuaguaaugguug

SEQ ID NO: 629438 - RNA, 63 nt, Homo Sapiens
aagaagugcuuuuuggauauggcagcacuuguaaaaauaaagcaguaagcaaaauccuuuuaa

SEQ ID NO: 629439 - RNA, 63 nt, Homo Sapiens
ggugacagagcgagacucugucucaaaaaaaaaaaaauaaagccgggcgugguggcucacgcc

SEQ ID NO: 629440 - RNA, 63 nt, Homo Sapiens
caacaagagcgaaacugucucaaaaaaaagaagaaaauaaauaaauaaaaaucagagcacaag

SEQ ID NO: 629441 - RNA, 63 nt, Homo Sapiens
agccaacuucuguauaccuucacccauuucaugaaaauaaaaucaaaagggaaaucaaaaaua

SEQ ID NO: 629442 - RNA, 63 nt, Homo Sapiens
cauuucaugaaaauaaaaucaaaagggaaaucaaaaauaaagaaaacgcuaaagaaaaaacaa

SEQ ID NO: 629443 - RNA, 63 nt, Homo Sapiens
aacacuugugucaaaaugauauagcuuaguauaaaaauaaaauucaacguuuuggccaaaaug

SEQ ID NO: 629444 - RNA, 63 nt, Homo Sapiens
uuuugguuuacaguguaauaauaccucauuuaaaaaauaaaaaccacuacuguuacauuuuau

SEQ ID NO: 629445 - RNA, 63 nt, Homo Sapiens
guuuauaguaguuugagcagaggaugauuugcaaaaauaaaaauaaaguuauuuuacucuccu

SEQ ID NO: 629446 - RNA, 63 nt, Homo Sapiens
aguaguuugagcagaggaugauuugcaaaaauaaaaauaaaguuauuuuacucuccucuugca

SEQ ID NO: 629447 - RNA, 63 nt, Homo Sapiens
aagggaaggauuuaaggaggugaagucgggucaaaaauaaaauauauauacauauauacauug

SEQ ID NO: 629448 - RNA, 63 nt, Homo Sapiens
aagguuacugagugaguuauugggagucuuaauaaaauaaacuagauauuagguccauucauu

SEQ ID NO: 629449 - RNA, 63 nt, Homo Sapiens
ugaacccuuccugagcuuuaugguccuaaaagcaaaauaaaaacuauucgaaugaaaagacaa

SEQ ID NO: 629450 - RNA, 63 nt, Homo Sapiens
uuuauguuuagauagggcugggcaaggaaaaagaaaauaaagacaaccauauuuagcagugca

SEQ ID NO: 629451 - RNA, 63 nt, Homo Sapiens
ucucugaaguauuccaugccugacaaggaugcuaaaauaaaagaaguaagaagcuauguaaac

SEQ ID NO: 629452 - RNA, 63 nt, Homo Sapiens
gaacuugcaauauuuuugcaacacaaaccuacaaaaauaaacuuaucuguuuugguauauugu

SEQ ID NO: 629453 - RNA, 63 nt, Homo Sapiens
caggcaaauaacuagagacuacauaaaguugaaaaaauaaauggcugcaucuauaugucacug

SEQ ID NO: 629454 - RNA, 63 nt, Homo Sapiens
acuaagcagcuuuuguuuggaaaaugcaaaugcaaaauaaauaguuuuuuucucacuuccuac

SEQ ID NO: 629455 - RNA, 63 nt, Homo Sapiens
ugagucccaauagagcuguugggauuuuaauugaaaauaaacuaagacauuuccuaauuuaug

SEQ ID NO: 629456 - RNA, 63 nt, Homo Sapiens
gcccaucaauaaguuugauauuugcaauaaaaaaaaauaaauuaaaaguuuucugaaaaaacu

SEQ ID NO: 629457 - RNA, 63 nt, Homo Sapiens
aauugggaaagaagguggguacauuagaauuuuaaaauaaaauuccauuaccuggcacuagca

SEQ ID NO: 629458 - RNA, 63 nt, Homo Sapiens
auaaugauuuauugcagaauauuugcuuuaaaaaaaauaaaaguuuuguccuuuccuucacug

SEQ ID NO: 629459 - RNA, 63 nt, Homo Sapiens
uaaauacaaaaaaaaauagcucaaaaaaaaauuaaaauaaauucaacagagcaagacucugcc

SEQ ID NO: 629460 - RNA, 63 nt, Homo Sapiens
acuaucaggauugaaaacagaauauauuuugaaaaaauaaagacaaauuagcaucccauggca

SEQ ID NO: 629461 - RNA, 63 nt, Homo Sapiens
ucuguuucuaacuaaaauguuuuucuauuuucaaaaauaaaauuuuuaaaaauauuguuugau

SEQ ID NO: 629462 - RNA, 63 nt, Homo Sapiens
uaagccacaaggaaugggugucuaaaaaaaaugaaaauaaacacaacauagcaagauuccauc

SEQ ID NO: 629463 - RNA, 63 nt, Homo Sapiens
uuagauuuaagucgagcucacauaaaauaaaauaaaauaaaauuuuauuagagggagcauggc

SEQ ID NO: 629464 - RNA, 63 nt, Homo Sapiens
aaaauuuagauuuaagucgaauggccauaaaauaaaauaaaauuuagauuuauuagagggagc

SEQ ID NO: 629465 - RNA, 63 nt, Homo Sapiens
aaaauaaaauuuagauuuaaggagcauggccauaaaauaaaauaaaauuuagauuuauuagag

SEQ ID NO: 629466 - RNA, 63 nt, Homo Sapiens
gcuagaauuugauuggauuuagucaauuuccacaaaauaaaguaaaacacuuuagaaucagcu

SEQ ID NO: 629467 - RNA, 63 nt, Homo Sapiens
auauacccgagccauuaaccaaauaaagaagauaaaauaaauuuaucauuauuccaaaauaca

SEQ ID NO: 629468 - RNA, 63 nt, Homo Sapiens
agauaaaauaaauuauauacuauuccaaaauacaaaauaaagauuuucagaugcagcuaucau

SEQ ID NO: 629469 - RNA, 63 nt, Homo Sapiens
gcuguuauuucuacuguguuaaaacugauacuuaaaauaaaugucaaaaugcacuuuuuaaua

SEQ ID NO: 629470 - RNA, 63 nt, Homo Sapiens
auuccuugaaaauauaaauaaauguuuuuauuuaaaauaaaguauggucaguaggcaaucuua

SEQ ID NO: 629471 - RNA, 63 nt, Homo Sapiens
ccucccuaauccuauuaucugagaagaugccauaaaauaaacaaagugcuaagaacuccauga

SEQ ID NO: 629472 - RNA, 63 nt, Homo Sapiens
uacaauuaaggcugacauuauuguuucaugcagaaaauaaagaucuuuagucaaaucucugca

SEQ ID NO: 629473 - RNA, 63 nt, Homo Sapiens
cuugaggaugugaacauaaauuauuuuuucuugaaaauaaagccacauugugcuacuacgacu

SEQ ID NO: 629474 - RNA, 63 nt, Homo Sapiens
uuuacccaaaaguauaagauuugguuguauaacaaaauaaaagcuaagauaguuuuaagauuu

SEQ ID NO: 629475 - RNA, 63 nt, Homo Sapiens
uugagucguugacuuuuguacuucuuuauaaugaaaauaaauccucauugugcuuucccuucc

SEQ ID NO: 629476 - RNA, 63 nt, Homo Sapiens
ucaggugcuauaacauguagcauaagguauuucaaaauaaaucagauuguaggagaugacaga

SEQ ID NO: 629477 - RNA, 63 nt, Homo Sapiens
auuguauuaaaaauuuaaaaagauguuuauauuaaaauaaaauuaucuuugucuauaacugac

SEQ ID NO: 629478 - RNA, 63 nt, Homo Sapiens
agauuguguugcuauuuuuucucucaguacccuaaaauaaacuuguccuuuaagucugcuagg

SEQ ID NO: 629479 - RNA, 63 nt, Homo Sapiens
aagaagcuggacauggugggauguagagacacaaaaauaaaugguuguauuuaaaagguagcc

SEQ ID NO: 629480 - RNA, 63 nt, Homo Sapiens
ggguugguuauauugcaauaguuuauuauuauuaaaauaaacaguuuuuaaaagacugacagu

SEQ ID NO: 629481 - RNA, 63 nt, Homo Sapiens
cuuuauaaacaccaucugcuuuuaagaaaauggaaaauaaaaaaaaggaaaucaaauguuauu

SEQ ID NO: 629482 - RNA, 63 nt, Homo Sapiens
ugccuugagagaccacucaggguugcagcagagaaaauaaauggguggaugucagaucuggua

SEQ ID NO: 629483 - RNA, 63 nt, Homo Sapiens
uguugaucaagacauggagucaccuaaaaaaauaaaauaaaaacauucuauuguguucuacuu

SEQ ID NO: 629484 - RNA, 63 nt, Homo Sapiens
aaaaauguugaucaagacauuacuucaccuaaaaaaauaaaauugagccauucuauuguguuc

SEQ ID NO: 629485 - RNA, 63 nt, Homo Sapiens
acaucauauauauguguaaaguacccauucuuaaaaauaaaucgugcuuuaugugguaguguu

SEQ ID NO: 629486 - RNA, 63 nt, Homo Sapiens
uugugcuuuaugugguaguguacccugaaacagaaaauaaauaaacacauuugccuaucuucu

SEQ ID NO: 629487 - RNA, 63 nt, Homo Sapiens
caauaaagacaauucugacuauguacaaaaacuaaaauaaaguuaugaacaugauuuuucuuu

SEQ ID NO: 629488 - RNA, 63 nt, Homo Sapiens
auauagcuacuuucaguugauaaaaugaacaauaaaauaaagcuaaaagcuuuggaaacucug

SEQ ID NO: 629489 - RNA, 63 nt, Homo Sapiens
uuugccaaauccuucagauuggaaauggaaaaaaaaauaaaucugugucuacuuuaaaaaacu

SEQ ID NO: 629490 - RNA, 63 nt, Homo Sapiens
uuguggccuuauauaucacaaagggguuuguccaaaauaaauagauaauaaaaucgcuacuuu

SEQ ID NO: 629491 - RNA, 63 nt, Homo Sapiens
aauagacacuaaaaucauguuuccuaauuuaguaaaauaaaaguuuguucuguaaaugcugcg

SEQ ID NO: 629492 - RNA, 63 nt, Homo Sapiens
ccuggccaacauggcgaaaacccaucucuacuaaaaauaaaauuagccaugcguggugcuugu

SEQ ID NO: 629493 - RNA, 63 nt, Homo Sapiens
aacacaaaauugguuucaaaauguuuucauguaaaaauaaauuaacuuuucuguaauuagauu

SEQ ID NO: 629494 - RNA, 63 nt, Homo Sapiens
cugggcuacagagagcaagacucugucucaaaaaaaauaaaauaaaauaaauaaaaaaagaua

SEQ ID NO: 629495 - RNA, 63 nt, Homo Sapiens
cuacagagagcaagacucugucucaaaaaaaauaaaauaaaauaaauaaaaaaagauauagua

SEQ ID NO: 629496 - RNA, 63 nt, Homo Sapiens
gagagcaagacucugucucaaaaaaaauaaaauaaaauaaauaaaaaaagauauaguauuaau

SEQ ID NO: 629497 - RNA, 63 nt, Homo Sapiens
aauaaaauuuucuacaucaaaguaagacuugagaaaauaaacuuauguguauauauguuuaaa

SEQ ID NO: 629498 - RNA, 63 nt, Homo Sapiens
ccagccugggcgacagagcaagacuccaucucaaaaauaaaauaaaaaaagaaagaaagaaaa

SEQ ID NO: 629499 - RNA, 63 nt, Homo Sapiens
cugggcgacagagcaagacuccaucucaaaaauaaaauaaaaaaagaaagaaagaaaagaaga

SEQ ID NO: 629500 - RNA, 63 nt, Homo Sapiens
ggugggaaaugggggaucuucaauguuuauuuuaaaauaaaauaaaauaaguucuugacuuuu

SEQ ID NO: 629501 - RNA, 63 nt, Homo Sapiens
gaaaugggggaucuucaauguuuauuuuaaaauaaaauaaaauaaguucuugacuuuucucau

SEQ ID NO: 629502 - RNA, 63 nt, Homo Sapiens
aacacuggccauggccgugggaguacugggaguaaaauaaaaauaucgagguauagacuagca

SEQ ID NO: 629503 - RNA, 63 nt, Homo Sapiens
uuuguuuucucuuauucuagguaaggcauauuaaaaauaaauauguaaagaagaaaaauaaaa

SEQ ID NO: 629504 - RNA, 63 nt, Homo Sapiens
uaaggcauauuaaaaauaaauauguaaagaagaaaaauaaaaguugucuucauggaagcaacu

SEQ ID NO: 629505 - RNA, 63 nt, Homo Sapiens
agugucaaauaaaaaauuaccaucauuaucauuaaaauaaauuuucacuguauuugagauggg

SEQ ID NO: 629506 - RNA, 63 nt, Homo Sapiens
aacuacuuugucgguugcucugaggguuaaaugaaaauaaaaagaaaaugugaaacagcacca

SEQ ID NO: 629507 - RNA, 63 nt, Homo Sapiens
ccagcccggccuacaagaacaaaacuccaucucaaaauaaauaaaaaaauaaauaaaaauaaa

SEQ ID NO: 629508 - RNA, 63 nt, Homo Sapiens
acaagaacaaaacuccaucucaaaauaaauaaaaaaauaaauaaaaauaaaaauagacuauau

SEQ ID NO: 629509 - RNA, 63 nt, Homo Sapiens
aacuccaucucaaaauaaauaaaaaaauaaauaaaaauaaaaauagacuauauauagucuuug

SEQ ID NO: 629510 - RNA, 63 nt, Homo Sapiens
gucuuugaauucauuuauuuuaaauaaaugaauaaaauaaaauaaaaaagaauauucagucgu

SEQ ID NO: 629511 - RNA, 63 nt, Homo Sapiens
ugaauucauuuauuuuaaauaaaugaauaaaauaaaauaaaaaagaauauucagucguuggca

SEQ ID NO: 629512 - RNA, 63 nt, Homo Sapiens
aaauuuccuuaggagugcagagggcucauugggaaaauaaaaauaauaaaaauaaauaaaacu

SEQ ID NO: 629513 - RNA, 63 nt, Homo Sapiens
ugcagagggcucauugggaaaauaaaaauaauaaaaauaaauaaaacuuccuaaaagaaaaga

SEQ ID NO: 629514 - RNA, 63 nt, Homo Sapiens
ucccacauuuuaagauuuuaaaaaugaaaccaaaaaauaaauugaagaaaacuguaaacuuua

SEQ ID NO: 629515 - RNA, 63 nt, Homo Sapiens
cagccuaggugacagucagacccugucucaaaaaaaauaaaaaaaauuuaaaauaaucuuggg

SEQ ID NO: 629516 - RNA, 63 nt, Homo Sapiens
cauuucagagcaaucugcauauuuaacagaccuaaaauaaauccuauuaggcaagucaguuga

SEQ ID NO: 629517 - RNA, 63 nt, Homo Sapiens
gucuacaauacaauaccuguauucaaaauaacaaaaauaaagccugauucuuuguuucuagaa

SEQ ID NO: 629518 - RNA, 63 nt, Homo Sapiens
gagcaagacuccgucucacaaaaaugaauaaauaaaauaaaaauaaaaauguuacuuuuuaaa

SEQ ID NO: 629519 - RNA, 63 nt, Homo Sapiens
gacuccgucucacaaaaaugaauaaauaaaauaaaaauaaaaauguuacuuuuuaaaaaguaa

SEQ ID NO: 629520 - RNA, 63 nt, Homo Sapiens
auguaacaagccugcacauguaccccagaaucuaaaauaaaaauaaaaagaaaaacaaagaau

SEQ ID NO: 629521 - RNA, 63 nt, Homo Sapiens
caagccugcacauguaccccagaaucuaaaauaaaaauaaaaagaaaaacaaagaauguacuc

SEQ ID NO: 629522 - RNA, 63 nt, Homo Sapiens
gccugggugacagagcaagacccugucucaaaaaaaauaaaauaaaaggcuuucugccuucau

SEQ ID NO: 629523 - RNA, 63 nt, Homo Sapiens
ggugacagagcaagacccugucucaaaaaaaauaaaauaaaaggcuuucugccuucauugccu

SEQ ID NO: 629524 - RNA, 63 nt, Homo Sapiens
ggccaucagagcaaauuuggggguuucucaaauaaaauaaaaauaaaaacaaauacuguguuu

SEQ ID NO: 629525 - RNA, 63 nt, Homo Sapiens
cagagcaaauuuggggguuucucaaauaaaauaaaaauaaaaacaaauacuguguuucagaag

SEQ ID NO: 629526 - RNA, 63 nt, Homo Sapiens
agaacugagaugucuguaugacagccacuccuaaaaauaaacaacaacaaaaacaaaaaaaga

SEQ ID NO: 629527 - RNA, 63 nt, Homo Sapiens
acaacaaaaacaaaaaaagaagaaaacuaaauaaaaauaaaaauaaaaauaagauccacuucu

SEQ ID NO: 629528 - RNA, 63 nt, Homo Sapiens
aaaacaaaaaaagaagaaaacuaaauaaaaauaaaaauaaaaauaagauccacuucucucugc

SEQ ID NO: 629529 - RNA, 63 nt, Homo Sapiens
aaguaaccuuauauuuaaaagaugauuuugcaaaaaauaaaaaauaaaaaauaugccuucugg

SEQ ID NO: 629530 - RNA, 63 nt, Homo Sapiens
cuuauauuuaaaagaugauuuugcaaaaaauaaaaaauaaaaaauaugccuucuggagugaug

SEQ ID NO: 629531 - RNA, 63 nt, Homo Sapiens
uuaaaaaacugugccuccguuuccuaaaaauaaaaaauaaaauuguaugguuugcaaaagggc

SEQ ID NO: 629532 - RNA, 63 nt, Homo Sapiens
auaaaauuuaaaaaacugugaaagggcuuccuaaaaauaaaaauauaucuuguaugguuugca

SEQ ID NO: 629533 - RNA, 63 nt, Homo Sapiens
ccugaaguauaaagcaucuaggaucauugugaaaaaauaaauuaaaccuucaucuaauacuuu

SEQ ID NO: 629534 - RNA, 63 nt, Homo Sapiens
aaaaaaccuucaucuaauacgucaauuaaaagcaaaauaaaacaauauguauauuuauuauuu

SEQ ID NO: 629535 - RNA, 63 nt, Homo Sapiens
agaauuucaaauuuaaaauuacuuuguagauuaaaaauaaauccccuuuuaaaaaauaaaaau

SEQ ID NO: 629536 - RNA, 63 nt, Homo Sapiens
uacuuuguagauuaaaaauagguucccuuuuaaaaaauaaaaauaagauuucaauaaugaaau

SEQ ID NO: 629537 - RNA, 63 nt, Homo Sapiens
ucgaauauuaaaaaguuguauuuacuuagauauaaaauaaacccaggaguauucuggaaucuu

SEQ ID NO: 629538 - RNA, 63 nt, Homo Sapiens
ucccaugucuuccauuugugugucccccuuuuaaaaauaaacuuuuuugcuauucugaucauu

SEQ ID NO: 629539 - RNA, 63 nt, Homo Sapiens
cucuuauaaauuucuauuuuuuuacaaguaacaaaaauaaaaauuuucucuaggaaauauacu

SEQ ID NO: 629540 - RNA, 63 nt, Homo Sapiens
aauagaacaaggcugaggauucucuguaaagcuaaaauaaagaucucauaacuugagaccuaa

SEQ ID NO: 629541 - RNA, 63 nt, Homo Sapiens
uaaaauagcucugaacauuugaaaucagcaguuaaaauaaaauagucgagagaucugaauaga

SEQ ID NO: 629542 - RNA, 63 nt, Homo Sapiens
uuccaauugcaaccaaacguagaaauggaauccaaaauaaauugcacaccuuucugaaaucca

SEQ ID NO: 629543 - RNA, 63 nt, Homo Sapiens
ucaacucaagcauaaagcuuaucacuuugggagaaaauaaaauacauuuauaggaggaaaaaa

SEQ ID NO: 629544 - RNA, 63 nt, Homo Sapiens
agauaaagggucagcaacaaggcuaccugaaaaaaaauaaauagagccuacucuaguucaaga

SEQ ID NO: 629545 - RNA, 63 nt, Homo Sapiens
uucugugucuaaggcaacuaauaauuuuauagaaaaauaaagcaaagaaaauuucucucggga

SEQ ID NO: 629546 - RNA, 63 nt, Homo Sapiens
cacacaaggacgucugcgcacacacacacacacaaaauaaagacagcaaaacacacacacaca

SEQ ID NO: 629547 - RNA, 63 nt, Homo Sapiens
aagauagauccauuuggacaauuuaggcaagagaaaauaaaccacccauuaggcaugccuaau

SEQ ID NO: 629548 - RNA, 63 nt, Homo Sapiens
auauuaauuuuugaaacccaacugacaagauggaaaauaaauucaagaacaccuuuguuuugc

SEQ ID NO: 629549 - RNA, 63 nt, Homo Sapiens
ccuuuggguucuugaauggauuuugaaaaaauaaaaauaaaagaaggaaaaaagguacuucua

SEQ ID NO: 629550 - RNA, 63 nt, Homo Sapiens
uaaaagccuuuggguucuugcuucuauuuugaaaaaauaaaaauaauaaaaggaaaaaaggua

SEQ ID NO: 629551 - RNA, 63 nt, Homo Sapiens
uuguuuucaucacugacuuuauagaguauguuuaaaauaaauauaauuuaaggauauauauua

SEQ ID NO: 629552 - RNA, 63 nt, Homo Sapiens
agaggugagaauauuguuacuuauaugaaguaaaaaauaaaucaaaaugaauuacacuguauc

SEQ ID NO: 629553 - RNA, 63 nt, Homo Sapiens
uucuaaauaaaaaguugaaaauaccuuuuaaauaaaauaaauucuugggacuuauguauauau

SEQ ID NO: 629554 - RNA, 63 nt, Homo Sapiens
aaaaugccaaccuuagaaaauggaucaaauugcaaaauaaagaauuuuuuuuuacuguaagua

SEQ ID NO: 629555 - RNA, 63 nt, Homo Sapiens
uauguauucuccuaacugaaaaaacugaaaauaaaaauaaaaacagagugagacuccaucuca

SEQ ID NO: 629556 - RNA, 63 nt, Homo Sapiens
uaaaaauauguauucuccuaaucucaaaaacugaaaauaaaaagggugacagagugagacucc

SEQ ID NO: 629557 - RNA, 63 nt, Homo Sapiens
aauaaacaaauaaaaaauuccaucucaaaaaauaaaauaaauagggcaacaacagcaaaacuc

SEQ ID NO: 629558 - RNA, 63 nt, Homo Sapiens
aaauaaauaaacaaauaaaaaacuccaucucaaaaaauaaaauagccugggcaacaacagcaa

SEQ ID NO: 629559 - RNA, 63 nt, Homo Sapiens
auaugagcaccauugaauucgcccucagucuaaaaaauaaaaacaguuggaaaaccuuuucag

SEQ ID NO: 629560 - RNA, 63 nt, Homo Sapiens
cauugcagaccgcacagguguugccugggauucaaaauaaagggaaggacucauccagcaaag

SEQ ID NO: 629561 - RNA, 63 nt, Homo Sapiens
guguauacacuacauuuguuuauaaccagaagcaaaauaaacucagcccacaaagcuagaauc

SEQ ID NO: 629562 - RNA, 63 nt, Homo Sapiens
cuuaaagauuaacuacaaagauaaacauggccaaaaauaaauaaauaaauauggccauauguc

SEQ ID NO: 629563 - RNA, 50 nt, Homo Sapiens; identical to SEQ ID NO: 62460

SEQ ID NO: 629564 - RNA, 63 nt, Homo Sapiens
aucuuuuaugcaccaaaguuggucuugaaaaggaaaauaaaaucacuuucuugcuugguaagc

SEQ ID NO: 629565 - RNA, 63 nt, Homo Sapiens
gagagcaaaucaaaaccucuauccagacaagacaaaauaaaacucaccaucuccugaagaccu

SEQ ID NO: 629566 - RNA, 63 nt, Homo Sapiens
uauaggccauaaagaaugggacugcauuggaccaaaauaaaugggaaaaucgugguuugaaaa

SEQ ID NO: 629567 - RNA, 63 nt, Homo Sapiens
uacauacuuuugcaaaauaaguaaauaauaaauaaaauaaaagccaaccuucaaagaaacuug

SEQ ID NO: 629568 - RNA, 63 nt, Homo Sapiens
ugcguuaaauaagcaaauaaacaguggcucauaaaaauaaaagucgcauuccauaucuuugga

SEQ ID NO: 629569 - RNA, 63 nt, Homo Sapiens
ugagaaguagauuguuacccaguaaugaaauaaaaaauaaaaauaaaaggauuuuuuucucua

SEQ ID NO: 629570 - RNA, 63 nt, Homo Sapiens
guagauuguuacccaguaaugaaauaaaaaauaaaaauaaaaggauuuuuuucucuauuguuu

SEQ ID NO: 629571 - RNA, 63 nt, Homo Sapiens
aauuguaaguuguuaacuccuguauauaucauuaaaauaaaucugaaguugaaguaguguuuu

SEQ ID NO: 629572 - RNA, 63 nt, Homo Sapiens
aaccuuaggauuccugaaaagaauuucaaaaaaaaaauaaagacacuguugccaaugugaccc

SEQ ID NO: 629573 - RNA, 63 nt, Homo Sapiens
aacauacuaauggcauauauuuguuacaauuaaaaaauaaauuuacuacuuaauccuauguug

SEQ ID NO: 629574 - RNA, 63 nt, Homo Sapiens
cugaguauuuaugugaaaacucucuagaagguaaaaauaaagauaauucuucaaaugaagucu

SEQ ID NO: 629575 - RNA, 63 nt, Homo Sapiens
uugguggugaggaggaagaacaaauaauagaagaaaauaaaaaugagauagaagaaaaguaag

SEQ ID NO: 629576 - RNA, 63 nt, Homo Sapiens
aaauuuuaacauuggcaucuaaaguguuauuugaaaauaaaauuauuuuccuguucauugauu

SEQ ID NO: 629577 - RNA, 63 nt, Homo Sapiens
aacuuauugugaaaguugugcuguuuucuaaguaaaauaaaaaauaaaaaauuagcaauuuau

SEQ ID NO: 629578 - RNA, 63 nt, Homo Sapiens
ugugaaaguugugcuguuuucuaaguaaaauaaaaaauaaaaaauuagcaauuuaugauagcc

SEQ ID NO: 629579 - RNA, 63 nt, Homo Sapiens
guaaguuauuaaaugguuaaucauggccuuuuaaaaauaaaauaaagugauaccuuuacaaug

SEQ ID NO: 629580 - RNA, 63 nt, Homo Sapiens
uuauuaaaugguuaaucauggccuuuuaaaaauaaaauaaagugauaccuuuacaaugaagac

SEQ ID NO: 629581 - RNA, 63 nt, Homo Sapiens
uuuucgacacuggacuggaagaacaagucuauaaaaauaaaaauggacaauuaacagugguga

SEQ ID NO: 629582 - RNA, 63 nt, Homo Sapiens
gguuggagaacgaaugaauacaaauuuuauuguaaaauaaaaauguauauaaagcauaugagc

SEQ ID NO: 629583 - RNA, 63 nt, Homo Sapiens
uuaaaaaauaauaauaaaaauuuaaaaaaauuaaaaauaaaaaaaaccacagaaaacaacuuu

SEQ ID NO: 629584 - RNA, 63 nt, Homo Sapiens
uuguagaagagauugagaaugguacucuaaucaaaaauaaaguuuuguagugggaccagaaau

SEQ ID NO: 629585 - RNA, 63 nt, Homo Sapiens
acgaugugcaauacauuuuuuucucuuuccuugaaaauaaaaagagaaacaaguauuuugcua

SEQ ID NO: 629586 - RNA, 63 nt, Homo Sapiens
auaugauauuuuucaugcuccacuauuuuauuaaaaauaaaauauguucuuuaguuugcugcu

SEQ ID NO: 629587 - RNA, 63 nt, Homo Sapiens
ugcuacuguuuuuccuuuuuuuacuaugacaggaaaauaaaugcaauuuuaguggaauugauu

SEQ ID NO: 629588 - RNA, 63 nt, Homo Sapiens
uaaagggcauugauagcauaccaaacaaaaggcaaaauaaagugaccuuuuuauauauuuuuu

SEQ ID NO: 629589 - RNA, 63 nt, Homo Sapiens
ucacugaaauauuuaugacagugcauaauuugcaaaauaaaaaauguacacuagcauaauauu

SEQ ID NO: 629590 - RNA, 63 nt, Homo Sapiens
uaauuguuaauauggaauaagcucaaauaugucaaaauaaauguaaaaaaugaguguugccca

SEQ ID NO: 629591 - RNA, 63 nt, Homo Sapiens
uuaucucagcuucuguuagcucuguuuaaaauaaaaauaaaauguaaccccuuuuuccuuucu

SEQ ID NO: 629592 - RNA, 63 nt, Homo Sapiens
uaaaauuuaucucagcuucucuuucuucuguuuaaaauaaaaaaaaaauguaaccccuuuuuc

SEQ ID NO: 629593 - RNA, 63 nt, Homo Sapiens
aagcaagacaaauuaaaaaugacuugcauaaccaaaauaaacacuuguuucaugaagagaaag

SEQ ID NO: 629594 - RNA, 63 nt, Homo Sapiens
cacacacagagcauuuuaguuuaaaaauacuaaaaaauaaagaauaaagcaagucuaucaaca

SEQ ID NO: 629595 - RNA, 63 nt, Homo Sapiens
aagugagauggcauggugaguguuacuuauuuuaaaauaaauguccuuuugauaaauuuaaaa

SEQ ID NO: 629596 - RNA, 63 nt, Homo Sapiens
caauccuuuugauaaauuuaaugcuuuaaaauaaaaauaaaaaagucugauccauauuuaaua

SEQ ID NO: 629597 - RNA, 63 nt, Homo Sapiens
uaaaaacaauccuuuugauauuaauaaugcuuuaaaauaaaaauuuucaagucugauccauau

SEQ ID NO: 629598 - RNA, 63 nt, Homo Sapiens
uucacauuuauguggcuuguuaaugccguaggaaaaauaaaacaugaaauaauuuuucuaggg

SEQ ID NO: 629599 - RNA, 63 nt, Homo Sapiens
guuucugaaaauguuuaaguuaccagcucauacaaaauaaauguuaaauuuaacucugguuuc

SEQ ID NO: 629600 - RNA, 62 nt, Homo Sapiens
ggagcuguuuuguggcuuugcuagucuuacuagaaaauaaaauacuaggguauugaauaaau

SEQ ID NO: 629601 - RNA, 63 nt, Homo Sapiens
gugcaagucuucaggauggcuuaagcuaucugaaaaauaaaauaacacacucgauuaaaaaug

SEQ ID NO: 629602 - RNA, 63 nt, Homo Sapiens
cccauggaaaugguuuaagaaaauaaauagauaaaaauaaaaagagcaagacuccaucucaaa

SEQ ID NO: 629603 - RNA, 63 nt, Homo Sapiens
gauaaaaauaaaaacccauggacuccaucucaaaaaauaaauacagccugggcaacagagcaa

SEQ ID NO: 629604 - RNA, 63 nt, Homo Sapiens
uugaauguguacuuaagucuaaaacuguaacagaaaauaaauucuucaacuccuuuuggcaag

SEQ ID NO: 629605 - RNA, 63 nt, Homo Sapiens
aauaaauaaaaucuuuuccauaaaguaaaauaaaaaauaaauaagucuuuuccucccagaacu

SEQ ID NO: 629606 - RNA, 63 nt, Homo Sapiens
auaaauaaauaaauaaaauccagaacuuaaaguaaaauaaaaauuaaagaagucuuuuccucc

SEQ ID NO: 629607 - RNA, 63 nt, Homo Sapiens
ucauaauguuagucuuauugaaguguagaaaauaaaauaaauuauagcaauaaaaguuagacg

SEQ ID NO: 629608 - RNA, 63 nt, Homo Sapiens
aaauuucauaauguuagucuagacgaaguguagaaaauaaaaucuauaauagcaauaaaaguu

SEQ ID NO: 629609 - RNA, 63 nt, Homo Sapiens
aaugcauuauguaaggucaggacuuuucagaagaaaauaaacaauuaaggaaguauaugaucu

SEQ ID NO: 629610 - RNA, 63 nt, Homo Sapiens
uguuuucuuuauaaauugccggacucauaagccaaaauaaaucucuuggacuccucagccuuu

SEQ ID NO: 629611 - RNA, 63 nt, Homo Sapiens
uguagacccuaacaguugugaacauuugaagaaaaaauaaaacaucacauaagacaucaugau

SEQ ID NO: 629612 - RNA, 63 nt, Homo Sapiens
aauaaauaaaauuaaaaaaaaaaaauaaaaauaaaaauaaauauaaagugcuaaaguguaaaa

SEQ ID NO: 629613 - RNA, 63 nt, Homo Sapiens
uaaauaaauaaauaaaauuaguaaaaaaaaauaaaaauaaaaaagggaauaaagugcuaaagu

SEQ ID NO: 629614 - RNA, 63 nt, Homo Sapiens
uaaaaauaaauaaauaaauauaaaguguaaaaaaaaauaaaaaaacuucagggaauaaagugc

SEQ ID NO: 629615 - RNA, 63 nt, Homo Sapiens
guggaaaaagguaucuucuguaaaaaguauacaaaaauaaaaauauuuacauuuucacucauc

SEQ ID NO: 629616 - RNA, 63 nt, Homo Sapiens
cuguggugcacauuucuaccuguguauguguuuaaaauaaaaccuguuuuugucaaggauggu

SEQ ID NO: 629617 - RNA, 63 nt, Homo Sapiens
uuauguauuaguguccuuuagauauugaaagaaaaaauaaacucccauugucccuuuauuuag

SEQ ID NO: 629618 - RNA, 63 nt, Homo Sapiens
gcaggacagaaauuguguugguguguggucugcaaaauaaacaaucuguucauauuuaacuuu

SEQ ID NO: 629619 - RNA, 63 nt, Homo Sapiens
aucguuuguuauuuaucucaguuuuauaaaauaaaaauaaaauaaauuuguuguaaacugcau

SEQ ID NO: 629620 - RNA, 63 nt, Homo Sapiens
uaaaauaucguuuguuauuucugcauguuuuauaaaauaaaaauuuuaaaaauuuguuguaaa

SEQ ID NO: 629621 - RNA, 63 nt, Homo Sapiens
aaaauuguuuucauuaccucgucucaaaaaauaaaaauaaaaagggugacagagcgagaccau

SEQ ID NO: 629622 - RNA, 63 nt, Homo Sapiens
uaaaaaaaaauuguuuucaugaccaugucucaaaaaauaaaaacagccugggugacagagcga

SEQ ID NO: 629623 - RNA, 63 nt, Homo Sapiens
aucuacuguacacaaucugaauuccaaaauaacaaaauaaauauaagccauaaaauaaauuuu

SEQ ID NO: 629624 - RNA, 63 nt, Homo Sapiens
uuauuccaaaauaacaaaaugauccuaagccauaaaauaaauucucucaaggcaggggucaua

SEQ ID NO: 629625 - RNA, 63 nt, Homo Sapiens
uuacagaacaacugguggaauguuucugucaggaaaauaaaucaaaaauaauaaugcaguggu

SEQ ID NO: 629626 - RNA, 63 nt, Homo Sapiens
aggaugguagaaagugauuaaauugcuguuuguaaaauaaaucagauauggaugccuucuaac

SEQ ID NO: 629627 - RNA, 63 nt, Homo Sapiens
guuggccagaauuaagcaacgacaagcucagggaaaauaaauaccccauuuuacugcaaaguu

SEQ ID NO: 629628 - RNA, 63 nt, Homo Sapiens
gguuugaggaauuaguuuaaauuuuacagauuuaaaauaaacauaauuuuuauuuucagaacc

SEQ ID NO: 629629 - RNA, 63 nt, Homo Sapiens
aaugguacuuucauuuuauagccuuuguuuguaaaaauaaaauccauuaacuagucuugaaau

SEQ ID NO: 629630 - RNA, 63 nt, Homo Sapiens
cauucagauugaaauucuaaugaaauuggcuuuaaaauaaaacucuuugaaacaauauuauuu

SEQ ID NO: 629631 - RNA, 63 nt, Homo Sapiens
augacauuuaguaucuaaggaugggagagccuaaaaauaaauugucccauuucaauuuccacc

SEQ ID NO: 629632 - RNA, 63 nt, Homo Sapiens
gugugccugauuauuuuugcuugauuaagauguaaaauaaaaauuccuuuuguauuuguaaug

SEQ ID NO: 629633 - RNA, 63 nt, Homo Sapiens
accuuaauucuuuauugacuaaugaggcuuuuaaaaauaaagugaugcuccugucaaaaggga

SEQ ID NO: 629634 - RNA, 63 nt, Homo Sapiens
ugcuaugcaaucuugaauauauaaccauuucaaaaaauaaaauauuuaaggaaauucuuuagg

SEQ ID NO: 629635 - RNA, 63 nt, Homo Sapiens
uaaaaauacauucaaaauuaucauuauuuugaaaaaauaaauuauguaaaauuuuuacuaaug

SEQ ID NO: 629636 - RNA, 63 nt, Homo Sapiens
gaguaugagucuucuguaauuaauuuccaggaaaaaauaaaaauuaguaaagcuuuucuuuuu

SEQ ID NO: 629637 - RNA, 63 nt, Homo Sapiens
aaagcuagauacuggaaaccaugucauugcuaaaaaauaaauaaaccuggcaaaaucuuguua

SEQ ID NO: 629638 - RNA, 63 nt, Homo Sapiens
auaacaugccugagggagaggggaauuuuguguaaaauaaaagauccacacaaccaaguucau

SEQ ID NO: 629639 - RNA, 63 nt, Homo Sapiens
agauguccacacaaauggauccuacauuauuggaaaauaaauguuugauacgccucaucuuau

SEQ ID NO: 629640 - RNA, 63 nt, Homo Sapiens
aaacuuagcuaggcauguugaaaauaaaaaauaaaaauaaaaaaguuagaccucaucucuaca

SEQ ID NO: 629641 - RNA, 63 nt, Homo Sapiens
uaaaaaaaacuuagcuaggcucuacaaaaauaaaaaauaaaaaaaacauaguuagaccucauc

SEQ ID NO: 629642 - RNA, 63 nt, Homo Sapiens
auaaaaauaaaaaaaacuuaccucaucucuacaaaaauaaaaaagccuggaaacauaguuaga

SEQ ID NO: 629643 - RNA, 63 nt, Homo Sapiens
aaguuuuaaaaacugaucaaaaaaaaaauuuaaaaaauaaaaaauaauauaaaauaaaaacuu

SEQ ID NO: 629644 - RNA, 63 nt, Homo Sapiens
cuuaaaaaaaauuuaaaaaauuguagauaauauaaaauaaaaauuaagggaaaaacuuuuacu

SEQ ID NO: 629645 - RNA, 63 nt, Homo Sapiens
aauggcaauagauuuuaaaaacguuuuugugcaaaaauaaaugaaagcuggugacauauuuau

SEQ ID NO: 629646 - RNA, 63 nt, Homo Sapiens
accccuacaaaaaaacuuuaaaaaaaaacacaaaaaauaaaaaccaauucuaagcagaaaaag

SEQ ID NO: 629647 - RNA, 63 nt, Homo Sapiens
cgcagugaacuuaaagcaaagaccucuuaguaaaaaauaaaaaaaaauaaaaaauaaaaauaa

SEQ ID NO: 629648 - RNA, 63 nt, Homo Sapiens
uuaaagcaaagaccucuuaguaaaaaauaaaaaaaaauaaaaaauaaaaauaaaaaaaguuaa

SEQ ID NO: 629649 - RNA, 63 nt, Homo Sapiens
aaagaccucuuaguaaaaaauaaaaaaaaauaaaaaauaaaaauaaaaaaaguuaaauuuauu

SEQ ID NO: 629650 - RNA, 63 nt, Homo Sapiens
cucuuaguaaaaaauaaaaaaaaauaaaaaauaaaaauaaaaaaaguuaaauuuauuuauaga

SEQ ID NO: 629651 - RNA, 63 nt, Homo Sapiens
cgagaaacuaugggaaaaaaaauugcaaaaucuaaaauaaaaaaugcaaaaucuaaaauaaaa

SEQ ID NO: 629652 - RNA, 63 nt, Homo Sapiens
auugcaaaaucuaaaauaaaaaaugcaaaaucuaaaauaaaaaauggaaaggaaacuuugaac

SEQ ID NO: 629653 - RNA, 63 nt, Homo Sapiens
caacaagagcaaaacuccgucucaaaaaagaugaaaauaaaauaaaauauauauuuacaggcc

SEQ ID NO: 629654 - RNA, 63 nt, Homo Sapiens
agagcaaaacuccgucucaaaaaagaugaaaauaaaauaaaauauauauuuacaggccuacaa

SEQ ID NO: 629655 - RNA, 63 nt, Homo Sapiens
uauuguuguuuaucuuguuuggaaguguguuucaaaauaaacaugucuagaauuuaaaguuuu

SEQ ID NO: 629656 - RNA, 63 nt, Homo Sapiens
aaacugguuccaauuuuuuggucauuucucagaaaaauaaaauacuuauaaauccuauauuuu

SEQ ID NO: 629657 - RNA, 63 nt, Homo Sapiens
cauggaguuuuuaaaaauuguuauaauuaaguaaaaauaaagcugaauugugucauuugugua

SEQ ID NO: 629658 - RNA, 63 nt, Homo Sapiens
cuccaaucaaggucuuguugauauuauauaguaaaaauaaaaccaaaaauaaauauuauucaa

SEQ ID NO: 629659 - RNA, 63 nt, Homo Sapiens
ucuuguugauauuauauaguaaaaauaaaaccaaaaauaaauauuauucaaguggcucuucua

SEQ ID NO: 629660 - RNA, 63 nt, Homo Sapiens
augguaucuaauuaauaacuagucugacaucagaaaauaaaauugaggcugauuuuuaaaaau

SEQ ID NO: 629661 - RNA, 63 nt, Homo Sapiens
gaaacccacuguuaaaauuuaaaaaggugcuuuaaaauaaaacgccuauaaagauugugcagu

SEQ ID NO: 629662 - RNA, 63 nt, Homo Sapiens
aaaaugugggaauaccaaauguccuuuauaagaaaaauaaauuuuauuuuaagggacauacua

SEQ ID NO: 629663 - RNA, 63 nt, Homo Sapiens
ucuaacuauucagggacauuuuuccauuuccaaaaaauaaaauuuauuaugcuuuauaaccuc

SEQ ID NO: 629664 - RNA, 63 nt, Homo Sapiens
ucucacguugugaggguuuuuuuuuucucauuuaaaauaaaaaaggaagaaagaaaauaauuu

SEQ ID NO: 629665 - RNA, 63 nt, Homo Sapiens
cagcuacauuuucaacaaaaaagcaaacagagaaaaauaaaugaacuuuaacacuguaaguuc

SEQ ID NO: 629666 - RNA, 63 nt, Homo Sapiens
gagucuuugaagcugaaaauauaaaacaaauaaaaaauaaaaaaauaaaaacccacaaaaaug

SEQ ID NO: 629667 - RNA, 63 nt, Homo Sapiens
gaagcugaaaauauaaaacaaauaaaaaauaaaaaaauaaaaacccacaaaaauguugaacca

SEQ ID NO: 629668 - RNA, 63 nt, Homo Sapiens
uuuguuaguuccuguaugaaagauugugggggaaaaauaaacgucgugccguuagcuuuuucc

SEQ ID NO: 629669 - RNA, 63 nt, Homo Sapiens
ucaaaggcaagauaucauuuauuggacuucuugaaaauaaaaguuacaaaauccaacaacaac

SEQ ID NO: 629670 - RNA, 63 nt, Homo Sapiens
gcauucuuauucacuuuaugccgguauuuagaaaaaauaaauuauagcaaguaugauuucuaa

SEQ ID NO: 629671 - RNA, 63 nt, Homo Sapiens
ccucuuuaauggaagcugcaaauuaauauuaguaaaauaaacauaauuucuuuuuuuaaagga

SEQ ID NO: 629672 - RNA, 63 nt, Homo Sapiens
aauaaguaguuucauuacgauuuauuaacuuuuaaaauaaagauaaaaauugagagguuuccu

SEQ ID NO: 629673 - RNA, 63 nt, Homo Sapiens
gcauauauccaaucacaagugaaagaagccagaaaaauaaaugucagcaggaauuacacauua

SEQ ID NO: 629674 - RNA, 63 nt, Homo Sapiens
aguguaauugggacguuugucuuuauacauuuaaaaauaaaaggugacuacagucaacaauaa

SEQ ID NO: 629675 - RNA, 63 nt, Homo Sapiens
aaaauagauuauuacgucuugucucuuugauuuaaaauaaauaguuuguuaggaaauggaaug

SEQ ID NO: 629676 - RNA, 63 nt, Homo Sapiens
ugauaguacauguguuguucuauuuuugcagguaaaauaaagcuuuuccaaguguagcuaaaa

SEQ ID NO: 629677 - RNA, 63 nt, Homo Sapiens
aaaauauauaaguguaacauuuuuuuuuucuuaaaaauaaaaaccaaaagcuuucacugaagg

SEQ ID NO: 629678 - RNA, 63 nt, Homo Sapiens
ccuuuuaagggaacuuccuggaaaguucagaaaaaaauaaagucagucagacauucgucaugg

SEQ ID NO: 629679 - RNA, 63 nt, Homo Sapiens
ccaaucuggcaacagagcgagaccuugucuuuaaaaauaaaaauaaaaacaucuuuacaacau

SEQ ID NO: 629680 - RNA, 63 nt, Homo Sapiens
uggcaacagagcgagaccuugucuuuaaaaauaaaaauaaaaacaucuuuacaacauuccugu

SEQ ID NO: 629681 - RNA, 63 nt, Homo Sapiens
ugagaauuagaaaauaagggacaacagggguuaaaaauaaacugauuuaauuugcucuauagu

SEQ ID NO: 629682 - RNA, 63 nt, Homo Sapiens
uugucacaaaguaguccauuccugaucucacuuaaaauaaaucacaaguaaauuugaauuuuc

SEQ ID NO: 629683 - RNA, 63 nt, Homo Sapiens
ucugacgaacugccuggaggaggggaauauauaaaaauaaaauuggugucacuucuuuucugc

SEQ ID NO: 629684 - RNA, 63 nt, Homo Sapiens
ccauacgcucauagucacauauggaauuuugagaaaauaaagcaugcugucuuuaggaauuuu

SEQ ID NO: 629685 - RNA, 63 nt, Homo Sapiens
acuuuggauuuuucuacaaaggcagugguguccaaaauaaaaucucugcccuaaauuuuacua

SEQ ID NO: 629686 - RNA, 63 nt, Homo Sapiens
uuuagaaacaucuuuagcccaaaguaacuaguaaaaauaaauggagugguauccuaucuucuu

SEQ ID NO: 629687 - RNA, 63 nt, Homo Sapiens
agauuuuuuuuuucacaguugaguuaguuugugaaaauaaagaacucuguagcucaccaaggu

SEQ ID NO: 629688 - RNA, 63 nt, Homo Sapiens
uuccaguuuugcuugacaguuucuaaacaaacaaaaauaaacucaaugaaaggaaagauguuu

SEQ ID NO: 629689 - RNA, 63 nt, Homo Sapiens
aauucauacaacaucagugguuacagcuauacuaaaauaaaacuuuauaugcuaauuaucuuc

SEQ ID NO: 629690 - RNA, 63 nt, Homo Sapiens
cuuuauaugcuaauuaucuucaagggucuuucuaaaauaaaagggguuguuaggcuacugcaa

SEQ ID NO: 629691 - RNA, 63 nt, Homo Sapiens
acugcagaccucuaaacauaaguaggaaaaagaaaaauaaaagaauauuaccaauaauuaaag

SEQ ID NO: 629692 - RNA, 63 nt, Homo Sapiens
gaccucaucauuaauaagugaagaauacaucagaaaauaaaauauucacucuccauuagaaaa

SEQ ID NO: 629693 - RNA, 63 nt, Homo Sapiens
cucaauguuucuggacauucucuuugauaacaaaaaauaaauuuuaaaaaggaauuuuguaaa

SEQ ID NO: 629694 - RNA, 63 nt, Homo Sapiens
aauuuaaauaucuuuuaaagaaaaaaacaccuaaaaauaaaucuuaacagaaaauucuguucu

SEQ ID NO: 629695 - RNA, 63 nt, Homo Sapiens
uuaaccaauacauuuaaaauuguacagaacaaaaaaauaaaaucaaagacugaucuuguacag

SEQ ID NO: 629696 - RNA, 63 nt, Homo Sapiens
auuuagucaucagagauacuuuccuaaaaaggaaaaauaaaaaacaaaauggugccacuuugg

SEQ ID NO: 629697 - RNA, 63 nt, Homo Sapiens
auuuugagaugucauacuguacacuguauuguaaaaauaaaaaguaaaauuauauuucaaauu

SEQ ID NO: 629698 - RNA, 63 nt, Homo Sapiens
cucuuuauugaagacaaacacucaccaaaaagaaaaauaaaaguuuucagagaaacuaauuuu

SEQ ID NO: 629699 - RNA, 63 nt, Homo Sapiens
cuguaccaaacugauuucaaaaguacuacauugaaaauaaaccggugacuguuuuucuucaua

SEQ ID NO: 629700 - RNA, 63 nt, Homo Sapiens
uauauauauaauauauacauauauacauaguguaaaauaaaauguuucuuggacaagaaaucc

SEQ ID NO: 629701 - RNA, 63 nt, Homo Sapiens
ugcccuuuuuacccguugacguuuauuuuacguaaaauaaacuguuguuuccaaugcaaucaa

SEQ ID NO: 629702 - RNA, 63 nt, Homo Sapiens
uggacacauuuggaucacauuuauacaguuauaaaaauaaagguuugauuuuggucguucuuc

SEQ ID NO: 629703 - RNA, 63 nt, Homo Sapiens
cuaaaaccucuuuaaaaacggucaguuaacuaaaaaauaaaaaucaagucuuuaggagaguag

SEQ ID NO: 629704 - RNA, 63 nt, Homo Sapiens
cagaguaccagaaaggguauuagaaaugccuuuaaaauaaauuugccuaaaagagaagguauc

SEQ ID NO: 629705 - RNA, 63 nt, Homo Sapiens
uguuucucucucaaccacuuaauaaaaaggccaaaaauaaaaucccuaaaaugcuagaauaau

SEQ ID NO: 629706 - RNA, 63 nt, Homo Sapiens
aguggaagcccuaaaaugcuaguuaaccaucuaaaaauaaaaggcaaauagguaucaucaaug

SEQ ID NO: 629707 - RNA, 63 nt, Homo Sapiens
aaauuauucaaagacuggaugcuuaaacuauugaaaauaaaucuuccuaagaggucuagaaau

SEQ ID NO: 629708 - RNA, 63 nt, Homo Sapiens
gaaacuuugucuccuguguuauauuuauuucauaaaauaaauaaaaaauagcauagaaaucau

SEQ ID NO: 629709 - RNA, 63 nt, Homo Sapiens
auuaaaggauuguugauaacagggaaaaaaauaaaaauaaaaaguauauugguucgaaauccc

SEQ ID NO: 629710 - RNA, 63 nt, Homo Sapiens
uaaaaaauuaaaggauuguuaaucccagggaaaaaaauaaaaacuaggaguauauugguucga

SEQ ID NO: 629711 - RNA, 63 nt, Homo Sapiens
aggugugagaauugugugugaauagagaacuucaaaauaaaacaguagaucaaaauagaacac

SEQ ID NO: 629712 - RNA, 63 nt, Homo Sapiens
cuauaaaaauguacuuuaggauauuaaaaacacaaaauaaaaagauugacuauaccaaacauu

SEQ ID NO: 629713 - RNA, 63 nt, Homo Sapiens
caaaauaaggaauccuuuuaaauaaaaaauaaaaaaauaaaaaagccagaccuugucucaaaa

SEQ ID NO: 629714 - RNA, 63 nt, Homo Sapiens
aauaaaaacaaaauaaggaaucucaaaaaauaaaaaauaaaaaagagagagagccagaccuug

SEQ ID NO: 629715 - RNA, 63 nt, Homo Sapiens
auaaaaaaauaaaaacaaaagaccuugucucaaaaaauaaaaagccugagagagagagagcca

SEQ ID NO: 629716 - RNA, 63 nt, Homo Sapiens
aaguaccuguaguguauuuauaggcuaaggacaaaaauaaacucuuaaaacuguggauuggcc

SEQ ID NO: 629717 - RNA, 63 nt, Homo Sapiens
cucacauauuucacuacuuauuaugggaguuugaaaauaaauauaguuuuucuaaauagaccc

SEQ ID NO: 629718 - RNA, 63 nt, Homo Sapiens
gaaauaucacugagcaguuguauuacucaaaguaaaauaaaugguaugagauagaaaaauuuu

SEQ ID NO: 629719 - RNA, 63 nt, Homo Sapiens
auuguuucuucaauugugacucacuugauuagaaaaauaaacccuuaugauucagcagcuugg

SEQ ID NO: 629720 - RNA, 63 nt, Homo Sapiens
accugguugcagcacauucaacccuaaagcaguaaaauaaaaagguguugagauuuacgugga

SEQ ID NO: 629721 - RNA, 63 nt, Homo Sapiens
aaauggauagaaaaaaacuaaauaacugaauaaaaaauaaauagaucuuuuguccauuccauu

SEQ ID NO: 629722 - RNA, 63 nt, Homo Sapiens
aguacgaguuagacauaugaguuacugaguuaaaaaauaaaaaaagcauucugugauccccug

SEQ ID NO: 629723 - RNA, 63 nt, Homo Sapiens
uuagacauaucacaccuaaacuguugcucuaacaaaauaaaccaaauaauuuugccuucuagg

SEQ ID NO: 629724 - RNA, 63 nt, Homo Sapiens
cucaggaccagccuagagagaucccaucucuaaaaaauaaaauauaagaaaauaaaacuuagg

SEQ ID NO: 629725 - RNA, 63 nt, Homo Sapiens
gagagaucccaucucuaaaaaauaaaauauaagaaaauaaaacuuaggggauauacagauuua

SEQ ID NO: 629726 - RNA, 63 nt, Homo Sapiens
ggauuguaggcaaacccaccuguggcaucacugaaaauaaauuugaucauaccuaagagguua

SEQ ID NO: 629727 - RNA, 63 nt, Homo Sapiens
cugugugacuuggcuagaguugggaguucccccaaaauaaacguguccccauuuuaccagaac

SEQ ID NO: 629728 - RNA, 63 nt, Homo Sapiens
cuccccuaauuuuuauucccagugccgauguucaaaauaaacuuucuccagucugggaaccuu

SEQ ID NO: 629729 - RNA, 63 nt, Homo Sapiens
ugugcuuaauguaaagccgcuuuauaaaacuguaaaauaaaguuuuuuucuuaaaaagaauau

SEQ ID NO: 629730 - RNA, 63 nt, Homo Sapiens
uaauaugaaauaacagacuaacauuuuaggggaaaaauaaauacaauuuagacucuaaaaagu

SEQ ID NO: 629731 - RNA, 63 nt, Homo Sapiens
ucccuacaaugggaaaugucacaagaaugugcaaaaauaaaaaucugaggaaaaaacccacau

SEQ ID NO: 629732 - RNA, 63 nt, Homo Sapiens
gauuauguauuuuuaacuaauuuauugcauuauaaaauaaaagaugugauguuguuaauuucu

SEQ ID NO: 629733 - RNA, 63 nt, Homo Sapiens; identical to SEQ ID NO: 62630

SEQ ID NO: 629734 - RNA, 63 nt, Homo Sapiens
uuuuuauaaaauuaaaaaaacaguuuguaaggaaaaauaaaagaucaggucuccuaacuaccc

SEQ ID NO: 629735 - RNA, 63 nt, Homo Sapiens
agcuauuaucaggucuccuacuuuggugccaagaaaauaaaaaaggaacacauaaguaaguug

SEQ ID NO: 629736 - RNA, 63 nt, Homo Sapiens
uccaaguuacacaguuuggcucagaauacuuuaaaaauaaaguuuaaaauucuuggaaaauuu

SEQ ID NO: 629737 - RNA, 63 nt, Homo Sapiens
auaaauaucuuuaaagagaauugguuucaugaaaaaauaaacgguauuguugaaucaauuacu

SEQ ID NO: 629738 - RNA, 63 nt, Homo Sapiens
uaauacaaauaaaaauacagaaaaauauuagaaaaaauaaaaagauuaaaccaauugcagauc

SEQ ID NO: 629739 - RNA, 63 nt, Homo Sapiens
auuauugcuuugugacaauuuaaacgacuuuaaaaaauaaaugcauuugccuauaaauaccug

SEQ ID NO: 629740 - RNA, 63 nt, Homo Sapiens
ugacauugaauucgaacuguucacugcaauguuaaaauaaauauuucuguuuagcagcauuuu

SEQ ID NO: 629741 - RNA, 63 nt, Homo Sapiens
cauuuaaaaaguaaugcugaauuauuuguacauaaaauaaaacuauggguacaacguauguuc

SEQ ID NO: 629742 - RNA, 63 nt, Homo Sapiens
auucuuugcaguaaaauauugcuagugauguauaaaauaaaauacuaauggcaaaaauucaug

SEQ ID NO: 629743 - RNA, 63 nt, Homo Sapiens
auuuauaaauaacuuuuguuaagguagaauuuuaaaauaaaagcuuacugauuaauuuuuaac

SEQ ID NO: 629744 - RNA, 63 nt, Homo Sapiens
guuugacuugaaucauuucuuauaaaucuauagaaaauaaacuuucuguugagggcaaaauau

SEQ ID NO: 629745 - RNA, 63 nt, Homo Sapiens
caguuccugagucacacaauaaugaaauaaaauaaaauaaaaucgcuauuuaaguuaaauuua

SEQ ID NO: 629746 - RNA, 63 nt, Homo Sapiens
aaaaucaguuccugagucacauuuaaaugaaauaaaauaaaauagugucgcuauuuaaguuaa

SEQ ID NO: 629747 - RNA, 63 nt, Homo Sapiens
aaauuucucaaacuaauuuauuguaccuuguacaaaauaaaacauguucacugugcagaggga

SEQ ID NO: 629748 - RNA, 63 nt, Homo Sapiens
aaugaguacaucuccccuuccagaaaaagcaaaaaaauaaauaacaauacuuugggcaauaau

SEQ ID NO: 629749 - RNA, 63 nt, Homo Sapiens
uuagagcaaaguuuaaaacucucaaaauaaaauaaaauaaaacgggcaauagcaagacuccau

SEQ ID NO: 629750 - RNA, 63 nt, Homo Sapiens
aaaacuuagagcaaaguuuauccaucucaaaauaaaauaaaauagcuugggcaauagcaagac

SEQ ID NO: 629751 - RNA, 63 nt, Homo Sapiens
aaaauaaaacuuagagcaaaaagacuccaucucaaaauaaaauacuccagcuugggcaauagc

SEQ ID NO: 629752 - RNA, 63 nt, Homo Sapiens
auaaauuaaaaaaguugccgccuauuucaauaaaaaauaaaauguuucacaaguuuugggcca

SEQ ID NO: 629753 - RNA, 63 nt, Homo Sapiens
uauuuucauaaaugguuugcuuuuaugccuuuuaaaauaaauuuuucuuuuuacacuaauaac

SEQ ID NO: 629754 - RNA, 63 nt, Homo Sapiens
auauuuuguucuauugguagugcugguauaauuaaaauaaaauggucuuucugggccuuacug

SEQ ID NO: 629755 - RNA, 63 nt, Homo Sapiens
auuaauaggaguugugagcccuuuaaggaaaauaaaauaaaaucaaauguaauuuuaugucug

SEQ ID NO: 629756 - RNA, 63 nt, Homo Sapiens
aaaauauuaauaggaguugugucugcuuuaaggaaaauaaaauucuuccaaauguaauuuuau

SEQ ID NO: 629757 - RNA, 63 nt, Homo Sapiens
ucaauuuuacaccucauaugauugagaauaacaaaaauaaauauacuauaacucugaucuucc

SEQ ID NO: 629758 - RNA, 63 nt, Homo Sapiens
uacuacauuucuaacguauuauuaacaucaugaaaaauaaaaggauuaauuuagauuagaauc

SEQ ID NO: 629759 - RNA, 63 nt, Homo Sapiens
auugauaaaagguguuuggaucaccuguuuuuaaaaauaaaacugauguauaaaaaaguggau

SEQ ID NO: 629760 - RNA, 63 nt, Homo Sapiens
aaaugcuuguuucauuuuuagugggagaaauccaaaauaaaguauauauuuauauuuuugggg

SEQ ID NO: 629761 - RNA, 63 nt, Homo Sapiens
guuuucuuuuggaacuacaaaauguagacuuuuaaaauaaacuagacaaagcauugacuuuua

SEQ ID NO: 629762 - RNA, 63 nt, Homo Sapiens
caaugauuuauuuuuuucccuuuguguuacuccaaaauaaaggaugugaaguuagugagucuu

SEQ ID NO: 629763 - RNA, 63 nt, Homo Sapiens
cagccuggaccacagagcaagacccuguguaaaaaaauaaaauaaaaaacagauuggaugucu

SEQ ID NO: 629764 - RNA, 63 nt, Homo Sapiens
uggaccacagagcaagacccuguguaaaaaaauaaaauaaaaaacagauuggaugucuuucuu

SEQ ID NO: 629765 - RNA, 63 nt, Homo Sapiens
gugagccacugugcccagccuaagccauuucuuaaaauaaaaaugcuaaaggacuaguaagua

SEQ ID NO: 629766 - RNA, 63 nt, Homo Sapiens
cuuaaaauaaaaaugcuaaaggacuaguaaguaaaaauaaaacuuccuaugggauuucccagu

SEQ ID NO: 629767 - RNA, 63 nt, Homo Sapiens
ggacuuuuacuuuuuauuacauaaaaauauuaaaaaauaaauaaaaaaaauaaaauuuuaaac

SEQ ID NO: 629768 - RNA, 63 nt, Homo Sapiens
uuauuacauaaaaauauuaaaaaauaaauaaaaaaaauaaaauuuuaaacuaacuuaaccugc

SEQ ID NO: 629769 - RNA, 63 nt, Homo Sapiens
gccuggaugacaagcaagacccucccuccaaagaaaauaaagcucaaaauaaaauaugauuug

SEQ ID NO: 629770 - RNA, 63 nt, Homo Sapiens
agcaagacccucccuccaaagaaaauaaagcucaaaauaaaauaugauuuguguucauguaga

SEQ ID NO: 629771 - RNA, 63 nt, Homo Sapiens
cugggcaacacagcgagacuccgucucaaggaaaaaauaaaaauaaaaagcgggcacgggccc

SEQ ID NO: 629772 - RNA, 63 nt, Homo Sapiens
aacacagcgagacuccgucucaaggaaaaaauaaaaauaaaaagcgggcacgggcccgugaca

SEQ ID NO: 629773 - RNA, 63 nt, Homo Sapiens
aacaagcaacaccuuaaaagaguuuuauuucugaaaauaaauuaauuuuuuguaaauaaaaug

SEQ ID NO: 629774 - RNA, 63 nt, Homo Sapiens
aaauaaauuaauuuuuuguaaauaaaauguuuaaaaauaaaaaagaaacuaaaguuacuugua

SEQ ID NO: 629775 - RNA, 63 nt, Homo Sapiens
aaagaaaacaaaauauaagggaaaaauaugagaaaaauaaaaauaaaaagagaauaauaggcc

SEQ ID NO: 629776 - RNA, 63 nt, Homo Sapiens
aacaaaauauaagggaaaaauaugagaaaaauaaaaauaaaaagagaauaauaggccaggcac

SEQ ID NO: 629777 - RNA, 63 nt, Homo Sapiens
uguccguucaucccugagaggucugaaagaauaaaaauaaauucuaaaaaaagccucugucug

SEQ ID NO: 629778 - RNA, 63 nt, Homo Sapiens
cucuauaacugcagaaauuagauaauguuuuauaaaauaaauuugccacauaauaugggaugc

SEQ ID NO: 629779 - RNA, 63 nt, Homo Sapiens
cucuuuuguaaauuacaguuauuucaguauuguaaaauaaauguugacucauuucaugcaggu

SEQ ID NO: 629780 - RNA, 63 nt, Homo Sapiens
agcacucuggugcgggaagaagcagaagcaaaaaaaauaaaaauaaaaaaauaaauaaaaaua

SEQ ID NO: 629781 - RNA, 63 nt, Homo Sapiens
cuggugcgggaagaagcagaagcaaaaaaaauaaaaauaaaaaaauaaauaaaaauaaaaaaa

SEQ ID NO: 629782 - RNA, 63 nt, Homo Sapiens
ggaagaagcagaagcaaaaaaaauaaaaauaaaaaaauaaauaaaaauaaaaaaaauaaaaaa

SEQ ID NO: 629783 - RNA, 63 nt, Homo Sapiens
gaagcaaaaaaaauaaaaauaaaaaaauaaauaaaaauaaaaaaaauaaaaaaggaaaaaaaa

SEQ ID NO: 629784 - RNA, 63 nt, Homo Sapiens
aaaauaaaaauaaaaaaauaaauaaaaauaaaaaaaauaaaaaaggaaaaaaaaaaaagaaga

SEQ ID NO: 629785 - RNA, 63 nt, Homo Sapiens
uguguacaaagagaugugaaauacuuucaggcaaaaauaaacuguaagugacucaucaauguc

SEQ ID NO: 629786 - RNA, 63 nt, Homo Sapiens
ugugugaauugacuaccguuguuugcaaacccgaaaauaaaagacguucauuauguaugaaaa

SEQ ID NO: 629787 - RNA, 63 nt, Homo Sapiens
aacauauagaaugcagagauuuuuuuuuccauuaaaauaaauggguauuggugguuaaaacug

SEQ ID NO: 629788 - RNA, 63 nt, Homo Sapiens
aguuucaggaaugaaguagaagguaguuauuuaaaaauaaaaaacacaguccgucccuaccaa

SEQ ID NO: 629789 - RNA, 63 nt, Homo Sapiens
gaaacuuccagugugaguugaccccaucauuuaaaaauaaaguccccggguuccuuaaugccu

SEQ ID NO: 629790 - RNA, 63 nt, Homo Sapiens
acuagauaaaaaaaaaaauuagacucugugucaaaaauaaaugccagccugggcaacagagcu

SEQ ID NO: 629791 - RNA, 63 nt, Homo Sapiens
cccagacuagaauaggguucaaauugcugauccaaaauaaaaacaguacugacuguguaagcu

SEQ ID NO: 629792 - RNA, 63 nt, Homo Sapiens
caauuuuuaaaaagagaauaaaaaaaauaaaauaaaauaaaaccaacauagugagauucuguu

SEQ ID NO: 629793 - RNA, 63 nt, Homo Sapiens
aaaaccaauuuuuaaaaagacuguuaaaaaaauaaaauaaaaucugggcaacauagugagauu

SEQ ID NO: 629794 - RNA, 63 nt, Homo Sapiens
aaaauaaaaccaauuuuuaaagauucuguuaaaaaaauaaaauccaaccugggcaacauagug

SEQ ID NO: 629795 - RNA, 63 nt, Homo Sapiens
uaaaaaaaauuagcugagugccugucucuacuaaaaauaaauuccuaggcaacauagugagac

SEQ ID NO: 629796 - RNA, 63 nt, Homo Sapiens
cuuuuaugauugggaauuuauaauacuugucuuaaaauaaaagauuuccauccuguauuugca

SEQ ID NO: 629797 - RNA, 63 nt, Homo Sapiens
guaaaagggaaauuugaacaacaaaaaccaaaaaaaauaaaaauaaaaaacuucaaaaguuga

SEQ ID NO: 629798 - RNA, 63 nt, Homo Sapiens
gggaaauuugaacaacaaaaaccaaaaaaaauaaaaauaaaaaacuucaaaaguugacaagaa

SEQ ID NO: 629799 - RNA, 63 nt, Homo Sapiens
aaguugcuugagccaagugcuuaaaaaguuaauaaaauaaaaugaucuguaugauaccugcaa

SEQ ID NO: 629800 - RNA, 63 nt, Homo Sapiens
aaaacuuuguguuuuggcaaucguuuuauaacuaaaauaaaaugaaagcuaaaucuacacgcu

SEQ ID NO: 629801 - RNA, 63 nt, Homo Sapiens
aaaccacuggaaaacaugcauuuuggaaacuuuaaaauaaaugguuaacauggcauuucuaag

SEQ ID NO: 629802 - RNA, 63 nt, Homo Sapiens
auaguaaggucaagaagaguaucaaaguauaauaaaauaaaaauuguauacucuccauauauu

SEQ ID NO: 629803 - RNA, 63 nt, Homo Sapiens
gaaaucuugauugcuuccaguuuucagugauuaaaaauaaagccgcuauaaacauuugugugc

SEQ ID NO: 629804 - RNA, 63 nt, Homo Sapiens
ucuagugccuugguuuucuuucuugaugcuggaaaaauaaacaaaccgguauugaguguuuag

SEQ ID NO: 629805 - RNA, 63 nt, Homo Sapiens
cguagggaggcccugagaacuaaauuuugccccaaaauaaaaacagaaauuaugagauugccu

SEQ ID NO: 629806 - RNA, 63 nt, Homo Sapiens
ucuauugaaaaaggaaaaucagcaauucagcaaaaaauaaauaaaaaauaaaaauguaaauau

SEQ ID NO: 629807 - RNA, 63 nt, Homo Sapiens
aggaaaaucagcaauucagcaaaaaauaaauaaaaaauaaaaauguaaauaugauaguaauaa

SEQ ID NO: 629808 - RNA, 63 nt, Homo Sapiens
ggagagagagagagaugcuguugagcacaugacaaaauaaaauaaaauggaugauucauucuu

SEQ ID NO: 629809 - RNA, 63 nt, Homo Sapiens
gagagagagaugcuguugagcacaugacaaaauaaaauaaaauggaugauucauucuuaagug

SEQ ID NO: 629810 - RNA, 63 nt, Homo Sapiens
uaaugagacaacuuguuaaucucuuuaauacuaaaaauaaauuacucuucuauuucagggacu

SEQ ID NO: 629811 - RNA, 63 nt, Homo Sapiens
auuacucuucuauuucagggacuuagguaauuuaaaauaaaccuucaauuuauggucuucugu

SEQ ID NO: 629812 - RNA, 63 nt, Homo Sapiens
guuaacucauuucucaugccauuagcucucuacaaaauaaagcaaaguaguucuagugugguc

SEQ ID NO: 629813 - RNA, 63 nt, Homo Sapiens
uugccugcuaaacaaguuagaauaggaaauaguaaaauaaauccaaacaagaguguaauauug

SEQ ID NO: 629814 - RNA, 63 nt, Homo Sapiens
aaugucauuacauagaacacuucagacacaggaaaaauaaacguggauuuuaaaaaaucaauc

SEQ ID NO: 629815 - RNA, 63 nt, Homo Sapiens
aucuacauaaaugauuuacagguuaaaagaauaaaaauaaagguaacuuuaccuuucuuaaau

SEQ ID NO: 629816 - RNA, 63 nt, Homo Sapiens
uagugagagacccuguaucugaaaguaauaauaaaaauaaaaaauauaaaugaggucucguug

SEQ ID NO: 629817 - RNA, 63 nt, Homo Sapiens
agccugggcaacaaagcaagacucugucucaaaaaaauaaaaauaaaaaaaaaaucuuaguuc

SEQ ID NO: 629818 - RNA, 63 nt, Homo Sapiens
ggcaacaaagcaagacucugucucaaaaaaauaaaaauaaaaaaaaaaucuuaguuccaugga

SEQ ID NO: 629819 - RNA, 63 nt, Homo Sapiens
guauuaaaauucaacuauggauguauaugaaacaaaauaaauggagauaauuuuucucccaca

SEQ ID NO: 629820 - RNA, 63 nt, Homo Sapiens
ucuuuuguacguaauaggacauuucauccuagaaaaauaaaguaauguuuuugacauuggauu

SEQ ID NO: 629821 - RNA, 63 nt, Homo Sapiens
aauaagaaguuaccuacuccaaaagaaaaaaugaaaauaaagguaagaauuaaaaaaauacaa

SEQ ID NO: 629822 - RNA, 63 nt, Homo Sapiens
aguaucacagcucuuuuagagaaguuuauucagaaaauaaaggccaacagaguaaaguggaag

SEQ ID NO: 629823 - RNA, 63 nt, Homo Sapiens
uugcucuguuguauaagaucucauuaaaauaaaaaaauaaaucuuucaaauacaccuuuuuga

SEQ ID NO: 629824 - RNA, 63 nt, Homo Sapiens
aauaaaucuugcucuguugucuuuuugaucauuaaaauaaaaacauagugcuuucaaauacac

SEQ ID NO: 629825 - RNA, 63 nt, Homo Sapiens
uuucauucagacuaccuuugacuugagguguuuaaaauaaauuuuuguagaaauguaaagauu

SEQ ID NO: 629826 - RNA, 63 nt, Homo Sapiens
gaacagugaggugguagcaauuagaccgcauaaaaaauaaagugcucuuacgaaaaacccagg

SEQ ID NO: 629827 - RNA, 63 nt, Homo Sapiens
uuacuuacaagcauaacagaaaaaguaaaaauaaaaauaaaccacuuccagaauagugauuuu

SEQ ID NO: 629828 - RNA, 63 nt, Homo Sapiens
uaaaccuuacuuacaagcaugauuuuaaaaguaaaaauaaaaaucuuuaacuuccagaauagu

SEQ ID NO: 629829 - RNA, 63 nt, Homo Sapiens
auuuguuuucugcuagaugcaaaaugaaaacaaaaaauaaaauuaagaaacucuaaagguuau

SEQ ID NO: 629830 - RNA, 61 nt, Homo Sapiens
cagaugcccuauuuucuguguaaaacgcaauuaaaaauaaaguaucuaaaggauggaaaaa

SEQ ID NO: 629831 - RNA, 63 nt, Homo Sapiens
gcaauuaaaaauaaacagauucuaaaggauggaaaaauaaaacccuuuuacauucugugugua

SEQ ID NO: 629832 - RNA, 63 nt, Homo Sapiens
guacuuaguguaaaauaauuauaguaaaaaaauaaaauaaauaguucuaggggguugaacuac

SEQ ID NO: 629833 - RNA, 63 nt, Homo Sapiens
aaauaguacuuaguguaaaaacuacauaguaaaaaaauaaaauaaacaguucuaggggguuga

SEQ ID NO: 629834 - RNA, 63 nt, Homo Sapiens
aacagcauuacuauuucuaauagaacccacuucaaaauaaaaagaauuaaaaccaaucauaag

SEQ ID NO: 629835 - RNA, 63 nt, Homo Sapiens
uaaucuucauuuuaguauuuaugcuuagaugugaaaauaaauguuauuuguugaucauuucua

SEQ ID NO: 629836 - RNA, 63 nt, Homo Sapiens
uuguccagccuauugcaggcuuuuccugacuuuaaaauaaauugugaucaauaauaguaccuu

SEQ ID NO: 629837 - RNA, 63 nt, Homo Sapiens
ucaucucacaguaaagccuauuuccccaggaaaaaaauaaaugccuuugaaugaaaauucuga

SEQ ID NO: 629838 - RNA, 63 nt, Homo Sapiens
uaauguuuuaagcuuaauagccuuugcacuuuuaaaauaaaaaccaaguaugcaaaucaaaga

SEQ ID NO: 629839 - RNA, 63 nt, Homo Sapiens
caucuaggagcaaggugagaaaucacaaugagaaaaauaaauggaaacaccacugcuagggga

SEQ ID NO: 629840 - RNA, 63 nt, Homo Sapiens
ucaagcacuccuaccuuaauuauugcacuagagaaaauaaauuccaaauuaggaaguguuucc

SEQ ID NO: 629841 - RNA, 63 nt, Homo Sapiens
uucugguauuuugacauguuauaauacgcaaguaaaauaaaacaauaguuuacucagcucaug

SEQ ID NO: 629842 - RNA, 63 nt, Homo Sapiens
gcaaaacauaaauuaaaacucaaaugccaggacaaaauaaaacaauauaccagauggagagga

SEQ ID NO: 629843 - RNA, 63 nt, Homo Sapiens
cugugaccuaguuggugcaguggcuugaaugccaaaauaaagcgugugcacuggauagugugu

SEQ ID NO: 629844 - RNA, 63 nt, Homo Sapiens
gaaccuccauauacauuaauuuuuuucugccuaaaaauaaaauugcguuguggcagcaauuug

SEQ ID NO: 629845 - RNA, 63 nt, Homo Sapiens
acauuuacguuguuaccaagauuuuugcuauugaaaauaaaguuuuuaugaauauuuauauau

SEQ ID NO: 629846 - RNA, 63 nt, Homo Sapiens
cuuuaauaauuguaagccagcuuuugguaccugaaaauaaaugaaaaguggaaugggauaugg

SEQ ID NO: 629847 - RNA, 63 nt, Homo Sapiens
guugauuguacuguucucauaaugaguaacugcaaaauaaauacagaaauucucaaucacuga

SEQ ID NO: 629848 - RNA, 63 nt, Homo Sapiens
guaugucgauugaauuguacaucuguuacuaaaaaaauaaauuuuaagagcucaauuugaaaa

SEQ ID NO: 629849 - RNA, 63 nt, Homo Sapiens
cauucauguuuguuaaaaacuaaauggcugucuaaaauaaagauuccucugaaccccaaacug

SEQ ID NO: 629850 - RNA, 63 nt, Homo Sapiens
aauugaaaaccugcaauuguccuuuguuuuucuaaaauaaaguccuauggcacaaauuguaaa

SEQ ID NO: 629851 - RNA, 63 nt, Homo Sapiens
ggauuuacugaguagagguugauugacuuucgcaaaauaaacaauggggaaaaaaagucuugu

SEQ ID NO: 629852 - RNA, 63 nt, Homo Sapiens
auaaucugaaaaccucauguaacgcccaggauuaaaauaaaaucuauguaaaaauaaaauuca

SEQ ID NO: 629853 - RNA, 63 nt, Homo Sapiens
ucaaacgcccaggauuaaaaaugcagcuauguaaaaauaaaauguuuugagggaauauacuaa

SEQ ID NO: 629854 - RNA, 63 nt, Homo Sapiens
gccugggcgacagagcaagacucugucucaaaaaaaauaaaaaauaaucagggcacaguggcu

SEQ ID NO: 629855 - RNA, 63 nt, Homo Sapiens
ccagccugggcaacaagagcaaaacuccgucucaaaauaaaaagaaaagaaaagaauggacag

SEQ ID NO: 629856 - RNA, 63 nt, Homo Sapiens
cugggcaauauagugaggcucccaucuguacuaaaaauaaaaaaguuaggcguggcgaugugc

SEQ ID NO: 629857 - RNA, 63 nt, Homo Sapiens
gggcuucugcauccauucccucuuuuuguuuuuaaaauaaauuguauuuuugaaucaaggagg

SEQ ID NO: 629858 - RNA, 63 nt, Homo Sapiens
cagccugggggacagagcacgacccugucuccaaaaauaaaauaaaaauaaaaauaaauauug

SEQ ID NO: 629859 - RNA, 63 nt, Homo Sapiens
ugggggacagagcacgacccugucuccaaaaauaaaauaaaaauaaaaauaaauauuggcggg

SEQ ID NO: 629860 - RNA, 63 nt, Homo Sapiens
acagagcacgacccugucuccaaaaauaaaauaaaaauaaaaauaaauauuggcgggggaacc

SEQ ID NO: 629861 - RNA, 63 nt, Homo Sapiens
cacgacccugucuccaaaaauaaaauaaaaauaaaaauaaauauuggcgggggaacccucugg

SEQ ID NO: 629862 - RNA, 63 nt, Homo Sapiens
agccugggcaauauagcaagaccccucacuacaaaaauaaaacaucaaaaacaaaaacaauua

SEQ ID NO: 629863 - RNA, 63 nt, Homo Sapiens
ccaggcuggguaacagaaugagaccuuaucucaaaaauaaacaaacuaauaaaaagcaaaaaa

SEQ ID NO: 629864 - RNA, 63 nt, Homo Sapiens
cccugaaugacugcauggauagaaccacuaagaaaaauaaacuuuuauauuuuuauagcuacu

SEQ ID NO: 629865 - RNA, 63 nt, Homo Sapiens
ccuggucgacagagugagacuccaucucaagaaaaaauaaaaauaaaguuguucucugaagag

SEQ ID NO: 629866 - RNA, 63 nt, Homo Sapiens
cgacagagugagacuccaucucaagaaaaaauaaaaauaaaguuguucucugaagagcaaaug

SEQ ID NO: 629867 - RNA, 63 nt, Homo Sapiens
cuuaguccaucagcaucuuauucuggguaauaaaaaauaaaaauaaacggauaccuguuuucc

SEQ ID NO: 629868 - RNA, 63 nt, Homo Sapiens
ccaucagcaucuuauucuggguaauaaaaaauaaaaauaaacggauaccuguuuuccacugcu

SEQ ID NO: 629869 - RNA, 63 nt, Homo Sapiens
uuuauacgaaaauauauuuucaaagguguaguaaaaauaaaaaaaauuuuaauccaaauuugu

SEQ ID NO: 629870 - RNA, 63 nt, Homo Sapiens
gaauauucuacuaaaugagaguucugaguauagaaaauaaaacuaaaguugguagaaaaauua

SEQ ID NO: 629871 - RNA, 63 nt, Homo Sapiens
aauaacauuuaggaagcaaauagauuaaacacaaaaauaaaacuaaagcauaggaauuauguu

SEQ ID NO: 629872 - RNA, 63 nt, Homo Sapiens
uuuaaauauaauuuuauuucuuucaacaaauauaaaauaaaaaacaacuuuggaacaaugacu

SEQ ID NO: 629873 - RNA, 63 nt, Homo Sapiens
auugcugggaauauuugacucuccguauuggagaaaauaaaauuacaacauuacgacauacua

SEQ ID NO: 629874 - RNA, 63 nt, Homo Sapiens
aguuuuuauaccuuaaaaagacugguagcauauaaaauaaaucuuaaaagcuaauuauacaca

SEQ ID NO: 629875 - RNA, 63 nt, Homo Sapiens
ccugggcgacagagugagacucccucucaaaagaaaauaaaaauaaaaauaaacuggccaggu

SEQ ID NO: 629876 - RNA, 63 nt, Homo Sapiens
cgacagagugagacucccucucaaaagaaaauaaaaauaaaaauaaacuggccaggugcggug

SEQ ID NO: 629877 - RNA, 63 nt, Homo Sapiens
agugagacucccucucaaaagaaaauaaaaauaaaaauaaacuggccaggugcgguggcucac

SEQ ID NO: 629878 - RNA, 63 nt, Homo Sapiens
ccugggcaagagagagagacuuugucucuauuaaaaauaaaaaugauuggccgagcauggugg

SEQ ID NO: 629879 - RNA, 63 nt, Homo Sapiens
acaggcugcaccauaagacccacucacaauaaaaaaauaaaaggccgagccgggcaugguugc

SEQ ID NO: 629880 - RNA, 63 nt, Homo Sapiens
gagccgggcaugguugcucacucccguaauaaaaaaauaaaagaacaggcugagccgggcaug

SEQ ID NO: 629881 - RNA, 63 nt, Homo Sapiens
uucugcaaagauaaauaauaucccugcauuaucaaaauaaaguagcagaccucucaauucaca

SEQ ID NO: 629882 - RNA, 63 nt, Homo Sapiens
auuaaugauacaugaaucuuggccacaaugagaaaaauaaaaaugaaaaaagagcaggcaucc

SEQ ID NO: 629883 - RNA, 63 nt, Homo Sapiens
acagaaagcaaggggugccuucaaaauaaauaaaaaauaaaagaacaagagcgaaacucuguc

SEQ ID NO: 629884 - RNA, 63 nt, Homo Sapiens
aaaaauaaaagacagaaagcgaaacucugucucaaaauaaauaccagccugggcaacaagagc

SEQ ID NO: 629885 - RNA, 63 nt, Homo Sapiens
aucuaagggcucaggaaccagucaaaaaaauaaaaaauaaaaagugacagaaugagacucugu

SEQ ID NO: 629886 - RNA, 63 nt, Homo Sapiens
auaaaaaaucuaagggcucaacucugugucaaaaaaauaaaaaagccugggugacagaaugag

SEQ ID NO: 629887 - RNA, 63 nt, Homo Sapiens
cagugcucaaaggguuaaguucaaagaacacucaaaauaaacuuuaaagguauuuauuagaaa

SEQ ID NO: 629888 - RNA, 63 nt, Homo Sapiens
aauaauaauguaugaagcucuugguuaaaaaauaaaauaaaauugaagcacuuuugcauuaau

SEQ ID NO: 629889 - RNA, 63 nt, Homo Sapiens
aaaauaauaauaauguaugauuaauuugguuaaaaaauaaaauuacuuugaagcacuuuugca

SEQ ID NO: 629890 - RNA, 63 nt, Homo Sapiens
caacccaaguaaagaacagcaaaaggaaacaacaaaauaaaacaauaaguauuuccgucaaga

SEQ ID NO: 629891 - RNA, 63 nt, Homo Sapiens
aucguaugauaugagauacaagugugauuauaaaaaauaaaagauuugguuagggauuauguc

SEQ ID NO: 629892 - RNA, 63 nt, Homo Sapiens
uuacuaagccaaagagaaaaagcuugugaaaggaaaauaaaaaaaagcauuauggcugucaca

SEQ ID NO: 629893 - RNA, 63 nt, Homo Sapiens
accaguuuguaaauggaaaaggggacgauucccaaaauaaaucaugcuuuaugaaaagguuau

SEQ ID NO: 629894 - RNA, 63 nt, Homo Sapiens
aauaagacagcacuuuauacaauaagauaaaauaaaauaaacagagcaaaauuucaucucaaa

SEQ ID NO: 629895 - RNA, 63 nt, Homo Sapiens
aaacaaauaagacagcacuuucaaaaauaagauaaaauaaaauaacaagagcaaaauuucauc

SEQ ID NO: 629896 - RNA, 63 nt, Homo Sapiens
ugguaauaaucuuuuuucaaccuugagacaaugaaaauaaacuuagauccagaguucagaaga

SEQ ID NO: 629897 - RNA, 63 nt, Homo Sapiens
aaaaggacuguaggaggcagauuauaaaaaaacaaaauaaauguauagcaagacucugccucu

SEQ ID NO: 629898 - RNA, 63 nt, Homo Sapiens
cucgcuucccccauagccaccccagaaauggugaaaauaaaauaaagcagguuuuucuccucu

SEQ ID NO: 629899 - RNA, 63 nt, Homo Sapiens
uucccccauagccaccccagaaauggugaaaauaaaauaaagcagguuuuucuccucuaccuu

SEQ ID NO: 629900 - RNA, 63 nt, Homo Sapiens
aaggucuuuuuaaaccaguuuagauuucaagaaaaaauaaauggaaaucaucgaaaauucauu

SEQ ID NO: 629901 - RNA, 63 nt, Homo Sapiens
aucaucgaaaauucauuucacauuaauggucuaaaaauaaaccaaaggacauuaugugugcau

SEQ ID NO: 629902 - RNA, 63 nt, Homo Sapiens
aauuaugcaugugauuuuaacauuuaauauucaaaaauaaaucucuugcuggauuugagagua

SEQ ID NO: 629903 - RNA, 63 nt, Homo Sapiens
gcuuguagaaacaauuuugaaagccccuugaggaaaauaaaaaucaagaagaacacuuuucuc

SEQ ID NO: 629904 - RNA, 63 nt, Homo Sapiens
cuccagccugggagggugagacuccaucuaaaaaaaauaaaauaaauggcaaccccuggucua

SEQ ID NO: 629905 - RNA, 63 nt, Homo Sapiens
gccugggagggugagacuccaucuaaaaaaaauaaaauaaauggcaaccccuggucuaagaua

SEQ ID NO: 629906 - RNA, 63 nt, Homo Sapiens
uuugccuauaugguagagcaauaaugcuuuuuaaaaauaaacuucugaaaacccaaggccagg

SEQ ID NO: 629907 - RNA, 63 nt, Homo Sapiens
cuugacuuuaaaaaaauuauuaaaaacaaaaaaaaaauaaauuuuuuugcaauccuuuccuca

SEQ ID NO: 629908 - RNA, 63 nt, Homo Sapiens
ugauauaaaggagauacauguuucuuccuuuaaaaaauaaacggaaguuacauuguuaauguu

SEQ ID NO: 629909 - RNA, 63 nt, Homo Sapiens
cagggagccuaaugagguuuuuaauaucaucuaaaaauaaagcauugaagugaaguuggugaa

SEQ ID NO: 629910 - RNA, 63 nt, Homo Sapiens
uucccacugcugggccucuaucuccaugacaacaaaauaaaaacagagguugcuugacucauu

SEQ ID NO: 629911 - RNA, 63 nt, Homo Sapiens
aaaggccacaaaaguucccucucacuuucaguaaaaauaaauaaaacagcagcagcaaacaaa

SEQ ID NO: 629912 - RNA, 63 nt, Homo Sapiens
uaaauauuguguugugcagcauuaaaaaaaaucaaaauaaaaauuaaaugugagcaaagaaug

SEQ ID NO: 629913 - RNA, 63 nt, Homo Sapiens
gccuaggcaacaagagugaaauuccgucucaaaaaaauaaauaaauaaauaaauaaauaaguu

SEQ ID NO: 629914 - RNA, 63 nt, Homo Sapiens
guuucuaaaacccuuaacacugguaagggcucaaaaauaaacguauguguucauauucgauca

SEQ ID NO: 629915 - RNA, 63 nt, Homo Sapiens
uuucccugugcuccuuuuacucuucagaaggugaaaauaaauaagagcuccaugcacacagug

SEQ ID NO: 629916 - RNA, 63 nt, Homo Sapiens
caaccaaaaaaauugaaggauuuaaugaaaaaaaaaauaaaaauuuugugaugaucaauggac

SEQ ID NO: 629917 - RNA, 63 nt, Homo Sapiens
uuggcuaaaaauuuuaaaaauuuucuaggcauaaaaauaaaagguccuaaacgucccauguau

SEQ ID NO: 629918 - RNA, 63 nt, Homo Sapiens
cuagacaucaaauuuagaucgauaauuuaaagaaaaauaaauaaaguaguucuuuaaauaaga

SEQ ID NO: 629919 - RNA, 63 nt, Homo Sapiens
acuucacaaaaacgguaaugcagcaaagcuuugaaaauaaaggaagucuguuaaagccauugu

SEQ ID NO: 629920 - RNA, 63 nt, Homo Sapiens
aauaacaaugugcucucgggacaucacuuguacaaaauaaacaaggcaaaauccuugcuuaug

SEQ ID NO: 629921 - RNA, 63 nt, Homo Sapiens
cagcucuacuggucuuguggucacugguagaccaaaauaaaacuugacugucacuguuccuug

SEQ ID NO: 629922 - RNA, 63 nt, Homo Sapiens
uggccauuugcuuuuucaccaacaaaaacacuaaaaauaaaaagaaccccuacaugaaacaga

SEQ ID NO: 629923 - RNA, 63 nt, Homo Sapiens
aacauuuuuuucaagcagggaauaaaaaaaauaaaaauaaaaaaauccccucaaaaaaauaaa

SEQ ID NO: 629924 - RNA, 63 nt, Homo Sapiens
uaaaaaaacauuuuuuucaaaauaaaaauaaaaaaaauaaaaacugugcaauccccucaaaaa

SEQ ID NO: 629925 - RNA, 63 nt, Homo Sapiens
aaauaaaaauaaaaaaacauccucaaaaaaauaaaaauaaaaaggaaauaaacugugcaaucc

SEQ ID NO: 629926 - RNA, 63 nt, Homo Sapiens
uaaaaaaaauaaaaauaaaacaauccccucaaaaaaauaaaaaguguuuggaaauaaacugug

SEQ ID NO: 629927 - RNA, 63 nt, Homo Sapiens
uguuaacaggaaugcagugucuguuaccuugaaaaaauaaaaaugucauuuguaugcaauuuc

SEQ ID NO: 629928 - RNA, 63 nt, Homo Sapiens
ggcaaggaucuacugucauuuuuuauuuagauaaaaauaaagaagaauucaucuugaguuauc

SEQ ID NO: 629929 - RNA, 63 nt, Homo Sapiens
cgcuggggaagggggcuccaaaagugaccaugaaaaauaaauuucacucacugccaaaaauag

SEQ ID NO: 629930 - RNA, 63 nt, Homo Sapiens
acagcuuaaagagaaaaauguaaauaauuaauuaaaauaaaaacaagacucugucucaauaaa

SEQ ID NO: 629931 - RNA, 63 nt, Homo Sapiens
aaccauaauccccagugcagaauacauaaauaaaaaauaaaccgacuccgucucaaaaaaaua

SEQ ID NO: 629932 - RNA, 63 nt, Homo Sapiens
cauaaauaaaaaauaaaccaacuccgucucaaaaaaauaaauaaggcugggcgacagagcgag

SEQ ID NO: 629933 - RNA, 63 nt, Homo Sapiens
guuuccuauuuuugguuuauuuauuuuagaagaaaaauaaaauuauuugggcauuuuuguuua

SEQ ID NO: 629934 - RNA, 63 nt, Homo Sapiens
ugccuagcauuuuauagauauuuauuauuuaaaaaaauaaagauauguuuuuaaugaagagag

SEQ ID NO: 629935 - RNA, 63 nt, Homo Sapiens
ucccuguauuugauaaaacacauaauuuugagaaaaauaaaguuuuaaauguaucuaugucuc

SEQ ID NO: 629936 - RNA, 63 nt, Homo Sapiens
uuuguuauaccaauaaaugcuuuagcugcaacuaaaauaaaaaaguuaaagguaagaaaauga

SEQ ID NO: 629937 - RNA, 63 nt, Homo Sapiens
cuaccaaaaauagccaguaguaucugaaaaugaaaaauaaaugaaguaucucuaggaaacagu

SEQ ID NO: 629938 - RNA, 63 nt, Homo Sapiens
auuuaaaaaacugaaaagguauaccucaacccaaaaauaaagguuuguuuugguuuguuaugg

SEQ ID NO: 629939 - RNA, 63 nt, Homo Sapiens
uuuuucuucuauuaaaauauaacauugugaaagaaaauaaaauuuaugcuauucuuugcuuug

SEQ ID NO: 629940 - RNA, 63 nt, Homo Sapiens
uagaaauccaauuaagacucacuuggguaaaaaaaaauaaaaaaauaaacaaaauaaacugcu

SEQ ID NO: 629941 - RNA, 63 nt, Homo Sapiens
caauuaagacucacuuggguaaaaaaaaauaaaaaaauaaacaaaauaaacugcucacuuauu

SEQ ID NO: 629942 - RNA, 63 nt, Homo Sapiens
cucacuuggguaaaaaaaaauaaaaaaauaaacaaaauaaacugcucacuuauuugaaaaauu

SEQ ID NO: 629943 - RNA, 63 nt, Homo Sapiens
uuacuuucuaucagcugagcaaccucucaagaaaaaauaaauaaauaaauaaaccucucuuua

SEQ ID NO: 629944 - RNA, 63 nt, Homo Sapiens
cagccaacauugugagacauaaucucuacaaauaaaauaaauuaguuggacaugauggugugc

SEQ ID NO: 629945 - RNA, 63 nt, Homo Sapiens
agccugagugacagagugagacuuugcaaccaaaaaauaaaauaauaauaauaaugaaauaaa

SEQ ID NO: 629946 - RNA, 63 nt, Homo Sapiens
ucugaaagugaacucucauaauucaaauuguauaaaauaaagcuacauuucuaagagcuuggu

SEQ ID NO: 629947 - RNA, 63 nt, Homo Sapiens
cugcauaggauuauccccugacauuccaagagcaaaauaaagcucuugagaguaauuguuguc

SEQ ID NO: 629948 - RNA, 63 nt, Homo Sapiens
aggggucuagugcccugcauuccuuugaggcaaaaaauaaaugggcuaugacugguuaaaugu

SEQ ID NO: 629949 - RNA, 63 nt, Homo Sapiens
auaucuguggaacauguaaauacugucaaauggaaaauaaaauaaguuauaauuuuugugaau

SEQ ID NO: 629950 - RNA, 63 nt, Homo Sapiens
gauguaaauguuuuacuuucaacuguguucuuuaaaauaaauccuaccugguuuuuaaauuuu

SEQ ID NO: 629951 - RNA, 63 nt, Homo Sapiens
augcauacaguuaaacauucaucaaaaauaaagaaaauaaaaaucuuggaaaaaauuuuaaga

SEQ ID NO: 629952 - RNA, 63 nt, Homo Sapiens
aaauaaaaaaugcauacaguauuuuaagaaucaaaaauaaagaauuucuauuucuuggaaaaa

SEQ ID NO: 629953 - RNA, 63 nt, Homo Sapiens
uucugggccuuacuuguuuuaaaaaugucuuagaaaauaaaaauauuuaugcccuuauauccc

SEQ ID NO: 629954 - RNA, 63 nt, Homo Sapiens
uacacagguaauuuaguaucguagugaaugcagaaaauaaaaauaaucaauggauauccuuca

SEQ ID NO: 629955 - RNA, 63 nt, Homo Sapiens
aaguguuuuacauaguaagguaaacauuuuuacaaaauaaauaacaguauuuuuauucauauu

SEQ ID NO: 629956 - RNA, 63 nt, Homo Sapiens
aagacuuucuaugugguuugaagcaagucuaccaaaauaaacuuuuaaaccaaugccuauaaa

SEQ ID NO: 629957 - RNA, 63 nt, Homo Sapiens
gcaguuauugauucuugccaugauggagaagggaaaauaaauuuuccuauucuuucuuaaauu

SEQ ID NO: 629958 - RNA, 63 nt, Homo Sapiens
uuugguauuuuguggucaugcugacacuugauaaaaauaaauacucaacuuuaauaaguuauc

SEQ ID NO: 629959 - RNA, 63 nt, Homo Sapiens
agugaaagaagcaagcugugcugucucaaaaauaaaauaaaaacuggaccacagagcaggccc

SEQ ID NO: 629960 - RNA, 63 nt, Homo Sapiens
aaaaaagugaaagaagcaagggccccugucucaaaaauaaaauauagccuggaccacagagca

SEQ ID NO: 629961 - RNA, 63 nt, Homo Sapiens
uaaaaaacuagccaggugugcccgucucuacaaaaaauaaauuccugggucacauagcaagac

SEQ ID NO: 629962 - RNA, 63 nt, Homo Sapiens
auggugggguuuucugcuuuguuuuuauuuaagaaaauaaacacgacauauuuaaagaagguu

SEQ ID NO: 629963 - RNA, 63 nt, Homo Sapiens
auuggaugaaagucaaagguugucuacuuuaagaaaauaaaauacccugaauggagcccagca

SEQ ID NO: 629964 - RNA, 63 nt, Homo Sapiens
uuccccuuuaauuguggauaguuuaaaguuuaaaaaauaaaguucuugcugggcacaguggcu

SEQ ID NO: 629965 - RNA, 63 nt, Homo Sapiens
cagcuugggcaacagagugagacuuaaucuugaaaaauaaauaaaugaaaaauaaaauucuug

SEQ ID NO: 629966 - RNA, 63 nt, Homo Sapiens
agccugggugacagagugagacccuauuucaaaaaaauaaaaauuggaagaagagcuuaaaaa

SEQ ID NO: 629967 - RNA, 63 nt, Homo Sapiens
gaauacaauguccuuccauagcaugggaagaagaaaauaaacaucuccuuuccaacagcugug

SEQ ID NO: 629968 - RNA, 63 nt, Homo Sapiens
agguggccuuucucccaagcugguggauaaugaaaaauaaagcaucccaucucucggcguucc

SEQ ID NO: 629969 - RNA, 63 nt, Homo Sapiens
ggcaucaucuuuuugcucuagcccuuccucuccaaaauaaaaucaaauaaaggaaaaucucca

SEQ ID NO: 629970 - RNA, 63 nt, Homo Sapiens
guagauguuuuaauaacaauuuuuguccuucuuaaaauaaaaugaaagaaacuugcuucccuu

SEQ ID NO: 629971 - RNA, 63 nt, Homo Sapiens
aaagaaacuugcuucccuuagccuuuguucuagaaaauaaacuugugcacuuugaccucuguc

SEQ ID NO: 629972 - RNA, 63 nt, Homo Sapiens
auaguuagauauucuagauuuacauuaaauuguaaaauaaauggacuuauugaagcauaucuu

SEQ ID NO: 629973 - RNA, 63 nt, Homo Sapiens
aggcugugucacuggcauguccuuaaccuuggcaaaauaaacuuucuaaauugaaaccugucu

SEQ ID NO: 629974 - RNA, 63 nt, Homo Sapiens
acuugagacuugugacaagcagacucuguucugaaaauaaaaacucuuuuuaaaaauaaaacc

SEQ ID NO: 629975 - RNA, 63 nt, Homo Sapiens
cagacucuguucugaaaauaccuucucuuuuuaaaaauaaaaccuagcauuuaucacuuuuuu

SEQ ID NO: 629976 - RNA, 63 nt, Homo Sapiens
accuugauuuugagcuggaauguuucaaugagcaaaauaaauuagacaaaaguuuacuuucuu

SEQ ID NO: 629977 - RNA, 63 nt, Homo Sapiens
uuuuuaaaaagacuguuuuuaaaaaggugcuacaaaauaaagugcuaucuuuuucuguuucuc

SEQ ID NO: 629978 - RNA, 63 nt, Homo Sapiens
gcagcacguggaggggaacacauacaugucuugaaaauaaacugcuagaauaaagaaaugcug

SEQ ID NO: 629979 - RNA, 63 nt, Homo Sapiens
auacuagaguaucuagaagggugaaaacaaaaaaaaauaaaaagaaacacagacgcccaggug

SEQ ID NO: 629980 - RNA, 63 nt, Homo Sapiens
ucuacugcacaccaacuguuuauagaauacacaaaaauaaaauguaauaacuguauucuguga

SEQ ID NO: 629981 - RNA, 63 nt, Homo Sapiens
uuuagaaauuagcuccagguucuuaaacuaacaaaaauaaaaccuaagcaugccacagagcua

SEQ ID NO: 629982 - RNA, 63 nt, Homo Sapiens
ugggagaggaaaugucagggcaugugcucugauaaaauaaaggcagggaaacaagcugaauua

SEQ ID NO: 629983 - RNA, 63 nt, Homo Sapiens
caugauuugaaaaguacaccuugcaaaguuuuaaaaauaaaguuuuuaggcaaaugcgauaag

SEQ ID NO: 629984 - RNA, 63 nt, Homo Sapiens
ugcugcaugacccuccaaguagaccuguggcuuaaaauaaagaaaaugcagcaaaaagaaugc

SEQ ID NO: 629985 - RNA, 63 nt, Homo Sapiens
uguacacauugauauuuaaugacaaauuuacuuaaaauaaauugaccccuuguucuuacuugc

SEQ ID NO: 629986 - RNA, 63 nt, Homo Sapiens
gcaacaugaugccagauuugagaaaggaucugcaaaauaaagauaccacaauucaucuuaaaa

SEQ ID NO: 629987 - RNA, 63 nt, Homo Sapiens
augaggaauggauugucagguugcugaaguauaaaaauaaacucuugguuguccugugcuuau

SEQ ID NO: 629988 - RNA, 63 nt, Homo Sapiens
cucuggcucaucuaguccugcuccuugugcuauaaaauaaaugcagacuaauuuccugcccaa

SEQ ID NO: 629989 - RNA, 63 nt, Homo Sapiens
aaauaaggagaaaagagaaugggagagugagagaaaauaaaaaaggcaaaagggagagagagg

SEQ ID NO: 629990 - RNA, 63 nt, Homo Sapiens
uguaauuuagguuuuucaacaaagcccuugucuaaaauaaaaggcauuauuggaaauauuuga

SEQ ID NO: 629991 - RNA, 63 nt, Homo Sapiens
gaaagccuacaaugaaucauuguucaaccuugaaaaauaaaauuuuguaaaacaucgguugau

SEQ ID NO: 629992 - RNA, 63 nt, Homo Sapiens
cuaacauacucacugugaacccagccuauugcaaaaauaaaaucuuuuuauaauauuaucuau

SEQ ID NO: 629993 - RNA, 63 nt, Homo Sapiens
auuuuugacaugcuccuauuuuuguaacuugaaaaaauaaaauuuugccuugugacagauuuu

SEQ ID NO: 629994 - RNA, 63 nt, Homo Sapiens
acuuuuaaaaaugacacauauuuaaacacuuagaaaauaaaguuaacacuuacugaagugcua

SEQ ID NO: 629995 - RNA, 63 nt, Homo Sapiens
gccugauauuaguucuuagagcuucuuguggcaaaaauaaaaugauuuaauucugauguuuga

SEQ ID NO: 629996 - RNA, 63 nt, Homo Sapiens
ucccauacuaucugcuuggauuuggagagccaaaaaauaaagcugauugucaugugauuaaau

SEQ ID NO: 629997 - RNA, 63 nt, Homo Sapiens
ggugaagcauacuccaguguuuuagggguuuugaaaauaaauauuuaaauuucacaguccuca

SEQ ID NO: 629998 - RNA, 63 nt, Homo Sapiens
aaauacaaauagcugacccggucucaaaacauaaaaauaaaaagggccacagagcaagacucc

SEQ ID NO: 629999 - RNA, 63 nt, Homo Sapiens
auaguaauaauauugaacauuuugcugacuauaaaaauaaaucaaaagcuuuuaagucucaug

SEQ ID NO: 630000 - RNA, 63 nt, Homo Sapiens
ucauagucaagauuugguagauguaacaacccaaaaauaaauggcccagauagguugaucuua

SEQ ID NO: 630001 - RNA, 63 nt, Homo Sapiens
augucaccacaaugguguauugcagaaaauuccaaaauaaauggaaacaccuuuuaagcugaa

SEQ ID NO: 630002 - RNA, 63 nt, Homo Sapiens
gcagugguucucaacuaggguuugaugaugcacaaaauaaacaacuguaguagaaacuuuagu

SEQ ID NO: 630003 - RNA, 63 nt, Homo Sapiens
ccgaggcuuacuguaguagaugccuccuuuguaaaaauaaacauuuugguucuacuugcuaua

SEQ ID NO: 630004 - RNA, 63 nt, Homo Sapiens
augaacaacuuucaacaaugcuacugcaauuagaaaauaaaauguaaagaaaucagauacaaa

SEQ ID NO: 630005 - RNA, 63 nt, Homo Sapiens
guuugaaauccaagaauaauaagcuaugcacagaaaauaaaauuuccuauaauacagugcuau

SEQ ID NO: 630006 - RNA, 63 nt, Homo Sapiens
gucaugcugcagaauauguuacagcugagaaauaaaauaaaauaguuucugaaugaaaaagcu

SEQ ID NO: 630007 - RNA, 63 nt, Homo Sapiens
acuuguugaaaagccuuuuuuagcaacuuguaaaaaauaaaauauauauaaauuuuaauuuca

SEQ ID NO: 630008 - RNA, 63 nt, Homo Sapiens
ugauuucacggaugugguuuguggaaaaaaauaaaaauaaaagguugacaugaagucaucuau

SEQ ID NO: 630009 - RNA, 63 nt, Homo Sapiens
uaaaagugauuucacggaugaucuauguggaaaaaaauaaaaauuuguaguugacaugaaguc

SEQ ID NO: 630010 - RNA, 63 nt, Homo Sapiens
aguuuaaugcagugaucuuugaauaauauuaacaaaauaaaggaauaauuguucaauguuuaa

SEQ ID NO: 630011 - RNA, 63 nt, Homo Sapiens
uagaaauauggcaugacauguuaaugcuagcaaaaaauaaauuaucguuuaaauaggaaaaau

SEQ ID NO: 630012 - RNA, 63 nt, Homo Sapiens
cuuaguucauacccuuccagaaaauaaauaaauaaaauaaauuacagugaaacuccaucucaa

SEQ ID NO: 630013 - RNA, 63 nt, Homo Sapiens
aauaaaauaaauucuuaguuaacuccaucucaaaaaauaaauauccagccugggcaacaguga

SEQ ID NO: 630014 - RNA, 63 nt, Homo Sapiens
uuaaaaugauauauaagacagugaguuuuuauaaaaauaaauuaguggacgcaaaauaauguu

SEQ ID NO: 630015 - RNA, 63 nt, Homo Sapiens
caguggacgcaaaauaauguaaagguaauuguaaaaauaaauacaaaaacuaucacuugcuau

SEQ ID NO: 630016 - RNA, 63 nt, Homo Sapiens
gcucuggucccaccucuggaguggagcucuuuaaaaauaaauucacccccacauccaaaggau

SEQ ID NO: 630017 - RNA, 63 nt, Homo Sapiens
aguacagaagggcuuauaauauacacagguaaaaaaauaaaauuuuaaaaaguaaagcaauau

SEQ ID NO: 630018 - RNA, 63 nt, Homo Sapiens
ugucuguuuucaaccaaagauaacuaucaaaacaaaauaaauucuaauacauauuaaaagaca

SEQ ID NO: 630019 - RNA, 63 nt, Homo Sapiens
auauaauucaaugguugucauuuaauuauaauaaaaauaaaguuauaaaguaaaauucaccau

SEQ ID NO: 630020 - RNA, 63 nt, Homo Sapiens
caaauguuuauuucagaagguauucccauuuuuaaaauaaauagcuugggaaaaaugaaauug

SEQ ID NO: 630021 - RNA, 63 nt, Homo Sapiens
aaagaaauaugucaccuuugaguucauuauuuaaaaauaaacuuaguauuuuugcagccuaag

SEQ ID NO: 630022 - RNA, 63 nt, Homo Sapiens
uccuuucgauuuagccaacuacaagaaaauacuaaaauaaaaauuuuuugauuaaaaauguga

SEQ ID NO: 630023 - RNA, 63 nt, Homo Sapiens
ucugaucgcauaaaaauaugguaaacaaaaaauaaaauaaaaucuauauuuuuauauucaugu

SEQ ID NO: 630024 - RNA, 63 nt, Homo Sapiens
aaaauucugaucgcauaaaacauguguaaacaaaaaauaaaauuuuuucuauauuuuuauauu

SEQ ID NO: 630025 - RNA, 63 nt, Homo Sapiens
ucauucugaauaucagccuuccauaguuauauaaaaauaaaggcugcaguaaggugguuuaaa

SEQ ID NO: 630026 - RNA, 63 nt, Homo Sapiens
gauuuuuccaguguugauuuucaaaguaguuagaaaauaaacauccaaucacuuaguagcccc

SEQ ID NO: 630027 - RNA, 63 nt, Homo Sapiens
auaaaacauuuccaaucacuccuacuagacuugaaaauaaaguaccccacuuauggguguaag

SEQ ID NO: 630028 - RNA, 63 nt, Homo Sapiens
uaauuaaaaaccuaagaaauuguuuggcaaaauaaaauaaaggauaaaagguauucccaggua

SEQ ID NO: 630029 - RNA, 63 nt, Homo Sapiens
aaagguaauuaaaaaccuaaagguauguuuggcaaaauaaaauaaaaaauaaaagguauuccc

SEQ ID NO: 630030 - RNA, 63 nt, Homo Sapiens
guauucccagguauguuuggccaagguaaaaaaaaaauaaaaguaugguuuggaaccaucacc

SEQ ID NO: 630031 - RNA, 63 nt, Homo Sapiens
cucaguaaugcucacgauaccaauuguuuugacaaaauaaauuuacuaaacuuggccuaaaau

SEQ ID NO: 630032 - RNA, 63 nt, Homo Sapiens
cacugcaugugcucuguuuauucugauuuuacuaaaauaaaaaguucaaaagucuuccugcug

SEQ ID NO: 630033 - RNA, 63 nt, Homo Sapiens
uuuuguuuuuuagccuguuauauuuccuucuguaaaauaaaauauguccagaagaggcauguu

SEQ ID NO: 630034 - RNA, 63 nt, Homo Sapiens
cuauugcugauacugucuuugcauaaaugaauaaaaauaaacuuuuuuucuucaaauguguuu

SEQ ID NO: 630035 - RNA, 63 nt, Homo Sapiens; identical to SEQ ID NO: 630033

SEQ ID NO: 630036 - RNA, 63 nt, Homo Sapiens; identical to SEQ ID NO: 630034

SEQ ID NO: 630037 - RNA, 63 nt, Homo Sapiens
auuaaaaaaaaacaugagcuucuguaaaaaauaaaaauaaaaccaacacagugagaacucauc

SEQ ID NO: 630038 - RNA, 63 nt, Homo Sapiens
uaaaacauuaaaaaaaaacacucaucucuguaaaaaauaaaaaccuaggcaacacagugagaa

SEQ ID NO: 630039 - RNA, 64 nt, Homo Sapiens; identical to SEQ ID NO: 45477

SEQ ID NO: 630040 - RNA, 64 nt, Homo Sapiens; identical to SEQ ID NO: 45478

SEQ ID NO: 630041 - RNA, 64 nt, Homo Sapiens; identical to SEQ ID NO: 45479

SEQ ID NO: 630042 - RNA, 64 nt, Homo Sapiens; identical to SEQ ID NO: 45480

SEQ ID NO: 630043 - RNA, 64 nt, Homo Sapiens; identical to SEQ ID NO: 45481

SEQ ID NO: 630044 - RNA, 64 nt, Homo Sapiens; identical to SEQ ID NO: 45482

SEQ ID NO: 630045 - RNA, 64 nt, Homo Sapiens; identical to SEQ ID NO: 45483

SEQ ID NO: 630046 - RNA, 64 nt, Homo Sapiens; identical to SEQ ID NO: 45484

SEQ ID NO: 630047 - RNA, 64 nt, Homo Sapiens; identical to SEQ ID NO: 45485

SEQ ID NO: 630048 - RNA, 64 nt, Homo Sapiens; identical to SEQ ID NO: 45486

SEQ ID NO: 630049 - RNA, 64 nt, Homo Sapiens; identical to SEQ ID NO: 45487

SEQ ID NO: 630050 - RNA, 56 nt, Homo Sapiens; identical to SEQ ID NO: 45488

SEQ ID NO: 630051 - RNA, 64 nt, Homo Sapiens; identical to SEQ ID NO: 45489

SEQ ID NO: 630052 - RNA, 64 nt, Homo Sapiens; identical to SEQ ID NO: 45490

SEQ ID NO: 630053 - RNA, 64 nt, Homo Sapiens; identical to SEQ ID NO: 45491

SEQ ID NO: 630054 - RNA, 64 nt, Homo Sapiens; identical to SEQ ID NO: 45492

SEQ ID NO: 630055 - RNA, 64 nt, Homo Sapiens; identical to SEQ ID NO: 45493

SEQ ID NO: 630056 - RNA, 64 nt, Homo Sapiens; identical to SEQ ID NO: 45494

SEQ ID NO: 630057 - RNA, 64 nt, Homo Sapiens; identical to SEQ ID NO: 45495

SEQ ID NO: 630058 - RNA, 64 nt, Homo Sapiens; identical to SEQ ID NO: 45496

SEQ ID NO: 630059 - RNA, 64 nt, Homo Sapiens; identical to SEQ ID NO: 45497

SEQ ID NO: 630060 - RNA, 64 nt, Homo Sapiens; identical to SEQ ID NO: 45498

SEQ ID NO: 630061 - RNA, 64 nt, Homo Sapiens; identical to SEQ ID NO: 45499

SEQ ID NO: 630062 - RNA, 64 nt, Homo Sapiens; identical to SEQ ID NO: 45500

SEQ ID NO: 630063 - RNA, 64 nt, Homo Sapiens; identical to SEQ ID NO: 45501

SEQ ID NO: 630064 - RNA, 64 nt, Homo Sapiens; identical to SEQ ID NO: 45502

SEQ ID NO: 630065 - RNA, 64 nt, Homo Sapiens; identical to SEQ ID NO: 45503

SEQ ID NO: 630066 - RNA, 64 nt, Homo Sapiens; identical to SEQ ID NO: 45504

SEQ ID NO: 630067 - RNA, 64 nt, Homo Sapiens; identical to SEQ ID NO: 45505

SEQ ID NO: 630068 - RNA, 64 nt, Homo Sapiens; identical to SEQ ID NO: 45506

SEQ ID NO: 630069 - RNA, 64 nt, Homo Sapiens; identical to SEQ ID NO: 45507

SEQ ID NO: 630070 - RNA, 64 nt, Homo Sapiens; identical to SEQ ID NO: 45508

SEQ ID NO: 630071 - RNA, 64 nt, Homo Sapiens; identical to SEQ ID NO: 45509

SEQ ID NO: 630072 - RNA, 64 nt, Homo Sapiens; identical to SEQ ID NO: 45510

SEQ ID NO: 630073 - RNA, 64 nt, Homo Sapiens; identical to SEQ ID NO: 45511

SEQ ID NO: 630074 - RNA, 64 nt, Homo Sapiens; identical to SEQ ID NO: 45512

SEQ ID NO: 630075 - RNA, 64 nt, Homo Sapiens; identical to SEQ ID NO: 45513

SEQ ID NO: 630076 - RNA, 64 nt, Homo Sapiens; identical to SEQ ID NO: 45514

SEQ ID NO: 630077 - RNA, 64 nt, Homo Sapiens; identical to SEQ ID NO: 45515

SEQ ID NO: 630078 - RNA, 64 nt, Homo Sapiens; identical to SEQ ID NO: 45516

SEQ ID NO: 630079 - RNA, 64 nt, Homo Sapiens; identical to SEQ ID NO: 45517

SEQ ID NO: 630080 - RNA, 64 nt, Homo Sapiens; identical to SEQ ID NO: 45518

SEQ ID NO: 630081 - RNA, 64 nt, Homo Sapiens; identical to SEQ ID NO: 45519

SEQ ID NO: 630082 - RNA, 64 nt, Homo Sapiens; identical to SEQ ID NO: 45520

SEQ ID NO: 630083 - RNA, 64 nt, Homo Sapiens; identical to SEQ ID NO: 45521

SEQ ID NO: 630084 - RNA, 64 nt, Homo Sapiens; identical to SEQ ID NO: 45522

SEQ ID NO: 630085 - RNA, 64 nt, Homo Sapiens; identical to SEQ ID NO: 45523

SEQ ID NO: 630086 - RNA, 64 nt, Homo Sapiens; identical to SEQ ID NO: 45524

SEQ ID NO: 630087 - RNA, 64 nt, Homo Sapiens; identical to SEQ ID NO: 45525

SEQ ID NO: 630088 - RNA, 64 nt, Homo Sapiens; identical to SEQ ID NO: 45526

SEQ ID NO: 630089 - RNA, 64 nt, Homo Sapiens; identical to SEQ ID NO: 45527

SEQ ID NO: 630090 - RNA, 64 nt, Homo Sapiens; identical to SEQ ID NO: 45528

SEQ ID NO: 630091 - RNA, 64 nt, Homo Sapiens; identical to SEQ ID NO: 45529

SEQ ID NO: 630092 - RNA, 64 nt, Homo Sapiens; identical to SEQ ID NO: 45530

SEQ ID NO: 630093 - RNA, 64 nt, Homo Sapiens; identical to SEQ ID NO: 45531

SEQ ID NO: 630094 - RNA, 64 nt, Homo Sapiens; identical to SEQ ID NO: 45532

SEQ ID NO: 630095 - RNA, 64 nt, Homo Sapiens; identical to SEQ ID NO: 45533

SEQ ID NO: 630096 - RNA, 64 nt, Homo Sapiens; identical to SEQ ID NO: 45534

SEQ ID NO: 630097 - RNA, 64 nt, Homo Sapiens; identical to SEQ ID NO: 45535

SEQ ID NO: 630098 - RNA, 64 nt, Homo Sapiens; identical to SEQ ID NO: 45536

SEQ ID NO: 630099 - RNA, 64 nt, Homo Sapiens; identical to SEQ ID NO: 45537

SEQ ID NO: 630100 - RNA, 64 nt, Homo Sapiens; identical to SEQ ID NO: 45538

SEQ ID NO: 630101 - RNA, 64 nt, Homo Sapiens; identical to SEQ ID NO: 45539

SEQ ID NO: 630102 - RNA, 64 nt, Homo Sapiens; identical to SEQ ID NO: 45540

SEQ ID NO: 630103 - RNA, 64 nt, Homo Sapiens; identical to SEQ ID NO: 45541

SEQ ID NO: 630104 - RNA, 64 nt, Homo Sapiens; identical to SEQ ID NO: 45542

SEQ ID NO: 630105 - RNA, 64 nt, Homo Sapiens; identical to SEQ ID NO: 45543

SEQ ID NO: 630106 - RNA, 64 nt, Homo Sapiens; identical to SEQ ID NO: 45544

SEQ ID NO: 630107 - RNA, 64 nt, Homo Sapiens; identical to SEQ ID NO: 45545

SEQ ID NO: 630108 - RNA, 64 nt, Homo Sapiens; identical to SEQ ID NO: 45546

SEQ ID NO: 630109 - RNA, 64 nt, Homo Sapiens; identical to SEQ ID NO: 45547

SEQ ID NO: 630110 - RNA, 64 nt, Homo Sapiens; identical to SEQ ID NO: 45548

SEQ ID NO: 630111 - RNA, 64 nt, Homo Sapiens; identical to SEQ ID NO: 45549

SEQ ID NO: 630112 - RNA, 64 nt, Homo Sapiens; identical to SEQ ID NO: 45550

SEQ ID NO: 630113 - RNA, 64 nt, Homo Sapiens; identical to SEQ ID NO: 45551

SEQ ID NO: 630114 - RNA, 64 nt, Homo Sapiens; identical to SEQ ID NO: 45552

SEQ ID NO: 630115 - RNA, 64 nt, Homo Sapiens; identical to SEQ ID NO: 45553

SEQ ID NO: 630116 - RNA, 64 nt, Homo Sapiens; identical to SEQ ID NO: 45554

SEQ ID NO: 630117 - RNA, 64 nt, Homo Sapiens; identical to SEQ ID NO: 45555

SEQ ID NO: 630118 - RNA, 64 nt, Homo Sapiens; identical to SEQ ID NO: 45556

SEQ ID NO: 630119 - RNA, 64 nt, Homo Sapiens; identical to SEQ ID NO: 45557

SEQ ID NO: 630120 - RNA, 64 nt, Homo Sapiens; identical to SEQ ID NO: 45558

SEQ ID NO: 630121 - RNA, 64 nt, Homo Sapiens; identical to SEQ ID NO: 45559

SEQ ID NO: 630122 - RNA, 64 nt, Homo Sapiens; identical to SEQ ID NO: 45560

SEQ ID NO: 630123 - RNA, 64 nt, Homo Sapiens; identical to SEQ ID NO: 45561

SEQ ID NO: 630124 - RNA, 64 nt, Homo Sapiens; identical to SEQ ID NO: 45562

SEQ ID NO: 630125 - RNA, 64 nt, Homo Sapiens; identical to SEQ ID NO: 45563

SEQ ID NO: 630126 - RNA, 64 nt, Homo Sapiens; identical to SEQ ID NO: 45564

SEQ ID NO: 630127 - RNA, 64 nt, Homo Sapiens; identical to SEQ ID NO: 45565

SEQ ID NO: 630128 - RNA, 64 nt, Homo Sapiens; identical to SEQ ID NO: 45566

SEQ ID NO: 630129 - RNA, 64 nt, Homo Sapiens; identical to SEQ ID NO: 45567

SEQ ID NO: 630130 - RNA, 64 nt, Homo Sapiens; identical to SEQ ID NO: 45568

SEQ ID NO: 630131 - RNA, 64 nt, Homo Sapiens; identical to SEQ ID NO: 45569

SEQ ID NO: 630132 - RNA, 64 nt, Homo Sapiens; identical to SEQ ID NO: 45570

SEQ ID NO: 630133 - RNA, 64 nt, Homo Sapiens; identical to SEQ ID NO: 45571

SEQ ID NO: 630134 - RNA, 64 nt, Homo Sapiens; identical to SEQ ID NO: 45572

SEQ ID NO: 630135 - RNA, 64 nt, Homo Sapiens; identical to SEQ ID NO: 45573

SEQ ID NO: 630136 - RNA, 64 nt, Homo Sapiens; identical to SEQ ID NO: 45574

SEQ ID NO: 630137 - RNA, 64 nt, Homo Sapiens; identical to SEQ ID NO: 45575

SEQ ID NO: 630138 - RNA, 64 nt, Homo Sapiens; identical to SEQ ID NO: 45576

SEQ ID NO: 630139 - RNA, 64 nt, Homo Sapiens; identical to SEQ ID NO: 45577

SEQ ID NO: 630140 - RNA, 64 nt, Homo Sapiens; identical to SEQ ID NO: 45578

SEQ ID NO: 630141 - RNA, 64 nt, Homo Sapiens; identical to SEQ ID NO: 45579

SEQ ID NO: 630142 - RNA, 64 nt, Homo Sapiens; identical to SEQ ID NO: 45580

SEQ ID NO: 630143 - RNA, 64 nt, Homo Sapiens; identical to SEQ ID NO: 45581

SEQ ID NO: 630144 - RNA, 64 nt, Homo Sapiens; identical to SEQ ID NO: 45582

SEQ ID NO: 630145 - RNA, 64 nt, Homo Sapiens; identical to SEQ ID NO: 45583

SEQ ID NO: 630146 - RNA, 64 nt, Homo Sapiens; identical to SEQ ID NO: 45584

SEQ ID NO: 630147 - RNA, 64 nt, Homo Sapiens; identical to SEQ ID NO: 45585

SEQ ID NO: 630148 - RNA, 64 nt, Homo Sapiens; identical to SEQ ID NO: 45586

SEQ ID NO: 630149 - RNA, 64 nt, Homo Sapiens; identical to SEQ ID NO: 45587

SEQ ID NO: 630150 - RNA, 64 nt, Homo Sapiens; identical to SEQ ID NO: 45588

SEQ ID NO: 630151 - RNA, 64 nt, Homo Sapiens; identical to SEQ ID NO: 45589

SEQ ID NO: 630152 - RNA, 64 nt, Homo Sapiens; identical to SEQ ID NO: 45590

SEQ ID NO: 630153 - RNA, 64 nt, Homo Sapiens; identical to SEQ ID NO: 45591

SEQ ID NO: 630154 - RNA, 64 nt, Homo Sapiens; identical to SEQ ID NO: 45592

SEQ ID NO: 630155 - RNA, 64 nt, Homo Sapiens; identical to SEQ ID NO: 45593

SEQ ID NO: 630156 - RNA, 64 nt, Homo Sapiens; identical to SEQ ID NO: 45594

SEQ ID NO: 630157 - RNA, 64 nt, Homo Sapiens; identical to SEQ ID NO: 45595

SEQ ID NO: 630158 - RNA, 64 nt, Homo Sapiens; identical to SEQ ID NO: 45596

SEQ ID NO: 630159 - RNA, 64 nt, Homo Sapiens; identical to SEQ ID NO: 45597

SEQ ID NO: 630160 - RNA, 64 nt, Homo Sapiens; identical to SEQ ID NO: 45598

SEQ ID NO: 630161 - RNA, 64 nt, Homo Sapiens; identical to SEQ ID NO: 45599

SEQ ID NO: 630162 - RNA, 64 nt, Homo Sapiens; identical to SEQ ID NO: 45600

SEQ ID NO: 630163 - RNA, 64 nt, Homo Sapiens; identical to SEQ ID NO: 45601

SEQ ID NO: 630164 - RNA, 64 nt, Homo Sapiens; identical to SEQ ID NO: 45602

SEQ ID NO: 630165 - RNA, 64 nt, Homo Sapiens; identical to SEQ ID NO: 45603

SEQ ID NO: 630166 - RNA, 64 nt, Homo Sapiens; identical to SEQ ID NO: 45604

SEQ ID NO: 630167 - RNA, 64 nt, Homo Sapiens; identical to SEQ ID NO: 45605

SEQ ID NO: 630168 - RNA, 64 nt, Homo Sapiens; identical to SEQ ID NO: 45606

SEQ ID NO: 630169 - RNA, 64 nt, Homo Sapiens; identical to SEQ ID NO: 45607

SEQ ID NO: 630170 - RNA, 64 nt, Homo Sapiens; identical to SEQ ID NO: 45608

SEQ ID NO: 630171 - RNA, 64 nt, Homo Sapiens; identical to SEQ ID NO: 45609

SEQ ID NO: 630172 - RNA, 64 nt, Homo Sapiens; identical to SEQ ID NO: 45610

SEQ ID NO: 630173 - RNA, 64 nt, Homo Sapiens; identical to SEQ ID NO: 45611

SEQ ID NO: 630174 - RNA, 64 nt, Homo Sapiens; identical to SEQ ID NO: 45612

SEQ ID NO: 630175 - RNA, 64 nt, Homo Sapiens; identical to SEQ ID NO: 45613

SEQ ID NO: 630176 - RNA, 64 nt, Homo Sapiens; identical to SEQ ID NO: 45614

SEQ ID NO: 630177 - RNA, 64 nt, Homo Sapiens; identical to SEQ ID NO: 45615

SEQ ID NO: 630178 - RNA, 64 nt, Homo Sapiens; identical to SEQ ID NO: 45616

SEQ ID NO: 630179 - RNA, 64 nt, Homo Sapiens; identical to SEQ ID NO: 45617

SEQ ID NO: 630180 - RNA, 64 nt, Homo Sapiens; identical to SEQ ID NO: 45618

SEQ ID NO: 630181 - RNA, 64 nt, Homo Sapiens; identical to SEQ ID NO: 45619

SEQ ID NO: 630182 - RNA, 64 nt, Homo Sapiens; identical to SEQ ID NO: 45620

SEQ ID NO: 630183 - RNA, 64 nt, Homo Sapiens; identical to SEQ ID NO: 45621

SEQ ID NO: 630184 - RNA, 64 nt, Homo Sapiens; identical to SEQ ID NO: 45622

SEQ ID NO: 630185 - RNA, 64 nt, Homo Sapiens; identical to SEQ ID NO: 45623

SEQ ID NO: 630186 - RNA, 64 nt, Homo Sapiens; identical to SEQ ID NO: 45624

SEQ ID NO: 630187 - RNA, 64 nt, Homo Sapiens; identical to SEQ ID NO: 45625

SEQ ID NO: 630188 - RNA, 64 nt, Homo Sapiens; identical to SEQ ID NO: 45626

SEQ ID NO: 630189 - RNA, 64 nt, Homo Sapiens; identical to SEQ ID NO: 45627

SEQ ID NO: 630190 - RNA, 64 nt, Homo Sapiens; identical to SEQ ID NO: 45628

SEQ ID NO: 630191 - RNA, 64 nt, Homo Sapiens; identical to SEQ ID NO: 45629

SEQ ID NO: 630192 - RNA, 64 nt, Homo Sapiens; identical to SEQ ID NO: 45630

SEQ ID NO: 630193 - RNA, 64 nt, Homo Sapiens; identical to SEQ ID NO: 45631

SEQ ID NO: 630194 - RNA, 64 nt, Homo Sapiens; identical to SEQ ID NO: 45632

SEQ ID NO: 630195 - RNA, 64 nt, Homo Sapiens; identical to SEQ ID NO: 45633

SEQ ID NO: 630196 - RNA, 64 nt, Homo Sapiens; identical to SEQ ID NO: 45634

SEQ ID NO: 630197 - RNA, 64 nt, Homo Sapiens; identical to SEQ ID NO: 45635

SEQ ID NO: 630198 - RNA, 64 nt, Homo Sapiens; identical to SEQ ID NO: 45636

SEQ ID NO: 630199 - RNA, 64 nt, Homo Sapiens; identical to SEQ ID NO: 45637

SEQ ID NO: 630200 - RNA, 64 nt, Homo Sapiens; identical to SEQ ID NO: 45638

SEQ ID NO: 630201 - RNA, 64 nt, Homo Sapiens; identical to SEQ ID NO: 45639

SEQ ID NO: 630202 - RNA, 64 nt, Homo Sapiens; identical to SEQ ID NO: 45640

SEQ ID NO: 630203 - RNA, 64 nt, Homo Sapiens; identical to SEQ ID NO: 45641

SEQ ID NO: 630204 - RNA, 64 nt, Homo Sapiens; identical to SEQ ID NO: 45642

SEQ ID NO: 630205 - RNA, 64 nt, Homo Sapiens; identical to SEQ ID NO: 45643

SEQ ID NO: 630206 - RNA, 64 nt, Homo Sapiens; identical to SEQ ID NO: 45644

SEQ ID NO: 630207 - RNA, 64 nt, Homo Sapiens; identical to SEQ ID NO: 45645

SEQ ID NO: 630208 - RNA, 64 nt, Homo Sapiens; identical to SEQ ID NO: 45646

SEQ ID NO: 630209 - RNA, 64 nt, Homo Sapiens; identical to SEQ ID NO: 45647

SEQ ID NO: 630210 - RNA, 64 nt, Homo Sapiens; identical to SEQ ID NO: 45648

SEQ ID NO: 630211 - RNA, 64 nt, Homo Sapiens; identical to SEQ ID NO: 45649

SEQ ID NO: 630212 - RNA, 64 nt, Homo Sapiens; identical to SEQ ID NO: 45650

SEQ ID NO: 630213 - RNA, 64 nt, Homo Sapiens; identical to SEQ ID NO: 45651

SEQ ID NO: 630214 - RNA, 64 nt, Homo Sapiens; identical to SEQ ID NO: 45652

SEQ ID NO: 630215 - RNA, 64 nt, Homo Sapiens; identical to SEQ ID NO: 45653

SEQ ID NO: 630216 - RNA, 64 nt, Homo Sapiens; identical to SEQ ID NO: 45654

SEQ ID NO: 630217 - RNA, 64 nt, Homo Sapiens; identical to SEQ ID NO: 45655

SEQ ID NO: 630218 - RNA, 64 nt, Homo Sapiens
aaaccuagaaaaacggguaguaaacuguggauagucaggaaaacacccagcaagggacacagcu

SEQ ID NO: 630219 - RNA, 64 nt, Homo Sapiens
uagucaggaaaacacccagcaagggacacagcugucaggaaaugaaucuuccccccaaccccca

SEQ ID NO: 630220 - RNA, 64 nt, Homo Sapiens
uuacagggcaauauuuuuaaucccacacaguacaucaggaaaacaacuaacuuaaccaugugcu

SEQ ID NO: 630221 - RNA, 64 nt, Homo Sapiens
aauuucccauugcgagggaccuguggcuccaacuucaggaaauacacaguaccucuuacacucc

SEQ ID NO: 630222 - RNA, 64 nt, Homo Sapiens
uguaguaugagaugaaauuaaaaguggauagcuuucaggaaagauaaagagaacaugcuuagaa

SEQ ID NO: 630223 - RNA, 64 nt, Homo Sapiens
cccauggguggguguugagguuuuuaaaguguggucaggaaaggccccacugauaagguaacau

SEQ ID NO: 630224 - RNA, 64 nt, Homo Sapiens
aauuugagaaggauuucaaggaaguguuugcuauucaggaaacaaaugggaacaguugacuggu

SEQ ID NO: 630225 - RNA, 64 nt, Homo Sapiens
aacaguugacugguuuaguggaugcugaaggccuucaggaaauaugcuacugguugccacugac

SEQ ID NO: 630226 - RNA, 64 nt, Homo Sapiens
uacucuaguauguucucauaggcauacuuuuaccucaggaaacugauugcacaucauucuuuaa

SEQ ID NO: 630227 - RNA, 64 nt, Homo Sapiens
agagcguugcuuuaucaucgcacugagcuugucuucaggaaaccguaugccuguacuugggcug

SEQ ID NO: 630228 - RNA, 64 nt, Homo Sapiens
guugaauaauauaugccuuguaguauuaucuuguucaggaaaagacuguccguaagcaguauau

SEQ ID NO: 630229 - RNA, 64 nt, Homo Sapiens
aacuuagacucuaguauuuacccuuuucaccuuuucaggaaaauaaagauaaagaccagaaauu

SEQ ID NO: 630230 - RNA, 64 nt, Homo Sapiens
uguauuauaaguuuauuaguucaggaaaugcaugucaggaaacuaaaugaucauuuggguucac

SEQ ID NO: 630231 - RNA, 64 nt, Homo Sapiens
caugucaggaaacuuguauuucauuuggguucacucaggaaauguuccuuguuuuaaaaaauga

SEQ ID NO: 630232 - RNA, 64 nt, Homo Sapiens
uuuuuucuuaauguuucucuaacauugaagauaaucaggaaagagaaagguguuuguuuuuaac

SEQ ID NO: 630233 - RNA, 64 nt, Homo Sapiens
gaggaguguuuccucuuuauggugagcuccucauucaggaaauaggggacugggauagaggaag

SEQ ID NO: 630234 - RNA, 64 nt, Homo Sapiens
aaaaccaggaacuaguuucagaacuuuuggggccucaggaaagaucuaaugcuaugcuggauau

SEQ ID NO: 630235 - RNA, 64 nt, Homo Sapiens
gcccacagcaaccaaagagacuuccucuuggcguucaggaaacacagauucuuuguccuuuucc

SEQ ID NO: 630236 - RNA, 64 nt, Homo Sapiens
gcacugccccaaagugagaacuugcucuacguggucaggaaagagcagggagaccaagcagagu

SEQ ID NO: 630237 - RNA, 64 nt, Homo Sapiens
gcuuuucucuguugccacauuuuccucagguuacucaggaaaaugcuccagcaugugcgagcac

SEQ ID NO: 630238 - RNA, 64 nt, Homo Sapiens
ucagcugccaauacauucaacccuuucucuuccuucaggaaaauaccuauacccaaauguuccc

SEQ ID NO: 630239 - RNA, 64 nt, Homo Sapiens
cacuauguugaauguccacuaggaugaugcucauucaggaaauccuaauauguuuucugaaacc

SEQ ID NO: 630240 - RNA, 64 nt, Homo Sapiens
auaauaaagucacuaucuuaacccuccuguuuauucaggaaaaaauuuuuuguuauuucaauau

SEQ ID NO: 630241 - RNA, 64 nt, Homo Sapiens
ugggugcugucuccaugccaacguucaccuugauucaggaaagcaccuugaaaacugaauauca

SEQ ID NO: 630242 - RNA, 64 nt, Homo Sapiens
gcaauauaucaggucuccucagugagacuuuuugucaggaaaagcuaauugagguacaucugca

SEQ ID NO: 630243 - RNA, 64 nt, Homo Sapiens
acaugcugcuguguuuauuuauuguggauucccaucaggaaagaggaaaaaauacacauguucu

SEQ ID NO: 630244 - RNA, 64 nt, Homo Sapiens
auuggcuucauacaaaauagacaauucucugauuucaggaaaugugcauggucuacccgcuuua

SEQ ID NO: 630245 - RNA, 64 nt, Homo Sapiens
gaugagaucagaaaacguucaugaaaaaucauauucaggaaauaaggaagaggaauauaaaugc

SEQ ID NO: 630246 - RNA, 64 nt, Homo Sapiens
auagguucccaagcaacauagauuucccuaucuuucaggaaacagcaucaaggaacucugaaaa

SEQ ID NO: 630247 - RNA, 64 nt, Homo Sapiens
aagauuuagguugcagaaucgacuccaaugccuuucaggaaaggacucggcacuucucugacug

SEQ ID NO: 630248 - RNA, 64 nt, Homo Sapiens
ggaaccuagcucuuuaaacucuggggagucggauucaggaaacacccccaggaggccaagccug

SEQ ID NO: 630249 - RNA, 64 nt, Homo Sapiens
gaacucauuaaaacuccuuaaaucacuguuaauuucaggaaacauucucuugcuugguguaacu

SEQ ID NO: 630250 - RNA, 64 nt, Homo Sapiens
agugcagaauuucuuccccaacugcaaaucauauucaggaaagauguaguuuaugcaguaucug

SEQ ID NO: 630251 - RNA, 64 nt, Homo Sapiens
aauuuuuuuucaauaaucuucaggaaaaagaaaaucaggaaaaaguuucuacaaaaauaaccuu

SEQ ID NO: 630252 - RNA, 64 nt, Homo Sapiens
gaaaaucaggaaaaaaauuuuacaaaaauaaccuucaggaaaaaucccuuuuuaccaugguuuc

SEQ ID NO: 630253 - RNA, 56 nt, Homo Sapiens
gcagagguuaccucaacugaacuuuuucaggaaauagagcugaugauuauaauauu

SEQ ID NO: 630254 - RNA, 64 nt, Homo Sapiens
agggagugggaggcuuccaacauaguauugaaucucaggaaaaacuauucuuucaugucugauu

SEQ ID NO: 630255 - RNA, 64 nt, Homo Sapiens
uaccagaagaguuauuaucuauuuguucucccuuucaggaaacuuauuguaaagggacuguuuu

SEQ ID NO: 630256 - RNA, 64 nt, Homo Sapiens
uccuuuuuauggaguuaacggggaggaagaccccucaggaaaacgaaaguaaauuguuaaggcu

SEQ ID NO: 630257 - RNA, 62 nt, Homo Sapiens
aaaaaaaaaaaaaaaaguauagcgaaacuccaucucaggaaaaccccagccugagcaacaag

SEQ ID NO: 630258 - RNA, 64 nt, Homo Sapiens
ggauugcugaugucugggaacccccacaagcuccucaggaaacacagaucauccccagagagag

SEQ ID NO: 630259 - RNA, 64 nt, Homo Sapiens
agauacagauuaauaugaguggcauugacuguuuucaggaaaauuagguccugucucagugugu

SEQ ID NO: 630260 - RNA, 64 nt, Homo Sapiens
uuaguuauuuauaguauaauuauaaugcaaggaaucaggaaacuguguugaaaacuagguuacu

SEQ ID NO: 630261 - RNA, 64 nt, Homo Sapiens
aggugcuguuaugagcagcuaaaagccagcucugucaggaaagguuggagcacauugauuuuuc

SEQ ID NO: 630262 - RNA, 64 nt, Homo Sapiens
agaaagggcuugaaauuuaaggguagaauuguagucaggaaaacaggauuuuuaaauuuuuuau

SEQ ID NO: 630263 - RNA, 64 nt, Homo Sapiens
aaaagaaacuuaguucuaccauucauacaugaagucaggaaaagaggucugaggugggucugaa

SEQ ID NO: 630264 - RNA, 64 nt, Homo Sapiens
acaaacuucaauuaaauguaaugcagacauacagucaggaaagaacaaauucugacuugcagaa

SEQ ID NO: 630265 - RNA, 64 nt, Homo Sapiens
uccccaaucuagcaaggcaggccaacauucagauucaggaaauacagagaacgccacaaagaua

SEQ ID NO: 630266 - RNA, 64 nt, Homo Sapiens
ggauaaauagucaagacccaucagggugcuguauucaggaaacccaucucacgugcagagacac

SEQ ID NO: 630267 - RNA, 64 nt, Homo Sapiens
auuuauuagaauuuggaauaugauacaaguggcaucaggaaaugaggaaauaauggaacuauuu

SEQ ID NO: 630268 - RNA, 64 nt, Homo Sapiens
aauacuuagcgguucuacuuaugaguaugaaugcucaggaaauacgcacuaggauauuuacugu

SEQ ID NO: 630269 - RNA, 64 nt, Homo Sapiens
gggccugagggagccccuggcuuuccccucagccucaggaaagguggucaggaaaacucuggcu

SEQ ID NO: 630270 - RNA, 64 nt, Homo Sapiens
ccccuggcuuuccccucagccucaggaaagguggucaggaaaacucuggcuggacaagggucag

SEQ ID NO: 630271 - RNA, 64 nt, Homo Sapiens
acagccuccuggaggaagcagccuccacuuuggaucaggaaauaguaaaggaaagcaguguugg

SEQ ID NO: 630272 - RNA, 64 nt, Homo Sapiens
ggauccuugucaguuguaacauucuauuucaacuucaggaaagcagcaguuuucuuuuaauuuu

SEQ ID NO: 630273 - RNA, 64 nt, Homo Sapiens
acucauugauuggguuucuacuucuuucaaggacucaggaaauuucacuuugaacugaggccaa

SEQ ID NO: 630274 - RNA, 64 nt, Homo Sapiens
augagcauguacaaccucuggagcuagaagcuccucaggaaagccaguucuccaaguucuuaac

SEQ ID NO: 630275 - RNA, 64 nt, Homo Sapiens
uauuuaaaaaaacuugaaaucagucagugucacuucaggaaagcaagaaaaggagagguagaua

SEQ ID NO: 630276 - RNA, 64 nt, Homo Sapiens
uuaagcaucgaaaaaagaaagagucaaggucaguucaggaaagcaaggaaaagagaggaggaua

SEQ ID NO: 630277 - RNA, 64 nt, Homo Sapiens; identical to SEQ ID NO: 170526

SEQ ID NO: 630278 - RNA, 64 nt, Homo Sapiens; identical to SEQ ID NO: 170527

SEQ ID NO: 630279 - RNA, 64 nt, Homo Sapiens; identical to SEQ ID NO: 170528

SEQ ID NO: 630280 - RNA, 64 nt, Homo Sapiens; identical to SEQ ID NO: 170529

SEQ ID NO: 630281 - RNA, 64 nt, Homo Sapiens; identical to SEQ ID NO: 170530

SEQ ID NO: 630282 - RNA, 64 nt, Homo Sapiens; identical to SEQ ID NO: 170531

SEQ ID NO: 630283 - RNA, 64 nt, Homo Sapiens; identical to SEQ ID NO: 170532

SEQ ID NO: 630284 - RNA, 64 nt, Homo Sapiens; identical to SEQ ID NO: 170533

SEQ ID NO: 630285 - RNA, 64 nt, Homo Sapiens; identical to SEQ ID NO: 170534

SEQ ID NO: 630286 - RNA, 64 nt, Homo Sapiens; identical to SEQ ID NO: 170535

SEQ ID NO: 630287 - RNA, 64 nt, Homo Sapiens; identical to SEQ ID NO: 170536

SEQ ID NO: 630288 - RNA, 64 nt, Homo Sapiens; identical to SEQ ID NO: 170537

SEQ ID NO: 630289 - RNA, 64 nt, Homo Sapiens; identical to SEQ ID NO: 170538

SEQ ID NO: 630290 - RNA, 64 nt, Homo Sapiens; identical to SEQ ID NO: 170539

SEQ ID NO: 630291 - RNA, 64 nt, Homo Sapiens; identical to SEQ ID NO: 170540

SEQ ID NO: 630292 - RNA, 64 nt, Homo Sapiens; identical to SEQ ID NO: 170541

SEQ ID NO: 630293 - RNA, 64 nt, Homo Sapiens; identical to SEQ ID NO: 170542

SEQ ID NO: 630294 - RNA, 64 nt, Homo Sapiens; identical to SEQ ID NO: 170543

SEQ ID NO: 630295 - RNA, 64 nt, Homo Sapiens; identical to SEQ ID NO: 170544

SEQ ID NO: 630296 - RNA, 64 nt, Homo Sapiens; identical to SEQ ID NO: 170545

SEQ ID NO: 630297 - RNA, 64 nt, Homo Sapiens; identical to SEQ ID NO: 170546

SEQ ID NO: 630298 - RNA, 64 nt, Homo Sapiens; identical to SEQ ID NO: 170547

SEQ ID NO: 630299 - RNA, 64 nt, Homo Sapiens; identical to SEQ ID NO: 170548

SEQ ID NO: 630300 - RNA, 64 nt, Homo Sapiens; identical to SEQ ID NO: 170549

SEQ ID NO: 630301 - RNA, 64 nt, Homo Sapiens; identical to SEQ ID NO: 170550

SEQ ID NO: 630302 - RNA, 53 nt, Homo Sapiens; identical to SEQ ID NO: 170551

SEQ ID NO: 630303 - RNA, 64 nt, Homo Sapiens; identical to SEQ ID NO: 170552

SEQ ID NO: 630304 - RNA, 64 nt, Homo Sapiens; identical to SEQ ID NO: 170553

SEQ ID NO: 630305 - RNA, 64 nt, Homo Sapiens; identical to SEQ ID NO: 170554

SEQ ID NO: 630306 - RNA, 64 nt, Homo Sapiens; identical to SEQ ID NO: 170555

SEQ ID NO: 630307 - RNA, 64 nt, Homo Sapiens; identical to SEQ ID NO: 170556

SEQ ID NO: 630308 - RNA, 64 nt, Homo Sapiens; identical to SEQ ID NO: 170557

SEQ ID NO: 630309 - RNA, 64 nt, Homo Sapiens; identical to SEQ ID NO: 170558

SEQ ID NO: 630310 - RNA, 64 nt, Homo Sapiens; identical to SEQ ID NO: 170559

SEQ ID NO: 630311 - RNA, 64 nt, Homo Sapiens; identical to SEQ ID NO: 170560

SEQ ID NO: 630312 - RNA, 64 nt, Homo Sapiens; identical to SEQ ID NO: 170561

SEQ ID NO: 630313 - RNA, 64 nt, Homo Sapiens; identical to SEQ ID NO: 170562

SEQ ID NO: 630314 - RNA, 64 nt, Homo Sapiens; identical to SEQ ID NO: 170563

SEQ ID NO: 630315 - RNA, 64 nt, Homo Sapiens; identical to SEQ ID NO: 170564

SEQ ID NO: 630316 - RNA, 64 nt, Homo Sapiens; identical to SEQ ID NO: 170565

SEQ ID NO: 630317 - RNA, 52 nt, Homo Sapiens; identical to SEQ ID NO: 170566

SEQ ID NO: 630318 - RNA, 64 nt, Homo Sapiens; identical to SEQ ID NO: 170567

SEQ ID NO: 630319 - RNA, 64 nt, Homo Sapiens; identical to SEQ ID NO: 170568

SEQ ID NO: 630320 - RNA, 64 nt, Homo Sapiens; identical to SEQ ID NO: 170569

SEQ ID NO: 630321 - RNA, 64 nt, Homo Sapiens; identical to SEQ ID NO: 170570

SEQ ID NO: 630322 - RNA, 64 nt, Homo Sapiens; identical to SEQ ID NO: 170571

SEQ ID NO: 630323 - RNA, 64 nt, Homo Sapiens; identical to SEQ ID NO: 170572

SEQ ID NO: 630324 - RNA, 64 nt, Homo Sapiens; identical to SEQ ID NO: 170573

SEQ ID NO: 630325 - RNA, 64 nt, Homo Sapiens; identical to SEQ ID NO: 170574

SEQ ID NO: 630326 - RNA, 64 nt, Homo Sapiens; identical to SEQ ID NO: 170575

SEQ ID NO: 630327 - RNA, 64 nt, Homo Sapiens; identical to SEQ ID NO: 170576

SEQ ID NO: 630328 - RNA, 64 nt, Homo Sapiens; identical to SEQ ID NO: 170577

SEQ ID NO: 630329 - RNA, 64 nt, Homo Sapiens; identical to SEQ ID NO: 170578

SEQ ID NO: 630330 - RNA, 64 nt, Homo Sapiens; identical to SEQ ID NO: 170579

SEQ ID NO: 630331 - RNA, 64 nt, Homo Sapiens; identical to SEQ ID NO: 170580

SEQ ID NO: 630332 - RNA, 64 nt, Homo Sapiens; identical to SEQ ID NO: 170581

SEQ ID NO: 630333 - RNA, 64 nt, Homo Sapiens; identical to SEQ ID NO: 170582

SEQ ID NO: 630334 - RNA, 64 nt, Homo Sapiens; identical to SEQ ID NO: 170583

SEQ ID NO: 630335 - RNA, 64 nt, Homo Sapiens; identical to SEQ ID NO: 170584

SEQ ID NO: 630336 - RNA, 64 nt, Homo Sapiens; identical to SEQ ID NO: 170585

SEQ ID NO: 630337 - RNA, 64 nt, Homo Sapiens; identical to SEQ ID NO: 170586

SEQ ID NO: 630338 - RNA, 64 nt, Homo Sapiens; identical to SEQ ID NO: 170587

SEQ ID NO: 630339 - RNA, 64 nt, Homo Sapiens; identical to SEQ ID NO: 170588

SEQ ID NO: 630340 - RNA, 64 nt, Homo Sapiens; identical to SEQ ID NO: 170589

SEQ ID NO: 630341 - RNA, 64 nt, Homo Sapiens; identical to SEQ ID NO: 170590

SEQ ID NO: 630342 - RNA, 64 nt, Homo Sapiens; identical to SEQ ID NO: 170591

SEQ ID NO: 630343 - RNA, 64 nt, Homo Sapiens; identical to SEQ ID NO: 170592

SEQ ID NO: 630344 - RNA, 64 nt, Homo Sapiens; identical to SEQ ID NO: 170593

SEQ ID NO: 630345 - RNA, 64 nt, Homo Sapiens; identical to SEQ ID NO: 170594

SEQ ID NO: 630346 - RNA, 64 nt, Homo Sapiens; identical to SEQ ID NO: 170595

SEQ ID NO: 630347 - RNA, 64 nt, Homo Sapiens; identical to SEQ ID NO: 170596

SEQ ID NO: 630348 - RNA, 64 nt, Homo Sapiens; identical to SEQ ID NO: 170597

SEQ ID NO: 630349 - RNA, 64 nt, Homo Sapiens; identical to SEQ ID NO: 170598

SEQ ID NO: 630350 - RNA, 64 nt, Homo Sapiens; identical to SEQ ID NO: 170599

SEQ ID NO: 630351 - RNA, 64 nt, Homo Sapiens; identical to SEQ ID NO: 170600

SEQ ID NO: 630352 - RNA, 64 nt, Homo Sapiens; identical to SEQ ID NO: 170601

SEQ ID NO: 630353 - RNA, 64 nt, Homo Sapiens; identical to SEQ ID NO: 170602

SEQ ID NO: 630354 - RNA, 64 nt, Homo Sapiens; identical to SEQ ID NO: 170603

SEQ ID NO: 630355 - RNA, 64 nt, Homo Sapiens; identical to SEQ ID NO: 170604

SEQ ID NO: 630356 - RNA, 64 nt, Homo Sapiens; identical to SEQ ID NO: 170605

SEQ ID NO: 630357 - RNA, 64 nt, Homo Sapiens; identical to SEQ ID NO: 170606

SEQ ID NO: 630358 - RNA, 64 nt, Homo Sapiens; identical to SEQ ID NO: 170607

SEQ ID NO: 630359 - RNA, 64 nt, Homo Sapiens; identical to SEQ ID NO: 170608

SEQ ID NO: 630360 - RNA, 64 nt, Homo Sapiens; identical to SEQ ID NO: 170609

SEQ ID NO: 630361 - RNA, 64 nt, Homo Sapiens; identical to SEQ ID NO: 170610

SEQ ID NO: 630362 - RNA, 64 nt, Homo Sapiens; identical to SEQ ID NO: 170611

SEQ ID NO: 630363 - RNA, 64 nt, Homo Sapiens; identical to SEQ ID NO: 170612

SEQ ID NO: 630364 - RNA, 64 nt, Homo Sapiens; identical to SEQ ID NO: 170613

SEQ ID NO: 630365 - RNA, 64 nt, Homo Sapiens; identical to SEQ ID NO: 170614

SEQ ID NO: 630366 - RNA, 64 nt, Homo Sapiens; identical to SEQ ID NO: 45231

SEQ ID NO: 630367 - RNA, 64 nt, Homo Sapiens; identical to SEQ ID NO: 45232

SEQ ID NO: 630368 - RNA, 64 nt, Homo Sapiens; identical to SEQ ID NO: 45233

SEQ ID NO: 630369 - RNA, 64 nt, Homo Sapiens; identical to SEQ ID NO: 45234

SEQ ID NO: 630370 - RNA, 64 nt, Homo Sapiens; identical to SEQ ID NO: 45235

SEQ ID NO: 630371 - RNA, 64 nt, Homo Sapiens; identical to SEQ ID NO: 45236

SEQ ID NO: 630372 - RNA, 64 nt, Homo Sapiens; identical to SEQ ID NO: 45237

SEQ ID NO: 630373 - RNA, 64 nt, Homo Sapiens; identical to SEQ ID NO: 45238

SEQ ID NO: 630374 - RNA, 64 nt, Homo Sapiens; identical to SEQ ID NO: 45239

SEQ ID NO: 630375 - RNA, 64 nt, Homo Sapiens; identical to SEQ ID NO: 45240

SEQ ID NO: 630376 - RNA, 64 nt, Homo Sapiens; identical to SEQ ID NO: 45241

SEQ ID NO: 630377 - RNA, 64 nt, Homo Sapiens; identical to SEQ ID NO: 45242

SEQ ID NO: 630378 - RNA, 64 nt, Homo Sapiens; identical to SEQ ID NO: 45243

SEQ ID NO: 630379 - RNA, 64 nt, Homo Sapiens; identical to SEQ ID NO: 45244

SEQ ID NO: 630380 - RNA, 64 nt, Homo Sapiens; identical to SEQ ID NO: 45245

SEQ ID NO: 630381 - RNA, 64 nt, Homo Sapiens; identical to SEQ ID NO: 45246

SEQ ID NO: 630382 - RNA, 64 nt, Homo Sapiens; identical to SEQ ID NO: 45247

SEQ ID NO: 630383 - RNA, 64 nt, Homo Sapiens; identical to SEQ ID NO: 45248

SEQ ID NO: 630384 - RNA, 64 nt, Homo Sapiens; identical to SEQ ID NO: 45249

SEQ ID NO: 630385 - RNA, 64 nt, Homo Sapiens; identical to SEQ ID NO: 45250

SEQ ID NO: 630386 - RNA, 64 nt, Homo Sapiens; identical to SEQ ID NO: 45251

SEQ ID NO: 630387 - RNA, 64 nt, Homo Sapiens; identical to SEQ ID NO: 45252

SEQ ID NO: 630388 - RNA, 64 nt, Homo Sapiens; identical to SEQ ID NO: 45253

SEQ ID NO: 630389 - RNA, 64 nt, Homo Sapiens; identical to SEQ ID NO: 45254

SEQ ID NO: 630390 - RNA, 64 nt, Homo Sapiens; identical to SEQ ID NO: 45255

SEQ ID NO: 630391 - RNA, 64 nt, Homo Sapiens; identical to SEQ ID NO: 45256

SEQ ID NO: 630392 - RNA, 64 nt, Homo Sapiens; identical to SEQ ID NO: 45257

SEQ ID NO: 630393 - RNA, 64 nt, Homo Sapiens; identical to SEQ ID NO: 45258

SEQ ID NO: 630394 - RNA, 64 nt, Homo Sapiens; identical to SEQ ID NO: 45259

SEQ ID NO: 630395 - RNA, 64 nt, Homo Sapiens; identical to SEQ ID NO: 45260

SEQ ID NO: 630396 - RNA, 64 nt, Homo Sapiens; identical to SEQ ID NO: 45261

SEQ ID NO: 630397 - RNA, 64 nt, Homo Sapiens; identical to SEQ ID NO: 45262

SEQ ID NO: 630398 - RNA, 64 nt, Homo Sapiens; identical to SEQ ID NO: 45263

SEQ ID NO: 630399 - RNA, 64 nt, Homo Sapiens; identical to SEQ ID NO: 45264

SEQ ID NO: 630400 - RNA, 64 nt, Homo Sapiens; identical to SEQ ID NO: 45265

SEQ ID NO: 630401 - RNA, 64 nt, Homo Sapiens; identical to SEQ ID NO: 45266

SEQ ID NO: 630402 - RNA, 64 nt, Homo Sapiens; identical to SEQ ID NO: 45267

SEQ ID NO: 630403 - RNA, 64 nt, Homo Sapiens; identical to SEQ ID NO: 45268

SEQ ID NO: 630404 - RNA, 64 nt, Homo Sapiens; identical to SEQ ID NO: 45269

SEQ ID NO: 630405 - RNA, 64 nt, Homo Sapiens; identical to SEQ ID NO: 45270

SEQ ID NO: 630406 - RNA, 64 nt, Homo Sapiens; identical to SEQ ID NO: 45271

SEQ ID NO: 630407 - RNA, 64 nt, Homo Sapiens; identical to SEQ ID NO: 45272

SEQ ID NO: 630408 - RNA, 64 nt, Homo Sapiens; identical to SEQ ID NO: 45273

SEQ ID NO: 630409 - RNA, 64 nt, Homo Sapiens; identical to SEQ ID NO: 45274

SEQ ID NO: 630410 - RNA, 64 nt, Homo Sapiens; identical to SEQ ID NO: 45275

SEQ ID NO: 630411 - RNA, 64 nt, Homo Sapiens; identical to SEQ ID NO: 45276

SEQ ID NO: 630412 - RNA, 64 nt, Homo Sapiens; identical to SEQ ID NO: 45277

SEQ ID NO: 630413 - RNA, 64 nt, Homo Sapiens; identical to SEQ ID NO: 45278

SEQ ID NO: 630414 - RNA, 64 nt, Homo Sapiens; identical to SEQ ID NO: 45279

SEQ ID NO: 630415 - RNA, 64 nt, Homo Sapiens; identical to SEQ ID NO: 45280

SEQ ID NO: 630416 - RNA, 64 nt, Homo Sapiens
guagucauuauuugugaaaaauucccaaaaagcuggggaaaacaaauguguaacuuuuccaguu

SEQ ID NO: 630417 - RNA, 64 nt, Homo Sapiens
uguaacuuuuccaguuacuugacacgauucagugggggaaaaccagcauuuuuuauucuauuga

SEQ ID NO: 630418 - RNA, 64 nt, Homo Sapiens
accuauccugcucuguuauuucuucaucugcuggggggaaaaaguaaauuacaaacaaacaaac

SEQ ID NO: 630419 - RNA, 64 nt, Homo Sapiens
acagaaaucauacaugaaaagguuuuacugagaaggggaaaaccuuagauagagggacauguga

SEQ ID NO: 630420 - RNA, 64 nt, Homo Sapiens
cuuugacaagcuuuauuaaguugagagagagagaggggaaaaaaaaaagccuuucguaguucag

SEQ ID NO: 630421 - RNA, 64 nt, Homo Sapiens
gugaaaauacaaaauacccaagauuuaagaccggggggaaaaaaccacaaauugguaaauaaag

SEQ ID NO: 630422 - RNA, 64 nt, Homo Sapiens
uggcgauucugucuuauaacgguuugagguacaaggggaaaagaugcagagcuugacuugauga

SEQ ID NO: 630423 - RNA, 64 nt, Homo Sapiens
caguaauguuugugggagccguccccauguugagggggaaaaugauuggcucaucaagaacaca

SEQ ID NO: 630424 - RNA, 64 nt, Homo Sapiens
acaaacguuugacaaacacauuuuugggagggauggggaaaacuugaaucaccaauuaaaaacc

SEQ ID NO: 630425 - RNA, 64 nt, Homo Sapiens
auuuugacaugacgugguaauuuauuaauauaugggggaaaauuuucuuuuauuaauacuuucu

SEQ ID NO: 630426 - RNA, 64 nt, Homo Sapiens
aaaccuucuaaaaugcuuuugauucugaaaauugggggaaaaaacuuuuaaucacaauuuucuu

SEQ ID NO: 630427 - RNA, 64 nt, Homo Sapiens
aaaaaacuuuuaaucacaauuuucuucaauacaaggggaaaauauucuugcggauucccaacgu

SEQ ID NO: 630428 - RNA, 64 nt, Homo Sapiens
aacaauugucccaacaaccacacuuaaauccaguggggaaaaaaagguuaacaguaaaaauuuc

SEQ ID NO: 630429 - RNA, 64 nt, Homo Sapiens
acguaauucaauuucucacaauagacagaaacagggggaaaauguuugcccuguucaaaguacu

SEQ ID NO: 630430 - RNA, 64 nt, Homo Sapiens
uagcuuuugaagaaaggccagugauccagcaaagggggaaaaauaugcauuucaccccacauga

SEQ ID NO: 630431 - RNA, 64 nt, Homo Sapiens
gcagccagcacaaugugacccaacuuaaaauuugggggaaaaagaaugcaggagugaaauaacc

SEQ ID NO: 630432 - RNA, 64 nt, Homo Sapiens
guaggauguuguugccuuuaacuuuucuuauccaggggaaaauugccauuuuagggucagcaug

SEQ ID NO: 630433 - RNA, 64 nt, Homo Sapiens
cuggaagcagcauugugugauauucucagaggcaggggaaaauagagggaaaaauagagacuau

SEQ ID NO: 630434 - RNA, 64 nt, Homo Sapiens
aaaaauaaaaaaaaucaaguauuggcaaagauguggggaaaauucucauaagcuacugaugaga

SEQ ID NO: 630435 - RNA, 64 nt, Homo Sapiens
gcuuguucuuguggcuucugaugauuucugacuuggggaaaaauggggaagaguugaaauacgu

SEQ ID NO: 630436 - RNA, 64 nt, Homo Sapiens
uaauuuauaagaaagaaugccauugaauuuuuuaggggaaaaacuacaaauuucuaauuuagcu

SEQ ID NO: 630437 - RNA, 64 nt, Homo Sapiens
aaccugggcagcagagcaagacucugucucaaaaggggaaaaaaaaaauugcugaugugaccca

SEQ ID NO: 630438 - RNA, 64 nt, Homo Sapiens
uuaaaauuuuccuuuaugauuccacaaauagucgggggaaaaaacccuucaauuauuucccauc

SEQ ID NO: 630439 - RNA, 64 nt, Homo Sapiens
ccccauagugccuugauuuuucaggguuauuugaggggaaaaaauucuuuuagucagaaaugau

SEQ ID NO: 630440 - RNA, 64 nt, Homo Sapiens
gaaauaauagggaaaauaccuauuuuauaugaugggggaaaaaaaguaaucuuuaaacuggcug

SEQ ID NO: 630441 - RNA, 64 nt, Homo Sapiens
uuuaaagaaaaauaugauacucucagauuuuaagggggaaaacuguucucuuuaaaauauuugu

SEQ ID NO: 630442 - RNA, 64 nt, Homo Sapiens
guguauauuuuaaugaauauugauguuaacaagaggggaaaacaaaacacagguuuuuucaauu

SEQ ID NO: 630443 - RNA, 64 nt, Homo Sapiens
aaggccagagaaaaaucacagcuuccuugucggaggggaaaaggacaggugaucuggggaaaac

SEQ ID NO: 630444 - RNA, 64 nt, Homo Sapiens
cuuccuugucggaggggaaaaggacaggugaucuggggaaaacgcagcuacaccuggagcaagg

SEQ ID NO: 630445 - RNA, 64 nt, Homo Sapiens
cacuacgcgcagugcucgguuguuuacaaucaguggggaaaagggcagaaccagugcccggccc

SEQ ID NO: 630446 - RNA, 64 nt, Homo Sapiens
uuccaaaguacauuacaaaucucugaggccauuaggggaaaaggaaggggugugguuugucuuu

SEQ ID NO: 630447 - RNA, 64 nt, Homo Sapiens
ccaacuuggugaacucccaguuaaaugucaugggggggaaaaacuauuugauaccaagggcuuu

SEQ ID NO: 630448 - RNA, 64 nt, Homo Sapiens
ucuucuucuggaaauacauaucuacuuuucuugaggggaaaaaguagaugcuuauccuuuaaau

SEQ ID NO: 630449 - RNA, 64 nt, Homo Sapiens
uugaaucacauguuaaaccucaguuuuauaagagggggaaaaaaccgucucuacauaguaaaac

SEQ ID NO: 630450 - RNA, 64 nt, Homo Sapiens
uuaguuuccaggcacuugaacugugcuacaaguaggggaaaaccuacuuuaaaguaugguaaau

SEQ ID NO: 630451 - RNA, 64 nt, Homo Sapiens
agccaucuuuuuaaacaaaaaaaaguuuaaaaugggggaaaaaaaggucacucgggaaggggga

SEQ ID NO: 630452 - RNA, 64 nt, Homo Sapiens
uuuaaaaugggggaaaaaaaggucacucgggaagggggaaaaagaucagucuaacaagucauua

SEQ ID NO: 630453 - RNA, 64 nt, Homo Sapiens
cccacauuuuaacuuuuaaagaugauuuguuucaggggaaaauguguguuggggaguggcaggg

SEQ ID NO: 630454 - RNA, 64 nt, Homo Sapiens
agccaucauccaacauuauuuucaucagaaugaaggggaaaaacauaacuugaguuuuccuaag

SEQ ID NO: 630455 - RNA, 64 nt, Homo Sapiens
aucuuucaagggcaaagaacaucucagggggaauggggaaaagaagagugucacacuccuggcu

SEQ ID NO: 630456 - RNA, 64 nt, Homo Sapiens
agauggagaccugcuccccaguuggguguggaagggggaaaagggucgcacuuggacucugagg

SEQ ID NO: 630457 - RNA, 64 nt, Homo Sapiens
gaauaagaagacuaucuaggacugauugaaauuuggggaaaaguaacauuugcuaaaugaaauu

SEQ ID NO: 630458 - RNA, 64 nt, Homo Sapiens
aagguuugagguuuuagaaacccauuuuaagaugggggaaaauuagcuuuuccagaagcugauu

SEQ ID NO: 630459 - RNA, 64 nt, Homo Sapiens
uaggagaaugcauuccucuggcccacccuccccaggggaaaaucucccagugaccuggaagcaa

SEQ ID NO: 630460 - RNA, 64 nt, Homo Sapiens
uguuuaugaguuuagccaacuuuucaggagguugggggaaaagacagauucugcaacugacuca

SEQ ID NO: 630461 - RNA, 64 nt, Homo Sapiens
auuaaauaaauaaacucccgcagagucuccaucuggggaaaaaauugcacuccagccugggcga

SEQ ID NO: 630462 - RNA, 64 nt, Homo Sapiens
ccgccuuaggcuggagccaagcggcuuucugaugggggaaaauguauucugagguacaggagcc

SEQ ID NO: 630463 - RNA, 64 nt, Homo Sapiens
ggaaaucuuguuaggcuugaacagugccuguuugggggaaaacaggaggugggcaggauggaga

SEQ ID NO: 630464 - RNA, 64 nt, Homo Sapiens
aaggccagggguucacauagcaucugauauccuaggggaaaaggccuuccucacagucuguagc

SEQ ID NO: 630465 - RNA, 64 nt, Homo Sapiens
aaauauuaaaaguaguucugguuuauuaaucaacggggaaaacaucuucuccaaaaaacuugga

SEQ ID NO: 630466 - RNA, 64 nt, Homo Sapiens
gauuaaguauucccucuugucaaacuggaagcuaggggaaaaagagggauuuuuauccuuuacu

SEQ ID NO: 630467 - RNA, 64 nt, Homo Sapiens
gcacuauccguguacgaaucaauugcaaaauuugggggaaaauguggggggcaauaaucaacug

SEQ ID NO: 630468 - RNA, 64 nt, Homo Sapiens
uccaaaacacaaacugugggguauggaaauuuugggggaaaaaagaucuagaugucuguuuguu

SEQ ID NO: 630469 - RNA, 64 nt, Homo Sapiens
gcuaaaagucuaauuuuuacguuugguguguauuggggaaaauauugaagccauaaaaauauua

SEQ ID NO: 630470 - RNA, 64 nt, Homo Sapiens
ugugcugcuguuagugcaacugggcaaguuugaaggggaaaauucuuguuuucuugcuuuauuc

SEQ ID NO: 630471 - RNA, 64 nt, Homo Sapiens
uucaggcuguuaacaauuccacuaucaaaaaugaggggaaaaggaguuacuacaucaaucugca

SEQ ID NO: 630472 - RNA, 64 nt, Homo Sapiens
uaccuuuccugaaaggggaguucuuaccagacauggggaaaagccuaacucccauugacauugc

SEQ ID NO: 630473 - RNA, 64 nt, Homo Sapiens
gaaugcaauucuuuauuugaaccuguaccuacaaggggaaaaauguagaugagaauagaagagu

SEQ ID NO: 630474 - RNA, 64 nt, Homo Sapiens
auaaaauaaccccuauuuuucuuguuuuuaauaaggggaaaaaguagaccuugguuugguaguu

SEQ ID NO: 630475 - RNA, 64 nt, Homo Sapiens
augucaucuccccccaccucuucuuuuauugcaaggggaaaaaacuuuccguuucaagaccuuu

SEQ ID NO: 630476 - RNA, 64 nt, Homo Sapiens
ucuuuucaagucuccucagucaucaauaguuccuggggaaaaacagagcugguagacuugaaga

SEQ ID NO: 630477 - RNA, 64 nt, Homo Sapiens
aagaaacacaagauuuaauuauuuuucuacuuggggggaaaaaaguccucauguagaagcaccc

SEQ ID NO: 630478 - RNA, 64 nt, Homo Sapiens
acuccugaccccagauucaacuuugcaaacaacaggggaaaaaaauggggaaaagaaaaaccac

SEQ ID NO: 630479 - RNA, 64 nt, Homo Sapiens
agauucaacuuugcaaacaacaggggaaaaaaauggggaaaagaaaaaccacgagagagggaaa

SEQ ID NO: 630480 - RNA, 64 nt, Homo Sapiens
ugaugcaucaggaagcaacgugauggaggacuugggggaaaaggaucacauacucagucuaugg

SEQ ID NO: 630481 - RNA, 64 nt, Homo Sapiens
cugagcugcuuccuguuuucuucugauugcuccuggggaaaacacgccuuguccugaagaacaa

SEQ ID NO: 630482 - RNA, 64 nt, Homo Sapiens
guuagcaugugccucacuuuaagaaaguccuguaggggaaaaaaaaaacugucagagcgaauuc

SEQ ID NO: 630483 - RNA, 64 nt, Homo Sapiens
gagaugcuucugagggaugcugaccucccacuauggggaaaaggguugcuuggaggaccugggg

SEQ ID NO: 630484 - RNA, 64 nt, Homo Sapiens
gcacucagggcacacagcauggguagacaggccaggggaaaaagugucauaugcaacuaaaaca

SEQ ID NO: 630485 - RNA, 64 nt, Homo Sapiens
gaaaauaacauuauuaagugaugucuaagauaauggggaaaauagaaaagaauacacuaaguua

SEQ ID NO: 630486 - RNA, 64 nt, Homo Sapiens
gaagagcucuuggcucccuuacuggaaauuaacaggggaaaagguaauugugcugcuacauuau

SEQ ID NO: 630487 - RNA, 64 nt, Homo Sapiens
ugacaacuaacaaaaccagcgagaaaacaaagaaggggaaaaaccaguggaaguuaagaggggu

SEQ ID NO: 630488 - RNA, 64 nt, Homo Sapiens
gacauauuuaacuggugcacuuuguaaauucccuggggaaaacuugcagcuaaggaggggaaaa

SEQ ID NO: 630489 - RNA, 64 nt, Homo Sapiens
uguaaauucccuggggaaaacuugcagcuaaggaggggaaaaaaauguuguuuccuaauaucaa

SEQ ID NO: 630490 - RNA, 64 nt, Homo Sapiens
uguguguacaacccaaauuuauacacauacaucaggggaaaauguggugaaucuauggacaguc

SEQ ID NO: 630491 - RNA, 64 nt, Homo Sapiens
ugcgguggucuagcuguauauagccauuuuggaaggggaaaacaccacuaccucccacaauacc

SEQ ID NO: 630492 - RNA, 64 nt, Homo Sapiens
uuacaaaaugcuacaguguugaagaugauugucaggggaaaaacaaagcuuaagugggaaaaag

SEQ ID NO: 630493 - RNA, 64 nt, Homo Sapiens
acuuucuuagacacacuggcauuacaaggaaccaggggaaaaaacuuccugccccuaguauuug

SEQ ID NO: 630494 - RNA, 64 nt, Homo Sapiens
acuaugaaaugggguauauaaccacgacucugguggggaaaaccguuuuuuaaaggacacacac

SEQ ID NO: 630495 - RNA, 64 nt, Homo Sapiens
uucugaccagugugcguguaacuuuaugaucugaggggaaaaauggcuuuuggguuuuuguuua

SEQ ID NO: 630496 - RNA, 64 nt, Homo Sapiens
agagacaucaaguaugguaggggagggcaggcuuggggaaaauggccaugcaggagguggagaa

SEQ ID NO: 630497 - RNA, 64 nt, Homo Sapiens
gaucuauggaagucgugucuuacuccaggugaagggggaaaaaaaaagccuauacuuuggcagg

SEQ ID NO: 630498 - RNA, 64 nt, Homo Sapiens
uggcgguuuuguggaauagaaaaggcggaaagguggggaaaagauugagaaauuggaugguugc

SEQ ID NO: 630499 - RNA, 64 nt, Homo Sapiens
uuucuacucugucuccucaacucuguugauauuuggggaaaauucuguuuuucauagauucuuu

SEQ ID NO: 630500 - RNA, 64 nt, Homo Sapiens
cccgugagucauuguaagcauuggguagacagguggggaaaagguuuaacuccuggguuggcug

SEQ ID NO: 630501 - RNA, 64 nt, Homo Sapiens
cccugcucacuuguuugcccgcgacaggaggccaggggaaaaacugaacauggaccacgcaguu

SEQ ID NO: 630502 - RNA, 64 nt, Homo Sapiens
cagggccuucccggcgggggagccucagcuggaaggggaaaaguacuugagcgccguguucuuc

SEQ ID NO: 630503 - RNA, 64 nt, Homo Sapiens
uaaggagcaaaauggggguugagacagggacaauggggaaaagugcugccugccugugggcugg

SEQ ID NO: 630504 - RNA, 64 nt, Homo Sapiens
cugaguccaccgcugugcagaucgugccagcccgggggaaaaggggaagcagaaguucaaggug

SEQ ID NO: 630505 - RNA, 64 nt, Homo Sapiens
ccggaucaggaucuagaaguagaaugaggauguuggggaaaaucgccucaguuuccccaucucu

SEQ ID NO: 630506 - RNA, 64 nt, Homo Sapiens
auauaaugcuugcaccucaggguggggcgggaugggggaaaaguaaaagaaaucauuuggguug

SEQ ID NO: 630507 - RNA, 62 nt, Homo Sapiens
ggugagcauauguuucaauuuucacuaauuagggggaaaaaacaaaugacaaaaaaacuuga

SEQ ID NO: 630508 - RNA, 64 nt, Homo Sapiens
aaccccuuccacuucccacuucccccaggcuuggggggaaaacagggcaugagccuucuggggc

SEQ ID NO: 630509 - RNA, 64 nt, Homo Sapiens
uguucacugugcaaagccccaguagucggauuccggggaaaagaacaaguaucuaguuuugaug

SEQ ID NO: 630510 - RNA, 64 nt, Homo Sapiens
ugaaaaucccgcucuguuucuaaagaaguaacucggggaaaagaccagucaauuaugacaaggu

SEQ ID NO: 630511 - RNA, 64 nt, Homo Sapiens
aaguagaggaaaaagugugugcuugcugugcuguggggaaaaaaauuuacaaauauugucaucc

SEQ ID NO: 630512 - RNA, 64 nt, Homo Sapiens
caagauggaggauguccacagaggcugaccugugggggaaaagaagugcucagguaagguuguc

SEQ ID NO: 630513 - RNA, 64 nt, Homo Sapiens
gccugaggcagggcgggaggcaugcaagccagugggggaaaaccccucugaagcugggcagccc

SEQ ID NO: 630514 - RNA, 64 nt, Homo Sapiens
aaagcaaaaugcugugauaaaccaaacagggaagggggaaaaacccuccuccuugggauuuuuu

SEQ ID NO: 630515 - RNA, 64 nt, Homo Sapiens
aacccgacacggacuuauuuuugucauuagcaagggggaaaaggccaaaggacaagggccucuu

SEQ ID NO: 630516 - RNA, 64 nt, Homo Sapiens
uguuuaucacuccagugauuuuuuaagucaucugggggaaaacccaugguauccugguuauuuu

SEQ ID NO: 630517 - RNA, 64 nt, Homo Sapiens
ugaggaucucuguuuuuccugcccuaucuagacuggggaaaaaugguuagaaauuggugccuca

SEQ ID NO: 630518 - RNA, 64 nt, Homo Sapiens; identical to SEQ ID NO: 370820

SEQ ID NO: 630519 - RNA, 64 nt, Homo Sapiens; identical to SEQ ID NO: 370821

SEQ ID NO: 630520 - RNA, 64 nt, Homo Sapiens; identical to SEQ ID NO: 370822

SEQ ID NO: 630521 - RNA, 64 nt, Homo Sapiens; identical to SEQ ID NO: 370823

SEQ ID NO: 630522 - RNA, 64 nt, Homo Sapiens; identical to SEQ ID NO: 370824

SEQ ID NO: 630523 - RNA, 64 nt, Homo Sapiens; identical to SEQ ID NO: 370825

SEQ ID NO: 630524 - RNA, 64 nt, Homo Sapiens; identical to SEQ ID NO: 370826

SEQ ID NO: 630525 - RNA, 64 nt, Homo Sapiens; identical to SEQ ID NO: 370827

SEQ ID NO: 630526 - RNA, 64 nt, Homo Sapiens; identical to SEQ ID NO: 370828

SEQ ID NO: 630527 - RNA, 64 nt, Homo Sapiens; identical to SEQ ID NO: 370829

SEQ ID NO: 630528 - RNA, 64 nt, Homo Sapiens; identical to SEQ ID NO: 370830

SEQ ID NO: 630529 - RNA, 64 nt, Homo Sapiens; identical to SEQ ID NO: 370831

SEQ ID NO: 630530 - RNA, 64 nt, Homo Sapiens; identical to SEQ ID NO: 370832

SEQ ID NO: 630531 - RNA, 64 nt, Homo Sapiens; identical to SEQ ID NO: 370833

SEQ ID NO: 630532 - RNA, 64 nt, Homo Sapiens; identical to SEQ ID NO: 370834

SEQ ID NO: 630533 - RNA, 64 nt, Homo Sapiens; identical to SEQ ID NO: 370835

SEQ ID NO: 630534 - RNA, 64 nt, Homo Sapiens; identical to SEQ ID NO: 370836

SEQ ID NO: 630535 - RNA, 64 nt, Homo Sapiens; identical to SEQ ID NO: 370837

SEQ ID NO: 630536 - RNA, 64 nt, Homo Sapiens; identical to SEQ ID NO: 370838

SEQ ID NO: 630537 - RNA, 64 nt, Homo Sapiens; identical to SEQ ID NO: 370839

SEQ ID NO: 630538 - RNA, 64 nt, Homo Sapiens; identical to SEQ ID NO: 370840

SEQ ID NO: 630539 - RNA, 64 nt, Homo Sapiens; identical to SEQ ID NO: 370841

SEQ ID NO: 630540 - RNA, 64 nt, Homo Sapiens; identical to SEQ ID NO: 370842

SEQ ID NO: 630541 - RNA, 64 nt, Homo Sapiens; identical to SEQ ID NO: 370843

SEQ ID NO: 630542 - RNA, 64 nt, Homo Sapiens; identical to SEQ ID NO: 370844

SEQ ID NO: 630543 - RNA, 64 nt, Homo Sapiens; identical to SEQ ID NO: 370845

SEQ ID NO: 630544 - RNA, 64 nt, Homo Sapiens; identical to SEQ ID NO: 370846

SEQ ID NO: 630545 - RNA, 64 nt, Homo Sapiens; identical to SEQ ID NO: 370847

SEQ ID NO: 630546 - RNA, 64 nt, Homo Sapiens; identical to SEQ ID NO: 370848

SEQ ID NO: 630547 - RNA, 64 nt, Homo Sapiens; identical to SEQ ID NO: 370849

SEQ ID NO: 630548 - RNA, 64 nt, Homo Sapiens; identical to SEQ ID NO: 370850

SEQ ID NO: 630549 - RNA, 64 nt, Homo Sapiens; identical to SEQ ID NO: 370851

SEQ ID NO: 630550 - RNA, 64 nt, Homo Sapiens; identical to SEQ ID NO: 370852

SEQ ID NO: 630551 - RNA, 64 nt, Homo Sapiens; identical to SEQ ID NO: 370853

SEQ ID NO: 630552 - RNA, 64 nt, Homo Sapiens; identical to SEQ ID NO: 370854

SEQ ID NO: 630553 - RNA, 60 nt, Homo Sapiens; identical to SEQ ID NO: 370855

SEQ ID NO: 630554 - RNA, 64 nt, Homo Sapiens; identical to SEQ ID NO: 370856

SEQ ID NO: 630555 - RNA, 64 nt, Homo Sapiens; identical to SEQ ID NO: 370857

SEQ ID NO: 630556 - RNA, 64 nt, Homo Sapiens; identical to SEQ ID NO: 370858

SEQ ID NO: 630557 - RNA, 64 nt, Homo Sapiens; identical to SEQ ID NO: 370859

SEQ ID NO: 630558 - RNA, 64 nt, Homo Sapiens; identical to SEQ ID NO: 370860

SEQ ID NO: 630559 - RNA, 64 nt, Homo Sapiens; identical to SEQ ID NO: 370861

SEQ ID NO: 630560 - RNA, 64 nt, Homo Sapiens; identical to SEQ ID NO: 370862

SEQ ID NO: 630561 - RNA, 64 nt, Homo Sapiens; identical to SEQ ID NO: 370863

SEQ ID NO: 630562 - RNA, 64 nt, Homo Sapiens; identical to SEQ ID NO: 370864

SEQ ID NO: 630563 - RNA, 64 nt, Homo Sapiens; identical to SEQ ID NO: 370865

SEQ ID NO: 630564 - RNA, 64 nt, Homo Sapiens; identical to SEQ ID NO: 370866

SEQ ID NO: 630565 - RNA, 64 nt, Homo Sapiens; identical to SEQ ID NO: 370867

SEQ ID NO: 630566 - RNA, 64 nt, Homo Sapiens; identical to SEQ ID NO: 370868

SEQ ID NO: 630567 - RNA, 64 nt, Homo Sapiens; identical to SEQ ID NO: 370869

SEQ ID NO: 630568 - RNA, 64 nt, Homo Sapiens
ggucccuuacuagagagguugagggaacacucuguaggcccauguuuccacucugcacauugua

SEQ ID NO: 630569 - RNA, 64 nt, Homo Sapiens
caggcuuuucugacuaaauaaaucuuuugccgucuaggcccagcuaaggguuagcccuuggcca

SEQ ID NO: 630570 - RNA, 64 nt, Homo Sapiens
auauuucugagagugaaaccgaagccuuaagccauaggcccaggagguccacucccugcuccac

SEQ ID NO: 630571 - RNA, 64 nt, Homo Sapiens
guccccuccacaucccagcagguggggacagugauaggcccaagccuugggacagccagagcug

SEQ ID NO: 630572 - RNA, 64 nt, Homo Sapiens
gccagcugcugcaggcaggacuccagcgucaggauguugccacuuggaguaugaacaaugggca

SEQ ID NO: 630573 - RNA, 64 nt, Homo Sapiens
accuugcauccaggguaugguguaaauaaaccuguguugccauggcaacagagaccggcgguac

SEQ ID NO: 630574 - RNA, 64 nt, Homo Sapiens
gccccauaugugugaauucuacuccagaaucugcuguugccauauagaaagaaaagacccugag

SEQ ID NO: 630575 - RNA, 64 nt, Homo Sapiens
uaagcccucgaaccaaggcagcgaggagagugguuguugccaacggguggcaccuccugagaag

SEQ ID NO: 630576 - RNA, 64 nt, Homo Sapiens
auuuuacuguuauaaacaauuacugaugggcauuuguugccauuguuuuacucaauuggucccc

SEQ ID NO: 630577 - RNA, 64 nt, Homo Sapiens
uuuuggauacaaauaauauagaauguucccuggauguugccagcuagaacauucuuuguaaccc

SEQ ID NO: 630578 - RNA, 64 nt, Homo Sapiens
cgccaagucccuggugcuggguuugcucucccgcuguugccaggggcuggaagcuggagggguc

SEQ ID NO: 630579 - RNA, 64 nt, Homo Sapiens
ugccaugcagagacguggcuggcccagaauggccuguugccauagcaacuggaggcgauggggc

SEQ ID NO: 630580 - RNA, 64 nt, Homo Sapiens
cagagggggaacagccagcaccgcucuagcugguuguugccaugccggaaugugggccuagugu

SEQ ID NO: 630581 - RNA, 64 nt, Homo Sapiens
agcugguuguugccaugccggaaugugggccuaguguugccagaucuucugauuuuucgaaaga

SEQ ID NO: 630582 - RNA, 64 nt, Homo Sapiens
uuuccuacucuuuaggcaugaggaaagggaaagauguugccauacucuguugcagggaaccagg

SEQ ID NO: 630583 - RNA, 64 nt, Homo Sapiens
cugugcugaggccugaggccacagugaaugguaguguugccaccucugaagaaauggcacaggg

SEQ ID NO: 630584 - RNA, 64 nt, Homo Sapiens
auguuuguuuguuuuuugagacaggaucucacucuguugccagggcuguagugcagugguguga

SEQ ID NO: 630585 - RNA, 64 nt, Homo Sapiens
uuuuuguauuuuuuguagagacgggguuuugccauguugccaaggcugguuucaaacuccugga

SEQ ID NO: 630586 - RNA, 64 nt, Homo Sapiens
gcucaucuugagaagcaggcacagcaucucacuauguugccaagaaaaaaaagaaaagaaaaag

SEQ ID NO: 630587 - RNA, 64 nt, Homo Sapiens
gagaagcaggcggguugggugagcaacuugaguuuguugccacuuaugugcaagguagcaugau

SEQ ID NO: 630588 - RNA, 64 nt, Homo Sapiens
aguugugugcucuguugaagccccacagagcagguguugccaaugcugcgguucgugcagaagc

SEQ ID NO: 630589 - RNA, 64 nt, Homo Sapiens
cagugcuggaagcaggaacccaggcuccagaagguguugccaggggcccagaugcccugacacu

SEQ ID NO: 630590 - RNA, 64 nt, Homo Sapiens
gagacugucaacguuguccuccuguucaccaagcuguugccauauuccuuguggacaacggggc

SEQ ID NO: 630591 - RNA, 64 nt, Homo Sapiens
gugaccaaacucuggaguccuuggaccccaccacuguugccaugaugcuccacccccaggcggu

SEQ ID NO: 630592 - RNA, 64 nt, Homo Sapiens
uuucugauuuuuuguguggagaaauggggcagaguguugccaaugucuaaauuguugccaugug

SEQ ID NO: 630593 - RNA, 64 nt, Homo Sapiens
uggaaauggggcagaguguuuggccugucuaaauuguugccaugagagccauguggagagcuca

SEQ ID NO: 630594 - RNA, 64 nt, Homo Sapiens
cuuaacccagcagacacucuuuauauuugaaauguguugccagaaauauuuauaguuaaaugau

SEQ ID NO: 630595 - RNA, 64 nt, Homo Sapiens
uguuuuuauguccuuuuugugagccuauguuuaauguugccacgauauuucauugguauuugug

SEQ ID NO: 630596 - RNA, 64 nt, Homo Sapiens; identical to SEQ ID NO: 140724

SEQ ID NO: 630597 - RNA, 64 nt, Homo Sapiens; identical to SEQ ID NO: 140725

SEQ ID NO: 630598 - RNA, 64 nt, Homo Sapiens; identical to SEQ ID NO: 140726

SEQ ID NO: 630599 - RNA, 64 nt, Homo Sapiens; identical to SEQ ID NO: 140727

SEQ ID NO: 630600 - RNA, 64 nt, Homo Sapiens; identical to SEQ ID NO: 140728

SEQ ID NO: 630601 - RNA, 64 nt, Homo Sapiens; identical to SEQ ID NO: 140729

SEQ ID NO: 630602 - RNA, 64 nt, Homo Sapiens; identical to SEQ ID NO: 140730

SEQ ID NO: 630603 - RNA, 64 nt, Homo Sapiens; identical to SEQ ID NO: 140731

SEQ ID NO: 630604 - RNA, 64 nt, Homo Sapiens; identical to SEQ ID NO: 140732

SEQ ID NO: 630605 - RNA, 64 nt, Homo Sapiens; identical to SEQ ID NO: 140733

SEQ ID NO: 630606 - RNA, 63 nt, Homo Sapiens
uucagaagguggauaggucuucccacuccagcauggcuugaacucuuaggggucugcagugcu

SEQ ID NO: 630607 - RNA, 63 nt, Homo Sapiens
uacacaccaggcagggcugucugccaccuuguguggcuugacccccuguggaggggagugccu

SEQ ID NO: 630608 - RNA, 63 nt, Homo Sapiens
ugauuuggaggcugucuucugccagauuuuuuguggcuugagaugauauuuucgaacccuucu

SEQ ID NO: 630609 - RNA, 63 nt, Homo Sapiens
uauuugcagcuggucuaaccaguuacguaugucuggcuugauuacauggccagagcaacauaa

SEQ ID NO: 630610 - RNA, 63 nt, Homo Sapiens
cuguugcugggggccgauucugaucaagacacauggcuugaaaauggaagacacaaaacugag

SEQ ID NO: 630611 - RNA, 63 nt, Homo Sapiens
ucaguaguuauugccaauauuguuguuggucaauggcuugaagauaaacuuucuaauaauuau

SEQ ID NO: 630612 - RNA, 63 nt, Homo Sapiens
uagauaaauacuuauacuuugcaaagucaaaaauggcuugauuuuuggaaacaauauagaggu

SEQ ID NO: 630613 - RNA, 63 nt, Homo Sapiens
augacuccuaagagaguuguaaaaauagaggcuuggcuugaauguacauagaugguaccuggc

SEQ ID NO: 630614 - RNA, 63 nt, Homo Sapiens
aucccgacacuuugggaggccaaggcaggaggauggcuugaagccaguaguucaagaccagcc

SEQ ID NO: 630615 - RNA, 63 nt, Homo Sapiens
ccuguuccccacuccacaggagggagcugacguuggcuugaaaggaguaaagucaacaucugc

SEQ ID NO: 630616 - RNA, 63 nt, Homo Sapiens
aaugaccucuguccacccacuuuuuuauugcacuggcuugaauacaguagcaguguugauaga

SEQ ID NO: 630617 - RNA, 63 nt, Homo Sapiens
uaucuuggaugagaaagaugggcaauccugggcuggcuugagggaaucaugggcagaggauga

SEQ ID NO: 630618 - RNA, 63 nt, Homo Sapiens
aaacuucucuccuccccacccuaccugccccccuggcuugagagaauaucuucaaggaucaaa

SEQ ID NO: 630619 - RNA, 63 nt, Homo Sapiens
agaaaacuugcuacuaaacuauuaggccaucaauggcuugaauaaaaaccagagaagguuuuu

SEQ ID NO: 630620 - RNA, 63 nt, Homo Sapiens
cugggcgggacagagcagucaagaaccacgguguggcuugagaaacaguccugcuuccugagc

SEQ ID NO: 630621 - RNA, 63 nt, Homo Sapiens
agcccuacccuacccucauuccccgacacccucuggcuugaaccauggcugagcagugccggc

SEQ ID NO: 630622 - RNA, 63 nt, Homo Sapiens
gagugcaacuguggcuuagcuaauauugcaauguggcuugaauguagguagcauccuuugaug

SEQ ID NO: 630623 - RNA, 63 nt, Homo Sapiens
cacaaugaaauuauauuuucuuuguaaagaaaguggcuugaaaucuuuuuuguucaaagauua

SEQ ID NO: 630624 - RNA, 63 nt, Homo Sapiens
uccgccaugacccugggcacugggcagccggccuggcuugaagaaaaacccugagugugauuc

SEQ ID NO: 630625 - RNA, 63 nt, Homo Sapiens
uuacaaauucuacuuguugcuuaacuaaguuuguggcuugaguaugucccuuaaccaugauua

SEQ ID NO: 630626 - RNA, 63 nt, Homo Sapiens
uuuuguccuugccuccuuuucccaaaguagccuuggcuugagugucaguuuccccucaaagua

SEQ ID NO: 630627 - RNA, 63 nt, Homo Sapiens
gcauucguuuccuucuggggcuucaggccacauuggcuugaagaugaaccuuuugucguggga

SEQ ID NO: 630628 - RNA, 63 nt, Homo Sapiens
ccaggaguucaagacuagccguaaugaggcagauggcuugagugugcauggugccucaugccu

SEQ ID NO: 630629 - RNA, 63 nt, Homo Sapiens
acagcccugcugcccuuuuggacccugccugccuggcuugagagagaauuguagggauugggg

SEQ ID NO: 630630 - RNA, 63 nt, Homo Sapiens
uuggcuaacugcaacuuccaggcuggagugcacuggcuugauccucucuugcucuguugccca

SEQ ID NO: 630631 - RNA, 63 nt, Homo Sapiens
ucaggaguucgagacuagccugagacgggaagauggcuugaacagcacuuugagaggccgagg

SEQ ID NO: 630632 - RNA, 63 nt, Homo Sapiens
uaccaaauaacaauauagaacagugcuuuuagauggcuugauaaguaaagaaaaggugcaaug

SEQ ID NO: 630633 - RNA, 63 nt, Homo Sapiens
cuggcaagauuaacaaaauuguuuuugugucaauggcuugaaacuucuuaauauggugcugau

SEQ ID NO: 630634 - RNA, 63 nt, Homo Sapiens
aaaauuuguuuuguguguuaucugaaaauguacuggcuugaacucucugcccugaauccgaaa

SEQ ID NO: 630635 - RNA, 63 nt, Homo Sapiens
ugcuaugucugcaugauaauauagaccauagcauggcuugaaauaaaaauuaaaauccuugac

SEQ ID NO: 630636 - RNA, 63 nt, Homo Sapiens
ccaagaguuugaagcugcagugaggcagaaggauggcuugagcaucccaacuacuagggacag

SEQ ID NO: 630637 - RNA, 63 nt, Homo Sapiens
cacugcacccaccccuccaggugcugagauuacuggcuugagcuuccaccucagccucccaaa

SEQ ID NO: 630638 - RNA, 63 nt, Homo Sapiens
guugacagagaaaaggcuuaccuaaccucugucuggcuugagcuagugggaggcugcaucuuc

SEQ ID NO: 630639 - RNA, 63 nt, Homo Sapiens
gaaggaaagcuugaaaaggcuccccugccuuccuggcuugauuucaacuuucggcgcccuuau

SEQ ID NO: 630640 - RNA, 63 nt, Homo Sapiens
uugcuucuuucuuucugugguaaagggcccucuuggcuugauuuaacuuagcaagaggacaag

SEQ ID NO: 630641 - RNA, 63 nt, Homo Sapiens
ccucugccugauguggcuccuuccuccauuccauggcuugaaagcugcuccucucugccgccu

SEQ ID NO: 630642 - RNA, 63 nt, Homo Sapiens
gccuuggggaaauuagggccgcacuuauggugguggcuugagaagcagagugacaugguggug

SEQ ID NO: 630643 - RNA, 63 nt, Homo Sapiens
guuugguuuggcuuuugcugcccccguggcauuuggcuugaugaccggguacugggcggagag

SEQ ID NO: 630644 - RNA, 63 nt, Homo Sapiens
caugggcuuucagugcuuuuaugguuuuggcuauggcuugacugaaccuacuuaagauagaac

SEQ ID NO: 630645 - RNA, 63 nt, Homo Sapiens
cugccaccacgggccgguuggggccaggguuccuggcuugaauagcgucagccuguagccgag

SEQ ID NO: 630646 - RNA, 63 nt, Homo Sapiens
uagcaaggauaccaaggcaagcauacauguagcuggcuugaguuuguaccaaaacaguccuuc

SEQ ID NO: 630647 - RNA, 63 nt, Homo Sapiens
gacccuucuaagaagauugggcaguuggguuucuggcuugagaugaauccaagcagcagaaug

SEQ ID NO: 630648 - RNA, 63 nt, Homo Sapiens
uguaucuuaaaaccuauuuuugaaaaacaaacuuggcuugauaaucauuugggcagcuugggu

SEQ ID NO: 630649 - RNA, 63 nt, Homo Sapiens
gcugcaguacgacugucuggcccugaauuugcauggcuugagaaggcacaccguaagacuaag

SEQ ID NO: 630650 - RNA, 63 nt, Homo Sapiens
auguuagaaaagaauuuuuaaacaaucuucagauggcuugaacacgugccauuauaguaucua

SEQ ID NO: 630651 - RNA, 63 nt, Homo Sapiens
cccccucgacggacuuauaauguuucagguggcuggcuugaacaugagucugcugugcuaucu

SEQ ID NO: 630652 - RNA, 63 nt, Homo Sapiens
ccagacuauagcauauuagcuguuuagaagggauggcuugaaaggaaggagacugaaaaacac

SEQ ID NO: 630653 - RNA, 63 nt, Homo Sapiens
uucuccccagaaaauggguuaaauuucugcagcuggcuugaauaggcuccuugcuacuuaugc

SEQ ID NO: 630654 - RNA, 63 nt, Homo Sapiens
cuacagggaguguaguaaagaaucuaaagccaguggcuugaggccagugaauaaggacuccag

SEQ ID NO: 630655 - RNA, 63 nt, Homo Sapiens
uuuucagagaauuuugucuuaaauauguuaaauuggcuugaaacaucgugaaagguacauuua

SEQ ID NO: 630656 - RNA, 63 nt, Homo Sapiens
uaaaggacauuuuauuuuuuaccaacagaaguuuggcuugaaccacgugcccacugaaguggc

SEQ ID NO: 630657 - RNA, 63 nt, Homo Sapiens
uguacagaauguuuugaaagaugcgguucugaguggcuugaaaaucacauuuguagaaaugua

SEQ ID NO: 630658 - RNA, 63 nt, Homo Sapiens
uccauggaauuucuaguaugugcgaguaaggauuggcuugaauguauacuucguaagaaggaa

SEQ ID NO: 630659 - RNA, 63 nt, Homo Sapiens
ccaggaggcagagguugcagugaggcaggggaauggcuugaacaucccagcuacucagggggc

SEQ ID NO: 630660 - RNA, 63 nt, Homo Sapiens
uucucaaaagccaucggaaggagcugggggagcuggcuugagucuggacagaaacaggaaugu

SEQ ID NO: 630661 - RNA, 63 nt, Homo Sapiens
caguaguuuaggaaugacaagugugcgcccgccuggcuugaggggagauuagcauuuuaguuu

SEQ ID NO: 630662 - RNA, 63 nt, Homo Sapiens
uugcagaacuguuguagaaagcugccuuauaguuggcuugacaaagcauaauucucucauaac

SEQ ID NO: 630663 - RNA, 63 nt, Homo Sapiens
guugggauugucaggguccuggccccucagaacuggcuugaucaagggccuuauguggagcag

SEQ ID NO: 630664 - RNA, 63 nt, Homo Sapiens
acaguuggcaugccaggguucgagaagagugaauggcuugacguacuugcaguuaacugugca

SEQ ID NO: 630665 - RNA, 63 nt, Homo Sapiens
gacuggcaggcggggccucaagccugcagccacuggcuugauugggcccuggacguugagccc

SEQ ID NO: 630666 - RNA, 63 nt, Homo Sapiens
agggcuccacugcugacaagguuugagaacugcuggcuugaggugagaaccccuuuaaccucu

SEQ ID NO: 630667 - RNA, 63 nt, Homo Sapiens
gucagugaagaccgggagggaaugucagugaauuggcuugaauguucuguggcaauccacagg

SEQ ID NO: 630668 - RNA, 63 nt, Homo Sapiens
agacaugaacuauacaaacaggauauauuuauauggcuugagguauguuuuguaauagcguug

SEQ ID NO: 630669 - RNA, 63 nt, Homo Sapiens
acuguaaacauggcugguggaaaaucacgauuguggcuugauguggcaagccgaaaccacuug

SEQ ID NO: 630670 - RNA, 63 nt, Homo Sapiens
uauguuuucuguaucgacacauuuuauuaaacuuggcuugauugcuucuuuauaguagucccu

SEQ ID NO: 630671 - RNA, 63 nt, Homo Sapiens
gaaccuuacaaggcucuaaaaugagaugugauauggcuugaaaugggaggagacacuuucuga

SEQ ID NO: 630672 - RNA, 63 nt, Homo Sapiens
ucuccuugugagcucaccugcuacccuuuggcuuggcuugaccucccugguguuguguguuac

SEQ ID NO: 630673 - RNA, 63 nt, Homo Sapiens
acacaccuuaggaacauguggcagaauucagguuggcuugacaacagggacuauaacagggag

SEQ ID NO: 630674 - RNA, 63 nt, Homo Sapiens
cucaucagcaggcagccucaccuucauuuaaguuggcuugaauagguucucauguggugaagc

SEQ ID NO: 630675 - RNA, 63 nt, Homo Sapiens
auaaaugaaaauauccuguuuguuuggggagguuggcuugaacuucuggacacuagauuuuuu

SEQ ID NO: 630676 - RNA, 63 nt, Homo Sapiens
uucuagucuguuugugaaaguugaaauaccuaauggcuugaaaaauaacgcacgguacuguuc

SEQ ID NO: 630677 - RNA, 63 nt, Homo Sapiens
uugcaugugucacagguuugaggagaaaugcaauggcuugagcaaugugcugacucccaaaag

SEQ ID NO: 630678 - RNA, 63 nt, Homo Sapiens
auaucccauggguuaucuguauggcucaaagaguggcuugaauuaaccaaauaaugaccaucg

SEQ ID NO: 630679 - RNA, 63 nt, Homo Sapiens
gugugaauaugaugugugcagaaaucaagagcauggcuugaguugagccugcaauagagcccu

SEQ ID NO: 630680 - RNA, 63 nt, Homo Sapiens
gacugcacuaaaacccacuagcaaucuaaauuguggcuugaagaaucuggagcacaccgaagg

SEQ ID NO: 630681 - RNA, 63 nt, Homo Sapiens
uuguaaauauauaaauguaaaaguugaaagccauggcuugaucugauuguugaaugaacaaca

SEQ ID NO: 630682 - RNA, 63 nt, Homo Sapiens
ucagcuccuggagggacaguaagaauggaaagguggcuugagcgaaagaguguggggagaaau

SEQ ID NO: 630683 - RNA, 63 nt, Homo Sapiens
cagcauguccccucaaaugacuuguuugugcuauggcuugaccauuucccuucuuuuguuucu

SEQ ID NO: 630684 - RNA, 63 nt, Homo Sapiens
ucuugaauaugcugagacccguacacauuucuguggcuugauucagggagccuagcaauacaa

SEQ ID NO: 630685 - RNA, 63 nt, Homo Sapiens
acagagaugccacuggggacccccagacaccaguggcuugacuuugagcuaaggcugaaguac

SEQ ID NO: 630686 - RNA, 63 nt, Homo Sapiens
uaaauuuuaccuuuauaagacaauggugaaaucuggcuugaacuugcuuauguguuuaaccua

SEQ ID NO: 630687 - RNA, 63 nt, Homo Sapiens
caaaugaccaagggcgccccuucuggccgugcuuggcuugaguaacugucucucuuuccccac

SEQ ID NO: 630688 - RNA, 63 nt, Homo Sapiens
ggaaugagaauuuaagccucaaauuugaacauguggcuugaauuaagaagaaaauuauggcau

SEQ ID NO: 630689 - RNA, 63 nt, Homo Sapiens
cuccacugugccccacuuucugccaaugaacaguggcuugauaauaccaaguauuguuguaau

SEQ ID NO: 630690 - RNA, 63 nt, Homo Sapiens
cagcaauuuuuuuaaaaaacugagauuuccuacuggcuugaaguuuuucuauuuagcaaaaua

SEQ ID NO: 630691 - RNA, 63 nt, Homo Sapiens
uucacccaagagugaaaaaaggaaaaucuaccauggcuugaaguuaaagagcagaacuccuga

SEQ ID NO: 630692 - RNA, 63 nt, Homo Sapiens
gugcugccauuugcuauaaaguugaacuuuguauggcuugaaaaagaaaugacaauauggaac

SEQ ID NO: 630693 - RNA, 63 nt, Homo Sapiens
auuuaaaguaaaacauuguuuaauguuaccuuuuggcuugagaaugucuuucagcuccagaau

SEQ ID NO: 630694 - RNA, 63 nt, Homo Sapiens
accuuggaagucaaugacuacgccuauggccacuggcuugaccucagacauguguaagguaga

SEQ ID NO: 630695 - RNA, 63 nt, Homo Sapiens
aauacgguagagauacuuagaaaguaauggaucuggcuugaaauauaagggacuuuuauuugu

SEQ ID NO: 630696 - RNA, 63 nt, Homo Sapiens
ccaaucucaguuuuguugucccuuagccuauaguggcuugacuugccagcaaucccugcuguu

SEQ ID NO: 630697 - RNA, 63 nt, Homo Sapiens
ccuaguguuuucauaauguaauuuauuaguaccuggcuugaaguucuuucuuuuaaauuaaau

SEQ ID NO: 630698 - RNA, 63 nt, Homo Sapiens
aaaaaaaaaaaaagaaaguaauuuuaaacucacuggcuugaaaugugugcuuucuguacaaug

SEQ ID NO: 630699 - RNA, 63 nt, Homo Sapiens
uucacuugguaguacuuugcuuuagcuuuuaaauggcuugauuuuaaaggagaaauucuauuu

SEQ ID NO: 630700 - RNA, 63 nt, Homo Sapiens
ucuuggugccuuuugugugaugcgccuugcugauggcuugacaugugcaauugugagggacau

SEQ ID NO: 630701 - RNA, 63 nt, Homo Sapiens
gucaaacauuuacugaaaauagaauuggccccauggcuugaugugaagacagcaaggaaagaa

SEQ ID NO: 630702 - RNA, 63 nt, Homo Sapiens
caggguuuugccaucguccaggcuggagugcgcuggcuugaucuuggcucacugcagccucaa

SEQ ID NO: 630703 - RNA, 63 nt, Homo Sapiens
aguguuaauacaugcaagaaguaagagcauuuguggcuugaacuugccagaugcaaauaccac

SEQ ID NO: 630704 - RNA, 63 nt, Homo Sapiens
cggaggacgugcccucaccccucacugguccacuggcuugagacucaccccgucugcccagua

SEQ ID NO: 630705 - RNA, 63 nt, Homo Sapiens
gggugcuuccaagaggcaugagagugccuacucuggcuugagcacuucuauaugcaaggugaa

SEQ ID NO: 630706 - RNA, 63 nt, Homo Sapiens
auuggcucuuucuaaaucaugugacguuuugacuggcuugagauucagaugcauaauuuuuaa

SEQ ID NO: 630707 - RNA, 63 nt, Homo Sapiens
gguagugucuaaagcgacacuuuacucacagccuggcuugagucaacaggaacaccauagcac

SEQ ID NO: 630708 - RNA, 63 nt, Homo Sapiens
agccaugggcuaaauggguaucccagugugaauuggcuugaagaucuugugaggguguguuuu

SEQ ID NO: 630709 - RNA, 63 nt, Homo Sapiens
uaugguugguaacacaaauucugucauuugcuuuggcuugaagcaugaaaagaacacuagagu

SEQ ID NO: 630710 - RNA, 63 nt, Homo Sapiens
auuuaaaauagcauuagagcaaguugcuugucauggcuugaagagcuuaacuuugucuuuugg

SEQ ID NO: 630711 - RNA, 63 nt, Homo Sapiens
ccuucuccuguuauuuaggauuucugacaaagcuggcuugagauuggucacuuagagccgacu

SEQ ID NO: 630712 - RNA, 63 nt, Homo Sapiens
ucccugcuugcauuuuuuaaaaacuagacauuguggcuugagaauuuaucaaucaucuuuccg

SEQ ID NO: 630713 - RNA, 63 nt, Homo Sapiens
ggacaucgaaaaggaggauggagccaggugccauggcuugagccuauaauccgaggcugaggu

SEQ ID NO: 630714 - RNA, 63 nt, Homo Sapiens
acuucaauaguaaccaaguccaaucaagcccaauggcuugauguucccaugaauucaagguga

SEQ ID NO: 630715 - RNA, 63 nt, Homo Sapiens
cugcucacugcucacacgcuuuuaguucguaccuggcuugaaguuuguaucaccucuucacaa

SEQ ID NO: 630716 - RNA, 63 nt, Homo Sapiens
ugggauugacaaaaugugucccugccuugaggauggcuugaccucucagugggugcagacagc

SEQ ID NO: 630717 - RNA, 63 nt, Homo Sapiens
acugggccaccaaagaacuuuuugcuauuuaaguggcuugacaaaauccucaagccaucagga

SEQ ID NO: 630718 - RNA, 63 nt, Homo Sapiens
uugauacacauuugaauuuuugaaaaacgacuguggcuugaugauuuuuguagccagagaaau

SEQ ID NO: 630719 - RNA, 63 nt, Homo Sapiens
acauuacagaacuauguuuucucuaggauaauguggcuugaacgauucuucugagcaguuaac

SEQ ID NO: 630720 - RNA, 63 nt, Homo Sapiens
ugauaagagaauucucgaacauucagugaugacuggcuugagacgagacugggacuauggcuu

SEQ ID NO: 630721 - RNA, 63 nt, Homo Sapiens
uucaaauggaaggaaccaccuagcuucaaaguguggcuugacaacacaaccuauuuuguuuua

SEQ ID NO: 630722 - RNA, 63 nt, Homo Sapiens
ucccgcugaugguuuucggugcucacuaacaucuggcuugagcacgccauuccuggucuaccg

SEQ ID NO: 630723 - RNA, 63 nt, Homo Sapiens
ugggccaaggcugugguccccguggcuggcaucuggcuugagucuccccgaggccugugcguc

SEQ ID NO: 630724 - RNA, 63 nt, Homo Sapiens
ucaaccaaacgccuauuuuuuaaugcuuaguuuuggcuugaaauucuucuucaccuggaguuu

SEQ ID NO: 630725 - RNA, 63 nt, Homo Sapiens
acaggggcucuugggguucggcucagcucaacauggcuugacauggugggcacacuggcgccc

SEQ ID NO: 630726 - RNA, 63 nt, Homo Sapiens
cuugcaggucagccccugccuugcagggcgggcuggcuugacucaggcccugugagauagagg

SEQ ID NO: 630727 - RNA, 63 nt, Homo Sapiens
aaaaaaaggaacagaaacaacuuugcauugcauuggcuugacccauaaacuaaguuauauccg

SEQ ID NO: 630728 - RNA, 63 nt, Homo Sapiens
auugugauguuucaaugugagacacaaaaacaauggcuugaaacuuguguaucauaugugauu

SEQ ID NO: 630729 - RNA, 63 nt, Homo Sapiens
accugauuaauuucuuauaaagcagcauaaccuuggcuugauuaaggaauucuacuuucaaaa

SEQ ID NO: 630730 - RNA, 63 nt, Homo Sapiens
cucccccuccuucuguccccucccuuucuuuccuggcuugagguaggggcucuuaagguacag

SEQ ID NO: 630731 - RNA, 63 nt, Homo Sapiens
guucaacuaggaucagaauaucacagaaaagcauggcuugaauaaggaaaugacaauuuuuuc

SEQ ID NO: 630732 - RNA, 63 nt, Homo Sapiens
aagauuauuaaggagaauauuccuuaacuauacuggcuugauuugaaacaggcucuuauugcc

SEQ ID NO: 630733 - RNA, 63 nt, Homo Sapiens
cauguguuugguuuguuuuaaauucugugaaaguggcuugauuaaaagacuccuuuuaaaugg

SEQ ID NO: 630734 - RNA, 63 nt, Homo Sapiens
auuuggccacccucagccuccauugggagggucuggcuugaaaagcuuugcacaguguauuaa

SEQ ID NO: 630735 - RNA, 63 nt, Homo Sapiens
caggauuuaaaaacuggaacuuuuuuuuuuuuuuggcuugacuuuuuuuguuuuguuuugguu

SEQ ID NO: 630736 - RNA, 63 nt, Homo Sapiens
ugucacuugguccccuccgcaugagucagaugguggcuugagucuuuguccccgcuccgggag

SEQ ID NO: 630737 - RNA, 63 nt, Homo Sapiens
uccaauagcugaacuugggcuuuuaucuuaaaguggcuugauuaguuugcacaaaagucagua

SEQ ID NO: 630738 - RNA, 63 nt, Homo Sapiens
gugauuuucauuccuugauuuaaucacguguauuggcuugaauccaaugauacaacaguaguu

SEQ ID NO: 630739 - RNA, 63 nt, Homo Sapiens
uugguucacugcaaccucuggcuggagugcaaauggcuugaucagucucacuguguugcccag

SEQ ID NO: 630740 - RNA, 63 nt, Homo Sapiens
ucagucaaucuggugcagauaucauuuuuauuguggcuugagcgaaaccuuuuucuacuuacu

SEQ ID NO: 630741 - RNA, 63 nt, Homo Sapiens
uuuaaccauuuauuacauaagaccugcaagauguggcuugaauuggcagaucuugacaggcug

SEQ ID NO: 630742 - RNA, 63 nt, Homo Sapiens
aaggacagcccuccuugacccugaaaggaacacuggcuugaaggacugcagacaggcucugag

SEQ ID NO: 630743 - RNA, 63 nt, Homo Sapiens
guucucuagcuguucuacaaaacuggagcaugcuggcuugaaaaacccuugcccaguuuugau

SEQ ID NO: 630744 - RNA, 63 nt, Homo Sapiens
aagaacaacagaaauuaucugucauuugagaaguggcuugacaaucauuugagcuuugaaagc

SEQ ID NO: 630745 - RNA, 63 nt, Homo Sapiens
aguaaauuucuugcuuaauguuuuuccaaguucuggcuugaauauuucuuauuaaagcuaucu

SEQ ID NO: 630746 - RNA, 63 nt, Homo Sapiens
aaauauuaacaaaaaugauuuggggaaaugacauggcuugauuguucuguuuaaauuuguacu

SEQ ID NO: 630747 - RNA, 63 nt, Homo Sapiens
gucccagcuacucuggaggcugaaguuggaggauggcuugagcccacgagauggaaguugcag

SEQ ID NO: 630748 - RNA, 63 nt, Homo Sapiens
aacaauugaaagggaagcuuauucauggaauauuggcuugauuuaucuagaaaguuuuuccuu

SEQ ID NO: 630749 - RNA, 63 nt, Homo Sapiens
auugcuggaauuacaguugugagccaccacaccuggcuugaauguagauuuuaauaauugaau

SEQ ID NO: 630750 - RNA, 63 nt, Homo Sapiens
cuaauagaaaaagaagucgauguucuggaaagcuggcuugauuucacaggggaguuggagcca

SEQ ID NO: 630751 - RNA, 63 nt, Homo Sapiens
aaaugugucagaauaggaaaacauugcaauaaauggcuugauuuuuuaaugucauuuuucccu

SEQ ID NO: 630752 - RNA, 63 nt, Homo Sapiens
guguuugcccacagucuauagaacuucccugaguggcuugaauuucaguaacuaaagaaaaag

SEQ ID NO: 630753 - RNA, 63 nt, Homo Sapiens
aauuucaguggcucucaggaguuuaaggguagcuggcuugaguagaguaagcaggggagacag

SEQ ID NO: 630754 - RNA, 63 nt, Homo Sapiens
ccaggaguucaagaccagcccaaagaaggaggauggcuugagcgucuuagcuacucgagaggc

SEQ ID NO: 630755 - RNA, 63 nt, Homo Sapiens
uagcagucauagcaaguuugaagacuuuuuaaauggcuugaugguguuuauaugaaacuacua

SEQ ID NO: 630756 - RNA, 63 nt, Homo Sapiens
uugugacugcucuacacugcaucccuguauucauggcuugacugcucacuggaauguuuuucc

SEQ ID NO: 630757 - RNA, 63 nt, Homo Sapiens
ccugacauugcauuuuuauucaaaguuccuaacuggcuugacuauaaaaagccauauauacug

SEQ ID NO: 630758 - RNA, 63 nt, Homo Sapiens
guuuucuuuaugucuuuugauacaccuagucuguggcuugacuggauauauguauugagauau

SEQ ID NO: 630759 - RNA, 63 nt, Homo Sapiens
cagggaacccugggggacuuaauaacccuguaguggcuugaugagugaaguauuauauuuuuc

SEQ ID NO: 630760 - RNA, 63 nt, Homo Sapiens
agccgcagggggagcaugccaaucagacagaaauggcuugagagguauggagugggccugcaa

SEQ ID NO: 630761 - RNA, 63 nt, Homo Sapiens
uucuuaggacaucuuuuuuacacuaacuuauuguggcuugaucuuagcauguauuauggaaaa

SEQ ID NO: 630762 - RNA, 63 nt, Homo Sapiens
gauccucccgccccagccucgccucgaccucccuggcuugaguugugaucccagcucacugca

SEQ ID NO: 630763 - RNA, 63 nt, Homo Sapiens
ucugggaggguggcccuggcgugguaggugggguggcuugagggggguggcaccaggugggca

SEQ ID NO: 630764 - RNA, 63 nt, Homo Sapiens
aucccucagcauuucucccaagaucgcuauugauggcuugauccugaacugugugcacuccuu

SEQ ID NO: 630765 - RNA, 63 nt, Homo Sapiens
guaguuauuaugaaaaaggcgguugcagagagcuggcuugagaaagauacaauucaaggguua

SEQ ID NO: 630766 - RNA, 63 nt, Homo Sapiens
uuuaugggaaaaguuauuuuugaagccaauuucuggcuugacucccaggucuccaugguuagu

SEQ ID NO: 630767 - RNA, 63 nt, Homo Sapiens
cagccaagaaccacaugggcaucagaccugagauggcuugaaggcugcugagcuugugugaaa

SEQ ID NO: 630768 - RNA, 63 nt, Homo Sapiens
uucuggguggcugaugggccugaaggaugaaucuggcuugaccuuuagaagguagauucgaug

SEQ ID NO: 630769 - RNA, 63 nt, Homo Sapiens
guuguugucagaaaggugcaucucucugaaaguuggcuugagauauuuuuucccuucauguuu

SEQ ID NO: 630770 - RNA, 63 nt, Homo Sapiens
aaguguagcauuucaggguaaagacccaugaaauggcuugauguauucuagacuacugaaaga

SEQ ID NO: 630771 - RNA, 63 nt, Homo Sapiens
gaaaguugcuuuucuuuugagaauuaaaaacuuuggcuugauuucuuuuuucccuuugcuuau

SEQ ID NO: 630772 - RNA, 63 nt, Homo Sapiens
aauggguaauaguagaaaauagguuagaaucuauggcuugauuaaaaauauguuauuacauua

SEQ ID NO: 630773 - RNA, 63 nt, Homo Sapiens
gggguuuggggaaggacaguguggugugacuauuggcuugaaacguuauggauaugguuggag

SEQ ID NO: 630774 - RNA, 63 nt, Homo Sapiens
uuaaaagcaugaaggagagaaaaaugggggucguggcuugagaaauuccaggcccuaccgauc

SEQ ID NO: 630775 - RNA, 63 nt, Homo Sapiens
cuuuccuugagcuguugugagcuuugaaguagguggcuugagcuagagauaaaacagaaucuu

SEQ ID NO: 630776 - RNA, 63 nt, Homo Sapiens
ugggacccucauuucuucugacagauuucagucuggcuugaaauuuggggauguuaaugaggg

SEQ ID NO: 630777 - RNA, 63 nt, Homo Sapiens
ccaggaguucgacaccagccuugaggugggcaauggcuugagcacacuuguaaucccagcacu

SEQ ID NO: 630778 - RNA, 63 nt, Homo Sapiens
ugaucaucaucucauaacugauauccacaacauuggcuugaugugaaggcuugaaaacaaaac

SEQ ID NO: 630779 - RNA, 63 nt, Homo Sapiens
aaccuugacugcuugguccuccgagaacgccuguggcuugaaggggccuggggcucuugcuuc

SEQ ID NO: 630780 - RNA, 63 nt, Homo Sapiens
acaaauggucuuagaauucagguuucguuuugcuggcuugaagcgcaaaucccuucaccacag

SEQ ID NO: 630781 - RNA, 63 nt, Homo Sapiens
agcggagauauuggagauugggagagagacauauggcuugagaaggggcugucucuguuugug

SEQ ID NO: 630782 - RNA, 63 nt, Homo Sapiens
aaauggcugaucaaaacuuauccugaguuuaaguggcuugauuucucuucuaacccccugaaa

SEQ ID NO: 630783 - RNA, 63 nt, Homo Sapiens
acuuuuacucauccuugagauguaugguguauuuggcuugaguuaugagagaugcuuauuuau

SEQ ID NO: 630784 - RNA, 63 nt, Homo Sapiens
cagggugauaauaaucuccauaguuauuugaaguggcuugaaaaaggcaagauugacuuuuau

SEQ ID NO: 630785 - RNA, 63 nt, Homo Sapiens
aaucccagcacuuugcaggccgagguagacagauggcuugagcucaggaguucgugaccagcc

SEQ ID NO: 630786 - RNA, 63 nt, Homo Sapiens
aaugcaguguuuuucuuuuuuucucugcauaaauggcuugagcauacuggcauuuacacagaa

SEQ ID NO: 630787 - RNA, 63 nt, Homo Sapiens
aacauaauuauuucuaacacuccuuaucuuuauuggcuugauagacccuuaacacuacacuuc

SEQ ID NO: 630788 - RNA, 63 nt, Homo Sapiens
gcaugagguguugugcauuuuaaguuuccccucuggcuugacauuccuacaucuucuucccag

SEQ ID NO: 630789 - RNA, 63 nt, Homo Sapiens
gaauguuaggccuugggggcgguugugagccaguggcuugagugucuuugcucaaauuaacca

SEQ ID NO: 630790 - RNA, 63 nt, Homo Sapiens
cuuuucccuucaguaauaacgcagugugaauauuggcuugaaccccuuacucuuucauugacu

SEQ ID NO: 630791 - RNA, 63 nt, Homo Sapiens
aaggcaggagguacaaaagaauuccuucagauuuggcuugacacgaaucugugugaaacuuuc

SEQ ID NO: 630792 - RNA, 63 nt, Homo Sapiens
gccaggaggaaugucugagcagagucaagcaacuggcuugaccacagucugaagcaaggugcc

SEQ ID NO: 630793 - RNA, 63 nt, Homo Sapiens
gaagccuuucuaagaaagaaaugggggugcgaguggcuugaaucucccaugauguuggagggc

SEQ ID NO: 630794 - RNA, 63 nt, Homo Sapiens
cuguccucugauuuagcugcugccuccagccucuggcuugagaacuuacuaaaggcacuuccu

SEQ ID NO: 630795 - RNA, 63 nt, Homo Sapiens
caaauugcugccaugcuggcaucuguagcucgguggcuugacauucuccccagggacuucccg

SEQ ID NO: 630796 - RNA, 63 nt, Homo Sapiens
uuagaaauuacuuuuuuuaaucuauuuaaaguuuggcuugaagaaugccaucucugacuauau

SEQ ID NO: 630797 - RNA, 63 nt, Homo Sapiens
gagucucgcucugucacccaggcuggagugcacuggcuugaucucggcucacugcaagcucca

SEQ ID NO: 630798 - RNA, 63 nt, Homo Sapiens
ggccacuugaguuacuguugcuuccucgccugcuggcuugaugagcaccgauggugggaucug

SEQ ID NO: 630799 - RNA, 63 nt, Homo Sapiens
uuuauucaacagccauuuagagugccaucaagauggcuugaaauggaauuuugugauuuguag

SEQ ID NO: 630800 - RNA, 63 nt, Homo Sapiens
ucaaaaaccaacauccaaaaugggagggagauguggcuugaggucaagcgccaugcaucccaa

SEQ ID NO: 630801 - RNA, 63 nt, Homo Sapiens
gugugaaaggaggguuuugccucuucuugagcauggcuugaguugguaaggaaagcuguaacu

SEQ ID NO: 630802 - RNA, 63 nt, Homo Sapiens
gcuaccccuaagaucgagcuuguuuucagugacuggcuugagucauaggaggaggagucuggu

SEQ ID NO: 630803 - RNA, 63 nt, Homo Sapiens
gguguuuugguuuguuuuauuuuuucuuguuuuuggcuugauauuacuauauuuuaacugaau

SEQ ID NO: 630804 - RNA, 63 nt, Homo Sapiens
aaagguccauauccaauaguauccuuugugcuguggcuugauuuuggccuauuuuacauuauu

SEQ ID NO: 630805 - RNA, 63 nt, Homo Sapiens
gggucuugaagagggggcaggucugcaggggccuggcuugaugacccacauggcgugcugucu

SEQ ID NO: 630806 - RNA, 63 nt, Homo Sapiens
acagguguucaaggccagccugaggagggaggauggcuugaacguucuagcugcuugggaggu

SEQ ID NO: 630807 - RNA, 63 nt, Homo Sapiens
ucacacauuuccaaucucuuuuuuuuuugucauuggcuugaugacaguucucagauuuacagc

SEQ ID NO: 630808 - RNA, 63 nt, Homo Sapiens
ccaggaguucaagaccggcccaaugugggagaauggcuugagcauccuagcacuuugggaaga

SEQ ID NO: 630809 - RNA, 63 nt, Homo Sapiens
gaucacccccaggaggggaagagcagcccacacuggcuugaugugaugagcuaugaaccacug

SEQ ID NO: 630810 - RNA, 63 nt, Homo Sapiens
cccacgugggggaggaggagcgccucugacccuuggcuugagucuugcucccagcagcggaag

SEQ ID NO: 630811 - RNA, 63 nt, Homo Sapiens
aguaaccaucagagcugaauuacuaacaucacauggcuugaaggagcacuucacuaucaaaaa

SEQ ID NO: 630812 - RNA, 63 nt, Homo Sapiens
caauauaauauauuguaaacgaacuuuuugcauuggcuugaagaaauagggaauauaauguau

SEQ ID NO: 630813 - RNA, 63 nt, Homo Sapiens
cagacuggaguggauaggaugaaacuugcccucuggcuugauugggccagccuugcacugagu

SEQ ID NO: 630814 - RNA, 63 nt, Homo Sapiens
ucacuguggaucgagcucacugcugugucacuguggcuugaagaccuguguaaugaauuagug

SEQ ID NO: 630815 - RNA, 50 nt, Homo Sapiens
uagcacugagagcuauuuaauggcuugacuacaaaaaggccucugaauaa

SEQ ID NO: 630816 - RNA, 63 nt, Homo Sapiens
ccgggagguggagguugcagugaggcaggaaaauggcuugaacaauccagcuacuugggaggc

SEQ ID NO: 630817 - RNA, 63 nt, Homo Sapiens
uggaguuacaacuugcauguuccuuacuccuguuggcuugauggaacaggugcauucacacua

SEQ ID NO: 630818 - RNA, 63 nt, Homo Sapiens
cauagauaaguaagcaccacugaagcaccucuguggcuugauauuuugcugugggugaaauuu

SEQ ID NO: 630819 - RNA, 63 nt, Homo Sapiens
uuuugaagacaacugucuuauuuuauuacaaauuggcuugacauauuuauacuguaacauugu

SEQ ID NO: 630820 - RNA, 63 nt, Homo Sapiens
aacaucacaccaaagaugaggguagcgagcaacuggcuugagcagacagaacggggaagacuc

SEQ ID NO: 630821 - RNA, 63 nt, Homo Sapiens
gaauuguguaccugaaguacggccuucucaggcuggcuugagugagcauugaucugcauccaa

SEQ ID NO: 630822 - RNA, 63 nt, Homo Sapiens
aacagcucuguugaaucacaucauucugcauccuggcuugaaacgucauuucauuaguauucc

SEQ ID NO: 630823 - RNA, 63 nt, Homo Sapiens
acggaagucauuagaauggcuugugauaucugauggcuugaacuugcccacaguugaacacaa

SEQ ID NO: 630824 - RNA, 63 nt, Homo Sapiens
augauagaaacauuugauguaauaaaacuugguuggcuugauauuuuaaggaauugaaaccua

SEQ ID NO: 630825 - RNA, 55 nt, Homo Sapiens
uuuuuuuguccuuccuggaaacaucuggcuugaacccaacucuggcugcugcuga

SEQ ID NO: 630826 - RNA, 63 nt, Homo Sapiens
gcuuaaacuauugacuuggucugaacagugaaguggcuugauucauuucaugauguaaagaaa

SEQ ID NO: 630827 - RNA, 63 nt, Homo Sapiens; identical to SEQ ID NO: 630826

SEQ ID NO: 630828 - RNA, 63 nt, Homo Sapiens
ccaagaggcagagguugcagugaggucagaggauggcuugagcgucccagcuacuugggaggc

SEQ ID NO: 630829 - RNA, 63 nt, Homo Sapiens
accuuuuuaaaucuagcccaguacagugaugguuggcuugaguuuuuucuuucuggaguuuaa

SEQ ID NO: 630830 - RNA, 63 nt, Homo Sapiens
uggucuuaauauuaucuuucucauuuguauauuuggcuugauauugagguaaaugaaacuuuc

SEQ ID NO: 630831 - RNA, 63 nt, Homo Sapiens
cccccucccuggauuuuauacaguagcuucuucuggcuugaaaauaaggacaagucaauuugu

SEQ ID NO: 630832 - RNA, 63 nt, Homo Sapiens
aagccauauuuggcauggguggggccuggauucuggcuugaagagaauucuaguuugguuuau

SEQ ID NO: 630833 - RNA, 63 nt, Homo Sapiens
caagaggaaguccuaaaucaucauaugcaggaauggcuugaaaggucccaucuccaaggugcg

SEQ ID NO: 630834 - RNA, 63 nt, Homo Sapiens
gcuucucucuuuuuuuaaauuuuaggcguuuucuggcuugacggaagaaacuagcgguguucu

SEQ ID NO: 630835 - RNA, 63 nt, Homo Sapiens
gggauaaaguugagaagugugccuuuuuuuuaauggcuugaaguuucagaggugauaaaaauu

SEQ ID NO: 630836 - RNA, 63 nt, Homo Sapiens
caccuuugauggggggugggcaauggggagcaguggcuugaacccacuugagaaggcugccuc

SEQ ID NO: 630837 - RNA, 63 nt, Homo Sapiens
acucuguggccagccuggcaucaguuuaggccuuggcuugauggaagugggccaguccugguu

SEQ ID NO: 630838 - RNA, 63 nt, Homo Sapiens
ugaccaaauuuaccuuugaguugauaaguccaguggcuugaguagugaaucccucagugcuga

SEQ ID NO: 630839 - RNA, 63 nt, Homo Sapiens
cuaacugagcugggugaaggcuugugcaucaccuggcuugaguuccuugcugucacagaugau

SEQ ID NO: 630840 - RNA, 63 nt, Homo Sapiens
cccucugccuccuccccaugcccccaguugcuguggcuugauucugcuacccugaccccacca

SEQ ID NO: 630841 - RNA, 63 nt, Homo Sapiens
cuguguggagaccagcuucaaggagcggaaggcuggcuugaggccacacagcuggggcgggga

SEQ ID NO: 630842 - RNA, 63 nt, Homo Sapiens
ugaguugaaaauaacuucgcuuacguucauggcuggcuugagaugcacacacagacuucucuc

SEQ ID NO: 630843 - RNA, 63 nt, Homo Sapiens
gggggauggaggacucaagggauguaagggauauggcuugaggagggaugggggcaggaauga

SEQ ID NO: 630844 - RNA, 63 nt, Homo Sapiens
aucccagcuauugggaaggaugagaugggaggauggcuugaggccagagguuugagaccgacc

SEQ ID NO: 630845 - RNA, 63 nt, Homo Sapiens
guccuaguuacuugggaggcugaggcaggagaauggcuugaacuggggaagcagagcuugcag

SEQ ID NO: 630846 - RNA, 63 nt, Homo Sapiens
cauauauuguuuaccuucaaagauacaauuaaauggcuugauuuuuaagcuguguucuagucg

SEQ ID NO: 630847 - RNA, 63 nt, Homo Sapiens
uggucccaggacaggaaugcgguucaaacccaguggcuugaaacuuccugagaaacuguagca

SEQ ID NO: 630848 - RNA, 63 nt, Homo Sapiens
aaauaggggagauuaaauaugaaacacaaauucuggcuugaaaggcuguucacuugauuaguu

SEQ ID NO: 630849 - RNA, 63 nt, Homo Sapiens
ggacuuucccugcuucccacgucuuggugcacauggcuugacccaaggccgcgcuggggcucu

SEQ ID NO: 630850 - RNA, 63 nt, Homo Sapiens
ccgggcccaugggcagcuuggacaugugggugguggcuugaccugggcuggccggacuccugg

SEQ ID NO: 630851 - RNA, 63 nt, Homo Sapiens
ccuguccccaaauugaagauccuuccuugccuguggcuugaugcggggcggguaaaggguauu

SEQ ID NO: 630852 - RNA, 63 nt, Homo Sapiens
gaggcucacucugucacccaggcuggagugcaguggcuugaucuuggcucacugcaaccuccg

SEQ ID NO: 630853 - RNA, 63 nt, Homo Sapiens
uccccacaccucccuacuccccugggcaucuucuggcuugacuggauggaaggagacuuagga

SEQ ID NO: 630854 - RNA, 63 nt, Homo Sapiens
ccacuucccaccccgucuccagccccuguacuuuggcuugaccucguggaaauauuuauuuuc

SEQ ID NO: 630855 - RNA, 63 nt, Homo Sapiens
cgaggggaggguggcaggugaccuucugggaaauggcuugaagccaagucagcuuugccuucc

SEQ ID NO: 630856 - RNA, 63 nt, Homo Sapiens
ucaaaucuugaagucgugagugaagcugcggguuggcuugacugggcucagccacugagcugc

SEQ ID NO: 630857 - RNA, 63 nt, Homo Sapiens
ccugcccaucacccuuagaaggaucuuuucccauggcuugacuuccuucauuucccuaacuga

SEQ ID NO: 630858 - RNA, 63 nt, Homo Sapiens
gggaagcauuuuuaacuggguagaaucugacuguggcuugaaauaaaaagcucucagaaaacu

SEQ ID NO: 630859 - RNA, 63 nt, Homo Sapiens
uucuggggaugcagguccacaggugacacggaguggcuugagccccuucuggggguggugggc

SEQ ID NO: 630860 - RNA, 63 nt, Homo Sapiens
aagaggggaaggugcguauuacguccuuggggguggcuugagggaugcgagcccccaggucug

SEQ ID NO: 630861 - RNA, 63 nt, Homo Sapiens
agauguccuuugaagagccagacaccauagagguggcuugagagaaggaguucuacuugucuu

SEQ ID NO: 630862 - RNA, 63 nt, Homo Sapiens
acucaacccagaaggcgaaggcauuuccacacuuggcuugagcaucugccgaagcagugacuu

SEQ ID NO: 630863 - RNA, 63 nt, Homo Sapiens
aagucgugguuucaucucuuuggcaaccaaauguggcuugacguagaauccuuuggaaucuua

SEQ ID NO: 630864 - RNA, 63 nt, Homo Sapiens
ggaggacgugggcugcgaggagaagcuguacuuuggcuugagugaguacagcaagucucugca

SEQ ID NO: 630865 - RNA, 63 nt, Homo Sapiens
accaauggguaaaaguaacaggcgggcagauuuuggcuugaggaagagcuucuagcacgacug

SEQ ID NO: 630866 - RNA, 63 nt, Homo Sapiens
uaauuaacauucccugugaccuaguuggugcaguggcuugaaugccaaaauaaagcgugugca

SEQ ID NO: 630867 - RNA, 63 nt, Homo Sapiens
gucacccuggguaaguucucagaguggucaggauggcuugaccugcagaagauacccaagguc

SEQ ID NO: 630868 - RNA, 63 nt, Homo Sapiens
ggaaaauaaugucaggucuucccuauuauuuucuggcuugaggacgucuucaugcuuucuccu

SEQ ID NO: 630869 - RNA, 63 nt, Homo Sapiens
aacuuugaucagaaauagaagaauugcuuuguuuggcuugauuaaauauuaaugauaauuuuu

SEQ ID NO: 630870 - RNA, 63 nt, Homo Sapiens
ucaguuuguaagauuucuuuucuggcacuuuaauggcuugagguaucauuaucaguuacaaau

SEQ ID NO: 630871 - RNA, 63 nt, Homo Sapiens
auuccacggcggcaagcugaccgcacagcagucuggcuugauuuucagccgucaucauugggu

SEQ ID NO: 630872 - RNA, 63 nt, Homo Sapiens
ugaaacugaggcucagauauaaaggaaagguacuggcuugaagucacaaccacgacaggagua

SEQ ID NO: 630873 - RNA, 63 nt, Homo Sapiens
ccauguuuacauugcaccuucccgugcuguaauuggcuugacaaagacaagcaggcuucucug

SEQ ID NO: 630874 - RNA, 63 nt, Homo Sapiens
guagaccucacccuuuccagacuuuagagcuuguggcuugaauguuaaaggugugaccaccga

SEQ ID NO: 630875 - RNA, 63 nt, Homo Sapiens
augcucaggaaauacgcacuaggauauuuacuguggcuugauuuguaguagccaaaaauuaga

SEQ ID NO: 630876 - RNA, 63 nt, Homo Sapiens
aucccaucacuuugggaggugcaggcaggcagauggcuugagcccaggaauucaagaccaguc

SEQ ID NO: 630877 - RNA, 63 nt, Homo Sapiens
gucccagcuacucaggaggcugagguaggaugauggcuugagcccaggaguucgagaccagcc

SEQ ID NO: 630878 - RNA, 63 nt, Homo Sapiens
aucccagcuacuccggaagcugaggcaggagaauggcuugaacccaggagguggagguugcug

SEQ ID NO: 630879 - RNA, 63 nt, Homo Sapiens
ccuggucaguccugcgcacuauaguuuugcaaguggcuugaagaggaguuucauucgcguccc

SEQ ID NO: 630880 - RNA, 63 nt, Homo Sapiens
uagacuggcuugcuuugauuaaaguagguuucuuggcuugaugcacugguuucucuccuuaga

SEQ ID NO: 630881 - RNA, 63 nt, Homo Sapiens
guuaagacagguuuauuuuagaaacacaaaaaguggcuugaugagaauuaaagaaagaggaaa

SEQ ID NO: 630882 - RNA, 63 nt, Homo Sapiens
cugggaagcgguugcagugaagaggcaggagaauggcuugaacgucucagcuacucgggaggc

SEQ ID NO: 630883 - RNA, 63 nt, Homo Sapiens
agucuucagcaccaaguuccgcuuccaugagacuggcuugagacacaucugagaacuaaaugu

SEQ ID NO: 630884 - RNA, 63 nt, Homo Sapiens
cuaggaguucgaggcugcagugcagugggaggauggcuugagcgguucagcuucuguggaguc

SEQ ID NO: 630885 - RNA, 63 nt, Homo Sapiens
cugggaggcagagguugcagugaggugggagaauggcuugagccucccagcaacucagggggc

SEQ ID NO: 630886 - RNA, 63 nt, Homo Sapiens
uuucuuauaaucccaugaaagagccacugcuccuggcuugaauaguguugggauugcaggcgu

SEQ ID NO: 630887 - RNA, 63 nt, Homo Sapiens
uucccagcugcuugggaggcugaggcaggagaauggcuugaaccugggagguggagguugcag

SEQ ID NO: 630888 - RNA, 63 nt, Homo Sapiens
cuauauuagggguaggguauuacagaagauaauuggcuugauguccuagaaguucuuugaucc

SEQ ID NO: 630889 - RNA, 63 nt, Homo Sapiens
aucccagcuacucgggaaccugaggcaggagaauggcuugaacccaggagacagagguugugg

SEQ ID NO: 630890 - RNA, 63 nt, Homo Sapiens
uacuccacgugcagaagucuaggggcuccauuauggcuugauucucgccuccuggggauucuc

SEQ ID NO: 630891 - RNA, 63 nt, Homo Sapiens
uauugugacuaaauugcacagaacacugaauuuuggcuugaaauucgguaucuuuuaauauaa

SEQ ID NO: 630892 - RNA, 63 nt, Homo Sapiens
uauaaggaauggcaucagaacaauagcuuggaauggcuugaaaucacaaaggaucugcaagau

SEQ ID NO: 630893 - RNA, 63 nt, Homo Sapiens
cuuauuugaaaaauuaaggaaggauuucaggcauggcuugauccagcuacucaaaaaagguug

SEQ ID NO: 630894 - RNA, 63 nt, Homo Sapiens
cagucucauucuguugcccaggcuggagugcaguggcuugaucucggcucacugcaaccucgc

SEQ ID NO: 630895 - RNA, 63 nt, Homo Sapiens
gucucuccacaaaccaaacucaacagaauacuuuggcuugaagccggcacacccaggguuacu

SEQ ID NO: 630896 - RNA, 63 nt, Homo Sapiens
aggacaaauccuuucagugaacccauuuauuacuggcuugaccaaauaugcgaaguucuccaa

SEQ ID NO: 630897 - RNA, 63 nt, Homo Sapiens
gcuuuuguuuuuggcuuuugcuacaagcuuuuguggcuugaggccuuuaucgccucaccucuu

SEQ ID NO: 630898 - RNA, 63 nt, Homo Sapiens
uuccuaagggaaggagaucuuuaucuuucugguuggcuugaccagucacguugggagaagaga

SEQ ID NO: 630899 - RNA, 63 nt, Homo Sapiens
gaauuucgcucugucacccagacuggagugcaauggcuugaucuuggcucacugcaaacucug

SEQ ID NO: 630900 - RNA, 63 nt, Homo Sapiens
uaauuucuguauucucugcaacuuugcaauguuuggcuugaagaaggagcucaguaaacaucu

SEQ ID NO: 630901 - RNA, 63 nt, Homo Sapiens
gggcacaacccuuauuugacaaaacuuggauguuggcuugacuguguuugucccuucagaugg

SEQ ID NO: 630902 - RNA, 63 nt, Homo Sapiens
agcauccaagggugcacaggauguuacccucauuggcuugaaaucuggcuccugccaccacaa

SEQ ID NO: 630903 - RNA, 63 nt, Homo Sapiens
gcagaaggacaaccuccgcagucugaagggucuuggcuugauuuccugggcucagcugccccu

SEQ ID NO: 630904 - RNA, 63 nt, Homo Sapiens
gguguaccuggagaggggguuuggccaggcugguggcuugaugcuggacagaaagaugcccgu

SEQ ID NO: 630905 - RNA, 63 nt, Homo Sapiens
aggaaguucccuaauaaucuggaauauucuacauggcuugauuacauagcaaacaagaccaag

SEQ ID NO: 630906 - RNA, 63 nt, Homo Sapiens
gacaacccaagucucugggccccaggcacccccuggcuugaaccuucaaagcuuuuguaaaau

SEQ ID NO: 630907 - RNA, 63 nt, Homo Sapiens
uaaguugcauagguuuaauaauuuuuaauuauauggcuugaguuuaaauuguaauaggcguaa

SEQ ID NO: 630908 - RNA, 63 nt, Homo Sapiens
uuuccuguuguuuguggaaccuacgcguuugaauggcuugaacguugcaucuuuuaaaguuau

SEQ ID NO: 630909 - RNA, 63 nt, Homo Sapiens
ccuagaaguaaugauauacaguuuucuuccuaguggcuugaaaaucuggacuuccucaauuau

SEQ ID NO: 630910 - RNA, 63 nt, Homo Sapiens
agugccuggcuauuacuauauaaugaagcccacuggcuugacuuguaaguucaaccuaaacca

SEQ ID NO: 630911 - RNA, 63 nt, Homo Sapiens
ccaggaguucaagaccagccuaaggcagggagauggcuugagaaucccagcauuuugggaggc

SEQ ID NO: 630912 - RNA, 63 nt, Homo Sapiens
acgaccuuucuuucuuuauugacaaucgaggucuggcuugagacacuuuuuuccccaagacaa

SEQ ID NO: 630913 - RNA, 63 nt, Homo Sapiens
cacaugacccaaacauagaauauuggaauccauuggcuugagagcaccacgauacccucugau

SEQ ID NO: 630914 - RNA, 63 nt, Homo Sapiens
uguucauggggccuugauguagcaaauuagcuuuggcuugagucagcagggguguucaguugg

SEQ ID NO: 630915 - RNA, 63 nt, Homo Sapiens
aucccaucuccuaaauugaguuuuuuguguguguggcuugagauauguaaagugcucauuaga

SEQ ID NO: 630916 - RNA, 63 nt, Homo Sapiens
gcaucuuccugguuguauguuguggcuucucaguggcuugacaaaugauuguuuucuaagcau

SEQ ID NO: 630917 - RNA, 63 nt, Homo Sapiens
aggaugaaagacaaacacauaucuuccagacuauggcuugaguacuuaauuuaccgaaggcaa

SEQ ID NO: 630918 - RNA, 63 nt, Homo Sapiens
uuuucuaucuacgcuugauuuguguuguuuucuuggcuugauggcaaacaaaauuaugugaau

SEQ ID NO: 630919 - RNA, 63 nt, Homo Sapiens
uggugacauuuagucccucaucugagagcaaacuggcuugaauacuucaaaacaaacagaugc

SEQ ID NO: 630920 - RNA, 63 nt, Homo Sapiens
uuuccauuauuuucuugaagaaauuggaauggcuggcuugaagaaacagcuaacugcaucagc

SEQ ID NO: 630921 - RNA, 63 nt, Homo Sapiens
agucccagcuauucaggagcugugguaggaggauggcuugagcucaagagguugaggcugcag

SEQ ID NO: 630922 - RNA, 63 nt, Homo Sapiens
aauauggacacuuaauacuaauuuccuugaauguggcuugagauccaaaauaguuaagacaug

SEQ ID NO: 630923 - RNA, 63 nt, Homo Sapiens
ccaaaacaucagcauuucuaaaauaguccuaaagcuugaaaguaaguugcuuccaugagcaug

SEQ ID NO: 630924 - RNA, 63 nt, Homo Sapiens
cuuucacuaccuuucuuacccuuaaugugccaagcuugaaacaggauuugauuuccugagcua

SEQ ID NO: 630925 - RNA, 63 nt, Homo Sapiens
ugccucacucucuccaguugguuuucagcuggggcuugaaaugcauuuuuagcccuuugacgu

SEQ ID NO: 630926 - RNA, 63 nt, Homo Sapiens
auaguguauuauuaucguuggggcuggcucuaugcuugaaaaccaguuuauuuauaaccuguu

SEQ ID NO: 630927 - RNA, 63 nt, Homo Sapiens
uuuuuucauaguuucauuuguucuugcccacaagcuugaaauccagguuaagguauccagccu

SEQ ID NO: 630928 - RNA, 63 nt, Homo Sapiens
guugcugggggccgauucugaucaagacacauggcuugaaaauggaagacacaaaacugagag

SEQ ID NO: 630929 - RNA, 63 nt, Homo Sapiens
aauauauaaaugcuucagaugucaaauacccaugcuugaaagcucguguaauuuacuuuaaga

SEQ ID NO: 630930 - RNA, 63 nt, Homo Sapiens
gcuaaacuuuauauaaugugugguuucaauucagcuugaaaaauaaucucacuacauguagca

SEQ ID NO: 630931 - RNA, 63 nt, Homo Sapiens
uguuccccacuccacaggagggagcugacguuggcuugaaaggaguaaagucaacaucugcug

SEQ ID NO: 630932 - RNA, 63 nt, Homo Sapiens
guucuauagccuucucuugcaguauuuggauuugcuugaaaccgggaaaacuguucccauuag

SEQ ID NO: 630933 - RNA, 63 nt, Homo Sapiens
guaucgguuuuauucuuugcugauguccuuucugcuugaaauaacagucaccauacagcuaaa

SEQ ID NO: 630934 - RNA, 63 nt, Homo Sapiens
auuacugucucuugaacaguugcaaucuuggcagcuugaaaauggugcuacacucuguuuugu

SEQ ID NO: 630935 - RNA, 63 nt, Homo Sapiens
auguuuaaaucgcuaaaggaaaauacaguaagugcuugaaagaugaaggaccaaaaggccaaa

SEQ ID NO: 630936 - RNA, 63 nt, Homo Sapiens
acuggcacuggaagaguuuaguguuucuuguaugcuugaaaauaaaguauguacuguuuugaa

SEQ ID NO: 630937 - RNA, 63 nt, Homo Sapiens
gucccacuggcuggccucaggcugucuuauuccgcuugaaaauagccaaaaagucuacugugg

SEQ ID NO: 630938 - RNA, 63 nt, Homo Sapiens
caaugaaauuauauuuucuuuguaaagaaaguggcuugaaaucuuuuuuguucaaagauuaau

SEQ ID NO: 630939 - RNA, 63 nt, Homo Sapiens
cguccgaaggcauucuuguucucugaggucugugcuugaaagcuuccaaagaagagucgaguc

SEQ ID NO: 630940 - RNA, 60 nt, Homo Sapiens
gauacuggcaagauacgauuacaaguaagggcuugaaaauaugggcaacaguggaaguag

SEQ ID NO: 630941 - RNA, 63 nt, Homo Sapiens
cuggcuuuaggaugguucuggggagguggucaagcuugaaaaaugugccuucagggaggaaga

SEQ ID NO: 630942 - RNA, 63 nt, Homo Sapiens
aucacacaggacacuuuucugaauuggaaacgugcuugaaacaguccagcagacacugaacca

SEQ ID NO: 630943 - RNA, 63 nt, Homo Sapiens
agcccaggaaaccagagcaguggaggugguggggcuugaaaugaacacugucaagguggagac

SEQ ID NO: 630944 - RNA, 63 nt, Homo Sapiens
agaggggugauuuucaauggcugcagaguaaaugcuugaaaaaaggcaagaugagauggcagc

SEQ ID NO: 630945 - RNA, 63 nt, Homo Sapiens
cauuauuuugaaugugaaguccgugaugcucaggcuugaaaugaaacacuaguuuugugccag

SEQ ID NO: 630946 - RNA, 63 nt, Homo Sapiens
gacagauaaguauugcccagcuccagggccugugcuugaaaaguuuuauguuguugacucugg

SEQ ID NO: 630947 - RNA, 63 nt, Homo Sapiens
auuacagaucaugauaccuaguaucuguuuuaugcuugaaagcuguuuuauaucuuaauucua

SEQ ID NO: 630948 - RNA, 63 nt, Homo Sapiens
ggcaagauuaacaaaauuaguuuugugucaauggcuugaaacuucuuaauauggugcugaugu

SEQ ID NO: 630949 - RNA, 63 nt, Homo Sapiens
cuaugucugcaugauaauuuagaccauagcauggcuugaaaugaaaauuaaaauccuugacau

SEQ ID NO: 630950 - RNA, 63 nt, Homo Sapiens
aacacaucgcaucuacauuuauuggaaacaaaagcuugaaagaagaaaaccuaaacuaauguc

SEQ ID NO: 630951 - RNA, 63 nt, Homo Sapiens
gucucucucccauggagaacaaaagauaugacugcuugaaauaacucacaaaacauuuugcua

SEQ ID NO: 630952 - RNA, 63 nt, Homo Sapiens
uguacaggugucaccaucauggcuauggagagggcuugaaaugggauauucaagccuuuggau

SEQ ID NO: 630953 - RNA, 63 nt, Homo Sapiens
augaugauauaaaggcuggagccuccuccuguugcuugaaauaaaugagcuaagcaaggcuga

SEQ ID NO: 630954 - RNA, 63 nt, Homo Sapiens
guuuccuuuacucauguugaaaaaacugucagugcuugaaacuuucuuugaauagucacucgu

SEQ ID NO: 630955 - RNA, 63 nt, Homo Sapiens
gcgcagagcccuauaccucaugauugaaggaaagcuugaaaagauuccccugccuuccuggcu

SEQ ID NO: 630956 - RNA, 63 nt, Homo Sapiens
agccaggguguaaucuuguugccucgauccagggcuugaaagaggaguuucaaaaacugauga

SEQ ID NO: 630957 - RNA, 63 nt, Homo Sapiens
ucugccugauguggcuccuuccuccauuccauggcuugaaaccugcuccucucugccgccuuu

SEQ ID NO: 630958 - RNA, 63 nt, Homo Sapiens
acaaaaguuuugcuggcacgcuacaaagaccuugcuugaaaccuaaaaugagaaacuuuuuuc

SEQ ID NO: 630959 - RNA, 63 nt, Homo Sapiens
uucacuuaggaacguaaucgccugcaaagcccagcuugaaaccugaccauacuaauuauaccc

SEQ ID NO: 630960 - RNA, 63 nt, Homo Sapiens
uuucaaauuuucagaaagggcagaaaagaaagugcuugaaagauauugugugcaaaggauggg

SEQ ID NO: 630961 - RNA, 63 nt, Homo Sapiens
gaugaagaaugucucuagaauaaugacaauguagcuugaaagcaaauuucacaagacuuauuu

SEQ ID NO: 630962 - RNA, 63 nt, Homo Sapiens
gcguugguaucuucauuuuagcuuugcuguaaugcuugaaaagacuuggcucugaacauacug

SEQ ID NO: 630963 - RNA, 63 nt, Homo Sapiens
cuaugcauccgauucuuaacaaaacugcagggagcuugaaaaaaugcagacuguacaaacgcu

SEQ ID NO: 630964 - RNA, 63 nt, Homo Sapiens
cagaaaaugcaucccugauuucauucauuuccagcuugaaagccagccauauuacucuagucc

SEQ ID NO: 630965 - RNA, 63 nt, Homo Sapiens
auaaauacaguaaguuuagauuauugaauuggugcuugaaauuuauugguuuuguuguaauuu

SEQ ID NO: 630966 - RNA, 63 nt, Homo Sapiens
guaauagugaaaccuguacucaaaauauaagcagcuugaaacuggcuuuaccaaucuugaaau

SEQ ID NO: 630967 - RNA, 63 nt, Homo Sapiens
aaucauaacuguuaauucucagccaucuuugaagcuugaaagaagagucuuugguauuuugua

SEQ ID NO: 630968 - RNA, 63 nt, Homo Sapiens
uuaguguccgaagaccgaauuuuauuuuacagagcuugaaaacucacuucaaugaacaaaggg

SEQ ID NO: 630969 - RNA, 63 nt, Homo Sapiens
uagcauaaagcuaggggaugcauggaaauagcagcuugaaacuaggagguaacaagaaagcuu

SEQ ID NO: 630970 - RNA, 63 nt, Homo Sapiens
uaaugggucuuggaguauagauuuuuauuaguagcuugaaagagcuuaaucauaugcaguaag

SEQ ID NO: 630971 - RNA, 63 nt, Homo Sapiens
gcacaucccgcugcagagggcauucccuuuaaggcuugaaaaugccuccuguagucccaaacc

SEQ ID NO: 630972 - RNA, 63 nt, Homo Sapiens
aggacuugggcgggacacaggcuccaaacuggagcuugaaauagugucugaugaauguuaaau

SEQ ID NO: 630973 - RNA, 63 nt, Homo Sapiens
gccagggggacuagccccuguggagacuggggggcuugaaauuguccccguggucucuuacuu

SEQ ID NO: 630974 - RNA, 63 nt, Homo Sapiens
agacuauagcauauuagcuguuuagaagggauggcuugaaaggaaggagacugaaaaacacuc

SEQ ID NO: 630975 - RNA, 63 nt, Homo Sapiens
cuaacuuuuuuuuacuuauagcugggauuacaggcuugaaagucugccucagccucccaaagu

SEQ ID NO: 630976 - RNA, 63 nt, Homo Sapiens
uugauacauauuggaauacauucaaaaugaccugcuugaaacuuugugauuucuuauuugagg

SEQ ID NO: 630977 - RNA, 63 nt, Homo Sapiens
auauaaaaucuuccuguccuuguacuaauuggggcuugaaaguuuuauauacuuucaauuagc

SEQ ID NO: 630978 - RNA, 63 nt, Homo Sapiens
uucagagaauuuugucuuccauauguuaaauuggcuugaaauuucgugaaagguacauuuaaa

SEQ ID NO: 630979 - RNA, 63 nt, Homo Sapiens
auuuccucuauaucaugccugaaaaaccccugugcuugaaaaugugauacauuuaagccacug

SEQ ID NO: 630980 - RNA, 63 nt, Homo Sapiens
acugcuguguuaagcuguucaguauuguuaccugcuugaaaacuuccuauuuuuuuuuccagu

SEQ ID NO: 630981 - RNA, 63 nt, Homo Sapiens
gagaugugaacacaucagcuagugaaagaggcagcuugaaacuaaaaaaauacugauguuccu

SEQ ID NO: 630982 - RNA, 63 nt, Homo Sapiens
uacagaauguuuugaaaguggcgguucugaguggcuugaaaugcacauuuguagaaauguaau

SEQ ID NO: 630983 - RNA, 63 nt, Homo Sapiens
gagugaguaccucagagaaaucugauauacauugcuugaaaauuuguuauaaaacauucaaau

SEQ ID NO: 630984 - RNA, 63 nt, Homo Sapiens
aaagcuucagauaaacuugcuugugacugaaaugcuugaaaccgcacuccucaauugggagug

SEQ ID NO: 630985 - RNA, 63 nt, Homo Sapiens
aaaauacuuacaauaguagcaaaaaauguaugugcuugaaagucgaaaagaaugaaaacagag

SEQ ID NO: 630986 - RNA, 63 nt, Homo Sapiens
ugcucuacauuaugaccaauauaauauaauuuagcuugaaagauugaguaucauguaauaauu

SEQ ID NO: 630987 - RNA, 61 nt, Homo Sapiens
uggauuaucuacuacagagugcugcauaacagcuugaaaacagcgugagaagcuuaacuag

SEQ ID NO: 630988 - RNA, 63 nt, Homo Sapiens
auaaagcucauuugguuuagccugggguguucagcuugaaagagcaaagcuaauuugccuuug

SEQ ID NO: 630989 - RNA, 63 nt, Homo Sapiens
aaaacuucuuucccuaccauuauucucuuaaaagcuugaaaauaaacucucuguuguuuguaa

SEQ ID NO: 630990 - RNA, 63 nt, Homo Sapiens
aucucagacccaaggcaccugaagaacuuguuugcuugaaaguccaccgugggacaucaagug

SEQ ID NO: 630991 - RNA, 63 nt, Homo Sapiens
caauucuuauaugaaauuuuguucuggcuuccugcuugaaaccuuuaagaaccagaggcagaa

SEQ ID NO: 630992 - RNA, 63 nt, Homo Sapiens
guuuggggcuugauagagugugaaagguguguugcuugaaagguguggccuuagacacuagga

SEQ ID NO: 630993 - RNA, 63 nt, Homo Sapiens
auagaugugugggugaagccauagaacauauuugcuugaaauucuugagcagggaucuuauaa

SEQ ID NO: 630994 - RNA, 63 nt, Homo Sapiens
caguuaaacacugcugcaauauuucaguguugugcuugaaaauauguacaguuuuuuuccaau

SEQ ID NO: 630995 - RNA, 63 nt, Homo Sapiens
uaagaggcugauaauuccagugguccauggaaugcuugaaaaaugugcaaaacagcguuuaag

SEQ ID NO: 630996 - RNA, 63 nt, Homo Sapiens
ugcauauucuuauguaugugaaaguuacaaauugcuugaaagaaaauaugcaucuaauaaaaa

SEQ ID NO: 630997 - RNA, 63 nt, Homo Sapiens
augggaccgcaagugguaggcagugucccuucugcuugaaaccuauugaaaccaauuuaaaac

SEQ ID NO: 630998 - RNA, 63 nt, Homo Sapiens
gaauuuugugagacaguugucaaauuguugcuagcuugaaaucugcggcaauuggaguauuua

SEQ ID NO: 630999 - RNA, 63 nt, Homo Sapiens
ggcagcacauauacuaaaaauuaauaagacccagcuugaaaauugagccugauaacaagauua

SEQ ID NO: 631000 - RNA, 63 nt, Homo Sapiens
uugugaaugaauaaauuacuaauccuccuugucgcuugaaaccuucccacacucccugcucca

SEQ ID NO: 631001 - RNA, 63 nt, Homo Sapiens
auuucugcucaaccacacauucucuaagaaacagcuugaaagcucugucugggucauucauuu

SEQ ID NO: 631002 - RNA, 63 nt, Homo Sapiens
caagaacacuuuaaggaaacauuuuacaaguaugcuugaaagaaugucacuaacugguccaga

SEQ ID NO: 631003 - RNA, 63 nt, Homo Sapiens
uuuagguauaauaucaucuugucuuugacuagagcuugaaaccuuguuaucugauuguguacc

SEQ ID NO: 631004 - RNA, 63 nt, Homo Sapiens
accuuacaaggcucuaaaaugagaugugauauggcuugaaaugggaggagacacuuucugaca

SEQ ID NO: 631005 - RNA, 63 nt, Homo Sapiens
ugggugagucugccaacucacaggugcuuuuaggcuugaaaucuccauccuaucauuuccguu

SEQ ID NO: 631006 - RNA, 63 nt, Homo Sapiens
guuuuguuugguuuacuuucaaaagaguagaaagcuugaaaagauucugaaaccacaguuuca

SEQ ID NO: 631007 - RNA, 63 nt, Homo Sapiens
aucccuggggauucugaaggacucaacuagaaagcuugaaaacagugaacuugguuugaucuu

SEQ ID NO: 631008 - RNA, 63 nt, Homo Sapiens
uuuuuuuuuaaugacugugcaauuauauguauagcuugaaaagugcuagcucaauuaguuuug

SEQ ID NO: 631009 - RNA, 63 nt, Homo Sapiens
cuagucuguuugugaaagaugaaauaccuaauggcuugaaauuuaacgcacgguacuguucuu

SEQ ID NO: 631010 - RNA, 63 nt, Homo Sapiens
ugcacuuagcacuuugguucauucagaacagaugcuugaaauacuuacuguggcuuuaaacau

SEQ ID NO: 631011 - RNA, 63 nt, Homo Sapiens
gcacagcccaaauaaaacaaaaucuagucaguugcuugaaagacaaacauucuguugaaggga

SEQ ID NO: 631012 - RNA, 63 nt, Homo Sapiens
uauagacaaucuuuaauguauauuuauaaaaaggcuugaaaaaacacaauaaccaaaagcuuu

SEQ ID NO: 631013 - RNA, 63 nt, Homo Sapiens
auguauguccucucuguaauuguuuuaaugugugcuugaaauauccagaaaaccuauggaguu

SEQ ID NO: 631014 - RNA, 63 nt, Homo Sapiens
uguuguucugagcagggggacaggauugaugaggcuugaaagagcccacugagccacucucug

SEQ ID NO: 631015 - RNA, 63 nt, Homo Sapiens
gaggugcaaaacauagauauagaacugaacagggcuugaaacaauauuaggauuacuacccag

SEQ ID NO: 631016 - RNA, 63 nt, Homo Sapiens
ucacucaaacauagcugacuuccuauugguacagcuugaaaagcacuuuuuacuacauacaca

SEQ ID NO: 631017 - RNA, 63 nt, Homo Sapiens
auggugcucuugucuucuuuguuugugacccaugcuugaaaacuugaaggaaguuagauauga

SEQ ID NO: 631018 - RNA, 63 nt, Homo Sapiens
aaagccuggacaaacuauagggugcuggggacugcuugaaaagcgacacaaacgggcgugcuc

SEQ ID NO: 631019 - RNA, 63 nt, Homo Sapiens
cuucaaggaagacucuacaagcuuuuguucacagcuugaaauagaugccucacaauucagaca

SEQ ID NO: 631020 - RNA, 63 nt, Homo Sapiens
gcugccauuugcuauaaaguugaacuuuguauggcuugaaaaagaaaugacaauauggaacau

SEQ ID NO: 631021 - RNA, 63 nt, Homo Sapiens
aacugucccauuguaaagguguaaguuauauaggcuugaaaaaaauuggcggguaaaaaucac

SEQ ID NO: 631022 - RNA, 63 nt, Homo Sapiens
caguuaguugauaacauaaaauuugauuacccugcuugaaauauuuguuuuuucuugcuuuuc

SEQ ID NO: 631023 - RNA, 63 nt, Homo Sapiens
uacgguagagauacuuagcuaguaauggaucuggcuugaaaaauaagggacuuuuauuuguaa

SEQ ID NO: 631024 - RNA, 63 nt, Homo Sapiens
uuugcucaaguuuauuuauguauauauccucuagcuugaaacuaauauauaauuuucuauaca

SEQ ID NO: 631025 - RNA, 63 nt, Homo Sapiens
ccuagaugaaguuuagauuuugucaaaugaaaggcuugaaauauuguauuauaaugaugauuc

SEQ ID NO: 631026 - RNA, 63 nt, Homo Sapiens
gaauuuuagcagaugguacuugauggaagaagugcuugaaagacauaucucaccucuaggaua

SEQ ID NO: 631027 - RNA, 63 nt, Homo Sapiens
aggaggcagagguugcagugagacagaagaacugcuugaaacccccagcuacucgggaggcug

SEQ ID NO: 631028 - RNA, 63 nt, Homo Sapiens
aaaaaaaaaaagaaaguaauuuuaaacucacuggcuugaaaugugugcuuucuguacaaugaa

SEQ ID NO: 631029 - RNA, 63 nt, Homo Sapiens
uuuuuuauuucaauauauacaguuugaugaugugcuugaaauuggugcaaauauauacacacc

SEQ ID NO: 631030 - RNA, 63 nt, Homo Sapiens
uucagaauaagcuuccccaccccaguuuuuguugcuugaaaauauuguugucccggauuuuug

SEQ ID NO: 631031 - RNA, 63 nt, Homo Sapiens
gagacgcagguugcaguggacauugggauuguugcuugaaaaauuaaaauuugaauauuuucu

SEQ ID NO: 631032 - RNA, 63 nt, Homo Sapiens
uuugaagucuucccuugacccuaguaaaauauagcuugaaacuuguaaacaacuguguuugcc

SEQ ID NO: 631033 - RNA, 63 nt, Homo Sapiens
aaaugcuuguccccuauaugaauauucuguuacgcuugaaaaauauuuucuccagcguugguu

SEQ ID NO: 631034 - RNA, 63 nt, Homo Sapiens
aggaauaaagccaaggggagugagaugaggugggcuugaaaguaccuuguccgcucagaagga

SEQ ID NO: 631035 - RNA, 63 nt, Homo Sapiens
ccaggguauccaccugcaccccacucccaaguagcuugaaaaagggaggacagucuuucccca

SEQ ID NO: 631036 - RNA, 63 nt, Homo Sapiens
uauaauacacauaaauaaaacaacuuauuagcugcuugaaaaaaauuaaauauuauguccuac

SEQ ID NO: 631037 - RNA, 63 nt, Homo Sapiens
aguuaaacugauuaguauucuuaaaaauauauagcuugaaagcacuguauguuuuaauugcau

SEQ ID NO: 631038 - RNA, 63 nt, Homo Sapiens
aaauaucucugaccaacuucuugcuuguugugugcuugaaagaugguguguauuggccaaguu

SEQ ID NO: 631039 - RNA, 63 nt, Homo Sapiens
ucccaugcaagagaguaguuccauaguaaaacagcuugaaauauuuuggucccugcuccuugc

SEQ ID NO: 631040 - RNA, 63 nt, Homo Sapiens
gagacacagaggugccagugauggacuggaucagcuugaaagaagcacaaagacuccgugauc

SEQ ID NO: 631041 - RNA, 63 nt, Homo Sapiens
cugggauugcaaacacuuuuuaaaaaauuguuugcuugaaaauacuacugaauauaaauaaga

SEQ ID NO: 631042 - RNA, 63 nt, Homo Sapiens
uguugcccaccuguucacaaaaaguaccuuuaugcuugaaaacauuagguucuuugguuacug

SEQ ID NO: 631043 - RNA, 63 nt, Homo Sapiens
gugaauuuuuuuuaaguggcacggucuuuuucugcuugaaaucugaucacaccccccagccau

SEQ ID NO: 631044 - RNA, 63 nt, Homo Sapiens
caaggggcaaguuucacccaaaugccugagacugcuugaaagauauauuuuaaguggugcacu

SEQ ID NO: 631045 - RNA, 63 nt, Homo Sapiens
auucaacugcaaaaucucaaucuugaaaaucaagcuugaaauuucauagguagaaauauuagc

SEQ ID NO: 631046 - RNA, 56 nt, Homo Sapiens
cugaugaccuggagaucuagauacaggcuugaaagcaucaagauuccacucaauug

SEQ ID NO: 631047 - RNA, 63 nt, Homo Sapiens
agaaucuugcaagacaguuauuaaacauucauagcuugaaauugcccauggugggagaguuua

SEQ ID NO: 631048 - RNA, 63 nt, Homo Sapiens
ucucugaugaaagugaaaaauaaguacaaggcagcuugaaacccagacaaagucaagcagcuu

SEQ ID NO: 631049 - RNA, 63 nt, Homo Sapiens
aaaauacguaaucuguuucaauuaaaauagcaugcuugaaaaacaugaugagauaucaaggua

SEQ ID NO: 631050 - RNA, 63 nt, Homo Sapiens
auaaagcucucucagguugaaaugacagccuaggcuugaaauuggagaaaugaagcaaaggug

SEQ ID NO: 631051 - RNA, 63 nt, Homo Sapiens
aggcucuccacaccauugaccuggauuuugaacgcuugaaaucuucuuauaagccagcucuga

SEQ ID NO: 631052 - RNA, 63 nt, Homo Sapiens
uuuuguuagggccucaaagauuccugaacauuugcuugaaauaggaggggugccguuuuuauu

SEQ ID NO: 631053 - RNA, 63 nt, Homo Sapiens
gggcugcaucccuauaaaccaaggagcuccucagcuugaaaugagguaugauuccuaagcccu

SEQ ID NO: 631054 - RNA, 63 nt, Homo Sapiens
aaccaaacgccuauuuuuuaaugcuuaguuuuggcuugaaauucuucuucaccuggaguuuuc

SEQ ID NO: 631055 - RNA, 63 nt, Homo Sapiens
auuuuuacacagguuuucuugucuugacaagaugcuugaaaaaccaagaggauaugaaaaucu

SEQ ID NO: 631056 - RNA, 63 nt, Homo Sapiens
ugugauguuucaaugugagacacaaaaacaauggcuugaaacuuguguaucauaugugauuuu

SEQ ID NO: 631057 - RNA, 63 nt, Homo Sapiens
gaagguggggacagugaccgcggaccccucugugcuugaaagauuuccuccacggccuuugcc

SEQ ID NO: 631058 - RNA, 63 nt, Homo Sapiens
uauuagucagaaagaaggagagaaugagugagugcuugaaaugugucauacuguuuuaggauc

SEQ ID NO: 631059 - RNA, 63 nt, Homo Sapiens
agcugucuccucaucucauccuagucuagguuugcuugaaauugggugugagagcuagaauga

SEQ ID NO: 631060 - RNA, 63 nt, Homo Sapiens
caaacuucauauaugucuaucagguaauaauaggcuugaaaauugauauccuguggugcuaaa

SEQ ID NO: 631061 - RNA, 63 nt, Homo Sapiens
cuuccaaaggcauaagacccuaagccuccuuuugcuugaaaccaaagauauauacacaggauc

SEQ ID NO: 631062 - RNA, 63 nt, Homo Sapiens
acauugauuauagaaccacuauuacgugaaaaggcuugaaacaaccaacauauacaaauaaaa

SEQ ID NO: 631063 - RNA, 63 nt, Homo Sapiens
uuggccacccucagccucuguugggagggucuggcuugaaaaucuuugcacaguguauuaaca

SEQ ID NO: 631064 - RNA, 63 nt, Homo Sapiens
aaaugcuaauacuuaagugugaugagcauaagugcuugaaauauuagacuuuuuaaacucaag

SEQ ID NO: 631065 - RNA, 63 nt, Homo Sapiens
aaaggagaagaugcugugucuuccuguauaacggcuugaaaggcacaguugauuuucggugug

SEQ ID NO: 631066 - RNA, 63 nt, Homo Sapiens
gauuaacuuauacuguagguuuucuauacaguagcuugaaauuuugugcaugcuaguguugua

SEQ ID NO: 631067 - RNA, 63 nt, Homo Sapiens
gaggugaguucacauaacaggaauucuggaacugcuugaaaacuaggacgauugggcaauauc

SEQ ID NO: 631068 - RNA, 63 nt, Homo Sapiens
cuauuaguacuucccuuugucugugccauaagugcuugaaaacguuaagguuuucuguuuugu

SEQ ID NO: 631069 - RNA, 63 nt, Homo Sapiens
ucucuagcuguucuacaaaacuggagcaugcuggcuugaaaaacccuugcccaguuuugaucc

SEQ ID NO: 631070 - RNA, 63 nt, Homo Sapiens
auuccagccaaggcaaauucaguuggaucuagggcuugaaaacugcccaagauuaaagagcua

SEQ ID NO: 631071 - RNA, 63 nt, Homo Sapiens
uuuuuauuugcugucuuugguaauuaucucucugcuugaaauuaaaugcacuauaaguuaaua

SEQ ID NO: 631072 - RNA, 63 nt, Homo Sapiens
auugcaauuguggucaaauaaggaacguuuccugcuugaaauuauauugauuuaaaugaugug

SEQ ID NO: 631073 - RNA, 63 nt, Homo Sapiens
uuaaaggagguuguucacuuggcaagaacggcagcuugaaaaacgcacagcagcgaugcagaa

SEQ ID NO: 631074 - RNA, 63 nt, Homo Sapiens
uagagggagagagggagagauuauuuuuauauagcuugaaacagcugcucuuaugccauuugu

SEQ ID NO: 631075 - RNA, 51 nt, Homo Sapiens
ggaagaauuuaguuuuguugagcuugaaaauccuuggagccgcccuccuga

SEQ ID NO: 631076 - RNA, 63 nt, Homo Sapiens
ucuuguuaugccagaaaguaaggaacaagaugagcuugaaauauuccaaagcaagggcaaggu

SEQ ID NO: 631077 - RNA, 63 nt, Homo Sapiens
ccuuuucauaaaagauaacucugggcugagagagcuugaaaguguaaaguuguuucaguuaaa

SEQ ID NO: 631078 - RNA, 63 nt, Homo Sapiens
auugaagagggccaaacacuauaaauucaaagagcuugaaaaguuaacuuaaaggcauugguu

SEQ ID NO: 631079 - RNA, 63 nt, Homo Sapiens
cuuauuagaaagccaaaguagaguucuguuuaagcuugaaagagguaugaaguaaucuguagu

SEQ ID NO: 631080 - RNA, 63 nt, Homo Sapiens
cugaaauuuaaacuugauauuuuucgcccucuugcuugaaaacuucacuugcuuccccauuuc

SEQ ID NO: 631081 - RNA, 63 nt, Homo Sapiens
ggcuugauuuaacauuguuuuuguguuauuuuugcuugaaacaacgcacacauuuucaacaac

SEQ ID NO: 631082 - RNA, 63 nt, Homo Sapiens
guuuaagagcagaacagaucuuuuacuuuggccgcuugaaaagcuaguguaccuccucucagu

SEQ ID NO: 631083 - RNA, 63 nt, Homo Sapiens
ccagcugggccaugucagucucaucgucccaaggcuugaaauccagcaggauggaggacuugg

SEQ ID NO: 631084 - RNA, 63 nt, Homo Sapiens
caguguuggugaaucuuuuggccuuuccccaaugcuugaaagaagaucaccacugcuggaggc

SEQ ID NO: 631085 - RNA, 63 nt, Homo Sapiens
gacaggugggugaggaucugagaaaugcuaaaggcuugaaagcaucugaagacaucuaacuua

SEQ ID NO: 631086 - RNA, 63 nt, Homo Sapiens
agaaauacaagguugcuugucugaccccaaucugcuugaaaccugacucugcuucucucauuu

SEQ ID NO: 631087 - RNA, 63 nt, Homo Sapiens
ccucuauguucugaauaaagugccaucaacauugcuugaaaugggggcugacagcaggcuuac

SEQ ID NO: 631088 - RNA, 63 nt, Homo Sapiens
uauuggauuacaugcucacaauuaugaccaagggcuugaaacauaaaauauggaaauuuuaaa

SEQ ID NO: 631089 - RNA, 63 nt, Homo Sapiens
uugcugaaaaacacaacuuggggaaaacagcuagcuugaaaacaaacaaugaauucuucaaca

SEQ ID NO: 631090 - RNA, 63 nt, Homo Sapiens
aaccuggagucgggggcacaugguguggcuucagcuugaaagcccacccucagcucuuuccuc

SEQ ID NO: 631091 - RNA, 63 nt, Homo Sapiens
aaauaccaaggaacaggaaaaaacauggccuuugcuugaaagaauugaaagggaguauuacaa

SEQ ID NO: 631092 - RNA, 57 nt, Homo Sapiens
cccggauuggugugagauaacuuuuuugcuugaaagagacugcucuauuuauucugu

SEQ ID NO: 631093 - RNA, 63 nt, Homo Sapiens
gguuuggggaaggacaguguggugugacuauuggcuugaaacguuauggauaugguuggaguc

SEQ ID NO: 631094 - RNA, 63 nt, Homo Sapiens
cauauaaauguggaggcuaucaacaaagaaugggcuugaaacauuauaaaaauugacaaugau

SEQ ID NO: 631095 - RNA, 63 nt, Homo Sapiens
cccagcuccucaggaggcugaggcaggagaauugcuugaaaccaggaggcggagguugcagug

SEQ ID NO: 631096 - RNA, 63 nt, Homo Sapiens
gaacuguuggacuggguagaaaucuuucaagaagcuugaaaauaaggccauaaaggaggggcu

SEQ ID NO: 631097 - RNA, 63 nt, Homo Sapiens
ggacccucauuucuucugacagauuucagucuggcuugaaauuuggggauguuaaugaggguc

SEQ ID NO: 631098 - RNA, 63 nt, Homo Sapiens
uagucuggagaaaacuggauaucaugcauaguagcuugaaaucuacaugguuacauguucuac

SEQ ID NO: 631099 - RNA, 63 nt, Homo Sapiens
gcagaagaaauucacaggaaccauucuuuuuaagcuugaaacuacaguguucuggaaaagaug

SEQ ID NO: 631100 - RNA, 63 nt, Homo Sapiens
aaaacauauccacaacauugcacuguucugaaggcuugaaaacaguggcccaucauucauacc

SEQ ID NO: 631101 - RNA, 63 nt, Homo Sapiens
auaaauuauaucaauuuccuaggcccacaguaugcuugaaaaggucuuuuuacugcaacccac

SEQ ID NO: 631102 - RNA, 63 nt, Homo Sapiens
uaaucuauagacggccccacuuauuguuugcuugcuugaaaccgcucgggagagcugaggguu

SEQ ID NO: 631103 - RNA, 63 nt, Homo Sapiens
uuuguaugaauuauuuuguccuacagcagugaugcuugaaauuccacugagcuggaggaauau

SEQ ID NO: 631104 - RNA, 63 nt, Homo Sapiens
aaauuuuaucaggcuaccaauuaaagcgauuuagcuugaaauucuuucuaucuucauaaccau

SEQ ID NO: 631105 - RNA, 63 nt, Homo Sapiens
gcuuuuccuuuucuacucuucuuacuuucucuugcuugaaacuccccucccuguccgccucuc

SEQ ID NO: 631106 - RNA, 63 nt, Homo Sapiens
cuuccccucuccagguucgguuaugugguuccugcuugaaaacggcgugaguuuuaggugaau

SEQ ID NO: 631107 - RNA, 63 nt, Homo Sapiens
auaaaauaaucauuuuugaaccuguguaauaaagcuugaaagcagggaaaagaauuuccuuuu

SEQ ID NO: 631108 - RNA, 63 nt, Homo Sapiens
gggugauaauaaucuccauaguuauuugaaguggcuugaaaaaggcaagauugacuuuuauga

SEQ ID NO: 631109 - RNA, 63 nt, Homo Sapiens
ucauaacacucucggucacauguuuuuccuucagcuugaaagcuuuuuuuuaaaaggaaaaga

SEQ ID NO: 631110 - RNA, 63 nt, Homo Sapiens
aauaccuuaauggugguagagccuuuaccuguagcuugaaaggggaaagauuggagguaagag

SEQ ID NO: 631111 - RNA, 63 nt, Homo Sapiens
guaggaauccaggaugcuuaguuucuagacccugcuugaaaguucuagagccuuugaaaggga

SEQ ID NO: 631112 - RNA, 63 nt, Homo Sapiens
cguaaagccauauguucuguucaagucuuguuugcuugaaaugauuauuccuacaagugaaac

SEQ ID NO: 631113 - RNA, 63 nt, Homo Sapiens
ugaagacaacaccugcuucaggggaacacaggcgcuugaaaaagaaaagagagaacagcccau

SEQ ID NO: 631114 - RNA, 63 nt, Homo Sapiens
ucaaaauaugagacuaugcuauaggcagugcuugcuugaaaagucucauuuuuaaaucucccu

SEQ ID NO: 631115 - RNA, 63 nt, Homo Sapiens
aucuuuugauucagugauuugggagaaaaggcugcuugaaaaucuuauaucuaauauauaucu

SEQ ID NO: 631116 - RNA, 63 nt, Homo Sapiens
acuguguaaauauaugucugauuauuuaccguugcuugaaauuuuuuuuaagggagggaauuu

SEQ ID NO: 631117 - RNA, 58 nt, Homo Sapiens
caaagcugcgaucccuucacgaaccagagcuugaaauucacaggugcccgaggacuga

SEQ ID NO: 631118 - RNA, 63 nt, Homo Sapiens
gguacacgggccagggaaauugcacagagcucugcuugaaacauuuggguguggugacccaga

SEQ ID NO: 631119 - RNA, 63 nt, Homo Sapiens
ucagcccugaaccuuuguccgggaaauucugcugcuugaaacuggucaccucaaauuuaaguc

SEQ ID NO: 631120 - RNA, 63 nt, Homo Sapiens
gccugaggacugccuuuaacccaucuagggcuagcuugaaagaccugucucaggacacacuug

SEQ ID NO: 631121 - RNA, 63 nt, Homo Sapiens
uagagaaagauaaaauguaauacacaugaaaaagcuugaaacuguugauuaaaccugucacuu

SEQ ID NO: 631122 - RNA, 63 nt, Homo Sapiens
gacaagcuggaccuauuccuuggagaacacagugcuugaaaugcugugaagaguggacagucu

SEQ ID NO: 631123 - RNA, 63 nt, Homo Sapiens
uauugccacccaugacauuuaacauguugugaugcuugaaaacacaggaguagagaaaaucga

SEQ ID NO: 631124 - RNA, 63 nt, Homo Sapiens
augaagcacuguuuuuaaacccaaguaaagacugcuugaaaccuguugauggaaaugacuuau

SEQ ID NO: 631125 - RNA, 63 nt, Homo Sapiens
uauucaacagccauuuagagugccaucaagauggcuugaaauggaauuuugugauuuguaguc

SEQ ID NO: 631126 - RNA, 63 nt, Homo Sapiens
agaauuguuuugcauuuuuugcuuaucugaaaugcuugaaaccaaauagaauauauauauauu

SEQ ID NO: 631127 - RNA, 63 nt, Homo Sapiens
gccuggcauauacuaaacgcauucacguaacaugcuugaaacuaugaagauugaaugugaugu

SEQ ID NO: 631128 - RNA, 63 nt, Homo Sapiens
gugaccuugcaacuucaugucaagugugcuuuagcuugaaaagaaaaaaaugcacauagcuau

SEQ ID NO: 631129 - RNA, 63 nt, Homo Sapiens
ccucugaacucagucuucuugacuccucuucaagcuugaaaaccccuuuuuauuuuaaaauuu

SEQ ID NO: 631130 - RNA, 63 nt, Homo Sapiens
cacauggauguaaaauuauacccauuaacaauugcuugaaauuuuaaugcagcccugcugguc

SEQ ID NO: 631131 - RNA, 63 nt, Homo Sapiens
cuaugaaggcagagcuucuacagaaauacagaagcuugaaauguguuuagacauuuuuugucc

SEQ ID NO: 631132 - RNA, 63 nt, Homo Sapiens
ccucuucauaguugaguaauaaaucaacugugcgcuugaaagaucauacgcuguacuugcuaa

SEQ ID NO: 631133 - RNA, 63 nt, Homo Sapiens
cuuuuguuauuucaggcaaacauaaugaaagaugcuugaaauguuaaugcaggacaucaacua

SEQ ID NO: 631134 - RNA, 63 nt, Homo Sapiens
auuguggguauuaucuguuuaacuuacaggauugcuugaaauuuuacaaacaagagaaaugag

SEQ ID NO: 631135 - RNA, 63 nt, Homo Sapiens
acaauuuuaaaaaugugacugaucuaaucaguagcuugaaaccacucaaggucgcuggaugcu

SEQ ID NO: 631136 - RNA, 63 nt, Homo Sapiens
ccgcgguuggcacuucgagagggggagcccagagcuugaaagggcugguucccguuuuccaga

SEQ ID NO: 631137 - RNA, 63 nt, Homo Sapiens
uaauaagugcugcuggaagggaaaacagaaagggcuugaaauuauggguagaauuguagucag

SEQ ID NO: 631138 - RNA, 63 nt, Homo Sapiens
aaaaagucuaucugguagugagacucaaguuaugcuugaaaugcacgagugucuccccagugc

SEQ ID NO: 631139 - RNA, 63 nt, Homo Sapiens
augaaauggucauuuuucugaagagaauauuuugcuugaaaugcaaaggacugaaagagauuu

SEQ ID NO: 631140 - RNA, 63 nt, Homo Sapiens
uuugccccaugggaaacguacccagccuguggugcuugaaacggacguccuuccauaucccug

SEQ ID NO: 631141 - RNA, 63 nt, Homo Sapiens
auccaucacauaagaaaauauagacuuuuauaggcuugaaaucuuuauacuuggguuauauau

SEQ ID NO: 631142 - RNA, 63 nt, Homo Sapiens
cagcucuguugaaucacaguauucugcauccuggcuugaaaaaucauuucauuaguauuccuc

SEQ ID NO: 631143 - RNA, 63 nt, Homo Sapiens
auucuacuuaagcuauaagucucugucauuuuugcuugaaaauuagcaugccucugucuuaaa

SEQ ID NO: 631144 - RNA, 63 nt, Homo Sapiens
uucuuuuuuaaagccauucuguucuuuggaugugcuugaaagggugugugauuacaccauugu

SEQ ID NO: 631145 - RNA, 63 nt, Homo Sapiens
guugcacuuugcugugcugaucccacaggaaaggcuugaaacacgagaagcagcaaagacaga

SEQ ID NO: 631146 - RNA, 63 nt, Homo Sapiens
uuuccccccaaguagaacuaaugcuagcuuccagcuugaaaguaaaacuccaguguggaguga

SEQ ID NO: 631147 - RNA, 63 nt, Homo Sapiens
ucaggguggccaguauuuugacuuauuuauccugcuugaaagcuacuugagauguguacugcu

SEQ ID NO: 631148 - RNA, 63 nt, Homo Sapiens
aguucaccuaaagcuagaucuacuagucaguuugcuugaaacuggagcaaaacacugauuuga

SEQ ID NO: 631149 - RNA, 63 nt, Homo Sapiens
cccaugaacauuaaagagccccuuuaauuucuugcuugaaaauacuuucauguuuuaaaaauc

SEQ ID NO: 631150 - RNA, 63 nt, Homo Sapiens
uaucauuuuaucaugaaaaccuuaauaaaguaagcuugaaauuaagcuguuuguuauaugcug

SEQ ID NO: 631151 - RNA, 63 nt, Homo Sapiens
uuaaugguuuagucuugugaucucauucaggaggcuugaaacaauuuagaugguccaagauaa

SEQ ID NO: 631152 - RNA, 63 nt, Homo Sapiens
gcugcaaaugacccucuaauuacauaaaccaaugcuugaaaauauguggcagaauuucccucu

SEQ ID NO: 631153 - RNA, 63 nt, Homo Sapiens
cccucccuggauuuuauagcguagcuucuucuggcuugaaaccaaggacaagucaauuuguca

SEQ ID NO: 631154 - RNA, 63 nt, Homo Sapiens
agaggaaguccuaaaucacaauaugcaggaauggcuugaaacaucccaucuccaaggugcguc

SEQ ID NO: 631155 - RNA, 63 nt, Homo Sapiens
uuaauuuuuuuuuuuuugcaguuuauguauuaugcuugaaauuuuuccccuguuuggugcuau

SEQ ID NO: 631156 - RNA, 63 nt, Homo Sapiens
gguccagcaaaagucaguagggacauugcagaagcuugaaaggccaauaccagaacacaggcu

SEQ ID NO: 631157 - RNA, 63 nt, Homo Sapiens
aucccagcuauucuggaggcugaggcaggaaucgcuugaaauuggaaagcagagguugcagug

SEQ ID NO: 631158 - RNA, 63 nt, Homo Sapiens
cccaguuugucuuucagaaggugacuuucaugugcuugaaaaguuuaauauuugaauauugug

SEQ ID NO: 631159 - RNA, 63 nt, Homo Sapiens
uuguuuucuuuaggagucuaccuuuguguaugugcuugaaaguauuuuuguaauccaagaaug

SEQ ID NO: 631160 - RNA, 63 nt, Homo Sapiens
gaauugcccuauaaacauagcaggauuuugagagcuugaaaauuuuccauuauucuggacaug

SEQ ID NO: 631161 - RNA, 63 nt, Homo Sapiens
guccccucugucaccagggaagccacaaugagagcuugaaagggugcugucaagauaaauguc

SEQ ID NO: 631162 - RNA, 63 nt, Homo Sapiens
aacagggagugguauuugaaguguccagcaguugcuugaaaugcuuugccgaaucugacucca

SEQ ID NO: 631163 - RNA, 63 nt, Homo Sapiens
uugguccuaaucuuaauuuuuuuccaaaaggcagcuugaaauguaccucuguuuuuaauuuuc

SEQ ID NO: 631164 - RNA, 63 nt, Homo Sapiens
uuggccagguuccaugaccaucagcuuaggcgugcuugaaaccggggugacuuuaguuuuucu

SEQ ID NO: 631165 - RNA, 63 nt, Homo Sapiens
cuaaacugcaaacauuuucacacccaccaugcugcuugaaagccacuugauccucaacauaua

SEQ ID NO: 631166 - RNA, 63 nt, Homo Sapiens
accagugacuucagagccuauggucucaacugugcuugaaaaacacugucucugaaaacaacu

SEQ ID NO: 631167 - RNA, 63 nt, Homo Sapiens
uuaagccagacugaccacuugcuuggagugugugcuugaaaaaaccagagcaauacuguuggg

SEQ ID NO: 631168 - RNA, 63 nt, Homo Sapiens
gucccaggacaggaaugcgguucaaacccaguggcuugaaacuuccugagaaacuguagcaua

SEQ ID NO: 631169 - RNA, 63 nt, Homo Sapiens
cucucuugacagggagcucaucuucuacccauugcuugaaaaugcaacacuccugccaagugg

SEQ ID NO: 631170 - RNA, 63 nt, Homo Sapiens
auaggggagauuaaauauuaaacacaaauucuggcuugaaaaacuguucacuugauuaguuga

SEQ ID NO: 631171 - RNA, 63 nt, Homo Sapiens
acaucuauccccuccucccccauacacaccuaggcuugaaaugcccuacaggcccagaacuuu

SEQ ID NO: 631172 - RNA, 63 nt, Homo Sapiens
gaauguuugggaaugagaggaugagugagugaggcuugaaaacacaccacauugaaaauccug

SEQ ID NO: 631173 - RNA, 63 nt, Homo Sapiens
aauugcgccgcuccuggagaccugauaacuuaggcuugaaauaauugacuugucuaaaaggac

SEQ ID NO: 631174 - RNA, 63 nt, Homo Sapiens
gaagcauuuuuaacuggguagaaucugacuguggcuugaaauaaaaagcucucagaaaacuca

SEQ ID NO: 631175 - RNA, 63 nt, Homo Sapiens
cccacccccuuuaggaaccaggcugguguucuugcuugaaagcguugugcccucugagugucu

SEQ ID NO: 631176 - RNA, 63 nt, Homo Sapiens
cguggcgcuuucugcaguuuccgaaggugaggagcuugaaaccgggaaggauagggugauguu

SEQ ID NO: 631177 - RNA, 63 nt, Homo Sapiens
acaaaccuuuuggguuaaaauccucugcaaugugcuugaaaacuguuaauucuaaauccuuga

SEQ ID NO: 631178 - RNA, 63 nt, Homo Sapiens
uuuaguuuuccuuauuaaugauucagaguugaugcuugaaaacgucagauuagggucucugcc

SEQ ID NO: 631179 - RNA, 63 nt, Homo Sapiens
aacccaacucuuugcugcacguguccuuuagaagcuugaaagggagcucuguuacagcccacu

SEQ ID NO: 631180 - RNA, 63 nt, Homo Sapiens
uaacacuuuucacuugguucgaugugaucagaugcuugaaauugcuuuaccuggucaccaugu

SEQ ID NO: 631181 - RNA, 63 nt, Homo Sapiens
ucugacagcuuuucuacuuuaaggcuggcgacagcuugaaaagaauuagagaaacagaagucc

SEQ ID NO: 631182 - RNA, 63 nt, Homo Sapiens
ucgcuuaagaucacaggcuuagugugaggacgagcuugaaaucccagucuccuggcccccagg

SEQ ID NO: 631183 - RNA, 63 nt, Homo Sapiens
guacauggguacaauccgagggugugaauuucagcuugaaauuccauugcuguuccuuguuuu

SEQ ID NO: 631184 - RNA, 63 nt, Homo Sapiens
guucaucucugaaacccagcauccuuuucagcugcuugaaaacauuguauuuuuuuuuuuuaa

SEQ ID NO: 631185 - RNA, 63 nt, Homo Sapiens
ugacaaggaaggaguugagcccuggguaggcuugcuugaaaagugaguccuuccagaauauuc

SEQ ID NO: 631186 - RNA, 63 nt, Homo Sapiens
aggaaagggucuuagucacugccucccgaaguugcuugaaagcacucggagaauugugcaggu

SEQ ID NO: 631187 - RNA, 63 nt, Homo Sapiens
cugcccagugucagaacaguuauacaaacgagggcuugaaaacauuuugugaaaacuugcuua

SEQ ID NO: 631188 - RNA, 63 nt, Homo Sapiens
acgauggugccucugggucaauggaaauaaacugcuugaaaagagucaacauuagaacugaaa

SEQ ID NO: 631189 - RNA, 63 nt, Homo Sapiens
uauaguuugaaauuaugacauauuacuaucuaggcuugaaauaugcacaguccauucuguuuu

SEQ ID NO: 631190 - RNA, 63 nt, Homo Sapiens
uugcuaaacguaaauuuguaugagauuuauggugcuugaaaugcuaaauguccaaaaagaaca

SEQ ID NO: 631191 - RNA, 63 nt, Homo Sapiens
caggagaauucauacuggaggucacaaaucacagcuugaaagaagacugugacaaaguuguca

SEQ ID NO: 631192 - RNA, 63 nt, Homo Sapiens
aacgcuccccucagacacccugucccaucgguagcuugaaauacugggaagccugggaguguu

SEQ ID NO: 631193 - RNA, 63 nt, Homo Sapiens
ggaagccuugccuucccgcuucuacaugcuugagcuugaaaagcagucaccuccucggggacc

SEQ ID NO: 631194 - RNA, 63 nt, Homo Sapiens
cuguuucaaugaccuuuauuuuaaaaacacauagcuugaaaauuuauuuuuauacugauauua

SEQ ID NO: 631195 - RNA, 63 nt, Homo Sapiens
uagcugaacaaaaaugugcaguuaauacuuggcgcuugaaaaugcaguagugaauguggaacc

SEQ ID NO: 631196 - RNA, 63 nt, Homo Sapiens
uaaggucuucuuguguccugaugaaaaauaugugcuugaaaugagaaacuuugaucucugcuu

SEQ ID NO: 631197 - RNA, 63 nt, Homo Sapiens
uaugagaaaaguugcuugaaauuugcaaaggaagcuugaaaaauuucuaauagccuuggguuu

SEQ ID NO: 631198 - RNA, 63 nt, Homo Sapiens
uuucagaaccucuuccccaguuucugccagggagcuugaaaguuuagccucccugaaaauguu

SEQ ID NO: 631199 - RNA, 63 nt, Homo Sapiens
uugcuguacuauagagcucauuuucuggaaacugcuugaaaucgaaaaugucguuguuguugu

SEQ ID NO: 631200 - RNA, 63 nt, Homo Sapiens
cuacauuuccaaggugaagauacccugacuaaagcuugaaaugaaaguaaagaaggaauaauc

SEQ ID NO: 631201 - RNA, 63 nt, Homo Sapiens
uugugacuaaauugcacaauacacugaauuuuggcuugaaauacgguaucuuuuaauauaaga

SEQ ID NO: 631202 - RNA, 63 nt, Homo Sapiens
uaaggaauggcaucagaacaauagcuuggaauggcuugaaaucacaaaggaucugcaagauga

SEQ ID NO: 631203 - RNA, 63 nt, Homo Sapiens
gaaaacugcagcauaucagacagcaauuuaacagcuugaaacaucuacagauaguuccuacua

SEQ ID NO: 631204 - RNA, 63 nt, Homo Sapiens
cuuagcuacucaggaggcugaggcaggagaaucgcuugaaaacaggagguggagguugcagug

SEQ ID NO: 631205 - RNA, 63 nt, Homo Sapiens
cuaggaaucauauguuguccaucccccccucaggcuugaaaguccucaaagagacccacuauc

SEQ ID NO: 631206 - RNA, 63 nt, Homo Sapiens
uguuaaaaauguucauaacacuuaucagcuguugcuugaaaccauaucuuaagagaugaauac

SEQ ID NO: 631207 - RNA, 63 nt, Homo Sapiens
aaguuggaggcaaauugauauggagauuguuacgcuugaaauuuaaacaagaauaauaaaggu

SEQ ID NO: 631208 - RNA, 63 nt, Homo Sapiens
uugcugaaauguucucauuuucaucucuugcuugcuugaaaucgucaccugaacaaugaccca

SEQ ID NO: 631209 - RNA, 63 nt, Homo Sapiens
ucuuuuuucuauauacagaaauguuacuccuaagcuugaaagcauuuauuguuuugguauuuc

SEQ ID NO: 631210 - RNA, 63 nt, Homo Sapiens
cugugccagauggagccuuugagcccacacaaagcuugaaagcgggagaagcuauagaaagag

SEQ ID NO: 631211 - RNA, 63 nt, Homo Sapiens
cauccaagggugcacagggaguuacccucauuggcuugaaaaguggcuccugccaccacaaau

SEQ ID NO: 631212 - RNA, 63 nt, Homo Sapiens
acugaauugagaaauacuucuucaaguuaugaugcuugaaaguucucaauaaaguucacgguu

SEQ ID NO: 631213 - RNA, 63 nt, Homo Sapiens
uaaauuuacacuauuuauaaauacauauuuauugcuugaaaauauuugugaauggaaugcugu

SEQ ID NO: 631214 - RNA, 63 nt, Homo Sapiens
cauauagcuauagauauaggcuuuuccuugaaagcuugaaaaaaauucgccaguaaaauaauc

SEQ ID NO: 631215 - RNA, 63 nt, Homo Sapiens
ugaaaccaauaugguuuucuuuaugucuuggcugcuugaaaauuaaaaaaaaaaaagguuugu

SEQ ID NO: 631216 - RNA, 63 nt, Homo Sapiens
cccaaaggaucuguacuuucuuuccuuacaacagcuugaaaaucauuauuuuaaaauccuuaa

SEQ ID NO: 631217 - RNA, 63 nt, Homo Sapiens
aauuuguuauguuuaaggaaauuaagauuuuaagcuugaaauuauacaagcagaaucuaauuu

SEQ ID NO: 631218 - RNA, 63 nt, Homo Sapiens
gugcuaccaguuugcugguggcuaacggcuugugcuugaaagucuucugaagucugaugugaa

SEQ ID NO: 631219 - RNA, 63 nt, Homo Sapiens
gcaugcauguugaaauuuuuuagcaguacuuuagcuugaaaguacucguacaaauacuguuag

SEQ ID NO: 631220 - RNA, 63 nt, Homo Sapiens
uagaaguaaugauauacaguuuucuuccuaguggcuugaaaaucuggacuuccucaauuauua

SEQ ID NO: 631221 - RNA, 63 nt, Homo Sapiens
gaaaagcaaucaauuauaccaaauuuugaaugugcuugaaagucaccauucuucuuuuguaau

SEQ ID NO: 631222 - RNA, 63 nt, Homo Sapiens
auuuagcauuugaauaguaaauaccuuauuaaagcuugaaaacuugguacuuggaauugauau

SEQ ID NO: 631223 - RNA, 63 nt, Homo Sapiens
gauuagcauacaucuaauguuugaaguuugacugcuugaaaaaaguaaauaaaacaguguauu

SEQ ID NO: 631224 - RNA, 63 nt, Homo Sapiens
aaaaguucaugaaguaccaagaaacaaauauuugcuugaaaaaaacugucagaauuguuaacu

SEQ ID NO: 631225 - RNA, 63 nt, Homo Sapiens
ucaauaaacuuugcucuguuuuuuccaaauguagcuugaaauuuuccaggauuuggauuuuga

SEQ ID NO: 631226 - RNA, 63 nt, Homo Sapiens
uucucaucucagaauacuuuugucagauauugugcuugaaagauuaaaaucauguauuuaaug

SEQ ID NO: 631227 - RNA, 63 nt, Homo Sapiens
acuggagcacguggucagggaagggcacucgcugcuugaaaguuaugaguuacuguggggucc

SEQ ID NO: 631228 - RNA, 63 nt, Homo Sapiens
cuugucgucacagcuggcaugggcuggacaguugcuugaaaugaccuaaccaaaaacauucaa

SEQ ID NO: 631229 - RNA, 63 nt, Homo Sapiens
auucacugacgaauucagagauugagggcacuugcuugaaaucaaggugcuccaacuuaguuu

SEQ ID NO: 631230 - RNA, 64 nt, Homo Sapiens
cccaaaacaucagcauuucuaaaauaguccuaaagcuugaaaguaaguugcuuccaugagcaug

SEQ ID NO: 631231 - RNA, 64 nt, Homo Sapiens
ucuuucacuaccuuucuuacccuuaaugugccaagcuugaaacaggauuugauuuccugagcua

SEQ ID NO: 631232 - RNA, 64 nt, Homo Sapiens
uugccucacucucuccaguugguuuucagcuggggcuugaaaugcauuuuuagcccuuugacgu

SEQ ID NO: 631233 - RNA, 64 nt, Homo Sapiens
aauaguguauuauuaucguuggggcuggcucuaugcuugaaaaccaguuuauuuauaaccuguu

SEQ ID NO: 631234 - RNA, 64 nt, Homo Sapiens
auuuuuucauaguuucauuuguucuugcccacaagcuugaaauccagguuaagguauccagccu

SEQ ID NO: 631235 - RNA, 64 nt, Homo Sapiens
uguugcugggggccgauucugaucaagacacauggcuugaaaauggaagacacaaaacugagag

SEQ ID NO: 631236 - RNA, 64 nt, Homo Sapiens
aaauauauaaaugcuucagaugucaaauacccaugcuugaaagcucguguaauuuacuuuaaga

SEQ ID NO: 631237 - RNA, 64 nt, Homo Sapiens
ugcuaaacuuuauauaaugugugguuucaauucagcuugaaaaauaaucucacuacauguagca

SEQ ID NO: 631238 - RNA, 64 nt, Homo Sapiens
cuguuccccacuccacaggagggagcugacguuggcuugaaaggaguaaagucaacaucugcug

SEQ ID NO: 631239 - RNA, 64 nt, Homo Sapiens
aguucuauagccuucucuugcaguauuuggauuugcuugaaaccgggaaaacuguucccauuag

SEQ ID NO: 631240 - RNA, 64 nt, Homo Sapiens
aguaucgguuuuauucuuugcugauguccuuucugcuugaaauaacagucaccauacagcuaaa

SEQ ID NO: 631241 - RNA, 64 nt, Homo Sapiens
gauuacugucucuugaacaguugcaaucuuggcagcuugaaaauggugcuacacucuguuuugu

SEQ ID NO: 631242 - RNA, 64 nt, Homo Sapiens; identical to SEQ ID NO: 190819

SEQ ID NO: 631243 - RNA, 64 nt, Homo Sapiens; identical to SEQ ID NO: 190820

SEQ ID NO: 631244 - RNA, 64 nt, Homo Sapiens
agucccacuggcuggccucaggcugucuuauuccgcuugaaaauagccaaaaagucuacugugg

SEQ ID NO: 631245 - RNA, 64 nt, Homo Sapiens
acaaugaaauuauauuuucuuuguaaagaaaguggcuugaaaucuuuuuuguucaaagauuaau

SEQ ID NO: 631246 - RNA, 64 nt, Homo Sapiens
cguccgaaggcauucuuguuccucugaggucugugcuugaaagcuuuccaaagaagagucgagu

SEQ ID NO: 631247 - RNA, 60 nt, Homo Sapiens; identical to SEQ ID NO: 630940

SEQ ID NO: 631248 - RNA, 64 nt, Homo Sapiens
cuggcuuuaggaugguucugagggagguggucaagcuugaaaaagugugccuucagggaggaag

SEQ ID NO: 631249 - RNA, 64 nt, Homo Sapiens
aucacacaggacacuuuucuagaauuggaaacgugcuugaaacacguccagcagacacugaacc

SEQ ID NO: 631250 - RNA, 64 nt, Homo Sapiens
agcccaggaaaccagagcagcuggaggugguggggcuugaaaugcaacacugucaagguggaga

SEQ ID NO: 631251 - RNA, 64 nt, Homo Sapiens
agaggggugauuuucaauggccugcagaguaaaugcuugaaaaagaggcaagaugagauggcag

SEQ ID NO: 631252 - RNA, 64 nt, Homo Sapiens
cauuauuuugaaugugaagugccgugaugcucaggcuugaaaugaaaacacuaguuuugugcca

SEQ ID NO: 631253 - RNA, 64 nt, Homo Sapiens
gacagauaaguauugcccaggcuccagggccugugcuugaaaagauuuuauguuguugacucug

SEQ ID NO: 631254 - RNA, 64 nt, Homo Sapiens
auuacagaucaugauaccuaaguaucuguuuuaugcuugaaagcauguuuuauaucuuaauucu

SEQ ID NO: 631255 - RNA, 64 nt, Homo Sapiens
ggcaagauuaacaaaauuaguuuuugugucaauggcuugaaacuuucuuaauauggugcugaug

SEQ ID NO: 631256 - RNA, 64 nt, Homo Sapiens
cuaugucugcaugauaauuuuagaccauagcauggcuugaaaugaaaaauuaaaauccuugaca

SEQ ID NO: 631257 - RNA, 64 nt, Homo Sapiens
aacacaucgcaucuacauuucauuggaaacaaaagcuugaaagaaagaaaaccuaaacuaaugu

SEQ ID NO: 631258 - RNA, 64 nt, Homo Sapiens
gucucucucccauggagaacaaaaagauaugacugcuugaaauaaacucacaaaacauuuugcu

SEQ ID NO: 631259 - RNA, 64 nt, Homo Sapiens
uguacaggugucaccaucauuggcuauggagagggcuugaaauguggauauucaagccuuugga

SEQ ID NO: 631260 - RNA, 64 nt, Homo Sapiens
augaugauauaaaggcuggaagccuccuccuguugcuugaaauagaaugagcuaagcaaggcug

SEQ ID NO: 631261 - RNA, 64 nt, Homo Sapiens
guuuccuuuacucauguugauaaaaacugucagugcuugaaacuauucuuugaauagucacucg

SEQ ID NO: 631262 - RNA, 64 nt, Homo Sapiens
gcgcagagcccuauaccucauugauugaaggaaagcuugaaaaguauuccccugccuuccuggc

SEQ ID NO: 631263 - RNA, 64 nt, Homo Sapiens
agccaggguguaaucuuguuagccucgauccagggcuugaaagacggaguuucaaaaacugaug

SEQ ID NO: 631264 - RNA, 64 nt, Homo Sapiens
ucugccugauguggcuccuuuccuccauuccauggcuugaaacccugcuccucucugccgccuu

SEQ ID NO: 631265 - RNA, 64 nt, Homo Sapiens
acaaaaguuuugcuggcacgccuacaaagaccuugcuugaaaccauaaaaugagaaacuuuuuu

SEQ ID NO: 631266 - RNA, 64 nt, Homo Sapiens
uucacuuaggaacguaaucgcccugcaaagcccagcuugaaaccgugaccauacuaauuauacc

SEQ ID NO: 631267 - RNA, 64 nt, Homo Sapiens
uuucaaauuuucagaaaggggcagaaaagaaagugcuugaaagaauauugugugcaaaggaugg

SEQ ID NO: 631268 - RNA, 64 nt, Homo Sapiens
gaugaagaaugucucuagaauuaaugacaauguagcuugaaagcaaaauuucacaagacuuauu

SEQ ID NO: 631269 - RNA, 64 nt, Homo Sapiens
gcguugguaucuucauuuuaggcuuugcuguaaugcuugaaaagcacuuggcucugaacauacu

SEQ ID NO: 631270 - RNA, 64 nt, Homo Sapiens
ucuaugcauccgauucuuaacaaaacugcagggagcuugaaaaaaugcagacuguacaaacgcu

SEQ ID NO: 631271 - RNA, 64 nt, Homo Sapiens
ucagaaaaugcaucccugauuucauucauuuccagcuugaaagccagccauauuacucuagucc

SEQ ID NO: 631272 - RNA, 64 nt, Homo Sapiens
uauaaauacaguaaguuuagauuauugaauuggugcuugaaauuuauugguuuuguuguaauuu

SEQ ID NO: 631273 - RNA, 64 nt, Homo Sapiens
uguaauagugaaaccuguacucaaaauauaagcagcuugaaacuggcuuuaccaaucuugaaau

SEQ ID NO: 631274 - RNA, 64 nt, Homo Sapiens
uaaucauaacuguuaauucucagccaucuuugaagcuugaaagaagagucuuugguauuuugua

SEQ ID NO: 631275 - RNA, 64 nt, Homo Sapiens
guuaguguccgaagaccgaauuuuauuuuacagagcuugaaaacucacuucaaugaacaaaggg

SEQ ID NO: 631276 - RNA, 64 nt, Homo Sapiens
auagcauaaagcuaggggaugcauggaaauagcagcuugaaacuaggagguaacaagaaagcuu

SEQ ID NO: 631277 - RNA, 64 nt, Homo Sapiens
guaaugggucuuggaguauagauuuuuauuaguagcuugaaagagcuuaaucauaugcaguaag

SEQ ID NO: 631278 - RNA, 64 nt, Homo Sapiens
agcacaucccgcugcagagggcauucccuuuaaggcuugaaaaugccuccuguagucccaaacc

SEQ ID NO: 631279 - RNA, 64 nt, Homo Sapiens
gaggacuugggcgggacacaggcuccaaacuggagcuugaaauagugucugaugaauguuaaau

SEQ ID NO: 631280 - RNA, 64 nt, Homo Sapiens
agccagggggacuagccccuguggagacuggggggcuugaaauuguccccguggucucuuacuu

SEQ ID NO: 631281 - RNA, 64 nt, Homo Sapiens
cagacuauagcauauuagcuguuuagaagggauggcuugaaaggaaggagacugaaaaacacuc

SEQ ID NO: 631282 - RNA, 64 nt, Homo Sapiens
cuaacuuuuuuuuacuuauaugcugggauuacaggcuugaaaguccugccucagccucccaaag

SEQ ID NO: 631283 - RNA, 64 nt, Homo Sapiens
uugauacauauuggaauacaguucaaaaugaccugcuugaaacuauugugauuucuuauuugag

SEQ ID NO: 631284 - RNA, 64 nt, Homo Sapiens
auauaaaaucuuccuguccucuguacuaauuggggcuugaaaguuuuuauauacuuucaauuag

SEQ ID NO: 631285 - RNA, 64 nt, Homo Sapiens
uucagagaauuuugucuuccaauauguuaaauuggcuugaaauuaucgugaaagguacauuuaa

SEQ ID NO: 631286 - RNA, 64 nt, Homo Sapiens
auuuccucuauaucaugccuggaaaaaccccugugcuugaaaauugugauacauuuaagccacu

SEQ ID NO: 631287 - RNA, 64 nt, Homo Sapiens
acugcuguguuaagcuguucuaguauuguuaccugcuugaaaaccuuccuauuuuuuuuuccag

SEQ ID NO: 631288 - RNA, 64 nt, Homo Sapiens
gagaugugaacacaucagcuuagugaaagaggcagcuugaaacuaaaaaaaauacugauguucc

SEQ ID NO: 631289 - RNA, 64 nt, Homo Sapiens
uacagaauguuuugaaagugugcgguucugaguggcuugaaaugucacauuuguagaaauguaa

SEQ ID NO: 631290 - RNA, 64 nt, Homo Sapiens
gagugaguaccucagagaaauucugauauacauugcuugaaaauguuguuauaaaacauucaaa

SEQ ID NO: 631291 - RNA, 64 nt, Homo Sapiens
aaagcuucagauaaacuugcguugugacugaaaugcuugaaaccggcacuccucaauugggagu

SEQ ID NO: 631292 - RNA, 64 nt, Homo Sapiens
aaaauacuuacaauaguagcgaaaaaauguaugugcuugaaaguccgaaaagaaugaaaacaga

SEQ ID NO: 631293 - RNA, 64 nt, Homo Sapiens
ugcucuacauuaugaccaauuauaauauaauuuagcuugaaagaauugaguaucauguaauaau

SEQ ID NO: 631294 - RNA, 61 nt, Homo Sapiens; identical to SEQ ID NO: 630987

SEQ ID NO: 631295 - RNA, 64 nt, Homo Sapiens
auaaagcucauuugguuuaggccugggguguucagcuugaaagaagcaaagcuaauuugccuuu

SEQ ID NO: 631296 - RNA, 64 nt, Homo Sapiens
aaaacuucuuucccuaccauauauucucuuaaaagcuugaaaauaaaacucucuguuguuugua

SEQ ID NO: 631297 - RNA, 64 nt, Homo Sapiens
aucucagacccaaggcaccuggaagaacuuguuugcuugaaagugccaccgugggacaucaagu

SEQ ID NO: 631298 - RNA, 64 nt, Homo Sapiens
caauucuuauaugaaauuuuaguucuggcuuccugcuugaaaccauuuaagaaccagaggcaga

SEQ ID NO: 631299 - RNA, 64 nt, Homo Sapiens
uguuuggggcuugauagagugugaaagguguguugcuugaaagguguggccuuagacacuagga

SEQ ID NO: 631300 - RNA, 64 nt, Homo Sapiens
aauagaugugugggugaagccauagaacauauuugcuugaaauucuugagcagggaucuuauaa

SEQ ID NO: 631301 - RNA, 64 nt, Homo Sapiens
ucaguuaaacacugcugcaauauuucaguguugugcuugaaaauauguacaguuuuuuuccaau

SEQ ID NO: 631302 - RNA, 64 nt, Homo Sapiens
auaagaggcugauaauuccagugguccauggaaugcuugaaaaaugugcaaaacagcguuuaag

SEQ ID NO: 631303 - RNA, 64 nt, Homo Sapiens
uugcauauucuuauguaugugaaaguuacaaauugcuugaaagaaaauaugcaucuaauaaaaa

SEQ ID NO: 631304 - RNA, 64 nt, Homo Sapiens
aaugggaccgcaagugguaggcagugucccuucugcuugaaaccuauugaaaccaauuuaaaac

SEQ ID NO: 631305 - RNA, 64 nt, Homo Sapiens
ggaauuuugugagacaguugucaaauuguugcuagcuugaaaucugcggcaauuggaguauuua

SEQ ID NO: 631306 - RNA, 64 nt, Homo Sapiens
cggcagcacauauacuaaaaauuaauaagacccagcuugaaaauugagccugauaacaagauua

SEQ ID NO: 631307 - RNA, 64 nt, Homo Sapiens
uuugugaaugaauaaauuacuaauccuccuugucgcuugaaaccuucccacacucccugcucca

SEQ ID NO: 631308 - RNA, 64 nt, Homo Sapiens
cauuucugcucaaccacacauucucuaagaaacagcuugaaagcucugucugggucauucauuu

SEQ ID NO: 631309 - RNA, 64 nt, Homo Sapiens
ccaagaacacuuuaaggaaacauuuuacaaguaugcuugaaagaaugucacuaacugguccaga

SEQ ID NO: 631310 - RNA, 64 nt, Homo Sapiens
auuuagguauaauaucaucuugucuuugacuagagcuugaaaccuuguuaucugauuguguacc

SEQ ID NO: 631311 - RNA, 64 nt, Homo Sapiens
aaccuuacaaggcucuaaaaugagaugugauauggcuugaaaugggaggagacacuuucugaca

SEQ ID NO: 631312 - RNA, 64 nt, Homo Sapiens; identical to SEQ ID NO: 190821

SEQ ID NO: 631313 - RNA, 64 nt, Homo Sapiens; identical to SEQ ID NO: 190822

SEQ ID NO: 631314 - RNA, 64 nt, Homo Sapiens
aucccuggggauucugaagguacucaacuagaaagcuugaaaacaagugaacuugguuugaucu

SEQ ID NO: 631315 - RNA, 64 nt, Homo Sapiens
uuuuuuuuuaaugacugugcgaauuauauguauagcuugaaaagaugcuagcucaauuaguuuu

SEQ ID NO: 631316 - RNA, 64 nt, Homo Sapiens
cuagucuguuugugaaagauugaaauaccuaauggcuugaaauuauaacgcacgguacuguucu

SEQ ID NO: 631317 - RNA, 64 nt, Homo Sapiens
ugcacuuagcacuuugguucuauucagaacagaugcuugaaauaacuuacuguggcuuuaaaca

SEQ ID NO: 631318 - RNA, 64 nt, Homo Sapiens
gcacagcccaaauaaaacaaaaaucuagucaguugcuugaaagaacaaacauucuguugaaggg

SEQ ID NO: 631319 - RNA, 64 nt, Homo Sapiens
uauagacaaucuuuaauguauuauuuauaaaaaggcuugaaaaaaacacaauaaccaaaagcuu

SEQ ID NO: 631320 - RNA, 64 nt, Homo Sapiens
aauguauguccucucuguaauuguuuuaaugugugcuugaaauauccagaaaaccuauggaguu

SEQ ID NO: 631321 - RNA, 64 nt, Homo Sapiens
guguuguucugagcagggggacaggauugaugaggcuugaaagagcccacugagccacucucug

SEQ ID NO: 631322 - RNA, 64 nt, Homo Sapiens
ugaggugcaaaacauagauauagaacugaacagggcuugaaacaauauuaggauuacuacccag

SEQ ID NO: 631323 - RNA, 64 nt, Homo Sapiens
cucacucaaacauagcugacuuccuauugguacagcuugaaaagcacuuuuuacuacauacaca

SEQ ID NO: 631324 - RNA, 64 nt, Homo Sapiens
uauggugcucuugucuucuuuguuugugacccaugcuugaaaacuugaaggaaguuagauauga

SEQ ID NO: 631325 - RNA, 63 nt, Homo Sapiens; identical to SEQ ID NO: 631018

SEQ ID NO: 631326 - RNA, 64 nt, Homo Sapiens
acuucaaggaagacucuacaagcuuuuguucacagcuugaaauagaugccucacaauucagaca

SEQ ID NO: 631327 - RNA, 64 nt, Homo Sapiens
ugcugccauuugcuauaaaguugaacuuuguauggcuugaaaaagaaaugacaauauggaacau

SEQ ID NO: 631328 - RNA, 64 nt, Homo Sapiens
uaacugucccauuguaaagguguaaguuauauaggcuugaaaaaaauuggcggguaaaaaucac

SEQ ID NO: 631329 - RNA, 64 nt, Homo Sapiens
caguuaguugauaacauaaacauuugauuacccugcuugaaauaauuuguuuuuucuugcuuuu

SEQ ID NO: 631330 - RNA, 64 nt, Homo Sapiens
uacgguagagauacuuagcuaaguaauggaucuggcuugaaaaaauaagggacuuuuauuugua

SEQ ID NO: 631331 - RNA, 64 nt, Homo Sapiens
uuugcucaaguuuauuuaugauauauauccucuagcuugaaacuaaauauauaauuuucuauac

SEQ ID NO: 631332 - RNA, 64 nt, Homo Sapiens
ccuagaugaaguuuagauuucugucaaaugaaaggcuugaaauaauuguauuauaaugaugauu

SEQ ID NO: 631333 - RNA, 64 nt, Homo Sapiens
gaauuuuagcagaugguacuaugauggaagaagugcuugaaagaccauaucucaccucuaggau

SEQ ID NO: 631334 - RNA, 64 nt, Homo Sapiens
aggaggcagagguugcaguggagacagaagaacugcuugaaaccucccagcuacucgggaggcu

SEQ ID NO: 631335 - RNA, 64 nt, Homo Sapiens
aaaaaaaaaaaagaaaguaauuuuaaacucacuggcuugaaaugugugcuuucuguacaaugaa

SEQ ID NO: 631336 - RNA, 64 nt, Homo Sapiens
uuuuuuuauuucaauauauacaguuugaugaugugcuugaaauuggugcaaauauauacacacc

SEQ ID NO: 631337 - RNA, 64 nt, Homo Sapiens
cuucagaauaagcuuccccaccccaguuuuuguugcuugaaaauauuguugucccggauuuuug

SEQ ID NO: 631338 - RNA, 64 nt, Homo Sapiens
ggagacgcagguugcaguggacauugggauuguugcuugaaaaauuaaaauuugaauauuuucu

SEQ ID NO: 631339 - RNA, 64 nt, Homo Sapiens
uuuugaagucuucccuugacccuaguaaaauauagcuugaaacuuguaaacaacuguguuugcc

SEQ ID NO: 631340 - RNA, 64 nt, Homo Sapiens
aaaaugcuuguccccuauaugaauauucuguuacgcuugaaaaauauuuucuccagcguugguu

SEQ ID NO: 631341 - RNA, 64 nt, Homo Sapiens
gaggaauaaagccaaggggagugagaugaggugggcuugaaaguaccuuguccgcucagaagga

SEQ ID NO: 631342 - RNA, 64 nt, Homo Sapiens
cccaggguauccaccugcaccccacucccaaguagcuugaaaaagggaggacagucuuucccca

SEQ ID NO: 631343 - RNA, 64 nt, Homo Sapiens
uauaauacacauaaauaaaaccaacuuauuagcugcuugaaaaagaauuaaauauuauguccua

SEQ ID NO: 631344 - RNA, 64 nt, Homo Sapiens
aguuaaacugauuaguauucuuuaaaaauauauagcuugaaagcgacuguauguuuuaauugca

SEQ ID NO: 631345 - RNA, 64 nt, Homo Sapiens
aaauaucucugaccaacuucuuugcuuguugugugcuugaaagauugguguguauuggccaagu

SEQ ID NO: 631346 - RNA, 64 nt, Homo Sapiens
ucccaugcaagagaguaguucccauaguaaaacagcuugaaauaauuuuggucccugcuccuug

SEQ ID NO: 631347 - RNA, 64 nt, Homo Sapiens
ugagacacagaggugccagugauggacuggaucagcuugaaagaagcacaaagacuccgugauc

SEQ ID NO: 631348 - RNA, 64 nt, Homo Sapiens
gcugggauugcaaacacuuuuuaaaaaauuguuugcuugaaaauacuacugaauauaaauaaga

SEQ ID NO: 631349 - RNA, 64 nt, Homo Sapiens
guguugcccaccuguucacaaaaaguaccuuuaugcuugaaaacauuagguucuuugguuacug

SEQ ID NO: 631350 - RNA, 64 nt, Homo Sapiens
ggugaauuuuuuuuaaguggcacggucuuuuucugcuugaaaucugaucacaccccccagccau

SEQ ID NO: 631351 - RNA, 64 nt, Homo Sapiens
gcaaggggcaaguuucacccaaaugccugagacugcuugaaagauauauuuuaaguggugcacu

SEQ ID NO: 631352 - RNA, 64 nt, Homo Sapiens
uauucaacugcaaaaucucaaucuugaaaaucaagcuugaaauuucauagguagaaauauuagc

SEQ ID NO: 631353 - RNA, 56 nt, Homo Sapiens; identical to SEQ ID NO: 631046

SEQ ID NO: 631354 - RNA, 64 nt, Homo Sapiens
aagaaucuugcaagacaguuauuaaacauucauagcuugaaauugcccauggugggagaguuua

SEQ ID NO: 631355 - RNA, 64 nt, Homo Sapiens
ucucugaugaaagugaaaaauuaaguacaaggcagcuugaaaccgcagacaaagucaagcagcu

SEQ ID NO: 631356 - RNA, 64 nt, Homo Sapiens
aaaauacguaaucuguuucaaauuaaaauagcaugcuugaaaaaacaugaugagauaucaaggu

SEQ ID NO: 631357 - RNA, 64 nt, Homo Sapiens
auaaagcucucucagguugagaaugacagccuaggcuugaaauuuggagaaaugaagcaaaggu

SEQ ID NO: 631358 - RNA, 64 nt, Homo Sapiens
aggcucuccacaccauugacacuggauuuugaacgcuugaaauccuucuuauaagccagcucug

SEQ ID NO: 631359 - RNA, 64 nt, Homo Sapiens
uuuuguuagggccucaaagauuuccugaacauuugcuugaaauagggaggggugccguuuuuau

SEQ ID NO: 631360 - RNA, 64 nt, Homo Sapiens
gggcugcaucccuauaaaccuaaggagcuccucagcuugaaauggagguaugauuccuaagccc

SEQ ID NO: 631361 - RNA, 64 nt, Homo Sapiens
caaccaaacgccuauuuuuuaaugcuuaguuuuggcuugaaauucuucuucaccuggaguuuuc

SEQ ID NO: 631362 - RNA, 64 nt, Homo Sapiens
uauuuuuacacagguuuucuugucuugacaagaugcuugaaaaaccaagaggauaugaaaaucu

SEQ ID NO: 631363 - RNA, 64 nt, Homo Sapiens
uugugauguuucaaugugagacacaaaaacaauggcuugaaacuuguguaucauaugugauuuu

SEQ ID NO: 631364 - RNA, 64 nt, Homo Sapiens
ugaagguggggacagugaccgcggaccccucugugcuugaaagauuuccuccacggccuuugcc

SEQ ID NO: 631365 - RNA, 64 nt, Homo Sapiens
cuauuagucagaaagaaggagagaaugagugagugcuugaaaugugucauacuguuuuaggauc

SEQ ID NO: 631366 - RNA, 64 nt, Homo Sapiens
uagcugucuccucaucucauccuagucuagguuugcuugaaauugggugugagagcuagaauga

SEQ ID NO: 631367 - RNA, 64 nt, Homo Sapiens
ccaaacuucauauaugucuaucagguaauaauaggcuugaaaauugauauccuguggugcuaaa

SEQ ID NO: 631368 - RNA, 64 nt, Homo Sapiens
ucuuccaaaggcauaagacccuaagccuccuuuugcuugaaaccaaagauauauacacaggauc

SEQ ID NO: 631369 - RNA, 64 nt, Homo Sapiens
uacauugauuauagaaccacuauuacgugaaaaggcuugaaacaaccaacauauacaaauaaaa

SEQ ID NO: 631370 - RNA, 64 nt, Homo Sapiens
uuggccacccucagccucugauugggagggucuggcuugaaaaugcuuugcacaguguauuaac

SEQ ID NO: 631371 - RNA, 64 nt, Homo Sapiens
aaaugcuaauacuuaaguguggaugagcauaagugcuugaaauaguuagacuuuuuaaacucaa

SEQ ID NO: 631372 - RNA, 64 nt, Homo Sapiens
aaaggagaagaugcugugucguuccuguauaacggcuugaaagggcacaguugauuuucggugu

SEQ ID NO: 631373 - RNA, 64 nt, Homo Sapiens
gauuaacuuauacuguagguauuucuauacaguagcuugaaauuauugugcaugcuaguguugu

SEQ ID NO: 631374 - RNA, 64 nt, Homo Sapiens
cgaggugaguucacauaacaggaauucuggaacugcuugaaaacuaggacgauugggcaauauc

SEQ ID NO: 631375 - RNA, 64 nt, Homo Sapiens
acuauuaguacuucccuuugucugugccauaagugcuugaaaacguuaagguuuucuguuuugu

SEQ ID NO: 631376 - RNA, 64 nt, Homo Sapiens
uucucuagcuguucuacaaaacuggagcaugcuggcuugaaaaacccuugcccaguuuugaucc

SEQ ID NO: 631377 - RNA, 64 nt, Homo Sapiens
aauuccagccaaggcaaauucaguuggaucuagggcuugaaaacugcccaagauuaaagagcua

SEQ ID NO: 631378 - RNA, 64 nt, Homo Sapiens
uuuuuuauuugcugucuuugguaauuaucucucugcuugaaauuaaaugcacuauaaguuaaua

SEQ ID NO: 631379 - RNA, 64 nt, Homo Sapiens
uauugcaauuguggucaaauaaggaacguuuccugcuugaaauuauauugauuuaaaugaugug

SEQ ID NO: 631380 - RNA, 64 nt, Homo Sapiens
uuaaaggagguuguucacuuaggcaagaacggcagcuugaaaaaccgcacagcagcgaugcaga

SEQ ID NO: 631381 - RNA, 64 nt, Homo Sapiens
uagagggagagagggagagauuuauuuuuauauagcuugaaacacgcugcucuuaugccauuug

SEQ ID NO: 631382 - RNA, 51 nt, Homo Sapiens; identical to SEQ ID NO: 631075

SEQ ID NO: 631383 - RNA, 64 nt, Homo Sapiens
ucuuguuaugccagaaaguauaggaacaagaugagcuugaaauaauuccaaagcaagggcaagg

SEQ ID NO: 631384 - RNA, 64 nt, Homo Sapiens
ccuuuucauaaaagauaacuacugggcugagagagcuugaaaguuguaaaguuguuucaguuaa

SEQ ID NO: 631385 - RNA, 64 nt, Homo Sapiens
auugaagagggccaaacacuuauaaauucaaagagcuugaaaagcuuaacuuaaaggcauuggu

SEQ ID NO: 631386 - RNA, 64 nt, Homo Sapiens
gcuuauuagaaagccaaaguagaguucuguuuaagcuugaaagagguaugaaguaaucuguagu

SEQ ID NO: 631387 - RNA, 64 nt, Homo Sapiens
ucugaaauuuaaacuugauauuuuucgcccucuugcuugaaaacuucacuugcuuccccauuuc

SEQ ID NO: 631388 - RNA, 64 nt, Homo Sapiens
gggcuugauuuaacauuguuuuuguguuauuuuugcuugaaacaacgcacacauuuucaacaac

SEQ ID NO: 631389 - RNA, 64 nt, Homo Sapiens
aguuuaagagcagaacagaucuuuuacuuuggccgcuugaaaagcuaguguaccuccucucagu

SEQ ID NO: 631390 - RNA, 64 nt, Homo Sapiens; identical to SEQ ID NO: 190823

SEQ ID NO: 631391 - RNA, 64 nt, Homo Sapiens; identical to SEQ ID NO: 190824

SEQ ID NO: 631392 - RNA, 64 nt, Homo Sapiens
ggacaggugggugaggaucugagaaaugcuaaaggcuugaaagcaucugaagacaucuaacuua

SEQ ID NO: 631393 - RNA, 64 nt, Homo Sapiens
gagaaauacaagguugcuugucugaccccaaucugcuugaaaccugacucugcuucucucauuu

SEQ ID NO: 631394 - RNA, 64 nt, Homo Sapiens
ccucuauguucugaauaaagcugccaucaacauugcuugaaaugaggggcugacagcaggcuua

SEQ ID NO: 631395 - RNA, 64 nt, Homo Sapiens
uauuggauuacaugcucacaaauuaugaccaagggcuugaaacauuaaaauauggaaauuuuaa

SEQ ID NO: 631396 - RNA, 64 nt, Homo Sapiens
uugcugaaaaacacaacuugagggaaaacagcuagcuugaaaacuaaacaaugaauucuucaac

SEQ ID NO: 631397 - RNA, 64 nt, Homo Sapiens
aaccuggagucgggggcacacugguguggcuucagcuugaaagcgccacccucagcucuuuccu

SEQ ID NO: 631398 - RNA, 64 nt, Homo Sapiens
aaauaccaaggaacaggaaaaaaacauggccuuugcuugaaagacauugaaagggaguauuaca

SEQ ID NO: 631399 - RNA, 57 nt, Homo Sapiens; identical to SEQ ID NO: 631092

SEQ ID NO: 631400 - RNA, 64 nt, Homo Sapiens
ggguuuggggaaggacaguguggugugacuauuggcuugaaacguuauggauaugguuggaguc

SEQ ID NO: 631401 - RNA, 64 nt, Homo Sapiens
ccauauaaauguggaggcuaucaacaaagaaugggcuugaaacauuauaaaaauugacaaugau

SEQ ID NO: 631402 - RNA, 64 nt, Homo Sapiens
ucccagcuccucaggaggcugaggcaggagaauugcuugaaaccaggaggcggagguugcagug

SEQ ID NO: 631403 - RNA, 64 nt, Homo Sapiens
ugaacuguuggacuggguagaaaucuuucaagaagcuugaaaauaaggccauaaaggaggggcu

SEQ ID NO: 631404 - RNA, 64 nt, Homo Sapiens
gggacccucauuucuucugacagauuucagucuggcuugaaauuuggggauguuaaugaggguc

SEQ ID NO: 631405 - RNA, 64 nt, Homo Sapiens
uagucuggagaaaacuggaucaucaugcauaguagcuugaaaucuuacaugguuacauguucua

SEQ ID NO: 631406 - RNA, 64 nt, Homo Sapiens
gcagaagaaauucacaggaagccauucuuuuuaagcuugaaacuuacaguguucuggaaaagau

SEQ ID NO: 631407 - RNA, 64 nt, Homo Sapiens
aaaacauauccacaacauugccacuguucugaaggcuugaaaacaaguggcccaucauucauac

SEQ ID NO: 631408 - RNA, 64 nt, Homo Sapiens
auaaauuauaucaauuuccucaggcccacaguaugcuugaaaagugucuuuuuacugcaaccca

SEQ ID NO: 631409 - RNA, 64 nt, Homo Sapiens
uaaucuauagacggccccacuuuauuguuugcuugcuugaaaccugcucgggagagcugagggu

SEQ ID NO: 631410 - RNA, 64 nt, Homo Sapiens
uuuguaugaauuauuuugucucuacagcagugaugcuugaaauucccacugagcuggaggaaua

SEQ ID NO: 631411 - RNA, 64 nt, Homo Sapiens
aaauuuuaucaggcuaccaauuuaaagcgauuuagcuugaaauuacuuucuaucuucauaacca

SEQ ID NO: 631412 - RNA, 64 nt, Homo Sapiens
gcuuuuccuuuucuacucuuccuuacuuucucuugcuugaaacuuccccucccuguccgccucu

SEQ ID NO: 631413 - RNA, 64 nt, Homo Sapiens
cuuccccucuccagguucgguuuaugugguuccugcuugaaaacaggcgugaguuuuaggugaa

SEQ ID NO: 631414 - RNA, 64 nt, Homo Sapiens
cauaaaauaaucauuuuugaaccuguguaauaaagcuugaaagcagggaaaagaauuuccuuuu

SEQ ID NO: 631415 - RNA, 64 nt, Homo Sapiens; identical to SEQ ID NO: 190825

SEQ ID NO: 631416 - RNA, 64 nt, Homo Sapiens; identical to SEQ ID NO: 190826

SEQ ID NO: 631417 - RNA, 64 nt, Homo Sapiens
caauaccuuaauggugguagagccuuuaccuguagcuugaaaggggaaagauuggagguaagag

SEQ ID NO: 631418 - RNA, 64 nt, Homo Sapiens
gguaggaauccaggaugcuuaguuucuagacccugcuugaaaguucuagagccuuugaaaggga

SEQ ID NO: 631419 - RNA, 64 nt, Homo Sapiens
ucguaaagccauauguucuguucaagucuuguuugcuugaaaugauuauuccuacaagugaaac

SEQ ID NO: 631420 - RNA, 64 nt, Homo Sapiens
cugaagacaacaccugcuucaggggaacacaggcgcuugaaaaagaaaagagagaacagcccau

SEQ ID NO: 631421 - RNA, 64 nt, Homo Sapiens
uucaaaauaugagacuaugcuauaggcagugcuugcuugaaaagucucauuuuuaaaucucccu

SEQ ID NO: 631422 - RNA, 64 nt, Homo Sapiens
aucuuuugauucagugauuuugggagaaaaggcugcuugaaaauccuuauaucuaauauauauc

SEQ ID NO: 631423 - RNA, 64 nt, Homo Sapiens
acuguguaaauauaugucuguauuauuuaccguugcuugaaauuguuuuuuaagggagggaauu

SEQ ID NO: 631424 - RNA, 58 nt, Homo Sapiens; identical to SEQ ID NO: 631117

SEQ ID NO: 631425 - RNA, 64 nt, Homo Sapiens
gguacacgggccagggaaauaugcacagagcucugcuugaaacacuuuggguguggugacccag

SEQ ID NO: 631426 - RNA, 64 nt, Homo Sapiens
ucagcccugaaccuuugucccgggaaauucugcugcuugaaacuuggucaccucaaauuuaagu

SEQ ID NO: 631427 - RNA, 64 nt, Homo Sapiens
gccugaggacugccuuuaacgccaucuagggcuagcuugaaagaaccugucucaggacacacuu

SEQ ID NO: 631428 - RNA, 64 nt, Homo Sapiens
uagagaaagauaaaauguaauuacacaugaaaaagcuugaaacuuguugauuaaaccugucacu

SEQ ID NO: 631429 - RNA, 64 nt, Homo Sapiens
gacaagcuggaccuauuccuuuggagaacacagugcuugaaauggcugugaagaguggacaguc

SEQ ID NO: 631430 - RNA, 64 nt, Homo Sapiens
guauugccacccaugacauuuaacauguugugaugcuugaaaacacaggaguagagaaaaucga

SEQ ID NO: 631431 - RNA, 64 nt, Homo Sapiens
caugaagcacuguuuuuaaacccaaguaaagacugcuugaaaccuguugauggaaaugacuuau

SEQ ID NO: 631432 - RNA, 64 nt, Homo Sapiens
uuauucaacagccauuuagagugccaucaagauggcuugaaauggaauuuugugauuuguaguc

SEQ ID NO: 631433 - RNA, 64 nt, Homo Sapiens
agaauuguuuugcauuuuuuugcuuaucugaaaugcuugaaaccaaaauagaauauauauauau

SEQ ID NO: 631434 - RNA, 64 nt, Homo Sapiens
gccuggcauauacuaaacgcuauucacguaacaugcuugaaacuuaugaagauugaaugugaug

SEQ ID NO: 631435 - RNA, 64 nt, Homo Sapiens
gugaccuugcaacuucauguucaagugugcuuuagcuugaaaagaaaaaaaaugcacauagcua

SEQ ID NO: 631436 - RNA, 64 nt, Homo Sapiens
ccucugaacucagucuucuuugacuccucuucaagcuugaaaacccccuuuuuauuuuaaaauu

SEQ ID NO: 631437 - RNA, 64 nt, Homo Sapiens
cacauggauguaaaauuauaccccauuaacaauugcuugaaauucuuaaugcagcccugcuggu

SEQ ID NO: 631438 - RNA, 64 nt, Homo Sapiens
cuaugaaggcagagcuucuaccagaaauacagaagcuugaaaugcuguuuagacauuuuuuguc

SEQ ID NO: 631439 - RNA, 64 nt, Homo Sapiens
ccucuucauaguugaguaauaaaaucaacugugcgcuugaaagauucauacgcuguacuugcua

SEQ ID NO: 631440 - RNA, 64 nt, Homo Sapiens
cuuuuguuauuucaggcaaaacauaaugaaagaugcuugaaauguuuaaugcaggacaucaacu

SEQ ID NO: 631441 - RNA, 64 nt, Homo Sapiens
auuguggguauuaucuguuugaacuuacaggauugcuugaaauuauuacaaacaagagaaauga

SEQ ID NO: 631442 - RNA, 64 nt, Homo Sapiens
acaauuuuaaaaaugugacuugaucuaaucaguagcuugaaacccacucaaggucgcuggaugc

SEQ ID NO: 631443 - RNA, 64 nt, Homo Sapiens
ccgcgguuggcacuucgagaagggggagcccagagcuugaaaggagcugguucccguuuuccag

SEQ ID NO: 631444 - RNA, 64 nt, Homo Sapiens
uaauaagugcugcuggaaggggaaaacagaaagggcuugaaauuuauggguagaauuguaguca

SEQ ID NO: 631445 - RNA, 64 nt, Homo Sapiens
aaaaagucuaucugguagugcagacucaaguuaugcuugaaaugccacgagugucuccccagug

SEQ ID NO: 631446 - RNA, 64 nt, Homo Sapiens
uaugaaauggucauuuuucugaagagaauauuuugcuugaaaugcaaaggacugaaagagauuu

SEQ ID NO: 631447 - RNA, 64 nt, Homo Sapiens
uuugccccaugggaaacguagcccagccuguggugcuugaaacgggacguccuuccauaucccu

SEQ ID NO: 631448 - RNA, 64 nt, Homo Sapiens
auccaucacauaagaaaauauuagacuuuuauaggcuugaaauccuuuauacuuggguuauaua

SEQ ID NO: 631449 - RNA, 64 nt, Homo Sapiens
cagcucuguugaaucacagucauucugcauccuggcuugaaaaagucauuucauuaguauuccu

SEQ ID NO: 631450 - RNA, 64 nt, Homo Sapiens
aauucuacuuaagcuauaagucucugucauuuuugcuugaaaauuagcaugccucugucuuaaa

SEQ ID NO: 631451 - RNA, 64 nt, Homo Sapiens
uuucuuuuuuaaagccauucuguucuuuggaugugcuugaaagggugugugauuacaccauugu

SEQ ID NO: 631452 - RNA, 64 nt, Homo Sapiens
aguugcacuuugcugugcugaucccacaggaaaggcuugaaacacgagaagcagcaaagacaga

SEQ ID NO: 631453 - RNA, 64 nt, Homo Sapiens
uuuuccccccaaguagaacuaaugcuagcuuccagcuugaaaguaaaacuccaguguggaguga

SEQ ID NO: 631454 - RNA, 64 nt, Homo Sapiens
cucaggguggccaguauuuugacuuauuuauccugcuugaaagcuacuugagauguguacugcu

SEQ ID NO: 631455 - RNA, 64 nt, Homo Sapiens
aguucaccuaaagcuagaucauacuagucaguuugcuugaaacugggagcaaaacacugauuug

SEQ ID NO: 631456 - RNA, 64 nt, Homo Sapiens
cccaugaacauuaaagagcccccuuuaauuucuugcuugaaaauuacuuucauguuuuaaaaau

SEQ ID NO: 631457 - RNA, 64 nt, Homo Sapiens
uaucauuuuaucaugaaaacgcuuaauaaaguaagcuugaaauuaaagcuguuuguuauaugcu

SEQ ID NO: 631458 - RNA, 64 nt, Homo Sapiens
uuaaugguuuagucuugugaaucucauucaggaggcuugaaacagauuuagaugguccaagaua

SEQ ID NO: 631459 - RNA, 64 nt, Homo Sapiens
gcugcaaaugacccucuaauuuacauaaaccaaugcuugaaaaucauguggcagaauuucccuc

SEQ ID NO: 631460 - RNA, 64 nt, Homo Sapiens
cccucccuggauuuuauagcaguagcuucuucuggcuugaaaccuaaggacaagucaauuuguc

SEQ ID NO: 631461 - RNA, 64 nt, Homo Sapiens
agaggaaguccuaaaucacacauaugcaggaauggcuugaaacagucccaucuccaaggugcgu

SEQ ID NO: 631462 - RNA, 64 nt, Homo Sapiens
uuaauuuuuuuuuuuuugcauguuuauguauuaugcuugaaauuuuuuccccuguuuggugcua

SEQ ID NO: 631463 - RNA, 64 nt, Homo Sapiens
agguccagcaaaagucaguagggacauugcagaagcuugaaaggccaauaccagaacacaggcu

SEQ ID NO: 631464 - RNA, 64 nt, Homo Sapiens
aaucccagcuauucuggaggcugaggcaggaaucgcuugaaauuggaaagcagagguugcagug

SEQ ID NO: 631465 - RNA, 64 nt, Homo Sapiens; identical to SEQ ID NO: 190827

SEQ ID NO: 631466 - RNA, 64 nt, Homo Sapiens; identical to SEQ ID NO: 190828

SEQ ID NO: 631467 - RNA, 64 nt, Homo Sapiens
agaauugcccuauaaacauagcaggauuuugagagcuugaaaauuuuccauuauucuggacaug

SEQ ID NO: 631468 - RNA, 64 nt, Homo Sapiens
uguccccucugucaccagggaagccacaaugagagcuugaaagggugcugucaagauaaauguc

SEQ ID NO: 631469 - RNA, 64 nt, Homo Sapiens
uaacagggagugguauuugaaguguccagcaguugcuugaaaugcuuugccgaaucugacucca

SEQ ID NO: 631470 - RNA, 64 nt, Homo Sapiens
uugguccuaaucuuaauuuucuuuccaaaaggcagcuugaaaugcuaccucuguuuuuaauuuu

SEQ ID NO: 631471 - RNA, 64 nt, Homo Sapiens
uuggccagguuccaugaccauucagcuuaggcgugcuugaaaccgggggugacuuuaguuuuuc

SEQ ID NO: 631472 - RNA, 64 nt, Homo Sapiens
ucuaaacugcaaacauuuucacacccaccaugcugcuugaaagccacuugauccucaacauaua

SEQ ID NO: 631473 - RNA, 64 nt, Homo Sapiens
aaccagugacuucagagccuauggucucaacugugcuugaaaaacacugucucugaaaacaacu

SEQ ID NO: 631474 - RNA, 64 nt, Homo Sapiens
auuaagccagacugaccacuugcuuggagugugugcuugaaaaaaccagagcaauacuguuggg

SEQ ID NO: 631475 - RNA, 64 nt, Homo Sapiens
ggucccaggacaggaaugcgguucaaacccaguggcuugaaacuuccugagaaacuguagcaua

SEQ ID NO: 631476 - RNA, 64 nt, Homo Sapiens
cucucuugacagggagcucagucuucuacccauugcuugaaaauugcaacacuccugccaagug

SEQ ID NO: 631477 - RNA, 64 nt, Homo Sapiens
auaggggagauuaaauauuaaaacacaaauucuggcuugaaaaagcuguucacuugauuaguug

SEQ ID NO: 631478 - RNA, 64 nt, Homo Sapiens
aacaucuauccccuccucccccauacacaccuaggcuugaaaugcccuacaggcccagaacuuu

SEQ ID NO: 631479 - RNA, 64 nt, Homo Sapiens
ugaauguuugggaaugagaggaugagugagugaggcuugaaaacacaccacauugaaaauccug

SEQ ID NO: 631480 - RNA, 64 nt, Homo Sapiens
aaauugcgccgcuccuggagaccugauaacuuaggcuugaaauaauugacuugucuaaaaggac

SEQ ID NO: 631481 - RNA, 64 nt, Homo Sapiens
ggaagcauuuuuaacuggguagaaucugacuguggcuugaaauaaaaagcucucagaaaacuca

SEQ ID NO: 631482 - RNA, 64 nt, Homo Sapiens
acccacccccuuuaggaaccaggcugguguucuugcuugaaagcguugugcccucugagugucu

SEQ ID NO: 631483 - RNA, 64 nt, Homo Sapiens
cguggcgcuuucugcaguuuuccgaaggugaggagcuugaaaccggggaaggauagggugaugu

SEQ ID NO: 631484 - RNA, 64 nt, Homo Sapiens
acaaaccuuuuggguuaaaaauccucugcaaugugcuugaaaacguguuaauucuaaauccuug

SEQ ID NO: 631485 - RNA, 64 nt, Homo Sapiens
uuuaguuuuccuuauuaaugcauucagaguugaugcuugaaaacagucagauuagggucucugc

SEQ ID NO: 631486 - RNA, 64 nt, Homo Sapiens
aacccaacucuuugcugcacuguguccuuuagaagcuugaaaggagagcucuguuacagcccac

SEQ ID NO: 631487 - RNA, 64 nt, Homo Sapiens
uaacacuuuucacuugguucugaugugaucagaugcuugaaauuagcuuuaccuggucaccaug

SEQ ID NO: 631488 - RNA, 64 nt, Homo Sapiens
ucugacagcuuuucuacuuucaaggcuggcgacagcuugaaaagcaauuagagaaacagaaguc

SEQ ID NO: 631489 - RNA, 64 nt, Homo Sapiens
cucgcuuaagaucacaggcuuagugugaggacgagcuugaaaucccagucuccuggcccccagg

SEQ ID NO: 631490 - RNA, 64 nt, Homo Sapiens
aguacauggguacaauccgagggugugaauuucagcuugaaauuccauugcuguuccuuguuuu

SEQ ID NO: 631491 - RNA, 64 nt, Homo Sapiens
cguucaucucugaaacccagcauccuuuucagcugcuugaaaacauuguauuuuuuuuuuuuaa

SEQ ID NO: 631492 - RNA, 64 nt, Homo Sapiens
cugacaaggaaggaguugagcccuggguaggcuugcuugaaaagugaguccuuccagaauauuc

SEQ ID NO: 631493 - RNA, 64 nt, Homo Sapiens
aaggaaagggucuuagucacugccucccgaaguugcuugaaagcacucggagaauugugcaggu

SEQ ID NO: 631494 - RNA, 64 nt, Homo Sapiens
gcugcccagugucagaacaguuauacaaacgagggcuugaaaacauuuugugaaaacuugcuua

SEQ ID NO: 631495 - RNA, 64 nt, Homo Sapiens
acgauggugccucugggucaaauggaaauaaacugcuugaaaagaagucaacauuagaacugaa

SEQ ID NO: 631496 - RNA, 64 nt, Homo Sapiens
uauaguuugaaauuaugacauuauuacuaucuaggcuugaaauacugcacaguccauucuguuu

SEQ ID NO: 631497 - RNA, 64 nt, Homo Sapiens
uugcuaaacguaaauuuguaaugagauuuauggugcuugaaaugccuaaauguccaaaaagaac

SEQ ID NO: 631498 - RNA, 64 nt, Homo Sapiens
caggagaauucauacuggagagucacaaaucacagcuugaaagaaagacugugacaaaguuguc

SEQ ID NO: 631499 - RNA, 64 nt, Homo Sapiens
aacgcuccccucagacacccuugucccaucgguagcuugaaauaccugggaagccugggagugu

SEQ ID NO: 631500 - RNA, 64 nt, Homo Sapiens
uggaagccuugccuucccgcuucuacaugcuugagcuugaaaagcagucaccuccucggggacc

SEQ ID NO: 631501 - RNA, 64 nt, Homo Sapiens
acuguuucaaugaccuuuauuuuaaaaacacauagcuugaaaauuuauuuuuauacugauauua

SEQ ID NO: 631502 - RNA, 64 nt, Homo Sapiens
cuagcugaacaaaaaugugcaguuaauacuuggcgcuugaaaaugcaguagugaauguggaacc

SEQ ID NO: 631503 - RNA, 64 nt, Homo Sapiens
guaaggucuucuuguguccugaugaaaaauaugugcuugaaaugagaaacuuugaucucugcuu

SEQ ID NO: 631504 - RNA, 64 nt, Homo Sapiens
uaugagaaaaguugcuugaauauuugcaaaggaagcuugaaaaaauuucuaauagccuuggguu

SEQ ID NO: 631505 - RNA, 64 nt, Homo Sapiens
uuucagaaccucuuccccaguuuucugccagggagcuugaaagucuuagccucccugaaaaugu

SEQ ID NO: 631506 - RNA, 64 nt, Homo Sapiens
uugcuguacuauagagcucauuuuucuggaaacugcuugaaaucagaaaaugucguuguuguug

SEQ ID NO: 631507 - RNA, 64 nt, Homo Sapiens
cuacauuuccaaggugaagacuacccugacuaaagcuugaaauggaaaguaaagaaggaauaau

SEQ ID NO: 631508 - RNA, 64 nt, Homo Sapiens
uugugacuaaauugcacaauaacacugaauuuuggcuugaaauaucgguaucuuuuaauauaag

SEQ ID NO: 631509 - RNA, 64 nt, Homo Sapiens
auaaggaauggcaucagaacaauagcuuggaauggcuugaaaucacaaaggaucugcaagauga

SEQ ID NO: 631510 - RNA, 64 nt, Homo Sapiens
ugaaaacugcagcauaucagacagcaauuuaacagcuugaaacaucuacagauaguuccuacua

SEQ ID NO: 631511 - RNA, 64 nt, Homo Sapiens
ucuuagcuacucaggaggcugaggcaggagaaucgcuugaaaacaggagguggagguugcagug

SEQ ID NO: 631512 - RNA, 64 nt, Homo Sapiens
ucuaggaaucauauguuguccaucccccccucaggcuugaaaguccucaaagagacccacuauc

SEQ ID NO: 631513 - RNA, 64 nt, Homo Sapiens
uguuaaaaauguucauaacaccuuaucagcuguugcuugaaaccaauaucuuaagagaugaaua

SEQ ID NO: 631514 - RNA, 64 nt, Homo Sapiens
aaguuggaggcaaauugauauuggagauuguuacgcuugaaauuuuaaacaagaauaauaaagg

SEQ ID NO: 631515 - RNA, 64 nt, Homo Sapiens
uugcugaaauguucucauuuaucaucucuugcuugcuugaaaucagucaccugaacaaugaccc

SEQ ID NO: 631516 - RNA, 64 nt, Homo Sapiens
ucuuuuuucuauauacagaacauguuacuccuaagcuugaaagcuauuuauuguuuugguauuu

SEQ ID NO: 631517 - RNA, 64 nt, Homo Sapiens
cugugccagauggagccuuuggagcccacacaaagcuugaaagcggggagaagcuauagaaaga

SEQ ID NO: 631518 - RNA, 64 nt, Homo Sapiens
cauccaagggugcacagggauguuacccucauuggcuugaaaagcuggcuccugccaccacaaa

SEQ ID NO: 631519 - RNA, 64 nt, Homo Sapiens
aacugaauugagaaauacuucuucaaguuaugaugcuugaaaguucucaauaaaguucacgguu

SEQ ID NO: 631520 - RNA, 64 nt, Homo Sapiens
guaaauuuacacuauuuauaaauacauauuuauugcuugaaaauauuugugaauggaaugcugu

SEQ ID NO: 631521 - RNA, 64 nt, Homo Sapiens
gcauauagcuauagauauaggcuuuuccuugaaagcuugaaaaaaauucgccaguaaaauaauc

SEQ ID NO: 631522 - RNA, 64 nt, Homo Sapiens
gugaaaccaauaugguuuucuuuaugucuuggcugcuugaaaauuaaaaaaaaaaaagguuugu

SEQ ID NO: 631523 - RNA, 64 nt, Homo Sapiens
ucccaaaggaucuguacuuucuuuccuuacaacagcuugaaaaucauuauuuuaaaauccuuaa

SEQ ID NO: 631524 - RNA, 64 nt, Homo Sapiens
aaauuuguuauguuuaaggaaauuaagauuuuaagcuugaaauuauacaagcagaaucuaauuu

SEQ ID NO: 631525 - RNA, 64 nt, Homo Sapiens; identical to SEQ ID NO: 190829

SEQ ID NO: 631526 - RNA, 64 nt, Homo Sapiens; identical to SEQ ID NO: 190830

SEQ ID NO: 631527 - RNA, 64 nt, Homo Sapiens
cuagaaguaaugauauacaguuuucuuccuaguggcuugaaaaucuggacuuccucaauuauua

SEQ ID NO: 631528 - RNA, 64 nt, Homo Sapiens
gaaaagcaaucaauuauaccuaaauuuugaaugugcuugaaaguucaccauucuucuuuuguaa

SEQ ID NO: 631529 - RNA, 64 nt, Homo Sapiens
auuuagcauuugaauaguaauauaccuuauuaaagcuugaaaaccuugguacuuggaauugaua

SEQ ID NO: 631530 - RNA, 64 nt, Homo Sapiens; identical to SEQ ID NO: 190831

SEQ ID NO: 631531 - RNA, 64 nt, Homo Sapiens; identical to SEQ ID NO: 190832

SEQ ID NO: 631532 - RNA, 64 nt, Homo Sapiens
ucaauaaacuuugcucuguuauuuuccaaauguagcuugaaauuguuccaggauuuggauuuug

SEQ ID NO: 631533 - RNA, 64 nt, Homo Sapiens
uucucaucucagaauacuuugugucagauauugugcuugaaagauuuaaaaucauguauuuaau

SEQ ID NO: 631534 - RNA, 64 nt, Homo Sapiens
acuggagcacguggucagggcaagggcacucgcugcuugaaagucuaugaguuacugugggguc

SEQ ID NO: 631535 - RNA, 64 nt, Homo Sapiens
acuugucgucacagcuggcaugggcuggacaguugcuugaaaugaccuaaccaaaaacauucaa

SEQ ID NO: 631536 - RNA, 64 nt, Homo Sapiens
aauucacugacgaauucagagauugagggcacuugcuugaaaucaaggugcuccaacuuaguuu

SEQ ID NO: 631537 - RNA, 65 nt, Homo Sapiens
ccccaaaacaucagcauuucuaaaauaguccuaaagcuugaaaguaaguugcuuccaugagcaug

SEQ ID NO: 631538 - RNA, 65 nt, Homo Sapiens
uucuuucacuaccuuucuuacccuuaaugugccaagcuugaaacaggauuugauuuccugagcua

SEQ ID NO: 631539 - RNA, 65 nt, Homo Sapiens
uuugccucacucucuccaguugguuuucagcuggggcuugaaaugcauuuuuagcccuuugacgu

SEQ ID NO: 631540 - RNA, 65 nt, Homo Sapiens
aaauaguguauuauuaucguuggggcuggcucuaugcuugaaaaccaguuuauuuauaaccuguu

SEQ ID NO: 631541 - RNA, 65 nt, Homo Sapiens
cauuuuuucauaguuucauuuguucuugcccacaagcuugaaauccagguuaagguauccagccu

SEQ ID NO: 631542 - RNA, 65 nt, Homo Sapiens
cuguugcugggggccgauucugaucaagacacauggcuugaaaauggaagacacaaaacugagag

SEQ ID NO: 631543 - RNA, 65 nt, Homo Sapiens
aaaauauauaaaugcuucagaugucaaauacccaugcuugaaagcucguguaauuuacuuuaaga

SEQ ID NO: 631544 - RNA, 65 nt, Homo Sapiens
uugcuaaacuuuauauaaugugugguuucaauucagcuugaaaaauaaucucacuacauguagca

SEQ ID NO: 631545 - RNA, 65 nt, Homo Sapiens
ccuguuccccacuccacaggagggagcugacguuggcuugaaaggaguaaagucaacaucugcug

SEQ ID NO: 631546 - RNA, 65 nt, Homo Sapiens
aaguucuauagccuucucuugcaguauuuggauuugcuugaaaccgggaaaacuguucccauuag

SEQ ID NO: 631547 - RNA, 65 nt, Homo Sapiens
aaguaucgguuuuauucuuugcugauguccuuucugcuugaaauaacagucaccauacagcuaaa

SEQ ID NO: 631548 - RNA, 65 nt, Homo Sapiens
agauuacugucucuugaacaguugcaaucuuggcagcuugaaaauggugcuacacucuguuuugu

SEQ ID NO: 631549 - RNA, 65 nt, Homo Sapiens
aaauguuuaaaucgcuaaaggaaaauacaguaagugcuugaaagaugaaggaccaaaaggccaaa

SEQ ID NO: 631550 - RNA, 65 nt, Homo Sapiens
guacuggcacuggaagaguuuaguguuucuuguaugcuugaaaauaaaguauguacuguuuugaa

SEQ ID NO: 631551 - RNA, 65 nt, Homo Sapiens
aagucccacuggcuggccucaggcugucuuauuccgcuugaaaauagccaaaaagucuacugugg

SEQ ID NO: 631552 - RNA, 65 nt, Homo Sapiens
cacaaugaaauuauauuuucuuuguaaagaaaguggcuugaaaucuuuuuuguucaaagauuaau

SEQ ID NO: 631553 - RNA, 65 nt, Homo Sapiens
cguccgaaggcauucuuguuuccucugaggucugugcuugaaagcuuuuccaaagaagagucgag

SEQ ID NO: 631554 - RNA, 60 nt, Homo Sapiens; identical to SEQ ID NO: 630940

SEQ ID NO: 631555 - RNA, 65 nt, Homo Sapiens
cuggcuuuaggaugguucuggagggagguggucaagcuugaaaaaggugugccuucagggaggaa

SEQ ID NO: 631556 - RNA, 65 nt, Homo Sapiens
aucacacaggacacuuuucucagaauuggaaacgugcuugaaacagcguccagcagacacugaac

SEQ ID NO: 631557 - RNA, 65 nt, Homo Sapiens
agcccaggaaaccagagcagacuggaggugguggggcuugaaaugccaacacugucaagguggag

SEQ ID NO: 631558 - RNA, 65 nt, Homo Sapiens
agaggggugauuuucaaugggccugcagaguaaaugcuugaaaaaagaggcaagaugagauggca

SEQ ID NO: 631559 - RNA, 65 nt, Homo Sapiens
cauuauuuugaaugugaaguagccgugaugcucaggcuugaaaugaaaaacacuaguuuugugcc

SEQ ID NO: 631560 - RNA, 65 nt, Homo Sapiens
gacagauaaguauugcccagggcuccagggccugugcuugaaaaguauuuuauguuguugacucu

SEQ ID NO: 631561 - RNA, 65 nt, Homo Sapiens
auuacagaucaugauaccuauaguaucuguuuuaugcuugaaagcaauguuuuauaucuuaauuc

SEQ ID NO: 631562 - RNA, 65 nt, Homo Sapiens
ggcaagauuaacaaaauuagguuuuugugucaauggcuugaaacucuucuuaauauggugcugau

SEQ ID NO: 631563 - RNA, 65 nt, Homo Sapiens
cuaugucugcaugauaauuuauagaccauagcauggcuugaaauguaaaaauuaaaauccuugac

SEQ ID NO: 631564 - RNA, 65 nt, Homo Sapiens
aacacaucgcaucuacauuuucauuggaaacaaaagcuugaaagaaaagaaaaccuaaacuaaug

SEQ ID NO: 631565 - RNA, 65 nt, Homo Sapiens
gucucucucccauggagaacuaaaaagauaugacugcuugaaauaaaacucacaaaacauuuugc

SEQ ID NO: 631566 - RNA, 65 nt, Homo Sapiens
uguacaggugucaccaucauauggcuauggagagggcuugaaauguuggauauucaagccuuugg

SEQ ID NO: 631567 - RNA, 65 nt, Homo Sapiens
augaugauauaaaggcuggagagccuccuccuguugcuugaaauaggaaugagcuaagcaaggcu

SEQ ID NO: 631568 - RNA, 65 nt, Homo Sapiens
guuuccuuuacucauguugaguaaaaacugucagugcuugaaacucauucuuugaauagucacuc

SEQ ID NO: 631569 - RNA, 65 nt, Homo Sapiens
gcgcagagcccuauaccucacuugauugaaggaaagcuugaaaaguuauuccccugccuuccugg

SEQ ID NO: 631570 - RNA, 65 nt, Homo Sapiens
agccaggguguaaucuuguugagccucgauccagggcuugaaagaacggaguuucaaaaacugau

SEQ ID NO: 631571 - RNA, 65 nt, Homo Sapiens
ucugccugauguggcuccuuuuccuccauuccauggcuugaaaccgcugcuccucucugccgccu

SEQ ID NO: 631572 - RNA, 65 nt, Homo Sapiens
acaaaaguuuugcuggcacguccuacaaagaccuugcuugaaaccaauaaaaugagaaacuuuuu

SEQ ID NO: 631573 - RNA, 65 nt, Homo Sapiens
uucacuuaggaacguaaucgccccugcaaagcccagcuugaaaccagugaccauacuaauuauac

SEQ ID NO: 631574 - RNA, 65 nt, Homo Sapiens
uuucaaauuuucagaaagggggcagaaaagaaagugcuugaaagacauauugugugcaaaggaug

SEQ ID NO: 631575 - RNA, 65 nt, Homo Sapiens
gaugaagaaugucucuagaauuuaaugacaauguagcuugaaagcaaaaauuucacaagacuuau

SEQ ID NO: 631576 - RNA, 65 nt, Homo Sapiens
gcguugguaucuucauuuuauggcuuugcuguaaugcuugaaaagucacuuggcucugaacauac

SEQ ID NO: 631577 - RNA, 65 nt, Homo Sapiens
uucuaugcauccgauucuuaacaaaacugcagggagcuugaaaaaaugcagacuguacaaacgcu

SEQ ID NO: 631578 - RNA, 65 nt, Homo Sapiens
uucagaaaaugcaucccugauuucauucauuuccagcuugaaagccagccauauuacucuagucc

SEQ ID NO: 631579 - RNA, 65 nt, Homo Sapiens
auauaaauacaguaaguuuagauuauugaauuggugcuugaaauuuauugguuuuguuguaauuu

SEQ ID NO: 631580 - RNA, 65 nt, Homo Sapiens
uuguaauagugaaaccuguacucaaaauauaagcagcuugaaacuggcuuuaccaaucuugaaau

SEQ ID NO: 631581 - RNA, 65 nt, Homo Sapiens
cuaaucauaacuguuaauucucagccaucuuugaagcuugaaagaagagucuuugguauuuugua

SEQ ID NO: 631582 - RNA, 65 nt, Homo Sapiens
aguuaguguccgaagaccgaauuuuauuuuacagagcuugaaaacucacuucaaugaacaaaggg

SEQ ID NO: 631583 - RNA, 65 nt, Homo Sapiens
cauagcauaaagcuaggggaugcauggaaauagcagcuugaaacuaggagguaacaagaaagcuu

SEQ ID NO: 631584 - RNA, 65 nt, Homo Sapiens
aguaaugggucuuggaguauagauuuuuauuaguagcuugaaagagcuuaaucauaugcaguaag

SEQ ID NO: 631585 - RNA, 65 nt, Homo Sapiens
cagcacaucccgcugcagagggcauucccuuuaaggcuugaaaaugccuccuguagucccaaacc

SEQ ID NO: 631586 - RNA, 65 nt, Homo Sapiens
ugaggacuugggcgggacacaggcuccaaacuggagcuugaaauagugucugaugaauguuaaau

SEQ ID NO: 631587 - RNA, 65 nt, Homo Sapiens
uagccagggggacuagccccuguggagacuggggggcuugaaauuguccccguggucucuuacuu

SEQ ID NO: 631588 - RNA, 65 nt, Homo Sapiens
ccagacuauagcauauuagcuguuuagaagggauggcuugaaaggaaggagacugaaaaacacuc

SEQ ID NO: 631589 - RNA, 65 nt, Homo Sapiens
cuaacuuuuuuuuacuuauagugcugggauuacaggcuugaaaguaccugccucagccucccaaa

SEQ ID NO: 631590 - RNA, 65 nt, Homo Sapiens
uugauacauauuggaauacagguucaaaaugaccugcuugaaacuuauugugauuucuuauuuga

SEQ ID NO: 631591 - RNA, 65 nt, Homo Sapiens
auauaaaaucuuccuguccugcuguacuaauuggggcuugaaaguuuuuuauauacuuucaauua

SEQ ID NO: 631592 - RNA, 65 nt, Homo Sapiens
uucagagaauuuugucuuccaaauauguuaaauuggcuugaaauucaucgugaaagguacauuua

SEQ ID NO: 631593 - RNA, 65 nt, Homo Sapiens
auuuccucuauaucaugccuuggaaaaaccccugugcuugaaaauaugugauacauuuaagccac

SEQ ID NO: 631594 - RNA, 65 nt, Homo Sapiens
acugcuguguuaagcuguucguaguauuguuaccugcuugaaaacgcuuccuauuuuuuuuucca

SEQ ID NO: 631595 - RNA, 65 nt, Homo Sapiens
gagaugugaacacaucagcucuagugaaagaggcagcuugaaacuaaaaaaaaauacugauguuc

SEQ ID NO: 631596 - RNA, 65 nt, Homo Sapiens
uacagaauguuuugaaagugaugcgguucugaguggcuugaaaugaucacauuuguagaaaugua

SEQ ID NO: 631597 - RNA, 65 nt, Homo Sapiens
gagugaguaccucagagaaaauucugauauacauugcuugaaaauuguuguuauaaaacauucaa

SEQ ID NO: 631598 - RNA, 65 nt, Homo Sapiens
aaagcuucagauaaacuugcuguugugacugaaaugcuugaaaccuggcacuccucaauugggag

SEQ ID NO: 631599 - RNA, 65 nt, Homo Sapiens
aaaauacuuacaauaguagcagaaaaaauguaugugcuugaaagugccgaaaagaaugaaaacag

SEQ ID NO: 631600 - RNA, 65 nt, Homo Sapiens
ugcucuacauuaugaccaauuuauaauauaauuuagcuugaaagagauugaguaucauguaauaa

SEQ ID NO: 631601 - RNA, 61 nt, Homo Sapiens; identical to SEQ ID NO: 630987

SEQ ID NO: 631602 - RNA, 65 nt, Homo Sapiens
auaaagcucauuugguuuagugccugggguguucagcuugaaagacagcaaagcuaauuugccuu

SEQ ID NO: 631603 - RNA, 65 nt, Homo Sapiens
aaaacuucuuucccuaccauaauauucucuuaaaagcuugaaaauuaaaacucucuguuguuugu

SEQ ID NO: 631604 - RNA, 65 nt, Homo Sapiens
aucucagacccaaggcaccuuggaagaacuuguuugcuugaaaguagccaccgugggacaucaag

SEQ ID NO: 631605 - RNA, 65 nt, Homo Sapiens
caauucuuauaugaaauuuuaaguucuggcuuccugcuugaaaccaauuuaagaaccagaggcag

SEQ ID NO: 631606 - RNA, 65 nt, Homo Sapiens
guguuuggggcuugauagagugugaaagguguguugcuugaaagguguggccuuagacacuagga

SEQ ID NO: 631607 - RNA, 65 nt, Homo Sapiens
gaauagaugugugggugaagccauagaacauauuugcuugaaauucuugagcagggaucuuauaa

SEQ ID NO: 631608 - RNA, 65 nt, Homo Sapiens
uucaguuaaacacugcugcaauauuucaguguugugcuugaaaauauguacaguuuuuuuccaau

SEQ ID NO: 631609 - RNA, 65 nt, Homo Sapiens
uauaagaggcugauaauuccagugguccauggaaugcuugaaaaaugugcaaaacagcguuuaag

SEQ ID NO: 631610 - RNA, 65 nt, Homo Sapiens
uuugcauauucuuauguaugugaaaguuacaaauugcuugaaagaaaauaugcaucuaauaaaaa

SEQ ID NO: 631611 - RNA, 65 nt, Homo Sapiens
aaaugggaccgcaagugguaggcagugucccuucugcuugaaaccuauugaaaccaauuuaaaac

SEQ ID NO: 631612 - RNA, 65 nt, Homo Sapiens
aggaauuuugugagacaguugucaaauuguugcuagcuugaaaucugcggcaauuggaguauuua

SEQ ID NO: 631613 - RNA, 65 nt, Homo Sapiens
ucggcagcacauauacuaaaaauuaauaagacccagcuugaaaauugagccugauaacaagauua

SEQ ID NO: 631614 - RNA, 65 nt, Homo Sapiens
guuugugaaugaauaaauuacuaauccuccuugucgcuugaaaccuucccacacucccugcucca

SEQ ID NO: 631615 - RNA, 65 nt, Homo Sapiens
ccauuucugcucaaccacacauucucuaagaaacagcuugaaagcucugucugggucauucauuu

SEQ ID NO: 631616 - RNA, 65 nt, Homo Sapiens
cccaagaacacuuuaaggaaacauuuuacaaguaugcuugaaagaaugucacuaacugguccaga

SEQ ID NO: 631617 - RNA, 65 nt, Homo Sapiens
uauuuagguauaauaucaucuugucuuugacuagagcuugaaaccuuguuaucugauuguguacc

SEQ ID NO: 631618 - RNA, 65 nt, Homo Sapiens
gaaccuuacaaggcucuaaaaugagaugugauauggcuugaaaugggaggagacacuuucugaca

SEQ ID NO: 631619 - RNA, 65 nt, Homo Sapiens
ccugggugagucugccaacucacaggugcuuuuaggcuugaaaucuccauccuaucauuuccguu

SEQ ID NO: 631620 - RNA, 65 nt, Homo Sapiens
caguuuuguuugguuuacuuucaaaagaguagaaagcuugaaaagauucugaaaccacaguuuca

SEQ ID NO: 631621 - RNA, 65 nt, Homo Sapiens
aucccuggggauucugaagguuacucaacuagaaagcuugaaaacgaagugaacuugguuugauc

SEQ ID NO: 631622 - RNA, 65 nt, Homo Sapiens
uuuuuuuuuaaugacugugcugaauuauauguauagcuugaaaagcaugcuagcucaauuaguuu

SEQ ID NO: 631623 - RNA, 65 nt, Homo Sapiens
cuagucuguuugugaaagauuugaaauaccuaauggcuugaaauuaauaacgcacgguacuguuc

SEQ ID NO: 631624 - RNA, 65 nt, Homo Sapiens
ugcacuuagcacuuugguucauauucagaacagaugcuugaaauaaacuuacuguggcuuuaaac

SEQ ID NO: 631625 - RNA, 65 nt, Homo Sapiens
gcacagcccaaauaaaacaagaaaucuagucaguugcuugaaagacacaaacauucuguugaagg

SEQ ID NO: 631626 - RNA, 65 nt, Homo Sapiens
uauagacaaucuuuaauguauuuauuuauaaaaaggcuugaaaaauaacacaauaaccaaaagcu

SEQ ID NO: 631627 - RNA, 65 nt, Homo Sapiens
aaauguauguccucucuguaauuguuuuaaugugugcuugaaauauccagaaaaccuauggaguu

SEQ ID NO: 631628 - RNA, 65 nt, Homo Sapiens
aguguuguucugagcagggggacaggauugaugaggcuugaaagagcccacugagccacucucug

SEQ ID NO: 631629 - RNA, 65 nt, Homo Sapiens
cugaggugcaaaacauagauauagaacugaacagggcuugaaacaauauuaggauuacuacccag

SEQ ID NO: 631630 - RNA, 65 nt, Homo Sapiens
ccucacucaaacauagcugacuuccuauugguacagcuugaaaagcacuuuuuacuacauacaca

SEQ ID NO: 631631 - RNA, 65 nt, Homo Sapiens
guauggugcucuugucuucuuuguuugugacccaugcuugaaaacuugaaggaaguuagauauga

SEQ ID NO: 631632 - RNA, 63 nt, Homo Sapiens; identical to SEQ ID NO: 631018

SEQ ID NO: 631633 - RNA, 65 nt, Homo Sapiens
uacuucaaggaagacucuacaagcuuuuguucacagcuugaaauagaugccucacaauucagaca

SEQ ID NO: 631634 - RNA, 65 nt, Homo Sapiens
gugcugccauuugcuauaaaguugaacuuuguauggcuugaaaaagaaaugacaauauggaacau

SEQ ID NO: 631635 - RNA, 65 nt, Homo Sapiens
uuaacugucccauuguaaagguguaaguuauauaggcuugaaaaaaauuggcggguaaaaaucac

SEQ ID NO: 631636 - RNA, 65 nt, Homo Sapiens
caguuaguugauaacauaaaucauuugauuacccugcuugaaauaaauuuguuuuuucuugcuuu

SEQ ID NO: 631637 - RNA, 65 nt, Homo Sapiens
uacgguagagauacuuagcuaaaguaauggaucuggcuugaaaaauauaagggacuuuuauuugu

SEQ ID NO: 631638 - RNA, 65 nt, Homo Sapiens
uuugcucaaguuuauuuaugcauauauauccucuagcuugaaacucaaauauauaauuuucuaua

SEQ ID NO: 631639 - RNA, 65 nt, Homo Sapiens
ccuagaugaaguuuagauuuucugucaaaugaaaggcuugaaauauauuguauuauaaugaugau

SEQ ID NO: 631640 - RNA, 65 nt, Homo Sapiens
gaauuuuagcagaugguacuuaugauggaagaagugcuugaaagacccauaucucaccucuagga

SEQ ID NO: 631641 - RNA, 65 nt, Homo Sapiens
aggaggcagagguugcagugugagacagaagaacugcuugaaaccgucccagcuacucgggaggc

SEQ ID NO: 631642 - RNA, 65 nt, Homo Sapiens
aaaaaaaaaaaaagaaaguaauuuuaaacucacuggcuugaaaugugugcuuucuguacaaugaa

SEQ ID NO: 631643 - RNA, 65 nt, Homo Sapiens
uuuuuuuuauuucaauauauacaguuugaugaugugcuugaaauuggugcaaauauauacacacc

SEQ ID NO: 631644 - RNA, 65 nt, Homo Sapiens
ccuucagaauaagcuuccccaccccaguuuuuguugcuugaaaauauuguugucccggauuuuug

SEQ ID NO: 631645 - RNA, 65 nt, Homo Sapiens
cggagacgcagguugcaguggacauugggauuguugcuugaaaaauuaaaauuugaauauuuucu

SEQ ID NO: 631646 - RNA, 65 nt, Homo Sapiens
uuuuugaagucuucccuugacccuaguaaaauauagcuugaaacuuguaaacaacuguguuugcc

SEQ ID NO: 631647 - RNA, 65 nt, Homo Sapiens
aaaaaugcuuguccccuauaugaauauucuguuacgcuugaaaaauauuuucuccagcguugguu

SEQ ID NO: 631648 - RNA, 65 nt, Homo Sapiens
ugaggaauaaagccaaggggagugagaugaggugggcuugaaaguaccuuguccgcucagaagga

SEQ ID NO: 631649 - RNA, 65 nt, Homo Sapiens
ucccaggguauccaccugcaccccacucccaaguagcuugaaaaagggaggacagucuuucccca

SEQ ID NO: 631650 - RNA, 65 nt, Homo Sapiens
uauaauacacauaaauaaaaaccaacuuauuagcugcuugaaaaacgaauuaaauauuauguccu

SEQ ID NO: 631651 - RNA, 65 nt, Homo Sapiens
aguuaaacugauuaguauucauuuaaaaauauauagcuugaaagcagacuguauguuuuaauugc

SEQ ID NO: 631652 - RNA, 65 nt, Homo Sapiens
aaauaucucugaccaacuucuuuugcuuguugugugcuugaaagaauugguguguauuggccaag

SEQ ID NO: 631653 - RNA, 65 nt, Homo Sapiens
ucccaugcaagagaguaguugcccauaguaaaacagcuugaaauacauuuuggucccugcuccuu

SEQ ID NO: 631654 - RNA, 65 nt, Homo Sapiens
cugagacacagaggugccagugauggacuggaucagcuugaaagaagcacaaagacuccgugauc

SEQ ID NO: 631655 - RNA, 65 nt, Homo Sapiens
ugcugggauugcaaacacuuuuuaaaaaauuguuugcuugaaaauacuacugaauauaaauaaga

SEQ ID NO: 631656 - RNA, 65 nt, Homo Sapiens
uguguugcccaccuguucacaaaaaguaccuuuaugcuugaaaacauuagguucuuugguuacug

SEQ ID NO: 631657 - RNA, 65 nt, Homo Sapiens
uggugaauuuuuuuuaaguggcacggucuuuuucugcuugaaaucugaucacaccccccagccau

SEQ ID NO: 631658 - RNA, 65 nt, Homo Sapiens
ugcaaggggcaaguuucacccaaaugccugagacugcuugaaagauauauuuuaaguggugcacu

SEQ ID NO: 631659 - RNA, 65 nt, Homo Sapiens
uuauucaacugcaaaaucucaaucuugaaaaucaagcuugaaauuucauagguagaaauauuagc

SEQ ID NO: 631660 - RNA, 56 nt, Homo Sapiens; identical to SEQ ID NO: 631046

SEQ ID NO: 631661 - RNA, 65 nt, Homo Sapiens
caagaaucuugcaagacaguuauuaaacauucauagcuugaaauugcccauggugggagaguuua

SEQ ID NO: 631662 - RNA, 65 nt, Homo Sapiens
ucucugaugaaagugaaaaauuuaaguacaaggcagcuugaaaccagcagacaaagucaagcagc

SEQ ID NO: 631663 - RNA, 65 nt, Homo Sapiens
aaaauacguaaucuguuucauaauuaaaauagcaugcuugaaaaacacaugaugagauaucaagg

SEQ ID NO: 631664 - RNA, 65 nt, Homo Sapiens
auaaagcucucucagguugaugaaugacagccuaggcuugaaauuuuggagaaaugaagcaaagg

SEQ ID NO: 631665 - RNA, 65 nt, Homo Sapiens
aggcucuccacaccauugacgacuggauuuugaacgcuugaaaucucuucuuauaagccagcucu

SEQ ID NO: 631666 - RNA, 65 nt, Homo Sapiens
uuuuguuagggccucaaagauuuuccugaacauuugcuugaaauaugggaggggugccguuuuua

SEQ ID NO: 631667 - RNA, 65 nt, Homo Sapiens
gggcugcaucccuauaaacccuaaggagcuccucagcuugaaaugagagguaugauuccuaagcc

SEQ ID NO: 631668 - RNA, 65 nt, Homo Sapiens
ucaaccaaacgccuauuuuuuaaugcuuaguuuuggcuugaaauucuucuucaccuggaguuuuc

SEQ ID NO: 631669 - RNA, 65 nt, Homo Sapiens
cuauuuuuacacagguuuucuugucuugacaagaugcuugaaaaaccaagaggauaugaaaaucu

SEQ ID NO: 631670 - RNA, 65 nt, Homo Sapiens
auugugauguuucaaugugagacacaaaaacaauggcuugaaacuuguguaucauaugugauuuu

SEQ ID NO: 631671 - RNA, 65 nt, Homo Sapiens
cugaagguggggacagugaccgcggaccccucugugcuugaaagauuuccuccacggccuuugcc

SEQ ID NO: 631672 - RNA, 65 nt, Homo Sapiens
ccuauuagucagaaagaaggagagaaugagugagugcuugaaaugugucauacuguuuuaggauc

SEQ ID NO: 631673 - RNA, 65 nt, Homo Sapiens
cuagcugucuccucaucucauccuagucuagguuugcuugaaauugggugugagagcuagaauga

SEQ ID NO: 631674 - RNA, 65 nt, Homo Sapiens
uccaaacuucauauaugucuaucagguaauaauaggcuugaaaauugauauccuguggugcuaaa

SEQ ID NO: 631675 - RNA, 65 nt, Homo Sapiens
cucuuccaaaggcauaagacccuaagccuccuuuugcuugaaaccaaagauauauacacaggauc

SEQ ID NO: 631676 - RNA, 65 nt, Homo Sapiens
cuacauugauuauagaaccacuauuacgugaaaaggcuugaaacaaccaacauauacaaauaaaa

SEQ ID NO: 631677 - RNA, 65 nt, Homo Sapiens
uuggccacccucagccucugcauugggagggucuggcuugaaaauagcuuugcacaguguauuaa

SEQ ID NO: 631678 - RNA, 65 nt, Homo Sapiens
aaaugcuaauacuuaaguguaggaugagcauaagugcuugaaauauguuagacuuuuuaaacuca

SEQ ID NO: 631679 - RNA, 65 nt, Homo Sapiens
aaaggagaagaugcugugucuguuccuguauaacggcuugaaaggcgcacaguugauuuucggug

SEQ ID NO: 631680 - RNA, 65 nt, Homo Sapiens
gauuaacuuauacuguagguuauuucuauacaguagcuugaaauuuauugugcaugcuaguguug

SEQ ID NO: 631681 - RNA, 65 nt, Homo Sapiens
acgaggugaguucacauaacaggaauucuggaacugcuugaaaacuaggacgauugggcaauauc

SEQ ID NO: 631682 - RNA, 65 nt, Homo Sapiens
cacuauuaguacuucccuuugucugugccauaagugcuugaaaacguuaagguuuucuguuuugu

SEQ ID NO: 631683 - RNA, 65 nt, Homo Sapiens
guucucuagcuguucuacaaaacuggagcaugcuggcuugaaaaacccuugcccaguuuugaucc

SEQ ID NO: 631684 - RNA, 65 nt, Homo Sapiens
gaauuccagccaaggcaaauucaguuggaucuagggcuugaaaacugcccaagauuaaagagcua

SEQ ID NO: 631685 - RNA, 65 nt, Homo Sapiens
auuuuuuauuugcugucuuugguaauuaucucucugcuugaaauuaaaugcacuauaaguuaaua

SEQ ID NO: 631686 - RNA, 65 nt, Homo Sapiens
uuauugcaauuguggucaaauaaggaacguuuccugcuugaaauuauauugauuuaaaugaugug

SEQ ID NO: 631687 - RNA, 65 nt, Homo Sapiens
uuaaaggagguuguucacuuaaggcaagaacggcagcuugaaaaaaccgcacagcagcgaugcag

SEQ ID NO: 631688 - RNA, 65 nt, Homo Sapiens
uagagggagagagggagagaguuuauuuuuauauagcuugaaacagcgcugcucuuaugccauuu

SEQ ID NO: 631689 - RNA, 51 nt, Homo Sapiens; identical to SEQ ID NO: 631075

SEQ ID NO: 631690 - RNA, 65 nt, Homo Sapiens
ucuuguuaugccagaaaguaguaggaacaagaugagcuugaaauagauuccaaagcaagggcaag

SEQ ID NO: 631691 - RNA, 65 nt, Homo Sapiens
ccuuuucauaaaagauaacuaacugggcugagagagcuugaaagucuguaaaguuguuucaguua

SEQ ID NO: 631692 - RNA, 65 nt, Homo Sapiens
auugaagagggccaaacacuuuauaaauucaaagagcuugaaaagucuuaacuuaaaggcauugg

SEQ ID NO: 631693 - RNA, 65 nt, Homo Sapiens
agcuuauuagaaagccaaaguagaguucuguuuaagcuugaaagagguaugaaguaaucuguagu

SEQ ID NO: 631694 - RNA, 65 nt, Homo Sapiens
uucugaaauuuaaacuugauauuuuucgcccucuugcuugaaaacuucacuugcuuccccauuuc

SEQ ID NO: 631695 - RNA, 65 nt, Homo Sapiens
ugggcuugauuuaacauuguuuuuguguuauuuuugcuugaaacaacgcacacauuuucaacaac

SEQ ID NO: 631696 - RNA, 65 nt, Homo Sapiens
caguuuaagagcagaacagaucuuuuacuuuggccgcuugaaaagcuaguguaccuccucucagu

SEQ ID NO: 631697 - RNA, 65 nt, Homo Sapiens
cuccagcugggccaugucagucucaucgucccaaggcuugaaauccagcaggauggaggacuugg

SEQ ID NO: 631698 - RNA, 65 nt, Homo Sapiens
accaguguuggugaaucuuuuggccuuuccccaaugcuugaaagaagaucaccacugcuggaggc

SEQ ID NO: 631699 - RNA, 65 nt, Homo Sapiens
aggacaggugggugaggaucugagaaaugcuaaaggcuugaaagcaucugaagacaucuaacuua

SEQ ID NO: 631700 - RNA, 65 nt, Homo Sapiens
ugagaaauacaagguugcuugucugaccccaaucugcuugaaaccugacucugcuucucucauuu

SEQ ID NO: 631701 - RNA, 65 nt, Homo Sapiens
ccucuauguucugaauaaagacugccaucaacauugcuugaaaugcaggggcugacagcaggcuu

SEQ ID NO: 631702 - RNA, 65 nt, Homo Sapiens
uauuggauuacaugcucacaaaauuaugaccaagggcuugaaacaauuaaaauauggaaauuuua

SEQ ID NO: 631703 - RNA, 65 nt, Homo Sapiens
uugcugaaaaacacaacuugcagggaaaacagcuagcuugaaaaccuaaacaaugaauucuucaa

SEQ ID NO: 631704 - RNA, 65 nt, Homo Sapiens
aaccuggagucgggggcacaucugguguggcuucagcuugaaagcugccacccucagcucuuucc

SEQ ID NO: 631705 - RNA, 65 nt, Homo Sapiens
aaauaccaaggaacaggaaaaaaaacauggccuuugcuugaaagaccauugaaagggaguauuac

SEQ ID NO: 631706 - RNA, 57 nt, Homo Sapiens; identical to SEQ ID NO: 631092

SEQ ID NO: 631707 - RNA, 65 nt, Homo Sapiens
gggguuuggggaaggacaguguggugugacuauuggcuugaaacguuauggauaugguuggaguc

SEQ ID NO: 631708 - RNA, 65 nt, Homo Sapiens
accauauaaauguggaggcuaucaacaaagaaugggcuugaaacauuauaaaaauugacaaugau

SEQ ID NO: 631709 - RNA, 65 nt, Homo Sapiens
aucccagcuccucaggaggcugaggcaggagaauugcuugaaaccaggaggcggagguugcagug

SEQ ID NO: 631710 - RNA, 65 nt, Homo Sapiens
gugaacuguuggacuggguagaaaucuuucaagaagcuugaaaauaaggccauaaaggaggggcu

SEQ ID NO: 631711 - RNA, 65 nt, Homo Sapiens
ugggacccucauuucuucugacagauuucagucuggcuugaaauuuggggauguuaaugaggguc

SEQ ID NO: 631712 - RNA, 65 nt, Homo Sapiens
uagucuggagaaaacuggauacaucaugcauaguagcuugaaaucguuacaugguuacauguucu

SEQ ID NO: 631713 - RNA, 65 nt, Homo Sapiens
gcagaagaaauucacaggaaugccauucuuuuuaagcuugaaacuauacaguguucuggaaaaga

SEQ ID NO: 631714 - RNA, 65 nt, Homo Sapiens
aaaacauauccacaacauugcccacuguucugaaggcuugaaaacaaaguggcccaucauucaua

SEQ ID NO: 631715 - RNA, 65 nt, Homo Sapiens
auaaauuauaucaauuuccuacaggcccacaguaugcuugaaaaguugucuuuuuacugcaaccc

SEQ ID NO: 631716 - RNA, 65 nt, Homo Sapiens
uaaucuauagacggccccacuuuuauuguuugcuugcuugaaacccugcucgggagagcugaggg

SEQ ID NO: 631717 - RNA, 65 nt, Homo Sapiens
uuuguaugaauuauuuugucaucuacagcagugaugcuugaaauuccccacugagcuggaggaau

SEQ ID NO: 631718 - RNA, 65 nt, Homo Sapiens
aaauuuuaucaggcuaccaaauuuaaagcgauuuagcuugaaauuuacuuucuaucuucauaacc

SEQ ID NO: 631719 - RNA, 65 nt, Homo Sapiens
gcuuuuccuuuucuacucuuuccuuacuuucucuugcuugaaacuuuccccucccuguccgccuc

SEQ ID NO: 631720 - RNA, 65 nt, Homo Sapiens
cuuccccucuccagguucggauuuaugugguuccugcuugaaaacuaggcgugaguuuuagguga

SEQ ID NO: 631721 - RNA, 65 nt, Homo Sapiens
gcauaaaauaaucauuuuugaaccuguguaauaaagcuugaaagcagggaaaagaauuuccuuuu

SEQ ID NO: 631722 - RNA, 65 nt, Homo Sapiens
cagggugauaauaaucuccauaguuauuugaaguggcuugaaaaaggcaagauugacuuuuauga

SEQ ID NO: 631723 - RNA, 65 nt, Homo Sapiens
aaucauaacacucucggucacauguuuuuccuucagcuugaaagcuuuuuuuuaaaaggaaaaga

SEQ ID NO: 631724 - RNA, 65 nt, Homo Sapiens
ucaauaccuuaauggugguagagccuuuaccuguagcuugaaaggggaaagauuggagguaagag

SEQ ID NO: 631725 - RNA, 65 nt, Homo Sapiens
ggguaggaauccaggaugcuuaguuucuagacccugcuugaaaguucuagagccuuugaaaggga

SEQ ID NO: 631726 - RNA, 65 nt, Homo Sapiens
aucguaaagccauauguucuguucaagucuuguuugcuugaaaugauuauuccuacaagugaaac

SEQ ID NO: 631727 - RNA, 65 nt, Homo Sapiens
gcugaagacaacaccugcuucaggggaacacaggcgcuugaaaaagaaaagagagaacagcccau

SEQ ID NO: 631728 - RNA, 65 nt, Homo Sapiens
uuucaaaauaugagacuaugcuauaggcagugcuugcuugaaaagucucauuuuuaaaucucccu

SEQ ID NO: 631729 - RNA, 65 nt, Homo Sapiens
aucuuuugauucagugauuucugggagaaaaggcugcuugaaaauuccuuauaucuaauauauau

SEQ ID NO: 631730 - RNA, 65 nt, Homo Sapiens
acuguguaaauauaugucuguuauuauuuaccguugcuugaaauuuguuuuuuaagggagggaau

SEQ ID NO: 631731 - RNA, 58 nt, Homo Sapiens; identical to SEQ ID NO: 631117

SEQ ID NO: 631732 - RNA, 65 nt, Homo Sapiens
gguacacgggccagggaaaugaugcacagagcucugcuugaaacaacuuuggguguggugaccca

SEQ ID NO: 631733 - RNA, 65 nt, Homo Sapiens
ucagcccugaaccuuuguccucgggaaauucugcugcuugaaacuuuggucaccucaaauuuaag

SEQ ID NO: 631734 - RNA, 65 nt, Homo Sapiens
gccugaggacugccuuuaacugccaucuagggcuagcuugaaagaaaccugucucaggacacacu

SEQ ID NO: 631735 - RNA, 65 nt, Homo Sapiens
uagagaaagauaaaauguaauuuacacaugaaaaagcuugaaacucuguugauuaaaccugucac

SEQ ID NO: 631736 - RNA, 65 nt, Homo Sapiens
gacaagcuggaccuauuccucuuggagaacacagugcuugaaaugggcugugaagaguggacagu

SEQ ID NO: 631737 - RNA, 65 nt, Homo Sapiens
gguauugccacccaugacauuuaacauguugugaugcuugaaaacacaggaguagagaaaaucga

SEQ ID NO: 631738 - RNA, 65 nt, Homo Sapiens
gcaugaagcacuguuuuuaaacccaaguaaagacugcuugaaaccuguugauggaaaugacuuau

SEQ ID NO: 631739 - RNA, 65 nt, Homo Sapiens
uuuauucaacagccauuuagagugccaucaagauggcuugaaauggaauuuugugauuuguaguc

SEQ ID NO: 631740 - RNA, 65 nt, Homo Sapiens
agaauuguuuugcauuuuuuuugcuuaucugaaaugcuugaaacccaaaauagaauauauauaua

SEQ ID NO: 631741 - RNA, 65 nt, Homo Sapiens
gccuggcauauacuaaacgcguauucacguaacaugcuugaaacuguaugaagauugaaugugau

SEQ ID NO: 631742 - RNA, 65 nt, Homo Sapiens
gugaccuugcaacuucauguaucaagugugcuuuagcuugaaaagaaaaaaaaaugcacauagcu

SEQ ID NO: 631743 - RNA, 65 nt, Homo Sapiens
ccucugaacucagucuucuuuugacuccucuucaagcuugaaaacuccccuuuuuauuuuaaaau

SEQ ID NO: 631744 - RNA, 65 nt, Homo Sapiens
cacauggauguaaaauuauauccccauuaacaauugcuugaaauuucuuaaugcagcccugcugg

SEQ ID NO: 631745 - RNA, 65 nt, Homo Sapiens
cuaugaaggcagagcuucuacccagaaauacagaagcuugaaaugucuguuuagacauuuuuugu

SEQ ID NO: 631746 - RNA, 65 nt, Homo Sapiens
ccucuucauaguugaguaauaaaaaucaacugugcgcuugaaagacuucauacgcuguacuugcu

SEQ ID NO: 631747 - RNA, 65 nt, Homo Sapiens
cuuuuguuauuucaggcaaauacauaaugaaagaugcuugaaaugguuuaaugcaggacaucaac

SEQ ID NO: 631748 - RNA, 65 nt, Homo Sapiens
auuguggguauuaucuguuuagaacuuacaggauugcuugaaauuaauuacaaacaagagaaaug

SEQ ID NO: 631749 - RNA, 65 nt, Homo Sapiens
acaauuuuaaaaaugugacucugaucuaaucaguagcuugaaaccgcacucaaggucgcuggaug

SEQ ID NO: 631750 - RNA, 65 nt, Homo Sapiens
ccgcgguuggcacuucgagagagggggagcccagagcuugaaaggaagcugguucccguuuucca

SEQ ID NO: 631751 - RNA, 65 nt, Homo Sapiens
uaauaagugcugcuggaaggaggaaaacagaaagggcuugaaauuuuauggguagaauuguaguc

SEQ ID NO: 631752 - RNA, 65 nt, Homo Sapiens
aaaaagucuaucugguaguggcagacucaaguuaugcuugaaaugaccacgagugucuccccagu

SEQ ID NO: 631753 - RNA, 65 nt, Homo Sapiens
uuaugaaauggucauuuuucugaagagaauauuuugcuugaaaugcaaaggacugaaagagauuu

SEQ ID NO: 631754 - RNA, 65 nt, Homo Sapiens
uuugccccaugggaaacguaugcccagccuguggugcuugaaacgaggacguccuuccauauccc

SEQ ID NO: 631755 - RNA, 65 nt, Homo Sapiens
auccaucacauaagaaaauaauuagacuuuuauaggcuugaaaucacuuuauacuuggguuauau

SEQ ID NO: 631756 - RNA, 65 nt, Homo Sapiens
cagcucuguugaaucacaguucauucugcauccuggcuugaaaaacgucauuucauuaguauucc

SEQ ID NO: 631757 - RNA, 65 nt, Homo Sapiens
gaauucuacuuaagcuauaagucucugucauuuuugcuugaaaauuagcaugccucugucuuaaa

SEQ ID NO: 631758 - RNA, 65 nt, Homo Sapiens
uuuucuuuuuuaaagccauucuguucuuuggaugugcuugaaagggugugugauuacaccauugu

SEQ ID NO: 631759 - RNA, 65 nt, Homo Sapiens
aaguugcacuuugcugugcugaucccacaggaaaggcuugaaacacgagaagcagcaaagacaga

SEQ ID NO: 631760 - RNA, 65 nt, Homo Sapiens
uuuuuccccccaaguagaacuaaugcuagcuuccagcuugaaaguaaaacuccaguguggaguga

SEQ ID NO: 631761 - RNA, 65 nt, Homo Sapiens
ucucaggguggccaguauuuugacuuauuuauccugcuugaaagcuacuugagauguguacugcu

SEQ ID NO: 631762 - RNA, 65 nt, Homo Sapiens
aguucaccuaaagcuagaucgauacuagucaguuugcuugaaacuagggagcaaaacacugauuu

SEQ ID NO: 631763 - RNA, 65 nt, Homo Sapiens
cccaugaacauuaaagagccucccuuuaauuucuugcuugaaaauuuacuuucauguuuuaaaaa

SEQ ID NO: 631764 - RNA, 65 nt, Homo Sapiens
uaucauuuuaucaugaaaacugcuuaauaaaguaagcuugaaauuaaaagcuguuuguuauaugc

SEQ ID NO: 631765 - RNA, 65 nt, Homo Sapiens
uuaaugguuuagucuugugaaaucucauucaggaggcuugaaacaugauuuagaugguccaagau

SEQ ID NO: 631766 - RNA, 65 nt, Homo Sapiens
gcugcaaaugacccucuaaucuuacauaaaccaaugcuugaaaauucauguggcagaauuucccu

SEQ ID NO: 631767 - RNA, 65 nt, Homo Sapiens
cccucccuggauuuuauagccaguagcuucuucuggcuugaaaccauaaggacaagucaauuugu

SEQ ID NO: 631768 - RNA, 65 nt, Homo Sapiens
agaggaaguccuaaaucacaucauaugcaggaauggcuugaaacaggucccaucuccaaggugcg

SEQ ID NO: 631769 - RNA, 65 nt, Homo Sapiens
uuaauuuuuuuuuuuuugcaauguuuauguauuaugcuugaaauuuuuuuccccuguuuggugcu

SEQ ID NO: 631770 - RNA, 65 nt, Homo Sapiens
cagguccagcaaaagucaguagggacauugcagaagcuugaaaggccaauaccagaacacaggcu

SEQ ID NO: 631771 - RNA, 65 nt, Homo Sapiens
uaaucccagcuauucuggaggcugaggcaggaaucgcuugaaauuggaaagcagagguugcagug

SEQ ID NO: 631772 - RNA, 65 nt, Homo Sapiens
agcccaguuugucuuucagaaggugacuuucaugugcuugaaaaguuuaauauuugaauauugug

SEQ ID NO: 631773 - RNA, 65 nt, Homo Sapiens
aguuguuuucuuuaggagucuaccuuuguguaugugcuugaaaguauuuuuguaauccaagaaug

SEQ ID NO: 631774 - RNA, 65 nt, Homo Sapiens
aagaauugcccuauaaacauagcaggauuuugagagcuugaaaauuuuccauuauucuggacaug

SEQ ID NO: 631775 - RNA, 65 nt, Homo Sapiens
cuguccccucugucaccagggaagccacaaugagagcuugaaagggugcugucaagauaaauguc

SEQ ID NO: 631776 - RNA, 65 nt, Homo Sapiens
uuaacagggagugguauuugaaguguccagcaguugcuugaaaugcuuugccgaaucugacucca

SEQ ID NO: 631777 - RNA, 65 nt, Homo Sapiens
uugguccuaaucuuaauuuuucuuuccaaaaggcagcuugaaaugucuaccucuguuuuuaauuu

SEQ ID NO: 631778 - RNA, 65 nt, Homo Sapiens
uuggccagguuccaugaccacuucagcuuaggcgugcuugaaaccugggggugacuuuaguuuuu

SEQ ID NO: 631779 - RNA, 65 nt, Homo Sapiens
aucuaaacugcaaacauuuucacacccaccaugcugcuugaaagccacuugauccucaacauaua

SEQ ID NO: 631780 - RNA, 65 nt, Homo Sapiens
aaaccagugacuucagagccuauggucucaacugugcuugaaaaacacugucucugaaaacaacu

SEQ ID NO: 631781 - RNA, 65 nt, Homo Sapiens
aauuaagccagacugaccacuugcuuggagugugugcuugaaaaaaccagagcaauacuguuggg

SEQ ID NO: 631782 - RNA, 65 nt, Homo Sapiens
uggucccaggacaggaaugcgguucaaacccaguggcuugaaacuuccugagaaacuguagcaua

SEQ ID NO: 631783 - RNA, 65 nt, Homo Sapiens
cucucuugacagggagcucaggucuucuacccauugcuugaaaauuugcaacacuccugccaagu

SEQ ID NO: 631784 - RNA, 65 nt, Homo Sapiens
auaggggagauuaaauauuagaaacacaaauucuggcuugaaaaaggcuguucacuugauuaguu

SEQ ID NO: 631785 - RNA, 65 nt, Homo Sapiens
gaacaucuauccccuccucccccauacacaccuaggcuugaaaugcccuacaggcccagaacuuu

SEQ ID NO: 631786 - RNA, 65 nt, Homo Sapiens
cugaauguuugggaaugagaggaugagugagugaggcuugaaaacacaccacauugaaaauccug

SEQ ID NO: 631787 - RNA, 65 nt, Homo Sapiens
aaaauugcgccgcuccuggagaccugauaacuuaggcuugaaauaauugacuugucuaaaaggac

SEQ ID NO: 631788 - RNA, 65 nt, Homo Sapiens
gggaagcauuuuuaacuggguagaaucugacuguggcuugaaauaaaaagcucucagaaaacuca

SEQ ID NO: 631789 - RNA, 65 nt, Homo Sapiens
cacccacccccuuuaggaaccaggcugguguucuugcuugaaagcguugugcccucugagugucu

SEQ ID NO: 631790 - RNA, 65 nt, Homo Sapiens
cguggcgcuuucugcaguuuuuccgaaggugaggagcuugaaaccaggggaaggauagggugaug

SEQ ID NO: 631791 - RNA, 65 nt, Homo Sapiens
acaaaccuuuuggguuaaaagauccucugcaaugugcuugaaaacaguguuaauucuaaauccuu

SEQ ID NO: 631792 - RNA, 65 nt, Homo Sapiens
uuuaguuuuccuuauuaaugccauucagaguugaugcuugaaaaccagucagauuagggucucug

SEQ ID NO: 631793 - RNA, 65 nt, Homo Sapiens
aacccaacucuuugcugcaccuguguccuuuagaagcuugaaagggagagcucuguuacagccca

SEQ ID NO: 631794 - RNA, 65 nt, Homo Sapiens
uaacacuuuucacuugguucgugaugugaucagaugcuugaaauuaagcuuuaccuggucaccau

SEQ ID NO: 631795 - RNA, 65 nt, Homo Sapiens
ucugacagcuuuucuacuuuccaaggcuggcgacagcuugaaaagacaauuagagaaacagaagu

SEQ ID NO: 631796 - RNA, 65 nt, Homo Sapiens
acucgcuuaagaucacaggcuuagugugaggacgagcuugaaaucccagucuccuggcccccagg

SEQ ID NO: 631797 - RNA, 65 nt, Homo Sapiens
caguacauggguacaauccgagggugugaauuucagcuugaaauuccauugcuguuccuuguuuu

SEQ ID NO: 631798 - RNA, 65 nt, Homo Sapiens
ccguucaucucugaaacccagcauccuuuucagcugcuugaaaacauuguauuuuuuuuuuuuaa

SEQ ID NO: 631799 - RNA, 65 nt, Homo Sapiens
ccugacaaggaaggaguugagcccuggguaggcuugcuugaaaagugaguccuuccagaauauuc

SEQ ID NO: 631800 - RNA, 65 nt, Homo Sapiens
caaggaaagggucuuagucacugccucccgaaguugcuugaaagcacucggagaauugugcaggu

SEQ ID NO: 631801 - RNA, 65 nt, Homo Sapiens
ugcugcccagugucagaacaguuauacaaacgagggcuugaaaacauuuugugaaaacuugcuua

SEQ ID NO: 631802 - RNA, 65 nt, Homo Sapiens
acgauggugccucugggucaaaauggaaauaaacugcuugaaaagaaagucaacauuagaacuga

SEQ ID NO: 631803 - RNA, 65 nt, Homo Sapiens
uauaguuugaaauuaugacauuuauuacuaucuaggcuugaaauaucugcacaguccauucuguu

SEQ ID NO: 631804 - RNA, 65 nt, Homo Sapiens
uugcuaaacguaaauuuguacaugagauuuauggugcuugaaauguccuaaauguccaaaaagaa

SEQ ID NO: 631805 - RNA, 65 nt, Homo Sapiens
caggagaauucauacuggagcagucacaaaucacagcuugaaagagaagacugugacaaaguugu

SEQ ID NO: 631806 - RNA, 65 nt, Homo Sapiens
aacgcuccccucagacacccuuugucccaucgguagcuugaaauaaccugggaagccugggagug

SEQ ID NO: 631807 - RNA, 65 nt, Homo Sapiens
cuggaagccuugccuucccgcuucuacaugcuugagcuugaaaagcagucaccuccucggggacc

SEQ ID NO: 631808 - RNA, 65 nt, Homo Sapiens
uacuguuucaaugaccuuuauuuuaaaaacacauagcuugaaaauuuauuuuuauacugauauua

SEQ ID NO: 631809 - RNA, 65 nt, Homo Sapiens
ucuagcugaacaaaaaugugcaguuaauacuuggcgcuugaaaaugcaguagugaauguggaacc

SEQ ID NO: 631810 - RNA, 65 nt, Homo Sapiens
uguaaggucuucuuguguccugaugaaaaauaugugcuugaaaugagaaacuuugaucucugcuu

SEQ ID NO: 631811 - RNA, 65 nt, Homo Sapiens
uaugagaaaaguugcuugaauuauuugcaaaggaagcuugaaaaacauuucuaauagccuugggu

SEQ ID NO: 631812 - RNA, 65 nt, Homo Sapiens
uuucagaaccucuuccccaguuuuucugccagggagcuugaaaguccuuagccucccugaaaaug

SEQ ID NO: 631813 - RNA, 65 nt, Homo Sapiens
uugcuguacuauagagcucaguuuuucuggaaacugcuugaaaucaagaaaaugucguuguuguu

SEQ ID NO: 631814 - RNA, 65 nt, Homo Sapiens
cuacauuuccaaggugaagaucuacccugacuaaagcuugaaaugugaaaguaaagaaggaauaa

SEQ ID NO: 631815 - RNA, 65 nt, Homo Sapiens
uugugacuaaauugcacaaugaacacugaauuuuggcuugaaauauucgguaucuuuuaauauaa

SEQ ID NO: 631816 - RNA, 65 nt, Homo Sapiens
uauaaggaauggcaucagaacaauagcuuggaauggcuugaaaucacaaaggaucugcaagauga

SEQ ID NO: 631817 - RNA, 65 nt, Homo Sapiens
augaaaacugcagcauaucagacagcaauuuaacagcuugaaacaucuacagauaguuccuacua

SEQ ID NO: 631818 - RNA, 65 nt, Homo Sapiens
gucuuagcuacucaggaggcugaggcaggagaaucgcuugaaaacaggagguggagguugcagug

SEQ ID NO: 631819 - RNA, 65 nt, Homo Sapiens
uucuaggaaucauauguuguccaucccccccucaggcuugaaaguccucaaagagacccacuauc

SEQ ID NO: 631820 - RNA, 65 nt, Homo Sapiens
uguuaaaaauguucauaacaaccuuaucagcuguugcuugaaaccaaauaucuuaagagaugaau

SEQ ID NO: 631821 - RNA, 65 nt, Homo Sapiens
aaguuggaggcaaauugauaguuggagauuguuacgcuugaaauuuuuaaacaagaauaauaaag

SEQ ID NO: 631822 - RNA, 65 nt, Homo Sapiens
uugcugaaauguucucauuucaucaucucuugcuugcuugaaauccagucaccugaacaaugacc

SEQ ID NO: 631823 - RNA, 65 nt, Homo Sapiens
ucuuuuuucuauauacagaaucauguuacuccuaagcuugaaagccuauuuauuguuuugguauu

SEQ ID NO: 631824 - RNA, 65 nt, Homo Sapiens
cugugccagauggagccuuuaggagcccacacaaagcuugaaagcuggggagaagcuauagaaag

SEQ ID NO: 631825 - RNA, 65 nt, Homo Sapiens
cauccaagggugcacagggaauguuacccucauuggcuugaaaagucuggcuccugccaccacaa

SEQ ID NO: 631826 - RNA, 65 nt, Homo Sapiens
aaacugaauugagaaauacuucuucaaguuaugaugcuugaaaguucucaauaaaguucacgguu

SEQ ID NO: 631827 - RNA, 65 nt, Homo Sapiens
uguaaauuuacacuauuuauaaauacauauuuauugcuugaaaauauuugugaauggaaugcugu

SEQ ID NO: 631828 - RNA, 65 nt, Homo Sapiens
agcauauagcuauagauauaggcuuuuccuugaaagcuugaaaaaaauucgccaguaaaauaauc

SEQ ID NO: 631829 - RNA, 65 nt, Homo Sapiens
ugugaaaccaauaugguuuucuuuaugucuuggcugcuugaaaauuaaaaaaaaaaaagguuugu

SEQ ID NO: 631830 - RNA, 65 nt, Homo Sapiens
cucccaaaggaucuguacuuucuuuccuuacaacagcuugaaaaucauuauuuuaaaauccuuaa

SEQ ID NO: 631831 - RNA, 65 nt, Homo Sapiens
gaaauuuguuauguuuaaggaaauuaagauuuuaagcuugaaauuauacaagcagaaucuaauuu

SEQ ID NO: 631832 - RNA, 65 nt, Homo Sapiens
uugugcuaccaguuugcugguggcuaacggcuugugcuugaaagucuucugaagucugaugugaa

SEQ ID NO: 631833 - RNA, 65 nt, Homo Sapiens
uugcaugcauguugaaauuuuuuagcaguacuuuagcuugaaaguacucguacaaauacuguuag

SEQ ID NO: 631834 - RNA, 65 nt, Homo Sapiens
ccuagaaguaaugauauacaguuuucuuccuaguggcuugaaaaucuggacuuccucaauuauua

SEQ ID NO: 631835 - RNA, 65 nt, Homo Sapiens
gaaaagcaaucaauuauaccauaaauuuugaaugugcuugaaaguuucaccauucuucuuuugua

SEQ ID NO: 631836 - RNA, 65 nt, Homo Sapiens
auuuagcauuugaauaguaaauauaccuuauuaaagcuugaaaacgcuugguacuuggaauugau

SEQ ID NO: 631837 - RNA, 65 nt, Homo Sapiens
gauuagcauacaucuaauguuuuugaaguuugacugcuugaaaaaauaguaaauaaaacagugua

SEQ ID NO: 631838 - RNA, 65 nt, Homo Sapiens
aaaaguucaugaaguaccaacugaaacaaauauuugcuugaaaaagaaacugucagaauuguuaa

SEQ ID NO: 631839 - RNA, 65 nt, Homo Sapiens
ucaauaaacuuugcucuguugauuuuccaaauguagcuugaaauugguuccaggauuuggauuuu

SEQ ID NO: 631840 - RNA, 65 nt, Homo Sapiens
uucucaucucagaauacuuuugugucagauauugugcuugaaagauuuuaaaaucauguauuuaa

SEQ ID NO: 631841 - RNA, 65 nt, Homo Sapiens
acuggagcacguggucagggccaagggcacucgcugcuugaaagugcuaugaguuacuguggggu

SEQ ID NO: 631842 - RNA, 65 nt, Homo Sapiens
aacuugucgucacagcuggcaugggcuggacaguugcuugaaaugaccuaaccaaaaacauucaa

SEQ ID NO: 631843 - RNA, 65 nt, Homo Sapiens
aaauucacugacgaauucagagauugagggcacuugcuugaaaucaaggugcuccaacuuaguuu

SEQ ID NO: 631844 - RNA, 64 nt, Homo Sapiens; identical to SEQ ID NO: 235993

SEQ ID NO: 631845 - RNA, 64 nt, Homo Sapiens; identical to SEQ ID NO: 235994

SEQ ID NO: 631846 - RNA, 64 nt, Homo Sapiens; identical to SEQ ID NO: 235995

SEQ ID NO: 631847 - RNA, 64 nt, Homo Sapiens; identical to SEQ ID NO: 235996

SEQ ID NO: 631848 - RNA, 64 nt, Homo Sapiens; identical to SEQ ID NO: 235997

SEQ ID NO: 631849 - RNA, 64 nt, Homo Sapiens; identical to SEQ ID NO: 235998

SEQ ID NO: 631850 - RNA, 64 nt, Homo Sapiens; identical to SEQ ID NO: 284063

SEQ ID NO: 631851 - RNA, 64 nt, Homo Sapiens; identical to SEQ ID NO: 284064

SEQ ID NO: 631852 - RNA, 64 nt, Homo Sapiens; identical to SEQ ID NO: 284065

SEQ ID NO: 631853 - RNA, 64 nt, Homo Sapiens; identical to SEQ ID NO: 284066

SEQ ID NO: 631854 - RNA, 64 nt, Homo Sapiens; identical to SEQ ID NO: 284067

SEQ ID NO: 631855 - RNA, 64 nt, Homo Sapiens; identical to SEQ ID NO: 284068

SEQ ID NO: 631856 - RNA, 64 nt, Homo Sapiens; identical to SEQ ID NO: 284069

SEQ ID NO: 631857 - RNA, 64 nt, Homo Sapiens; identical to SEQ ID NO: 284070

SEQ ID NO: 631858 - RNA, 64 nt, Homo Sapiens; identical to SEQ ID NO: 284071

SEQ ID NO: 631859 - RNA, 64 nt, Homo Sapiens; identical to SEQ ID NO: 284072

SEQ ID NO: 631860 - RNA, 57 nt, Homo Sapiens; identical to SEQ ID NO: 284073

SEQ ID NO: 631861 - RNA, 64 nt, Homo Sapiens; identical to SEQ ID NO: 284074

SEQ ID NO: 631862 - RNA, 64 nt, Homo Sapiens; identical to SEQ ID NO: 284075

SEQ ID NO: 631863 - RNA, 64 nt, Homo Sapiens; identical to SEQ ID NO: 284076

SEQ ID NO: 631864 - RNA, 64 nt, Homo Sapiens; identical to SEQ ID NO: 284077

SEQ ID NO: 631865 - RNA, 64 nt, Homo Sapiens; identical to SEQ ID NO: 284078

SEQ ID NO: 631866 - RNA, 64 nt, Homo Sapiens; identical to SEQ ID NO: 284079

SEQ ID NO: 631867 - RNA, 64 nt, Homo Sapiens; identical to SEQ ID NO: 284080

SEQ ID NO: 631868 - RNA, 64 nt, Homo Sapiens; identical to SEQ ID NO: 284081

SEQ ID NO: 631869 - RNA, 64 nt, Homo Sapiens; identical to SEQ ID NO: 284082

SEQ ID NO: 631870 - RNA, 64 nt, Homo Sapiens; identical to SEQ ID NO: 284083

SEQ ID NO: 631871 - RNA, 64 nt, Homo Sapiens; identical to SEQ ID NO: 284084

SEQ ID NO: 631872 - RNA, 64 nt, Homo Sapiens; identical to SEQ ID NO: 284085

SEQ ID NO: 631873 - RNA, 64 nt, Homo Sapiens; identical to SEQ ID NO: 284086

SEQ ID NO: 631874 - RNA, 64 nt, Homo Sapiens; identical to SEQ ID NO: 284087

SEQ ID NO: 631875 - RNA, 64 nt, Homo Sapiens; identical to SEQ ID NO: 284088

SEQ ID NO: 631876 - RNA, 64 nt, Homo Sapiens; identical to SEQ ID NO: 284089

SEQ ID NO: 631877 - RNA, 64 nt, Homo Sapiens; identical to SEQ ID NO: 284090

SEQ ID NO: 631878 - RNA, 55 nt, Homo Sapiens; identical to SEQ ID NO: 284091

SEQ ID NO: 631879 - RNA, 64 nt, Homo Sapiens; identical to SEQ ID NO: 284092

SEQ ID NO: 631880 - RNA, 64 nt, Homo Sapiens; identical to SEQ ID NO: 284093

SEQ ID NO: 631881 - RNA, 64 nt, Homo Sapiens; identical to SEQ ID NO: 284094

SEQ ID NO: 631882 - RNA, 64 nt, Homo Sapiens; identical to SEQ ID NO: 284095

SEQ ID NO: 631883 - RNA, 64 nt, Homo Sapiens; identical to SEQ ID NO: 284096

SEQ ID NO: 631884 - RNA, 64 nt, Homo Sapiens; identical to SEQ ID NO: 284097

SEQ ID NO: 631885 - RNA, 64 nt, Homo Sapiens; identical to SEQ ID NO: 284098

SEQ ID NO: 631886 - RNA, 64 nt, Homo Sapiens; identical to SEQ ID NO: 284099

SEQ ID NO: 631887 - RNA, 64 nt, Homo Sapiens; identical to SEQ ID NO: 284100

SEQ ID NO: 631888 - RNA, 64 nt, Homo Sapiens; identical to SEQ ID NO: 284101

SEQ ID NO: 631889 - RNA, 64 nt, Homo Sapiens; identical to SEQ ID NO: 284102

SEQ ID NO: 631890 - RNA, 64 nt, Homo Sapiens; identical to SEQ ID NO: 284103

SEQ ID NO: 631891 - RNA, 64 nt, Homo Sapiens; identical to SEQ ID NO: 284104

SEQ ID NO: 631892 - RNA, 64 nt, Homo Sapiens; identical to SEQ ID NO: 284105

SEQ ID NO: 631893 - RNA, 64 nt, Homo Sapiens; identical to SEQ ID NO: 284106

SEQ ID NO: 631894 - RNA, 64 nt, Homo Sapiens; identical to SEQ ID NO: 284107

SEQ ID NO: 631895 - RNA, 64 nt, Homo Sapiens; identical to SEQ ID NO: 284108

SEQ ID NO: 631896 - RNA, 64 nt, Homo Sapiens; identical to SEQ ID NO: 284109

SEQ ID NO: 631897 - RNA, 64 nt, Homo Sapiens; identical to SEQ ID NO: 284110

SEQ ID NO: 631898 - RNA, 64 nt, Homo Sapiens; identical to SEQ ID NO: 284111

SEQ ID NO: 631899 - RNA, 64 nt, Homo Sapiens; identical to SEQ ID NO: 284112

SEQ ID NO: 631900 - RNA, 64 nt, Homo Sapiens; identical to SEQ ID NO: 284113

SEQ ID NO: 631901 - RNA, 64 nt, Homo Sapiens; identical to SEQ ID NO: 284114

SEQ ID NO: 631902 - RNA, 64 nt, Homo Sapiens; identical to SEQ ID NO: 284115

SEQ ID NO: 631903 - RNA, 64 nt, Homo Sapiens; identical to SEQ ID NO: 284116

SEQ ID NO: 631904 - RNA, 64 nt, Homo Sapiens; identical to SEQ ID NO: 284117

SEQ ID NO: 631905 - RNA, 64 nt, Homo Sapiens; identical to SEQ ID NO: 284118

SEQ ID NO: 631906 - RNA, 64 nt, Homo Sapiens; identical to SEQ ID NO: 284119

SEQ ID NO: 631907 - RNA, 64 nt, Homo Sapiens; identical to SEQ ID NO: 284120

SEQ ID NO: 631908 - RNA, 64 nt, Homo Sapiens; identical to SEQ ID NO: 284121

SEQ ID NO: 631909 - RNA, 64 nt, Homo Sapiens; identical to SEQ ID NO: 284122

SEQ ID NO: 631910 - RNA, 64 nt, Homo Sapiens; identical to SEQ ID NO: 284123

SEQ ID NO: 631911 - RNA, 64 nt, Homo Sapiens; identical to SEQ ID NO: 284124

SEQ ID NO: 631912 - RNA, 64 nt, Homo Sapiens; identical to SEQ ID NO: 284125

SEQ ID NO: 631913 - RNA, 64 nt, Homo Sapiens; identical to SEQ ID NO: 284126

SEQ ID NO: 631914 - RNA, 64 nt, Homo Sapiens; identical to SEQ ID NO: 284127

SEQ ID NO: 631915 - RNA, 64 nt, Homo Sapiens; identical to SEQ ID NO: 284128

SEQ ID NO: 631916 - RNA, 64 nt, Homo Sapiens; identical to SEQ ID NO: 284129

SEQ ID NO: 631917 - RNA, 64 nt, Homo Sapiens; identical to SEQ ID NO: 284130

SEQ ID NO: 631918 - RNA, 64 nt, Homo Sapiens; identical to SEQ ID NO: 175619

SEQ ID NO: 631919 - RNA, 64 nt, Homo Sapiens; identical to SEQ ID NO: 175620

SEQ ID NO: 631920 - RNA, 64 nt, Homo Sapiens; identical to SEQ ID NO: 175621

SEQ ID NO: 631921 - RNA, 64 nt, Homo Sapiens; identical to SEQ ID NO: 175622

SEQ ID NO: 631922 - RNA, 64 nt, Homo Sapiens; identical to SEQ ID NO: 175623

SEQ ID NO: 631923 - RNA, 64 nt, Homo Sapiens; identical to SEQ ID NO: 175624

SEQ ID NO: 631924 - RNA, 64 nt, Homo Sapiens; identical to SEQ ID NO: 175625

SEQ ID NO: 631925 - RNA, 64 nt, Homo Sapiens; identical to SEQ ID NO: 175626

SEQ ID NO: 631926 - RNA, 64 nt, Homo Sapiens; identical to SEQ ID NO: 175627

SEQ ID NO: 631927 - RNA, 64 nt, Homo Sapiens; identical to SEQ ID NO: 175628

SEQ ID NO: 631928 - RNA, 64 nt, Homo Sapiens; identical to SEQ ID NO: 175629

SEQ ID NO: 631929 - RNA, 64 nt, Homo Sapiens; identical to SEQ ID NO: 175630

SEQ ID NO: 631930 - RNA, 64 nt, Homo Sapiens; identical to SEQ ID NO: 175631

SEQ ID NO: 631931 - RNA, 64 nt, Homo Sapiens; identical to SEQ ID NO: 175632

SEQ ID NO: 631932 - RNA, 64 nt, Homo Sapiens; identical to SEQ ID NO: 61495

SEQ ID NO: 631933 - RNA, 64 nt, Homo Sapiens; identical to SEQ ID NO: 61496

SEQ ID NO: 631934 - RNA, 64 nt, Homo Sapiens; identical to SEQ ID NO: 61497

SEQ ID NO: 631935 - RNA, 64 nt, Homo Sapiens; identical to SEQ ID NO: 61498

SEQ ID NO: 631936 - RNA, 64 nt, Homo Sapiens; identical to SEQ ID NO: 61499

SEQ ID NO: 631937 - RNA, 64 nt, Homo Sapiens; identical to SEQ ID NO: 61500

SEQ ID NO: 631938 - RNA, 64 nt, Homo Sapiens; identical to SEQ ID NO: 61501

SEQ ID NO: 631939 - RNA, 64 nt, Homo Sapiens; identical to SEQ ID NO: 61502

SEQ ID NO: 631940 - RNA, 64 nt, Homo Sapiens; identical to SEQ ID NO: 61503

SEQ ID NO: 631941 - RNA, 64 nt, Homo Sapiens; identical to SEQ ID NO: 61504

SEQ ID NO: 631942 - RNA, 64 nt, Homo Sapiens; identical to SEQ ID NO: 61505

SEQ ID NO: 631943 - RNA, 64 nt, Homo Sapiens; identical to SEQ ID NO: 61506

SEQ ID NO: 631944 - RNA, 64 nt, Homo Sapiens; identical to SEQ ID NO: 61507

SEQ ID NO: 631945 - RNA, 64 nt, Homo Sapiens; identical to SEQ ID NO: 61508

SEQ ID NO: 631946 - RNA, 64 nt, Homo Sapiens; identical to SEQ ID NO: 61509

SEQ ID NO: 631947 - RNA, 64 nt, Homo Sapiens; identical to SEQ ID NO: 61510

SEQ ID NO: 631948 - RNA, 64 nt, Homo Sapiens; identical to SEQ ID NO: 61511

SEQ ID NO: 631949 - RNA, 64 nt, Homo Sapiens; identical to SEQ ID NO: 61512

SEQ ID NO: 631950 - RNA, 64 nt, Homo Sapiens; identical to SEQ ID NO: 61513

SEQ ID NO: 631951 - RNA, 64 nt, Homo Sapiens; identical to SEQ ID NO: 61514

SEQ ID NO: 631952 - RNA, 64 nt, Homo Sapiens; identical to SEQ ID NO: 61515

SEQ ID NO: 631953 - RNA, 64 nt, Homo Sapiens; identical to SEQ ID NO: 61516

SEQ ID NO: 631954 - RNA, 64 nt, Homo Sapiens; identical to SEQ ID NO: 61517

SEQ ID NO: 631955 - RNA, 64 nt, Homo Sapiens; identical to SEQ ID NO: 175619

SEQ ID NO: 631956 - RNA, 64 nt, Homo Sapiens; identical to SEQ ID NO: 175620

SEQ ID NO: 631957 - RNA, 64 nt, Homo Sapiens; identical to SEQ ID NO: 175621

SEQ ID NO: 631958 - RNA, 64 nt, Homo Sapiens; identical to SEQ ID NO: 175622

SEQ ID NO: 631959 - RNA, 64 nt, Homo Sapiens; identical to SEQ ID NO: 175623

SEQ ID NO: 631960 - RNA, 64 nt, Homo Sapiens; identical to SEQ ID NO: 175624

SEQ ID NO: 631961 - RNA, 64 nt, Homo Sapiens; identical to SEQ ID NO: 175625

SEQ ID NO: 631962 - RNA, 64 nt, Homo Sapiens; identical to SEQ ID NO: 175626

SEQ ID NO: 631963 - RNA, 64 nt, Homo Sapiens; identical to SEQ ID NO: 175627

SEQ ID NO: 631964 - RNA, 64 nt, Homo Sapiens; identical to SEQ ID NO: 175628

SEQ ID NO: 631965 - RNA, 64 nt, Homo Sapiens; identical to SEQ ID NO: 175629

SEQ ID NO: 631966 - RNA, 64 nt, Homo Sapiens; identical to SEQ ID NO: 175630

SEQ ID NO: 631967 - RNA, 64 nt, Homo Sapiens; identical to SEQ ID NO: 175631

SEQ ID NO: 631968 - RNA, 64 nt, Homo Sapiens; identical to SEQ ID NO: 175632

SEQ ID NO: 631969 - RNA, 64 nt, Homo Sapiens; identical to SEQ ID NO: 61495

SEQ ID NO: 631970 - RNA, 64 nt, Homo Sapiens; identical to SEQ ID NO: 61496

SEQ ID NO: 631971 - RNA, 64 nt, Homo Sapiens; identical to SEQ ID NO: 61497

SEQ ID NO: 631972 - RNA, 64 nt, Homo Sapiens; identical to SEQ ID NO: 61498

SEQ ID NO: 631973 - RNA, 64 nt, Homo Sapiens; identical to SEQ ID NO: 61499

SEQ ID NO: 631974 - RNA, 64 nt, Homo Sapiens; identical to SEQ ID NO: 61500

SEQ ID NO: 631975 - RNA, 64 nt, Homo Sapiens; identical to SEQ ID NO: 61501

SEQ ID NO: 631976 - RNA, 64 nt, Homo Sapiens; identical to SEQ ID NO: 61502

SEQ ID NO: 631977 - RNA, 64 nt, Homo Sapiens; identical to SEQ ID NO: 61503

SEQ ID NO: 631978 - RNA, 64 nt, Homo Sapiens; identical to SEQ ID NO: 61504

SEQ ID NO: 631979 - RNA, 64 nt, Homo Sapiens; identical to SEQ ID NO: 61505

SEQ ID NO: 631980 - RNA, 64 nt, Homo Sapiens; identical to SEQ ID NO: 61506

SEQ ID NO: 631981 - RNA, 64 nt, Homo Sapiens; identical to SEQ ID NO: 61507

SEQ ID NO: 631982 - RNA, 64 nt, Homo Sapiens; identical to SEQ ID NO: 61508

SEQ ID NO: 631983 - RNA, 64 nt, Homo Sapiens; identical to SEQ ID NO: 61509

SEQ ID NO: 631984 - RNA, 64 nt, Homo Sapiens; identical to SEQ ID NO: 61510

SEQ ID NO: 631985 - RNA, 64 nt, Homo Sapiens; identical to SEQ ID NO: 61511

SEQ ID NO: 631986 - RNA, 64 nt, Homo Sapiens; identical to SEQ ID NO: 61512

SEQ ID NO: 631987 - RNA, 64 nt, Homo Sapiens; identical to SEQ ID NO: 61513

SEQ ID NO: 631988 - RNA, 64 nt, Homo Sapiens; identical to SEQ ID NO: 61514

SEQ ID NO: 631989 - RNA, 64 nt, Homo Sapiens; identical to SEQ ID NO: 61515

SEQ ID NO: 631990 - RNA, 64 nt, Homo Sapiens; identical to SEQ ID NO: 61516

SEQ ID NO: 631991 - RNA, 64 nt, Homo Sapiens; identical to SEQ ID NO: 61517

SEQ ID NO: 631992 - RNA, 63 nt, Homo Sapiens; identical to SEQ ID NO: 118067

SEQ ID NO: 631993 - RNA, 64 nt, Homo Sapiens; identical to SEQ ID NO: 118068

SEQ ID NO: 631994 - RNA, 64 nt, Homo Sapiens; identical to SEQ ID NO: 118069

SEQ ID NO: 631995 - RNA, 64 nt, Homo Sapiens; identical to SEQ ID NO: 118070

SEQ ID NO: 631996 - RNA, 64 nt, Homo Sapiens; identical to SEQ ID NO: 118071

SEQ ID NO: 631997 - RNA, 64 nt, Homo Sapiens; identical to SEQ ID NO: 118072

SEQ ID NO: 631998 - RNA, 64 nt, Homo Sapiens; identical to SEQ ID NO: 118073

SEQ ID NO: 631999 - RNA, 64 nt, Homo Sapiens; identical to SEQ ID NO: 118074

SEQ ID NO: 632000 - RNA, 64 nt, Homo Sapiens; identical to SEQ ID NO: 118075

SEQ ID NO: 632001 - RNA, 64 nt, Homo Sapiens; identical to SEQ ID NO: 118076

SEQ ID NO: 632002 - RNA, 64 nt, Homo Sapiens; identical to SEQ ID NO: 118077

SEQ ID NO: 632003 - RNA, 64 nt, Homo Sapiens; identical to SEQ ID NO: 118078

SEQ ID NO: 632004 - RNA, 64 nt, Homo Sapiens; identical to SEQ ID NO: 118079

SEQ ID NO: 632005 - RNA, 64 nt, Homo Sapiens; identical to SEQ ID NO: 118080

SEQ ID NO: 632006 - RNA, 64 nt, Homo Sapiens; identical to SEQ ID NO: 118081

SEQ ID NO: 632007 - RNA, 64 nt, Homo Sapiens; identical to SEQ ID NO: 118082

SEQ ID NO: 632008 - RNA, 64 nt, Homo Sapiens; identical to SEQ ID NO: 118083

SEQ ID NO: 632009 - RNA, 64 nt, Homo Sapiens; identical to SEQ ID NO: 118084

SEQ ID NO: 632010 - RNA, 64 nt, Homo Sapiens; identical to SEQ ID NO: 118085

SEQ ID NO: 632011 - RNA, 64 nt, Homo Sapiens; identical to SEQ ID NO: 118086

SEQ ID NO: 632012 - RNA, 64 nt, Homo Sapiens; identical to SEQ ID NO: 118087

SEQ ID NO: 632013 - RNA, 64 nt, Homo Sapiens; identical to SEQ ID NO: 118088

SEQ ID NO: 632014 - RNA, 64 nt, Homo Sapiens; identical to SEQ ID NO: 118089

SEQ ID NO: 632015 - RNA, 64 nt, Homo Sapiens; identical to SEQ ID NO: 118090

SEQ ID NO: 632016 - RNA, 64 nt, Homo Sapiens; identical to SEQ ID NO: 118091

SEQ ID NO: 632017 - RNA, 64 nt, Homo Sapiens; identical to SEQ ID NO: 118092

SEQ ID NO: 632018 - RNA, 64 nt, Homo Sapiens; identical to SEQ ID NO: 118093

SEQ ID NO: 632019 - RNA, 64 nt, Homo Sapiens; identical to SEQ ID NO: 118094

SEQ ID NO: 632020 - RNA, 64 nt, Homo Sapiens; identical to SEQ ID NO: 118095

SEQ ID NO: 632021 - RNA, 64 nt, Homo Sapiens; identical to SEQ ID NO: 118096

SEQ ID NO: 632022 - RNA, 64 nt, Homo Sapiens; identical to SEQ ID NO: 118097

SEQ ID NO: 632023 - RNA, 64 nt, Homo Sapiens; identical to SEQ ID NO: 118098

SEQ ID NO: 632024 - RNA, 64 nt, Homo Sapiens; identical to SEQ ID NO: 118099

SEQ ID NO: 632025 - RNA, 64 nt, Homo Sapiens; identical to SEQ ID NO: 118100

SEQ ID NO: 632026 - RNA, 64 nt, Homo Sapiens; identical to SEQ ID NO: 118101

SEQ ID NO: 632027 - RNA, 64 nt, Homo Sapiens; identical to SEQ ID NO: 118102

SEQ ID NO: 632028 - RNA, 64 nt, Homo Sapiens; identical to SEQ ID NO: 118103

SEQ ID NO: 632029 - RNA, 64 nt, Homo Sapiens; identical to SEQ ID NO: 118104

SEQ ID NO: 632030 - RNA, 64 nt, Homo Sapiens; identical to SEQ ID NO: 118105

SEQ ID NO: 632031 - RNA, 64 nt, Homo Sapiens; identical to SEQ ID NO: 118106

SEQ ID NO: 632032 - RNA, 64 nt, Homo Sapiens; identical to SEQ ID NO: 118107

SEQ ID NO: 632033 - RNA, 64 nt, Homo Sapiens; identical to SEQ ID NO: 118108

SEQ ID NO: 632034 - RNA, 64 nt, Homo Sapiens; identical to SEQ ID NO: 118109

SEQ ID NO: 632035 - RNA, 64 nt, Homo Sapiens; identical to SEQ ID NO: 118110

SEQ ID NO: 632036 - RNA, 64 nt, Homo Sapiens; identical to SEQ ID NO: 118111

SEQ ID NO: 632037 - RNA, 64 nt, Homo Sapiens; identical to SEQ ID NO: 118112

SEQ ID NO: 632038 - RNA, 64 nt, Homo Sapiens; identical to SEQ ID NO: 118113

SEQ ID NO: 632039 - RNA, 64 nt, Homo Sapiens; identical to SEQ ID NO: 118114

SEQ ID NO: 632040 - RNA, 64 nt, Homo Sapiens; identical to SEQ ID NO: 118115

SEQ ID NO: 632041 - RNA, 64 nt, Homo Sapiens; identical to SEQ ID NO: 118116

SEQ ID NO: 632042 - RNA, 64 nt, Homo Sapiens; identical to SEQ ID NO: 118117

SEQ ID NO: 632043 - RNA, 64 nt, Homo Sapiens; identical to SEQ ID NO: 118118

SEQ ID NO: 632044 - RNA, 64 nt, Homo Sapiens; identical to SEQ ID NO: 118119

SEQ ID NO: 632045 - RNA, 64 nt, Homo Sapiens; identical to SEQ ID NO: 118120

SEQ ID NO: 632046 - RNA, 64 nt, Homo Sapiens; identical to SEQ ID NO: 118121

SEQ ID NO: 632047 - RNA, 64 nt, Homo Sapiens
acacacacacacacacacacacacacacacacacacacacaagaccugggcccuuaaguuuaca

SEQ ID NO: 632048 - RNA, 64 nt, Homo Sapiens
ugugugugugugugugugugucucccucucucacacacacaagagcaguuugcuguugcuguuu

SEQ ID NO: 632049 - RNA, 64 nt, Homo Sapiens
uauccauagguuucucucccuccuucuccuucucacacacaacuguccauacuaacaaguuugg

SEQ ID NO: 632050 - RNA, 64 nt, Homo Sapiens
cuguaauggguacaaugaagaaguuucuaaaaacacacacaaagcacauugggccaacuauuua

SEQ ID NO: 632051 - RNA, 64 nt, Homo Sapiens
gggggcaaccacauccaguaacacacacaaccacacacacaaauggccaccaacacacaaccac

SEQ ID NO: 632052 - RNA, 64 nt, Homo Sapiens
acacacacaaaugggggcaaacacacaaccacacacacacaaccaggcucagcuguggccacca

SEQ ID NO: 632053 - RNA, 64 nt, Homo Sapiens
acacacacacaaccacacacagcuguggccaccaacacacaaccuucucuggugacagaggcuc

SEQ ID NO: 632054 - RNA, 64 nt, Homo Sapiens
ucgaaaaugcaaacuuggggagggcggaaacaucacacacaagguuuccacuucacacuuggag

SEQ ID NO: 632055 - RNA, 64 nt, Homo Sapiens
uuucuaaggauaccagaaaggaaauggcaugcacacacacaaaaaauaccuaaauuuuggauga

SEQ ID NO: 632056 - RNA, 64 nt, Homo Sapiens
uaucuuaaaacuccuguuucauaaaccuuuuuggacacacaaauguucaaguccugccucuuaa

SEQ ID NO: 632057 - RNA, 64 nt, Homo Sapiens
ugucugagagauucaugcugagccuacaggccucacacacaaugucaaccucuguauuugaauc

SEQ ID NO: 632058 - RNA, 64 nt, Homo Sapiens
ucaagaaaacagcaagggagacacacaaaugcagacacacaacaacacacgcagacacacacac

SEQ ID NO: 632059 - RNA, 64 nt, Homo Sapiens
gcagacacacaacaucaagagcagacacacacacacacacaaaugugauggaacacacacacac

SEQ ID NO: 632060 - RNA, 64 nt, Homo Sapiens
aagcacaagcccgcugcauguaaaacacacaaacacacacaaaaucauuuggagauguauggug

SEQ ID NO: 632061 - RNA, 64 nt, Homo Sapiens
acacacaaaaaagcacaagcauguaugguguaaaacacacaaacaauaaauacuucauuuggag

SEQ ID NO: 632062 - RNA, 64 nt, Homo Sapiens
acgucugcgcagcaagaaaacacacaaaauaaagacacacaaggcacacacacacacacacaca

SEQ ID NO: 632063 - RNA, 64 nt, Homo Sapiens
uaaagacacacaaggacgucacacacacacacacacacacaaaaccuaucccagcaaaacacac

SEQ ID NO: 632064 - RNA, 64 nt, Homo Sapiens
uucacgauguauggucaggaacaaacacacacacacacacaauuauacacacacacccacacac

SEQ ID NO: 632065 - RNA, 64 nt, Homo Sapiens
acacacacacacacaauuuuacacacacacccacacacacaaacaccagcauauacauggacau

SEQ ID NO: 632066 - RNA, 64 nt, Homo Sapiens
uauauaucuaucuaucuauaauauauauauaucuacacacaaauaaauacguaauaaagaauac

SEQ ID NO: 632067 - RNA, 64 nt, Homo Sapiens
aaaaaaaucacuaaaaauucucaaauggggaaaaacacacaaaauuuuaagggggggaaagguu

SEQ ID NO: 632068 - RNA, 64 nt, Homo Sapiens
cuucuccaucucacccucccucucucacacauacacacacaaacacauacacacaacacuaagu

SEQ ID NO: 632069 - RNA, 64 nt, Homo Sapiens
ccucccucucucacacauacacacacaaacacauacacacaacacuaagugccuagacuuuaaa

SEQ ID NO: 632070 - RNA, 64 nt, Homo Sapiens
gcacagagcacacugcacacacagaccacacagcacacacaagucagcacaugcacacaggugc

SEQ ID NO: 632071 - RNA, 64 nt, Homo Sapiens
ugcauaggccacacagcacagcacuaacacaugcacacacaaagaagugcacagaccacacaca

SEQ ID NO: 632072 - RNA, 64 nt, Homo Sapiens
gaguugagcuuuaacagccauggcaauuacacacacacacaaacauacacucacacacacaauu

SEQ ID NO: 632073 - RNA, 64 nt, Homo Sapiens
uggcaauuacacacacacacaaacauacacucacacacacaauuacuauguauaacauauauga

SEQ ID NO: 632074 - RNA, 64 nt, Homo Sapiens
aggaacuacaagagagucggagaugaugcagcacacacacaauuccccagcccagugaugcuug

SEQ ID NO: 632075 - RNA, 64 nt, Homo Sapiens
aaagcagcagacaacacacuguagagucuugcacacacacaagugcccaggcaaggugcuuggc

SEQ ID NO: 632076 - RNA, 64 nt, Homo Sapiens; identical to SEQ ID NO: 91262

SEQ ID NO: 632077 - RNA, 64 nt, Homo Sapiens; identical to SEQ ID NO: 91263

SEQ ID NO: 632078 - RNA, 64 nt, Homo Sapiens; identical to SEQ ID NO: 91264

SEQ ID NO: 632079 - RNA, 64 nt, Homo Sapiens; identical to SEQ ID NO: 91265

SEQ ID NO: 632080 - RNA, 64 nt, Homo Sapiens; identical to SEQ ID NO: 91266

SEQ ID NO: 632081 - RNA, 64 nt, Homo Sapiens; identical to SEQ ID NO: 91267

SEQ ID NO: 632082 - RNA, 64 nt, Homo Sapiens; identical to SEQ ID NO: 91268

SEQ ID NO: 632083 - RNA, 64 nt, Homo Sapiens; identical to SEQ ID NO: 91269

SEQ ID NO: 632084 - RNA, 64 nt, Homo Sapiens; identical to SEQ ID NO: 91270

SEQ ID NO: 632085 - RNA, 64 nt, Homo Sapiens; identical to SEQ ID NO: 91271

SEQ ID NO: 632086 - RNA, 64 nt, Homo Sapiens; identical to SEQ ID NO: 91272

SEQ ID NO: 632087 - RNA, 64 nt, Homo Sapiens; identical to SEQ ID NO: 91273

SEQ ID NO: 632088 - RNA, 64 nt, Homo Sapiens; identical to SEQ ID NO: 91274

SEQ ID NO: 632089 - RNA, 64 nt, Homo Sapiens; identical to SEQ ID NO: 91275

SEQ ID NO: 632090 - RNA, 64 nt, Homo Sapiens; identical to SEQ ID NO: 91276

SEQ ID NO: 632091 - RNA, 64 nt, Homo Sapiens; identical to SEQ ID NO: 91277

SEQ ID NO: 632092 - RNA, 64 nt, Homo Sapiens; identical to SEQ ID NO: 91278

SEQ ID NO: 632093 - RNA, 64 nt, Homo Sapiens; identical to SEQ ID NO: 91279

SEQ ID NO: 632094 - RNA, 64 nt, Homo Sapiens; identical to SEQ ID NO: 91280

SEQ ID NO: 632095 - RNA, 64 nt, Homo Sapiens; identical to SEQ ID NO: 91281

SEQ ID NO: 632096 - RNA, 64 nt, Homo Sapiens; identical to SEQ ID NO: 91282

SEQ ID NO: 632097 - RNA, 64 nt, Homo Sapiens; identical to SEQ ID NO: 91283

SEQ ID NO: 632098 - RNA, 64 nt, Homo Sapiens; identical to SEQ ID NO: 91284

SEQ ID NO: 632099 - RNA, 64 nt, Homo Sapiens; identical to SEQ ID NO: 91285

SEQ ID NO: 632100 - RNA, 64 nt, Homo Sapiens; identical to SEQ ID NO: 91286

SEQ ID NO: 632101 - RNA, 64 nt, Homo Sapiens; identical to SEQ ID NO: 91287

SEQ ID NO: 632102 - RNA, 64 nt, Homo Sapiens; identical to SEQ ID NO: 91288

SEQ ID NO: 632103 - RNA, 64 nt, Homo Sapiens; identical to SEQ ID NO: 91289

SEQ ID NO: 632104 - RNA, 64 nt, Homo Sapiens; identical to SEQ ID NO: 91290

SEQ ID NO: 632105 - RNA, 64 nt, Homo Sapiens; identical to SEQ ID NO: 91291

SEQ ID NO: 632106 - RNA, 64 nt, Homo Sapiens; identical to SEQ ID NO: 91292

SEQ ID NO: 632107 - RNA, 64 nt, Homo Sapiens; identical to SEQ ID NO: 91293

SEQ ID NO: 632108 - RNA, 64 nt, Homo Sapiens; identical to SEQ ID NO: 91294

SEQ ID NO: 632109 - RNA, 64 nt, Homo Sapiens; identical to SEQ ID NO: 91295

SEQ ID NO: 632110 - RNA, 64 nt, Homo Sapiens; identical to SEQ ID NO: 91296

SEQ ID NO: 632111 - RNA, 64 nt, Homo Sapiens; identical to SEQ ID NO: 91297

SEQ ID NO: 632112 - RNA, 64 nt, Homo Sapiens; identical to SEQ ID NO: 91298

SEQ ID NO: 632113 - RNA, 64 nt, Homo Sapiens; identical to SEQ ID NO: 91299

SEQ ID NO: 632114 - RNA, 64 nt, Homo Sapiens; identical to SEQ ID NO: 91300

SEQ ID NO: 632115 - RNA, 64 nt, Homo Sapiens; identical to SEQ ID NO: 91301

SEQ ID NO: 632116 - RNA, 64 nt, Homo Sapiens; identical to SEQ ID NO: 91302

SEQ ID NO: 632117 - RNA, 64 nt, Homo Sapiens; identical to SEQ ID NO: 91303

SEQ ID NO: 632118 - RNA, 64 nt, Homo Sapiens; identical to SEQ ID NO: 91304

SEQ ID NO: 632119 - RNA, 64 nt, Homo Sapiens; identical to SEQ ID NO: 91305

SEQ ID NO: 632120 - RNA, 64 nt, Homo Sapiens; identical to SEQ ID NO: 91306

SEQ ID NO: 632121 - RNA, 64 nt, Homo Sapiens; identical to SEQ ID NO: 91307

SEQ ID NO: 632122 - RNA, 64 nt, Homo Sapiens; identical to SEQ ID NO: 91308

SEQ ID NO: 632123 - RNA, 64 nt, Homo Sapiens; identical to SEQ ID NO: 91309

SEQ ID NO: 632124 - RNA, 64 nt, Homo Sapiens; identical to SEQ ID NO: 91310

SEQ ID NO: 632125 - RNA, 64 nt, Homo Sapiens; identical to SEQ ID NO: 91311

SEQ ID NO: 632126 - RNA, 64 nt, Homo Sapiens; identical to SEQ ID NO: 91312

SEQ ID NO: 632127 - RNA, 64 nt, Homo Sapiens; identical to SEQ ID NO: 91313

SEQ ID NO: 632128 - RNA, 64 nt, Homo Sapiens; identical to SEQ ID NO: 91314

SEQ ID NO: 632129 - RNA, 64 nt, Homo Sapiens; identical to SEQ ID NO: 91315

SEQ ID NO: 632130 - RNA, 64 nt, Homo Sapiens; identical to SEQ ID NO: 91316

SEQ ID NO: 632131 - RNA, 64 nt, Homo Sapiens; identical to SEQ ID NO: 91317

SEQ ID NO: 632132 - RNA, 64 nt, Homo Sapiens; identical to SEQ ID NO: 91318

SEQ ID NO: 632133 - RNA, 64 nt, Homo Sapiens; identical to SEQ ID NO: 91319

SEQ ID NO: 632134 - RNA, 64 nt, Homo Sapiens; identical to SEQ ID NO: 91320

SEQ ID NO: 632135 - RNA, 64 nt, Homo Sapiens; identical to SEQ ID NO: 91321

SEQ ID NO: 632136 - RNA, 64 nt, Homo Sapiens; identical to SEQ ID NO: 91322

SEQ ID NO: 632137 - RNA, 64 nt, Homo Sapiens; identical to SEQ ID NO: 91323

SEQ ID NO: 632138 - RNA, 64 nt, Homo Sapiens; identical to SEQ ID NO: 91324

SEQ ID NO: 632139 - RNA, 64 nt, Homo Sapiens; identical to SEQ ID NO: 91325

SEQ ID NO: 632140 - RNA, 64 nt, Homo Sapiens; identical to SEQ ID NO: 91326

SEQ ID NO: 632141 - RNA, 64 nt, Homo Sapiens; identical to SEQ ID NO: 91327

SEQ ID NO: 632142 - RNA, 64 nt, Homo Sapiens; identical to SEQ ID NO: 91328

SEQ ID NO: 632143 - RNA, 64 nt, Homo Sapiens; identical to SEQ ID NO: 91329

SEQ ID NO: 632144 - RNA, 64 nt, Homo Sapiens; identical to SEQ ID NO: 91330

SEQ ID NO: 632145 - RNA, 64 nt, Homo Sapiens; identical to SEQ ID NO: 91331

SEQ ID NO: 632146 - RNA, 64 nt, Homo Sapiens; identical to SEQ ID NO: 91332

SEQ ID NO: 632147 - RNA, 64 nt, Homo Sapiens; identical to SEQ ID NO: 91333

SEQ ID NO: 632148 - RNA, 64 nt, Homo Sapiens; identical to SEQ ID NO: 91334

SEQ ID NO: 632149 - RNA, 64 nt, Homo Sapiens; identical to SEQ ID NO: 91335

SEQ ID NO: 632150 - RNA, 64 nt, Homo Sapiens; identical to SEQ ID NO: 91336

SEQ ID NO: 632151 - RNA, 64 nt, Homo Sapiens; identical to SEQ ID NO: 91337

SEQ ID NO: 632152 - RNA, 64 nt, Homo Sapiens; identical to SEQ ID NO: 91338

SEQ ID NO: 632153 - RNA, 64 nt, Homo Sapiens; identical to SEQ ID NO: 91339

SEQ ID NO: 632154 - RNA, 64 nt, Homo Sapiens; identical to SEQ ID NO: 91340

SEQ ID NO: 632155 - RNA, 64 nt, Homo Sapiens; identical to SEQ ID NO: 91341

SEQ ID NO: 632156 - RNA, 64 nt, Homo Sapiens; identical to SEQ ID NO: 91342

SEQ ID NO: 632157 - RNA, 64 nt, Homo Sapiens; identical to SEQ ID NO: 91343

SEQ ID NO: 632158 - RNA, 64 nt, Homo Sapiens; identical to SEQ ID NO: 91344

SEQ ID NO: 632159 - RNA, 64 nt, Homo Sapiens; identical to SEQ ID NO: 91345

SEQ ID NO: 632160 - RNA, 64 nt, Homo Sapiens; identical to SEQ ID NO: 91346

SEQ ID NO: 632161 - RNA, 64 nt, Homo Sapiens; identical to SEQ ID NO: 91347

SEQ ID NO: 632162 - RNA, 64 nt, Homo Sapiens; identical to SEQ ID NO: 91348

SEQ ID NO: 632163 - RNA, 64 nt, Homo Sapiens; identical to SEQ ID NO: 91349

SEQ ID NO: 632164 - RNA, 64 nt, Homo Sapiens; identical to SEQ ID NO: 91350

SEQ ID NO: 632165 - RNA, 64 nt, Homo Sapiens; identical to SEQ ID NO: 91351

SEQ ID NO: 632166 - RNA, 64 nt, Homo Sapiens; identical to SEQ ID NO: 91352

SEQ ID NO: 632167 - RNA, 64 nt, Homo Sapiens; identical to SEQ ID NO: 91353

SEQ ID NO: 632168 - RNA, 54 nt, Homo Sapiens; identical to SEQ ID NO: 91354

SEQ ID NO: 632169 - RNA, 64 nt, Homo Sapiens; identical to SEQ ID NO: 91355

SEQ ID NO: 632170 - RNA, 64 nt, Homo Sapiens; identical to SEQ ID NO: 91356

SEQ ID NO: 632171 - RNA, 64 nt, Homo Sapiens; identical to SEQ ID NO: 91357

SEQ ID NO: 632172 - RNA, 64 nt, Homo Sapiens; identical to SEQ ID NO: 91358

SEQ ID NO: 632173 - RNA, 64 nt, Homo Sapiens; identical to SEQ ID NO: 91359

SEQ ID NO: 632174 - RNA, 64 nt, Homo Sapiens; identical to SEQ ID NO: 91360

SEQ ID NO: 632175 - RNA, 64 nt, Homo Sapiens; identical to SEQ ID NO: 91361

SEQ ID NO: 632176 - RNA, 64 nt, Homo Sapiens; identical to SEQ ID NO: 91362

SEQ ID NO: 632177 - RNA, 64 nt, Homo Sapiens; identical to SEQ ID NO: 91363

SEQ ID NO: 632178 - RNA, 64 nt, Homo Sapiens; identical to SEQ ID NO: 91364

SEQ ID NO: 632179 - RNA, 64 nt, Homo Sapiens; identical to SEQ ID NO: 91365

SEQ ID NO: 632180 - RNA, 64 nt, Homo Sapiens; identical to SEQ ID NO: 91366

SEQ ID NO: 632181 - RNA, 64 nt, Homo Sapiens; identical to SEQ ID NO: 91367

SEQ ID NO: 632182 - RNA, 64 nt, Homo Sapiens; identical to SEQ ID NO: 91368

SEQ ID NO: 632183 - RNA, 64 nt, Homo Sapiens; identical to SEQ ID NO: 91369

SEQ ID NO: 632184 - RNA, 64 nt, Homo Sapiens; identical to SEQ ID NO: 91370

SEQ ID NO: 632185 - RNA, 64 nt, Homo Sapiens; identical to SEQ ID NO: 91371

SEQ ID NO: 632186 - RNA, 64 nt, Homo Sapiens; identical to SEQ ID NO: 91372

SEQ ID NO: 632187 - RNA, 64 nt, Homo Sapiens; identical to SEQ ID NO: 91373

SEQ ID NO: 632188 - RNA, 64 nt, Homo Sapiens; identical to SEQ ID NO: 91374

SEQ ID NO: 632189 - RNA, 64 nt, Homo Sapiens; identical to SEQ ID NO: 91375

SEQ ID NO: 632190 - RNA, 64 nt, Homo Sapiens; identical to SEQ ID NO: 91376

SEQ ID NO: 632191 - RNA, 64 nt, Homo Sapiens; identical to SEQ ID NO: 91377

SEQ ID NO: 632192 - RNA, 64 nt, Homo Sapiens; identical to SEQ ID NO: 91378

SEQ ID NO: 632193 - RNA, 64 nt, Homo Sapiens; identical to SEQ ID NO: 91379

SEQ ID NO: 632194 - RNA, 64 nt, Homo Sapiens; identical to SEQ ID NO: 91380

SEQ ID NO: 632195 - RNA, 64 nt, Homo Sapiens; identical to SEQ ID NO: 133550

SEQ ID NO: 632196 - RNA, 64 nt, Homo Sapiens; identical to SEQ ID NO: 133551

SEQ ID NO: 632197 - RNA, 64 nt, Homo Sapiens; identical to SEQ ID NO: 133552

SEQ ID NO: 632198 - RNA, 64 nt, Homo Sapiens; identical to SEQ ID NO: 133553

SEQ ID NO: 632199 - RNA, 64 nt, Homo Sapiens; identical to SEQ ID NO: 133554

SEQ ID NO: 632200 - RNA, 64 nt, Homo Sapiens; identical to SEQ ID NO: 133555

SEQ ID NO: 632201 - RNA, 64 nt, Homo Sapiens; identical to SEQ ID NO: 133556

SEQ ID NO: 632202 - RNA, 64 nt, Homo Sapiens; identical to SEQ ID NO: 133557

SEQ ID NO: 632203 - RNA, 64 nt, Homo Sapiens; identical to SEQ ID NO: 133558

SEQ ID NO: 632204 - RNA, 64 nt, Homo Sapiens; identical to SEQ ID NO: 133559

SEQ ID NO: 632205 - RNA, 64 nt, Homo Sapiens; identical to SEQ ID NO: 133560

SEQ ID NO: 632206 - RNA, 64 nt, Homo Sapiens; identical to SEQ ID NO: 133561

SEQ ID NO: 632207 - RNA, 64 nt, Homo Sapiens; identical to SEQ ID NO: 133562

SEQ ID NO: 632208 - RNA, 64 nt, Homo Sapiens; identical to SEQ ID NO: 133563

SEQ ID NO: 632209 - RNA, 64 nt, Homo Sapiens; identical to SEQ ID NO: 133564

SEQ ID NO: 632210 - RNA, 64 nt, Homo Sapiens; identical to SEQ ID NO: 133565

SEQ ID NO: 632211 - RNA, 64 nt, Homo Sapiens; identical to SEQ ID NO: 133566

SEQ ID NO: 632212 - RNA, 64 nt, Homo Sapiens; identical to SEQ ID NO: 133567

SEQ ID NO: 632213 - RNA, 64 nt, Homo Sapiens; identical to SEQ ID NO: 133568

SEQ ID NO: 632214 - RNA, 64 nt, Homo Sapiens; identical to SEQ ID NO: 133569

SEQ ID NO: 632215 - RNA, 64 nt, Homo Sapiens; identical to SEQ ID NO: 133570

SEQ ID NO: 632216 - RNA, 64 nt, Homo Sapiens; identical to SEQ ID NO: 133571

SEQ ID NO: 632217 - RNA, 64 nt, Homo Sapiens; identical to SEQ ID NO: 133572

SEQ ID NO: 632218 - RNA, 64 nt, Homo Sapiens; identical to SEQ ID NO: 133573

SEQ ID NO: 632219 - RNA, 64 nt, Homo Sapiens; identical to SEQ ID NO: 133574

SEQ ID NO: 632220 - RNA, 64 nt, Homo Sapiens; identical to SEQ ID NO: 133575

SEQ ID NO: 632221 - RNA, 64 nt, Homo Sapiens; identical to SEQ ID NO: 133576

SEQ ID NO: 632222 - RNA, 64 nt, Homo Sapiens; identical to SEQ ID NO: 133577

SEQ ID NO: 632223 - RNA, 64 nt, Homo Sapiens; identical to SEQ ID NO: 133578

SEQ ID NO: 632224 - RNA, 64 nt, Homo Sapiens; identical to SEQ ID NO: 133579

SEQ ID NO: 632225 - RNA, 64 nt, Homo Sapiens; identical to SEQ ID NO: 133580

SEQ ID NO: 632226 - RNA, 64 nt, Homo Sapiens; identical to SEQ ID NO: 133581

SEQ ID NO: 632227 - RNA, 64 nt, Homo Sapiens; identical to SEQ ID NO: 133582

SEQ ID NO: 632228 - RNA, 64 nt, Homo Sapiens; identical to SEQ ID NO: 133583

SEQ ID NO: 632229 - RNA, 64 nt, Homo Sapiens; identical to SEQ ID NO: 133584

SEQ ID NO: 632230 - RNA, 64 nt, Homo Sapiens; identical to SEQ ID NO: 133585

SEQ ID NO: 632231 - RNA, 64 nt, Homo Sapiens; identical to SEQ ID NO: 133586

SEQ ID NO: 632232 - RNA, 64 nt, Homo Sapiens; identical to SEQ ID NO: 133587

SEQ ID NO: 632233 - RNA, 64 nt, Homo Sapiens; identical to SEQ ID NO: 133588

SEQ ID NO: 632234 - RNA, 64 nt, Homo Sapiens; identical to SEQ ID NO: 133589

SEQ ID NO: 632235 - RNA, 64 nt, Homo Sapiens; identical to SEQ ID NO: 133590

SEQ ID NO: 632236 - RNA, 64 nt, Homo Sapiens; identical to SEQ ID NO: 133591

SEQ ID NO: 632237 - RNA, 64 nt, Homo Sapiens; identical to SEQ ID NO: 133592

SEQ ID NO: 632238 - RNA, 64 nt, Homo Sapiens; identical to SEQ ID NO: 133593

SEQ ID NO: 632239 - RNA, 64 nt, Homo Sapiens; identical to SEQ ID NO: 133594

SEQ ID NO: 632240 - RNA, 64 nt, Homo Sapiens; identical to SEQ ID NO: 133595

SEQ ID NO: 632241 - RNA, 64 nt, Homo Sapiens; identical to SEQ ID NO: 133596

SEQ ID NO: 632242 - RNA, 64 nt, Homo Sapiens; identical to SEQ ID NO: 133597

SEQ ID NO: 632243 - RNA, 64 nt, Homo Sapiens; identical to SEQ ID NO: 133598

SEQ ID NO: 632244 - RNA, 64 nt, Homo Sapiens; identical to SEQ ID NO: 133599

SEQ ID NO: 632245 - RNA, 64 nt, Homo Sapiens; identical to SEQ ID NO: 133600

SEQ ID NO: 632246 - RNA, 64 nt, Homo Sapiens; identical to SEQ ID NO: 133601

SEQ ID NO: 632247 - RNA, 64 nt, Homo Sapiens; identical to SEQ ID NO: 133602

SEQ ID NO: 632248 - RNA, 64 nt, Homo Sapiens; identical to SEQ ID NO: 133603

SEQ ID NO: 632249 - RNA, 64 nt, Homo Sapiens; identical to SEQ ID NO: 133604

SEQ ID NO: 632250 - RNA, 64 nt, Homo Sapiens; identical to SEQ ID NO: 133605

SEQ ID NO: 632251 - RNA, 64 nt, Homo Sapiens; identical to SEQ ID NO: 133606

SEQ ID NO: 632252 - RNA, 64 nt, Homo Sapiens; identical to SEQ ID NO: 133607

SEQ ID NO: 632253 - RNA, 64 nt, Homo Sapiens; identical to SEQ ID NO: 133608

SEQ ID NO: 632254 - RNA, 64 nt, Homo Sapiens; identical to SEQ ID NO: 133609

SEQ ID NO: 632255 - RNA, 64 nt, Homo Sapiens; identical to SEQ ID NO: 133610

SEQ ID NO: 632256 - RNA, 52 nt, Homo Sapiens; identical to SEQ ID NO: 133611

SEQ ID NO: 632257 - RNA, 55 nt, Homo Sapiens; identical to SEQ ID NO: 133612

SEQ ID NO: 632258 - RNA, 64 nt, Homo Sapiens; identical to SEQ ID NO: 133613

SEQ ID NO: 632259 - RNA, 64 nt, Homo Sapiens; identical to SEQ ID NO: 133614

SEQ ID NO: 632260 - RNA, 64 nt, Homo Sapiens; identical to SEQ ID NO: 133615

SEQ ID NO: 632261 - RNA, 64 nt, Homo Sapiens; identical to SEQ ID NO: 133616

SEQ ID NO: 632262 - RNA, 64 nt, Homo Sapiens; identical to SEQ ID NO: 133617

SEQ ID NO: 632263 - RNA, 64 nt, Homo Sapiens; identical to SEQ ID NO: 133618

SEQ ID NO: 632264 - RNA, 64 nt, Homo Sapiens; identical to SEQ ID NO: 133619

SEQ ID NO: 632265 - RNA, 64 nt, Homo Sapiens; identical to SEQ ID NO: 133620

SEQ ID NO: 632266 - RNA, 64 nt, Homo Sapiens; identical to SEQ ID NO: 133621

SEQ ID NO: 632267 - RNA, 64 nt, Homo Sapiens; identical to SEQ ID NO: 133622

SEQ ID NO: 632268 - RNA, 64 nt, Homo Sapiens; identical to SEQ ID NO: 133623

SEQ ID NO: 632269 - RNA, 64 nt, Homo Sapiens; identical to SEQ ID NO: 133624

SEQ ID NO: 632270 - RNA, 64 nt, Homo Sapiens; identical to SEQ ID NO: 133625

SEQ ID NO: 632271 - RNA, 64 nt, Homo Sapiens; identical to SEQ ID NO: 133626

SEQ ID NO: 632272 - RNA, 64 nt, Homo Sapiens; identical to SEQ ID NO: 133627

SEQ ID NO: 632273 - RNA, 64 nt, Homo Sapiens; identical to SEQ ID NO: 133628

SEQ ID NO: 632274 - RNA, 64 nt, Homo Sapiens; identical to SEQ ID NO: 133629

SEQ ID NO: 632275 - RNA, 64 nt, Homo Sapiens; identical to SEQ ID NO: 133630

SEQ ID NO: 632276 - RNA, 64 nt, Homo Sapiens; identical to SEQ ID NO: 133631

SEQ ID NO: 632277 - RNA, 64 nt, Homo Sapiens; identical to SEQ ID NO: 133632

SEQ ID NO: 632278 - RNA, 64 nt, Homo Sapiens; identical to SEQ ID NO: 133633

SEQ ID NO: 632279 - RNA, 64 nt, Homo Sapiens; identical to SEQ ID NO: 133634

SEQ ID NO: 632280 - RNA, 64 nt, Homo Sapiens; identical to SEQ ID NO: 133635

SEQ ID NO: 632281 - RNA, 64 nt, Homo Sapiens; identical to SEQ ID NO: 133636

SEQ ID NO: 632282 - RNA, 64 nt, Homo Sapiens; identical to SEQ ID NO: 133637

SEQ ID NO: 632283 - RNA, 64 nt, Homo Sapiens; identical to SEQ ID NO: 133638

SEQ ID NO: 632284 - RNA, 63 nt, Homo Sapiens; identical to SEQ ID NO: 133639

SEQ ID NO: 632285 - RNA, 51 nt, Homo Sapiens; identical to SEQ ID NO: 133640

SEQ ID NO: 632286 - RNA, 64 nt, Homo Sapiens; identical to SEQ ID NO: 133641

SEQ ID NO: 632287 - RNA, 64 nt, Homo Sapiens; identical to SEQ ID NO: 133642

SEQ ID NO: 632288 - RNA, 64 nt, Homo Sapiens; identical to SEQ ID NO: 133643

SEQ ID NO: 632289 - RNA, 64 nt, Homo Sapiens; identical to SEQ ID NO: 133644

SEQ ID NO: 632290 - RNA, 64 nt, Homo Sapiens; identical to SEQ ID NO: 133645

SEQ ID NO: 632291 - RNA, 64 nt, Homo Sapiens; identical to SEQ ID NO: 133646

SEQ ID NO: 632292 - RNA, 64 nt, Homo Sapiens; identical to SEQ ID NO: 133647

SEQ ID NO: 632293 - RNA, 64 nt, Homo Sapiens; identical to SEQ ID NO: 133648

SEQ ID NO: 632294 - RNA, 64 nt, Homo Sapiens; identical to SEQ ID NO: 133649

SEQ ID NO: 632295 - RNA, 64 nt, Homo Sapiens; identical to SEQ ID NO: 133650

SEQ ID NO: 632296 - RNA, 64 nt, Homo Sapiens; identical to SEQ ID NO: 133651

SEQ ID NO: 632297 - RNA, 64 nt, Homo Sapiens; identical to SEQ ID NO: 133652

SEQ ID NO: 632298 - RNA, 64 nt, Homo Sapiens; identical to SEQ ID NO: 133653

SEQ ID NO: 632299 - RNA, 64 nt, Homo Sapiens; identical to SEQ ID NO: 133654

SEQ ID NO: 632300 - RNA, 64 nt, Homo Sapiens; identical to SEQ ID NO: 133655

SEQ ID NO: 632301 - RNA, 64 nt, Homo Sapiens; identical to SEQ ID NO: 133656

SEQ ID NO: 632302 - RNA, 64 nt, Homo Sapiens; identical to SEQ ID NO: 133657

SEQ ID NO: 632303 - RNA, 64 nt, Homo Sapiens; identical to SEQ ID NO: 133658

SEQ ID NO: 632304 - RNA, 64 nt, Homo Sapiens; identical to SEQ ID NO: 133659

SEQ ID NO: 632305 - RNA, 64 nt, Homo Sapiens; identical to SEQ ID NO: 133660

SEQ ID NO: 632306 - RNA, 64 nt, Homo Sapiens; identical to SEQ ID NO: 133661

SEQ ID NO: 632307 - RNA, 64 nt, Homo Sapiens; identical to SEQ ID NO: 133662

SEQ ID NO: 632308 - RNA, 64 nt, Homo Sapiens; identical to SEQ ID NO: 133663

SEQ ID NO: 632309 - RNA, 64 nt, Homo Sapiens; identical to SEQ ID NO: 133664

SEQ ID NO: 632310 - RNA, 64 nt, Homo Sapiens; identical to SEQ ID NO: 133665

SEQ ID NO: 632311 - RNA, 64 nt, Homo Sapiens; identical to SEQ ID NO: 133666

SEQ ID NO: 632312 - RNA, 64 nt, Homo Sapiens; identical to SEQ ID NO: 133667

SEQ ID NO: 632313 - RNA, 64 nt, Homo Sapiens; identical to SEQ ID NO: 133668

SEQ ID NO: 632314 - RNA, 64 nt, Homo Sapiens; identical to SEQ ID NO: 133669

SEQ ID NO: 632315 - RNA, 64 nt, Homo Sapiens; identical to SEQ ID NO: 133670

SEQ ID NO: 632316 - RNA, 64 nt, Homo Sapiens; identical to SEQ ID NO: 133671

SEQ ID NO: 632317 - RNA, 64 nt, Homo Sapiens; identical to SEQ ID NO: 133672

SEQ ID NO: 632318 - RNA, 64 nt, Homo Sapiens; identical to SEQ ID NO: 133673

SEQ ID NO: 632319 - RNA, 64 nt, Homo Sapiens; identical to SEQ ID NO: 133674

SEQ ID NO: 632320 - RNA, 64 nt, Homo Sapiens; identical to SEQ ID NO: 133675

SEQ ID NO: 632321 - RNA, 64 nt, Homo Sapiens; identical to SEQ ID NO: 133676

SEQ ID NO: 632322 - RNA, 50 nt, Homo Sapiens; identical to SEQ ID NO: 133677

SEQ ID NO: 632323 - RNA, 64 nt, Homo Sapiens; identical to SEQ ID NO: 133678

SEQ ID NO: 632324 - RNA, 64 nt, Homo Sapiens; identical to SEQ ID NO: 133679

SEQ ID NO: 632325 - RNA, 64 nt, Homo Sapiens; identical to SEQ ID NO: 133680

SEQ ID NO: 632326 - RNA, 64 nt, Homo Sapiens; identical to SEQ ID NO: 133681

SEQ ID NO: 632327 - RNA, 64 nt, Homo Sapiens; identical to SEQ ID NO: 133682

SEQ ID NO: 632328 - RNA, 64 nt, Homo Sapiens; identical to SEQ ID NO: 133683

SEQ ID NO: 632329 - RNA, 64 nt, Homo Sapiens; identical to SEQ ID NO: 133684

SEQ ID NO: 632330 - RNA, 64 nt, Homo Sapiens; identical to SEQ ID NO: 133685

SEQ ID NO: 632331 - RNA, 64 nt, Homo Sapiens; identical to SEQ ID NO: 133686

SEQ ID NO: 632332 - RNA, 64 nt, Homo Sapiens; identical to SEQ ID NO: 133687

SEQ ID NO: 632333 - RNA, 64 nt, Homo Sapiens; identical to SEQ ID NO: 133688

SEQ ID NO: 632334 - RNA, 64 nt, Homo Sapiens; identical to SEQ ID NO: 133689

SEQ ID NO: 632335 - RNA, 64 nt, Homo Sapiens; identical to SEQ ID NO: 133690

SEQ ID NO: 632336 - RNA, 64 nt, Homo Sapiens; identical to SEQ ID NO: 133691

SEQ ID NO: 632337 - RNA, 64 nt, Homo Sapiens; identical to SEQ ID NO: 133692

SEQ ID NO: 632338 - RNA, 64 nt, Homo Sapiens; identical to SEQ ID NO: 133693

SEQ ID NO: 632339 - RNA, 64 nt, Homo Sapiens; identical to SEQ ID NO: 133694

SEQ ID NO: 632340 - RNA, 64 nt, Homo Sapiens; identical to SEQ ID NO: 133695

SEQ ID NO: 632341 - RNA, 64 nt, Homo Sapiens; identical to SEQ ID NO: 133696

SEQ ID NO: 632342 - RNA, 64 nt, Homo Sapiens; identical to SEQ ID NO: 133697

SEQ ID NO: 632343 - RNA, 64 nt, Homo Sapiens; identical to SEQ ID NO: 133698

SEQ ID NO: 632344 - RNA, 64 nt, Homo Sapiens; identical to SEQ ID NO: 133699

SEQ ID NO: 632345 - RNA, 64 nt, Homo Sapiens; identical to SEQ ID NO: 133700

SEQ ID NO: 632346 - RNA, 64 nt, Homo Sapiens; identical to SEQ ID NO: 133701

SEQ ID NO: 632347 - RNA, 64 nt, Homo Sapiens; identical to SEQ ID NO: 133702

SEQ ID NO: 632348 - RNA, 64 nt, Homo Sapiens; identical to SEQ ID NO: 133703

SEQ ID NO: 632349 - RNA, 64 nt, Homo Sapiens; identical to SEQ ID NO: 133704

SEQ ID NO: 632350 - RNA, 64 nt, Homo Sapiens; identical to SEQ ID NO: 133705

SEQ ID NO: 632351 - RNA, 64 nt, Homo Sapiens; identical to SEQ ID NO: 133706

SEQ ID NO: 632352 - RNA, 64 nt, Homo Sapiens; identical to SEQ ID NO: 133707

SEQ ID NO: 632353 - RNA, 64 nt, Homo Sapiens; identical to SEQ ID NO: 133708

SEQ ID NO: 632354 - RNA, 64 nt, Homo Sapiens; identical to SEQ ID NO: 133709

SEQ ID NO: 632355 - RNA, 64 nt, Homo Sapiens; identical to SEQ ID NO: 133710

SEQ ID NO: 632356 - RNA, 64 nt, Homo Sapiens; identical to SEQ ID NO: 133711

SEQ ID NO: 632357 - RNA, 64 nt, Homo Sapiens; identical to SEQ ID NO: 133712

SEQ ID NO: 632358 - RNA, 64 nt, Homo Sapiens; identical to SEQ ID NO: 133713

SEQ ID NO: 632359 - RNA, 64 nt, Homo Sapiens; identical to SEQ ID NO: 133714

SEQ ID NO: 632360 - RNA, 64 nt, Homo Sapiens; identical to SEQ ID NO: 133715

SEQ ID NO: 632361 - RNA, 64 nt, Homo Sapiens; identical to SEQ ID NO: 133716

SEQ ID NO: 632362 - RNA, 64 nt, Homo Sapiens; identical to SEQ ID NO: 133717

SEQ ID NO: 632363 - RNA, 64 nt, Homo Sapiens; identical to SEQ ID NO: 133718

SEQ ID NO: 632364 - RNA, 64 nt, Homo Sapiens; identical to SEQ ID NO: 133719

SEQ ID NO: 632365 - RNA, 64 nt, Homo Sapiens; identical to SEQ ID NO: 133720

SEQ ID NO: 632366 - RNA, 64 nt, Homo Sapiens; identical to SEQ ID NO: 133721

SEQ ID NO: 632367 - RNA, 64 nt, Homo Sapiens; identical to SEQ ID NO: 133722

SEQ ID NO: 632368 - RNA, 64 nt, Homo Sapiens; identical to SEQ ID NO: 133723

SEQ ID NO: 632369 - RNA, 64 nt, Homo Sapiens; identical to SEQ ID NO: 133724

SEQ ID NO: 632370 - RNA, 64 nt, Homo Sapiens; identical to SEQ ID NO: 133725

SEQ ID NO: 632371 - RNA, 64 nt, Homo Sapiens; identical to SEQ ID NO: 133726

SEQ ID NO: 632372 - RNA, 64 nt, Homo Sapiens; identical to SEQ ID NO: 133727

SEQ ID NO: 632373 - RNA, 64 nt, Homo Sapiens; identical to SEQ ID NO: 133728

SEQ ID NO: 632374 - RNA, 64 nt, Homo Sapiens; identical to SEQ ID NO: 133729

SEQ ID NO: 632375 - RNA, 64 nt, Homo Sapiens; identical to SEQ ID NO: 133730

SEQ ID NO: 632376 - RNA, 64 nt, Homo Sapiens; identical to SEQ ID NO: 133731

SEQ ID NO: 632377 - RNA, 64 nt, Homo Sapiens; identical to SEQ ID NO: 133732

SEQ ID NO: 632378 - RNA, 64 nt, Homo Sapiens; identical to SEQ ID NO: 133733

SEQ ID NO: 632379 - RNA, 64 nt, Homo Sapiens; identical to SEQ ID NO: 133734

SEQ ID NO: 632380 - RNA, 64 nt, Homo Sapiens; identical to SEQ ID NO: 133735

SEQ ID NO: 632381 - RNA, 64 nt, Homo Sapiens; identical to SEQ ID NO: 133736

SEQ ID NO: 632382 - RNA, 64 nt, Homo Sapiens; identical to SEQ ID NO: 133737

SEQ ID NO: 632383 - RNA, 64 nt, Homo Sapiens; identical to SEQ ID NO: 133738

SEQ ID NO: 632384 - RNA, 64 nt, Homo Sapiens; identical to SEQ ID NO: 133739

SEQ ID NO: 632385 - RNA, 64 nt, Homo Sapiens; identical to SEQ ID NO: 133740

SEQ ID NO: 632386 - RNA, 64 nt, Homo Sapiens; identical to SEQ ID NO: 133741

SEQ ID NO: 632387 - RNA, 64 nt, Homo Sapiens; identical to SEQ ID NO: 133742

SEQ ID NO: 632388 - RNA, 64 nt, Homo Sapiens; identical to SEQ ID NO: 133743

SEQ ID NO: 632389 - RNA, 64 nt, Homo Sapiens; identical to SEQ ID NO: 133744

SEQ ID NO: 632390 - RNA, 64 nt, Homo Sapiens; identical to SEQ ID NO: 133745

SEQ ID NO: 632391 - RNA, 64 nt, Homo Sapiens; identical to SEQ ID NO: 133746

SEQ ID NO: 632392 - RNA, 64 nt, Homo Sapiens; identical to SEQ ID NO: 133747

SEQ ID NO: 632393 - RNA, 64 nt, Homo Sapiens; identical to SEQ ID NO: 133748

SEQ ID NO: 632394 - RNA, 64 nt, Homo Sapiens; identical to SEQ ID NO: 133749

SEQ ID NO: 632395 - RNA, 64 nt, Homo Sapiens; identical to SEQ ID NO: 133750

SEQ ID NO: 632396 - RNA, 64 nt, Homo Sapiens; identical to SEQ ID NO: 133751

SEQ ID NO: 632397 - RNA, 64 nt, Homo Sapiens; identical to SEQ ID NO: 133752

SEQ ID NO: 632398 - RNA, 64 nt, Homo Sapiens; identical to SEQ ID NO: 133753

SEQ ID NO: 632399 - RNA, 64 nt, Homo Sapiens; identical to SEQ ID NO: 133754

SEQ ID NO: 632400 - RNA, 64 nt, Homo Sapiens; identical to SEQ ID NO: 133755

SEQ ID NO: 632401 - RNA, 64 nt, Homo Sapiens; identical to SEQ ID NO: 133756

SEQ ID NO: 632402 - RNA, 64 nt, Homo Sapiens; identical to SEQ ID NO: 133757

SEQ ID NO: 632403 - RNA, 64 nt, Homo Sapiens; identical to SEQ ID NO: 133758

SEQ ID NO: 632404 - RNA, 64 nt, Homo Sapiens; identical to SEQ ID NO: 133759

SEQ ID NO: 632405 - RNA, 64 nt, Homo Sapiens; identical to SEQ ID NO: 133760

SEQ ID NO: 632406 - RNA, 64 nt, Homo Sapiens; identical to SEQ ID NO: 133761

SEQ ID NO: 632407 - RNA, 64 nt, Homo Sapiens; identical to SEQ ID NO: 133762

SEQ ID NO: 632408 - RNA, 64 nt, Homo Sapiens; identical to SEQ ID NO: 133763

SEQ ID NO: 632409 - RNA, 64 nt, Homo Sapiens; identical to SEQ ID NO: 133764

SEQ ID NO: 632410 - RNA, 64 nt, Homo Sapiens; identical to SEQ ID NO: 133765

SEQ ID NO: 632411 - RNA, 60 nt, Homo Sapiens; identical to SEQ ID NO: 133766

SEQ ID NO: 632412 - RNA, 57 nt, Homo Sapiens; identical to SEQ ID NO: 133767

SEQ ID NO: 632413 - RNA, 64 nt, Homo Sapiens; identical to SEQ ID NO: 133768

SEQ ID NO: 632414 - RNA, 64 nt, Homo Sapiens; identical to SEQ ID NO: 133769

SEQ ID NO: 632415 - RNA, 64 nt, Homo Sapiens; identical to SEQ ID NO: 133770

SEQ ID NO: 632416 - RNA, 64 nt, Homo Sapiens; identical to SEQ ID NO: 133771

SEQ ID NO: 632417 - RNA, 64 nt, Homo Sapiens; identical to SEQ ID NO: 133772

SEQ ID NO: 632418 - RNA, 64 nt, Homo Sapiens; identical to SEQ ID NO: 133773

SEQ ID NO: 632419 - RNA, 64 nt, Homo Sapiens; identical to SEQ ID NO: 133774

SEQ ID NO: 632420 - RNA, 64 nt, Homo Sapiens; identical to SEQ ID NO: 133775

SEQ ID NO: 632421 - RNA, 64 nt, Homo Sapiens; identical to SEQ ID NO: 133776

SEQ ID NO: 632422 - RNA, 64 nt, Homo Sapiens; identical to SEQ ID NO: 133777

SEQ ID NO: 632423 - RNA, 64 nt, Homo Sapiens; identical to SEQ ID NO: 133778

SEQ ID NO: 632424 - RNA, 64 nt, Homo Sapiens; identical to SEQ ID NO: 133779

SEQ ID NO: 632425 - RNA, 64 nt, Homo Sapiens; identical to SEQ ID NO: 133780

SEQ ID NO: 632426 - RNA, 64 nt, Homo Sapiens; identical to SEQ ID NO: 133781

SEQ ID NO: 632427 - RNA, 64 nt, Homo Sapiens; identical to SEQ ID NO: 133782

SEQ ID NO: 632428 - RNA, 64 nt, Homo Sapiens; identical to SEQ ID NO: 133783

SEQ ID NO: 632429 - RNA, 64 nt, Homo Sapiens; identical to SEQ ID NO: 133784

SEQ ID NO: 632430 - RNA, 64 nt, Homo Sapiens; identical to SEQ ID NO: 133785

SEQ ID NO: 632431 - RNA, 64 nt, Homo Sapiens; identical to SEQ ID NO: 133786

SEQ ID NO: 632432 - RNA, 64 nt, Homo Sapiens; identical to SEQ ID NO: 133787

SEQ ID NO: 632433 - RNA, 64 nt, Homo Sapiens; identical to SEQ ID NO: 133788

SEQ ID NO: 632434 - RNA, 64 nt, Homo Sapiens; identical to SEQ ID NO: 133789

SEQ ID NO: 632435 - RNA, 64 nt, Homo Sapiens; identical to SEQ ID NO: 133790

SEQ ID NO: 632436 - RNA, 64 nt, Homo Sapiens; identical to SEQ ID NO: 133791

SEQ ID NO: 632437 - RNA, 64 nt, Homo Sapiens; identical to SEQ ID NO: 133792

SEQ ID NO: 632438 - RNA, 64 nt, Homo Sapiens; identical to SEQ ID NO: 133793

SEQ ID NO: 632439 - RNA, 64 nt, Homo Sapiens; identical to SEQ ID NO: 133794

SEQ ID NO: 632440 - RNA, 64 nt, Homo Sapiens; identical to SEQ ID NO: 133795

SEQ ID NO: 632441 - RNA, 64 nt, Homo Sapiens; identical to SEQ ID NO: 133796

SEQ ID NO: 632442 - RNA, 64 nt, Homo Sapiens; identical to SEQ ID NO: 133797

SEQ ID NO: 632443 - RNA, 64 nt, Homo Sapiens; identical to SEQ ID NO: 133798

SEQ ID NO: 632444 - RNA, 64 nt, Homo Sapiens; identical to SEQ ID NO: 133799

SEQ ID NO: 632445 - RNA, 64 nt, Homo Sapiens; identical to SEQ ID NO: 133800

SEQ ID NO: 632446 - RNA, 64 nt, Homo Sapiens; identical to SEQ ID NO: 133801

SEQ ID NO: 632447 - RNA, 64 nt, Homo Sapiens; identical to SEQ ID NO: 133802

SEQ ID NO: 632448 - RNA, 64 nt, Homo Sapiens; identical to SEQ ID NO: 133803

SEQ ID NO: 632449 - RNA, 64 nt, Homo Sapiens; identical to SEQ ID NO: 133804

SEQ ID NO: 632450 - RNA, 64 nt, Homo Sapiens; identical to SEQ ID NO: 133805

SEQ ID NO: 632451 - RNA, 64 nt, Homo Sapiens; identical to SEQ ID NO: 133806

SEQ ID NO: 632452 - RNA, 64 nt, Homo Sapiens; identical to SEQ ID NO: 133807

SEQ ID NO: 632453 - RNA, 64 nt, Homo Sapiens; identical to SEQ ID NO: 133808

SEQ ID NO: 632454 - RNA, 64 nt, Homo Sapiens; identical to SEQ ID NO: 133809

SEQ ID NO: 632455 - RNA, 64 nt, Homo Sapiens; identical to SEQ ID NO: 133810

SEQ ID NO: 632456 - RNA, 64 nt, Homo Sapiens; identical to SEQ ID NO: 133811

SEQ ID NO: 632457 - RNA, 64 nt, Homo Sapiens; identical to SEQ ID NO: 133812

SEQ ID NO: 632458 - RNA, 64 nt, Homo Sapiens; identical to SEQ ID NO: 133813

SEQ ID NO: 632459 - RNA, 64 nt, Homo Sapiens; identical to SEQ ID NO: 133814

SEQ ID NO: 632460 - RNA, 64 nt, Homo Sapiens; identical to SEQ ID NO: 133815

SEQ ID NO: 632461 - RNA, 64 nt, Homo Sapiens; identical to SEQ ID NO: 133816

SEQ ID NO: 632462 - RNA, 64 nt, Homo Sapiens; identical to SEQ ID NO: 133817

SEQ ID NO: 632463 - RNA, 64 nt, Homo Sapiens; identical to SEQ ID NO: 133818

SEQ ID NO: 632464 - RNA, 64 nt, Homo Sapiens; identical to SEQ ID NO: 133819

SEQ ID NO: 632465 - RNA, 64 nt, Homo Sapiens; identical to SEQ ID NO: 133820

SEQ ID NO: 632466 - RNA, 64 nt, Homo Sapiens; identical to SEQ ID NO: 133821

SEQ ID NO: 632467 - RNA, 64 nt, Homo Sapiens; identical to SEQ ID NO: 133822

SEQ ID NO: 632468 - RNA, 64 nt, Homo Sapiens; identical to SEQ ID NO: 133823

SEQ ID NO: 632469 - RNA, 64 nt, Homo Sapiens; identical to SEQ ID NO: 133824

SEQ ID NO: 632470 - RNA, 64 nt, Homo Sapiens; identical to SEQ ID NO: 133825

SEQ ID NO: 632471 - RNA, 64 nt, Homo Sapiens; identical to SEQ ID NO: 133826

SEQ ID NO: 632472 - RNA, 64 nt, Homo Sapiens; identical to SEQ ID NO: 133827

SEQ ID NO: 632473 - RNA, 64 nt, Homo Sapiens; identical to SEQ ID NO: 133828

SEQ ID NO: 632474 - RNA, 64 nt, Homo Sapiens; identical to SEQ ID NO: 133829

SEQ ID NO: 632475 - RNA, 64 nt, Homo Sapiens; identical to SEQ ID NO: 573978

SEQ ID NO: 632476 - RNA, 64 nt, Homo Sapiens; identical to SEQ ID NO: 573979

SEQ ID NO: 632477 - RNA, 64 nt, Homo Sapiens; identical to SEQ ID NO: 573980

SEQ ID NO: 632478 - RNA, 64 nt, Homo Sapiens; identical to SEQ ID NO: 573981

SEQ ID NO: 632479 - RNA, 64 nt, Homo Sapiens; identical to SEQ ID NO: 573982

SEQ ID NO: 632480 - RNA, 64 nt, Homo Sapiens; identical to SEQ ID NO: 573983

SEQ ID NO: 632481 - RNA, 64 nt, Homo Sapiens; identical to SEQ ID NO: 573984

SEQ ID NO: 632482 - RNA, 64 nt, Homo Sapiens; identical to SEQ ID NO: 573985

SEQ ID NO: 632483 - RNA, 64 nt, Homo Sapiens; identical to SEQ ID NO: 573986

SEQ ID NO: 632484 - RNA, 64 nt, Homo Sapiens; identical to SEQ ID NO: 573987

SEQ ID NO: 632485 - RNA, 64 nt, Homo Sapiens; identical to SEQ ID NO: 573988

SEQ ID NO: 632486 - RNA, 64 nt, Homo Sapiens; identical to SEQ ID NO: 573989

SEQ ID NO: 632487 - RNA, 64 nt, Homo Sapiens; identical to SEQ ID NO: 573990

SEQ ID NO: 632488 - RNA, 64 nt, Homo Sapiens; identical to SEQ ID NO: 573991

SEQ ID NO: 632489 - RNA, 64 nt, Homo Sapiens; identical to SEQ ID NO: 573992

SEQ ID NO: 632490 - RNA, 64 nt, Homo Sapiens; identical to SEQ ID NO: 573993

SEQ ID NO: 632491 - RNA, 64 nt, Homo Sapiens; identical to SEQ ID NO: 573994

SEQ ID NO: 632492 - RNA, 64 nt, Homo Sapiens; identical to SEQ ID NO: 573995

SEQ ID NO: 632493 - RNA, 64 nt, Homo Sapiens; identical to SEQ ID NO: 573996

SEQ ID NO: 632494 - RNA, 62 nt, Homo Sapiens; identical to SEQ ID NO: 573997

SEQ ID NO: 632495 - RNA, 64 nt, Homo Sapiens; identical to SEQ ID NO: 274983

SEQ ID NO: 632496 - RNA, 64 nt, Homo Sapiens; identical to SEQ ID NO: 274984

SEQ ID NO: 632497 - RNA, 64 nt, Homo Sapiens; identical to SEQ ID NO: 274985

SEQ ID NO: 632498 - RNA, 64 nt, Homo Sapiens; identical to SEQ ID NO: 274986

SEQ ID NO: 632499 - RNA, 64 nt, Homo Sapiens; identical to SEQ ID NO: 274987

SEQ ID NO: 632500 - RNA, 64 nt, Homo Sapiens; identical to SEQ ID NO: 274988

SEQ ID NO: 632501 - RNA, 64 nt, Homo Sapiens; identical to SEQ ID NO: 274989

SEQ ID NO: 632502 - RNA, 64 nt, Homo Sapiens; identical to SEQ ID NO: 274990

SEQ ID NO: 632503 - RNA, 64 nt, Homo Sapiens; identical to SEQ ID NO: 274991

SEQ ID NO: 632504 - RNA, 64 nt, Homo Sapiens; identical to SEQ ID NO: 274992

SEQ ID NO: 632505 - RNA, 64 nt, Homo Sapiens; identical to SEQ ID NO: 274993

SEQ ID NO: 632506 - RNA, 64 nt, Homo Sapiens; identical to SEQ ID NO: 274994

SEQ ID NO: 632507 - RNA, 64 nt, Homo Sapiens; identical to SEQ ID NO: 274995

SEQ ID NO: 632508 - RNA, 64 nt, Homo Sapiens; identical to SEQ ID NO: 274996

SEQ ID NO: 632509 - RNA, 64 nt, Homo Sapiens
agaaauacaaagagugccauccagcuuuuaaaacaacagcuaccacuagccaucacuacaauca

SEQ ID NO: 632510 - RNA, 64 nt, Homo Sapiens
gucuaauucucuuuucaacacaaaaugcuuuaugaacagcuacauuaccaggacuagcagaaau

SEQ ID NO: 632511 - RNA, 64 nt, Homo Sapiens
ugcugaaaauacacauucuccugggaagacgauaaacagcuagcuaagaagccgagguucagug

SEQ ID NO: 632512 - RNA, 64 nt, Homo Sapiens
uaccauuaggcauacuuucagaagcaaccuggagaacagcuaucaaucauauucaaaaccagua

SEQ ID NO: 632513 - RNA, 64 nt, Homo Sapiens
auauucucuagaaugagcacaaaacaaaucgaauaacagcuaaacaaaucgaauaacagcuaaa

SEQ ID NO: 632514 - RNA, 64 nt, Homo Sapiens
aaaacaaaucgaauaacagcuaaacaaaucgaauaacagcuaaacgaaucgaauaacagcuuuu

SEQ ID NO: 632515 - RNA, 64 nt, Homo Sapiens
ugggcuacugaacuacaugcauaaacuaaaaacuaacagcuacaaacuuuuaagauuucucuaa

SEQ ID NO: 632516 - RNA, 64 nt, Homo Sapiens
uaucuauuugaauaaauuaugagcuauccuuucaaacagcuauuggcaaguuuuaaacccaaaa

SEQ ID NO: 632517 - RNA, 64 nt, Homo Sapiens
gacaaucauaaaugaaugaucauugugauaugaaaacagcuauaagacacugaacuugaacuuc

SEQ ID NO: 632518 - RNA, 64 nt, Homo Sapiens
gacaaucauaaaugaaugaucacugugguaugaaaacagcuauauuacagcaacucaauucuac

SEQ ID NO: 632519 - RNA, 64 nt, Homo Sapiens
agcaugguuccaauuuuuuuuauucacuuuuguaaacagcuaaucuuuaaaaugagcuacuucu

SEQ ID NO: 632520 - RNA, 64 nt, Homo Sapiens
gcuuugggucauuuuuaacuuuguuuuuuugagaaacagcuacauuguuuuuuuuuguuuuguu

SEQ ID NO: 632521 - RNA, 64 nt, Homo Sapiens
gucauccauugcugucgugacuacucaaaacacaacuucucagucauacuauagaaaacaccug

SEQ ID NO: 632522 - RNA, 64 nt, Homo Sapiens
auagcuguuauauauauaugaaaaaucuuuuuucacuucucauguaauauuuucauuuuugggg

SEQ ID NO: 632523 - RNA, 64 nt, Homo Sapiens
cucaauguagaggcauaaaccugugcugaacauaacuucucauguauauuacccaauggaaaau

SEQ ID NO: 632524 - RNA, 64 nt, Homo Sapiens
gugagccuugcaugacaucaugaggccggaugaaacuucucaguccagcaguuuccaguccuaa

SEQ ID NO: 632525 - RNA, 64 nt, Homo Sapiens
cgccuucugcugucagaauuugcaaucaagggugacuucucagcuaauccuacagccugagugg

SEQ ID NO: 632526 - RNA, 64 nt, Homo Sapiens
ccuucucuucuguacagcagaaguaauuacaagcacuucucacgaaggcagaagacugaugcaa

SEQ ID NO: 632527 - RNA, 64 nt, Homo Sapiens
uuuugaaauuauaugaauauucagcaaguaggauacuucucauguuagggucauuuggcacuuc

SEQ ID NO: 632528 - RNA, 64 nt, Homo Sapiens
aaguaggauacuucucauguuagggucauuuggcacuucucagcuucuaagauauuuugaauau

SEQ ID NO: 632529 - RNA, 64 nt, Homo Sapiens
aucucauuugaauucuuuccuaaacuugaagcaaacuucucaugauuuaaaaggaaaaagguau

SEQ ID NO: 632530 - RNA, 64 nt, Homo Sapiens
uuuccuuuugcagucaauccucuuuacccugaaaacuucucauugaucaugauacagaacacuu

SEQ ID NO: 632531 - RNA, 64 nt, Homo Sapiens
agucuagcuagcauuucagcaugauauugcaagcacuucucauugcuaaaaauaaauaaaccaa

SEQ ID NO: 632532 - RNA, 64 nt, Homo Sapiens
ucuaucucuugcuacaauaauuccaacuaagugaacuucucaauuaucaucauacuuacuuacc

SEQ ID NO: 632533 - RNA, 64 nt, Homo Sapiens
ccgcacuucuccucuacugaggaucagggauauuacuucucaacggcuucugcccagggcucca

SEQ ID NO: 632534 - RNA, 64 nt, Homo Sapiens
ccuccuuacuaggcuuggccuaccucuuuuuccaacuucucacuaugcaggccucccuucagug

SEQ ID NO: 632535 - RNA, 64 nt, Homo Sapiens; identical to SEQ ID NO: 159813

SEQ ID NO: 632536 - RNA, 64 nt, Homo Sapiens; identical to SEQ ID NO: 159814

SEQ ID NO: 632537 - RNA, 64 nt, Homo Sapiens; identical to SEQ ID NO: 159815

SEQ ID NO: 632538 - RNA, 64 nt, Homo Sapiens; identical to SEQ ID NO: 159816

SEQ ID NO: 632539 - RNA, 64 nt, Homo Sapiens; identical to SEQ ID NO: 417312

SEQ ID NO: 632540 - RNA, 64 nt, Homo Sapiens; identical to SEQ ID NO: 417313

SEQ ID NO: 632541 - RNA, 64 nt, Homo Sapiens; identical to SEQ ID NO: 417314

SEQ ID NO: 632542 - RNA, 64 nt, Homo Sapiens; identical to SEQ ID NO: 417315

SEQ ID NO: 632543 - RNA, 64 nt, Homo Sapiens; identical to SEQ ID NO: 417316

SEQ ID NO: 632544 - RNA, 64 nt, Homo Sapiens; identical to SEQ ID NO: 417317

SEQ ID NO: 632545 - RNA, 64 nt, Homo Sapiens; identical to SEQ ID NO: 417318

SEQ ID NO: 632546 - RNA, 64 nt, Homo Sapiens; identical to SEQ ID NO: 417319

SEQ ID NO: 632547 - RNA, 64 nt, Homo Sapiens; identical to SEQ ID NO: 417320

SEQ ID NO: 632548 - RNA, 64 nt, Homo Sapiens; identical to SEQ ID NO: 417321

SEQ ID NO: 632549 - RNA, 64 nt, Homo Sapiens; identical to SEQ ID NO: 417322

SEQ ID NO: 632550 - RNA, 64 nt, Homo Sapiens; identical to SEQ ID NO: 417323

SEQ ID NO: 632551 - RNA, 64 nt, Homo Sapiens; identical to SEQ ID NO: 417324

SEQ ID NO: 632552 - RNA, 64 nt, Homo Sapiens; identical to SEQ ID NO: 417325

SEQ ID NO: 632553 - RNA, 64 nt, Homo Sapiens; identical to SEQ ID NO: 417326

SEQ ID NO: 632554 - RNA, 64 nt, Homo Sapiens; identical to SEQ ID NO: 417327

SEQ ID NO: 632555 - RNA, 64 nt, Homo Sapiens; identical to SEQ ID NO: 417328

SEQ ID NO: 632556 - RNA, 64 nt, Homo Sapiens; identical to SEQ ID NO: 417329

SEQ ID NO: 632557 - RNA, 64 nt, Homo Sapiens; identical to SEQ ID NO: 417330

SEQ ID NO: 632558 - RNA, 64 nt, Homo Sapiens; identical to SEQ ID NO: 417331

SEQ ID NO: 632559 - RNA, 64 nt, Homo Sapiens; identical to SEQ ID NO: 417332

SEQ ID NO: 632560 - RNA, 64 nt, Homo Sapiens; identical to SEQ ID NO: 417333

SEQ ID NO: 632561 - RNA, 64 nt, Homo Sapiens; identical to SEQ ID NO: 417334

SEQ ID NO: 632562 - RNA, 64 nt, Homo Sapiens; identical to SEQ ID NO: 417335

SEQ ID NO: 632563 - RNA, 64 nt, Homo Sapiens; identical to SEQ ID NO: 417336

SEQ ID NO: 632564 - RNA, 64 nt, Homo Sapiens; identical to SEQ ID NO: 417337

SEQ ID NO: 632565 - RNA, 64 nt, Homo Sapiens; identical to SEQ ID NO: 417338

SEQ ID NO: 632566 - RNA, 64 nt, Homo Sapiens; identical to SEQ ID NO: 417339

SEQ ID NO: 632567 - RNA, 64 nt, Homo Sapiens; identical to SEQ ID NO: 417340

SEQ ID NO: 632568 - RNA, 64 nt, Homo Sapiens; identical to SEQ ID NO: 417341

SEQ ID NO: 632569 - RNA, 64 nt, Homo Sapiens; identical to SEQ ID NO: 417342

SEQ ID NO: 632570 - RNA, 64 nt, Homo Sapiens; identical to SEQ ID NO: 417343

SEQ ID NO: 632571 - RNA, 64 nt, Homo Sapiens; identical to SEQ ID NO: 417344

SEQ ID NO: 632572 - RNA, 64 nt, Homo Sapiens; identical to SEQ ID NO: 417345

SEQ ID NO: 632573 - RNA, 64 nt, Homo Sapiens; identical to SEQ ID NO: 417346

SEQ ID NO: 632574 - RNA, 64 nt, Homo Sapiens; identical to SEQ ID NO: 417347

SEQ ID NO: 632575 - RNA, 64 nt, Homo Sapiens; identical to SEQ ID NO: 417348

SEQ ID NO: 632576 - RNA, 64 nt, Homo Sapiens; identical to SEQ ID NO: 417349

SEQ ID NO: 632577 - RNA, 64 nt, Homo Sapiens; identical to SEQ ID NO: 417350

SEQ ID NO: 632578 - RNA, 64 nt, Homo Sapiens; identical to SEQ ID NO: 417351

SEQ ID NO: 632579 - RNA, 64 nt, Homo Sapiens; identical to SEQ ID NO: 417352

SEQ ID NO: 632580 - RNA, 64 nt, Homo Sapiens; identical to SEQ ID NO: 417353

SEQ ID NO: 632581 - RNA, 64 nt, Homo Sapiens; identical to SEQ ID NO: 417354

SEQ ID NO: 632582 - RNA, 64 nt, Homo Sapiens; identical to SEQ ID NO: 417355

SEQ ID NO: 632583 - RNA, 64 nt, Homo Sapiens; identical to SEQ ID NO: 417356

SEQ ID NO: 632584 - RNA, 50 nt, Homo Sapiens; identical to SEQ ID NO: 417357

SEQ ID NO: 632585 - RNA, 64 nt, Homo Sapiens; identical to SEQ ID NO: 417358

SEQ ID NO: 632586 - RNA, 56 nt, Homo Sapiens; identical to SEQ ID NO: 417359

SEQ ID NO: 632587 - RNA, 64 nt, Homo Sapiens; identical to SEQ ID NO: 417360

SEQ ID NO: 632588 - RNA, 64 nt, Homo Sapiens; identical to SEQ ID NO: 417361

SEQ ID NO: 632589 - RNA, 64 nt, Homo Sapiens; identical to SEQ ID NO: 417362

SEQ ID NO: 632590 - RNA, 64 nt, Homo Sapiens; identical to SEQ ID NO: 417363

SEQ ID NO: 632591 - RNA, 64 nt, Homo Sapiens; identical to SEQ ID NO: 417364

SEQ ID NO: 632592 - RNA, 64 nt, Homo Sapiens; identical to SEQ ID NO: 417365

SEQ ID NO: 632593 - RNA, 64 nt, Homo Sapiens; identical to SEQ ID NO: 417366

SEQ ID NO: 632594 - RNA, 64 nt, Homo Sapiens; identical to SEQ ID NO: 417367

SEQ ID NO: 632595 - RNA, 64 nt, Homo Sapiens; identical to SEQ ID NO: 417368

SEQ ID NO: 632596 - RNA, 64 nt, Homo Sapiens; identical to SEQ ID NO: 417369

SEQ ID NO: 632597 - RNA, 64 nt, Homo Sapiens; identical to SEQ ID NO: 417370

SEQ ID NO: 632598 - RNA, 64 nt, Homo Sapiens; identical to SEQ ID NO: 417371

SEQ ID NO: 632599 - RNA, 64 nt, Homo Sapiens; identical to SEQ ID NO: 417372

SEQ ID NO: 632600 - RNA, 63 nt, Homo Sapiens; identical to SEQ ID NO: 417373

SEQ ID NO: 632601 - RNA, 64 nt, Homo Sapiens; identical to SEQ ID NO: 417374

SEQ ID NO: 632602 - RNA, 64 nt, Homo Sapiens; identical to SEQ ID NO: 417375

SEQ ID NO: 632603 - RNA, 64 nt, Homo Sapiens; identical to SEQ ID NO: 417376

SEQ ID NO: 632604 - RNA, 64 nt, Homo Sapiens; identical to SEQ ID NO: 417377

SEQ ID NO: 632605 - RNA, 64 nt, Homo Sapiens; identical to SEQ ID NO: 417378

SEQ ID NO: 632606 - RNA, 64 nt, Homo Sapiens; identical to SEQ ID NO: 417379

SEQ ID NO: 632607 - RNA, 64 nt, Homo Sapiens; identical to SEQ ID NO: 417380

SEQ ID NO: 632608 - RNA, 64 nt, Homo Sapiens; identical to SEQ ID NO: 417381

SEQ ID NO: 632609 - RNA, 64 nt, Homo Sapiens; identical to SEQ ID NO: 417382

SEQ ID NO: 632610 - RNA, 64 nt, Homo Sapiens; identical to SEQ ID NO: 417383

SEQ ID NO: 632611 - RNA, 64 nt, Homo Sapiens; identical to SEQ ID NO: 417384

SEQ ID NO: 632612 - RNA, 64 nt, Homo Sapiens; identical to SEQ ID NO: 417385

SEQ ID NO: 632613 - RNA, 64 nt, Homo Sapiens; identical to SEQ ID NO: 417386

SEQ ID NO: 632614 - RNA, 64 nt, Homo Sapiens; identical to SEQ ID NO: 417387

SEQ ID NO: 632615 - RNA, 64 nt, Homo Sapiens; identical to SEQ ID NO: 417388

SEQ ID NO: 632616 - RNA, 64 nt, Homo Sapiens; identical to SEQ ID NO: 417389

SEQ ID NO: 632617 - RNA, 64 nt, Homo Sapiens; identical to SEQ ID NO: 417390

SEQ ID NO: 632618 - RNA, 64 nt, Homo Sapiens; identical to SEQ ID NO: 417391

SEQ ID NO: 632619 - RNA, 64 nt, Homo Sapiens; identical to SEQ ID NO: 417392

SEQ ID NO: 632620 - RNA, 64 nt, Homo Sapiens; identical to SEQ ID NO: 417393

SEQ ID NO: 632621 - RNA, 64 nt, Homo Sapiens; identical to SEQ ID NO: 417394

SEQ ID NO: 632622 - RNA, 64 nt, Homo Sapiens; identical to SEQ ID NO: 417395

SEQ ID NO: 632623 - RNA, 64 nt, Homo Sapiens; identical to SEQ ID NO: 417396

SEQ ID NO: 632624 - RNA, 64 nt, Homo Sapiens; identical to SEQ ID NO: 417397

SEQ ID NO: 632625 - RNA, 64 nt, Homo Sapiens; identical to SEQ ID NO: 417398

SEQ ID NO: 632626 - RNA, 64 nt, Homo Sapiens; identical to SEQ ID NO: 417399

SEQ ID NO: 632627 - RNA, 64 nt, Homo Sapiens; identical to SEQ ID NO: 417400

SEQ ID NO: 632628 - RNA, 64 nt, Homo Sapiens; identical to SEQ ID NO: 417401

SEQ ID NO: 632629 - RNA, 64 nt, Homo Sapiens; identical to SEQ ID NO: 417402

SEQ ID NO: 632630 - RNA, 64 nt, Homo Sapiens; identical to SEQ ID NO: 417403

SEQ ID NO: 632631 - RNA, 64 nt, Homo Sapiens; identical to SEQ ID NO: 417404

SEQ ID NO: 632632 - RNA, 64 nt, Homo Sapiens; identical to SEQ ID NO: 417405

SEQ ID NO: 632633 - RNA, 64 nt, Homo Sapiens; identical to SEQ ID NO: 417406

SEQ ID NO: 632634 - RNA, 64 nt, Homo Sapiens; identical to SEQ ID NO: 417407

SEQ ID NO: 632635 - RNA, 64 nt, Homo Sapiens; identical to SEQ ID NO: 417408

SEQ ID NO: 632636 - RNA, 64 nt, Homo Sapiens; identical to SEQ ID NO: 417409

SEQ ID NO: 632637 - RNA, 64 nt, Homo Sapiens; identical to SEQ ID NO: 417410

SEQ ID NO: 632638 - RNA, 64 nt, Homo Sapiens; identical to SEQ ID NO: 417411

SEQ ID NO: 632639 - RNA, 64 nt, Homo Sapiens; identical to SEQ ID NO: 417412

SEQ ID NO: 632640 - RNA, 64 nt, Homo Sapiens; identical to SEQ ID NO: 417413

SEQ ID NO: 632641 - RNA, 63 nt, Homo Sapiens; identical to SEQ ID NO: 417414

SEQ ID NO: 632642 - RNA, 51 nt, Homo Sapiens; identical to SEQ ID NO: 417415

SEQ ID NO: 632643 - RNA, 64 nt, Homo Sapiens; identical to SEQ ID NO: 417416

SEQ ID NO: 632644 - RNA, 64 nt, Homo Sapiens; identical to SEQ ID NO: 417417

SEQ ID NO: 632645 - RNA, 64 nt, Homo Sapiens; identical to SEQ ID NO: 417418

SEQ ID NO: 632646 - RNA, 64 nt, Homo Sapiens; identical to SEQ ID NO: 417419

SEQ ID NO: 632647 - RNA, 64 nt, Homo Sapiens; identical to SEQ ID NO: 417420

SEQ ID NO: 632648 - RNA, 64 nt, Homo Sapiens; identical to SEQ ID NO: 417421

SEQ ID NO: 632649 - RNA, 64 nt, Homo Sapiens; identical to SEQ ID NO: 417422

SEQ ID NO: 632650 - RNA, 64 nt, Homo Sapiens; identical to SEQ ID NO: 417423

SEQ ID NO: 632651 - RNA, 64 nt, Homo Sapiens; identical to SEQ ID NO: 417424

SEQ ID NO: 632652 - RNA, 64 nt, Homo Sapiens; identical to SEQ ID NO: 417425

SEQ ID NO: 632653 - RNA, 64 nt, Homo Sapiens; identical to SEQ ID NO: 417426

SEQ ID NO: 632654 - RNA, 64 nt, Homo Sapiens; identical to SEQ ID NO: 417427

SEQ ID NO: 632655 - RNA, 64 nt, Homo Sapiens; identical to SEQ ID NO: 417428

SEQ ID NO: 632656 - RNA, 64 nt, Homo Sapiens; identical to SEQ ID NO: 417429

SEQ ID NO: 632657 - RNA, 64 nt, Homo Sapiens; identical to SEQ ID NO: 417430

SEQ ID NO: 632658 - RNA, 64 nt, Homo Sapiens; identical to SEQ ID NO: 417431

SEQ ID NO: 632659 - RNA, 64 nt, Homo Sapiens; identical to SEQ ID NO: 417432

SEQ ID NO: 632660 - RNA, 64 nt, Homo Sapiens; identical to SEQ ID NO: 417433

SEQ ID NO: 632661 - RNA, 64 nt, Homo Sapiens; identical to SEQ ID NO: 417434

SEQ ID NO: 632662 - RNA, 64 nt, Homo Sapiens; identical to SEQ ID NO: 417435

SEQ ID NO: 632663 - RNA, 64 nt, Homo Sapiens; identical to SEQ ID NO: 417436

SEQ ID NO: 632664 - RNA, 64 nt, Homo Sapiens; identical to SEQ ID NO: 417437

SEQ ID NO: 632665 - RNA, 64 nt, Homo Sapiens; identical to SEQ ID NO: 417438

SEQ ID NO: 632666 - RNA, 64 nt, Homo Sapiens; identical to SEQ ID NO: 417439

SEQ ID NO: 632667 - RNA, 64 nt, Homo Sapiens; identical to SEQ ID NO: 417440

SEQ ID NO: 632668 - RNA, 64 nt, Homo Sapiens; identical to SEQ ID NO: 417441

SEQ ID NO: 632669 - RNA, 64 nt, Homo Sapiens; identical to SEQ ID NO: 417442

SEQ ID NO: 632670 - RNA, 64 nt, Homo Sapiens; identical to SEQ ID NO: 417443

SEQ ID NO: 632671 - RNA, 64 nt, Homo Sapiens; identical to SEQ ID NO: 417444

SEQ ID NO: 632672 - RNA, 64 nt, Homo Sapiens; identical to SEQ ID NO: 417445

SEQ ID NO: 632673 - RNA, 64 nt, Homo Sapiens; identical to SEQ ID NO: 417446

SEQ ID NO: 632674 - RNA, 64 nt, Homo Sapiens; identical to SEQ ID NO: 417447

SEQ ID NO: 632675 - RNA, 64 nt, Homo Sapiens; identical to SEQ ID NO: 417448

SEQ ID NO: 632676 - RNA, 64 nt, Homo Sapiens; identical to SEQ ID NO: 417449

SEQ ID NO: 632677 - RNA, 64 nt, Homo Sapiens; identical to SEQ ID NO: 417450

SEQ ID NO: 632678 - RNA, 64 nt, Homo Sapiens; identical to SEQ ID NO: 417451

SEQ ID NO: 632679 - RNA, 64 nt, Homo Sapiens; identical to SEQ ID NO: 417452

SEQ ID NO: 632680 - RNA, 64 nt, Homo Sapiens; identical to SEQ ID NO: 417453

SEQ ID NO: 632681 - RNA, 64 nt, Homo Sapiens; identical to SEQ ID NO: 417454

SEQ ID NO: 632682 - RNA, 64 nt, Homo Sapiens; identical to SEQ ID NO: 417455

SEQ ID NO: 632683 - RNA, 64 nt, Homo Sapiens; identical to SEQ ID NO: 417456

SEQ ID NO: 632684 - RNA, 64 nt, Homo Sapiens; identical to SEQ ID NO: 417457

SEQ ID NO: 632685 - RNA, 63 nt, Homo Sapiens; identical to SEQ ID NO: 417458

SEQ ID NO: 632686 - RNA, 64 nt, Homo Sapiens; identical to SEQ ID NO: 417459

SEQ ID NO: 632687 - RNA, 64 nt, Homo Sapiens; identical to SEQ ID NO: 417460

SEQ ID NO: 632688 - RNA, 64 nt, Homo Sapiens; identical to SEQ ID NO: 417461

SEQ ID NO: 632689 - RNA, 64 nt, Homo Sapiens; identical to SEQ ID NO: 417462

SEQ ID NO: 632690 - RNA, 64 nt, Homo Sapiens; identical to SEQ ID NO: 417463

SEQ ID NO: 632691 - RNA, 64 nt, Homo Sapiens; identical to SEQ ID NO: 417464

SEQ ID NO: 632692 - RNA, 64 nt, Homo Sapiens; identical to SEQ ID NO: 417465

SEQ ID NO: 632693 - RNA, 64 nt, Homo Sapiens; identical to SEQ ID NO: 417466

SEQ ID NO: 632694 - RNA, 64 nt, Homo Sapiens; identical to SEQ ID NO: 159813

SEQ ID NO: 632695 - RNA, 64 nt, Homo Sapiens; identical to SEQ ID NO: 159814

SEQ ID NO: 632696 - RNA, 64 nt, Homo Sapiens; identical to SEQ ID NO: 159815

SEQ ID NO: 632697 - RNA, 64 nt, Homo Sapiens; identical to SEQ ID NO: 159816

SEQ ID NO: 632698 - RNA, 64 nt, Homo Sapiens; identical to SEQ ID NO: 417312

SEQ ID NO: 632699 - RNA, 64 nt, Homo Sapiens; identical to SEQ ID NO: 417313

SEQ ID NO: 632700 - RNA, 64 nt, Homo Sapiens; identical to SEQ ID NO: 417314

SEQ ID NO: 632701 - RNA, 64 nt, Homo Sapiens; identical to SEQ ID NO: 417315

SEQ ID NO: 632702 - RNA, 64 nt, Homo Sapiens; identical to SEQ ID NO: 417316

SEQ ID NO: 632703 - RNA, 64 nt, Homo Sapiens; identical to SEQ ID NO: 417317

SEQ ID NO: 632704 - RNA, 64 nt, Homo Sapiens; identical to SEQ ID NO: 417318

SEQ ID NO: 632705 - RNA, 64 nt, Homo Sapiens; identical to SEQ ID NO: 417319

SEQ ID NO: 632706 - RNA, 64 nt, Homo Sapiens; identical to SEQ ID NO: 417320

SEQ ID NO: 632707 - RNA, 64 nt, Homo Sapiens; identical to SEQ ID NO: 417321

SEQ ID NO: 632708 - RNA, 64 nt, Homo Sapiens; identical to SEQ ID NO: 417322

SEQ ID NO: 632709 - RNA, 64 nt, Homo Sapiens; identical to SEQ ID NO: 417323

SEQ ID NO: 632710 - RNA, 64 nt, Homo Sapiens; identical to SEQ ID NO: 417324

SEQ ID NO: 632711 - RNA, 64 nt, Homo Sapiens; identical to SEQ ID NO: 417325

SEQ ID NO: 632712 - RNA, 64 nt, Homo Sapiens; identical to SEQ ID NO: 417326

SEQ ID NO: 632713 - RNA, 64 nt, Homo Sapiens; identical to SEQ ID NO: 417327

SEQ ID NO: 632714 - RNA, 64 nt, Homo Sapiens; identical to SEQ ID NO: 417328

SEQ ID NO: 632715 - RNA, 64 nt, Homo Sapiens; identical to SEQ ID NO: 417329

SEQ ID NO: 632716 - RNA, 64 nt, Homo Sapiens; identical to SEQ ID NO: 417330

SEQ ID NO: 632717 - RNA, 64 nt, Homo Sapiens; identical to SEQ ID NO: 417331

SEQ ID NO: 632718 - RNA, 64 nt, Homo Sapiens; identical to SEQ ID NO: 417332

SEQ ID NO: 632719 - RNA, 64 nt, Homo Sapiens; identical to SEQ ID NO: 417333

SEQ ID NO: 632720 - RNA, 64 nt, Homo Sapiens; identical to SEQ ID NO: 417334

SEQ ID NO: 632721 - RNA, 64 nt, Homo Sapiens; identical to SEQ ID NO: 417335

SEQ ID NO: 632722 - RNA, 64 nt, Homo Sapiens; identical to SEQ ID NO: 417336

SEQ ID NO: 632723 - RNA, 64 nt, Homo Sapiens; identical to SEQ ID NO: 417337

SEQ ID NO: 632724 - RNA, 64 nt, Homo Sapiens; identical to SEQ ID NO: 417338

SEQ ID NO: 632725 - RNA, 64 nt, Homo Sapiens; identical to SEQ ID NO: 417339

SEQ ID NO: 632726 - RNA, 64 nt, Homo Sapiens; identical to SEQ ID NO: 417340

SEQ ID NO: 632727 - RNA, 64 nt, Homo Sapiens; identical to SEQ ID NO: 417341

SEQ ID NO: 632728 - RNA, 64 nt, Homo Sapiens; identical to SEQ ID NO: 417342

SEQ ID NO: 632729 - RNA, 64 nt, Homo Sapiens; identical to SEQ ID NO: 417343

SEQ ID NO: 632730 - RNA, 64 nt, Homo Sapiens; identical to SEQ ID NO: 417344

SEQ ID NO: 632731 - RNA, 64 nt, Homo Sapiens; identical to SEQ ID NO: 417345

SEQ ID NO: 632732 - RNA, 64 nt, Homo Sapiens; identical to SEQ ID NO: 417346

SEQ ID NO: 632733 - RNA, 64 nt, Homo Sapiens; identical to SEQ ID NO: 417347

SEQ ID NO: 632734 - RNA, 64 nt, Homo Sapiens; identical to SEQ ID NO: 417348

SEQ ID NO: 632735 - RNA, 64 nt, Homo Sapiens; identical to SEQ ID NO: 417349

SEQ ID NO: 632736 - RNA, 64 nt, Homo Sapiens; identical to SEQ ID NO: 417350

SEQ ID NO: 632737 - RNA, 64 nt, Homo Sapiens; identical to SEQ ID NO: 417351

SEQ ID NO: 632738 - RNA, 64 nt, Homo Sapiens; identical to SEQ ID NO: 417352

SEQ ID NO: 632739 - RNA, 64 nt, Homo Sapiens; identical to SEQ ID NO: 417353

SEQ ID NO: 632740 - RNA, 64 nt, Homo Sapiens; identical to SEQ ID NO: 417354

SEQ ID NO: 632741 - RNA, 64 nt, Homo Sapiens; identical to SEQ ID NO: 417355

SEQ ID NO: 632742 - RNA, 64 nt, Homo Sapiens; identical to SEQ ID NO: 417356

SEQ ID NO: 632743 - RNA, 50 nt, Homo Sapiens; identical to SEQ ID NO: 417357

SEQ ID NO: 632744 - RNA, 64 nt, Homo Sapiens; identical to SEQ ID NO: 417358

SEQ ID NO: 632745 - RNA, 56 nt, Homo Sapiens; identical to SEQ ID NO: 417359

SEQ ID NO: 632746 - RNA, 64 nt, Homo Sapiens; identical to SEQ ID NO: 417360

SEQ ID NO: 632747 - RNA, 64 nt, Homo Sapiens; identical to SEQ ID NO: 417361

SEQ ID NO: 632748 - RNA, 64 nt, Homo Sapiens; identical to SEQ ID NO: 417362

SEQ ID NO: 632749 - RNA, 64 nt, Homo Sapiens; identical to SEQ ID NO: 417363

SEQ ID NO: 632750 - RNA, 64 nt, Homo Sapiens; identical to SEQ ID NO: 417364

SEQ ID NO: 632751 - RNA, 64 nt, Homo Sapiens; identical to SEQ ID NO: 417365

SEQ ID NO: 632752 - RNA, 64 nt, Homo Sapiens; identical to SEQ ID NO: 417366

SEQ ID NO: 632753 - RNA, 64 nt, Homo Sapiens; identical to SEQ ID NO: 417367

SEQ ID NO: 632754 - RNA, 64 nt, Homo Sapiens; identical to SEQ ID NO: 417368

SEQ ID NO: 632755 - RNA, 64 nt, Homo Sapiens; identical to SEQ ID NO: 417369

SEQ ID NO: 632756 - RNA, 64 nt, Homo Sapiens; identical to SEQ ID NO: 417370

SEQ ID NO: 632757 - RNA, 64 nt, Homo Sapiens; identical to SEQ ID NO: 417371

SEQ ID NO: 632758 - RNA, 64 nt, Homo Sapiens; identical to SEQ ID NO: 417372

SEQ ID NO: 632759 - RNA, 63 nt, Homo Sapiens; identical to SEQ ID NO: 417373

SEQ ID NO: 632760 - RNA, 64 nt, Homo Sapiens; identical to SEQ ID NO: 417374

SEQ ID NO: 632761 - RNA, 64 nt, Homo Sapiens; identical to SEQ ID NO: 417375

SEQ ID NO: 632762 - RNA, 64 nt, Homo Sapiens; identical to SEQ ID NO: 417376

SEQ ID NO: 632763 - RNA, 64 nt, Homo Sapiens; identical to SEQ ID NO: 417377

SEQ ID NO: 632764 - RNA, 64 nt, Homo Sapiens; identical to SEQ ID NO: 417378

SEQ ID NO: 632765 - RNA, 64 nt, Homo Sapiens; identical to SEQ ID NO: 417379

SEQ ID NO: 632766 - RNA, 64 nt, Homo Sapiens; identical to SEQ ID NO: 417380

SEQ ID NO: 632767 - RNA, 64 nt, Homo Sapiens; identical to SEQ ID NO: 417381

SEQ ID NO: 632768 - RNA, 64 nt, Homo Sapiens; identical to SEQ ID NO: 417382

SEQ ID NO: 632769 - RNA, 64 nt, Homo Sapiens; identical to SEQ ID NO: 417383

SEQ ID NO: 632770 - RNA, 64 nt, Homo Sapiens; identical to SEQ ID NO: 417384

SEQ ID NO: 632771 - RNA, 64 nt, Homo Sapiens; identical to SEQ ID NO: 417385

SEQ ID NO: 632772 - RNA, 64 nt, Homo Sapiens; identical to SEQ ID NO: 417386

SEQ ID NO: 632773 - RNA, 64 nt, Homo Sapiens; identical to SEQ ID NO: 417387

SEQ ID NO: 632774 - RNA, 64 nt, Homo Sapiens; identical to SEQ ID NO: 417388

SEQ ID NO: 632775 - RNA, 64 nt, Homo Sapiens; identical to SEQ ID NO: 417389

SEQ ID NO: 632776 - RNA, 64 nt, Homo Sapiens; identical to SEQ ID NO: 417390

SEQ ID NO: 632777 - RNA, 64 nt, Homo Sapiens; identical to SEQ ID NO: 417391

SEQ ID NO: 632778 - RNA, 64 nt, Homo Sapiens; identical to SEQ ID NO: 417392

SEQ ID NO: 632779 - RNA, 64 nt, Homo Sapiens; identical to SEQ ID NO: 417393

SEQ ID NO: 632780 - RNA, 64 nt, Homo Sapiens; identical to SEQ ID NO: 417394

SEQ ID NO: 632781 - RNA, 64 nt, Homo Sapiens; identical to SEQ ID NO: 417395

SEQ ID NO: 632782 - RNA, 64 nt, Homo Sapiens; identical to SEQ ID NO: 417396

SEQ ID NO: 632783 - RNA, 64 nt, Homo Sapiens; identical to SEQ ID NO: 417397

SEQ ID NO: 632784 - RNA, 64 nt, Homo Sapiens; identical to SEQ ID NO: 417398

SEQ ID NO: 632785 - RNA, 64 nt, Homo Sapiens; identical to SEQ ID NO: 417399

SEQ ID NO: 632786 - RNA, 64 nt, Homo Sapiens; identical to SEQ ID NO: 417400

SEQ ID NO: 632787 - RNA, 64 nt, Homo Sapiens; identical to SEQ ID NO: 417401

SEQ ID NO: 632788 - RNA, 64 nt, Homo Sapiens; identical to SEQ ID NO: 417402

SEQ ID NO: 632789 - RNA, 64 nt, Homo Sapiens; identical to SEQ ID NO: 417403

SEQ ID NO: 632790 - RNA, 64 nt, Homo Sapiens; identical to SEQ ID NO: 417404

SEQ ID NO: 632791 - RNA, 64 nt, Homo Sapiens; identical to SEQ ID NO: 417405

SEQ ID NO: 632792 - RNA, 64 nt, Homo Sapiens; identical to SEQ ID NO: 417406

SEQ ID NO: 632793 - RNA, 64 nt, Homo Sapiens; identical to SEQ ID NO: 417407

SEQ ID NO: 632794 - RNA, 64 nt, Homo Sapiens; identical to SEQ ID NO: 417408

SEQ ID NO: 632795 - RNA, 64 nt, Homo Sapiens; identical to SEQ ID NO: 417409

SEQ ID NO: 632796 - RNA, 64 nt, Homo Sapiens; identical to SEQ ID NO: 417410

SEQ ID NO: 632797 - RNA, 64 nt, Homo Sapiens; identical to SEQ ID NO: 417411

SEQ ID NO: 632798 - RNA, 64 nt, Homo Sapiens; identical to SEQ ID NO: 417412

SEQ ID NO: 632799 - RNA, 64 nt, Homo Sapiens; identical to SEQ ID NO: 417413

SEQ ID NO: 632800 - RNA, 63 nt, Homo Sapiens; identical to SEQ ID NO: 417414

SEQ ID NO: 632801 - RNA, 51 nt, Homo Sapiens; identical to SEQ ID NO: 417415

SEQ ID NO: 632802 - RNA, 64 nt, Homo Sapiens; identical to SEQ ID NO: 417416

SEQ ID NO: 632803 - RNA, 64 nt, Homo Sapiens; identical to SEQ ID NO: 417417

SEQ ID NO: 632804 - RNA, 64 nt, Homo Sapiens; identical to SEQ ID NO: 417418

SEQ ID NO: 632805 - RNA, 64 nt, Homo Sapiens; identical to SEQ ID NO: 417419

SEQ ID NO: 632806 - RNA, 64 nt, Homo Sapiens; identical to SEQ ID NO: 417420

SEQ ID NO: 632807 - RNA, 64 nt, Homo Sapiens; identical to SEQ ID NO: 417421

SEQ ID NO: 632808 - RNA, 64 nt, Homo Sapiens; identical to SEQ ID NO: 417422

SEQ ID NO: 632809 - RNA, 64 nt, Homo Sapiens; identical to SEQ ID NO: 417423

SEQ ID NO: 632810 - RNA, 64 nt, Homo Sapiens; identical to SEQ ID NO: 417424

SEQ ID NO: 632811 - RNA, 64 nt, Homo Sapiens; identical to SEQ ID NO: 417425

SEQ ID NO: 632812 - RNA, 64 nt, Homo Sapiens; identical to SEQ ID NO: 417426

SEQ ID NO: 632813 - RNA, 64 nt, Homo Sapiens; identical to SEQ ID NO: 417427

SEQ ID NO: 632814 - RNA, 64 nt, Homo Sapiens; identical to SEQ ID NO: 417428

SEQ ID NO: 632815 - RNA, 64 nt, Homo Sapiens; identical to SEQ ID NO: 417429

SEQ ID NO: 632816 - RNA, 64 nt, Homo Sapiens; identical to SEQ ID NO: 417430

SEQ ID NO: 632817 - RNA, 64 nt, Homo Sapiens; identical to SEQ ID NO: 417431

SEQ ID NO: 632818 - RNA, 64 nt, Homo Sapiens; identical to SEQ ID NO: 417432

SEQ ID NO: 632819 - RNA, 64 nt, Homo Sapiens; identical to SEQ ID NO: 417433

SEQ ID NO: 632820 - RNA, 64 nt, Homo Sapiens; identical to SEQ ID NO: 417434

SEQ ID NO: 632821 - RNA, 64 nt, Homo Sapiens; identical to SEQ ID NO: 417435

SEQ ID NO: 632822 - RNA, 64 nt, Homo Sapiens; identical to SEQ ID NO: 417436

SEQ ID NO: 632823 - RNA, 64 nt, Homo Sapiens; identical to SEQ ID NO: 417437

SEQ ID NO: 632824 - RNA, 64 nt, Homo Sapiens; identical to SEQ ID NO: 417438

SEQ ID NO: 632825 - RNA, 64 nt, Homo Sapiens; identical to SEQ ID NO: 417439

SEQ ID NO: 632826 - RNA, 64 nt, Homo Sapiens; identical to SEQ ID NO: 417440

SEQ ID NO: 632827 - RNA, 64 nt, Homo Sapiens; identical to SEQ ID NO: 417441

SEQ ID NO: 632828 - RNA, 64 nt, Homo Sapiens; identical to SEQ ID NO: 417442

SEQ ID NO: 632829 - RNA, 64 nt, Homo Sapiens; identical to SEQ ID NO: 417443

SEQ ID NO: 632830 - RNA, 64 nt, Homo Sapiens; identical to SEQ ID NO: 417444

SEQ ID NO: 632831 - RNA, 64 nt, Homo Sapiens; identical to SEQ ID NO: 417445

SEQ ID NO: 632832 - RNA, 64 nt, Homo Sapiens; identical to SEQ ID NO: 417446

SEQ ID NO: 632833 - RNA, 64 nt, Homo Sapiens; identical to SEQ ID NO: 417447

SEQ ID NO: 632834 - RNA, 64 nt, Homo Sapiens; identical to SEQ ID NO: 417448

SEQ ID NO: 632835 - RNA, 64 nt, Homo Sapiens; identical to SEQ ID NO: 417449

SEQ ID NO: 632836 - RNA, 64 nt, Homo Sapiens; identical to SEQ ID NO: 417450

SEQ ID NO: 632837 - RNA, 64 nt, Homo Sapiens; identical to SEQ ID NO: 417451

SEQ ID NO: 632838 - RNA, 64 nt, Homo Sapiens; identical to SEQ ID NO: 417452

SEQ ID NO: 632839 - RNA, 64 nt, Homo Sapiens; identical to SEQ ID NO: 417453

SEQ ID NO: 632840 - RNA, 64 nt, Homo Sapiens; identical to SEQ ID NO: 417454

SEQ ID NO: 632841 - RNA, 64 nt, Homo Sapiens; identical to SEQ ID NO: 417455

SEQ ID NO: 632842 - RNA, 64 nt, Homo Sapiens; identical to SEQ ID NO: 417456

SEQ ID NO: 632843 - RNA, 64 nt, Homo Sapiens; identical to SEQ ID NO: 417457

SEQ ID NO: 632844 - RNA, 63 nt, Homo Sapiens; identical to SEQ ID NO: 417458

SEQ ID NO: 632845 - RNA, 64 nt, Homo Sapiens; identical to SEQ ID NO: 417459

SEQ ID NO: 632846 - RNA, 64 nt, Homo Sapiens; identical to SEQ ID NO: 417460

SEQ ID NO: 632847 - RNA, 64 nt, Homo Sapiens; identical to SEQ ID NO: 417461

SEQ ID NO: 632848 - RNA, 64 nt, Homo Sapiens; identical to SEQ ID NO: 417462

SEQ ID NO: 632849 - RNA, 64 nt, Homo Sapiens; identical to SEQ ID NO: 417463

SEQ ID NO: 632850 - RNA, 64 nt, Homo Sapiens; identical to SEQ ID NO: 417464

SEQ ID NO: 632851 - RNA, 64 nt, Homo Sapiens; identical to SEQ ID NO: 417465

SEQ ID NO: 632852 - RNA, 64 nt, Homo Sapiens; identical to SEQ ID NO: 417466

SEQ ID NO: 632853 - RNA, 64 nt, Homo Sapiens; identical to SEQ ID NO: 259893

SEQ ID NO: 632854 - RNA, 64 nt, Homo Sapiens; identical to SEQ ID NO: 259894

SEQ ID NO: 632855 - RNA, 64 nt, Homo Sapiens; identical to SEQ ID NO: 259895

SEQ ID NO: 632856 - RNA, 64 nt, Homo Sapiens; identical to SEQ ID NO: 259896

SEQ ID NO: 632857 - RNA, 63 nt, Homo Sapiens; identical to SEQ ID NO: 483635

SEQ ID NO: 632858 - RNA, 63 nt, Homo Sapiens; identical to SEQ ID NO: 483636

SEQ ID NO: 632859 - RNA, 63 nt, Homo Sapiens; identical to SEQ ID NO: 483637

SEQ ID NO: 632860 - RNA, 63 nt, Homo Sapiens; identical to SEQ ID NO: 483638

SEQ ID NO: 632861 - RNA, 63 nt, Homo Sapiens; identical to SEQ ID NO: 483639

SEQ ID NO: 632862 - RNA, 63 nt, Homo Sapiens; identical to SEQ ID NO: 483640

SEQ ID NO: 632863 - RNA, 63 nt, Homo Sapiens; identical to SEQ ID NO: 483641

SEQ ID NO: 632864 - RNA, 63 nt, Homo Sapiens; identical to SEQ ID NO: 483642

SEQ ID NO: 632865 - RNA, 63 nt, Homo Sapiens; identical to SEQ ID NO: 483643

SEQ ID NO: 632866 - RNA, 63 nt, Homo Sapiens; identical to SEQ ID NO: 483644

SEQ ID NO: 632867 - RNA, 63 nt, Homo Sapiens; identical to SEQ ID NO: 483645

SEQ ID NO: 632868 - RNA, 63 nt, Homo Sapiens; identical to SEQ ID NO: 483646

SEQ ID NO: 632869 - RNA, 63 nt, Homo Sapiens; identical to SEQ ID NO: 483647

SEQ ID NO: 632870 - RNA, 63 nt, Homo Sapiens; identical to SEQ ID NO: 483648

SEQ ID NO: 632871 - RNA, 63 nt, Homo Sapiens; identical to SEQ ID NO: 483649

SEQ ID NO: 632872 - RNA, 63 nt, Homo Sapiens; identical to SEQ ID NO: 483650

SEQ ID NO: 632873 - RNA, 63 nt, Homo Sapiens; identical to SEQ ID NO: 483651

SEQ ID NO: 632874 - RNA, 61 nt, Homo Sapiens; identical to SEQ ID NO: 379771

SEQ ID NO: 632875 - RNA, 63 nt, Homo Sapiens; identical to SEQ ID NO: 483653

SEQ ID NO: 632876 - RNA, 63 nt, Homo Sapiens; identical to SEQ ID NO: 483654

SEQ ID NO: 632877 - RNA, 63 nt, Homo Sapiens; identical to SEQ ID NO: 483655

SEQ ID NO: 632878 - RNA, 63 nt, Homo Sapiens; identical to SEQ ID NO: 483656

SEQ ID NO: 632879 - RNA, 63 nt, Homo Sapiens; identical to SEQ ID NO: 483657

SEQ ID NO: 632880 - RNA, 63 nt, Homo Sapiens; identical to SEQ ID NO: 483658

SEQ ID NO: 632881 - RNA, 63 nt, Homo Sapiens; identical to SEQ ID NO: 483659

SEQ ID NO: 632882 - RNA, 63 nt, Homo Sapiens; identical to SEQ ID NO: 483660

SEQ ID NO: 632883 - RNA, 63 nt, Homo Sapiens; identical to SEQ ID NO: 483661

SEQ ID NO: 632884 - RNA, 63 nt, Homo Sapiens; identical to SEQ ID NO: 483662

SEQ ID NO: 632885 - RNA, 63 nt, Homo Sapiens; identical to SEQ ID NO: 483663

SEQ ID NO: 632886 - RNA, 63 nt, Homo Sapiens; identical to SEQ ID NO: 483664

SEQ ID NO: 632887 - RNA, 63 nt, Homo Sapiens; identical to SEQ ID NO: 483665

SEQ ID NO: 632888 - RNA, 63 nt, Homo Sapiens; identical to SEQ ID NO: 483666

SEQ ID NO: 632889 - RNA, 63 nt, Homo Sapiens; identical to SEQ ID NO: 483667

SEQ ID NO: 632890 - RNA, 63 nt, Homo Sapiens; identical to SEQ ID NO: 483668

SEQ ID NO: 632891 - RNA, 63 nt, Homo Sapiens; identical to SEQ ID NO: 483669

SEQ ID NO: 632892 - RNA, 63 nt, Homo Sapiens; identical to SEQ ID NO: 483670

SEQ ID NO: 632893 - RNA, 63 nt, Homo Sapiens; identical to SEQ ID NO: 483671

SEQ ID NO: 632894 - RNA, 63 nt, Homo Sapiens; identical to SEQ ID NO: 483672

SEQ ID NO: 632895 - RNA, 64 nt, Homo Sapiens; identical to SEQ ID NO: 266775

SEQ ID NO: 632896 - RNA, 64 nt, Homo Sapiens; identical to SEQ ID NO: 266776

SEQ ID NO: 632897 - RNA, 64 nt, Homo Sapiens; identical to SEQ ID NO: 266777

SEQ ID NO: 632898 - RNA, 64 nt, Homo Sapiens; identical to SEQ ID NO: 266778

SEQ ID NO: 632899 - RNA, 62 nt, Homo Sapiens; identical to SEQ ID NO: 266779

SEQ ID NO: 632900 - RNA, 64 nt, Homo Sapiens; identical to SEQ ID NO: 266780

SEQ ID NO: 632901 - RNA, 64 nt, Homo Sapiens; identical to SEQ ID NO: 266781

SEQ ID NO: 632902 - RNA, 64 nt, Homo Sapiens; identical to SEQ ID NO: 266782

SEQ ID NO: 632903 - RNA, 64 nt, Homo Sapiens; identical to SEQ ID NO: 266783

SEQ ID NO: 632904 - RNA, 64 nt, Homo Sapiens; identical to SEQ ID NO: 266784

SEQ ID NO: 632905 - RNA, 64 nt, Homo Sapiens; identical to SEQ ID NO: 266785

SEQ ID NO: 632906 - RNA, 64 nt, Homo Sapiens; identical to SEQ ID NO: 266786

SEQ ID NO: 632907 - RNA, 64 nt, Homo Sapiens; identical to SEQ ID NO: 266787

SEQ ID NO: 632908 - RNA, 64 nt, Homo Sapiens; identical to SEQ ID NO: 266788

SEQ ID NO: 632909 - RNA, 64 nt, Homo Sapiens; identical to SEQ ID NO: 266789

SEQ ID NO: 632910 - RNA, 64 nt, Homo Sapiens; identical to SEQ ID NO: 266790

SEQ ID NO: 632911 - RNA, 64 nt, Homo Sapiens; identical to SEQ ID NO: 266791

SEQ ID NO: 632912 - RNA, 64 nt, Homo Sapiens; identical to SEQ ID NO: 266792

SEQ ID NO: 632913 - RNA, 64 nt, Homo Sapiens; identical to SEQ ID NO: 266793

SEQ ID NO: 632914 - RNA, 64 nt, Homo Sapiens; identical to SEQ ID NO: 266794

SEQ ID NO: 632915 - RNA, 64 nt, Homo Sapiens; identical to SEQ ID NO: 266795

SEQ ID NO: 632916 - RNA, 64 nt, Homo Sapiens; identical to SEQ ID NO: 266796

SEQ ID NO: 632917 - RNA, 64 nt, Homo Sapiens; identical to SEQ ID NO: 266797

SEQ ID NO: 632918 - RNA, 64 nt, Homo Sapiens; identical to SEQ ID NO: 266798

SEQ ID NO: 632919 - RNA, 64 nt, Homo Sapiens; identical to SEQ ID NO: 266799

SEQ ID NO: 632920 - RNA, 64 nt, Homo Sapiens; identical to SEQ ID NO: 266800

SEQ ID NO: 632921 - RNA, 64 nt, Homo Sapiens
ugcuuuaccuugagccauuauuugugucagagaacaaaagaaacagaaucaauauauaaaauuc

SEQ ID NO: 632922 - RNA, 64 nt, Homo Sapiens
gagacuuuuucuuugcuuguuuguguaauucaaccaaaagaauuucaauacccauucaaauugu

SEQ ID NO: 632923 - RNA, 64 nt, Homo Sapiens
auuguguaaacuuagauccuucucccuuuuggcccaaaagaacccuugauuuaguuccagaauc

SEQ ID NO: 632924 - RNA, 64 nt, Homo Sapiens
aagccugagcuuucucuuauuccuaaagugguggcaaaagaaugaacuggguaugacccugccc

SEQ ID NO: 632925 - RNA, 64 nt, Homo Sapiens
aggagaagaauauuuuguguccaaaacuggauugcaaaagaaagacacagauuauuuuuuggcu

SEQ ID NO: 632926 - RNA, 64 nt, Homo Sapiens
ucauaaaacuccugaauuuaagugauacucagaacaaaagaaagaaaaacuuuuuauacucuaa

SEQ ID NO: 632927 - RNA, 64 nt, Homo Sapiens
uacucugggaauagucauacuauaaaaauaggagcaaaagaaaauugauuauuguguuuauaug

SEQ ID NO: 632928 - RNA, 64 nt, Homo Sapiens
auugaaaacugaggcaguuauagcggagguaaaacaaaagaaauuacagcaacauucgccauac

SEQ ID NO: 632929 - RNA, 64 nt, Homo Sapiens
uuuuccagaguuucacaggcauuuuuggauccuucaaaagaagagguauauaacaguucuuuua

SEQ ID NO: 632930 - RNA, 64 nt, Homo Sapiens
ugggaucuaauuaaacuaaagagcuucugcacagcaaaagaaacuaccaucagagugaacaggc

SEQ ID NO: 632931 - RNA, 64 nt, Homo Sapiens
aaaaagugggugaaggacaugaacagacacuucucaaaagaagacauuuaugcagccaaaaaac

SEQ ID NO: 632932 - RNA, 64 nt, Homo Sapiens
ugccuuacacugguucauguuaugucauauaucacaaaagaaaucuacccuucccuucaaggag

SEQ ID NO: 632933 - RNA, 64 nt, Homo Sapiens
uacaggaggaacuuucugacgagcaguuccccaacaaaagaagcaucugaucuuagcaauuuug

SEQ ID NO: 632934 - RNA, 64 nt, Homo Sapiens
ugaaauaguuuuuauugaaagucaagugacauuucaaaagaaguucuauaacaauuauguuuca

SEQ ID NO: 632935 - RNA, 64 nt, Homo Sapiens
uuuugccacaucugcaaugauuauuguuuaauuucaaaagaauccucaggcucuacaaucuagg

SEQ ID NO: 632936 - RNA, 64 nt, Homo Sapiens
gugcauauauuuauucuguacacacacaaagauucaaaagaaauacuuuuaauguuuucucucu

SEQ ID NO: 632937 - RNA, 64 nt, Homo Sapiens
ggaaaauaaaagaaauauauugcuuuuuuuuuuucaaaagaaaagagagaagaaaauauauuag

SEQ ID NO: 632938 - RNA, 64 nt, Homo Sapiens
uaguauugcugacauuuuaaaaaaauacaaaauacaaaagaaaccauuagaaauuaauaacugu

SEQ ID NO: 632939 - RNA, 64 nt, Homo Sapiens
acagcagcuuuagaauagcuucuuacugaauaugcaaaagaauaauuccuuguuauuuccuaau

SEQ ID NO: 632940 - RNA, 64 nt, Homo Sapiens
gugacuagauaucaaucaguuacuuacccuucuacaaaagaaguaaacaaccaaagaaaauugg

SEQ ID NO: 632941 - RNA, 64 nt, Homo Sapiens
uguguaacagaguugagguuaucaaaauugaccucaaaagaaaaggagaggacaaguguaauaa

SEQ ID NO: 632942 - RNA, 64 nt, Homo Sapiens
uuaaagcguuugcacagaucaacuuaccaggcaccaaaagaaguaaaagcaaaaaagaaaaccu

SEQ ID NO: 632943 - RNA, 64 nt, Homo Sapiens
ucacuaaaucuuuuauaggauuuauuuaaaauagcaaaagaagaaguuucaucauuuuuuacuu

SEQ ID NO: 632944 - RNA, 64 nt, Homo Sapiens
uaaaaauagaauuuggaaacuuauuuuuucuccccaaaagaaucagcagcacaggggaacuaug

SEQ ID NO: 632945 - RNA, 64 nt, Homo Sapiens
uucuugucuccauauauucauguaagaugcacaacaaaagaaacaucagaaguuuauaaaaaua

SEQ ID NO: 632946 - RNA, 64 nt, Homo Sapiens
gugccucacccacucccuucuccuggucucuccucaaaagaauuuuacaugauuuuaaaauaau

SEQ ID NO: 632947 - RNA, 64 nt, Homo Sapiens
uaauaaauggacacaacacaaaacucaaaagguacaaaagaauaaaacaguuaaaaacuaugcc

SEQ ID NO: 632948 - RNA, 64 nt, Homo Sapiens
gacaagacaagcacuuauuuuuauuuucagaagacaaaagaaccaagaugccaacuggcugcga

SEQ ID NO: 632949 - RNA, 64 nt, Homo Sapiens
gaguaauggugaaaauuguugucuuuggaaagcacaaaagaaaccuggaaaggcaguucggcuc

SEQ ID NO: 632950 - RNA, 64 nt, Homo Sapiens
uuaaaauugggcaaaggcaugaacagacacuuuucaaaagaagaccuacaauuggccaacaaac

SEQ ID NO: 632951 - RNA, 64 nt, Homo Sapiens
ucacaaagucagagaugguggugaggcugcagagcaaaagaaacagacacuguuggugggaaag

SEQ ID NO: 632952 - RNA, 64 nt, Homo Sapiens
gguauuuucagugcuacauacuugcagagcaucacaaaagaacacacuauauuuuucuauuuua

SEQ ID NO: 632953 - RNA, 64 nt, Homo Sapiens
agcaugauugaagauacaucagaaucucaaauuucaaaagaaaucuacacuggguaccuuugaa

SEQ ID NO: 632954 - RNA, 64 nt, Homo Sapiens
ugcucacgugcagcuccagaauauggaaacagagcaaaagaacaacccuaguaccuuuuuuuag

SEQ ID NO: 632955 - RNA, 64 nt, Homo Sapiens
uaaaaaacaaaaaaaaaaaacaaaaaaaaaaaaacaaaagaaaaaaauaaaaauacgguggcaa

SEQ ID NO: 632956 - RNA, 64 nt, Homo Sapiens
ccauuauaugacauuggacacuuuuuuauuauuccaaaagaagaaaaaauuaaaacaacuugcu

SEQ ID NO: 632957 - RNA, 64 nt, Homo Sapiens
ccacaguucugaaacauguggcuaccuugucuuucaaaagaacucagaauccuccaggaucuag

SEQ ID NO: 632958 - RNA, 64 nt, Homo Sapiens
gugagaaggagggucucuugaccgccgaaugaagcaaaagaaacagugaagaucugguuccaga

SEQ ID NO: 632959 - RNA, 62 nt, Homo Sapiens
ccucccaaaacaggucaguccuggaugaaagucaaaagaaacucuccagcgcagacuuuuga

SEQ ID NO: 632960 - RNA, 64 nt, Homo Sapiens
caucuguggccaacaauccugaacagacacuuuucaaaagaagaaaaaagugggcaaaggacau

SEQ ID NO: 632961 - RNA, 64 nt, Homo Sapiens
uaucaagagaguaaacagacaaagagcugcacagcaaaagaaacaaaugggaucuaauuaaacu

SEQ ID NO: 632962 - RNA, 64 nt, Homo Sapiens
cucuucugguugauugugacuuuauuugacagagcaaaagaaccuuugcuagcuuuuaaauaua

SEQ ID NO: 632963 - RNA, 64 nt, Homo Sapiens
ggaacuuaauguugugccaacaggauccaauacccaaaagaaaugggcauacacacucaaaaag

SEQ ID NO: 632964 - RNA, 64 nt, Homo Sapiens
aauaaucauugaugaaguaugucaguuacaagcacaaaagaauauaacugcuuuuauaaaucuu

SEQ ID NO: 632965 - RNA, 64 nt, Homo Sapiens
ucagcuuuuuaauguagguuaccacuuauaagcacaaaagaaacauguauaagaaaccagauuu

SEQ ID NO: 632966 - RNA, 64 nt, Homo Sapiens
cuuugcucuuucccccuuccaucucugacuuaagcaaaagaaaaagauuacccaaaaacugucu

SEQ ID NO: 632967 - RNA, 64 nt, Homo Sapiens
cugugugccccggucaccuagcaagcugccgaaccaaaagaauuugcaccccgcugcgggccca

SEQ ID NO: 632968 - RNA, 64 nt, Homo Sapiens
aauaaauaaucuacaucaagguucuccacugacacaaaagaagauauacauauagauagauaau

SEQ ID NO: 632969 - RNA, 64 nt, Homo Sapiens
aaauugauuauuuugugcaaaagaaauuaacacccaaaagaauuuaugacaaauuuagccaaua

SEQ ID NO: 632970 - RNA, 64 nt, Homo Sapiens
agagaaacaaguauuuugcuauauauaaagacaacaaaagaaaucuccuaacaaaagaacuaag

SEQ ID NO: 632971 - RNA, 64 nt, Homo Sapiens
gcuauauauaaagacaacaaaagaaaucuccuaacaaaagaacuaagaggcccagcccucagaa

SEQ ID NO: 632972 - RNA, 64 nt, Homo Sapiens
guuggagcuuuuuauuaaaggaguauaucuuagucaaaagaauuaacacuuggaggcaauuaau

SEQ ID NO: 632973 - RNA, 64 nt, Homo Sapiens
guugacuucagagauguguuaacucgugauacaccaaaagaagacagucauuuauuaaggauuc

SEQ ID NO: 632974 - RNA, 64 nt, Homo Sapiens
cauccccaggaucacugggcaaugcuggaaagagcaaaagaauaucauuggcccugaucacaua

SEQ ID NO: 632975 - RNA, 64 nt, Homo Sapiens
uuuagcucagaaauucuaucuucgggagucaccacaaaagaaaaaaaucaaaaugcagaaaaug

SEQ ID NO: 632976 - RNA, 64 nt, Homo Sapiens
uuuugcuacuaauuccuaucccauacauuugacacaaaagaaguguugguaauggauaaauaac

SEQ ID NO: 632977 - RNA, 64 nt, Homo Sapiens
ugguuuggucacaguugccuaugaguguggguuucaaaagaaacauaaagccuuaacuuagaau

SEQ ID NO: 632978 - RNA, 64 nt, Homo Sapiens
uuacagguauugcacuggguaacauuuggaaccccaaaagaaagaauugcaauaagaagcagug

SEQ ID NO: 632979 - RNA, 64 nt, Homo Sapiens
gcaauaagaagcagugaacaucuaauggauguggcaaaagaauuuacugacugggacuucauau

SEQ ID NO: 632980 - RNA, 64 nt, Homo Sapiens
auaaauucauaaaaaagacucauaucuuugcaaacaaaagaagggcagauacugggcuucuaca

SEQ ID NO: 632981 - RNA, 64 nt, Homo Sapiens
uccuagaguugauucauuguuuuccuccauccugcaaaagaagaucccuuuguuaagcagcuca

SEQ ID NO: 632982 - RNA, 64 nt, Homo Sapiens
ugggaucuaauuaaacuaaagaccuucugcacagcaaaagaaacuaccaucagagucaacaggc

SEQ ID NO: 632983 - RNA, 64 nt, Homo Sapiens
aaaaagucggcaaaggacaugaacagacacuucucaaaagaagacauuuaugcagccaaaaaac

SEQ ID NO: 632984 - RNA, 64 nt, Homo Sapiens
ugggaccuaauuaaacuaaauaacuucugcacagcaaaagaagcuauuugcagacuacagaaug

SEQ ID NO: 632985 - RNA, 64 nt, Homo Sapiens
aaaaacugggcaaaggccaugaauagaccuuucucaaaagaauacauacauguggcaauaagca

SEQ ID NO: 632986 - RNA, 64 nt, Homo Sapiens
aaacauugucuguacagguucuuacugcuuuuuacaaaagaaaccauuuaguuacugggcauaa

SEQ ID NO: 632987 - RNA, 64 nt, Homo Sapiens
aagauaaaccagccucaaucuuaguuccucaucacaaaagaacauuuuuucuccccucccaaau

SEQ ID NO: 632988 - RNA, 64 nt, Homo Sapiens
cuagugaagaguuuuuucuggaauugauuuuucccaaaagaauauauuaauugagguuaagaag

SEQ ID NO: 632989 - RNA, 64 nt, Homo Sapiens
auaguaagaugaguggaaguguuuaucgagcaugcaaaagaaacccucacggcuaagggcucug

SEQ ID NO: 632990 - RNA, 64 nt, Homo Sapiens
cagguccgagggggcgggggcagggccaagaguucaaaagaagccaauggagggagagggagcg

SEQ ID NO: 632991 - RNA, 64 nt, Homo Sapiens
ugucaccccugagcagaagcagucaaaucuugggcaaaagaauuucgguuagaaaagaaaaucc

SEQ ID NO: 632992 - RNA, 64 nt, Homo Sapiens
uacucaggcagugcaguacucaguaagacagugcagugcucaguaaggcagugcaauacucagu

SEQ ID NO: 632993 - RNA, 64 nt, Homo Sapiens
caguaaagcaaugcaaugcucaguaacacagugcagugcucaauaaggcagugcagugcucagu

SEQ ID NO: 632994 - RNA, 64 nt, Homo Sapiens
caguaacacagugcagugcucaauaaggcagugcagugcucaguaaggcagugaauugcuuagu

SEQ ID NO: 632995 - RNA, 64 nt, Homo Sapiens
caguaaggcagugaauugcuuaguaacacaguguagugcucaguaggacagcauaguacucagu

SEQ ID NO: 632996 - RNA, 64 nt, Homo Sapiens
ugcuaacacugucucuuuugugaaaaucuggaaaagugcucauauucacagguggcuggugcua

SEQ ID NO: 632997 - RNA, 64 nt, Homo Sapiens
uauguaaagcaguuuaaaauggaauucaauguucagugcucagguauguaguaaguacuguagu

SEQ ID NO: 632998 - RNA, 64 nt, Homo Sapiens
gaauauuaauuuaguucugcucuuccaucguuacagugcucaguccaacccuuaggaaaagccc

SEQ ID NO: 632999 - RNA, 64 nt, Homo Sapiens
uaaauguaaguguuauuccuauuuauuacagaaaagugcucagucuacaaaaaccuacuuuggu

SEQ ID NO: 633000 - RNA, 64 nt, Homo Sapiens
guuggaaguaagaaguuuuauuuuaaguacuuucagugcucaaaaaaaugcaaucacuguguug

SEQ ID NO: 633001 - RNA, 64 nt, Homo Sapiens
aacacuuuucuagcguugguacaucugagaaaugagugcucagguggauuuuauccucgcaagc

SEQ ID NO: 633002 - RNA, 64 nt, Homo Sapiens
uguuucauaauucuucccccaauuggcuuuucauagugcucagauguaacccaccuugaccaua

SEQ ID NO: 633003 - RNA, 64 nt, Homo Sapiens
aauuuucugaucucagagcaucuggcaucacgucagugcucagacacguguggaauuuuccacu

SEQ ID NO: 633004 - RNA, 64 nt, Homo Sapiens
agagaaucacccuuaccccagaccuucaugagacagugcucaugaagccagugcguuucccaga

SEQ ID NO: 633005 - RNA, 64 nt, Homo Sapiens
aaagaauucaaauaaagagacuuggcacagaguaagugcucaguaaaugguuacugguauuauc

SEQ ID NO: 633006 - RNA, 64 nt, Homo Sapiens
cuuuugacccaaucauauaguggggcucagggccagugcucacucuuauugguaagcuauagga

SEQ ID NO: 633007 - RNA, 64 nt, Homo Sapiens
agcucaguuucucaguugcgcuaaucacauuucaagugcucagcagccacccgugucuacuacu

SEQ ID NO: 633008 - RNA, 64 nt, Homo Sapiens
uauguggcauuugcuuaggaggaaccguagugucagugcucauuaccucugauccccuucagug

SEQ ID NO: 633009 - RNA, 64 nt, Homo Sapiens
ugccccagccuggcucuaccggauaagcuccccgagugcucaccugccgaugaaaagagagggu

SEQ ID NO: 633010 - RNA, 64 nt, Homo Sapiens
cagauaacuggcuuaugacaccuugaaaaguucaagugcucauauaacacaccacacugaaccc

SEQ ID NO: 633011 - RNA, 64 nt, Homo Sapiens
gucaccaggucucccaagugcacucauccaggucagugcucagauguguuuaaggagacccuau

SEQ ID NO: 633012 - RNA, 64 nt, Homo Sapiens; identical to SEQ ID NO: 223145

SEQ ID NO: 633013 - RNA, 64 nt, Homo Sapiens; identical to SEQ ID NO: 223146

SEQ ID NO: 633014 - RNA, 64 nt, Homo Sapiens; identical to SEQ ID NO: 223147

SEQ ID NO: 633015 - RNA, 64 nt, Homo Sapiens; identical to SEQ ID NO: 223148

SEQ ID NO: 633016 - RNA, 64 nt, Homo Sapiens; identical to SEQ ID NO: 223149

SEQ ID NO: 633017 - RNA, 64 nt, Homo Sapiens; identical to SEQ ID NO: 223150

SEQ ID NO: 633018 - RNA, 64 nt, Homo Sapiens; identical to SEQ ID NO: 223151

SEQ ID NO: 633019 - RNA, 64 nt, Homo Sapiens; identical to SEQ ID NO: 223152

SEQ ID NO: 633020 - RNA, 64 nt, Homo Sapiens; identical to SEQ ID NO: 223153

SEQ ID NO: 633021 - RNA, 64 nt, Homo Sapiens; identical to SEQ ID NO: 223154

SEQ ID NO: 633022 - RNA, 64 nt, Homo Sapiens; identical to SEQ ID NO: 223155

SEQ ID NO: 633023 - RNA, 64 nt, Homo Sapiens; identical to SEQ ID NO: 223156

SEQ ID NO: 633024 - RNA, 64 nt, Homo Sapiens; identical to SEQ ID NO: 223157

SEQ ID NO: 633025 - RNA, 64 nt, Homo Sapiens; identical to SEQ ID NO: 223158

SEQ ID NO: 633026 - RNA, 64 nt, Homo Sapiens; identical to SEQ ID NO: 223159

SEQ ID NO: 633027 - RNA, 64 nt, Homo Sapiens; identical to SEQ ID NO: 223160

SEQ ID NO: 633028 - RNA, 64 nt, Homo Sapiens; identical to SEQ ID NO: 223161

SEQ ID NO: 633029 - RNA, 64 nt, Homo Sapiens; identical to SEQ ID NO: 223162

SEQ ID NO: 633030 - RNA, 64 nt, Homo Sapiens; identical to SEQ ID NO: 223163

SEQ ID NO: 633031 - RNA, 64 nt, Homo Sapiens; identical to SEQ ID NO: 223164

SEQ ID NO: 633032 - RNA, 64 nt, Homo Sapiens; identical to SEQ ID NO: 223165

SEQ ID NO: 633033 - RNA, 64 nt, Homo Sapiens; identical to SEQ ID NO: 223166

SEQ ID NO: 633034 - RNA, 64 nt, Homo Sapiens; identical to SEQ ID NO: 223167

SEQ ID NO: 633035 - RNA, 64 nt, Homo Sapiens; identical to SEQ ID NO: 223168

SEQ ID NO: 633036 - RNA, 64 nt, Homo Sapiens; identical to SEQ ID NO: 223169

SEQ ID NO: 633037 - RNA, 64 nt, Homo Sapiens; identical to SEQ ID NO: 223170

SEQ ID NO: 633038 - RNA, 64 nt, Homo Sapiens; identical to SEQ ID NO: 223171

SEQ ID NO: 633039 - RNA, 64 nt, Homo Sapiens; identical to SEQ ID NO: 223172

SEQ ID NO: 633040 - RNA, 64 nt, Homo Sapiens; identical to SEQ ID NO: 223173

SEQ ID NO: 633041 - RNA, 64 nt, Homo Sapiens; identical to SEQ ID NO: 223174

SEQ ID NO: 633042 - RNA, 64 nt, Homo Sapiens; identical to SEQ ID NO: 223175

SEQ ID NO: 633043 - RNA, 64 nt, Homo Sapiens; identical to SEQ ID NO: 223176

SEQ ID NO: 633044 - RNA, 64 nt, Homo Sapiens; identical to SEQ ID NO: 223177

SEQ ID NO: 633045 - RNA, 64 nt, Homo Sapiens; identical to SEQ ID NO: 223178

SEQ ID NO: 633046 - RNA, 64 nt, Homo Sapiens; identical to SEQ ID NO: 223179

SEQ ID NO: 633047 - RNA, 64 nt, Homo Sapiens; identical to SEQ ID NO: 223180

SEQ ID NO: 633048 - RNA, 64 nt, Homo Sapiens; identical to SEQ ID NO: 223181

SEQ ID NO: 633049 - RNA, 64 nt, Homo Sapiens; identical to SEQ ID NO: 223182

SEQ ID NO: 633050 - RNA, 64 nt, Homo Sapiens; identical to SEQ ID NO: 223183

SEQ ID NO: 633051 - RNA, 64 nt, Homo Sapiens; identical to SEQ ID NO: 223184

SEQ ID NO: 633052 - RNA, 64 nt, Homo Sapiens; identical to SEQ ID NO: 223185

SEQ ID NO: 633053 - RNA, 64 nt, Homo Sapiens; identical to SEQ ID NO: 223186

SEQ ID NO: 633054 - RNA, 64 nt, Homo Sapiens; identical to SEQ ID NO: 223187

SEQ ID NO: 633055 - RNA, 64 nt, Homo Sapiens; identical to SEQ ID NO: 223188

SEQ ID NO: 633056 - RNA, 64 nt, Homo Sapiens; identical to SEQ ID NO: 223189

SEQ ID NO: 633057 - RNA, 64 nt, Homo Sapiens; identical to SEQ ID NO: 223190

SEQ ID NO: 633058 - RNA, 64 nt, Homo Sapiens; identical to SEQ ID NO: 223191

SEQ ID NO: 633059 - RNA, 64 nt, Homo Sapiens; identical to SEQ ID NO: 223192

SEQ ID NO: 633060 - RNA, 64 nt, Homo Sapiens; identical to SEQ ID NO: 223193

SEQ ID NO: 633061 - RNA, 64 nt, Homo Sapiens; identical to SEQ ID NO: 223194

SEQ ID NO: 633062 - RNA, 64 nt, Homo Sapiens; identical to SEQ ID NO: 223195

SEQ ID NO: 633063 - RNA, 57 nt, Homo Sapiens; identical to SEQ ID NO: 223196

SEQ ID NO: 633064 - RNA, 64 nt, Homo Sapiens; identical to SEQ ID NO: 223197

SEQ ID NO: 633065 - RNA, 54 nt, Homo Sapiens; identical to SEQ ID NO: 223198

SEQ ID NO: 633066 - RNA, 64 nt, Homo Sapiens
aggauaugcacgugcaucuggcuucucaaugaaugagauacaccaguuaaucuuuugcaggccc

SEQ ID NO: 633067 - RNA, 64 nt, Homo Sapiens
uuacaaauauacaagcaaauuuacauucuagcaggagauacaauaguaucuguccucaugcagc

SEQ ID NO: 633068 - RNA, 64 nt, Homo Sapiens
uuuuuguguggguugaaugaguccauuuugauuugagauacaacuuaagaccuugcauaugucu

SEQ ID NO: 633069 - RNA, 64 nt, Homo Sapiens
uugaaggagaguugucuguugggauuacagaaaugagauacauuagccuugaccucacuuagca

SEQ ID NO: 633070 - RNA, 64 nt, Homo Sapiens
ccaucuuccuguccugccugacaguucgcucauuccaacuaaucaucaucuucaaguuuuccac

SEQ ID NO: 633071 - RNA, 64 nt, Homo Sapiens
uuuuuuuuaacuuaagaggauucaggguuaagcaccaacuaaauuaaaucaugcuauuuaauuu

SEQ ID NO: 633072 - RNA, 64 nt, Homo Sapiens
ugcagguucuagggcuucucccagccuucagaagccaacuaacucugcagauggggcuaggacu

SEQ ID NO: 633073 - RNA, 64 nt, Homo Sapiens
cgugcugacggcaaggggcaauggagugaguuucccaacuaagaaaccacuauuauauauuuuu

SEQ ID NO: 633074 - RNA, 64 nt, Homo Sapiens
cggauuguguuaguaguagccaucaggagggucuccaacuaaaacacuuguuccugcuugcucc

SEQ ID NO: 633075 - RNA, 64 nt, Homo Sapiens
uguggcagcccauggguaugacauaggccaaggcccaacuaacagucaagaaacagcuccucgu

SEQ ID NO: 633076 - RNA, 64 nt, Homo Sapiens
aucuuuuuaaucauaaucaacaucaguuuuugacccaacuaaccuugacuguauucaaacuuau

SEQ ID NO: 633077 - RNA, 64 nt, Homo Sapiens
auccguuuacccuaugcaaaguugcuguaugaugccaacuaaacuacucuuuaggcagccuucu

SEQ ID NO: 633078 - RNA, 53 nt, Homo Sapiens
gucuauuagugcgauggugacaaccaacuaauaaaauuuaaagaccacacugc

SEQ ID NO: 633079 - RNA, 64 nt, Homo Sapiens
cauucauaaggcaggcacuaucagaaaguguacgccaacuaagggacccacaaagcaggcagag

SEQ ID NO: 633080 - RNA, 64 nt, Homo Sapiens
guaagaaaccccuguccccagucagagauaacauccaacuaacuccagaagcggaagaggauau

SEQ ID NO: 633081 - RNA, 64 nt, Homo Sapiens
uucagucaguauguuuguuuuacugcaaauagucccaacuaagacucucaaaaauaaucuuaaa

SEQ ID NO: 633082 - RNA, 64 nt, Homo Sapiens
ccucgaaccaaggcagccucgagagugguuguugccaacuaagcgcaccuccugagaaggcgag

SEQ ID NO: 633083 - RNA, 64 nt, Homo Sapiens
acucucaaaccauaccugguaacgcccaagaaaaccaacuaaggugguggauuucuuacuaccu

SEQ ID NO: 633084 - RNA, 64 nt, Homo Sapiens
uaaaauguuuugcuaaaucuuuuucucuuugucuccaacuaauagugccuucauacaauaauau

SEQ ID NO: 633085 - RNA, 64 nt, Homo Sapiens
uggagagaugaaucauucugcacaaaacaucuagccaacuaaaacaagcaauucuaagaucuuc

SEQ ID NO: 633086 - RNA, 64 nt, Homo Sapiens
uuaagaugcagcauuuuagaaaauguggucuuugccaacuaaaucuaaacucaugcuuauugcu

SEQ ID NO: 633087 - RNA, 64 nt, Homo Sapiens
gggacuacaggcacgugccaccugccucagucucccaacuaagucuccagggcucaaggauccu

SEQ ID NO: 633088 - RNA, 64 nt, Homo Sapiens
uuuauugaagaccuacuuugggaaaagcaguaaaccaacuaauaacccuccagauguauccuug

SEQ ID NO: 633089 - RNA, 64 nt, Homo Sapiens
uuuguauuuuuaguagagacgugccuggccacgcccaacuaauugauuacaggcgugagccacc

SEQ ID NO: 633090 - RNA, 64 nt, Homo Sapiens
gacauguagcucauguauggaucuuauacauaauccaacuaauugcauuauuucauaaaaugcu

SEQ ID NO: 633091 - RNA, 64 nt, Homo Sapiens
guacaucacaguuuucaagagaacuacagagccaccaacuaaauaugaaaccagaaauccaugu

SEQ ID NO: 633092 - RNA, 56 nt, Homo Sapiens
uuacaggaagugaagaaugagauggcccaacuaaaccaauuuggaaucauuaacua

SEQ ID NO: 633093 - RNA, 64 nt, Homo Sapiens
acccugggagcagacaauaagaggaagaaugaagccaacuaaaauucugaaugcuuuuuguugg

SEQ ID NO: 633094 - RNA, 64 nt, Homo Sapiens
uuaaguguuauuuauuuuacucaagaacuggaaaccaacuaaaugccuucuauagaaguaauuu

SEQ ID NO: 633095 - RNA, 64 nt, Homo Sapiens
uuuguguuuuuaauaaagaccaugugccacccacccaacuaauucugaguagcuggauuacagg

SEQ ID NO: 633096 - RNA, 64 nt, Homo Sapiens
guuauugaacuguaauucucugagccucaugaagccaacuaaguugaagccacauuuuccaaca

SEQ ID NO: 633097 - RNA, 64 nt, Homo Sapiens
gaccuacacggacuuuuauuagucuucuuuccuuccaacuaaauuaucuaaugucucccuaaua

SEQ ID NO: 633098 - RNA, 64 nt, Homo Sapiens
uccuuuucuuucuguuguuguuucccagcuacaaccaacuaaagacacaaauggcguucugcaa

SEQ ID NO: 633099 - RNA, 64 nt, Homo Sapiens
agugagacaucugccauucccaacucugggaaaaccaacuaauauacaaccauauaaaugaagg

SEQ ID NO: 633100 - RNA, 64 nt, Homo Sapiens
aaauauucuaugguacauucucagaaauuggcuuccaacuaaaauacguuugacccauuuugaa

SEQ ID NO: 633101 - RNA, 64 nt, Homo Sapiens
ugggccuuugauuuaccaacacuggaaaugccugccaacuaaucuuggauagauucuuuaaggc

SEQ ID NO: 633102 - RNA, 64 nt, Homo Sapiens
agacaacugggaagagccccugccccuuccugggccaacuaaccccacccgccagcuccaggac

SEQ ID NO: 633103 - RNA, 64 nt, Homo Sapiens
auuuuuuucuaaauaaauauguuucuucuguuuuccaacuaaauaugaaguguguuuuucuuug

SEQ ID NO: 633104 - RNA, 64 nt, Homo Sapiens
guaaugcaagaaccaaaugcacugugauguggcaccaacuaauuagcaagcaugaauuuuucac

SEQ ID NO: 633105 - RNA, 64 nt, Homo Sapiens
aggguaucgcauacucaaaugguagacaaugaccccaacuaaaucuuccugauguuacacugcu

SEQ ID NO: 633106 - RNA, 64 nt, Homo Sapiens
ugauauauggaugaagcaacaccaucauaucauaccaacuaaaauuguaacuuaccaaaaacaa

SEQ ID NO: 633107 - RNA, 64 nt, Homo Sapiens
gcacguccuuucuuucuuuguggaaagcaaauugccaacuaaugacuccaggugugugguauua

SEQ ID NO: 633108 - RNA, 64 nt, Homo Sapiens
agaucauuaucucuuuccuuuuuuuugucuuauuccaacuaaguagggaauaauaaaggccuga

SEQ ID NO: 633109 - RNA, 64 nt, Homo Sapiens
ggucguuugauuaggaaacagucccagucacugaccaacuaacuagagagcaugauggagcaga

SEQ ID NO: 633110 - RNA, 64 nt, Homo Sapiens
auccagugaccucucucucugggacuugguuuccccaacuaaaauuugaaguaguugaaugggg

SEQ ID NO: 633111 - RNA, 64 nt, Homo Sapiens
gugucuuuugugcuuuuuuguuguuauuaaaacaccaacuaaaccuuauagucaagacaaggcu

SEQ ID NO: 633112 - RNA, 64 nt, Homo Sapiens
aacauuuuccuauuaaaauaauuuccaaaacguuccaacuaaaaagaagacauugcguuaucuu

SEQ ID NO: 633113 - RNA, 64 nt, Homo Sapiens
cuacccacacgaaaaaagaauuuaaggacuugggccaacuaaguuuauuuuuauauggaaaagu

SEQ ID NO: 633114 - RNA, 64 nt, Homo Sapiens
uuauuuuuuauuuuuugcagaugcaccaccauacccaacuaauuaaguaacuaagacuacaggc

SEQ ID NO: 633115 - RNA, 64 nt, Homo Sapiens
aaggcagcugagucccucaguacacauuuuaaagccaacuaacggauauugucucccauuuuau

SEQ ID NO: 633116 - RNA, 64 nt, Homo Sapiens
augaaacuauugaucaauacaguaaagaaaaaugccaacuaaacuucagaggaaaguaccaguc

SEQ ID NO: 633117 - RNA, 64 nt, Homo Sapiens
aauagccaggggcuacaggcauauaccaccaugcccaacuaauuuuuuaauuuuuuguagagau

SEQ ID NO: 633118 - RNA, 64 nt, Homo Sapiens
auauuuaugaagcaagaauagguacagucauuuuccaacuaacaucuagugagacugggauuca

SEQ ID NO: 633119 - RNA, 64 nt, Homo Sapiens
gcauuuaguugaaugaagucuucuuggauuucacccaacuaaaaggauuuuuaaaaauaaauaa

SEQ ID NO: 633120 - RNA, 64 nt, Homo Sapiens
uuuugauagaauuaaauuuauuuaaauuuauccuccaacuaaauaaauuuuugauagaauuaaa

SEQ ID NO: 633121 - RNA, 64 nt, Homo Sapiens
uaaaaugcacugaagccuuagagcacaguuaaggccaacuaacgauuauuucaacacaauggaa

SEQ ID NO: 633122 - RNA, 64 nt, Homo Sapiens
accauuugucuuucccauuuuguuuauaaaauaaccaacuaauaaauuuaaguuuuaaauauug

SEQ ID NO: 633123 - RNA, 64 nt, Homo Sapiens
aaaaaauucaaaccaauucaguuugcuuguaaaaccaacuaaauaaguaaacaacauauuuggg

SEQ ID NO: 633124 - RNA, 64 nt, Homo Sapiens
aaaaaaaaauaaagaaaaaacucgauucucguacccaacuaaaaggguuuuguucccccuccau

SEQ ID NO: 633125 - RNA, 64 nt, Homo Sapiens
aguuagaaaacauaaucuucugccuucucaugauccaacuaaugccuuacucuucuugaaauuu

SEQ ID NO: 633126 - RNA, 64 nt, Homo Sapiens
aguaaaaaugaaaaagacgaaauuuaguuaccucccaacuaaaaaugauaucaaaagaauaauc

SEQ ID NO: 633127 - RNA, 64 nt, Homo Sapiens
ccuaaaccucgguauuagcccgggucaaagcggaccaacuaacguucugcuccaugcucuuccu

SEQ ID NO: 633128 - RNA, 64 nt, Homo Sapiens
uuuuaaaaaucaacuauuacaguccaugaucugaccaacuaagcaacacuucacagagggucac

SEQ ID NO: 633129 - RNA, 64 nt, Homo Sapiens
auuacgcuaucuagaauuguuauagucacaauauccaacuaaaauuccaaauguauuucauuac

SEQ ID NO: 633130 - RNA, 64 nt, Homo Sapiens
caacuguaauguacuugauaguuuucuuuuucguccaacuaaaauaauuuauuuuugauucuuu

SEQ ID NO: 633131 - RNA, 64 nt, Homo Sapiens
gagaauuuaaagcagauuaccuuuuaaaacuggaccaacuaaguaauugguauuuaaucaaaga

SEQ ID NO: 633132 - RNA, 64 nt, Homo Sapiens
ucugcacacucacauuaucuugcuaucacuguaaccaacuaaugccaaaagaacgguuuuguaa

SEQ ID NO: 633133 - RNA, 64 nt, Homo Sapiens
aagcacaggaaacagaccuuaaaauuguaaccuaccaacuaacuuacaugcuuauaaaaguaaa

SEQ ID NO: 633134 - RNA, 64 nt, Homo Sapiens
caggaccccaaugcgacaaguccauuuugcaaacccaacuaagcauuaaaguuuguguguugug

SEQ ID NO: 633135 - RNA, 64 nt, Homo Sapiens
uauauugcugcaaauggaaguguguuucaacaagccaacuaaaacuugcuuucaggaagagaga

SEQ ID NO: 633136 - RNA, 64 nt, Homo Sapiens
cuguuaucagggcccaaauaacaguggcaagcuaccaacuaaguuguauuuuaauaaagauucc

SEQ ID NO: 633137 - RNA, 64 nt, Homo Sapiens
gucucugaagacaaauaauuaaaccuuuuuuuucccaacuaaagaauggauuuaauuaaacuau

SEQ ID NO: 633138 - RNA, 64 nt, Homo Sapiens
gccaggauugauggcagcugagggaaauucuugcccaacuaaacccagaacucaaacuuaacau

SEQ ID NO: 633139 - RNA, 64 nt, Homo Sapiens
acucaucauggucacauccagcccccacccccggccaacuaaccacugcaggcuccucuuccag

SEQ ID NO: 633140 - RNA, 64 nt, Homo Sapiens
ugcucgcgcccucccagcacggucuucucuucugccaacuaacggaccccugcuaacacaugca

SEQ ID NO: 633141 - RNA, 64 nt, Homo Sapiens
uggaggcuuuggaagggcagugggaccugucuuuccaacuaaaucacuaucagagccacaaauc

SEQ ID NO: 633142 - RNA, 64 nt, Homo Sapiens
ccagggccugccggcgcggggaggaaagcaaaauccaacuaaugguauauauuguaggguacag

SEQ ID NO: 633143 - RNA, 64 nt, Homo Sapiens
gcaaugaaucuagaugcaauuaauuuuauuccuuccaacuaaaauuacaauauuuuuagguuaa

SEQ ID NO: 633144 - RNA, 64 nt, Homo Sapiens
uugucuccuccuuuaacugagucaucaucuuaguccaacuaaugcagucgauacaaugcguaga

SEQ ID NO: 633145 - RNA, 64 nt, Homo Sapiens
auauuuuaauggcagacugagaaaacagaauucuccaacuaaaaagccaugguucuuucuggug

SEQ ID NO: 633146 - RNA, 64 nt, Homo Sapiens
gcuuuccuacuaagaucaggcauccuugauguuuccaacuaaauaaaaacccuacaucuagcau

SEQ ID NO: 633147 - RNA, 64 nt, Homo Sapiens
acaccaggaggguugugggcucagguuugucuggccaacuaagggcuuuucuacaauuggcaga

SEQ ID NO: 633148 - RNA, 64 nt, Homo Sapiens
ccgugacccgacugauaccuuugaauugucaaagccaacuaauaugcagcuugcuugcugcauu

SEQ ID NO: 633149 - RNA, 64 nt, Homo Sapiens
aaguagcugggauuacaggcacccaccaccaugcccaacuaauuuuuguauuuuuauagagaua

SEQ ID NO: 633150 - RNA, 64 nt, Homo Sapiens
uacaaacaaugcaaccaacuauccaaguguuauaccaacuaaaacccccaauaaaccuugaaca

SEQ ID NO: 633151 - RNA, 64 nt, Homo Sapiens
uugagaaagaugucaugcaaaaggacgacgguggccaacuaaagcaagucuuccuuccacccug

SEQ ID NO: 633152 - RNA, 64 nt, Homo Sapiens
gugcauuagguauauauuuuuugaaguauuuuugccaacuaaaaugaagucuguaaauucuguu

SEQ ID NO: 633153 - RNA, 64 nt, Homo Sapiens
agacuuuaauucuucucuuuauuucaggagaaaaccaacuaaguguuuuuuaggaaucagaauc

SEQ ID NO: 633154 - RNA, 64 nt, Homo Sapiens
uggacuucucugcuuuauccagagugagaauuccccaacuaaauccucauccggggcuuuggau

SEQ ID NO: 633155 - RNA, 64 nt, Homo Sapiens
caaauuuuuaaagaugcuuacucccaguguauugccaacuaaauccuagauauuuaugugaaac

SEQ ID NO: 633156 - RNA, 64 nt, Homo Sapiens
ucagauauacaugucuagauguuacagcaaagccccaacuaaucuuuagaagcauauuggaacu

SEQ ID NO: 633157 - RNA, 64 nt, Homo Sapiens
cuuagcaaggaaacagugcaggaaauguagguuaccaacuaagcagcuuuugcucuuaguacug

SEQ ID NO: 633158 - RNA, 64 nt, Homo Sapiens
auagcuuacauuuccucuuuuugccuuuaucuccccaacuaaaauacaauggggaagaagucug

SEQ ID NO: 633159 - RNA, 64 nt, Homo Sapiens
aaguccuucauacaccuucuggguagggaaacaaccaacuaauugacuaacaccaccaacaaca

SEQ ID NO: 633160 - RNA, 64 nt, Homo Sapiens
agaaaaaaacgaaaacagucaaccaaccccaucgccaacuaagcgaggcaugccugagagacau

SEQ ID NO: 633161 - RNA, 64 nt, Homo Sapiens
aacauuucauuaugaggucagacuaggauaauguccaacuaaaaacaaacccuuuucauccugg

SEQ ID NO: 633162 - RNA, 64 nt, Homo Sapiens
cauagauuccccaaagugagggcaagaauaugccccaacuaaagaaaugcagagaugaggcuaa

SEQ ID NO: 633163 - RNA, 64 nt, Homo Sapiens
ggaaacacucuuccccuucuccagcugagguggaccaacuaauuaaaaucaguaguuaggcagc

SEQ ID NO: 633164 - RNA, 64 nt, Homo Sapiens
cuguacaaaauagcugacagauuauugcuaguggccaacuaaacaauagcuagaauucaaauug

SEQ ID NO: 633165 - RNA, 64 nt, Homo Sapiens
auaaagaauaggcuauaaggcguccuuuggcaucccaacuaacaacuuccaaaggucaauaugu

SEQ ID NO: 633166 - RNA, 64 nt, Homo Sapiens
auaaagaguaggcuauaaggcauccuuuggcaucccaacuaacaacuucuaaaggucaauauau

SEQ ID NO: 633167 - RNA, 64 nt, Homo Sapiens
gcuccccuguccucuucaaucccuugagauauagccaacuaacgacgcuacuggaagccccaga

SEQ ID NO: 633168 - RNA, 64 nt, Homo Sapiens
aguuauaaucuuggcacuguauacacauaugcaaccaacuaaacauuuuuucuuucuuuuuuua

SEQ ID NO: 633169 - RNA, 64 nt, Homo Sapiens
ugcuugaggcuaccucuacccuuguuuaacaaacccaacuaaaguguaguuuccgcuuugcuug

SEQ ID NO: 633170 - RNA, 64 nt, Homo Sapiens
uguuucugguuacuaacagaccccuuacugaugcccaacuaaugggaaccauuccuuuauguug

SEQ ID NO: 633171 - RNA, 64 nt, Homo Sapiens
aaauauauagagcauuuuauugaaacaaaaugucccaacuaagaaacauaaccaaaaauuaaau

SEQ ID NO: 633172 - RNA, 64 nt, Homo Sapiens
ugucugcuuacucacccacucuguccuuuccucaccaacuaacaugugccagccaggcagaguc

SEQ ID NO: 633173 - RNA, 64 nt, Homo Sapiens
cuaauuugcuuuggugggguccuuaaaacauuucccaacuaaagaauagaauuguaaaggaaaa

SEQ ID NO: 633174 - RNA, 64 nt, Homo Sapiens
uaaaauaccauuguuaaagaauucuaucuuaaggccaacuaauaaucuauuugguuuaaaaagu

SEQ ID NO: 633175 - RNA, 64 nt, Homo Sapiens
uauuuggcuauaaaaagucagcauaaaauaugauccaacuaaaagggauuaauuuuuggcauuu

SEQ ID NO: 633176 - RNA, 64 nt, Homo Sapiens
uuugucaaugguagugacuuacugaacaugggcaccaacuaauuuuguuguuguucuaccagaa

SEQ ID NO: 633177 - RNA, 64 nt, Homo Sapiens
uuuguuucgccugaucucaaguuuuagcaacucaccaacuaaggcguaaccucauuuuauguuc

SEQ ID NO: 633178 - RNA, 64 nt, Homo Sapiens
uaauuagaaaguagcuuauuuuuuucuuaaaaugccaacuaaaacuuuuuuuucuuucucuuuu

SEQ ID NO: 633179 - RNA, 64 nt, Homo Sapiens
gacagaugugugagaacaagcugcccaacugugaccaacuaaauaacuuuuaacccgcuucuac

SEQ ID NO: 633180 - RNA, 64 nt, Homo Sapiens
cacagaaaaacuguuuacuuaccuauauuucuagccaacuaacuaaaacuuuggaaaguguguu

SEQ ID NO: 633181 - RNA, 64 nt, Homo Sapiens
ggaucuucaaaaaauaaaauaaugugaagcaaaaccaacuaaaaagugauucuugcacaugaac

SEQ ID NO: 633182 - RNA, 64 nt, Homo Sapiens
uaagacuuggauucucuucugcccuuguuaaucuccaacuaauuacuacagauugacacguuuu

SEQ ID NO: 633183 - RNA, 64 nt, Homo Sapiens
uuauugcuuuaaacaaguuugugcuuaaucugucccaacuaaaauggagcuuauaaacuuacuu

SEQ ID NO: 633184 - RNA, 64 nt, Homo Sapiens
gucacccucccucugcugggaugagguccaggagccaacuaaaacaauggcagaggagacaucu

SEQ ID NO: 633185 - RNA, 64 nt, Homo Sapiens
aaguagcugggacuacaggcacacgccaccacacccaacuaauuuuuguauuuuuaguagagau

SEQ ID NO: 633186 - RNA, 64 nt, Homo Sapiens
ggcaguggggagcccccaucccuucacaccgccaccaacuaaccaagcuuggccucugacuccc

SEQ ID NO: 633187 - RNA, 64 nt, Homo Sapiens
gcccccacuguaagcccccgcuuccgaaccugugccaacuaaggauucaugucugccuggggcc

SEQ ID NO: 633188 - RNA, 64 nt, Homo Sapiens
ccuagaagagcuucugaggcaacaaaaagcuuccccaacuaaaggacuccgucacaacaacaac

SEQ ID NO: 633189 - RNA, 64 nt, Homo Sapiens
agaaacucacccccaaggggagcacccagcaacuccaacuaacacugccagacggcacccaccc

SEQ ID NO: 633190 - RNA, 64 nt, Homo Sapiens
ccaaugaaaacaccauuccaauuaaccucuucccccaacuaacacaggcccuggcucuguaacc

SEQ ID NO: 633191 - RNA, 64 nt, Homo Sapiens
guccaaaaccuaaauugaauauaaacuuguuuauccaacuaaguuauguugacuaaauuuacaa

SEQ ID NO: 633192 - RNA, 64 nt, Homo Sapiens
ggguguggcuuuuuuucucuccuuuuuaccaaccccaacuaaacugggaguaagacuuagucag

SEQ ID NO: 633193 - RNA, 64 nt, Homo Sapiens
gauguuaacaguauuaaaaauuaaaccccauaaaccaacuaagccuuauggaauucacagucac

SEQ ID NO: 633194 - RNA, 64 nt, Homo Sapiens
acacuuuaauuguuuuucuucauauaaaaaagcaccaacuaaugauaaugucaggucuuucacu

SEQ ID NO: 633195 - RNA, 64 nt, Homo Sapiens
caguaaacuguuauacuaguucaauaauugacagccaacuaauaugugugaaaugaaggaacug

SEQ ID NO: 633196 - RNA, 64 nt, Homo Sapiens
ugcuucuucgaaacugaagugaguaaggacauuaccaacuaaauucccuuuguaaagacuuggg

SEQ ID NO: 633197 - RNA, 64 nt, Homo Sapiens
gcacugaaacuguguauuaccaagcucacucuagccaacuaaauaaaaaucucuggcaguaaaa

SEQ ID NO: 633198 - RNA, 64 nt, Homo Sapiens
guaguaauaccagcauacuucccgcugcacaacaccaacuaaaacuuuacuggacugauuuuaa

SEQ ID NO: 633199 - RNA, 64 nt, Homo Sapiens
uuuauauuuuuaguagagacacaugccaccacgcccaacuaauuuaguagcuggcauuacaggc

SEQ ID NO: 633200 - RNA, 64 nt, Homo Sapiens
accagaauauaaaaagcaaauacaaaaauaaaauccaacuaaaggcuuucuacuuuauaucaua

SEQ ID NO: 633201 - RNA, 64 nt, Homo Sapiens
uacuugggagauaggccaagcgagaggucaugggccaacuaaguguuauccaguagaaaagaca

SEQ ID NO: 633202 - RNA, 64 nt, Homo Sapiens
gauaaacacaaaauccauuccagguagcucggcaccaacuaagaaaaaaagcacaaaguucuca

SEQ ID NO: 633203 - RNA, 64 nt, Homo Sapiens
gaguagcugggauuacaggcaugcgccaccacgcccaacuaauuuuguauuuuuaguagagacg

SEQ ID NO: 633204 - RNA, 64 nt, Homo Sapiens
aacggauggccucuacgcuguuccaucacagucuccaacuaaggcuuaugguauuucauuaaac

SEQ ID NO: 633205 - RNA, 64 nt, Homo Sapiens
ucagggguguuucaugggaaggucuauaaaucacccaacuaagaugaucaccaccaacaucaua

SEQ ID NO: 633206 - RNA, 64 nt, Homo Sapiens
gacuugauguauuuuuucauuuuguccaguguuaccaacuaaauugugcaguuuggggcuuuuc

SEQ ID NO: 633207 - RNA, 64 nt, Homo Sapiens
aaguuaauauucagauguuggucuuggucauuugccaacuaauuuuaaaguaaaaggcacugca

SEQ ID NO: 633208 - RNA, 64 nt, Homo Sapiens
uugguggaauccuuguggacgaggcccugauaaaccaacuaacucucauaugaaggaugaaaaa

SEQ ID NO: 633209 - RNA, 64 nt, Homo Sapiens
uuuguauuuuuaguagagacgcccgccaccacacccaacuaauucaguagcugggaccacaggu

SEQ ID NO: 633210 - RNA, 64 nt, Homo Sapiens
caaucuggaacaaugucccuccucuuagaaugucccaacuaaagaccaguuaaaauauuagggu

SEQ ID NO: 633211 - RNA, 64 nt, Homo Sapiens
gagaguguuucuccaagguuuucuaucuucaaaaccaacuaaguuaugaaaguagagagaucug

SEQ ID NO: 633212 - RNA, 64 nt, Homo Sapiens
ucuucuugcccuuaagggucuuuuaccucccucaccaacuaagauuuggucauguugcguauaa

SEQ ID NO: 633213 - RNA, 64 nt, Homo Sapiens
uuuggauaaaauuggguuuuaacauaccucgaguccaacuaaucucauuaaacaaauauucucc

SEQ ID NO: 633214 - RNA, 64 nt, Homo Sapiens
uguguauauauuucuaucucuugcuacaauaauuccaacuaagugaacuucucaauuaucauca

SEQ ID NO: 633215 - RNA, 64 nt, Homo Sapiens
cagcaggcucaaaggcauaagucauuccaaucagccaacuaaguuguccuuuucugguuucgug

SEQ ID NO: 633216 - RNA, 64 nt, Homo Sapiens
agucuuguuggagaagcccagagagaaugggacuccaacuaagggaaccugaaaucaacucaau

SEQ ID NO: 633217 - RNA, 64 nt, Homo Sapiens
ggacaucagucuccauuuuuauugaaaucuuuugccaacuaaguuccuuuuuuuuuuuugaucg

SEQ ID NO: 633218 - RNA, 64 nt, Homo Sapiens
auucauguucaaauuacuuauaaaauguuauuuaccaacuaaguugaaaccuaaauagaauucu

SEQ ID NO: 633219 - RNA, 64 nt, Homo Sapiens
gaacaguuagagcagagaugcugguuguuauucaccaacuaaggcuguuguuuuuaggauggag

SEQ ID NO: 633220 - RNA, 64 nt, Homo Sapiens
gauguaaaacuuucuuaaaguguacauguccuuaccaacuaaauuguuugacaauaaauugugc

SEQ ID NO: 633221 - RNA, 64 nt, Homo Sapiens
uuaccgaaccuaaaacccaccagccauuaagaucccaacuaauucugucucuuccugcuuuaga

SEQ ID NO: 633222 - RNA, 64 nt, Homo Sapiens
gaguguuaauagcagcaguccucccccuaccccgccccgagaccccaccccgagaccccacccc

SEQ ID NO: 633223 - RNA, 64 nt, Homo Sapiens
agcaguccucccccuaccccgccccgagaccccaccccgagaccccaccccggaccaguuacau

SEQ ID NO: 633224 - RNA, 64 nt, Homo Sapiens
gcaccucuucaaugacugucugcugcugucucggccccgagaggguagccgauuccugguauuu

SEQ ID NO: 633225 - RNA, 64 nt, Homo Sapiens
cuccccccagguacagugccuucgagccuacaagccccgagagaaugaugaauuggcacuggag

SEQ ID NO: 633226 - RNA, 56 nt, Homo Sapiens
aaugcugcuccaucaugugagccggcccccgagaccccggcccccaccccacacca

SEQ ID NO: 633227 - RNA, 64 nt, Homo Sapiens
gcuuggaccaggguccugggucuucccaaccauaccccgagaucaggccccaccugccagcucu

SEQ ID NO: 633228 - RNA, 58 nt, Homo Sapiens
ucguugguuuuuuggagucuacucacauugaagggacuugcuugaagcuguuuccuuu

SEQ ID NO: 633229 - RNA, 58 nt, Homo Sapiens
uuguuggcuuuuagaguguuacucauguugaagggacuugcuugaaacuguuuccuuu

SEQ ID NO: 633230 - RNA, 58 nt, Homo Sapiens
gcucaggcagcugagggcugaugcacauugaagggaggccugaugaguguuccccagg

SEQ ID NO: 633231 - RNA, 58 nt, Homo Sapiens
guagauggugcaaagcaagcgagugggcugaagggagaggccaguuggccaccagggg

SEQ ID NO: 633232 - RNA, 58 nt, Homo Sapiens
gauuucucauugcagaggguaaaaugguugaagggaggauuacauucuauaguuacca

SEQ ID NO: 633233 - RNA, 58 nt, Homo Sapiens
aaaaauucuggacucuuugaaggauuugugaagggaaaaugccuuguccugauguuga

SEQ ID NO: 633234 - RNA, 58 nt, Homo Sapiens
augaauugcuggaacagcuaggggcaguugaagggaacgacugcugagugagagggca

SEQ ID NO: 633235 - RNA, 58 nt, Homo Sapiens
aagucaacuggacugcugaguuuuaaaaugaagggacaguuggggguuuuuuuuguuu

SEQ ID NO: 633236 - RNA, 58 nt, Homo Sapiens
agaauauauuccuugccuguguuagacaugaagggaaaaagaggucacauauugugau

SEQ ID NO: 633237 - RNA, 58 nt, Homo Sapiens
gaguccaggauggaauuucacaggaaagugaagggauacugcaggccuguguuugcag

SEQ ID NO: 633238 - RNA, 58 nt, Homo Sapiens
ugauaauaagaaacauuguuacagauggugaagggagaaagugguauuuauuaauaua

SEQ ID NO: 633239 - RNA, 58 nt, Homo Sapiens
auaagaaggaccaacucuaggcucaauaugaagggauuuaguucuguaagcagcaaaa

SEQ ID NO: 633240 - RNA, 58 nt, Homo Sapiens
uguccucaccacaugcggagaacaaaugugaagggaguaggauauugggucagugucc

SEQ ID NO: 633241 - RNA, 58 nt, Homo Sapiens
cacaauaguaaccuggguaaaugcagcgugaagggauuuuagucacacguggucuuuc

SEQ ID NO: 633242 - RNA, 58 nt, Homo Sapiens
uuacaaucaaacaccaauuccugguuaaugaagggagagugugggcuuagcagaguua

SEQ ID NO: 633243 - RNA, 58 nt, Homo Sapiens
guacuacauguaucuauccacacacugcugaagggaacuugacccuacgcauuccaaa

SEQ ID NO: 633244 - RNA, 58 nt, Homo Sapiens
ccccgagagcuuccuccuucucacagccugaagggaggagaacagccccucuccccag

SEQ ID NO: 633245 - RNA, 58 nt, Homo Sapiens
guugcucccaguccagaggcuuugcgggugaagggaguuggggugcuuuuccugaauc

SEQ ID NO: 633246 - RNA, 58 nt, Homo Sapiens
guacguaaaacaaaauagggauuuuuagugaagggaauauguagacuggcuugcuuug

SEQ ID NO: 633247 - RNA, 58 nt, Homo Sapiens
caggacaggcucugugacuucauucagaugaagggacuaaacucagucuuuucacccu

SEQ ID NO: 633248 - RNA, 64 nt, Homo Sapiens
ggaaaugaagaagcaucuuccuuaggucugcccugcuugcaaauccacuagcaccgaccccacc

SEQ ID NO: 633249 - RNA, 64 nt, Homo Sapiens
ugccucucgagacauacaaauccuugcuuugucagcuugcaaaggaggagaguuuaggauuagg

SEQ ID NO: 633250 - RNA, 64 nt, Homo Sapiens
agcaucagcaauugcuacucaauugucaaacacagcuugcaauauacauagaaacgucugugcu

SEQ ID NO: 633251 - RNA, 64 nt, Homo Sapiens
guuugauuuaauagguaucuuaaucaagaauuaagcuugcaacauuggcuuugcucagaugcag

SEQ ID NO: 633252 - RNA, 64 nt, Homo Sapiens
ccacuuuuccacuucucacucuuauggucucaaagcuugcaaagauagcuucugauauuguugu

SEQ ID NO: 633253 - RNA, 64 nt, Homo Sapiens
uccaacuuccacuucucacucuuauggucucaaagcuugcaaagauagcuucugauauuguugu

SEQ ID NO: 633254 - RNA, 64 nt, Homo Sapiens
ccucacucaacuucagccaggaggacuggguggugcuugcaauguuggaaugaccggcucaaag

SEQ ID NO: 633255 - RNA, 64 nt, Homo Sapiens
aggccucaguccagugggaggauaagcagguucugcuugcaaagcugggaacacaaaggcagcu

SEQ ID NO: 633256 - RNA, 64 nt, Homo Sapiens
uuguuggaagagcuggagaaccuggccccugguggcuugcaaaaaauuagacaaggauuuacua

SEQ ID NO: 633257 - RNA, 64 nt, Homo Sapiens
cauuuuguucccuuuugccuuaacagcccacugugcuugcaaaggccccuccugagugugucac

SEQ ID NO: 633258 - RNA, 64 nt, Homo Sapiens
aauccuucuaucaucuaacaugagcucagauccagcuugcaacuguuuccuucaugcccaagcc

SEQ ID NO: 633259 - RNA, 64 nt, Homo Sapiens
augcauuuccaaacuugaaaacuuuuguauugcugcuugcaaauauuaugcauucuucaugaau

SEQ ID NO: 633260 - RNA, 64 nt, Homo Sapiens
cuguauuuaauugcauuuuaauaauggccagaaggcuugcaaauguuaauuuuuaaauguuuac

SEQ ID NO: 633261 - RNA, 64 nt, Homo Sapiens
acaagcuuggaggugagacagguggguggugugggcuugcaaauugccgaaagaggguauuaug

SEQ ID NO: 633262 - RNA, 64 nt, Homo Sapiens
gagaaacacaggcuugucgugccguuuaagcuuugcuugcaagaguggaugccccgcaaucguu

SEQ ID NO: 633263 - RNA, 64 nt, Homo Sapiens
cauuccauauuauuauaguuaaugucuuaauccagcuugcaagugaauggaaaaaaaaauaagc

SEQ ID NO: 633264 - RNA, 64 nt, Homo Sapiens
cagugaggagacugcccagugccuuuggggcugugcuugcaauaaagaauuuccuggaaaggca

SEQ ID NO: 633265 - RNA, 50 nt, Homo Sapiens
cauuuauaagugguaaaugagcuugcaauguguuaaagaagauuaaccau

SEQ ID NO: 633266 - RNA, 64 nt, Homo Sapiens
ucaagaguaaagauuauacugcucuguacaggaagcuugcaaauuuucuguacaaugugcugug

SEQ ID NO: 633267 - RNA, 64 nt, Homo Sapiens
auauauacaguauguauauuuuuuaaaaagauuugcuugcaaugaccuuauaagugacauuuaa

SEQ ID NO: 633268 - RNA, 64 nt, Homo Sapiens
uccaaucagucaaaagaggucaaugaauuaaaaggcuugcaacuuuuucaaaaaccuguuagaa

SEQ ID NO: 633269 - RNA, 64 nt, Homo Sapiens
cacguuuggaaaauaaucugcagaaacgagcugugcuugcaaagacuucauaguucccaagaau

SEQ ID NO: 633270 - RNA, 64 nt, Homo Sapiens
uagcuacauggugcacccggaaagacuugucaaagcuugcaacaaaaaacaggccagaaugggu

SEQ ID NO: 633271 - RNA, 64 nt, Homo Sapiens
aaauucucugacacauaguucauaacuaaauaaagcuugcaacaauugauagaguguuaucagu

SEQ ID NO: 633272 - RNA, 64 nt, Homo Sapiens
cucaugcuccuggaauagggaauagggaucucaugcuugcaaacuacacaaugcugcaggugcu

SEQ ID NO: 633273 - RNA, 64 nt, Homo Sapiens
gacuucugagcuauaacuugugggaguaauaccagcuugcaaugggucagcacuuuaccuuuuu

SEQ ID NO: 633274 - RNA, 64 nt, Homo Sapiens
aauugugacuuuauucuacuguaagcaauaauuugcuugcaauuuuucauguaauuuuuaaauu

SEQ ID NO: 633275 - RNA, 64 nt, Homo Sapiens
gccaaaacauaaaaaaaaaaaaauccucaguauagcuugcaauuaagaccuagaucacaguauu

SEQ ID NO: 633276 - RNA, 64 nt, Homo Sapiens
uuaaggcuaauacaaugacagacugagcaaaauugcuugcaaaaguggcacagaguuagcacuc

SEQ ID NO: 633277 - RNA, 64 nt, Homo Sapiens
uguacucuaguccugacuuggggugcagagggcugcuugcaauccuguuuguaaggcugugccu

SEQ ID NO: 633278 - RNA, 64 nt, Homo Sapiens
ggacugcagacucuaccaauucuagauuucaggugcuugcaacuagguuauaggucuuucucuc

SEQ ID NO: 633279 - RNA, 64 nt, Homo Sapiens
uuuaagacucaaagucacugaauuuuuauccuuugcuugcaacauaucugacaaaauucccuug

SEQ ID NO: 633280 - RNA, 64 nt, Homo Sapiens
uagccucacccaagaagacuuugaacagcccagagcuugcaaccuggagagauucuggcaaccu

SEQ ID NO: 633281 - RNA, 64 nt, Homo Sapiens
acacaaucuaaaaguguguuacagcugagagugggcuugcaagauuuauuggguguuaacuuug

SEQ ID NO: 633282 - RNA, 64 nt, Homo Sapiens
gaagagaaacugcaaacguggaaagugugacaaagcuugcaaccacacucaaucuauucuaaau

SEQ ID NO: 633283 - RNA, 64 nt, Homo Sapiens
uuacaagcuuuaauggacucguaagccagcaugggcuugcaaaaauuucuuguuuaccagagca

SEQ ID NO: 633284 - RNA, 64 nt, Homo Sapiens
uuucacuacacuucuauucucaguaaccaagauugcuugcaacuuuuuuugccuuggugacuuu

SEQ ID NO: 633285 - RNA, 64 nt, Homo Sapiens
uuugauuugaugucaucuguuugcccuucaucuugcuugcaagugugcaugguucaaucccuca

SEQ ID NO: 633286 - RNA, 64 nt, Homo Sapiens
guuaagggcauuguaaauacuguaguuuuauguagcuugcaacuucuacugaaaugaguuuaau

SEQ ID NO: 633287 - RNA, 64 nt, Homo Sapiens
cuguuaugcuccugauagccaauagcagauagaagcuugcaaucaagaggguaggacauguguu

SEQ ID NO: 633288 - RNA, 64 nt, Homo Sapiens
ucaaaauaaauuggcagauucuauuaaauuguaagcuugcaaaccugaagcuaccugauuuauu

SEQ ID NO: 633289 - RNA, 64 nt, Homo Sapiens
uguaauaaauacacuuguguauguagaacagagugcuugcaaaauugaugguggcguuuuugaa

SEQ ID NO: 633290 - RNA, 64 nt, Homo Sapiens
ugccaugagguaaauguaauguuucaggcauucugcuugcaaaaaaaucuaucaugugcuuuuc

SEQ ID NO: 633291 - RNA, 64 nt, Homo Sapiens
cacuuuacuuucagguuaaaaauguuucuaacacgcuugcaacuucccuuauggcauuaaucuu

SEQ ID NO: 633292 - RNA, 64 nt, Homo Sapiens
aaaaaauucucaagugcaauguguuuuaaaauaagcuugcaaaugacagcagagacauuuacuu

SEQ ID NO: 633293 - RNA, 64 nt, Homo Sapiens
ggaccagaggaagccccuuacuaugaucucaggagcuugcaagaagcaggaaggggaauggaau

SEQ ID NO: 633294 - RNA, 64 nt, Homo Sapiens
agugguaacacacuuaguuaauaaaauaagccaggcuugcaacuaaguaucuaacuuuacaggc

SEQ ID NO: 633295 - RNA, 64 nt, Homo Sapiens
gucccaagggcccaauggccugacuuuuagaauugcuugcaauugguguuuucucuugaauuug

SEQ ID NO: 633296 - RNA, 64 nt, Homo Sapiens
uuggccaccugucugcaagagaggcggccccugugcuugcaacgcuuacguguugaucccagug

SEQ ID NO: 633297 - RNA, 64 nt, Homo Sapiens
gggauuuuaaaauacacuaagaggucaguguuaggcuugcaauauugccuuaagaguuacuagc

SEQ ID NO: 633298 - RNA, 64 nt, Homo Sapiens
uacugaacacaauaaugcugaccagugcauuucagcuugcaaguaauguccaaguuuguguaaa

SEQ ID NO: 633299 - RNA, 64 nt, Homo Sapiens
uaacgcuuuuauuuuuauuugcagcccucucuuggcuugcaagaguccacccagucacauccgu

SEQ ID NO: 633300 - RNA, 64 nt, Homo Sapiens
ugccaucccauuucaccuugcugugaaggcaccagcuugcaauauuguccaugguucugacuuu

SEQ ID NO: 633301 - RNA, 64 nt, Homo Sapiens
gacuccagaugccuauuauuaguuaggcuucugagcuugcaaucauauugaauguaugaagagc

SEQ ID NO: 633302 - RNA, 64 nt, Homo Sapiens
aacucaaggucaacggcuuauuagugaaacuggggcuugcaagaggaggugguucugaaagugg

SEQ ID NO: 633303 - RNA, 64 nt, Homo Sapiens
gggccacguuuuaccuucagugagguuuuguuuggcuugcaaugaguacauggguuuuagguug

SEQ ID NO: 633304 - RNA, 64 nt, Homo Sapiens
ucccacucccagauugcacaugugcugaccaaaggcuugcaauacauaugaagaaaucauugaa

SEQ ID NO: 633305 - RNA, 64 nt, Homo Sapiens
caauggggaacguguucucguuuuaaaaagagaugcuugcaaagcccggggacaguggcugugc

SEQ ID NO: 633306 - RNA, 64 nt, Homo Sapiens
uacuuuguuaacaaaagcuguuugcccuugaaaugcuugcaaaaagucuguagacauuuuugcc

SEQ ID NO: 633307 - RNA, 64 nt, Homo Sapiens
cagagagagcagcuucccuuugcaaaacugguuggcuugcaaccugauaauuuucucuucuugc

SEQ ID NO: 633308 - RNA, 64 nt, Homo Sapiens
cuccuauucagcaguuuuuguggaaagcaguaaugcuugcaaaacgugugugucauucagcauu

SEQ ID NO: 633309 - RNA, 64 nt, Homo Sapiens
uagaguagaacacagccccggaaugcuuccaguugcuugcaagggaccaugccggcccgggugg

SEQ ID NO: 633310 - RNA, 64 nt, Homo Sapiens
guccccauauuagcugcauugccaucuucugggagcuugcaagaaauguacauucucaggaucc

SEQ ID NO: 633311 - RNA, 64 nt, Homo Sapiens
aacuguauccaaauuuucagaaaagacagcuucagcuugcaaauucuauccucuaaacuuaucu

SEQ ID NO: 633312 - RNA, 64 nt, Homo Sapiens
agagugacuagaaaguuucuaggagcaccuccaggcuugcaaagaaagugaggccucuugguau

SEQ ID NO: 633313 - RNA, 64 nt, Homo Sapiens
cagugcaaaguguaauugggucauggucaaaaacgcuugcaacaucuaauuggcguucaagaua

SEQ ID NO: 633314 - RNA, 64 nt, Homo Sapiens
aaagaggcuccagcauggggugggucagagaugugcuugcaagguccagggacugcguggucug

SEQ ID NO: 633315 - RNA, 64 nt, Homo Sapiens
acaguaguuauuugacuguuaauaggugcuacuugcuugcaaggauuuggagauguaaacauga

SEQ ID NO: 633316 - RNA, 64 nt, Homo Sapiens
uagcucacaccugaccaaucccuuuaaacacggggcuugcaacuugggaaggugaccacaucca

SEQ ID NO: 633317 - RNA, 59 nt, Homo Sapiens
cugggguccucuuguucccuuuccagccugcuugcaacccacggaucacuuuugucuga

SEQ ID NO: 633318 - RNA, 64 nt, Homo Sapiens
uguuuuuaaaugauuguuucuucuucaugcuuuugcuugcaauguagucaauaaaaccucaugu

SEQ ID NO: 633319 - RNA, 64 nt, Homo Sapiens
uaugaaucgacaauuuggauuguugaacuugaaggcuugcaaaauaugguacaugcuggauagu

SEQ ID NO: 633320 - RNA, 64 nt, Homo Sapiens
gcccauguagaaagagagagaccucaucuuucaugcuugcaagugaaauauguuacagaacaug

SEQ ID NO: 633321 - RNA, 64 nt, Homo Sapiens
agagucagggucaccagugaaacagcagaaagaugcuugcaagcagaggaugacgacaacgugc

SEQ ID NO: 633322 - RNA, 64 nt, Homo Sapiens
ucuguauuuauuguucucugcuguuacauauacugcuugcaauuuguauuuaaagaaaauauua

SEQ ID NO: 633323 - RNA, 64 nt, Homo Sapiens
aagauaucaaucugaaaugccagucaagccuacugcuugcaauugauuuuuaguuugguuuuua

SEQ ID NO: 633324 - RNA, 64 nt, Homo Sapiens
aaggagaggauuauuguugauuccauuuacucaugcuugcaaaacuagagaccccuaaggcaga

SEQ ID NO: 633325 - RNA, 64 nt, Homo Sapiens
cuuuucuguuugaauuaagaugggcuaagauggggcuugcaacauuaaacaugagcugagcauc

SEQ ID NO: 633326 - RNA, 64 nt, Homo Sapiens
cugugccuuuuccacuaacuaccggaccuggugggcuugcaagcggagcagaucuggggucaga

SEQ ID NO: 633327 - RNA, 64 nt, Homo Sapiens
agccaagauugcgccacugcacccgggagguggagcuugcaauggaggcaggagaauggcguga

SEQ ID NO: 633328 - RNA, 64 nt, Homo Sapiens
guggauggcagauuuaaagggaagaaccacaaaggcuugcaaagauaggagaggcuccaucucu

SEQ ID NO: 633329 - RNA, 64 nt, Homo Sapiens
aggcguccuaaagaccucuaggcuggaagcuugggcuugcaaguggauccgggaccgagggugg

SEQ ID NO: 633330 - RNA, 64 nt, Homo Sapiens
uuacauuauugauaguuaagcucuuaauuguguagcuugcaaaagacagcacuuuuuaguuaca

SEQ ID NO: 633331 - RNA, 64 nt, Homo Sapiens
augcugccccagugagauagugaguggucaccaggcuugcaaaugaacuucagacggaccucag

SEQ ID NO: 633332 - RNA, 64 nt, Homo Sapiens
gugccaggcugucuucugucucuaaucuggacuugcuugcaaaggccuugggguuggccguucc

SEQ ID NO: 633333 - RNA, 64 nt, Homo Sapiens
uaaucugaacugaccuugaagacaaaauucauuugcuugcaaucaagguuuccauaagcuuggu

SEQ ID NO: 633334 - RNA, 64 nt, Homo Sapiens
acuacaaccaauggaaugugggcagacucuuuaugcuugcaaaaguucaacuuauuaacaauua

SEQ ID NO: 633335 - RNA, 64 nt, Homo Sapiens
uagcucacugaagagcuguuuggauuacuucugagcuugcaacaagucugacuugguucguuag

SEQ ID NO: 633336 - RNA, 64 nt, Homo Sapiens
gaagcugcugggcuuggcucaggauguguucugggcuugcaagccccccgcccaaucauguguu

SEQ ID NO: 633337 - RNA, 64 nt, Homo Sapiens
cuucacaugaagagccucugcagcccuucccacagcuugcaaggaccaagggaggccagcaggu

SEQ ID NO: 633338 - RNA, 64 nt, Homo Sapiens
cuggaaaauauuuugacuagaaaagcccccaggggcuugcaauuguggcacucaggucacccug

SEQ ID NO: 633339 - RNA, 64 nt, Homo Sapiens
aguaaguuucuucaaagaaguggaagaugccagggcuugcaagaccacuacuaggacagccaau

SEQ ID NO: 633340 - RNA, 64 nt, Homo Sapiens
cuuagaggaaauaaaaagggucucuggugcugcugcuugcaaguggccaggagggcagguuccc

SEQ ID NO: 633341 - RNA, 64 nt, Homo Sapiens
uauuucucauuuaaauuuugucaaaucuuucuuugcuugcaagcauuucuuguuacccaaaucu

SEQ ID NO: 633342 - RNA, 64 nt, Homo Sapiens
augcucuaacuucaauauaccaauaaaauaaucagcuugcaauuucugauuauagcaucuccuu

SEQ ID NO: 633343 - RNA, 64 nt, Homo Sapiens
guuuugaguucccucauucuuauuaccagaaagagcuugcaaauaguuuuacuuucuuggcacu

SEQ ID NO: 633344 - RNA, 64 nt, Homo Sapiens
cuucuuucguuuccucgucaaacaucugauugacgcuugcaaacugucugaauuugccaugcaa

SEQ ID NO: 633345 - RNA, 64 nt, Homo Sapiens
ugcaggccugagacugcuaucccuagaaaggucugcuugcaaaguuggcccuuggcuggcaucu

SEQ ID NO: 633346 - RNA, 64 nt, Homo Sapiens
aaguuuaugugaagacagaauuuggauuuggaaggcuugcaaugugguugacuaccuuuugaua

SEQ ID NO: 633347 - RNA, 64 nt, Homo Sapiens
ucugcugguggugucucuuucaauaaaacaaucagcuugcaauuaugcucuaacuucaguauac

SEQ ID NO: 633348 - RNA, 64 nt, Homo Sapiens
ugagcucuugaacaaauaaaaugcuugguuuaaugcuugcaaucggcucacagaaucaaagccu

SEQ ID NO: 633349 - RNA, 64 nt, Homo Sapiens
ugaauccuuuugccaaggacaauuccugaucgaggcuugcaaagaggacacaucgaaguuguua

SEQ ID NO: 633350 - RNA, 64 nt, Homo Sapiens
gcuggaaaaaaacgcguaucaccuuucaggccccgcuugcaagacagagcagcccggacccgaa

SEQ ID NO: 633351 - RNA, 64 nt, Homo Sapiens
ucaagcaauaagaggggggugccagcgagggugugcuugcaaauccucugagcgaucaggcgag

SEQ ID NO: 633352 - RNA, 64 nt, Homo Sapiens
auacaaaaaaaauuagcuggguauguuggugcaggcuugcaaucccagcuacuugggacgcuga

SEQ ID NO: 633353 - RNA, 64 nt, Homo Sapiens
agcacuuaacauuuuaggaauucuuuuuaaagcugcuugcaaaguguuggugauuuuacugaaa

SEQ ID NO: 633354 - RNA, 64 nt, Homo Sapiens
guauuaaagucaaaagcugacguuugauauuagugcuugcaauuuuguuucuuuauauaguuug

SEQ ID NO: 633355 - RNA, 64 nt, Homo Sapiens
uuaaaaguagcucacauuuaugauuaaaaauaaagcuugcaauuaacuuaaaauugaauugguu

SEQ ID NO: 633356 - RNA, 64 nt, Homo Sapiens
caaaacagaagaaacaaacaaacaaacaaaaaaagcuugcaaaauauuuuaugguuuccaagcu

SEQ ID NO: 633357 - RNA, 64 nt, Homo Sapiens
uuaugagaguuuaaaaaauaauauuuuacugcuagcuugcaaaguuaguaaaauauugaaggca

SEQ ID NO: 633358 - RNA, 64 nt, Homo Sapiens
acauuagucgugaaaucccuuuguaaauacacaugcuugcaaaaaaggaaauaaaaacacagag

SEQ ID NO: 633359 - RNA, 64 nt, Homo Sapiens
cagucucuggccucugcccaacgagccuggcugggcuugcaacgcagcugauucugagacaggc

SEQ ID NO: 633360 - RNA, 64 nt, Homo Sapiens
auauauuuuuaugagcuggugucuucaaugauaugcuugcaaaaugaauugacaaucugaaaga

SEQ ID NO: 633361 - RNA, 64 nt, Homo Sapiens
auguccuuaagguguuuaaccugccucugaccuggcuugcaaugcauaggugaggagaagcaga

SEQ ID NO: 633362 - RNA, 64 nt, Homo Sapiens
ggguagugagugggauccuauccaguugaggaaugcuugcaaugcucauugaagggauuugcuu

SEQ ID NO: 633363 - RNA, 64 nt, Homo Sapiens
cuacuucuaccacuuguguaucucuagccaaugugcuugcaaguguacagaucuguguagagga

SEQ ID NO: 633364 - RNA, 64 nt, Homo Sapiens
aaacugauccaucagucauguagcuagcuguagagcuugcaacuuaauagcagcagcugcccaa

SEQ ID NO: 633365 - RNA, 64 nt, Homo Sapiens
uuuccuccccagcagguggggaggggguuugggggcuugcaaguauguuuuagcauguguuugg

SEQ ID NO: 633366 - RNA, 64 nt, Homo Sapiens
cugcuuacgugcuaagcagaucaguuuauuuaaugcuugcaacgacucucugagguagaaaaua

SEQ ID NO: 633367 - RNA, 64 nt, Homo Sapiens
ugugugcuggucacaggaaguguugaauggauuggcuugcaaaggggguagguggggagagaua

SEQ ID NO: 633368 - RNA, 64 nt, Homo Sapiens
ggugugcgucagaagcacccgucuuugaacccuugcuugcaauaccugccauuuuggguuuugg

SEQ ID NO: 633369 - RNA, 64 nt, Homo Sapiens
ucucaucacacagccacauaguaccuauaacugggcuugcaaccuaacaaucuucugaacucca

SEQ ID NO: 633370 - RNA, 64 nt, Homo Sapiens
ugccgaagcagugacuugcagauuauauugggcagcuugcaaucgcuggcauagaaggcucuua

SEQ ID NO: 633371 - RNA, 64 nt, Homo Sapiens
ggccuucagcuuuaaauguacaggcuuaaagugcgcuugcaaacguuugcucuccuuuuuuucu

SEQ ID NO: 633372 - RNA, 64 nt, Homo Sapiens
ucaucugauuuugcuagaaacuauguuuuuccuugcuugcaaucuuucuuccuaccgggauuac

SEQ ID NO: 633373 - RNA, 64 nt, Homo Sapiens
cacgucugcgccgccgccggaguccacucccagugcuugcaagauuccaaguucucaccucuua

SEQ ID NO: 633374 - RNA, 64 nt, Homo Sapiens
cgucccucgccaacggccgagcuugugauucugagcuugcaaugccgccaagcgccccccgcca

SEQ ID NO: 633375 - RNA, 64 nt, Homo Sapiens
auguuaagucauaguaaacccuguagaugauguugcuugcaagcguaauauccaacaguuuaag

SEQ ID NO: 633376 - RNA, 64 nt, Homo Sapiens
aauaaaaauaaacuggccaggugcgguggcucacgcuugcaaucccagugcuuugggagacuga

SEQ ID NO: 633377 - RNA, 64 nt, Homo Sapiens
uauuuuugcauauuaacccuuuaucagguauacagcuugcaacuauuuucucccauuucugagu

SEQ ID NO: 633378 - RNA, 64 nt, Homo Sapiens
uuguggaaggauuuagcuuaauuugggagucuuagcuugcaagcuaaaaaauuccaaagccuuu

SEQ ID NO: 633379 - RNA, 64 nt, Homo Sapiens
aaagugaaugggccuguggccacaggaagcgggggcuugcaaggggacaaaggccucucaucac

SEQ ID NO: 633380 - RNA, 64 nt, Homo Sapiens
guugaucucccuggauccagaacucuuaauaucagcuugcaacuuuagaacagauccaauagac

SEQ ID NO: 633381 - RNA, 64 nt, Homo Sapiens
ccauuuuguauauaguugcaacuuaaacuuuuuggcuugcaaaauauuuuuguaauaaagauuu

SEQ ID NO: 633382 - RNA, 64 nt, Homo Sapiens
ugucccagaguuaguaagccucggcuugucaccugcuugcaaaggguauagacaucauucuggg

SEQ ID NO: 633383 - RNA, 64 nt, Homo Sapiens
agugacuuauauuccaaagagauucuauuuuuuagcuugcaaaaggacuagaucaccuuaguuu

SEQ ID NO: 633384 - RNA, 64 nt, Homo Sapiens
ccuucucaagggucucacaagagcuuagggaugugcuugcaaacccuucagccaugcuggcccc

SEQ ID NO: 633385 - RNA, 64 nt, Homo Sapiens
aaaacuuuucuuggcaucucuuucugcucacugugcuugcaauauuugugugagaagacaucuc

SEQ ID NO: 633386 - RNA, 64 nt, Homo Sapiens
aaaaaaagaaaaaagaaaaacacaagcuaagagagcuugcaaaaugugaugucuggucugaaug

SEQ ID NO: 633387 - RNA, 64 nt, Homo Sapiens
cuuccccguuugcuuuguuuguugguuuuaaugagcuugcaacccucuggaacugggugcucau

SEQ ID NO: 633388 - RNA, 64 nt, Homo Sapiens
aaugaagacaaaauacucagcaugcacugaugcugcuugcaaaagcuuucaacuuuuguugcau

SEQ ID NO: 633389 - RNA, 64 nt, Homo Sapiens
uuaugucuugcuuuggacauauugaacaugugaagcuugcaacuugcauauauaucuuacccua

SEQ ID NO: 633390 - RNA, 64 nt, Homo Sapiens
uaggcagcuagacccugcguucuaaaaaaggauugcuugcaauguugguuuggcuauucauuug

SEQ ID NO: 633391 - RNA, 64 nt, Homo Sapiens
uuggcuguguuuucaaugcacaaggggaaauuuggcuugcaauucaucacuuugaaaagguuag

SEQ ID NO: 633392 - RNA, 64 nt, Homo Sapiens
gugcugggauuacaggcgugagccaccgcacccggcuugcaauuuagaaagggcacuuggcaac

SEQ ID NO: 633393 - RNA, 64 nt, Homo Sapiens
gguauauuauuuuaaucauuccaugccuuaauaugcuugcaauacaagaauaucuucagauggg

SEQ ID NO: 633394 - RNA, 64 nt, Homo Sapiens
uaacacccucccuucaggccucccaaaggcauaggcuugcaaagagcagaaggugugaaaucac

SEQ ID NO: 633395 - RNA, 64 nt, Homo Sapiens
aaugugcaaacugcaucuaugugguuagucaauggcuugcaauaucuucacaucugcccauucu

SEQ ID NO: 633396 - RNA, 64 nt, Homo Sapiens
ugggacugcaauauuacauuaaaaucauuuuucagcuugcaaaacagauuuuaugcguguugac

SEQ ID NO: 633397 - RNA, 64 nt, Homo Sapiens
aaucuuaagacuaacaaauccuugaaaucacacagcuugcaaauacguacuaaacugcacaagg

SEQ ID NO: 633398 - RNA, 64 nt, Homo Sapiens
guugccauguuaggaaggucagcugcacagccaagaguguaagaguguaaagaaaugccuuuuu

SEQ ID NO: 633399 - RNA, 64 nt, Homo Sapiens
guuaggaaggucagcugcacagccaagaguguaagaguguaaagaaaugccuuuuuuuuuuuuu

SEQ ID NO: 633400 - RNA, 64 nt, Homo Sapiens
acaauuuagaauggauauuuugacgaaucggcaugaguguaacagugauaaccugaucuguuug

SEQ ID NO: 633401 - RNA, 64 nt, Homo Sapiens
uuaaagugccacauuuggcaguacaaaugagucugaguguaauagcccagagauuuauauauag

SEQ ID NO: 633402 - RNA, 64 nt, Homo Sapiens
uuucucucagaccccuuuuguuguagugcuuguagaguguaaagugaaacaguuuugcauuuuc

SEQ ID NO: 633403 - RNA, 64 nt, Homo Sapiens
agugaccuuugucaguguccuuuuuaagacaagugaguguaagggucaaugugcuugcuuggag

SEQ ID NO: 633404 - RNA, 64 nt, Homo Sapiens
acaugaaaaaucuuacacuggagagaaacccuaugaguguaagcaaugugggaaagccuuuguu

SEQ ID NO: 633405 - RNA, 64 nt, Homo Sapiens
ucaugaaaggacucacacuggagagaaccccuaugaguguaagcaauuugggaaagccuucaga

SEQ ID NO: 633406 - RNA, 64 nt, Homo Sapiens
ucaugaaaggacucacacuggagagaaacccuaugaguguaagcaaugugggaaagccuucaga

SEQ ID NO: 633407 - RNA, 64 nt, Homo Sapiens
aggcaugguaggacucacuggagagaaacccuaugaguguaaggaaugugggaaagccuucaga

SEQ ID NO: 633408 - RNA, 64 nt, Homo Sapiens
ccaugaaaggacucacacuggagagaaacccuaugaguguaagcaaugugggaaagccuucaga

SEQ ID NO: 633409 - RNA, 64 nt, Homo Sapiens
gcaugcugggacucacccugaagagaagcccuacgaguguaagcaaugugggaaagccuucaga

SEQ ID NO: 633410 - RNA, 64 nt, Homo Sapiens
ccaugguagaacucacacuggagagaaacccuaugaguguaaggaaugugggaaagccuucaga

SEQ ID NO: 633411 - RNA, 64 nt, Homo Sapiens
accugaaaaaucuuacacuggagagaaacccuaugaguguaagcaaugugggaaagccuuuauu

SEQ ID NO: 633412 - RNA, 64 nt, Homo Sapiens
acaugaaaggacucacacuggagagaaacccuaugaguguaagcaauguggaaaaaccuucaga

SEQ ID NO: 633413 - RNA, 64 nt, Homo Sapiens
cagacccaccaggaggaaagaggcccagcucucagcugacgauggaggcagaaccggagucggg

SEQ ID NO: 633414 - RNA, 64 nt, Homo Sapiens
cacagucauccacaccauugcucuggggccgucugcugacgaagaacuggagacccugucaaau

SEQ ID NO: 633415 - RNA, 64 nt, Homo Sapiens
gugguuuuuaaaggagcgcccacgaaguguaguggcugacgauuucaaccucacacagcaguuu

SEQ ID NO: 633416 - RNA, 64 nt, Homo Sapiens
caagacaaagccucccaccaaacagaaccuccaggcugacgaggcugcugcuuugcucuuucaa

SEQ ID NO: 633417 - RNA, 64 nt, Homo Sapiens
agcccagauuugggccuaauggccaggccccagugcugacgaggccuguccuggagggggcaga

SEQ ID NO: 633418 - RNA, 64 nt, Homo Sapiens
aguccucucucccuccagucugauuuuauaaagugcugacgagauugggaauaaagaggcauaa

SEQ ID NO: 633419 - RNA, 64 nt, Homo Sapiens
uguguguccgugaagugagucccgucugccaggagcugacgaaccacgaaugcuucugccugug

SEQ ID NO: 633420 - RNA, 64 nt, Homo Sapiens
gcagcagacuaugggcagcccagugcugccaccugcugacgacccuugagaagcugccauaucu

SEQ ID NO: 633421 - RNA, 64 nt, Homo Sapiens
aggacccuguggcagcuuugaugugcgcaagacagcugacgacugagcccugcuucugcugggg

SEQ ID NO: 633422 - RNA, 64 nt, Homo Sapiens
aaucaggugagagggaggcccucaaggaccucacgcugacgagcauuucaggcacuuguggccc

SEQ ID NO: 633423 - RNA, 64 nt, Homo Sapiens
uugagggcugaggcugguuaucgguuuugguggagcugacgauuaucagauuuuugccuagcac

SEQ ID NO: 633424 - RNA, 64 nt, Homo Sapiens
gggggcugauggcugccccucauccccauucggggcugacgaugcacucagaaagaggucuccc

SEQ ID NO: 633425 - RNA, 64 nt, Homo Sapiens
agcaauauccaaagucuugucuccguucaagaaugcugacgaaaaccuuggcaacuccagggcg

SEQ ID NO: 633426 - RNA, 64 nt, Homo Sapiens
gaagcacggguccacagaguuccagagaaugaaugcugacgacuaagcaccagccuccacuccc

SEQ ID NO: 633427 - RNA, 64 nt, Homo Sapiens
cccaacaagccagccuuugguaagcucggugccugcugacgaacucugagaucccaauggugug

SEQ ID NO: 633428 - RNA, 64 nt, Homo Sapiens
uuccauggcccucauuaaugcaugugacucugaagcugacgaacaaccgcccaggaucagauug

SEQ ID NO: 633429 - RNA, 64 nt, Homo Sapiens
ggugccaggacaaugaaauacuccagcaccuguggcugacgaauuuguuucuacagaaauaaca

SEQ ID NO: 633430 - RNA, 64 nt, Homo Sapiens
uuugggucugugagguucuguaaacugugcuagugcugacgauguucuguacaacuuaacucac

SEQ ID NO: 633431 - RNA, 64 nt, Homo Sapiens
agcaugugcucugaggccaggccccagcucugcugcugacgagcugugugguccugggcagagu

SEQ ID NO: 633432 - RNA, 64 nt, Homo Sapiens
gacagcccacccccagccugaagcccguggcccugcugacgagacaggacaagcacuuucucag

SEQ ID NO: 633433 - RNA, 64 nt, Homo Sapiens
caccaucaacuuguaggcggccaaggccgccugugcugacgaggcccggagcugcuccugcugc

SEQ ID NO: 633434 - RNA, 64 nt, Homo Sapiens
gacuuuccuccgcagaaagcaaaguuuggggagggcugacgauuuuguagaacacaacagugac

SEQ ID NO: 633435 - RNA, 64 nt, Homo Sapiens
agauaaauaauggagcaugcagugagcacaucuagcugacgauaaucacaccuuuucccccguc

SEQ ID NO: 633436 - RNA, 64 nt, Homo Sapiens
uaaaggaaauaauugccaaauaccuaggcccauugcugacgauuaguucuaaaaucuuauuccu

SEQ ID NO: 633437 - RNA, 61 nt, Homo Sapiens
auggcuaaagccucucuugauuuaggcuugggcugacgacaaaguuguacauccugaaccc

SEQ ID NO: 633438 - RNA, 64 nt, Homo Sapiens
aagcgcugucccugugaugagccccaucgggcucgcugacgaggggccuuucccuuccgcgccu

SEQ ID NO: 633439 - RNA, 64 nt, Homo Sapiens
aggguggugaguagagcccuaggagcuugggugugcugacgagcucuaggagccccaguagccc

SEQ ID NO: 633440 - RNA, 64 nt, Homo Sapiens
ggauccuggaaccaaaccccugcagauacuaagggcugacgaucuagguaagacuggauuuaac

SEQ ID NO: 633441 - RNA, 63 nt, Homo Sapiens
ccauggagguguccuguugaagcccuugaucccgcugacgacgcccacgucgaggccccaccg

SEQ ID NO: 633442 - RNA, 64 nt, Homo Sapiens
uccaagcugcucugguugaauggagguucagggugcugacgaaauuacggagcacagucauaag

SEQ ID NO: 633443 - RNA, 64 nt, Homo Sapiens
ggcagggaggcaccauucaggaaccuggaccaaagcugacgaggcugggccaagccagggaugg

SEQ ID NO: 633444 - RNA, 64 nt, Homo Sapiens
ggccgucucugauucucccuuuaugaagcugcaggcugacgagagauggucccuucccauuggc

SEQ ID NO: 633445 - RNA, 64 nt, Homo Sapiens
uccuuuauuaugugguuagcauagguuauacuuugcugacgauucacauuuuauuaguuugguu

SEQ ID NO: 633446 - RNA, 64 nt, Homo Sapiens
agggccuggaggggccuggggcccgggaccggaggcugacgaggcuggacuuccucgaguggcc

SEQ ID NO: 633447 - RNA, 64 nt, Homo Sapiens
cacccccauuuuccagggggguuguaauuuauaagcugacgaagguagccagacuuccggagga

SEQ ID NO: 633448 - RNA, 64 nt, Homo Sapiens
cagcuggcccagucuugggaucucagacgaggcagcugacgagguaaguaccugccccuucacc

SEQ ID NO: 633449 - RNA, 64 nt, Homo Sapiens
aaggagcaggugggucgauccugcuugaguaaucgcugacgagcuucgugcugcugcuuuccug

SEQ ID NO: 633450 - RNA, 64 nt, Homo Sapiens
ccccuuggccucacaggcaaagaauaacuuaaaagcugacgauuugaauaaauuauguuacagu

SEQ ID NO: 633451 - RNA, 64 nt, Homo Sapiens; identical to SEQ ID NO: 583943

SEQ ID NO: 633452 - RNA, 64 nt, Homo Sapiens; identical to SEQ ID NO: 583944

SEQ ID NO: 633453 - RNA, 64 nt, Homo Sapiens; identical to SEQ ID NO: 583945

SEQ ID NO: 633454 - RNA, 64 nt, Homo Sapiens; identical to SEQ ID NO: 583946

SEQ ID NO: 633455 - RNA, 64 nt, Homo Sapiens; identical to SEQ ID NO: 583947

SEQ ID NO: 633456 - RNA, 64 nt, Homo Sapiens; identical to SEQ ID NO: 583948

SEQ ID NO: 633457 - RNA, 64 nt, Homo Sapiens; identical to SEQ ID NO: 583949

SEQ ID NO: 633458 - RNA, 64 nt, Homo Sapiens; identical to SEQ ID NO: 583950

SEQ ID NO: 633459 - RNA, 64 nt, Homo Sapiens; identical to SEQ ID NO: 583951

SEQ ID NO: 633460 - RNA, 64 nt, Homo Sapiens; identical to SEQ ID NO: 583952

SEQ ID NO: 633461 - RNA, 64 nt, Homo Sapiens; identical to SEQ ID NO: 583953

SEQ ID NO: 633462 - RNA, 64 nt, Homo Sapiens; identical to SEQ ID NO: 583954

SEQ ID NO: 633463 - RNA, 64 nt, Homo Sapiens; identical to SEQ ID NO: 583955

SEQ ID NO: 633464 - RNA, 64 nt, Homo Sapiens; identical to SEQ ID NO: 583956

SEQ ID NO: 633465 - RNA, 64 nt, Homo Sapiens; identical to SEQ ID NO: 583957

SEQ ID NO: 633466 - RNA, 64 nt, Homo Sapiens; identical to SEQ ID NO: 583958

SEQ ID NO: 633467 - RNA, 64 nt, Homo Sapiens; identical to SEQ ID NO: 583959

SEQ ID NO: 633468 - RNA, 64 nt, Homo Sapiens; identical to SEQ ID NO: 583960

SEQ ID NO: 633469 - RNA, 64 nt, Homo Sapiens; identical to SEQ ID NO: 583961

SEQ ID NO: 633470 - RNA, 64 nt, Homo Sapiens; identical to SEQ ID NO: 583962

SEQ ID NO: 633471 - RNA, 64 nt, Homo Sapiens; identical to SEQ ID NO: 583963

SEQ ID NO: 633472 - RNA, 64 nt, Homo Sapiens; identical to SEQ ID NO: 583964

SEQ ID NO: 633473 - RNA, 64 nt, Homo Sapiens; identical to SEQ ID NO: 583965

SEQ ID NO: 633474 - RNA, 64 nt, Homo Sapiens; identical to SEQ ID NO: 583966

SEQ ID NO: 633475 - RNA, 64 nt, Homo Sapiens; identical to SEQ ID NO: 583967

SEQ ID NO: 633476 - RNA, 64 nt, Homo Sapiens; identical to SEQ ID NO: 583968

SEQ ID NO: 633477 - RNA, 64 nt, Homo Sapiens; identical to SEQ ID NO: 583969

SEQ ID NO: 633478 - RNA, 64 nt, Homo Sapiens; identical to SEQ ID NO: 583970

SEQ ID NO: 633479 - RNA, 64 nt, Homo Sapiens; identical to SEQ ID NO: 583971

SEQ ID NO: 633480 - RNA, 64 nt, Homo Sapiens; identical to SEQ ID NO: 583972

SEQ ID NO: 633481 - RNA, 64 nt, Homo Sapiens; identical to SEQ ID NO: 583973

SEQ ID NO: 633482 - RNA, 64 nt, Homo Sapiens; identical to SEQ ID NO: 583974

SEQ ID NO: 633483 - RNA, 64 nt, Homo Sapiens; identical to SEQ ID NO: 583975

SEQ ID NO: 633484 - RNA, 64 nt, Homo Sapiens; identical to SEQ ID NO: 583976

SEQ ID NO: 633485 - RNA, 64 nt, Homo Sapiens; identical to SEQ ID NO: 583977

SEQ ID NO: 633486 - RNA, 64 nt, Homo Sapiens; identical to SEQ ID NO: 583978

SEQ ID NO: 633487 - RNA, 64 nt, Homo Sapiens; identical to SEQ ID NO: 583979

SEQ ID NO: 633488 - RNA, 64 nt, Homo Sapiens; identical to SEQ ID NO: 583980

SEQ ID NO: 633489 - RNA, 64 nt, Homo Sapiens; identical to SEQ ID NO: 583981

SEQ ID NO: 633490 - RNA, 64 nt, Homo Sapiens; identical to SEQ ID NO: 583982

SEQ ID NO: 633491 - RNA, 64 nt, Homo Sapiens; identical to SEQ ID NO: 583983

SEQ ID NO: 633492 - RNA, 64 nt, Homo Sapiens; identical to SEQ ID NO: 583984

SEQ ID NO: 633493 - RNA, 64 nt, Homo Sapiens; identical to SEQ ID NO: 583985

SEQ ID NO: 633494 - RNA, 64 nt, Homo Sapiens; identical to SEQ ID NO: 583986

SEQ ID NO: 633495 - RNA, 64 nt, Homo Sapiens; identical to SEQ ID NO: 583987

SEQ ID NO: 633496 - RNA, 64 nt, Homo Sapiens; identical to SEQ ID NO: 583988

SEQ ID NO: 633497 - RNA, 64 nt, Homo Sapiens; identical to SEQ ID NO: 583989

SEQ ID NO: 633498 - RNA, 64 nt, Homo Sapiens; identical to SEQ ID NO: 583990

SEQ ID NO: 633499 - RNA, 64 nt, Homo Sapiens; identical to SEQ ID NO: 583991

SEQ ID NO: 633500 - RNA, 64 nt, Homo Sapiens; identical to SEQ ID NO: 583992

SEQ ID NO: 633501 - RNA, 64 nt, Homo Sapiens; identical to SEQ ID NO: 583993

SEQ ID NO: 633502 - RNA, 64 nt, Homo Sapiens; identical to SEQ ID NO: 583994

SEQ ID NO: 633503 - RNA, 64 nt, Homo Sapiens; identical to SEQ ID NO: 583995

SEQ ID NO: 633504 - RNA, 64 nt, Homo Sapiens; identical to SEQ ID NO: 583996

SEQ ID NO: 633505 - RNA, 64 nt, Homo Sapiens; identical to SEQ ID NO: 583997

SEQ ID NO: 633506 - RNA, 64 nt, Homo Sapiens
gaguugacauggaggcagugcuugcauugcuuuguucgccuaucaucuggccacaugaggcugu

SEQ ID NO: 633507 - RNA, 64 nt, Homo Sapiens
ugaucuuucuuggaauaaaauauccugucaucuuuucgccuaccuaguuuauggauugacucug

SEQ ID NO: 633508 - RNA, 64 nt, Homo Sapiens
ugcccuggagcaaacaaacaguaugugauuuugcuucgccuauuuuuuuuuucuuuuuuggggg

SEQ ID NO: 633509 - RNA, 64 nt, Homo Sapiens
cacauaccucuguccagcuuuuuaggaaauacauuucgccuauugcgacuuuuuccauuuaccc

SEQ ID NO: 633510 - RNA, 64 nt, Homo Sapiens
ucacacaauuuuccaguucaaaaauggagaauacuucgccuaaaauacuguuaaguggguuaau

SEQ ID NO: 633511 - RNA, 64 nt, Homo Sapiens
gaucccauucguugcuucuaaaauguuuuauguguucgccuacuauuuccauuuuccuccgugu

SEQ ID NO: 633512 - RNA, 64 nt, Homo Sapiens
augaaaugucucaucagaccugagugauuucaccuucgccuacuaagcugcucuaaaaucucac

SEQ ID NO: 633513 - RNA, 64 nt, Homo Sapiens
aggacuucucagccuccauaagugugugggccaguucgccuaauaaauccccucuccuggccgg

SEQ ID NO: 633514 - RNA, 64 nt, Homo Sapiens
aggugccccccacauuggugcucugggagggagguucgccuaggcaggacuucugaucucaguc

SEQ ID NO: 633515 - RNA, 64 nt, Homo Sapiens
ggcucccccucgguacugcgguugcacagaguauuucgccuaaaccaagaaauuuuuuauuacc

SEQ ID NO: 633516 - RNA, 64 nt, Homo Sapiens
aaugcauaauuuucagauuuugcuuuccaaauacuucgccuaugagaggggagggauggguagg

SEQ ID NO: 633517 - RNA, 64 nt, Homo Sapiens
cgugaccagcugcuccagacccccgcuccugggauucgccuaccucaagccuccauucuccauc

SEQ ID NO: 633518 - RNA, 64 nt, Homo Sapiens
aucucugccuuuguuucaauaagucucugccucuuucgccuagugaaguuguaguguauauagg

SEQ ID NO: 633519 - RNA, 64 nt, Homo Sapiens
cuaaugaaauuaaaaaggauucuucaucauggauuucgccuaagugauauuacagccaccucau

SEQ ID NO: 633520 - RNA, 64 nt, Homo Sapiens
ccuuuaccacuuggcaggugcccacaguacaucauucgccuaacucaucaugauccagaaguaa

SEQ ID NO: 633521 - RNA, 64 nt, Homo Sapiens
caagccugcauuuuuuugagcaggcaugagccacuucgccuagccucccaaagugcuuggauug

SEQ ID NO: 633522 - RNA, 64 nt, Homo Sapiens
augaaggcccuggugaggagaaagcacucuguucuucgccuacucuguaaucguuuugucauaa

SEQ ID NO: 633523 - RNA, 64 nt, Homo Sapiens
augucaagggaaauguaaucagauuuggccagaguucgccuacagauaagaaggcacugggcca

SEQ ID NO: 633524 - RNA, 64 nt, Homo Sapiens; identical to SEQ ID NO: 279762

SEQ ID NO: 633525 - RNA, 64 nt, Homo Sapiens; identical to SEQ ID NO: 279763

SEQ ID NO: 633526 - RNA, 64 nt, Homo Sapiens; identical to SEQ ID NO: 279764

SEQ ID NO: 633527 - RNA, 64 nt, Homo Sapiens; identical to SEQ ID NO: 279765

SEQ ID NO: 633528 - RNA, 64 nt, Homo Sapiens; identical to SEQ ID NO: 279766

SEQ ID NO: 633529 - RNA, 64 nt, Homo Sapiens; identical to SEQ ID NO: 279767

SEQ ID NO: 633530 - RNA, 64 nt, Homo Sapiens; identical to SEQ ID NO: 279768

SEQ ID NO: 633531 - RNA, 64 nt, Homo Sapiens; identical to SEQ ID NO: 279769

SEQ ID NO: 633532 - RNA, 64 nt, Homo Sapiens; identical to SEQ ID NO: 279770

SEQ ID NO: 633533 - RNA, 64 nt, Homo Sapiens; identical to SEQ ID NO: 279771

SEQ ID NO: 633534 - RNA, 64 nt, Homo Sapiens; identical to SEQ ID NO: 279772

SEQ ID NO: 633535 - RNA, 64 nt, Homo Sapiens; identical to SEQ ID NO: 279773

SEQ ID NO: 633536 - RNA, 64 nt, Homo Sapiens; identical to SEQ ID NO: 279774

SEQ ID NO: 633537 - RNA, 64 nt, Homo Sapiens; identical to SEQ ID NO: 279775

SEQ ID NO: 633538 - RNA, 64 nt, Homo Sapiens; identical to SEQ ID NO: 238026

SEQ ID NO: 633539 - RNA, 64 nt, Homo Sapiens; identical to SEQ ID NO: 238027

SEQ ID NO: 633540 - RNA, 64 nt, Homo Sapiens; identical to SEQ ID NO: 238028

SEQ ID NO: 633541 - RNA, 64 nt, Homo Sapiens; identical to SEQ ID NO: 238029

SEQ ID NO: 633542 - RNA, 64 nt, Homo Sapiens; identical to SEQ ID NO: 238030

SEQ ID NO: 633543 - RNA, 64 nt, Homo Sapiens; identical to SEQ ID NO: 238031

SEQ ID NO: 633544 - RNA, 64 nt, Homo Sapiens; identical to SEQ ID NO: 238032

SEQ ID NO: 633545 - RNA, 64 nt, Homo Sapiens; identical to SEQ ID NO: 238033

SEQ ID NO: 633546 - RNA, 64 nt, Homo Sapiens; identical to SEQ ID NO: 238034

SEQ ID NO: 633547 - RNA, 64 nt, Homo Sapiens; identical to SEQ ID NO: 238035

SEQ ID NO: 633548 - RNA, 64 nt, Homo Sapiens; identical to SEQ ID NO: 238036

SEQ ID NO: 633549 - RNA, 64 nt, Homo Sapiens; identical to SEQ ID NO: 238037

SEQ ID NO: 633550 - RNA, 64 nt, Homo Sapiens; identical to SEQ ID NO: 238038

SEQ ID NO: 633551 - RNA, 64 nt, Homo Sapiens; identical to SEQ ID NO: 238039

SEQ ID NO: 633552 - RNA, 64 nt, Homo Sapiens; identical to SEQ ID NO: 238040

SEQ ID NO: 633553 - RNA, 64 nt, Homo Sapiens; identical to SEQ ID NO: 238041

SEQ ID NO: 633554 - RNA, 64 nt, Homo Sapiens; identical to SEQ ID NO: 238042

SEQ ID NO: 633555 - RNA, 64 nt, Homo Sapiens; identical to SEQ ID NO: 238043

SEQ ID NO: 633556 - RNA, 64 nt, Homo Sapiens; identical to SEQ ID NO: 238044

SEQ ID NO: 633557 - RNA, 64 nt, Homo Sapiens; identical to SEQ ID NO: 238045

SEQ ID NO: 633558 - RNA, 64 nt, Homo Sapiens; identical to SEQ ID NO: 238046

SEQ ID NO: 633559 - RNA, 64 nt, Homo Sapiens; identical to SEQ ID NO: 238047

SEQ ID NO: 633560 - RNA, 64 nt, Homo Sapiens; identical to SEQ ID NO: 238048

SEQ ID NO: 633561 - RNA, 64 nt, Homo Sapiens; identical to SEQ ID NO: 238049

SEQ ID NO: 633562 - RNA, 64 nt, Homo Sapiens; identical to SEQ ID NO: 238050

SEQ ID NO: 633563 - RNA, 64 nt, Homo Sapiens; identical to SEQ ID NO: 238051

SEQ ID NO: 633564 - RNA, 64 nt, Homo Sapiens; identical to SEQ ID NO: 238052

SEQ ID NO: 633565 - RNA, 64 nt, Homo Sapiens; identical to SEQ ID NO: 238053

SEQ ID NO: 633566 - RNA, 64 nt, Homo Sapiens; identical to SEQ ID NO: 238054

SEQ ID NO: 633567 - RNA, 64 nt, Homo Sapiens; identical to SEQ ID NO: 238055

SEQ ID NO: 633568 - RNA, 64 nt, Homo Sapiens; identical to SEQ ID NO: 238056

SEQ ID NO: 633569 - RNA, 64 nt, Homo Sapiens; identical to SEQ ID NO: 238057

SEQ ID NO: 633570 - RNA, 64 nt, Homo Sapiens; identical to SEQ ID NO: 238058

SEQ ID NO: 633571 - RNA, 64 nt, Homo Sapiens; identical to SEQ ID NO: 238059

SEQ ID NO: 633572 - RNA, 64 nt, Homo Sapiens; identical to SEQ ID NO: 238060

SEQ ID NO: 633573 - RNA, 64 nt, Homo Sapiens; identical to SEQ ID NO: 238061

SEQ ID NO: 633574 - RNA, 64 nt, Homo Sapiens; identical to SEQ ID NO: 238062

SEQ ID NO: 633575 - RNA, 64 nt, Homo Sapiens; identical to SEQ ID NO: 238063

SEQ ID NO: 633576 - RNA, 64 nt, Homo Sapiens; identical to SEQ ID NO: 238064

SEQ ID NO: 633577 - RNA, 64 nt, Homo Sapiens; identical to SEQ ID NO: 238065

SEQ ID NO: 633578 - RNA, 64 nt, Homo Sapiens; identical to SEQ ID NO: 238066

SEQ ID NO: 633579 - RNA, 64 nt, Homo Sapiens; identical to SEQ ID NO: 238067

SEQ ID NO: 633580 - RNA, 64 nt, Homo Sapiens; identical to SEQ ID NO: 238068

SEQ ID NO: 633581 - RNA, 64 nt, Homo Sapiens; identical to SEQ ID NO: 238069

SEQ ID NO: 633582 - RNA, 64 nt, Homo Sapiens; identical to SEQ ID NO: 238070

SEQ ID NO: 633583 - RNA, 64 nt, Homo Sapiens; identical to SEQ ID NO: 238071

SEQ ID NO: 633584 - RNA, 64 nt, Homo Sapiens; identical to SEQ ID NO: 238072

SEQ ID NO: 633585 - RNA, 64 nt, Homo Sapiens; identical to SEQ ID NO: 238073

SEQ ID NO: 633586 - RNA, 64 nt, Homo Sapiens; identical to SEQ ID NO: 238074

SEQ ID NO: 633587 - RNA, 64 nt, Homo Sapiens; identical to SEQ ID NO: 238075

SEQ ID NO: 633588 - RNA, 64 nt, Homo Sapiens; identical to SEQ ID NO: 238076

SEQ ID NO: 633589 - RNA, 60 nt, Homo Sapiens
uucugccccugaaugauucugucuagaaaagcucuggaguauugaucacuacuggaaaaa

SEQ ID NO: 633590 - RNA, 60 nt, Homo Sapiens
aucuccagggccccaccucagaucaaagcagcucuggaugagaugggaccugcagcucuc

SEQ ID NO: 633591 - RNA, 60 nt, Homo Sapiens
aacccuguuuccugaguuuguguuggacccgcucuggaccagauuagcucuggaccagcc

SEQ ID NO: 633592 - RNA, 60 nt, Homo Sapiens
agccuguuggacccgcucugccuuagauuagcucuggaccgaaucaaagacauggaauua

SEQ ID NO: 633593 - RNA, 60 nt, Homo Sapiens
ggagacaccugcuccaggcccaacuucaaagcucuggacaauacuuuuguagaaguggac

SEQ ID NO: 633594 - RNA, 60 nt, Homo Sapiens
uuugguuuuguuuucuuuuuuuguaagugggcucuggauuuggcccuaaugagaaacccu

SEQ ID NO: 633595 - RNA, 60 nt, Homo Sapiens
gacgagccacguaugaggugccugcccugggcucuggaccccgggcacacgagggacggu

SEQ ID NO: 633596 - RNA, 60 nt, Homo Sapiens
ccucuggguacaaaagugccucaacgacaugcucuggaaaucccaaaugccacagucuga

SEQ ID NO: 633597 - RNA, 60 nt, Homo Sapiens
caccucugugaccucaggcacuagccuuuggcucuggagacagccccagagcaggguguu

SEQ ID NO: 633598 - RNA, 60 nt, Homo Sapiens
ccccacgcccuccccuccccugcugcaggggcucuggagagaaacaauaaagagauucac

SEQ ID NO: 633599 - RNA, 60 nt, Homo Sapiens
gcccagccacaccugaguccguugagggaggcucuggaaacuucagccugugaggggagg

SEQ ID NO: 633600 - RNA, 60 nt, Homo Sapiens
agaagcuggaucacucuugggcagggugcagcucuggagauagggagaggguggauuugu

SEQ ID NO: 633601 - RNA, 60 nt, Homo Sapiens
ugugugggauagcgauugcauuuuccuuuugcucuggaguuucacuccccuucugggucc

SEQ ID NO: 633602 - RNA, 60 nt, Homo Sapiens
acuccaguugccucagguugguucugcugugcucuggaaaguaacugcagccaccaggua

SEQ ID NO: 633603 - RNA, 60 nt, Homo Sapiens
uuguuacuuccaauuuauaaucaagaaggggcucuggauccccuuuuaaauuacacacac

SEQ ID NO: 633604 - RNA, 60 nt, Homo Sapiens
accuacccaaaccuuuuguucuguaaaacugcucuggaaauaccgggaagcccaguuuuc

SEQ ID NO: 633605 - RNA, 60 nt, Homo Sapiens
agcuggagcagcucauuucuaggcugcugugcucuggagaagaugcugacaggcccuggg

SEQ ID NO: 633606 - RNA, 60 nt, Homo Sapiens
augaaggacaauugacucaaccacuugguagcucuggacaaauuccugugcucugaaaug

SEQ ID NO: 633607 - RNA, 60 nt, Homo Sapiens
gcaguggugugauuagggauucacucuggcgcucuggagugagggguuaaagacaggauc

SEQ ID NO: 633608 - RNA, 60 nt, Homo Sapiens
cugggaaguccauaguggaguuggcucagagcucuggagguuauaauaaacagaaaugua

SEQ ID NO: 633609 - RNA, 60 nt, Homo Sapiens
ggcaggggcagaguuuuggaaacagugcaggcucuggagccagacuggcgagauucaaau

SEQ ID NO: 633610 - RNA, 60 nt, Homo Sapiens
cagaucgggggcuugaacccagguggucaggcucuggagcccacaauugucuuacccacu

SEQ ID NO: 633611 - RNA, 60 nt, Homo Sapiens
ggggccgaggccccagaugcucaggaagaagcucuggagucauugcugugcauggcuccc

SEQ ID NO: 633612 - RNA, 60 nt, Homo Sapiens
cugaagcccugagaaggagacuccccuggggcucuggaacacccugccccuggcugggag

SEQ ID NO: 633613 - RNA, 60 nt, Homo Sapiens
gaauaaggcugccuuggagggccuucuuuagcucuggaaaagugggcgcaggcacgccag

SEQ ID NO: 633614 - RNA, 60 nt, Homo Sapiens
gagcagaaccucaccccauugagccagagggcucuggaguucuccuaacccaagauggaa

SEQ ID NO: 633615 - RNA, 66 nt, Homo Sapiens
ccucguguaugacagguagcuagggagcucuuggagauguagcaguugggauugugggagauuacu

SEQ ID NO: 633616 - RNA, 66 nt, Homo Sapiens
uaauuaagugaaaaaaguuuaaucccagaagaguaaauguagcaugaugcccuuucuaaaugaaag

SEQ ID NO: 633617 - RNA, 66 nt, Homo Sapiens
aucuuagccuacguuaccagcuucuuuggaaaugaaauguagcacaaauaaagaccuccaagggua

SEQ ID NO: 633618 - RNA, 66 nt, Homo Sapiens
gaguggugauacccagaccaguauagauguuuguggauguagcacuuguuagugacccacaggaca

SEQ ID NO: 633619 - RNA, 66 nt, Homo Sapiens
cccaccuagcucccuggccagaaugcguucugcagcauguagcaugcggcagcucuuccugccacu

SEQ ID NO: 633620 - RNA, 66 nt, Homo Sapiens
cgcugcagcuggccacacugcacuguuuucugagaaauguagcauccuugacucucccggcucugc

SEQ ID NO: 633621 - RNA, 66 nt, Homo Sapiens
agaaugaaaauuguugagguuaucucccauucaaucauguagcaagaacuuaaagaaauucacuac

SEQ ID NO: 633622 - RNA, 66 nt, Homo Sapiens
aagaaaauagagaauuuaauauauggugauugggauauguagcauucaaaaaaagugaauugccaa

SEQ ID NO: 633623 - RNA, 66 nt, Homo Sapiens
ucaauguguaagauauaugucauuucaggguauaagauguagcauugcuuggcucucuacacaugg

SEQ ID NO: 633624 - RNA, 66 nt, Homo Sapiens
aaaaauauauuuuaaugaagaauuguggucguguuaauguagcacaaauucagcuuucuuuaacuu

SEQ ID NO: 633625 - RNA, 66 nt, Homo Sapiens
cacuuagaguaaauggacuuuggacauacagugccuauguagcaggccaaugcuaugguuuccaug

SEQ ID NO: 633626 - RNA, 66 nt, Homo Sapiens
uauggcuuaaucucuuagaccuuuuaaugaacuuaaauguagcacaaaauaaaagcaugcccucag

SEQ ID NO: 633627 - RNA, 66 nt, Homo Sapiens
aaaauguuacaacucuacuauuaugcugaauuauacauguagcaccuauuuuaaaaaggcuuuggc

SEQ ID NO: 633628 - RNA, 66 nt, Homo Sapiens
aucacacuguauuuaaauuguacuacuuuaaaucaaauguagcauuuuuggcaauuuauaauuuau

SEQ ID NO: 633629 - RNA, 66 nt, Homo Sapiens
gacagagcuagacuguaaagcaaaaauuugggauucauguagcagagcccagaggggaacuugauu

SEQ ID NO: 633630 - RNA, 66 nt, Homo Sapiens
auaccaggcagacagaaccucuuuugauaugagacaauguagcagauuuuugaguuaaaaauggca

SEQ ID NO: 633631 - RNA, 66 nt, Homo Sapiens
aggcacucuuaaaugaucugccucuaaaagcguuggauguagcauuaugcaauuagguuuuuccuu

SEQ ID NO: 633632 - RNA, 66 nt, Homo Sapiens
ucauuguacuaccuguguauauaguuuuuaccuuuuauguagcacauaaacuuuggggaagggagg

SEQ ID NO: 633633 - RNA, 66 nt, Homo Sapiens
cuuucaugagggagucaauauguaguggaaagaagcauguagcaaaaaagacaaccuugaucuuua

SEQ ID NO: 633634 - RNA, 66 nt, Homo Sapiens
aaaaaaagcagaacccacuggaguagaaaaggaagcauguagcauauacucaguagugaaauuuaa

SEQ ID NO: 633635 - RNA, 66 nt, Homo Sapiens
uuauugucuugguugccaguaguaccuuguuuugccauguagcagacaacacacaaaauaaugcag

SEQ ID NO: 633636 - RNA, 66 nt, Homo Sapiens
aagccucagcucauagugaacacagcagaccuagaaauguagcagcagccuacugaguagcuuuca

SEQ ID NO: 633637 - RNA, 64 nt, Homo Sapiens; identical to SEQ ID NO: 266194

SEQ ID NO: 633638 - RNA, 64 nt, Homo Sapiens; identical to SEQ ID NO: 266195

SEQ ID NO: 633639 - RNA, 64 nt, Homo Sapiens; identical to SEQ ID NO: 266196

SEQ ID NO: 633640 - RNA, 64 nt, Homo Sapiens; identical to SEQ ID NO: 266197

SEQ ID NO: 633641 - RNA, 64 nt, Homo Sapiens; identical to SEQ ID NO: 266198

SEQ ID NO: 633642 - RNA, 64 nt, Homo Sapiens; identical to SEQ ID NO: 266199

SEQ ID NO: 633643 - RNA, 64 nt, Homo Sapiens; identical to SEQ ID NO: 266200

SEQ ID NO: 633644 - RNA, 64 nt, Homo Sapiens; identical to SEQ ID NO: 266201

SEQ ID NO: 633645 - RNA, 64 nt, Homo Sapiens; identical to SEQ ID NO: 266202

SEQ ID NO: 633646 - RNA, 64 nt, Homo Sapiens; identical to SEQ ID NO: 266203

SEQ ID NO: 633647 - RNA, 64 nt, Homo Sapiens; identical to SEQ ID NO: 266204

SEQ ID NO: 633648 - RNA, 64 nt, Homo Sapiens; identical to SEQ ID NO: 266205

SEQ ID NO: 633649 - RNA, 64 nt, Homo Sapiens; identical to SEQ ID NO: 266206

SEQ ID NO: 633650 - RNA, 64 nt, Homo Sapiens; identical to SEQ ID NO: 266207

SEQ ID NO: 633651 - RNA, 64 nt, Homo Sapiens; identical to SEQ ID NO: 266208

SEQ ID NO: 633652 - RNA, 64 nt, Homo Sapiens; identical to SEQ ID NO: 266209

SEQ ID NO: 633653 - RNA, 64 nt, Homo Sapiens; identical to SEQ ID NO: 266210

SEQ ID NO: 633654 - RNA, 64 nt, Homo Sapiens; identical to SEQ ID NO: 266211

SEQ ID NO: 633655 - RNA, 64 nt, Homo Sapiens; identical to SEQ ID NO: 266212

SEQ ID NO: 633656 - RNA, 64 nt, Homo Sapiens; identical to SEQ ID NO: 266213

SEQ ID NO: 633657 - RNA, 64 nt, Homo Sapiens; identical to SEQ ID NO: 266214

SEQ ID NO: 633658 - RNA, 64 nt, Homo Sapiens; identical to SEQ ID NO: 266215

SEQ ID NO: 633659 - RNA, 64 nt, Homo Sapiens; identical to SEQ ID NO: 266216

SEQ ID NO: 633660 - RNA, 64 nt, Homo Sapiens; identical to SEQ ID NO: 266217

SEQ ID NO: 633661 - RNA, 64 nt, Homo Sapiens; identical to SEQ ID NO: 266218

SEQ ID NO: 633662 - RNA, 64 nt, Homo Sapiens; identical to SEQ ID NO: 266219

SEQ ID NO: 633663 - RNA, 64 nt, Homo Sapiens; identical to SEQ ID NO: 266220

SEQ ID NO: 633664 - RNA, 64 nt, Homo Sapiens; identical to SEQ ID NO: 266221

SEQ ID NO: 633665 - RNA, 64 nt, Homo Sapiens; identical to SEQ ID NO: 266222

SEQ ID NO: 633666 - RNA, 64 nt, Homo Sapiens; identical to SEQ ID NO: 266223

SEQ ID NO: 633667 - RNA, 64 nt, Homo Sapiens; identical to SEQ ID NO: 266224

SEQ ID NO: 633668 - RNA, 64 nt, Homo Sapiens; identical to SEQ ID NO: 266225

SEQ ID NO: 633669 - RNA, 64 nt, Homo Sapiens; identical to SEQ ID NO: 266226

SEQ ID NO: 633670 - RNA, 64 nt, Homo Sapiens; identical to SEQ ID NO: 266227

SEQ ID NO: 633671 - RNA, 64 nt, Homo Sapiens; identical to SEQ ID NO: 266228

SEQ ID NO: 633672 - RNA, 64 nt, Homo Sapiens; identical to SEQ ID NO: 266229

SEQ ID NO: 633673 - RNA, 64 nt, Homo Sapiens; identical to SEQ ID NO: 266230

SEQ ID NO: 633674 - RNA, 64 nt, Homo Sapiens; identical to SEQ ID NO: 266231

SEQ ID NO: 633675 - RNA, 64 nt, Homo Sapiens; identical to SEQ ID NO: 266232

SEQ ID NO: 633676 - RNA, 64 nt, Homo Sapiens; identical to SEQ ID NO: 266233

SEQ ID NO: 633677 - RNA, 64 nt, Homo Sapiens; identical to SEQ ID NO: 266234

SEQ ID NO: 633678 - RNA, 64 nt, Homo Sapiens; identical to SEQ ID NO: 266235

SEQ ID NO: 633679 - RNA, 64 nt, Homo Sapiens; identical to SEQ ID NO: 266236

SEQ ID NO: 633680 - RNA, 64 nt, Homo Sapiens; identical to SEQ ID NO: 266237

SEQ ID NO: 633681 - RNA, 64 nt, Homo Sapiens; identical to SEQ ID NO: 266238

SEQ ID NO: 633682 - RNA, 64 nt, Homo Sapiens; identical to SEQ ID NO: 266239

SEQ ID NO: 633683 - RNA, 64 nt, Homo Sapiens; identical to SEQ ID NO: 266240

SEQ ID NO: 633684 - RNA, 64 nt, Homo Sapiens; identical to SEQ ID NO: 266241

SEQ ID NO: 633685 - RNA, 64 nt, Homo Sapiens; identical to SEQ ID NO: 266242

SEQ ID NO: 633686 - RNA, 64 nt, Homo Sapiens; identical to SEQ ID NO: 266243

SEQ ID NO: 633687 - RNA, 64 nt, Homo Sapiens; identical to SEQ ID NO: 266244

SEQ ID NO: 633688 - RNA, 64 nt, Homo Sapiens; identical to SEQ ID NO: 266245

SEQ ID NO: 633689 - RNA, 64 nt, Homo Sapiens; identical to SEQ ID NO: 266246

SEQ ID NO: 633690 - RNA, 64 nt, Homo Sapiens; identical to SEQ ID NO: 266247

SEQ ID NO: 633691 - RNA, 64 nt, Homo Sapiens; identical to SEQ ID NO: 266248

SEQ ID NO: 633692 - RNA, 64 nt, Homo Sapiens; identical to SEQ ID NO: 266249

SEQ ID NO: 633693 - RNA, 64 nt, Homo Sapiens; identical to SEQ ID NO: 266250

SEQ ID NO: 633694 - RNA, 64 nt, Homo Sapiens; identical to SEQ ID NO: 266251

SEQ ID NO: 633695 - RNA, 64 nt, Homo Sapiens; identical to SEQ ID NO: 266252

SEQ ID NO: 633696 - RNA, 64 nt, Homo Sapiens; identical to SEQ ID NO: 468387

SEQ ID NO: 633697 - RNA, 64 nt, Homo Sapiens; identical to SEQ ID NO: 468388

SEQ ID NO: 633698 - RNA, 64 nt, Homo Sapiens; identical to SEQ ID NO: 468389

SEQ ID NO: 633699 - RNA, 64 nt, Homo Sapiens; identical to SEQ ID NO: 468390

SEQ ID NO: 633700 - RNA, 64 nt, Homo Sapiens; identical to SEQ ID NO: 468391

SEQ ID NO: 633701 - RNA, 64 nt, Homo Sapiens; identical to SEQ ID NO: 468392

SEQ ID NO: 633702 - RNA, 64 nt, Homo Sapiens; identical to SEQ ID NO: 468393

SEQ ID NO: 633703 - RNA, 64 nt, Homo Sapiens; identical to SEQ ID NO: 468394

SEQ ID NO: 633704 - RNA, 64 nt, Homo Sapiens; identical to SEQ ID NO: 468395

SEQ ID NO: 633705 - RNA, 64 nt, Homo Sapiens; identical to SEQ ID NO: 468396

SEQ ID NO: 633706 - RNA, 64 nt, Homo Sapiens; identical to SEQ ID NO: 468397

SEQ ID NO: 633707 - RNA, 64 nt, Homo Sapiens; identical to SEQ ID NO: 468398

SEQ ID NO: 633708 - RNA, 64 nt, Homo Sapiens; identical to SEQ ID NO: 468399

SEQ ID NO: 633709 - RNA, 64 nt, Homo Sapiens; identical to SEQ ID NO: 468400

SEQ ID NO: 633710 - RNA, 64 nt, Homo Sapiens; identical to SEQ ID NO: 468401

SEQ ID NO: 633711 - RNA, 64 nt, Homo Sapiens; identical to SEQ ID NO: 468402

SEQ ID NO: 633712 - RNA, 64 nt, Homo Sapiens; identical to SEQ ID NO: 466453

SEQ ID NO: 633713 - RNA, 64 nt, Homo Sapiens; identical to SEQ ID NO: 466454

SEQ ID NO: 633714 - RNA, 64 nt, Homo Sapiens; identical to SEQ ID NO: 466455

SEQ ID NO: 633715 - RNA, 64 nt, Homo Sapiens; identical to SEQ ID NO: 466456

SEQ ID NO: 633716 - RNA, 64 nt, Homo Sapiens; identical to SEQ ID NO: 466457

SEQ ID NO: 633717 - RNA, 64 nt, Homo Sapiens; identical to SEQ ID NO: 466458

SEQ ID NO: 633718 - RNA, 64 nt, Homo Sapiens; identical to SEQ ID NO: 466459

SEQ ID NO: 633719 - RNA, 64 nt, Homo Sapiens; identical to SEQ ID NO: 466460

SEQ ID NO: 633720 - RNA, 64 nt, Homo Sapiens; identical to SEQ ID NO: 466461

SEQ ID NO: 633721 - RNA, 64 nt, Homo Sapiens; identical to SEQ ID NO: 466462

SEQ ID NO: 633722 - RNA, 64 nt, Homo Sapiens; identical to SEQ ID NO: 466463

SEQ ID NO: 633723 - RNA, 64 nt, Homo Sapiens; identical to SEQ ID NO: 466464

SEQ ID NO: 633724 - RNA, 64 nt, Homo Sapiens; identical to SEQ ID NO: 466465

SEQ ID NO: 633725 - RNA, 64 nt, Homo Sapiens; identical to SEQ ID NO: 466466

SEQ ID NO: 633726 - RNA, 64 nt, Homo Sapiens; identical to SEQ ID NO: 466467

SEQ ID NO: 633727 - RNA, 64 nt, Homo Sapiens; identical to SEQ ID NO: 466468

SEQ ID NO: 633728 - RNA, 64 nt, Homo Sapiens; identical to SEQ ID NO: 466469

SEQ ID NO: 633729 - RNA, 64 nt, Homo Sapiens; identical to SEQ ID NO: 466470

SEQ ID NO: 633730 - RNA, 64 nt, Homo Sapiens; identical to SEQ ID NO: 466471

SEQ ID NO: 633731 - RNA, 64 nt, Homo Sapiens; identical to SEQ ID NO: 466472

SEQ ID NO: 633732 - RNA, 64 nt, Homo Sapiens; identical to SEQ ID NO: 466473

SEQ ID NO: 633733 - RNA, 64 nt, Homo Sapiens; identical to SEQ ID NO: 466474

SEQ ID NO: 633734 - RNA, 64 nt, Homo Sapiens; identical to SEQ ID NO: 466475

SEQ ID NO: 633735 - RNA, 64 nt, Homo Sapiens; identical to SEQ ID NO: 466476

SEQ ID NO: 633736 - RNA, 64 nt, Homo Sapiens; identical to SEQ ID NO: 466477

SEQ ID NO: 633737 - RNA, 64 nt, Homo Sapiens; identical to SEQ ID NO: 466478

SEQ ID NO: 633738 - RNA, 64 nt, Homo Sapiens; identical to SEQ ID NO: 466479

SEQ ID NO: 633739 - RNA, 64 nt, Homo Sapiens; identical to SEQ ID NO: 466480

SEQ ID NO: 633740 - RNA, 64 nt, Homo Sapiens; identical to SEQ ID NO: 466481

SEQ ID NO: 633741 - RNA, 64 nt, Homo Sapiens; identical to SEQ ID NO: 466482

SEQ ID NO: 633742 - RNA, 64 nt, Homo Sapiens; identical to SEQ ID NO: 466483

SEQ ID NO: 633743 - RNA, 64 nt, Homo Sapiens; identical to SEQ ID NO: 466484

SEQ ID NO: 633744 - RNA, 64 nt, Homo Sapiens; identical to SEQ ID NO: 466485

SEQ ID NO: 633745 - RNA, 64 nt, Homo Sapiens; identical to SEQ ID NO: 466486

SEQ ID NO: 633746 - RNA, 64 nt, Homo Sapiens; identical to SEQ ID NO: 466487

SEQ ID NO: 633747 - RNA, 64 nt, Homo Sapiens; identical to SEQ ID NO: 466488

SEQ ID NO: 633748 - RNA, 64 nt, Homo Sapiens; identical to SEQ ID NO: 466489

SEQ ID NO: 633749 - RNA, 64 nt, Homo Sapiens; identical to SEQ ID NO: 466490

SEQ ID NO: 633750 - RNA, 64 nt, Homo Sapiens; identical to SEQ ID NO: 466491

SEQ ID NO: 633751 - RNA, 64 nt, Homo Sapiens; identical to SEQ ID NO: 466492

SEQ ID NO: 633752 - RNA, 64 nt, Homo Sapiens; identical to SEQ ID NO: 466493

SEQ ID NO: 633753 - RNA, 64 nt, Homo Sapiens; identical to SEQ ID NO: 466494

SEQ ID NO: 633754 - RNA, 64 nt, Homo Sapiens; identical to SEQ ID NO: 466495

SEQ ID NO: 633755 - RNA, 64 nt, Homo Sapiens; identical to SEQ ID NO: 466496

SEQ ID NO: 633756 - RNA, 64 nt, Homo Sapiens; identical to SEQ ID NO: 466497

SEQ ID NO: 633757 - RNA, 64 nt, Homo Sapiens; identical to SEQ ID NO: 466498

SEQ ID NO: 633758 - RNA, 64 nt, Homo Sapiens; identical to SEQ ID NO: 466499

SEQ ID NO: 633759 - RNA, 64 nt, Homo Sapiens; identical to SEQ ID NO: 466500

SEQ ID NO: 633760 - RNA, 64 nt, Homo Sapiens; identical to SEQ ID NO: 466501

SEQ ID NO: 633761 - RNA, 64 nt, Homo Sapiens; identical to SEQ ID NO: 466502

SEQ ID NO: 633762 - RNA, 64 nt, Homo Sapiens; identical to SEQ ID NO: 466503

SEQ ID NO: 633763 - RNA, 64 nt, Homo Sapiens; identical to SEQ ID NO: 466504

SEQ ID NO: 633764 - RNA, 64 nt, Homo Sapiens; identical to SEQ ID NO: 466505

SEQ ID NO: 633765 - RNA, 64 nt, Homo Sapiens; identical to SEQ ID NO: 466506

SEQ ID NO: 633766 - RNA, 64 nt, Homo Sapiens; identical to SEQ ID NO: 466507

SEQ ID NO: 633767 - RNA, 64 nt, Homo Sapiens; identical to SEQ ID NO: 466508

SEQ ID NO: 633768 - RNA, 64 nt, Homo Sapiens; identical to SEQ ID NO: 466509

SEQ ID NO: 633769 - RNA, 64 nt, Homo Sapiens; identical to SEQ ID NO: 466510

SEQ ID NO: 633770 - RNA, 64 nt, Homo Sapiens; identical to SEQ ID NO: 234645

SEQ ID NO: 633771 - RNA, 64 nt, Homo Sapiens; identical to SEQ ID NO: 234646

SEQ ID NO: 633772 - RNA, 64 nt, Homo Sapiens; identical to SEQ ID NO: 234647

SEQ ID NO: 633773 - RNA, 64 nt, Homo Sapiens; identical to SEQ ID NO: 234648

SEQ ID NO: 633774 - RNA, 64 nt, Homo Sapiens; identical to SEQ ID NO: 234649

SEQ ID NO: 633775 - RNA, 64 nt, Homo Sapiens; identical to SEQ ID NO: 234650

SEQ ID NO: 633776 - RNA, 64 nt, Homo Sapiens; identical to SEQ ID NO: 234651

SEQ ID NO: 633777 - RNA, 64 nt, Homo Sapiens; identical to SEQ ID NO: 234652

SEQ ID NO: 633778 - RNA, 64 nt, Homo Sapiens; identical to SEQ ID NO: 234653

SEQ ID NO: 633779 - RNA, 64 nt, Homo Sapiens; identical to SEQ ID NO: 234654

SEQ ID NO: 633780 - RNA, 64 nt, Homo Sapiens; identical to SEQ ID NO: 234655

SEQ ID NO: 633781 - RNA, 64 nt, Homo Sapiens; identical to SEQ ID NO: 234656

SEQ ID NO: 633782 - RNA, 64 nt, Homo Sapiens; identical to SEQ ID NO: 234657

SEQ ID NO: 633783 - RNA, 64 nt, Homo Sapiens; identical to SEQ ID NO: 234658

SEQ ID NO: 633784 - RNA, 64 nt, Homo Sapiens; identical to SEQ ID NO: 234659

SEQ ID NO: 633785 - RNA, 64 nt, Homo Sapiens; identical to SEQ ID NO: 234660

SEQ ID NO: 633786 - RNA, 64 nt, Homo Sapiens; identical to SEQ ID NO: 234661

SEQ ID NO: 633787 - RNA, 64 nt, Homo Sapiens; identical to SEQ ID NO: 234662

SEQ ID NO: 633788 - RNA, 64 nt, Homo Sapiens; identical to SEQ ID NO: 234663

SEQ ID NO: 633789 - RNA, 64 nt, Homo Sapiens; identical to SEQ ID NO: 234664

SEQ ID NO: 633790 - RNA, 64 nt, Homo Sapiens; identical to SEQ ID NO: 234665

SEQ ID NO: 633791 - RNA, 63 nt, Homo Sapiens; identical to SEQ ID NO: 234666

SEQ ID NO: 633792 - RNA, 64 nt, Homo Sapiens; identical to SEQ ID NO: 234667

SEQ ID NO: 633793 - RNA, 64 nt, Homo Sapiens; identical to SEQ ID NO: 234668

SEQ ID NO: 633794 - RNA, 64 nt, Homo Sapiens; identical to SEQ ID NO: 234669

SEQ ID NO: 633795 - RNA, 64 nt, Homo Sapiens; identical to SEQ ID NO: 234670

SEQ ID NO: 633796 - RNA, 64 nt, Homo Sapiens; identical to SEQ ID NO: 234671

SEQ ID NO: 633797 - RNA, 64 nt, Homo Sapiens; identical to SEQ ID NO: 234672

SEQ ID NO: 633798 - RNA, 64 nt, Homo Sapiens; identical to SEQ ID NO: 234673

SEQ ID NO: 633799 - RNA, 64 nt, Homo Sapiens; identical to SEQ ID NO: 234674

SEQ ID NO: 633800 - RNA, 64 nt, Homo Sapiens; identical to SEQ ID NO: 234675

SEQ ID NO: 633801 - RNA, 64 nt, Homo Sapiens; identical to SEQ ID NO: 234676

SEQ ID NO: 633802 - RNA, 64 nt, Homo Sapiens; identical to SEQ ID NO: 234677

SEQ ID NO: 633803 - RNA, 64 nt, Homo Sapiens; identical to SEQ ID NO: 234678

SEQ ID NO: 633804 - RNA, 64 nt, Homo Sapiens; identical to SEQ ID NO: 234679

SEQ ID NO: 633805 - RNA, 64 nt, Homo Sapiens; identical to SEQ ID NO: 234680

SEQ ID NO: 633806 - RNA, 64 nt, Homo Sapiens; identical to SEQ ID NO: 234681

SEQ ID NO: 633807 - RNA, 64 nt, Homo Sapiens; identical to SEQ ID NO: 234682

SEQ ID NO: 633808 - RNA, 64 nt, Homo Sapiens; identical to SEQ ID NO: 234683

SEQ ID NO: 633809 - RNA, 64 nt, Homo Sapiens; identical to SEQ ID NO: 234684

SEQ ID NO: 633810 - RNA, 64 nt, Homo Sapiens; identical to SEQ ID NO: 234685

SEQ ID NO: 633811 - RNA, 64 nt, Homo Sapiens; identical to SEQ ID NO: 234686

SEQ ID NO: 633812 - RNA, 64 nt, Homo Sapiens; identical to SEQ ID NO: 234687

SEQ ID NO: 633813 - RNA, 64 nt, Homo Sapiens; identical to SEQ ID NO: 234688

SEQ ID NO: 633814 - RNA, 64 nt, Homo Sapiens; identical to SEQ ID NO: 234689

SEQ ID NO: 633815 - RNA, 64 nt, Homo Sapiens; identical to SEQ ID NO: 234690

SEQ ID NO: 633816 - RNA, 64 nt, Homo Sapiens; identical to SEQ ID NO: 234691

SEQ ID NO: 633817 - RNA, 64 nt, Homo Sapiens; identical to SEQ ID NO: 234692

SEQ ID NO: 633818 - RNA, 64 nt, Homo Sapiens; identical to SEQ ID NO: 234693

SEQ ID NO: 633819 - RNA, 64 nt, Homo Sapiens; identical to SEQ ID NO: 234694

SEQ ID NO: 633820 - RNA, 64 nt, Homo Sapiens; identical to SEQ ID NO: 234695

SEQ ID NO: 633821 - RNA, 64 nt, Homo Sapiens; identical to SEQ ID NO: 234696

SEQ ID NO: 633822 - RNA, 61 nt, Homo Sapiens
aagaugggauugccacucacuuuucccugagaaaggagaaagcagaauggcccuagaguuc

SEQ ID NO: 633823 - RNA, 61 nt, Homo Sapiens
uuuaacuuugcuauuuauuucuuuauuuuuaaaaggagaagguugcuugguugguuuguug

SEQ ID NO: 633824 - RNA, 61 nt, Homo Sapiens
uaguuuauuucauaugggcaaauuuggauagaaaggagaugagcaauugcuccaccuuaca

SEQ ID NO: 633825 - RNA, 61 nt, Homo Sapiens
accacagauccuacaggacuugagauugucaaaaggagacaagggcaggcacgaagaacag

SEQ ID NO: 633826 - RNA, 61 nt, Homo Sapiens
auguguauguguagugcgauuuucuucaaggaaaggagacaaguccaaagcucguuugugg

SEQ ID NO: 633827 - RNA, 61 nt, Homo Sapiens
aguucaugcugauacucaaauuucuuuuuaaaaaggagaaacaggaagguuucuuuuggag

SEQ ID NO: 633828 - RNA, 61 nt, Homo Sapiens
ugcaaauuuuaccaaaagaucuuauuuugaaaaaggagaaugugacuccaacuauggauag

SEQ ID NO: 633829 - RNA, 61 nt, Homo Sapiens
aucaauuaucaggaaagcuaagaaaaaauauaaaggagaaaaguaaauuauagaauguaua

SEQ ID NO: 633830 - RNA, 61 nt, Homo Sapiens
gggaucugguuuagggcaauuguucucaaccaaaggagaugccaucuagcaaaugaggcac

SEQ ID NO: 633831 - RNA, 61 nt, Homo Sapiens
ggccauacaaauguuuucuaagcaagauaauaaaggagaugacaggaacauuguuuucuag

SEQ ID NO: 633832 - RNA, 61 nt, Homo Sapiens
aaauucuaguauauuuuaagacacacagcaaaaaggagaaaaguaaaagaugaaguuuuau

SEQ ID NO: 633833 - RNA, 61 nt, Homo Sapiens
gguggcgccauggacguggccaguugggaagaaaggagaggaggaaagagggcacccuuuu

SEQ ID NO: 633834 - RNA, 61 nt, Homo Sapiens
uuguuacuuacgguucugaggacugccauggaaaggagaguaagccauuggaugaggaggg

SEQ ID NO: 633835 - RNA, 61 nt, Homo Sapiens
auguucuuauuuggaagcagugacaggauuuaaaggagagaagcagcaaccucugcagggc

SEQ ID NO: 633836 - RNA, 61 nt, Homo Sapiens
ucagaaugauacaguauuuugcaguauugaaaaaggagaaugacaucagaguauuugaccu

SEQ ID NO: 633837 - RNA, 61 nt, Homo Sapiens
ugaggggagauuugcaccuagacacuucuugaaaggagacacucaguuucacaagugagcc

SEQ ID NO: 633838 - RNA, 61 nt, Homo Sapiens
ucccuuaccuccuuucguugauggccaaagcaaaggagaguccugggagcccacaagaucc

SEQ ID NO: 633839 - RNA, 61 nt, Homo Sapiens
aaacgaugcaucaagcuuguaaaagggaaaaaaaggagaaaugcaucuuuuuaaaacaagg

SEQ ID NO: 633840 - RNA, 61 nt, Homo Sapiens
uauguguuaacgcuuuguuuaaaauaacauuaaaggagacuaaagaugaguuaaccaaagg

SEQ ID NO: 633841 - RNA, 61 nt, Homo Sapiens
gcuaacucuaggaugaagcuggcuaaugagaaaaggagacagcaggaaguuguaaaucacu

SEQ ID NO: 633842 - RNA, 61 nt, Homo Sapiens
aggaaguuguaaaucacuggugguggaaagcaaaggagagcgggacaggguauagcuuaga

SEQ ID NO: 633843 - RNA, 61 nt, Homo Sapiens
uggaguuugagaggagggaggugcuggggccaaaggagacacuagaaaagugguagauggg

SEQ ID NO: 633844 - RNA, 61 nt, Homo Sapiens
aauguaaaagggcaguaauuaggggugagggaaaggagauaggggacccuaggagguagag

SEQ ID NO: 633845 - RNA, 61 nt, Homo Sapiens
ggugauuauucaugacaggcggagcgagacgaaaggagaacgacaggcgagaaguacgagg

SEQ ID NO: 633846 - RNA, 61 nt, Homo Sapiens
gcuagucuagauaaaaaaagagaaguaaggaaaaggagagauuuuucuacagauucaugga

SEQ ID NO: 633847 - RNA, 61 nt, Homo Sapiens
auuguagaccaucaagaagauagaccaaacuaaaggagaucuccaggacauaugguaauac

SEQ ID NO: 633848 - RNA, 61 nt, Homo Sapiens
gucucgaugucauggauuuauagguuaaggaaaaggagauguguuccaguuugauaugggu

SEQ ID NO: 633849 - RNA, 61 nt, Homo Sapiens
gguaggcgagggguucggagguucacacaccaaaggagaagccugucccgcuagccugugu

SEQ ID NO: 633850 - RNA, 61 nt, Homo Sapiens
uuagcaggaguccuagcccuaaagcguccagaaaggagagcaaguucugcuguuuuuagca

SEQ ID NO: 633851 - RNA, 61 nt, Homo Sapiens
uacaucaggccuucauccugauuaaagcguaaaaggagaccgagcguccccucacaaauaa

SEQ ID NO: 633852 - RNA, 61 nt, Homo Sapiens
cccacagagguauuugauguauuuaauugugaaaggagacuuugcagauaaaugaggccag

SEQ ID NO: 633853 - RNA, 61 nt, Homo Sapiens
aguaacauccacagaacuaguccaacucuuaaaaggagagaggaaaaacacaggcaccagu

SEQ ID NO: 633854 - RNA, 61 nt, Homo Sapiens
uguucugcauguagccuucuguggucaugugaaaggagacaggcucuucuaaguugaguug

SEQ ID NO: 633855 - RNA, 61 nt, Homo Sapiens
uucucuggaauuccugucucuccuuuaaaagaaaggagagaacauuuuagaacaauaguuc

SEQ ID NO: 633856 - RNA, 61 nt, Homo Sapiens
uguucucggugcugggaguacagcagugagcaaaggagacaauauucccugcucacagaga

SEQ ID NO: 633857 - RNA, 61 nt, Homo Sapiens
ccaugaguauguauguuuaccugugccuaauaaaggagaauuaugaaauaauuuuauuuuu

SEQ ID NO: 633858 - RNA, 61 nt, Homo Sapiens
acgcugcaauaaagguugggagaaggcgcggaaaggagaggagcuggggccuuggggaccc

SEQ ID NO: 633859 - RNA, 61 nt, Homo Sapiens
uauugaucuuguguucuuugugccaauaugaaaaggagaggguugguucuuuccuuuauug

SEQ ID NO: 633860 - RNA, 61 nt, Homo Sapiens
ucaaagcuuuagaugugucccauguggcaagaaaggagacagugaauuuugucaaacaaua

SEQ ID NO: 633861 - RNA, 61 nt, Homo Sapiens
agcauaugagaaucucugagagguccucuagaaaggagagaaaaagcaccucuuuuggcuc

SEQ ID NO: 633862 - RNA, 61 nt, Homo Sapiens
uagauacagucagugucacuucagaugaagaaaaggagagguuuagacaaaagcaagagga

SEQ ID NO: 633863 - RNA, 61 nt, Homo Sapiens
uagauacagucagugucacuccugaugaagaaaaggagagguggauuuagaaaaaggaaca

SEQ ID NO: 633864 - RNA, 64 nt, Homo Sapiens; identical to SEQ ID NO: 486536

SEQ ID NO: 633865 - RNA, 64 nt, Homo Sapiens; identical to SEQ ID NO: 486537

SEQ ID NO: 633866 - RNA, 64 nt, Homo Sapiens; identical to SEQ ID NO: 486538

SEQ ID NO: 633867 - RNA, 64 nt, Homo Sapiens; identical to SEQ ID NO: 486539

SEQ ID NO: 633868 - RNA, 64 nt, Homo Sapiens; identical to SEQ ID NO: 486540

SEQ ID NO: 633869 - RNA, 64 nt, Homo Sapiens; identical to SEQ ID NO: 486541

SEQ ID NO: 633870 - RNA, 64 nt, Homo Sapiens; identical to SEQ ID NO: 486542

SEQ ID NO: 633871 - RNA, 64 nt, Homo Sapiens; identical to SEQ ID NO: 486543

SEQ ID NO: 633872 - RNA, 64 nt, Homo Sapiens; identical to SEQ ID NO: 486544

SEQ ID NO: 633873 - RNA, 64 nt, Homo Sapiens; identical to SEQ ID NO: 486545

SEQ ID NO: 633874 - RNA, 64 nt, Homo Sapiens; identical to SEQ ID NO: 486546

SEQ ID NO: 633875 - RNA, 64 nt, Homo Sapiens; identical to SEQ ID NO: 486547

SEQ ID NO: 633876 - RNA, 64 nt, Homo Sapiens; identical to SEQ ID NO: 486548

SEQ ID NO: 633877 - RNA, 64 nt, Homo Sapiens; identical to SEQ ID NO: 486549

SEQ ID NO: 633878 - RNA, 63 nt, Homo Sapiens
ccaaauucgccuccacccaccuuaaugucuucuuccucucaagacccagaccucagaugagga

SEQ ID NO: 633879 - RNA, 63 nt, Homo Sapiens
cucccugaugaagaguugacauucccacuccccuccucucagcucacagacauuaaagugacg

SEQ ID NO: 633880 - RNA, 63 nt, Homo Sapiens
gcauguuucccuccaauauuuuuucccuuguuuuccucucauuugggcuguaacaauucaggg

SEQ ID NO: 633881 - RNA, 63 nt, Homo Sapiens
ccacguuuugcucaagaagcgaaggcccucucuuccucucauaauuuucagaaagggaacaac

SEQ ID NO: 633882 - RNA, 63 nt, Homo Sapiens
uuuccucuuugacuaaauggccaauccugcuccuccucucaugacaugucauugaucuugccc

SEQ ID NO: 633883 - RNA, 63 nt, Homo Sapiens
uauuauacaauuuaaaaacuuuauauucauagauccucucaagaauuauaaacaggacccaau

SEQ ID NO: 633884 - RNA, 63 nt, Homo Sapiens
uuggccugagcuugugggucuguucagacugucuccucucaugguuugaaacugcaucugaau

SEQ ID NO: 633885 - RNA, 63 nt, Homo Sapiens
augauuaguucacauuuacuggugcauccuugauccucucacagauagaggucuuaaagguug

SEQ ID NO: 633886 - RNA, 63 nt, Homo Sapiens
caaccaagguugaccacacaaccaggaaauugcuccucucagcggcugucuuuacuuguggaa

SEQ ID NO: 633887 - RNA, 63 nt, Homo Sapiens
uggugcagaaacagucaagagcagagcagccccuccucucauucccccccgccacgccuuaga

SEQ ID NO: 633888 - RNA, 63 nt, Homo Sapiens
caccugagaagaaaguguacgaagagaguguccuccucucacaugagccagaucagccagaaa

SEQ ID NO: 633889 - RNA, 63 nt, Homo Sapiens
uguagaguguggaaaggaguugcugauugcauuuccucucauuaacaauuggguguguaauaa

SEQ ID NO: 633890 - RNA, 63 nt, Homo Sapiens
gucuuggaugccauccugcucaucuccagcauuuccucucaccuccguguucucggggagugc

SEQ ID NO: 633891 - RNA, 63 nt, Homo Sapiens
gugucagaucccauccugcucaucuccagcauuuccucucaccucuguguucucggggagugc

SEQ ID NO: 633892 - RNA, 63 nt, Homo Sapiens
gugucagaucccauccugcuccucuccagcauuuccucucaccuccguguucucggggagugc

SEQ ID NO: 633893 - RNA, 63 nt, Homo Sapiens
gugucagaucccauccugcuccucuccagaguuuccucucaccuccguguucucggggagugc

SEQ ID NO: 633894 - RNA, 63 nt, Homo Sapiens
augcaggugacauuuguucauucucuaaucccauccucucacccauccauuuccucacucagu

SEQ ID NO: 633895 - RNA, 63 nt, Homo Sapiens
gccucugccuugggccucgccucuguccucagguccucucagaggcagauaccuaggggagcu

SEQ ID NO: 633896 - RNA, 63 nt, Homo Sapiens
ccaaaucuccuccuuccacaccugcugccagucuccucucaagcaagccuccugaaccacugg

SEQ ID NO: 633897 - RNA, 63 nt, Homo Sapiens
gaggaaggcaggggauuuaggaucgcccucccauccucucacccacuggaccccguaggaguc

SEQ ID NO: 633898 - RNA, 63 nt, Homo Sapiens
gguaccccaccuacuuagggugaaauguggcaguccucucagguaggcaccccucuuccuuaa

SEQ ID NO: 633899 - RNA, 63 nt, Homo Sapiens
uugggaccgagggggugggggguggaaacacuguccucucaucgagggacucuaagaaccuaa

SEQ ID NO: 633900 - RNA, 63 nt, Homo Sapiens
gaacuaaugcucugaaaaggggaccucuuuuuuuccucucagguuuaugaaagcaauugguua

SEQ ID NO: 633901 - RNA, 63 nt, Homo Sapiens
uguaaaagaugaacucuuuguccuucgauguuuuccucucagugagagaggaguuuuauuucc

SEQ ID NO: 633902 - RNA, 63 nt, Homo Sapiens
gcaaaugaaacgguauauuauuucuuugcagucuccucucagucauucaucaauguggccagc

SEQ ID NO: 633903 - RNA, 63 nt, Homo Sapiens
ucugucugcagaacuuucaggaugacuauuaauuccucucagaugucauuuuugaguggucca

SEQ ID NO: 633904 - RNA, 63 nt, Homo Sapiens
ccccuagagcaggaaagagggaagguacagggguccucucagccuugaaggagcccacugcuc

SEQ ID NO: 633905 - RNA, 63 nt, Homo Sapiens
uucucaucugcagguuggcuagaagugguggcauccucucacucuguaauuguaaucucagcu

SEQ ID NO: 633906 - RNA, 63 nt, Homo Sapiens
acugaccaaacacauggaacucugaauuauucuuccucucaugucucucuuguuuccucucac

SEQ ID NO: 633907 - RNA, 63 nt, Homo Sapiens
cugaauuauucuuccucucaaaucucucuuguuuccucucacucuucccugagggcugccuag

SEQ ID NO: 633908 - RNA, 63 nt, Homo Sapiens
acacaucccaaauaccaccaccaaccaccuucuuccucucaacucugucccacaggccugucu

SEQ ID NO: 633909 - RNA, 63 nt, Homo Sapiens
gaaggccauuucaagcgcugcuucucacuccauuccucucagcuguuauugcugcagggccaa

SEQ ID NO: 633910 - RNA, 63 nt, Homo Sapiens
cuaaggacuucagacaccauguccgaaaccuguuccucucaagugcccuguuguguggaacac

SEQ ID NO: 633911 - RNA, 63 nt, Homo Sapiens
uaaggaaugcauuaugggucaaaaaucaaacauuccucucauguuauguauauuuuguuccug

SEQ ID NO: 633912 - RNA, 63 nt, Homo Sapiens
agcacaagugcauacuaggaucugauguaugaguccucucagaaauauuuuuccccacaauug

SEQ ID NO: 633913 - RNA, 63 nt, Homo Sapiens
aaggaaauauuuuuccccacauguucagagaauuccucucauugcuuccaaaccucacugagc

SEQ ID NO: 633914 - RNA, 64 nt, Homo Sapiens; identical to SEQ ID NO: 91381

SEQ ID NO: 633915 - RNA, 64 nt, Homo Sapiens; identical to SEQ ID NO: 91382

SEQ ID NO: 633916 - RNA, 64 nt, Homo Sapiens; identical to SEQ ID NO: 91383

SEQ ID NO: 633917 - RNA, 64 nt, Homo Sapiens; identical to SEQ ID NO: 91384

SEQ ID NO: 633918 - RNA, 64 nt, Homo Sapiens; identical to SEQ ID NO: 91385

SEQ ID NO: 633919 - RNA, 64 nt, Homo Sapiens; identical to SEQ ID NO: 91386

SEQ ID NO: 633920 - RNA, 64 nt, Homo Sapiens; identical to SEQ ID NO: 245291

SEQ ID NO: 633921 - RNA, 64 nt, Homo Sapiens; identical to SEQ ID NO: 245292

SEQ ID NO: 633922 - RNA, 64 nt, Homo Sapiens; identical to SEQ ID NO: 245293

SEQ ID NO: 633923 - RNA, 64 nt, Homo Sapiens; identical to SEQ ID NO: 245294

SEQ ID NO: 633924 - RNA, 64 nt, Homo Sapiens
gggucuccccagaggggccggcgggggcuggggaggggguaaguuuauccaugcagacaccaag

SEQ ID NO: 633925 - RNA, 64 nt, Homo Sapiens
agagcgucuccagccccaucuccuaacgggggcuggggguaagagaaaucuaacugcgcucccc

SEQ ID NO: 633926 - RNA, 64 nt, Homo Sapiens
auucaguagauuuuuguuuggcaucauguugaagcaccgaaagauaaaugauuuuuaaaaggcu

SEQ ID NO: 633927 - RNA, 64 nt, Homo Sapiens
ccauacugcaccguacaugccagcguacccauugcaccgaaagcaggcccuuagggcaggaagg

SEQ ID NO: 633928 - RNA, 64 nt, Homo Sapiens
caacuggaauugagguugcacacugugauuuuuacaccgaaaagccaaaaggagcuggccaucc

SEQ ID NO: 633929 - RNA, 64 nt, Homo Sapiens
uuaugaugacagcccacuugucaaauauguaauucaccgaaaccacaccaaguccugcuacugu

SEQ ID NO: 633930 - RNA, 64 nt, Homo Sapiens
uuccuuuugauaauuuuuuaaguuuccagcucuucaccgaaauguuguauucuuauuucagugu

SEQ ID NO: 633931 - RNA, 64 nt, Homo Sapiens
cuuggaauugcaucccaaggcaaagcuuuuggcucaccgaaagcucacagauugcagaaauuag

SEQ ID NO: 633932 - RNA, 64 nt, Homo Sapiens
acgugagugagaugagccaaaccucauccucggccaccgaaacccucgcuucaggaagaaaagu

SEQ ID NO: 633933 - RNA, 64 nt, Homo Sapiens
uagaucaaaguccagaucuaguuccaagucugggcaccgaaagagagcaucaaaaucaccaaga

SEQ ID NO: 633934 - RNA, 64 nt, Homo Sapiens
aacacugucucaucgcugaaauaagaggccauagcaccgaaaagcagcgugggcgccggcugag

SEQ ID NO: 633935 - RNA, 64 nt, Homo Sapiens
ugcaggcauucucacucacaucuccgccccugaccaccgaaacggggaaucuggaguacaggcc

SEQ ID NO: 633936 - RNA, 64 nt, Homo Sapiens
uaagauuccaaagaacuuagauucauuucuucaacaccgaaaugcuggagguguuugaucaguu

SEQ ID NO: 633937 - RNA, 64 nt, Homo Sapiens
uugcaguguauaagguggaagccuaaagaaaucucaccgaaacuuacugcugaaugauuacauu

SEQ ID NO: 633938 - RNA, 64 nt, Homo Sapiens
guuaauauuugaaauaagucuuuuuccauucaggcaccgaaauaucucugagcuaauguuuaua

SEQ ID NO: 633939 - RNA, 64 nt, Homo Sapiens
ggccuugauaucaccucugggacugugccuugcucaccgaaacccgcgcccaggaguauggcug

SEQ ID NO: 633940 - RNA, 64 nt, Homo Sapiens
gagggcuugggaaucccugaaagucauacuuuuccaccgaaaggaguaauggguuugcagugau

SEQ ID NO: 633941 - RNA, 64 nt, Homo Sapiens
ugcaaagccugucuuccgcucaguucacuaaaagcaccgaaaucaaaaaguuuacggaaaacac

SEQ ID NO: 633942 - RNA, 62 nt, Homo Sapiens
accucacgccucucauucguuuaaaugucugcuacaccgaaacaggaguuggcaaauaagaa

SEQ ID NO: 633943 - RNA, 64 nt, Homo Sapiens
cagauagcucagggacugcugcuuaagagagaaacaccgaaauuaucauccuccaaagcaagag

SEQ ID NO: 633944 - RNA, 64 nt, Homo Sapiens
accugggagauaaaauucaauuugccugcaggugcaccgaaaggugcccuuccgccccccacac

SEQ ID NO: 633945 - RNA, 64 nt, Homo Sapiens
gacauuucuaccuaggcaauuguaucacugaggccaccgaaaagaugaccauaaacaguaucaa

SEQ ID NO: 633946 - RNA, 64 nt, Homo Sapiens
cauauaggccauuuuagaaggccaaggagagccacaccgaaaaaggagacaguuccugugaucu

SEQ ID NO: 633947 - RNA, 64 nt, Homo Sapiens
uuucacucuugguuuucaggauauaacagcacuucaccgaaauauucuuucagccauaccacug

SEQ ID NO: 633948 - RNA, 64 nt, Homo Sapiens
ucuuguuuuguugcgacauaagauuaacuauuugcaccgaaaugcaaauggaaaaaaagaggaa

SEQ ID NO: 633949 - RNA, 64 nt, Homo Sapiens
ggugccgccggcccccacucaauggggagaaagucaccgaaauguggcaauucuguuuacauga

SEQ ID NO: 633950 - RNA, 64 nt, Homo Sapiens
ugacagccccuuuacagguuacaucauugcaguccaccgaaaaaugguuaguuaaauguuaggc

SEQ ID NO: 633951 - RNA, 51 nt, Homo Sapiens
gaguguuuuguuguuucagaacaccgaaaagcuuuggaggauuucacucuu

SEQ ID NO: 633952 - RNA, 64 nt, Homo Sapiens
ucccauaaacuuaagugccucuaugauccucuaacaccgaaauugaauggcuuaaacuaauuug

SEQ ID NO: 633953 - RNA, 64 nt, Homo Sapiens
guguaccaacgaauucaccauaaacagcugggcacaccgaaacagcucugcuagucaggauuga

SEQ ID NO: 633954 - RNA, 64 nt, Homo Sapiens
gacuuuagcugaagaggaggacugcagccugugacaccgaaagagggagggcuuuagcaaugag

SEQ ID NO: 633955 - RNA, 64 nt, Homo Sapiens
cuccaucugcuccagggggacacugaugcagucccaccgaaagcaugaagaccuuucccuccac

SEQ ID NO: 633956 - RNA, 64 nt, Homo Sapiens
ccgugaagaaaggcuuugacuccccaaccaaguccaccgaaaguguaugugggcuuugcaaccc

SEQ ID NO: 633957 - RNA, 64 nt, Homo Sapiens
acagguuccaaagucuaccuuccuccgggacagucaccgaaaacuccugguaccccacauccuc

SEQ ID NO: 633958 - RNA, 64 nt, Homo Sapiens
aacaagcacguggugagaggacauggucuuaacucaccgaaauaccucugagauggaauugaua

SEQ ID NO: 633959 - RNA, 64 nt, Homo Sapiens
gagaauggaaaaaucccccagcccagcccagccccaccgaaaagcaaaaauuacacgucgucag

SEQ ID NO: 633960 - RNA, 64 nt, Homo Sapiens
cagucccugugcugguuagacacggagcgcugcacaccgaaagcccaaauugggagcucugccu

SEQ ID NO: 633961 - RNA, 64 nt, Homo Sapiens
ccucaggucccuuggucagguaggugaaagaaaccaccgaaaucgucagccaauccgauugccu

SEQ ID NO: 633962 - RNA, 64 nt, Homo Sapiens
ucccugucgggcuccuccgacuccucgggcuggacaccgaaaccucccuucuuaaagcguguga

SEQ ID NO: 633963 - RNA, 64 nt, Homo Sapiens
ggcucaaaaauaaacguauguguucauauucgaucaccgaaaugagaguucuuaauugcuaauu

SEQ ID NO: 633964 - RNA, 64 nt, Homo Sapiens
ucaggggagcacagaagccccccccaucagggcccaccgaaagcugugaaauggcuugucuccu

SEQ ID NO: 633965 - RNA, 64 nt, Homo Sapiens
ccauauaccuuuuaaguuugacaaaggucuccuucaccgaaaaccaaggacaccacuggaacuc

SEQ ID NO: 633966 - RNA, 64 nt, Homo Sapiens
acacaaccuccuccuccucuuccagcaaggaacgcaccgaaaagucacaugaugagaaauaugg

SEQ ID NO: 633967 - RNA, 64 nt, Homo Sapiens
ugauaauuguauuauuuucuccgaaaacuucacucaccgaaaggucgauagauugaggcuacuc

SEQ ID NO: 633968 - RNA, 64 nt, Homo Sapiens
ucauaagagccacaggucuuuauguugagucgcgcaccgaaaaacuaaaaauaaugggcgcuuu

SEQ ID NO: 633969 - RNA, 64 nt, Homo Sapiens
agaaaagaaaucuguuucuaucacuccauugacccaccgaaaaaauuaugucaguggugaaaug

SEQ ID NO: 633970 - RNA, 64 nt, Homo Sapiens; identical to SEQ ID NO: 265328

SEQ ID NO: 633971 - RNA, 64 nt, Homo Sapiens; identical to SEQ ID NO: 265329

SEQ ID NO: 633972 - RNA, 64 nt, Homo Sapiens; identical to SEQ ID NO: 265330

SEQ ID NO: 633973 - RNA, 64 nt, Homo Sapiens; identical to SEQ ID NO: 265331

SEQ ID NO: 633974 - RNA, 64 nt, Homo Sapiens; identical to SEQ ID NO: 265332

SEQ ID NO: 633975 - RNA, 64 nt, Homo Sapiens; identical to SEQ ID NO: 265333

SEQ ID NO: 633976 - RNA, 64 nt, Homo Sapiens; identical to SEQ ID NO: 265334

SEQ ID NO: 633977 - RNA, 64 nt, Homo Sapiens; identical to SEQ ID NO: 265335

SEQ ID NO: 633978 - RNA, 64 nt, Homo Sapiens; identical to SEQ ID NO: 265336

SEQ ID NO: 633979 - RNA, 64 nt, Homo Sapiens; identical to SEQ ID NO: 265337

SEQ ID NO: 633980 - RNA, 64 nt, Homo Sapiens; identical to SEQ ID NO: 265338

SEQ ID NO: 633981 - RNA, 64 nt, Homo Sapiens; identical to SEQ ID NO: 265339

SEQ ID NO: 633982 - RNA, 64 nt, Homo Sapiens; identical to SEQ ID NO: 265340

SEQ ID NO: 633983 - RNA, 64 nt, Homo Sapiens; identical to SEQ ID NO: 265341

SEQ ID NO: 633984 - RNA, 64 nt, Homo Sapiens; identical to SEQ ID NO: 265342

SEQ ID NO: 633985 - RNA, 64 nt, Homo Sapiens; identical to SEQ ID NO: 265343

SEQ ID NO: 633986 - RNA, 64 nt, Homo Sapiens; identical to SEQ ID NO: 265344

SEQ ID NO: 633987 - RNA, 64 nt, Homo Sapiens; identical to SEQ ID NO: 265345

SEQ ID NO: 633988 - RNA, 64 nt, Homo Sapiens; identical to SEQ ID NO: 265346

SEQ ID NO: 633989 - RNA, 64 nt, Homo Sapiens; identical to SEQ ID NO: 265347

SEQ ID NO: 633990 - RNA, 64 nt, Homo Sapiens; identical to SEQ ID NO: 265348

SEQ ID NO: 633991 - RNA, 64 nt, Homo Sapiens; identical to SEQ ID NO: 265349

SEQ ID NO: 633992 - RNA, 64 nt, Homo Sapiens; identical to SEQ ID NO: 265350

SEQ ID NO: 633993 - RNA, 64 nt, Homo Sapiens; identical to SEQ ID NO: 265351

SEQ ID NO: 633994 - RNA, 64 nt, Homo Sapiens; identical to SEQ ID NO: 265352

SEQ ID NO: 633995 - RNA, 64 nt, Homo Sapiens; identical to SEQ ID NO: 265353

SEQ ID NO: 633996 - RNA, 64 nt, Homo Sapiens; identical to SEQ ID NO: 265354

SEQ ID NO: 633997 - RNA, 64 nt, Homo Sapiens; identical to SEQ ID NO: 265355

SEQ ID NO: 633998 - RNA, 64 nt, Homo Sapiens; identical to SEQ ID NO: 265356

SEQ ID NO: 633999 - RNA, 64 nt, Homo Sapiens; identical to SEQ ID NO: 265357

SEQ ID NO: 634000 - RNA, 64 nt, Homo Sapiens; identical to SEQ ID NO: 265358

SEQ ID NO: 634001 - RNA, 64 nt, Homo Sapiens; identical to SEQ ID NO: 265359

SEQ ID NO: 634002 - RNA, 64 nt, Homo Sapiens; identical to SEQ ID NO: 265360

SEQ ID NO: 634003 - RNA, 64 nt, Homo Sapiens; identical to SEQ ID NO: 265361

SEQ ID NO: 634004 - RNA, 64 nt, Homo Sapiens; identical to SEQ ID NO: 265362

SEQ ID NO: 634005 - RNA, 64 nt, Homo Sapiens; identical to SEQ ID NO: 265363

SEQ ID NO: 634006 - RNA, 64 nt, Homo Sapiens; identical to SEQ ID NO: 265364

SEQ ID NO: 634007 - RNA, 64 nt, Homo Sapiens; identical to SEQ ID NO: 265365

SEQ ID NO: 634008 - RNA, 64 nt, Homo Sapiens; identical to SEQ ID NO: 265366

SEQ ID NO: 634009 - RNA, 64 nt, Homo Sapiens; identical to SEQ ID NO: 265367

SEQ ID NO: 634010 - RNA, 64 nt, Homo Sapiens; identical to SEQ ID NO: 265368

SEQ ID NO: 634011 - RNA, 64 nt, Homo Sapiens; identical to SEQ ID NO: 265369

SEQ ID NO: 634012 - RNA, 64 nt, Homo Sapiens; identical to SEQ ID NO: 265370

SEQ ID NO: 634013 - RNA, 64 nt, Homo Sapiens; identical to SEQ ID NO: 265371

SEQ ID NO: 634014 - RNA, 64 nt, Homo Sapiens; identical to SEQ ID NO: 265372

SEQ ID NO: 634015 - RNA, 64 nt, Homo Sapiens; identical to SEQ ID NO: 265373

SEQ ID NO: 634016 - RNA, 64 nt, Homo Sapiens; identical to SEQ ID NO: 265374

SEQ ID NO: 634017 - RNA, 64 nt, Homo Sapiens; identical to SEQ ID NO: 265375

SEQ ID NO: 634018 - RNA, 64 nt, Homo Sapiens; identical to SEQ ID NO: 265376

SEQ ID NO: 634019 - RNA, 64 nt, Homo Sapiens; identical to SEQ ID NO: 265377

SEQ ID NO: 634020 - RNA, 64 nt, Homo Sapiens; identical to SEQ ID NO: 265378

SEQ ID NO: 634021 - RNA, 64 nt, Homo Sapiens; identical to SEQ ID NO: 265379

SEQ ID NO: 634022 - RNA, 64 nt, Homo Sapiens; identical to SEQ ID NO: 265380

SEQ ID NO: 634023 - RNA, 64 nt, Homo Sapiens; identical to SEQ ID NO: 265381

SEQ ID NO: 634024 - RNA, 64 nt, Homo Sapiens; identical to SEQ ID NO: 265382

SEQ ID NO: 634025 - RNA, 64 nt, Homo Sapiens; identical to SEQ ID NO: 265383

SEQ ID NO: 634026 - RNA, 64 nt, Homo Sapiens; identical to SEQ ID NO: 265384

SEQ ID NO: 634027 - RNA, 64 nt, Homo Sapiens; identical to SEQ ID NO: 265385

SEQ ID NO: 634028 - RNA, 64 nt, Homo Sapiens; identical to SEQ ID NO: 265386

SEQ ID NO: 634029 - RNA, 64 nt, Homo Sapiens; identical to SEQ ID NO: 265387

SEQ ID NO: 634030 - RNA, 64 nt, Homo Sapiens; identical to SEQ ID NO: 265388

SEQ ID NO: 634031 - RNA, 64 nt, Homo Sapiens; identical to SEQ ID NO: 265389

SEQ ID NO: 634032 - RNA, 64 nt, Homo Sapiens; identical to SEQ ID NO: 265390

SEQ ID NO: 634033 - RNA, 64 nt, Homo Sapiens; identical to SEQ ID NO: 265391

SEQ ID NO: 634034 - RNA, 64 nt, Homo Sapiens; identical to SEQ ID NO: 265392

SEQ ID NO: 634035 - RNA, 64 nt, Homo Sapiens; identical to SEQ ID NO: 265393

SEQ ID NO: 634036 - RNA, 64 nt, Homo Sapiens; identical to SEQ ID NO: 265394

SEQ ID NO: 634037 - RNA, 64 nt, Homo Sapiens; identical to SEQ ID NO: 265395

SEQ ID NO: 634038 - RNA, 64 nt, Homo Sapiens; identical to SEQ ID NO: 265396

SEQ ID NO: 634039 - RNA, 64 nt, Homo Sapiens; identical to SEQ ID NO: 265397

SEQ ID NO: 634040 - RNA, 64 nt, Homo Sapiens; identical to SEQ ID NO: 265398

SEQ ID NO: 634041 - RNA, 64 nt, Homo Sapiens; identical to SEQ ID NO: 265399

SEQ ID NO: 634042 - RNA, 64 nt, Homo Sapiens; identical to SEQ ID NO: 265400

SEQ ID NO: 634043 - RNA, 64 nt, Homo Sapiens; identical to SEQ ID NO: 265401

SEQ ID NO: 634044 - RNA, 64 nt, Homo Sapiens; identical to SEQ ID NO: 265402

SEQ ID NO: 634045 - RNA, 64 nt, Homo Sapiens; identical to SEQ ID NO: 265403

SEQ ID NO: 634046 - RNA, 64 nt, Homo Sapiens; identical to SEQ ID NO: 265404

SEQ ID NO: 634047 - RNA, 64 nt, Homo Sapiens; identical to SEQ ID NO: 265405

SEQ ID NO: 634048 - RNA, 64 nt, Homo Sapiens; identical to SEQ ID NO: 265406

SEQ ID NO: 634049 - RNA, 64 nt, Homo Sapiens; identical to SEQ ID NO: 265407

SEQ ID NO: 634050 - RNA, 64 nt, Homo Sapiens; identical to SEQ ID NO: 265408

SEQ ID NO: 634051 - RNA, 64 nt, Homo Sapiens; identical to SEQ ID NO: 265409

SEQ ID NO: 634052 - RNA, 64 nt, Homo Sapiens; identical to SEQ ID NO: 265410

SEQ ID NO: 634053 - RNA, 64 nt, Homo Sapiens; identical to SEQ ID NO: 265411

SEQ ID NO: 634054 - RNA, 64 nt, Homo Sapiens; identical to SEQ ID NO: 265412

SEQ ID NO: 634055 - RNA, 64 nt, Homo Sapiens; identical to SEQ ID NO: 265413

SEQ ID NO: 634056 - RNA, 64 nt, Homo Sapiens; identical to SEQ ID NO: 265414

SEQ ID NO: 634057 - RNA, 64 nt, Homo Sapiens; identical to SEQ ID NO: 265415

SEQ ID NO: 634058 - RNA, 64 nt, Homo Sapiens; identical to SEQ ID NO: 265416

SEQ ID NO: 634059 - RNA, 64 nt, Homo Sapiens; identical to SEQ ID NO: 265417

SEQ ID NO: 634060 - RNA, 64 nt, Homo Sapiens; identical to SEQ ID NO: 265418

SEQ ID NO: 634061 - RNA, 64 nt, Homo Sapiens; identical to SEQ ID NO: 265419

SEQ ID NO: 634062 - RNA, 63 nt, Homo Sapiens; identical to SEQ ID NO: 265420

SEQ ID NO: 634063 - RNA, 64 nt, Homo Sapiens; identical to SEQ ID NO: 265421

SEQ ID NO: 634064 - RNA, 64 nt, Homo Sapiens; identical to SEQ ID NO: 265422

SEQ ID NO: 634065 - RNA, 64 nt, Homo Sapiens; identical to SEQ ID NO: 265423

SEQ ID NO: 634066 - RNA, 64 nt, Homo Sapiens; identical to SEQ ID NO: 265424

SEQ ID NO: 634067 - RNA, 64 nt, Homo Sapiens; identical to SEQ ID NO: 265425

SEQ ID NO: 634068 - RNA, 64 nt, Homo Sapiens; identical to SEQ ID NO: 265426

SEQ ID NO: 634069 - RNA, 64 nt, Homo Sapiens; identical to SEQ ID NO: 265427

SEQ ID NO: 634070 - RNA, 64 nt, Homo Sapiens; identical to SEQ ID NO: 265428

SEQ ID NO: 634071 - RNA, 64 nt, Homo Sapiens; identical to SEQ ID NO: 265429

SEQ ID NO: 634072 - RNA, 64 nt, Homo Sapiens; identical to SEQ ID NO: 265430

SEQ ID NO: 634073 - RNA, 64 nt, Homo Sapiens; identical to SEQ ID NO: 265431

SEQ ID NO: 634074 - RNA, 64 nt, Homo Sapiens; identical to SEQ ID NO: 265432

SEQ ID NO: 634075 - RNA, 64 nt, Homo Sapiens; identical to SEQ ID NO: 265433

SEQ ID NO: 634076 - RNA, 64 nt, Homo Sapiens; identical to SEQ ID NO: 265434

SEQ ID NO: 634077 - RNA, 64 nt, Homo Sapiens; identical to SEQ ID NO: 265435

SEQ ID NO: 634078 - RNA, 64 nt, Homo Sapiens; identical to SEQ ID NO: 265436

SEQ ID NO: 634079 - RNA, 64 nt, Homo Sapiens; identical to SEQ ID NO: 265437

SEQ ID NO: 634080 - RNA, 64 nt, Homo Sapiens; identical to SEQ ID NO: 265438

SEQ ID NO: 634081 - RNA, 64 nt, Homo Sapiens; identical to SEQ ID NO: 265439

SEQ ID NO: 634082 - RNA, 64 nt, Homo Sapiens; identical to SEQ ID NO: 265440

SEQ ID NO: 634083 - RNA, 64 nt, Homo Sapiens; identical to SEQ ID NO: 265441

SEQ ID NO: 634084 - RNA, 64 nt, Homo Sapiens; identical to SEQ ID NO: 265442

SEQ ID NO: 634085 - RNA, 64 nt, Homo Sapiens; identical to SEQ ID NO: 265443

SEQ ID NO: 634086 - RNA, 64 nt, Homo Sapiens; identical to SEQ ID NO: 265444

SEQ ID NO: 634087 - RNA, 64 nt, Homo Sapiens; identical to SEQ ID NO: 265445

SEQ ID NO: 634088 - RNA, 64 nt, Homo Sapiens; identical to SEQ ID NO: 265446

SEQ ID NO: 634089 - RNA, 64 nt, Homo Sapiens; identical to SEQ ID NO: 265447

SEQ ID NO: 634090 - RNA, 64 nt, Homo Sapiens; identical to SEQ ID NO: 265448

SEQ ID NO: 634091 - RNA, 64 nt, Homo Sapiens; identical to SEQ ID NO: 265449

SEQ ID NO: 634092 - RNA, 64 nt, Homo Sapiens; identical to SEQ ID NO: 265450

SEQ ID NO: 634093 - RNA, 50 nt, Homo Sapiens; identical to SEQ ID NO: 265451

SEQ ID NO: 634094 - RNA, 64 nt, Homo Sapiens; identical to SEQ ID NO: 265452

SEQ ID NO: 634095 - RNA, 64 nt, Homo Sapiens; identical to SEQ ID NO: 265453

SEQ ID NO: 634096 - RNA, 64 nt, Homo Sapiens; identical to SEQ ID NO: 265454

SEQ ID NO: 634097 - RNA, 64 nt, Homo Sapiens; identical to SEQ ID NO: 265455

SEQ ID NO: 634098 - RNA, 64 nt, Homo Sapiens; identical to SEQ ID NO: 265456

SEQ ID NO: 634099 - RNA, 64 nt, Homo Sapiens; identical to SEQ ID NO: 265457

SEQ ID NO: 634100 - RNA, 64 nt, Homo Sapiens; identical to SEQ ID NO: 265458

SEQ ID NO: 634101 - RNA, 64 nt, Homo Sapiens; identical to SEQ ID NO: 265459

SEQ ID NO: 634102 - RNA, 64 nt, Homo Sapiens; identical to SEQ ID NO: 265460

SEQ ID NO: 634103 - RNA, 64 nt, Homo Sapiens; identical to SEQ ID NO: 265461

SEQ ID NO: 634104 - RNA, 64 nt, Homo Sapiens; identical to SEQ ID NO: 265462

SEQ ID NO: 634105 - RNA, 64 nt, Homo Sapiens; identical to SEQ ID NO: 265463

SEQ ID NO: 634106 - RNA, 64 nt, Homo Sapiens; identical to SEQ ID NO: 265464

SEQ ID NO: 634107 - RNA, 64 nt, Homo Sapiens; identical to SEQ ID NO: 113285

SEQ ID NO: 634108 - RNA, 64 nt, Homo Sapiens; identical to SEQ ID NO: 113286

SEQ ID NO: 634109 - RNA, 64 nt, Homo Sapiens; identical to SEQ ID NO: 113287

SEQ ID NO: 634110 - RNA, 64 nt, Homo Sapiens; identical to SEQ ID NO: 113288

SEQ ID NO: 634111 - RNA, 64 nt, Homo Sapiens; identical to SEQ ID NO: 113289

SEQ ID NO: 634112 - RNA, 64 nt, Homo Sapiens; identical to SEQ ID NO: 113290

SEQ ID NO: 634113 - RNA, 64 nt, Homo Sapiens; identical to SEQ ID NO: 113291

SEQ ID NO: 634114 - RNA, 64 nt, Homo Sapiens; identical to SEQ ID NO: 113292

SEQ ID NO: 634115 - RNA, 64 nt, Homo Sapiens; identical to SEQ ID NO: 113293

SEQ ID NO: 634116 - RNA, 64 nt, Homo Sapiens; identical to SEQ ID NO: 113294

SEQ ID NO: 634117 - RNA, 64 nt, Homo Sapiens; identical to SEQ ID NO: 113295

SEQ ID NO: 634118 - RNA, 64 nt, Homo Sapiens; identical to SEQ ID NO: 113296

SEQ ID NO: 634119 - RNA, 64 nt, Homo Sapiens; identical to SEQ ID NO: 113297

SEQ ID NO: 634120 - RNA, 64 nt, Homo Sapiens; identical to SEQ ID NO: 113298

SEQ ID NO: 634121 - RNA, 64 nt, Homo Sapiens; identical to SEQ ID NO: 113299

SEQ ID NO: 634122 - RNA, 64 nt, Homo Sapiens; identical to SEQ ID NO: 113300

SEQ ID NO: 634123 - RNA, 64 nt, Homo Sapiens; identical to SEQ ID NO: 113301

SEQ ID NO: 634124 - RNA, 64 nt, Homo Sapiens; identical to SEQ ID NO: 113302

SEQ ID NO: 634125 - RNA, 64 nt, Homo Sapiens; identical to SEQ ID NO: 113303

SEQ ID NO: 634126 - RNA, 64 nt, Homo Sapiens; identical to SEQ ID NO: 113304

SEQ ID NO: 634127 - RNA, 64 nt, Homo Sapiens; identical to SEQ ID NO: 113305

SEQ ID NO: 634128 - RNA, 64 nt, Homo Sapiens; identical to SEQ ID NO: 113306

SEQ ID NO: 634129 - RNA, 64 nt, Homo Sapiens; identical to SEQ ID NO: 113307

SEQ ID NO: 634130 - RNA, 64 nt, Homo Sapiens; identical to SEQ ID NO: 113308

SEQ ID NO: 634131 - RNA, 64 nt, Homo Sapiens; identical to SEQ ID NO: 113309

SEQ ID NO: 634132 - RNA, 64 nt, Homo Sapiens; identical to SEQ ID NO: 113310

SEQ ID NO: 634133 - RNA, 64 nt, Homo Sapiens; identical to SEQ ID NO: 113311

SEQ ID NO: 634134 - RNA, 64 nt, Homo Sapiens; identical to SEQ ID NO: 113312

SEQ ID NO: 634135 - RNA, 64 nt, Homo Sapiens; identical to SEQ ID NO: 113313

SEQ ID NO: 634136 - RNA, 64 nt, Homo Sapiens; identical to SEQ ID NO: 113314

SEQ ID NO: 634137 - RNA, 64 nt, Homo Sapiens; identical to SEQ ID NO: 113315

SEQ ID NO: 634138 - RNA, 64 nt, Homo Sapiens; identical to SEQ ID NO: 113316

SEQ ID NO: 634139 - RNA, 64 nt, Homo Sapiens; identical to SEQ ID NO: 113317

SEQ ID NO: 634140 - RNA, 64 nt, Homo Sapiens; identical to SEQ ID NO: 113318

SEQ ID NO: 634141 - RNA, 64 nt, Homo Sapiens; identical to SEQ ID NO: 113319

SEQ ID NO: 634142 - RNA, 64 nt, Homo Sapiens; identical to SEQ ID NO: 113320

SEQ ID NO: 634143 - RNA, 64 nt, Homo Sapiens; identical to SEQ ID NO: 113321

SEQ ID NO: 634144 - RNA, 64 nt, Homo Sapiens; identical to SEQ ID NO: 113322

SEQ ID NO: 634145 - RNA, 64 nt, Homo Sapiens; identical to SEQ ID NO: 113323

SEQ ID NO: 634146 - RNA, 64 nt, Homo Sapiens; identical to SEQ ID NO: 113324

SEQ ID NO: 634147 - RNA, 64 nt, Homo Sapiens
cagcccuauacuuuggggaucauuugccuaccauggcauauauuugaaauugcuuuggacaagu

SEQ ID NO: 634148 - RNA, 64 nt, Homo Sapiens
aacacauuuucuaugcaugugucucuguguauauggcauauaccuaguaaguauguuucuguaa

SEQ ID NO: 634149 - RNA, 64 nt, Homo Sapiens
uggcccuggcccacauugcacauggaaacccaaaggcauauaucugcguaugugugguacuuag

SEQ ID NO: 634150 - RNA, 64 nt, Homo Sapiens
aggaaaaaaaaagucauguauauauacacauaaaggcauauagcuauauauaaagagauaaggg

SEQ ID NO: 634151 - RNA, 64 nt, Homo Sapiens
gcacuccugaauuuuaucaaacacacuuccagcuggcauauagguugcagucucggccucgugg

SEQ ID NO: 634152 - RNA, 64 nt, Homo Sapiens
ugaaguuguaaacacagugugguuauggggagagggcauauaaauuccccauauuuguguucag

SEQ ID NO: 634153 - RNA, 64 nt, Homo Sapiens
ugguauaaaugacuguagcuauguaacuaucggaggcauauacgaccaaaaacccaaacacccu

SEQ ID NO: 634154 - RNA, 64 nt, Homo Sapiens
guauaugccaagaacacuacuggaaguggucugaggcauauagauuagcugaauagaaagaaug

SEQ ID NO: 634155 - RNA, 64 nt, Homo Sapiens
aaagucaaaaaucaaaaucaccaggacccacuggggcauauaaaucccaguugagcucccaaga

SEQ ID NO: 634156 - RNA, 64 nt, Homo Sapiens
aucucugcuguauccuuucgccaggacccacuggggcauauaaaucccaguugagcucccaaga

SEQ ID NO: 634157 - RNA, 64 nt, Homo Sapiens
uggaagaaacagcgauuuaaauuguauugaacagggcauauaaaaugcauucuguacccugauc

SEQ ID NO: 634158 - RNA, 64 nt, Homo Sapiens
cagggcauauaaaaugcauucuguacccugaucuggcauauagcuucaaaacugcaguggcgag

SEQ ID NO: 634159 - RNA, 64 nt, Homo Sapiens
aagcuuagugaucaggcaagauaaagauaugaaaggcauauauaaauaggaagaggggaaguca

SEQ ID NO: 634160 - RNA, 64 nt, Homo Sapiens
aucaauggaauagguaagagaacccagaaauaaaggcauauaccuacaaccaugugauccucaa

SEQ ID NO: 634161 - RNA, 64 nt, Homo Sapiens; identical to SEQ ID NO: 199403

SEQ ID NO: 634162 - RNA, 64 nt, Homo Sapiens; identical to SEQ ID NO: 199404

SEQ ID NO: 634163 - RNA, 64 nt, Homo Sapiens; identical to SEQ ID NO: 199405

SEQ ID NO: 634164 - RNA, 64 nt, Homo Sapiens; identical to SEQ ID NO: 199406

SEQ ID NO: 634165 - RNA, 64 nt, Homo Sapiens; identical to SEQ ID NO: 199407

SEQ ID NO: 634166 - RNA, 64 nt, Homo Sapiens; identical to SEQ ID NO: 199408

SEQ ID NO: 634167 - RNA, 64 nt, Homo Sapiens; identical to SEQ ID NO: 199409

SEQ ID NO: 634168 - RNA, 64 nt, Homo Sapiens; identical to SEQ ID NO: 199410

SEQ ID NO: 634169 - RNA, 64 nt, Homo Sapiens; identical to SEQ ID NO: 199411

SEQ ID NO: 634170 - RNA, 64 nt, Homo Sapiens; identical to SEQ ID NO: 199412

SEQ ID NO: 634171 - RNA, 64 nt, Homo Sapiens; identical to SEQ ID NO: 199413

SEQ ID NO: 634172 - RNA, 64 nt, Homo Sapiens; identical to SEQ ID NO: 199414

SEQ ID NO: 634173 - RNA, 64 nt, Homo Sapiens; identical to SEQ ID NO: 199415

SEQ ID NO: 634174 - RNA, 64 nt, Homo Sapiens; identical to SEQ ID NO: 199416

SEQ ID NO: 634175 - RNA, 64 nt, Homo Sapiens; identical to SEQ ID NO: 199417

SEQ ID NO: 634176 - RNA, 64 nt, Homo Sapiens; identical to SEQ ID NO: 199418

SEQ ID NO: 634177 - RNA, 64 nt, Homo Sapiens; identical to SEQ ID NO: 199419

SEQ ID NO: 634178 - RNA, 64 nt, Homo Sapiens; identical to SEQ ID NO: 199420

SEQ ID NO: 634179 - RNA, 64 nt, Homo Sapiens; identical to SEQ ID NO: 199421

SEQ ID NO: 634180 - RNA, 64 nt, Homo Sapiens; identical to SEQ ID NO: 199422

SEQ ID NO: 634181 - RNA, 64 nt, Homo Sapiens; identical to SEQ ID NO: 199423

SEQ ID NO: 634182 - RNA, 64 nt, Homo Sapiens; identical to SEQ ID NO: 199424

SEQ ID NO: 634183 - RNA, 64 nt, Homo Sapiens; identical to SEQ ID NO: 199425

SEQ ID NO: 634184 - RNA, 64 nt, Homo Sapiens; identical to SEQ ID NO: 199426

SEQ ID NO: 634185 - RNA, 64 nt, Homo Sapiens; identical to SEQ ID NO: 199427

SEQ ID NO: 634186 - RNA, 64 nt, Homo Sapiens; identical to SEQ ID NO: 199428

SEQ ID NO: 634187 - RNA, 64 nt, Homo Sapiens; identical to SEQ ID NO: 85324

SEQ ID NO: 634188 - RNA, 64 nt, Homo Sapiens; identical to SEQ ID NO: 85325

SEQ ID NO: 634189 - RNA, 64 nt, Homo Sapiens; identical to SEQ ID NO: 85326

SEQ ID NO: 634190 - RNA, 64 nt, Homo Sapiens; identical to SEQ ID NO: 85327

SEQ ID NO: 634191 - RNA, 64 nt, Homo Sapiens; identical to SEQ ID NO: 85328

SEQ ID NO: 634192 - RNA, 64 nt, Homo Sapiens; identical to SEQ ID NO: 85329

SEQ ID NO: 634193 - RNA, 64 nt, Homo Sapiens; identical to SEQ ID NO: 85330

SEQ ID NO: 634194 - RNA, 64 nt, Homo Sapiens; identical to SEQ ID NO: 85331

SEQ ID NO: 634195 - RNA, 64 nt, Homo Sapiens; identical to SEQ ID NO: 85332

SEQ ID NO: 634196 - RNA, 64 nt, Homo Sapiens; identical to SEQ ID NO: 85333

SEQ ID NO: 634197 - RNA, 64 nt, Homo Sapiens; identical to SEQ ID NO: 85334

SEQ ID NO: 634198 - RNA, 64 nt, Homo Sapiens; identical to SEQ ID NO: 85335

SEQ ID NO: 634199 - RNA, 64 nt, Homo Sapiens; identical to SEQ ID NO: 85336

SEQ ID NO: 634200 - RNA, 64 nt, Homo Sapiens; identical to SEQ ID NO: 85337

SEQ ID NO: 634201 - RNA, 64 nt, Homo Sapiens; identical to SEQ ID NO: 85338

SEQ ID NO: 634202 - RNA, 64 nt, Homo Sapiens; identical to SEQ ID NO: 85339

SEQ ID NO: 634203 - RNA, 64 nt, Homo Sapiens; identical to SEQ ID NO: 85340

SEQ ID NO: 634204 - RNA, 64 nt, Homo Sapiens; identical to SEQ ID NO: 85341

SEQ ID NO: 634205 - RNA, 64 nt, Homo Sapiens; identical to SEQ ID NO: 85342

SEQ ID NO: 634206 - RNA, 64 nt, Homo Sapiens; identical to SEQ ID NO: 85343

SEQ ID NO: 634207 - RNA, 64 nt, Homo Sapiens; identical to SEQ ID NO: 85344

SEQ ID NO: 634208 - RNA, 64 nt, Homo Sapiens; identical to SEQ ID NO: 85345

SEQ ID NO: 634209 - RNA, 64 nt, Homo Sapiens; identical to SEQ ID NO: 85346

SEQ ID NO: 634210 - RNA, 64 nt, Homo Sapiens; identical to SEQ ID NO: 85347

SEQ ID NO: 634211 - RNA, 64 nt, Homo Sapiens; identical to SEQ ID NO: 85348

SEQ ID NO: 634212 - RNA, 64 nt, Homo Sapiens; identical to SEQ ID NO: 85349

SEQ ID NO: 634213 - RNA, 64 nt, Homo Sapiens; identical to SEQ ID NO: 85350

SEQ ID NO: 634214 - RNA, 64 nt, Homo Sapiens; identical to SEQ ID NO: 85351

SEQ ID NO: 634215 - RNA, 64 nt, Homo Sapiens; identical to SEQ ID NO: 85352

SEQ ID NO: 634216 - RNA, 64 nt, Homo Sapiens; identical to SEQ ID NO: 85353

SEQ ID NO: 634217 - RNA, 64 nt, Homo Sapiens; identical to SEQ ID NO: 85354

SEQ ID NO: 634218 - RNA, 64 nt, Homo Sapiens; identical to SEQ ID NO: 85355

SEQ ID NO: 634219 - RNA, 64 nt, Homo Sapiens; identical to SEQ ID NO: 85356

SEQ ID NO: 634220 - RNA, 64 nt, Homo Sapiens; identical to SEQ ID NO: 85357

SEQ ID NO: 634221 - RNA, 64 nt, Homo Sapiens; identical to SEQ ID NO: 85358

SEQ ID NO: 634222 - RNA, 64 nt, Homo Sapiens; identical to SEQ ID NO: 85359

SEQ ID NO: 634223 - RNA, 64 nt, Homo Sapiens; identical to SEQ ID NO: 85360

SEQ ID NO: 634224 - RNA, 64 nt, Homo Sapiens; identical to SEQ ID NO: 85361

SEQ ID NO: 634225 - RNA, 64 nt, Homo Sapiens; identical to SEQ ID NO: 85362

SEQ ID NO: 634226 - RNA, 64 nt, Homo Sapiens; identical to SEQ ID NO: 85363

SEQ ID NO: 634227 - RNA, 64 nt, Homo Sapiens; identical to SEQ ID NO: 85364

SEQ ID NO: 634228 - RNA, 64 nt, Homo Sapiens; identical to SEQ ID NO: 85365

SEQ ID NO: 634229 - RNA, 64 nt, Homo Sapiens; identical to SEQ ID NO: 85366

SEQ ID NO: 634230 - RNA, 64 nt, Homo Sapiens; identical to SEQ ID NO: 85367

SEQ ID NO: 634231 - RNA, 64 nt, Homo Sapiens; identical to SEQ ID NO: 85368

SEQ ID NO: 634232 - RNA, 64 nt, Homo Sapiens; identical to SEQ ID NO: 85369

SEQ ID NO: 634233 - RNA, 64 nt, Homo Sapiens; identical to SEQ ID NO: 237127

SEQ ID NO: 634234 - RNA, 64 nt, Homo Sapiens; identical to SEQ ID NO: 237128

SEQ ID NO: 634235 - RNA, 64 nt, Homo Sapiens; identical to SEQ ID NO: 237129

SEQ ID NO: 634236 - RNA, 64 nt, Homo Sapiens; identical to SEQ ID NO: 237130

SEQ ID NO: 634237 - RNA, 64 nt, Homo Sapiens; identical to SEQ ID NO: 237131

SEQ ID NO: 634238 - RNA, 64 nt, Homo Sapiens; identical to SEQ ID NO: 237132

SEQ ID NO: 634239 - RNA, 64 nt, Homo Sapiens; identical to SEQ ID NO: 237133

SEQ ID NO: 634240 - RNA, 64 nt, Homo Sapiens; identical to SEQ ID NO: 237134

SEQ ID NO: 634241 - RNA, 64 nt, Homo Sapiens; identical to SEQ ID NO: 147779

SEQ ID NO: 634242 - RNA, 64 nt, Homo Sapiens; identical to SEQ ID NO: 147780

SEQ ID NO: 634243 - RNA, 64 nt, Homo Sapiens; identical to SEQ ID NO: 147781

SEQ ID NO: 634244 - RNA, 64 nt, Homo Sapiens; identical to SEQ ID NO: 147782

SEQ ID NO: 634245 - RNA, 64 nt, Homo Sapiens; identical to SEQ ID NO: 147783

SEQ ID NO: 634246 - RNA, 64 nt, Homo Sapiens; identical to SEQ ID NO: 147784

SEQ ID NO: 634247 - RNA, 64 nt, Homo Sapiens; identical to SEQ ID NO: 147785

SEQ ID NO: 634248 - RNA, 64 nt, Homo Sapiens; identical to SEQ ID NO: 147786

SEQ ID NO: 634249 - RNA, 64 nt, Homo Sapiens; identical to SEQ ID NO: 147787

SEQ ID NO: 634250 - RNA, 64 nt, Homo Sapiens; identical to SEQ ID NO: 147788

SEQ ID NO: 634251 - RNA, 64 nt, Homo Sapiens; identical to SEQ ID NO: 147789

SEQ ID NO: 634252 - RNA, 64 nt, Homo Sapiens; identical to SEQ ID NO: 147790

SEQ ID NO: 634253 - RNA, 64 nt, Homo Sapiens; identical to SEQ ID NO: 147791

SEQ ID NO: 634254 - RNA, 64 nt, Homo Sapiens; identical to SEQ ID NO: 147792

SEQ ID NO: 634255 - RNA, 64 nt, Homo Sapiens; identical to SEQ ID NO: 147793

SEQ ID NO: 634256 - RNA, 64 nt, Homo Sapiens; identical to SEQ ID NO: 147794

SEQ ID NO: 634257 - RNA, 64 nt, Homo Sapiens; identical to SEQ ID NO: 147795

SEQ ID NO: 634258 - RNA, 64 nt, Homo Sapiens; identical to SEQ ID NO: 147796

SEQ ID NO: 634259 - RNA, 64 nt, Homo Sapiens; identical to SEQ ID NO: 147797

SEQ ID NO: 634260 - RNA, 64 nt, Homo Sapiens; identical to SEQ ID NO: 147798

SEQ ID NO: 634261 - RNA, 64 nt, Homo Sapiens; identical to SEQ ID NO: 147799

SEQ ID NO: 634262 - RNA, 64 nt, Homo Sapiens; identical to SEQ ID NO: 147800

SEQ ID NO: 634263 - RNA, 64 nt, Homo Sapiens; identical to SEQ ID NO: 147801

SEQ ID NO: 634264 - RNA, 64 nt, Homo Sapiens; identical to SEQ ID NO: 147802

SEQ ID NO: 634265 - RNA, 64 nt, Homo Sapiens; identical to SEQ ID NO: 147803

SEQ ID NO: 634266 - RNA, 64 nt, Homo Sapiens; identical to SEQ ID NO: 147804

SEQ ID NO: 634267 - RNA, 64 nt, Homo Sapiens; identical to SEQ ID NO: 147805

SEQ ID NO: 634268 - RNA, 54 nt, Homo Sapiens; identical to SEQ ID NO: 147806

SEQ ID NO: 634269 - RNA, 64 nt, Homo Sapiens; identical to SEQ ID NO: 147807

SEQ ID NO: 634270 - RNA, 64 nt, Homo Sapiens; identical to SEQ ID NO: 147808

SEQ ID NO: 634271 - RNA, 64 nt, Homo Sapiens; identical to SEQ ID NO: 147809

SEQ ID NO: 634272 - RNA, 64 nt, Homo Sapiens; identical to SEQ ID NO: 147810

SEQ ID NO: 634273 - RNA, 64 nt, Homo Sapiens; identical to SEQ ID NO: 147811

SEQ ID NO: 634274 - RNA, 64 nt, Homo Sapiens; identical to SEQ ID NO: 147812

SEQ ID NO: 634275 - RNA, 64 nt, Homo Sapiens; identical to SEQ ID NO: 147813

SEQ ID NO: 634276 - RNA, 64 nt, Homo Sapiens; identical to SEQ ID NO: 147814

SEQ ID NO: 634277 - RNA, 64 nt, Homo Sapiens; identical to SEQ ID NO: 147815

SEQ ID NO: 634278 - RNA, 64 nt, Homo Sapiens; identical to SEQ ID NO: 147816

SEQ ID NO: 634279 - RNA, 64 nt, Homo Sapiens; identical to SEQ ID NO: 147817

SEQ ID NO: 634280 - RNA, 64 nt, Homo Sapiens; identical to SEQ ID NO: 147818

SEQ ID NO: 634281 - RNA, 64 nt, Homo Sapiens; identical to SEQ ID NO: 147819

SEQ ID NO: 634282 - RNA, 64 nt, Homo Sapiens; identical to SEQ ID NO: 147820

SEQ ID NO: 634283 - RNA, 64 nt, Homo Sapiens; identical to SEQ ID NO: 147821

SEQ ID NO: 634284 - RNA, 64 nt, Homo Sapiens; identical to SEQ ID NO: 147822

SEQ ID NO: 634285 - RNA, 64 nt, Homo Sapiens; identical to SEQ ID NO: 147823

SEQ ID NO: 634286 - RNA, 64 nt, Homo Sapiens; identical to SEQ ID NO: 147824

SEQ ID NO: 634287 - RNA, 64 nt, Homo Sapiens; identical to SEQ ID NO: 147825

SEQ ID NO: 634288 - RNA, 64 nt, Homo Sapiens; identical to SEQ ID NO: 147826

SEQ ID NO: 634289 - RNA, 64 nt, Homo Sapiens; identical to SEQ ID NO: 147827

SEQ ID NO: 634290 - RNA, 64 nt, Homo Sapiens; identical to SEQ ID NO: 147828

SEQ ID NO: 634291 - RNA, 64 nt, Homo Sapiens; identical to SEQ ID NO: 147829

SEQ ID NO: 634292 - RNA, 64 nt, Homo Sapiens; identical to SEQ ID NO: 147830

SEQ ID NO: 634293 - RNA, 64 nt, Homo Sapiens; identical to SEQ ID NO: 147831

SEQ ID NO: 634294 - RNA, 64 nt, Homo Sapiens; identical to SEQ ID NO: 147832

SEQ ID NO: 634295 - RNA, 64 nt, Homo Sapiens; identical to SEQ ID NO: 147833

SEQ ID NO: 634296 - RNA, 64 nt, Homo Sapiens; identical to SEQ ID NO: 147834

SEQ ID NO: 634297 - RNA, 64 nt, Homo Sapiens; identical to SEQ ID NO: 147835

SEQ ID NO: 634298 - RNA, 64 nt, Homo Sapiens; identical to SEQ ID NO: 147836

SEQ ID NO: 634299 - RNA, 64 nt, Homo Sapiens; identical to SEQ ID NO: 147837

SEQ ID NO: 634300 - RNA, 64 nt, Homo Sapiens; identical to SEQ ID NO: 147838

SEQ ID NO: 634301 - RNA, 64 nt, Homo Sapiens; identical to SEQ ID NO: 147839

SEQ ID NO: 634302 - RNA, 64 nt, Homo Sapiens; identical to SEQ ID NO: 147840

SEQ ID NO: 634303 - RNA, 64 nt, Homo Sapiens; identical to SEQ ID NO: 147841

SEQ ID NO: 634304 - RNA, 64 nt, Homo Sapiens; identical to SEQ ID NO: 147842

SEQ ID NO: 634305 - RNA, 64 nt, Homo Sapiens; identical to SEQ ID NO: 147843

SEQ ID NO: 634306 - RNA, 58 nt, Homo Sapiens; identical to SEQ ID NO: 147844

SEQ ID NO: 634307 - RNA, 64 nt, Homo Sapiens; identical to SEQ ID NO: 147845

SEQ ID NO: 634308 - RNA, 64 nt, Homo Sapiens; identical to SEQ ID NO: 147846

SEQ ID NO: 634309 - RNA, 64 nt, Homo Sapiens; identical to SEQ ID NO: 147847

SEQ ID NO: 634310 - RNA, 64 nt, Homo Sapiens; identical to SEQ ID NO: 147848

SEQ ID NO: 634311 - RNA, 64 nt, Homo Sapiens; identical to SEQ ID NO: 147849

SEQ ID NO: 634312 - RNA, 64 nt, Homo Sapiens; identical to SEQ ID NO: 147850

SEQ ID NO: 634313 - RNA, 64 nt, Homo Sapiens; identical to SEQ ID NO: 147851

SEQ ID NO: 634314 - RNA, 64 nt, Homo Sapiens; identical to SEQ ID NO: 147852

SEQ ID NO: 634315 - RNA, 64 nt, Homo Sapiens; identical to SEQ ID NO: 147853

SEQ ID NO: 634316 - RNA, 64 nt, Homo Sapiens; identical to SEQ ID NO: 147854

SEQ ID NO: 634317 - RNA, 64 nt, Homo Sapiens; identical to SEQ ID NO: 147855

SEQ ID NO: 634318 - RNA, 64 nt, Homo Sapiens; identical to SEQ ID NO: 147856

SEQ ID NO: 634319 - RNA, 64 nt, Homo Sapiens; identical to SEQ ID NO: 147857

SEQ ID NO: 634320 - RNA, 64 nt, Homo Sapiens; identical to SEQ ID NO: 147858

SEQ ID NO: 634321 - RNA, 64 nt, Homo Sapiens; identical to SEQ ID NO: 147859

SEQ ID NO: 634322 - RNA, 64 nt, Homo Sapiens; identical to SEQ ID NO: 147860

SEQ ID NO: 634323 - RNA, 64 nt, Homo Sapiens; identical to SEQ ID NO: 147861

SEQ ID NO: 634324 - RNA, 64 nt, Homo Sapiens; identical to SEQ ID NO: 147862

SEQ ID NO: 634325 - RNA, 64 nt, Homo Sapiens; identical to SEQ ID NO: 147863

SEQ ID NO: 634326 - RNA, 64 nt, Homo Sapiens; identical to SEQ ID NO: 147864

SEQ ID NO: 634327 - RNA, 64 nt, Homo Sapiens; identical to SEQ ID NO: 147865

SEQ ID NO: 634328 - RNA, 64 nt, Homo Sapiens; identical to SEQ ID NO: 147866

SEQ ID NO: 634329 - RNA, 64 nt, Homo Sapiens; identical to SEQ ID NO: 147867

SEQ ID NO: 634330 - RNA, 64 nt, Homo Sapiens; identical to SEQ ID NO: 147868

SEQ ID NO: 634331 - RNA, 64 nt, Homo Sapiens; identical to SEQ ID NO: 147869

SEQ ID NO: 634332 - RNA, 64 nt, Homo Sapiens; identical to SEQ ID NO: 147870

SEQ ID NO: 634333 - RNA, 64 nt, Homo Sapiens; identical to SEQ ID NO: 147871

SEQ ID NO: 634334 - RNA, 64 nt, Homo Sapiens; identical to SEQ ID NO: 147872

SEQ ID NO: 634335 - RNA, 64 nt, Homo Sapiens; identical to SEQ ID NO: 147873

SEQ ID NO: 634336 - RNA, 64 nt, Homo Sapiens; identical to SEQ ID NO: 147874

SEQ ID NO: 634337 - RNA, 64 nt, Homo Sapiens; identical to SEQ ID NO: 147875

SEQ ID NO: 634338 - RNA, 64 nt, Homo Sapiens; identical to SEQ ID NO: 147876

SEQ ID NO: 634339 - RNA, 64 nt, Homo Sapiens; identical to SEQ ID NO: 147877

SEQ ID NO: 634340 - RNA, 64 nt, Homo Sapiens; identical to SEQ ID NO: 147878

SEQ ID NO: 634341 - RNA, 64 nt, Homo Sapiens; identical to SEQ ID NO: 147879

SEQ ID NO: 634342 - RNA, 64 nt, Homo Sapiens; identical to SEQ ID NO: 147880

SEQ ID NO: 634343 - RNA, 64 nt, Homo Sapiens; identical to SEQ ID NO: 147881

SEQ ID NO: 634344 - RNA, 64 nt, Homo Sapiens; identical to SEQ ID NO: 147882

SEQ ID NO: 634345 - RNA, 64 nt, Homo Sapiens; identical to SEQ ID NO: 147883

SEQ ID NO: 634346 - RNA, 64 nt, Homo Sapiens; identical to SEQ ID NO: 147884

SEQ ID NO: 634347 - RNA, 64 nt, Homo Sapiens; identical to SEQ ID NO: 147885

SEQ ID NO: 634348 - RNA, 64 nt, Homo Sapiens; identical to SEQ ID NO: 147886

SEQ ID NO: 634349 - RNA, 64 nt, Homo Sapiens; identical to SEQ ID NO: 147887

SEQ ID NO: 634350 - RNA, 64 nt, Homo Sapiens; identical to SEQ ID NO: 147888

SEQ ID NO: 634351 - RNA, 64 nt, Homo Sapiens; identical to SEQ ID NO: 147889

SEQ ID NO: 634352 - RNA, 64 nt, Homo Sapiens; identical to SEQ ID NO: 147890

SEQ ID NO: 634353 - RNA, 64 nt, Homo Sapiens; identical to SEQ ID NO: 147891

SEQ ID NO: 634354 - RNA, 64 nt, Homo Sapiens; identical to SEQ ID NO: 147892

SEQ ID NO: 634355 - RNA, 64 nt, Homo Sapiens; identical to SEQ ID NO: 147893

SEQ ID NO: 634356 - RNA, 64 nt, Homo Sapiens; identical to SEQ ID NO: 147894

SEQ ID NO: 634357 - RNA, 64 nt, Homo Sapiens; identical to SEQ ID NO: 147895

SEQ ID NO: 634358 - RNA, 64 nt, Homo Sapiens; identical to SEQ ID NO: 147896

SEQ ID NO: 634359 - RNA, 64 nt, Homo Sapiens; identical to SEQ ID NO: 147897

SEQ ID NO: 634360 - RNA, 64 nt, Homo Sapiens; identical to SEQ ID NO: 147898

SEQ ID NO: 634361 - RNA, 64 nt, Homo Sapiens; identical to SEQ ID NO: 147899

SEQ ID NO: 634362 - RNA, 64 nt, Homo Sapiens; identical to SEQ ID NO: 147900

SEQ ID NO: 634363 - RNA, 64 nt, Homo Sapiens; identical to SEQ ID NO: 147901

SEQ ID NO: 634364 - RNA, 64 nt, Homo Sapiens; identical to SEQ ID NO: 147902

SEQ ID NO: 634365 - RNA, 64 nt, Homo Sapiens; identical to SEQ ID NO: 147903

SEQ ID NO: 634366 - RNA, 64 nt, Homo Sapiens; identical to SEQ ID NO: 147904

SEQ ID NO: 634367 - RNA, 64 nt, Homo Sapiens; identical to SEQ ID NO: 147905

SEQ ID NO: 634368 - RNA, 64 nt, Homo Sapiens; identical to SEQ ID NO: 147906

SEQ ID NO: 634369 - RNA, 64 nt, Homo Sapiens; identical to SEQ ID NO: 147907

SEQ ID NO: 634370 - RNA, 64 nt, Homo Sapiens; identical to SEQ ID NO: 147908

SEQ ID NO: 634371 - RNA, 64 nt, Homo Sapiens; identical to SEQ ID NO: 147909

SEQ ID NO: 634372 - RNA, 64 nt, Homo Sapiens; identical to SEQ ID NO: 147910

SEQ ID NO: 634373 - RNA, 64 nt, Homo Sapiens; identical to SEQ ID NO: 147911

SEQ ID NO: 634374 - RNA, 64 nt, Homo Sapiens; identical to SEQ ID NO: 147912

SEQ ID NO: 634375 - RNA, 64 nt, Homo Sapiens; identical to SEQ ID NO: 147913

SEQ ID NO: 634376 - RNA, 64 nt, Homo Sapiens; identical to SEQ ID NO: 147914

SEQ ID NO: 634377 - RNA, 64 nt, Homo Sapiens; identical to SEQ ID NO: 147915

SEQ ID NO: 634378 - RNA, 64 nt, Homo Sapiens; identical to SEQ ID NO: 147916

SEQ ID NO: 634379 - RNA, 64 nt, Homo Sapiens; identical to SEQ ID NO: 147917

SEQ ID NO: 634380 - RNA, 64 nt, Homo Sapiens; identical to SEQ ID NO: 147918

SEQ ID NO: 634381 - RNA, 64 nt, Homo Sapiens; identical to SEQ ID NO: 147919

SEQ ID NO: 634382 - RNA, 64 nt, Homo Sapiens; identical to SEQ ID NO: 147920

SEQ ID NO: 634383 - RNA, 64 nt, Homo Sapiens; identical to SEQ ID NO: 147921

SEQ ID NO: 634384 - RNA, 64 nt, Homo Sapiens; identical to SEQ ID NO: 147922

SEQ ID NO: 634385 - RNA, 64 nt, Homo Sapiens; identical to SEQ ID NO: 147923

SEQ ID NO: 634386 - RNA, 64 nt, Homo Sapiens; identical to SEQ ID NO: 147924

SEQ ID NO: 634387 - RNA, 64 nt, Homo Sapiens; identical to SEQ ID NO: 147925

SEQ ID NO: 634388 - RNA, 64 nt, Homo Sapiens; identical to SEQ ID NO: 147926

SEQ ID NO: 634389 - RNA, 64 nt, Homo Sapiens; identical to SEQ ID NO: 147927

SEQ ID NO: 634390 - RNA, 64 nt, Homo Sapiens; identical to SEQ ID NO: 147928

SEQ ID NO: 634391 - RNA, 64 nt, Homo Sapiens; identical to SEQ ID NO: 147929

SEQ ID NO: 634392 - RNA, 64 nt, Homo Sapiens; identical to SEQ ID NO: 147930

SEQ ID NO: 634393 - RNA, 64 nt, Homo Sapiens; identical to SEQ ID NO: 147931

SEQ ID NO: 634394 - RNA, 64 nt, Homo Sapiens; identical to SEQ ID NO: 147932

SEQ ID NO: 634395 - RNA, 64 nt, Homo Sapiens; identical to SEQ ID NO: 147933

SEQ ID NO: 634396 - RNA, 64 nt, Homo Sapiens; identical to SEQ ID NO: 147934

SEQ ID NO: 634397 - RNA, 64 nt, Homo Sapiens; identical to SEQ ID NO: 147935

SEQ ID NO: 634398 - RNA, 64 nt, Homo Sapiens; identical to SEQ ID NO: 363385

SEQ ID NO: 634399 - RNA, 64 nt, Homo Sapiens; identical to SEQ ID NO: 363386

SEQ ID NO: 634400 - RNA, 64 nt, Homo Sapiens; identical to SEQ ID NO: 363387

SEQ ID NO: 634401 - RNA, 64 nt, Homo Sapiens; identical to SEQ ID NO: 363388

SEQ ID NO: 634402 - RNA, 64 nt, Homo Sapiens; identical to SEQ ID NO: 363389

SEQ ID NO: 634403 - RNA, 64 nt, Homo Sapiens; identical to SEQ ID NO: 363390

SEQ ID NO: 634404 - RNA, 64 nt, Homo Sapiens; identical to SEQ ID NO: 363391

SEQ ID NO: 634405 - RNA, 64 nt, Homo Sapiens; identical to SEQ ID NO: 363392

SEQ ID NO: 634406 - RNA, 64 nt, Homo Sapiens; identical to SEQ ID NO: 363393

SEQ ID NO: 634407 - RNA, 64 nt, Homo Sapiens; identical to SEQ ID NO: 363394

SEQ ID NO: 634408 - RNA, 64 nt, Homo Sapiens; identical to SEQ ID NO: 363395

SEQ ID NO: 634409 - RNA, 64 nt, Homo Sapiens; identical to SEQ ID NO: 363396

SEQ ID NO: 634410 - RNA, 64 nt, Homo Sapiens; identical to SEQ ID NO: 363397

SEQ ID NO: 634411 - RNA, 64 nt, Homo Sapiens; identical to SEQ ID NO: 363398

SEQ ID NO: 634412 - RNA, 64 nt, Homo Sapiens; identical to SEQ ID NO: 363399

SEQ ID NO: 634413 - RNA, 64 nt, Homo Sapiens; identical to SEQ ID NO: 363400

SEQ ID NO: 634414 - RNA, 64 nt, Homo Sapiens; identical to SEQ ID NO: 363401

SEQ ID NO: 634415 - RNA, 64 nt, Homo Sapiens; identical to SEQ ID NO: 363402

SEQ ID NO: 634416 - RNA, 64 nt, Homo Sapiens; identical to SEQ ID NO: 363403

SEQ ID NO: 634417 - RNA, 64 nt, Homo Sapiens; identical to SEQ ID NO: 363404

SEQ ID NO: 634418 - RNA, 64 nt, Homo Sapiens; identical to SEQ ID NO: 363405

SEQ ID NO: 634419 - RNA, 64 nt, Homo Sapiens; identical to SEQ ID NO: 363406

SEQ ID NO: 634420 - RNA, 64 nt, Homo Sapiens; identical to SEQ ID NO: 363407

SEQ ID NO: 634421 - RNA, 64 nt, Homo Sapiens; identical to SEQ ID NO: 363408

SEQ ID NO: 634422 - RNA, 64 nt, Homo Sapiens; identical to SEQ ID NO: 363409

SEQ ID NO: 634423 - RNA, 64 nt, Homo Sapiens; identical to SEQ ID NO: 363410

SEQ ID NO: 634424 - RNA, 64 nt, Homo Sapiens; identical to SEQ ID NO: 363411

SEQ ID NO: 634425 - RNA, 64 nt, Homo Sapiens; identical to SEQ ID NO: 363412

SEQ ID NO: 634426 - RNA, 64 nt, Homo Sapiens; identical to SEQ ID NO: 363413

SEQ ID NO: 634427 - RNA, 64 nt, Homo Sapiens; identical to SEQ ID NO: 363414

SEQ ID NO: 634428 - RNA, 64 nt, Homo Sapiens; identical to SEQ ID NO: 363415

SEQ ID NO: 634429 - RNA, 64 nt, Homo Sapiens; identical to SEQ ID NO: 363416

SEQ ID NO: 634430 - RNA, 64 nt, Homo Sapiens; identical to SEQ ID NO: 363417

SEQ ID NO: 634431 - RNA, 64 nt, Homo Sapiens; identical to SEQ ID NO: 363418

SEQ ID NO: 634432 - RNA, 64 nt, Homo Sapiens; identical to SEQ ID NO: 363419

SEQ ID NO: 634433 - RNA, 64 nt, Homo Sapiens; identical to SEQ ID NO: 363420

SEQ ID NO: 634434 - RNA, 64 nt, Homo Sapiens; identical to SEQ ID NO: 363421

SEQ ID NO: 634435 - RNA, 64 nt, Homo Sapiens; identical to SEQ ID NO: 363422

SEQ ID NO: 634436 - RNA, 64 nt, Homo Sapiens; identical to SEQ ID NO: 363423

SEQ ID NO: 634437 - RNA, 64 nt, Homo Sapiens; identical to SEQ ID NO: 363424

SEQ ID NO: 634438 - RNA, 64 nt, Homo Sapiens; identical to SEQ ID NO: 363425

SEQ ID NO: 634439 - RNA, 64 nt, Homo Sapiens; identical to SEQ ID NO: 363426

SEQ ID NO: 634440 - RNA, 64 nt, Homo Sapiens; identical to SEQ ID NO: 363427

SEQ ID NO: 634441 - RNA, 64 nt, Homo Sapiens; identical to SEQ ID NO: 363428

SEQ ID NO: 634442 - RNA, 64 nt, Homo Sapiens; identical to SEQ ID NO: 363429

SEQ ID NO: 634443 - RNA, 64 nt, Homo Sapiens; identical to SEQ ID NO: 210956

SEQ ID NO: 634444 - RNA, 64 nt, Homo Sapiens; identical to SEQ ID NO: 210957

SEQ ID NO: 634445 - RNA, 64 nt, Homo Sapiens; identical to SEQ ID NO: 210958

SEQ ID NO: 634446 - RNA, 64 nt, Homo Sapiens; identical to SEQ ID NO: 210959

SEQ ID NO: 634447 - RNA, 64 nt, Homo Sapiens
uuacacuucucagagggcagaguggcagccgggcacccuacagaaacucagagggcagaguggc

SEQ ID NO: 634448 - RNA, 64 nt, Homo Sapiens
uaguaucuggggcgaguguuggggguaaaagcccacccuacagaaaguggaacagcccggagcc

SEQ ID NO: 634449 - RNA, 64 nt, Homo Sapiens
uaacuguagauaagaaaauucauacuggaaagaaacccuacaaaugugaagucuguggcaaagc

SEQ ID NO: 634450 - RNA, 64 nt, Homo Sapiens
uuacuacauguaagaguauuuauacuggaaagaaacccuacaaauguaaaaaacguggcaaugc

SEQ ID NO: 634451 - RNA, 64 nt, Homo Sapiens
ucacugaacauaaguuaauucauacuggagaaaaacccuacaaauguaaagaauguggaaaagc

SEQ ID NO: 634452 - RNA, 64 nt, Homo Sapiens
uuauuacacauaagauaauucacaguggagaaaaacccuacaaaugugaagaauguggcaaagc

SEQ ID NO: 634453 - RNA, 64 nt, Homo Sapiens
uuaugagacauaagaaaauucauaguaaagagaaacccuacaaaugugaacaguguggcaaggu

SEQ ID NO: 634454 - RNA, 64 nt, Homo Sapiens
uuacuaaacacaagaagauucauacuagagagaaacccuacaaaugugaagaauguggcauauc

SEQ ID NO: 634455 - RNA, 64 nt, Homo Sapiens
uugcuauacauaagaugauucacacuugaaugaaacccuacaaaugugaacgauguggcaguug

SEQ ID NO: 634456 - RNA, 64 nt, Homo Sapiens
ccucuccucuucacuagccucacauuucaaauucacccuacauugcugcauugacucuauuaau

SEQ ID NO: 634457 - RNA, 64 nt, Homo Sapiens
cuucggcucucuggacacuuggaccuugcuuuggacccuacacacucccgggcacauccaggaa

SEQ ID NO: 634458 - RNA, 64 nt, Homo Sapiens
uuaauacacauaagauaauuaaugcuggagagaaacccuacaaaugugaagaauguggcaaaga

SEQ ID NO: 634459 - RNA, 64 nt, Homo Sapiens
ugccuacacguaagauaauucauacuggaaggaaacccuacaaauaugaggaaugucucaaagc

SEQ ID NO: 634460 - RNA, 64 nt, Homo Sapiens
uuacuacacauuagauaauucaugcuggagagaaacccuacaaaugugaaaaauguggcaaagc

SEQ ID NO: 634461 - RNA, 64 nt, Homo Sapiens
cuuuauugaacaaaauaauucauacaggagagaaacccuacaaaugugaagaaugugacaaagc

SEQ ID NO: 634462 - RNA, 59 nt, Homo Sapiens
uuacuaaacauaauucauaauggagaaaaacccuacaaaugugaagaaugugucaaagc

SEQ ID NO: 634463 - RNA, 64 nt, Homo Sapiens
ccuuacuaaacauaagggaauucauaauagagaaacccuacaaaugugaagaacguggccuggc

SEQ ID NO: 634464 - RNA, 64 nt, Homo Sapiens
uguaaggaaugugggaaagccauacuggagagaaacccuacaaacucaaagacaugaaaggacu

SEQ ID NO: 634465 - RNA, 64 nt, Homo Sapiens
ugcaaggaaugugggaaagccauacuggagagaaacccuacaaacucaaagacaugaaaagacu

SEQ ID NO: 634466 - RNA, 64 nt, Homo Sapiens
uguaaggaaugugggaaacccauacuggagagaaacccuacaaacucaaaaacaugaaaaggcu

SEQ ID NO: 634467 - RNA, 64 nt, Homo Sapiens
ugugaagaauguggcaagccuauacaggagggaaacccuacaaauuacugaacauaagggaauu

SEQ ID NO: 634468 - RNA, 64 nt, Homo Sapiens
ugcgaagaaugugauaaagacauacuggagagaaacccuacaaauuguggaacauaagagaauu

SEQ ID NO: 634469 - RNA, 64 nt, Homo Sapiens; identical to SEQ ID NO: 175895

SEQ ID NO: 634470 - RNA, 64 nt, Homo Sapiens; identical to SEQ ID NO: 175896

SEQ ID NO: 634471 - RNA, 64 nt, Homo Sapiens; identical to SEQ ID NO: 175897

SEQ ID NO: 634472 - RNA, 64 nt, Homo Sapiens; identical to SEQ ID NO: 175898

SEQ ID NO: 634473 - RNA, 64 nt, Homo Sapiens; identical to SEQ ID NO: 175899

SEQ ID NO: 634474 - RNA, 64 nt, Homo Sapiens; identical to SEQ ID NO: 175900

SEQ ID NO: 634475 - RNA, 64 nt, Homo Sapiens; identical to SEQ ID NO: 175901

SEQ ID NO: 634476 - RNA, 64 nt, Homo Sapiens; identical to SEQ ID NO: 175902

SEQ ID NO: 634477 - RNA, 64 nt, Homo Sapiens; identical to SEQ ID NO: 175903

SEQ ID NO: 634478 - RNA, 64 nt, Homo Sapiens; identical to SEQ ID NO: 175904

SEQ ID NO: 634479 - RNA, 64 nt, Homo Sapiens; identical to SEQ ID NO: 175905

SEQ ID NO: 634480 - RNA, 64 nt, Homo Sapiens; identical to SEQ ID NO: 175906

SEQ ID NO: 634481 - RNA, 64 nt, Homo Sapiens; identical to SEQ ID NO: 175907

SEQ ID NO: 634482 - RNA, 64 nt, Homo Sapiens; identical to SEQ ID NO: 175908

SEQ ID NO: 634483 - RNA, 64 nt, Homo Sapiens; identical to SEQ ID NO: 175909

SEQ ID NO: 634484 - RNA, 64 nt, Homo Sapiens; identical to SEQ ID NO: 175910

SEQ ID NO: 634485 - RNA, 64 nt, Homo Sapiens; identical to SEQ ID NO: 175911

SEQ ID NO: 634486 - RNA, 64 nt, Homo Sapiens; identical to SEQ ID NO: 175912

SEQ ID NO: 634487 - RNA, 64 nt, Homo Sapiens; identical to SEQ ID NO: 175913

SEQ ID NO: 634488 - RNA, 64 nt, Homo Sapiens; identical to SEQ ID NO: 175914

SEQ ID NO: 634489 - RNA, 64 nt, Homo Sapiens; identical to SEQ ID NO: 175915

SEQ ID NO: 634490 - RNA, 64 nt, Homo Sapiens; identical to SEQ ID NO: 175916

SEQ ID NO: 634491 - RNA, 64 nt, Homo Sapiens; identical to SEQ ID NO: 175917

SEQ ID NO: 634492 - RNA, 64 nt, Homo Sapiens; identical to SEQ ID NO: 175918

SEQ ID NO: 634493 - RNA, 64 nt, Homo Sapiens; identical to SEQ ID NO: 175919

SEQ ID NO: 634494 - RNA, 64 nt, Homo Sapiens; identical to SEQ ID NO: 175920

SEQ ID NO: 634495 - RNA, 64 nt, Homo Sapiens; identical to SEQ ID NO: 175921

SEQ ID NO: 634496 - RNA, 64 nt, Homo Sapiens; identical to SEQ ID NO: 175922

SEQ ID NO: 634497 - RNA, 64 nt, Homo Sapiens; identical to SEQ ID NO: 175923

SEQ ID NO: 634498 - RNA, 64 nt, Homo Sapiens; identical to SEQ ID NO: 175924

SEQ ID NO: 634499 - RNA, 64 nt, Homo Sapiens; identical to SEQ ID NO: 175925

SEQ ID NO: 634500 - RNA, 64 nt, Homo Sapiens; identical to SEQ ID NO: 175926

SEQ ID NO: 634501 - RNA, 64 nt, Homo Sapiens; identical to SEQ ID NO: 175927

SEQ ID NO: 634502 - RNA, 64 nt, Homo Sapiens; identical to SEQ ID NO: 175928

SEQ ID NO: 634503 - RNA, 64 nt, Homo Sapiens; identical to SEQ ID NO: 175929

SEQ ID NO: 634504 - RNA, 64 nt, Homo Sapiens; identical to SEQ ID NO: 175930

SEQ ID NO: 634505 - RNA, 64 nt, Homo Sapiens; identical to SEQ ID NO: 175931

SEQ ID NO: 634506 - RNA, 64 nt, Homo Sapiens; identical to SEQ ID NO: 175932

SEQ ID NO: 634507 - RNA, 64 nt, Homo Sapiens; identical to SEQ ID NO: 175933

SEQ ID NO: 634508 - RNA, 64 nt, Homo Sapiens; identical to SEQ ID NO: 175934

SEQ ID NO: 634509 - RNA, 64 nt, Homo Sapiens; identical to SEQ ID NO: 175935

SEQ ID NO: 634510 - RNA, 64 nt, Homo Sapiens; identical to SEQ ID NO: 175936

SEQ ID NO: 634511 - RNA, 64 nt, Homo Sapiens; identical to SEQ ID NO: 175937

SEQ ID NO: 634512 - RNA, 64 nt, Homo Sapiens; identical to SEQ ID NO: 175938

SEQ ID NO: 634513 - RNA, 64 nt, Homo Sapiens; identical to SEQ ID NO: 175939

SEQ ID NO: 634514 - RNA, 64 nt, Homo Sapiens; identical to SEQ ID NO: 175940

SEQ ID NO: 634515 - RNA, 64 nt, Homo Sapiens; identical to SEQ ID NO: 175941

SEQ ID NO: 634516 - RNA, 64 nt, Homo Sapiens; identical to SEQ ID NO: 175942

SEQ ID NO: 634517 - RNA, 64 nt, Homo Sapiens; identical to SEQ ID NO: 175943

SEQ ID NO: 634518 - RNA, 64 nt, Homo Sapiens; identical to SEQ ID NO: 175944

SEQ ID NO: 634519 - RNA, 64 nt, Homo Sapiens; identical to SEQ ID NO: 175945

SEQ ID NO: 634520 - RNA, 64 nt, Homo Sapiens; identical to SEQ ID NO: 175946

SEQ ID NO: 634521 - RNA, 64 nt, Homo Sapiens; identical to SEQ ID NO: 175947

SEQ ID NO: 634522 - RNA, 64 nt, Homo Sapiens; identical to SEQ ID NO: 175948

SEQ ID NO: 634523 - RNA, 64 nt, Homo Sapiens; identical to SEQ ID NO: 175949

SEQ ID NO: 634524 - RNA, 64 nt, Homo Sapiens; identical to SEQ ID NO: 175950

SEQ ID NO: 634525 - RNA, 64 nt, Homo Sapiens; identical to SEQ ID NO: 175951

SEQ ID NO: 634526 - RNA, 64 nt, Homo Sapiens; identical to SEQ ID NO: 175952

SEQ ID NO: 634527 - RNA, 64 nt, Homo Sapiens; identical to SEQ ID NO: 175953

SEQ ID NO: 634528 - RNA, 62 nt, Homo Sapiens; identical to SEQ ID NO: 175954

SEQ ID NO: 634529 - RNA, 64 nt, Homo Sapiens; identical to SEQ ID NO: 175955

SEQ ID NO: 634530 - RNA, 64 nt, Homo Sapiens; identical to SEQ ID NO: 175956

SEQ ID NO: 634531 - RNA, 64 nt, Homo Sapiens; identical to SEQ ID NO: 175957

SEQ ID NO: 634532 - RNA, 64 nt, Homo Sapiens; identical to SEQ ID NO: 175958

SEQ ID NO: 634533 - RNA, 64 nt, Homo Sapiens; identical to SEQ ID NO: 175959

SEQ ID NO: 634534 - RNA, 64 nt, Homo Sapiens; identical to SEQ ID NO: 175960

SEQ ID NO: 634535 - RNA, 64 nt, Homo Sapiens; identical to SEQ ID NO: 175961

SEQ ID NO: 634536 - RNA, 64 nt, Homo Sapiens; identical to SEQ ID NO: 175962

SEQ ID NO: 634537 - RNA, 64 nt, Homo Sapiens; identical to SEQ ID NO: 175963

SEQ ID NO: 634538 - RNA, 64 nt, Homo Sapiens; identical to SEQ ID NO: 175964

SEQ ID NO: 634539 - RNA, 64 nt, Homo Sapiens; identical to SEQ ID NO: 175965

SEQ ID NO: 634540 - RNA, 64 nt, Homo Sapiens; identical to SEQ ID NO: 175966

SEQ ID NO: 634541 - RNA, 64 nt, Homo Sapiens; identical to SEQ ID NO: 175967

SEQ ID NO: 634542 - RNA, 64 nt, Homo Sapiens; identical to SEQ ID NO: 175968

SEQ ID NO: 634543 - RNA, 64 nt, Homo Sapiens; identical to SEQ ID NO: 175969

SEQ ID NO: 634544 - RNA, 64 nt, Homo Sapiens; identical to SEQ ID NO: 175970

SEQ ID NO: 634545 - RNA, 64 nt, Homo Sapiens; identical to SEQ ID NO: 175971

SEQ ID NO: 634546 - RNA, 64 nt, Homo Sapiens; identical to SEQ ID NO: 175972

SEQ ID NO: 634547 - RNA, 64 nt, Homo Sapiens; identical to SEQ ID NO: 175973

SEQ ID NO: 634548 - RNA, 64 nt, Homo Sapiens; identical to SEQ ID NO: 175974

SEQ ID NO: 634549 - RNA, 64 nt, Homo Sapiens; identical to SEQ ID NO: 175975

SEQ ID NO: 634550 - RNA, 64 nt, Homo Sapiens; identical to SEQ ID NO: 175976

SEQ ID NO: 634551 - RNA, 64 nt, Homo Sapiens; identical to SEQ ID NO: 175977

SEQ ID NO: 634552 - RNA, 64 nt, Homo Sapiens; identical to SEQ ID NO: 175978

SEQ ID NO: 634553 - RNA, 64 nt, Homo Sapiens; identical to SEQ ID NO: 175979

SEQ ID NO: 634554 - RNA, 64 nt, Homo Sapiens; identical to SEQ ID NO: 175980

SEQ ID NO: 634555 - RNA, 64 nt, Homo Sapiens; identical to SEQ ID NO: 175981

SEQ ID NO: 634556 - RNA, 64 nt, Homo Sapiens; identical to SEQ ID NO: 175982

SEQ ID NO: 634557 - RNA, 64 nt, Homo Sapiens; identical to SEQ ID NO: 175983

SEQ ID NO: 634558 - RNA, 64 nt, Homo Sapiens; identical to SEQ ID NO: 175984

SEQ ID NO: 634559 - RNA, 64 nt, Homo Sapiens; identical to SEQ ID NO: 175985

SEQ ID NO: 634560 - RNA, 64 nt, Homo Sapiens; identical to SEQ ID NO: 175986

SEQ ID NO: 634561 - RNA, 64 nt, Homo Sapiens; identical to SEQ ID NO: 175987

SEQ ID NO: 634562 - RNA, 64 nt, Homo Sapiens; identical to SEQ ID NO: 175988

SEQ ID NO: 634563 - RNA, 64 nt, Homo Sapiens; identical to SEQ ID NO: 175989

SEQ ID NO: 634564 - RNA, 64 nt, Homo Sapiens; identical to SEQ ID NO: 175990

SEQ ID NO: 634565 - RNA, 64 nt, Homo Sapiens; identical to SEQ ID NO: 175991

SEQ ID NO: 634566 - RNA, 64 nt, Homo Sapiens; identical to SEQ ID NO: 175992

SEQ ID NO: 634567 - RNA, 64 nt, Homo Sapiens; identical to SEQ ID NO: 175993

SEQ ID NO: 634568 - RNA, 64 nt, Homo Sapiens; identical to SEQ ID NO: 175994

SEQ ID NO: 634569 - RNA, 64 nt, Homo Sapiens; identical to SEQ ID NO: 175995

SEQ ID NO: 634570 - RNA, 64 nt, Homo Sapiens; identical to SEQ ID NO: 175996

SEQ ID NO: 634571 - RNA, 64 nt, Homo Sapiens; identical to SEQ ID NO: 175997

SEQ ID NO: 634572 - RNA, 62 nt, Homo Sapiens; identical to SEQ ID NO: 175998

SEQ ID NO: 634573 - RNA, 64 nt, Homo Sapiens; identical to SEQ ID NO: 175999

SEQ ID NO: 634574 - RNA, 64 nt, Homo Sapiens; identical to SEQ ID NO: 176000

SEQ ID NO: 634575 - RNA, 64 nt, Homo Sapiens; identical to SEQ ID NO: 176001

SEQ ID NO: 634576 - RNA, 64 nt, Homo Sapiens; identical to SEQ ID NO: 176002

SEQ ID NO: 634577 - RNA, 64 nt, Homo Sapiens; identical to SEQ ID NO: 176003

SEQ ID NO: 634578 - RNA, 64 nt, Homo Sapiens; identical to SEQ ID NO: 176004

SEQ ID NO: 634579 - RNA, 64 nt, Homo Sapiens; identical to SEQ ID NO: 176005

SEQ ID NO: 634580 - RNA, 64 nt, Homo Sapiens; identical to SEQ ID NO: 176006

SEQ ID NO: 634581 - RNA, 64 nt, Homo Sapiens; identical to SEQ ID NO: 176007

SEQ ID NO: 634582 - RNA, 64 nt, Homo Sapiens; identical to SEQ ID NO: 176008

SEQ ID NO: 634583 - RNA, 64 nt, Homo Sapiens; identical to SEQ ID NO: 176009

SEQ ID NO: 634584 - RNA, 64 nt, Homo Sapiens; identical to SEQ ID NO: 176010

SEQ ID NO: 634585 - RNA, 64 nt, Homo Sapiens; identical to SEQ ID NO: 176011

SEQ ID NO: 634586 - RNA, 64 nt, Homo Sapiens; identical to SEQ ID NO: 176012

SEQ ID NO: 634587 - RNA, 64 nt, Homo Sapiens; identical to SEQ ID NO: 176013

SEQ ID NO: 634588 - RNA, 64 nt, Homo Sapiens; identical to SEQ ID NO: 176014

SEQ ID NO: 634589 - RNA, 64 nt, Homo Sapiens; identical to SEQ ID NO: 176015

SEQ ID NO: 634590 - RNA, 64 nt, Homo Sapiens; identical to SEQ ID NO: 176016

SEQ ID NO: 634591 - RNA, 64 nt, Homo Sapiens; identical to SEQ ID NO: 176017

SEQ ID NO: 634592 - RNA, 64 nt, Homo Sapiens; identical to SEQ ID NO: 176018

SEQ ID NO: 634593 - RNA, 64 nt, Homo Sapiens; identical to SEQ ID NO: 176019

SEQ ID NO: 634594 - RNA, 64 nt, Homo Sapiens; identical to SEQ ID NO: 176020

SEQ ID NO: 634595 - RNA, 64 nt, Homo Sapiens; identical to SEQ ID NO: 176021

SEQ ID NO: 634596 - RNA, 64 nt, Homo Sapiens; identical to SEQ ID NO: 176022

SEQ ID NO: 634597 - RNA, 64 nt, Homo Sapiens; identical to SEQ ID NO: 176023

SEQ ID NO: 634598 - RNA, 64 nt, Homo Sapiens; identical to SEQ ID NO: 176024

SEQ ID NO: 634599 - RNA, 64 nt, Homo Sapiens; identical to SEQ ID NO: 176025

SEQ ID NO: 634600 - RNA, 64 nt, Homo Sapiens; identical to SEQ ID NO: 176026

SEQ ID NO: 634601 - RNA, 64 nt, Homo Sapiens; identical to SEQ ID NO: 176027

SEQ ID NO: 634602 - RNA, 64 nt, Homo Sapiens; identical to SEQ ID NO: 176028

SEQ ID NO: 634603 - RNA, 64 nt, Homo Sapiens; identical to SEQ ID NO: 176029

SEQ ID NO: 634604 - RNA, 59 nt, Homo Sapiens; identical to SEQ ID NO: 176030

SEQ ID NO: 634605 - RNA, 56 nt, Homo Sapiens; identical to SEQ ID NO: 176031

SEQ ID NO: 634606 - RNA, 64 nt, Homo Sapiens; identical to SEQ ID NO: 176032

SEQ ID NO: 634607 - RNA, 64 nt, Homo Sapiens; identical to SEQ ID NO: 176033

SEQ ID NO: 634608 - RNA, 64 nt, Homo Sapiens; identical to SEQ ID NO: 176034

SEQ ID NO: 634609 - RNA, 64 nt, Homo Sapiens; identical to SEQ ID NO: 176035

SEQ ID NO: 634610 - RNA, 64 nt, Homo Sapiens; identical to SEQ ID NO: 176036

SEQ ID NO: 634611 - RNA, 64 nt, Homo Sapiens; identical to SEQ ID NO: 176037

SEQ ID NO: 634612 - RNA, 64 nt, Homo Sapiens; identical to SEQ ID NO: 176038

SEQ ID NO: 634613 - RNA, 64 nt, Homo Sapiens; identical to SEQ ID NO: 176039

SEQ ID NO: 634614 - RNA, 64 nt, Homo Sapiens; identical to SEQ ID NO: 176040

SEQ ID NO: 634615 - RNA, 64 nt, Homo Sapiens; identical to SEQ ID NO: 176041

SEQ ID NO: 634616 - RNA, 64 nt, Homo Sapiens; identical to SEQ ID NO: 176042

SEQ ID NO: 634617 - RNA, 64 nt, Homo Sapiens; identical to SEQ ID NO: 176043

SEQ ID NO: 634618 - RNA, 64 nt, Homo Sapiens; identical to SEQ ID NO: 176044

SEQ ID NO: 634619 - RNA, 64 nt, Homo Sapiens; identical to SEQ ID NO: 176045

SEQ ID NO: 634620 - RNA, 64 nt, Homo Sapiens; identical to SEQ ID NO: 176046

SEQ ID NO: 634621 - RNA, 64 nt, Homo Sapiens; identical to SEQ ID NO: 176047

SEQ ID NO: 634622 - RNA, 64 nt, Homo Sapiens; identical to SEQ ID NO: 176048

SEQ ID NO: 634623 - RNA, 64 nt, Homo Sapiens; identical to SEQ ID NO: 176049

SEQ ID NO: 634624 - RNA, 64 nt, Homo Sapiens; identical to SEQ ID NO: 176050

SEQ ID NO: 634625 - RNA, 64 nt, Homo Sapiens; identical to SEQ ID NO: 176051

SEQ ID NO: 634626 - RNA, 64 nt, Homo Sapiens; identical to SEQ ID NO: 176052

SEQ ID NO: 634627 - RNA, 64 nt, Homo Sapiens; identical to SEQ ID NO: 176053

SEQ ID NO: 634628 - RNA, 64 nt, Homo Sapiens; identical to SEQ ID NO: 176054

SEQ ID NO: 634629 - RNA, 64 nt, Homo Sapiens; identical to SEQ ID NO: 176055

SEQ ID NO: 634630 - RNA, 64 nt, Homo Sapiens; identical to SEQ ID NO: 176056

SEQ ID NO: 634631 - RNA, 64 nt, Homo Sapiens; identical to SEQ ID NO: 176057

SEQ ID NO: 634632 - RNA, 64 nt, Homo Sapiens; identical to SEQ ID NO: 176058

SEQ ID NO: 634633 - RNA, 64 nt, Homo Sapiens; identical to SEQ ID NO: 176059

SEQ ID NO: 634634 - RNA, 64 nt, Homo Sapiens; identical to SEQ ID NO: 176060

SEQ ID NO: 634635 - RNA, 64 nt, Homo Sapiens; identical to SEQ ID NO: 176061

SEQ ID NO: 634636 - RNA, 64 nt, Homo Sapiens; identical to SEQ ID NO: 176062

SEQ ID NO: 634637 - RNA, 64 nt, Homo Sapiens; identical to SEQ ID NO: 176063

SEQ ID NO: 634638 - RNA, 64 nt, Homo Sapiens; identical to SEQ ID NO: 176064

SEQ ID NO: 634639 - RNA, 64 nt, Homo Sapiens; identical to SEQ ID NO: 176065

SEQ ID NO: 634640 - RNA, 64 nt, Homo Sapiens; identical to SEQ ID NO: 176066

SEQ ID NO: 634641 - RNA, 64 nt, Homo Sapiens; identical to SEQ ID NO: 176067

SEQ ID NO: 634642 - RNA, 64 nt, Homo Sapiens; identical to SEQ ID NO: 176068

SEQ ID NO: 634643 - RNA, 64 nt, Homo Sapiens; identical to SEQ ID NO: 176069

SEQ ID NO: 634644 - RNA, 64 nt, Homo Sapiens; identical to SEQ ID NO: 176070

SEQ ID NO: 634645 - RNA, 64 nt, Homo Sapiens; identical to SEQ ID NO: 176071

SEQ ID NO: 634646 - RNA, 64 nt, Homo Sapiens; identical to SEQ ID NO: 176072

SEQ ID NO: 634647 - RNA, 64 nt, Homo Sapiens; identical to SEQ ID NO: 176073

SEQ ID NO: 634648 - RNA, 64 nt, Homo Sapiens; identical to SEQ ID NO: 176074

SEQ ID NO: 634649 - RNA, 64 nt, Homo Sapiens; identical to SEQ ID NO: 176075

SEQ ID NO: 634650 - RNA, 64 nt, Homo Sapiens
uugcuuaguuuucuuacugcuaaggagcguuguugaccauaauauauguaguuauucuaaaguu

SEQ ID NO: 634651 - RNA, 64 nt, Homo Sapiens
ugcaacauugucucauuaaaaaaagauguugguugaccauaauuuaugcuugaaguauuuggug

SEQ ID NO: 634652 - RNA, 64 nt, Homo Sapiens
auuguacagauaauccacaggucaggcugacacagaccauaagacuagacuauauccaacccca

SEQ ID NO: 634653 - RNA, 64 nt, Homo Sapiens
uccucgugauaaugugacuuaauauugcaaaaaugaccauaaauugccaaacaagauuuuguag

SEQ ID NO: 634654 - RNA, 64 nt, Homo Sapiens
uaaaaguggagucacuaaaucaucuuagucauacgaccauaaauggauaggcuuauauucaaaa

SEQ ID NO: 634655 - RNA, 64 nt, Homo Sapiens
aaaaaguaaacuuucuuuagauuuucaaugcagagaccauaaucuuaaagaaaaauuccuacag

SEQ ID NO: 634656 - RNA, 64 nt, Homo Sapiens
uacaucauuuaucuugaacaucugacguguaaaggaccauaaggacaucaguuaucuugaacau

SEQ ID NO: 634657 - RNA, 64 nt, Homo Sapiens
uacaucaguuaucuugaacagucuuccuuucaaggaccauaagguugacuccuggaaguauuga

SEQ ID NO: 634658 - RNA, 64 nt, Homo Sapiens; identical to SEQ ID NO: 76114

SEQ ID NO: 634659 - RNA, 64 nt, Homo Sapiens; identical to SEQ ID NO: 76115

SEQ ID NO: 634660 - RNA, 64 nt, Homo Sapiens; identical to SEQ ID NO: 76116

SEQ ID NO: 634661 - RNA, 64 nt, Homo Sapiens; identical to SEQ ID NO: 76117

SEQ ID NO: 634662 - RNA, 64 nt, Homo Sapiens; identical to SEQ ID NO: 76118

SEQ ID NO: 634663 - RNA, 64 nt, Homo Sapiens; identical to SEQ ID NO: 76119

SEQ ID NO: 634664 - RNA, 64 nt, Homo Sapiens; identical to SEQ ID NO: 76120

SEQ ID NO: 634665 - RNA, 64 nt, Homo Sapiens; identical to SEQ ID NO: 76121

SEQ ID NO: 634666 - RNA, 64 nt, Homo Sapiens; identical to SEQ ID NO: 76122

SEQ ID NO: 634667 - RNA, 64 nt, Homo Sapiens; identical to SEQ ID NO: 76123

SEQ ID NO: 634668 - RNA, 64 nt, Homo Sapiens; identical to SEQ ID NO: 76124

SEQ ID NO: 634669 - RNA, 64 nt, Homo Sapiens; identical to SEQ ID NO: 76125

SEQ ID NO: 634670 - RNA, 64 nt, Homo Sapiens; identical to SEQ ID NO: 76126

SEQ ID NO: 634671 - RNA, 64 nt, Homo Sapiens; identical to SEQ ID NO: 76127

SEQ ID NO: 634672 - RNA, 64 nt, Homo Sapiens; identical to SEQ ID NO: 76128

SEQ ID NO: 634673 - RNA, 64 nt, Homo Sapiens; identical to SEQ ID NO: 76129

SEQ ID NO: 634674 - RNA, 64 nt, Homo Sapiens; identical to SEQ ID NO: 76130

SEQ ID NO: 634675 - RNA, 64 nt, Homo Sapiens; identical to SEQ ID NO: 76131

SEQ ID NO: 634676 - RNA, 64 nt, Homo Sapiens; identical to SEQ ID NO: 76132

SEQ ID NO: 634677 - RNA, 64 nt, Homo Sapiens; identical to SEQ ID NO: 76133

SEQ ID NO: 634678 - RNA, 64 nt, Homo Sapiens; identical to SEQ ID NO: 76134

SEQ ID NO: 634679 - RNA, 64 nt, Homo Sapiens; identical to SEQ ID NO: 76135

SEQ ID NO: 634680 - RNA, 64 nt, Homo Sapiens; identical to SEQ ID NO: 76136

SEQ ID NO: 634681 - RNA, 64 nt, Homo Sapiens; identical to SEQ ID NO: 76137

SEQ ID NO: 634682 - RNA, 64 nt, Homo Sapiens; identical to SEQ ID NO: 76138

SEQ ID NO: 634683 - RNA, 64 nt, Homo Sapiens; identical to SEQ ID NO: 76139

SEQ ID NO: 634684 - RNA, 64 nt, Homo Sapiens; identical to SEQ ID NO: 76140

SEQ ID NO: 634685 - RNA, 64 nt, Homo Sapiens; identical to SEQ ID NO: 76141

SEQ ID NO: 634686 - RNA, 64 nt, Homo Sapiens; identical to SEQ ID NO: 76142

SEQ ID NO: 634687 - RNA, 64 nt, Homo Sapiens; identical to SEQ ID NO: 76143

SEQ ID NO: 634688 - RNA, 64 nt, Homo Sapiens; identical to SEQ ID NO: 76144

SEQ ID NO: 634689 - RNA, 64 nt, Homo Sapiens; identical to SEQ ID NO: 76145

SEQ ID NO: 634690 - RNA, 64 nt, Homo Sapiens; identical to SEQ ID NO: 76146

SEQ ID NO: 634691 - RNA, 64 nt, Homo Sapiens; identical to SEQ ID NO: 76147

SEQ ID NO: 634692 - RNA, 64 nt, Homo Sapiens; identical to SEQ ID NO: 76148

SEQ ID NO: 634693 - RNA, 64 nt, Homo Sapiens; identical to SEQ ID NO: 76149

SEQ ID NO: 634694 - RNA, 64 nt, Homo Sapiens; identical to SEQ ID NO: 76150

SEQ ID NO: 634695 - RNA, 64 nt, Homo Sapiens; identical to SEQ ID NO: 76151

SEQ ID NO: 634696 - RNA, 64 nt, Homo Sapiens; identical to SEQ ID NO: 76152

SEQ ID NO: 634697 - RNA, 64 nt, Homo Sapiens; identical to SEQ ID NO: 76153

SEQ ID NO: 634698 - RNA, 64 nt, Homo Sapiens; identical to SEQ ID NO: 76154

SEQ ID NO: 634699 - RNA, 64 nt, Homo Sapiens; identical to SEQ ID NO: 103925

SEQ ID NO: 634700 - RNA, 64 nt, Homo Sapiens; identical to SEQ ID NO: 103926

SEQ ID NO: 634701 - RNA, 64 nt, Homo Sapiens; identical to SEQ ID NO: 103927

SEQ ID NO: 634702 - RNA, 64 nt, Homo Sapiens; identical to SEQ ID NO: 103928

SEQ ID NO: 634703 - RNA, 64 nt, Homo Sapiens; identical to SEQ ID NO: 103929

SEQ ID NO: 634704 - RNA, 64 nt, Homo Sapiens; identical to SEQ ID NO: 103930

SEQ ID NO: 634705 - RNA, 64 nt, Homo Sapiens; identical to SEQ ID NO: 103931

SEQ ID NO: 634706 - RNA, 64 nt, Homo Sapiens; identical to SEQ ID NO: 103932

SEQ ID NO: 634707 - RNA, 64 nt, Homo Sapiens; identical to SEQ ID NO: 103933

SEQ ID NO: 634708 - RNA, 64 nt, Homo Sapiens; identical to SEQ ID NO: 103934

SEQ ID NO: 634709 - RNA, 64 nt, Homo Sapiens; identical to SEQ ID NO: 103935

SEQ ID NO: 634710 - RNA, 64 nt, Homo Sapiens; identical to SEQ ID NO: 103936

SEQ ID NO: 634711 - RNA, 64 nt, Homo Sapiens; identical to SEQ ID NO: 103937

SEQ ID NO: 634712 - RNA, 64 nt, Homo Sapiens; identical to SEQ ID NO: 103938

SEQ ID NO: 634713 - RNA, 64 nt, Homo Sapiens; identical to SEQ ID NO: 103939

SEQ ID NO: 634714 - RNA, 64 nt, Homo Sapiens; identical to SEQ ID NO: 125091

SEQ ID NO: 634715 - RNA, 64 nt, Homo Sapiens; identical to SEQ ID NO: 125092

SEQ ID NO: 634716 - RNA, 64 nt, Homo Sapiens; identical to SEQ ID NO: 125093

SEQ ID NO: 634717 - RNA, 64 nt, Homo Sapiens; identical to SEQ ID NO: 125094

SEQ ID NO: 634718 - RNA, 64 nt, Homo Sapiens; identical to SEQ ID NO: 125095

SEQ ID NO: 634719 - RNA, 64 nt, Homo Sapiens; identical to SEQ ID NO: 125096

SEQ ID NO: 634720 - RNA, 64 nt, Homo Sapiens; identical to SEQ ID NO: 125097

SEQ ID NO: 634721 - RNA, 64 nt, Homo Sapiens; identical to SEQ ID NO: 125098

SEQ ID NO: 634722 - RNA, 64 nt, Homo Sapiens; identical to SEQ ID NO: 125099

SEQ ID NO: 634723 - RNA, 64 nt, Homo Sapiens; identical to SEQ ID NO: 125100

SEQ ID NO: 634724 - RNA, 64 nt, Homo Sapiens; identical to SEQ ID NO: 125101

SEQ ID NO: 634725 - RNA, 64 nt, Homo Sapiens; identical to SEQ ID NO: 125102

SEQ ID NO: 634726 - RNA, 64 nt, Homo Sapiens; identical to SEQ ID NO: 125103

SEQ ID NO: 634727 - RNA, 64 nt, Homo Sapiens; identical to SEQ ID NO: 125104

SEQ ID NO: 634728 - RNA, 64 nt, Homo Sapiens; identical to SEQ ID NO: 125105

SEQ ID NO: 634729 - RNA, 64 nt, Homo Sapiens; identical to SEQ ID NO: 125106

SEQ ID NO: 634730 - RNA, 64 nt, Homo Sapiens; identical to SEQ ID NO: 125107

SEQ ID NO: 634731 - RNA, 64 nt, Homo Sapiens; identical to SEQ ID NO: 125108

SEQ ID NO: 634732 - RNA, 64 nt, Homo Sapiens; identical to SEQ ID NO: 125109

SEQ ID NO: 634733 - RNA, 64 nt, Homo Sapiens; identical to SEQ ID NO: 125110

SEQ ID NO: 634734 - RNA, 64 nt, Homo Sapiens; identical to SEQ ID NO: 125111

SEQ ID NO: 634735 - RNA, 64 nt, Homo Sapiens; identical to SEQ ID NO: 125112

SEQ ID NO: 634736 - RNA, 64 nt, Homo Sapiens; identical to SEQ ID NO: 125113

SEQ ID NO: 634737 - RNA, 64 nt, Homo Sapiens; identical to SEQ ID NO: 125114

SEQ ID NO: 634738 - RNA, 64 nt, Homo Sapiens; identical to SEQ ID NO: 125115

SEQ ID NO: 634739 - RNA, 64 nt, Homo Sapiens; identical to SEQ ID NO: 125116

SEQ ID NO: 634740 - RNA, 64 nt, Homo Sapiens; identical to SEQ ID NO: 125117

SEQ ID NO: 634741 - RNA, 64 nt, Homo Sapiens; identical to SEQ ID NO: 125118

SEQ ID NO: 634742 - RNA, 64 nt, Homo Sapiens; identical to SEQ ID NO: 125119

SEQ ID NO: 634743 - RNA, 64 nt, Homo Sapiens; identical to SEQ ID NO: 125120

SEQ ID NO: 634744 - RNA, 64 nt, Homo Sapiens; identical to SEQ ID NO: 125121

SEQ ID NO: 634745 - RNA, 64 nt, Homo Sapiens; identical to SEQ ID NO: 125122

SEQ ID NO: 634746 - RNA, 64 nt, Homo Sapiens; identical to SEQ ID NO: 125123

SEQ ID NO: 634747 - RNA, 64 nt, Homo Sapiens; identical to SEQ ID NO: 125124

SEQ ID NO: 634748 - RNA, 64 nt, Homo Sapiens; identical to SEQ ID NO: 125125

SEQ ID NO: 634749 - RNA, 64 nt, Homo Sapiens; identical to SEQ ID NO: 125126

SEQ ID NO: 634750 - RNA, 64 nt, Homo Sapiens; identical to SEQ ID NO: 125127

SEQ ID NO: 634751 - RNA, 64 nt, Homo Sapiens; identical to SEQ ID NO: 125128

SEQ ID NO: 634752 - RNA, 64 nt, Homo Sapiens; identical to SEQ ID NO: 125129

SEQ ID NO: 634753 - RNA, 64 nt, Homo Sapiens; identical to SEQ ID NO: 125130

SEQ ID NO: 634754 - RNA, 64 nt, Homo Sapiens; identical to SEQ ID NO: 125131

SEQ ID NO: 634755 - RNA, 64 nt, Homo Sapiens; identical to SEQ ID NO: 125132

SEQ ID NO: 634756 - RNA, 64 nt, Homo Sapiens; identical to SEQ ID NO: 125133

SEQ ID NO: 634757 - RNA, 64 nt, Homo Sapiens; identical to SEQ ID NO: 125134

SEQ ID NO: 634758 - RNA, 64 nt, Homo Sapiens; identical to SEQ ID NO: 125135

SEQ ID NO: 634759 - RNA, 64 nt, Homo Sapiens; identical to SEQ ID NO: 125136

SEQ ID NO: 634760 - RNA, 64 nt, Homo Sapiens; identical to SEQ ID NO: 125137

SEQ ID NO: 634761 - RNA, 64 nt, Homo Sapiens; identical to SEQ ID NO: 125138

SEQ ID NO: 634762 - RNA, 64 nt, Homo Sapiens; identical to SEQ ID NO: 125139

SEQ ID NO: 634763 - RNA, 64 nt, Homo Sapiens; identical to SEQ ID NO: 125140

SEQ ID NO: 634764 - RNA, 64 nt, Homo Sapiens; identical to SEQ ID NO: 125141

SEQ ID NO: 634765 - RNA, 64 nt, Homo Sapiens; identical to SEQ ID NO: 125142

SEQ ID NO: 634766 - RNA, 64 nt, Homo Sapiens; identical to SEQ ID NO: 125143

SEQ ID NO: 634767 - RNA, 64 nt, Homo Sapiens; identical to SEQ ID NO: 125144

SEQ ID NO: 634768 - RNA, 64 nt, Homo Sapiens; identical to SEQ ID NO: 125145

SEQ ID NO: 634769 - RNA, 64 nt, Homo Sapiens; identical to SEQ ID NO: 125146

SEQ ID NO: 634770 - RNA, 64 nt, Homo Sapiens; identical to SEQ ID NO: 125147

SEQ ID NO: 634771 - RNA, 64 nt, Homo Sapiens; identical to SEQ ID NO: 125148

SEQ ID NO: 634772 - RNA, 64 nt, Homo Sapiens; identical to SEQ ID NO: 125149

SEQ ID NO: 634773 - RNA, 64 nt, Homo Sapiens; identical to SEQ ID NO: 125150

SEQ ID NO: 634774 - RNA, 64 nt, Homo Sapiens; identical to SEQ ID NO: 125151

SEQ ID NO: 634775 - RNA, 64 nt, Homo Sapiens; identical to SEQ ID NO: 125152

SEQ ID NO: 634776 - RNA, 64 nt, Homo Sapiens; identical to SEQ ID NO: 125153

SEQ ID NO: 634777 - RNA, 64 nt, Homo Sapiens; identical to SEQ ID NO: 125154

SEQ ID NO: 634778 - RNA, 64 nt, Homo Sapiens; identical to SEQ ID NO: 125155

SEQ ID NO: 634779 - RNA, 64 nt, Homo Sapiens; identical to SEQ ID NO: 125156

SEQ ID NO: 634780 - RNA, 64 nt, Homo Sapiens; identical to SEQ ID NO: 125157

SEQ ID NO: 634781 - RNA, 64 nt, Homo Sapiens; identical to SEQ ID NO: 125158

SEQ ID NO: 634782 - RNA, 64 nt, Homo Sapiens; identical to SEQ ID NO: 125159

SEQ ID NO: 634783 - RNA, 64 nt, Homo Sapiens; identical to SEQ ID NO: 125160

SEQ ID NO: 634784 - RNA, 64 nt, Homo Sapiens; identical to SEQ ID NO: 125161

SEQ ID NO: 634785 - RNA, 64 nt, Homo Sapiens; identical to SEQ ID NO: 125162

SEQ ID NO: 634786 - RNA, 64 nt, Homo Sapiens; identical to SEQ ID NO: 125163

SEQ ID NO: 634787 - RNA, 64 nt, Homo Sapiens; identical to SEQ ID NO: 125164

SEQ ID NO: 634788 - RNA, 64 nt, Homo Sapiens; identical to SEQ ID NO: 125165

SEQ ID NO: 634789 - RNA, 64 nt, Homo Sapiens; identical to SEQ ID NO: 125166

SEQ ID NO: 634790 - RNA, 64 nt, Homo Sapiens; identical to SEQ ID NO: 125167

SEQ ID NO: 634791 - RNA, 64 nt, Homo Sapiens; identical to SEQ ID NO: 125168

SEQ ID NO: 634792 - RNA, 64 nt, Homo Sapiens; identical to SEQ ID NO: 125169

SEQ ID NO: 634793 - RNA, 64 nt, Homo Sapiens; identical to SEQ ID NO: 125170

SEQ ID NO: 634794 - RNA, 64 nt, Homo Sapiens; identical to SEQ ID NO: 125171

SEQ ID NO: 634795 - RNA, 64 nt, Homo Sapiens; identical to SEQ ID NO: 125172

SEQ ID NO: 634796 - RNA, 64 nt, Homo Sapiens; identical to SEQ ID NO: 125173

SEQ ID NO: 634797 - RNA, 64 nt, Homo Sapiens; identical to SEQ ID NO: 125174

SEQ ID NO: 634798 - RNA, 64 nt, Homo Sapiens; identical to SEQ ID NO: 125175

SEQ ID NO: 634799 - RNA, 64 nt, Homo Sapiens; identical to SEQ ID NO: 125176

SEQ ID NO: 634800 - RNA, 64 nt, Homo Sapiens; identical to SEQ ID NO: 125177

SEQ ID NO: 634801 - RNA, 64 nt, Homo Sapiens; identical to SEQ ID NO: 125178

SEQ ID NO: 634802 - RNA, 64 nt, Homo Sapiens; identical to SEQ ID NO: 125179

SEQ ID NO: 634803 - RNA, 64 nt, Homo Sapiens; identical to SEQ ID NO: 125180

SEQ ID NO: 634804 - RNA, 64 nt, Homo Sapiens; identical to SEQ ID NO: 125181

SEQ ID NO: 634805 - RNA, 64 nt, Homo Sapiens; identical to SEQ ID NO: 125182

SEQ ID NO: 634806 - RNA, 64 nt, Homo Sapiens; identical to SEQ ID NO: 125183

SEQ ID NO: 634807 - RNA, 64 nt, Homo Sapiens; identical to SEQ ID NO: 125184

SEQ ID NO: 634808 - RNA, 64 nt, Homo Sapiens; identical to SEQ ID NO: 125185

SEQ ID NO: 634809 - RNA, 64 nt, Homo Sapiens; identical to SEQ ID NO: 125186

SEQ ID NO: 634810 - RNA, 64 nt, Homo Sapiens; identical to SEQ ID NO: 125187

SEQ ID NO: 634811 - RNA, 64 nt, Homo Sapiens; identical to SEQ ID NO: 125188

SEQ ID NO: 634812 - RNA, 64 nt, Homo Sapiens; identical to SEQ ID NO: 125189

SEQ ID NO: 634813 - RNA, 58 nt, Homo Sapiens; identical to SEQ ID NO: 125190

SEQ ID NO: 634814 - RNA, 64 nt, Homo Sapiens; identical to SEQ ID NO: 125191

SEQ ID NO: 634815 - RNA, 64 nt, Homo Sapiens; identical to SEQ ID NO: 125192

SEQ ID NO: 634816 - RNA, 64 nt, Homo Sapiens; identical to SEQ ID NO: 125193

SEQ ID NO: 634817 - RNA, 64 nt, Homo Sapiens; identical to SEQ ID NO: 125194

SEQ ID NO: 634818 - RNA, 64 nt, Homo Sapiens; identical to SEQ ID NO: 125195

SEQ ID NO: 634819 - RNA, 64 nt, Homo Sapiens; identical to SEQ ID NO: 125196

SEQ ID NO: 634820 - RNA, 64 nt, Homo Sapiens; identical to SEQ ID NO: 125197

SEQ ID NO: 634821 - RNA, 64 nt, Homo Sapiens; identical to SEQ ID NO: 125198

SEQ ID NO: 634822 - RNA, 64 nt, Homo Sapiens; identical to SEQ ID NO: 125199

SEQ ID NO: 634823 - RNA, 64 nt, Homo Sapiens; identical to SEQ ID NO: 125200

SEQ ID NO: 634824 - RNA, 64 nt, Homo Sapiens; identical to SEQ ID NO: 125201

SEQ ID NO: 634825 - RNA, 64 nt, Homo Sapiens; identical to SEQ ID NO: 125202

SEQ ID NO: 634826 - RNA, 64 nt, Homo Sapiens; identical to SEQ ID NO: 125203

SEQ ID NO: 634827 - RNA, 64 nt, Homo Sapiens; identical to SEQ ID NO: 125204

SEQ ID NO: 634828 - RNA, 64 nt, Homo Sapiens; identical to SEQ ID NO: 125205

SEQ ID NO: 634829 - RNA, 64 nt, Homo Sapiens; identical to SEQ ID NO: 125206

SEQ ID NO: 634830 - RNA, 64 nt, Homo Sapiens; identical to SEQ ID NO: 125207

SEQ ID NO: 634831 - RNA, 64 nt, Homo Sapiens; identical to SEQ ID NO: 125208

SEQ ID NO: 634832 - RNA, 64 nt, Homo Sapiens; identical to SEQ ID NO: 125209

SEQ ID NO: 634833 - RNA, 64 nt, Homo Sapiens; identical to SEQ ID NO: 125210

SEQ ID NO: 634834 - RNA, 64 nt, Homo Sapiens; identical to SEQ ID NO: 125211

SEQ ID NO: 634835 - RNA, 64 nt, Homo Sapiens; identical to SEQ ID NO: 125212

SEQ ID NO: 634836 - RNA, 64 nt, Homo Sapiens; identical to SEQ ID NO: 125213

SEQ ID NO: 634837 - RNA, 64 nt, Homo Sapiens; identical to SEQ ID NO: 125214

SEQ ID NO: 634838 - RNA, 64 nt, Homo Sapiens; identical to SEQ ID NO: 125215

SEQ ID NO: 634839 - RNA, 64 nt, Homo Sapiens; identical to SEQ ID NO: 125216

SEQ ID NO: 634840 - RNA, 64 nt, Homo Sapiens; identical to SEQ ID NO: 125217

SEQ ID NO: 634841 - RNA, 64 nt, Homo Sapiens; identical to SEQ ID NO: 125218

SEQ ID NO: 634842 - RNA, 64 nt, Homo Sapiens; identical to SEQ ID NO: 125219

SEQ ID NO: 634843 - RNA, 64 nt, Homo Sapiens; identical to SEQ ID NO: 125220

SEQ ID NO: 634844 - RNA, 64 nt, Homo Sapiens; identical to SEQ ID NO: 125221

SEQ ID NO: 634845 - RNA, 64 nt, Homo Sapiens; identical to SEQ ID NO: 125222

SEQ ID NO: 634846 - RNA, 64 nt, Homo Sapiens; identical to SEQ ID NO: 125223

SEQ ID NO: 634847 - RNA, 64 nt, Homo Sapiens; identical to SEQ ID NO: 125224

SEQ ID NO: 634848 - RNA, 64 nt, Homo Sapiens; identical to SEQ ID NO: 125225

SEQ ID NO: 634849 - RNA, 64 nt, Homo Sapiens; identical to SEQ ID NO: 125226

SEQ ID NO: 634850 - RNA, 64 nt, Homo Sapiens; identical to SEQ ID NO: 125227

SEQ ID NO: 634851 - RNA, 64 nt, Homo Sapiens; identical to SEQ ID NO: 125228

SEQ ID NO: 634852 - RNA, 64 nt, Homo Sapiens; identical to SEQ ID NO: 125229

SEQ ID NO: 634853 - RNA, 64 nt, Homo Sapiens; identical to SEQ ID NO: 125230

SEQ ID NO: 634854 - RNA, 64 nt, Homo Sapiens; identical to SEQ ID NO: 125231

SEQ ID NO: 634855 - RNA, 64 nt, Homo Sapiens; identical to SEQ ID NO: 125232

SEQ ID NO: 634856 - RNA, 64 nt, Homo Sapiens; identical to SEQ ID NO: 125233

SEQ ID NO: 634857 - RNA, 64 nt, Homo Sapiens; identical to SEQ ID NO: 125234

SEQ ID NO: 634858 - RNA, 64 nt, Homo Sapiens; identical to SEQ ID NO: 125235

SEQ ID NO: 634859 - RNA, 64 nt, Homo Sapiens; identical to SEQ ID NO: 125236

SEQ ID NO: 634860 - RNA, 64 nt, Homo Sapiens; identical to SEQ ID NO: 125237

SEQ ID NO: 634861 - RNA, 64 nt, Homo Sapiens; identical to SEQ ID NO: 125238

SEQ ID NO: 634862 - RNA, 64 nt, Homo Sapiens; identical to SEQ ID NO: 125239

SEQ ID NO: 634863 - RNA, 64 nt, Homo Sapiens; identical to SEQ ID NO: 125240

SEQ ID NO: 634864 - RNA, 64 nt, Homo Sapiens; identical to SEQ ID NO: 125241

SEQ ID NO: 634865 - RNA, 64 nt, Homo Sapiens; identical to SEQ ID NO: 125242

SEQ ID NO: 634866 - RNA, 64 nt, Homo Sapiens; identical to SEQ ID NO: 125243

SEQ ID NO: 634867 - RNA, 64 nt, Homo Sapiens; identical to SEQ ID NO: 125244

SEQ ID NO: 634868 - RNA, 64 nt, Homo Sapiens; identical to SEQ ID NO: 125245

SEQ ID NO: 634869 - RNA, 64 nt, Homo Sapiens; identical to SEQ ID NO: 125246

SEQ ID NO: 634870 - RNA, 64 nt, Homo Sapiens; identical to SEQ ID NO: 125247

SEQ ID NO: 634871 - RNA, 64 nt, Homo Sapiens; identical to SEQ ID NO: 125248

SEQ ID NO: 634872 - RNA, 64 nt, Homo Sapiens; identical to SEQ ID NO: 125249

SEQ ID NO: 634873 - RNA, 64 nt, Homo Sapiens; identical to SEQ ID NO: 125250

SEQ ID NO: 634874 - RNA, 64 nt, Homo Sapiens; identical to SEQ ID NO: 125251

SEQ ID NO: 634875 - RNA, 64 nt, Homo Sapiens; identical to SEQ ID NO: 125252

SEQ ID NO: 634876 - RNA, 64 nt, Homo Sapiens; identical to SEQ ID NO: 125253

SEQ ID NO: 634877 - RNA, 64 nt, Homo Sapiens; identical to SEQ ID NO: 125254

SEQ ID NO: 634878 - RNA, 64 nt, Homo Sapiens; identical to SEQ ID NO: 125255

SEQ ID NO: 634879 - RNA, 64 nt, Homo Sapiens; identical to SEQ ID NO: 125256

SEQ ID NO: 634880 - RNA, 64 nt, Homo Sapiens; identical to SEQ ID NO: 125257

SEQ ID NO: 634881 - RNA, 64 nt, Homo Sapiens; identical to SEQ ID NO: 125258

SEQ ID NO: 634882 - RNA, 64 nt, Homo Sapiens; identical to SEQ ID NO: 125259

SEQ ID NO: 634883 - RNA, 64 nt, Homo Sapiens; identical to SEQ ID NO: 125260

SEQ ID NO: 634884 - RNA, 64 nt, Homo Sapiens; identical to SEQ ID NO: 125261

SEQ ID NO: 634885 - RNA, 64 nt, Homo Sapiens; identical to SEQ ID NO: 125262

SEQ ID NO: 634886 - RNA, 64 nt, Homo Sapiens; identical to SEQ ID NO: 125263

SEQ ID NO: 634887 - RNA, 64 nt, Homo Sapiens; identical to SEQ ID NO: 125264

SEQ ID NO: 634888 - RNA, 64 nt, Homo Sapiens; identical to SEQ ID NO: 125265

SEQ ID NO: 634889 - RNA, 64 nt, Homo Sapiens; identical to SEQ ID NO: 125266

SEQ ID NO: 634890 - RNA, 64 nt, Homo Sapiens; identical to SEQ ID NO: 125267

SEQ ID NO: 634891 - RNA, 64 nt, Homo Sapiens; identical to SEQ ID NO: 125268

SEQ ID NO: 634892 - RNA, 64 nt, Homo Sapiens; identical to SEQ ID NO: 125269

SEQ ID NO: 634893 - RNA, 64 nt, Homo Sapiens; identical to SEQ ID NO: 125270

SEQ ID NO: 634894 - RNA, 64 nt, Homo Sapiens; identical to SEQ ID NO: 125271

SEQ ID NO: 634895 - RNA, 64 nt, Homo Sapiens; identical to SEQ ID NO: 125272

SEQ ID NO: 634896 - RNA, 64 nt, Homo Sapiens; identical to SEQ ID NO: 125273

SEQ ID NO: 634897 - RNA, 64 nt, Homo Sapiens; identical to SEQ ID NO: 125274

SEQ ID NO: 634898 - RNA, 64 nt, Homo Sapiens; identical to SEQ ID NO: 125275

SEQ ID NO: 634899 - RNA, 64 nt, Homo Sapiens; identical to SEQ ID NO: 125276

SEQ ID NO: 634900 - RNA, 64 nt, Homo Sapiens; identical to SEQ ID NO: 125277

SEQ ID NO: 634901 - RNA, 64 nt, Homo Sapiens; identical to SEQ ID NO: 125278

SEQ ID NO: 634902 - RNA, 64 nt, Homo Sapiens; identical to SEQ ID NO: 125279

SEQ ID NO: 634903 - RNA, 63 nt, Homo Sapiens; identical to SEQ ID NO: 125280

SEQ ID NO: 634904 - RNA, 64 nt, Homo Sapiens; identical to SEQ ID NO: 125281

SEQ ID NO: 634905 - RNA, 64 nt, Homo Sapiens; identical to SEQ ID NO: 125282

SEQ ID NO: 634906 - RNA, 64 nt, Homo Sapiens; identical to SEQ ID NO: 125283

SEQ ID NO: 634907 - RNA, 64 nt, Homo Sapiens; identical to SEQ ID NO: 125284

SEQ ID NO: 634908 - RNA, 64 nt, Homo Sapiens; identical to SEQ ID NO: 125285

SEQ ID NO: 634909 - RNA, 64 nt, Homo Sapiens; identical to SEQ ID NO: 125286

SEQ ID NO: 634910 - RNA, 64 nt, Homo Sapiens; identical to SEQ ID NO: 125287

SEQ ID NO: 634911 - RNA, 64 nt, Homo Sapiens; identical to SEQ ID NO: 125288

SEQ ID NO: 634912 - RNA, 64 nt, Homo Sapiens; identical to SEQ ID NO: 125289

SEQ ID NO: 634913 - RNA, 64 nt, Homo Sapiens; identical to SEQ ID NO: 125290

SEQ ID NO: 634914 - RNA, 64 nt, Homo Sapiens; identical to SEQ ID NO: 125291

SEQ ID NO: 634915 - RNA, 64 nt, Homo Sapiens; identical to SEQ ID NO: 125292

SEQ ID NO: 634916 - RNA, 64 nt, Homo Sapiens; identical to SEQ ID NO: 125293

SEQ ID NO: 634917 - RNA, 64 nt, Homo Sapiens; identical to SEQ ID NO: 125294

SEQ ID NO: 634918 - RNA, 64 nt, Homo Sapiens; identical to SEQ ID NO: 125295

SEQ ID NO: 634919 - RNA, 64 nt, Homo Sapiens; identical to SEQ ID NO: 125296

SEQ ID NO: 634920 - RNA, 64 nt, Homo Sapiens; identical to SEQ ID NO: 125297

SEQ ID NO: 634921 - RNA, 64 nt, Homo Sapiens; identical to SEQ ID NO: 74579

SEQ ID NO: 634922 - RNA, 64 nt, Homo Sapiens; identical to SEQ ID NO: 74580

SEQ ID NO: 634923 - RNA, 64 nt, Homo Sapiens; identical to SEQ ID NO: 110383

SEQ ID NO: 634924 - RNA, 64 nt, Homo Sapiens; identical to SEQ ID NO: 110384

SEQ ID NO: 634925 - RNA, 64 nt, Homo Sapiens; identical to SEQ ID NO: 110385

SEQ ID NO: 634926 - RNA, 64 nt, Homo Sapiens; identical to SEQ ID NO: 110386

SEQ ID NO: 634927 - RNA, 64 nt, Homo Sapiens; identical to SEQ ID NO: 110387

SEQ ID NO: 634928 - RNA, 64 nt, Homo Sapiens; identical to SEQ ID NO: 110388

SEQ ID NO: 634929 - RNA, 64 nt, Homo Sapiens
guaagcucauaaaaauaauugaugauaacacuuaccaaaagaucacugcaaaccugccucaaga

SEQ ID NO: 634930 - RNA, 64 nt, Homo Sapiens
gacgauacaaaagccagcaauaauucuucaagauccaaaagaaaaaaauauacuaccucagauu

SEQ ID NO: 634931 - RNA, 64 nt, Homo Sapiens
uuaaaagcuguucuguucucacuucugacuuuaaccaaaagauuucaacccacaaugaucaggu

SEQ ID NO: 634932 - RNA, 64 nt, Homo Sapiens
gucaaucaaaaucccuaagagcagaacuccuaccccaaaagaagccuggaagucuaauuaagag

SEQ ID NO: 634933 - RNA, 64 nt, Homo Sapiens
auuaaaagucauacauuacaaaaguccuacucugccaaaagaagcaacugcuauuauaauucuc

SEQ ID NO: 634934 - RNA, 64 nt, Homo Sapiens
uuuuuagaguuguaaaaaccagucaugagguuuuccaaaagaugucugcauuugugagugguuc

SEQ ID NO: 634935 - RNA, 64 nt, Homo Sapiens
cuuaaaaauggguuuauuuuucaauuuggagugaccaaaagauaguauuuuuuuaugagcaaua

SEQ ID NO: 634936 - RNA, 64 nt, Homo Sapiens
gaagacaaaaagacaaacacgauuuaaauguaaaccaaaagaugcaggggauauuuuuugagau

SEQ ID NO: 634937 - RNA, 64 nt, Homo Sapiens
acaugaaguaugguguaauaggaauaauauuuauccaaaagauuuuuaaaaauagggcuguguu

SEQ ID NO: 634938 - RNA, 64 nt, Homo Sapiens
ggaaguaaaucuauaucuguuagaaauaauguagccaaaagaauguaaauuugaggauuuuuuu

SEQ ID NO: 634939 - RNA, 64 nt, Homo Sapiens
uuuuagaaucaauuuauaaagaagguuuugaaugccaaaagauaagaaaauguaaaaugcucau

SEQ ID NO: 634940 - RNA, 64 nt, Homo Sapiens
caucgcaggaagaaguuaaggcagaggggagacuccaaaagagucaguacugaauuaugccuug

SEQ ID NO: 634941 - RNA, 64 nt, Homo Sapiens
ugcagcucuguggcuuggaauuucauuugagcaauuucuauaggauauguauuuauuauugauu

SEQ ID NO: 634942 - RNA, 64 nt, Homo Sapiens
uaauguaaauugugauuuuuguuuuacauguggguuucuauaguuuuaauuuuuucagcuuuua

SEQ ID NO: 634943 - RNA, 64 nt, Homo Sapiens
ugacuaauguuugaaauuauuuuuucuaagaguuuuucuauaaccuuccaaaagucgugauguu

SEQ ID NO: 634944 - RNA, 64 nt, Homo Sapiens
uuugggguuuuuaaauaagcauuaacuaacaaccuuucuauaguuaaugcagaguuaaugaaca

SEQ ID NO: 634945 - RNA, 64 nt, Homo Sapiens
aauguaguuauaaugcuuuugaaaaauuuuccuuuuucuauauccccuuaguccagccucucuu

SEQ ID NO: 634946 - RNA, 64 nt, Homo Sapiens
gugugacuugaagauuaccaaugauuuugaggcuuuucuauaauaaaaagagguucuaaccauu

SEQ ID NO: 634947 - RNA, 64 nt, Homo Sapiens
uggaggaccuggcaaaccugcccagauuccaugcuuucuauaacucuugcagagaacaagucug

SEQ ID NO: 634948 - RNA, 64 nt, Homo Sapiens
uuuuauugcaagagguaaagauauuugucuauuuuuucuauaagaagcuguaaauugcaugugc

SEQ ID NO: 634949 - RNA, 64 nt, Homo Sapiens
aaauuaacaagauucaccuaagcaagaauucuuauuucuauaaucuauuguaacacauaaagac

SEQ ID NO: 634950 - RNA, 64 nt, Homo Sapiens
cacaaaaucaguguuuauucacuucaaauaguuuuuucuauaaaaacucaaauuccuguuucca

SEQ ID NO: 634951 - RNA, 64 nt, Homo Sapiens
ccuuucuccugguuucaugacaguguuauuccuuuuucuauaaauauauuuuuaggaaaaaaag

SEQ ID NO: 634952 - RNA, 64 nt, Homo Sapiens
ugaaauguucuauacacuaucaaauauauaaagcuuucuauauugaauguacauuauacagauc

SEQ ID NO: 634953 - RNA, 64 nt, Homo Sapiens
aauuuguuacaugucagugauuuuuuuuuuuuuuuuucuauacauggcccgguaccaccuuuuu

SEQ ID NO: 634954 - RNA, 64 nt, Homo Sapiens
guaggacucaguggggacuuuaauaucaaaggaauuucuauaucuaaaauauuuuuguauuuug

SEQ ID NO: 634955 - RNA, 64 nt, Homo Sapiens
uaugcaaaagguuuauuccggaaacuaguguacauuucuauaaauagaugcuguguauauggua

SEQ ID NO: 634956 - RNA, 64 nt, Homo Sapiens
uuuauuuccuuuguccuuuuucaggagaauuagauuucuauaggauuuuucuuuaggagauuua

SEQ ID NO: 634957 - RNA, 64 nt, Homo Sapiens
ugauguaugccauuaaaaaaauuguuuuuuuaauuuucuauauuauaaacauaaaauaaguaau

SEQ ID NO: 634958 - RNA, 64 nt, Homo Sapiens
uauuaaaugcugaggccaauaccaagaaguuuauuuucuauauuauacaauuaugaauuacaug

SEQ ID NO: 634959 - RNA, 64 nt, Homo Sapiens
uuucaaauauguacucuugaagucaagcaauaaauuucuauacauaaaauaggauccugauuua

SEQ ID NO: 634960 - RNA, 64 nt, Homo Sapiens
agucuuuuaucauauuuauacugcuguccaaucuuuucuauauuuagaaauaauaauguacaua

SEQ ID NO: 634961 - RNA, 64 nt, Homo Sapiens
ugaccaauaaguugauauuuguccauaggucuccuuucuauaaaucaucuugauguuuaacaac

SEQ ID NO: 634962 - RNA, 64 nt, Homo Sapiens
cucaguauccuaaaacuuagaaccuuauugauauuuucuauacaguaguuuugugauuagaauu

SEQ ID NO: 634963 - RNA, 64 nt, Homo Sapiens
auguaaaugauauauuuuuggugaaaugcaaccuuuucuauaaaaugugggcaacauuuuaaag

SEQ ID NO: 634964 - RNA, 64 nt, Homo Sapiens
acuuccccgguaugaugauuguugguaacaacuuuuucuauagucauugauggaguagaucaug

SEQ ID NO: 634965 - RNA, 64 nt, Homo Sapiens
aaauaguugagucaagcuugucuccugcagugcuuuucuauaugaauguuuuuaaacaaaguuu

SEQ ID NO: 634966 - RNA, 64 nt, Homo Sapiens
gacauagcacagaugaaccaaauaucugacgggauuucuauaugcugaauuacccgguagacug

SEQ ID NO: 634967 - RNA, 64 nt, Homo Sapiens
auggagacggcuuucauauguagucaaaucuccuuuucuauaaauaaaguauucuucguuucuu

SEQ ID NO: 634968 - RNA, 64 nt, Homo Sapiens
auaauaacauacccacacaaauuuguuauauauguuucuauagacacaguauaauuacauaaga

SEQ ID NO: 634969 - RNA, 64 nt, Homo Sapiens
auaagaacauacacgauucaauauccugguuaaguuucuauaaaaagaagaaugaaacgccugu

SEQ ID NO: 634970 - RNA, 64 nt, Homo Sapiens
ugaguugcuggggaccuucaaggaaauaaauagcuuucuauauauuuguuuuugaguuuucuau

SEQ ID NO: 634971 - RNA, 64 nt, Homo Sapiens
aaauaaauagcuuucuauaucuuuguuuuugaguuuucuauaggcuuuauuuuucuuucuuuuu

SEQ ID NO: 634972 - RNA, 64 nt, Homo Sapiens
caaauugaucuuauuuuugauguucuuuaaggaauuucuauaacuugaaauaauuaaguggugg

SEQ ID NO: 634973 - RNA, 64 nt, Homo Sapiens
ccuuuauuuucaaaugcacaauuugugaacaacguuucuauaguuaauaccugagagucuuaaa

SEQ ID NO: 634974 - RNA, 64 nt, Homo Sapiens
cuuacaauguauguaugauguugauuuauuuaauuuucuauauuuuaacuuaauauuuaauuau

SEQ ID NO: 634975 - RNA, 64 nt, Homo Sapiens
uggagaaaguuugugcccugaccauuucaacuauuuucuauauuucccgguaaaaaugaauuga

SEQ ID NO: 634976 - RNA, 64 nt, Homo Sapiens
auguuuucgcuuuuguauuuaccauagauaguucuuucuauauuuaaagucugugagaauauca

SEQ ID NO: 634977 - RNA, 64 nt, Homo Sapiens
ugaaacauaaaguggcagggcauuucuauaaauguuucuauauaaugaaaagaugguaauaugu

SEQ ID NO: 634978 - RNA, 64 nt, Homo Sapiens
uguuucuauauaugaaacauaugguaauaugucauuucuauaaaccugcuuagcuuaugaaaag

SEQ ID NO: 634979 - RNA, 64 nt, Homo Sapiens
uucacauauguaguauuauuauuuuagggauucauuucuauauuuucucucaaaugaaaauuua

SEQ ID NO: 634980 - RNA, 64 nt, Homo Sapiens
aauauaguuggaaauaaauguaugaaguagcaauuuucuauaggcaaaauguguugaagugccc

SEQ ID NO: 634981 - RNA, 64 nt, Homo Sapiens
agcugggacuacaggcaugugccaccacaccuaauuucuauauuuuuuguagagacuagguuuc

SEQ ID NO: 634982 - RNA, 64 nt, Homo Sapiens
ucuaugcugagcuuacauagaauuucuuccauguuuucuauagcuauaguguauuuuuaccuuu

SEQ ID NO: 634983 - RNA, 64 nt, Homo Sapiens
aacaagugcuaaguguaccguugauuugaaauguuuucuauagaugguucacaucauaaagaac

SEQ ID NO: 634984 - RNA, 64 nt, Homo Sapiens
auggguaggcaggagaaaagagccucucuuguuuuuucuauaaagugcuaccagccacggaagg

SEQ ID NO: 634985 - RNA, 64 nt, Homo Sapiens
uuuaaaaacuucgugcauuuguuacagcucauguuuucuauaugaacuuagucauuaauguucu

SEQ ID NO: 634986 - RNA, 64 nt, Homo Sapiens
ccacuacauuuuggugcuauuuaaggugugcaauuuucuauaggugacuuuugcaauucaggga

SEQ ID NO: 634987 - RNA, 64 nt, Homo Sapiens
ggcaacuuaaauaacuccugagcaguuggcacuagaacagaauacuuggaaugacaccaaaguu

SEQ ID NO: 634988 - RNA, 64 nt, Homo Sapiens
gcaaagaucaugauuaacugucaagacacugguagaacagaacaagcaaaagauuaagaguuca

SEQ ID NO: 634989 - RNA, 64 nt, Homo Sapiens
ggcuuucaaugaguuccuauguggauuuuuaaaagaacagaacaguaaugaaauauuugaagua

SEQ ID NO: 634990 - RNA, 64 nt, Homo Sapiens
aaaagcuauaugcagaguuuuguauaaaacaauagaacagaaauuugggacauuuuucuaggaa

SEQ ID NO: 634991 - RNA, 64 nt, Homo Sapiens
ccugaagacaaugauuauuucuggaggagcaagggaacagaaacuacauuguaaccuguuuguc

SEQ ID NO: 634992 - RNA, 64 nt, Homo Sapiens
agggaaguuuuuaaaaaugucauuacuuucaaaggaacagaaguaguuaaccaaacuaacaagc

SEQ ID NO: 634993 - RNA, 64 nt, Homo Sapiens
ugcucuuuauuucauuccuuggauuugauacuaggaacagaaucucuuuuaagaaucaaaauau

SEQ ID NO: 634994 - RNA, 64 nt, Homo Sapiens
cgucuuugaauucuccaacauaauuuguuugcuggaacagaagcacgugacuacaauggauaaa

SEQ ID NO: 634995 - RNA, 64 nt, Homo Sapiens
auccuacacaaccacuaaggguagucaucaaggugaacagaagcaaaacaggauucuugcuucu

SEQ ID NO: 634996 - RNA, 64 nt, Homo Sapiens
agaugaaugaaagaaccaaguuuacuuuuuuaaagaacagaaaagagauauuccaaaguuuuau

SEQ ID NO: 634997 - RNA, 64 nt, Homo Sapiens
gaaaaacaguguaugaaaguaggagaaggauugggaacagaauguuguauccaucaaguauuac

SEQ ID NO: 634998 - RNA, 64 nt, Homo Sapiens
cgauggaguagccagugguaauacaaagcagggagaacagaaagguagaguuacuaaggccuuc

SEQ ID NO: 634999 - RNA, 64 nt, Homo Sapiens
agaacagaaagguagaguuacuaaggccuucagugaacagaaaggagcagagagcaagauuaga

SEQ ID NO: 635000 - RNA, 64 nt, Homo Sapiens
gcaaauagucucuauuuguaaggaucuauugagugaacagaauucaugucuagcuuucaccucc

SEQ ID NO: 635001 - RNA, 64 nt, Homo Sapiens
aucagaccuuugaaugauuccggcgggccucagggaacagaauggguaugaagccagaccuccc

SEQ ID NO: 635002 - RNA, 64 nt, Homo Sapiens
ggguagugggugggcuagggagcugggagauagggaacagaagaaagugggggauggcuaagaa

SEQ ID NO: 635003 - RNA, 64 nt, Homo Sapiens
aaggaaagaaagaugggaggaaaagaaagcaaaggaacagaaggggcagaaggaaggagggaag

SEQ ID NO: 635004 - RNA, 64 nt, Homo Sapiens; identical to SEQ ID NO: 169330

SEQ ID NO: 635005 - RNA, 64 nt, Homo Sapiens; identical to SEQ ID NO: 169331

SEQ ID NO: 635006 - RNA, 64 nt, Homo Sapiens; identical to SEQ ID NO: 169332

SEQ ID NO: 635007 - RNA, 64 nt, Homo Sapiens; identical to SEQ ID NO: 169333

SEQ ID NO: 635008 - RNA, 64 nt, Homo Sapiens; identical to SEQ ID NO: 169334

SEQ ID NO: 635009 - RNA, 64 nt, Homo Sapiens; identical to SEQ ID NO: 169335

SEQ ID NO: 635010 - RNA, 64 nt, Homo Sapiens; identical to SEQ ID NO: 169336

SEQ ID NO: 635011 - RNA, 64 nt, Homo Sapiens; identical to SEQ ID NO: 169337

SEQ ID NO: 635012 - RNA, 64 nt, Homo Sapiens; identical to SEQ ID NO: 169338

SEQ ID NO: 635013 - RNA, 64 nt, Homo Sapiens; identical to SEQ ID NO: 169339

SEQ ID NO: 635014 - RNA, 64 nt, Homo Sapiens; identical to SEQ ID NO: 169340

SEQ ID NO: 635015 - RNA, 64 nt, Homo Sapiens; identical to SEQ ID NO: 169341

SEQ ID NO: 635016 - RNA, 64 nt, Homo Sapiens; identical to SEQ ID NO: 169342

SEQ ID NO: 635017 - RNA, 64 nt, Homo Sapiens; identical to SEQ ID NO: 169343

SEQ ID NO: 635018 - RNA, 64 nt, Homo Sapiens; identical to SEQ ID NO: 169344

SEQ ID NO: 635019 - RNA, 64 nt, Homo Sapiens; identical to SEQ ID NO: 169345

SEQ ID NO: 635020 - RNA, 64 nt, Homo Sapiens; identical to SEQ ID NO: 169346

SEQ ID NO: 635021 - RNA, 64 nt, Homo Sapiens; identical to SEQ ID NO: 169347

SEQ ID NO: 635022 - RNA, 64 nt, Homo Sapiens; identical to SEQ ID NO: 169348

SEQ ID NO: 635023 - RNA, 64 nt, Homo Sapiens; identical to SEQ ID NO: 169349

SEQ ID NO: 635024 - RNA, 64 nt, Homo Sapiens; identical to SEQ ID NO: 169350

SEQ ID NO: 635025 - RNA, 64 nt, Homo Sapiens; identical to SEQ ID NO: 169351

SEQ ID NO: 635026 - RNA, 64 nt, Homo Sapiens; identical to SEQ ID NO: 169352

SEQ ID NO: 635027 - RNA, 64 nt, Homo Sapiens; identical to SEQ ID NO: 169353

SEQ ID NO: 635028 - RNA, 64 nt, Homo Sapiens; identical to SEQ ID NO: 169354

SEQ ID NO: 635029 - RNA, 64 nt, Homo Sapiens; identical to SEQ ID NO: 169355

SEQ ID NO: 635030 - RNA, 64 nt, Homo Sapiens; identical to SEQ ID NO: 169356

SEQ ID NO: 635031 - RNA, 64 nt, Homo Sapiens; identical to SEQ ID NO: 169357

SEQ ID NO: 635032 - RNA, 64 nt, Homo Sapiens; identical to SEQ ID NO: 169358

SEQ ID NO: 635033 - RNA, 64 nt, Homo Sapiens; identical to SEQ ID NO: 169359

SEQ ID NO: 635034 - RNA, 64 nt, Homo Sapiens; identical to SEQ ID NO: 169360

SEQ ID NO: 635035 - RNA, 64 nt, Homo Sapiens; identical to SEQ ID NO: 169361

SEQ ID NO: 635036 - RNA, 64 nt, Homo Sapiens; identical to SEQ ID NO: 169362

SEQ ID NO: 635037 - RNA, 64 nt, Homo Sapiens; identical to SEQ ID NO: 169363

SEQ ID NO: 635038 - RNA, 64 nt, Homo Sapiens; identical to SEQ ID NO: 169364

SEQ ID NO: 635039 - RNA, 64 nt, Homo Sapiens; identical to SEQ ID NO: 169365

SEQ ID NO: 635040 - RNA, 64 nt, Homo Sapiens; identical to SEQ ID NO: 169366

SEQ ID NO: 635041 - RNA, 64 nt, Homo Sapiens; identical to SEQ ID NO: 169367

SEQ ID NO: 635042 - RNA, 64 nt, Homo Sapiens; identical to SEQ ID NO: 169368

SEQ ID NO: 635043 - RNA, 64 nt, Homo Sapiens; identical to SEQ ID NO: 169369

SEQ ID NO: 635044 - RNA, 64 nt, Homo Sapiens; identical to SEQ ID NO: 169370

SEQ ID NO: 635045 - RNA, 64 nt, Homo Sapiens; identical to SEQ ID NO: 169371

SEQ ID NO: 635046 - RNA, 64 nt, Homo Sapiens; identical to SEQ ID NO: 169372

SEQ ID NO: 635047 - RNA, 64 nt, Homo Sapiens; identical to SEQ ID NO: 169373

SEQ ID NO: 635048 - RNA, 64 nt, Homo Sapiens; identical to SEQ ID NO: 169374

SEQ ID NO: 635049 - RNA, 64 nt, Homo Sapiens; identical to SEQ ID NO: 169375

SEQ ID NO: 635050 - RNA, 64 nt, Homo Sapiens; identical to SEQ ID NO: 169376

SEQ ID NO: 635051 - RNA, 64 nt, Homo Sapiens
uuagacuggaaguucauaccuaaguacuguaauaauaccucaauguuugaggagcauguuuugu

SEQ ID NO: 635052 - RNA, 64 nt, Homo Sapiens
auauauuuagugcugcaucuuauagcacuuugaaauaccucauguuuaugaaaauaaauagcuu

SEQ ID NO: 635053 - RNA, 64 nt, Homo Sapiens
uuuuuuugcucuccauuuugacuugcaagaaauaauaccucaagauaaucugauuuauuagcua

SEQ ID NO: 635054 - RNA, 64 nt, Homo Sapiens
cacacuuuuuuugacugaugacaucuccuuugcuauaccucaauuuuuggaauuuagagaagaa

SEQ ID NO: 635055 - RNA, 64 nt, Homo Sapiens
agccugcauugauaacagccuuaacccucgaggaauaccucaauaccucagacaaggcccuucc

SEQ ID NO: 635056 - RNA, 64 nt, Homo Sapiens
uugauaacagccuuaacccucgaggaauaccucaauaccucagacaaggcccuuccaauauguu

SEQ ID NO: 635057 - RNA, 64 nt, Homo Sapiens
auuuugacguuaaaaaacaacaacagaucuagagauaccucaaggauaucauuuuugauuuugu

SEQ ID NO: 635058 - RNA, 64 nt, Homo Sapiens
cacacuuuucacugacgggauaucucuuuaugcaauaccucaauuuuucauauugcaaagagua

SEQ ID NO: 635059 - RNA, 64 nt, Homo Sapiens
uuugaaauauaggaaagaaacaugaucuuuugcaauaccucaauaaggcaugcuuucugacuga

SEQ ID NO: 635060 - RNA, 64 nt, Homo Sapiens
agcuggaucuuuuauuuuucuuugacuuguaaggauaccucauaagccuuuaguugcucucuau

SEQ ID NO: 635061 - RNA, 64 nt, Homo Sapiens
uuaaccaauagauauucucuauggcagcacagauauaccucauuguguucucauggcacacuuc

SEQ ID NO: 635062 - RNA, 64 nt, Homo Sapiens
aauucaacuauuuuuucauauguggucaagaugcauaccucauguuguacuuacacugugggca

SEQ ID NO: 635063 - RNA, 64 nt, Homo Sapiens
agucuguuuugcucuaauccuccauuaagcgagcauaccucaagugggucuauuagcauuuaau

SEQ ID NO: 635064 - RNA, 64 nt, Homo Sapiens
caaauccuaaguguauaauuaugugcaauguucaauaccucauauaauacuugcucaacaguau

SEQ ID NO: 635065 - RNA, 64 nt, Homo Sapiens
cagcacaccucaccacaccacaccgcacugcaccauaccucaccacaucucaccacaccacagc

SEQ ID NO: 635066 - RNA, 64 nt, Homo Sapiens
uugccuuuguuguuguauuacaaaucugcauaaaauaccucauuucaaaucaaaucuuacaaau

SEQ ID NO: 635067 - RNA, 64 nt, Homo Sapiens
cauccccacacgugccgaugucagguucauugaaauaccucagauuuguaauuguugauguuug

SEQ ID NO: 635068 - RNA, 64 nt, Homo Sapiens
gaggaaagggaaucaaaagcuugagcacaaacagauaccucagcccgguaagcugcagcucugc

SEQ ID NO: 635069 - RNA, 64 nt, Homo Sapiens
gugauagcacauggguagccuaggcagugaguaaauaccucagauguccuccugcagcaagugu

SEQ ID NO: 635070 - RNA, 64 nt, Homo Sapiens
uugacuugucuaaaaggacaaagagaaaaaaaaaauaccucaugacugcauucucucugacuag

SEQ ID NO: 635071 - RNA, 64 nt, Homo Sapiens
aggggacgugagaaaggaaaaggcaugaaguucuauaccucagccagcagcugccuucguuugg

SEQ ID NO: 635072 - RNA, 62 nt, Homo Sapiens
cuucauugaaaguagugcuguaaauauucugccauaggaauacugucuacaugcuuucucau

SEQ ID NO: 635073 - RNA, 62 nt, Homo Sapiens
ggccucacccaggcaucugcuuuacucuggaccauaggaaacaagaccguuuggagguuuca

SEQ ID NO: 635074 - RNA, 62 nt, Homo Sapiens
ccuucaagugggcugaagcccuuggaaagugacauaggaaguccccagaucuugcccuucuc

SEQ ID NO: 635075 - RNA, 62 nt, Homo Sapiens
aauuguauuuagaucuuguuauugcuccaguacauaggaauuguguaaaguguuaacagcag

SEQ ID NO: 635076 - RNA, 62 nt, Homo Sapiens
accauagauuucuuucagaaaaaaaaaacaggcauaggaacaguuuucucuucauauauuau

SEQ ID NO: 635077 - RNA, 62 nt, Homo Sapiens
auaucuuuaaaauuuuccuuuauguuccauuccauaggaaaacacacauaugcacacaaaac

SEQ ID NO: 635078 - RNA, 62 nt, Homo Sapiens
ggugguuauuugguauuaaacuccaaaugagccauaggaaggcacuacaugaaauaaugcac

SEQ ID NO: 635079 - RNA, 62 nt, Homo Sapiens
uuguaauuuugaugauacaaagauugaaagaucauaggaaagcauugcccuucaucacagaa

SEQ ID NO: 635080 - RNA, 62 nt, Homo Sapiens
gaagcagacacaacccaaacauuugcuacuaacauaggaaacacacacauacagacaccccc

SEQ ID NO: 635081 - RNA, 62 nt, Homo Sapiens
ugagaguuggugcaaauucuuguguguguuugcauaggaaggugagaugaccaucuacuaaa

SEQ ID NO: 635082 - RNA, 62 nt, Homo Sapiens
ccccccggaaaugaacaaagccgggcccuuuccauaggaacugcccuuggagauagcagagu

SEQ ID NO: 635083 - RNA, 62 nt, Homo Sapiens
cucaccaucaugauaccagauacaggugaauacauaggaacuaucugccuguguccucaauc

SEQ ID NO: 635084 - RNA, 62 nt, Homo Sapiens
gauuuuuauuuguuacagguuuccaauggccccauaggaauaagcaauaauguagacugaua

SEQ ID NO: 635085 - RNA, 62 nt, Homo Sapiens
agugaucaccccggacgggcgagcuguauccucauaggaaaccuuuugugaaggccgaacuc

SEQ ID NO: 635086 - RNA, 62 nt, Homo Sapiens
uggaauccaagagcuauaaugcagaucgggggcauaggaauucuccagagcccacgaggcuu

SEQ ID NO: 635087 - RNA, 62 nt, Homo Sapiens
gcccccaucucccaucugggaugggggggagucauaggaaaaccacgucuuccagcuggggg

SEQ ID NO: 635088 - RNA, 62 nt, Homo Sapiens
aaggacugugggcgcugggugugaaguggugucauaggaaugucugagauguggugacucau

SEQ ID NO: 635089 - RNA, 62 nt, Homo Sapiens
gggcccuauuuuccugcugccaaccauaggaucauaggaaagggguucuccucaaagccuca

SEQ ID NO: 635090 - RNA, 62 nt, Homo Sapiens
aaacuguagaguuccauauuccugcaguaacccauaggaaauacagucgaggaaaauugaua

SEQ ID NO: 635091 - RNA, 62 nt, Homo Sapiens
uaaagaaaucauuagcaagaucuuauauuuuccauaggaaggucuuauacagagaucuagaa

SEQ ID NO: 635092 - RNA, 62 nt, Homo Sapiens
ggauccuaccuauguuaauuucagcagccugucauaggaacuuugaugcucauaucuguucu

SEQ ID NO: 635093 - RNA, 62 nt, Homo Sapiens
agggggaaagucucuuacuguccuugaauguacauaggaacagagccuucuugcuuucauuu

SEQ ID NO: 635094 - RNA, 62 nt, Homo Sapiens
auauuaugugcagguccuaguaggcacuuagucauaggaaacggggcaacuuugugaacacg

SEQ ID NO: 635095 - RNA, 62 nt, Homo Sapiens
guauuuuucuugauccaaagaugcuguuaaaacauaggaaggcauucacuauuguauagaag

SEQ ID NO: 635096 - RNA, 62 nt, Homo Sapiens
auacaaguaaggaugugagaacuuacaguuaacauaggaaaaagccguguuuacuuguauua

SEQ ID NO: 635097 - RNA, 62 nt, Homo Sapiens
guuauuuugugggggggggauuuguuaaaauucauaggaaauacacauuuuguaaauaacuu

SEQ ID NO: 635098 - RNA, 62 nt, Homo Sapiens
cggccaccaggacaugcuucaaugccuggugccauaggaagcccaggggacagucacaacuu

SEQ ID NO: 635099 - RNA, 62 nt, Homo Sapiens
aucauuguuuaauaaaaguaaucccugcuggucauaggaaaacacacgguucuaauuaagug

SEQ ID NO: 635100 - RNA, 62 nt, Homo Sapiens
cauauuacucauaaaucauuaauuaauauaagcauaggaaauggucuuaaaagauacugcau

SEQ ID NO: 635101 - RNA, 62 nt, Homo Sapiens
cuugacacaacuuugaaacugcauaaaguagacauaggaacuagaggaaagcucaggcugca

SEQ ID NO: 635102 - RNA, 57 nt, Homo Sapiens
cuggggaaagugaagcaugaagggaaucauaggaaaaauguacugaucauauaauua

SEQ ID NO: 635103 - RNA, 62 nt, Homo Sapiens
cauuuccugcuuuuguguaaggaaggugcucacauaggaaguuuuuauuugguuagagacag

SEQ ID NO: 635104 - RNA, 62 nt, Homo Sapiens
gggggccuucccuggacaguuaugcacagagccauaggaacuggucaagaacaaauggcccc

SEQ ID NO: 635105 - RNA, 62 nt, Homo Sapiens
uugaaaggucugaggaugaucuauauaagucacauaggaaacguacuaagcacagaaacuca

SEQ ID NO: 635106 - RNA, 62 nt, Homo Sapiens
guaaaugguuugaauaagaggcacauccaucucauaggaauuugcauauaggguauggaauu

SEQ ID NO: 635107 - RNA, 62 nt, Homo Sapiens
aguuguuuaaugcucagggcaaccaaauuuagcauaggaaaacucaggcacuucaaaacuaa

SEQ ID NO: 635108 - RNA, 62 nt, Homo Sapiens
cuggagguggguucuggucagacaacuuuggucauaggaacucaguguccggagcggcucua

SEQ ID NO: 635109 - RNA, 62 nt, Homo Sapiens
guaaagccagggugcugacgggccccauagugcauaggaacaaaacaugggcugaaaaugaa

SEQ ID NO: 635110 - RNA, 62 nt, Homo Sapiens
ugacuuaggaaaaagagaaaguauguaaaacacauaggaagccagggucugugauuuuacau

SEQ ID NO: 635111 - RNA, 62 nt, Homo Sapiens
acuuugguuaagaguaaguuuauccauuuugacauaggaagacuguauguauaacccguaaa

SEQ ID NO: 635112 - RNA, 62 nt, Homo Sapiens
augacccaacauuucuuagcccuuugaacuuucauaggaaaaauuggaauuagaccauuugg

SEQ ID NO: 635113 - RNA, 62 nt, Homo Sapiens
uuguuuuugguuucuuuaucaacuuaaaagaacauaggaauuauaggagucuucugccucuu

SEQ ID NO: 635114 - RNA, 62 nt, Homo Sapiens
gaucugucagaacaggcagcgauauguguauccauaggaagacuuugguuugaggagguaga

SEQ ID NO: 635115 - RNA, 62 nt, Homo Sapiens
agccauaccugguaagcaaaaacuaguaaagacauaggaacauguaguuuuacuugguguuu

SEQ ID NO: 635116 - RNA, 62 nt, Homo Sapiens
cucuguucuccaagaggacccggaaguaaucacauaggaaaugauaaggaagaccaggagga

SEQ ID NO: 635117 - RNA, 62 nt, Homo Sapiens
gacuacccagccagugaagugcagaggauagacauaggaaaacauuccaggcauuuggagac

SEQ ID NO: 635118 - RNA, 62 nt, Homo Sapiens
uacauucuacagggagaaagagauagccaauacauaggaauaaauauauacaagguaucaug

SEQ ID NO: 635119 - RNA, 62 nt, Homo Sapiens
cagaggagauauuaucuguccucuguguggcacauaggaaaaugugagaccuagaauuauag

SEQ ID NO: 635120 - RNA, 62 nt, Homo Sapiens
cauacaauccaaaauuuaaaaaaauauuuuugcauaggaaaaauugagaaggaaguaaacca

SEQ ID NO: 635121 - RNA, 62 nt, Homo Sapiens
uaaacaauaaagcaauaagaacaaauacaauacauaggaaguuaaaagcacaaaggaaugaa

SEQ ID NO: 635122 - RNA, 62 nt, Homo Sapiens
ugauagcaguccugccaccuucuaguucaucccauaggaauguuuuuccaaguccuuccagu

SEQ ID NO: 635123 - RNA, 62 nt, Homo Sapiens
acuuauauacauauuuuuuaaaaguagcuuuacauaggaaggaaguggcauaguuuuaucaa

SEQ ID NO: 635124 - RNA, 62 nt, Homo Sapiens
gccaucuucccaaaguuauccaggcaaugaaucauaggaacaaugccauuccuaagagugcc

SEQ ID NO: 635125 - RNA, 62 nt, Homo Sapiens
auguagucacaaccuguuuuguuuuuguaaaacauaggaagucucuuuaaugcaaugauuug

SEQ ID NO: 635126 - RNA, 62 nt, Homo Sapiens
guuaauaacucucagcaggcaaagaccgauugcauaggaauugcacaauccaugaacagcau

SEQ ID NO: 635127 - RNA, 62 nt, Homo Sapiens
cuggaagaggucuggguggggaggccaguucccauaggaaggagucugccucuucugucccc

SEQ ID NO: 635128 - RNA, 62 nt, Homo Sapiens
ucuguggggugacucuacugagccguugaacacauaggaauggugaugguaugcugaaguuc

SEQ ID NO: 635129 - RNA, 62 nt, Homo Sapiens
ccccacccccguccaccccauggggaacccuucauaggaaauaagcaggcugcucccagagg

SEQ ID NO: 635130 - RNA, 62 nt, Homo Sapiens
gucuuggagucaucagaucugggggccagagucauaggaaggcacuagaaguggcugggcag

SEQ ID NO: 635131 - RNA, 62 nt, Homo Sapiens
uaacacauauauaccuucucauaaaauguccacauaggaaauaugucauguauaaaauauga

SEQ ID NO: 635132 - RNA, 62 nt, Homo Sapiens
auggcaugaacaucuuuaggcccaauguaaugcauaggaaguuaugcugcuguuuacaaaag

SEQ ID NO: 635133 - RNA, 62 nt, Homo Sapiens
gaggcuguguuagugaaagccggauccagucacauaggaaagcacugauggcccugaagaag

SEQ ID NO: 635134 - RNA, 62 nt, Homo Sapiens
aaaaugugauguauguguccgugggcuaaagccauaggaagaucucuuuugguggggugggg

SEQ ID NO: 635135 - RNA, 62 nt, Homo Sapiens
ccagaaaauuauuaauccguggcauuguaacucauaggaauuuaucuuaauugcuacugguu

SEQ ID NO: 635136 - RNA, 62 nt, Homo Sapiens
guugguguuuuauuguacauacuucagaugcacauaggaauagaaguguguuauaaaucuag

SEQ ID NO: 635137 - RNA, 62 nt, Homo Sapiens
auuucauuaugauugaaaaacauaaaaacuaacauaggaaagugaaugaucaguuacuuaug

SEQ ID NO: 635138 - RNA, 62 nt, Homo Sapiens
agucuaucugcaauuacucaacgaggcauuuucauaggaaacagacuaugauuaauccauuu

SEQ ID NO: 635139 - RNA, 62 nt, Homo Sapiens
ccacucaguuuugcuuuugcgaggcgauuugacauaggaacuuugagacuccaugagaaagu

SEQ ID NO: 635140 - RNA, 62 nt, Homo Sapiens
aauaacauuugcuguuuuauagguuugaagaacauaggaaaaacuaagagguuuuguuuuua

SEQ ID NO: 635141 - RNA, 62 nt, Homo Sapiens
cugacugauuuuguuacgggguugauucugaccauaggaaguaugcaaugugaaucacuauu

SEQ ID NO: 635142 - RNA, 62 nt, Homo Sapiens
uugagaagaaagggucucuugaccuguauuaacauaggaaaguaaaguucuuuuuguuuuuc

SEQ ID NO: 635143 - RNA, 62 nt, Homo Sapiens
gagcacaggcuuuuucagguagaaucaucagacauaggaacuuagaauuugaucagaaucac

SEQ ID NO: 635144 - RNA, 62 nt, Homo Sapiens
gcaaaugaaauaaacucuuuguagguguaccacauaggaagauauuuaaauagaagauuuuu

SEQ ID NO: 635145 - RNA, 62 nt, Homo Sapiens
aguggauaauuuucagcuauagaacaugcuuccauaggaaaucuaaccuuaauuauucugua

SEQ ID NO: 635146 - RNA, 62 nt, Homo Sapiens
aauguauuuacuaagugucaaggcuauuaacacauaggaaaagacuaaucaaaggcaaacaa

SEQ ID NO: 635147 - RNA, 62 nt, Homo Sapiens
auugacccagaaccugacuuauccaaccaaagcauaggaaacaauauauacuuuauuaaauc

SEQ ID NO: 635148 - RNA, 62 nt, Homo Sapiens
aaauaaaauauuauuagaacaugauuuacauucauaggaauauuuuuaaaacaucaaaauuu

SEQ ID NO: 635149 - RNA, 62 nt, Homo Sapiens
cuagaggaaagagaacacugcgggguucuucucauaggaaugucguguuugacuuguccauu

SEQ ID NO: 635150 - RNA, 62 nt, Homo Sapiens
aaacuugagcgguauacucaaccugaagaagucauaggaaagcuguguuaauaaaugacaga

SEQ ID NO: 635151 - RNA, 62 nt, Homo Sapiens
cagaaggaagcuuggcugagcuggccuuuuaacauaggaauguauuucguuggaaacauucu

SEQ ID NO: 635152 - RNA, 62 nt, Homo Sapiens
cauuucauuuguauuuuuguccagaaauuucccauaggaagacuucaccuccuacaacuccg

SEQ ID NO: 635153 - RNA, 62 nt, Homo Sapiens
aacucauuuuaguugauuuucaguacuauuuacauaggaauugauuuuuauggauauaguag

SEQ ID NO: 635154 - RNA, 62 nt, Homo Sapiens
aaauggaaaauaagagaucaaaaugaauauagcauaggaauaaagauuucacuagaaauugc

SEQ ID NO: 635155 - RNA, 62 nt, Homo Sapiens
aagacuuucuuuuucaucuuuuauagcguuaccauaggaaacuguuccaaacugaguuagcu

SEQ ID NO: 635156 - RNA, 62 nt, Homo Sapiens
augucaauauauauuuaaaauaauaauggaaacauaggaaaucagcuauuuaaaccagauca

SEQ ID NO: 635157 - RNA, 62 nt, Homo Sapiens
guccauccccagauucgccauuccacuccccacauaggaauauuccucaccaggagcccggc

SEQ ID NO: 635158 - RNA, 62 nt, Homo Sapiens
cugugauaaccaguaaggaauaaagccuguuccauaggaaggcuccugcaaauuuaguuugu

SEQ ID NO: 635159 - RNA, 62 nt, Homo Sapiens
cagcuuaaacauaaauaucagaauguggcuuucauaggaaaggaugggauugggucacuuuu

SEQ ID NO: 635160 - RNA, 62 nt, Homo Sapiens
ugccaugaaaauugcuuuuggaaaauuuuccacauaggaaaaaccauagaaagaugacaaaa

SEQ ID NO: 635161 - RNA, 62 nt, Homo Sapiens
acauacacuuccauaaauagacgguucuggggcauaggaaacggguuaccuguaucugaagg

SEQ ID NO: 635162 - RNA, 62 nt, Homo Sapiens
acaaucacaucaguaaguuaauguauagauuacauaggaagaagaaaucacucacuuugauu

SEQ ID NO: 635163 - RNA, 62 nt, Homo Sapiens
guucaacaauucugugaaagcuccacagaucucauaggaaauccaguguucuccaccuuguc

SEQ ID NO: 635164 - RNA, 62 nt, Homo Sapiens
uuaguuaauauugauauaucaaauaaaucuaccauaggaauguguucaguuuuauggaggaa

SEQ ID NO: 635165 - RNA, 62 nt, Homo Sapiens
cagaccauaggcaaacucugacuuacuuuccccauaggaagaaaauaacccugagguuuugu

SEQ ID NO: 635166 - RNA, 62 nt, Homo Sapiens
guacugugggaacuauucuaaaacauaauuuacauaggaaauugguucuaaaaauugcauuc

SEQ ID NO: 635167 - RNA, 62 nt, Homo Sapiens
ggggaagagaggcugaguguaagauugagcaacauaggaaaaaagaaccuaggagggaaagg

SEQ ID NO: 635168 - RNA, 62 nt, Homo Sapiens
auggccguucuuuuccacccuguuucuucccccauaggaagaacccaccuguagcccugagg

SEQ ID NO: 635169 - RNA, 62 nt, Homo Sapiens
ggaguuaauaaagaaguucauuuugguuuaaacauaggaaagaagagaaccaugaaaauggg

SEQ ID NO: 635170 - RNA, 62 nt, Homo Sapiens
ccuccagauuuggguggagccucugugggaaccauaggaagugugugggcugccuuccuggg

SEQ ID NO: 635171 - RNA, 62 nt, Homo Sapiens
aaacgaucauagucuuaggaguucauuuaaaccauaggaacuuuucacuuaucucauguuag

SEQ ID NO: 635172 - RNA, 62 nt, Homo Sapiens
acugagggugugucuuuguaauugggcuuccucauaggaagcaaguggccaccuuuugauug

SEQ ID NO: 635173 - RNA, 62 nt, Homo Sapiens
uagcagaaaugauagacacacuggccuccucacauaggaauccaugaaggucagcaccaucc

SEQ ID NO: 635174 - RNA, 62 nt, Homo Sapiens
cacauuaucuucuggacuaugcccugcauuuucauaggaagaucauacuuaaaaauuuauua

SEQ ID NO: 635175 - RNA, 62 nt, Homo Sapiens
gucaccuucaggauacaaauaauugucucuugcauaggaaguagaaccagaccuugguaaag

SEQ ID NO: 635176 - RNA, 62 nt, Homo Sapiens
guugaagaggucuugcagucaaaugcucuaaacauaggaauggcccuuaaacuggauucaaa

SEQ ID NO: 635177 - RNA, 62 nt, Homo Sapiens
uaauaguaaugcuugaacuuugguuaauguuacauaggaauuaaaugaagagacaggcuauc

SEQ ID NO: 635178 - RNA, 62 nt, Homo Sapiens
accacaacccaccaaguaccaauauuucucaccauaggaauauucccuuacuaaucaccaug

SEQ ID NO: 635179 - RNA, 62 nt, Homo Sapiens
ucuccacgccgugauggcagcgcugccgaggacauaggaaccacgacuggaaagauaauuua

SEQ ID NO: 635180 - RNA, 62 nt, Homo Sapiens
uuucucccccacgaguggaaaauagacuucuacauaggaaagcuaaaauauguuaauauuuu

SEQ ID NO: 635181 - RNA, 62 nt, Homo Sapiens
ugacuaucaggaaugugugcugugucaggauacauaggaaguugaccucgggguaucaugga

SEQ ID NO: 635182 - RNA, 62 nt, Homo Sapiens
guaaguguuaaguuuuuaaucugggagcagggcauaggaagaaaaugucaguagugcuaaug

SEQ ID NO: 635183 - RNA, 62 nt, Homo Sapiens
caaaacuuaauugauccuacaagcuuacuacacauaggaaaauucauacuggagagaaacua

SEQ ID NO: 635184 - RNA, 62 nt, Homo Sapiens
uuucccguaacgcacaggacacgugugcaauucauaggaacggcccagaucgcccucaugag

SEQ ID NO: 635185 - RNA, 62 nt, Homo Sapiens
auacugggguagauuauugccugccccuuauacauaggaauaugcugcauaauugcgcauaa

SEQ ID NO: 635186 - RNA, 62 nt, Homo Sapiens
aaaccucaugccuuauucagcaucacaaaaugcauaggaaagagaaaucguaugaauguaau

SEQ ID NO: 635187 - RNA, 62 nt, Homo Sapiens
aacacuuuuuuucuaauucucccuaguauaugcauaggaauuuaauauacuuuauaaauaag

SEQ ID NO: 635188 - RNA, 62 nt, Homo Sapiens
guggugguuucuguuugcauuuuugcaggagccauaggaaacuacugaaaugauugugcugg

SEQ ID NO: 635189 - RNA, 62 nt, Homo Sapiens
cacuguguuuucauuugauggugacuuucuaacauaggaauuucuguggcagacauugccga

SEQ ID NO: 635190 - RNA, 62 nt, Homo Sapiens
cacuguguuuucauuugaugaaugcuguguaacauaggaauuuacauaacagugcagagcac

SEQ ID NO: 635191 - RNA, 62 nt, Homo Sapiens
aaaaaauuaucuuuucauauaacagaaaaugucauaggaauagcugaaaagaaaaucguaaa

SEQ ID NO: 635192 - RNA, 62 nt, Homo Sapiens
gagaauugggagugggaagaugauaccgcacccauaggaauuagaaugcuuauucucuuaga

SEQ ID NO: 635193 - RNA, 62 nt, Homo Sapiens
ggagauuggcuugucucacguaaugaaaaaagcauaggaauuucgagauaguuuuuucuuuu

SEQ ID NO: 635194 - RNA, 62 nt, Homo Sapiens
guagacauuuuauuuauaaccuucugaagaaucauaggaagaaaucugaggaaacauaaauu

SEQ ID NO: 635195 - RNA, 62 nt, Homo Sapiens
ucuuaaaauucuugggagugguugcaaugacacauaggaaaacuugcuuuuucaauucuccu

SEQ ID NO: 635196 - RNA, 62 nt, Homo Sapiens
uccuucauaaaacauguaacugguucuuuuuucauaggaaauccagaggaggccucuuuggu

SEQ ID NO: 635197 - RNA, 62 nt, Homo Sapiens
auuuugacaauguggaguuuuugccaauauuccauaggaaaaacaauauaacuuuacauucu

SEQ ID NO: 635198 - RNA, 62 nt, Homo Sapiens
auuauucagaauguagucugaccagugugauacauaggaaucaaccacuaauuuugaaaauu

SEQ ID NO: 635199 - RNA, 62 nt, Homo Sapiens
uagaaaauacuaauaacuuuauuaaaugcuaacauaggaaguaacuaguauauaaaguacua

SEQ ID NO: 635200 - RNA, 62 nt, Homo Sapiens
ucagggacauuucaaguugcuccccuguauaucauaggaaaccagccaggaaggacaggcuu

SEQ ID NO: 635201 - RNA, 62 nt, Homo Sapiens
uauuuuagggguuggagguguucucuuacugccauaggaaaugccugcaucccucccuuccu

SEQ ID NO: 635202 - RNA, 62 nt, Homo Sapiens
acgugccaguuguggaggaacucaauaaucgucauaggaaagacagucaaagagacaucucc

SEQ ID NO: 635203 - RNA, 62 nt, Homo Sapiens
ugcagcuuugggcucccccauagugacugugccauaggaaagcagccccuccucacacauac

SEQ ID NO: 635204 - RNA, 62 nt, Homo Sapiens
guugauggaaaccaucugugcuuagucucugacauaggaagcuugcuucaggcaauggcuuu

SEQ ID NO: 635205 - RNA, 62 nt, Homo Sapiens
cacaauuguugacuaaaaugcugcuuuuaaaacauaggaaaguagaaugguugagugcaaau

SEQ ID NO: 635206 - RNA, 62 nt, Homo Sapiens
accugagaaaugcuaauggagauuugcugguacauaggaaucuagcaaauucaggaaccaag

SEQ ID NO: 635207 - RNA, 62 nt, Homo Sapiens
uuugcacagucuuacuucuguagaacacuggccauaggaaaugcuguuuuuuuguacuggac

SEQ ID NO: 635208 - RNA, 56 nt, Homo Sapiens
guaggaagaugauuuuguaaagugcgcauaggaacccauuacuuaauagaagucag

SEQ ID NO: 635209 - RNA, 62 nt, Homo Sapiens
cuugaaucuucucccuuguccugcuugggguucauaggaauugguaaggccucuggacuggc

SEQ ID NO: 635210 - RNA, 62 nt, Homo Sapiens
uacuucaaaaccaaaaaaacagucaucacaagcauaggaagauuagccuaguuuucucauac

SEQ ID NO: 635211 - RNA, 62 nt, Homo Sapiens
gcaugcuuucagccagaugcuuaguugguuuccauaggaaaggcuggcgccaucgcuccgga

SEQ ID NO: 635212 - RNA, 62 nt, Homo Sapiens
ccccacggugggucagaagggaggaggggccacauaggaaaguuuguuacuuacgguucuga

SEQ ID NO: 635213 - RNA, 62 nt, Homo Sapiens
auaagaacaauagguaaagcuuguagaagcagcauaggaacauaaguauaguugauguaaca

SEQ ID NO: 635214 - RNA, 62 nt, Homo Sapiens
gaucugccagacgcgaacucaauaggauuucccauaggaagaugcuuuguaauagagucugu

SEQ ID NO: 635215 - RNA, 62 nt, Homo Sapiens
aagacaacauucaauuugauggucucacccaccauaggaaaccuucaaacacuggcaccuug

SEQ ID NO: 635216 - RNA, 62 nt, Homo Sapiens
cucaguagaaauaccuuuggcuuacugugggacauaggaaaauugaguucucucuaacccag

SEQ ID NO: 635217 - RNA, 62 nt, Homo Sapiens
uuggucagagugaauugaaucguggauuuucucauaggaaguuacuuuucauuuuggcucac

SEQ ID NO: 635218 - RNA, 62 nt, Homo Sapiens
augguuugcuaaaaucuauaagaacccaaugucauaggaaauuugaacugcagaccuguaug

SEQ ID NO: 635219 - RNA, 62 nt, Homo Sapiens
ccauuucaaaacuguuucuucuauuccugguucauaggaaagaaaaaaguuauucaaaguau

SEQ ID NO: 635220 - RNA, 62 nt, Homo Sapiens
ugagcccagaaguucgagacuagccugggaaacauaggaagcccucgucucuacaaaaaaaa

SEQ ID NO: 635221 - RNA, 62 nt, Homo Sapiens
ucgcuacucuuaagaauauacauguauguauucauaggaacauuuuuucucaauauuuguau

SEQ ID NO: 635222 - RNA, 62 nt, Homo Sapiens
uaugagaacacauuuucacaguuauguuucuucauaggaaaacuauauuuagugggcaacaa

SEQ ID NO: 635223 - RNA, 62 nt, Homo Sapiens
uuuugauaacuagcuuuccagguggacuuagccauaggaaaauauuacuaauguaauuuaac

SEQ ID NO: 635224 - RNA, 62 nt, Homo Sapiens
agaagcauauauggguuggaauuaugccaaagcauaggaagcugggaauaagcaaacaaaug

SEQ ID NO: 635225 - RNA, 62 nt, Homo Sapiens
cacuuaucagggccuggagcccugauggaagccauaggaacuccagaguugccaagccauag

SEQ ID NO: 635226 - RNA, 62 nt, Homo Sapiens
gugaaaauauuuguguuuguguuaaaaacaaacauaggaaaucaguggcuuuaugaaguaaa

SEQ ID NO: 635227 - RNA, 62 nt, Homo Sapiens
gugggccuggguaaagagucaaagccagugcgcauaggaacacauaugaugugaaugccuac

SEQ ID NO: 635228 - RNA, 62 nt, Homo Sapiens
aaaccagaugaagaugaaugucagagaauucacauaggaaagaaguaaacccucacugugaa

SEQ ID NO: 635229 - RNA, 62 nt, Homo Sapiens
gguguagauaagcaugcaauagauaucguguacauaggaacuacuuuaaacuucuauagaaa

SEQ ID NO: 635230 - RNA, 62 nt, Homo Sapiens
cuguaaguuggaauuaucuuuuuuuucccuuacauaggaaaauuuaaacuaccauaauucca

SEQ ID NO: 635231 - RNA, 62 nt, Homo Sapiens
uuguaaaaauaacauaauaaauagaucuuaaacauaggaaaaccauacuguucugauaauaa

SEQ ID NO: 635232 - RNA, 62 nt, Homo Sapiens
aaaacagcaugauacuggcauaacaacagacacauaggaacaguauagacaacccagaaaca

SEQ ID NO: 635233 - RNA, 62 nt, Homo Sapiens
aaaaccuaauggugcuucucccuuggaaaugccauaggaagcccacaaccgcuaacacuuac

SEQ ID NO: 635234 - RNA, 62 nt, Homo Sapiens
agccucugcccccaggcugggccugucacuggcauaggaaggccagccccgcaucucccacu

SEQ ID NO: 635235 - RNA, 62 nt, Homo Sapiens
gggauccaagaucuuugcaguucaaucgaccacauaggaauuuccaggcaccaaaaugauau

SEQ ID NO: 635236 - RNA, 62 nt, Homo Sapiens
gaucuauaggcagcuucuaagagcgaacuucacauaggaagggaucugagaacacguugcca

SEQ ID NO: 635237 - RNA, 62 nt, Homo Sapiens
ugacuuuagagagaguaaaaugugccaggagccauaggaauaucuguauguuggaugacuuu

SEQ ID NO: 635238 - RNA, 62 nt, Homo Sapiens
cauuuuaaaauagaacuauccuuguucgauagcauaggaaaauguucuggugauugucaggg

SEQ ID NO: 635239 - RNA, 62 nt, Homo Sapiens
uuaaauauuaaaaauuguguaaauacaauugacauaggaauuacauuaaaauauuaggaaga

SEQ ID NO: 635240 - RNA, 62 nt, Homo Sapiens
gugucauggaguccaaauaaucuagucaagggcauaggaacgcaauguauaauacauucaca

SEQ ID NO: 635241 - RNA, 62 nt, Homo Sapiens
gggugcuggcuggccauggugaugccagcugccauaggaagacucuggucaccacaaugcuu

SEQ ID NO: 635242 - RNA, 62 nt, Homo Sapiens
auccucauugauccucuucaggcuuccuaucucauaggaaacaauugauccccaaccugcca

SEQ ID NO: 635243 - RNA, 62 nt, Homo Sapiens
uguuucauuuuggugugcaaaaagaacucauucauaggaaggcuccuaaaugccccauauua

SEQ ID NO: 635244 - RNA, 62 nt, Homo Sapiens
uguuagccaccauccaugcuaccuagguaguccauaggaaccacccccaugaccaccaccaa

SEQ ID NO: 635245 - RNA, 62 nt, Homo Sapiens
uccacaccagggcugugguccucccagacaugcauaggaauggccacagguuuacacugccu

SEQ ID NO: 635246 - RNA, 62 nt, Homo Sapiens
cuacucagaaauuuuuauuuuucuaagguucucauaggaaaaguacauuuaauacagcagug

SEQ ID NO: 635247 - RNA, 62 nt, Homo Sapiens
auauauuuaaaaaaccuuuuuuuauuguggagcauaggaauugccccccuccaggcuucacc

SEQ ID NO: 635248 - RNA, 62 nt, Homo Sapiens
aaagguuauggaagaaugguuuaugaacuucccauaggaagcaccugagagauaguaaacug

SEQ ID NO: 635249 - RNA, 62 nt, Homo Sapiens
aagccugucuccucacccacccccagcccuagcauaggaaaagcuuccuugaugugagcucu

SEQ ID NO: 635250 - RNA, 62 nt, Homo Sapiens
gacuagaugcauaccguuuugugaaaaccagccauaggaaaacaugugagcaacaaccccca

SEQ ID NO: 635251 - RNA, 62 nt, Homo Sapiens
gacaugguuacuuuauuuuccccuuguuaagacauaggaagacuuaauuuuuaaacggucag

SEQ ID NO: 635252 - RNA, 62 nt, Homo Sapiens
cuuguccagagacaagacuuaucaaggggacccauaggaaauccccaaacucaggccgaaug

SEQ ID NO: 635253 - RNA, 62 nt, Homo Sapiens
uagaaacuugcuuaucaaaaccguucccugaacauaggaaaaccagcuuucuucuguugaug

SEQ ID NO: 635254 - RNA, 62 nt, Homo Sapiens
ugacucaggagccuccuaggccagagagcaaacauaggaauaaaacaguuuagcccaucucu

SEQ ID NO: 635255 - RNA, 62 nt, Homo Sapiens
ucacagaaaugaggaggcugcauuccagcugucauaggaagaaagguuagguguuuuaggua

SEQ ID NO: 635256 - RNA, 62 nt, Homo Sapiens
gucauuacaguaugaauuauuguaauucuuuucauaggaaauguggauuccaugacauauau

SEQ ID NO: 635257 - RNA, 62 nt, Homo Sapiens
ccuugguucagagggaagugauaucuaaaaagcauaggaaauagaaggccuuuucugaaggg

SEQ ID NO: 635258 - RNA, 62 nt, Homo Sapiens
gcuuggugcaguuaacggguauaguuccaggccauaggaauguacugggcagguccaaaagg

SEQ ID NO: 635259 - RNA, 62 nt, Homo Sapiens
cacuuccccaggcuucucccuccccccacccccauaggaacaggauuuggccuuagcuucug

SEQ ID NO: 635260 - RNA, 62 nt, Homo Sapiens
guccaggcuccaguaggagagaaagaacuccucauaggaauacugaagaagugggaaggaac

SEQ ID NO: 635261 - RNA, 62 nt, Homo Sapiens
gccaggacaugaagaaaaggaacugggaaucucauaggaagaccauuuugucuuccauagga

SEQ ID NO: 635262 - RNA, 62 nt, Homo Sapiens
ucucccaggaaagaaauauauugucuccccuccauaggaauuguccauuaagacucugauaa

SEQ ID NO: 635263 - RNA, 62 nt, Homo Sapiens
uuuucugcuuuuuaaauacaggaaacugcucucauaggaaaguguauaauauguaauuguag

SEQ ID NO: 635264 - RNA, 62 nt, Homo Sapiens
uagaaccuaacuuuuauaggugagucacacugcauaggaauucauucuaggcucuauuuaac

SEQ ID NO: 635265 - RNA, 62 nt, Homo Sapiens
aaauguagucucccugugucauaaaaaauucucauaggaauuuugaaaagauuuuaacaagu

SEQ ID NO: 635266 - RNA, 62 nt, Homo Sapiens
cugaaugcugcuguaaagugugcugaguauuucauaggaaagguuguauauaauauuuaaga

SEQ ID NO: 635267 - RNA, 62 nt, Homo Sapiens
aacaggaagauuccaaagacuggaauguuauucauaggaaaugauauuugaauuaucuugau

SEQ ID NO: 635268 - RNA, 62 nt, Homo Sapiens
ggccucaggagcaggaaggguccgcuggcacccauaggaaggaaggccacccuagaaagaag

SEQ ID NO: 635269 - RNA, 62 nt, Homo Sapiens
gacugauaaaaugaaauauguguucaaaaauacauaggaaaaauagaguaauauuugagcug

SEQ ID NO: 635270 - RNA, 62 nt, Homo Sapiens
auguuggauagucagcuguacccuucuguuuccauaggaaucccagcaaaccaggacucugc

SEQ ID NO: 635271 - RNA, 62 nt, Homo Sapiens
cugagaugccuuuuauuccaaagaaaaugcugcauaggaaaaaagguaacguguuccuagaa

SEQ ID NO: 635272 - RNA, 62 nt, Homo Sapiens
uuauuucaaagaaauauuacuuuuuucuggaccauaggaauaucaguuauaaauauggugaa

SEQ ID NO: 635273 - RNA, 62 nt, Homo Sapiens
accuauacuuugauacugaagacugccaaauacauaggaauuuucuuucuuaaaaaacagua

SEQ ID NO: 635274 - RNA, 62 nt, Homo Sapiens
ugucucacuggcaucuuguugagggccuugcacauaggaaacuuuugauaaguaucugcgga

SEQ ID NO: 635275 - RNA, 62 nt, Homo Sapiens
cuccuuaaugugaaaaaucaagggcuuacugacauaggaacaacagaaaugcuccuggaacu

SEQ ID NO: 635276 - RNA, 62 nt, Homo Sapiens
ucuguuuccaacagaaaagaaacauuuguuugcauaggaauucaugaaggcgacccaaccug

SEQ ID NO: 635277 - RNA, 62 nt, Homo Sapiens
uuuucccaguaaauccccugaugaaggaagggcauaggaaaaacccuaggaaguagggagaa

SEQ ID NO: 635278 - RNA, 62 nt, Homo Sapiens
gaucuugcaggucuaguauuaggcuuccaaggcauaggaagaugaauagaucaugaagucau

SEQ ID NO: 635279 - RNA, 62 nt, Homo Sapiens
agaauuacagguaagguacacuuaaauccucccauaggaaauauaguguuccuaagauaucu

SEQ ID NO: 635280 - RNA, 62 nt, Homo Sapiens
aauuaucuuaaaacuuuggcuuaguuuugugccauaggaaaaaauuuuggguauacuugugg

SEQ ID NO: 635281 - RNA, 62 nt, Homo Sapiens
agcuggaaggccuccggauggugcugcaggcccauaggaaggucacgcgucugacagagcug

SEQ ID NO: 635282 - RNA, 62 nt, Homo Sapiens
uaaccaagcacaaaguuauaguuuuguugcgacauaggaaaauauuugcaccgaaaugucuu

SEQ ID NO: 635283 - RNA, 62 nt, Homo Sapiens
ugccuauucuucaaccaccuugguuacuuugacauaggaauugacuucuuuuccuugaaugg

SEQ ID NO: 635284 - RNA, 62 nt, Homo Sapiens
aaggagauuuucuagcuccacaucugucugcacauaggaaggaaaagauaggacucuaaacc

SEQ ID NO: 635285 - RNA, 62 nt, Homo Sapiens
agagcccugggguccuguccugcaggaugcugcauaggaaugggcagagauguccuggaugg

SEQ ID NO: 635286 - RNA, 62 nt, Homo Sapiens
uaauaaccaagacuuuucaagcuucuagaucucauaggaaagcuuguaauagcaaaauugua

SEQ ID NO: 635287 - RNA, 62 nt, Homo Sapiens
gcuguguaacaugaccuuaaauagucuuccugcauaggaagagcaaaaggguauucaucaau

SEQ ID NO: 635288 - RNA, 62 nt, Homo Sapiens
cagcucuggugagucuuggcggcagcagccaucauaggaagggaccaaggcaaggcaggugc

SEQ ID NO: 635289 - RNA, 62 nt, Homo Sapiens
ugcaagaauuaaaacugaguccaugaaaauaccauaggaagacauaaaacuuuaaaaggcaa

SEQ ID NO: 635290 - RNA, 62 nt, Homo Sapiens
guacaguaaaacuaugguauuguguuuacaaacauaggaaagguaacacaguggugaguauu

SEQ ID NO: 635291 - RNA, 62 nt, Homo Sapiens
gaaucuccuuuggaaggugacuuggaacaacgcauaggaaaacugaugccaccuccucuguu

SEQ ID NO: 635292 - RNA, 62 nt, Homo Sapiens
gacacacauccaccuaaaaucuuccugcuauacauaggaaaaaauacguauguuuaaaaacc

SEQ ID NO: 635293 - RNA, 62 nt, Homo Sapiens
gacuucuuuuccuugaauggugguuacuuugacauaggaauuugccuauucuucaaccaccu

SEQ ID NO: 635294 - RNA, 62 nt, Homo Sapiens
uacuucuuuuccuugaguggcgguuacucugacauaggaauuuaccuauucuucaaccaccu

SEQ ID NO: 635295 - RNA, 62 nt, Homo Sapiens
caggaggacaaaaccaccauagguagccucuucauaggaaccacuccauaagugauccuaaa

SEQ ID NO: 635296 - RNA, 62 nt, Homo Sapiens
gagggggcuggaggcgaagggugggagcauagcauaggaacgcugcauagaccauggaggcc

SEQ ID NO: 635297 - RNA, 62 nt, Homo Sapiens
ggggccuagauguagccucuguuccuccuggacauaggaaggucccaagcuuaguaucccac

SEQ ID NO: 635298 - RNA, 62 nt, Homo Sapiens
uccuuggaagaagggaugggucgauuuccugucauaggaagccuggauuugccaacuagaau

SEQ ID NO: 635299 - RNA, 62 nt, Homo Sapiens
ccaagguugauccacuuaacauucuaccuacacauaggaagguccacugggaagagacagga

SEQ ID NO: 635300 - RNA, 62 nt, Homo Sapiens
uuuugucccugcuguuaaugugcugaaacgcgcauaggaagcuggaguggagagaguauucc

SEQ ID NO: 635301 - RNA, 62 nt, Homo Sapiens
gguauaagaagagacucauuucgaucaguagucauaggaauuaggaaacuauuaaaauuggc

SEQ ID NO: 635302 - RNA, 62 nt, Homo Sapiens
aaguucagacaucgcuacaauuucucuuaacacauaggaaaaugugauacagcggucacuau

SEQ ID NO: 635303 - RNA, 62 nt, Homo Sapiens
cuggaagauaaccuaggcaauaccauucuggacauaggaacggaaaaagauuucaugacaaa

SEQ ID NO: 635304 - RNA, 62 nt, Homo Sapiens
ugucuggaaccagugaaugcauuagaaccuuccauaggaaaagaaaaggggcugaguuccau

SEQ ID NO: 635305 - RNA, 62 nt, Homo Sapiens
cugcccccagguauuuacuguggagaacauugcauaggaaugucuggaaaaagccucuacaa

SEQ ID NO: 635306 - RNA, 62 nt, Homo Sapiens
cauuauuagccaugaagggaauaucuuugucacauaggaauuguucagcaacagaaagauac

SEQ ID NO: 635307 - RNA, 62 nt, Homo Sapiens
uuguaaauuuaugugauggcaaagaaggagagcauaggaaaccacacagacuugggcagggu

SEQ ID NO: 635308 - RNA, 62 nt, Homo Sapiens
ccucucaagggcauucugggcuuguaaacagacauaggaagccucuguuuacccugaagcac

SEQ ID NO: 635309 - RNA, 62 nt, Homo Sapiens
gcaccugccaauagcuuugucaaucacagccccauaggaacgucuggaauugcuugggaguu

SEQ ID NO: 635310 - RNA, 62 nt, Homo Sapiens
auuauauuuuuuuuugguaaaaaagaaauguccauaggaaacaaauucccgugucuuaaaac

SEQ ID NO: 635311 - RNA, 62 nt, Homo Sapiens
ggcuggucuggagucccacccaggugacagaucauaggaaguaaggggccuugcucugagca

SEQ ID NO: 635312 - RNA, 62 nt, Homo Sapiens
cguugcggaguccgccccguggaggugguguacauaggaacgacugaccucagggccgaagg

SEQ ID NO: 635313 - RNA, 62 nt, Homo Sapiens
cuuccuuucuggccaagguggggcagcaccuccauaggaagccugagaagacagacugagca

SEQ ID NO: 635314 - RNA, 62 nt, Homo Sapiens
aaaauaaaaaacuaaaaaagaccuuguccagccauaggaaucagauguucuagaauguagau

SEQ ID NO: 635315 - RNA, 62 nt, Homo Sapiens
ccggaugggaauauucacauaugcaacuuuuucauaggaaguaauuauucuuucauuuuaua

SEQ ID NO: 635316 - RNA, 62 nt, Homo Sapiens
accaaauauacauacuuauuuauauauauguacauaggaaaaggguuuuauaaauaaauaua

SEQ ID NO: 635317 - RNA, 62 nt, Homo Sapiens
uccugaguccaccuccuggugggacccaggaccauaggaaggccuccacccuugguggggag

SEQ ID NO: 635318 - RNA, 62 nt, Homo Sapiens
uuaggaguuaccucucugugggguucagagaucauaggaauaauuuuaggaggguuuaaaua

SEQ ID NO: 635319 - RNA, 62 nt, Homo Sapiens
uuuuggaaugaggcagaaaauuauauaaugagcauaggaaaauccuucugauuuugccuguc

SEQ ID NO: 635320 - RNA, 62 nt, Homo Sapiens
aaucuaccucaucauuuaaauucacuuuacugcauaggaaacguauggauuuuuuuguuauc

SEQ ID NO: 635321 - RNA, 62 nt, Homo Sapiens
aaauauguaacccagaacaacaccuaaguuuacauaggaauggaagguggggucuuggauau

SEQ ID NO: 635322 - RNA, 62 nt, Homo Sapiens
ccacauacucagccuggaugagagggacccagcauaggaaagaaaugcucccugucccaugg

SEQ ID NO: 635323 - RNA, 62 nt, Homo Sapiens
cuauuccccaacagauauuguggcaaaucacacauaggaaagagaauuugggaauacaguag

SEQ ID NO: 635324 - RNA, 62 nt, Homo Sapiens
auuaucuaaagaaucauugucuuucagagacucauaggaaaaaaaaacuaggaaaaguguca

SEQ ID NO: 635325 - RNA, 62 nt, Homo Sapiens
cauuuaaaauaaauaguuuuuucugucuuauacauaggaaaaaaguagaaagugcuugguau

SEQ ID NO: 635326 - RNA, 62 nt, Homo Sapiens
cauucuccuuuuucauuuuuucuguggaaaagcauaggaaggggcaugaaauagugauuaua

SEQ ID NO: 635327 - RNA, 62 nt, Homo Sapiens
uauuuuuuuaagcuaccaauaugcccuuaaaucauaggaaaggaaggacagcgaugggaaaa

SEQ ID NO: 635328 - RNA, 62 nt, Homo Sapiens
aucaggguccccagccucugggcuccuguuuccauaggaaggggcgacaccuuccucccagg

SEQ ID NO: 635329 - RNA, 62 nt, Homo Sapiens
caaauagauuaaacacaaaaauaaaacuaaagcauaggaauuauguuuuugagauaccuuug

SEQ ID NO: 635330 - RNA, 62 nt, Homo Sapiens
gguagggggacuguucuagccagcuguggacacauaggaaugcuggaccaggguaccagauu

SEQ ID NO: 635331 - RNA, 62 nt, Homo Sapiens
gcuccucccccacucaagcaauagggccccgccauaggaagacccccagagagagggucagc

SEQ ID NO: 635332 - RNA, 62 nt, Homo Sapiens
cagcaguccaggugccacaggcagcccugggacauaggaagcugggagcaaggaaagggucu

SEQ ID NO: 635333 - RNA, 62 nt, Homo Sapiens
acuggauaaacccacuccacaugugcuggggacauaggaagaccuuaagccauagcucaucc

SEQ ID NO: 635334 - RNA, 62 nt, Homo Sapiens
cacaaggguauugacuggggaguaaagacaggcauaggaaauugacaggauugagagauuaa

SEQ ID NO: 635335 - RNA, 62 nt, Homo Sapiens
gguuauauuccaccauaacaaaaaaacacauacauaggaacugauacaacauauucccccca

SEQ ID NO: 635336 - RNA, 62 nt, Homo Sapiens
uuuauuuaaaggaaagaauacucacaacuaagcauaggaaguggaaucccuuuugcuucaug

SEQ ID NO: 635337 - RNA, 62 nt, Homo Sapiens
acauucuagaggaaagguuuuuuuauguugagcauaggaaguuagaacucuuccuuugcgaa

SEQ ID NO: 635338 - RNA, 62 nt, Homo Sapiens
gaacaccuggacgugugauauuuucuagucugcauaggaagggagaaacugaugauuuuaca

SEQ ID NO: 635339 - RNA, 62 nt, Homo Sapiens
ugacauguaggagggcuauacaggagaaaaaccauaggaaaguauccaucugagagccaaca

SEQ ID NO: 635340 - RNA, 62 nt, Homo Sapiens
guagaacucagucucuaguuuaggugaggauucauaggaagauuacuccuggaccacaacug

SEQ ID NO: 635341 - RNA, 62 nt, Homo Sapiens
uccguguuccagcaucuaaccuuuuacuuuugcauaggaaauacuugauuuaauuacagguc

SEQ ID NO: 635342 - RNA, 62 nt, Homo Sapiens
gggcagcaggcaucauuuuccuuuucuagcuucauaggaauauugugagcucaccaugcugu

SEQ ID NO: 635343 - RNA, 62 nt, Homo Sapiens
gugguuuuuguguuuuuuuuuuuuucuuuuuccauaggaaagaauauauaaauuuguaaauc

SEQ ID NO: 635344 - RNA, 62 nt, Homo Sapiens
ccuuuccuauuauuucucuuuuuuaaaacuaacauaggaaagaauuaaaaauaacacagucu

SEQ ID NO: 635345 - RNA, 62 nt, Homo Sapiens
aaaucaaugaauuuaggggugagccacauuuacauaggaaccccaaaguaaacuguguaggg

SEQ ID NO: 635346 - RNA, 62 nt, Homo Sapiens
caccccuacucguuccuauagaacacagaggacauaggaaacccuuaaaacacacaugggau

SEQ ID NO: 635347 - RNA, 62 nt, Homo Sapiens
caacagccagcccuucauccuccagcgucugccauaggaaugugagagggguguuugcugag

SEQ ID NO: 635348 - RNA, 62 nt, Homo Sapiens
aucuggcagaaguuuccagaagagaacuugggcauaggaacagucuucuuuugaggaugauc

SEQ ID NO: 635349 - RNA, 62 nt, Homo Sapiens
augugucagggaauagaugugaaacaagggaucauaggaaaaggggaaagagaaaugaucug

SEQ ID NO: 635350 - RNA, 62 nt, Homo Sapiens
uauagcaaguguugcuguaaaguguuuuucuccauaggaagugugaacuguguauugucuau

SEQ ID NO: 635351 - RNA, 62 nt, Homo Sapiens
ggugaucaaaacgcuccaucuuuuuacaguggcauaggaagacggcaaaaauuuccuaaagu

SEQ ID NO: 635352 - RNA, 62 nt, Homo Sapiens
aacucuuuaacuuguaauaaacccuuaacuggcauaggaaaugguauccagaauggaauuuu

SEQ ID NO: 635353 - RNA, 62 nt, Homo Sapiens
uccaugccaaguaacagcagagggaguuaagccauaggaauuuggcuguggaguaagaggga

SEQ ID NO: 635354 - RNA, 62 nt, Homo Sapiens
aaauguaacuguuaccauuggaaauuucacgucauaggaaguuagccuuuaucuaccaacuu

SEQ ID NO: 635355 - RNA, 62 nt, Homo Sapiens
aaaauggaauugauguaaagaaguguuaucuacauaggaaaucauauaugccaucuguccuc

SEQ ID NO: 635356 - RNA, 62 nt, Homo Sapiens
ugagaaacuguaauauuuggagugccaguauucauaggaaagcauauaaacaugaaauaaac

SEQ ID NO: 635357 - RNA, 62 nt, Homo Sapiens
gccuuuagagaaagcauuugugcaauucuaugcauaggaagacugcaucaccacaguguaua

SEQ ID NO: 635358 - RNA, 62 nt, Homo Sapiens
cucuauguuuguauauuucuuauuauccaaagcauaggaaggaaugucaaugaguaauucau

SEQ ID NO: 635359 - RNA, 62 nt, Homo Sapiens
auacccagagacccaucauggccaucaucugccauaggaaagagcaggaaccuaaaauaucu

SEQ ID NO: 635360 - RNA, 62 nt, Homo Sapiens
ccucacuguuuaaccaugugugucuagucuuccauaggaaauucugcuucuaaaaacuucua

SEQ ID NO: 635361 - RNA, 62 nt, Homo Sapiens
auuucguuggcugaacguuauccuacugccgccauaggaauuccgcuucugcguuuuguuau

SEQ ID NO: 635362 - RNA, 63 nt, Homo Sapiens
acuucauugaaaguagugcuguaaauauucugccauaggaauacugucuacaugcuuucucau

SEQ ID NO: 635363 - RNA, 63 nt, Homo Sapiens
cggccucacccaggcaucugcuuuacucuggaccauaggaaacaagaccguuuggagguuuca

SEQ ID NO: 635364 - RNA, 63 nt, Homo Sapiens
cccuucaagugggcugaagcccuuggaaagugacauaggaaguccccagaucuugcccuucuc

SEQ ID NO: 635365 - RNA, 63 nt, Homo Sapiens
uaauuguauuuagaucuuguuauugcuccaguacauaggaauuguguaaaguguuaacagcag

SEQ ID NO: 635366 - RNA, 63 nt, Homo Sapiens
aaccauagauuucuuucagaaaaaaaaaacaggcauaggaacaguuuucucuucauauauuau

SEQ ID NO: 635367 - RNA, 63 nt, Homo Sapiens
uauaucuuuaaaauuuuccuuuauguuccauuccauaggaaaacacacauaugcacacaaaac

SEQ ID NO: 635368 - RNA, 63 nt, Homo Sapiens
uggugguuauuugguauuaaacuccaaaugagccauaggaaggcacuacaugaaauaaugcac

SEQ ID NO: 635369 - RNA, 63 nt, Homo Sapiens
auuguaauuuugaugauacaaagauugaaagaucauaggaaagcauugcccuucaucacagaa

SEQ ID NO: 635370 - RNA, 63 nt, Homo Sapiens
ggaagcagacacaacccaaacauuugcuacuaacauaggaaacacacacauacagacaccccc

SEQ ID NO: 635371 - RNA, 63 nt, Homo Sapiens
gugagaguuggugcaaauucuuguguguguuugcauaggaaggugagaugaccaucuacuaaa

SEQ ID NO: 635372 - RNA, 63 nt, Homo Sapiens
uccccccggaaaugaacaaagccgggcccuuuccauaggaacugcccuuggagauagcagagu

SEQ ID NO: 635373 - RNA, 63 nt, Homo Sapiens
ccucaccaucaugauaccagauacaggugaauacauaggaacuaucugccuguguccucaauc

SEQ ID NO: 635374 - RNA, 63 nt, Homo Sapiens
ugauuuuuauuuguuacagguuuccaauggccccauaggaauaagcaauaauguagacugaua

SEQ ID NO: 635375 - RNA, 63 nt, Homo Sapiens
agugaucaccccggacgggccgagcuguauccucauaggaaacccuuuugugaaggccgaacu

SEQ ID NO: 635376 - RNA, 63 nt, Homo Sapiens
uggaauccaagagcuauaauugcagaucgggggcauaggaauugcuccagagcccacgaggcu

SEQ ID NO: 635377 - RNA, 63 nt, Homo Sapiens
gcccccaucucccaucuggggaugggggggagucauaggaaaacccacgucuuccagcugggg

SEQ ID NO: 635378 - RNA, 63 nt, Homo Sapiens
aaggacugugggcgcuggguugugaaguggugucauaggaauguucugagauguggugacuca

SEQ ID NO: 635379 - RNA, 63 nt, Homo Sapiens
gggcccuauuuuccugcugcacaaccauaggaucauaggaaagaggguucuccucaaagccuc

SEQ ID NO: 635380 - RNA, 63 nt, Homo Sapiens
aaacuguagaguuccauauuaccugcaguaacccauaggaaaucacagucgaggaaaauugau

SEQ ID NO: 635381 - RNA, 63 nt, Homo Sapiens
uaaagaaaucauuagcaagaaucuuauauuuuccauaggaaggaucuuauacagagaucuaga

SEQ ID NO: 635382 - RNA, 63 nt, Homo Sapiens
ggauccuaccuauguuaauuuucagcagccugucauaggaacucuugaugcucauaucuguuc

SEQ ID NO: 635383 - RNA, 63 nt, Homo Sapiens
agggggaaagucucuuacuguuccuugaauguacauaggaacaagagccuucuugcuuucauu

SEQ ID NO: 635384 - RNA, 63 nt, Homo Sapiens
auauuaugugcagguccuagguaggcacuuagucauaggaaacuggggcaacuuugugaacac

SEQ ID NO: 635385 - RNA, 63 nt, Homo Sapiens
guauuuuucuugauccaaaggaugcuguuaaaacauaggaaggucauucacuauuguauagaa

SEQ ID NO: 635386 - RNA, 63 nt, Homo Sapiens
auacaaguaaggaugugagaaacuuacaguuaacauaggaaaauagccguguuuacuuguauu

SEQ ID NO: 635387 - RNA, 63 nt, Homo Sapiens
guuauuuugugggggggggauuuuguuaaaauucauaggaaaugacacauuuuguaaauaacu

SEQ ID NO: 635388 - RNA, 63 nt, Homo Sapiens
ccggccaccaggacaugcuucaaugccuggugccauaggaagcccaggggacagucacaacuu

SEQ ID NO: 635389 - RNA, 63 nt, Homo Sapiens
uaucauuguuuaauaaaaguaaucccugcuggucauaggaaaacacacgguucuaauuaagug

SEQ ID NO: 635390 - RNA, 63 nt, Homo Sapiens
gcauauuacucauaaaucauuaauuaauauaagcauaggaaauggucuuaaaagauacugcau

SEQ ID NO: 635391 - RNA, 63 nt, Homo Sapiens
acuugacacaacuuugaaacugcauaaaguagacauaggaacuagaggaaagcucaggcugca

SEQ ID NO: 635392 - RNA, 57 nt, Homo Sapiens; identical to SEQ ID NO: 635102

SEQ ID NO: 635393 - RNA, 63 nt, Homo Sapiens
ccauuuccugcuuuuguguaaggaaggugcucacauaggaaguuuuuauuugguuagagacag

SEQ ID NO: 635394 - RNA, 63 nt, Homo Sapiens
gggggccuucccuggacagucuaugcacagagccauaggaacucggucaagaacaaauggccc

SEQ ID NO: 635395 - RNA, 63 nt, Homo Sapiens
uugaaaggucugaggaugauacuauauaagucacauaggaaacgguacuaagcacagaaacuc

SEQ ID NO: 635396 - RNA, 63 nt, Homo Sapiens
guaaaugguuugaauaagagugcacauccaucucauaggaauucugcauauaggguauggaau

SEQ ID NO: 635397 - RNA, 63 nt, Homo Sapiens
aguuguuuaaugcucagggcaaaccaaauuuagcauaggaaaaucucaggcacuucaaaacua

SEQ ID NO: 635398 - RNA, 63 nt, Homo Sapiens
cuggagguggguucuggucaagacaacuuuggucauaggaacugcaguguccggagcggcucu

SEQ ID NO: 635399 - RNA, 63 nt, Homo Sapiens
guaaagccagggugcugacgaggccccauagugcauaggaacagaaacaugggcugaaaauga

SEQ ID NO: 635400 - RNA, 63 nt, Homo Sapiens
ugacuuaggaaaaagagaaauguauguaaaacacauaggaagcgcagggucugugauuuuaca

SEQ ID NO: 635401 - RNA, 63 nt, Homo Sapiens
acuuugguuaagaguaaguuauauccauuuugacauaggaagaucuguauguauaacccguaa

SEQ ID NO: 635402 - RNA, 63 nt, Homo Sapiens
augacccaacauuucuuagcgccuuugaacuuucauaggaaaagauuggaauuagaccauuug

SEQ ID NO: 635403 - RNA, 63 nt, Homo Sapiens
uuguuuuugguuucuuuaucuaacuuaaaagaacauaggaauuaauaggagucuucugccucu

SEQ ID NO: 635404 - RNA, 63 nt, Homo Sapiens
gaucugucagaacaggcagcagauauguguauccauaggaagagcuuugguuugaggagguag

SEQ ID NO: 635405 - RNA, 63 nt, Homo Sapiens
uagccauaccugguaagcaaaaacuaguaaagacauaggaacauguaguuuuacuugguguuu

SEQ ID NO: 635406 - RNA, 63 nt, Homo Sapiens
gcucuguucuccaagaggacccggaaguaaucacauaggaaaugauaaggaagaccaggagga

SEQ ID NO: 635407 - RNA, 63 nt, Homo Sapiens
agacuacccagccagugaagugcagaggauagacauaggaaaacauuccaggcauuuggagac

SEQ ID NO: 635408 - RNA, 63 nt, Homo Sapiens
uuacauucuacagggagaaagagauagccaauacauaggaauaaauauauacaagguaucaug

SEQ ID NO: 635409 - RNA, 63 nt, Homo Sapiens
ccagaggagauauuaucuguccucuguguggcacauaggaaaaugugagaccuagaauuauag

SEQ ID NO: 635410 - RNA, 63 nt, Homo Sapiens
acauacaauccaaaauuuaaaaaaauauuuuugcauaggaaaaauugagaaggaaguaaacca

SEQ ID NO: 635411 - RNA, 63 nt, Homo Sapiens
uuaaacaauaaagcaauaagaacaaauacaauacauaggaaguuaaaagcacaaaggaaugaa

SEQ ID NO: 635412 - RNA, 63 nt, Homo Sapiens
augauagcaguccugccaccuucuaguucaucccauaggaauguuuuuccaaguccuuccagu

SEQ ID NO: 635413 - RNA, 63 nt, Homo Sapiens
uacuuauauacauauuuuuuaaaaguagcuuuacauaggaaggaaguggcauaguuuuaucaa

SEQ ID NO: 635414 - RNA, 63 nt, Homo Sapiens
ggccaucuucccaaaguuauccaggcaaugaaucauaggaacaaugccauuccuaagagugcc

SEQ ID NO: 635415 - RNA, 63 nt, Homo Sapiens
cauguagucacaaccuguuuuguuuuuguaaaacauaggaagucucuuuaaugcaaugauuug

SEQ ID NO: 635416 - RNA, 63 nt, Homo Sapiens
uguuaauaacucucagcaggcaaagaccgauugcauaggaauugcacaauccaugaacagcau

SEQ ID NO: 635417 - RNA, 63 nt, Homo Sapiens
ccuggaagaggucuggguggggaggccaguucccauaggaaggagucugccucuucugucccc

SEQ ID NO: 635418 - RNA, 63 nt, Homo Sapiens
ucuguggggugacucuacugcagccguugaacacauaggaaugggugaugguaugcugaaguu

SEQ ID NO: 635419 - RNA, 63 nt, Homo Sapiens
ccccacccccguccaccccaguggggaacccuucauaggaaaucaagcaggcugcucccagag

SEQ ID NO: 635420 - RNA, 63 nt, Homo Sapiens
gucuuggagucaucagaucuggggggccagagucauaggaagggcacuagaaguggcugggca

SEQ ID NO: 635421 - RNA, 63 nt, Homo Sapiens
uaacacauauauaccuucucaauaaaauguccacauaggaaauaaugucauguauaaaauaug

SEQ ID NO: 635422 - RNA, 63 nt, Homo Sapiens
auggcaugaacaucuuuagggcccaauguaaugcauaggaaguuuaugcugcuguuuacaaaa

SEQ ID NO: 635423 - RNA, 63 nt, Homo Sapiens
gaggcuguguuagugaaagcgcggauccagucacauaggaaaggcacugauggcccugaagaa

SEQ ID NO: 635424 - RNA, 63 nt, Homo Sapiens
aaaaugugauguauguguccggugggcuaaagccauaggaagagucucuuuuggugggguggg

SEQ ID NO: 635425 - RNA, 63 nt, Homo Sapiens
ccagaaaauuauuaauccguuggcauuguaacucauaggaauuguaucuuaauugcuacuggu

SEQ ID NO: 635426 - RNA, 63 nt, Homo Sapiens
uguugguguuuuauuguacauacuucagaugcacauaggaauagaaguguguuauaaaucuag

SEQ ID NO: 635427 - RNA, 63 nt, Homo Sapiens
uauuucauuaugauugaaaaacauaaaaacuaacauaggaaagugaaugaucaguuacuuaug

SEQ ID NO: 635428 - RNA, 63 nt, Homo Sapiens
uagucuaucugcaauuacucaacgaggcauuuucauaggaaacagacuaugauuaauccauuu

SEQ ID NO: 635429 - RNA, 63 nt, Homo Sapiens
accacucaguuuugcuuuugcgaggcgauuugacauaggaacuuugagacuccaugagaaagu

SEQ ID NO: 635430 - RNA, 63 nt, Homo Sapiens
aaauaacauuugcuguuuuauagguuugaagaacauaggaaaaacuaagagguuuuguuuuua

SEQ ID NO: 635431 - RNA, 63 nt, Homo Sapiens
ucugacugauuuuguuacgggguugauucugaccauaggaaguaugcaaugugaaucacuauu

SEQ ID NO: 635432 - RNA, 63 nt, Homo Sapiens
uuugagaagaaagggucucuugaccuguauuaacauaggaaaguaaaguucuuuuuguuuuuc

SEQ ID NO: 635433 - RNA, 63 nt, Homo Sapiens
gagcacaggcuuuuucaggucagaaucaucagacauaggaacuguagaauuugaucagaauca

SEQ ID NO: 635434 - RNA, 63 nt, Homo Sapiens
gcaaaugaaauaaacucuuuuguagguguaccacauaggaagauuauuuaaauagaagauuuu

SEQ ID NO: 635435 - RNA, 63 nt, Homo Sapiens
aguggauaauuuucagcuauaagaacaugcuuccauaggaaauccuaaccuuaauuauucugu

SEQ ID NO: 635436 - RNA, 63 nt, Homo Sapiens
aauguauuuacuaagugucaaaggcuauuaacacauaggaaaaagacuaaucaaaggcaaaca

SEQ ID NO: 635437 - RNA, 63 nt, Homo Sapiens
auugacccagaaccugacuucauccaaccaaagcauaggaaacaaauauauacuuuauuaaau

SEQ ID NO: 635438 - RNA, 63 nt, Homo Sapiens
aaauaaaauauuauuagaacuaugauuuacauucauaggaauaauuuuuaaaacaucaaaauu

SEQ ID NO: 635439 - RNA, 63 nt, Homo Sapiens
cuagaggaaagagaacacugucgggguucuucucauaggaauguucguguuugacuuguccau

SEQ ID NO: 635440 - RNA, 63 nt, Homo Sapiens
aaacuugagcgguauacucaaaccugaagaagucauaggaaagacuguguuaauaaaugacag

SEQ ID NO: 635441 - RNA, 63 nt, Homo Sapiens
ccagaaggaagcuuggcugagcuggccuuuuaacauaggaauguauuucguuggaaacauucu

SEQ ID NO: 635442 - RNA, 63 nt, Homo Sapiens
ucauuucauuuguauuuuuguccagaaauuucccauaggaagacuucaccuccuacaacuccg

SEQ ID NO: 635443 - RNA, 63 nt, Homo Sapiens
uaacucauuuuaguugauuuucaguacuauuuacauaggaauugauuuuuauggauauaguag

SEQ ID NO: 635444 - RNA, 63 nt, Homo Sapiens
aaaauggaaaauaagagaucaaaaugaauauagcauaggaauaaagauuucacuagaaauugc

SEQ ID NO: 635445 - RNA, 63 nt, Homo Sapiens
uaagacuuucuuuuucaucuuuuauagcguuaccauaggaaacuguuccaaacugaguuagcu

SEQ ID NO: 635446 - RNA, 63 nt, Homo Sapiens
aaugucaauauauauuuaaaauaauaauggaaacauaggaaaucagcuauuuaaaccagauca

SEQ ID NO: 635447 - RNA, 63 nt, Homo Sapiens
guccauccccagauucgccacuuccacuccccacauaggaauauuuccucaccaggagcccgg

SEQ ID NO: 635448 - RNA, 63 nt, Homo Sapiens
cugugauaaccaguaaggaauuaaagccuguuccauaggaaggucuccugcaaauuuaguuug

SEQ ID NO: 635449 - RNA, 63 nt, Homo Sapiens
cagcuuaaacauaaauaucaugaauguggcuuucauaggaaagugaugggauugggucacuuu

SEQ ID NO: 635450 - RNA, 63 nt, Homo Sapiens
ugccaugaaaauugcuuuugagaaaauuuuccacauaggaaaauaccauagaaagaugacaaa

SEQ ID NO: 635451 - RNA, 63 nt, Homo Sapiens
acauacacuuccauaaauaggacgguucuggggcauaggaaaccggguuaccuguaucugaag

SEQ ID NO: 635452 - RNA, 63 nt, Homo Sapiens
acaaucacaucaguaaguuauauguauagauuacauaggaagagagaaaucacucacuuugau

SEQ ID NO: 635453 - RNA, 63 nt, Homo Sapiens
guucaacaauucugugaaagccuccacagaucucauaggaaauaccaguguucuccaccuugu

SEQ ID NO: 635454 - RNA, 63 nt, Homo Sapiens
uuaguuaauauugauauaucaaaauaaaucuaccauaggaaugcuguucaguuuuauggagga

SEQ ID NO: 635455 - RNA, 63 nt, Homo Sapiens
cagaccauaggcaaacucuguacuuacuuuccccauaggaagauaaauaacccugagguuuug

SEQ ID NO: 635456 - RNA, 63 nt, Homo Sapiens
guacugugggaacuauucuacaaacauaauuuacauaggaaauaugguucuaaaaauugcauu

SEQ ID NO: 635457 - RNA, 63 nt, Homo Sapiens
ggggaagagaggcugagugugaagauugagcaacauaggaaaauaagaaccuaggagggaaag

SEQ ID NO: 635458 - RNA, 63 nt, Homo Sapiens
uauggccguucuuuuccacccuguuucuucccccauaggaagaacccaccuguagcccugagg

SEQ ID NO: 635459 - RNA, 63 nt, Homo Sapiens
aggaguuaauaaagaaguucauuuugguuuaaacauaggaaagaagagaaccaugaaaauggg

SEQ ID NO: 635460 - RNA, 63 nt, Homo Sapiens
gccuccagauuuggguggagccucugugggaaccauaggaagugugugggcugccuuccuggg

SEQ ID NO: 635461 - RNA, 63 nt, Homo Sapiens
aaaacgaucauagucuuaggaguucauuuaaaccauaggaacuuuucacuuaucucauguuag

SEQ ID NO: 635462 - RNA, 63 nt, Homo Sapiens
acugagggugugucuuuguagauugggcuuccucauaggaagcaaaguggccaccuuuugauu

SEQ ID NO: 635463 - RNA, 63 nt, Homo Sapiens
uagcagaaaugauagacacaccuggccuccucacauaggaaucucaugaaggucagcaccauc

SEQ ID NO: 635464 - RNA, 63 nt, Homo Sapiens
cacauuaucuucuggacuauagcccugcauuuucauaggaagauucauacuuaaaaauuuauu

SEQ ID NO: 635465 - RNA, 63 nt, Homo Sapiens
gucaccuucaggauacaaaugaauugucucuugcauaggaagugagaaccagaccuugguaaa

SEQ ID NO: 635466 - RNA, 63 nt, Homo Sapiens
guugaagaggucuugcagucaaaaugcucuaaacauaggaaugggcccuuaaacuggauucaa

SEQ ID NO: 635467 - RNA, 63 nt, Homo Sapiens
uaauaguaaugcuugaacuucugguuaauguuacauaggaauuaaaaugaagagacaggcuau

SEQ ID NO: 635468 - RNA, 63 nt, Homo Sapiens
accacaacccaccaaguaccgaauauuucucaccauaggaauacuucccuuacuaaucaccau

SEQ ID NO: 635469 - RNA, 63 nt, Homo Sapiens
gucuccacgccgugauggcagcgcugccgaggacauaggaaccacgacuggaaagauaauuua

SEQ ID NO: 635470 - RNA, 63 nt, Homo Sapiens
uuuucucccccacgaguggaaaauagacuucuacauaggaaagcuaaaauauguuaauauuuu

SEQ ID NO: 635471 - RNA, 63 nt, Homo Sapiens
uugacuaucaggaaugugugcugugucaggauacauaggaaguugaccucgggguaucaugga

SEQ ID NO: 635472 - RNA, 63 nt, Homo Sapiens
uguaaguguuaaguuuuuaaucugggagcagggcauaggaagaaaaugucaguagugcuaaug

SEQ ID NO: 635473 - RNA, 63 nt, Homo Sapiens
gcaaaacuuaauugauccuacaagcuuacuacacauaggaaaauucauacuggagagaaacua

SEQ ID NO: 635474 - RNA, 63 nt, Homo Sapiens
cuuucccguaacgcacaggacacgugugcaauucauaggaacggcccagaucgcccucaugag

SEQ ID NO: 635475 - RNA, 63 nt, Homo Sapiens
uauacugggguagauuauugccugccccuuauacauaggaauaugcugcauaauugcgcauaa

SEQ ID NO: 635476 - RNA, 63 nt, Homo Sapiens
caaaccucaugccuuauucagcaucacaaaaugcauaggaaagagaaaucguaugaauguaau

SEQ ID NO: 635477 - RNA, 63 nt, Homo Sapiens
aaacacuuuuuuucuaauucucccuaguauaugcauaggaauuuaauauacuuuauaaauaag

SEQ ID NO: 635478 - RNA, 63 nt, Homo Sapiens
uguggugguuucuguuugcauuuuugcaggagccauaggaaacuacugaaaugauugugcugg

SEQ ID NO: 635479 - RNA, 63 nt, Homo Sapiens
cacuguguuuucauuugaugagugacuuucuaacauaggaauugucuguggcagacauugccg

SEQ ID NO: 635480 - RNA, 63 nt, Homo Sapiens
cacuguguuuucauuugaugcaaugcuguguaacauaggaauuuuacauaacagugcagagca

SEQ ID NO: 635481 - RNA, 63 nt, Homo Sapiens
aaaaaauuaucuuuucauauaaacagaaaaugucauaggaauaugcugaaaagaaaaucguaa

SEQ ID NO: 635482 - RNA, 63 nt, Homo Sapiens
gagaauugggagugggaagaaugauaccgcacccauaggaauuaagaaugcuuauucucuuag

SEQ ID NO: 635483 - RNA, 63 nt, Homo Sapiens
ggagauuggcuugucucacguuaaugaaaaaagcauaggaauucucgagauaguuuuuucuuu

SEQ ID NO: 635484 - RNA, 63 nt, Homo Sapiens
guagacauuuuauuuauaacucuucugaagaaucauaggaagaaaaucugaggaaacauaaau

SEQ ID NO: 635485 - RNA, 63 nt, Homo Sapiens
ucuuaaaauucuugggaguguguugcaaugacacauaggaaaaucuugcuuuuucaauucucc

SEQ ID NO: 635486 - RNA, 63 nt, Homo Sapiens
uccuucauaaaacauguaacuugguucuuuuuucauaggaaaucccagaggaggccucuuugg

SEQ ID NO: 635487 - RNA, 63 nt, Homo Sapiens
auuuugacaauguggaguuuuuugccaauauuccauaggaaaacacaauauaacuuuacauuc

SEQ ID NO: 635488 - RNA, 63 nt, Homo Sapiens
auuauucagaauguagucuguaccagugugauacauaggaaucuaaccacuaauuuugaaaau

SEQ ID NO: 635489 - RNA, 63 nt, Homo Sapiens
uagaaaauacuaauaacuuuaauuaaaugcuaacauaggaagucaacuaguauauaaaguacu

SEQ ID NO: 635490 - RNA, 63 nt, Homo Sapiens
ucagggacauuucaaguugcuuccccuguauaucauaggaaacgcagccaggaaggacaggcu

SEQ ID NO: 635491 - RNA, 63 nt, Homo Sapiens
uauuuuagggguuggagguguuucucuuacugccauaggaaauagccugcaucccucccuucc

SEQ ID NO: 635492 - RNA, 63 nt, Homo Sapiens
acgugccaguuguggaggaaccucaauaaucgucauaggaaaggacagucaaagagacaucuc

SEQ ID NO: 635493 - RNA, 63 nt, Homo Sapiens
cugcagcuuugggcucccccauagugacugugccauaggaaagcagccccuccucacacauac

SEQ ID NO: 635494 - RNA, 63 nt, Homo Sapiens
uguugauggaaaccaucugugcuuagucucugacauaggaagcuugcuucaggcaauggcuuu

SEQ ID NO: 635495 - RNA, 63 nt, Homo Sapiens
ucacaauuguugacuaaaaugcugcuuuuaaaacauaggaaaguagaaugguugagugcaaau

SEQ ID NO: 635496 - RNA, 63 nt, Homo Sapiens
aaccugagaaaugcuaauggagauuugcugguacauaggaaucuagcaaauucaggaaccaag

SEQ ID NO: 635497 - RNA, 63 nt, Homo Sapiens
guuugcacagucuuacuucuguagaacacuggccauaggaaaugcuguuuuuuuguacuggac

SEQ ID NO: 635498 - RNA, 56 nt, Homo Sapiens; identical to SEQ ID NO: 635208

SEQ ID NO: 635499 - RNA, 63 nt, Homo Sapiens
ccuugaaucuucucccuuguccugcuugggguucauaggaauugguaaggccucuggacuggc

SEQ ID NO: 635500 - RNA, 63 nt, Homo Sapiens
uacuucaaaaccaaaaaaaccagucaucacaagcauaggaagaauuagccuaguuuucucaua

SEQ ID NO: 635501 - RNA, 63 nt, Homo Sapiens
gcaugcuuucagccagaugcauuaguugguuuccauaggaaagagcuggcgccaucgcuccgg

SEQ ID NO: 635502 - RNA, 63 nt, Homo Sapiens
ccccacggugggucagaaggagaggaggggccacauaggaaagguuuguuacuuacgguucug

SEQ ID NO: 635503 - RNA, 63 nt, Homo Sapiens
auaagaacaauagguaaagcauuguagaagcagcauaggaacacuaaguauaguugauguaac

SEQ ID NO: 635504 - RNA, 63 nt, Homo Sapiens
gaucugccagacgcgaacucuaauaggauuucccauaggaagauugcuuuguaauagagucug

SEQ ID NO: 635505 - RNA, 63 nt, Homo Sapiens
aagacaacauucaauuugaugggucucacccaccauaggaaacacuucaaacacuggcaccuu

SEQ ID NO: 635506 - RNA, 63 nt, Homo Sapiens
cucaguagaaauaccuuugggcuuacugugggacauaggaaaauuugaguucucucuaaccca

SEQ ID NO: 635507 - RNA, 63 nt, Homo Sapiens
uuggucagagugaauugaauccguggauuuucucauaggaaguguacuuuucauuuuggcuca

SEQ ID NO: 635508 - RNA, 63 nt, Homo Sapiens
augguuugcuaaaaucuauagagaacccaaugucauaggaaauuuugaacugcagaccuguau

SEQ ID NO: 635509 - RNA, 63 nt, Homo Sapiens
accauuucaaaacuguuucuucuauuccugguucauaggaaagaaaaaaguuauucaaaguau

SEQ ID NO: 635510 - RNA, 63 nt, Homo Sapiens
uugagcccagaaguucgagacuagccugggaaacauaggaagcccucgucucuacaaaaaaaa

SEQ ID NO: 635511 - RNA, 63 nt, Homo Sapiens
aucgcuacucuuaagaauauacauguauguauucauaggaacauuuuuucucaauauuuguau

SEQ ID NO: 635512 - RNA, 63 nt, Homo Sapiens
uuaugagaacacauuuucacaguuauguuucuucauaggaaaacuauauuuagugggcaacaa

SEQ ID NO: 635513 - RNA, 63 nt, Homo Sapiens
auuuugauaacuagcuuuccagguggacuuagccauaggaaaauauuacuaauguaauuuaac

SEQ ID NO: 635514 - RNA, 63 nt, Homo Sapiens
aagaagcauauauggguuggaauuaugccaaagcauaggaagcugggaauaagcaaacaaaug

SEQ ID NO: 635515 - RNA, 63 nt, Homo Sapiens
ccacuuaucagggccuggagcccugauggaagccauaggaacuccagaguugccaagccauag

SEQ ID NO: 635516 - RNA, 63 nt, Homo Sapiens
gugaaaauauuuguguuuguaguuaaaaacaaacauaggaaauucaguggcuuuaugaaguaa

SEQ ID NO: 635517 - RNA, 63 nt, Homo Sapiens
gugggccuggguaaagaguccaaagccagugcgcauaggaacaacauaugaugugaaugccua

SEQ ID NO: 635518 - RNA, 63 nt, Homo Sapiens
aaaccagaugaagaugaaugaucagagaauucacauaggaaaggaaguaaacccucacuguga

SEQ ID NO: 635519 - RNA, 63 nt, Homo Sapiens
gguguagauaagcaugcaauaagauaucguguacauaggaacucacuuuaaacuucuauagaa

SEQ ID NO: 635520 - RNA, 63 nt, Homo Sapiens
cuguaaguuggaauuaucuuauuuuuucccuuacauaggaaaauuuuaaacuaccauaauucc

SEQ ID NO: 635521 - RNA, 63 nt, Homo Sapiens
cuuguaaaaauaacauaauaaauagaucuuaaacauaggaaaaccauacuguucugauaauaa

SEQ ID NO: 635522 - RNA, 63 nt, Homo Sapiens
caaaacagcaugauacuggcauaacaacagacacauaggaacaguauagacaacccagaaaca

SEQ ID NO: 635523 - RNA, 63 nt, Homo Sapiens
gaaaaccuaauggugcuucucccuuggaaaugccauaggaagcccacaaccgcuaacacuuac

SEQ ID NO: 635524 - RNA, 63 nt, Homo Sapiens
gagccucugcccccaggcugggccugucacuggcauaggaaggccagccccgcaucucccacu

SEQ ID NO: 635525 - RNA, 63 nt, Homo Sapiens
agggauccaagaucuuugcaguucaaucgaccacauaggaauuuccaggcaccaaaaugauau

SEQ ID NO: 635526 - RNA, 63 nt, Homo Sapiens
ggaucuauaggcagcuucuaagagcgaacuucacauaggaagggaucugagaacacguugcca

SEQ ID NO: 635527 - RNA, 63 nt, Homo Sapiens
cugacuuuagagagaguaaaaugugccaggagccauaggaauaucuguauguuggaugacuuu

SEQ ID NO: 635528 - RNA, 63 nt, Homo Sapiens
acauuuuaaaauagaacuauccuuguucgauagcauaggaaaauguucuggugauugucaggg

SEQ ID NO: 635529 - RNA, 63 nt, Homo Sapiens
guuaaauauuaaaaauuguguaaauacaauugacauaggaauuacauuaaaauauuaggaaga

SEQ ID NO: 635530 - RNA, 63 nt, Homo Sapiens
gugucauggaguccaaauaaaucuagucaagggcauaggaacgacaauguauaauacauucac

SEQ ID NO: 635531 - RNA, 63 nt, Homo Sapiens
gggugcuggcuggccaugguugaugccagcugccauaggaagaccucuggucaccacaaugcu

SEQ ID NO: 635532 - RNA, 63 nt, Homo Sapiens
auccucauugauccucuucaaggcuuccuaucucauaggaaaccaauugauccccaaccugcc

SEQ ID NO: 635533 - RNA, 63 nt, Homo Sapiens
uguuucauuuuggugugcaaaaaagaacucauucauaggaaggccuccuaaaugccccauauu

SEQ ID NO: 635534 - RNA, 63 nt, Homo Sapiens
cuguuagccaccauccaugcuaccuagguaguccauaggaaccacccccaugaccaccaccaa

SEQ ID NO: 635535 - RNA, 63 nt, Homo Sapiens
cuccacaccagggcugugguccucccagacaugcauaggaauggccacagguuuacacugccu

SEQ ID NO: 635536 - RNA, 63 nt, Homo Sapiens
ucuacucagaaauuuuuauuuuucuaagguucucauaggaaaaguacauuuaauacagcagug

SEQ ID NO: 635537 - RNA, 63 nt, Homo Sapiens
aauauauuuaaaaaaccuuuuuuuauuguggagcauaggaauugccccccuccaggcuucacc

SEQ ID NO: 635538 - RNA, 63 nt, Homo Sapiens
aaaagguuauggaagaaugguuuaugaacuucccauaggaagcaccugagagauaguaaacug

SEQ ID NO: 635539 - RNA, 63 nt, Homo Sapiens
aaagccugucuccucacccacccccagcccuagcauaggaaaagcuuccuugaugugagcucu

SEQ ID NO: 635540 - RNA, 63 nt, Homo Sapiens
ggacuagaugcauaccguuuugugaaaaccagccauaggaaaacaugugagcaacaaccccca

SEQ ID NO: 635541 - RNA, 63 nt, Homo Sapiens
agacaugguuacuuuauuuuccccuuguuaagacauaggaagacuuaauuuuuaaacggucag

SEQ ID NO: 635542 - RNA, 63 nt, Homo Sapiens
cuuguccagagacaagacuugaucaaggggacccauaggaaauaccccaaacucaggccgaau

SEQ ID NO: 635543 - RNA, 63 nt, Homo Sapiens
uagaaacuugcuuaucaaaagccguucccugaacauaggaaaagccagcuuucuucuguugau

SEQ ID NO: 635544 - RNA, 63 nt, Homo Sapiens
ugacucaggagccuccuagguccagagagcaaacauaggaauauaaacaguuuagcccaucuc

SEQ ID NO: 635545 - RNA, 63 nt, Homo Sapiens
ucacagaaaugaggaggcugacauuccagcugucauaggaagagaagguuagguguuuuaggu

SEQ ID NO: 635546 - RNA, 63 nt, Homo Sapiens
gucauuacaguaugaauuauuuguaauucuuuucauaggaaaugguggauuccaugacauaua

SEQ ID NO: 635547 - RNA, 63 nt, Homo Sapiens
ccuugguucagagggaaguggauaucuaaaaagcauaggaaaugagaaggccuuuucugaagg

SEQ ID NO: 635548 - RNA, 63 nt, Homo Sapiens
gcuuggugcaguuaacgggugauaguuccaggccauaggaaugauacugggcagguccaaaag

SEQ ID NO: 635549 - RNA, 63 nt, Homo Sapiens
ccacuuccccaggcuucucccuccccccacccccauaggaacaggauuuggccuuagcuucug

SEQ ID NO: 635550 - RNA, 63 nt, Homo Sapiens
gguccaggcuccaguaggagagaaagaacuccucauaggaauacugaagaagugggaaggaac

SEQ ID NO: 635551 - RNA, 63 nt, Homo Sapiens
gccaggacaugaagaaaaggaaacugggaaucucauaggaagagccauuuugucuuccauagg

SEQ ID NO: 635552 - RNA, 63 nt, Homo Sapiens
ucucccaggaaagaaauauaauugucuccccuccauaggaauuuguccauuaagacucugaua

SEQ ID NO: 635553 - RNA, 63 nt, Homo Sapiens
uuuucugcuuuuuaaauacagggaaacugcucucauaggaaaguuguauaauauguaauugua

SEQ ID NO: 635554 - RNA, 63 nt, Homo Sapiens
uagaaccuaacuuuuauaggcugagucacacugcauaggaauugcauucuaggcucuauuuaa

SEQ ID NO: 635555 - RNA, 63 nt, Homo Sapiens
aaauguagucucccugugucuauaaaaaauucucauaggaauuauugaaaagauuuuaacaag

SEQ ID NO: 635556 - RNA, 63 nt, Homo Sapiens
cugaaugcugcuguaaagugaugcugaguauuucauaggaaagaguuguauauaauauuuaag

SEQ ID NO: 635557 - RNA, 63 nt, Homo Sapiens
aacaggaagauuccaaagacuuggaauguuauucauaggaaauagauauuugaauuaucuuga

SEQ ID NO: 635558 - RNA, 63 nt, Homo Sapiens
ggccucaggagcaggaagggguccgcuggcacccauaggaaggaaaggccacccuagaaagaa

SEQ ID NO: 635559 - RNA, 63 nt, Homo Sapiens
gacugauaaaaugaaauaugguguucaaaaauacauaggaaaauauagaguaauauuugagcu

SEQ ID NO: 635560 - RNA, 63 nt, Homo Sapiens
auguuggauagucagcuguaccccuucuguuuccauaggaaucgccagcaaaccaggacucug

SEQ ID NO: 635561 - RNA, 63 nt, Homo Sapiens
cugagaugccuuuuauuccaaaagaaaaugcugcauaggaaaagaagguaacguguuccuaga

SEQ ID NO: 635562 - RNA, 63 nt, Homo Sapiens
uuauuucaaagaaauauuacauuuuuucuggaccauaggaauaaucaguuauaaauaugguga

SEQ ID NO: 635563 - RNA, 63 nt, Homo Sapiens
uaccuauacuuugauacugaagacugccaaauacauaggaauuuucuuucuuaaaaaacagua

SEQ ID NO: 635564 - RNA, 63 nt, Homo Sapiens
cugucucacuggcaucuuguugagggccuugcacauaggaaacuuuugauaaguaucugcgga

SEQ ID NO: 635565 - RNA, 63 nt, Homo Sapiens
ccuccuuaaugugaaaaaucaagggcuuacugacauaggaacaacagaaaugcuccuggaacu

SEQ ID NO: 635566 - RNA, 63 nt, Homo Sapiens
uucuguuuccaacagaaaagaaacauuuguuugcauaggaauucaugaaggcgacccaaccug

SEQ ID NO: 635567 - RNA, 63 nt, Homo Sapiens
uuuucccaguaaauccccugaaugaaggaagggcauaggaaaaaacccuaggaaguagggaga

SEQ ID NO: 635568 - RNA, 63 nt, Homo Sapiens
gaucuugcaggucuaguauuuaggcuuccaaggcauaggaagaaugaauagaucaugaaguca

SEQ ID NO: 635569 - RNA, 63 nt, Homo Sapiens
agaauuacagguaagguacaucuuaaauccucccauaggaaauaauaguguuccuaagauauc

SEQ ID NO: 635570 - RNA, 63 nt, Homo Sapiens
aauuaucuuaaaacuuuggcguuaguuuugugccauaggaaaauaauuuuggguauacuugug

SEQ ID NO: 635571 - RNA, 63 nt, Homo Sapiens
agcuggaaggccuccggaugggugcugcaggcccauaggaagguucacgcgucugacagagcu

SEQ ID NO: 635572 - RNA, 63 nt, Homo Sapiens
uaaccaagcacaaaguuauauguuuuguugcgacauaggaaaacuauuugcaccgaaaugucu

SEQ ID NO: 635573 - RNA, 63 nt, Homo Sapiens
cugccuauucuucaaccaccuugguuacuuugacauaggaauugacuucuuuuccuugaaugg

SEQ ID NO: 635574 - RNA, 63 nt, Homo Sapiens
gaaggagauuuucuagcuccacaucugucugcacauaggaaggaaaagauaggacucuaaacc

SEQ ID NO: 635575 - RNA, 63 nt, Homo Sapiens
aagagcccugggguccuguccugcaggaugcugcauaggaaugggcagagauguccuggaugg

SEQ ID NO: 635576 - RNA, 63 nt, Homo Sapiens
auaauaaccaagacuuuucaagcuucuagaucucauaggaaagcuuguaauagcaaaauugua

SEQ ID NO: 635577 - RNA, 63 nt, Homo Sapiens
ugcuguguaacaugaccuuaaauagucuuccugcauaggaagagcaaaaggguauucaucaau

SEQ ID NO: 635578 - RNA, 63 nt, Homo Sapiens
ccagcucuggugagucuuggcggcagcagccaucauaggaagggaccaaggcaaggcaggugc

SEQ ID NO: 635579 - RNA, 63 nt, Homo Sapiens
cugcaagaauuaaaacugaguccaugaaaauaccauaggaagacauaaaacuuuaaaaggcaa

SEQ ID NO: 635580 - RNA, 63 nt, Homo Sapiens
guacaguaaaacuaugguauuuguguuuacaaacauaggaaaguguaacacaguggugaguau

SEQ ID NO: 635581 - RNA, 63 nt, Homo Sapiens
gaaucuccuuuggaaggugaucuuggaacaacgcauaggaaaaccugaugccaccuccucugu

SEQ ID NO: 635582 - RNA, 63 nt, Homo Sapiens
gacacacauccaccuaaaauccuuccugcuauacauaggaaaaaaauacguauguuuaaaaac

SEQ ID NO: 635583 - RNA, 63 nt, Homo Sapiens
gacuucuuuuccuugaaugguugguuacuuugacauaggaauucugccuauucuucaaccacc

SEQ ID NO: 635584 - RNA, 63 nt, Homo Sapiens
uacuucuuuuccuugaguggucgguuacucugacauaggaauuauaccuauucuucaaccacc

SEQ ID NO: 635585 - RNA, 63 nt, Homo Sapiens
caggaggacaaaaccaccauaagguagccucuucauaggaacccacuccauaagugauccuaa

SEQ ID NO: 635586 - RNA, 63 nt, Homo Sapiens
ugagggggcuggaggcgaagggugggagcauagcauaggaacgcugcauagaccauggaggcc

SEQ ID NO: 635587 - RNA, 63 nt, Homo Sapiens
aggggccuagauguagccucuguuccuccuggacauaggaaggucccaagcuuaguaucccac

SEQ ID NO: 635588 - RNA, 63 nt, Homo Sapiens
uccuuggaagaagggauggguucgauuuccugucauaggaagcacuggauuugccaacuagaa

SEQ ID NO: 635589 - RNA, 63 nt, Homo Sapiens
ccaagguugauccacuuaacaauucuaccuacacauaggaagguuccacugggaagagacagg

SEQ ID NO: 635590 - RNA, 63 nt, Homo Sapiens
uuuugucccugcuguuaaugcugcugaaacgcgcauaggaagccuggaguggagagaguauuc

SEQ ID NO: 635591 - RNA, 63 nt, Homo Sapiens
gguauaagaagagacucauucucgaucaguagucauaggaauucaggaaacuauuaaaauugg

SEQ ID NO: 635592 - RNA, 63 nt, Homo Sapiens
aaguucagacaucgcuacaauuuucucuuaacacauaggaaaauugugauacagcggucacua

SEQ ID NO: 635593 - RNA, 63 nt, Homo Sapiens
ucuggaagauaaccuaggcaauaccauucuggacauaggaacggaaaaagauuucaugacaaa

SEQ ID NO: 635594 - RNA, 63 nt, Homo Sapiens
cugucuggaaccagugaaugcauuagaaccuuccauaggaaaagaaaaggggcugaguuccau

SEQ ID NO: 635595 - RNA, 63 nt, Homo Sapiens
gcugcccccagguauuuacuguggagaacauugcauaggaaugucuggaaaaagccucuacaa

SEQ ID NO: 635596 - RNA, 63 nt, Homo Sapiens
ccauuauuagccaugaagggaauaucuuugucacauaggaauuguucagcaacagaaagauac

SEQ ID NO: 635597 - RNA, 63 nt, Homo Sapiens
uuuguaaauuuaugugauggcaaagaaggagagcauaggaaaccacacagacuugggcagggu

SEQ ID NO: 635598 - RNA, 63 nt, Homo Sapiens
uccucucaagggcauucugggcuuguaaacagacauaggaagccucuguuuacccugaagcac

SEQ ID NO: 635599 - RNA, 63 nt, Homo Sapiens
ggcaccugccaauagcuuugucaaucacagccccauaggaacgucuggaauugcuugggaguu

SEQ ID NO: 635600 - RNA, 63 nt, Homo Sapiens
uauuauauuuuuuuuugguaaaaaagaaauguccauaggaaacaaauucccgugucuuaaaac

SEQ ID NO: 635601 - RNA, 63 nt, Homo Sapiens
ggcuggucuggagucccaccacaggugacagaucauaggaaguuaaggggccuugcucugagc

SEQ ID NO: 635602 - RNA, 63 nt, Homo Sapiens
cguugcggaguccgccccgugggaggugguguacauaggaacgcacugaccucagggccgaag

SEQ ID NO: 635603 - RNA, 63 nt, Homo Sapiens
cuuccuuucuggccaaggugagggcagcaccuccauaggaagcccugagaagacagacugagc

SEQ ID NO: 635604 - RNA, 63 nt, Homo Sapiens
aaaauaaaaaacuaaaaaaguaccuuguccagccauaggaaucaagauguucuagaauguaga

SEQ ID NO: 635605 - RNA, 63 nt, Homo Sapiens
ccggaugggaauauucacauaaugcaacuuuuucauaggaagucaauuauucuuucauuuuau

SEQ ID NO: 635606 - RNA, 63 nt, Homo Sapiens
accaaauauacauacuuauuauauauauauguacauaggaaaacggguuuuauaaauaaauau

SEQ ID NO: 635607 - RNA, 63 nt, Homo Sapiens
uccugaguccaccuccugguggggacccaggaccauaggaaggcccuccacccuuggugggga

SEQ ID NO: 635608 - RNA, 63 nt, Homo Sapiens
uuaggaguuaccucucugugaggguucagagaucauaggaauauauuuuaggaggguuuaaau

SEQ ID NO: 635609 - RNA, 63 nt, Homo Sapiens
uuuuggaaugaggcagaaaacuuauauaaugagcauaggaaaacuccuucugauuuugccugu

SEQ ID NO: 635610 - RNA, 63 nt, Homo Sapiens
aaucuaccucaucauuuaaacuucacuuuacugcauaggaaacuguauggauuuuuuuguuau

SEQ ID NO: 635611 - RNA, 63 nt, Homo Sapiens
aaauauguaacccagaacaaucaccuaaguuuacauaggaaugagaagguggggucuuggaua

SEQ ID NO: 635612 - RNA, 63 nt, Homo Sapiens
ccacauacucagccuggauggagagggacccagcauaggaaaguaaaugcucccugucccaug

SEQ ID NO: 635613 - RNA, 63 nt, Homo Sapiens
acuauuccccaacagauauuguggcaaaucacacauaggaaagagaauuugggaauacaguag

SEQ ID NO: 635614 - RNA, 63 nt, Homo Sapiens
aauuaucuaaagaaucauugucuuucagagacucauaggaaaaaaaaacuaggaaaaguguca

SEQ ID NO: 635615 - RNA, 63 nt, Homo Sapiens
cauuuaaaauaaauaguuuuuuucugucuuauacauaggaaaaaaaguagaaagugcuuggua

SEQ ID NO: 635616 - RNA, 63 nt, Homo Sapiens
cauucuccuuuuucauuuuuaucuguggaaaagcauaggaaggaggcaugaaauagugauuau

SEQ ID NO: 635617 - RNA, 63 nt, Homo Sapiens
uauuuuuuuaagcuaccaauaaugcccuuaaaucauaggaaagcgaaggacagcgaugggaaa

SEQ ID NO: 635618 - RNA, 63 nt, Homo Sapiens
caucaggguccccagccucugggcuccuguuuccauaggaaggggcgacaccuuccucccagg

SEQ ID NO: 635619 - RNA, 63 nt, Homo Sapiens
gcaaauagauuaaacacaaaaauaaaacuaaagcauaggaauuauguuuuugagauaccuuug

SEQ ID NO: 635620 - RNA, 63 nt, Homo Sapiens
agguagggggacuguucuagccagcuguggacacauaggaaugcuggaccaggguaccagauu

SEQ ID NO: 635621 - RNA, 63 nt, Homo Sapiens
ggcuccucccccacucaagcaauagggccccgccauaggaagacccccagagagagggucagc

SEQ ID NO: 635622 - RNA, 63 nt, Homo Sapiens
gcagcaguccaggugccacaggcagcccugggacauaggaagcugggagcaaggaaagggucu

SEQ ID NO: 635623 - RNA, 63 nt, Homo Sapiens
cacuggauaaacccacuccacaugugcuggggacauaggaagaccuuaagccauagcucaucc

SEQ ID NO: 635624 - RNA, 63 nt, Homo Sapiens
cacaaggguauugacuggggaaguaaagacaggcauaggaaaucugacaggauugagagauua

SEQ ID NO: 635625 - RNA, 63 nt, Homo Sapiens
gguuauauuccaccauaacaaaaaaaacacauacauaggaacuugauacaacauauucccccc

SEQ ID NO: 635626 - RNA, 63 nt, Homo Sapiens
uuuauuuaaaggaaagaauagcucacaacuaagcauaggaagugggaaucccuuuugcuucau

SEQ ID NO: 635627 - RNA, 63 nt, Homo Sapiens
acauucuagaggaaagguuuauuuuauguugagcauaggaaguuuagaacucuuccuuugcga

SEQ ID NO: 635628 - RNA, 63 nt, Homo Sapiens
gaacaccuggacgugugauaauuuucuagucugcauaggaaggggagaaacugaugauuuuac

SEQ ID NO: 635629 - RNA, 63 nt, Homo Sapiens
ugacauguaggagggcuauaacaggagaaaaaccauaggaaagcuauccaucugagagccaac

SEQ ID NO: 635630 - RNA, 63 nt, Homo Sapiens
guagaacucagucucuaguuguaggugaggauucauaggaagaauuacuccuggaccacaacu

SEQ ID NO: 635631 - RNA, 63 nt, Homo Sapiens
auccguguuccagcaucuaaccuuuuacuuuugcauaggaaauacuugauuuaauuacagguc

SEQ ID NO: 635632 - RNA, 63 nt, Homo Sapiens
ugggcagcaggcaucauuuuccuuuucuagcuucauaggaauauugugagcucaccaugcugu

SEQ ID NO: 635633 - RNA, 63 nt, Homo Sapiens
ugugguuuuuguguuuuuuuuuuuuucuuuuuccauaggaaagaauauauaaauuuguaaauc

SEQ ID NO: 635634 - RNA, 63 nt, Homo Sapiens
ccuuuccuauuauuucucuuuuuuuaaaacuaacauaggaaaggaauuaaaaauaacacaguc

SEQ ID NO: 635635 - RNA, 63 nt, Homo Sapiens
aaaucaaugaauuuagggguggagccacauuuacauaggaaccgccaaaguaaacuguguagg

SEQ ID NO: 635636 - RNA, 63 nt, Homo Sapiens
gcaccccuacucguuccuauagaacacagaggacauaggaaacccuuaaaacacacaugggau

SEQ ID NO: 635637 - RNA, 63 nt, Homo Sapiens
ccaacagccagcccuucauccuccagcgucugccauaggaaugugagagggguguuugcugag

SEQ ID NO: 635638 - RNA, 63 nt, Homo Sapiens
aucuggcagaaguuuccagacagagaacuugggcauaggaacaugucuucuuuugaggaugau

SEQ ID NO: 635639 - RNA, 63 nt, Homo Sapiens
aaugugucagggaauagaugugaaacaagggaucauaggaaaaggggaaagagaaaugaucug

SEQ ID NO: 635640 - RNA, 63 nt, Homo Sapiens
cuauagcaaguguugcuguaaaguguuuuucuccauaggaagugugaacuguguauugucuau

SEQ ID NO: 635641 - RNA, 63 nt, Homo Sapiens
cggugaucaaaacgcuccaucuuuuuacaguggcauaggaagacggcaaaaauuuccuaaagu

SEQ ID NO: 635642 - RNA, 63 nt, Homo Sapiens
aaacucuuuaacuuguaauaaacccuuaacuggcauaggaaaugguauccagaauggaauuuu

SEQ ID NO: 635643 - RNA, 63 nt, Homo Sapiens
cuccaugccaaguaacagcagagggaguuaagccauaggaauuuggcuguggaguaagaggga

SEQ ID NO: 635644 - RNA, 63 nt, Homo Sapiens
aaaauguaacuguuaccauuggaaauuucacgucauaggaaguuagccuuuaucuaccaacuu

SEQ ID NO: 635645 - RNA, 63 nt, Homo Sapiens
aaaauggaauugauguaaagcaaguguuaucuacauaggaaauacauauaugccaucuguccu

SEQ ID NO: 635646 - RNA, 63 nt, Homo Sapiens
ugagaaacuguaauauuuggcagugccaguauucauaggaaagacauauaaacaugaaauaaa

SEQ ID NO: 635647 - RNA, 63 nt, Homo Sapiens
gccuuuagagaaagcauuugaugcaauucuaugcauaggaagaccugcaucaccacaguguau

SEQ ID NO: 635648 - RNA, 63 nt, Homo Sapiens
cucuauguuuguauauuucuuuauuauccaaagcauaggaagggaaugucaaugaguaauuca

SEQ ID NO: 635649 - RNA, 63 nt, Homo Sapiens
auacccagagacccaucaugugccaucaucugccauaggaaagcagcaggaaccuaaaauauc

SEQ ID NO: 635650 - RNA, 63 nt, Homo Sapiens
ccucacuguuuaaccaugugaugucuagucuuccauaggaaaucucugcuucuaaaaacuucu

SEQ ID NO: 635651 - RNA, 63 nt, Homo Sapiens
auuucguuggcugaacguuauuccuacugccgccauaggaauucccgcuucugcguuuuguua

SEQ ID NO: 635652 - RNA, 64 nt, Homo Sapiens
accugaccugcugaauuguuuauaauggcaagaaauaggaaaccccccaaugucuguugaacag

SEQ ID NO: 635653 - RNA, 64 nt, Homo Sapiens
cggccucacccaggcaucugcuuuacucuggaccauaggaaacaagaccguuuggagguuucau

SEQ ID NO: 635654 - RNA, 64 nt, Homo Sapiens
aucuuuagugucugagcuucucaaauuagcugcaauaggaaaaaaacaaauugggaaaugaaaa

SEQ ID NO: 635655 - RNA, 64 nt, Homo Sapiens
uuuuuguuuuuuuaaaggaaacuauuugugggcuauaggaaacuuucugaugccuccggauugu

SEQ ID NO: 635656 - RNA, 64 nt, Homo Sapiens
uucuauaggcaaagaaagcucuagacagauuggaauaggaaauggauauuugccuuuuagcuac

SEQ ID NO: 635657 - RNA, 64 nt, Homo Sapiens
uugcagcaucuuuucuaguugaaauggugaacugauaggaaaacaaaugaguagaaagaguuca

SEQ ID NO: 635658 - RNA, 64 nt, Homo Sapiens
acaguuuucucuucauauauuaugauuaugaauaauaggaaaguuguauuaauucaguauuugu

SEQ ID NO: 635659 - RNA, 64 nt, Homo Sapiens
uauaucuuuaaaauuuuccuuuauguuccauuccauaggaaaacacacauaugcacacaaaacu

SEQ ID NO: 635660 - RNA, 64 nt, Homo Sapiens
uaucagaaauuagggaagguaguccugcuuuauaauaggaaaauguauuucuguauaagaguuc

SEQ ID NO: 635661 - RNA, 64 nt, Homo Sapiens
auuguaauuuugaugauacaaagauugaaagaucauaggaaagcauugcccuucaucacagaag

SEQ ID NO: 635662 - RNA, 64 nt, Homo Sapiens
ggaagcagacacaacccaaacauuugcuacuaacauaggaaacacacacauacagacaccccca

SEQ ID NO: 635663 - RNA, 64 nt, Homo Sapiens
agugcgagcacacacccacuauacaagaguggcuauaggaaaaaagaaaguguaucuauccuuu

SEQ ID NO: 635664 - RNA, 64 nt, Homo Sapiens
auugugcauaaugcuuuggaaaaaugggucuuuuauaggaaaaaaacugggauaacugauuucu

SEQ ID NO: 635665 - RNA, 64 nt, Homo Sapiens
caaaaauucacuaguugagaugguuuguuuuaggauaggaaaugaaauugccucucagugacag

SEQ ID NO: 635666 - RNA, 64 nt, Homo Sapiens
uugugguggugguaguggaaggggauaauuguaaauaggaaacaugaauguucauuuuuuucuu

SEQ ID NO: 635667 - RNA, 64 nt, Homo Sapiens
uugagugucugugucuuagaccugcaaacagcuaauaggaaauucuauuaauauguuagcuugc

SEQ ID NO: 635668 - RNA, 64 nt, Homo Sapiens
auccccaugacuacauaauccaucaucguaggaaauaggaaagcaaauuugauuuugguuuugu

SEQ ID NO: 635669 - RNA, 64 nt, Homo Sapiens
uauggagcaccaaagcauuuggauaaagaccguuauaggaaaugggggggaaauggcuaaaaga

SEQ ID NO: 635670 - RNA, 64 nt, Homo Sapiens
uacuggcuagaaguuuggauggauuauuuacaauauaggaaagaaagccaagauuuagguaaug

SEQ ID NO: 635671 - RNA, 64 nt, Homo Sapiens
cugcugggcuauuuucagcugaggaggggugaauauaggaaaaaugcauuuuugaaacguuugc

SEQ ID NO: 635672 - RNA, 64 nt, Homo Sapiens
uuucuuugauuaaacagaacaaauuacuugaguaauaggaaauuaggaggaucuagggacagaa

SEQ ID NO: 635673 - RNA, 64 nt, Homo Sapiens
gugaucaccccggacgggcgcgagcuguauccucauaggaaacaccuuuugugaaggccgaacu

SEQ ID NO: 635674 - RNA, 64 nt, Homo Sapiens
uaugugugugguaugaaaagaccauuccugagaaauaggaaauagugcauaguaaugacacagc

SEQ ID NO: 635675 - RNA, 64 nt, Homo Sapiens
cccccaucucccaucugggagaugggggggagucauaggaaaagcccacgucuuccagcugggg

SEQ ID NO: 635676 - RNA, 55 nt, Homo Sapiens
aggguaucaugaugaaauucauuuuauaggaaaaacuuucagagugaaaaaguaa

SEQ ID NO: 635677 - RNA, 64 nt, Homo Sapiens
ggcccuauuuuccugcugcuacaaccauaggaucauaggaaaggaggguucuccucaaagccuc

SEQ ID NO: 635678 - RNA, 64 nt, Homo Sapiens
acaaaagcagguugagauggcuaaguguaucuugauaggaaacaggaugucuuuggggguuuug

SEQ ID NO: 635679 - RNA, 64 nt, Homo Sapiens
aacuguagaguuccauauucaccugcaguaacccauaggaaauacacagucgaggaaaauugau

SEQ ID NO: 635680 - RNA, 64 nt, Homo Sapiens
aauguggacuuacuaaaugguauuuagcaaucaaauaggaaaugauaacugaaaaacucuuaaa

SEQ ID NO: 635681 - RNA, 64 nt, Homo Sapiens
uuuuuuuuuuuuuuuuuuuugguauuuucaaacaauaggaaacuuuacaaucuuauauuaaacu

SEQ ID NO: 635682 - RNA, 64 nt, Homo Sapiens
cggaagaaguuacccuuaagugccucuacaguuaauaggaaaaacggcaagacagugccuauac

SEQ ID NO: 635683 - RNA, 64 nt, Homo Sapiens
ucacaaaacugagcacucuuaaagcaucugucaaauaggaaacaaaauaaaugauccuggggaa

SEQ ID NO: 635684 - RNA, 64 nt, Homo Sapiens
ugugguuuuacuauuuuugcauguguaacuuuuuauaggaaaagagcuaucccuacagaagaua

SEQ ID NO: 635685 - RNA, 64 nt, Homo Sapiens
cuaggauuggauaaugcugcgguagggcccagaaauaggaaaggcacacacucccuguagucca

SEQ ID NO: 635686 - RNA, 64 nt, Homo Sapiens
gucucuaaaugugaggcugaagauauaaauuguaauaggaaacagguaucucuuaggcaaauag

SEQ ID NO: 635687 - RNA, 64 nt, Homo Sapiens
caucuaugaauucaucaugauagcaauuuaagaaauaggaaaguauaaaugcaauuuacucaag

SEQ ID NO: 635688 - RNA, 64 nt, Homo Sapiens
ccuaaaggguacuuaaacccauaggguguaaccaauaggaaacccggccuccgauugguggcgc

SEQ ID NO: 635689 - RNA, 64 nt, Homo Sapiens
auaguauuucauuguuuuaaauauagcgacuugaauaggaaaccaacaguaacaacaaaaaaau

SEQ ID NO: 635690 - RNA, 64 nt, Homo Sapiens
uauuaugugcagguccuagcguaggcacuuagucauaggaaacauggggcaacuuugugaacac

SEQ ID NO: 635691 - RNA, 64 nt, Homo Sapiens
aguggucacaaacuugcaucgcuacuuaagguauauaggaaagggcuguguccaccuucuguga

SEQ ID NO: 635692 - RNA, 64 nt, Homo Sapiens
aaacuaaaacguggauuuaauaaguaucucacaaauaggaaauacucucagcauuacaaaagag

SEQ ID NO: 635693 - RNA, 64 nt, Homo Sapiens
auuuccuucuuuuguuucucagaguauacauuggauaggaaagagaaagagugcauuagucuga

SEQ ID NO: 635694 - RNA, 64 nt, Homo Sapiens
uacaaguaaggaugugagaaaacuuacaguuaacauaggaaaaauagccguguuuacuuguauu

SEQ ID NO: 635695 - RNA, 64 nt, Homo Sapiens
uuagucgaaaauaaagguugcgaauauaauggaaauaggaaaaaguugcaaaagaugguauagc

SEQ ID NO: 635696 - RNA, 64 nt, Homo Sapiens
gcagauuguggcagugucgccacuugaugcacaaauaggaaaaauuucaaacuauuuagauaac

SEQ ID NO: 635697 - RNA, 64 nt, Homo Sapiens
uuauuuugugggggggggauuuuuguuaaaauucauaggaaauggacacauuuuguaaauaacu

SEQ ID NO: 635698 - RNA, 64 nt, Homo Sapiens
ggacaacauacuuuacgcaaugaacaguaguuaaauaggaaauaaacuaguuccauauaaguau

SEQ ID NO: 635699 - RNA, 64 nt, Homo Sapiens
gugccaaaugaaacuuuuuuccuaaguaacuguaauaggaaaaaguuuauuuugagaguuucuu

SEQ ID NO: 635700 - RNA, 64 nt, Homo Sapiens
cuucacgaagacugcugauaacuaucugugauugauaggaaauuuuuuuucuugauuucucugu

SEQ ID NO: 635701 - RNA, 64 nt, Homo Sapiens
uaucauuguuuaauaaaaguaaucccugcuggucauaggaaaacacacgguucuaauuaagugu

SEQ ID NO: 635702 - RNA, 64 nt, Homo Sapiens
gaacucacagcucuguguguguguguucaggcugauaggaaauucaaagagucuccugccagca

SEQ ID NO: 635703 - RNA, 64 nt, Homo Sapiens
gauuauguauuggcauuuauuuaugugcaaggugauaggaaaacugaauccaucuuuguagaag

SEQ ID NO: 635704 - RNA, 64 nt, Homo Sapiens
aaaacaaacucuacuaauuuuuagauauucauuaauaggaaagauuuaauguuacagcaucuac

SEQ ID NO: 635705 - RNA, 64 nt, Homo Sapiens
caaaacuuggugaauagucccagugcuaggucauauaggaaacagaaagcaugacaguggccuu

SEQ ID NO: 635706 - RNA, 64 nt, Homo Sapiens
auacagaaucucauugcuuuugcacauggagcauauaggaaacuccaaacagaucacaaugagg

SEQ ID NO: 635707 - RNA, 64 nt, Homo Sapiens
ucccaaaagcuuagcuauguauaaagugccacagauaggaaacagcuguuaauuacaaagagaa

SEQ ID NO: 635708 - RNA, 64 nt, Homo Sapiens
aauuuauaaaaaauaauuacacagaaaaaauggaauaggaaaaauuaugcaucuagcacauuua

SEQ ID NO: 635709 - RNA, 64 nt, Homo Sapiens
aaagcaauacauaauuuagggaaaauuggaaaauauaggaaacuuuaaacgagaaaaugaaacc

SEQ ID NO: 635710 - RNA, 64 nt, Homo Sapiens
aauacuugauuguaaacuaaauucaagaucauuuauaggaaaaucuaguuucacagcuauuuga

SEQ ID NO: 635711 - RNA, 64 nt, Homo Sapiens
aguuucgggggaccacccuggucuggccuuguauauaggaaaugcugcugaacugaauagaaag

SEQ ID NO: 635712 - RNA, 64 nt, Homo Sapiens
uagacuucagaaguguggaaaucuucggguuucuauaggaaacuaguuuuuuuuuuuuaagaaa

SEQ ID NO: 635713 - RNA, 64 nt, Homo Sapiens
uuuuucacuccuguccagucuauuuauuauucaaauaggaaaaauuacuuuacagguuguuuua

SEQ ID NO: 635714 - RNA, 64 nt, Homo Sapiens
uuuuguuuuguuuuuggugaggaaaaggugguaaauaggaaaccaugaaugggaaggauggcaa

SEQ ID NO: 635715 - RNA, 64 nt, Homo Sapiens
gcauauuacucauaaaucauuaauuaauauaagcauaggaaauggucuuaaaagauacugcauu

SEQ ID NO: 635716 - RNA, 58 nt, Homo Sapiens
cuggggaaagugaagcaugaagggaaucauaggaaaaauguacugaucauauaauuaa

SEQ ID NO: 635717 - RNA, 64 nt, Homo Sapiens
uaagguauuuuaugcacagaauacacuuagauugauaggaaagaacucguaauggaguuugagu

SEQ ID NO: 635718 - RNA, 64 nt, Homo Sapiens
ggcagcccccaucugcucaauaucacugcucuggauaggaaaugaccgccaucuccagccggcc

SEQ ID NO: 635719 - RNA, 64 nt, Homo Sapiens
cuggcaucaguuugcuacagugagcucagaucaaauaggaaaauacuugaaaugcaugucucaa

SEQ ID NO: 635720 - RNA, 64 nt, Homo Sapiens
aacuuuuuaaaaguuuggauguauagagggauaaauaggaaauauaagaauugguuauuugggg

SEQ ID NO: 635721 - RNA, 64 nt, Homo Sapiens
ugaaaggucugaggaugaugacuauauaagucacauaggaaacugguacuaagcacagaaacuc

SEQ ID NO: 635722 - RNA, 64 nt, Homo Sapiens
gcacacucauguugauuccuuauaguacuuaaauauaggaaaauuggggaaagguuuaagauua

SEQ ID NO: 635723 - RNA, 64 nt, Homo Sapiens
auccauuugaagacaauguuccuacuacccugguauaggaaagauuugagugguuccucagaga

SEQ ID NO: 635724 - RNA, 64 nt, Homo Sapiens
guuguuuaaugcucagggcaaaaccaaauuuagcauaggaaaaaucucaggcacuucaaaacua

SEQ ID NO: 635725 - RNA, 64 nt, Homo Sapiens
auaccuaaaagcgaauuuguauuugcaaaaggguauaggaaaauccucugaaggugauuuugua

SEQ ID NO: 635726 - RNA, 64 nt, Homo Sapiens
ccaggccuuugaggugcucuaagaaaguggagcuauaggaaaugguaggguucaggugagcaaa

SEQ ID NO: 635727 - RNA, 64 nt, Homo Sapiens
aaaugucgauuuuuauucagaucgcauagaucaaauaggaaaaauguagaccagcacuacaaag

SEQ ID NO: 635728 - RNA, 64 nt, Homo Sapiens
gaaacucuguggaauauaaacauagauuaaggaaauaggaaacuuguauguauguauauaaaua

SEQ ID NO: 635729 - RNA, 64 nt, Homo Sapiens
uuucugcacuugacccuauuuuacacacuagcauauaggaaauauguauauaauuaguuuauau

SEQ ID NO: 635730 - RNA, 64 nt, Homo Sapiens
ugacccaacauuucuuagcagccuuugaacuuucauaggaaaaagauuggaauuagaccauuug

SEQ ID NO: 635731 - RNA, 64 nt, Homo Sapiens
ucaaucuuuuuuuuuuuucgacuuucaugccaguauaggaaaccacgauaaaaauuguaugugu

SEQ ID NO: 635732 - RNA, 64 nt, Homo Sapiens
uacauaaucaugcucagauagucaagcuggguaaauaggaaaaaagaaaagauuuaagcaccuu

SEQ ID NO: 635733 - RNA, 64 nt, Homo Sapiens
auaugcagccaaccaagauguugguuugggaucaauaggaaagcaaaugaagugauucuaagau

SEQ ID NO: 635734 - RNA, 64 nt, Homo Sapiens
aaugguaguucauguuugagaugguaagauguuuauaggaaaguauaauuggaaauuuucuaua

SEQ ID NO: 635735 - RNA, 64 nt, Homo Sapiens
auaaacaggucaaugaaugaucuggauggauuuuauaggaaaaaacucuauaauacagugggcu

SEQ ID NO: 635736 - RNA, 64 nt, Homo Sapiens
uguucagccuauaagacgaagucucacaagaccuauaggaaaguuuaccaucugccuuaaauau

SEQ ID NO: 635737 - RNA, 64 nt, Homo Sapiens
gcucuguucuccaagaggacccggaaguaaucacauaggaaaugauaaggaagaccaggaggag

SEQ ID NO: 635738 - RNA, 64 nt, Homo Sapiens
ugguuuuuggcauguugggucaagacguguuucuauaggaaaugcuugcacguggcacuggcuu

SEQ ID NO: 635739 - RNA, 64 nt, Homo Sapiens
agacuacccagccagugaagugcagaggauagacauaggaaaacauuccaggcauuuggagaca

SEQ ID NO: 635740 - RNA, 64 nt, Homo Sapiens
uugaaaacacaugagauugaaucaacaugcuuuaauaggaaaagauguauggucuauauaugua

SEQ ID NO: 635741 - RNA, 64 nt, Homo Sapiens
gacccaauugcuugcccccaugaggcuagcacuaauaggaaacccuuuuuuguugucauuuaau

SEQ ID NO: 635742 - RNA, 64 nt, Homo Sapiens
ccagaggagauauuaucuguccucuguguggcacauaggaaaaugugagaccuagaauuauagc

SEQ ID NO: 635743 - RNA, 64 nt, Homo Sapiens
acauacaauccaaaauuuaaaaaaauauuuuugcauaggaaaaauugagaaggaaguaaaccaa

SEQ ID NO: 635744 - RNA, 64 nt, Homo Sapiens
gucaaaacaaaaacuuuacugaaaauggacagaaauaggaaauggacuuuuuccuuacugucua

SEQ ID NO: 635745 - RNA, 64 nt, Homo Sapiens
caaguaguuugaugagacagucugugacuucaugauaggaaagaggaggaugaggucugggguu

SEQ ID NO: 635746 - RNA, 64 nt, Homo Sapiens
guuucuccagucuccccagucuguuggugucuuuauaggaaacuauaaagcagagcaguggugu

SEQ ID NO: 635747 - RNA, 64 nt, Homo Sapiens
aguauguuuguaacuauggcaaugaagucaguagauaggaaaccaguuauuccuucuaccuuua

SEQ ID NO: 635748 - RNA, 64 nt, Homo Sapiens
acacauugaaaacuggacuggguauaacuauguuauaggaaaguagaaauuguauucuuuauuu

SEQ ID NO: 635749 - RNA, 64 nt, Homo Sapiens
auuacggcuuuuacagcaacaauacgauuaucuuauaggaaaaaaaaaaucauuguaaaguauc

SEQ ID NO: 635750 - RNA, 64 nt, Homo Sapiens
gcccauaauugaaauaaauuucugauugaaagguauaggaaacauuaaaaugcauuacuaagag

SEQ ID NO: 635751 - RNA, 64 nt, Homo Sapiens
ccaggaggauucuuccugauucaaagacugucaaauaggaaaaaagaaaacaguaaaugaacaa

SEQ ID NO: 635752 - RNA, 64 nt, Homo Sapiens
aaauguacaaaacaugaaaauuaaaaugaacaauauaggaaaauaauuguaacaggcauaagug

SEQ ID NO: 635753 - RNA, 64 nt, Homo Sapiens
uguuugcaaacauuugccauguugaagaguguguauaggaaaggucuagaaauaaauaggcuug

SEQ ID NO: 635754 - RNA, 64 nt, Homo Sapiens
uaguauauguaacauuaaaaaaaaguugcuggcuauaggaaauguuauuuuguuuucaaaauau

SEQ ID NO: 635755 - RNA, 64 nt, Homo Sapiens
uuguuggcuguggaauauccuuuuguaauagggaauaggaaaccuauauucaggguauccggua

SEQ ID NO: 635756 - RNA, 64 nt, Homo Sapiens
aagaaguaaaacuauuugcaauaaauguauccagauaggaaaagcauuugggaaagaaaaagaa

SEQ ID NO: 635757 - RNA, 64 nt, Homo Sapiens
cccacccccguccaccccagguggggaacccuucauaggaaauccaagcaggcugcucccagag

SEQ ID NO: 635758 - RNA, 64 nt, Homo Sapiens
auaguuggaaauguaaucauauuaaaugucaauuauaggaaaaccuaacuuuucaaaaacuaac

SEQ ID NO: 635759 - RNA, 64 nt, Homo Sapiens
aguaauuuugaguuugaaauuguucaggcaaaaaauaggaaaugguacuauuugauccucauug

SEQ ID NO: 635760 - RNA, 64 nt, Homo Sapiens
cacuuuaaacauaauuaaaagaggcuaaacucugauaggaaaagcuagcacauacuacaucuaa

SEQ ID NO: 635761 - RNA, 64 nt, Homo Sapiens
aaggugagacucuuccauggccucggguuuuucaauaggaaaauggugucuccuaagaacugug

SEQ ID NO: 635762 - RNA, 64 nt, Homo Sapiens
aacacauauauaccuucucuaauaaaauguccacauaggaaauuaaugucauguauaaaauaug

SEQ ID NO: 635763 - RNA, 64 nt, Homo Sapiens
auaguauuuuugagaauaacgagcauuugauuuuauaggaaaaacuguuaaaaguguggccacu

SEQ ID NO: 635764 - RNA, 64 nt, Homo Sapiens
aggcuguguuagugaaagcagcggauccagucacauaggaaagggcacugauggcccugaagaa

SEQ ID NO: 635765 - RNA, 64 nt, Homo Sapiens
gaaaaauuucauugagaugagaaaguucuagaaaauaggaaaacuugcuuuguuuccuuuuuua

SEQ ID NO: 635766 - RNA, 64 nt, Homo Sapiens
agacaaacaauauucagaaaugucugauauuuaaauaggaaauccuauguauuuccuauaauga

SEQ ID NO: 635767 - RNA, 64 nt, Homo Sapiens
aauuaacuguuuuaaaaagagaugaaaguaaauuauaggaaaaaaacaaagauaauauacuuuc

SEQ ID NO: 635768 - RNA, 64 nt, Homo Sapiens
ggauaaaauaucaagagacagggagauguugucaauaggaaaugcuaaauaauuucagggguag

SEQ ID NO: 635769 - RNA, 64 nt, Homo Sapiens
uccaguguuuuuaagagaauguuucuuaaaaccaauaggaaacuuaagcgagguuucaugacac

SEQ ID NO: 635770 - RNA, 64 nt, Homo Sapiens
uauuucauuaugauugaaaaacauaaaaacuaacauaggaaagugaaugaucaguuacuuauga

SEQ ID NO: 635771 - RNA, 64 nt, Homo Sapiens
uaaaauuugugaggugauuuugaaucuuguccauauaggaaaaugaagcacagaauuacucagu

SEQ ID NO: 635772 - RNA, 64 nt, Homo Sapiens
uguaauauauccugaaagcauuauuuuuuguugaauaggaaauaaaauuaaugaagacagaggc

SEQ ID NO: 635773 - RNA, 64 nt, Homo Sapiens
guauccuguuguucuuacucacucuucucauaaaauaggaaauauuuuaguucuguuucuuggg

SEQ ID NO: 635774 - RNA, 64 nt, Homo Sapiens
acuguuaauguuuguucacaaauucagaaaucuaauaggaaaacaugauacuuucaaugugcca

SEQ ID NO: 635775 - RNA, 64 nt, Homo Sapiens
uagucuaucugcaauuacucaacgaggcauuuucauaggaaacagacuaugauuaauccauuua

SEQ ID NO: 635776 - RNA, 64 nt, Homo Sapiens
guacaaggucugaaaugacaagggcaagagugagauaggaaacugugugugaaaggaaagcccu

SEQ ID NO: 635777 - RNA, 64 nt, Homo Sapiens
auuauuuaaccaguuacuuccaccuggacauacgauaggaaauucaaacucaaaauaugaaaau

SEQ ID NO: 635778 - RNA, 64 nt, Homo Sapiens
guaagauuccuuuugugaaaaguuugguaaugggauaggaaaaaaagauuuccaagaaaguaaa

SEQ ID NO: 635779 - RNA, 64 nt, Homo Sapiens
uaagccucaaaugcuagcacuuuuuggcaguuggauaggaaaugagacauucuuuggcagccaa

SEQ ID NO: 635780 - RNA, 64 nt, Homo Sapiens
aaauaacauuugcuguuuuauagguuugaagaacauaggaaaaacuaagagguuuuguuuuuau

SEQ ID NO: 635781 - RNA, 64 nt, Homo Sapiens
aaauaaugugaaguguuuuuuauaucagauuaauauaggaaauguuuauucuugaaaaauacuc

SEQ ID NO: 635782 - RNA, 55 nt, Homo Sapiens
uuuauuuucaguuuauuuagauuugauaggaaaauuaaagcuaacugaaagacuu

SEQ ID NO: 635783 - RNA, 64 nt, Homo Sapiens
uuugagaagaaagggucucuugaccuguauuaacauaggaaaguaaaguucuuuuuguuuuucu

SEQ ID NO: 635784 - RNA, 64 nt, Homo Sapiens
gcaguaagucuuuuuugaucauucccuuuuccauauaggaaacauaauuuugaaguggccagau

SEQ ID NO: 635785 - RNA, 64 nt, Homo Sapiens
guggauaauuuucagcuauuaagaacaugcuuccauaggaaauaccuaaccuuaauuauucugu

SEQ ID NO: 635786 - RNA, 64 nt, Homo Sapiens
aaucagucuccucauuugcuuaaaccagcucuagauaggaaaaauuaauggcuucacuugaauu

SEQ ID NO: 635787 - RNA, 64 nt, Homo Sapiens
uuuuaauguuucuuggggaacacuuuuauaagaaauaggaaauauggaaauacacuguuaucuu

SEQ ID NO: 635788 - RNA, 64 nt, Homo Sapiens
uugucauggauucaaguuaucuuuuaucaucagaauaggaaaaauguauaaaaauguauuggcu

SEQ ID NO: 635789 - RNA, 64 nt, Homo Sapiens
aagcagauaccuugcaaagcaagcaacucaaguuauaggaaagguuucaaguauacuaagagua

SEQ ID NO: 635790 - RNA, 64 nt, Homo Sapiens
auaugggaugaacacuuuuauauuccucuuuguaauaggaaacuguguguaguuacuuaaaggu

SEQ ID NO: 635791 - RNA, 64 nt, Homo Sapiens
aguucugagaucuagucccugaauaccugugaggauaggaaauuucuuccauugagugaaugau

SEQ ID NO: 635792 - RNA, 64 nt, Homo Sapiens
auguauuuacuaagugucacaaggcuauuaacacauaggaaaaaagacuaaucaaaggcaaaca

SEQ ID NO: 635793 - RNA, 64 nt, Homo Sapiens
aaugauguacuacauuaaaucuuugaauaggaugauaggaaauaauauuucccaauacauacca

SEQ ID NO: 635794 - RNA, 64 nt, Homo Sapiens
cgaaagauaaagugaaaguuauaguugaacucuuauaggaaaauucuacuuucuacuagcccca

SEQ ID NO: 635795 - RNA, 64 nt, Homo Sapiens
uugaugcuguaauuugggucguuacaauauuggaauaggaaaauuuuucacaguggggaagugg

SEQ ID NO: 635796 - RNA, 64 nt, Homo Sapiens
aaacaacuaccuaauacaaauuguaagcaauagaauaggaaauauauuaauguggauuuuaaaa

SEQ ID NO: 635797 - RNA, 64 nt, Homo Sapiens
cagcacucagaaugguuucaaagucuaggcacauauaggaaaugagaauuuaucaggcauuacc

SEQ ID NO: 635798 - RNA, 64 nt, Homo Sapiens
uugacccagaaccugacuuacauccaaccaaagcauaggaaacaaaauauauacuuuauuaaau

SEQ ID NO: 635799 - RNA, 64 nt, Homo Sapiens
auuuacucaggauaugugauggauagagagugggauaggaaaauccuuuauuucaguggugaag

SEQ ID NO: 635800 - RNA, 64 nt, Homo Sapiens
aacuugagcgguauacucagaaccugaagaagucauaggaaagaacuguguuaauaaaugacag

SEQ ID NO: 635801 - RNA, 62 nt, Homo Sapiens
ccguaaccgugaaagagugacaaggacagccuauaggaaaaacaauaccacuuaaaacaauc

SEQ ID NO: 635802 - RNA, 64 nt, Homo Sapiens
auucaacccacuacaaggaguuuuuuaaacaaaaauaggaaacuuagauguaacuuagcacuuu

SEQ ID NO: 635803 - RNA, 64 nt, Homo Sapiens
uaagacuuucuuuuucaucuuuuauagcguuaccauaggaaacuguuccaaacugaguuagcuu

SEQ ID NO: 635804 - RNA, 64 nt, Homo Sapiens
uuauguacuauuuaacuuaaauauauuuuguuuaauaggaaauauauaauaauagcauuuuaug

SEQ ID NO: 635805 - RNA, 64 nt, Homo Sapiens
aaugucaauauauauuuaaaauaauaauggaaacauaggaaaucagcuauuuaaaccagaucac

SEQ ID NO: 635806 - RNA, 64 nt, Homo Sapiens
ccuccuaugucucuuuucaaguuguaauuacuauauaggaaaaacuaaguugucacccaauauc

SEQ ID NO: 635807 - RNA, 64 nt, Homo Sapiens
caauguuuuucucaaaaagcugcuauccaaugauauaggaaaauacauuguguuuuccuaaaca

SEQ ID NO: 635808 - RNA, 64 nt, Homo Sapiens
ucuucuacccaauagaauauuuucaugccuggaaauaggaaaaugugugaacagcguauucucu

SEQ ID NO: 635809 - RNA, 64 nt, Homo Sapiens
agcuuaaacauaaauaucagugaauguggcuuucauaggaaagcugaugggauugggucacuuu

SEQ ID NO: 635810 - RNA, 64 nt, Homo Sapiens
gccaugaaaauugcuuuugaagaaaauuuuccacauaggaaaauuaccauagaaagaugacaaa

SEQ ID NO: 635811 - RNA, 64 nt, Homo Sapiens
cauacacuuccauaaauagcgacgguucuggggcauaggaaacacggguuaccuguaucugaag

SEQ ID NO: 635812 - RNA, 64 nt, Homo Sapiens
uucaacaauucugugaaaggccuccacagaucucauaggaaaugaccaguguucuccaccuugu

SEQ ID NO: 635813 - RNA, 64 nt, Homo Sapiens
agaauauaaaguaucaacaauucauaauguuaaaauaggaaaguacauuguaaaauuccagguu

SEQ ID NO: 635814 - RNA, 64 nt, Homo Sapiens
aaaguucuagauagguuaaaugcauuuguuuucaauaggaaaacuaguacuaagcaaugugucu

SEQ ID NO: 635815 - RNA, 64 nt, Homo Sapiens
uuuuagugaguuacacguacugggggcaaaugaaauaggaaaauaauaauuuaagacacuacaa

SEQ ID NO: 635816 - RNA, 64 nt, Homo Sapiens
ugcugcucuugcacuugcugauaauuguauugaaauaggaaaguacaucauauaauuucugccc

SEQ ID NO: 635817 - RNA, 64 nt, Homo Sapiens
uacugugggaacuauucuaucaaacauaauuuacauaggaaaugaugguucuaaaaauugcauu

SEQ ID NO: 635818 - RNA, 64 nt, Homo Sapiens
gggaagagaggcugagugucgaagauugagcaacauaggaaaaguaagaaccuaggagggaaag

SEQ ID NO: 635819 - RNA, 64 nt, Homo Sapiens
aguaguuaagaaauggcccuuuugaauguugaagauaggaaagaaagccauauauucaaauaug

SEQ ID NO: 635820 - RNA, 64 nt, Homo Sapiens
uuucuguuuuauauucaacucauaagacuuugggauaggaaaaaugaguaaugguuacuaggcu

SEQ ID NO: 635821 - RNA, 64 nt, Homo Sapiens
uuuuuguauggucauggagcuccaaccauuuuuaauaggaaagucuuuuguaaauuguugucgu

SEQ ID NO: 635822 - RNA, 64 nt, Homo Sapiens
aggcagagcaaauacccuagagauucucugugauauaggaaauuuggaugaagggagcuagaag

SEQ ID NO: 635823 - RNA, 64 nt, Homo Sapiens
aggcagagcaaauacccuagagauucucugugauauaggaaauuuggaucaaggaagcuaaaag

SEQ ID NO: 635824 - RNA, 64 nt, Homo Sapiens
cuaguguucuccuaaucccuuaagacuagaaccuauaggaaacuacuuggagcaaacucaaagg

SEQ ID NO: 635825 - RNA, 64 nt, Homo Sapiens
gcaaaccaaagaauuggaucuuaccaaugcggcuauaggaaaacagccuguugcaugguaagag

SEQ ID NO: 635826 - RNA, 64 nt, Homo Sapiens
aggaguuaauaaagaaguucauuuugguuuaaacauaggaaagaagagaaccaugaaaaugggg

SEQ ID NO: 635827 - RNA, 64 nt, Homo Sapiens
ggccggcgccguacugccugcguugugucagagaauaggaaaagcagcuuuguuuggggcauua

SEQ ID NO: 635828 - RNA, 64 nt, Homo Sapiens
auuuacuuguuugugaaaacaauaccccaagguaauaggaaaaguuugaguuaaguguuuuuaa

SEQ ID NO: 635829 - RNA, 64 nt, Homo Sapiens
uucauguuucuccuucugacuuuuaauaaugguaauaggaaaacaaaacccaaagcuuuucaga

SEQ ID NO: 635830 - RNA, 64 nt, Homo Sapiens
ggauggaaaucaacugucagaauuaccucaggaaauaggaaaucugaagaaccugcuguguuua

SEQ ID NO: 635831 - RNA, 64 nt, Homo Sapiens
auauauuuuaaguggugcacuaauuagugaauauauaggaaaauuaucugacgaguaucugaag

SEQ ID NO: 635832 - RNA, 64 nt, Homo Sapiens
gacagagagagaauacauaucacugccaggccugauaggaaaaaucugcucuuccuuuuaauaa

SEQ ID NO: 635833 - RNA, 64 nt, Homo Sapiens
ccugaagcuggugaucagccuggccucccaauagauaggaaacacagcuggcgccagggaacga

SEQ ID NO: 635834 - RNA, 64 nt, Homo Sapiens
auguacuauuuucuuaaagcuuaaagaacugguaauaggaaagccucuaggaaggcguagaauu

SEQ ID NO: 635835 - RNA, 64 nt, Homo Sapiens
agaugaaaacagauucuucaccaacuccaggcugauaggaaaaacccauucuuuauuccccaga

SEQ ID NO: 635836 - RNA, 64 nt, Homo Sapiens
aucaaaugauccaaaaaaacggaauacaugguuuauaggaaaugcucucaguaauauagagacc

SEQ ID NO: 635837 - RNA, 64 nt, Homo Sapiens
acaauuugucaaauauguuuguaagcuucucuaaauaggaaaccacacacauaaaguuccaugu

SEQ ID NO: 635838 - RNA, 64 nt, Homo Sapiens
aaaugaguuuggagacuucaauauuugugacugaauaggaaaauuuguuuucuuuacagcugca

SEQ ID NO: 635839 - RNA, 64 nt, Homo Sapiens
gauuacaaauauuaccuccaaccaagaauaaauaauaggaaaguaugguaauuauaguucuguu

SEQ ID NO: 635840 - RNA, 64 nt, Homo Sapiens
agaaauacgucucauucuucaauaauuuucaucaauaggaaaaaacagacuggauagcuuuucu

SEQ ID NO: 635841 - RNA, 64 nt, Homo Sapiens
aagauggaagcagagaaucuggucaugcagugagauaggaaaucauuaguaacagcucuaagau

SEQ ID NO: 635842 - RNA, 64 nt, Homo Sapiens
aaaauacuaugcauaaucuagaaagauuugucagauaggaaauuuuauaaugcauuagccauua

SEQ ID NO: 635843 - RNA, 64 nt, Homo Sapiens
uaauaccugagugccuucuuaaggaaaccauuugauaggaaagaugaaccaaauaacucaauga

SEQ ID NO: 635844 - RNA, 64 nt, Homo Sapiens
uuuucucccccacgaguggaaaauagacuucuacauaggaaagcuaaaauauguuaauauuuuu

SEQ ID NO: 635845 - RNA, 64 nt, Homo Sapiens
gcaaaacuuaauugauccuacaagcuuacuacacauaggaaaauucauacuggagagaaacuac

SEQ ID NO: 635846 - RNA, 64 nt, Homo Sapiens
uaaaugauucugaauguuaguguuuuauguucauauaggaaauauuuucauugaguccaaaaua

SEQ ID NO: 635847 - RNA, 64 nt, Homo Sapiens
caaaccucaugccuuauucagcaucacaaaaugcauaggaaagagaaaucguaugaauguaaug

SEQ ID NO: 635848 - RNA, 64 nt, Homo Sapiens
uguggugguuucuguuugcauuuuugcaggagccauaggaaacuacugaaaugauugugcuggg

SEQ ID NO: 635849 - RNA, 64 nt, Homo Sapiens
gauaaaauuaauugcaaucuaccauaucuuaaguauaggaaauuugguguccaaccuggagaug

SEQ ID NO: 635850 - RNA, 64 nt, Homo Sapiens
agucagcagaugagagacacaaagagaagugguaauaggaaacggaagagacuugguagacgag

SEQ ID NO: 635851 - RNA, 64 nt, Homo Sapiens
cccugagauuaaaaaaagacuauuuggauaacuuauaggaaagccuagaaccucccaguagagu

SEQ ID NO: 635852 - RNA, 64 nt, Homo Sapiens
aauacaugagaacugcuugucaugaccagacaagauaggaaaggggaaaccccagaaacgugcu

SEQ ID NO: 635853 - RNA, 64 nt, Homo Sapiens
uaauuuccaauugcacacaucagaauaccuccuuauaggaaagugagaaguuuuguucauucca

SEQ ID NO: 635854 - RNA, 64 nt, Homo Sapiens
aacuauuagaauuuaaagaacugaacuuuagaguauaggaaauuuuuuaugcugaaaguaugcu

SEQ ID NO: 635855 - RNA, 64 nt, Homo Sapiens
gagccuuauugacaauuaagaacacuuugcugaaauaggaaaaucuguuuagcuuuauaaaaca

SEQ ID NO: 635856 - RNA, 64 nt, Homo Sapiens
cuuuaaaccccggucauccgaggcuuuaucgagaauaggaaaacacuccccguacagugcgcac

SEQ ID NO: 635857 - RNA, 64 nt, Homo Sapiens
aaaucaaacccaaagaaaguugcuaaaauuuauuauaggaaaauaagaaacauuuuacauaaaa

SEQ ID NO: 635858 - RNA, 64 nt, Homo Sapiens
cugaauaaaaauggagggauuauaaagaauagguauaggaaagacuggcauguaauucuuccuc

SEQ ID NO: 635859 - RNA, 64 nt, Homo Sapiens
gaaauccuuuggaauuuuaagaaauggagauauuauaggaaaaauuuugguaugaugauacuca

SEQ ID NO: 635860 - RNA, 64 nt, Homo Sapiens
cuuaaaauucuugggaguguuguugcaaugacacauaggaaaauucuugcuuuuucaauucucc

SEQ ID NO: 635861 - RNA, 64 nt, Homo Sapiens
ccuucauaaaacauguaacauugguucuuuuuucauaggaaauucccagaggaggccucuuugg

SEQ ID NO: 635862 - RNA, 64 nt, Homo Sapiens
uuuugacaauguggaguuuuuuugccaauauuccauaggaaaaacacaauauaacuuuacauuc

SEQ ID NO: 635863 - RNA, 64 nt, Homo Sapiens
aguaucuacguuuuuaguuuucuugugaaacuguauaggaaaaauuguuuacagcauauuuaag

SEQ ID NO: 635864 - RNA, 64 nt, Homo Sapiens
cagggacauuucaaguugcuuuccccuguauaucauaggaaacugcagccaggaaggacaggcu

SEQ ID NO: 635865 - RNA, 64 nt, Homo Sapiens
ucaaguaaaugcauuaucaaaugacgauuaaucuauaggaaagccauaaucugcuuagcagaaa

SEQ ID NO: 635866 - RNA, 64 nt, Homo Sapiens
gucauuggaauguugcacagcauaugucacugaaauaggaaacaaaaguagcaacauaugucaa

SEQ ID NO: 635867 - RNA, 64 nt, Homo Sapiens
auuuuagggguuggaggugguuucucuuacugccauaggaaauuagccugcaucccucccuucc

SEQ ID NO: 635868 - RNA, 64 nt, Homo Sapiens
ugagaaagaauacguauaaauacuguuuugcaugauaggaaaaugugaauguguugagauuuuu

SEQ ID NO: 635869 - RNA, 64 nt, Homo Sapiens
cgugccaguuguggaggaaaccucaauaaucgucauaggaaagagacagucaaagagacaucuc

SEQ ID NO: 635870 - RNA, 64 nt, Homo Sapiens
cugcagcuuugggcucccccauagugacugugccauaggaaagcagccccuccucacacauaca

SEQ ID NO: 635871 - RNA, 64 nt, Homo Sapiens
cgccucuugccccuucuaggggcaggugaaaggaauaggaaauugaaccugggguuuugacuug

SEQ ID NO: 635872 - RNA, 64 nt, Homo Sapiens
agucagagggauuccccuuuuucaucucauuuuaauaggaaaauuccuuaugguuaacaucucc

SEQ ID NO: 635873 - RNA, 64 nt, Homo Sapiens
ugaguuguuuucaguuuucagacgaaugaauguaauaggaaacuauggaguuaccaauauugcc

SEQ ID NO: 635874 - RNA, 64 nt, Homo Sapiens
uggugcuuauguaaccauuuuaaacgugguuucuauaggaaagaccaacauuuguuuagcuugc

SEQ ID NO: 635875 - RNA, 64 nt, Homo Sapiens
uauuugaggaaaaaaugaguuuucacauuguuuuauaggaaauuaaauuuguccaaagauuugg

SEQ ID NO: 635876 - RNA, 64 nt, Homo Sapiens
uuuguugacuucugacauuccacuuuccuagguuauaggaaagaucuguuuauguaguuuguuu

SEQ ID NO: 635877 - RNA, 64 nt, Homo Sapiens
cucugccaacaacucuuuuguggaauucuaauuuauaggaaacauuuuaguaugagcuucagug

SEQ ID NO: 635878 - RNA, 64 nt, Homo Sapiens
ucacaauuguugacuaaaaugcugcuuuuaaaacauaggaaaguagaaugguugagugcaaauc

SEQ ID NO: 635879 - RNA, 64 nt, Homo Sapiens
guuugcacagucuuacuucuguagaacacuggccauaggaaaugcuguuuuuuuguacuggacu

SEQ ID NO: 635880 - RNA, 64 nt, Homo Sapiens
cauugcuuaaccugaguccgagauggacaaugguauaggaaagauauucgguauggagaaucag

SEQ ID NO: 635881 - RNA, 64 nt, Homo Sapiens
gaauguauaaaauuucucaggcagaguccuggauauaggaaaaaguaauuuaugaaguaaacuu

SEQ ID NO: 635882 - RNA, 64 nt, Homo Sapiens
ucccccuguuuuuagagcuuccaaaugugucagaauaggaaaacauugcaauaaauggcuugau

SEQ ID NO: 635883 - RNA, 64 nt, Homo Sapiens
augugugucccaaggaaauccuauguuugggaauauaggaaacuaacagaaacgccuuaagaca

SEQ ID NO: 635884 - RNA, 64 nt, Homo Sapiens
caugcuuucagccagaugcuauuaguugguuuccauaggaaaggagcuggcgccaucgcuccgg

SEQ ID NO: 635885 - RNA, 64 nt, Homo Sapiens
cccacggugggucagaaggcagaggaggggccacauaggaaagcguuuguuacuuacgguucug

SEQ ID NO: 635886 - RNA, 64 nt, Homo Sapiens
uagaauucaggaauuaaaagcccuucuacuggagauaggaaaagccuucugcuuagauccaggg

SEQ ID NO: 635887 - RNA, 64 nt, Homo Sapiens
agacaacauucaauuugauagggucucacccaccauaggaaacaacuucaaacacuggcaccuu

SEQ ID NO: 635888 - RNA, 64 nt, Homo Sapiens
cauuauuaguaguaaacuuuuuuuuuuuuuccauauaggaaagccaauugucacauuuuaagac

SEQ ID NO: 635889 - RNA, 64 nt, Homo Sapiens
uauucacugcugcuuuuaauuuuaaguuauugagauaggaaauaaguuuacauaaagaaguuuu

SEQ ID NO: 635890 - RNA, 64 nt, Homo Sapiens
aaaaggacaaaaguccucaaugaagcaucugauaauaggaaaagaacaaaagguagaauagggc

SEQ ID NO: 635891 - RNA, 64 nt, Homo Sapiens
auaugaagaacccaucauuucucuuugucaucuuauaggaaaauguaaauccaggaauauuagg

SEQ ID NO: 635892 - RNA, 64 nt, Homo Sapiens
gauacccauuacauaguuaccuguauuacugaauauaggaaagauaaauuacaccugugugcac

SEQ ID NO: 635893 - RNA, 64 nt, Homo Sapiens
aauaauggcaguaguucucaggauaguuuuucaaauaggaaagcgguacauuccuugauuucca

SEQ ID NO: 635894 - RNA, 64 nt, Homo Sapiens
aaaaacuuauuuuucuaguaaguugggagaacaaauaggaaaaauuaacuuauuucauuaaaga

SEQ ID NO: 635895 - RNA, 64 nt, Homo Sapiens
guaauuaaaauauaauuuuagguauaguccuucaauaggaaauucuguggggaaaggucaggaa

SEQ ID NO: 635896 - RNA, 64 nt, Homo Sapiens
gaucuuuucagaugcugcuuggaaaugaacuagaauaggaaauagguuuucaauaacagggcuu

SEQ ID NO: 635897 - RNA, 64 nt, Homo Sapiens
ucaguagaaauaccuuuggugcuuacugugggacauaggaaaacuuugaguucucucuaaccca

SEQ ID NO: 635898 - RNA, 64 nt, Homo Sapiens
ugguuugcuaaaaucuauaagagaacccaaugucauaggaaauauuugaacugcagaccuguau

SEQ ID NO: 635899 - RNA, 64 nt, Homo Sapiens
ugugaauuuuaaaaugcaaauauugcuauuguuuauaggaaauaaaucuaaauauaaaugaaau

SEQ ID NO: 635900 - RNA, 64 nt, Homo Sapiens
cacauaaagggaacaaaugucuaguuuuauuuguauaggaaauuucccugacccuaaauaauac

SEQ ID NO: 635901 - RNA, 64 nt, Homo Sapiens
accauuucaaaacuguuucuucuauuccugguucauaggaaagaaaaaaguuauucaaaguauu

SEQ ID NO: 635902 - RNA, 64 nt, Homo Sapiens
augaggggaugacaaagaacaguuuuuaagcuauauaggaaacauuguuauugguguugcccua

SEQ ID NO: 635903 - RNA, 64 nt, Homo Sapiens
acuuuaauuauauauuuucauccuauaagcuuaaauaggaaaguuucuucaacaggauuacagu

SEQ ID NO: 635904 - RNA, 64 nt, Homo Sapiens
gucucuuggcccagucaggugcugccagguuuagauaggaaaguacaugucccauuuucauggg

SEQ ID NO: 635905 - RNA, 64 nt, Homo Sapiens
acaugagauuccuuuugcuggauaugcagaaaugauaggaaaaaaaccaauggugaaauuucaa

SEQ ID NO: 635906 - RNA, 64 nt, Homo Sapiens
augaauugccuaauugcugcaaaguauaacccagauaggaaaucauauguuuuuuuccaagagu

SEQ ID NO: 635907 - RNA, 64 nt, Homo Sapiens
uuaugagaacacauuuucacaguuauguuucuucauaggaaaacuauauuuagugggcaacaac

SEQ ID NO: 635908 - RNA, 64 nt, Homo Sapiens
auuuugauaacuagcuuuccagguggacuuagccauaggaaaauauuacuaauguaauuuaaca

SEQ ID NO: 635909 - RNA, 64 nt, Homo Sapiens
aauaguaguuggaugcuuggcacgucguccuguaauaggaaacccuugccucaucaguuuuccu

SEQ ID NO: 635910 - RNA, 64 nt, Homo Sapiens
augaaauggacagauucauggaacuuagaguccaauaggaaagugagacccagacaaugacaau

SEQ ID NO: 635911 - RNA, 64 nt, Homo Sapiens
cuucauucuuuauaaaacuuuuuuuaaaagaaauauaggaaacacuuucaagaugaaccaaggu

SEQ ID NO: 635912 - RNA, 64 nt, Homo Sapiens
caauggaacaaggguggguuuuugaauagcaaugauaggaaaaaucuuuuccacaacauaggac

SEQ ID NO: 635913 - RNA, 64 nt, Homo Sapiens
ugaaaauauuuguguuuguuaguuaaaaacaaacauaggaaaugucaguggcuuuaugaaguaa

SEQ ID NO: 635914 - RNA, 64 nt, Homo Sapiens
aaccagaugaagaugaaugcaucagagaauucacauaggaaagagaaguaaacccucacuguga

SEQ ID NO: 635915 - RNA, 64 nt, Homo Sapiens
cagaaaacccauccaguucuaacucauauuuuugauaggaaaaauuagagccucuuuuucuccc

SEQ ID NO: 635916 - RNA, 64 nt, Homo Sapiens
cuaagccuggacuaagugccgcuucagggcucuuauaggaaaugcagcuccugaacagaaacua

SEQ ID NO: 635917 - RNA, 64 nt, Homo Sapiens
uguaaguuggaauuaucuuuauuuuuucccuuacauaggaaaacuuuuaaacuaccauaauucc

SEQ ID NO: 635918 - RNA, 64 nt, Homo Sapiens
guggcucagaggucaucuacccccaauucauagaauaggaaacugucccgagagauuuacuaaa

SEQ ID NO: 635919 - RNA, 64 nt, Homo Sapiens
agugaaagcauauggguuagaauuugcaucugaaauaggaaacaucaccuuccgcacgcggauu

SEQ ID NO: 635920 - RNA, 64 nt, Homo Sapiens
cagcaaauuuauccuugaaggugugaugguagaaauaggaaaacaacaaaagaaaaacaauaac

SEQ ID NO: 635921 - RNA, 64 nt, Homo Sapiens
cuuguaaaaauaacauaauaaauagaucuuaaacauaggaaaaccauacuguucugauaauaaa

SEQ ID NO: 635922 - RNA, 64 nt, Homo Sapiens
aucuuuguaguuaugccuuggguucuaaaauguuauaggaaacugcugaauugaauccuagcuu

SEQ ID NO: 635923 - RNA, 64 nt, Homo Sapiens
acuaaaaguggaaaaaacuuauuggugaaugaauauaggaaacauuuugcccaaugccacucuu

SEQ ID NO: 635924 - RNA, 64 nt, Homo Sapiens
gaggccagagaaaaugcacaaacuguaggaaacuauaggaaagcauuuacuaugagguuauauu

SEQ ID NO: 635925 - RNA, 64 nt, Homo Sapiens
ggcuaaaagggagcagcacagggagagaaacaggauaggaaagcagaauggcgagcagccuaug

SEQ ID NO: 635926 - RNA, 64 nt, Homo Sapiens
agcuccucccagggcuguguggaucugacaggguauaggaaaauaaaaagcggagaaggugucu

SEQ ID NO: 635927 - RNA, 64 nt, Homo Sapiens
gguuaaacaccaaagaaagacugguguguacugaauaggaaagggaaguuuuauuuggaaccuu

SEQ ID NO: 635928 - RNA, 64 nt, Homo Sapiens
uguugcucgccuucaggucaccagcugagcugcgauaggaaaaucugaauggaggcagcaaaca

SEQ ID NO: 635929 - RNA, 64 nt, Homo Sapiens
acauuuuaaaauagaacuauccuuguucgauagcauaggaaaauguucuggugauugucagggu

SEQ ID NO: 635930 - RNA, 64 nt, Homo Sapiens
aauuaaaacauacaagccaggaugaaugaagccaauaggaaauaaaaaacaggcacacaacauu

SEQ ID NO: 635931 - RNA, 64 nt, Homo Sapiens
cuuaaccuaaaauuaaaccacuuugcuguuguggauaggaaagaugcacgagggagaacaaggc

SEQ ID NO: 635932 - RNA, 64 nt, Homo Sapiens
aaaauaugcauuugcuuaguuggcugcuuuuauaauaggaaaaaguacuccuacucucuuauac

SEQ ID NO: 635933 - RNA, 64 nt, Homo Sapiens
cacuucuuuccuucauuuuuugcuccacuggauaauaggaaaaauaucucucuucucacaauua

SEQ ID NO: 635934 - RNA, 64 nt, Homo Sapiens
aaugccuuacagaugugccugaaugggcugugugauaggaaacaaguugguggguguuaagcua

SEQ ID NO: 635935 - RNA, 64 nt, Homo Sapiens
agauuuagugggugggaagaaguagcuucuagagauaggaaauuguuucuaagaguuuagccac

SEQ ID NO: 635936 - RNA, 64 nt, Homo Sapiens
aaaugauauuuucuaaguaacucaauuuugaaauauaggaaagagacaugaucuuuugcaauac

SEQ ID NO: 635937 - RNA, 64 nt, Homo Sapiens
uccucauugauccucuucagaggcuuccuaucucauaggaaacacaauugauccccaaccugcc

SEQ ID NO: 635938 - RNA, 64 nt, Homo Sapiens
uagcucuugguaacuagcaagaaagcugaacuuaauaggaaagccuuuuaauuucaguuuuaau

SEQ ID NO: 635939 - RNA, 64 nt, Homo Sapiens
augcuuaaaauccugucauuaugcuguauuauauauaggaaaaauuuaaauaaaauuuuaagug

SEQ ID NO: 635940 - RNA, 64 nt, Homo Sapiens
caguucuuuuaaaauuucuugggccucaaugaugauaggaaaauaugauggcaugaaguaaaag

SEQ ID NO: 635941 - RNA, 64 nt, Homo Sapiens
cacauuacuacaaaauggggaccucuuuuugcuaauaggaaaauuaagucuacaggggcuggug

SEQ ID NO: 635942 - RNA, 64 nt, Homo Sapiens
gauuggagugauacauugugggaacccucagaagauaggaaaaaagcauggaauagauucuccc

SEQ ID NO: 635943 - RNA, 64 nt, Homo Sapiens
ucuacucagaaauuuuuauuuuucuaagguucucauaggaaaaguacauuuaauacagcagugu

SEQ ID NO: 635944 - RNA, 64 nt, Homo Sapiens
uugauucaguaguuguuaccaagaaacauauguuauaggaaaacaacuugguauuuaaguauga

SEQ ID NO: 635945 - RNA, 64 nt, Homo Sapiens
aaguugaacaugggagcuuauugcuaauuuagagauaggaaacugaagcauaaagaauuaauga

SEQ ID NO: 635946 - RNA, 64 nt, Homo Sapiens
uagaagauuagaaacuaccaaucccaacuacguaauaggaaaauguaggaucaaaaggcccaug

SEQ ID NO: 635947 - RNA, 64 nt, Homo Sapiens
aagaggcguguagguuugcaaacaaaguuaagaaauaggaaacugaauuuuucauuguacagaa

SEQ ID NO: 635948 - RNA, 64 nt, Homo Sapiens
aaagccugucuccucacccacccccagcccuagcauaggaaaagcuuccuugaugugagcucug

SEQ ID NO: 635949 - RNA, 64 nt, Homo Sapiens
ggacuagaugcauaccguuuugugaaaaccagccauaggaaaacaugugagcaacaacccccau

SEQ ID NO: 635950 - RNA, 64 nt, Homo Sapiens
ugcugaguauagccaaaugccuguucugaaacuuauaggaaauuggaauuuuguuuaaaauuuu

SEQ ID NO: 635951 - RNA, 64 nt, Homo Sapiens
uaaugugugccuucuaggauauguacuuacuaugauaggaaauauuuaaauaugaaguacuuaa

SEQ ID NO: 635952 - RNA, 64 nt, Homo Sapiens
uuguccagagacaagacuucgaucaaggggacccauaggaaaucaccccaaacucaggccgaau

SEQ ID NO: 635953 - RNA, 64 nt, Homo Sapiens
agaaacuugcuuaucaaaacgccguucccugaacauaggaaaaugccagcuuucuucuguugau

SEQ ID NO: 635954 - RNA, 64 nt, Homo Sapiens
agcccaugucuugaaauauguuuguauagugucuauaggaaaguguaaaaaucaauucagggga

SEQ ID NO: 635955 - RNA, 64 nt, Homo Sapiens
auaaauauauaguuuuaagcuucaugccaauaaaauaggaaauugguuuuuaaguuuagaaaua

SEQ ID NO: 635956 - RNA, 64 nt, Homo Sapiens
gaccucccauuucuuaagcauggaaugucuuuauauaggaaauauucuaagagauuggauacuu

SEQ ID NO: 635957 - RNA, 64 nt, Homo Sapiens
ugauuguuaaugcugacuguaauaauggaugaaaauaggaaaaaucucuaacaugauauuggaa

SEQ ID NO: 635958 - RNA, 64 nt, Homo Sapiens
uaaauaagauuacagagguaagcaguaugauguuauaggaaacaaaaacuuacauuacuugcca

SEQ ID NO: 635959 - RNA, 64 nt, Homo Sapiens
ucauuacaguaugaauuauauuguaauucuuuucauaggaaauggguggauuccaugacauaua

SEQ ID NO: 635960 - RNA, 64 nt, Homo Sapiens
cuugguucagagggaagugggauaucuaaaaagcauaggaaaucgagaaggccuuuucugaagg

SEQ ID NO: 635961 - RNA, 64 nt, Homo Sapiens
auucaaagcucuaauagaguguaaagauaaaaggauaggaaaagugaggccauucccuguagga

SEQ ID NO: 635962 - RNA, 64 nt, Homo Sapiens
ccucuucaguaugcaaauguaaauaaauuguaauauaggaaaucuuuuguuuuaauauaagaau

SEQ ID NO: 635963 - RNA, 64 nt, Homo Sapiens
auacauauauauuuuuugcuuuuguauauccuauauaggaaacuaagcauuguauuuuuuuuaa

SEQ ID NO: 635964 - RNA, 64 nt, Homo Sapiens
cauuuacagucuuguauuuacaagcuaaauauauauaggaaaucacaaauaaaucccuuuuaag

SEQ ID NO: 635965 - RNA, 64 nt, Homo Sapiens
agauuuucuuccauuucuaagacuguuauuuacaauaggaaaauuccuguuuggcuuuuugucu

SEQ ID NO: 635966 - RNA, 64 nt, Homo Sapiens
uucuuuucaagacuuccucaugaaucucucaauuauaggaaaaguuauugugauaaaauaggaa

SEQ ID NO: 635967 - RNA, 64 nt, Homo Sapiens
cuccuaauggaaacauuaucuuuaaaaguugcauauaggaaauauacauauuuuacguuugaac

SEQ ID NO: 635968 - RNA, 64 nt, Homo Sapiens
uuuauccagaugaagguauuuuuauauuuugacaauaggaaacagugaccauuuucagaguaau

SEQ ID NO: 635969 - RNA, 64 nt, Homo Sapiens
agagucaccagcagguuccaaauugauguguaugauaggaaaaaaaccuuaauuuuaaauauaa

SEQ ID NO: 635970 - RNA, 64 nt, Homo Sapiens
aagugucgaucuugaauucccugaaaaaauuucuauaggaaaugaagcuucccugguccccucc

SEQ ID NO: 635971 - RNA, 64 nt, Homo Sapiens
cauguuauagacuuucacuuaugucagauuuaugauaggaaaaauuccaucuucauuacugccu

SEQ ID NO: 635972 - RNA, 64 nt, Homo Sapiens
ccaacagguaaacuagaaaugaacaccuuucccaauaggaaacccgccuuccucacuccauaua

SEQ ID NO: 635973 - RNA, 64 nt, Homo Sapiens
ggggaauuacuguguauuugccgcugggacgucaauaggaaacggacgcgcaggagucagacuu

SEQ ID NO: 635974 - RNA, 64 nt, Homo Sapiens
uuucugcuuuuuaaauacaagggaaacugcucucauaggaaaguuuguauaauauguaauugua

SEQ ID NO: 635975 - RNA, 64 nt, Homo Sapiens
uagaaaccaagcaagaaggcugugugcacaauaaauaggaaaugauucugugugugugugugug

SEQ ID NO: 635976 - RNA, 64 nt, Homo Sapiens
auauuuuccaguguuauuugucuugaucacuuguauaggaaacauuucuuuuucuuuguuuuuu

SEQ ID NO: 635977 - RNA, 64 nt, Homo Sapiens
uugcauauggagauuacagucuuuuagguugccuauaggaaauacaaggguuggggcagcugca

SEQ ID NO: 635978 - RNA, 64 nt, Homo Sapiens
ugaaugcugcuguaaagugcaugcugaguauuucauaggaaagcaguuguauauaauauuuaag

SEQ ID NO: 635979 - RNA, 64 nt, Homo Sapiens
agucucuguaucaauguuuacgacugcuauguguauaggaaagcuuuaacucaaauauugucuu

SEQ ID NO: 635980 - RNA, 64 nt, Homo Sapiens
uguuauuaaauaaagaauuucuuggugugguuaaauaggaaaaucuuaaauacaccugcuggua

SEQ ID NO: 635981 - RNA, 64 nt, Homo Sapiens
acaggaagauuccaaagacguuggaauguuauucauaggaaauaagauauuugaauuaucuuga

SEQ ID NO: 635982 - RNA, 64 nt, Homo Sapiens
aauagcuuucuauauaugaguuuuugaguuuucuauaggaaauauuuuucuuucuuuuucuuug

SEQ ID NO: 635983 - RNA, 64 nt, Homo Sapiens
aauaaaguuaaaauuucaacguguugcuuuuguaauaggaaaauuuuuauuauguaaugaauau

SEQ ID NO: 635984 - RNA, 64 nt, Homo Sapiens
acugauaaaaugaaauauggguguucaaaaauacauaggaaaaguauagaguaauauuugagcu

SEQ ID NO: 635985 - RNA, 64 nt, Homo Sapiens
ucauuuuaaauauaacacucguuuguuuaauuuaauaggaaaccaccugcuuucauguuuuaau

SEQ ID NO: 635986 - RNA, 64 nt, Homo Sapiens
uaaacguuuuaaacaugguauucggcagcuuuuaauaggaaaguaaguuguuauuguuaaccuu

SEQ ID NO: 635987 - RNA, 64 nt, Homo Sapiens
augggggaguaguuaagcaauguaguaaauucaaauaggaaaaaauuuaaaaaacaaacuucau

SEQ ID NO: 635988 - RNA, 64 nt, Homo Sapiens
ugagaugccuuuuauuccaaaaagaaaaugcugcauaggaaaacgaagguaacguguuccuaga

SEQ ID NO: 635989 - RNA, 64 nt, Homo Sapiens
cauuacaguaguguaauauaagaagaggaagagaauaggaaaacagagagaaaaaaagacuuag

SEQ ID NO: 635990 - RNA, 64 nt, Homo Sapiens
gguacaucucaugaccucaauucccucaccugaaauaggaaaugagaauguuucauuguagccc

SEQ ID NO: 635991 - RNA, 64 nt, Homo Sapiens
cugucucacuggcaucuuguugagggccuugcacauaggaaacuuuugauaaguaucugcggaa

SEQ ID NO: 635992 - RNA, 64 nt, Homo Sapiens
aaacguagaaagaagacauagcgccugccagggaauaggaaaugagggcacuuacacauuaaug

SEQ ID NO: 635993 - RNA, 64 nt, Homo Sapiens
gcuuuuguggagaaauuagcacaccccaacuuuaauaggaaauuuguucucuuuuuccgccccu

SEQ ID NO: 635994 - RNA, 51 nt, Homo Sapiens
ccgauuauugcguauucuaaaauaggaaacaagacuuuaaauuuuaaaaaa

SEQ ID NO: 635995 - RNA, 64 nt, Homo Sapiens
auauauuugcuuaaaaauugcuuucagaaggcaaauaggaaacuacuauuuuuauaucugcugu

SEQ ID NO: 635996 - RNA, 64 nt, Homo Sapiens
uuccgccugcuuaccugugauuccaguuuugagaauaggaaagagaucuaguaguaaccaaaaa

SEQ ID NO: 635997 - RNA, 64 nt, Homo Sapiens
agaaaagauaauacccauuucauuuuaauuaauuauaggaaagaauuguacagguccauaauuu

SEQ ID NO: 635998 - RNA, 64 nt, Homo Sapiens
uuauuuuauuuuuauugaugcaguuguaaaguaaauaggaaaaauucuuguggcaaguaauuca

SEQ ID NO: 635999 - RNA, 64 nt, Homo Sapiens
aauaauuuuaacuuuuaaggaaguaucauuacauauaggaaaaccuuaaaaaucuaugccuaaa

SEQ ID NO: 636000 - RNA, 64 nt, Homo Sapiens
uucaccagcauaauuuuaucuuaaggaauaacuaauaggaaaagucagcuuaauuauuuaaggc

SEQ ID NO: 636001 - RNA, 64 nt, Homo Sapiens
aagcaccuaagaaaagaacugcaaagucugagaaauaggaaaaaugucugagacagcaaaauau

SEQ ID NO: 636002 - RNA, 64 nt, Homo Sapiens
uuuuacaaauccccagcucaugaacgugaagcugauaggaaaucaccccagggaacccgaaaaa

SEQ ID NO: 636003 - RNA, 64 nt, Homo Sapiens
aguggucuccaagcuuuugugauuguauauuccuauaggaaaaaaagaauugauuaugcauacc

SEQ ID NO: 636004 - RNA, 64 nt, Homo Sapiens
aguccaagucagacuauuucacaaagucagagcgauaggaaagcacccugcccuucaucuucau

SEQ ID NO: 636005 - RNA, 64 nt, Homo Sapiens
auucuguucuguuacagugauuuaaaccaguaguauaggaaaaaacuuaaaaaaacaaaaaaac

SEQ ID NO: 636006 - RNA, 64 nt, Homo Sapiens
uuucccaguaaauccccugaaaugaaggaagggcauaggaaaauaacccuaggaaguagggaga

SEQ ID NO: 636007 - RNA, 64 nt, Homo Sapiens
auuacuuguuaacuucuuacugaacagauguuaaauaggaaauuacgcagcggaaaugucauua

SEQ ID NO: 636008 - RNA, 64 nt, Homo Sapiens
gcuaaggaggccucauaaaugugacaagcauuuaauaggaaaauuaaauaaaacuaugguaaau

SEQ ID NO: 636009 - RNA, 64 nt, Homo Sapiens
gaauuacagguaagguacacucuuaaauccucccauaggaaauaaauaguguuccuaagauauc

SEQ ID NO: 636010 - RNA, 64 nt, Homo Sapiens
auuaucuuaaaacuuuggccguuaguuuugugccauaggaaaaauaauuuuggguauacuugug

SEQ ID NO: 636011 - RNA, 64 nt, Homo Sapiens
cugacaguguuuagcaacauucuaaauggugcauauaggaaauauaaaaaaaagugagguauag

SEQ ID NO: 636012 - RNA, 64 nt, Homo Sapiens
aaccaagcacaaaguuauauuguuuuguugcgacauaggaaaaucuauuugcaccgaaaugucu

SEQ ID NO: 636013 - RNA, 64 nt, Homo Sapiens
ugugaauaacugaagaaaauaacuugcuggcuauauaggaaaaugcuguggaaaugaacugugu

SEQ ID NO: 636014 - RNA, 64 nt, Homo Sapiens
uucuagauguagcuugugcagauguagcaggaaaauaggaaaaccuaccaucucagugagcacc

SEQ ID NO: 636015 - RNA, 64 nt, Homo Sapiens
agaaagaacaaaaaauguuuuaaauuucucuuauauaggaaauaauaggaacgucaaagcucug

SEQ ID NO: 636016 - RNA, 64 nt, Homo Sapiens
uuccugaguugccuaguagcaauaaaacaagugaauaggaaaauaauuaauauauuauucuauu

SEQ ID NO: 636017 - RNA, 64 nt, Homo Sapiens
auccucuugccauaugaauagcguuuuccaugaaauaggaaaauauuacuugguauagcauuuc

SEQ ID NO: 636018 - RNA, 64 nt, Homo Sapiens
auaauaaccaagacuuuucaagcuucuagaucucauaggaaagcuuguaauagcaaaauuguaa

SEQ ID NO: 636019 - RNA, 64 nt, Homo Sapiens
caguuccuauaauuuuuacugggggggauuugugauaggaaaguccuugggaaacauuuccaau

SEQ ID NO: 636020 - RNA, 64 nt, Homo Sapiens
uacaguaaaacuaugguauuuuguguuuacaaacauaggaaagguguaacacaguggugaguau

SEQ ID NO: 636021 - RNA, 64 nt, Homo Sapiens
aaucuccuuuggaaggugacucuuggaacaacgcauaggaaaagccugaugccaccuccucugu

SEQ ID NO: 636022 - RNA, 64 nt, Homo Sapiens
acacacauccaccuaaaauuccuuccugcuauacauaggaaaagaaauacguauguuuaaaaac

SEQ ID NO: 636023 - RNA, 64 nt, Homo Sapiens
uuuuaucuucuuaccaaguaaauauaaaugaagaauaggaaacauaagcaugcagaugacuuac

SEQ ID NO: 636024 - RNA, 64 nt, Homo Sapiens
aggaaaaauaauggaaacacagggacugauuuuuauaggaaagggagugauaaagccagcgggg

SEQ ID NO: 636025 - RNA, 64 nt, Homo Sapiens
uacuccgcguccugcccccaucaacucuuucccuauaggaaacuucagucccugcagacucuuc

SEQ ID NO: 636026 - RNA, 64 nt, Homo Sapiens
aaguauuuuugugaugaggauuaacuccccuguaauaggaaauacauuucuuuuuucuucuucu

SEQ ID NO: 636027 - RNA, 64 nt, Homo Sapiens
uauauuaaugagauuaauaauuucaugcuuauuuauaggaaaguauauaugcauccuccaaaug

SEQ ID NO: 636028 - RNA, 64 nt, Homo Sapiens
uuucgaucaugcaagugcuuucugaaucucugcaauaggaaaugucuucaggauaaaaagaacu

SEQ ID NO: 636029 - RNA, 64 nt, Homo Sapiens
aaaaaaaaagagagagugugugauuagaagcuaaauaggaaaguuuugagcuucaagucaguga

SEQ ID NO: 636030 - RNA, 64 nt, Homo Sapiens
gugcuguucugaagucuucaaauuuuucccucuaauaggaaacaguauaaauuuuaauuaaaaa

SEQ ID NO: 636031 - RNA, 64 nt, Homo Sapiens
aguugaaugucagacucucaguuuacuuuggaauauaggaaaaccuugaguguugaaaggaauu

SEQ ID NO: 636032 - RNA, 64 nt, Homo Sapiens
ucccccaucucccuuccugcggacaugcacuggaauaggaaauguguacccaguuuauuuaagg

SEQ ID NO: 636033 - RNA, 64 nt, Homo Sapiens
gaaccaaaucucauuaauuaaaaacagugggaauauaggaaaggcaauccucuccugaaacuua

SEQ ID NO: 636034 - RNA, 64 nt, Homo Sapiens
auuucuagugcuacaggcauaauguuuauuuuaaauaggaaagcaaagcucuauuuuaaaauuu

SEQ ID NO: 636035 - RNA, 64 nt, Homo Sapiens
ccguacuaaagauacucuacagccuuguuguuggauaggaaaacaauaaauggagagagagaga

SEQ ID NO: 636036 - RNA, 64 nt, Homo Sapiens
aguucagacaucgcuacaauuuuucucuuaacacauaggaaaaauugugauacagcggucacua

SEQ ID NO: 636037 - RNA, 64 nt, Homo Sapiens
cugucuggaaccagugaaugcauuagaaccuuccauaggaaaagaaaaggggcugaguuccauu

SEQ ID NO: 636038 - RNA, 64 nt, Homo Sapiens
uagugaccauuuggcaucaaguuaacaucacacaauaggaaacaccacuuccacaagucucaag

SEQ ID NO: 636039 - RNA, 64 nt, Homo Sapiens
guucuuagucauugauuuuuguguuuaaaaaaaaauaggaaagagggaaacugcagcuuucauu

SEQ ID NO: 636040 - RNA, 64 nt, Homo Sapiens
uuaccgagaaaaggagaaaggagcucugaaucugauaggaaaagaaggcugccuaaggaggagu

SEQ ID NO: 636041 - RNA, 64 nt, Homo Sapiens
uuuguaaauuuaugugauggcaaagaaggagagcauaggaaaccacacagacuugggcagggua

SEQ ID NO: 636042 - RNA, 64 nt, Homo Sapiens
ugcaucaaucuguuugccugcuaaacaaguuagaauaggaaauaguaaaauaaauccaaacaag

SEQ ID NO: 636043 - RNA, 63 nt, Homo Sapiens; identical to SEQ ID NO: 635600

SEQ ID NO: 636044 - RNA, 64 nt, Homo Sapiens
auuuuuuaaaaaaagccauuuuuuuugaugcuuuauaggaaacugcugagguuuucucugaggu

SEQ ID NO: 636045 - RNA, 64 nt, Homo Sapiens
cagggccagagcgagccauggccgggccacagcaauaggaaagccuaccccaggagugggccag

SEQ ID NO: 636046 - RNA, 64 nt, Homo Sapiens
cagccaggcgugguggcagaagugucaacuaaaaauaggaaaauuggccaaccuggugaaaugc

SEQ ID NO: 636047 - RNA, 64 nt, Homo Sapiens
ccucuuuccacagacuuagggcauccauguggauauaggaaaaguuuuccauuggcuucagggc

SEQ ID NO: 636048 - RNA, 64 nt, Homo Sapiens
gaagcucaaggguaaccaguauaacucuuugcaaauaggaaaguccaucucaaaaaaauuauaa

SEQ ID NO: 636049 - RNA, 64 nt, Homo Sapiens
auuuguaucauuuccuuuuuugcacaacauuuuuauaggaaaaugucuuuauacuuuauaguaa

SEQ ID NO: 636050 - RNA, 64 nt, Homo Sapiens
cuucauuaggaauuuaucaguauauuuuaugaauauaggaaaauacaagaugaaucuuauaaac

SEQ ID NO: 636051 - RNA, 64 nt, Homo Sapiens
cuuugacucuugcccagugcacuggcaaagaugaauaggaaaaaugaagcagcagauuugauag

SEQ ID NO: 636052 - RNA, 64 nt, Homo Sapiens
ccaaauauacauacuuauuuauauauauauguacauaggaaaaacggguuuuauaaauaaauau

SEQ ID NO: 636053 - RNA, 64 nt, Homo Sapiens
aacucuuuauuuuuguaguugggcucacuuuuggauaggaaauaccucuaccacccaacacccu

SEQ ID NO: 636054 - RNA, 64 nt, Homo Sapiens
gggaaaguauuuauuguacaaaaauucuuuaauaauaggaaaaguagacuguagauuauuuauu

SEQ ID NO: 636055 - RNA, 64 nt, Homo Sapiens
cugucagguuugguuuuuuuaaaaaauacuaccuauaggaaaguauuuugguuuuucaacacug

SEQ ID NO: 636056 - RNA, 64 nt, Homo Sapiens
uuuggaaugaggcagaaaagcuuauauaaugagcauaggaaaaucuccuucugauuuugccugu

SEQ ID NO: 636057 - RNA, 64 nt, Homo Sapiens
cugaacagaagggcuaguguaccaggagcuuauuauaggaaaggacuucaaaagaccauaauca

SEQ ID NO: 636058 - RNA, 64 nt, Homo Sapiens
aaagggcauuguucacagauaaagcuguugaaaaauaggaaaacuuugcacaacuuugguuuua

SEQ ID NO: 636059 - RNA, 64 nt, Homo Sapiens
aucuaccucaucauuuaaaacuucacuuuacugcauaggaaacauguauggauuuuuuuguuau

SEQ ID NO: 636060 - RNA, 64 nt, Homo Sapiens
aagagguaauuuuacauuucaaaggaagaaggggauaggaaaaggccagagggcucaggauggg

SEQ ID NO: 636061 - RNA, 64 nt, Homo Sapiens
cacauacucagccuggaugggagagggacccagcauaggaaagcuaaaugcucccugucccaug

SEQ ID NO: 636062 - RNA, 61 nt, Homo Sapiens
agaagaggaaugaacauuaauaccugaaacuauaggaaagguuaauuugccuauaauuaua

SEQ ID NO: 636063 - RNA, 64 nt, Homo Sapiens
ucacaauuucaacaugucaaaccuaugaagggagauaggaaacaaugagaaacuuacuuuugcu

SEQ ID NO: 636064 - RNA, 64 nt, Homo Sapiens
uauccaguuugaaaaucauucccuaaagcaugcaauaggaaaaagaaccuccuggcugggacug

SEQ ID NO: 636065 - RNA, 64 nt, Homo Sapiens
acuauuccccaacagauauuguggcaaaucacacauaggaaagagaauuugggaauacaguagc

SEQ ID NO: 636066 - RNA, 64 nt, Homo Sapiens
aauuaucuaaagaaucauugucuuucagagacucauaggaaaaaaaaacuaggaaaagugucac

SEQ ID NO: 636067 - RNA, 64 nt, Homo Sapiens
acagugcaaaauguguuaagaauuaggugugaaaauaggaaaauauaaauccuacuagaguaaa

SEQ ID NO: 636068 - RNA, 64 nt, Homo Sapiens
caaaaguuuauugcuguuugauauuaggugucauauaggaaacacuauauuacuguaggacugg

SEQ ID NO: 636069 - RNA, 64 nt, Homo Sapiens
caccuacaggagauguaaacauuggcacaaaguuauaggaaaauuaccaaauaguaugacacca

SEQ ID NO: 636070 - RNA, 64 nt, Homo Sapiens
gguauagugugcaaguguacagugcaauuuucuuauaggaaauacaacuagaaauccaguuaga

SEQ ID NO: 636071 - RNA, 64 nt, Homo Sapiens
aaacacuaguucaguuuuauacuucacaggaaauauaggaaaagauuuauucagcuaaaauagu

SEQ ID NO: 636072 - RNA, 64 nt, Homo Sapiens
ucguacagugacauaaguucuuaacuuuuggaugauaggaaagaugagcaaacauauuugaaag

SEQ ID NO: 636073 - RNA, 64 nt, Homo Sapiens
auuuaaaauaaauaguuuuuuuucugucuuauacauaggaaaacaaaguagaaagugcuuggua

SEQ ID NO: 636074 - RNA, 64 nt, Homo Sapiens
auuuuuuuaagcuaccaauuaaugcccuuaaaucauaggaaagucgaaggacagcgaugggaaa

SEQ ID NO: 636075 - RNA, 64 nt, Homo Sapiens
cugcucaggagaaagaagcuaaaacucagaggaaauaggaaaauauucagaguugaauuuaaug

SEQ ID NO: 636076 - RNA, 64 nt, Homo Sapiens
aagaguaaagcucagugugaaaugaaagaccuuaauaggaaaaacuuguugaucauuaccugua

SEQ ID NO: 636077 - RNA, 64 nt, Homo Sapiens
uacuucauuaccuaaaaucaauugaguuacuuugauaggaaaaacuuagauacuaguugucuga

SEQ ID NO: 636078 - RNA, 64 nt, Homo Sapiens
cuccgucuaccuggcguuuuguuagaaaugucagauaggaaaauaaaaaccauuugaguaaaaa

SEQ ID NO: 636079 - RNA, 64 nt, Homo Sapiens
ggaauuuuucaguuccaagugcaucccuuauucuauaggaaauaaacuggagacaaaucucauu

SEQ ID NO: 636080 - RNA, 64 nt, Homo Sapiens
agaaauaguggcuucccuggaauuguuuaacuugauaggaaaaaucuaucauauauaggacaua

SEQ ID NO: 636081 - RNA, 64 nt, Homo Sapiens
uaucccuccucaauuggaggcuggacagagcugaauaggaaagacuugcuauugccuaaggcua

SEQ ID NO: 636082 - RNA, 64 nt, Homo Sapiens
acaaggguauugacuggggaaaguaaagacaggcauaggaaauccugacaggauugagagauua

SEQ ID NO: 636083 - RNA, 64 nt, Homo Sapiens
gcuaccuagacuaggcaugucggcagcugugccaauaggaaaaaaagcuuccacgggugaaugc

SEQ ID NO: 636084 - RNA, 64 nt, Homo Sapiens
auuuucccauaauuccagaaagaauuagagggaaauaggaaaugacuaguaauacagcuguuga

SEQ ID NO: 636085 - RNA, 64 nt, Homo Sapiens
ccuucucaugaaaacuacaaagucaauuuggugaauaggaaaaguucauacugacaaggaaccg

SEQ ID NO: 636086 - RNA, 64 nt, Homo Sapiens; identical to SEQ ID NO: 636085

SEQ ID NO: 636087 - RNA, 64 nt, Homo Sapiens
caguauguuuucaguccauuccccauuauuuuaaauaggaaaaauuuguauuauuuuuauuugg

SEQ ID NO: 636088 - RNA, 64 nt, Homo Sapiens
uuauauauguagcucacguauuuuuaaaauuguuauaggaaaauaaaugaauaacacuuuuuug

SEQ ID NO: 636089 - RNA, 64 nt, Homo Sapiens
cuugauuuugaaauuaucaaauagugugauuaauauaggaaaucuacucaacauuauauaaugu

SEQ ID NO: 636090 - RNA, 64 nt, Homo Sapiens
gacauguaggagggcuauagacaggagaaaaaccauaggaaagucuauccaucugagagccaac

SEQ ID NO: 636091 - RNA, 64 nt, Homo Sapiens
guuuaagugaugacaaguucugauuuucaucuuuauaggaaauaaaaaauacuuuuuauuagcc

SEQ ID NO: 636092 - RNA, 64 nt, Homo Sapiens
cacaugagaacaggugcaauacuuacugucuaauauaggaaaaaugcccuugagcagggaagga

SEQ ID NO: 636093 - RNA, 64 nt, Homo Sapiens
auccguguuccagcaucuaaccuuuuacuuuugcauaggaaauacuugauuuaauuacaggucc

SEQ ID NO: 636094 - RNA, 64 nt, Homo Sapiens
guucucugaaaaaugaugucccaaaaguauuauaauaggaaaaaagcauuaaauauaauaaacu

SEQ ID NO: 636095 - RNA, 64 nt, Homo Sapiens
uugaaaaccugcuuuguagaugcagagagaagcuauaggaaacccaguaccaccccuggucugu

SEQ ID NO: 636096 - RNA, 64 nt, Homo Sapiens
gaguauuguaggggaaggaaauuuacaagauuuaauaggaaaugaaacagcuugaauuucaaac

SEQ ID NO: 636097 - RNA, 64 nt, Homo Sapiens
gggcugcccaucuccccaacccagucacagagagauaggaaacggcauuugaguggguguccag

SEQ ID NO: 636098 - RNA, 64 nt, Homo Sapiens
ugaaagccagaacaagagagcgcuccucucccagauaggaaaagggccucuaacaaggagaaau

SEQ ID NO: 636099 - RNA, 64 nt, Homo Sapiens
ugugguuuuuguguuuuuuuuuuuuucuuuuuccauaggaaagaauauauaaauuuguaaaucc

SEQ ID NO: 636100 - RNA, 64 nt, Homo Sapiens
cuuuccuauuauuucucuucuuuuuaaaacuaacauaggaaagcgaauuaaaaauaacacaguc

SEQ ID NO: 636101 - RNA, 64 nt, Homo Sapiens
cagaaauagguuuugucuggagucugagaaagaaauaggaaauggagagucugguaggcaaagc

SEQ ID NO: 636102 - RNA, 64 nt, Homo Sapiens
guuggauauuugaggccaugguuuaaaauguaagauaggaaaauuguagguucuuuuaacuuug

SEQ ID NO: 636103 - RNA, 64 nt, Homo Sapiens
uaaccacggaggcaccgaguaaaucacaagcaaaauaggaaaguccugacccagaacagccuuu

SEQ ID NO: 636104 - RNA, 64 nt, Homo Sapiens
agcuaaaugucauucuccaucaaaucuuaucuauauaggaaaauuuuuguuaagaguacaauug

SEQ ID NO: 636105 - RNA, 64 nt, Homo Sapiens
gcaccccuacucguuccuauagaacacagaggacauaggaaacccuuaaaacacacaugggauu

SEQ ID NO: 636106 - RNA, 64 nt, Homo Sapiens
accauuugccuuaccugucuuagucugaaauguaauaggaaagauaacgggaagaugccaguug

SEQ ID NO: 636107 - RNA, 64 nt, Homo Sapiens
cagauugccagagaaaucugggucaaagaaaggaauaggaaagaaaguuucuguagucaagcac

SEQ ID NO: 636108 - RNA, 64 nt, Homo Sapiens
gguguguuuaguggggaaagccucagaacccaggauaggaaaugaaucccagaggcagucccag

SEQ ID NO: 636109 - RNA, 64 nt, Homo Sapiens
ggauguuauggagcuucaaguuccucugcucauaauaggaaaaucaagccaucugcauguuuau

SEQ ID NO: 636110 - RNA, 64 nt, Homo Sapiens
gaagaucagauauuuugcuuaaaggucugaucauauaggaaauauaugcagaacauuuuaaaga

SEQ ID NO: 636111 - RNA, 64 nt, Homo Sapiens
acaauuaaauucaaaguucuucccuuuuuuaaagauaggaaacaggcauugccaaaaaaaaaaa

SEQ ID NO: 636112 - RNA, 64 nt, Homo Sapiens
cccacuaauuauaaugacuuucugucuggaucuuauaggaaaagauacuuucuuuuuucuucca

SEQ ID NO: 636113 - RNA, 64 nt, Homo Sapiens
aaugugucagggaauagaugugaaacaagggaucauaggaaaaggggaaagagaaaugaucugu

SEQ ID NO: 636114 - RNA, 64 nt, Homo Sapiens
gauaacuuaucagggcuaguuuaaacaaauguguauaggaaaggauguuauuuauauauucuua

SEQ ID NO: 636115 - RNA, 64 nt, Homo Sapiens
uauaauuaauaaacuuccuacaucuauagaauguauaggaaauuuuauguugugcacauuugca

SEQ ID NO: 636116 - RNA, 64 nt, Homo Sapiens
aaacucuuuaacuuguaauaaacccuuaacuggcauaggaaaugguauccagaauggaauuuug

SEQ ID NO: 636117 - RNA, 64 nt, Homo Sapiens
uagggggaaccuuauuuauuuguguguuaacugaauaggaaaauguacauacuauguucaugau

SEQ ID NO: 636118 - RNA, 64 nt, Homo Sapiens
ucuucaaccagggauuguuucuguuuaacuucuuauaggaaagcuugaguaaaauaaauauugu

SEQ ID NO: 636119 - RNA, 64 nt, Homo Sapiens
accacacccugggccccuaaucccaggccccgagauaggaaagccagcuagucucuucucuucu

SEQ ID NO: 636120 - RNA, 64 nt, Homo Sapiens
aaauggaauugauguaaagucaaguguuaucuacauaggaaauaacauauaugccaucuguccu

SEQ ID NO: 636121 - RNA, 64 nt, Homo Sapiens
gagaaacuguaauauuuggccagugccaguauucauaggaaaguacauauaaacaugaaauaaa

SEQ ID NO: 636122 - RNA, 64 nt, Homo Sapiens
uuucaugucccuuaaauauuauagcauuauuuuuauaggaaauacacugaauaaaguacaccau

SEQ ID NO: 636123 - RNA, 64 nt, Homo Sapiens
uuuaaugcuagcaaaaaauaacagcaucguuuaaauaggaaaaacagauuagcucauauucuau

SEQ ID NO: 636124 - RNA, 64 nt, Homo Sapiens
aucaacauaccuuggccagcgaagaguggcagcuauaggaaauuaugggaagagggugauaaua

SEQ ID NO: 636125 - RNA, 64 nt, Homo Sapiens
uuuuuuggaaaggauggauuccaaaucucucaauauaggaaacaagcuaauuuuuuuuuuuuua

SEQ ID NO: 636126 - RNA, 64 nt, Homo Sapiens
uacccagagacccaucauguugccaucaucugccauaggaaagacagcaggaaccuaaaauauc

SEQ ID NO: 636127 - RNA, 64 nt, Homo Sapiens
cucacuguuuaaccaugugaaugucuagucuuccauaggaaauccucugcuucuaaaaacuucu

SEQ ID NO: 636128 - RNA, 64 nt, Homo Sapiens
uuuuugugauuacggaauacugcaaacugcaucuauaggaaacaucaauggcuugcaauaaaug

SEQ ID NO: 636129 - RNA, 64 nt, Homo Sapiens
gggcaaaucgcaggugaccuggagguugcuagagauaggaaauggggugggggcauggggccca

SEQ ID NO: 636130 - RNA, 64 nt, Homo Sapiens
aauaauugccaugagguaacuaaucuccauauugauaggaaagcgucagucuccuucagaaaua

SEQ ID NO: 636131 - RNA, 64 nt, Homo Sapiens; identical to SEQ ID NO: 42679

SEQ ID NO: 636132 - RNA, 64 nt, Homo Sapiens; identical to SEQ ID NO: 42680

SEQ ID NO: 636133 - RNA, 64 nt, Homo Sapiens; identical to SEQ ID NO: 42681

SEQ ID NO: 636134 - RNA, 64 nt, Homo Sapiens; identical to SEQ ID NO: 42682

SEQ ID NO: 636135 - RNA, 64 nt, Homo Sapiens; identical to SEQ ID NO: 42683

SEQ ID NO: 636136 - RNA, 64 nt, Homo Sapiens; identical to SEQ ID NO: 42684

SEQ ID NO: 636137 - RNA, 64 nt, Homo Sapiens; identical to SEQ ID NO: 42685

SEQ ID NO: 636138 - RNA, 64 nt, Homo Sapiens; identical to SEQ ID NO: 42686

SEQ ID NO: 636139 - RNA, 64 nt, Homo Sapiens; identical to SEQ ID NO: 42687

SEQ ID NO: 636140 - RNA, 64 nt, Homo Sapiens; identical to SEQ ID NO: 42688

SEQ ID NO: 636141 - RNA, 64 nt, Homo Sapiens; identical to SEQ ID NO: 42689

SEQ ID NO: 636142 - RNA, 64 nt, Homo Sapiens; identical to SEQ ID NO: 42690

SEQ ID NO: 636143 - RNA, 64 nt, Homo Sapiens; identical to SEQ ID NO: 42691

SEQ ID NO: 636144 - RNA, 64 nt, Homo Sapiens; identical to SEQ ID NO: 42692

SEQ ID NO: 636145 - RNA, 64 nt, Homo Sapiens; identical to SEQ ID NO: 42693

SEQ ID NO: 636146 - RNA, 64 nt, Homo Sapiens; identical to SEQ ID NO: 42694

SEQ ID NO: 636147 - RNA, 64 nt, Homo Sapiens; identical to SEQ ID NO: 42695

SEQ ID NO: 636148 - RNA, 64 nt, Homo Sapiens; identical to SEQ ID NO: 42696

SEQ ID NO: 636149 - RNA, 64 nt, Homo Sapiens; identical to SEQ ID NO: 42697

SEQ ID NO: 636150 - RNA, 64 nt, Homo Sapiens; identical to SEQ ID NO: 42698

SEQ ID NO: 636151 - RNA, 64 nt, Homo Sapiens; identical to SEQ ID NO: 42699

SEQ ID NO: 636152 - RNA, 64 nt, Homo Sapiens; identical to SEQ ID NO: 42700

SEQ ID NO: 636153 - RNA, 64 nt, Homo Sapiens; identical to SEQ ID NO: 42701

SEQ ID NO: 636154 - RNA, 64 nt, Homo Sapiens; identical to SEQ ID NO: 42702

SEQ ID NO: 636155 - RNA, 64 nt, Homo Sapiens; identical to SEQ ID NO: 42703

SEQ ID NO: 636156 - RNA, 64 nt, Homo Sapiens; identical to SEQ ID NO: 42704

SEQ ID NO: 636157 - RNA, 64 nt, Homo Sapiens; identical to SEQ ID NO: 42705

SEQ ID NO: 636158 - RNA, 64 nt, Homo Sapiens; identical to SEQ ID NO: 42706

SEQ ID NO: 636159 - RNA, 64 nt, Homo Sapiens; identical to SEQ ID NO: 42707

SEQ ID NO: 636160 - RNA, 64 nt, Homo Sapiens; identical to SEQ ID NO: 42708

SEQ ID NO: 636161 - RNA, 64 nt, Homo Sapiens; identical to SEQ ID NO: 42709

SEQ ID NO: 636162 - RNA, 64 nt, Homo Sapiens; identical to SEQ ID NO: 42710

SEQ ID NO: 636163 - RNA, 64 nt, Homo Sapiens; identical to SEQ ID NO: 42711

SEQ ID NO: 636164 - RNA, 64 nt, Homo Sapiens; identical to SEQ ID NO: 42712

SEQ ID NO: 636165 - RNA, 64 nt, Homo Sapiens; identical to SEQ ID NO: 42713

SEQ ID NO: 636166 - RNA, 64 nt, Homo Sapiens; identical to SEQ ID NO: 42714

SEQ ID NO: 636167 - RNA, 64 nt, Homo Sapiens; identical to SEQ ID NO: 42715

SEQ ID NO: 636168 - RNA, 64 nt, Homo Sapiens; identical to SEQ ID NO: 42716

SEQ ID NO: 636169 - RNA, 64 nt, Homo Sapiens; identical to SEQ ID NO: 42717

SEQ ID NO: 636170 - RNA, 64 nt, Homo Sapiens; identical to SEQ ID NO: 42718

SEQ ID NO: 636171 - RNA, 64 nt, Homo Sapiens; identical to SEQ ID NO: 42719

SEQ ID NO: 636172 - RNA, 64 nt, Homo Sapiens; identical to SEQ ID NO: 42720

SEQ ID NO: 636173 - RNA, 64 nt, Homo Sapiens; identical to SEQ ID NO: 42721

SEQ ID NO: 636174 - RNA, 64 nt, Homo Sapiens; identical to SEQ ID NO: 42722

SEQ ID NO: 636175 - RNA, 64 nt, Homo Sapiens; identical to SEQ ID NO: 42723

SEQ ID NO: 636176 - RNA, 64 nt, Homo Sapiens; identical to SEQ ID NO: 42724

SEQ ID NO: 636177 - RNA, 64 nt, Homo Sapiens; identical to SEQ ID NO: 42725

SEQ ID NO: 636178 - RNA, 64 nt, Homo Sapiens; identical to SEQ ID NO: 42726

SEQ ID NO: 636179 - RNA, 64 nt, Homo Sapiens; identical to SEQ ID NO: 42727

SEQ ID NO: 636180 - RNA, 64 nt, Homo Sapiens; identical to SEQ ID NO: 42728

SEQ ID NO: 636181 - RNA, 64 nt, Homo Sapiens; identical to SEQ ID NO: 42729

SEQ ID NO: 636182 - RNA, 64 nt, Homo Sapiens; identical to SEQ ID NO: 42730

SEQ ID NO: 636183 - RNA, 64 nt, Homo Sapiens; identical to SEQ ID NO: 42731

SEQ ID NO: 636184 - RNA, 64 nt, Homo Sapiens; identical to SEQ ID NO: 42732

SEQ ID NO: 636185 - RNA, 64 nt, Homo Sapiens; identical to SEQ ID NO: 42733

SEQ ID NO: 636186 - RNA, 64 nt, Homo Sapiens; identical to SEQ ID NO: 42734

SEQ ID NO: 636187 - RNA, 64 nt, Homo Sapiens; identical to SEQ ID NO: 42735

SEQ ID NO: 636188 - RNA, 64 nt, Homo Sapiens; identical to SEQ ID NO: 42736

SEQ ID NO: 636189 - RNA, 64 nt, Homo Sapiens; identical to SEQ ID NO: 42737

SEQ ID NO: 636190 - RNA, 64 nt, Homo Sapiens; identical to SEQ ID NO: 42738

SEQ ID NO: 636191 - RNA, 64 nt, Homo Sapiens; identical to SEQ ID NO: 42739

SEQ ID NO: 636192 - RNA, 64 nt, Homo Sapiens; identical to SEQ ID NO: 42740

SEQ ID NO: 636193 - RNA, 64 nt, Homo Sapiens; identical to SEQ ID NO: 42741

SEQ ID NO: 636194 - RNA, 64 nt, Homo Sapiens; identical to SEQ ID NO: 42742

SEQ ID NO: 636195 - RNA, 64 nt, Homo Sapiens; identical to SEQ ID NO: 42743

SEQ ID NO: 636196 - RNA, 64 nt, Homo Sapiens; identical to SEQ ID NO: 42744

SEQ ID NO: 636197 - RNA, 64 nt, Homo Sapiens; identical to SEQ ID NO: 42745

SEQ ID NO: 636198 - RNA, 64 nt, Homo Sapiens; identical to SEQ ID NO: 42746

SEQ ID NO: 636199 - RNA, 64 nt, Homo Sapiens; identical to SEQ ID NO: 42747

SEQ ID NO: 636200 - RNA, 64 nt, Homo Sapiens; identical to SEQ ID NO: 42748

SEQ ID NO: 636201 - RNA, 64 nt, Homo Sapiens; identical to SEQ ID NO: 42749

SEQ ID NO: 636202 - RNA, 64 nt, Homo Sapiens; identical to SEQ ID NO: 42750

SEQ ID NO: 636203 - RNA, 64 nt, Homo Sapiens; identical to SEQ ID NO: 42751

SEQ ID NO: 636204 - RNA, 64 nt, Homo Sapiens; identical to SEQ ID NO: 42752

SEQ ID NO: 636205 - RNA, 64 nt, Homo Sapiens; identical to SEQ ID NO: 42753

SEQ ID NO: 636206 - RNA, 64 nt, Homo Sapiens; identical to SEQ ID NO: 42754

SEQ ID NO: 636207 - RNA, 64 nt, Homo Sapiens; identical to SEQ ID NO: 42755

SEQ ID NO: 636208 - RNA, 64 nt, Homo Sapiens; identical to SEQ ID NO: 42756

SEQ ID NO: 636209 - RNA, 64 nt, Homo Sapiens; identical to SEQ ID NO: 42757

SEQ ID NO: 636210 - RNA, 64 nt, Homo Sapiens; identical to SEQ ID NO: 42758

SEQ ID NO: 636211 - RNA, 64 nt, Homo Sapiens; identical to SEQ ID NO: 42759

SEQ ID NO: 636212 - RNA, 64 nt, Homo Sapiens; identical to SEQ ID NO: 42760

SEQ ID NO: 636213 - RNA, 64 nt, Homo Sapiens; identical to SEQ ID NO: 42761

SEQ ID NO: 636214 - RNA, 64 nt, Homo Sapiens; identical to SEQ ID NO: 42762

SEQ ID NO: 636215 - RNA, 64 nt, Homo Sapiens; identical to SEQ ID NO: 42763

SEQ ID NO: 636216 - RNA, 64 nt, Homo Sapiens; identical to SEQ ID NO: 42764

SEQ ID NO: 636217 - RNA, 64 nt, Homo Sapiens; identical to SEQ ID NO: 42765

SEQ ID NO: 636218 - RNA, 64 nt, Homo Sapiens; identical to SEQ ID NO: 42766

SEQ ID NO: 636219 - RNA, 64 nt, Homo Sapiens; identical to SEQ ID NO: 42767

SEQ ID NO: 636220 - RNA, 64 nt, Homo Sapiens; identical to SEQ ID NO: 42768

SEQ ID NO: 636221 - RNA, 64 nt, Homo Sapiens; identical to SEQ ID NO: 42769

SEQ ID NO: 636222 - RNA, 64 nt, Homo Sapiens; identical to SEQ ID NO: 42770

SEQ ID NO: 636223 - RNA, 64 nt, Homo Sapiens; identical to SEQ ID NO: 42771

SEQ ID NO: 636224 - RNA, 64 nt, Homo Sapiens; identical to SEQ ID NO: 42772

SEQ ID NO: 636225 - RNA, 64 nt, Homo Sapiens; identical to SEQ ID NO: 42773

SEQ ID NO: 636226 - RNA, 64 nt, Homo Sapiens; identical to SEQ ID NO: 42774

SEQ ID NO: 636227 - RNA, 64 nt, Homo Sapiens; identical to SEQ ID NO: 42775

SEQ ID NO: 636228 - RNA, 64 nt, Homo Sapiens; identical to SEQ ID NO: 42776

SEQ ID NO: 636229 - RNA, 64 nt, Homo Sapiens; identical to SEQ ID NO: 42777

SEQ ID NO: 636230 - RNA, 64 nt, Homo Sapiens; identical to SEQ ID NO: 42778

SEQ ID NO: 636231 - RNA, 64 nt, Homo Sapiens; identical to SEQ ID NO: 42779

SEQ ID NO: 636232 - RNA, 64 nt, Homo Sapiens; identical to SEQ ID NO: 42780

SEQ ID NO: 636233 - RNA, 64 nt, Homo Sapiens; identical to SEQ ID NO: 42781

SEQ ID NO: 636234 - RNA, 64 nt, Homo Sapiens; identical to SEQ ID NO: 42782

SEQ ID NO: 636235 - RNA, 64 nt, Homo Sapiens; identical to SEQ ID NO: 42783

SEQ ID NO: 636236 - RNA, 64 nt, Homo Sapiens; identical to SEQ ID NO: 42784

SEQ ID NO: 636237 - RNA, 64 nt, Homo Sapiens; identical to SEQ ID NO: 42785

SEQ ID NO: 636238 - RNA, 64 nt, Homo Sapiens; identical to SEQ ID NO: 42786

SEQ ID NO: 636239 - RNA, 64 nt, Homo Sapiens; identical to SEQ ID NO: 42787

SEQ ID NO: 636240 - RNA, 64 nt, Homo Sapiens; identical to SEQ ID NO: 42788

SEQ ID NO: 636241 - RNA, 64 nt, Homo Sapiens; identical to SEQ ID NO: 42789

SEQ ID NO: 636242 - RNA, 64 nt, Homo Sapiens; identical to SEQ ID NO: 42790

SEQ ID NO: 636243 - RNA, 64 nt, Homo Sapiens; identical to SEQ ID NO: 42791

SEQ ID NO: 636244 - RNA, 64 nt, Homo Sapiens; identical to SEQ ID NO: 42792

SEQ ID NO: 636245 - RNA, 64 nt, Homo Sapiens; identical to SEQ ID NO: 42793

SEQ ID NO: 636246 - RNA, 64 nt, Homo Sapiens; identical to SEQ ID NO: 42794

SEQ ID NO: 636247 - RNA, 64 nt, Homo Sapiens; identical to SEQ ID NO: 42795

SEQ ID NO: 636248 - RNA, 64 nt, Homo Sapiens; identical to SEQ ID NO: 42796

SEQ ID NO: 636249 - RNA, 64 nt, Homo Sapiens; identical to SEQ ID NO: 42797

SEQ ID NO: 636250 - RNA, 64 nt, Homo Sapiens; identical to SEQ ID NO: 42798

SEQ ID NO: 636251 - RNA, 64 nt, Homo Sapiens; identical to SEQ ID NO: 42799

SEQ ID NO: 636252 - RNA, 64 nt, Homo Sapiens; identical to SEQ ID NO: 42800

SEQ ID NO: 636253 - RNA, 64 nt, Homo Sapiens; identical to SEQ ID NO: 42801

SEQ ID NO: 636254 - RNA, 64 nt, Homo Sapiens; identical to SEQ ID NO: 42802

SEQ ID NO: 636255 - RNA, 64 nt, Homo Sapiens; identical to SEQ ID NO: 42803

SEQ ID NO: 636256 - RNA, 64 nt, Homo Sapiens; identical to SEQ ID NO: 42804

SEQ ID NO: 636257 - RNA, 64 nt, Homo Sapiens; identical to SEQ ID NO: 42805

SEQ ID NO: 636258 - RNA, 64 nt, Homo Sapiens; identical to SEQ ID NO: 42806

SEQ ID NO: 636259 - RNA, 64 nt, Homo Sapiens; identical to SEQ ID NO: 42807

SEQ ID NO: 636260 - RNA, 64 nt, Homo Sapiens; identical to SEQ ID NO: 42808

SEQ ID NO: 636261 - RNA, 64 nt, Homo Sapiens; identical to SEQ ID NO: 42809

SEQ ID NO: 636262 - RNA, 64 nt, Homo Sapiens; identical to SEQ ID NO: 42810

SEQ ID NO: 636263 - RNA, 64 nt, Homo Sapiens; identical to SEQ ID NO: 42811

SEQ ID NO: 636264 - RNA, 64 nt, Homo Sapiens; identical to SEQ ID NO: 42812

SEQ ID NO: 636265 - RNA, 64 nt, Homo Sapiens; identical to SEQ ID NO: 42813

SEQ ID NO: 636266 - RNA, 64 nt, Homo Sapiens; identical to SEQ ID NO: 42814

SEQ ID NO: 636267 - RNA, 64 nt, Homo Sapiens; identical to SEQ ID NO: 42815

SEQ ID NO: 636268 - RNA, 64 nt, Homo Sapiens; identical to SEQ ID NO: 42816

SEQ ID NO: 636269 - RNA, 64 nt, Homo Sapiens; identical to SEQ ID NO: 42817

SEQ ID NO: 636270 - RNA, 64 nt, Homo Sapiens; identical to SEQ ID NO: 42818

SEQ ID NO: 636271 - RNA, 64 nt, Homo Sapiens; identical to SEQ ID NO: 42819

SEQ ID NO: 636272 - RNA, 64 nt, Homo Sapiens; identical to SEQ ID NO: 42820

SEQ ID NO: 636273 - RNA, 64 nt, Homo Sapiens; identical to SEQ ID NO: 42821

SEQ ID NO: 636274 - RNA, 64 nt, Homo Sapiens; identical to SEQ ID NO: 42822

SEQ ID NO: 636275 - RNA, 64 nt, Homo Sapiens; identical to SEQ ID NO: 42823

SEQ ID NO: 636276 - RNA, 64 nt, Homo Sapiens; identical to SEQ ID NO: 42824

SEQ ID NO: 636277 - RNA, 64 nt, Homo Sapiens; identical to SEQ ID NO: 42825

SEQ ID NO: 636278 - RNA, 64 nt, Homo Sapiens; identical to SEQ ID NO: 42826

SEQ ID NO: 636279 - RNA, 64 nt, Homo Sapiens; identical to SEQ ID NO: 42827

SEQ ID NO: 636280 - RNA, 64 nt, Homo Sapiens; identical to SEQ ID NO: 42828

SEQ ID NO: 636281 - RNA, 64 nt, Homo Sapiens; identical to SEQ ID NO: 42829

SEQ ID NO: 636282 - RNA, 64 nt, Homo Sapiens; identical to SEQ ID NO: 42830

SEQ ID NO: 636283 - RNA, 64 nt, Homo Sapiens; identical to SEQ ID NO: 42831

SEQ ID NO: 636284 - RNA, 64 nt, Homo Sapiens; identical to SEQ ID NO: 42832

SEQ ID NO: 636285 - RNA, 64 nt, Homo Sapiens; identical to SEQ ID NO: 42833

SEQ ID NO: 636286 - RNA, 64 nt, Homo Sapiens; identical to SEQ ID NO: 42834

SEQ ID NO: 636287 - RNA, 64 nt, Homo Sapiens; identical to SEQ ID NO: 42835

SEQ ID NO: 636288 - RNA, 64 nt, Homo Sapiens; identical to SEQ ID NO: 42836

SEQ ID NO: 636289 - RNA, 64 nt, Homo Sapiens; identical to SEQ ID NO: 42837

SEQ ID NO: 636290 - RNA, 64 nt, Homo Sapiens; identical to SEQ ID NO: 42838

SEQ ID NO: 636291 - RNA, 64 nt, Homo Sapiens; identical to SEQ ID NO: 42839

SEQ ID NO: 636292 - RNA, 64 nt, Homo Sapiens; identical to SEQ ID NO: 42840

SEQ ID NO: 636293 - RNA, 64 nt, Homo Sapiens; identical to SEQ ID NO: 42841

SEQ ID NO: 636294 - RNA, 64 nt, Homo Sapiens; identical to SEQ ID NO: 42842

SEQ ID NO: 636295 - RNA, 64 nt, Homo Sapiens; identical to SEQ ID NO: 42843

SEQ ID NO: 636296 - RNA, 64 nt, Homo Sapiens; identical to SEQ ID NO: 42844

SEQ ID NO: 636297 - RNA, 64 nt, Homo Sapiens; identical to SEQ ID NO: 42845

SEQ ID NO: 636298 - RNA, 64 nt, Homo Sapiens; identical to SEQ ID NO: 42846

SEQ ID NO: 636299 - RNA, 64 nt, Homo Sapiens; identical to SEQ ID NO: 42847

SEQ ID NO: 636300 - RNA, 64 nt, Homo Sapiens; identical to SEQ ID NO: 42848

SEQ ID NO: 636301 - RNA, 64 nt, Homo Sapiens; identical to SEQ ID NO: 42849

SEQ ID NO: 636302 - RNA, 64 nt, Homo Sapiens; identical to SEQ ID NO: 42850

SEQ ID NO: 636303 - RNA, 64 nt, Homo Sapiens; identical to SEQ ID NO: 42851

SEQ ID NO: 636304 - RNA, 64 nt, Homo Sapiens; identical to SEQ ID NO: 42852

SEQ ID NO: 636305 - RNA, 64 nt, Homo Sapiens; identical to SEQ ID NO: 42853

SEQ ID NO: 636306 - RNA, 64 nt, Homo Sapiens; identical to SEQ ID NO: 42854

SEQ ID NO: 636307 - RNA, 64 nt, Homo Sapiens; identical to SEQ ID NO: 42855

SEQ ID NO: 636308 - RNA, 64 nt, Homo Sapiens; identical to SEQ ID NO: 42856

SEQ ID NO: 636309 - RNA, 64 nt, Homo Sapiens; identical to SEQ ID NO: 42857

SEQ ID NO: 636310 - RNA, 64 nt, Homo Sapiens; identical to SEQ ID NO: 42858

SEQ ID NO: 636311 - RNA, 64 nt, Homo Sapiens; identical to SEQ ID NO: 42859

SEQ ID NO: 636312 - RNA, 64 nt, Homo Sapiens; identical to SEQ ID NO: 42860

SEQ ID NO: 636313 - RNA, 64 nt, Homo Sapiens; identical to SEQ ID NO: 42861

SEQ ID NO: 636314 - RNA, 64 nt, Homo Sapiens; identical to SEQ ID NO: 42862

SEQ ID NO: 636315 - RNA, 64 nt, Homo Sapiens; identical to SEQ ID NO: 42863

SEQ ID NO: 636316 - RNA, 64 nt, Homo Sapiens; identical to SEQ ID NO: 42864

SEQ ID NO: 636317 - RNA, 64 nt, Homo Sapiens; identical to SEQ ID NO: 42865

SEQ ID NO: 636318 - RNA, 64 nt, Homo Sapiens; identical to SEQ ID NO: 42866

SEQ ID NO: 636319 - RNA, 64 nt, Homo Sapiens; identical to SEQ ID NO: 42867

SEQ ID NO: 636320 - RNA, 64 nt, Homo Sapiens; identical to SEQ ID NO: 42868

SEQ ID NO: 636321 - RNA, 64 nt, Homo Sapiens; identical to SEQ ID NO: 42869

SEQ ID NO: 636322 - RNA, 64 nt, Homo Sapiens; identical to SEQ ID NO: 42870

SEQ ID NO: 636323 - RNA, 64 nt, Homo Sapiens; identical to SEQ ID NO: 42871

SEQ ID NO: 636324 - RNA, 64 nt, Homo Sapiens; identical to SEQ ID NO: 42872

SEQ ID NO: 636325 - RNA, 64 nt, Homo Sapiens; identical to SEQ ID NO: 42873

SEQ ID NO: 636326 - RNA, 64 nt, Homo Sapiens; identical to SEQ ID NO: 42874

SEQ ID NO: 636327 - RNA, 64 nt, Homo Sapiens; identical to SEQ ID NO: 42875

SEQ ID NO: 636328 - RNA, 64 nt, Homo Sapiens; identical to SEQ ID NO: 42876

SEQ ID NO: 636329 - RNA, 64 nt, Homo Sapiens; identical to SEQ ID NO: 42877

SEQ ID NO: 636330 - RNA, 64 nt, Homo Sapiens; identical to SEQ ID NO: 42878

SEQ ID NO: 636331 - RNA, 64 nt, Homo Sapiens; identical to SEQ ID NO: 42879

SEQ ID NO: 636332 - RNA, 64 nt, Homo Sapiens; identical to SEQ ID NO: 42880

SEQ ID NO: 636333 - RNA, 64 nt, Homo Sapiens; identical to SEQ ID NO: 42881

SEQ ID NO: 636334 - RNA, 64 nt, Homo Sapiens; identical to SEQ ID NO: 42882

SEQ ID NO: 636335 - RNA, 64 nt, Homo Sapiens; identical to SEQ ID NO: 42883

SEQ ID NO: 636336 - RNA, 64 nt, Homo Sapiens; identical to SEQ ID NO: 42884

SEQ ID NO: 636337 - RNA, 64 nt, Homo Sapiens; identical to SEQ ID NO: 42885

SEQ ID NO: 636338 - RNA, 64 nt, Homo Sapiens; identical to SEQ ID NO: 42886

SEQ ID NO: 636339 - RNA, 64 nt, Homo Sapiens; identical to SEQ ID NO: 42887

SEQ ID NO: 636340 - RNA, 64 nt, Homo Sapiens; identical to SEQ ID NO: 42888

SEQ ID NO: 636341 - RNA, 64 nt, Homo Sapiens; identical to SEQ ID NO: 42889

SEQ ID NO: 636342 - RNA, 64 nt, Homo Sapiens; identical to SEQ ID NO: 42890

SEQ ID NO: 636343 - RNA, 64 nt, Homo Sapiens; identical to SEQ ID NO: 42891

SEQ ID NO: 636344 - RNA, 64 nt, Homo Sapiens; identical to SEQ ID NO: 42892

SEQ ID NO: 636345 - RNA, 64 nt, Homo Sapiens; identical to SEQ ID NO: 42893

SEQ ID NO: 636346 - RNA, 64 nt, Homo Sapiens; identical to SEQ ID NO: 42894

SEQ ID NO: 636347 - RNA, 64 nt, Homo Sapiens; identical to SEQ ID NO: 42895

SEQ ID NO: 636348 - RNA, 64 nt, Homo Sapiens; identical to SEQ ID NO: 42896

SEQ ID NO: 636349 - RNA, 64 nt, Homo Sapiens; identical to SEQ ID NO: 42897

SEQ ID NO: 636350 - RNA, 64 nt, Homo Sapiens; identical to SEQ ID NO: 42898

SEQ ID NO: 636351 - RNA, 64 nt, Homo Sapiens; identical to SEQ ID NO: 42899

SEQ ID NO: 636352 - RNA, 64 nt, Homo Sapiens; identical to SEQ ID NO: 42900

SEQ ID NO: 636353 - RNA, 64 nt, Homo Sapiens; identical to SEQ ID NO: 42901

SEQ ID NO: 636354 - RNA, 64 nt, Homo Sapiens; identical to SEQ ID NO: 42902

SEQ ID NO: 636355 - RNA, 64 nt, Homo Sapiens; identical to SEQ ID NO: 42903

SEQ ID NO: 636356 - RNA, 64 nt, Homo Sapiens; identical to SEQ ID NO: 42904

SEQ ID NO: 636357 - RNA, 64 nt, Homo Sapiens; identical to SEQ ID NO: 42905

SEQ ID NO: 636358 - RNA, 64 nt, Homo Sapiens; identical to SEQ ID NO: 42906

SEQ ID NO: 636359 - RNA, 64 nt, Homo Sapiens; identical to SEQ ID NO: 42907

SEQ ID NO: 636360 - RNA, 64 nt, Homo Sapiens; identical to SEQ ID NO: 42908

SEQ ID NO: 636361 - RNA, 64 nt, Homo Sapiens; identical to SEQ ID NO: 42909

SEQ ID NO: 636362 - RNA, 64 nt, Homo Sapiens; identical to SEQ ID NO: 42910

SEQ ID NO: 636363 - RNA, 64 nt, Homo Sapiens; identical to SEQ ID NO: 42911

SEQ ID NO: 636364 - RNA, 64 nt, Homo Sapiens; identical to SEQ ID NO: 42912

SEQ ID NO: 636365 - RNA, 64 nt, Homo Sapiens; identical to SEQ ID NO: 42913

SEQ ID NO: 636366 - RNA, 64 nt, Homo Sapiens; identical to SEQ ID NO: 42914

SEQ ID NO: 636367 - RNA, 64 nt, Homo Sapiens; identical to SEQ ID NO: 42915

SEQ ID NO: 636368 - RNA, 64 nt, Homo Sapiens; identical to SEQ ID NO: 42916

SEQ ID NO: 636369 - RNA, 64 nt, Homo Sapiens; identical to SEQ ID NO: 42917

SEQ ID NO: 636370 - RNA, 64 nt, Homo Sapiens; identical to SEQ ID NO: 42918

SEQ ID NO: 636371 - RNA, 64 nt, Homo Sapiens; identical to SEQ ID NO: 42919

SEQ ID NO: 636372 - RNA, 64 nt, Homo Sapiens; identical to SEQ ID NO: 42920

SEQ ID NO: 636373 - RNA, 64 nt, Homo Sapiens; identical to SEQ ID NO: 42921

SEQ ID NO: 636374 - RNA, 64 nt, Homo Sapiens; identical to SEQ ID NO: 42922

SEQ ID NO: 636375 - RNA, 64 nt, Homo Sapiens; identical to SEQ ID NO: 42923

SEQ ID NO: 636376 - RNA, 64 nt, Homo Sapiens; identical to SEQ ID NO: 42924

SEQ ID NO: 636377 - RNA, 64 nt, Homo Sapiens; identical to SEQ ID NO: 42925

SEQ ID NO: 636378 - RNA, 64 nt, Homo Sapiens; identical to SEQ ID NO: 42926

SEQ ID NO: 636379 - RNA, 64 nt, Homo Sapiens; identical to SEQ ID NO: 42927

SEQ ID NO: 636380 - RNA, 64 nt, Homo Sapiens; identical to SEQ ID NO: 42928

SEQ ID NO: 636381 - RNA, 64 nt, Homo Sapiens; identical to SEQ ID NO: 42929

SEQ ID NO: 636382 - RNA, 64 nt, Homo Sapiens; identical to SEQ ID NO: 42930

SEQ ID NO: 636383 - RNA, 64 nt, Homo Sapiens; identical to SEQ ID NO: 42931

SEQ ID NO: 636384 - RNA, 64 nt, Homo Sapiens; identical to SEQ ID NO: 42932

SEQ ID NO: 636385 - RNA, 64 nt, Homo Sapiens; identical to SEQ ID NO: 42933

SEQ ID NO: 636386 - RNA, 64 nt, Homo Sapiens; identical to SEQ ID NO: 42934

SEQ ID NO: 636387 - RNA, 64 nt, Homo Sapiens; identical to SEQ ID NO: 42935

SEQ ID NO: 636388 - RNA, 64 nt, Homo Sapiens; identical to SEQ ID NO: 42936

SEQ ID NO: 636389 - RNA, 64 nt, Homo Sapiens; identical to SEQ ID NO: 42937

SEQ ID NO: 636390 - RNA, 64 nt, Homo Sapiens; identical to SEQ ID NO: 42938

SEQ ID NO: 636391 - RNA, 64 nt, Homo Sapiens; identical to SEQ ID NO: 42939

SEQ ID NO: 636392 - RNA, 64 nt, Homo Sapiens; identical to SEQ ID NO: 42940

SEQ ID NO: 636393 - RNA, 64 nt, Homo Sapiens; identical to SEQ ID NO: 42941

SEQ ID NO: 636394 - RNA, 64 nt, Homo Sapiens; identical to SEQ ID NO: 42942

SEQ ID NO: 636395 - RNA, 64 nt, Homo Sapiens; identical to SEQ ID NO: 42943

SEQ ID NO: 636396 - RNA, 64 nt, Homo Sapiens; identical to SEQ ID NO: 42944

SEQ ID NO: 636397 - RNA, 64 nt, Homo Sapiens; identical to SEQ ID NO: 42945

SEQ ID NO: 636398 - RNA, 64 nt, Homo Sapiens; identical to SEQ ID NO: 42946

SEQ ID NO: 636399 - RNA, 64 nt, Homo Sapiens; identical to SEQ ID NO: 42947

SEQ ID NO: 636400 - RNA, 64 nt, Homo Sapiens; identical to SEQ ID NO: 42948

SEQ ID NO: 636401 - RNA, 64 nt, Homo Sapiens; identical to SEQ ID NO: 42949

SEQ ID NO: 636402 - RNA, 64 nt, Homo Sapiens; identical to SEQ ID NO: 42950

SEQ ID NO: 636403 - RNA, 64 nt, Homo Sapiens; identical to SEQ ID NO: 42951

SEQ ID NO: 636404 - RNA, 64 nt, Homo Sapiens; identical to SEQ ID NO: 42952

SEQ ID NO: 636405 - RNA, 64 nt, Homo Sapiens; identical to SEQ ID NO: 42953

SEQ ID NO: 636406 - RNA, 64 nt, Homo Sapiens; identical to SEQ ID NO: 42954

SEQ ID NO: 636407 - RNA, 64 nt, Homo Sapiens; identical to SEQ ID NO: 42955

SEQ ID NO: 636408 - RNA, 64 nt, Homo Sapiens; identical to SEQ ID NO: 42956

SEQ ID NO: 636409 - RNA, 64 nt, Homo Sapiens; identical to SEQ ID NO: 42957

SEQ ID NO: 636410 - RNA, 64 nt, Homo Sapiens; identical to SEQ ID NO: 42958

SEQ ID NO: 636411 - RNA, 64 nt, Homo Sapiens; identical to SEQ ID NO: 42959

SEQ ID NO: 636412 - RNA, 64 nt, Homo Sapiens; identical to SEQ ID NO: 42960

SEQ ID NO: 636413 - RNA, 64 nt, Homo Sapiens; identical to SEQ ID NO: 42961

SEQ ID NO: 636414 - RNA, 64 nt, Homo Sapiens; identical to SEQ ID NO: 42962

SEQ ID NO: 636415 - RNA, 64 nt, Homo Sapiens; identical to SEQ ID NO: 42963

SEQ ID NO: 636416 - RNA, 64 nt, Homo Sapiens; identical to SEQ ID NO: 42964

SEQ ID NO: 636417 - RNA, 64 nt, Homo Sapiens; identical to SEQ ID NO: 42965

SEQ ID NO: 636418 - RNA, 64 nt, Homo Sapiens; identical to SEQ ID NO: 42966

SEQ ID NO: 636419 - RNA, 64 nt, Homo Sapiens; identical to SEQ ID NO: 42967

SEQ ID NO: 636420 - RNA, 64 nt, Homo Sapiens; identical to SEQ ID NO: 42968

SEQ ID NO: 636421 - RNA, 64 nt, Homo Sapiens; identical to SEQ ID NO: 42969

SEQ ID NO: 636422 - RNA, 64 nt, Homo Sapiens; identical to SEQ ID NO: 42970

SEQ ID NO: 636423 - RNA, 64 nt, Homo Sapiens; identical to SEQ ID NO: 42971

SEQ ID NO: 636424 - RNA, 64 nt, Homo Sapiens; identical to SEQ ID NO: 42972

SEQ ID NO: 636425 - RNA, 64 nt, Homo Sapiens; identical to SEQ ID NO: 42973

SEQ ID NO: 636426 - RNA, 64 nt, Homo Sapiens; identical to SEQ ID NO: 42974

SEQ ID NO: 636427 - RNA, 64 nt, Homo Sapiens; identical to SEQ ID NO: 42975

SEQ ID NO: 636428 - RNA, 64 nt, Homo Sapiens; identical to SEQ ID NO: 42976

SEQ ID NO: 636429 - RNA, 64 nt, Homo Sapiens; identical to SEQ ID NO: 42977

SEQ ID NO: 636430 - RNA, 64 nt, Homo Sapiens; identical to SEQ ID NO: 42978

SEQ ID NO: 636431 - RNA, 64 nt, Homo Sapiens; identical to SEQ ID NO: 42979

SEQ ID NO: 636432 - RNA, 64 nt, Homo Sapiens; identical to SEQ ID NO: 42980

SEQ ID NO: 636433 - RNA, 64 nt, Homo Sapiens; identical to SEQ ID NO: 42981

SEQ ID NO: 636434 - RNA, 64 nt, Homo Sapiens; identical to SEQ ID NO: 42982

SEQ ID NO: 636435 - RNA, 64 nt, Homo Sapiens; identical to SEQ ID NO: 42983

SEQ ID NO: 636436 - RNA, 64 nt, Homo Sapiens; identical to SEQ ID NO: 42984

SEQ ID NO: 636437 - RNA, 64 nt, Homo Sapiens; identical to SEQ ID NO: 42985

SEQ ID NO: 636438 - RNA, 64 nt, Homo Sapiens; identical to SEQ ID NO: 42986

SEQ ID NO: 636439 - RNA, 64 nt, Homo Sapiens; identical to SEQ ID NO: 42987

SEQ ID NO: 636440 - RNA, 64 nt, Homo Sapiens; identical to SEQ ID NO: 42988

SEQ ID NO: 636441 - RNA, 64 nt, Homo Sapiens; identical to SEQ ID NO: 42989

SEQ ID NO: 636442 - RNA, 64 nt, Homo Sapiens; identical to SEQ ID NO: 42990

SEQ ID NO: 636443 - RNA, 64 nt, Homo Sapiens; identical to SEQ ID NO: 42991

SEQ ID NO: 636444 - RNA, 64 nt, Homo Sapiens; identical to SEQ ID NO: 42992

SEQ ID NO: 636445 - RNA, 64 nt, Homo Sapiens; identical to SEQ ID NO: 42993

SEQ ID NO: 636446 - RNA, 64 nt, Homo Sapiens; identical to SEQ ID NO: 42994

SEQ ID NO: 636447 - RNA, 64 nt, Homo Sapiens; identical to SEQ ID NO: 42995

SEQ ID NO: 636448 - RNA, 64 nt, Homo Sapiens; identical to SEQ ID NO: 42996

SEQ ID NO: 636449 - RNA, 64 nt, Homo Sapiens; identical to SEQ ID NO: 42997

SEQ ID NO: 636450 - RNA, 64 nt, Homo Sapiens; identical to SEQ ID NO: 42998

SEQ ID NO: 636451 - RNA, 64 nt, Homo Sapiens; identical to SEQ ID NO: 42999

SEQ ID NO: 636452 - RNA, 64 nt, Homo Sapiens; identical to SEQ ID NO: 43000

SEQ ID NO: 636453 - RNA, 64 nt, Homo Sapiens; identical to SEQ ID NO: 43001

SEQ ID NO: 636454 - RNA, 64 nt, Homo Sapiens; identical to SEQ ID NO: 43002

SEQ ID NO: 636455 - RNA, 64 nt, Homo Sapiens; identical to SEQ ID NO: 43003

SEQ ID NO: 636456 - RNA, 64 nt, Homo Sapiens; identical to SEQ ID NO: 43004

SEQ ID NO: 636457 - RNA, 64 nt, Homo Sapiens; identical to SEQ ID NO: 43005

SEQ ID NO: 636458 - RNA, 64 nt, Homo Sapiens; identical to SEQ ID NO: 43006

SEQ ID NO: 636459 - RNA, 64 nt, Homo Sapiens; identical to SEQ ID NO: 43007

SEQ ID NO: 636460 - RNA, 64 nt, Homo Sapiens; identical to SEQ ID NO: 43008

SEQ ID NO: 636461 - RNA, 64 nt, Homo Sapiens; identical to SEQ ID NO: 43009

SEQ ID NO: 636462 - RNA, 64 nt, Homo Sapiens; identical to SEQ ID NO: 43010

SEQ ID NO: 636463 - RNA, 64 nt, Homo Sapiens; identical to SEQ ID NO: 43011

SEQ ID NO: 636464 - RNA, 64 nt, Homo Sapiens; identical to SEQ ID NO: 43012

SEQ ID NO: 636465 - RNA, 62 nt, Homo Sapiens; identical to SEQ ID NO: 43013

SEQ ID NO: 636466 - RNA, 64 nt, Homo Sapiens; identical to SEQ ID NO: 43014

SEQ ID NO: 636467 - RNA, 64 nt, Homo Sapiens; identical to SEQ ID NO: 43015

SEQ ID NO: 636468 - RNA, 64 nt, Homo Sapiens; identical to SEQ ID NO: 43016

SEQ ID NO: 636469 - RNA, 64 nt, Homo Sapiens; identical to SEQ ID NO: 43017

SEQ ID NO: 636470 - RNA, 64 nt, Homo Sapiens; identical to SEQ ID NO: 43018

SEQ ID NO: 636471 - RNA, 64 nt, Homo Sapiens; identical to SEQ ID NO: 43019

SEQ ID NO: 636472 - RNA, 64 nt, Homo Sapiens; identical to SEQ ID NO: 43020

SEQ ID NO: 636473 - RNA, 64 nt, Homo Sapiens; identical to SEQ ID NO: 43021

SEQ ID NO: 636474 - RNA, 64 nt, Homo Sapiens; identical to SEQ ID NO: 43022

SEQ ID NO: 636475 - RNA, 64 nt, Homo Sapiens; identical to SEQ ID NO: 43023

SEQ ID NO: 636476 - RNA, 64 nt, Homo Sapiens; identical to SEQ ID NO: 43024

SEQ ID NO: 636477 - RNA, 64 nt, Homo Sapiens; identical to SEQ ID NO: 43025

SEQ ID NO: 636478 - RNA, 64 nt, Homo Sapiens; identical to SEQ ID NO: 43026

SEQ ID NO: 636479 - RNA, 64 nt, Homo Sapiens; identical to SEQ ID NO: 43027

SEQ ID NO: 636480 - RNA, 64 nt, Homo Sapiens; identical to SEQ ID NO: 43028

SEQ ID NO: 636481 - RNA, 64 nt, Homo Sapiens; identical to SEQ ID NO: 43029

SEQ ID NO: 636482 - RNA, 64 nt, Homo Sapiens; identical to SEQ ID NO: 43030

SEQ ID NO: 636483 - RNA, 64 nt, Homo Sapiens; identical to SEQ ID NO: 43031

SEQ ID NO: 636484 - RNA, 64 nt, Homo Sapiens; identical to SEQ ID NO: 43032

SEQ ID NO: 636485 - RNA, 64 nt, Homo Sapiens; identical to SEQ ID NO: 43033

SEQ ID NO: 636486 - RNA, 64 nt, Homo Sapiens; identical to SEQ ID NO: 43034

SEQ ID NO: 636487 - RNA, 64 nt, Homo Sapiens; identical to SEQ ID NO: 43035

SEQ ID NO: 636488 - RNA, 64 nt, Homo Sapiens; identical to SEQ ID NO: 43036

SEQ ID NO: 636489 - RNA, 64 nt, Homo Sapiens; identical to SEQ ID NO: 43037

SEQ ID NO: 636490 - RNA, 64 nt, Homo Sapiens; identical to SEQ ID NO: 43038

SEQ ID NO: 636491 - RNA, 64 nt, Homo Sapiens; identical to SEQ ID NO: 43039

SEQ ID NO: 636492 - RNA, 64 nt, Homo Sapiens; identical to SEQ ID NO: 43040

SEQ ID NO: 636493 - RNA, 64 nt, Homo Sapiens; identical to SEQ ID NO: 43041

SEQ ID NO: 636494 - RNA, 64 nt, Homo Sapiens; identical to SEQ ID NO: 43042

SEQ ID NO: 636495 - RNA, 64 nt, Homo Sapiens; identical to SEQ ID NO: 43043

SEQ ID NO: 636496 - RNA, 64 nt, Homo Sapiens; identical to SEQ ID NO: 43044

SEQ ID NO: 636497 - RNA, 64 nt, Homo Sapiens; identical to SEQ ID NO: 43045

SEQ ID NO: 636498 - RNA, 64 nt, Homo Sapiens; identical to SEQ ID NO: 43046

SEQ ID NO: 636499 - RNA, 64 nt, Homo Sapiens; identical to SEQ ID NO: 43047

SEQ ID NO: 636500 - RNA, 64 nt, Homo Sapiens; identical to SEQ ID NO: 43048

SEQ ID NO: 636501 - RNA, 64 nt, Homo Sapiens; identical to SEQ ID NO: 43049

SEQ ID NO: 636502 - RNA, 64 nt, Homo Sapiens; identical to SEQ ID NO: 43050

SEQ ID NO: 636503 - RNA, 64 nt, Homo Sapiens; identical to SEQ ID NO: 43051

SEQ ID NO: 636504 - RNA, 64 nt, Homo Sapiens; identical to SEQ ID NO: 43052

SEQ ID NO: 636505 - RNA, 64 nt, Homo Sapiens; identical to SEQ ID NO: 43053

SEQ ID NO: 636506 - RNA, 64 nt, Homo Sapiens; identical to SEQ ID NO: 43054

SEQ ID NO: 636507 - RNA, 64 nt, Homo Sapiens; identical to SEQ ID NO: 43055

SEQ ID NO: 636508 - RNA, 64 nt, Homo Sapiens; identical to SEQ ID NO: 43056

SEQ ID NO: 636509 - RNA, 64 nt, Homo Sapiens; identical to SEQ ID NO: 43057

SEQ ID NO: 636510 - RNA, 64 nt, Homo Sapiens; identical to SEQ ID NO: 43058

SEQ ID NO: 636511 - RNA, 64 nt, Homo Sapiens; identical to SEQ ID NO: 43059

SEQ ID NO: 636512 - RNA, 64 nt, Homo Sapiens; identical to SEQ ID NO: 43060

SEQ ID NO: 636513 - RNA, 64 nt, Homo Sapiens; identical to SEQ ID NO: 43061

SEQ ID NO: 636514 - RNA, 64 nt, Homo Sapiens; identical to SEQ ID NO: 43062

SEQ ID NO: 636515 - RNA, 64 nt, Homo Sapiens; identical to SEQ ID NO: 43063

SEQ ID NO: 636516 - RNA, 64 nt, Homo Sapiens; identical to SEQ ID NO: 43064

SEQ ID NO: 636517 - RNA, 64 nt, Homo Sapiens; identical to SEQ ID NO: 43065

SEQ ID NO: 636518 - RNA, 64 nt, Homo Sapiens; identical to SEQ ID NO: 43066

SEQ ID NO: 636519 - RNA, 64 nt, Homo Sapiens; identical to SEQ ID NO: 43067

SEQ ID NO: 636520 - RNA, 64 nt, Homo Sapiens; identical to SEQ ID NO: 43068

SEQ ID NO: 636521 - RNA, 64 nt, Homo Sapiens; identical to SEQ ID NO: 43069

SEQ ID NO: 636522 - RNA, 64 nt, Homo Sapiens; identical to SEQ ID NO: 43070

SEQ ID NO: 636523 - RNA, 64 nt, Homo Sapiens; identical to SEQ ID NO: 43071

SEQ ID NO: 636524 - RNA, 64 nt, Homo Sapiens; identical to SEQ ID NO: 43072

SEQ ID NO: 636525 - RNA, 64 nt, Homo Sapiens; identical to SEQ ID NO: 43073

SEQ ID NO: 636526 - RNA, 64 nt, Homo Sapiens; identical to SEQ ID NO: 43074

SEQ ID NO: 636527 - RNA, 64 nt, Homo Sapiens; identical to SEQ ID NO: 43075

SEQ ID NO: 636528 - RNA, 64 nt, Homo Sapiens; identical to SEQ ID NO: 43076

SEQ ID NO: 636529 - RNA, 64 nt, Homo Sapiens; identical to SEQ ID NO: 43077

SEQ ID NO: 636530 - RNA, 64 nt, Homo Sapiens; identical to SEQ ID NO: 43078

SEQ ID NO: 636531 - RNA, 64 nt, Homo Sapiens; identical to SEQ ID NO: 43079

SEQ ID NO: 636532 - RNA, 64 nt, Homo Sapiens; identical to SEQ ID NO: 43080

SEQ ID NO: 636533 - RNA, 64 nt, Homo Sapiens; identical to SEQ ID NO: 43081

SEQ ID NO: 636534 - RNA, 64 nt, Homo Sapiens; identical to SEQ ID NO: 43082

SEQ ID NO: 636535 - RNA, 64 nt, Homo Sapiens; identical to SEQ ID NO: 43083

SEQ ID NO: 636536 - RNA, 64 nt, Homo Sapiens; identical to SEQ ID NO: 43084

SEQ ID NO: 636537 - RNA, 64 nt, Homo Sapiens; identical to SEQ ID NO: 43085

SEQ ID NO: 636538 - RNA, 64 nt, Homo Sapiens; identical to SEQ ID NO: 43086

SEQ ID NO: 636539 - RNA, 64 nt, Homo Sapiens; identical to SEQ ID NO: 43087

SEQ ID NO: 636540 - RNA, 64 nt, Homo Sapiens; identical to SEQ ID NO: 43088

SEQ ID NO: 636541 - RNA, 64 nt, Homo Sapiens; identical to SEQ ID NO: 43089

SEQ ID NO: 636542 - RNA, 64 nt, Homo Sapiens; identical to SEQ ID NO: 43090

SEQ ID NO: 636543 - RNA, 64 nt, Homo Sapiens; identical to SEQ ID NO: 43091

SEQ ID NO: 636544 - RNA, 64 nt, Homo Sapiens; identical to SEQ ID NO: 43092

SEQ ID NO: 636545 - RNA, 64 nt, Homo Sapiens; identical to SEQ ID NO: 43093

SEQ ID NO: 636546 - RNA, 64 nt, Homo Sapiens; identical to SEQ ID NO: 43094

SEQ ID NO: 636547 - RNA, 64 nt, Homo Sapiens; identical to SEQ ID NO: 43095

SEQ ID NO: 636548 - RNA, 64 nt, Homo Sapiens; identical to SEQ ID NO: 43096

SEQ ID NO: 636549 - RNA, 64 nt, Homo Sapiens; identical to SEQ ID NO: 43097

SEQ ID NO: 636550 - RNA, 64 nt, Homo Sapiens; identical to SEQ ID NO: 43098

SEQ ID NO: 636551 - RNA, 64 nt, Homo Sapiens; identical to SEQ ID NO: 43099

SEQ ID NO: 636552 - RNA, 63 nt, Homo Sapiens; identical to SEQ ID NO: 43100

SEQ ID NO: 636553 - RNA, 64 nt, Homo Sapiens; identical to SEQ ID NO: 43101

SEQ ID NO: 636554 - RNA, 64 nt, Homo Sapiens; identical to SEQ ID NO: 43102

SEQ ID NO: 636555 - RNA, 64 nt, Homo Sapiens; identical to SEQ ID NO: 43103

SEQ ID NO: 636556 - RNA, 64 nt, Homo Sapiens; identical to SEQ ID NO: 43104

SEQ ID NO: 636557 - RNA, 64 nt, Homo Sapiens; identical to SEQ ID NO: 43105

SEQ ID NO: 636558 - RNA, 64 nt, Homo Sapiens; identical to SEQ ID NO: 43106

SEQ ID NO: 636559 - RNA, 64 nt, Homo Sapiens; identical to SEQ ID NO: 43107

SEQ ID NO: 636560 - RNA, 64 nt, Homo Sapiens; identical to SEQ ID NO: 43108

SEQ ID NO: 636561 - RNA, 64 nt, Homo Sapiens; identical to SEQ ID NO: 43109

SEQ ID NO: 636562 - RNA, 64 nt, Homo Sapiens; identical to SEQ ID NO: 43110

SEQ ID NO: 636563 - RNA, 64 nt, Homo Sapiens; identical to SEQ ID NO: 43111

SEQ ID NO: 636564 - RNA, 64 nt, Homo Sapiens; identical to SEQ ID NO: 43112

SEQ ID NO: 636565 - RNA, 64 nt, Homo Sapiens; identical to SEQ ID NO: 43113

SEQ ID NO: 636566 - RNA, 64 nt, Homo Sapiens; identical to SEQ ID NO: 43114

SEQ ID NO: 636567 - RNA, 64 nt, Homo Sapiens; identical to SEQ ID NO: 43115

SEQ ID NO: 636568 - RNA, 64 nt, Homo Sapiens; identical to SEQ ID NO: 43116

SEQ ID NO: 636569 - RNA, 64 nt, Homo Sapiens; identical to SEQ ID NO: 43117

SEQ ID NO: 636570 - RNA, 64 nt, Homo Sapiens; identical to SEQ ID NO: 43118

SEQ ID NO: 636571 - RNA, 64 nt, Homo Sapiens; identical to SEQ ID NO: 43119

SEQ ID NO: 636572 - RNA, 64 nt, Homo Sapiens; identical to SEQ ID NO: 43120

SEQ ID NO: 636573 - RNA, 64 nt, Homo Sapiens; identical to SEQ ID NO: 43121

SEQ ID NO: 636574 - RNA, 64 nt, Homo Sapiens; identical to SEQ ID NO: 43122

SEQ ID NO: 636575 - RNA, 64 nt, Homo Sapiens; identical to SEQ ID NO: 43123

SEQ ID NO: 636576 - RNA, 64 nt, Homo Sapiens; identical to SEQ ID NO: 43124

SEQ ID NO: 636577 - RNA, 64 nt, Homo Sapiens; identical to SEQ ID NO: 43125

SEQ ID NO: 636578 - RNA, 64 nt, Homo Sapiens; identical to SEQ ID NO: 43126

SEQ ID NO: 636579 - RNA, 64 nt, Homo Sapiens; identical to SEQ ID NO: 43127

SEQ ID NO: 636580 - RNA, 64 nt, Homo Sapiens; identical to SEQ ID NO: 43128

SEQ ID NO: 636581 - RNA, 64 nt, Homo Sapiens; identical to SEQ ID NO: 43129

SEQ ID NO: 636582 - RNA, 64 nt, Homo Sapiens; identical to SEQ ID NO: 43130

SEQ ID NO: 636583 - RNA, 64 nt, Homo Sapiens; identical to SEQ ID NO: 43131

SEQ ID NO: 636584 - RNA, 64 nt, Homo Sapiens; identical to SEQ ID NO: 43132

SEQ ID NO: 636585 - RNA, 61 nt, Homo Sapiens; identical to SEQ ID NO: 43133

SEQ ID NO: 636586 - RNA, 64 nt, Homo Sapiens; identical to SEQ ID NO: 43134

SEQ ID NO: 636587 - RNA, 64 nt, Homo Sapiens; identical to SEQ ID NO: 43135

SEQ ID NO: 636588 - RNA, 64 nt, Homo Sapiens; identical to SEQ ID NO: 43136

SEQ ID NO: 636589 - RNA, 64 nt, Homo Sapiens; identical to SEQ ID NO: 43137

SEQ ID NO: 636590 - RNA, 64 nt, Homo Sapiens; identical to SEQ ID NO: 43138

SEQ ID NO: 636591 - RNA, 64 nt, Homo Sapiens; identical to SEQ ID NO: 43139

SEQ ID NO: 636592 - RNA, 64 nt, Homo Sapiens; identical to SEQ ID NO: 43140

SEQ ID NO: 636593 - RNA, 64 nt, Homo Sapiens; identical to SEQ ID NO: 43141

SEQ ID NO: 636594 - RNA, 64 nt, Homo Sapiens; identical to SEQ ID NO: 43142

SEQ ID NO: 636595 - RNA, 64 nt, Homo Sapiens; identical to SEQ ID NO: 43143

SEQ ID NO: 636596 - RNA, 64 nt, Homo Sapiens; identical to SEQ ID NO: 43144

SEQ ID NO: 636597 - RNA, 64 nt, Homo Sapiens; identical to SEQ ID NO: 43145

SEQ ID NO: 636598 - RNA, 64 nt, Homo Sapiens; identical to SEQ ID NO: 43146

SEQ ID NO: 636599 - RNA, 64 nt, Homo Sapiens; identical to SEQ ID NO: 43147

SEQ ID NO: 636600 - RNA, 64 nt, Homo Sapiens; identical to SEQ ID NO: 43148

SEQ ID NO: 636601 - RNA, 64 nt, Homo Sapiens; identical to SEQ ID NO: 43149

SEQ ID NO: 636602 - RNA, 64 nt, Homo Sapiens; identical to SEQ ID NO: 43150

SEQ ID NO: 636603 - RNA, 64 nt, Homo Sapiens; identical to SEQ ID NO: 43151

SEQ ID NO: 636604 - RNA, 64 nt, Homo Sapiens; identical to SEQ ID NO: 43152

SEQ ID NO: 636605 - RNA, 64 nt, Homo Sapiens; identical to SEQ ID NO: 43153

SEQ ID NO: 636606 - RNA, 64 nt, Homo Sapiens; identical to SEQ ID NO: 43154

SEQ ID NO: 636607 - RNA, 64 nt, Homo Sapiens; identical to SEQ ID NO: 43155

SEQ ID NO: 636608 - RNA, 64 nt, Homo Sapiens; identical to SEQ ID NO: 43156

SEQ ID NO: 636609 - RNA, 64 nt, Homo Sapiens; identical to SEQ ID NO: 43157

SEQ ID NO: 636610 - RNA, 64 nt, Homo Sapiens; identical to SEQ ID NO: 43158

SEQ ID NO: 636611 - RNA, 64 nt, Homo Sapiens; identical to SEQ ID NO: 43159

SEQ ID NO: 636612 - RNA, 64 nt, Homo Sapiens; identical to SEQ ID NO: 43160

SEQ ID NO: 636613 - RNA, 64 nt, Homo Sapiens; identical to SEQ ID NO: 43161

SEQ ID NO: 636614 - RNA, 64 nt, Homo Sapiens; identical to SEQ ID NO: 43162

SEQ ID NO: 636615 - RNA, 64 nt, Homo Sapiens; identical to SEQ ID NO: 43163

SEQ ID NO: 636616 - RNA, 64 nt, Homo Sapiens; identical to SEQ ID NO: 43164

SEQ ID NO: 636617 - RNA, 64 nt, Homo Sapiens; identical to SEQ ID NO: 43165

SEQ ID NO: 636618 - RNA, 64 nt, Homo Sapiens; identical to SEQ ID NO: 43166

SEQ ID NO: 636619 - RNA, 64 nt, Homo Sapiens; identical to SEQ ID NO: 43167

SEQ ID NO: 636620 - RNA, 64 nt, Homo Sapiens; identical to SEQ ID NO: 43168

SEQ ID NO: 636621 - RNA, 64 nt, Homo Sapiens; identical to SEQ ID NO: 43169

SEQ ID NO: 636622 - RNA, 64 nt, Homo Sapiens; identical to SEQ ID NO: 43170

SEQ ID NO: 636623 - RNA, 64 nt, Homo Sapiens; identical to SEQ ID NO: 43171

SEQ ID NO: 636624 - RNA, 64 nt, Homo Sapiens; identical to SEQ ID NO: 43172

SEQ ID NO: 636625 - RNA, 64 nt, Homo Sapiens; identical to SEQ ID NO: 43173

SEQ ID NO: 636626 - RNA, 64 nt, Homo Sapiens; identical to SEQ ID NO: 43174

SEQ ID NO: 636627 - RNA, 64 nt, Homo Sapiens; identical to SEQ ID NO: 43175

SEQ ID NO: 636628 - RNA, 64 nt, Homo Sapiens; identical to SEQ ID NO: 43176

SEQ ID NO: 636629 - RNA, 64 nt, Homo Sapiens; identical to SEQ ID NO: 43177

SEQ ID NO: 636630 - RNA, 64 nt, Homo Sapiens; identical to SEQ ID NO: 43178

SEQ ID NO: 636631 - RNA, 64 nt, Homo Sapiens; identical to SEQ ID NO: 43179

SEQ ID NO: 636632 - RNA, 64 nt, Homo Sapiens; identical to SEQ ID NO: 43180

SEQ ID NO: 636633 - RNA, 64 nt, Homo Sapiens; identical to SEQ ID NO: 43181

SEQ ID NO: 636634 - RNA, 64 nt, Homo Sapiens; identical to SEQ ID NO: 43182

SEQ ID NO: 636635 - RNA, 64 nt, Homo Sapiens; identical to SEQ ID NO: 43183

SEQ ID NO: 636636 - RNA, 63 nt, Homo Sapiens; identical to SEQ ID NO: 43184

SEQ ID NO: 636637 - RNA, 64 nt, Homo Sapiens; identical to SEQ ID NO: 43185

SEQ ID NO: 636638 - RNA, 64 nt, Homo Sapiens; identical to SEQ ID NO: 43186

SEQ ID NO: 636639 - RNA, 64 nt, Homo Sapiens; identical to SEQ ID NO: 43187

SEQ ID NO: 636640 - RNA, 64 nt, Homo Sapiens; identical to SEQ ID NO: 43188

SEQ ID NO: 636641 - RNA, 64 nt, Homo Sapiens; identical to SEQ ID NO: 43189

SEQ ID NO: 636642 - RNA, 64 nt, Homo Sapiens; identical to SEQ ID NO: 43190

SEQ ID NO: 636643 - RNA, 64 nt, Homo Sapiens; identical to SEQ ID NO: 43191

SEQ ID NO: 636644 - RNA, 64 nt, Homo Sapiens; identical to SEQ ID NO: 43192

SEQ ID NO: 636645 - RNA, 64 nt, Homo Sapiens; identical to SEQ ID NO: 43193

SEQ ID NO: 636646 - RNA, 64 nt, Homo Sapiens; identical to SEQ ID NO: 43194

SEQ ID NO: 636647 - RNA, 64 nt, Homo Sapiens; identical to SEQ ID NO: 43195

SEQ ID NO: 636648 - RNA, 64 nt, Homo Sapiens; identical to SEQ ID NO: 43196

SEQ ID NO: 636649 - RNA, 64 nt, Homo Sapiens; identical to SEQ ID NO: 43197

SEQ ID NO: 636650 - RNA, 64 nt, Homo Sapiens; identical to SEQ ID NO: 43198

SEQ ID NO: 636651 - RNA, 64 nt, Homo Sapiens; identical to SEQ ID NO: 43199

SEQ ID NO: 636652 - RNA, 64 nt, Homo Sapiens; identical to SEQ ID NO: 43200

SEQ ID NO: 636653 - RNA, 64 nt, Homo Sapiens; identical to SEQ ID NO: 43201

SEQ ID NO: 636654 - RNA, 64 nt, Homo Sapiens; identical to SEQ ID NO: 43202

SEQ ID NO: 636655 - RNA, 64 nt, Homo Sapiens; identical to SEQ ID NO: 43203

SEQ ID NO: 636656 - RNA, 64 nt, Homo Sapiens; identical to SEQ ID NO: 43204

SEQ ID NO: 636657 - RNA, 64 nt, Homo Sapiens; identical to SEQ ID NO: 43205

SEQ ID NO: 636658 - RNA, 64 nt, Homo Sapiens; identical to SEQ ID NO: 43206

SEQ ID NO: 636659 - RNA, 64 nt, Homo Sapiens; identical to SEQ ID NO: 43207

SEQ ID NO: 636660 - RNA, 64 nt, Homo Sapiens; identical to SEQ ID NO: 43208

SEQ ID NO: 636661 - RNA, 64 nt, Homo Sapiens; identical to SEQ ID NO: 43209

SEQ ID NO: 636662 - RNA, 64 nt, Homo Sapiens; identical to SEQ ID NO: 43210

SEQ ID NO: 636663 - RNA, 64 nt, Homo Sapiens; identical to SEQ ID NO: 43211

SEQ ID NO: 636664 - RNA, 64 nt, Homo Sapiens; identical to SEQ ID NO: 43212

SEQ ID NO: 636665 - RNA, 64 nt, Homo Sapiens; identical to SEQ ID NO: 43213

SEQ ID NO: 636666 - RNA, 64 nt, Homo Sapiens; identical to SEQ ID NO: 43214

SEQ ID NO: 636667 - RNA, 64 nt, Homo Sapiens; identical to SEQ ID NO: 43215

SEQ ID NO: 636668 - RNA, 64 nt, Homo Sapiens; identical to SEQ ID NO: 43216

SEQ ID NO: 636669 - RNA, 64 nt, Homo Sapiens; identical to SEQ ID NO: 43217

SEQ ID NO: 636670 - RNA, 64 nt, Homo Sapiens; identical to SEQ ID NO: 43218

SEQ ID NO: 636671 - RNA, 64 nt, Homo Sapiens; identical to SEQ ID NO: 43219

SEQ ID NO: 636672 - RNA, 64 nt, Homo Sapiens; identical to SEQ ID NO: 43220

SEQ ID NO: 636673 - RNA, 64 nt, Homo Sapiens; identical to SEQ ID NO: 43221

SEQ ID NO: 636674 - RNA, 64 nt, Homo Sapiens; identical to SEQ ID NO: 43222

SEQ ID NO: 636675 - RNA, 64 nt, Homo Sapiens; identical to SEQ ID NO: 43223

SEQ ID NO: 636676 - RNA, 64 nt, Homo Sapiens; identical to SEQ ID NO: 43224

SEQ ID NO: 636677 - RNA, 64 nt, Homo Sapiens; identical to SEQ ID NO: 43225

SEQ ID NO: 636678 - RNA, 64 nt, Homo Sapiens; identical to SEQ ID NO: 43226

SEQ ID NO: 636679 - RNA, 64 nt, Homo Sapiens; identical to SEQ ID NO: 43227

SEQ ID NO: 636680 - RNA, 64 nt, Homo Sapiens; identical to SEQ ID NO: 43228

SEQ ID NO: 636681 - RNA, 64 nt, Homo Sapiens; identical to SEQ ID NO: 43229

SEQ ID NO: 636682 - RNA, 64 nt, Homo Sapiens; identical to SEQ ID NO: 43230

SEQ ID NO: 636683 - RNA, 64 nt, Homo Sapiens; identical to SEQ ID NO: 43231

SEQ ID NO: 636684 - RNA, 64 nt, Homo Sapiens; identical to SEQ ID NO: 43232

SEQ ID NO: 636685 - RNA, 64 nt, Homo Sapiens; identical to SEQ ID NO: 43233

SEQ ID NO: 636686 - RNA, 64 nt, Homo Sapiens; identical to SEQ ID NO: 43234

SEQ ID NO: 636687 - RNA, 64 nt, Homo Sapiens; identical to SEQ ID NO: 43235

SEQ ID NO: 636688 - RNA, 64 nt, Homo Sapiens; identical to SEQ ID NO: 43236

SEQ ID NO: 636689 - RNA, 64 nt, Homo Sapiens; identical to SEQ ID NO: 43237

SEQ ID NO: 636690 - RNA, 64 nt, Homo Sapiens; identical to SEQ ID NO: 43238

SEQ ID NO: 636691 - RNA, 64 nt, Homo Sapiens; identical to SEQ ID NO: 43239

SEQ ID NO: 636692 - RNA, 64 nt, Homo Sapiens; identical to SEQ ID NO: 43240

SEQ ID NO: 636693 - RNA, 64 nt, Homo Sapiens; identical to SEQ ID NO: 43241

SEQ ID NO: 636694 - RNA, 64 nt, Homo Sapiens; identical to SEQ ID NO: 43242

SEQ ID NO: 636695 - RNA, 64 nt, Homo Sapiens; identical to SEQ ID NO: 43243

SEQ ID NO: 636696 - RNA, 64 nt, Homo Sapiens; identical to SEQ ID NO: 43244

SEQ ID NO: 636697 - RNA, 64 nt, Homo Sapiens; identical to SEQ ID NO: 43245

SEQ ID NO: 636698 - RNA, 64 nt, Homo Sapiens; identical to SEQ ID NO: 43246

SEQ ID NO: 636699 - RNA, 64 nt, Homo Sapiens; identical to SEQ ID NO: 43247

SEQ ID NO: 636700 - RNA, 64 nt, Homo Sapiens; identical to SEQ ID NO: 43248

SEQ ID NO: 636701 - RNA, 64 nt, Homo Sapiens; identical to SEQ ID NO: 43249

SEQ ID NO: 636702 - RNA, 64 nt, Homo Sapiens; identical to SEQ ID NO: 43250

SEQ ID NO: 636703 - RNA, 64 nt, Homo Sapiens; identical to SEQ ID NO: 43251

SEQ ID NO: 636704 - RNA, 64 nt, Homo Sapiens; identical to SEQ ID NO: 43252

SEQ ID NO: 636705 - RNA, 64 nt, Homo Sapiens; identical to SEQ ID NO: 43253

SEQ ID NO: 636706 - RNA, 64 nt, Homo Sapiens; identical to SEQ ID NO: 43254

SEQ ID NO: 636707 - RNA, 64 nt, Homo Sapiens; identical to SEQ ID NO: 43255

SEQ ID NO: 636708 - RNA, 64 nt, Homo Sapiens; identical to SEQ ID NO: 43256

SEQ ID NO: 636709 - RNA, 64 nt, Homo Sapiens; identical to SEQ ID NO: 43257

SEQ ID NO: 636710 - RNA, 64 nt, Homo Sapiens; identical to SEQ ID NO: 43258

SEQ ID NO: 636711 - RNA, 64 nt, Homo Sapiens; identical to SEQ ID NO: 43259

SEQ ID NO: 636712 - RNA, 64 nt, Homo Sapiens; identical to SEQ ID NO: 43260

SEQ ID NO: 636713 - RNA, 64 nt, Homo Sapiens; identical to SEQ ID NO: 43261

SEQ ID NO: 636714 - RNA, 64 nt, Homo Sapiens; identical to SEQ ID NO: 43262

SEQ ID NO: 636715 - RNA, 64 nt, Homo Sapiens; identical to SEQ ID NO: 43263

SEQ ID NO: 636716 - RNA, 64 nt, Homo Sapiens; identical to SEQ ID NO: 43264

SEQ ID NO: 636717 - RNA, 64 nt, Homo Sapiens; identical to SEQ ID NO: 43265

SEQ ID NO: 636718 - RNA, 64 nt, Homo Sapiens; identical to SEQ ID NO: 43266

SEQ ID NO: 636719 - RNA, 64 nt, Homo Sapiens; identical to SEQ ID NO: 43267

SEQ ID NO: 636720 - RNA, 64 nt, Homo Sapiens; identical to SEQ ID NO: 43268

SEQ ID NO: 636721 - RNA, 64 nt, Homo Sapiens; identical to SEQ ID NO: 43269

SEQ ID NO: 636722 - RNA, 64 nt, Homo Sapiens; identical to SEQ ID NO: 43270

SEQ ID NO: 636723 - RNA, 64 nt, Homo Sapiens; identical to SEQ ID NO: 43271

SEQ ID NO: 636724 - RNA, 64 nt, Homo Sapiens; identical to SEQ ID NO: 43272

SEQ ID NO: 636725 - RNA, 64 nt, Homo Sapiens; identical to SEQ ID NO: 43273

SEQ ID NO: 636726 - RNA, 64 nt, Homo Sapiens; identical to SEQ ID NO: 43274

SEQ ID NO: 636727 - RNA, 64 nt, Homo Sapiens; identical to SEQ ID NO: 43275

SEQ ID NO: 636728 - RNA, 64 nt, Homo Sapiens; identical to SEQ ID NO: 43276

SEQ ID NO: 636729 - RNA, 64 nt, Homo Sapiens; identical to SEQ ID NO: 43277

SEQ ID NO: 636730 - RNA, 64 nt, Homo Sapiens; identical to SEQ ID NO: 43278

SEQ ID NO: 636731 - RNA, 64 nt, Homo Sapiens; identical to SEQ ID NO: 43279

SEQ ID NO: 636732 - RNA, 64 nt, Homo Sapiens; identical to SEQ ID NO: 43280

SEQ ID NO: 636733 - RNA, 64 nt, Homo Sapiens; identical to SEQ ID NO: 43281

SEQ ID NO: 636734 - RNA, 64 nt, Homo Sapiens; identical to SEQ ID NO: 43282

SEQ ID NO: 636735 - RNA, 64 nt, Homo Sapiens; identical to SEQ ID NO: 43283

SEQ ID NO: 636736 - RNA, 64 nt, Homo Sapiens; identical to SEQ ID NO: 43284

SEQ ID NO: 636737 - RNA, 64 nt, Homo Sapiens; identical to SEQ ID NO: 43285

SEQ ID NO: 636738 - RNA, 64 nt, Homo Sapiens; identical to SEQ ID NO: 43286

SEQ ID NO: 636739 - RNA, 64 nt, Homo Sapiens; identical to SEQ ID NO: 43287

SEQ ID NO: 636740 - RNA, 63 nt, Homo Sapiens; identical to SEQ ID NO: 43288

SEQ ID NO: 636741 - RNA, 64 nt, Homo Sapiens; identical to SEQ ID NO: 43289

SEQ ID NO: 636742 - RNA, 64 nt, Homo Sapiens; identical to SEQ ID NO: 43290

SEQ ID NO: 636743 - RNA, 64 nt, Homo Sapiens; identical to SEQ ID NO: 43291

SEQ ID NO: 636744 - RNA, 64 nt, Homo Sapiens; identical to SEQ ID NO: 43292

SEQ ID NO: 636745 - RNA, 64 nt, Homo Sapiens; identical to SEQ ID NO: 43293

SEQ ID NO: 636746 - RNA, 64 nt, Homo Sapiens; identical to SEQ ID NO: 43294

SEQ ID NO: 636747 - RNA, 64 nt, Homo Sapiens; identical to SEQ ID NO: 43295

SEQ ID NO: 636748 - RNA, 64 nt, Homo Sapiens; identical to SEQ ID NO: 43296

SEQ ID NO: 636749 - RNA, 64 nt, Homo Sapiens; identical to SEQ ID NO: 43297

SEQ ID NO: 636750 - RNA, 64 nt, Homo Sapiens; identical to SEQ ID NO: 43298

SEQ ID NO: 636751 - RNA, 64 nt, Homo Sapiens; identical to SEQ ID NO: 43299

SEQ ID NO: 636752 - RNA, 64 nt, Homo Sapiens; identical to SEQ ID NO: 43300

SEQ ID NO: 636753 - RNA, 64 nt, Homo Sapiens; identical to SEQ ID NO: 43301

SEQ ID NO: 636754 - RNA, 64 nt, Homo Sapiens; identical to SEQ ID NO: 43302

SEQ ID NO: 636755 - RNA, 64 nt, Homo Sapiens; identical to SEQ ID NO: 43303

SEQ ID NO: 636756 - RNA, 64 nt, Homo Sapiens; identical to SEQ ID NO: 43304

SEQ ID NO: 636757 - RNA, 64 nt, Homo Sapiens; identical to SEQ ID NO: 43305

SEQ ID NO: 636758 - RNA, 64 nt, Homo Sapiens; identical to SEQ ID NO: 43306

SEQ ID NO: 636759 - RNA, 64 nt, Homo Sapiens; identical to SEQ ID NO: 43307

SEQ ID NO: 636760 - RNA, 64 nt, Homo Sapiens; identical to SEQ ID NO: 43308

SEQ ID NO: 636761 - RNA, 64 nt, Homo Sapiens; identical to SEQ ID NO: 43309

SEQ ID NO: 636762 - RNA, 64 nt, Homo Sapiens; identical to SEQ ID NO: 43310

SEQ ID NO: 636763 - RNA, 64 nt, Homo Sapiens; identical to SEQ ID NO: 43311

SEQ ID NO: 636764 - RNA, 64 nt, Homo Sapiens; identical to SEQ ID NO: 43312

SEQ ID NO: 636765 - RNA, 64 nt, Homo Sapiens; identical to SEQ ID NO: 43313

SEQ ID NO: 636766 - RNA, 64 nt, Homo Sapiens; identical to SEQ ID NO: 43314

SEQ ID NO: 636767 - RNA, 64 nt, Homo Sapiens; identical to SEQ ID NO: 43315

SEQ ID NO: 636768 - RNA, 64 nt, Homo Sapiens; identical to SEQ ID NO: 43316

SEQ ID NO: 636769 - RNA, 64 nt, Homo Sapiens; identical to SEQ ID NO: 43317

SEQ ID NO: 636770 - RNA, 64 nt, Homo Sapiens; identical to SEQ ID NO: 43318

SEQ ID NO: 636771 - RNA, 64 nt, Homo Sapiens; identical to SEQ ID NO: 43319

SEQ ID NO: 636772 - RNA, 64 nt, Homo Sapiens; identical to SEQ ID NO: 43320

SEQ ID NO: 636773 - RNA, 64 nt, Homo Sapiens; identical to SEQ ID NO: 43321

SEQ ID NO: 636774 - RNA, 64 nt, Homo Sapiens; identical to SEQ ID NO: 43322

SEQ ID NO: 636775 - RNA, 64 nt, Homo Sapiens; identical to SEQ ID NO: 43323

SEQ ID NO: 636776 - RNA, 64 nt, Homo Sapiens; identical to SEQ ID NO: 43324

SEQ ID NO: 636777 - RNA, 64 nt, Homo Sapiens; identical to SEQ ID NO: 43325

SEQ ID NO: 636778 - RNA, 64 nt, Homo Sapiens; identical to SEQ ID NO: 43326

SEQ ID NO: 636779 - RNA, 64 nt, Homo Sapiens; identical to SEQ ID NO: 43327

SEQ ID NO: 636780 - RNA, 64 nt, Homo Sapiens; identical to SEQ ID NO: 43328

SEQ ID NO: 636781 - RNA, 64 nt, Homo Sapiens; identical to SEQ ID NO: 43329

SEQ ID NO: 636782 - RNA, 64 nt, Homo Sapiens; identical to SEQ ID NO: 43330

SEQ ID NO: 636783 - RNA, 64 nt, Homo Sapiens; identical to SEQ ID NO: 43331

SEQ ID NO: 636784 - RNA, 64 nt, Homo Sapiens; identical to SEQ ID NO: 43332

SEQ ID NO: 636785 - RNA, 64 nt, Homo Sapiens; identical to SEQ ID NO: 43333

SEQ ID NO: 636786 - RNA, 64 nt, Homo Sapiens; identical to SEQ ID NO: 43334

SEQ ID NO: 636787 - RNA, 64 nt, Homo Sapiens; identical to SEQ ID NO: 43335

SEQ ID NO: 636788 - RNA, 64 nt, Homo Sapiens; identical to SEQ ID NO: 43336

SEQ ID NO: 636789 - RNA, 64 nt, Homo Sapiens; identical to SEQ ID NO: 43337

SEQ ID NO: 636790 - RNA, 64 nt, Homo Sapiens; identical to SEQ ID NO: 43338

SEQ ID NO: 636791 - RNA, 64 nt, Homo Sapiens; identical to SEQ ID NO: 43339

SEQ ID NO: 636792 - RNA, 64 nt, Homo Sapiens; identical to SEQ ID NO: 43340

SEQ ID NO: 636793 - RNA, 64 nt, Homo Sapiens; identical to SEQ ID NO: 43341

SEQ ID NO: 636794 - RNA, 64 nt, Homo Sapiens; identical to SEQ ID NO: 43342

SEQ ID NO: 636795 - RNA, 54 nt, Homo Sapiens; identical to SEQ ID NO: 43343

SEQ ID NO: 636796 - RNA, 64 nt, Homo Sapiens; identical to SEQ ID NO: 43344

SEQ ID NO: 636797 - RNA, 64 nt, Homo Sapiens; identical to SEQ ID NO: 43345

SEQ ID NO: 636798 - RNA, 64 nt, Homo Sapiens; identical to SEQ ID NO: 43346

SEQ ID NO: 636799 - RNA, 64 nt, Homo Sapiens; identical to SEQ ID NO: 43347

SEQ ID NO: 636800 - RNA, 64 nt, Homo Sapiens; identical to SEQ ID NO: 43348

SEQ ID NO: 636801 - RNA, 64 nt, Homo Sapiens; identical to SEQ ID NO: 43349

SEQ ID NO: 636802 - RNA, 64 nt, Homo Sapiens; identical to SEQ ID NO: 43350

SEQ ID NO: 636803 - RNA, 64 nt, Homo Sapiens; identical to SEQ ID NO: 43351

SEQ ID NO: 636804 - RNA, 64 nt, Homo Sapiens; identical to SEQ ID NO: 43352

SEQ ID NO: 636805 - RNA, 64 nt, Homo Sapiens; identical to SEQ ID NO: 43353

SEQ ID NO: 636806 - RNA, 64 nt, Homo Sapiens; identical to SEQ ID NO: 43354

SEQ ID NO: 636807 - RNA, 64 nt, Homo Sapiens; identical to SEQ ID NO: 43355

SEQ ID NO: 636808 - RNA, 64 nt, Homo Sapiens; identical to SEQ ID NO: 43356

SEQ ID NO: 636809 - RNA, 64 nt, Homo Sapiens; identical to SEQ ID NO: 43357

SEQ ID NO: 636810 - RNA, 64 nt, Homo Sapiens; identical to SEQ ID NO: 43358

SEQ ID NO: 636811 - RNA, 64 nt, Homo Sapiens; identical to SEQ ID NO: 43359

SEQ ID NO: 636812 - RNA, 64 nt, Homo Sapiens; identical to SEQ ID NO: 43360

SEQ ID NO: 636813 - RNA, 64 nt, Homo Sapiens; identical to SEQ ID NO: 43361

SEQ ID NO: 636814 - RNA, 64 nt, Homo Sapiens; identical to SEQ ID NO: 43362

SEQ ID NO: 636815 - RNA, 64 nt, Homo Sapiens; identical to SEQ ID NO: 43363

SEQ ID NO: 636816 - RNA, 64 nt, Homo Sapiens; identical to SEQ ID NO: 43364

SEQ ID NO: 636817 - RNA, 64 nt, Homo Sapiens; identical to SEQ ID NO: 43365

SEQ ID NO: 636818 - RNA, 64 nt, Homo Sapiens; identical to SEQ ID NO: 43366

SEQ ID NO: 636819 - RNA, 64 nt, Homo Sapiens; identical to SEQ ID NO: 43367

SEQ ID NO: 636820 - RNA, 64 nt, Homo Sapiens; identical to SEQ ID NO: 43368

SEQ ID NO: 636821 - RNA, 64 nt, Homo Sapiens; identical to SEQ ID NO: 43369

SEQ ID NO: 636822 - RNA, 64 nt, Homo Sapiens; identical to SEQ ID NO: 43370

SEQ ID NO: 636823 - RNA, 64 nt, Homo Sapiens; identical to SEQ ID NO: 43371

SEQ ID NO: 636824 - RNA, 64 nt, Homo Sapiens; identical to SEQ ID NO: 43372

SEQ ID NO: 636825 - RNA, 64 nt, Homo Sapiens; identical to SEQ ID NO: 43373

SEQ ID NO: 636826 - RNA, 64 nt, Homo Sapiens; identical to SEQ ID NO: 43374

SEQ ID NO: 636827 - RNA, 64 nt, Homo Sapiens; identical to SEQ ID NO: 43375

SEQ ID NO: 636828 - RNA, 64 nt, Homo Sapiens; identical to SEQ ID NO: 43376

SEQ ID NO: 636829 - RNA, 64 nt, Homo Sapiens; identical to SEQ ID NO: 43377

SEQ ID NO: 636830 - RNA, 64 nt, Homo Sapiens; identical to SEQ ID NO: 43378

SEQ ID NO: 636831 - RNA, 64 nt, Homo Sapiens; identical to SEQ ID NO: 43379

SEQ ID NO: 636832 - RNA, 64 nt, Homo Sapiens; identical to SEQ ID NO: 43380

SEQ ID NO: 636833 - RNA, 64 nt, Homo Sapiens; identical to SEQ ID NO: 43381

SEQ ID NO: 636834 - RNA, 64 nt, Homo Sapiens; identical to SEQ ID NO: 43382

SEQ ID NO: 636835 - RNA, 64 nt, Homo Sapiens; identical to SEQ ID NO: 43383

SEQ ID NO: 636836 - RNA, 64 nt, Homo Sapiens; identical to SEQ ID NO: 43384

SEQ ID NO: 636837 - RNA, 64 nt, Homo Sapiens; identical to SEQ ID NO: 43385

SEQ ID NO: 636838 - RNA, 64 nt, Homo Sapiens; identical to SEQ ID NO: 43386

SEQ ID NO: 636839 - RNA, 64 nt, Homo Sapiens; identical to SEQ ID NO: 43387

SEQ ID NO: 636840 - RNA, 64 nt, Homo Sapiens; identical to SEQ ID NO: 43388

SEQ ID NO: 636841 - RNA, 64 nt, Homo Sapiens; identical to SEQ ID NO: 43389

SEQ ID NO: 636842 - RNA, 64 nt, Homo Sapiens; identical to SEQ ID NO: 43390

SEQ ID NO: 636843 - RNA, 64 nt, Homo Sapiens; identical to SEQ ID NO: 43391

SEQ ID NO: 636844 - RNA, 64 nt, Homo Sapiens; identical to SEQ ID NO: 43392

SEQ ID NO: 636845 - RNA, 64 nt, Homo Sapiens; identical to SEQ ID NO: 43393

SEQ ID NO: 636846 - RNA, 64 nt, Homo Sapiens; identical to SEQ ID NO: 43394

SEQ ID NO: 636847 - RNA, 64 nt, Homo Sapiens; identical to SEQ ID NO: 43395

SEQ ID NO: 636848 - RNA, 64 nt, Homo Sapiens; identical to SEQ ID NO: 43396

SEQ ID NO: 636849 - RNA, 64 nt, Homo Sapiens; identical to SEQ ID NO: 43397

SEQ ID NO: 636850 - RNA, 64 nt, Homo Sapiens; identical to SEQ ID NO: 43398

SEQ ID NO: 636851 - RNA, 64 nt, Homo Sapiens; identical to SEQ ID NO: 43399

SEQ ID NO: 636852 - RNA, 64 nt, Homo Sapiens; identical to SEQ ID NO: 43400

SEQ ID NO: 636853 - RNA, 64 nt, Homo Sapiens; identical to SEQ ID NO: 43401

SEQ ID NO: 636854 - RNA, 64 nt, Homo Sapiens; identical to SEQ ID NO: 43402

SEQ ID NO: 636855 - RNA, 64 nt, Homo Sapiens; identical to SEQ ID NO: 43403

SEQ ID NO: 636856 - RNA, 64 nt, Homo Sapiens; identical to SEQ ID NO: 43404

SEQ ID NO: 636857 - RNA, 64 nt, Homo Sapiens; identical to SEQ ID NO: 43405

SEQ ID NO: 636858 - RNA, 64 nt, Homo Sapiens; identical to SEQ ID NO: 43406

SEQ ID NO: 636859 - RNA, 64 nt, Homo Sapiens; identical to SEQ ID NO: 43407

SEQ ID NO: 636860 - RNA, 64 nt, Homo Sapiens; identical to SEQ ID NO: 43408

SEQ ID NO: 636861 - RNA, 64 nt, Homo Sapiens; identical to SEQ ID NO: 43409

SEQ ID NO: 636862 - RNA, 64 nt, Homo Sapiens; identical to SEQ ID NO: 43410

SEQ ID NO: 636863 - RNA, 64 nt, Homo Sapiens; identical to SEQ ID NO: 43411

SEQ ID NO: 636864 - RNA, 64 nt, Homo Sapiens; identical to SEQ ID NO: 43412

SEQ ID NO: 636865 - RNA, 64 nt, Homo Sapiens; identical to SEQ ID NO: 43413

SEQ ID NO: 636866 - RNA, 64 nt, Homo Sapiens; identical to SEQ ID NO: 43414

SEQ ID NO: 636867 - RNA, 64 nt, Homo Sapiens; identical to SEQ ID NO: 43415

SEQ ID NO: 636868 - RNA, 64 nt, Homo Sapiens; identical to SEQ ID NO: 43416

SEQ ID NO: 636869 - RNA, 64 nt, Homo Sapiens; identical to SEQ ID NO: 43417

SEQ ID NO: 636870 - RNA, 64 nt, Homo Sapiens; identical to SEQ ID NO: 43418

SEQ ID NO: 636871 - RNA, 64 nt, Homo Sapiens; identical to SEQ ID NO: 43419

SEQ ID NO: 636872 - RNA, 64 nt, Homo Sapiens; identical to SEQ ID NO: 43420

SEQ ID NO: 636873 - RNA, 64 nt, Homo Sapiens; identical to SEQ ID NO: 43421

SEQ ID NO: 636874 - RNA, 64 nt, Homo Sapiens; identical to SEQ ID NO: 43422

SEQ ID NO: 636875 - RNA, 64 nt, Homo Sapiens; identical to SEQ ID NO: 43423

SEQ ID NO: 636876 - RNA, 64 nt, Homo Sapiens; identical to SEQ ID NO: 43424

SEQ ID NO: 636877 - RNA, 64 nt, Homo Sapiens; identical to SEQ ID NO: 43425

SEQ ID NO: 636878 - RNA, 64 nt, Homo Sapiens; identical to SEQ ID NO: 43426

SEQ ID NO: 636879 - RNA, 64 nt, Homo Sapiens; identical to SEQ ID NO: 43427

SEQ ID NO: 636880 - RNA, 64 nt, Homo Sapiens; identical to SEQ ID NO: 43428

SEQ ID NO: 636881 - RNA, 64 nt, Homo Sapiens; identical to SEQ ID NO: 43429

SEQ ID NO: 636882 - RNA, 64 nt, Homo Sapiens; identical to SEQ ID NO: 43430

SEQ ID NO: 636883 - RNA, 64 nt, Homo Sapiens; identical to SEQ ID NO: 43431

SEQ ID NO: 636884 - RNA, 64 nt, Homo Sapiens; identical to SEQ ID NO: 43432

SEQ ID NO: 636885 - RNA, 64 nt, Homo Sapiens; identical to SEQ ID NO: 43433

SEQ ID NO: 636886 - RNA, 64 nt, Homo Sapiens; identical to SEQ ID NO: 43434

SEQ ID NO: 636887 - RNA, 64 nt, Homo Sapiens; identical to SEQ ID NO: 43435

SEQ ID NO: 636888 - RNA, 64 nt, Homo Sapiens; identical to SEQ ID NO: 43436

SEQ ID NO: 636889 - RNA, 64 nt, Homo Sapiens; identical to SEQ ID NO: 43437

SEQ ID NO: 636890 - RNA, 64 nt, Homo Sapiens; identical to SEQ ID NO: 43438

SEQ ID NO: 636891 - RNA, 64 nt, Homo Sapiens; identical to SEQ ID NO: 43439

SEQ ID NO: 636892 - RNA, 64 nt, Homo Sapiens; identical to SEQ ID NO: 43440

SEQ ID NO: 636893 - RNA, 64 nt, Homo Sapiens; identical to SEQ ID NO: 43441

SEQ ID NO: 636894 - RNA, 64 nt, Homo Sapiens; identical to SEQ ID NO: 43442

SEQ ID NO: 636895 - RNA, 64 nt, Homo Sapiens; identical to SEQ ID NO: 43443

SEQ ID NO: 636896 - RNA, 64 nt, Homo Sapiens; identical to SEQ ID NO: 43444

SEQ ID NO: 636897 - RNA, 64 nt, Homo Sapiens; identical to SEQ ID NO: 43445

SEQ ID NO: 636898 - RNA, 64 nt, Homo Sapiens; identical to SEQ ID NO: 43446

SEQ ID NO: 636899 - RNA, 64 nt, Homo Sapiens; identical to SEQ ID NO: 43447

SEQ ID NO: 636900 - RNA, 64 nt, Homo Sapiens; identical to SEQ ID NO: 43448

SEQ ID NO: 636901 - RNA, 64 nt, Homo Sapiens; identical to SEQ ID NO: 43449

SEQ ID NO: 636902 - RNA, 64 nt, Homo Sapiens; identical to SEQ ID NO: 43450

SEQ ID NO: 636903 - RNA, 64 nt, Homo Sapiens; identical to SEQ ID NO: 43451

SEQ ID NO: 636904 - RNA, 64 nt, Homo Sapiens; identical to SEQ ID NO: 43452

SEQ ID NO: 636905 - RNA, 64 nt, Homo Sapiens; identical to SEQ ID NO: 43453

SEQ ID NO: 636906 - RNA, 64 nt, Homo Sapiens; identical to SEQ ID NO: 43454

SEQ ID NO: 636907 - RNA, 64 nt, Homo Sapiens; identical to SEQ ID NO: 43455

SEQ ID NO: 636908 - RNA, 64 nt, Homo Sapiens; identical to SEQ ID NO: 43456

SEQ ID NO: 636909 - RNA, 64 nt, Homo Sapiens; identical to SEQ ID NO: 43457

SEQ ID NO: 636910 - RNA, 64 nt, Homo Sapiens; identical to SEQ ID NO: 43458

SEQ ID NO: 636911 - RNA, 64 nt, Homo Sapiens; identical to SEQ ID NO: 43459

SEQ ID NO: 636912 - RNA, 64 nt, Homo Sapiens; identical to SEQ ID NO: 43460

SEQ ID NO: 636913 - RNA, 64 nt, Homo Sapiens; identical to SEQ ID NO: 43461

SEQ ID NO: 636914 - RNA, 64 nt, Homo Sapiens; identical to SEQ ID NO: 43462

SEQ ID NO: 636915 - RNA, 64 nt, Homo Sapiens; identical to SEQ ID NO: 43463

SEQ ID NO: 636916 - RNA, 64 nt, Homo Sapiens; identical to SEQ ID NO: 43464

SEQ ID NO: 636917 - RNA, 64 nt, Homo Sapiens; identical to SEQ ID NO: 43465

SEQ ID NO: 636918 - RNA, 64 nt, Homo Sapiens; identical to SEQ ID NO: 43466

SEQ ID NO: 636919 - RNA, 64 nt, Homo Sapiens; identical to SEQ ID NO: 43467

SEQ ID NO: 636920 - RNA, 64 nt, Homo Sapiens; identical to SEQ ID NO: 43468

SEQ ID NO: 636921 - RNA, 64 nt, Homo Sapiens; identical to SEQ ID NO: 43469

SEQ ID NO: 636922 - RNA, 64 nt, Homo Sapiens; identical to SEQ ID NO: 43470

SEQ ID NO: 636923 - RNA, 64 nt, Homo Sapiens; identical to SEQ ID NO: 43471

SEQ ID NO: 636924 - RNA, 64 nt, Homo Sapiens; identical to SEQ ID NO: 43472

SEQ ID NO: 636925 - RNA, 64 nt, Homo Sapiens; identical to SEQ ID NO: 43473

SEQ ID NO: 636926 - RNA, 64 nt, Homo Sapiens; identical to SEQ ID NO: 43474

SEQ ID NO: 636927 - RNA, 64 nt, Homo Sapiens; identical to SEQ ID NO: 43475

SEQ ID NO: 636928 - RNA, 64 nt, Homo Sapiens; identical to SEQ ID NO: 43476

SEQ ID NO: 636929 - RNA, 64 nt, Homo Sapiens; identical to SEQ ID NO: 43477

SEQ ID NO: 636930 - RNA, 64 nt, Homo Sapiens; identical to SEQ ID NO: 43478

SEQ ID NO: 636931 - RNA, 64 nt, Homo Sapiens; identical to SEQ ID NO: 43479

SEQ ID NO: 636932 - RNA, 64 nt, Homo Sapiens; identical to SEQ ID NO: 43480

SEQ ID NO: 636933 - RNA, 64 nt, Homo Sapiens; identical to SEQ ID NO: 43481

SEQ ID NO: 636934 - RNA, 64 nt, Homo Sapiens; identical to SEQ ID NO: 43482

SEQ ID NO: 636935 - RNA, 64 nt, Homo Sapiens; identical to SEQ ID NO: 43483

SEQ ID NO: 636936 - RNA, 64 nt, Homo Sapiens; identical to SEQ ID NO: 43484

SEQ ID NO: 636937 - RNA, 64 nt, Homo Sapiens; identical to SEQ ID NO: 43485

SEQ ID NO: 636938 - RNA, 64 nt, Homo Sapiens; identical to SEQ ID NO: 43486

SEQ ID NO: 636939 - RNA, 64 nt, Homo Sapiens; identical to SEQ ID NO: 43487

SEQ ID NO: 636940 - RNA, 64 nt, Homo Sapiens; identical to SEQ ID NO: 43488

SEQ ID NO: 636941 - RNA, 64 nt, Homo Sapiens; identical to SEQ ID NO: 43489

SEQ ID NO: 636942 - RNA, 64 nt, Homo Sapiens; identical to SEQ ID NO: 43490

SEQ ID NO: 636943 - RNA, 64 nt, Homo Sapiens; identical to SEQ ID NO: 43491

SEQ ID NO: 636944 - RNA, 64 nt, Homo Sapiens; identical to SEQ ID NO: 43492

SEQ ID NO: 636945 - RNA, 64 nt, Homo Sapiens; identical to SEQ ID NO: 43493

SEQ ID NO: 636946 - RNA, 64 nt, Homo Sapiens; identical to SEQ ID NO: 43494

SEQ ID NO: 636947 - RNA, 64 nt, Homo Sapiens; identical to SEQ ID NO: 43495

SEQ ID NO: 636948 - RNA, 64 nt, Homo Sapiens; identical to SEQ ID NO: 43496

SEQ ID NO: 636949 - RNA, 64 nt, Homo Sapiens; identical to SEQ ID NO: 43497

SEQ ID NO: 636950 - RNA, 64 nt, Homo Sapiens; identical to SEQ ID NO: 43498

SEQ ID NO: 636951 - RNA, 64 nt, Homo Sapiens; identical to SEQ ID NO: 43499

SEQ ID NO: 636952 - RNA, 64 nt, Homo Sapiens; identical to SEQ ID NO: 43500

SEQ ID NO: 636953 - RNA, 64 nt, Homo Sapiens; identical to SEQ ID NO: 43501

SEQ ID NO: 636954 - RNA, 64 nt, Homo Sapiens; identical to SEQ ID NO: 43502

SEQ ID NO: 636955 - RNA, 64 nt, Homo Sapiens; identical to SEQ ID NO: 43503

SEQ ID NO: 636956 - RNA, 64 nt, Homo Sapiens; identical to SEQ ID NO: 43504

SEQ ID NO: 636957 - RNA, 64 nt, Homo Sapiens; identical to SEQ ID NO: 43505

SEQ ID NO: 636958 - RNA, 64 nt, Homo Sapiens; identical to SEQ ID NO: 43506

SEQ ID NO: 636959 - RNA, 64 nt, Homo Sapiens; identical to SEQ ID NO: 43507

SEQ ID NO: 636960 - RNA, 64 nt, Homo Sapiens; identical to SEQ ID NO: 43508

SEQ ID NO: 636961 - RNA, 64 nt, Homo Sapiens; identical to SEQ ID NO: 43509

SEQ ID NO: 636962 - RNA, 62 nt, Homo Sapiens; identical to SEQ ID NO: 43510

SEQ ID NO: 636963 - RNA, 64 nt, Homo Sapiens; identical to SEQ ID NO: 43511

SEQ ID NO: 636964 - RNA, 64 nt, Homo Sapiens; identical to SEQ ID NO: 43512

SEQ ID NO: 636965 - RNA, 64 nt, Homo Sapiens; identical to SEQ ID NO: 43513

SEQ ID NO: 636966 - RNA, 64 nt, Homo Sapiens; identical to SEQ ID NO: 43514

SEQ ID NO: 636967 - RNA, 64 nt, Homo Sapiens; identical to SEQ ID NO: 43515

SEQ ID NO: 636968 - RNA, 64 nt, Homo Sapiens; identical to SEQ ID NO: 43516

SEQ ID NO: 636969 - RNA, 64 nt, Homo Sapiens; identical to SEQ ID NO: 43517

SEQ ID NO: 636970 - RNA, 64 nt, Homo Sapiens; identical to SEQ ID NO: 43518

SEQ ID NO: 636971 - RNA, 64 nt, Homo Sapiens; identical to SEQ ID NO: 43519

SEQ ID NO: 636972 - RNA, 64 nt, Homo Sapiens; identical to SEQ ID NO: 43520

SEQ ID NO: 636973 - RNA, 64 nt, Homo Sapiens; identical to SEQ ID NO: 43521

SEQ ID NO: 636974 - RNA, 64 nt, Homo Sapiens; identical to SEQ ID NO: 43522

SEQ ID NO: 636975 - RNA, 64 nt, Homo Sapiens; identical to SEQ ID NO: 43523

SEQ ID NO: 636976 - RNA, 64 nt, Homo Sapiens; identical to SEQ ID NO: 43524

SEQ ID NO: 636977 - RNA, 64 nt, Homo Sapiens; identical to SEQ ID NO: 43525

SEQ ID NO: 636978 - RNA, 64 nt, Homo Sapiens; identical to SEQ ID NO: 43526

SEQ ID NO: 636979 - RNA, 64 nt, Homo Sapiens; identical to SEQ ID NO: 43527

SEQ ID NO: 636980 - RNA, 64 nt, Homo Sapiens; identical to SEQ ID NO: 43528

SEQ ID NO: 636981 - RNA, 64 nt, Homo Sapiens; identical to SEQ ID NO: 43529

SEQ ID NO: 636982 - RNA, 64 nt, Homo Sapiens; identical to SEQ ID NO: 43530

SEQ ID NO: 636983 - RNA, 64 nt, Homo Sapiens; identical to SEQ ID NO: 43531

SEQ ID NO: 636984 - RNA, 64 nt, Homo Sapiens; identical to SEQ ID NO: 43532

SEQ ID NO: 636985 - RNA, 64 nt, Homo Sapiens; identical to SEQ ID NO: 43533

SEQ ID NO: 636986 - RNA, 64 nt, Homo Sapiens; identical to SEQ ID NO: 43534

SEQ ID NO: 636987 - RNA, 64 nt, Homo Sapiens; identical to SEQ ID NO: 43535

SEQ ID NO: 636988 - RNA, 64 nt, Homo Sapiens; identical to SEQ ID NO: 43536

SEQ ID NO: 636989 - RNA, 64 nt, Homo Sapiens; identical to SEQ ID NO: 43537

SEQ ID NO: 636990 - RNA, 64 nt, Homo Sapiens; identical to SEQ ID NO: 43538

SEQ ID NO: 636991 - RNA, 64 nt, Homo Sapiens; identical to SEQ ID NO: 43539

SEQ ID NO: 636992 - RNA, 61 nt, Homo Sapiens; identical to SEQ ID NO: 43540

SEQ ID NO: 636993 - RNA, 64 nt, Homo Sapiens; identical to SEQ ID NO: 43541

SEQ ID NO: 636994 - RNA, 64 nt, Homo Sapiens; identical to SEQ ID NO: 43542

SEQ ID NO: 636995 - RNA, 64 nt, Homo Sapiens; identical to SEQ ID NO: 43543

SEQ ID NO: 636996 - RNA, 64 nt, Homo Sapiens; identical to SEQ ID NO: 43544

SEQ ID NO: 636997 - RNA, 64 nt, Homo Sapiens; identical to SEQ ID NO: 43545

SEQ ID NO: 636998 - RNA, 64 nt, Homo Sapiens; identical to SEQ ID NO: 43546

SEQ ID NO: 636999 - RNA, 64 nt, Homo Sapiens; identical to SEQ ID NO: 43547

SEQ ID NO: 637000 - RNA, 64 nt, Homo Sapiens; identical to SEQ ID NO: 43548

SEQ ID NO: 637001 - RNA, 64 nt, Homo Sapiens; identical to SEQ ID NO: 43549

SEQ ID NO: 637002 - RNA, 64 nt, Homo Sapiens; identical to SEQ ID NO: 43550

SEQ ID NO: 637003 - RNA, 64 nt, Homo Sapiens; identical to SEQ ID NO: 43551

SEQ ID NO: 637004 - RNA, 64 nt, Homo Sapiens; identical to SEQ ID NO: 43552

SEQ ID NO: 637005 - RNA, 64 nt, Homo Sapiens; identical to SEQ ID NO: 43553

SEQ ID NO: 637006 - RNA, 64 nt, Homo Sapiens; identical to SEQ ID NO: 43554

SEQ ID NO: 637007 - RNA, 64 nt, Homo Sapiens; identical to SEQ ID NO: 43555

SEQ ID NO: 637008 - RNA, 64 nt, Homo Sapiens; identical to SEQ ID NO: 43556

SEQ ID NO: 637009 - RNA, 64 nt, Homo Sapiens; identical to SEQ ID NO: 43557

SEQ ID NO: 637010 - RNA, 64 nt, Homo Sapiens; identical to SEQ ID NO: 43558

SEQ ID NO: 637011 - RNA, 64 nt, Homo Sapiens; identical to SEQ ID NO: 43559

SEQ ID NO: 637012 - RNA, 64 nt, Homo Sapiens; identical to SEQ ID NO: 43560

SEQ ID NO: 637013 - RNA, 64 nt, Homo Sapiens; identical to SEQ ID NO: 43561

SEQ ID NO: 637014 - RNA, 64 nt, Homo Sapiens; identical to SEQ ID NO: 43562

SEQ ID NO: 637015 - RNA, 64 nt, Homo Sapiens; identical to SEQ ID NO: 43563

SEQ ID NO: 637016 - RNA, 64 nt, Homo Sapiens; identical to SEQ ID NO: 43564

SEQ ID NO: 637017 - RNA, 64 nt, Homo Sapiens; identical to SEQ ID NO: 43565

SEQ ID NO: 637018 - RNA, 64 nt, Homo Sapiens; identical to SEQ ID NO: 43566

SEQ ID NO: 637019 - RNA, 64 nt, Homo Sapiens; identical to SEQ ID NO: 43567

SEQ ID NO: 637020 - RNA, 64 nt, Homo Sapiens; identical to SEQ ID NO: 43568

SEQ ID NO: 637021 - RNA, 64 nt, Homo Sapiens; identical to SEQ ID NO: 43569

SEQ ID NO: 637022 - RNA, 64 nt, Homo Sapiens; identical to SEQ ID NO: 43570

SEQ ID NO: 637023 - RNA, 64 nt, Homo Sapiens; identical to SEQ ID NO: 43571

SEQ ID NO: 637024 - RNA, 64 nt, Homo Sapiens; identical to SEQ ID NO: 43572

SEQ ID NO: 637025 - RNA, 64 nt, Homo Sapiens; identical to SEQ ID NO: 43573

SEQ ID NO: 637026 - RNA, 64 nt, Homo Sapiens; identical to SEQ ID NO: 43574

SEQ ID NO: 637027 - RNA, 64 nt, Homo Sapiens; identical to SEQ ID NO: 43575

SEQ ID NO: 637028 - RNA, 64 nt, Homo Sapiens; identical to SEQ ID NO: 43576

SEQ ID NO: 637029 - RNA, 64 nt, Homo Sapiens; identical to SEQ ID NO: 43577

SEQ ID NO: 637030 - RNA, 64 nt, Homo Sapiens; identical to SEQ ID NO: 43578

SEQ ID NO: 637031 - RNA, 64 nt, Homo Sapiens; identical to SEQ ID NO: 43579

SEQ ID NO: 637032 - RNA, 64 nt, Homo Sapiens; identical to SEQ ID NO: 43580

SEQ ID NO: 637033 - RNA, 64 nt, Homo Sapiens; identical to SEQ ID NO: 43581

SEQ ID NO: 637034 - RNA, 64 nt, Homo Sapiens; identical to SEQ ID NO: 43582

SEQ ID NO: 637035 - RNA, 64 nt, Homo Sapiens; identical to SEQ ID NO: 43583

SEQ ID NO: 637036 - RNA, 64 nt, Homo Sapiens; identical to SEQ ID NO: 43584

SEQ ID NO: 637037 - RNA, 64 nt, Homo Sapiens; identical to SEQ ID NO: 43585

SEQ ID NO: 637038 - RNA, 64 nt, Homo Sapiens; identical to SEQ ID NO: 43586

SEQ ID NO: 637039 - RNA, 64 nt, Homo Sapiens; identical to SEQ ID NO: 43587

SEQ ID NO: 637040 - RNA, 64 nt, Homo Sapiens; identical to SEQ ID NO: 43588

SEQ ID NO: 637041 - RNA, 64 nt, Homo Sapiens; identical to SEQ ID NO: 43589

SEQ ID NO: 637042 - RNA, 64 nt, Homo Sapiens; identical to SEQ ID NO: 43590

SEQ ID NO: 637043 - RNA, 64 nt, Homo Sapiens; identical to SEQ ID NO: 43591

SEQ ID NO: 637044 - RNA, 64 nt, Homo Sapiens; identical to SEQ ID NO: 43592

SEQ ID NO: 637045 - RNA, 64 nt, Homo Sapiens; identical to SEQ ID NO: 43593

SEQ ID NO: 637046 - RNA, 64 nt, Homo Sapiens; identical to SEQ ID NO: 43594

SEQ ID NO: 637047 - RNA, 64 nt, Homo Sapiens; identical to SEQ ID NO: 43595

SEQ ID NO: 637048 - RNA, 64 nt, Homo Sapiens; identical to SEQ ID NO: 43596

SEQ ID NO: 637049 - RNA, 64 nt, Homo Sapiens; identical to SEQ ID NO: 43597

SEQ ID NO: 637050 - RNA, 64 nt, Homo Sapiens; identical to SEQ ID NO: 43598

SEQ ID NO: 637051 - RNA, 64 nt, Homo Sapiens; identical to SEQ ID NO: 43599

SEQ ID NO: 637052 - RNA, 64 nt, Homo Sapiens; identical to SEQ ID NO: 43600

SEQ ID NO: 637053 - RNA, 64 nt, Homo Sapiens; identical to SEQ ID NO: 43601

SEQ ID NO: 637054 - RNA, 64 nt, Homo Sapiens; identical to SEQ ID NO: 43602

SEQ ID NO: 637055 - RNA, 64 nt, Homo Sapiens; identical to SEQ ID NO: 43603

SEQ ID NO: 637056 - RNA, 64 nt, Homo Sapiens; identical to SEQ ID NO: 43604

SEQ ID NO: 637057 - RNA, 64 nt, Homo Sapiens; identical to SEQ ID NO: 43605

SEQ ID NO: 637058 - RNA, 64 nt, Homo Sapiens; identical to SEQ ID NO: 43606

SEQ ID NO: 637059 - RNA, 64 nt, Homo Sapiens; identical to SEQ ID NO: 43607

SEQ ID NO: 637060 - RNA, 64 nt, Homo Sapiens; identical to SEQ ID NO: 43608

SEQ ID NO: 637061 - RNA, 64 nt, Homo Sapiens; identical to SEQ ID NO: 43609

SEQ ID NO: 637062 - RNA, 64 nt, Homo Sapiens; identical to SEQ ID NO: 43610

SEQ ID NO: 637063 - RNA, 64 nt, Homo Sapiens; identical to SEQ ID NO: 43611

SEQ ID NO: 637064 - RNA, 64 nt, Homo Sapiens; identical to SEQ ID NO: 43612

SEQ ID NO: 637065 - RNA, 64 nt, Homo Sapiens; identical to SEQ ID NO: 43613

SEQ ID NO: 637066 - RNA, 64 nt, Homo Sapiens; identical to SEQ ID NO: 43614

SEQ ID NO: 637067 - RNA, 64 nt, Homo Sapiens; identical to SEQ ID NO: 43615

SEQ ID NO: 637068 - RNA, 64 nt, Homo Sapiens; identical to SEQ ID NO: 43616

SEQ ID NO: 637069 - RNA, 64 nt, Homo Sapiens; identical to SEQ ID NO: 43617

SEQ ID NO: 637070 - RNA, 64 nt, Homo Sapiens; identical to SEQ ID NO: 43618

SEQ ID NO: 637071 - RNA, 64 nt, Homo Sapiens; identical to SEQ ID NO: 43619

SEQ ID NO: 637072 - RNA, 64 nt, Homo Sapiens; identical to SEQ ID NO: 43620

SEQ ID NO: 637073 - RNA, 64 nt, Homo Sapiens; identical to SEQ ID NO: 43621

SEQ ID NO: 637074 - RNA, 64 nt, Homo Sapiens; identical to SEQ ID NO: 43622

SEQ ID NO: 637075 - RNA, 64 nt, Homo Sapiens; identical to SEQ ID NO: 43623

SEQ ID NO: 637076 - RNA, 64 nt, Homo Sapiens; identical to SEQ ID NO: 43624

SEQ ID NO: 637077 - RNA, 64 nt, Homo Sapiens; identical to SEQ ID NO: 43625

SEQ ID NO: 637078 - RNA, 64 nt, Homo Sapiens; identical to SEQ ID NO: 43626

SEQ ID NO: 637079 - RNA, 64 nt, Homo Sapiens; identical to SEQ ID NO: 43627

SEQ ID NO: 637080 - RNA, 64 nt, Homo Sapiens; identical to SEQ ID NO: 43628

SEQ ID NO: 637081 - RNA, 64 nt, Homo Sapiens; identical to SEQ ID NO: 43629

SEQ ID NO: 637082 - RNA, 64 nt, Homo Sapiens; identical to SEQ ID NO: 43630

SEQ ID NO: 637083 - RNA, 64 nt, Homo Sapiens; identical to SEQ ID NO: 43631

SEQ ID NO: 637084 - RNA, 64 nt, Homo Sapiens; identical to SEQ ID NO: 43632

SEQ ID NO: 637085 - RNA, 64 nt, Homo Sapiens; identical to SEQ ID NO: 43633

SEQ ID NO: 637086 - RNA, 64 nt, Homo Sapiens; identical to SEQ ID NO: 43634

SEQ ID NO: 637087 - RNA, 64 nt, Homo Sapiens; identical to SEQ ID NO: 43635

SEQ ID NO: 637088 - RNA, 64 nt, Homo Sapiens; identical to SEQ ID NO: 43636

SEQ ID NO: 637089 - RNA, 64 nt, Homo Sapiens; identical to SEQ ID NO: 43637

SEQ ID NO: 637090 - RNA, 64 nt, Homo Sapiens; identical to SEQ ID NO: 43638

SEQ ID NO: 637091 - RNA, 64 nt, Homo Sapiens; identical to SEQ ID NO: 43639

SEQ ID NO: 637092 - RNA, 64 nt, Homo Sapiens; identical to SEQ ID NO: 43640

SEQ ID NO: 637093 - RNA, 64 nt, Homo Sapiens; identical to SEQ ID NO: 43641

SEQ ID NO: 637094 - RNA, 64 nt, Homo Sapiens; identical to SEQ ID NO: 43642

SEQ ID NO: 637095 - RNA, 64 nt, Homo Sapiens; identical to SEQ ID NO: 43643

SEQ ID NO: 637096 - RNA, 64 nt, Homo Sapiens; identical to SEQ ID NO: 43644

SEQ ID NO: 637097 - RNA, 64 nt, Homo Sapiens; identical to SEQ ID NO: 43645

SEQ ID NO: 637098 - RNA, 64 nt, Homo Sapiens; identical to SEQ ID NO: 43646

SEQ ID NO: 637099 - RNA, 64 nt, Homo Sapiens; identical to SEQ ID NO: 43647

SEQ ID NO: 637100 - RNA, 64 nt, Homo Sapiens; identical to SEQ ID NO: 43648

SEQ ID NO: 637101 - RNA, 64 nt, Homo Sapiens; identical to SEQ ID NO: 43649

SEQ ID NO: 637102 - RNA, 64 nt, Homo Sapiens; identical to SEQ ID NO: 43650

SEQ ID NO: 637103 - RNA, 64 nt, Homo Sapiens; identical to SEQ ID NO: 43651

SEQ ID NO: 637104 - RNA, 64 nt, Homo Sapiens; identical to SEQ ID NO: 43652

SEQ ID NO: 637105 - RNA, 64 nt, Homo Sapiens; identical to SEQ ID NO: 43653

SEQ ID NO: 637106 - RNA, 64 nt, Homo Sapiens; identical to SEQ ID NO: 43654

SEQ ID NO: 637107 - RNA, 64 nt, Homo Sapiens; identical to SEQ ID NO: 43655

SEQ ID NO: 637108 - RNA, 64 nt, Homo Sapiens; identical to SEQ ID NO: 43656

SEQ ID NO: 637109 - RNA, 64 nt, Homo Sapiens; identical to SEQ ID NO: 43657

SEQ ID NO: 637110 - RNA, 64 nt, Homo Sapiens; identical to SEQ ID NO: 43658

SEQ ID NO: 637111 - RNA, 64 nt, Homo Sapiens; identical to SEQ ID NO: 43659

SEQ ID NO: 637112 - RNA, 64 nt, Homo Sapiens; identical to SEQ ID NO: 43660

SEQ ID NO: 637113 - RNA, 64 nt, Homo Sapiens; identical to SEQ ID NO: 43661

SEQ ID NO: 637114 - RNA, 64 nt, Homo Sapiens; identical to SEQ ID NO: 43662

SEQ ID NO: 637115 - RNA, 64 nt, Homo Sapiens; identical to SEQ ID NO: 43663

SEQ ID NO: 637116 - RNA, 64 nt, Homo Sapiens; identical to SEQ ID NO: 43664

SEQ ID NO: 637117 - RNA, 64 nt, Homo Sapiens; identical to SEQ ID NO: 43665

SEQ ID NO: 637118 - RNA, 64 nt, Homo Sapiens; identical to SEQ ID NO: 43666

SEQ ID NO: 637119 - RNA, 64 nt, Homo Sapiens; identical to SEQ ID NO: 43667

SEQ ID NO: 637120 - RNA, 64 nt, Homo Sapiens; identical to SEQ ID NO: 43668

SEQ ID NO: 637121 - RNA, 64 nt, Homo Sapiens; identical to SEQ ID NO: 43669

SEQ ID NO: 637122 - RNA, 64 nt, Homo Sapiens; identical to SEQ ID NO: 43670

SEQ ID NO: 637123 - RNA, 64 nt, Homo Sapiens; identical to SEQ ID NO: 43671

SEQ ID NO: 637124 - RNA, 64 nt, Homo Sapiens; identical to SEQ ID NO: 43672

SEQ ID NO: 637125 - RNA, 64 nt, Homo Sapiens; identical to SEQ ID NO: 43673

SEQ ID NO: 637126 - RNA, 64 nt, Homo Sapiens; identical to SEQ ID NO: 43674

SEQ ID NO: 637127 - RNA, 64 nt, Homo Sapiens; identical to SEQ ID NO: 43675

SEQ ID NO: 637128 - RNA, 64 nt, Homo Sapiens; identical to SEQ ID NO: 43676

SEQ ID NO: 637129 - RNA, 64 nt, Homo Sapiens; identical to SEQ ID NO: 43677

SEQ ID NO: 637130 - RNA, 64 nt, Homo Sapiens; identical to SEQ ID NO: 43678

SEQ ID NO: 637131 - RNA, 64 nt, Homo Sapiens; identical to SEQ ID NO: 43679

SEQ ID NO: 637132 - RNA, 64 nt, Homo Sapiens; identical to SEQ ID NO: 43680

SEQ ID NO: 637133 - RNA, 64 nt, Homo Sapiens; identical to SEQ ID NO: 43681

SEQ ID NO: 637134 - RNA, 64 nt, Homo Sapiens; identical to SEQ ID NO: 43682

SEQ ID NO: 637135 - RNA, 64 nt, Homo Sapiens; identical to SEQ ID NO: 43683

SEQ ID NO: 637136 - RNA, 64 nt, Homo Sapiens; identical to SEQ ID NO: 43684

SEQ ID NO: 637137 - RNA, 64 nt, Homo Sapiens; identical to SEQ ID NO: 43685

SEQ ID NO: 637138 - RNA, 64 nt, Homo Sapiens; identical to SEQ ID NO: 43686

SEQ ID NO: 637139 - RNA, 64 nt, Homo Sapiens; identical to SEQ ID NO: 43687

SEQ ID NO: 637140 - RNA, 64 nt, Homo Sapiens; identical to SEQ ID NO: 43688

SEQ ID NO: 637141 - RNA, 64 nt, Homo Sapiens; identical to SEQ ID NO: 43689

SEQ ID NO: 637142 - RNA, 64 nt, Homo Sapiens; identical to SEQ ID NO: 43690

SEQ ID NO: 637143 - RNA, 64 nt, Homo Sapiens; identical to SEQ ID NO: 43691

SEQ ID NO: 637144 - RNA, 64 nt, Homo Sapiens; identical to SEQ ID NO: 43692

SEQ ID NO: 637145 - RNA, 64 nt, Homo Sapiens; identical to SEQ ID NO: 43693

SEQ ID NO: 637146 - RNA, 64 nt, Homo Sapiens; identical to SEQ ID NO: 43694

SEQ ID NO: 637147 - RNA, 64 nt, Homo Sapiens; identical to SEQ ID NO: 90702

SEQ ID NO: 637148 - RNA, 64 nt, Homo Sapiens; identical to SEQ ID NO: 90703

SEQ ID NO: 637149 - RNA, 64 nt, Homo Sapiens; identical to SEQ ID NO: 90704

SEQ ID NO: 637150 - RNA, 64 nt, Homo Sapiens; identical to SEQ ID NO: 90705

SEQ ID NO: 637151 - RNA, 64 nt, Homo Sapiens; identical to SEQ ID NO: 90706

SEQ ID NO: 637152 - RNA, 64 nt, Homo Sapiens; identical to SEQ ID NO: 90707

SEQ ID NO: 637153 - RNA, 64 nt, Homo Sapiens; identical to SEQ ID NO: 90708

SEQ ID NO: 637154 - RNA, 64 nt, Homo Sapiens; identical to SEQ ID NO: 90709

SEQ ID NO: 637155 - RNA, 64 nt, Homo Sapiens; identical to SEQ ID NO: 90710

SEQ ID NO: 637156 - RNA, 64 nt, Homo Sapiens; identical to SEQ ID NO: 90711

SEQ ID NO: 637157 - RNA, 64 nt, Homo Sapiens; identical to SEQ ID NO: 90712

SEQ ID NO: 637158 - RNA, 64 nt, Homo Sapiens; identical to SEQ ID NO: 90713

SEQ ID NO: 637159 - RNA, 64 nt, Homo Sapiens; identical to SEQ ID NO: 90714

SEQ ID NO: 637160 - RNA, 64 nt, Homo Sapiens; identical to SEQ ID NO: 90715

SEQ ID NO: 637161 - RNA, 64 nt, Homo Sapiens; identical to SEQ ID NO: 90716

SEQ ID NO: 637162 - RNA, 64 nt, Homo Sapiens; identical to SEQ ID NO: 90717

SEQ ID NO: 637163 - RNA, 64 nt, Homo Sapiens; identical to SEQ ID NO: 90718

SEQ ID NO: 637164 - RNA, 64 nt, Homo Sapiens; identical to SEQ ID NO: 90719

SEQ ID NO: 637165 - RNA, 64 nt, Homo Sapiens; identical to SEQ ID NO: 90720

SEQ ID NO: 637166 - RNA, 64 nt, Homo Sapiens; identical to SEQ ID NO: 90721

SEQ ID NO: 637167 - RNA, 64 nt, Homo Sapiens; identical to SEQ ID NO: 90722

SEQ ID NO: 637168 - RNA, 64 nt, Homo Sapiens; identical to SEQ ID NO: 90723

SEQ ID NO: 637169 - RNA, 64 nt, Homo Sapiens; identical to SEQ ID NO: 90724

SEQ ID NO: 637170 - RNA, 64 nt, Homo Sapiens; identical to SEQ ID NO: 90725

SEQ ID NO: 637171 - RNA, 64 nt, Homo Sapiens; identical to SEQ ID NO: 90726

SEQ ID NO: 637172 - RNA, 64 nt, Homo Sapiens; identical to SEQ ID NO: 90727

SEQ ID NO: 637173 - RNA, 64 nt, Homo Sapiens; identical to SEQ ID NO: 90728

SEQ ID NO: 637174 - RNA, 64 nt, Homo Sapiens; identical to SEQ ID NO: 90729

SEQ ID NO: 637175 - RNA, 64 nt, Homo Sapiens; identical to SEQ ID NO: 90730

SEQ ID NO: 637176 - RNA, 64 nt, Homo Sapiens; identical to SEQ ID NO: 90731

SEQ ID NO: 637177 - RNA, 64 nt, Homo Sapiens; identical to SEQ ID NO: 90732

SEQ ID NO: 637178 - RNA, 64 nt, Homo Sapiens; identical to SEQ ID NO: 90733

SEQ ID NO: 637179 - RNA, 64 nt, Homo Sapiens; identical to SEQ ID NO: 90734

SEQ ID NO: 637180 - RNA, 61 nt, Homo Sapiens
cucuuguuucucaggcugccugcagaagaagucgcuauaaauuaucuguugucuacauggu

SEQ ID NO: 637181 - RNA, 61 nt, Homo Sapiens
agguccuagagcuccaggacaaugauaagacucgcuauauggggaagggugucucaaagcc

SEQ ID NO: 637182 - RNA, 61 nt, Homo Sapiens
auaaaaacauuaauaagauaauaauuuuaugucgcuauaguaucuucaaaccaaggcagaa

SEQ ID NO: 637183 - RNA, 61 nt, Homo Sapiens
aacauaaauguauuauuaaccaugaagcugcucgcuauauuuuuggcauaacaaaauaaua

SEQ ID NO: 637184 - RNA, 61 nt, Homo Sapiens
aaaaauaguuaaaaugcugaaugaggaggccucgcuauagcaugauaaauuaugauaauau

SEQ ID NO: 637185 - RNA, 61 nt, Homo Sapiens
cucuucuuggcucguguagucuuuaaacauuucgcuauacugugcccggccacucucugua

SEQ ID NO: 637186 - RNA, 61 nt, Homo Sapiens
agucacugcacuggagucuacgagccggaacucgcuauaugcacguguguguguccguaug

SEQ ID NO: 637187 - RNA, 61 nt, Homo Sapiens
gaaggugaggccaguaaccaucucaugggauucgcuauaaucagccuauuugagcugcugg

SEQ ID NO: 637188 - RNA, 61 nt, Homo Sapiens
ccuccuuucuucagagaagccaguacuugaaucgcuauauuucuauuuuuuuuucccugua

SEQ ID NO: 637189 - RNA, 61 nt, Homo Sapiens
auaaugcauuaauaaaaugaauagauaucuaucgcuauagaaaaauauauauaaauauaua

SEQ ID NO: 637190 - RNA, 61 nt, Homo Sapiens
ggucccaccuaaagucccuaaccgggaggcaucgcuauacuccccuccuucaacucucccc

SEQ ID NO: 637191 - RNA, 61 nt, Homo Sapiens
gccuuuuuuucuucagagcuuguugucuuuuucgcuauauuagacuuugcaguaugcccag

SEQ ID NO: 637192 - RNA, 61 nt, Homo Sapiens
uuuuaccucaaaucaguccaucagucauauuucgcuauagacagucuaaucuagugacacc

SEQ ID NO: 637193 - RNA, 61 nt, Homo Sapiens
caucagaagcacauuuacugugcuaucuauaucgcuauauaaaaguguuuuauaaaaaccc

SEQ ID NO: 637194 - RNA, 61 nt, Homo Sapiens
aguucugacacauuuuccaugaaacaaaccaucgcuauauucaagauaaugaaccuaucua

SEQ ID NO: 637195 - RNA, 61 nt, Homo Sapiens
cauaggcccggcauggcugugggguguacacucgcuauaggccugggggauggccgugcau

SEQ ID NO: 637196 - RNA, 61 nt, Homo Sapiens
uaaaagguaacuguacaaaaaaaacccauuuucgcuauaaauuuguuacucuguaaaugaa

SEQ ID NO: 637197 - RNA, 61 nt, Homo Sapiens
aaguaucuaaaauuugggagacuuugaaucaucgcuauaucgcaacuuaaauauuugcuag

SEQ ID NO: 637198 - RNA, 64 nt, Homo Sapiens; identical to SEQ ID NO: 175212

SEQ ID NO: 637199 - RNA, 64 nt, Homo Sapiens; identical to SEQ ID NO: 175213

SEQ ID NO: 637200 - RNA, 64 nt, Homo Sapiens; identical to SEQ ID NO: 175214

SEQ ID NO: 637201 - RNA, 64 nt, Homo Sapiens; identical to SEQ ID NO: 175215

SEQ ID NO: 637202 - RNA, 64 nt, Homo Sapiens; identical to SEQ ID NO: 175216

SEQ ID NO: 637203 - RNA, 64 nt, Homo Sapiens; identical to SEQ ID NO: 175217

SEQ ID NO: 637204 - RNA, 64 nt, Homo Sapiens; identical to SEQ ID NO: 175218

SEQ ID NO: 637205 - RNA, 64 nt, Homo Sapiens; identical to SEQ ID NO: 175219

SEQ ID NO: 637206 - RNA, 64 nt, Homo Sapiens; identical to SEQ ID NO: 175220

SEQ ID NO: 637207 - RNA, 64 nt, Homo Sapiens; identical to SEQ ID NO: 175221

SEQ ID NO: 637208 - RNA, 64 nt, Homo Sapiens; identical to SEQ ID NO: 175222

SEQ ID NO: 637209 - RNA, 64 nt, Homo Sapiens; identical to SEQ ID NO: 175223

SEQ ID NO: 637210 - RNA, 64 nt, Homo Sapiens; identical to SEQ ID NO: 175224

SEQ ID NO: 637211 - RNA, 64 nt, Homo Sapiens; identical to SEQ ID NO: 175225

SEQ ID NO: 637212 - RNA, 64 nt, Homo Sapiens; identical to SEQ ID NO: 175226

SEQ ID NO: 637213 - RNA, 64 nt, Homo Sapiens; identical to SEQ ID NO: 175227

SEQ ID NO: 637214 - RNA, 64 nt, Homo Sapiens; identical to SEQ ID NO: 175228

SEQ ID NO: 637215 - RNA, 64 nt, Homo Sapiens; identical to SEQ ID NO: 175229

SEQ ID NO: 637216 - RNA, 64 nt, Homo Sapiens; identical to SEQ ID NO: 175230

SEQ ID NO: 637217 - RNA, 64 nt, Homo Sapiens; identical to SEQ ID NO: 175231

SEQ ID NO: 637218 - RNA, 64 nt, Homo Sapiens; identical to SEQ ID NO: 175232

SEQ ID NO: 637219 - RNA, 64 nt, Homo Sapiens; identical to SEQ ID NO: 175233

SEQ ID NO: 637220 - RNA, 64 nt, Homo Sapiens; identical to SEQ ID NO: 175234

SEQ ID NO: 637221 - RNA, 64 nt, Homo Sapiens; identical to SEQ ID NO: 175235

SEQ ID NO: 637222 - RNA, 64 nt, Homo Sapiens; identical to SEQ ID NO: 175236

SEQ ID NO: 637223 - RNA, 64 nt, Homo Sapiens; identical to SEQ ID NO: 97987

SEQ ID NO: 637224 - RNA, 64 nt, Homo Sapiens; identical to SEQ ID NO: 97988

SEQ ID NO: 637225 - RNA, 64 nt, Homo Sapiens; identical to SEQ ID NO: 97989

SEQ ID NO: 637226 - RNA, 64 nt, Homo Sapiens; identical to SEQ ID NO: 97990

SEQ ID NO: 637227 - RNA, 64 nt, Homo Sapiens; identical to SEQ ID NO: 97991

SEQ ID NO: 637228 - RNA, 64 nt, Homo Sapiens; identical to SEQ ID NO: 97992

SEQ ID NO: 637229 - RNA, 64 nt, Homo Sapiens; identical to SEQ ID NO: 97993

SEQ ID NO: 637230 - RNA, 64 nt, Homo Sapiens; identical to SEQ ID NO: 97994

SEQ ID NO: 637231 - RNA, 64 nt, Homo Sapiens; identical to SEQ ID NO: 97995

SEQ ID NO: 637232 - RNA, 64 nt, Homo Sapiens; identical to SEQ ID NO: 97996

SEQ ID NO: 637233 - RNA, 64 nt, Homo Sapiens; identical to SEQ ID NO: 97997

SEQ ID NO: 637234 - RNA, 64 nt, Homo Sapiens; identical to SEQ ID NO: 97998

SEQ ID NO: 637235 - RNA, 64 nt, Homo Sapiens; identical to SEQ ID NO: 97999

SEQ ID NO: 637236 - RNA, 64 nt, Homo Sapiens; identical to SEQ ID NO: 98000

SEQ ID NO: 637237 - RNA, 64 nt, Homo Sapiens; identical to SEQ ID NO: 98001

SEQ ID NO: 637238 - RNA, 64 nt, Homo Sapiens; identical to SEQ ID NO: 98002

SEQ ID NO: 637239 - RNA, 64 nt, Homo Sapiens; identical to SEQ ID NO: 98003

SEQ ID NO: 637240 - RNA, 64 nt, Homo Sapiens; identical to SEQ ID NO: 98004

SEQ ID NO: 637241 - RNA, 64 nt, Homo Sapiens; identical to SEQ ID NO: 98005

SEQ ID NO: 637242 - RNA, 64 nt, Homo Sapiens; identical to SEQ ID NO: 98006

SEQ ID NO: 637243 - RNA, 64 nt, Homo Sapiens; identical to SEQ ID NO: 98007

SEQ ID NO: 637244 - RNA, 64 nt, Homo Sapiens; identical to SEQ ID NO: 98008

SEQ ID NO: 637245 - RNA, 53 nt, Homo Sapiens; identical to SEQ ID NO: 98009

SEQ ID NO: 637246 - RNA, 64 nt, Homo Sapiens; identical to SEQ ID NO: 98010

SEQ ID NO: 637247 - RNA, 64 nt, Homo Sapiens; identical to SEQ ID NO: 164628

SEQ ID NO: 637248 - RNA, 64 nt, Homo Sapiens; identical to SEQ ID NO: 164629

SEQ ID NO: 637249 - RNA, 64 nt, Homo Sapiens; identical to SEQ ID NO: 164630

SEQ ID NO: 637250 - RNA, 64 nt, Homo Sapiens; identical to SEQ ID NO: 164631

SEQ ID NO: 637251 - RNA, 64 nt, Homo Sapiens; identical to SEQ ID NO: 164632

SEQ ID NO: 637252 - RNA, 64 nt, Homo Sapiens; identical to SEQ ID NO: 164633

SEQ ID NO: 637253 - RNA, 64 nt, Homo Sapiens; identical to SEQ ID NO: 164634

SEQ ID NO: 637254 - RNA, 64 nt, Homo Sapiens; identical to SEQ ID NO: 164635

SEQ ID NO: 637255 - RNA, 64 nt, Homo Sapiens; identical to SEQ ID NO: 164636

SEQ ID NO: 637256 - RNA, 64 nt, Homo Sapiens; identical to SEQ ID NO: 164637

SEQ ID NO: 637257 - RNA, 64 nt, Homo Sapiens; identical to SEQ ID NO: 164638

SEQ ID NO: 637258 - RNA, 64 nt, Homo Sapiens; identical to SEQ ID NO: 164639

SEQ ID NO: 637259 - RNA, 64 nt, Homo Sapiens; identical to SEQ ID NO: 164640

SEQ ID NO: 637260 - RNA, 64 nt, Homo Sapiens; identical to SEQ ID NO: 164641

SEQ ID NO: 637261 - RNA, 64 nt, Homo Sapiens; identical to SEQ ID NO: 164642

SEQ ID NO: 637262 - RNA, 64 nt, Homo Sapiens; identical to SEQ ID NO: 164643

SEQ ID NO: 637263 - RNA, 64 nt, Homo Sapiens; identical to SEQ ID NO: 286103

SEQ ID NO: 637264 - RNA, 64 nt, Homo Sapiens; identical to SEQ ID NO: 286104

SEQ ID NO: 637265 - RNA, 64 nt, Homo Sapiens; identical to SEQ ID NO: 286105

SEQ ID NO: 637266 - RNA, 64 nt, Homo Sapiens; identical to SEQ ID NO: 286106

SEQ ID NO: 637267 - RNA, 64 nt, Homo Sapiens; identical to SEQ ID NO: 286107

SEQ ID NO: 637268 - RNA, 64 nt, Homo Sapiens; identical to SEQ ID NO: 286108

SEQ ID NO: 637269 - RNA, 64 nt, Homo Sapiens; identical to SEQ ID NO: 286109

SEQ ID NO: 637270 - RNA, 64 nt, Homo Sapiens; identical to SEQ ID NO: 286110

SEQ ID NO: 637271 - RNA, 64 nt, Homo Sapiens; identical to SEQ ID NO: 286111

SEQ ID NO: 637272 - RNA, 64 nt, Homo Sapiens; identical to SEQ ID NO: 286112

SEQ ID NO: 637273 - RNA, 64 nt, Homo Sapiens; identical to SEQ ID NO: 286113

SEQ ID NO: 637274 - RNA, 64 nt, Homo Sapiens; identical to SEQ ID NO: 286114

SEQ ID NO: 637275 - RNA, 64 nt, Homo Sapiens; identical to SEQ ID NO: 286115

SEQ ID NO: 637276 - RNA, 64 nt, Homo Sapiens; identical to SEQ ID NO: 286116

SEQ ID NO: 637277 - RNA, 64 nt, Homo Sapiens; identical to SEQ ID NO: 286117

SEQ ID NO: 637278 - RNA, 64 nt, Homo Sapiens; identical to SEQ ID NO: 286118

SEQ ID NO: 637279 - RNA, 64 nt, Homo Sapiens; identical to SEQ ID NO: 286119

SEQ ID NO: 637280 - RNA, 64 nt, Homo Sapiens; identical to SEQ ID NO: 286120

SEQ ID NO: 637281 - RNA, 64 nt, Homo Sapiens; identical to SEQ ID NO: 286121

SEQ ID NO: 637282 - RNA, 64 nt, Homo Sapiens; identical to SEQ ID NO: 286122

SEQ ID NO: 637283 - RNA, 64 nt, Homo Sapiens; identical to SEQ ID NO: 286123

SEQ ID NO: 637284 - RNA, 64 nt, Homo Sapiens; identical to SEQ ID NO: 286124

SEQ ID NO: 637285 - RNA, 64 nt, Homo Sapiens; identical to SEQ ID NO: 288178

SEQ ID NO: 637286 - RNA, 64 nt, Homo Sapiens; identical to SEQ ID NO: 288179

SEQ ID NO: 637287 - RNA, 64 nt, Homo Sapiens; identical to SEQ ID NO: 288180

SEQ ID NO: 637288 - RNA, 64 nt, Homo Sapiens; identical to SEQ ID NO: 288181

SEQ ID NO: 637289 - RNA, 64 nt, Homo Sapiens; identical to SEQ ID NO: 288182

SEQ ID NO: 637290 - RNA, 64 nt, Homo Sapiens; identical to SEQ ID NO: 288183

SEQ ID NO: 637291 - RNA, 64 nt, Homo Sapiens; identical to SEQ ID NO: 288184

SEQ ID NO: 637292 - RNA, 64 nt, Homo Sapiens; identical to SEQ ID NO: 288185

SEQ ID NO: 637293 - RNA, 64 nt, Homo Sapiens; identical to SEQ ID NO: 288186

SEQ ID NO: 637294 - RNA, 64 nt, Homo Sapiens; identical to SEQ ID NO: 288187

SEQ ID NO: 637295 - RNA, 64 nt, Homo Sapiens; identical to SEQ ID NO: 288188

SEQ ID NO: 637296 - RNA, 64 nt, Homo Sapiens; identical to SEQ ID NO: 288189

SEQ ID NO: 637297 - RNA, 64 nt, Homo Sapiens; identical to SEQ ID NO: 288190

SEQ ID NO: 637298 - RNA, 64 nt, Homo Sapiens; identical to SEQ ID NO: 288191

SEQ ID NO: 637299 - RNA, 64 nt, Homo Sapiens; identical to SEQ ID NO: 288192

SEQ ID NO: 637300 - RNA, 64 nt, Homo Sapiens; identical to SEQ ID NO: 288193

SEQ ID NO: 637301 - RNA, 64 nt, Homo Sapiens; identical to SEQ ID NO: 288194

SEQ ID NO: 637302 - RNA, 64 nt, Homo Sapiens; identical to SEQ ID NO: 288195

SEQ ID NO: 637303 - RNA, 64 nt, Homo Sapiens
aagauauucuugguaguaacugacaaguauguugcacauguauugggggaggcgcuucauuuuu

SEQ ID NO: 637304 - RNA, 64 nt, Homo Sapiens
guauugggggaggcgcuucauuuuuauuuuaauacacauguauuuccuccuugcacaggauuuu

SEQ ID NO: 637305 - RNA, 64 nt, Homo Sapiens
cuagaacuuaaaguauauaaaccugcacguugugcacauguacccauguauucauauguaacaa

SEQ ID NO: 637306 - RNA, 64 nt, Homo Sapiens
cauauguaacaaaccugcacgccaaccaaccuggcacauguauuaugacgaguuaaugggugca

SEQ ID NO: 637307 - RNA, 64 nt, Homo Sapiens
uaugaaaagaaaacacuguauuccuuaugcaaaacacauguaucuuucauuauuuauaaguggc

SEQ ID NO: 637308 - RNA, 64 nt, Homo Sapiens
uguguaccaccccauauauuucauauuacuguuucacauguacagcuuucuacuucuuuguaag

SEQ ID NO: 637309 - RNA, 64 nt, Homo Sapiens
cuaaaacuuaaaguauaauuaccugcacguugugcacauguacccauguauacauauguagcua

SEQ ID NO: 637310 - RNA, 64 nt, Homo Sapiens
cauauguagcuaaccugcacgcacgccaacauggcacauguauaaugacgaguuacuggaugca

SEQ ID NO: 637311 - RNA, 64 nt, Homo Sapiens
uugguaagagugacuaaccagccuaacuuuaauacacauguauaaagauguucacagagaaaga

SEQ ID NO: 637312 - RNA, 64 nt, Homo Sapiens
uagaggacagacugauaguuucuuucuuucauaucacauguauagagaaauaauuauaucagaa

SEQ ID NO: 637313 - RNA, 64 nt, Homo Sapiens
gagcuggucuucugcauuuaaacccuaaaauacccacauguauuaacccaucacuucugguguu

SEQ ID NO: 637314 - RNA, 64 nt, Homo Sapiens
uuugugccuuacaccuugagaauagccuguuuuccacauguaaauucgugggguuacaucugug

SEQ ID NO: 637315 - RNA, 64 nt, Homo Sapiens
aaguuguguaugugugugcacaucugagcacgugcacauguacaccugagccaaaaacacgaga

SEQ ID NO: 637316 - RNA, 64 nt, Homo Sapiens
auugaucauuuagacuauucuggcuaagucugcccacauguaauuaccggcuaauucaagcgag

SEQ ID NO: 637317 - RNA, 64 nt, Homo Sapiens
cuagaacuuaaaaaaaaaaaaucugcacguugugcacauguacccauguauacauauguaacaa

SEQ ID NO: 637318 - RNA, 64 nt, Homo Sapiens
cauauguaacaaaucugcacgcacaccaacauggcacauguauaaugacgaguuaaugggugca

SEQ ID NO: 637319 - RNA, 64 nt, Homo Sapiens
uauccacagaauaugggaagcucuagcuaccaugcacauguacagagauacucugguggaggga

SEQ ID NO: 637320 - RNA, 64 nt, Homo Sapiens
ccauaaccaccaaaaauacugcaugagcuggccacacauguaaucagccccugcucaagaaaaa

SEQ ID NO: 637321 - RNA, 64 nt, Homo Sapiens
acgugugauacacacaugcauguacagguaagcacacauguacaagcuccuacaggcuugcucu

SEQ ID NO: 637322 - RNA, 64 nt, Homo Sapiens
gucucccacacgugagcucccacacguacacaugcacauguacgcaccacaaacacaugcgcag

SEQ ID NO: 637323 - RNA, 64 nt, Homo Sapiens
ccagaacuuaaaguauaauaaccugcacauucagcacauguauccauguauaccuguguaacaa

SEQ ID NO: 637324 - RNA, 64 nt, Homo Sapiens
ccuguguaacaaaccugcacgcaaaguaccauggcacauguauaaugauggguugaugggugca

SEQ ID NO: 637325 - RNA, 64 nt, Homo Sapiens
uuuauaugcagugaauuguucaugugcacauguacacauguacagagucaugaaauacuuaaca

SEQ ID NO: 637326 - RNA, 64 nt, Homo Sapiens
cauguacauuuauaugcaguacuuaacacaugugcacauguacaaaaggcuugagucaugaaau

SEQ ID NO: 637327 - RNA, 64 nt, Homo Sapiens
aagaauuuggugaauuuuaaagaggaacaagaugacaucugagcucacacucaguguuugcacu

SEQ ID NO: 637328 - RNA, 64 nt, Homo Sapiens
uuguguaagaaggagcccuagacugaaagucaagacaucugaauuucaggcuggaaaacuauca

SEQ ID NO: 637329 - RNA, 64 nt, Homo Sapiens
uccucaaguugcuacgguucagugagagaggcagacaucugaacaggcagguaggauucagugu

SEQ ID NO: 637330 - RNA, 64 nt, Homo Sapiens
cuuagaggaagagaagaaacauggcaagcagauuacaucugagccguuugaauuguguuuuucu

SEQ ID NO: 637331 - RNA, 64 nt, Homo Sapiens
uaaacuuaugugauguucuguuaacauugcuguuacaucugaaaaagaauuaaacuugucaauu

SEQ ID NO: 637332 - RNA, 64 nt, Homo Sapiens
uauucauguuuuccuuuuguuuguaagaugggagacaucugaaagcuuugacagauugauaacu

SEQ ID NO: 637333 - RNA, 64 nt, Homo Sapiens
augugaaaccaagaaauguaaucaagcaguaaaaacaucugaauguagaccaugaucucaaguu

SEQ ID NO: 637334 - RNA, 64 nt, Homo Sapiens
aacaaaauuauguuaauaaauauucccacauaauacaucugaaugguuaaaaauacuggaagag

SEQ ID NO: 637335 - RNA, 64 nt, Homo Sapiens
agaguauacauugcuauuaugggagaccacccagacaucugacuaauggcucugugcccacacu

SEQ ID NO: 637336 - RNA, 64 nt, Homo Sapiens
ugcucacgaugaguuuaguguguaaaguuuagagacaucugacuuugauagcuaaauuaaacca

SEQ ID NO: 637337 - RNA, 64 nt, Homo Sapiens
ggcuugaaaugcccuacaggcccagaacuuucucacaucugaaauggaggcauugcaaugaaaa

SEQ ID NO: 637338 - RNA, 64 nt, Homo Sapiens
aucagacaaauccacauuaggggcauucugcuaaacaucugacccagacucuucaaaaaugaag

SEQ ID NO: 637339 - RNA, 64 nt, Homo Sapiens
guuucucaaauuaucuucccuucucuuggggacaacaucugaaggguauguugcaugcauuuuu

SEQ ID NO: 637340 - RNA, 64 nt, Homo Sapiens
cucuggaccauccuggcuggaaacuuggcuguagacaucugaagagggugcaccuuuucucuuu

SEQ ID NO: 637341 - RNA, 64 nt, Homo Sapiens
aggcuaaacuguugaugaauaagucaaauaaucaacacuaaaggggcucuuccauuuugcagau

SEQ ID NO: 637342 - RNA, 64 nt, Homo Sapiens
cugcucuagauaaacugcuccuguacacaucacuacacuaaacauuagauuaauauggccaacc

SEQ ID NO: 637343 - RNA, 64 nt, Homo Sapiens
gguuucaccugaucauauaguuuugcaagauuuaacacuaaaaauuauuuaauggccaaauggu

SEQ ID NO: 637344 - RNA, 64 nt, Homo Sapiens
gcaggugguucuaauauuuuuaguuuauuuuguuacacuaaaggauuaaguaaaccaaaaaggc

SEQ ID NO: 637345 - RNA, 64 nt, Homo Sapiens
augaacaaauuuucgguuacagaucagcucucaaacacuaaaguccuuaauggcaaggucuuuu

SEQ ID NO: 637346 - RNA, 64 nt, Homo Sapiens
ugaaccagaggacauacuagucacauguuauuauacacuaaaaaauaggaagucaucuugaaag

SEQ ID NO: 637347 - RNA, 64 nt, Homo Sapiens
augucucauuuugcaguaacuccuacaguguguaacacuaaaaauaagaacuaaugauggcuaa

SEQ ID NO: 637348 - RNA, 64 nt, Homo Sapiens
uguaacacuaaaaauaagaacuaaugauggcuaaacacuaaaguagccauucauacuuaugcau

SEQ ID NO: 637349 - RNA, 64 nt, Homo Sapiens
guacuaauuguacaaaggucuuguacucuaaaagacacuaaauuagcuuuuaaaagacacuaaa

SEQ ID NO: 637350 - RNA, 64 nt, Homo Sapiens
guacucuaaaagacacuaaagaagcuuuuaaaagacacuaaauuaaaauguuuuaaauauuuag

SEQ ID NO: 637351 - RNA, 64 nt, Homo Sapiens
auauugaaacuucaucuagucucuuaauuuuuuaacacuaaauucaagucauuuguuuuaaguc

SEQ ID NO: 637352 - RNA, 64 nt, Homo Sapiens
cauccauucauaugcauggggucugaucgcaaauacacuaaauguggaguguaggaaccaaaau

SEQ ID NO: 637353 - RNA, 64 nt, Homo Sapiens
cuucuugcuuuugcauuauagcuguacaguucguacacuaaacuaagauagagcuacaaacuca

SEQ ID NO: 637354 - RNA, 64 nt, Homo Sapiens
cauguugaucuauaauuacaaaauaaaagaauagacacuaaaaugcugcguuccuaauuuagua

SEQ ID NO: 637355 - RNA, 64 nt, Homo Sapiens
cuagaaaguacuuuggccuccucaguuuuacgcaacacuaaauugcagcuaaagaugagagggg

SEQ ID NO: 637356 - RNA, 64 nt, Homo Sapiens
cuggguuacauaugccuccagugcucuauagcagacacuaaagagagccauaugacaagccuuu

SEQ ID NO: 637357 - RNA, 64 nt, Homo Sapiens
cuaagcacugucuuaagagguaggcuaucuuggcacacuaaauguauauacauacauacaaaca

SEQ ID NO: 637358 - RNA, 64 nt, Homo Sapiens
uugcaagucaaguaaccaaaaugcaugaaacccaacacuaaauugagauuugaaguuuggggcu

SEQ ID NO: 637359 - RNA, 64 nt, Homo Sapiens
uuucuuccucuuuggacugaagcuucuuauaguaacacuaaaacgcuaacauuuucagagauac

SEQ ID NO: 637360 - RNA, 64 nt, Homo Sapiens
uuccucagucugauuaauuuuuuaagccaguuuuacacuaaaugaaauucugcugacaaaaaau

SEQ ID NO: 637361 - RNA, 64 nt, Homo Sapiens
uaggugacauggugacaucuaucccuuuauuuugacacuaaaacauggacacaacuagaaagag

SEQ ID NO: 637362 - RNA, 64 nt, Homo Sapiens
uugaaaguauuuguuaauuaucugcuuaguauuaacacuaaauuuguagaaugacuuucagguu

SEQ ID NO: 637363 - RNA, 64 nt, Homo Sapiens
aaagcuaaaauggcuuaacaucaugcuacacuuuacacuaaaaaucuauuacugugaguggucu

SEQ ID NO: 637364 - RNA, 64 nt, Homo Sapiens
uaaucugagggaaaacauguucagggcuucuagaacacuaaaaaauuuggcuuaaaccaguguu

SEQ ID NO: 637365 - RNA, 64 nt, Homo Sapiens; identical to SEQ ID NO: 335989

SEQ ID NO: 637366 - RNA, 64 nt, Homo Sapiens; identical to SEQ ID NO: 335990

SEQ ID NO: 637367 - RNA, 64 nt, Homo Sapiens; identical to SEQ ID NO: 335991

SEQ ID NO: 637368 - RNA, 64 nt, Homo Sapiens; identical to SEQ ID NO: 335992

SEQ ID NO: 637369 - RNA, 64 nt, Homo Sapiens; identical to SEQ ID NO: 335993

SEQ ID NO: 637370 - RNA, 64 nt, Homo Sapiens; identical to SEQ ID NO: 335994

SEQ ID NO: 637371 - RNA, 64 nt, Homo Sapiens; identical to SEQ ID NO: 335995

SEQ ID NO: 637372 - RNA, 64 nt, Homo Sapiens; identical to SEQ ID NO: 335996

SEQ ID NO: 637373 - RNA, 62 nt, Homo Sapiens; identical to SEQ ID NO: 335997

SEQ ID NO: 637374 - RNA, 64 nt, Homo Sapiens; identical to SEQ ID NO: 335998

SEQ ID NO: 637375 - RNA, 64 nt, Homo Sapiens; identical to SEQ ID NO: 335999

SEQ ID NO: 637376 - RNA, 64 nt, Homo Sapiens; identical to SEQ ID NO: 336000

SEQ ID NO: 637377 - RNA, 64 nt, Homo Sapiens; identical to SEQ ID NO: 336001

SEQ ID NO: 637378 - RNA, 64 nt, Homo Sapiens; identical to SEQ ID NO: 336002

SEQ ID NO: 637379 - RNA, 64 nt, Homo Sapiens; identical to SEQ ID NO: 336003

SEQ ID NO: 637380 - RNA, 64 nt, Homo Sapiens; identical to SEQ ID NO: 336004

SEQ ID NO: 637381 - RNA, 64 nt, Homo Sapiens; identical to SEQ ID NO: 336005

SEQ ID NO: 637382 - RNA, 64 nt, Homo Sapiens; identical to SEQ ID NO: 336006

SEQ ID NO: 637383 - RNA, 64 nt, Homo Sapiens; identical to SEQ ID NO: 336007

SEQ ID NO: 637384 - RNA, 64 nt, Homo Sapiens; identical to SEQ ID NO: 336008

SEQ ID NO: 637385 - RNA, 64 nt, Homo Sapiens; identical to SEQ ID NO: 336009

SEQ ID NO: 637386 - RNA, 64 nt, Homo Sapiens; identical to SEQ ID NO: 336010

SEQ ID NO: 637387 - RNA, 64 nt, Homo Sapiens; identical to SEQ ID NO: 336011

SEQ ID NO: 637388 - RNA, 64 nt, Homo Sapiens; identical to SEQ ID NO: 336012

SEQ ID NO: 637389 - RNA, 64 nt, Homo Sapiens; identical to SEQ ID NO: 336013

SEQ ID NO: 637390 - RNA, 64 nt, Homo Sapiens; identical to SEQ ID NO: 336014

SEQ ID NO: 637391 - RNA, 64 nt, Homo Sapiens; identical to SEQ ID NO: 336015

SEQ ID NO: 637392 - RNA, 64 nt, Homo Sapiens; identical to SEQ ID NO: 336016

SEQ ID NO: 637393 - RNA, 64 nt, Homo Sapiens; identical to SEQ ID NO: 336017

SEQ ID NO: 637394 - RNA, 64 nt, Homo Sapiens; identical to SEQ ID NO: 336018

SEQ ID NO: 637395 - RNA, 64 nt, Homo Sapiens; identical to SEQ ID NO: 336019

SEQ ID NO: 637396 - RNA, 64 nt, Homo Sapiens; identical to SEQ ID NO: 336020

SEQ ID NO: 637397 - RNA, 64 nt, Homo Sapiens; identical to SEQ ID NO: 336021

SEQ ID NO: 637398 - RNA, 64 nt, Homo Sapiens; identical to SEQ ID NO: 336022

SEQ ID NO: 637399 - RNA, 64 nt, Homo Sapiens; identical to SEQ ID NO: 336023

SEQ ID NO: 637400 - RNA, 64 nt, Homo Sapiens; identical to SEQ ID NO: 336024

SEQ ID NO: 637401 - RNA, 64 nt, Homo Sapiens; identical to SEQ ID NO: 336025

SEQ ID NO: 637402 - RNA, 64 nt, Homo Sapiens; identical to SEQ ID NO: 336026

SEQ ID NO: 637403 - RNA, 64 nt, Homo Sapiens; identical to SEQ ID NO: 336027

SEQ ID NO: 637404 - RNA, 64 nt, Homo Sapiens; identical to SEQ ID NO: 336028

SEQ ID NO: 637405 - RNA, 64 nt, Homo Sapiens; identical to SEQ ID NO: 95656

SEQ ID NO: 637406 - RNA, 64 nt, Homo Sapiens; identical to SEQ ID NO: 95657

SEQ ID NO: 637407 - RNA, 64 nt, Homo Sapiens; identical to SEQ ID NO: 95658

SEQ ID NO: 637408 - RNA, 64 nt, Homo Sapiens; identical to SEQ ID NO: 95659

SEQ ID NO: 637409 - RNA, 64 nt, Homo Sapiens; identical to SEQ ID NO: 95660

SEQ ID NO: 637410 - RNA, 64 nt, Homo Sapiens; identical to SEQ ID NO: 95661

SEQ ID NO: 637411 - RNA, 64 nt, Homo Sapiens; identical to SEQ ID NO: 95662

SEQ ID NO: 637412 - RNA, 64 nt, Homo Sapiens; identical to SEQ ID NO: 95663

SEQ ID NO: 637413 - RNA, 64 nt, Homo Sapiens; identical to SEQ ID NO: 95664

SEQ ID NO: 637414 - RNA, 64 nt, Homo Sapiens; identical to SEQ ID NO: 95665

SEQ ID NO: 637415 - RNA, 64 nt, Homo Sapiens; identical to SEQ ID NO: 95666

SEQ ID NO: 637416 - RNA, 64 nt, Homo Sapiens; identical to SEQ ID NO: 95667

SEQ ID NO: 637417 - RNA, 64 nt, Homo Sapiens; identical to SEQ ID NO: 95668

SEQ ID NO: 637418 - RNA, 64 nt, Homo Sapiens; identical to SEQ ID NO: 95669

SEQ ID NO: 637419 - RNA, 64 nt, Homo Sapiens; identical to SEQ ID NO: 95670

SEQ ID NO: 637420 - RNA, 64 nt, Homo Sapiens; identical to SEQ ID NO: 95671

SEQ ID NO: 637421 - RNA, 64 nt, Homo Sapiens; identical to SEQ ID NO: 95672

SEQ ID NO: 637422 - RNA, 64 nt, Homo Sapiens; identical to SEQ ID NO: 95673

SEQ ID NO: 637423 - RNA, 64 nt, Homo Sapiens; identical to SEQ ID NO: 95674

SEQ ID NO: 637424 - RNA, 64 nt, Homo Sapiens; identical to SEQ ID NO: 95675

SEQ ID NO: 637425 - RNA, 64 nt, Homo Sapiens; identical to SEQ ID NO: 95676

SEQ ID NO: 637426 - RNA, 64 nt, Homo Sapiens; identical to SEQ ID NO: 95677

SEQ ID NO: 637427 - RNA, 64 nt, Homo Sapiens; identical to SEQ ID NO: 95678

SEQ ID NO: 637428 - RNA, 64 nt, Homo Sapiens; identical to SEQ ID NO: 95679

SEQ ID NO: 637429 - RNA, 64 nt, Homo Sapiens; identical to SEQ ID NO: 95680

SEQ ID NO: 637430 - RNA, 64 nt, Homo Sapiens; identical to SEQ ID NO: 95681

SEQ ID NO: 637431 - RNA, 64 nt, Homo Sapiens; identical to SEQ ID NO: 95682

SEQ ID NO: 637432 - RNA, 64 nt, Homo Sapiens; identical to SEQ ID NO: 95683

SEQ ID NO: 637433 - RNA, 64 nt, Homo Sapiens; identical to SEQ ID NO: 95684

SEQ ID NO: 637434 - RNA, 64 nt, Homo Sapiens; identical to SEQ ID NO: 95685

SEQ ID NO: 637435 - RNA, 64 nt, Homo Sapiens; identical to SEQ ID NO: 95686

SEQ ID NO: 637436 - RNA, 64 nt, Homo Sapiens; identical to SEQ ID NO: 95687

SEQ ID NO: 637437 - RNA, 64 nt, Homo Sapiens; identical to SEQ ID NO: 95688

SEQ ID NO: 637438 - RNA, 64 nt, Homo Sapiens
aaucuugcuuaaauuuugucgagugaaaaguuggaacgcauauagacaguguagaagaauuccu

SEQ ID NO: 637439 - RNA, 64 nt, Homo Sapiens
auucugugauacagccauucaccgugaacuuucuaacgcauaauuuuuagagcuagguauagug

SEQ ID NO: 637440 - RNA, 64 nt, Homo Sapiens
cuauaggaagccagguuuaccagucugggcaaagaacgcauauucuucaaauguuaagaaauaa

SEQ ID NO: 637441 - RNA, 64 nt, Homo Sapiens
ggaguugugggggaauaaugugcauuucagucucaacgcauagauaaauuuaggggaauuggau

SEQ ID NO: 637442 - RNA, 64 nt, Homo Sapiens
cuaacaucaccauuaaaaggcaggaaagaucaaaaacgcauaccuaaaugcccacaagggaaag

SEQ ID NO: 637443 - RNA, 64 nt, Homo Sapiens
aaauaaauuaaagguacaaaaagcaagacuuacuaacgcauauccaaccaaaagccaaaaacca

SEQ ID NO: 637444 - RNA, 64 nt, Homo Sapiens
uaucucugaugugccauuggaaaugugaaaguacaacgcauauuguugaguggcacaaccuugu

SEQ ID NO: 637445 - RNA, 64 nt, Homo Sapiens
gacagcacgcuuuacuuagugggauuuuguuuugaacgcauauucauaagcuaauaccacugua

SEQ ID NO: 637446 - RNA, 64 nt, Homo Sapiens
ucccauuauaacagugaacagagcuccagguaauaacgcauaggcaugucagguugcaucugua

SEQ ID NO: 637447 - RNA, 64 nt, Homo Sapiens
aaaagaaucuccuuuggaagucuguucuuggaacaacgcauaggcccagccugaugccaccucc

SEQ ID NO: 637448 - RNA, 64 nt, Homo Sapiens
uauaacuugggcuuuguagcuuuuauuuauucagaacgcauacggcauguuaaugacucugaug

SEQ ID NO: 637449 - RNA, 64 nt, Homo Sapiens
caaaauauuuaccuucuacgauacaacuaauguuaacgcauaaaguaucuuacugguaacaaaa

SEQ ID NO: 637450 - RNA, 64 nt, Homo Sapiens
gaaaaauggccgggccaggucaggaaaaaaaaacaacgcauaaagcugugcaggcaaaaccuag

SEQ ID NO: 637451 - RNA, 64 nt, Homo Sapiens; identical to SEQ ID NO: 201839

SEQ ID NO: 637452 - RNA, 64 nt, Homo Sapiens; identical to SEQ ID NO: 201840

SEQ ID NO: 637453 - RNA, 64 nt, Homo Sapiens; identical to SEQ ID NO: 201841

SEQ ID NO: 637454 - RNA, 64 nt, Homo Sapiens; identical to SEQ ID NO: 201842

SEQ ID NO: 637455 - RNA, 64 nt, Homo Sapiens; identical to SEQ ID NO: 201843

SEQ ID NO: 637456 - RNA, 64 nt, Homo Sapiens; identical to SEQ ID NO: 201844

SEQ ID NO: 637457 - RNA, 64 nt, Homo Sapiens; identical to SEQ ID NO: 201845

SEQ ID NO: 637458 - RNA, 64 nt, Homo Sapiens; identical to SEQ ID NO: 201846

SEQ ID NO: 637459 - RNA, 64 nt, Homo Sapiens
gagaaucucguuaguagcauguggccuaacaaaaggaaaaaauguuuuuaaacacacacacaca

SEQ ID NO: 637460 - RNA, 64 nt, Homo Sapiens
gggaggagacaucuggccuuuuuagaaccugagaggaaaaaaagagucuuuuuuuccccucugu

SEQ ID NO: 637461 - RNA, 64 nt, Homo Sapiens
agacgucaccaagaaaacaugcaacucaaacgacggaaaaaaaaagggaaugggaaaaaagaaa

SEQ ID NO: 637462 - RNA, 64 nt, Homo Sapiens
augcaacucaaacgacggaaaaaaaaagggaaugggaaaaaagaaaacagauccugggaggggg

SEQ ID NO: 637463 - RNA, 64 nt, Homo Sapiens
gaaagcuaucuaccuauccugagucuaucuuaaaggaaaaaaagaaaaaaaccuuaucucuugc

SEQ ID NO: 637464 - RNA, 64 nt, Homo Sapiens
cacucuuucauuaauuuguuuuaagcuccguguuggaaaaaagggguagugcauuuuaaauuga

SEQ ID NO: 637465 - RNA, 64 nt, Homo Sapiens
uacuaacuccaguuuuacuauuauuauuuugguuggaaaaaaaauucacucuuuacgugcuaau

SEQ ID NO: 637466 - RNA, 64 nt, Homo Sapiens
uccucucguaucucaccccaaaccccaaacugggggaaaaaaaguuaacucuuugugaauggaa

SEQ ID NO: 637467 - RNA, 64 nt, Homo Sapiens
uugcacuuucugguaaaaaguuaaaaauuuuuaaggaaaaaauaauuucaaugguuaaaguuuu

SEQ ID NO: 637468 - RNA, 64 nt, Homo Sapiens
guuuacauuuaaagaucauuugcaccuuuuucaaggaaaaaaaguauugaguaaacaauuguuu

SEQ ID NO: 637469 - RNA, 64 nt, Homo Sapiens
uugacaagcuuuauuaaguugagagagagagaggggaaaaaaaaaagccuuucguaguucagua

SEQ ID NO: 637470 - RNA, 64 nt, Homo Sapiens
gaaaauacaaaauacccaagauuuaagaccggggggaaaaaaccacaaauugguaaauaaaggu

SEQ ID NO: 637471 - RNA, 64 nt, Homo Sapiens
ccuaaguaaucccagaacaauggcuauucaugugggaaaaaaagaaauuuuacuuucucucacc

SEQ ID NO: 637472 - RNA, 64 nt, Homo Sapiens
ccucacaauaagaaugaaucucagaaaauauuaaggaaaaaagcaaguuugaagagaccacaug

SEQ ID NO: 637473 - RNA, 64 nt, Homo Sapiens
aaaaguaaaacaaagacaaaucaccaucccaugaggaaaaaaaaccaucuacgccauauaccca

SEQ ID NO: 637474 - RNA, 64 nt, Homo Sapiens
cuuuggaaauagauugaaaauuaccccaagggcaggaaaaaagucugcacagcggcagcaagga

SEQ ID NO: 637475 - RNA, 64 nt, Homo Sapiens
caucaaaucaaauagaaucuagaccuguuaauggggaaaaaauauuauugcuuucuuuuauggu

SEQ ID NO: 637476 - RNA, 64 nt, Homo Sapiens
caaaacuuuauaccaaugauucuuuaaacuaucaggaaaaaaaccuguuuuuguacuuuacuaa

SEQ ID NO: 637477 - RNA, 64 nt, Homo Sapiens
aauuaaaaaaaaaaugcaagguggaauacggugaggaaaaaaaaccuuccccagccacagguau

SEQ ID NO: 637478 - RNA, 64 nt, Homo Sapiens
agaugggguaagaaaacuacgcguuaauuauugaggaaaaaaaauuucaaacaaugguuucucu

SEQ ID NO: 637479 - RNA, 64 nt, Homo Sapiens
aaaccgaagccaguauuuuauaggaaauuugaaaggaaaaaaagacaaauauguaaagcaauug

SEQ ID NO: 637480 - RNA, 64 nt, Homo Sapiens
caccuuguggcauuaagucuuuaauuacucuuggggaaaaaagagaaucaugggcuugauugaa

SEQ ID NO: 637481 - RNA, 64 nt, Homo Sapiens
uuuuaacugaaauauuuauugacuucaugcaaauggaaaaaaagguaggagauauagugaccca

SEQ ID NO: 637482 - RNA, 64 nt, Homo Sapiens
aauugcaucacacuaauuacaaaauacaaguucuggaaaaaauauuuuucuucauuuuaaaacu

SEQ ID NO: 637483 - RNA, 64 nt, Homo Sapiens
uguuuaacuggaguugucaaguaugagucccucaggaaaaaaaaaaaauucuguuuuaaaaagc

SEQ ID NO: 637484 - RNA, 64 nt, Homo Sapiens
aaggauggagaaaaaucuaggacagugucuucucggaaaaaaccagccuugaagguaaugaaac

SEQ ID NO: 637485 - RNA, 64 nt, Homo Sapiens
ugaugagaaggauucuuuuucgaauauaaccagaggaaaaaaggauggagaaauaucuaggaaa

SEQ ID NO: 637486 - RNA, 64 nt, Homo Sapiens
uucugagaaaccaccaggcuugaagugucuucucggaaaaaaccauccuuggagguaaugaaac

SEQ ID NO: 637487 - RNA, 64 nt, Homo Sapiens
agcuuguuuauauuucauacuuuuuauacuuugaggaaaaaaagucaaagaaaaauuguauuug

SEQ ID NO: 637488 - RNA, 64 nt, Homo Sapiens
gaggaaaaaaagucaaagaaaaauuguauuugagggaaaaaaccaugaccaaguaaaggauaaa

SEQ ID NO: 637489 - RNA, 64 nt, Homo Sapiens
cgacccgccgaccuucagcuuugugggacuaucaggaaaaaacaaaacaaaaacaaaauguaga

SEQ ID NO: 637490 - RNA, 64 nt, Homo Sapiens
uauugagaauguuaacuuauugcuuuguaucuugggaaaaaaacuuuguaaauaaguuauaaag

SEQ ID NO: 637491 - RNA, 64 nt, Homo Sapiens
aaaaaaaccaauguuuugcagaaagaaaaaaaaaggaaaaaaaauucauaugcaguaaaagaaa

SEQ ID NO: 637492 - RNA, 64 nt, Homo Sapiens
aagacaggcugccacaguauccuuuuuugguaguggaaaaaaaaucuuaaaagguaucaaugua

SEQ ID NO: 637493 - RNA, 64 nt, Homo Sapiens
aaaaagucucugaaauuugauguuucuugcuuuuggaaaaaaaaacuagcuugccuggagauga

SEQ ID NO: 637494 - RNA, 64 nt, Homo Sapiens
aaaugccuguaccuacaaugguuucauuguuuaaggaaaaaaaagacauguugagaucauuguu

SEQ ID NO: 637495 - RNA, 64 nt, Homo Sapiens
uuuccacuuagauauuuuacuagcuauagaguugggaaaaaauauuuacugggacuuuuaaauc

SEQ ID NO: 637496 - RNA, 64 nt, Homo Sapiens
caggaaaauauaucaaaucaggcuugguaggaggggaaaaaaguaggcugggagagacuaggaa

SEQ ID NO: 637497 - RNA, 64 nt, Homo Sapiens
uagauucugaaccauuuauuucagggaaaaaugaggaaaaaaaaauauaagcuauaacaucaaa

SEQ ID NO: 637498 - RNA, 64 nt, Homo Sapiens
guccuaggagaaagcgacguguucauaccaugggggaaaaaaaagcuguggcuuuuagggcuug

SEQ ID NO: 637499 - RNA, 64 nt, Homo Sapiens
uuuaggaaacucaccuuccuuuaaaagauuuguuggaaaaaauuuuggugaucuaauccuaaau

SEQ ID NO: 637500 - RNA, 64 nt, Homo Sapiens
uauucaauaagagauuaggaaaaguagcaauuauggaaaaaaaauacuuuggcaacccuuuuga

SEQ ID NO: 637501 - RNA, 64 nt, Homo Sapiens
aacaggucaaugaaugaaacggauggauuuuauaggaaaaaauacuauaauacagugggcuucu

SEQ ID NO: 637502 - RNA, 64 nt, Homo Sapiens
cccccuuugacugaucagugugauaaggacuuuaggaaaaaaagcauguauguuuuuuacuguu

SEQ ID NO: 637503 - RNA, 64 nt, Homo Sapiens
uucguuaaucuugcugcuuaugugccaauuuaguggaaaaaaacaacccuugcugaaaaauucc

SEQ ID NO: 637504 - RNA, 64 nt, Homo Sapiens
gcuaguuuauaaugucuuacuaaugcagaaacaaggaaaaaagcaaaauuggccugaauauucu

SEQ ID NO: 637505 - RNA, 64 nt, Homo Sapiens
auuaguugauucacaguacagaacaagguauaaaggaaaaaacccugcuagguaguguuauaau

SEQ ID NO: 637506 - RNA, 64 nt, Homo Sapiens
aucugaagauacaugucuuucuccagggacauguggaaaaaaaaaagauguuauacaaccauca

SEQ ID NO: 637507 - RNA, 64 nt, Homo Sapiens
uaaaaggguaucccaaaaauaaaacuauccuuuuggaaaaaaaaagauuuaaaauaauuccugg

SEQ ID NO: 637508 - RNA, 64 nt, Homo Sapiens
ggaaggcgagcuaagaggagacuuagauccagugggaaaaaaaauagcguuucacauaaaaagc

SEQ ID NO: 637509 - RNA, 64 nt, Homo Sapiens
gaacacaccaaaaaagugaaagagaaauugaaagggaaaaaagacaaaaagcauaaggcuccaa

SEQ ID NO: 637510 - RNA, 64 nt, Homo Sapiens
uuucugcaaaaaggaaaaagaaaccacaaauuggggaaaaaaaaagaagaaaaaccuguuuccg

SEQ ID NO: 637511 - RNA, 64 nt, Homo Sapiens
gggaagagaggagagggagaaaaauaaaaugaaaggaaaaaaaaaaguuugcaaauucagacag

SEQ ID NO: 637512 - RNA, 64 nt, Homo Sapiens
cagcuugacacccaccaagcaaaaguuucagccuggaaaaaaaaugggggggaaggguggauga

SEQ ID NO: 637513 - RNA, 64 nt, Homo Sapiens
uguggggugccagaaagugucugcugauauuuguggaaaaaaaaucuauuuuguuuaccuacug

SEQ ID NO: 637514 - RNA, 64 nt, Homo Sapiens
cauggagaaaacccgguacgcucaaaaagaaaaaggaaaaaaaaaaaucccaucacccacagca

SEQ ID NO: 637515 - RNA, 64 nt, Homo Sapiens
uuggacauuuuaauuguuuaaaaauuguacaaaaggaaaaaauuagaauaaguacuggcgaacc

SEQ ID NO: 637516 - RNA, 64 nt, Homo Sapiens
cuacuguauguaacggaauuaaaaaaauagcuuuggaaaaaaaacuuuauauuaacgauacuaa

SEQ ID NO: 637517 - RNA, 64 nt, Homo Sapiens
aaaaacacgucaaaaguuaggaagauuggaaaaaggaaaaaaaaggcgggccaaccccgagaau

SEQ ID NO: 637518 - RNA, 64 nt, Homo Sapiens
caugcugauacagcuggcuacuuuuaugauguacggaaaaaaacgagcauagagaaacaaaaau

SEQ ID NO: 637519 - RNA, 64 nt, Homo Sapiens
uuugcagacaccugcccuaacuuuggcacuuuuuggaaaaaaagaaagagccaaaauaaauaua

SEQ ID NO: 637520 - RNA, 64 nt, Homo Sapiens
uuaaauuuugaauugaguguauguuauuuaaggaggaaaaaauaagcugccucaugacaaguac

SEQ ID NO: 637521 - RNA, 64 nt, Homo Sapiens
guauuuuugagaauaacauacauuugauuuuauaggaaaaaauauuaaaaguguggccacugag

SEQ ID NO: 637522 - RNA, 64 nt, Homo Sapiens
gccaccauucuugguauaaugccuguauagauggggaaaaaauuacuugccacuagauggcagu

SEQ ID NO: 637523 - RNA, 64 nt, Homo Sapiens
gucuugcaaugugcuguaaugacguuuauuaaaaggaaaaaaauagggaaacucagaguacuag

SEQ ID NO: 637524 - RNA, 64 nt, Homo Sapiens
cugaagaaacugccgcucugagacugcacauccaggaaaaaagacuaggacuugccacacacug

SEQ ID NO: 637525 - RNA, 64 nt, Homo Sapiens
uggccuauuaucuggaugucccuugccuagagcaggaaaaaagucucagaauuaccuaaaaaca

SEQ ID NO: 637526 - RNA, 64 nt, Homo Sapiens
uugcuccuccauagauuuuuaauuuucuauaaagggaaaaaaguacuucauaucacacaaaaug

SEQ ID NO: 637527 - RNA, 64 nt, Homo Sapiens
agaguucauaguuugagcuggccuaaggcauaaaggaaaaaaacauuucuuggagaauuuggau

SEQ ID NO: 637528 - RNA, 64 nt, Homo Sapiens
aaaauuuuccuuuaugauuccacaaauagucgggggaaaaaauucuucaauuauuucccaucuc

SEQ ID NO: 637529 - RNA, 64 nt, Homo Sapiens
ccauagugccuugauuuuaaaggguuauuugaggggaaaaaacccuuuuagucagaaaugauuc

SEQ ID NO: 637530 - RNA, 64 nt, Homo Sapiens
uguucuauuuuuacaucuuuggcacauucagaguggaaaaaauuaaaaguacauugguaauuug

SEQ ID NO: 637531 - RNA, 64 nt, Homo Sapiens
aagaacucuuagacacugcuuuggugaagaugcgggaaaaaaaaaauaaaauaaaaauaacaua

SEQ ID NO: 637532 - RNA, 64 nt, Homo Sapiens
uuuauuugaagauggagcacugcugauuuaugaaggaaaaaagaagaauuuucuaaagauuaca

SEQ ID NO: 637533 - RNA, 64 nt, Homo Sapiens
auucaggauuuaagucugagguagucaacccucaggaaaaaaaaaauggcuuaucugaaaucag

SEQ ID NO: 637534 - RNA, 64 nt, Homo Sapiens
cuuaauuaugacaugagaaugaagaaauuauuuuggaaaaaaaaaaugaccuaauuuaccuauc

SEQ ID NO: 637535 - RNA, 64 nt, Homo Sapiens
aggcuuauggcaugaucucuggaacaaauuuguaggaaaaaauuacuccaauugaaugacugau

SEQ ID NO: 637536 - RNA, 64 nt, Homo Sapiens
aaauuaaccuccuaaaaggaauucauauuuuaaaggaaaaaaauacaacuaaugaugcacauuu

SEQ ID NO: 637537 - RNA, 64 nt, Homo Sapiens
aucauaugguauugugauuuucuuuccccugcuaggaaaaaauugcacugaaaugcugacaaaa

SEQ ID NO: 637538 - RNA, 64 nt, Homo Sapiens
aaaacaucaguaacaaaagauguuaacuguucuuggaaaaaauagccaauaggugccuaguaaa

SEQ ID NO: 637539 - RNA, 64 nt, Homo Sapiens
aauauuuagcaguauuguucaaaaaaaaaaagcaggaaaaaaggucccaguauguuuuaacaaa

SEQ ID NO: 637540 - RNA, 64 nt, Homo Sapiens
auaacaaaauguuuuauuuuuauuuucuauaaaaggaaaaaaguaaaagaaauaaaaauauuuu

SEQ ID NO: 637541 - RNA, 64 nt, Homo Sapiens
aauaaaaauauuuuuauuuucuggagagaaaggaggaaaaaagaaggagaccagagaccgccua

SEQ ID NO: 637542 - RNA, 64 nt, Homo Sapiens
aaaugaaaugaagagugggaugauuugguccucuggaaaaaaaaagaauguaauauguaaacug

SEQ ID NO: 637543 - RNA, 64 nt, Homo Sapiens
accauguaagauaugugugcauuuuacaaauaaaggaaaaaagauaugacacaaucucuuuaua

SEQ ID NO: 637544 - RNA, 64 nt, Homo Sapiens
auagcaccguuuguucugugagcuggaaacagaaggaaaaaacauacccuuggguacccauagc

SEQ ID NO: 637545 - RNA, 64 nt, Homo Sapiens
gagauaaugaaaagugauaucuucgcauacgaaaggaaaaaagguugagguauauaugauuuuu

SEQ ID NO: 637546 - RNA, 64 nt, Homo Sapiens
cauccuuaagauuuaaaaaaaaaaaaaaaaaaaaggaaaaaaaagugauggaagccguaagugc

SEQ ID NO: 637547 - RNA, 64 nt, Homo Sapiens
uugucuauuuuuucucuucauguuguaacaaaaaggaaaaaagaaaaaaaaaucccaucccuuu

SEQ ID NO: 637548 - RNA, 64 nt, Homo Sapiens
cgaaaaggacagacgaagaguuuaaagagaaaagggaaaaaagaaagaaaaaguaagcagggcu

SEQ ID NO: 637549 - RNA, 64 nt, Homo Sapiens
guacaggggcagucaguggagggcgagugguuucggaaaaaaaaaaagaaaaaaagaaaaaaaa

SEQ ID NO: 637550 - RNA, 64 nt, Homo Sapiens
cuuaaaauucaaggccacaaaaacaauguuugggggaaaaaaaagaaaaaaucaugccagcuaa

SEQ ID NO: 637551 - RNA, 64 nt, Homo Sapiens
aaauaccuggcaaaacuaaauaaauuaccaaaaaggaaaaaaaauccaccaaaccaugauaaac

SEQ ID NO: 637552 - RNA, 64 nt, Homo Sapiens
guguuuauuuauuguggauucccaucaggaaagaggaaaaaauacacauguucuuucauauagg

SEQ ID NO: 637553 - RNA, 64 nt, Homo Sapiens
caggaagcauauaccggggaauguguagccuucaggaaaaaaaugccaauugacacaaagcauu

SEQ ID NO: 637554 - RNA, 64 nt, Homo Sapiens
uuucacauuuugauuuauuagguacuagcacugaggaaaaaaaauucagcacuuggacuaucau

SEQ ID NO: 637555 - RNA, 64 nt, Homo Sapiens
acaacacuacaagucuugaguuaagaaggaaagaggaaaaaagaaaaaacaccaauacccagau

SEQ ID NO: 637556 - RNA, 64 nt, Homo Sapiens
aaugcuuucuuuuccagucgucuuugagaauaaaggaaaaaaaaaucuucagaugcaaugguuu

SEQ ID NO: 637557 - RNA, 64 nt, Homo Sapiens
gacuuuuaugaaagccaaagacugcuugcuaguaggaaaaaauuucaaauaauaaccaaagcug

SEQ ID NO: 637558 - RNA, 64 nt, Homo Sapiens
uacaccaucugcaaccauaugcuauuaauaaaauggaaaaaaacaaaauggucauuuugcauau

SEQ ID NO: 637559 - RNA, 64 nt, Homo Sapiens
uucuuuugcucucauagaaaauaauuuugaacuuggaaaaaagugauaaauaauaaaacuuguc

SEQ ID NO: 637560 - RNA, 64 nt, Homo Sapiens
gauccuuuucaaaaagauuaaauggacaagagugggaaaaaagacuugcucugauaugugaagu

SEQ ID NO: 637561 - RNA, 64 nt, Homo Sapiens
uugucgcuauuugagaaucuaggaaaaaaaaucaggaaaaaagcuaauaacaaaguugcuaggc

SEQ ID NO: 637562 - RNA, 64 nt, Homo Sapiens
ucaggaaaaaagcuugucgcaaaguugcuaggcaggaaaaaaaauagacagugaggauaauaac

SEQ ID NO: 637563 - RNA, 64 nt, Homo Sapiens
gucauugguauaugguggcuguuuaccaauaaaaggaaaaaauucauuaaccgguugcuuccaa

SEQ ID NO: 637564 - RNA, 64 nt, Homo Sapiens
ucagaguuauccacuguauuuauaaggaagagucggaaaaaacaaugaccuuaguuuuuuuuaa

SEQ ID NO: 637565 - RNA, 64 nt, Homo Sapiens
cucacucauucccauguuguaaaaaguaaauuaaggaaaaaaucgcaaaaaaauguaagaggaa

SEQ ID NO: 637566 - RNA, 64 nt, Homo Sapiens
uaaauuaaggaaaaaauccuaaaaaaauguaagaggaaaaaaaguaucaauggagcaugugugc

SEQ ID NO: 637567 - RNA, 63 nt, Homo Sapiens
auguauaaccuuguaagugaaaaguacugucaagggaaaaaauaaauauggaugaaaauuaau

SEQ ID NO: 637568 - RNA, 64 nt, Homo Sapiens
aaagaaaaaagaaaaagccgcucccgucucucucggaaaaaaaaaaccugggcaacauggugac

SEQ ID NO: 637569 - RNA, 64 nt, Homo Sapiens
uuuuucucuguaagaaaguuauauacauuuuuaaggaaaaaagauuuucagccauuuuugccac

SEQ ID NO: 637570 - RNA, 64 nt, Homo Sapiens
aucuacguuuuuaguuuuuuugugaaacuguauaggaaaaaaguuuuacagcauauuuaagucu

SEQ ID NO: 637571 - RNA, 64 nt, Homo Sapiens
ccuaaaaccuuuuagugacaaaauccuaauauguggaaaaaagcauaugcauaaaggaauaaua

SEQ ID NO: 637572 - RNA, 64 nt, Homo Sapiens
aaauuuuccuguuuuucccccuuugaaaaacucaggaaaaaaggaagauugaacuaauaaaauu

SEQ ID NO: 637573 - RNA, 64 nt, Homo Sapiens
uuucacauuuuaauuuagcaaauugauuuaccuaggaaaaaauuaucaccuucaaagauaggca

SEQ ID NO: 637574 - RNA, 64 nt, Homo Sapiens
acuucuauaaugcuuauuaugguaaaauaaaauuggaaaaaauuaaaacugaccuauaagagug

SEQ ID NO: 637575 - RNA, 64 nt, Homo Sapiens
acaguggucuguaucucaacauuuucuuuuuaaaggaaaaaauauauauauauaguuucuuuuu

SEQ ID NO: 637576 - RNA, 64 nt, Homo Sapiens
uuucucuuacuacguacucacagguuugcaaaugggaaaaaaguuuacauuucaguuuaggggc

SEQ ID NO: 637577 - RNA, 64 nt, Homo Sapiens
uugcacuuaaaguugcauugccuacuguuauacuggaaaaaauagaguucaagaauaauaugac

SEQ ID NO: 637578 - RNA, 64 nt, Homo Sapiens
aaaagugugauagcgauauuagugccaaucaaauggaaaaaagguaguuuuaauaaacaagaca

SEQ ID NO: 637579 - RNA, 64 nt, Homo Sapiens
uaaguaauuuuuaguucuauuuauauaaaguacuggaaaaaagcuguuuaaaaaagaucucaau

SEQ ID NO: 637580 - RNA, 64 nt, Homo Sapiens
ccacaaaaaucagcacuccuuuuguuuccuucugggaaaaaaccuuuuuuuccccuauuuauuc

SEQ ID NO: 637581 - RNA, 64 nt, Homo Sapiens
ggacaaccucuugacuagguaguaaccaugcaauggaaaaaaauuuaguuucuggggaaagaau

SEQ ID NO: 637582 - RNA, 64 nt, Homo Sapiens
gaaauccaugaauccauacuucccaauuccauugggaaaaaauagagaaaaaaauaaaauaaau

SEQ ID NO: 637583 - RNA, 64 nt, Homo Sapiens
acucuuuuugguuguccucauaaaaaaaaaaaaaggaaaaaaagagugauauuucucuaguagu

SEQ ID NO: 637584 - RNA, 64 nt, Homo Sapiens
aaaagaggaaaacccucaaguuauauacaauaauggaaaaaaaaauuaaaagucacaauguucu

SEQ ID NO: 637585 - RNA, 64 nt, Homo Sapiens
aucuuuaacagcucuuuguuauauuaaugagaagggaaaaaaguggggauucuuuucuaaggua

SEQ ID NO: 637586 - RNA, 64 nt, Homo Sapiens
gguagcacuuauucauuccauuuaugccuacuuaggaaaaaaagaagaaggaaaugaaaauauu

SEQ ID NO: 637587 - RNA, 64 nt, Homo Sapiens
aacuuauuuuucuaguaaauugggagaacaaauaggaaaaaaaaacuuauuucauuaaagaagu

SEQ ID NO: 637588 - RNA, 64 nt, Homo Sapiens
uacagaagaaaagcaaaugacuaguaaacaugugggaaaaaauauuacauuuuaagggggaaaa

SEQ ID NO: 637589 - RNA, 64 nt, Homo Sapiens
uaaacaugugggaaaaaauauuacauuuuaagggggaaaaaaaaacccaccauucucuucuccc

SEQ ID NO: 637590 - RNA, 64 nt, Homo Sapiens
cuggacaacauagggagaccccaucucuaccggaggaaaaaaaaaagagucaggccugguggug

SEQ ID NO: 637591 - RNA, 64 nt, Homo Sapiens
cagagugagaccuugucucaaaaaaguaacauaaggaaaaaagaagccuugcuuuagcacaggu

SEQ ID NO: 637592 - RNA, 64 nt, Homo Sapiens
aguuugaacacaaaggcucuaaaaaaagaaaaaaggaaaaaaacgaaaaaaugaaaaaaaaagg

SEQ ID NO: 637593 - RNA, 64 nt, Homo Sapiens
aaaaaaggaaaaaaacaguuaaaugaaaaaaaaaggaaaaaaagugaaaucuuaaaaaaagaaa

SEQ ID NO: 637594 - RNA, 64 nt, Homo Sapiens
cacauaauacaaacauacauagagggagagaggaggaaaaaauacucucucuagagcgagcaag

SEQ ID NO: 637595 - RNA, 64 nt, Homo Sapiens
guauagcaccaagccaguauaaaaauauuaacuaggaaaaaacacuuacguagacagaaauaau

SEQ ID NO: 637596 - RNA, 64 nt, Homo Sapiens
aaaaauuauuccagugcacaugacuuuuugccaaggaaaaaaauguuuuuaaaaauguagcacu

SEQ ID NO: 637597 - RNA, 64 nt, Homo Sapiens
uuauauauauauucuccuuuuaagaagggaaauuggaaaaaaaagucccccucuucucugggug

SEQ ID NO: 637598 - RNA, 64 nt, Homo Sapiens
gagcgcuuucuagggucagaauuacacccagggaggaaaaaaagcuuaaugauaccccaaaaug

SEQ ID NO: 637599 - RNA, 64 nt, Homo Sapiens
ugugaacuaacuuauuuaauacuuaagugcugggggaaaaaaaacacauuagagacuaacugua

SEQ ID NO: 637600 - RNA, 64 nt, Homo Sapiens
ugucgucuuuaaugccuacuuuuuaugaauaaaaggaaaaaaccauaaauuguugcaaauuugu

SEQ ID NO: 637601 - RNA, 64 nt, Homo Sapiens
auguuaacacaucacaggucacuguagcuuuuagggaaaaaaaacaaagagagguuauggaggu

SEQ ID NO: 637602 - RNA, 64 nt, Homo Sapiens
auguuuuaaauuucaaaauguaauaauuuuauuaggaaaaaaucuaauaagaugucagaauaac

SEQ ID NO: 637603 - RNA, 64 nt, Homo Sapiens
uuuuuuucaauaaucuuauugaaaaagaaaaucaggaaaaaaauucuacaaaaauaaccuucag

SEQ ID NO: 637604 - RNA, 64 nt, Homo Sapiens
aaaaguuguuugcuuaaaaaaaauuucaugugagggaaaaaaaaaaaaccuauuccagaauaag

SEQ ID NO: 637605 - RNA, 64 nt, Homo Sapiens
aaacagaaaacaauuccacgaggccaaucuaaagggaaaaaauccuacacuacuuuuacuacuu

SEQ ID NO: 637606 - RNA, 64 nt, Homo Sapiens
gcaacuucuucugguugauaccugagacuguuaaggaaaaaaauuuuaaaccccugauuuauau

SEQ ID NO: 637607 - RNA, 64 nt, Homo Sapiens
auuauagauguaaaaugaaauuucauuuguaauuggaaaaaauccaauaaaaaggauauucauu

SEQ ID NO: 637608 - RNA, 64 nt, Homo Sapiens
ucaguucucacaguauagaagagaacuuaaagagggaaaaaacaauaugaagauagggaaugca

SEQ ID NO: 637609 - RNA, 64 nt, Homo Sapiens
uuuggaccauacacuauguuacaaaacuaaaaguggaaaaaacuuauuggugaaugaauauagg

SEQ ID NO: 637610 - RNA, 64 nt, Homo Sapiens
gaguugcaggauaucuagcaauuuaagaaaauguggaaaaaauauuuuuauugagaaauagcau

SEQ ID NO: 637611 - RNA, 64 nt, Homo Sapiens
ucuagccuggaagacagagugagaccccaucucaggaaaaaagaaaaaaaaaaagaugucauuc

SEQ ID NO: 637612 - RNA, 64 nt, Homo Sapiens
cugugaggaaggaugggccuugcugaaguguggaggaaaaaauuaugaacgggccaaggccugc

SEQ ID NO: 637613 - RNA, 64 nt, Homo Sapiens
uaagaucagccauauuucauuuugaaucugcaguggaaaaaaagcccacauuugagguggcuca

SEQ ID NO: 637614 - RNA, 64 nt, Homo Sapiens
caaucuaauagucaccuaaaauaucuuuuuuguuggaaaaaaguuuauaauaaaaaaguuuguc

SEQ ID NO: 637615 - RNA, 64 nt, Homo Sapiens
caaauguuuauuaaguagcuagaaauaauuauguggaaaaaaaugaauaauggaaaauagugag

SEQ ID NO: 637616 - RNA, 64 nt, Homo Sapiens
uauuagaguauuucccuuccaaagagggauguuuggaaaaaacucugaaggagaggaggaauua

SEQ ID NO: 637617 - RNA, 64 nt, Homo Sapiens
cuacagccuagggcagacaauaguauagaagucuggaaaaaaacaaaaacagaauuugagaacc

SEQ ID NO: 637618 - RNA, 64 nt, Homo Sapiens
uccuucaauuccauauauccuuuucuucuauguaggaaaaaaauagucuaguguaguauucuuc

SEQ ID NO: 637619 - RNA, 64 nt, Homo Sapiens
uuaggcuuucagcuuacacaaaucuauuuaauuaggaaaaaaacuauuaaggauguagcuuuuc

SEQ ID NO: 637620 - RNA, 64 nt, Homo Sapiens
acauggagcaaaagagacagggagagguggagaaggaaaaaacccuacaaaacaaaaacaaacc

SEQ ID NO: 637621 - RNA, 64 nt, Homo Sapiens
agggugcccacaaaaagaaucaggacuuguacugggaaaaaaaccccuaaauuaauuauauuuc

SEQ ID NO: 637622 - RNA, 64 nt, Homo Sapiens
caagggaauuccagucaggccuuuuaucaucuaaggaaaaaagacucagcaaggcauguuacua

SEQ ID NO: 637623 - RNA, 64 nt, Homo Sapiens
gucaucuccccccaccucaucuuuuauugcaaggggaaaaaaauuuccguuucaagaccuuuuu

SEQ ID NO: 637624 - RNA, 64 nt, Homo Sapiens
cagagagcaaagugcauuacaaauaagguagaauggaaaaaaccuuuuuuaauuaaugcacuuu

SEQ ID NO: 637625 - RNA, 64 nt, Homo Sapiens
gggguggggggugggggguggaacaaaagggaaaggaaaaaaugcacuggaugagcggugagac

SEQ ID NO: 637626 - RNA, 64 nt, Homo Sapiens
aaaucugaacaauccuacagggaaaucagaauuaggaaaaaaaucuggagaacaauaugguuga

SEQ ID NO: 637627 - RNA, 64 nt, Homo Sapiens
uggagugauacauugugggaacccucagaagauaggaaaaaagcauggaauagauucucccuca

SEQ ID NO: 637628 - RNA, 64 nt, Homo Sapiens
uccugaccccagauucaacuuugcaaacaacaggggaaaaaaauggggaaaagaaaaaccacga

SEQ ID NO: 637629 - RNA, 64 nt, Homo Sapiens
gaaaaaaauggggaaaagaaaaaccacgagagagggaaaaaaaauuauucugcaccuguaaaaa

SEQ ID NO: 637630 - RNA, 64 nt, Homo Sapiens
aguaaguucuucaaacacccauuuuugcucuaugggaaaaaaacgauuuaccaauuaauauuac

SEQ ID NO: 637631 - RNA, 64 nt, Homo Sapiens
aagguauugcacuacauuauggaaucaugcaaaaggaaaaaaaguuucaugauaucuguuguug

SEQ ID NO: 637632 - RNA, 64 nt, Homo Sapiens
aaggaaauaucaucguauuucuuuuuuuuaauaaggaaaaaauaauauccauacagucaagaua

SEQ ID NO: 637633 - RNA, 64 nt, Homo Sapiens
uuguuuugacuugaauaaaguacuacaucaguguggaaaaaaauucugauacauuagcagcuau

SEQ ID NO: 637634 - RNA, 64 nt, Homo Sapiens
cuuuuuuuuaaauuaaaaagaucuuuguaucuggggaaaaaaaauuuuuuaugcaagggcaaaa

SEQ ID NO: 637635 - RNA, 64 nt, Homo Sapiens
guggaucagugauuuuacuuuguguguccaggaaggaaaaaaagcaaggcagggaagaaggaug

SEQ ID NO: 637636 - RNA, 64 nt, Homo Sapiens
cacuuugggagaaaauaaaauaacauuuauaggaggaaaaaaauauacccucaguuaagcaugu

SEQ ID NO: 637637 - RNA, 64 nt, Homo Sapiens
uuguauuuuccugaagcuacuacuuaaccagaagggaaaaaaaguuugcuccaaauucuuauuu

SEQ ID NO: 637638 - RNA, 64 nt, Homo Sapiens
ccugauuaaagaguuucugcuuuguuuuagaguuggaaaaaaagauuuaaggaaaaaaugggau

SEQ ID NO: 637639 - RNA, 64 nt, Homo Sapiens
ggauuuuguuuuagaguuggggaacuaaauuuaaggaaaaaauggcaaaguucucuguuccuga

SEQ ID NO: 637640 - RNA, 64 nt, Homo Sapiens
uuugauguaacaauuuuuuagacacagauuugaaggaaaaaaauaaacuguuguuugguuaaag

SEQ ID NO: 637641 - RNA, 64 nt, Homo Sapiens
acuagugugaaguuuacaguauuaauacuaacugggaaaaaaaagaauuaaaaauuuucuaaau

SEQ ID NO: 637642 - RNA, 64 nt, Homo Sapiens
uuaaacaaacaaaaaaaaauuuuaaacaaagaaaggaaaaaaauugacaauaaaagucacucuu

SEQ ID NO: 637643 - RNA, 64 nt, Homo Sapiens
gaagauucuuucuucugaaagccaagcaccacaaggaaaaaaaaaauuauuaauagcucagguu

SEQ ID NO: 637644 - RNA, 64 nt, Homo Sapiens
uaagcuuacuugaacuaauuacuugaaaacugguggaaaaaagagaccaacuuuguuauuuuuu

SEQ ID NO: 637645 - RNA, 64 nt, Homo Sapiens
uagcaugugccucacuuuaagaaaguccuguaggggaaaaaaaaaacugucagagcgaauucau

SEQ ID NO: 637646 - RNA, 64 nt, Homo Sapiens
ugcaaaguuaagaucgaauccauccgcuuguaggggaaaaaaaggaaaaaaauuaaccagagag

SEQ ID NO: 637647 - RNA, 64 nt, Homo Sapiens
aagaucgaauccauccgcuuguaggggaaaaaaaggaaaaaaauuaaccagagagggucuguaa

SEQ ID NO: 637648 - RNA, 64 nt, Homo Sapiens
auuaauguaguugaacuuuuuaaauuuuugaauuggaaaaaaauucuaaugaaacccugauauc

SEQ ID NO: 637649 - RNA, 64 nt, Homo Sapiens
ccaagguuaaucaggaaaaauagcuuuugacaggggaaaaaacucaauaacuagcuauuuuuga

SEQ ID NO: 637650 - RNA, 64 nt, Homo Sapiens
augcuacuugugaggcagaagaguuuucugugaaggaaaaaagcccauuagaguucuucaauuc

SEQ ID NO: 637651 - RNA, 64 nt, Homo Sapiens
uuuauauuuuaagacuuuaaguagaauaaacccuggaaaaaagaucaagaguaaaaauauauag

SEQ ID NO: 637652 - RNA, 64 nt, Homo Sapiens
gccaugauugauuagcaaugucugcacuggauacggaaaaaagaaggugcuugcagguuuacag

SEQ ID NO: 637653 - RNA, 64 nt, Homo Sapiens
caaugcaguuagguggcucuuuccaagacucuggggaaaaaaguaguaaaaagcuaaaugcaau

SEQ ID NO: 637654 - RNA, 64 nt, Homo Sapiens
aauguauuaacucauacugccugucuuuuauaggggaaaaaaauaaccuuuuuuauuuuaaagu

SEQ ID NO: 637655 - RNA, 64 nt, Homo Sapiens
gucaccagcagguuccaaauugauguguaugauaggaaaaaaaccuuaauuuuaaauauaauau

SEQ ID NO: 637656 - RNA, 64 nt, Homo Sapiens
uuaccagcacgcugucucagaaaacgaaaacggaggaaaaaaaccccaaaccccaaacaaucuu

SEQ ID NO: 637657 - RNA, 64 nt, Homo Sapiens
gacguggaacuacacacgaaguguaauuagugggggaaaaaauauuuuuuaaacaaaggauaua

SEQ ID NO: 637658 - RNA, 64 nt, Homo Sapiens
aaaagcauaaaaaaccacaggaaaaaaaaaaaaaggaaaaaacccggcuaaaugaaauaaagug

SEQ ID NO: 637659 - RNA, 64 nt, Homo Sapiens
aaaaaggaaaaaaccaaaagaaaugaaauaaaguggaaaaaaaagcucuagccacugagcggcu

SEQ ID NO: 637660 - RNA, 64 nt, Homo Sapiens
gaugugacagggagugaagauaaugaaaguguugggaaaaaaguauagcagagcaaaauaugga

SEQ ID NO: 637661 - RNA, 64 nt, Homo Sapiens
auccaagaaauguauugaauuguuccugcaguuaggaaaaaaaaccgagcguuuuuauguaugc

SEQ ID NO: 637662 - RNA, 64 nt, Homo Sapiens
ugguuucacaccucuuguuaaaaagguuuugaagggaaaaaaagaugaaccuuaaaaaaaaaaa

SEQ ID NO: 637663 - RNA, 64 nt, Homo Sapiens
aaauuaaugaaccuuaaaaaugcuuuuguaaucaggaaaaaaaaaagaccaaaaaaugagguuu

SEQ ID NO: 637664 - RNA, 64 nt, Homo Sapiens
auuauuugaagaaagaaaaaacagauuuuaggguggaaaaaacagucaacucacacaaagaaug

SEQ ID NO: 637665 - RNA, 64 nt, Homo Sapiens
aggguggaaaaaacagucaacucacacaaagaauggaaaaaaauacugaguuaaauuaagcaaa

SEQ ID NO: 637666 - RNA, 64 nt, Homo Sapiens
guguuaauucuaauuaucuauuucaaauuuagcaggaaaaaagagaacaucaccuuguaaaacu

SEQ ID NO: 637667 - RNA, 64 nt, Homo Sapiens
uuagguuuaauaaauagccuuaacuauuuggaggggaaaaaaugggucaacuuuuuuuuuuuuu

SEQ ID NO: 637668 - RNA, 64 nt, Homo Sapiens
aguuggauuaaaggguuguaacugacuacagcauggaaaaaaauaguucuuuuaauucuuucac

SEQ ID NO: 637669 - RNA, 64 nt, Homo Sapiens
acuagaugcaccaaccguaucauuauuuguuugaggaaaaaaagaaaucugcauuuuaauucau

SEQ ID NO: 637670 - RNA, 64 nt, Homo Sapiens
ggauuuauauauauaagguuuuuucuucuacaaaggaaaaaauuaguuuguaaaauuauuuugg

SEQ ID NO: 637671 - RNA, 64 nt, Homo Sapiens
uugauuaggaccacagauuucguuucuuuuucuuggaaaaaaagaauguauuuuaaacacauau

SEQ ID NO: 637672 - RNA, 64 nt, Homo Sapiens
agacaagucuaguggaaccaaaaaauaugagauuggaaaaaauuuuucaccuaucuggaaaaaa

SEQ ID NO: 637673 - RNA, 64 nt, Homo Sapiens
aaauaugagauuggaaaaaaguuuucaccuaucuggaaaaaaaaguggaaggcacacugagcaa

SEQ ID NO: 637674 - RNA, 64 nt, Homo Sapiens
guauaaaagguugccaaauuuugcacuguaaugaggaaaaaaugaacggcagugucauuccccu

SEQ ID NO: 637675 - RNA, 64 nt, Homo Sapiens
uguagcgacagcauuuuaaguucugaauuggaagggaaaaaaaauacuaugguaacacuuugcu

SEQ ID NO: 637676 - RNA, 64 nt, Homo Sapiens
aaaaagcaauuagguagcaccagaaaguuggaaaggaaaaaagacacugcugcugccucugaaa

SEQ ID NO: 637677 - RNA, 64 nt, Homo Sapiens
uuacuaaaaaaaguguguauuaggaggagagagaggaaaaaaagaggaaagaaggaaaaaaaaa

SEQ ID NO: 637678 - RNA, 64 nt, Homo Sapiens
uuaggaggagagagaggaaaaaaagaggaaagaaggaaaaaaaaaagaauuaaaaaaaaaaaaa

SEQ ID NO: 637679 - RNA, 64 nt, Homo Sapiens
aaaaaaaaaaagaaaaacagaagaugaccuugauggaaaaaaaauauuuuuuaaaaaaaagaua

SEQ ID NO: 637680 - RNA, 64 nt, Homo Sapiens
auuaauaccagaccaaagacauuuucuguuuccuggaaaaaaaaaaugaaucauguuaggcuuu

SEQ ID NO: 637681 - RNA, 64 nt, Homo Sapiens
uaauuaguaggcuccugcugccaaaaugcaaaggggaaaaaaaggcagggauugggggggaugg

SEQ ID NO: 637682 - RNA, 64 nt, Homo Sapiens
auagaucacauacguuaucaaaaacuacucccuuggaaaaaauaucuuucgaaaaucaaauuua

SEQ ID NO: 637683 - RNA, 64 nt, Homo Sapiens
agagucaagguugcgaguacaggccaagaccaugggaaaaaaagccaugcucacuggccaauaa

SEQ ID NO: 637684 - RNA, 64 nt, Homo Sapiens
augggaaagcaaagcagaaaacagugccccaaauggaaaaaagauacucacacagaacaaaaca

SEQ ID NO: 637685 - RNA, 64 nt, Homo Sapiens
ugguugacuguuuuuguuuaacgcaauuauauuaggaaaaaaguaucacuuuguucugguauug

SEQ ID NO: 637686 - RNA, 64 nt, Homo Sapiens
aucuuaaaacuuuggccauaaguuuugugccauaggaaaaaauuuuuuggguauacuugugguu

SEQ ID NO: 637687 - RNA, 64 nt, Homo Sapiens
aacauguuacaguguuuuuuggauguagccucugggaaaaaacauaaaguauuccagcaaaaga

SEQ ID NO: 637688 - RNA, 64 nt, Homo Sapiens
aaauaaggacuucaauccaaugucucuaaguaaaggaaaaaacaacagcagcacuguauauacc

SEQ ID NO: 637689 - RNA, 64 nt, Homo Sapiens
gcaucaugaaaggcaaaaagcccguggcuccuaaggaaaaaacaauaauugaaguucagaguca

SEQ ID NO: 637690 - RNA, 64 nt, Homo Sapiens
uguuuucaguuaaacacuacaccaacagaaaaaaggaaaaaaauguaaugcauaaugcuuucuc

SEQ ID NO: 637691 - RNA, 64 nt, Homo Sapiens
aaaagggcuucagucucaugucuugcucucuaugggaaaaaaaccugcuugcugccuuuaauug

SEQ ID NO: 637692 - RNA, 64 nt, Homo Sapiens
gugguuuggccuugcugcugaugcuuaacagagaggaaaaaaauuuaccucauuucaagaaaau

SEQ ID NO: 637693 - RNA, 64 nt, Homo Sapiens
aaucacucuauguugccccacaucugucaauuaaggaaaaaaaauagcuuguugaaauguuuug

SEQ ID NO: 637694 - RNA, 64 nt, Homo Sapiens
aaaaacuucuuuaggcauuuccaucuuuggaaaaggaaaaaaaagauaaacuagcucauuauuu

SEQ ID NO: 637695 - RNA, 64 nt, Homo Sapiens
auuagggagaaaacuagucuaaauuauuucaacuggaaaaaagaaaaaagaguccucuucuuuu

SEQ ID NO: 637696 - RNA, 64 nt, Homo Sapiens
ucuauggaagucgugucuuacuccaggugaagggggaaaaaaaaagccuauacuuuggcagguu

SEQ ID NO: 637697 - RNA, 64 nt, Homo Sapiens
ccagguucuagaugggugaacuauguugagaaguggaaaaaaacuaauguuuccauguucccaa

SEQ ID NO: 637698 - RNA, 64 nt, Homo Sapiens
acgaccuacugcacgaaggguggucaaagugaggggaaaaaagcaauaggcgggaucgcuuugu

SEQ ID NO: 637699 - RNA, 64 nt, Homo Sapiens
gcaacucuaaaaaaaaaaaaaauacaaauaaaaaggaaaaaaaauuacauuuuuuaucuuauac

SEQ ID NO: 637700 - RNA, 64 nt, Homo Sapiens
ggcaguauucagcuucuuaaccagucgcuauuuaggaaaaaaaacccacuaguuaggccaucaa

SEQ ID NO: 637701 - RNA, 64 nt, Homo Sapiens
auugauaucacugcugacuuuuauauuaugggagggaaaaaauaacauuaauaaaaaggugaua

SEQ ID NO: 637702 - RNA, 64 nt, Homo Sapiens
uacccccccacuaugcccucauuuuuuuaaaaaaggaaaaaaaaaagaaacuggguuccagucu

SEQ ID NO: 637703 - RNA, 64 nt, Homo Sapiens
uaaaaaaauaaauaaaaauaaaaaaaauaaaaaaggaaaaaaaaaaaagaagaaacaagacaug

SEQ ID NO: 637704 - RNA, 64 nt, Homo Sapiens
ccacauagcucugggccuuuuugaaagguauuaaggaaaaaauuugccgucuucacagacaaac

SEQ ID NO: 637705 - RNA, 64 nt, Homo Sapiens
caccccaucguucccuacuccuucugaaaugaagggaaaaaaaccacuacaguagaagaacuua

SEQ ID NO: 637706 - RNA, 64 nt, Homo Sapiens
aaaccccacucagaaacagaguguguacaauccaggaaaaaaacacuccauuccaccugacccu

SEQ ID NO: 637707 - RNA, 64 nt, Homo Sapiens
acauuagcugugguuguaaaugacugggaacaauggaaaaaauugcacacaauggguuuggagc

SEQ ID NO: 637708 - RNA, 64 nt, Homo Sapiens
gggcuuugcacacaauggguucauuuagaugcauggaaaaaaauaauuucauagccuguaucua

SEQ ID NO: 637709 - RNA, 64 nt, Homo Sapiens
uuacuaaaaccuagguaacuaagcuuguuuuuguggaaaaaaacuagcuuguauuauaguuauu

SEQ ID NO: 637710 - RNA, 64 nt, Homo Sapiens
guuuuuaauagaaaugaacuauguagcuacuuaaggaaaaaaggguaaaaaggaaucuugccag

SEQ ID NO: 637711 - RNA, 64 nt, Homo Sapiens
augucucuaauuacuggcuugcuuucuaguccugggaaaaaaagaugcagucauguggaaccuu

SEQ ID NO: 637712 - RNA, 64 nt, Homo Sapiens
acaguucaccauguggaguuguugucaaaccaagggaaaaaaccaugaauuuaauguauaaaau

SEQ ID NO: 637713 - RNA, 64 nt, Homo Sapiens
gucaacggccacuguguguggcugcucugagugaggaaaaaauuaaaaagaaaaacugguucca

SEQ ID NO: 637714 - RNA, 64 nt, Homo Sapiens
aaaggcucagcuggggaugguguuugacuucggaggaaaaaaguugcuauugcccguuaaaggc

SEQ ID NO: 637715 - RNA, 64 nt, Homo Sapiens
cuccuguuugcaauugcuucccucaucucaguagggaaaaaauugagugggaguacugagaugu

SEQ ID NO: 637716 - RNA, 64 nt, Homo Sapiens
aaaaacaaacccagaccccauauauauuugaaaaggaaaaaacacauacagagguugaauugag

SEQ ID NO: 637717 - RNA, 64 nt, Homo Sapiens
cuccaguuuguuuuacagguaagguugauuaaagggaaaaaaggaguuaaaaaaaaagacauau

SEQ ID NO: 637718 - RNA, 64 nt, Homo Sapiens
aaaaacccuggaaaauagaaaaaaaaucccuccuggaaaaaaaaaaaauaacaaaagaggaaaa

SEQ ID NO: 637719 - RNA, 64 nt, Homo Sapiens
aaucccuccuggaaaaaaaaaaaauaacaaaagaggaaaaaaaaaggcgagcaagccuuuuuga

SEQ ID NO: 637720 - RNA, 64 nt, Homo Sapiens
cuucccuagagcuaguauccacgcuguuuaaaaaggaaaaaaucauccuaggcaacagagugau

SEQ ID NO: 637721 - RNA, 64 nt, Homo Sapiens
ggaaaauaggagaagguggaccaucucaacagaaggaaaaaaaacugggugacagagugagacu

SEQ ID NO: 637722 - RNA, 64 nt, Homo Sapiens
acucauccagaauucauauuugguguugaaaacuggaaaaaauagcuuuugcaaaaaucuuuau

SEQ ID NO: 637723 - RNA, 64 nt, Homo Sapiens
aaaagaaaggacauugaguugccuggagcaaaaaggaaaaaaaaagcagaacaaaucgucaggu

SEQ ID NO: 637724 - RNA, 64 nt, Homo Sapiens
aaaacaaaaaacuauaguuauuuuuuaacaacugggaaaaaacauugaaacugugaguuguuuu

SEQ ID NO: 637725 - RNA, 64 nt, Homo Sapiens
aacagauuucagagauuaaauuuuauaaauggagggaaaaaaugcaaaugauaaauugaccccu

SEQ ID NO: 637726 - RNA, 64 nt, Homo Sapiens
uauuauaugccaaaaagauccuacauuuugguagggaaaaaacaacacuguguuugacguauuu

SEQ ID NO: 637727 - RNA, 64 nt, Homo Sapiens
uauacaguauaaacuaccucacuugccuuucuugggaaaaaaaaaaugaauggacuuuaacaau

SEQ ID NO: 637728 - RNA, 64 nt, Homo Sapiens
cagauuuguagugcauagguguguguuucaagaaggaaaaaaaaagacuucuguucaaaguuaa

SEQ ID NO: 637729 - RNA, 64 nt, Homo Sapiens
uuauuauacacuguacauuuuuuucacagcaauuggaaaaaaacaaccacuugcaaucauucaa

SEQ ID NO: 637730 - RNA, 64 nt, Homo Sapiens
aguaaagcucagugugaauggaaagaccuuaauaggaaaaaaagguugaucauuaccuguaaau

SEQ ID NO: 637731 - RNA, 64 nt, Homo Sapiens
ucuugugauugacuuucgcaugccuagauaauggggaaaaaaaguaucauaaaauuuucauaua

SEQ ID NO: 637732 - RNA, 64 nt, Homo Sapiens
uuguaauaaaauaaucuaauaaaugacugguaauggaaaaaaugugaauguaacugugcacagg

SEQ ID NO: 637733 - RNA, 64 nt, Homo Sapiens
aaaugugcuaauaaaacuucccucuucccuugggggaaaaaaaacuccuucuccuccuccuccu

SEQ ID NO: 637734 - RNA, 64 nt, Homo Sapiens
acacaucacacaguguccuguagcuaagugucuaggaaaaaacaaaaacuccaaacccuucagu

SEQ ID NO: 637735 - RNA, 64 nt, Homo Sapiens
agccuauaacuuuucagcuggugcuuuuacuuagggaaaaaaacaauuuguaaauacagaacau

SEQ ID NO: 637736 - RNA, 64 nt, Homo Sapiens
aauuuauaaauuaaacuuuagauauguauguacaggaaaaaauguaguauauaguaucguauau

SEQ ID NO: 637737 - RNA, 64 nt, Homo Sapiens
aaaaauguaguauauaguaucguauauauguacaggaaaaaaacguacuaucugugguuucagg

SEQ ID NO: 637738 - RNA, 64 nt, Homo Sapiens
aaaagacauaaacuggcaccuuaaaaaaaaaaaaggaaaaaaaaagaaaacacacagaagagau

SEQ ID NO: 637739 - RNA, 64 nt, Homo Sapiens
gcaacaaaaaaagaaaacacacacaaacagaagaggaaaaaaaaaucaaaaaagcgacaaaaaa

SEQ ID NO: 637740 - RNA, 64 nt, Homo Sapiens
uuugggcagcguggugggggauaaauaaauaaaaggaaaaaaaacuuagccuagaauuagaauu

SEQ ID NO: 637741 - RNA, 64 nt, Homo Sapiens
agccaagaauaagcagcagaacccuguuccauauggaaaaaagaaaaacaauuuuuugucccua

SEQ ID NO: 637742 - RNA, 64 nt, Homo Sapiens
guuaguauuuaaaaauagagaaauugcacuuccuggaaaaaauuaaaaaguaguuaguuuaauu

SEQ ID NO: 637743 - RNA, 64 nt, Homo Sapiens
ucaacuagaccccacaccagggcacccuaagaggggaaaaaagugaauucaaagcaaaaauaac

SEQ ID NO: 637744 - RNA, 64 nt, Homo Sapiens
aaagaauucccuguaucaucuggaucucaacaucggaaaaaagaagcggauaguguuuauggag

SEQ ID NO: 637745 - RNA, 64 nt, Homo Sapiens
gagaaaaaugggcuggagagaaggagaaggauuaggaaaaaacaaagaaggcaauaaggaaccc

SEQ ID NO: 637746 - RNA, 64 nt, Homo Sapiens
cagugaagcauuagaugcuguuaaagucuacaauggaaaaaaagcauguauuuauucaagugca

SEQ ID NO: 637747 - RNA, 64 nt, Homo Sapiens
acuccauguauuuauucaagguaauucauuuugaggaaaaaacaccaucucagucuuuauuugu

SEQ ID NO: 637748 - RNA, 64 nt, Homo Sapiens
aaacuuucaaauugaaaugaguauaaaaaucaauggaaaaaaauuuauuuguguuauucuggau

SEQ ID NO: 637749 - RNA, 64 nt, Homo Sapiens
gcuucuuucuacuuuguuuagcuaaauacuguagggaaaaaaauaaggacuuuuucuuagguuu

SEQ ID NO: 637750 - RNA, 64 nt, Homo Sapiens
auguuuuucaguuuaauucuuggagaaaaaugaaggaaaaaauuugucugaccugcaaaaaugc

SEQ ID NO: 637751 - RNA, 64 nt, Homo Sapiens
gggaaguuggggauaggcagcaaauguucagugaggaaaaaaaggugaggaaaaaacauucaga

SEQ ID NO: 637752 - RNA, 64 nt, Homo Sapiens
uucagacaaauguucagugaaacauguucagugaggaaaaaacauguucagugugagugaggaa

SEQ ID NO: 637753 - RNA, 64 nt, Homo Sapiens
aucagaaauaauaaaaaauucacauuacaagccuggaaaaaaaccugcagauaaguggccuuga

SEQ ID NO: 637754 - RNA, 64 nt, Homo Sapiens
gcuuuugagagaacauagauuaguucugugacuaggaaaaaauuuaaaguaguaaaagaagaaa

SEQ ID NO: 637755 - RNA, 64 nt, Homo Sapiens
uuugguuuuauaaaauucauccuucaaaguugaaggaaaaaaaguucaacuuuuuaguuuuguu

SEQ ID NO: 637756 - RNA, 64 nt, Homo Sapiens
agcccaaacuuaaccucugauugaauuaaaagaaggaaaaaaaauuuuuguauaaaaauuuaaa

SEQ ID NO: 637757 - RNA, 64 nt, Homo Sapiens
aagggagcucaaagucacaagaagaaaaaugaaaggaaaaaacagcagcccuauucagaaauug

SEQ ID NO: 637758 - RNA, 64 nt, Homo Sapiens
caggagucaucaauucauccauaaauauaaaaagggaaaaaaacuuaaggcaguagucugcauu

SEQ ID NO: 637759 - RNA, 64 nt, Homo Sapiens; identical to SEQ ID NO: 38325

SEQ ID NO: 637760 - RNA, 64 nt, Homo Sapiens; identical to SEQ ID NO: 38326

SEQ ID NO: 637761 - RNA, 64 nt, Homo Sapiens; identical to SEQ ID NO: 38327

SEQ ID NO: 637762 - RNA, 64 nt, Homo Sapiens; identical to SEQ ID NO: 38328

SEQ ID NO: 637763 - RNA, 64 nt, Homo Sapiens; identical to SEQ ID NO: 38329

SEQ ID NO: 637764 - RNA, 64 nt, Homo Sapiens; identical to SEQ ID NO: 38330

SEQ ID NO: 637765 - RNA, 64 nt, Homo Sapiens; identical to SEQ ID NO: 38331

SEQ ID NO: 637766 - RNA, 64 nt, Homo Sapiens; identical to SEQ ID NO: 38332

SEQ ID NO: 637767 - RNA, 64 nt, Homo Sapiens; identical to SEQ ID NO: 38333

SEQ ID NO: 637768 - RNA, 64 nt, Homo Sapiens; identical to SEQ ID NO: 38334

SEQ ID NO: 637769 - RNA, 64 nt, Homo Sapiens; identical to SEQ ID NO: 38335

SEQ ID NO: 637770 - RNA, 64 nt, Homo Sapiens; identical to SEQ ID NO: 38336

SEQ ID NO: 637771 - RNA, 64 nt, Homo Sapiens; identical to SEQ ID NO: 38337

SEQ ID NO: 637772 - RNA, 64 nt, Homo Sapiens; identical to SEQ ID NO: 38338

SEQ ID NO: 637773 - RNA, 64 nt, Homo Sapiens; identical to SEQ ID NO: 38339

SEQ ID NO: 637774 - RNA, 64 nt, Homo Sapiens; identical to SEQ ID NO: 38340

SEQ ID NO: 637775 - RNA, 64 nt, Homo Sapiens; identical to SEQ ID NO: 38341

SEQ ID NO: 637776 - RNA, 64 nt, Homo Sapiens; identical to SEQ ID NO: 38342

SEQ ID NO: 637777 - RNA, 64 nt, Homo Sapiens; identical to SEQ ID NO: 38343

SEQ ID NO: 637778 - RNA, 64 nt, Homo Sapiens; identical to SEQ ID NO: 38344

SEQ ID NO: 637779 - RNA, 64 nt, Homo Sapiens; identical to SEQ ID NO: 38345

SEQ ID NO: 637780 - RNA, 64 nt, Homo Sapiens; identical to SEQ ID NO: 38346

SEQ ID NO: 637781 - RNA, 64 nt, Homo Sapiens; identical to SEQ ID NO: 38347

SEQ ID NO: 637782 - RNA, 64 nt, Homo Sapiens; identical to SEQ ID NO: 38348

SEQ ID NO: 637783 - RNA, 64 nt, Homo Sapiens; identical to SEQ ID NO: 38349

SEQ ID NO: 637784 - RNA, 64 nt, Homo Sapiens; identical to SEQ ID NO: 38350

SEQ ID NO: 637785 - RNA, 64 nt, Homo Sapiens; identical to SEQ ID NO: 38351

SEQ ID NO: 637786 - RNA, 64 nt, Homo Sapiens; identical to SEQ ID NO: 38352

SEQ ID NO: 637787 - RNA, 64 nt, Homo Sapiens; identical to SEQ ID NO: 38353

SEQ ID NO: 637788 - RNA, 64 nt, Homo Sapiens; identical to SEQ ID NO: 38354

SEQ ID NO: 637789 - RNA, 64 nt, Homo Sapiens; identical to SEQ ID NO: 38355

SEQ ID NO: 637790 - RNA, 64 nt, Homo Sapiens; identical to SEQ ID NO: 38356

SEQ ID NO: 637791 - RNA, 64 nt, Homo Sapiens; identical to SEQ ID NO: 38357

SEQ ID NO: 637792 - RNA, 64 nt, Homo Sapiens; identical to SEQ ID NO: 38358

SEQ ID NO: 637793 - RNA, 64 nt, Homo Sapiens; identical to SEQ ID NO: 38359

SEQ ID NO: 637794 - RNA, 64 nt, Homo Sapiens; identical to SEQ ID NO: 38360

SEQ ID NO: 637795 - RNA, 64 nt, Homo Sapiens; identical to SEQ ID NO: 38361

SEQ ID NO: 637796 - RNA, 64 nt, Homo Sapiens; identical to SEQ ID NO: 38362

SEQ ID NO: 637797 - RNA, 64 nt, Homo Sapiens; identical to SEQ ID NO: 38363

SEQ ID NO: 637798 - RNA, 64 nt, Homo Sapiens; identical to SEQ ID NO: 38364

SEQ ID NO: 637799 - RNA, 64 nt, Homo Sapiens; identical to SEQ ID NO: 38365

SEQ ID NO: 637800 - RNA, 64 nt, Homo Sapiens; identical to SEQ ID NO: 38366

SEQ ID NO: 637801 - RNA, 64 nt, Homo Sapiens; identical to SEQ ID NO: 38367

SEQ ID NO: 637802 - RNA, 64 nt, Homo Sapiens; identical to SEQ ID NO: 38368

SEQ ID NO: 637803 - RNA, 64 nt, Homo Sapiens; identical to SEQ ID NO: 38369

SEQ ID NO: 637804 - RNA, 64 nt, Homo Sapiens; identical to SEQ ID NO: 38370

SEQ ID NO: 637805 - RNA, 64 nt, Homo Sapiens; identical to SEQ ID NO: 38371

SEQ ID NO: 637806 - RNA, 64 nt, Homo Sapiens; identical to SEQ ID NO: 38372

SEQ ID NO: 637807 - RNA, 64 nt, Homo Sapiens; identical to SEQ ID NO: 38373

SEQ ID NO: 637808 - RNA, 64 nt, Homo Sapiens; identical to SEQ ID NO: 38374

SEQ ID NO: 637809 - RNA, 64 nt, Homo Sapiens; identical to SEQ ID NO: 38375

SEQ ID NO: 637810 - RNA, 64 nt, Homo Sapiens; identical to SEQ ID NO: 38376

SEQ ID NO: 637811 - RNA, 64 nt, Homo Sapiens; identical to SEQ ID NO: 38377

SEQ ID NO: 637812 - RNA, 64 nt, Homo Sapiens; identical to SEQ ID NO: 38378

SEQ ID NO: 637813 - RNA, 64 nt, Homo Sapiens; identical to SEQ ID NO: 38379

SEQ ID NO: 637814 - RNA, 64 nt, Homo Sapiens; identical to SEQ ID NO: 38380

SEQ ID NO: 637815 - RNA, 64 nt, Homo Sapiens; identical to SEQ ID NO: 38381

SEQ ID NO: 637816 - RNA, 64 nt, Homo Sapiens; identical to SEQ ID NO: 38382

SEQ ID NO: 637817 - RNA, 64 nt, Homo Sapiens; identical to SEQ ID NO: 38383

SEQ ID NO: 637818 - RNA, 64 nt, Homo Sapiens; identical to SEQ ID NO: 38384

SEQ ID NO: 637819 - RNA, 64 nt, Homo Sapiens
ccuggagagcuagaaccuggagaacuagaaccuggagggcuagaacuggagaggcuagaaccaa

SEQ ID NO: 637820 - RNA, 64 nt, Homo Sapiens
ccuggagggcuggaaucuggagagcuagaaccuggagggcuagaaccuggagggcuagaaucug

SEQ ID NO: 637821 - RNA, 64 nt, Homo Sapiens
ucuggagagcuagaaccuggagggcuagaaccuggagggcuagaaucuggagagcuagaaccug

SEQ ID NO: 637822 - RNA, 64 nt, Homo Sapiens
ccuggagggcuagaaucuggagagcuagaaccuggagggcuagaaucuggagagcuagaaccug

SEQ ID NO: 637823 - RNA, 64 nt, Homo Sapiens
ccuggagggcuagaaucuggagagcuagaaccuggagggcuagaaccuggagagcuagaaccua

SEQ ID NO: 637824 - RNA, 64 nt, Homo Sapiens
ccuggagggcuggaaucuggagagcuagaaccuggagggcuagaaccuggagggcuagaaccua

SEQ ID NO: 637825 - RNA, 64 nt, Homo Sapiens
ucuggagagcuagaaccuggagggcuagaaccuggagggcuagaaccuagaagggcuagaaccu

SEQ ID NO: 637826 - RNA, 64 nt, Homo Sapiens; identical to SEQ ID NO: 637824

SEQ ID NO: 637827 - RNA, 64 nt, Homo Sapiens; identical to SEQ ID NO: 637825

SEQ ID NO: 637828 - RNA, 64 nt, Homo Sapiens
cuggagggcuagaaccuagaagggcuagaaccuggagggcuagaaccuggcagguuagaaccua

SEQ ID NO: 637829 - RNA, 64 nt, Homo Sapiens
cuagaagggcuagaaccuggagagccagaaccuggagggcuagaaccuggaagggcuagaaccu

SEQ ID NO: 637830 - RNA, 64 nt, Homo Sapiens
ccuggcaagcuagaaccuggagggaaugaaccuggagggcuagaaccuggagaaugagaaaaau

SEQ ID NO: 637831 - RNA, 64 nt, Homo Sapiens; identical to SEQ ID NO: 276332

SEQ ID NO: 637832 - RNA, 64 nt, Homo Sapiens; identical to SEQ ID NO: 276333

SEQ ID NO: 637833 - RNA, 64 nt, Homo Sapiens; identical to SEQ ID NO: 276334

SEQ ID NO: 637834 - RNA, 64 nt, Homo Sapiens; identical to SEQ ID NO: 276335

SEQ ID NO: 637835 - RNA, 64 nt, Homo Sapiens; identical to SEQ ID NO: 276336

SEQ ID NO: 637836 - RNA, 64 nt, Homo Sapiens; identical to SEQ ID NO: 276337

SEQ ID NO: 637837 - RNA, 64 nt, Homo Sapiens; identical to SEQ ID NO: 276338

SEQ ID NO: 637838 - RNA, 64 nt, Homo Sapiens; identical to SEQ ID NO: 276339

SEQ ID NO: 637839 - RNA, 64 nt, Homo Sapiens; identical to SEQ ID NO: 276340

SEQ ID NO: 637840 - RNA, 64 nt, Homo Sapiens; identical to SEQ ID NO: 276341

SEQ ID NO: 637841 - RNA, 64 nt, Homo Sapiens; identical to SEQ ID NO: 276342

SEQ ID NO: 637842 - RNA, 64 nt, Homo Sapiens; identical to SEQ ID NO: 276343

SEQ ID NO: 637843 - RNA, 64 nt, Homo Sapiens; identical to SEQ ID NO: 276344

SEQ ID NO: 637844 - RNA, 64 nt, Homo Sapiens; identical to SEQ ID NO: 276345

SEQ ID NO: 637845 - RNA, 64 nt, Homo Sapiens; identical to SEQ ID NO: 276346

SEQ ID NO: 637846 - RNA, 64 nt, Homo Sapiens; identical to SEQ ID NO: 276347

SEQ ID NO: 637847 - RNA, 64 nt, Homo Sapiens; identical to SEQ ID NO: 276348

SEQ ID NO: 637848 - RNA, 64 nt, Homo Sapiens; identical to SEQ ID NO: 276349

SEQ ID NO: 637849 - RNA, 64 nt, Homo Sapiens; identical to SEQ ID NO: 276350

SEQ ID NO: 637850 - RNA, 64 nt, Homo Sapiens; identical to SEQ ID NO: 276351

SEQ ID NO: 637851 - RNA, 64 nt, Homo Sapiens; identical to SEQ ID NO: 276352

SEQ ID NO: 637852 - RNA, 64 nt, Homo Sapiens; identical to SEQ ID NO: 276353

SEQ ID NO: 637853 - RNA, 64 nt, Homo Sapiens; identical to SEQ ID NO: 276354

SEQ ID NO: 637854 - RNA, 64 nt, Homo Sapiens; identical to SEQ ID NO: 276355

SEQ ID NO: 637855 - RNA, 64 nt, Homo Sapiens; identical to SEQ ID NO: 276356

SEQ ID NO: 637856 - RNA, 64 nt, Homo Sapiens; identical to SEQ ID NO: 276357

SEQ ID NO: 637857 - RNA, 64 nt, Homo Sapiens; identical to SEQ ID NO: 276358

SEQ ID NO: 637858 - RNA, 64 nt, Homo Sapiens; identical to SEQ ID NO: 276359

SEQ ID NO: 637859 - RNA, 64 nt, Homo Sapiens; identical to SEQ ID NO: 257770

SEQ ID NO: 637860 - RNA, 64 nt, Homo Sapiens; identical to SEQ ID NO: 257771

SEQ ID NO: 637861 - RNA, 61 nt, Homo Sapiens; identical to SEQ ID NO: 257772

SEQ ID NO: 637862 - RNA, 64 nt, Homo Sapiens; identical to SEQ ID NO: 257773

SEQ ID NO: 637863 - RNA, 64 nt, Homo Sapiens; identical to SEQ ID NO: 257774

SEQ ID NO: 637864 - RNA, 64 nt, Homo Sapiens; identical to SEQ ID NO: 257775

SEQ ID NO: 637865 - RNA, 64 nt, Homo Sapiens; identical to SEQ ID NO: 475408

SEQ ID NO: 637866 - RNA, 57 nt, Homo Sapiens; identical to SEQ ID NO: 475409

SEQ ID NO: 637867 - RNA, 64 nt, Homo Sapiens; identical to SEQ ID NO: 133894

SEQ ID NO: 637868 - RNA, 64 nt, Homo Sapiens; identical to SEQ ID NO: 133895

SEQ ID NO: 637869 - RNA, 64 nt, Homo Sapiens; identical to SEQ ID NO: 133896

SEQ ID NO: 637870 - RNA, 64 nt, Homo Sapiens; identical to SEQ ID NO: 133897

SEQ ID NO: 637871 - RNA, 64 nt, Homo Sapiens; identical to SEQ ID NO: 133898

SEQ ID NO: 637872 - RNA, 64 nt, Homo Sapiens; identical to SEQ ID NO: 133899

SEQ ID NO: 637873 - RNA, 64 nt, Homo Sapiens; identical to SEQ ID NO: 133900

SEQ ID NO: 637874 - RNA, 64 nt, Homo Sapiens; identical to SEQ ID NO: 133901

SEQ ID NO: 637875 - RNA, 64 nt, Homo Sapiens; identical to SEQ ID NO: 133902

SEQ ID NO: 637876 - RNA, 64 nt, Homo Sapiens; identical to SEQ ID NO: 133903

SEQ ID NO: 637877 - RNA, 64 nt, Homo Sapiens; identical to SEQ ID NO: 133904

SEQ ID NO: 637878 - RNA, 64 nt, Homo Sapiens; identical to SEQ ID NO: 133905

SEQ ID NO: 637879 - RNA, 64 nt, Homo Sapiens; identical to SEQ ID NO: 133906

SEQ ID NO: 637880 - RNA, 64 nt, Homo Sapiens; identical to SEQ ID NO: 133907

SEQ ID NO: 637881 - RNA, 64 nt, Homo Sapiens; identical to SEQ ID NO: 133908

SEQ ID NO: 637882 - RNA, 64 nt, Homo Sapiens; identical to SEQ ID NO: 133909

SEQ ID NO: 637883 - RNA, 64 nt, Homo Sapiens; identical to SEQ ID NO: 133910

SEQ ID NO: 637884 - RNA, 64 nt, Homo Sapiens; identical to SEQ ID NO: 133911

SEQ ID NO: 637885 - RNA, 64 nt, Homo Sapiens; identical to SEQ ID NO: 133912

SEQ ID NO: 637886 - RNA, 64 nt, Homo Sapiens; identical to SEQ ID NO: 133913

SEQ ID NO: 637887 - RNA, 64 nt, Homo Sapiens; identical to SEQ ID NO: 133914

SEQ ID NO: 637888 - RNA, 64 nt, Homo Sapiens; identical to SEQ ID NO: 133915

SEQ ID NO: 637889 - RNA, 64 nt, Homo Sapiens; identical to SEQ ID NO: 444674

SEQ ID NO: 637890 - RNA, 64 nt, Homo Sapiens; identical to SEQ ID NO: 444675

SEQ ID NO: 637891 - RNA, 64 nt, Homo Sapiens; identical to SEQ ID NO: 444676

SEQ ID NO: 637892 - RNA, 64 nt, Homo Sapiens; identical to SEQ ID NO: 444677

SEQ ID NO: 637893 - RNA, 64 nt, Homo Sapiens; identical to SEQ ID NO: 444678

SEQ ID NO: 637894 - RNA, 64 nt, Homo Sapiens; identical to SEQ ID NO: 444679

SEQ ID NO: 637895 - RNA, 64 nt, Homo Sapiens; identical to SEQ ID NO: 444680

SEQ ID NO: 637896 - RNA, 64 nt, Homo Sapiens; identical to SEQ ID NO: 444681

SEQ ID NO: 637897 - RNA, 64 nt, Homo Sapiens; identical to SEQ ID NO: 444682

SEQ ID NO: 637898 - RNA, 64 nt, Homo Sapiens; identical to SEQ ID NO: 444683

SEQ ID NO: 637899 - RNA, 64 nt, Homo Sapiens; identical to SEQ ID NO: 444684

SEQ ID NO: 637900 - RNA, 64 nt, Homo Sapiens; identical to SEQ ID NO: 444685

SEQ ID NO: 637901 - RNA, 64 nt, Homo Sapiens; identical to SEQ ID NO: 444686

SEQ ID NO: 637902 - RNA, 64 nt, Homo Sapiens; identical to SEQ ID NO: 444687

SEQ ID NO: 637903 - RNA, 64 nt, Homo Sapiens; identical to SEQ ID NO: 444688

SEQ ID NO: 637904 - RNA, 64 nt, Homo Sapiens; identical to SEQ ID NO: 444689

SEQ ID NO: 637905 - RNA, 64 nt, Homo Sapiens; identical to SEQ ID NO: 444690

SEQ ID NO: 637906 - RNA, 64 nt, Homo Sapiens; identical to SEQ ID NO: 444691

SEQ ID NO: 637907 - RNA, 64 nt, Homo Sapiens; identical to SEQ ID NO: 444692

SEQ ID NO: 637908 - RNA, 64 nt, Homo Sapiens; identical to SEQ ID NO: 444693

SEQ ID NO: 637909 - RNA, 64 nt, Homo Sapiens; identical to SEQ ID NO: 444694

SEQ ID NO: 637910 - RNA, 64 nt, Homo Sapiens; identical to SEQ ID NO: 444695

SEQ ID NO: 637911 - RNA, 64 nt, Homo Sapiens; identical to SEQ ID NO: 444696

SEQ ID NO: 637912 - RNA, 64 nt, Homo Sapiens; identical to SEQ ID NO: 444697

SEQ ID NO: 637913 - RNA, 64 nt, Homo Sapiens; identical to SEQ ID NO: 444698

SEQ ID NO: 637914 - RNA, 64 nt, Homo Sapiens; identical to SEQ ID NO: 444699

SEQ ID NO: 637915 - RNA, 64 nt, Homo Sapiens; identical to SEQ ID NO: 444700

SEQ ID NO: 637916 - RNA, 64 nt, Homo Sapiens; identical to SEQ ID NO: 444701

SEQ ID NO: 637917 - RNA, 64 nt, Homo Sapiens; identical to SEQ ID NO: 444702

SEQ ID NO: 637918 - RNA, 64 nt, Homo Sapiens; identical to SEQ ID NO: 444703

SEQ ID NO: 637919 - RNA, 64 nt, Homo Sapiens; identical to SEQ ID NO: 444704

SEQ ID NO: 637920 - RNA, 64 nt, Homo Sapiens; identical to SEQ ID NO: 444705

SEQ ID NO: 637921 - RNA, 64 nt, Homo Sapiens; identical to SEQ ID NO: 444706

SEQ ID NO: 637922 - RNA, 64 nt, Homo Sapiens; identical to SEQ ID NO: 444707

SEQ ID NO: 637923 - RNA, 64 nt, Homo Sapiens; identical to SEQ ID NO: 444708

SEQ ID NO: 637924 - RNA, 64 nt, Homo Sapiens; identical to SEQ ID NO: 444709

SEQ ID NO: 637925 - RNA, 64 nt, Homo Sapiens; identical to SEQ ID NO: 444710

SEQ ID NO: 637926 - RNA, 64 nt, Homo Sapiens; identical to SEQ ID NO: 444711

SEQ ID NO: 637927 - RNA, 64 nt, Homo Sapiens; identical to SEQ ID NO: 444712

SEQ ID NO: 637928 - RNA, 64 nt, Homo Sapiens; identical to SEQ ID NO: 444713

SEQ ID NO: 637929 - RNA, 64 nt, Homo Sapiens; identical to SEQ ID NO: 444714

SEQ ID NO: 637930 - RNA, 64 nt, Homo Sapiens; identical to SEQ ID NO: 444715

SEQ ID NO: 637931 - RNA, 64 nt, Homo Sapiens; identical to SEQ ID NO: 444716

SEQ ID NO: 637932 - RNA, 64 nt, Homo Sapiens; identical to SEQ ID NO: 444717

SEQ ID NO: 637933 - RNA, 64 nt, Homo Sapiens; identical to SEQ ID NO: 444718

SEQ ID NO: 637934 - RNA, 64 nt, Homo Sapiens; identical to SEQ ID NO: 444719

SEQ ID NO: 637935 - RNA, 64 nt, Homo Sapiens; identical to SEQ ID NO: 444720

SEQ ID NO: 637936 - RNA, 64 nt, Homo Sapiens; identical to SEQ ID NO: 444721

SEQ ID NO: 637937 - RNA, 64 nt, Homo Sapiens; identical to SEQ ID NO: 444722

SEQ ID NO: 637938 - RNA, 64 nt, Homo Sapiens; identical to SEQ ID NO: 444723

SEQ ID NO: 637939 - RNA, 64 nt, Homo Sapiens; identical to SEQ ID NO: 444724

SEQ ID NO: 637940 - RNA, 64 nt, Homo Sapiens; identical to SEQ ID NO: 444725

SEQ ID NO: 637941 - RNA, 64 nt, Homo Sapiens; identical to SEQ ID NO: 444726

SEQ ID NO: 637942 - RNA, 64 nt, Homo Sapiens; identical to SEQ ID NO: 444727

SEQ ID NO: 637943 - RNA, 64 nt, Homo Sapiens
caggcauaggcagggaaccgagcagcaggucagagcaggcgagcugacauucugcagccuggac

SEQ ID NO: 637944 - RNA, 64 nt, Homo Sapiens
gcagagagaccagugcagggcuguuaacaggguugcaggcgagagacuggggugcugggcuccc

SEQ ID NO: 637945 - RNA, 61 nt, Homo Sapiens
uccugcucuuccccgacuagggcgggcagaugcgcucgagccccacgggccuuccaccucc

SEQ ID NO: 637946 - RNA, 64 nt, Homo Sapiens
auggaggaugaugcauacaugucggucaaguucagcgcucgacauuuuauggaaagauuuuuuu

SEQ ID NO: 637947 - RNA, 64 nt, Homo Sapiens
aagaagguaggaaucccggcaacgcuauguuagcgcgcucgagguaggauuuccaauuguuaau

SEQ ID NO: 637948 - RNA, 64 nt, Homo Sapiens
gaccucagcaagcugcccagcccuggcccccacagcgcucgauggucuccaugugugugccaag

SEQ ID NO: 637949 - RNA, 64 nt, Homo Sapiens
ugugcuguuaggcuaagaggcagcccagggcacagcgcucgagggcggccugccgccacgucag

SEQ ID NO: 637950 - RNA, 59 nt, Homo Sapiens
gcacaggagcccgagacaaugcagccguggcgcucgacucauccuggaucauccaauga

SEQ ID NO: 637951 - RNA, 64 nt, Homo Sapiens
gcccaacgccucccggaccggcccugggcuccuagcgcucgaaaggcgccccgggucuuccgcc

SEQ ID NO: 637952 - RNA, 64 nt, Homo Sapiens
uucagguuccgagccugaccccuggaacugaccagcgcucgauugucagccuuggccugggguu

SEQ ID NO: 637953 - RNA, 64 nt, Homo Sapiens
ccugccucagccucccaaagugcuggcauuacaggcgcucgaggcuuucugauguggcugcugc

SEQ ID NO: 637954 - RNA, 64 nt, Homo Sapiens
gagcggagcacgccggcucccaguacuaggggcugcgcucgagcaguggcgggggcggaggggu

SEQ ID NO: 637955 - RNA, 64 nt, Homo Sapiens
acacgugguagaugcccaccuccuccaugccucggcgcucgaucuccuccacgcacuggcgcac

SEQ ID NO: 637956 - RNA, 64 nt, Homo Sapiens
aauaaaaugguucgauccggucuugacuugccaggcgcucgaggcgggguggggcugcccgggc

SEQ ID NO: 637957 - RNA, 64 nt, Homo Sapiens
uugaucuccccagcgagggcuaaauagcauuuuggcgcucgaagcuuucuuucuuuuuuuuuuu

SEQ ID NO: 637958 - RNA, 64 nt, Homo Sapiens
acaauucacggaacuguuaugcaggaaauggccagccucaaacguucuugucuggaagaguucu

SEQ ID NO: 637959 - RNA, 64 nt, Homo Sapiens
uacgauuacgagacuuaggaccgauucucuucgugccucaaaaagcucauugaaccuccacaca

SEQ ID NO: 637960 - RNA, 64 nt, Homo Sapiens
ugccuguuuugaucuguuuugaaaaagauaaagagccucaaaucagaccagcacugauuaauua

SEQ ID NO: 637961 - RNA, 64 nt, Homo Sapiens
gcacacuccaaucugggugaaagaccgagacuccgccucaaaaaaaaaaaaaaaagaaagaaag

SEQ ID NO: 637962 - RNA, 64 nt, Homo Sapiens
acaguagcauugaaguguuuuggaagaaaauuaggccucaaaugagcauggcauauagugcccu

SEQ ID NO: 637963 - RNA, 64 nt, Homo Sapiens
uuccuuacugucucucuugucuaaagaauauaaagccucaaaucaguauggcaaaaguaggcau

SEQ ID NO: 637964 - RNA, 64 nt, Homo Sapiens
auuccauaauguuacaauggauuuaagcuaugaagccucaaaacaucacgagauaagcaugaug

SEQ ID NO: 637965 - RNA, 64 nt, Homo Sapiens
uaucuacgauaaaaauuuuuauacagaaccuacugccucaaacugaaucccaucaagaaaacua

SEQ ID NO: 637966 - RNA, 64 nt, Homo Sapiens
ugggccuucgagccuucgaagcccacgugcaagcgccucaaaccaagucacgcuuggcgaggcc

SEQ ID NO: 637967 - RNA, 64 nt, Homo Sapiens
ggucuugaccacgagcuaguucugaauugcaggggccucaaagcagcaccuaaaccuugagggg

SEQ ID NO: 637968 - RNA, 64 nt, Homo Sapiens
gugcauguaagccuuuguuuccuggaggagaagggccucaaacugccauaugggcucacagcac

SEQ ID NO: 637969 - RNA, 64 nt, Homo Sapiens
ugacuuggucccacuuggagaaacuucuggcuaggccucaaaacaacaugucgcaaaaugaacc

SEQ ID NO: 637970 - RNA, 64 nt, Homo Sapiens
ucaguuuauugaagacauuuuuuuuuuuuguucugccucaaagcgagagguuuuagauuuuugu

SEQ ID NO: 637971 - RNA, 64 nt, Homo Sapiens
uagcaccuuaaguuaaaggcucauagucaauggugccucaaacaugcucuccuaugaccccaaa

SEQ ID NO: 637972 - RNA, 64 nt, Homo Sapiens
aaagaaauauauccuaugcaucaaauuugacucugccucaaaaaauuguguacaauuuggggcc

SEQ ID NO: 637973 - RNA, 64 nt, Homo Sapiens
ugacucugccucaaaaaaaaguguacaauuuggggccucaaauuagccaccaaaaaaaaguauu

SEQ ID NO: 637974 - RNA, 64 nt, Homo Sapiens
auccuccugccucggccucccucuccaacuacuggccucaaacguugcuacguugcccacacug

SEQ ID NO: 637975 - RNA, 64 nt, Homo Sapiens
ccugggcucaagcgauccuccauggcucacugcagccucaaauucugaagugcgguggugcaau

SEQ ID NO: 637976 - RNA, 61 nt, Homo Sapiens
agcccaccuggcucacacacagccucauggguagggucagcaaaccagauggcuuguuguu

SEQ ID NO: 637977 - RNA, 61 nt, Homo Sapiens
ucacuguuagaaauaggcuuuguuagcugacuagggucagggaaacuuuucucuucaaauu

SEQ ID NO: 637978 - RNA, 61 nt, Homo Sapiens
cauuccaguugcugggacggaaggcugaauguagggucauuuuguaugggauaugcagagc

SEQ ID NO: 637979 - RNA, 61 nt, Homo Sapiens
cugccaaugaccccugggagagggacuuugguagggucaugauaaaguggcgggggucugg

SEQ ID NO: 637980 - RNA, 61 nt, Homo Sapiens
ugggcuucuucugggguuccacccugacaaguagggucacagaggcuggugcacaguuucu

SEQ ID NO: 637981 - RNA, 61 nt, Homo Sapiens
cauugagguaacugagcacuugagaauauuuuagggucaaaguguaauuauucauaaugaa

SEQ ID NO: 637982 - RNA, 61 nt, Homo Sapiens
agccaugguccucuagaugcaguuaaccaaauagggucauuuuuauuaaaaguaguguuuc

SEQ ID NO: 637983 - RNA, 61 nt, Homo Sapiens
gacaaaaaaccucaggccuggugccugaguuuagggucaagcaggggggaguaugagcaga

SEQ ID NO: 637984 - RNA, 61 nt, Homo Sapiens
uuugugccucacuggaauuagaauguuuugauagggucacaguugguaauacugaauggua

SEQ ID NO: 637985 - RNA, 61 nt, Homo Sapiens
ugaaagcuucagucucggaauauauuggaacuagggucauugauaaacugaagaaaguguc

SEQ ID NO: 637986 - RNA, 61 nt, Homo Sapiens
uuaagcucuggggaaaaaggucccugcgcuauagggucacuaagccaaggaacuaccccgc

SEQ ID NO: 637987 - RNA, 61 nt, Homo Sapiens
ucugcugccauucugaggaacccuuaccuccuagggucacccugcagccucgaaaaaguug

SEQ ID NO: 637988 - RNA, 61 nt, Homo Sapiens
ucauggguauguggagaauggguuuugagauuagggucaggccccagagcuugccagguug

SEQ ID NO: 637989 - RNA, 61 nt, Homo Sapiens
guuacucaucccuuuucaaaggagguaagaguagggucagacagcuugaauugauggggag

SEQ ID NO: 637990 - RNA, 61 nt, Homo Sapiens
gugucuaaccuccaacugcugugcugucugcuagggucaccuccuguuugugaaaggggac

SEQ ID NO: 637991 - RNA, 61 nt, Homo Sapiens
gcacggccccuuuuauccugcgcauguggccuagggucauccccagcccaucccuguguca

SEQ ID NO: 637992 - RNA, 61 nt, Homo Sapiens
cuuguucccugaugugucucgagcccauugguagggucauacaaagcccacgguuacaagc

SEQ ID NO: 637993 - RNA, 61 nt, Homo Sapiens
cgcaggccaacccauccccaguugagccuuauagggucaguagcucuccacaugaagaccu

SEQ ID NO: 637994 - RNA, 61 nt, Homo Sapiens
ugagcuuguagcucugauuaucuagcauuuuuagggucauucuccuuaauaggcuuuuaug

SEQ ID NO: 637995 - RNA, 61 nt, Homo Sapiens
aguuaugggaaagagaaugcauagaccuaucuagggucaucauagaagccuuuauaauuua

SEQ ID NO: 637996 - RNA, 61 nt, Homo Sapiens
acuuuucuuauccaggggaaaauugccauuuuagggucagcaugaacagcucuuucuugua

SEQ ID NO: 637997 - RNA, 61 nt, Homo Sapiens
uauuuacauuuuauauuuuuguacauauuguuagggucagccauuuuuaaugaucucggau

SEQ ID NO: 637998 - RNA, 61 nt, Homo Sapiens
cgcgugcccuguugcugaaugcacuuguccguagggucacaagugggcacucccaaccuca

SEQ ID NO: 637999 - RNA, 61 nt, Homo Sapiens
uguaaacccuggaaccugagagcccaaaguuuagggucaaaagcacccagacagauuuaga

SEQ ID NO: 638000 - RNA, 61 nt, Homo Sapiens
ccauaugauaaaacuaaagguaccaggacaauagggucauugcaucacuguguugggauca

SEQ ID NO: 638001 - RNA, 61 nt, Homo Sapiens
gagcaggugggcugaagccaggagaagagcauagggucaugagacagcuucgagaaccaga

SEQ ID NO: 638002 - RNA, 61 nt, Homo Sapiens
gauuuuccucucaguuuauuauuuggggggauagggucagguggguauaguaguacuuuac

SEQ ID NO: 638003 - RNA, 61 nt, Homo Sapiens
uuaaaacagcagaaguacaagaauacagcuguagggucauugcuuuaaauuauauaaaaug

SEQ ID NO: 638004 - RNA, 61 nt, Homo Sapiens
cuuacacugaagaguccuuuagcucaauugauagggucagcgucucgcaagcaaaaaaucu

SEQ ID NO: 638005 - RNA, 61 nt, Homo Sapiens
aaaaccagagcacuugaugaacucgggguacuagggucagggcuuauagcaggaugucugg

SEQ ID NO: 638006 - RNA, 61 nt, Homo Sapiens
uaucuucccuuuguuaagguguaacuugauguagggucaagguuuuugugacaacaggcag

SEQ ID NO: 638007 - RNA, 56 nt, Homo Sapiens
ggcccagagagaugaaguagcuugucuagggucacgcagcuuguaaguggcagagc

SEQ ID NO: 638008 - RNA, 61 nt, Homo Sapiens
uuaagaauagguuuagcuaggcagagccuucuagggucaccguuucagccuccagaagaca

SEQ ID NO: 638009 - RNA, 61 nt, Homo Sapiens
ucuccaccuuguuuuucuucaauuuuugguauagggucaucuccauuauuggagcuuuaau

SEQ ID NO: 638010 - RNA, 61 nt, Homo Sapiens
cgcaaagcccuagcagaaugacuguccacuguagggucauccagaguucuauccugccccc

SEQ ID NO: 638011 - RNA, 61 nt, Homo Sapiens
aaugaauuugagggaacaguauugccaauacuagggucaaauauauaaauagcaaagggcu

SEQ ID NO: 638012 - RNA, 61 nt, Homo Sapiens
ugaaacgcagacacugagaucuguuugaguuuagggucauuuuuagaaaggggcaguuuaa

SEQ ID NO: 638013 - RNA, 61 nt, Homo Sapiens
gagaaauaaaagcaugcccuuccaugcaaaguagggucauaaguuuccuaggauaauacag

SEQ ID NO: 638014 - RNA, 61 nt, Homo Sapiens
aucucuacauuccuuaggauuccaaauuugguagggucaucuaaacucauuggagucuagu

SEQ ID NO: 638015 - RNA, 61 nt, Homo Sapiens
gcauuuuaguaaacuuuuagacaaaauuuguuagggucauucaugaaaacuuuaauacuaa

SEQ ID NO: 638016 - RNA, 61 nt, Homo Sapiens
uccagaugacagcacagcuguuugggacugauagggucacaguugccagguugggaaugcu

SEQ ID NO: 638017 - RNA, 61 nt, Homo Sapiens
ucauuuuccuaaauauguuuauaagcucaucuagggucacccuguuagaggagacauauaa

SEQ ID NO: 638018 - RNA, 61 nt, Homo Sapiens
uugcaccacggcaggugccucuguguggagcuagggucaagcccugagcagcuucacuucc

SEQ ID NO: 638019 - RNA, 61 nt, Homo Sapiens
cagccggguggugacaaggagaaaagccuucuagggucacugucauucccuggccauguug

SEQ ID NO: 638020 - RNA, 61 nt, Homo Sapiens
aguaccucacagugguugugcucugcuggcuuagggucagaagagcagcuagaggcuccuc

SEQ ID NO: 638021 - RNA, 61 nt, Homo Sapiens
gggugaggaucaaagacacacuuucuucccuuagggucacacagaguuacugacacucagg

SEQ ID NO: 638022 - RNA, 61 nt, Homo Sapiens
uauaaaaucagacaaacauuuuacaguaacguagggucagcaacaugagcccugcccucaa

SEQ ID NO: 638023 - RNA, 61 nt, Homo Sapiens
aaacguauuguuguauauuuccauuuuugaauagggucaaggagcccaagcaaaucauuuc

SEQ ID NO: 638024 - RNA, 61 nt, Homo Sapiens
cuggauaguaguuauguugcugugaaaacuguagggucaaagccuuauagcaaaaaaaauu

SEQ ID NO: 638025 - RNA, 61 nt, Homo Sapiens
uauuucuguaagaucugagaaguggaauuuguagggucauagguuauguacacuuaaguuu

SEQ ID NO: 638026 - RNA, 61 nt, Homo Sapiens
auguugggaaggguguagugagaccuggcaguagggucauguugaguguuacaaaaucugu

SEQ ID NO: 638027 - RNA, 61 nt, Homo Sapiens
uuaauaugaugauaaugugcuuuggugaagguagggucauaaaggacaagaucaggauagc

SEQ ID NO: 638028 - RNA, 61 nt, Homo Sapiens
cgccaaggauuccaaagguggaaugagagaguagggucaaacugucacaguaucugcucca

SEQ ID NO: 638029 - RNA, 61 nt, Homo Sapiens
uggcacuucucagcaaguagauuuugaauauuagggucauuaaggauagcauuucuaagau

SEQ ID NO: 638030 - RNA, 61 nt, Homo Sapiens
aucguggagagaauacucagggagcgcuuucuagggucagaacacccagggaggaaaaaaa

SEQ ID NO: 638031 - RNA, 61 nt, Homo Sapiens
auccaugucuuacuccaacacacaaaaaccauagggucaagugauuuauuggaacagucua

SEQ ID NO: 638032 - RNA, 61 nt, Homo Sapiens
ggaaauguaaucuggaauuaaauguauauucuagggucagguuccuuuuuuuaacuuuaaa

SEQ ID NO: 638033 - RNA, 61 nt, Homo Sapiens
aucaaaaguuacuggaacuggaaaagcacauuagggucacuauucaaaaaacagauaauca

SEQ ID NO: 638034 - RNA, 61 nt, Homo Sapiens
ucacacauuuacacauaccaauuuuuuucaauagggucacguuaagccaugcuguaagcau

SEQ ID NO: 638035 - RNA, 61 nt, Homo Sapiens
ccuuggaggccaccgggacagaccuggacacuagggucaggcggggugcugugguggggag

SEQ ID NO: 638036 - RNA, 61 nt, Homo Sapiens
auaaggacccucagugacuaauuauuguggguagggucaagauuaacuaguuuuauacaga

SEQ ID NO: 638037 - RNA, 61 nt, Homo Sapiens
acuaacacauguuaaaaggacauuguuuuuauagggucauuuuaggcccuuugacuaaguu

SEQ ID NO: 638038 - RNA, 61 nt, Homo Sapiens
aacccauuauaaaaugaucuuaaaggacaccuagggucaauuaaagcuuuccaggugguuc

SEQ ID NO: 638039 - RNA, 61 nt, Homo Sapiens
agagacccuucugggucagacaugugagacauagggucacugcaugugagaugagacuugg

SEQ ID NO: 638040 - RNA, 61 nt, Homo Sapiens
ugcaccacccauggagaggugcauguugggauagggucagaaaggagaugagcguccuaag

SEQ ID NO: 638041 - RNA, 61 nt, Homo Sapiens
caccaggccuggacugaagguuggcucuggauagggucaguuagcugguucuggguuggag

SEQ ID NO: 638042 - RNA, 61 nt, Homo Sapiens
cacacccucuguaauuuuaacugaaccaucuuagggucacuccuccuuccuccagugccug

SEQ ID NO: 638043 - RNA, 61 nt, Homo Sapiens
ucggcuccccagaauuccuagacuggguuaauagggucauauugugaaugucucacuacaa

SEQ ID NO: 638044 - RNA, 61 nt, Homo Sapiens
caccuucagaauguaucgacaccagcuggguuagggucaagggugccuggggagggugagu

SEQ ID NO: 638045 - RNA, 61 nt, Homo Sapiens
gguguacaaugcccuguuuguacuuacugguuagggucaggguaacuugccagcccaagau

SEQ ID NO: 638046 - RNA, 61 nt, Homo Sapiens
caguguuugcuccaccuucauauuggcuagguagggucaccuagggaagcacuugcucaaa

SEQ ID NO: 638047 - RNA, 61 nt, Homo Sapiens
aauccuuacccaaaggaagcuucagagggcauagggucaugacaacucaagguggaaguau

SEQ ID NO: 638048 - RNA, 61 nt, Homo Sapiens
gauggugcuauuaauugaacugcucagggucuagggucacauccacuuccaguacuggacg

SEQ ID NO: 638049 - RNA, 61 nt, Homo Sapiens
ucucccugccugcuuugugcuuuugggaagguagggucauuuggucaugcuccugugaguu

SEQ ID NO: 638050 - RNA, 61 nt, Homo Sapiens
aucacaggcgccuauacagcuucugucucaauagggucagauauuuugcacuguauauucu

SEQ ID NO: 638051 - RNA, 61 nt, Homo Sapiens
augcuaaaggugauucuaguuaaucugggauuagggucaggaaaaugauagcaagacacau

SEQ ID NO: 638052 - RNA, 61 nt, Homo Sapiens
uguacauaaaggcuuaauuuguuuuccuuguuagggucaaggguguccuccacucuuuaac

SEQ ID NO: 638053 - RNA, 61 nt, Homo Sapiens
aaagaauaguuaggaaauaacuugguuuugauagggucaugauuaagaaaugauauauugg

SEQ ID NO: 638054 - RNA, 61 nt, Homo Sapiens
gacauucuauuugaacacuuccacuaagaauuagggucaaaaagcauauacaauccacuuc

SEQ ID NO: 638055 - RNA, 61 nt, Homo Sapiens
uuugaguuuguuuuucuuuuauaauaaaggguagggucauuuaaaagccaguauucuaaaa

SEQ ID NO: 638056 - RNA, 61 nt, Homo Sapiens
accauaucaaauuaaacaauucaugccuuuauagggucaggccuacaaugaauagguaugg

SEQ ID NO: 638057 - RNA, 61 nt, Homo Sapiens
gcuccucaggacccucugggucacacaucuuuagggucaguggccaauggggcacauuugg

SEQ ID NO: 638058 - RNA, 61 nt, Homo Sapiens
acccccacaagaccaagcaucacauggaguguagggucacugggagagcagaggucacagc

SEQ ID NO: 638059 - RNA, 61 nt, Homo Sapiens
uuuuuucaacguuuuuuuuucuuucaaacuguagggucacuuuugauugaggcaaaggggu

SEQ ID NO: 638060 - RNA, 61 nt, Homo Sapiens
aggcuguccauugaaaccccuuguccaugaauagggucauacuccuaagacugauggggug

SEQ ID NO: 638061 - RNA, 61 nt, Homo Sapiens
ccccuuagauacaaccaaugcuguaauauucuagggucacuaaucacuggaacugagcauu

SEQ ID NO: 638062 - RNA, 61 nt, Homo Sapiens
cauggcaaggccggaaguugcaugcaaagaguagggucagcaggggagugcacaagccgcc

SEQ ID NO: 638063 - RNA, 61 nt, Homo Sapiens
acucacugaagaaacuacuuuucaggcacuguagggucacccauaugccuccagcucaguu

SEQ ID NO: 638064 - RNA, 61 nt, Homo Sapiens
cucugcugucaacuucccaucuggcucagcauagggucacuuugccauuaugcaaauggag

SEQ ID NO: 638065 - RNA, 61 nt, Homo Sapiens
agaggauaguaaugaaaaugucucaguauuuuagggucaaugagagccauaaaaauauaac

SEQ ID NO: 638066 - RNA, 61 nt, Homo Sapiens
ugagccugguaggcugaggcagaagcugagauagggucaccccuguagucccaccuacucg

SEQ ID NO: 638067 - RNA, 61 nt, Homo Sapiens
uugaucucugcaguuugcucguuccguugacuagggucaucguggcugaccugggcugcug

SEQ ID NO: 638068 - RNA, 61 nt, Homo Sapiens
gugccucucagcuaguuggcuggacaucuccuagggucacucucucagccuggaggcuggc

SEQ ID NO: 638069 - RNA, 61 nt, Homo Sapiens
aaccaagccagaaacguaaccacagccaagguagggucacuacucuucccaccucagugcc

SEQ ID NO: 638070 - RNA, 61 nt, Homo Sapiens
ugccauuuccuaccuucucuaccugaggcuauagggucacuaaugggguguuuucuugcug

SEQ ID NO: 638071 - RNA, 61 nt, Homo Sapiens
acggcccucuggccaccuacccgagagaucguagggucacauacauccaacuucaccacuu

SEQ ID NO: 638072 - RNA, 61 nt, Homo Sapiens
ccacggcagccuaccggcaaugugcacguaguagggucagguccccuaaugccugcggagu

SEQ ID NO: 638073 - RNA, 61 nt, Homo Sapiens
gaauuccuaaauccaggaagaagccuggacguagggucauuagcuuugggaauagaaggcu

SEQ ID NO: 638074 - RNA, 61 nt, Homo Sapiens
cuguugauggacuuuuacauuguuuacagcuuagggucauaauaaaucaugcuucugagaa

SEQ ID NO: 638075 - RNA, 61 nt, Homo Sapiens
gcccgcccuucccggcgcaggugcgcgcggcuagggucaccuacaggguuccacuuuagaa

SEQ ID NO: 638076 - RNA, 61 nt, Homo Sapiens
ggaaugcuuuguguuguuuuaaaagacuucauagggucacugggagaauuggccauuggua

SEQ ID NO: 638077 - RNA, 61 nt, Homo Sapiens
ucuggcagcccacuugggcccugggcucuaauagggucauccuucuggugggcaagggccc

SEQ ID NO: 638078 - RNA, 61 nt, Homo Sapiens
cuugucagggucucuucggagacccaggauuuagggucacaugcugcaggcagggcugugg

SEQ ID NO: 638079 - RNA, 61 nt, Homo Sapiens
ugaucuuuaugggaugccuauaguuuugucuuagggucaaggcaugcagcuaacuccucuu

SEQ ID NO: 638080 - RNA, 61 nt, Homo Sapiens
uuucccauuucccuucaauguuugcuucugauagggucagcgcagcucugggaccuaggag

SEQ ID NO: 638081 - RNA, 61 nt, Homo Sapiens
uuguaguauucuugagaaaaacuuuaauguuuagggucagugggauuuaaugcacaggugu

SEQ ID NO: 638082 - RNA, 61 nt, Homo Sapiens
ccauauguuaauggaaagcuuuucuuaggccuagggucaaaaggguuuauuuccuuaugau

SEQ ID NO: 638083 - RNA, 61 nt, Homo Sapiens
cacguaggccuguugcugagggaaggcccucuagggucaucugguccagggguucuuugcu

SEQ ID NO: 638084 - RNA, 61 nt, Homo Sapiens
aacacugagcauuuaauuuacaaauguuugcuagggucacccucucggccaucccacgagg

SEQ ID NO: 638085 - RNA, 61 nt, Homo Sapiens
gacaaugucaaacuguguaaugaguccccuguagggucagagucggcugcugaugucuaga

SEQ ID NO: 638086 - RNA, 61 nt, Homo Sapiens
gucucagggaacccugagcuacagcagaacuuagggucaggcugguccccagggcaaggga

SEQ ID NO: 638087 - RNA, 61 nt, Homo Sapiens
gccccuaacucauaaagcaaggcacuggggcuagggucacaaggucagcaccuuccuguag

SEQ ID NO: 638088 - RNA, 61 nt, Homo Sapiens
agagacucagaguccagggccagucauggguuagggucagcggcaguggaugggaugcagc

SEQ ID NO: 638089 - RNA, 61 nt, Homo Sapiens
agagaaaguuccuuuccccacugguuaaguauagggucaccuuaagaugauugaagcuuua

SEQ ID NO: 638090 - RNA, 61 nt, Homo Sapiens
cugucauagaccaaaggaaucugauucucccuagggucaagaacaggcuaaggauacuaac

SEQ ID NO: 638091 - RNA, 61 nt, Homo Sapiens
cacaaaaagaggcagaugauagacacugggguagggucauaccacagggaaauaccuuucc

SEQ ID NO: 638092 - RNA, 61 nt, Homo Sapiens
agcauauaaauuaugacaauccuuuuagagguagggucaauauaguggauaaaccugucua

SEQ ID NO: 638093 - RNA, 61 nt, Homo Sapiens
aaagcaauagucacuaagcuuuucaagagucuagggucagaagaggccaguuuaaauaggc

SEQ ID NO: 638094 - RNA, 64 nt, Homo Sapiens; identical to SEQ ID NO: 411830

SEQ ID NO: 638095 - RNA, 64 nt, Homo Sapiens; identical to SEQ ID NO: 411831

SEQ ID NO: 638096 - RNA, 64 nt, Homo Sapiens; identical to SEQ ID NO: 411832

SEQ ID NO: 638097 - RNA, 64 nt, Homo Sapiens; identical to SEQ ID NO: 411833

SEQ ID NO: 638098 - RNA, 64 nt, Homo Sapiens; identical to SEQ ID NO: 411834

SEQ ID NO: 638099 - RNA, 64 nt, Homo Sapiens; identical to SEQ ID NO: 411835

SEQ ID NO: 638100 - RNA, 64 nt, Homo Sapiens; identical to SEQ ID NO: 411836

SEQ ID NO: 638101 - RNA, 64 nt, Homo Sapiens; identical to SEQ ID NO: 411837

SEQ ID NO: 638102 - RNA, 64 nt, Homo Sapiens; identical to SEQ ID NO: 411838

SEQ ID NO: 638103 - RNA, 64 nt, Homo Sapiens; identical to SEQ ID NO: 411839

SEQ ID NO: 638104 - RNA, 64 nt, Homo Sapiens; identical to SEQ ID NO: 411840

SEQ ID NO: 638105 - RNA, 64 nt, Homo Sapiens; identical to SEQ ID NO: 411841

SEQ ID NO: 638106 - RNA, 64 nt, Homo Sapiens; identical to SEQ ID NO: 411842

SEQ ID NO: 638107 - RNA, 64 nt, Homo Sapiens; identical to SEQ ID NO: 411843

SEQ ID NO: 638108 - RNA, 64 nt, Homo Sapiens; identical to SEQ ID NO: 411844

SEQ ID NO: 638109 - RNA, 64 nt, Homo Sapiens; identical to SEQ ID NO: 411845

SEQ ID NO: 638110 - RNA, 64 nt, Homo Sapiens; identical to SEQ ID NO: 411846

SEQ ID NO: 638111 - RNA, 64 nt, Homo Sapiens; identical to SEQ ID NO: 411847

SEQ ID NO: 638112 - RNA, 64 nt, Homo Sapiens; identical to SEQ ID NO: 411848

SEQ ID NO: 638113 - RNA, 64 nt, Homo Sapiens; identical to SEQ ID NO: 411849

SEQ ID NO: 638114 - RNA, 64 nt, Homo Sapiens; identical to SEQ ID NO: 411850

SEQ ID NO: 638115 - RNA, 64 nt, Homo Sapiens; identical to SEQ ID NO: 411851

SEQ ID NO: 638116 - RNA, 64 nt, Homo Sapiens; identical to SEQ ID NO: 411852

SEQ ID NO: 638117 - RNA, 64 nt, Homo Sapiens; identical to SEQ ID NO: 411853

SEQ ID NO: 638118 - RNA, 64 nt, Homo Sapiens; identical to SEQ ID NO: 411854

SEQ ID NO: 638119 - RNA, 64 nt, Homo Sapiens; identical to SEQ ID NO: 411855

SEQ ID NO: 638120 - RNA, 64 nt, Homo Sapiens; identical to SEQ ID NO: 411856

SEQ ID NO: 638121 - RNA, 64 nt, Homo Sapiens
uguguugaaugaaugugccuaccuuggcagaugcuagauaaaugcacccagcacagugcuguga

SEQ ID NO: 638122 - RNA, 64 nt, Homo Sapiens
uucauuacugaagauggaauggggauuucuuaauuagauaaaagcccucagauuuuauaaacug

SEQ ID NO: 638123 - RNA, 64 nt, Homo Sapiens
gaaacuaauaauagcucuauuuuuccucuguugcuagauaaauaauuucuuacaugauuuuuug

SEQ ID NO: 638124 - RNA, 64 nt, Homo Sapiens
uucagucugauaaccucaaauguggaaauaacccuagauaaaaaucuuuuucacuguagaauaa

SEQ ID NO: 638125 - RNA, 64 nt, Homo Sapiens; identical to SEQ ID NO: 163278

SEQ ID NO: 638126 - RNA, 64 nt, Homo Sapiens; identical to SEQ ID NO: 163279

SEQ ID NO: 638127 - RNA, 64 nt, Homo Sapiens; identical to SEQ ID NO: 163280

SEQ ID NO: 638128 - RNA, 64 nt, Homo Sapiens; identical to SEQ ID NO: 163281

SEQ ID NO: 638129 - RNA, 64 nt, Homo Sapiens; identical to SEQ ID NO: 163282

SEQ ID NO: 638130 - RNA, 64 nt, Homo Sapiens; identical to SEQ ID NO: 163283

SEQ ID NO: 638131 - RNA, 64 nt, Homo Sapiens; identical to SEQ ID NO: 163284

SEQ ID NO: 638132 - RNA, 64 nt, Homo Sapiens; identical to SEQ ID NO: 163285

SEQ ID NO: 638133 - RNA, 64 nt, Homo Sapiens; identical to SEQ ID NO: 163286

SEQ ID NO: 638134 - RNA, 64 nt, Homo Sapiens; identical to SEQ ID NO: 163287

SEQ ID NO: 638135 - RNA, 64 nt, Homo Sapiens; identical to SEQ ID NO: 163288

SEQ ID NO: 638136 - RNA, 64 nt, Homo Sapiens; identical to SEQ ID NO: 163289

SEQ ID NO: 638137 - RNA, 64 nt, Homo Sapiens; identical to SEQ ID NO: 163290

SEQ ID NO: 638138 - RNA, 64 nt, Homo Sapiens; identical to SEQ ID NO: 163291

SEQ ID NO: 638139 - RNA, 64 nt, Homo Sapiens; identical to SEQ ID NO: 163292

SEQ ID NO: 638140 - RNA, 64 nt, Homo Sapiens; identical to SEQ ID NO: 163293

SEQ ID NO: 638141 - RNA, 64 nt, Homo Sapiens; identical to SEQ ID NO: 163294

SEQ ID NO: 638142 - RNA, 64 nt, Homo Sapiens; identical to SEQ ID NO: 163295

SEQ ID NO: 638143 - RNA, 64 nt, Homo Sapiens; identical to SEQ ID NO: 163296

SEQ ID NO: 638144 - RNA, 64 nt, Homo Sapiens; identical to SEQ ID NO: 163297

SEQ ID NO: 638145 - RNA, 64 nt, Homo Sapiens; identical to SEQ ID NO: 163298

SEQ ID NO: 638146 - RNA, 64 nt, Homo Sapiens; identical to SEQ ID NO: 163299

SEQ ID NO: 638147 - RNA, 64 nt, Homo Sapiens; identical to SEQ ID NO: 163300

SEQ ID NO: 638148 - RNA, 64 nt, Homo Sapiens; identical to SEQ ID NO: 163301

SEQ ID NO: 638149 - RNA, 64 nt, Homo Sapiens; identical to SEQ ID NO: 163302

SEQ ID NO: 638150 - RNA, 64 nt, Homo Sapiens; identical to SEQ ID NO: 163303

SEQ ID NO: 638151 - RNA, 64 nt, Homo Sapiens; identical to SEQ ID NO: 163304

SEQ ID NO: 638152 - RNA, 64 nt, Homo Sapiens; identical to SEQ ID NO: 163305

SEQ ID NO: 638153 - RNA, 64 nt, Homo Sapiens; identical to SEQ ID NO: 163306

SEQ ID NO: 638154 - RNA, 64 nt, Homo Sapiens; identical to SEQ ID NO: 163307

SEQ ID NO: 638155 - RNA, 64 nt, Homo Sapiens; identical to SEQ ID NO: 163308

SEQ ID NO: 638156 - RNA, 64 nt, Homo Sapiens; identical to SEQ ID NO: 163309

SEQ ID NO: 638157 - RNA, 64 nt, Homo Sapiens; identical to SEQ ID NO: 163310

SEQ ID NO: 638158 - RNA, 64 nt, Homo Sapiens; identical to SEQ ID NO: 163311

SEQ ID NO: 638159 - RNA, 64 nt, Homo Sapiens; identical to SEQ ID NO: 163312

SEQ ID NO: 638160 - RNA, 64 nt, Homo Sapiens; identical to SEQ ID NO: 163313

SEQ ID NO: 638161 - RNA, 64 nt, Homo Sapiens; identical to SEQ ID NO: 163314

SEQ ID NO: 638162 - RNA, 64 nt, Homo Sapiens; identical to SEQ ID NO: 163315

SEQ ID NO: 638163 - RNA, 62 nt, Homo Sapiens
gcuuucccugguaucaggaacaaaagguaccucuucuguaaaauguccuucaaugcccaccu

SEQ ID NO: 638164 - RNA, 62 nt, Homo Sapiens
acuccaagcagccucagcagggccaagauuuccuucuguaucccuuauaggauuuucuuucu

SEQ ID NO: 638165 - RNA, 62 nt, Homo Sapiens
uagagaugguagagccaagauaaguguuuuaccuucuguaagcaacagaaaucugucucugu

SEQ ID NO: 638166 - RNA, 62 nt, Homo Sapiens
uaguaccauauuccaguuuuuaccccuuuagccuucuguaccuauaguauuuggggcuuucc

SEQ ID NO: 638167 - RNA, 62 nt, Homo Sapiens
aaugugucaccccagagggcuguucccaccugcuucuguagaaggcccugggacgucuguga

SEQ ID NO: 638168 - RNA, 62 nt, Homo Sapiens
uggcagcccugggccccaggccuccuucagcccuucuguaccgcccacccuggccuggacag

SEQ ID NO: 638169 - RNA, 62 nt, Homo Sapiens
auaugguuucaaacaucuuucuacagcuuauucuucuguaacguagaguaagaacuuaguga

SEQ ID NO: 638170 - RNA, 62 nt, Homo Sapiens
acaucaugcuuuaucauuucgucuauuuuaaccuucuguauggcugaauuuacuuguuguaa

SEQ ID NO: 638171 - RNA, 62 nt, Homo Sapiens
cggugacaaaggaagaggcagagaaugaugugcuucuguaguggaugagagcaaaaaccugg

SEQ ID NO: 638172 - RNA, 62 nt, Homo Sapiens
cggguaaagugggggccucagaagcuuuguuucuucuguaccgugaccucccugggccucug

SEQ ID NO: 638173 - RNA, 62 nt, Homo Sapiens
ggcaaauggugguauucaguuugguuuaaaaacuucuguacuuuucugcuuuaugccucagu

SEQ ID NO: 638174 - RNA, 62 nt, Homo Sapiens
uugcuugcuauuaaaaagguuugauugcauuacuucuguaugaaaaucaagggaaauacaag

SEQ ID NO: 638175 - RNA, 62 nt, Homo Sapiens
ugucugacacuagcacugucacgagccugagccuucuguacguuggcuggggauaugguaua

SEQ ID NO: 638176 - RNA, 62 nt, Homo Sapiens
aaaucuccaggauuuacaaagaagggucucugcuucuguacaagucuagggaggagggagug

SEQ ID NO: 638177 - RNA, 62 nt, Homo Sapiens
uuaauaaaugcugcucccccauauagucuucccuucuguauaauuaacauagguugucucau

SEQ ID NO: 638178 - RNA, 62 nt, Homo Sapiens
auuaagagaggcaugauaaugccauuuuuuuucuucuguacaacuggucagauuucaauaaa

SEQ ID NO: 638179 - RNA, 62 nt, Homo Sapiens
agcaaggaagaauucucauguccuuugucuuccuucuguagccauuaacugcugaauccaug

SEQ ID NO: 638180 - RNA, 62 nt, Homo Sapiens
cuauugcuauaaaccuagccaguucucuugcucuucuguauuuuccuauuucccugccauca

SEQ ID NO: 638181 - RNA, 62 nt, Homo Sapiens
ucacagugcuuaaaucucagaagccaaccugccuucuguaaguaaaaguaaauuuccucauu

SEQ ID NO: 638182 - RNA, 62 nt, Homo Sapiens
ugucacuuuaguaaaauaccuuuagauguuugcuucuguagauaaaacuccuauuaaaaaug

SEQ ID NO: 638183 - RNA, 62 nt, Homo Sapiens
uaccuuuuggauuuuguaaauuguauugauuucuucuguauucuuauuuaauauaaucucua

SEQ ID NO: 638184 - RNA, 62 nt, Homo Sapiens
uguagggaagaaagcuguaggauuucuggaagcuucuguaaccucuuauucugccuuacgag

SEQ ID NO: 638185 - RNA, 62 nt, Homo Sapiens
ccuaauuuucccuuauaaacguucuuuccagacuucuguaggcacccuugccccaugcccuu

SEQ ID NO: 638186 - RNA, 62 nt, Homo Sapiens
cuuaguaagaugaguuucuaccuuuucagagucuucuguauuuuucaagcaucacaagacaa

SEQ ID NO: 638187 - RNA, 62 nt, Homo Sapiens
auggaugaucaucuuaauauaaucuaugggugcuucuguaagaauguuuucauaacaauauu

SEQ ID NO: 638188 - RNA, 62 nt, Homo Sapiens
uuauucuuggauguauaaagugaacuuuuuggcuucuguaaguaugcucuaugcaccucuaa

SEQ ID NO: 638189 - RNA, 62 nt, Homo Sapiens
cugguccaugaggcugcccagagaaagcacugcuucuguaugucucuugugguauuggaaca

SEQ ID NO: 638190 - RNA, 62 nt, Homo Sapiens
cuguauuucccauuucuuuugaaggugcaugucuucuguauuauccaguacuauguaagaua

SEQ ID NO: 638191 - RNA, 62 nt, Homo Sapiens
uaaaaguguuuuugcuaaauaagauauuuaggcuucuguacaauugguauucuaaaccuccu

SEQ ID NO: 638192 - RNA, 64 nt, Homo Sapiens
uaaugaucaauuuaccugcauauaaaauuuauuuuuaaucaagcugaucuuaauguauauaauc

SEQ ID NO: 638193 - RNA, 64 nt, Homo Sapiens
gcuaggaaaugcugaaaacaacuguguuuuuuaauuaaucaauaacugcaaaauuaaaguaccu

SEQ ID NO: 638194 - RNA, 64 nt, Homo Sapiens
ggaauuuuaauauauuccuuuaaaagaaagcaauuuaaucaauugcaaagcaauuauauaaaac

SEQ ID NO: 638195 - RNA, 64 nt, Homo Sapiens
aguguuuggccuggaagagugauaugcuugcugcuuaaucaaaggauuaaagauuuaaagaugu

SEQ ID NO: 638196 - RNA, 64 nt, Homo Sapiens
aaaaugcacguuucaggguguguuugcauaugauuuaaucaaucaguaugguuacauugauaaa

SEQ ID NO: 638197 - RNA, 64 nt, Homo Sapiens
uuagaauucauauugaauuaaauuaauugcuagcuuaaucaaaauguuugauucuccuauacuu

SEQ ID NO: 638198 - RNA, 64 nt, Homo Sapiens
aaaucauauacauuagaaaaucacagucagauguuuaaucaauccaaaauguccacuauuucuu

SEQ ID NO: 638199 - RNA, 64 nt, Homo Sapiens
uagucuacauguuucuaaacauauaaaugugaauuuaaucaauuccuuucauaguuuuauaauu

SEQ ID NO: 638200 - RNA, 64 nt, Homo Sapiens
ucuuccccaaggauuucaagaugaauugaaauuuuuaaucaagauagugugcuuuauucuguug

SEQ ID NO: 638201 - RNA, 64 nt, Homo Sapiens
cuauauauuuguuaaaaauugauagagugauuaguuaaucaaaauaaugaauuauauauagaua

SEQ ID NO: 638202 - RNA, 64 nt, Homo Sapiens
aauaauccuuagccaauuuauauuuagaaucacuuuaaucaaccaugaaacacacaacguaagu

SEQ ID NO: 638203 - RNA, 64 nt, Homo Sapiens
auucuaaguuuuggguaauguuaacucagaacacuuaaucaaauugagcuaugugccauaaggu

SEQ ID NO: 638204 - RNA, 64 nt, Homo Sapiens
uggaauucagacacuguucuuaccguguuuguuuuuaaucaaauauuaccuaaaaauguacaaa

SEQ ID NO: 638205 - RNA, 64 nt, Homo Sapiens
guggaugauggcuuauuaaaaggauuaaacauuuuuaaucaauuggauauugaugcacaauuua

SEQ ID NO: 638206 - RNA, 64 nt, Homo Sapiens
accuauauugauuuaaaaguuaauuucagggaaauuaaucaagugauuuugguaaugauguuga

SEQ ID NO: 638207 - RNA, 64 nt, Homo Sapiens
auuccuauuaaauauuaaaaguaguucugguuuauuaaucaacggggaaaacaucuucuccaaa

SEQ ID NO: 638208 - RNA, 64 nt, Homo Sapiens
ccuuuuaaaacuggaccaacuaaguaauugguauuuaaucaaagagaaaaugguaauaaacuuu

SEQ ID NO: 638209 - RNA, 64 nt, Homo Sapiens
uuuucagagucuauuaguucuuuuuacaucuugcuuaaucaauaguagaugaaacuguauaaga

SEQ ID NO: 638210 - RNA, 64 nt, Homo Sapiens
acuuuuuugugaguuuugugaaaagagauauucuuuaaucaauucuaaaauguauauuuugcau

SEQ ID NO: 638211 - RNA, 64 nt, Homo Sapiens
auguucugaaguguguuguguuucauguucaagcuuaaucaaggcagccauuaauauacgaacu

SEQ ID NO: 638212 - RNA, 64 nt, Homo Sapiens
gucauagccaaucuaacgguaaugguaaaugcuuuuaaucaagcaggaaaaaguucucaugauu

SEQ ID NO: 638213 - RNA, 64 nt, Homo Sapiens
ugguaaugcuuggaauggcaauaggguagaaugauuaaucaaaggcauaucuucuauaucugaa

SEQ ID NO: 638214 - RNA, 64 nt, Homo Sapiens
aggguuuaauagacugagucagaugggucugauauuaaucaaaauugucucuucugaggaccgc

SEQ ID NO: 638215 - RNA, 64 nt, Homo Sapiens
cuguauggcaaaaccaucaucaugaguucuagcauuaaucaacaucagugaguccauacuaagu

SEQ ID NO: 638216 - RNA, 64 nt, Homo Sapiens
uggaauagagaacaguuauaucacaguugagaguuuaaucaaaaugaccggaucagcauauucu

SEQ ID NO: 638217 - RNA, 64 nt, Homo Sapiens
gucacaccuugcaagucaucauguggcauaguuuuuaaucaacaaaacccuacaaguguaauga

SEQ ID NO: 638218 - RNA, 64 nt, Homo Sapiens
aacaacccuugcacgucaucauguggcaagguuuuuaaucaaaaaaacuuuacaaguguaauga

SEQ ID NO: 638219 - RNA, 64 nt, Homo Sapiens
aucacaccuugcaagucaucaugugacaugguuuuuaaucaacaaaaccuuacaagcacaauga

SEQ ID NO: 638220 - RNA, 64 nt, Homo Sapiens
agcaaccuuugcacaucaccauguggcaagguuuuuaaucaaaaaaaccuuacaagcauaauga

SEQ ID NO: 638221 - RNA, 64 nt, Homo Sapiens
acuguccugugcuauuccuaccaaggacaauuuauuaaucaauugacuuagaaaauagggggag

SEQ ID NO: 638222 - RNA, 64 nt, Homo Sapiens
agcuaaacacuuacuaguagugucuuuaaauuauuuaaucaaccuugucuuuucaaggaaauua

SEQ ID NO: 638223 - RNA, 64 nt, Homo Sapiens
cccaccaggaggaaagaggcccagcucucagcugacgauggaggcagaaccggagucggguuug

SEQ ID NO: 638224 - RNA, 64 nt, Homo Sapiens
agauagugacaaggugaugcagaugugaccuaggacgauggaccgccggacucuuuucugcagc

SEQ ID NO: 638225 - RNA, 64 nt, Homo Sapiens
uuaaauacuguuuguggaaucuguaaagaauacaacgauggauuuuuaguaaucuaggcuuugc

SEQ ID NO: 638226 - RNA, 64 nt, Homo Sapiens
cauuccccuugggcuuuuuguuuuuacuugcaagacgauggacauagcuauagcuucagaagca

SEQ ID NO: 638227 - RNA, 64 nt, Homo Sapiens
caagugauguacauccaagugauguauucuggaaacgauggaauuuuacaguuacaguuccauu

SEQ ID NO: 638228 - RNA, 64 nt, Homo Sapiens
ggaauaacuuggaaguaagguucauucccuuaagacgauggauucuguugaacuaugggguccc

SEQ ID NO: 638229 - RNA, 64 nt, Homo Sapiens
uguacacauucacccuucauguuugucaccaagaacgauggauaccaaaaucagcugaguugaa

SEQ ID NO: 638230 - RNA, 64 nt, Homo Sapiens
uugcuuccaaugaaagguuuaguucuugaucuggacgauggauauguccaucugaccccaaagg

SEQ ID NO: 638231 - RNA, 64 nt, Homo Sapiens
caccagucccaccccagccuagcccaacagguccacgauggaucuccggacaccacaccacaug

SEQ ID NO: 638232 - RNA, 64 nt, Homo Sapiens
gggaaucgaaccuagggauagugcuccacuucugacgauggagugaagacacuuggcagacuug

SEQ ID NO: 638233 - RNA, 64 nt, Homo Sapiens
uauggugcgccgcaugacaugggaggcgauggggacgauggacagagacagagcgugcacacgu

SEQ ID NO: 638234 - RNA, 64 nt, Homo Sapiens
aaggugaaggggaaggggaaagcucauuguggaaacgauggaggagaagccaccugcacagcag

SEQ ID NO: 638235 - RNA, 64 nt, Homo Sapiens
cuugcauagaaaaaaaaaucaccgcaaagcugcaacgauggacuggaaccgcggaguuuggcuc

SEQ ID NO: 638236 - RNA, 64 nt, Homo Sapiens
cagaaugaggauuuuuuuguaaauaggucagaagacgauggaacuguccuggguuaguauagua

SEQ ID NO: 638237 - RNA, 55 nt, Homo Sapiens
ucaaugaagaucuaaguuaggaaagacgauggagguggaauccuuuaagauuaug

SEQ ID NO: 638238 - RNA, 64 nt, Homo Sapiens
ucagugauguauaugcaacauuuuguugaaagccacgauggacuuacaagcuuuaauggacucg

SEQ ID NO: 638239 - RNA, 64 nt, Homo Sapiens
uccucugaagcauuugguggccuaauuuacaagcacgauggagagagccuuauaaacagauaau

SEQ ID NO: 638240 - RNA, 64 nt, Homo Sapiens
ccagagacaaugcucaguauucauucauacacagacgauggaagaagccacuucuucccugggc

SEQ ID NO: 638241 - RNA, 64 nt, Homo Sapiens
ggucaaauuuaccuacuucuuuccaaaauauuauacgauggagauguaagcuauguugggccaa

SEQ ID NO: 638242 - RNA, 64 nt, Homo Sapiens
ccuuauaugguguguuaccucaggucuccucaggacgauggagggucaggaaaaggcaauauau

SEQ ID NO: 638243 - RNA, 64 nt, Homo Sapiens
guaaauucaaugaaaaaaaaugugguacauagauacgauggaaaacuaugcagccaugaaacac

SEQ ID NO: 638244 - RNA, 64 nt, Homo Sapiens
uuuggacacugugugcuuuuccugaguugcaggcacgauggagaugugcggccagauagcuguu

SEQ ID NO: 638245 - RNA, 64 nt, Homo Sapiens
cgugacagcacuuuccuguuacuguauguguugcacgauggauccgaggccuuugcuuuacagc

SEQ ID NO: 638246 - RNA, 64 nt, Homo Sapiens
ccaaagucagaugggaguacgcccuugguguuacacgauggaucgaauccagauccuguggaag

SEQ ID NO: 638247 - RNA, 64 nt, Homo Sapiens
uuuuguagacuuuugcugucuagaacuuucugugacgauggauaucuagaacagugcugucuaa

SEQ ID NO: 638248 - RNA, 64 nt, Homo Sapiens
cguucaguaaagaacccaagauggauggaugcggacgauggaaccagacacggaccuauggacu

SEQ ID NO: 638249 - RNA, 64 nt, Homo Sapiens
uugggaaacuuaaccguuacauucgauauuauguacgauggagaucuacacacuugugauuccu

SEQ ID NO: 638250 - RNA, 64 nt, Homo Sapiens
guaaaauaaauugguuuuguuucucccaucgcccacgauggaauaugcuaaauuauuauuuagc

SEQ ID NO: 638251 - RNA, 64 nt, Homo Sapiens
uugguucuuuaaaauauaucagcugcaguuguccacgauggauaaaaauaaggaaggaaaacgu

SEQ ID NO: 638252 - RNA, 64 nt, Homo Sapiens
aggcacggcugcuucuuaccggcaagggaaagggacgauggagaagaguuugcuucuggcuggc

SEQ ID NO: 638253 - RNA, 64 nt, Homo Sapiens
ccaaaugccucaaguuauguguuauucagugggcacgauggacugaaauuucagcagcaaaguu

SEQ ID NO: 638254 - RNA, 64 nt, Homo Sapiens
gcaucuguuacuagagacugaaguacaacuuggaacgauggaauccaagaauuauagcguuuau

SEQ ID NO: 638255 - RNA, 64 nt, Homo Sapiens
ugagaccuggccaucaaaugacacaaacaacuaaacgauggaagagagagcgagcccggguccu

SEQ ID NO: 638256 - RNA, 64 nt, Homo Sapiens
agcgagaacuacgcacagcugccgcguugagcguacgauggaggccuaccucucguuucugccc

SEQ ID NO: 638257 - RNA, 64 nt, Homo Sapiens
gauacuacagaugugggugcaggcaugcacacacacgauggaauauggccauuccuacacaggu

SEQ ID NO: 638258 - RNA, 64 nt, Homo Sapiens
gacaagcccuuccgaucaugacgauaaagcaaagacgauggauuggcaguagcacacuuugcac

SEQ ID NO: 638259 - RNA, 64 nt, Homo Sapiens
gaugccagugaccucauaaugugcucauagcuuuacgauggagaauuaaaugagggcaggcccu

SEQ ID NO: 638260 - RNA, 64 nt, Homo Sapiens
aaaauacaguagaaacaccacuguuuacgauuauacgauggacauucauaaaaagcauaauuuc

SEQ ID NO: 638261 - RNA, 64 nt, Homo Sapiens
ucgaccauaugguauugguuaaauuaacaucuauacgauggaauacuagauggucauuaaaauu

SEQ ID NO: 638262 - RNA, 64 nt, Homo Sapiens
uuaacaggcuucaacauaguaugugugcagauggacgauggauuuaaagagcauaccuuaugau

SEQ ID NO: 638263 - RNA, 64 nt, Homo Sapiens
ccaaaguacaagggagaauaauugggaguaggaaacgauggacuuauuuacugucugugagagc

SEQ ID NO: 638264 - RNA, 64 nt, Homo Sapiens
uugcagucagcuucauaccauuuuuaaagucaauacgauggaaaucaauaaaucugaauuccga

SEQ ID NO: 638265 - RNA, 64 nt, Homo Sapiens
guugcagauacgugacuuggagcacccgugucuuacgauggacagugauaaaggugaacacaca

SEQ ID NO: 638266 - RNA, 64 nt, Homo Sapiens
auuuuuugagaagaaacuaaauucucugaagucuacgauggagcuucucucacagggggaccca

SEQ ID NO: 638267 - RNA, 64 nt, Homo Sapiens
uguguuuugcguuuuuugguagcccuuaagaugcacgauggaauuuccuauuuuugacgauugg

SEQ ID NO: 638268 - RNA, 64 nt, Homo Sapiens
uucccguggagugguuugaucuauauacacugugacgauggacagaagguacuuuuaaaagugg

SEQ ID NO: 638269 - RNA, 64 nt, Homo Sapiens
cauggguaacuugggggagagaagaauccuccaaacgauggaguagccagugguaauacaaagc

SEQ ID NO: 638270 - RNA, 64 nt, Homo Sapiens
gugggggucuggagggggcuccugcaaugaaugcacgauggaguccgucgcuaaacugcacgau

SEQ ID NO: 638271 - RNA, 64 nt, Homo Sapiens
ccaacaaauaggucggucggccucauguuuucacacgauggagauggcauguaagugcccacuu

SEQ ID NO: 638272 - RNA, 64 nt, Homo Sapiens
agugagagagagucagguugaaaugcuccucaacacgauggauauuuuuagcauuuaaggugug

SEQ ID NO: 638273 - RNA, 64 nt, Homo Sapiens
ccauugguaagcugcccuauuugaagagagagacacgauggagaacccagggcucagcuuuuga

SEQ ID NO: 638274 - RNA, 64 nt, Homo Sapiens
acccagaacgcuccuucugacagacuuccaggggacgauggaauguugaggggguuguaccugc

SEQ ID NO: 638275 - RNA, 64 nt, Homo Sapiens
uuguuucuuugauuucuuugccagcacaaaaccgacgauggagucaaaagaacaacaaaaaaac

SEQ ID NO: 638276 - RNA, 64 nt, Homo Sapiens
ccguguuuguccugccaucuccuggcugauaaccacgauggagccagucacauccugagcugcu

SEQ ID NO: 638277 - RNA, 64 nt, Homo Sapiens
gcugguuuccucugcagcgcuuugccucgaagccacgauggaucugcgucucggaugucugucu

SEQ ID NO: 638278 - RNA, 64 nt, Homo Sapiens
ugagucauuuggaauuguggguaaauuauuauguacgauggaauccacggaugagaccucaggu

SEQ ID NO: 638279 - RNA, 64 nt, Homo Sapiens
ucuucucauuuugcagaagagaaacugaggcccagaggcggagggcagucugcucaaggucacg

SEQ ID NO: 638280 - RNA, 64 nt, Homo Sapiens
agauugaagaugcauccaacccucugcugcugaagaggcggaagaaagcucgggcccuggaggc

SEQ ID NO: 638281 - RNA, 64 nt, Homo Sapiens
uugcagugagccgagaucacucgcuugaaccugggaggcggaguuuggaggcgaggcacgagaa

SEQ ID NO: 638282 - RNA, 64 nt, Homo Sapiens
uuacagugagccgagaucacucgcuugaacccgggaggcggagggggaggcugaggcaggagaa

SEQ ID NO: 638283 - RNA, 64 nt, Homo Sapiens
uuuuaaauuacaguuaguuuuuuuguuuguuuuugaggcggagucucuguuacccaggcuggag

SEQ ID NO: 638284 - RNA, 64 nt, Homo Sapiens
uggaggcucaggcacaagaaucacuugaaccuacgaggcggagguugcagugggccaggaucgu

SEQ ID NO: 638285 - RNA, 64 nt, Homo Sapiens
gugcgcgcauguaaucccagcuacucgggaggcugaggcggaagaaucacuugaacccgggagg

SEQ ID NO: 638286 - RNA, 64 nt, Homo Sapiens
gggaggcugaggcggaagaaucacuugaacccgggaggcggagguuccagugagccgagauggc

SEQ ID NO: 638287 - RNA, 64 nt, Homo Sapiens
aggaggcugagggaggagaaucccuugaacccgggaggcggagguucauggggaacccagcagg

SEQ ID NO: 638288 - RNA, 64 nt, Homo Sapiens
aggaggcugaggcagaagaaucgcuugaacccuggaggcggagguugccgugagccaagaucgc

SEQ ID NO: 638289 - RNA, 64 nt, Homo Sapiens
gcucacaccuguaaucccagcacuuugggaggcugaggcggauggaucacgaggucaggcaguc

SEQ ID NO: 638290 - RNA, 64 nt, Homo Sapiens
aggaggcugaggcaggagaacugcuugaaccugggaggcggagguugcagugagccgagauugc

SEQ ID NO: 638291 - RNA, 64 nt, Homo Sapiens
uugcagugagccaagauuguuugcuugaacccgggaggcggagggggaggcugagacaggagau

SEQ ID NO: 638292 - RNA, 64 nt, Homo Sapiens
uugcgguaagccgagaucacaucacuugaacccggaggcggaggaggaaggcugaggcggcaga

SEQ ID NO: 638293 - RNA, 64 nt, Homo Sapiens
agaaggcugaggcaggagaaucacuugaaccuaggaggcggagguugcagugagccaagauggc

SEQ ID NO: 638294 - RNA, 64 nt, Homo Sapiens
gggaggcugaggcaggagaaucgcuugaacccaggaggcggagguugcagugagccaagauggc

SEQ ID NO: 638295 - RNA, 64 nt, Homo Sapiens
aggaggcugaggcaugagaaucgcuuaaacccaggaggcggagguugcagugagcugagaucac

SEQ ID NO: 638296 - RNA, 64 nt, Homo Sapiens
aggaggcugaggcagcagaaucguuugaacccgggaggcggagguugcagugaguggagaucgu

SEQ ID NO: 638297 - RNA, 64 nt, Homo Sapiens
guuuacgccuguaaucccagcacugugggaggccgaggcggauggaucaccugaggucgggaau

SEQ ID NO: 638298 - RNA, 64 nt, Homo Sapiens
gggaggcugaggcaggaaaaucacuugaacccgggaggcggagguugcggugagccaagaucgc

SEQ ID NO: 638299 - RNA, 64 nt, Homo Sapiens
gcccgcggugaucccagccagggccccgagcgcagaggcggagcugugcucagcacaggccugg

SEQ ID NO: 638300 - RNA, 64 nt, Homo Sapiens
ggacagagcucagaggcccccgagguguguguaggaggcggaggcccgcagagcacagagcagg

SEQ ID NO: 638301 - RNA, 64 nt, Homo Sapiens
uugcagugagccaaaauugcucgcuugaaccugagaggcggagggggaggcugaggcaggagaa

SEQ ID NO: 638302 - RNA, 64 nt, Homo Sapiens
auaaggucaggagaucaagacacuuugggaggccgaggcggaucgcucacgccuguaaucccag

SEQ ID NO: 638303 - RNA, 64 nt, Homo Sapiens
aggaggcugaggcaggagaauggcgugaacccgggaggcggagcuugcagugagccgagaucgc

SEQ ID NO: 638304 - RNA, 64 nt, Homo Sapiens
gugcacaccaguauucccagcuacucuggaggcugaggcggaggcaggauugcuugauaugagg

SEQ ID NO: 638305 - RNA, 64 nt, Homo Sapiens
uugcagugagccaagaucgcuggcgugaaccugggaggcggagcgggaggcugaggcaggagaa

SEQ ID NO: 638306 - RNA, 64 nt, Homo Sapiens
cgggcagaucgcgaggucaguaccagcacuuugggaggcggagggcgguggcucaugccuguaa

SEQ ID NO: 638307 - RNA, 64 nt, Homo Sapiens
gauugcuugaggccaggagucuacucagaaggcugaggcggaagcaacaauggauugaucaggg

SEQ ID NO: 638308 - RNA, 64 nt, Homo Sapiens
cgugaggacgcugcgggccagcggcuucagcucggaggcggacguccccacucugggugagugg

SEQ ID NO: 638309 - RNA, 64 nt, Homo Sapiens
ccaaccacacgcuguaccccauggucacgcgguggaggcggaacgaggauggagccaucugcag

SEQ ID NO: 638310 - RNA, 64 nt, Homo Sapiens
ucaguuaaaaggaagcccgaaguuguguuugugcugcccacaggacagugggaguuacaguuca

SEQ ID NO: 638311 - RNA, 64 nt, Homo Sapiens
uucaauguguuuacauuguaugaauugagcuuuuugcccacagauucuugauuuguaguuguuu

SEQ ID NO: 638312 - RNA, 64 nt, Homo Sapiens
gccugggcaguugcuguggcccuguuaccacggaugcccacaggugggcucucaaagcccugcg

SEQ ID NO: 638313 - RNA, 64 nt, Homo Sapiens
cagagcaagaugaguugcugucccuguuacacacugcccacacuuguccgcucucagcccacuc

SEQ ID NO: 638314 - RNA, 64 nt, Homo Sapiens
cagaacgaauguggaggccggccgaaacugaugcugcccacagucccagugaaguuaggugggu

SEQ ID NO: 638315 - RNA, 64 nt, Homo Sapiens
ugccauuccuuucuaaguguguuuuauggcauccugcccacaaagaacucacagucugauuagg

SEQ ID NO: 638316 - RNA, 64 nt, Homo Sapiens
gagccagcaaguccugcugugcacaguguccuugugcccacacucaccacucacucaaccagug

SEQ ID NO: 638317 - RNA, 64 nt, Homo Sapiens
uuccgcccacagaccuccaggccauguccaccugugcccacagccuaugaccccacgucugaca

SEQ ID NO: 638318 - RNA, 64 nt, Homo Sapiens
gcugcugcuucaugcgagaggagcaguggagccuugcccacagggagacagaagucaaaaggaa

SEQ ID NO: 638319 - RNA, 64 nt, Homo Sapiens
uccauuuuggaggcaggcagugcauucucauaccugcccacagccuggcucaacuucaccaaga

SEQ ID NO: 638320 - RNA, 64 nt, Homo Sapiens
acuaagaaacauaucaaggugcuuuuggcacaggugcccacaaauacggaugcagugcugagau

SEQ ID NO: 638321 - RNA, 64 nt, Homo Sapiens
gcaaaagaggcuacuugauugguggccaaccucgugcccacauggaagguaucuuuaauagggu

SEQ ID NO: 638322 - RNA, 64 nt, Homo Sapiens
gcuuagggccuacugagggauaaaacacggucccugcccacaguccuggggaaacaucagugaa

SEQ ID NO: 638323 - RNA, 64 nt, Homo Sapiens
gcuauggugggaagagggccccugacaccaguuuugcccacauugcuccuuuuucuggcugggg

SEQ ID NO: 638324 - RNA, 64 nt, Homo Sapiens
gccagcacugacuuguguuccugggaggcgcagaugcccacacaccucaggugugcgagugccu

SEQ ID NO: 638325 - RNA, 64 nt, Homo Sapiens
uuuccuuugcuucucccagagagcagggagugggugcccacagucccacccugggguuggggag

SEQ ID NO: 638326 - RNA, 64 nt, Homo Sapiens
guggguucgcugacaggcgagggucagccugcugugcccacacacacccacuaaggagaaagaa

SEQ ID NO: 638327 - RNA, 64 nt, Homo Sapiens
uuuuccacuuugagggaggugcuucgaagaauguugcccacaccuaaguguuagaagccuaugu

SEQ ID NO: 638328 - RNA, 64 nt, Homo Sapiens
gggggccagagcuagggugggcugaggcugaaguugcccacacugcggccacaggcgagggugg

SEQ ID NO: 638329 - RNA, 64 nt, Homo Sapiens
ucccugccuagagacccgggcucacugcccacucugcccacacuguggagcugccugccuugcc

SEQ ID NO: 638330 - RNA, 64 nt, Homo Sapiens
caguuuuuuaaucuaacaacuacuuuuggggacuugcccacaucucugggauuugaauggggau

SEQ ID NO: 638331 - RNA, 64 nt, Homo Sapiens
aauacuucauuccuuaacucucccucauuugcuuugcccacagccuauucaguuccuuuguuug

SEQ ID NO: 638332 - RNA, 64 nt, Homo Sapiens
cccacaugugcacugugguugugauccaggaggcugcccacaucugaguccacacugucccuga

SEQ ID NO: 638333 - RNA, 64 nt, Homo Sapiens
gcucauguuguaugccuuuggguuggugaggcagugcccacaagcagcacaaccagccaccagu

SEQ ID NO: 638334 - RNA, 64 nt, Homo Sapiens
guccucuuccuuccacuuggccagggcccucuggugcccacacuuuccuuccccuaagauguuu

SEQ ID NO: 638335 - RNA, 64 nt, Homo Sapiens
caacaguccacagcccuugguccgcauugcccugugcccacaagggcccacagccaguggccug

SEQ ID NO: 638336 - RNA, 64 nt, Homo Sapiens
cucugggcugaguuccuucucuccaggccucuccugcccacaccggcuguggguggaggccuga

SEQ ID NO: 638337 - RNA, 64 nt, Homo Sapiens
uccagguguuggaagggcaguuuugugggaccgcugcccacagaucagggagccccaaggggga

SEQ ID NO: 638338 - RNA, 64 nt, Homo Sapiens
auggagcacucugagaucucaucgcggacaccacugcccacaccuccaucccguccugcgcagg

SEQ ID NO: 638339 - RNA, 64 nt, Homo Sapiens
cugggggagcugcugauggaguccucgcugcucaugcccacagcccucccagagugcuaugcga

SEQ ID NO: 638340 - RNA, 64 nt, Homo Sapiens
ggacugggcccuccgcagggcgacagcccagcagugcccacacacccuccugcacccaggcugg

SEQ ID NO: 638341 - RNA, 64 nt, Homo Sapiens
gggcaaagaaacugcccaugugguaggauaggggugcccacagaccucucagcccaacugcagg

SEQ ID NO: 638342 - RNA, 64 nt, Homo Sapiens
aggaacuugaaauguggggagugauaauaguccagugauuaaacuacaguccagugauuaccac

SEQ ID NO: 638343 - RNA, 64 nt, Homo Sapiens
gugggccgcuacccuucuuucccuuuagaaaacugugauuaauuaaauaaaaagucuuacuacu

SEQ ID NO: 638344 - RNA, 64 nt, Homo Sapiens
cauuuacuguccaauuuaaaacuuuggaauugcugugauuaaagugaucaaaaugccaaaauac

SEQ ID NO: 638345 - RNA, 64 nt, Homo Sapiens
uucuuuguaagaacaccaaccaaccaagguuuaagugauuaauaggcuugagcaccggguggca

SEQ ID NO: 638346 - RNA, 64 nt, Homo Sapiens
guacuuuccuuauuggcaacuuauggacucgcuagugauuaaacgaggcaaugacugugagcga

SEQ ID NO: 638347 - RNA, 64 nt, Homo Sapiens
cauuggccuuaauauaccuaaaucuccaaaaacagugauuaaagcaagagaauuauuacaaggg

SEQ ID NO: 638348 - RNA, 64 nt, Homo Sapiens
ucaaguugcuuggcagcacaacuaucuuugcaaaaaaaaguaaagaaaaaguaaaugaugguuu

SEQ ID NO: 638349 - RNA, 64 nt, Homo Sapiens
ggcagcacaacuaucuuugcaaaaaaaaguaaagaaaaaguaaaugaugguuuaaaaaauacac

SEQ ID NO: 638350 - RNA, 64 nt, Homo Sapiens
cuuaaaauuccuggauggcugcagauguugggggaaaaaguacgugauauuuuagaaacuuagu

SEQ ID NO: 638351 - RNA, 64 nt, Homo Sapiens
uuaaaagcuacauuuuauaacacuggcacacacaaaaaaguaguuuuaagcuuguuugcacagu

SEQ ID NO: 638352 - RNA, 64 nt, Homo Sapiens
acacuguaauaacauauacugugaaaacauuccuaaaaaguaaccaaaggguuugcuaacucug

SEQ ID NO: 638353 - RNA, 64 nt, Homo Sapiens
ucucugugccaaauacauuauaucaggauuacacaaaaaguaucacaaaggauggucuuggcca

SEQ ID NO: 638354 - RNA, 64 nt, Homo Sapiens
aaauaaguggaauuauguaucuuuucuaaaguuaaaaaaguaaaauauuuuauuaugaguuauu

SEQ ID NO: 638355 - RNA, 64 nt, Homo Sapiens
uaggaagaugacaguauuuuuuucaaguuaucauaaaaaguaauucagaugacauuugagaagu

SEQ ID NO: 638356 - RNA, 64 nt, Homo Sapiens
gaaacacugaccgacccuccuggggucugucaggaaaaaguagaagaaaagccacccccugcac

SEQ ID NO: 638357 - RNA, 64 nt, Homo Sapiens
uuuuuggaaacuuuagcugugcugucaacuuuggaaaaaguaucccgguuuacuguguugaguu

SEQ ID NO: 638358 - RNA, 64 nt, Homo Sapiens
gacccaaggccuaugcugaggucuaaaccucugaaaaaaguauaguaucgaguacccguucccu

SEQ ID NO: 638359 - RNA, 64 nt, Homo Sapiens
ucuuuuuaaaugucuuucuuauauggguuuuaaaaaaaaguaauaaaagccuguugcaaaaaug

SEQ ID NO: 638360 - RNA, 64 nt, Homo Sapiens
ugcucagaccuaugaacguagaagggaagagguuaaaaaguaagaagaaagggaagaaagggga

SEQ ID NO: 638361 - RNA, 64 nt, Homo Sapiens
cuuuuagcaaccccaguauugcaaaaaaaaaaaaaaaaaguaauuuuaagguacacugcauuuu

SEQ ID NO: 638362 - RNA, 64 nt, Homo Sapiens
guauggaugaaagcaaucugagagauuugaauagaaaaaguaaucaaguuaaaaccugcaaagc

SEQ ID NO: 638363 - RNA, 64 nt, Homo Sapiens
cucuuuguucaguugacuuacuguuucuuaccuuaaaaaguaauuguagauggaaaucaguugu

SEQ ID NO: 638364 - RNA, 64 nt, Homo Sapiens
uacaaagcuaguugccauauuucuauuuuauuuuaaaaaguaaacaugcggcugggcguggugg

SEQ ID NO: 638365 - RNA, 64 nt, Homo Sapiens
ccugggcaacaagagcaaaaaucccucucaaaaaaaaaaguaaacaugggcacugauuguuuua

SEQ ID NO: 638366 - RNA, 64 nt, Homo Sapiens
uugacagaaaacucucuaagauuuaguaagugaaaaaaaguaggaugcaagaguuuuuauaguu

SEQ ID NO: 638367 - RNA, 64 nt, Homo Sapiens
caugucuuugucuaaauguguuuuucuucaaauaaaaaaguaacauuuauuaaaacauacuuuu

SEQ ID NO: 638368 - RNA, 64 nt, Homo Sapiens
cguuaauauaccguccucaauuaaucuccuuuacaaaaaguauaugauuuaauuuuuaaauguu

SEQ ID NO: 638369 - RNA, 64 nt, Homo Sapiens
gaacaacaacaaaauaaagccaaugagccacagcaaaaaguaaagaaaaaccugggcaccuaag

SEQ ID NO: 638370 - RNA, 64 nt, Homo Sapiens
uuuguaucaaccuaaaugagaauauuuaaagaaaaaaaaguaguacuaaucuuucugaacugua

SEQ ID NO: 638371 - RNA, 64 nt, Homo Sapiens
cuaauagaaauuauguuuucauguguuucacaugaaaaaguauauauauacaaaguuaauauag

SEQ ID NO: 638372 - RNA, 64 nt, Homo Sapiens
uuacugaugcuuuauguuaccaaaacauacaguaaaaaaguagaaauuuaugaaauacuuuuga

SEQ ID NO: 638373 - RNA, 64 nt, Homo Sapiens
gcagaaaacuugagucagaaaauucuggaacuugaaaaaguaguaagggccuccagaauugacu

SEQ ID NO: 638374 - RNA, 64 nt, Homo Sapiens
uuauccauaaugaucuaaacuaauaagauucaccaaaaaguaaaaauucaauuuuacaauauac

SEQ ID NO: 638375 - RNA, 64 nt, Homo Sapiens
uuuuuuguuuaaaaaaaaaaaaaacacugcauuaaaaaaguaucuguugcauuaaggcacauag

SEQ ID NO: 638376 - RNA, 64 nt, Homo Sapiens
uuauuuuaaauauauuuuuaaugaaaagggacuuaaaaaguaaacaugauuaucuaaauuacuu

SEQ ID NO: 638377 - RNA, 64 nt, Homo Sapiens
cuuuaagagugaaauaauuagaaaagcacuuuuuaaaaaguacuuugcuuuaauguguauugaa

SEQ ID NO: 638378 - RNA, 64 nt, Homo Sapiens
uuuuuaaguuagagaauauaaucaaauauuaccaaaaaaguauugugcucucaucagaaauguc

SEQ ID NO: 638379 - RNA, 64 nt, Homo Sapiens
caguggcaucagcagucacagagcaccaagccaaaaaaaguacggcccucagccagucgcuaug

SEQ ID NO: 638380 - RNA, 64 nt, Homo Sapiens
uuauuuugccaccuuuauauuguauuuauaaaaaaaaaaguacuaucaaucaaucauacuacuu

SEQ ID NO: 638381 - RNA, 64 nt, Homo Sapiens
ugauuuuuaaaguaaauauuauaaaauuuaauuuaaaaaguaucauucuuaugucgcucaaaaa

SEQ ID NO: 638382 - RNA, 64 nt, Homo Sapiens
aauuagcugggcgugguggcuacaaaaaaauuuuaaaaaguaaagcauauugagacucugucuc

SEQ ID NO: 638383 - RNA, 64 nt, Homo Sapiens
aauuauaaaugcaauuaacuaugcacaugguaauaaaaaguauaauuucacuaaauuuagagaa

SEQ ID NO: 638384 - RNA, 64 nt, Homo Sapiens
uauacauaucuuuugaagugauguuacuuguaaaaaaaaguauaugaagaugugaucauuugug

SEQ ID NO: 638385 - RNA, 64 nt, Homo Sapiens
agauaaguuuguuaaaguaugugacuguccccguaaaaaguagaagaaucuguuuguugaucaa

SEQ ID NO: 638386 - RNA, 64 nt, Homo Sapiens
ugggcuguguacuuuugcuucaaaaaccauuguuaaaaaguauuucuuuuguaaucaaucuaaa

SEQ ID NO: 638387 - RNA, 64 nt, Homo Sapiens
agauucaaacaaucuuuuauucaaagauugaaauaaaaaguaucgggugccaacugugauuuuu

SEQ ID NO: 638388 - RNA, 64 nt, Homo Sapiens
caguggagccuuucagugaaauaggugacuauuaaaaaaguaauaguauuacagaaaaaugagc

SEQ ID NO: 638389 - RNA, 64 nt, Homo Sapiens
gagcaacuauuuuauaugacuguucuguacaaacaaaaaguauguaauacccauuuuaaaaaac

SEQ ID NO: 638390 - RNA, 64 nt, Homo Sapiens
guuuuuguuucaauuuuuaucaucauaaaugggcaaaaaguaguuggacuaauuucgguuuuua

SEQ ID NO: 638391 - RNA, 64 nt, Homo Sapiens
ucauuauuucuucaguauaaaguuauucuuccugaaaaaguaagauauaccugggaaauauucu

SEQ ID NO: 638392 - RNA, 64 nt, Homo Sapiens
auuacuucacuugaggguacuugacaauaugaacaaaaaguaaauuuuuauuugcauaauuuua

SEQ ID NO: 638393 - RNA, 64 nt, Homo Sapiens
ugaaauuaaauuaucuauucuucccccccccaaaaaaaaguauuguaaauccuuaaguaaaauu

SEQ ID NO: 638394 - RNA, 64 nt, Homo Sapiens
aggccacacaugguuuauuuucuuuuuauguaguaaaaaguauacacacccggcacaucuucau

SEQ ID NO: 638395 - RNA, 64 nt, Homo Sapiens
uauuuuuacauuagaaaaggcccccucccucugaaaaaaguaugguuuucuaguuuaaguuguu

SEQ ID NO: 638396 - RNA, 64 nt, Homo Sapiens
uguauguguugugauauuaaccucugucaaugaaaaaaaguacaauauuuuugaaaggcauguu

SEQ ID NO: 638397 - RNA, 64 nt, Homo Sapiens
aaaacuaaaaaggaccagaguauuggagcauaucaaaaaguauuguguuagauagaauuuccaa

SEQ ID NO: 638398 - RNA, 64 nt, Homo Sapiens
uuguguugaucauuauuuccauucuuaaugugaaaaaaaguaauuauuuauacuuauuauaaaa

SEQ ID NO: 638399 - RNA, 64 nt, Homo Sapiens
aaugugaaaaaaaguaauuauuuauacuuauuauaaaaaguauuugaaauuugcacauuuaauu

SEQ ID NO: 638400 - RNA, 64 nt, Homo Sapiens
acaaaaccaagaacauaucuagcaagaaaacuugaaaaaguauaagcauuuguuaaaaauguga

SEQ ID NO: 638401 - RNA, 64 nt, Homo Sapiens
aauaaaacccaaucauaguaagugauuaacuagcaaaaaguaaagcuauuuauagcaaauuucu

SEQ ID NO: 638402 - RNA, 63 nt, Homo Sapiens
acauggccugguccuaccaggaauaaaaaagcuuaaaaaguauuauaucuuugaacuuuucaa

SEQ ID NO: 638403 - RNA, 64 nt, Homo Sapiens
aaaaagagaagauauuuagguauuuuacuacaauaaaaaguauaggcaaauuguauguuauacc

SEQ ID NO: 638404 - RNA, 64 nt, Homo Sapiens
uauuaaacagucuugaucuccuggauuucccucaaaaaaguaacaaugguacaggcaaauguga

SEQ ID NO: 638405 - RNA, 64 nt, Homo Sapiens
uauauauucuaucguauucauacaucugcaguuuaaaaaguaaaaggccaacgguccaagggau

SEQ ID NO: 638406 - RNA, 64 nt, Homo Sapiens
aaguuggcuuagauaacuugacaaaaaaguagcaaaaaaguacaaaucauacugcauacaugcu

SEQ ID NO: 638407 - RNA, 64 nt, Homo Sapiens
aaaaaaguacaaaguuggcugcauacaugcuacaaaaaaguagcggaaguccagaaaucauacu

SEQ ID NO: 638408 - RNA, 64 nt, Homo Sapiens
agugucagauggcaguggaagcauguguguuucuaaaaaguaaaaaucucaagaaaacagaaau

SEQ ID NO: 638409 - RNA, 64 nt, Homo Sapiens
acuuagugaaagagagcugcaguugaaauuguuuaaaaaguagcagguacaaugaauauuguca

SEQ ID NO: 638410 - RNA, 64 nt, Homo Sapiens
acaagagugaaacuccaucuccaaaaaaaaaaagaaaaaguaacaaaaggaaauuauuuguuuu

SEQ ID NO: 638411 - RNA, 64 nt, Homo Sapiens
ugagcuuucuagaauauuugccuaauugggaauuaaaaaguaaaauaauaggccaggcauggug

SEQ ID NO: 638412 - RNA, 64 nt, Homo Sapiens
ugggugccacagcgagacccuaguuaagagaaaaaaaaaguaaaaacaaauugugggucaaagu

SEQ ID NO: 638413 - RNA, 64 nt, Homo Sapiens
uguaaacuaguacuauuaugugacuaauucacaaaaaaaguaaucagaauucugaaguuuccua

SEQ ID NO: 638414 - RNA, 64 nt, Homo Sapiens
uuagcaaccuuuuguugguacugagcaugccccaaaaaaguaguguccuaaagggacaauaacu

SEQ ID NO: 638415 - RNA, 64 nt, Homo Sapiens
agucaaaccaaacuuccucaccccgccccccgcaaaaaaguaaagucaauucugaaccaccacc

SEQ ID NO: 638416 - RNA, 64 nt, Homo Sapiens
cccaagugauuuuaauuuaaaaauauuugaaaauaaaaaguauucugauaguucuauauuuuca

SEQ ID NO: 638417 - RNA, 64 nt, Homo Sapiens
auaucauggacauacauuuucagacuuuuggauuaaaaaguauuuuuuauuuuuuaauaugggu

SEQ ID NO: 638418 - RNA, 64 nt, Homo Sapiens
cuuauuuuuucuaacuagaauguauggaaaccuuaaaaaguaaaagcauguagagaucaucaca

SEQ ID NO: 638419 - RNA, 64 nt, Homo Sapiens
ugaauuccaauuauaccuuacaucagcaaguuaaaaaaaguacuuuaaaauaaagcaaagggag

SEQ ID NO: 638420 - RNA, 64 nt, Homo Sapiens
agacuuuagaugucuuguauuaaaaauuacacaaaaaaaguaaaacuuuuuauacuuacccuuu

SEQ ID NO: 638421 - RNA, 64 nt, Homo Sapiens
uuccagcaguccaaagauguacauguucauaauuaaaaaguauuucugcuguuuuuuauuuuua

SEQ ID NO: 638422 - RNA, 64 nt, Homo Sapiens
auugaaucuuaaaguguuuauucagaggagagaaaaaaaguaaugacaucuucaccggacacau

SEQ ID NO: 638423 - RNA, 64 nt, Homo Sapiens
uuuacugugugccacauauuagacaauaaauggaaaaaaguaccauguucaauggggguauggg

SEQ ID NO: 638424 - RNA, 64 nt, Homo Sapiens
aauuaaaggacauccacaauucaauguauaacagaaaaaguaaugauuaaagcuugugaaucug

SEQ ID NO: 638425 - RNA, 64 nt, Homo Sapiens
cacuuuaaguuugauguguuuuauuuuaauguucaaaaaguaaauuucuguauuuaccugacau

SEQ ID NO: 638426 - RNA, 64 nt, Homo Sapiens
guacauauggcuggauuuuuuuuauuauuaaagaaaaaaguaauccccaguucagaguugaaug

SEQ ID NO: 638427 - RNA, 64 nt, Homo Sapiens
caaaaauaaaaaguggaaaaauuuucacucaucuaaaaaguauacaucuuuaggauauauuuac

SEQ ID NO: 638428 - RNA, 64 nt, Homo Sapiens
aaacauuugcauucucagaauccugcacccccuaaaaaaguaccuuuccccugccgucuccuca

SEQ ID NO: 638429 - RNA, 64 nt, Homo Sapiens
aauaacuauguuuugagauauauuuauauaacuuaaaaaguaaaccuauauugaaaauguauau

SEQ ID NO: 638430 - RNA, 64 nt, Homo Sapiens
acuucguucuuuaucagccucuuauuuuaaugaaaaaaaguaaagaugcaauaguagaaagcua

SEQ ID NO: 638431 - RNA, 64 nt, Homo Sapiens
ucauaauuuuaauuuguguuauguagcauauauaaaaaaguaucuugcaauguuuuuauuguua

SEQ ID NO: 638432 - RNA, 64 nt, Homo Sapiens
ucaagaaauuauuuuaucaugcuuaauuggauuaaaaaaguacuauucgaagugauuauuauca

SEQ ID NO: 638433 - RNA, 64 nt, Homo Sapiens
uauguucuuuaccaaauuguugcaucugguucugaaaaaguauagcauguagcagcuuccaaac

SEQ ID NO: 638434 - RNA, 64 nt, Homo Sapiens
uauucaugaaacuucauugcagggguaauagaagaaaaaguaaauugggaggacuuaauggaag

SEQ ID NO: 638435 - RNA, 64 nt, Homo Sapiens
ucugauguuugugauuguuuuucucacggugaugaaaaaguaugugcuauaaguagaggagcgc

SEQ ID NO: 638436 - RNA, 64 nt, Homo Sapiens
cugaucugagacguugggaggcaagaauaaagugaaaaaguauauguaaucccaacaucuaauu

SEQ ID NO: 638437 - RNA, 64 nt, Homo Sapiens
acuugucuuuucugugaauuuagucuauguagauaaaaaguaccuacugaaaguuuauauagua

SEQ ID NO: 638438 - RNA, 64 nt, Homo Sapiens
cauugaauaaggcuguuuauuguugcucauuuaaaaaaaguauaaguuauaugucugcuaucug

SEQ ID NO: 638439 - RNA, 64 nt, Homo Sapiens
aauguguauguggcuguuuguugagaacaaaaacaaaaaguaucuuaacuuuguauuuugauug

SEQ ID NO: 638440 - RNA, 64 nt, Homo Sapiens
acauggcaaaaaauaaaauaugauggacaaaaaaaaaaaguaaauuuuaagauuaaagguacac

SEQ ID NO: 638441 - RNA, 64 nt, Homo Sapiens
uagaaaaaaagugcuuaauagcuacaccauguagaaaaaguauguuggggauucaaaggggauu

SEQ ID NO: 638442 - RNA, 64 nt, Homo Sapiens
acaagaaaaguacauucuuugaaaagacuuuuuaaaaaaguaaacaaaacuuuuuuuuugaaau

SEQ ID NO: 638443 - RNA, 64 nt, Homo Sapiens
cauguuauauauauguaguuggcauuugguucccaaaaaguaggauguagguauuuauuguguu

SEQ ID NO: 638444 - RNA, 64 nt, Homo Sapiens
gcugguuuauaccuauguucauuuauaugcuguaaaaaaguaguagcuucuucuacaauguaaa

SEQ ID NO: 638445 - RNA, 64 nt, Homo Sapiens
uuguaaaguguuauacaaucacagaugagaaagcaaaaaguacucagauugucagaaguuccag

SEQ ID NO: 638446 - RNA, 64 nt, Homo Sapiens
ucugguucuugguuuaaguuccugugagaacuguaaaaaguaccaaauauauauauauacacac

SEQ ID NO: 638447 - RNA, 64 nt, Homo Sapiens
aaagccuuucucuugccugcuauuugcaauggguaaaaaguauuagacaugugaagcaaauuca

SEQ ID NO: 638448 - RNA, 64 nt, Homo Sapiens
uuccugcauuguuuuagucaaguaauggcuuuugaaaaaguaaaguucaauaauaacuaaggcu

SEQ ID NO: 638449 - RNA, 64 nt, Homo Sapiens
uugaaauuucagacaaagcaaacccagcagguauaaaaaguaguauaaauacaaaucuguaagu

SEQ ID NO: 638450 - RNA, 64 nt, Homo Sapiens
agucaauuauuuuucaaaauaauuguguucuguaaaaaaguauugaaaugccaacaauaguuug

SEQ ID NO: 638451 - RNA, 64 nt, Homo Sapiens
cagcugcacuuuuuuugcacuacguauuucaaguaaaaaguagaguaaauaguaguguuggucu

SEQ ID NO: 638452 - RNA, 64 nt, Homo Sapiens
gcaggucaugagugugaaauucucaaauuuacauaaaaaguagaaguauagacaguuuaacauu

SEQ ID NO: 638453 - RNA, 64 nt, Homo Sapiens
guccauucugcagcuguuagaucugccucucaggaaaaaguacuaacuuguucuuuuuguuccu

SEQ ID NO: 638454 - RNA, 64 nt, Homo Sapiens
ugaaaggauucacucuggagucucaaaaaaaaaaaaaaaguacaggcgacagagccagacccug

SEQ ID NO: 638455 - RNA, 64 nt, Homo Sapiens
agguguggugguaugccccuucuacaaaaaauagaaaaaguagccaaaauggugaaaccauguc

SEQ ID NO: 638456 - RNA, 64 nt, Homo Sapiens
ucagaaaauauaagcuuuuaauuuaauuacugucaaaaaguauuacuuaaaaaaaguauuauaa

SEQ ID NO: 638457 - RNA, 64 nt, Homo Sapiens
auaaauuuaauuacugucaacagagaguacuuaaaaaaaguauugcucacaucuuacucaacau

SEQ ID NO: 638458 - RNA, 64 nt, Homo Sapiens
aaaaauagagaaauugcacuuccuggaaaaaauuaaaaaguaguuaguuuaauuauucuguaaa

SEQ ID NO: 638459 - RNA, 64 nt, Homo Sapiens
uuguuauuuauucuuuuaauaauggaauuuuuuuaaaaaguauuuuguaacugaggaauuuuga

SEQ ID NO: 638460 - RNA, 64 nt, Homo Sapiens
gguauguguacauauauaauauugcuuuaaaggaaaaaaguauaugaacagaguuuugaaaggc

SEQ ID NO: 638461 - RNA, 64 nt, Homo Sapiens
uauacuuuagaaaacaguccacaguaguagccauaaaaaguacuucucuuuggaugaauaggag

SEQ ID NO: 638462 - RNA, 64 nt, Homo Sapiens
auuguuaacagugacuuuaaaaaaagaaauagccaaaaaguacaacagggcaaaagaggggagu

SEQ ID NO: 638463 - RNA, 64 nt, Homo Sapiens
ggaaaaagugugugguuaaggugcuguggggaaaaaaaaguagaaauauugucauccgcuugcu

SEQ ID NO: 638464 - RNA, 64 nt, Homo Sapiens
uaggguucccugccucccaucuuuccacuguuguaaaaaguauaucaaauuauuccuucaaguu

SEQ ID NO: 638465 - RNA, 64 nt, Homo Sapiens
gaacaaguaauuuuauauugugcuuuaauuuuuuaaaaaguauucuuuauucauauguauagaa

SEQ ID NO: 638466 - RNA, 64 nt, Homo Sapiens
aaggaccuucacucuaagauguuauauuuuucuuaaaaaguaacuccuaguagggguaccacug

SEQ ID NO: 638467 - RNA, 64 nt, Homo Sapiens
ugcacaugauuucacaaauauuaaaaagucuuuuaaaaaguauugccaaacauuaauguugauu

SEQ ID NO: 638468 - RNA, 64 nt, Homo Sapiens
aaagaaaaggacucccuuagcucaaaaaaaaaaaaaaaaguaaggcaacagagcgagacuccau

SEQ ID NO: 638469 - RNA, 64 nt, Homo Sapiens
ucuaaauacaggauuauaaugacucugucucaaaaaaaaguauccagccugagugauagaguga

SEQ ID NO: 638470 - RNA, 64 nt, Homo Sapiens
cuuuuguuucuaaccauuguauuuaagaaauaccaaaaaguaagaauaaauuguacuaaaaguc

SEQ ID NO: 638471 - RNA, 64 nt, Homo Sapiens
gguguuauaacucucaauguuauaacguguuguuaaaaaguaguucaaagauucuuuccuaaag

SEQ ID NO: 638472 - RNA, 64 nt, Homo Sapiens; identical to SEQ ID NO: 164102

SEQ ID NO: 638473 - RNA, 64 nt, Homo Sapiens; identical to SEQ ID NO: 164103

SEQ ID NO: 638474 - RNA, 64 nt, Homo Sapiens; identical to SEQ ID NO: 164104

SEQ ID NO: 638475 - RNA, 64 nt, Homo Sapiens; identical to SEQ ID NO: 164105

SEQ ID NO: 638476 - RNA, 64 nt, Homo Sapiens; identical to SEQ ID NO: 164106

SEQ ID NO: 638477 - RNA, 64 nt, Homo Sapiens; identical to SEQ ID NO: 164107

SEQ ID NO: 638478 - RNA, 64 nt, Homo Sapiens
accauaaguauaguauuucauuuaagauuuaaaaguuucacacaacaugauuauguuaagaggc

SEQ ID NO: 638479 - RNA, 64 nt, Homo Sapiens
uaaguugaaacaggguguguaauguguucaucaaguuucacaucggacuggaauuuuuuucauu

SEQ ID NO: 638480 - RNA, 64 nt, Homo Sapiens
gcuuagaccuuuaccuuccauauauauguauaguguuucacaaacaauauaaguaaauauagau

SEQ ID NO: 638481 - RNA, 64 nt, Homo Sapiens
ucguuguuagaucuuuauuugacguugcagugcaguuucacagagucagggaagaacgaaccuu

SEQ ID NO: 638482 - RNA, 64 nt, Homo Sapiens
uuuaacacugcuaauagaaauuauguuuucauguguuucacaugaaaaaguauauauauacaaa

SEQ ID NO: 638483 - RNA, 64 nt, Homo Sapiens
gcaucuguuuuaggucucaaaauauaacucagcuguuucacacuguauauguacauuguuuucu

SEQ ID NO: 638484 - RNA, 64 nt, Homo Sapiens
auaaaggacugaauaaucuaaaaagcauauaaaaguuucacacagcauaaaagauaccaaaaua

SEQ ID NO: 638485 - RNA, 64 nt, Homo Sapiens
uaaugcauacuggaaguacuuugauacucaaguuguuucacaagauuuauaauauagaugguuu

SEQ ID NO: 638486 - RNA, 64 nt, Homo Sapiens
uuuacagauccaacgacacaccaugaguuuuuuaguuucacagugucucaggaaaugcauguuu

SEQ ID NO: 638487 - RNA, 64 nt, Homo Sapiens
aaguuucugcaaccuaacguaggcagaggcaaaaguuucacacacuauccgagggaugagauua

SEQ ID NO: 638488 - RNA, 64 nt, Homo Sapiens
auuucuauuuaaggcagcuaaugaaaauaauaguguuucacaguuaaucagugauuuuuguuau

SEQ ID NO: 638489 - RNA, 64 nt, Homo Sapiens
uuuuaaccccucugugcuuugagaguugcuucugguuucacacuugcugcuucgugucucacuc

SEQ ID NO: 638490 - RNA, 64 nt, Homo Sapiens
ggauggcaccuuuuggcuucaacaugcgggccugguuucacaucuuaugaucagggauuuuaua

SEQ ID NO: 638491 - RNA, 64 nt, Homo Sapiens
agagaacaggugguuuuuaaggguuaucuuagauguuucacaccggaagguuuuuaaacacuaa

SEQ ID NO: 638492 - RNA, 64 nt, Homo Sapiens
aaugugauuacugcucuauuccaaaaagguugcuguuucacaauaccucaugcuucacuuagcc

SEQ ID NO: 638493 - RNA, 64 nt, Homo Sapiens
gcagagcuccuaagucaccacucaaccaguggcuguuucacaaggauuugagggcacuugccug

SEQ ID NO: 638494 - RNA, 64 nt, Homo Sapiens
ucugucuccuuuuuuuacauaagaaccaauccguguuucacauugggcuaaguggauuccuuau

SEQ ID NO: 638495 - RNA, 64 nt, Homo Sapiens; identical to SEQ ID NO: 261645

SEQ ID NO: 638496 - RNA, 64 nt, Homo Sapiens; identical to SEQ ID NO: 261646

SEQ ID NO: 638497 - RNA, 64 nt, Homo Sapiens; identical to SEQ ID NO: 261647

SEQ ID NO: 638498 - RNA, 64 nt, Homo Sapiens; identical to SEQ ID NO: 261648

SEQ ID NO: 638499 - RNA, 64 nt, Homo Sapiens
augaggguuguuaauccaucaucuguccgucuguaaggcguagagucugucuguaaggcguaga

SEQ ID NO: 638500 - RNA, 64 nt, Homo Sapiens
aucuguccgucuguaaggcguccugucugucuguaaggcguagacuuuuccuuuuagguuuaag

SEQ ID NO: 638501 - RNA, 64 nt, Homo Sapiens; identical to SEQ ID NO: 156691

SEQ ID NO: 638502 - RNA, 64 nt, Homo Sapiens; identical to SEQ ID NO: 156692

SEQ ID NO: 638503 - RNA, 64 nt, Homo Sapiens; identical to SEQ ID NO: 156693

SEQ ID NO: 638504 - RNA, 64 nt, Homo Sapiens; identical to SEQ ID NO: 156694

SEQ ID NO: 638505 - RNA, 64 nt, Homo Sapiens; identical to SEQ ID NO: 156695

SEQ ID NO: 638506 - RNA, 64 nt, Homo Sapiens; identical to SEQ ID NO: 156696

SEQ ID NO: 638507 - RNA, 64 nt, Homo Sapiens; identical to SEQ ID NO: 156697

SEQ ID NO: 638508 - RNA, 64 nt, Homo Sapiens; identical to SEQ ID NO: 156698

SEQ ID NO: 638509 - RNA, 64 nt, Homo Sapiens; identical to SEQ ID NO: 156699

SEQ ID NO: 638510 - RNA, 64 nt, Homo Sapiens; identical to SEQ ID NO: 156700

SEQ ID NO: 638511 - RNA, 64 nt, Homo Sapiens; identical to SEQ ID NO: 156701

SEQ ID NO: 638512 - RNA, 64 nt, Homo Sapiens; identical to SEQ ID NO: 156702

SEQ ID NO: 638513 - RNA, 64 nt, Homo Sapiens; identical to SEQ ID NO: 156703

SEQ ID NO: 638514 - RNA, 64 nt, Homo Sapiens; identical to SEQ ID NO: 156704

SEQ ID NO: 638515 - RNA, 64 nt, Homo Sapiens; identical to SEQ ID NO: 156705

SEQ ID NO: 638516 - RNA, 64 nt, Homo Sapiens; identical to SEQ ID NO: 156706

SEQ ID NO: 638517 - RNA, 64 nt, Homo Sapiens; identical to SEQ ID NO: 156707

SEQ ID NO: 638518 - RNA, 64 nt, Homo Sapiens; identical to SEQ ID NO: 156708

SEQ ID NO: 638519 - RNA, 64 nt, Homo Sapiens; identical to SEQ ID NO: 156709

SEQ ID NO: 638520 - RNA, 64 nt, Homo Sapiens; identical to SEQ ID NO: 156710

SEQ ID NO: 638521 - RNA, 64 nt, Homo Sapiens; identical to SEQ ID NO: 156711

SEQ ID NO: 638522 - RNA, 64 nt, Homo Sapiens; identical to SEQ ID NO: 156712

SEQ ID NO: 638523 - RNA, 64 nt, Homo Sapiens; identical to SEQ ID NO: 156713

SEQ ID NO: 638524 - RNA, 64 nt, Homo Sapiens; identical to SEQ ID NO: 156714

SEQ ID NO: 638525 - RNA, 64 nt, Homo Sapiens; identical to SEQ ID NO: 156715

SEQ ID NO: 638526 - RNA, 64 nt, Homo Sapiens; identical to SEQ ID NO: 156716

SEQ ID NO: 638527 - RNA, 64 nt, Homo Sapiens; identical to SEQ ID NO: 156717

SEQ ID NO: 638528 - RNA, 64 nt, Homo Sapiens; identical to SEQ ID NO: 156718

SEQ ID NO: 638529 - RNA, 64 nt, Homo Sapiens; identical to SEQ ID NO: 156719

SEQ ID NO: 638530 - RNA, 64 nt, Homo Sapiens; identical to SEQ ID NO: 156720

SEQ ID NO: 638531 - RNA, 64 nt, Homo Sapiens; identical to SEQ ID NO: 156721

SEQ ID NO: 638532 - RNA, 64 nt, Homo Sapiens; identical to SEQ ID NO: 156722

SEQ ID NO: 638533 - RNA, 64 nt, Homo Sapiens; identical to SEQ ID NO: 156723

SEQ ID NO: 638534 - RNA, 50 nt, Homo Sapiens; identical to SEQ ID NO: 156724

SEQ ID NO: 638535 - RNA, 64 nt, Homo Sapiens; identical to SEQ ID NO: 156725

SEQ ID NO: 638536 - RNA, 64 nt, Homo Sapiens; identical to SEQ ID NO: 156726

SEQ ID NO: 638537 - RNA, 64 nt, Homo Sapiens; identical to SEQ ID NO: 156727

SEQ ID NO: 638538 - RNA, 64 nt, Homo Sapiens; identical to SEQ ID NO: 156728

SEQ ID NO: 638539 - RNA, 64 nt, Homo Sapiens; identical to SEQ ID NO: 156729

SEQ ID NO: 638540 - RNA, 64 nt, Homo Sapiens; identical to SEQ ID NO: 156730

SEQ ID NO: 638541 - RNA, 64 nt, Homo Sapiens; identical to SEQ ID NO: 156731

SEQ ID NO: 638542 - RNA, 64 nt, Homo Sapiens; identical to SEQ ID NO: 156732

SEQ ID NO: 638543 - RNA, 64 nt, Homo Sapiens; identical to SEQ ID NO: 156733

SEQ ID NO: 638544 - RNA, 64 nt, Homo Sapiens; identical to SEQ ID NO: 156734

SEQ ID NO: 638545 - RNA, 64 nt, Homo Sapiens; identical to SEQ ID NO: 156735

SEQ ID NO: 638546 - RNA, 64 nt, Homo Sapiens; identical to SEQ ID NO: 156736

SEQ ID NO: 638547 - RNA, 64 nt, Homo Sapiens; identical to SEQ ID NO: 156737

SEQ ID NO: 638548 - RNA, 64 nt, Homo Sapiens; identical to SEQ ID NO: 156738

SEQ ID NO: 638549 - RNA, 64 nt, Homo Sapiens
cuugcaggggucccugcuaggcagcucgaggcccccgaccaacacuccccucgugucagcucag

SEQ ID NO: 638550 - RNA, 64 nt, Homo Sapiens
ucuccugugcugaaguugccuguaaagcugccauccgaccaaggguuuuguuucguguguuguu

SEQ ID NO: 638551 - RNA, 64 nt, Homo Sapiens
ccucaaaacaaacaagagauggcaaagcagcaguccgaccaagcccacuggaauuauccuuuaa

SEQ ID NO: 638552 - RNA, 64 nt, Homo Sapiens
gaccuucugugggguuuggggaucuccaggaagcccgaccaagcuguccccuuccccugugcca

SEQ ID NO: 638553 - RNA, 64 nt, Homo Sapiens
cuucguuuuacaguugcccaaacuuagagaucacccgaccaaccuggaccacauucggaagggg

SEQ ID NO: 638554 - RNA, 64 nt, Homo Sapiens
gugggucaccugagguugggaguucgagaccagcccgaccaacauggugaaaccccgucucuac

SEQ ID NO: 638555 - RNA, 64 nt, Homo Sapiens
gaaacauuccaccuggcuacggcuguugguuuuaccgaccaaaugaggugaaaaaugguuguau

SEQ ID NO: 638556 - RNA, 64 nt, Homo Sapiens
gcgaaggaauguuuguuuguacguuuugucuaguccgaccaagacuuucugauaaucagagaga

SEQ ID NO: 638557 - RNA, 64 nt, Homo Sapiens
auccugaugccccagguuauccacagccuccuucccgaccaagacccuauccaccuggaccucc

SEQ ID NO: 638558 - RNA, 64 nt, Homo Sapiens
ucucaugacagcuccaucaagaaugugggaugugccgaccaaggauuugagaaaguuguacaga

SEQ ID NO: 638559 - RNA, 64 nt, Homo Sapiens
uugacuaguuuguuggacuuuuguucggugccagccgaccaagaggacccagagcgagaugggu

SEQ ID NO: 638560 - RNA, 64 nt, Homo Sapiens
cgggcggaucaugaggucaggaguucgagaccaaccgaccaacauggugaaaccccaucuuuac

SEQ ID NO: 638561 - RNA, 64 nt, Homo Sapiens
ccuugccagcugaccuucaaacccugcauuugaaccgaccaacauuaaguccagagaguaaacu

SEQ ID NO: 638562 - RNA, 64 nt, Homo Sapiens
acgccuacagugcuuugaagugccccagcuuuccccgaccaaucgcuucuuagggcccucuccc

SEQ ID NO: 638563 - RNA, 64 nt, Homo Sapiens
agucaaauaaugaauuucuuccucccucucgcaaccgaccaaaauuuugacaacgaugauguuc

SEQ ID NO: 638564 - RNA, 64 nt, Homo Sapiens
ccaccugcagccucccuggguggccuaggcucccccgaccaagagaccucccucucaugaucac

SEQ ID NO: 638565 - RNA, 64 nt, Homo Sapiens
cuccuuccucuccccuggggcugggaggcuccauccgaccaaugucuguaaagugcuuugagga

SEQ ID NO: 638566 - RNA, 64 nt, Homo Sapiens
cccuccacucuucccgcgaacaucacaccguuccccgaccaagccgugugcaauacaacagagg

SEQ ID NO: 638567 - RNA, 64 nt, Homo Sapiens
uuugaccucagugaucacgagaagaaagccaugaccgaccaauauguugacauacugauccucu

SEQ ID NO: 638568 - RNA, 64 nt, Homo Sapiens
uauuaugcagcuuauuuuaccugaaacuguuaagccgaccaagaucccucccugcaagacagau

SEQ ID NO: 638569 - RNA, 64 nt, Homo Sapiens
cccaagaccuggaucccaggcgcagcuuccucccccgaccaaaccccccagggucccaaggccc

SEQ ID NO: 638570 - RNA, 64 nt, Homo Sapiens
cccgcgcgcugcugcgucccgaacgaccccuggaccgaccaaaggugugaaggagaagaggcaa

SEQ ID NO: 638571 - RNA, 64 nt, Homo Sapiens
agccuguuggcaagagcugguauucccugcccagccgaccaaaugaccucugcauucuucaggu

SEQ ID NO: 638572 - RNA, 64 nt, Homo Sapiens
agucacugcugcuacugccccugaccugggggagccgaccaauuugccagacacugcgccccgc

SEQ ID NO: 638573 - RNA, 64 nt, Homo Sapiens
gcggaucaccugaggucgggaguuugagaccagcccgaccaacauggagaaacccugucucuac

SEQ ID NO: 638574 - RNA, 64 nt, Homo Sapiens
gccuccugcuguggcagaggagcagcugggauucccgaccaaagccccagggggugcagaagac

SEQ ID NO: 638575 - RNA, 64 nt, Homo Sapiens
uaggcuggugaggaaguccaucauaguacagaacccgaccaaagaaacccaaagcaaguaguga

SEQ ID NO: 638576 - RNA, 64 nt, Homo Sapiens
gcccuaagcccccagggccucucacugaacuccaccgaccaacuccuucucugggucugauuuu

SEQ ID NO: 638577 - RNA, 64 nt, Homo Sapiens
aaccugcuuuucuaaaaggauccuggugagcagcccgaccaauagaaccucucacguugcugug

SEQ ID NO: 638578 - RNA, 64 nt, Homo Sapiens
ugguauggagggauuaacucagucauggcauucuccgaccaaaaccacaccugugucucuggca

SEQ ID NO: 638579 - RNA, 64 nt, Homo Sapiens
gacccucagcccuggccuuuuucuuuaaggucccccgaccaauccccagccuaggacgccaacu

SEQ ID NO: 638580 - RNA, 64 nt, Homo Sapiens
augacagggcagggggcagucuuccucccccuccccgaccaaaccucggggagcccuccugugc

SEQ ID NO: 638581 - RNA, 64 nt, Homo Sapiens
cccaggauggcggaagcucaccugaguuugagugccgaccaaccguucaggagaccggccuguu

SEQ ID NO: 638582 - RNA, 64 nt, Homo Sapiens
gugcucgccuucggccucucuuggaacugcaccaccgaccaacuccagacuugggagcuuuaaa

SEQ ID NO: 638583 - RNA, 64 nt, Homo Sapiens
aauaaaaaaaaaacaagaauacuuaacaauauacauuccucauaugugucccuugauaacagug

SEQ ID NO: 638584 - RNA, 64 nt, Homo Sapiens
acauggucaggggauuuuuuagguaggucguagcauuccucaucgucauacuagggugugagag

SEQ ID NO: 638585 - RNA, 64 nt, Homo Sapiens
guggcaugggcuuucuucucaacaauuauguuacauuccucaaaguaccuuuguacccagacaa

SEQ ID NO: 638586 - RNA, 64 nt, Homo Sapiens
aggcaugaaguuguaaaaaccuucugaaaucaaaauuccucauagcugagucuguggaaugaua

SEQ ID NO: 638587 - RNA, 64 nt, Homo Sapiens
ugcuacguucuuucuucaugccuaugugugcuccauuccucauuucuacuuggcucaagaaaac

SEQ ID NO: 638588 - RNA, 64 nt, Homo Sapiens
guaagacuuuuaagaaaagaaaaaguuaugccucauuccucauguggcuuccaauaaguaucuu

SEQ ID NO: 638589 - RNA, 64 nt, Homo Sapiens
uuucuuuugaucgugcacuuauagucuucauuuaauuccucauagaaucccagucaccuuuaua

SEQ ID NO: 638590 - RNA, 64 nt, Homo Sapiens
aauuaccuuuauauaucauauguuauuggaagagauuccucaguaaucuccaaucucucauagu

SEQ ID NO: 638591 - RNA, 64 nt, Homo Sapiens
guaacauuugggaggggauuucauuuaaagaaacauuccucaguuguuaauuuuaaggucuuua

SEQ ID NO: 638592 - RNA, 64 nt, Homo Sapiens
agcuggguuaccaucuucagaaggugggguauuuauuccucacuuguuucucuguggacugggc

SEQ ID NO: 638593 - RNA, 64 nt, Homo Sapiens
uuaugugaucaguuuuggggguuaacuuugcuuaauuccucaggcuuugcgauuuaaggaggag

SEQ ID NO: 638594 - RNA, 64 nt, Homo Sapiens
aucuuuuuuuauuauuaaaagcaaguuucuuuguauuccucacccuagauuuguauaaaugccu

SEQ ID NO: 638595 - RNA, 64 nt, Homo Sapiens
caguggcuggggaaacccuuccuagucucacuugauuccucaugacggaaaucacacuaaagag

SEQ ID NO: 638596 - RNA, 64 nt, Homo Sapiens
cacuguugcugagguugaaaauaaucaugcagucauuccucaauuacugccugcagcaauuccu

SEQ ID NO: 638597 - RNA, 64 nt, Homo Sapiens
agcacuuuaaacgccgaagagugacaaugauuguauuccucagugagugcggugaugaacuuac

SEQ ID NO: 638598 - RNA, 64 nt, Homo Sapiens
aacacuaagauuaauuguguguguuuuaaaaacaauuccucauggaugaaaguuuugcccaguu

SEQ ID NO: 638599 - RNA, 64 nt, Homo Sapiens
ugauucucaucauugggagaucuuaaaucuuagcaagcauuagcaauauuaaaugccaaaauuc

SEQ ID NO: 638600 - RNA, 64 nt, Homo Sapiens
ucagguuucuacaaauaggguaauuguaaauuuaaagcauuagcauuuauuggugaauaaugua

SEQ ID NO: 638601 - RNA, 64 nt, Homo Sapiens
cucuuguaaauggaaugguuugggguuuuuaaauaagcauuaacuaacaaccuuucuauaguua

SEQ ID NO: 638602 - RNA, 64 nt, Homo Sapiens
aaaguguuugagaacuucauccaaaccuacuuuaaagcauuaugugcaauuaaguuguuaugac

SEQ ID NO: 638603 - RNA, 63 nt, Homo Sapiens
cccggacgcuggucaugugagacauuuccagaaaagcauuaugguuuucagaacacuucaagu

SEQ ID NO: 638604 - RNA, 64 nt, Homo Sapiens
cuaaacauaugcauauauuuuuaaaaaucaguaaaagcauuacucuaaguguagacuuaauacc

SEQ ID NO: 638605 - RNA, 64 nt, Homo Sapiens
uuuuguuuuauaguuaugcugguuaggauagcacaagcauuaacuugcugaagaaugugucugu

SEQ ID NO: 638606 - RNA, 64 nt, Homo Sapiens
gaguucugaagcuuaagauucagaggcguuccuuaagcauuagaucccuuauauggcaaucagg

SEQ ID NO: 638607 - RNA, 64 nt, Homo Sapiens
uauaacugaagaguauaacauauuugaaagauagaagcauuauuaaaugcauauauuuagcggg

SEQ ID NO: 638608 - RNA, 64 nt, Homo Sapiens
auagaguugauguuucauucuauagaagcucuucaagcauuaaacugauauauuuaauaagagg

SEQ ID NO: 638609 - RNA, 64 nt, Homo Sapiens
aauauuguaaaaccuacaugagcagaugaaauagaagcauuaaauauuuuuaucuauauccaaa

SEQ ID NO: 638610 - RNA, 64 nt, Homo Sapiens
gcagccacuggaaauacauucugugguguccuagaagcauuauugguagguucuaaaguuuucu

SEQ ID NO: 638611 - RNA, 64 nt, Homo Sapiens
ccaggucuuauguucccaggcccugucuucuggaaagcauuacugggaaguggacacuaggaau

SEQ ID NO: 638612 - RNA, 64 nt, Homo Sapiens
aucauuguagccacacaucauugcugggagaauuaagcauuauccugaagacucugccaggaga

SEQ ID NO: 638613 - RNA, 64 nt, Homo Sapiens
gguaugccuggcaggugugaugcugcuauugaagaagcauuagggcagcugcaggcaagcauua

SEQ ID NO: 638614 - RNA, 64 nt, Homo Sapiens
cugcuauugaagaagcauuauagcagcugcaggcaagcauuauggcuccuccaaaguucuggcu

SEQ ID NO: 638615 - RNA, 64 nt, Homo Sapiens
ugggaaagccuuuaagcaguccucaacucuuacuaagcauuaaauauuggccgggugcgguggc

SEQ ID NO: 638616 - RNA, 64 nt, Homo Sapiens
auuuuacucaacacagagaguuccugcuuaauaaaagcauuauaagugcaauuacugucaaaag

SEQ ID NO: 638617 - RNA, 64 nt, Homo Sapiens
ugacauuaaacuguuuauguuuaacauugaguuuaagcauuaauugaccugaguuugaguugac

SEQ ID NO: 638618 - RNA, 64 nt, Homo Sapiens
ugacauuacaguuaaaugaguauagcaagccaucaagcauuaauguuguuucaaaugccauuag

SEQ ID NO: 638619 - RNA, 64 nt, Homo Sapiens
ugccauuaaacuguuuauguuuaacauugauuucaagcauuaaucuugaccugaguuuguugau

SEQ ID NO: 638620 - RNA, 64 nt, Homo Sapiens
ugacauuagagucaaaucaguauagcaaaccaucaagcauuaauguuguuucaaaugcagugag

SEQ ID NO: 638621 - RNA, 64 nt, Homo Sapiens
gcugucacaagcuugugaaaguaucagugugucaaagcauuaugggaaaaaucuauauaaaaca

SEQ ID NO: 638622 - RNA, 64 nt, Homo Sapiens
cgacauuaaacuguuuauguuuaacauugauuucaagcauuaauugaccugaguuugaguugac

SEQ ID NO: 638623 - RNA, 64 nt, Homo Sapiens; identical to SEQ ID NO: 182986

SEQ ID NO: 638624 - RNA, 64 nt, Homo Sapiens; identical to SEQ ID NO: 182987

SEQ ID NO: 638625 - RNA, 64 nt, Homo Sapiens; identical to SEQ ID NO: 182988

SEQ ID NO: 638626 - RNA, 64 nt, Homo Sapiens; identical to SEQ ID NO: 182989

SEQ ID NO: 638627 - RNA, 64 nt, Homo Sapiens; identical to SEQ ID NO: 182990

SEQ ID NO: 638628 - RNA, 64 nt, Homo Sapiens; identical to SEQ ID NO: 182991

SEQ ID NO: 638629 - RNA, 64 nt, Homo Sapiens; identical to SEQ ID NO: 182992

SEQ ID NO: 638630 - RNA, 64 nt, Homo Sapiens; identical to SEQ ID NO: 182993

SEQ ID NO: 638631 - RNA, 64 nt, Homo Sapiens; identical to SEQ ID NO: 182994

SEQ ID NO: 638632 - RNA, 64 nt, Homo Sapiens; identical to SEQ ID NO: 182995

SEQ ID NO: 638633 - RNA, 64 nt, Homo Sapiens; identical to SEQ ID NO: 182996

SEQ ID NO: 638634 - RNA, 64 nt, Homo Sapiens; identical to SEQ ID NO: 182997

SEQ ID NO: 638635 - RNA, 64 nt, Homo Sapiens; identical to SEQ ID NO: 182998

SEQ ID NO: 638636 - RNA, 64 nt, Homo Sapiens; identical to SEQ ID NO: 182999

SEQ ID NO: 638637 - RNA, 64 nt, Homo Sapiens; identical to SEQ ID NO: 183000

SEQ ID NO: 638638 - RNA, 64 nt, Homo Sapiens; identical to SEQ ID NO: 183001

SEQ ID NO: 638639 - RNA, 64 nt, Homo Sapiens; identical to SEQ ID NO: 183002

SEQ ID NO: 638640 - RNA, 64 nt, Homo Sapiens; identical to SEQ ID NO: 183003

SEQ ID NO: 638641 - RNA, 64 nt, Homo Sapiens; identical to SEQ ID NO: 183004

SEQ ID NO: 638642 - RNA, 64 nt, Homo Sapiens; identical to SEQ ID NO: 183005

SEQ ID NO: 638643 - RNA, 64 nt, Homo Sapiens; identical to SEQ ID NO: 183006

SEQ ID NO: 638644 - RNA, 64 nt, Homo Sapiens; identical to SEQ ID NO: 183007

SEQ ID NO: 638645 - RNA, 64 nt, Homo Sapiens; identical to SEQ ID NO: 183008

SEQ ID NO: 638646 - RNA, 64 nt, Homo Sapiens; identical to SEQ ID NO: 183009

SEQ ID NO: 638647 - RNA, 64 nt, Homo Sapiens; identical to SEQ ID NO: 183010

SEQ ID NO: 638648 - RNA, 64 nt, Homo Sapiens; identical to SEQ ID NO: 183011

SEQ ID NO: 638649 - RNA, 64 nt, Homo Sapiens; identical to SEQ ID NO: 183012

SEQ ID NO: 638650 - RNA, 64 nt, Homo Sapiens; identical to SEQ ID NO: 183013

SEQ ID NO: 638651 - RNA, 64 nt, Homo Sapiens; identical to SEQ ID NO: 183014

SEQ ID NO: 638652 - RNA, 64 nt, Homo Sapiens; identical to SEQ ID NO: 183015

SEQ ID NO: 638653 - RNA, 64 nt, Homo Sapiens; identical to SEQ ID NO: 183016

SEQ ID NO: 638654 - RNA, 64 nt, Homo Sapiens; identical to SEQ ID NO: 183017

SEQ ID NO: 638655 - RNA, 64 nt, Homo Sapiens; identical to SEQ ID NO: 183018

SEQ ID NO: 638656 - RNA, 64 nt, Homo Sapiens; identical to SEQ ID NO: 183019

SEQ ID NO: 638657 - RNA, 64 nt, Homo Sapiens; identical to SEQ ID NO: 183020

SEQ ID NO: 638658 - RNA, 64 nt, Homo Sapiens; identical to SEQ ID NO: 183021

SEQ ID NO: 638659 - RNA, 64 nt, Homo Sapiens; identical to SEQ ID NO: 183022

SEQ ID NO: 638660 - RNA, 64 nt, Homo Sapiens; identical to SEQ ID NO: 183023

SEQ ID NO: 638661 - RNA, 64 nt, Homo Sapiens; identical to SEQ ID NO: 183024

SEQ ID NO: 638662 - RNA, 64 nt, Homo Sapiens; identical to SEQ ID NO: 183025

SEQ ID NO: 638663 - RNA, 64 nt, Homo Sapiens; identical to SEQ ID NO: 183026

SEQ ID NO: 638664 - RNA, 64 nt, Homo Sapiens; identical to SEQ ID NO: 183027

SEQ ID NO: 638665 - RNA, 64 nt, Homo Sapiens; identical to SEQ ID NO: 183028

SEQ ID NO: 638666 - RNA, 64 nt, Homo Sapiens; identical to SEQ ID NO: 183029

SEQ ID NO: 638667 - RNA, 64 nt, Homo Sapiens; identical to SEQ ID NO: 183030

SEQ ID NO: 638668 - RNA, 64 nt, Homo Sapiens; identical to SEQ ID NO: 183031

SEQ ID NO: 638669 - RNA, 64 nt, Homo Sapiens; identical to SEQ ID NO: 183032

SEQ ID NO: 638670 - RNA, 64 nt, Homo Sapiens; identical to SEQ ID NO: 183033

SEQ ID NO: 638671 - RNA, 64 nt, Homo Sapiens; identical to SEQ ID NO: 183034

SEQ ID NO: 638672 - RNA, 64 nt, Homo Sapiens; identical to SEQ ID NO: 183035

SEQ ID NO: 638673 - RNA, 64 nt, Homo Sapiens; identical to SEQ ID NO: 183036

SEQ ID NO: 638674 - RNA, 64 nt, Homo Sapiens; identical to SEQ ID NO: 183037

SEQ ID NO: 638675 - RNA, 64 nt, Homo Sapiens; identical to SEQ ID NO: 183038

SEQ ID NO: 638676 - RNA, 64 nt, Homo Sapiens; identical to SEQ ID NO: 183039

SEQ ID NO: 638677 - RNA, 64 nt, Homo Sapiens; identical to SEQ ID NO: 183040

SEQ ID NO: 638678 - RNA, 64 nt, Homo Sapiens; identical to SEQ ID NO: 183041

SEQ ID NO: 638679 - RNA, 64 nt, Homo Sapiens; identical to SEQ ID NO: 183042

SEQ ID NO: 638680 - RNA, 64 nt, Homo Sapiens; identical to SEQ ID NO: 183043

SEQ ID NO: 638681 - RNA, 64 nt, Homo Sapiens; identical to SEQ ID NO: 183044

SEQ ID NO: 638682 - RNA, 64 nt, Homo Sapiens; identical to SEQ ID NO: 183045

SEQ ID NO: 638683 - RNA, 64 nt, Homo Sapiens; identical to SEQ ID NO: 183046

SEQ ID NO: 638684 - RNA, 64 nt, Homo Sapiens; identical to SEQ ID NO: 183047

SEQ ID NO: 638685 - RNA, 64 nt, Homo Sapiens; identical to SEQ ID NO: 183048

SEQ ID NO: 638686 - RNA, 64 nt, Homo Sapiens; identical to SEQ ID NO: 183049

SEQ ID NO: 638687 - RNA, 64 nt, Homo Sapiens; identical to SEQ ID NO: 183050

SEQ ID NO: 638688 - RNA, 64 nt, Homo Sapiens; identical to SEQ ID NO: 183051

SEQ ID NO: 638689 - RNA, 64 nt, Homo Sapiens; identical to SEQ ID NO: 183052

SEQ ID NO: 638690 - RNA, 64 nt, Homo Sapiens; identical to SEQ ID NO: 183053

SEQ ID NO: 638691 - RNA, 64 nt, Homo Sapiens; identical to SEQ ID NO: 183054

SEQ ID NO: 638692 - RNA, 64 nt, Homo Sapiens; identical to SEQ ID NO: 183055

SEQ ID NO: 638693 - RNA, 64 nt, Homo Sapiens; identical to SEQ ID NO: 183056

SEQ ID NO: 638694 - RNA, 64 nt, Homo Sapiens; identical to SEQ ID NO: 183057

SEQ ID NO: 638695 - RNA, 64 nt, Homo Sapiens; identical to SEQ ID NO: 183058

SEQ ID NO: 638696 - RNA, 64 nt, Homo Sapiens; identical to SEQ ID NO: 183059

SEQ ID NO: 638697 - RNA, 64 nt, Homo Sapiens; identical to SEQ ID NO: 183060

SEQ ID NO: 638698 - RNA, 64 nt, Homo Sapiens; identical to SEQ ID NO: 183061

SEQ ID NO: 638699 - RNA, 64 nt, Homo Sapiens; identical to SEQ ID NO: 183062

SEQ ID NO: 638700 - RNA, 64 nt, Homo Sapiens; identical to SEQ ID NO: 183063

SEQ ID NO: 638701 - RNA, 64 nt, Homo Sapiens; identical to SEQ ID NO: 183064

SEQ ID NO: 638702 - RNA, 64 nt, Homo Sapiens; identical to SEQ ID NO: 183065

SEQ ID NO: 638703 - RNA, 64 nt, Homo Sapiens; identical to SEQ ID NO: 183066

SEQ ID NO: 638704 - RNA, 64 nt, Homo Sapiens; identical to SEQ ID NO: 183067

SEQ ID NO: 638705 - RNA, 64 nt, Homo Sapiens; identical to SEQ ID NO: 183068

SEQ ID NO: 638706 - RNA, 64 nt, Homo Sapiens; identical to SEQ ID NO: 183069

SEQ ID NO: 638707 - RNA, 64 nt, Homo Sapiens; identical to SEQ ID NO: 183070

SEQ ID NO: 638708 - RNA, 64 nt, Homo Sapiens; identical to SEQ ID NO: 183071

SEQ ID NO: 638709 - RNA, 64 nt, Homo Sapiens; identical to SEQ ID NO: 183072

SEQ ID NO: 638710 - RNA, 64 nt, Homo Sapiens; identical to SEQ ID NO: 183073

SEQ ID NO: 638711 - RNA, 64 nt, Homo Sapiens; identical to SEQ ID NO: 183074

SEQ ID NO: 638712 - RNA, 64 nt, Homo Sapiens; identical to SEQ ID NO: 183075

SEQ ID NO: 638713 - RNA, 64 nt, Homo Sapiens; identical to SEQ ID NO: 183076

SEQ ID NO: 638714 - RNA, 64 nt, Homo Sapiens; identical to SEQ ID NO: 183077

SEQ ID NO: 638715 - RNA, 64 nt, Homo Sapiens; identical to SEQ ID NO: 183078

SEQ ID NO: 638716 - RNA, 64 nt, Homo Sapiens; identical to SEQ ID NO: 183079

SEQ ID NO: 638717 - RNA, 64 nt, Homo Sapiens; identical to SEQ ID NO: 183080

SEQ ID NO: 638718 - RNA, 64 nt, Homo Sapiens; identical to SEQ ID NO: 183081

SEQ ID NO: 638719 - RNA, 64 nt, Homo Sapiens; identical to SEQ ID NO: 183082

SEQ ID NO: 638720 - RNA, 64 nt, Homo Sapiens; identical to SEQ ID NO: 183083

SEQ ID NO: 638721 - RNA, 64 nt, Homo Sapiens; identical to SEQ ID NO: 183084

SEQ ID NO: 638722 - RNA, 64 nt, Homo Sapiens; identical to SEQ ID NO: 183085

SEQ ID NO: 638723 - RNA, 64 nt, Homo Sapiens; identical to SEQ ID NO: 183086

SEQ ID NO: 638724 - RNA, 64 nt, Homo Sapiens; identical to SEQ ID NO: 183087

SEQ ID NO: 638725 - RNA, 64 nt, Homo Sapiens; identical to SEQ ID NO: 183088

SEQ ID NO: 638726 - RNA, 64 nt, Homo Sapiens; identical to SEQ ID NO: 183089

SEQ ID NO: 638727 - RNA, 64 nt, Homo Sapiens; identical to SEQ ID NO: 183090

SEQ ID NO: 638728 - RNA, 64 nt, Homo Sapiens; identical to SEQ ID NO: 183091

SEQ ID NO: 638729 - RNA, 64 nt, Homo Sapiens; identical to SEQ ID NO: 183092

SEQ ID NO: 638730 - RNA, 64 nt, Homo Sapiens; identical to SEQ ID NO: 183093

SEQ ID NO: 638731 - RNA, 64 nt, Homo Sapiens; identical to SEQ ID NO: 183094

SEQ ID NO: 638732 - RNA, 64 nt, Homo Sapiens; identical to SEQ ID NO: 183095

SEQ ID NO: 638733 - RNA, 64 nt, Homo Sapiens; identical to SEQ ID NO: 183096

SEQ ID NO: 638734 - RNA, 64 nt, Homo Sapiens; identical to SEQ ID NO: 183097

SEQ ID NO: 638735 - RNA, 64 nt, Homo Sapiens; identical to SEQ ID NO: 183098

SEQ ID NO: 638736 - RNA, 64 nt, Homo Sapiens; identical to SEQ ID NO: 183099

SEQ ID NO: 638737 - RNA, 64 nt, Homo Sapiens; identical to SEQ ID NO: 183100

SEQ ID NO: 638738 - RNA, 64 nt, Homo Sapiens; identical to SEQ ID NO: 183101

SEQ ID NO: 638739 - RNA, 64 nt, Homo Sapiens; identical to SEQ ID NO: 183102

SEQ ID NO: 638740 - RNA, 64 nt, Homo Sapiens; identical to SEQ ID NO: 183103

SEQ ID NO: 638741 - RNA, 64 nt, Homo Sapiens; identical to SEQ ID NO: 183104

SEQ ID NO: 638742 - RNA, 64 nt, Homo Sapiens; identical to SEQ ID NO: 183105

SEQ ID NO: 638743 - RNA, 64 nt, Homo Sapiens; identical to SEQ ID NO: 183106

SEQ ID NO: 638744 - RNA, 64 nt, Homo Sapiens; identical to SEQ ID NO: 183107

SEQ ID NO: 638745 - RNA, 64 nt, Homo Sapiens; identical to SEQ ID NO: 183108

SEQ ID NO: 638746 - RNA, 64 nt, Homo Sapiens; identical to SEQ ID NO: 183109

SEQ ID NO: 638747 - RNA, 64 nt, Homo Sapiens; identical to SEQ ID NO: 183110

SEQ ID NO: 638748 - RNA, 64 nt, Homo Sapiens; identical to SEQ ID NO: 183111

SEQ ID NO: 638749 - RNA, 64 nt, Homo Sapiens; identical to SEQ ID NO: 183112

SEQ ID NO: 638750 - RNA, 64 nt, Homo Sapiens; identical to SEQ ID NO: 183113

SEQ ID NO: 638751 - RNA, 64 nt, Homo Sapiens; identical to SEQ ID NO: 183114

SEQ ID NO: 638752 - RNA, 64 nt, Homo Sapiens; identical to SEQ ID NO: 183115

SEQ ID NO: 638753 - RNA, 64 nt, Homo Sapiens; identical to SEQ ID NO: 183116

SEQ ID NO: 638754 - RNA, 64 nt, Homo Sapiens; identical to SEQ ID NO: 183117

SEQ ID NO: 638755 - RNA, 64 nt, Homo Sapiens; identical to SEQ ID NO: 183118

SEQ ID NO: 638756 - RNA, 64 nt, Homo Sapiens; identical to SEQ ID NO: 183119

SEQ ID NO: 638757 - RNA, 64 nt, Homo Sapiens; identical to SEQ ID NO: 183120

SEQ ID NO: 638758 - RNA, 64 nt, Homo Sapiens; identical to SEQ ID NO: 183121

SEQ ID NO: 638759 - RNA, 64 nt, Homo Sapiens; identical to SEQ ID NO: 183122

SEQ ID NO: 638760 - RNA, 64 nt, Homo Sapiens; identical to SEQ ID NO: 183123

SEQ ID NO: 638761 - RNA, 64 nt, Homo Sapiens; identical to SEQ ID NO: 183124

SEQ ID NO: 638762 - RNA, 64 nt, Homo Sapiens; identical to SEQ ID NO: 183125

SEQ ID NO: 638763 - RNA, 64 nt, Homo Sapiens; identical to SEQ ID NO: 183126

SEQ ID NO: 638764 - RNA, 64 nt, Homo Sapiens; identical to SEQ ID NO: 183127

SEQ ID NO: 638765 - RNA, 64 nt, Homo Sapiens; identical to SEQ ID NO: 183128

SEQ ID NO: 638766 - RNA, 64 nt, Homo Sapiens; identical to SEQ ID NO: 183129

SEQ ID NO: 638767 - RNA, 64 nt, Homo Sapiens; identical to SEQ ID NO: 183130

SEQ ID NO: 638768 - RNA, 64 nt, Homo Sapiens; identical to SEQ ID NO: 183131

SEQ ID NO: 638769 - RNA, 64 nt, Homo Sapiens; identical to SEQ ID NO: 183132

SEQ ID NO: 638770 - RNA, 64 nt, Homo Sapiens; identical to SEQ ID NO: 183133

SEQ ID NO: 638771 - RNA, 64 nt, Homo Sapiens; identical to SEQ ID NO: 183134

SEQ ID NO: 638772 - RNA, 64 nt, Homo Sapiens; identical to SEQ ID NO: 183135

SEQ ID NO: 638773 - RNA, 64 nt, Homo Sapiens; identical to SEQ ID NO: 183136

SEQ ID NO: 638774 - RNA, 64 nt, Homo Sapiens; identical to SEQ ID NO: 183137

SEQ ID NO: 638775 - RNA, 64 nt, Homo Sapiens; identical to SEQ ID NO: 183138

SEQ ID NO: 638776 - RNA, 64 nt, Homo Sapiens; identical to SEQ ID NO: 183139

SEQ ID NO: 638777 - RNA, 64 nt, Homo Sapiens; identical to SEQ ID NO: 183140

SEQ ID NO: 638778 - RNA, 64 nt, Homo Sapiens; identical to SEQ ID NO: 183141

SEQ ID NO: 638779 - RNA, 64 nt, Homo Sapiens; identical to SEQ ID NO: 183142

SEQ ID NO: 638780 - RNA, 64 nt, Homo Sapiens; identical to SEQ ID NO: 183143

SEQ ID NO: 638781 - RNA, 64 nt, Homo Sapiens; identical to SEQ ID NO: 183144

SEQ ID NO: 638782 - RNA, 64 nt, Homo Sapiens; identical to SEQ ID NO: 183145

SEQ ID NO: 638783 - RNA, 64 nt, Homo Sapiens; identical to SEQ ID NO: 183146

SEQ ID NO: 638784 - RNA, 64 nt, Homo Sapiens; identical to SEQ ID NO: 183147

SEQ ID NO: 638785 - RNA, 64 nt, Homo Sapiens; identical to SEQ ID NO: 183148

SEQ ID NO: 638786 - RNA, 64 nt, Homo Sapiens; identical to SEQ ID NO: 183149

SEQ ID NO: 638787 - RNA, 64 nt, Homo Sapiens; identical to SEQ ID NO: 183150

SEQ ID NO: 638788 - RNA, 64 nt, Homo Sapiens; identical to SEQ ID NO: 183151

SEQ ID NO: 638789 - RNA, 64 nt, Homo Sapiens; identical to SEQ ID NO: 183152

SEQ ID NO: 638790 - RNA, 64 nt, Homo Sapiens; identical to SEQ ID NO: 183153

SEQ ID NO: 638791 - RNA, 64 nt, Homo Sapiens; identical to SEQ ID NO: 183154

SEQ ID NO: 638792 - RNA, 64 nt, Homo Sapiens; identical to SEQ ID NO: 183155

SEQ ID NO: 638793 - RNA, 64 nt, Homo Sapiens; identical to SEQ ID NO: 183156

SEQ ID NO: 638794 - RNA, 64 nt, Homo Sapiens; identical to SEQ ID NO: 183157

SEQ ID NO: 638795 - RNA, 64 nt, Homo Sapiens; identical to SEQ ID NO: 183158

SEQ ID NO: 638796 - RNA, 64 nt, Homo Sapiens; identical to SEQ ID NO: 183159

SEQ ID NO: 638797 - RNA, 64 nt, Homo Sapiens; identical to SEQ ID NO: 183160

SEQ ID NO: 638798 - RNA, 64 nt, Homo Sapiens; identical to SEQ ID NO: 183161

SEQ ID NO: 638799 - RNA, 64 nt, Homo Sapiens; identical to SEQ ID NO: 183162

SEQ ID NO: 638800 - RNA, 64 nt, Homo Sapiens; identical to SEQ ID NO: 183163

SEQ ID NO: 638801 - RNA, 64 nt, Homo Sapiens; identical to SEQ ID NO: 183164

SEQ ID NO: 638802 - RNA, 64 nt, Homo Sapiens; identical to SEQ ID NO: 183165

SEQ ID NO: 638803 - RNA, 64 nt, Homo Sapiens; identical to SEQ ID NO: 183166

SEQ ID NO: 638804 - RNA, 64 nt, Homo Sapiens; identical to SEQ ID NO: 183167

SEQ ID NO: 638805 - RNA, 64 nt, Homo Sapiens; identical to SEQ ID NO: 183168

SEQ ID NO: 638806 - RNA, 64 nt, Homo Sapiens; identical to SEQ ID NO: 183169

SEQ ID NO: 638807 - RNA, 64 nt, Homo Sapiens; identical to SEQ ID NO: 183170

SEQ ID NO: 638808 - RNA, 64 nt, Homo Sapiens; identical to SEQ ID NO: 183171

SEQ ID NO: 638809 - RNA, 64 nt, Homo Sapiens; identical to SEQ ID NO: 183172

SEQ ID NO: 638810 - RNA, 64 nt, Homo Sapiens; identical to SEQ ID NO: 183173

SEQ ID NO: 638811 - RNA, 64 nt, Homo Sapiens; identical to SEQ ID NO: 183174

SEQ ID NO: 638812 - RNA, 64 nt, Homo Sapiens; identical to SEQ ID NO: 183175

SEQ ID NO: 638813 - RNA, 64 nt, Homo Sapiens; identical to SEQ ID NO: 183176

SEQ ID NO: 638814 - RNA, 64 nt, Homo Sapiens; identical to SEQ ID NO: 183177

SEQ ID NO: 638815 - RNA, 64 nt, Homo Sapiens; identical to SEQ ID NO: 183178

SEQ ID NO: 638816 - RNA, 64 nt, Homo Sapiens; identical to SEQ ID NO: 183179

SEQ ID NO: 638817 - RNA, 64 nt, Homo Sapiens; identical to SEQ ID NO: 183180

SEQ ID NO: 638818 - RNA, 64 nt, Homo Sapiens; identical to SEQ ID NO: 183181

SEQ ID NO: 638819 - RNA, 64 nt, Homo Sapiens; identical to SEQ ID NO: 183182

SEQ ID NO: 638820 - RNA, 64 nt, Homo Sapiens; identical to SEQ ID NO: 183183

SEQ ID NO: 638821 - RNA, 64 nt, Homo Sapiens; identical to SEQ ID NO: 183184

SEQ ID NO: 638822 - RNA, 64 nt, Homo Sapiens; identical to SEQ ID NO: 183185

SEQ ID NO: 638823 - RNA, 64 nt, Homo Sapiens; identical to SEQ ID NO: 183186

SEQ ID NO: 638824 - RNA, 64 nt, Homo Sapiens; identical to SEQ ID NO: 183187

SEQ ID NO: 638825 - RNA, 64 nt, Homo Sapiens; identical to SEQ ID NO: 183188

SEQ ID NO: 638826 - RNA, 64 nt, Homo Sapiens; identical to SEQ ID NO: 183189

SEQ ID NO: 638827 - RNA, 64 nt, Homo Sapiens; identical to SEQ ID NO: 183190

SEQ ID NO: 638828 - RNA, 64 nt, Homo Sapiens; identical to SEQ ID NO: 183191

SEQ ID NO: 638829 - RNA, 64 nt, Homo Sapiens; identical to SEQ ID NO: 183192

SEQ ID NO: 638830 - RNA, 64 nt, Homo Sapiens; identical to SEQ ID NO: 183193

SEQ ID NO: 638831 - RNA, 64 nt, Homo Sapiens; identical to SEQ ID NO: 183194

SEQ ID NO: 638832 - RNA, 64 nt, Homo Sapiens; identical to SEQ ID NO: 183195

SEQ ID NO: 638833 - RNA, 64 nt, Homo Sapiens; identical to SEQ ID NO: 183196

SEQ ID NO: 638834 - RNA, 64 nt, Homo Sapiens; identical to SEQ ID NO: 183197

SEQ ID NO: 638835 - RNA, 64 nt, Homo Sapiens; identical to SEQ ID NO: 183198

SEQ ID NO: 638836 - RNA, 64 nt, Homo Sapiens; identical to SEQ ID NO: 183199

SEQ ID NO: 638837 - RNA, 64 nt, Homo Sapiens; identical to SEQ ID NO: 183200

SEQ ID NO: 638838 - RNA, 64 nt, Homo Sapiens; identical to SEQ ID NO: 183201

SEQ ID NO: 638839 - RNA, 64 nt, Homo Sapiens; identical to SEQ ID NO: 183202

SEQ ID NO: 638840 - RNA, 64 nt, Homo Sapiens; identical to SEQ ID NO: 183203

SEQ ID NO: 638841 - RNA, 64 nt, Homo Sapiens; identical to SEQ ID NO: 183204

SEQ ID NO: 638842 - RNA, 64 nt, Homo Sapiens; identical to SEQ ID NO: 183205

SEQ ID NO: 638843 - RNA, 64 nt, Homo Sapiens; identical to SEQ ID NO: 183206

SEQ ID NO: 638844 - RNA, 64 nt, Homo Sapiens; identical to SEQ ID NO: 183207

SEQ ID NO: 638845 - RNA, 64 nt, Homo Sapiens; identical to SEQ ID NO: 183208

SEQ ID NO: 638846 - RNA, 64 nt, Homo Sapiens; identical to SEQ ID NO: 183209

SEQ ID NO: 638847 - RNA, 64 nt, Homo Sapiens; identical to SEQ ID NO: 183210

SEQ ID NO: 638848 - RNA, 64 nt, Homo Sapiens; identical to SEQ ID NO: 183211

SEQ ID NO: 638849 - RNA, 64 nt, Homo Sapiens; identical to SEQ ID NO: 183212

SEQ ID NO: 638850 - RNA, 64 nt, Homo Sapiens; identical to SEQ ID NO: 183213

SEQ ID NO: 638851 - RNA, 64 nt, Homo Sapiens; identical to SEQ ID NO: 183214

SEQ ID NO: 638852 - RNA, 64 nt, Homo Sapiens; identical to SEQ ID NO: 183215

SEQ ID NO: 638853 - RNA, 64 nt, Homo Sapiens; identical to SEQ ID NO: 183216

SEQ ID NO: 638854 - RNA, 64 nt, Homo Sapiens; identical to SEQ ID NO: 183217

SEQ ID NO: 638855 - RNA, 64 nt, Homo Sapiens; identical to SEQ ID NO: 183218

SEQ ID NO: 638856 - RNA, 64 nt, Homo Sapiens; identical to SEQ ID NO: 183219

SEQ ID NO: 638857 - RNA, 64 nt, Homo Sapiens; identical to SEQ ID NO: 183220

SEQ ID NO: 638858 - RNA, 64 nt, Homo Sapiens; identical to SEQ ID NO: 183221

SEQ ID NO: 638859 - RNA, 64 nt, Homo Sapiens; identical to SEQ ID NO: 183222

SEQ ID NO: 638860 - RNA, 64 nt, Homo Sapiens; identical to SEQ ID NO: 183223

SEQ ID NO: 638861 - RNA, 64 nt, Homo Sapiens; identical to SEQ ID NO: 183224

SEQ ID NO: 638862 - RNA, 64 nt, Homo Sapiens; identical to SEQ ID NO: 183225

SEQ ID NO: 638863 - RNA, 64 nt, Homo Sapiens; identical to SEQ ID NO: 183226

SEQ ID NO: 638864 - RNA, 64 nt, Homo Sapiens; identical to SEQ ID NO: 183227

SEQ ID NO: 638865 - RNA, 64 nt, Homo Sapiens; identical to SEQ ID NO: 183228

SEQ ID NO: 638866 - RNA, 64 nt, Homo Sapiens; identical to SEQ ID NO: 183229

SEQ ID NO: 638867 - RNA, 64 nt, Homo Sapiens; identical to SEQ ID NO: 183230

SEQ ID NO: 638868 - RNA, 64 nt, Homo Sapiens; identical to SEQ ID NO: 183231

SEQ ID NO: 638869 - RNA, 64 nt, Homo Sapiens; identical to SEQ ID NO: 183232

SEQ ID NO: 638870 - RNA, 64 nt, Homo Sapiens; identical to SEQ ID NO: 183233

SEQ ID NO: 638871 - RNA, 64 nt, Homo Sapiens; identical to SEQ ID NO: 183234

SEQ ID NO: 638872 - RNA, 64 nt, Homo Sapiens; identical to SEQ ID NO: 183235

SEQ ID NO: 638873 - RNA, 64 nt, Homo Sapiens; identical to SEQ ID NO: 183236

SEQ ID NO: 638874 - RNA, 64 nt, Homo Sapiens; identical to SEQ ID NO: 183237

SEQ ID NO: 638875 - RNA, 64 nt, Homo Sapiens; identical to SEQ ID NO: 183238

SEQ ID NO: 638876 - RNA, 64 nt, Homo Sapiens; identical to SEQ ID NO: 183239

SEQ ID NO: 638877 - RNA, 64 nt, Homo Sapiens; identical to SEQ ID NO: 183240

SEQ ID NO: 638878 - RNA, 64 nt, Homo Sapiens; identical to SEQ ID NO: 183241

SEQ ID NO: 638879 - RNA, 64 nt, Homo Sapiens; identical to SEQ ID NO: 183242

SEQ ID NO: 638880 - RNA, 64 nt, Homo Sapiens; identical to SEQ ID NO: 183243

SEQ ID NO: 638881 - RNA, 64 nt, Homo Sapiens; identical to SEQ ID NO: 183244

SEQ ID NO: 638882 - RNA, 64 nt, Homo Sapiens; identical to SEQ ID NO: 183245

SEQ ID NO: 638883 - RNA, 64 nt, Homo Sapiens; identical to SEQ ID NO: 183246

SEQ ID NO: 638884 - RNA, 64 nt, Homo Sapiens; identical to SEQ ID NO: 183247

SEQ ID NO: 638885 - RNA, 64 nt, Homo Sapiens; identical to SEQ ID NO: 183248

SEQ ID NO: 638886 - RNA, 64 nt, Homo Sapiens; identical to SEQ ID NO: 183249

SEQ ID NO: 638887 - RNA, 64 nt, Homo Sapiens; identical to SEQ ID NO: 183250

SEQ ID NO: 638888 - RNA, 64 nt, Homo Sapiens; identical to SEQ ID NO: 183251

SEQ ID NO: 638889 - RNA, 64 nt, Homo Sapiens; identical to SEQ ID NO: 183252

SEQ ID NO: 638890 - RNA, 64 nt, Homo Sapiens; identical to SEQ ID NO: 183253

SEQ ID NO: 638891 - RNA, 64 nt, Homo Sapiens; identical to SEQ ID NO: 183254

SEQ ID NO: 638892 - RNA, 64 nt, Homo Sapiens; identical to SEQ ID NO: 183255

SEQ ID NO: 638893 - RNA, 64 nt, Homo Sapiens; identical to SEQ ID NO: 183256

SEQ ID NO: 638894 - RNA, 64 nt, Homo Sapiens; identical to SEQ ID NO: 183257

SEQ ID NO: 638895 - RNA, 64 nt, Homo Sapiens; identical to SEQ ID NO: 183258

SEQ ID NO: 638896 - RNA, 64 nt, Homo Sapiens; identical to SEQ ID NO: 183259

SEQ ID NO: 638897 - RNA, 64 nt, Homo Sapiens; identical to SEQ ID NO: 183260

SEQ ID NO: 638898 - RNA, 64 nt, Homo Sapiens; identical to SEQ ID NO: 183261

SEQ ID NO: 638899 - RNA, 64 nt, Homo Sapiens; identical to SEQ ID NO: 183262

SEQ ID NO: 638900 - RNA, 64 nt, Homo Sapiens; identical to SEQ ID NO: 183263

SEQ ID NO: 638901 - RNA, 64 nt, Homo Sapiens; identical to SEQ ID NO: 183264

SEQ ID NO: 638902 - RNA, 64 nt, Homo Sapiens; identical to SEQ ID NO: 183265

SEQ ID NO: 638903 - RNA, 64 nt, Homo Sapiens; identical to SEQ ID NO: 183266

SEQ ID NO: 638904 - RNA, 64 nt, Homo Sapiens; identical to SEQ ID NO: 183267

SEQ ID NO: 638905 - RNA, 64 nt, Homo Sapiens; identical to SEQ ID NO: 183268

SEQ ID NO: 638906 - RNA, 64 nt, Homo Sapiens; identical to SEQ ID NO: 183269

SEQ ID NO: 638907 - RNA, 64 nt, Homo Sapiens; identical to SEQ ID NO: 183270

SEQ ID NO: 638908 - RNA, 64 nt, Homo Sapiens; identical to SEQ ID NO: 183271

SEQ ID NO: 638909 - RNA, 64 nt, Homo Sapiens; identical to SEQ ID NO: 183272

SEQ ID NO: 638910 - RNA, 64 nt, Homo Sapiens; identical to SEQ ID NO: 183273

SEQ ID NO: 638911 - RNA, 64 nt, Homo Sapiens; identical to SEQ ID NO: 183274

SEQ ID NO: 638912 - RNA, 64 nt, Homo Sapiens; identical to SEQ ID NO: 183275

SEQ ID NO: 638913 - RNA, 64 nt, Homo Sapiens; identical to SEQ ID NO: 183276

SEQ ID NO: 638914 - RNA, 64 nt, Homo Sapiens; identical to SEQ ID NO: 183277

SEQ ID NO: 638915 - RNA, 64 nt, Homo Sapiens; identical to SEQ ID NO: 183278

SEQ ID NO: 638916 - RNA, 64 nt, Homo Sapiens; identical to SEQ ID NO: 183279

SEQ ID NO: 638917 - RNA, 64 nt, Homo Sapiens; identical to SEQ ID NO: 183280

SEQ ID NO: 638918 - RNA, 64 nt, Homo Sapiens; identical to SEQ ID NO: 183281

SEQ ID NO: 638919 - RNA, 64 nt, Homo Sapiens; identical to SEQ ID NO: 183282

SEQ ID NO: 638920 - RNA, 64 nt, Homo Sapiens; identical to SEQ ID NO: 183283

SEQ ID NO: 638921 - RNA, 64 nt, Homo Sapiens; identical to SEQ ID NO: 183284

SEQ ID NO: 638922 - RNA, 64 nt, Homo Sapiens; identical to SEQ ID NO: 183285

SEQ ID NO: 638923 - RNA, 64 nt, Homo Sapiens; identical to SEQ ID NO: 183286

SEQ ID NO: 638924 - RNA, 64 nt, Homo Sapiens; identical to SEQ ID NO: 183287

SEQ ID NO: 638925 - RNA, 64 nt, Homo Sapiens; identical to SEQ ID NO: 183288

SEQ ID NO: 638926 - RNA, 64 nt, Homo Sapiens; identical to SEQ ID NO: 183289

SEQ ID NO: 638927 - RNA, 64 nt, Homo Sapiens; identical to SEQ ID NO: 183290

SEQ ID NO: 638928 - RNA, 64 nt, Homo Sapiens; identical to SEQ ID NO: 183291

SEQ ID NO: 638929 - RNA, 64 nt, Homo Sapiens; identical to SEQ ID NO: 183292

SEQ ID NO: 638930 - RNA, 64 nt, Homo Sapiens; identical to SEQ ID NO: 183293

SEQ ID NO: 638931 - RNA, 64 nt, Homo Sapiens; identical to SEQ ID NO: 183294

SEQ ID NO: 638932 - RNA, 64 nt, Homo Sapiens; identical to SEQ ID NO: 183295

SEQ ID NO: 638933 - RNA, 64 nt, Homo Sapiens; identical to SEQ ID NO: 183296

SEQ ID NO: 638934 - RNA, 64 nt, Homo Sapiens; identical to SEQ ID NO: 183297

SEQ ID NO: 638935 - RNA, 64 nt, Homo Sapiens; identical to SEQ ID NO: 183298

SEQ ID NO: 638936 - RNA, 64 nt, Homo Sapiens; identical to SEQ ID NO: 183299

SEQ ID NO: 638937 - RNA, 64 nt, Homo Sapiens; identical to SEQ ID NO: 183300

SEQ ID NO: 638938 - RNA, 64 nt, Homo Sapiens; identical to SEQ ID NO: 183301

SEQ ID NO: 638939 - RNA, 64 nt, Homo Sapiens; identical to SEQ ID NO: 183302

SEQ ID NO: 638940 - RNA, 64 nt, Homo Sapiens; identical to SEQ ID NO: 183303

SEQ ID NO: 638941 - RNA, 64 nt, Homo Sapiens; identical to SEQ ID NO: 183304

SEQ ID NO: 638942 - RNA, 64 nt, Homo Sapiens; identical to SEQ ID NO: 183305

SEQ ID NO: 638943 - RNA, 64 nt, Homo Sapiens; identical to SEQ ID NO: 183306

SEQ ID NO: 638944 - RNA, 64 nt, Homo Sapiens; identical to SEQ ID NO: 183307

SEQ ID NO: 638945 - RNA, 64 nt, Homo Sapiens; identical to SEQ ID NO: 183308

SEQ ID NO: 638946 - RNA, 64 nt, Homo Sapiens; identical to SEQ ID NO: 183309

SEQ ID NO: 638947 - RNA, 64 nt, Homo Sapiens; identical to SEQ ID NO: 183310

SEQ ID NO: 638948 - RNA, 64 nt, Homo Sapiens; identical to SEQ ID NO: 183311

SEQ ID NO: 638949 - RNA, 64 nt, Homo Sapiens; identical to SEQ ID NO: 183312

SEQ ID NO: 638950 - RNA, 64 nt, Homo Sapiens; identical to SEQ ID NO: 183313

SEQ ID NO: 638951 - RNA, 64 nt, Homo Sapiens; identical to SEQ ID NO: 183314

SEQ ID NO: 638952 - RNA, 64 nt, Homo Sapiens; identical to SEQ ID NO: 183315

SEQ ID NO: 638953 - RNA, 64 nt, Homo Sapiens; identical to SEQ ID NO: 183316

SEQ ID NO: 638954 - RNA, 64 nt, Homo Sapiens; identical to SEQ ID NO: 183317

SEQ ID NO: 638955 - RNA, 64 nt, Homo Sapiens; identical to SEQ ID NO: 183318

SEQ ID NO: 638956 - RNA, 64 nt, Homo Sapiens; identical to SEQ ID NO: 183319

SEQ ID NO: 638957 - RNA, 64 nt, Homo Sapiens; identical to SEQ ID NO: 183320

SEQ ID NO: 638958 - RNA, 64 nt, Homo Sapiens; identical to SEQ ID NO: 183321

SEQ ID NO: 638959 - RNA, 64 nt, Homo Sapiens; identical to SEQ ID NO: 183322

SEQ ID NO: 638960 - RNA, 64 nt, Homo Sapiens; identical to SEQ ID NO: 183323

SEQ ID NO: 638961 - RNA, 64 nt, Homo Sapiens; identical to SEQ ID NO: 183324

SEQ ID NO: 638962 - RNA, 64 nt, Homo Sapiens; identical to SEQ ID NO: 183325

SEQ ID NO: 638963 - RNA, 64 nt, Homo Sapiens; identical to SEQ ID NO: 183326

SEQ ID NO: 638964 - RNA, 64 nt, Homo Sapiens; identical to SEQ ID NO: 183327

SEQ ID NO: 638965 - RNA, 64 nt, Homo Sapiens; identical to SEQ ID NO: 183328

SEQ ID NO: 638966 - RNA, 64 nt, Homo Sapiens; identical to SEQ ID NO: 183329

SEQ ID NO: 638967 - RNA, 64 nt, Homo Sapiens; identical to SEQ ID NO: 183330

SEQ ID NO: 638968 - RNA, 64 nt, Homo Sapiens; identical to SEQ ID NO: 183331

SEQ ID NO: 638969 - RNA, 64 nt, Homo Sapiens; identical to SEQ ID NO: 183332

SEQ ID NO: 638970 - RNA, 64 nt, Homo Sapiens; identical to SEQ ID NO: 183333

SEQ ID NO: 638971 - RNA, 64 nt, Homo Sapiens; identical to SEQ ID NO: 183334

SEQ ID NO: 638972 - RNA, 64 nt, Homo Sapiens; identical to SEQ ID NO: 183335

SEQ ID NO: 638973 - RNA, 64 nt, Homo Sapiens; identical to SEQ ID NO: 183336

SEQ ID NO: 638974 - RNA, 64 nt, Homo Sapiens; identical to SEQ ID NO: 183337

SEQ ID NO: 638975 - RNA, 64 nt, Homo Sapiens; identical to SEQ ID NO: 183338

SEQ ID NO: 638976 - RNA, 64 nt, Homo Sapiens; identical to SEQ ID NO: 183339

SEQ ID NO: 638977 - RNA, 64 nt, Homo Sapiens; identical to SEQ ID NO: 183340

SEQ ID NO: 638978 - RNA, 64 nt, Homo Sapiens; identical to SEQ ID NO: 183341

SEQ ID NO: 638979 - RNA, 64 nt, Homo Sapiens; identical to SEQ ID NO: 183342

SEQ ID NO: 638980 - RNA, 64 nt, Homo Sapiens; identical to SEQ ID NO: 183343

SEQ ID NO: 638981 - RNA, 64 nt, Homo Sapiens; identical to SEQ ID NO: 183344

SEQ ID NO: 638982 - RNA, 64 nt, Homo Sapiens; identical to SEQ ID NO: 183345

SEQ ID NO: 638983 - RNA, 64 nt, Homo Sapiens; identical to SEQ ID NO: 183346

SEQ ID NO: 638984 - RNA, 64 nt, Homo Sapiens; identical to SEQ ID NO: 183347

SEQ ID NO: 638985 - RNA, 64 nt, Homo Sapiens; identical to SEQ ID NO: 183348

SEQ ID NO: 638986 - RNA, 64 nt, Homo Sapiens; identical to SEQ ID NO: 183349

SEQ ID NO: 638987 - RNA, 64 nt, Homo Sapiens; identical to SEQ ID NO: 183350

SEQ ID NO: 638988 - RNA, 64 nt, Homo Sapiens; identical to SEQ ID NO: 183351

SEQ ID NO: 638989 - RNA, 64 nt, Homo Sapiens; identical to SEQ ID NO: 183352

SEQ ID NO: 638990 - RNA, 64 nt, Homo Sapiens; identical to SEQ ID NO: 183353

SEQ ID NO: 638991 - RNA, 64 nt, Homo Sapiens; identical to SEQ ID NO: 183354

SEQ ID NO: 638992 - RNA, 64 nt, Homo Sapiens; identical to SEQ ID NO: 183355

SEQ ID NO: 638993 - RNA, 64 nt, Homo Sapiens; identical to SEQ ID NO: 183356

SEQ ID NO: 638994 - RNA, 64 nt, Homo Sapiens; identical to SEQ ID NO: 183357

SEQ ID NO: 638995 - RNA, 64 nt, Homo Sapiens; identical to SEQ ID NO: 183358

SEQ ID NO: 638996 - RNA, 64 nt, Homo Sapiens; identical to SEQ ID NO: 183359

SEQ ID NO: 638997 - RNA, 64 nt, Homo Sapiens; identical to SEQ ID NO: 183360

SEQ ID NO: 638998 - RNA, 64 nt, Homo Sapiens; identical to SEQ ID NO: 183361

SEQ ID NO: 638999 - RNA, 64 nt, Homo Sapiens; identical to SEQ ID NO: 183362

SEQ ID NO: 639000 - RNA, 64 nt, Homo Sapiens; identical to SEQ ID NO: 183363

SEQ ID NO: 639001 - RNA, 64 nt, Homo Sapiens; identical to SEQ ID NO: 183364

SEQ ID NO: 639002 - RNA, 64 nt, Homo Sapiens; identical to SEQ ID NO: 183365

SEQ ID NO: 639003 - RNA, 64 nt, Homo Sapiens; identical to SEQ ID NO: 183366

SEQ ID NO: 639004 - RNA, 64 nt, Homo Sapiens; identical to SEQ ID NO: 183367

SEQ ID NO: 639005 - RNA, 64 nt, Homo Sapiens; identical to SEQ ID NO: 183368

SEQ ID NO: 639006 - RNA, 63 nt, Homo Sapiens; identical to SEQ ID NO: 183369

SEQ ID NO: 639007 - RNA, 64 nt, Homo Sapiens; identical to SEQ ID NO: 183370

SEQ ID NO: 639008 - RNA, 64 nt, Homo Sapiens; identical to SEQ ID NO: 183371

SEQ ID NO: 639009 - RNA, 64 nt, Homo Sapiens; identical to SEQ ID NO: 183372

SEQ ID NO: 639010 - RNA, 64 nt, Homo Sapiens; identical to SEQ ID NO: 183373

SEQ ID NO: 639011 - RNA, 64 nt, Homo Sapiens; identical to SEQ ID NO: 183374

SEQ ID NO: 639012 - RNA, 64 nt, Homo Sapiens; identical to SEQ ID NO: 183375

SEQ ID NO: 639013 - RNA, 64 nt, Homo Sapiens; identical to SEQ ID NO: 183376

SEQ ID NO: 639014 - RNA, 64 nt, Homo Sapiens; identical to SEQ ID NO: 183377

SEQ ID NO: 639015 - RNA, 64 nt, Homo Sapiens; identical to SEQ ID NO: 183378

SEQ ID NO: 639016 - RNA, 64 nt, Homo Sapiens; identical to SEQ ID NO: 183379

SEQ ID NO: 639017 - RNA, 64 nt, Homo Sapiens; identical to SEQ ID NO: 183380

SEQ ID NO: 639018 - RNA, 64 nt, Homo Sapiens; identical to SEQ ID NO: 183381

SEQ ID NO: 639019 - RNA, 64 nt, Homo Sapiens; identical to SEQ ID NO: 183382

SEQ ID NO: 639020 - RNA, 64 nt, Homo Sapiens; identical to SEQ ID NO: 183383

SEQ ID NO: 639021 - RNA, 64 nt, Homo Sapiens; identical to SEQ ID NO: 183384

SEQ ID NO: 639022 - RNA, 64 nt, Homo Sapiens; identical to SEQ ID NO: 183385

SEQ ID NO: 639023 - RNA, 64 nt, Homo Sapiens; identical to SEQ ID NO: 183386

SEQ ID NO: 639024 - RNA, 64 nt, Homo Sapiens; identical to SEQ ID NO: 183387

SEQ ID NO: 639025 - RNA, 64 nt, Homo Sapiens; identical to SEQ ID NO: 183388

SEQ ID NO: 639026 - RNA, 64 nt, Homo Sapiens; identical to SEQ ID NO: 183389

SEQ ID NO: 639027 - RNA, 64 nt, Homo Sapiens; identical to SEQ ID NO: 183390

SEQ ID NO: 639028 - RNA, 64 nt, Homo Sapiens; identical to SEQ ID NO: 183391

SEQ ID NO: 639029 - RNA, 64 nt, Homo Sapiens; identical to SEQ ID NO: 183392

SEQ ID NO: 639030 - RNA, 64 nt, Homo Sapiens; identical to SEQ ID NO: 183393

SEQ ID NO: 639031 - RNA, 64 nt, Homo Sapiens; identical to SEQ ID NO: 183394

SEQ ID NO: 639032 - RNA, 64 nt, Homo Sapiens; identical to SEQ ID NO: 183395

SEQ ID NO: 639033 - RNA, 64 nt, Homo Sapiens; identical to SEQ ID NO: 183396

SEQ ID NO: 639034 - RNA, 64 nt, Homo Sapiens; identical to SEQ ID NO: 183397

SEQ ID NO: 639035 - RNA, 64 nt, Homo Sapiens; identical to SEQ ID NO: 183398

SEQ ID NO: 639036 - RNA, 64 nt, Homo Sapiens; identical to SEQ ID NO: 183399

SEQ ID NO: 639037 - RNA, 64 nt, Homo Sapiens; identical to SEQ ID NO: 183400

SEQ ID NO: 639038 - RNA, 64 nt, Homo Sapiens; identical to SEQ ID NO: 183401

SEQ ID NO: 639039 - RNA, 64 nt, Homo Sapiens; identical to SEQ ID NO: 183402

SEQ ID NO: 639040 - RNA, 64 nt, Homo Sapiens; identical to SEQ ID NO: 183403

SEQ ID NO: 639041 - RNA, 64 nt, Homo Sapiens; identical to SEQ ID NO: 183404

SEQ ID NO: 639042 - RNA, 64 nt, Homo Sapiens; identical to SEQ ID NO: 183405

SEQ ID NO: 639043 - RNA, 64 nt, Homo Sapiens; identical to SEQ ID NO: 183406

SEQ ID NO: 639044 - RNA, 64 nt, Homo Sapiens; identical to SEQ ID NO: 183407

SEQ ID NO: 639045 - RNA, 64 nt, Homo Sapiens; identical to SEQ ID NO: 183408

SEQ ID NO: 639046 - RNA, 64 nt, Homo Sapiens; identical to SEQ ID NO: 183409

SEQ ID NO: 639047 - RNA, 64 nt, Homo Sapiens; identical to SEQ ID NO: 183410

SEQ ID NO: 639048 - RNA, 64 nt, Homo Sapiens; identical to SEQ ID NO: 183411

SEQ ID NO: 639049 - RNA, 64 nt, Homo Sapiens; identical to SEQ ID NO: 183412

SEQ ID NO: 639050 - RNA, 64 nt, Homo Sapiens; identical to SEQ ID NO: 183413

SEQ ID NO: 639051 - RNA, 64 nt, Homo Sapiens; identical to SEQ ID NO: 183414

SEQ ID NO: 639052 - RNA, 64 nt, Homo Sapiens; identical to SEQ ID NO: 183415

SEQ ID NO: 639053 - RNA, 64 nt, Homo Sapiens; identical to SEQ ID NO: 183416

SEQ ID NO: 639054 - RNA, 64 nt, Homo Sapiens; identical to SEQ ID NO: 183417

SEQ ID NO: 639055 - RNA, 64 nt, Homo Sapiens; identical to SEQ ID NO: 183418

SEQ ID NO: 639056 - RNA, 64 nt, Homo Sapiens; identical to SEQ ID NO: 183419

SEQ ID NO: 639057 - RNA, 64 nt, Homo Sapiens; identical to SEQ ID NO: 183420

SEQ ID NO: 639058 - RNA, 64 nt, Homo Sapiens; identical to SEQ ID NO: 183421

SEQ ID NO: 639059 - RNA, 64 nt, Homo Sapiens; identical to SEQ ID NO: 183422

SEQ ID NO: 639060 - RNA, 64 nt, Homo Sapiens; identical to SEQ ID NO: 183423

SEQ ID NO: 639061 - RNA, 64 nt, Homo Sapiens; identical to SEQ ID NO: 183424

SEQ ID NO: 639062 - RNA, 64 nt, Homo Sapiens; identical to SEQ ID NO: 183425

SEQ ID NO: 639063 - RNA, 64 nt, Homo Sapiens; identical to SEQ ID NO: 183426

SEQ ID NO: 639064 - RNA, 64 nt, Homo Sapiens; identical to SEQ ID NO: 183427

SEQ ID NO: 639065 - RNA, 64 nt, Homo Sapiens; identical to SEQ ID NO: 183428

SEQ ID NO: 639066 - RNA, 64 nt, Homo Sapiens; identical to SEQ ID NO: 183429

SEQ ID NO: 639067 - RNA, 64 nt, Homo Sapiens; identical to SEQ ID NO: 183430

SEQ ID NO: 639068 - RNA, 64 nt, Homo Sapiens; identical to SEQ ID NO: 183431

SEQ ID NO: 639069 - RNA, 64 nt, Homo Sapiens; identical to SEQ ID NO: 183432

SEQ ID NO: 639070 - RNA, 64 nt, Homo Sapiens; identical to SEQ ID NO: 183433

SEQ ID NO: 639071 - RNA, 64 nt, Homo Sapiens; identical to SEQ ID NO: 183434

SEQ ID NO: 639072 - RNA, 64 nt, Homo Sapiens; identical to SEQ ID NO: 183435

SEQ ID NO: 639073 - RNA, 64 nt, Homo Sapiens; identical to SEQ ID NO: 183436

SEQ ID NO: 639074 - RNA, 64 nt, Homo Sapiens; identical to SEQ ID NO: 183437

SEQ ID NO: 639075 - RNA, 64 nt, Homo Sapiens; identical to SEQ ID NO: 183438

SEQ ID NO: 639076 - RNA, 64 nt, Homo Sapiens; identical to SEQ ID NO: 183439

SEQ ID NO: 639077 - RNA, 64 nt, Homo Sapiens; identical to SEQ ID NO: 183440

SEQ ID NO: 639078 - RNA, 64 nt, Homo Sapiens; identical to SEQ ID NO: 183441

SEQ ID NO: 639079 - RNA, 64 nt, Homo Sapiens; identical to SEQ ID NO: 183442

SEQ ID NO: 639080 - RNA, 64 nt, Homo Sapiens; identical to SEQ ID NO: 183443

SEQ ID NO: 639081 - RNA, 64 nt, Homo Sapiens; identical to SEQ ID NO: 183444

SEQ ID NO: 639082 - RNA, 64 nt, Homo Sapiens; identical to SEQ ID NO: 183445

SEQ ID NO: 639083 - RNA, 64 nt, Homo Sapiens; identical to SEQ ID NO: 183446

SEQ ID NO: 639084 - RNA, 64 nt, Homo Sapiens; identical to SEQ ID NO: 183447

SEQ ID NO: 639085 - RNA, 64 nt, Homo Sapiens; identical to SEQ ID NO: 183448

SEQ ID NO: 639086 - RNA, 64 nt, Homo Sapiens; identical to SEQ ID NO: 183449

SEQ ID NO: 639087 - RNA, 64 nt, Homo Sapiens; identical to SEQ ID NO: 183450

SEQ ID NO: 639088 - RNA, 64 nt, Homo Sapiens; identical to SEQ ID NO: 183451

SEQ ID NO: 639089 - RNA, 64 nt, Homo Sapiens; identical to SEQ ID NO: 183452

SEQ ID NO: 639090 - RNA, 64 nt, Homo Sapiens; identical to SEQ ID NO: 183453

SEQ ID NO: 639091 - RNA, 64 nt, Homo Sapiens; identical to SEQ ID NO: 183454

SEQ ID NO: 639092 - RNA, 64 nt, Homo Sapiens; identical to SEQ ID NO: 183455

SEQ ID NO: 639093 - RNA, 64 nt, Homo Sapiens; identical to SEQ ID NO: 183456

SEQ ID NO: 639094 - RNA, 64 nt, Homo Sapiens; identical to SEQ ID NO: 183457

SEQ ID NO: 639095 - RNA, 64 nt, Homo Sapiens; identical to SEQ ID NO: 183458

SEQ ID NO: 639096 - RNA, 64 nt, Homo Sapiens; identical to SEQ ID NO: 183459

SEQ ID NO: 639097 - RNA, 64 nt, Homo Sapiens; identical to SEQ ID NO: 183460

SEQ ID NO: 639098 - RNA, 64 nt, Homo Sapiens; identical to SEQ ID NO: 183461

SEQ ID NO: 639099 - RNA, 64 nt, Homo Sapiens; identical to SEQ ID NO: 183462

SEQ ID NO: 639100 - RNA, 64 nt, Homo Sapiens; identical to SEQ ID NO: 183463

SEQ ID NO: 639101 - RNA, 64 nt, Homo Sapiens; identical to SEQ ID NO: 183464

SEQ ID NO: 639102 - RNA, 64 nt, Homo Sapiens; identical to SEQ ID NO: 183465

SEQ ID NO: 639103 - RNA, 64 nt, Homo Sapiens; identical to SEQ ID NO: 183466

SEQ ID NO: 639104 - RNA, 64 nt, Homo Sapiens; identical to SEQ ID NO: 183467

SEQ ID NO: 639105 - RNA, 64 nt, Homo Sapiens; identical to SEQ ID NO: 183468

SEQ ID NO: 639106 - RNA, 64 nt, Homo Sapiens; identical to SEQ ID NO: 183469

SEQ ID NO: 639107 - RNA, 64 nt, Homo Sapiens; identical to SEQ ID NO: 183470

SEQ ID NO: 639108 - RNA, 64 nt, Homo Sapiens; identical to SEQ ID NO: 183471

SEQ ID NO: 639109 - RNA, 64 nt, Homo Sapiens; identical to SEQ ID NO: 183472

SEQ ID NO: 639110 - RNA, 64 nt, Homo Sapiens; identical to SEQ ID NO: 183473

SEQ ID NO: 639111 - RNA, 64 nt, Homo Sapiens; identical to SEQ ID NO: 183474

SEQ ID NO: 639112 - RNA, 64 nt, Homo Sapiens; identical to SEQ ID NO: 183475

SEQ ID NO: 639113 - RNA, 64 nt, Homo Sapiens; identical to SEQ ID NO: 183476

SEQ ID NO: 639114 - RNA, 64 nt, Homo Sapiens; identical to SEQ ID NO: 183477

SEQ ID NO: 639115 - RNA, 64 nt, Homo Sapiens; identical to SEQ ID NO: 183478

SEQ ID NO: 639116 - RNA, 64 nt, Homo Sapiens; identical to SEQ ID NO: 183479

SEQ ID NO: 639117 - RNA, 64 nt, Homo Sapiens; identical to SEQ ID NO: 183480

SEQ ID NO: 639118 - RNA, 64 nt, Homo Sapiens; identical to SEQ ID NO: 183481

SEQ ID NO: 639119 - RNA, 64 nt, Homo Sapiens; identical to SEQ ID NO: 183482

SEQ ID NO: 639120 - RNA, 64 nt, Homo Sapiens; identical to SEQ ID NO: 183483

SEQ ID NO: 639121 - RNA, 64 nt, Homo Sapiens; identical to SEQ ID NO: 183484

SEQ ID NO: 639122 - RNA, 64 nt, Homo Sapiens; identical to SEQ ID NO: 183485

SEQ ID NO: 639123 - RNA, 64 nt, Homo Sapiens; identical to SEQ ID NO: 183486

SEQ ID NO: 639124 - RNA, 64 nt, Homo Sapiens; identical to SEQ ID NO: 183487

SEQ ID NO: 639125 - RNA, 64 nt, Homo Sapiens; identical to SEQ ID NO: 183488

SEQ ID NO: 639126 - RNA, 64 nt, Homo Sapiens; identical to SEQ ID NO: 183489

SEQ ID NO: 639127 - RNA, 64 nt, Homo Sapiens; identical to SEQ ID NO: 183490

SEQ ID NO: 639128 - RNA, 64 nt, Homo Sapiens; identical to SEQ ID NO: 183491

SEQ ID NO: 639129 - RNA, 64 nt, Homo Sapiens; identical to SEQ ID NO: 183492

SEQ ID NO: 639130 - RNA, 64 nt, Homo Sapiens; identical to SEQ ID NO: 183493

SEQ ID NO: 639131 - RNA, 64 nt, Homo Sapiens; identical to SEQ ID NO: 183494

SEQ ID NO: 639132 - RNA, 64 nt, Homo Sapiens; identical to SEQ ID NO: 183495

SEQ ID NO: 639133 - RNA, 64 nt, Homo Sapiens; identical to SEQ ID NO: 183496

SEQ ID NO: 639134 - RNA, 64 nt, Homo Sapiens; identical to SEQ ID NO: 183497

SEQ ID NO: 639135 - RNA, 64 nt, Homo Sapiens; identical to SEQ ID NO: 183498

SEQ ID NO: 639136 - RNA, 64 nt, Homo Sapiens; identical to SEQ ID NO: 183499

SEQ ID NO: 639137 - RNA, 64 nt, Homo Sapiens; identical to SEQ ID NO: 183500

SEQ ID NO: 639138 - RNA, 64 nt, Homo Sapiens; identical to SEQ ID NO: 183501

SEQ ID NO: 639139 - RNA, 64 nt, Homo Sapiens; identical to SEQ ID NO: 183502

SEQ ID NO: 639140 - RNA, 64 nt, Homo Sapiens; identical to SEQ ID NO: 183503

SEQ ID NO: 639141 - RNA, 64 nt, Homo Sapiens; identical to SEQ ID NO: 183504

SEQ ID NO: 639142 - RNA, 64 nt, Homo Sapiens; identical to SEQ ID NO: 183505

SEQ ID NO: 639143 - RNA, 64 nt, Homo Sapiens; identical to SEQ ID NO: 183506

SEQ ID NO: 639144 - RNA, 64 nt, Homo Sapiens; identical to SEQ ID NO: 183507

SEQ ID NO: 639145 - RNA, 64 nt, Homo Sapiens; identical to SEQ ID NO: 183508

SEQ ID NO: 639146 - RNA, 64 nt, Homo Sapiens; identical to SEQ ID NO: 183509

SEQ ID NO: 639147 - RNA, 64 nt, Homo Sapiens; identical to SEQ ID NO: 183510

SEQ ID NO: 639148 - RNA, 64 nt, Homo Sapiens; identical to SEQ ID NO: 183511

SEQ ID NO: 639149 - RNA, 64 nt, Homo Sapiens; identical to SEQ ID NO: 183512

SEQ ID NO: 639150 - RNA, 64 nt, Homo Sapiens; identical to SEQ ID NO: 183513

SEQ ID NO: 639151 - RNA, 64 nt, Homo Sapiens; identical to SEQ ID NO: 183514

SEQ ID NO: 639152 - RNA, 64 nt, Homo Sapiens; identical to SEQ ID NO: 183515

SEQ ID NO: 639153 - RNA, 64 nt, Homo Sapiens; identical to SEQ ID NO: 183516

SEQ ID NO: 639154 - RNA, 64 nt, Homo Sapiens; identical to SEQ ID NO: 183517

SEQ ID NO: 639155 - RNA, 64 nt, Homo Sapiens; identical to SEQ ID NO: 183518

SEQ ID NO: 639156 - RNA, 64 nt, Homo Sapiens; identical to SEQ ID NO: 183519

SEQ ID NO: 639157 - RNA, 64 nt, Homo Sapiens; identical to SEQ ID NO: 183520

SEQ ID NO: 639158 - RNA, 64 nt, Homo Sapiens; identical to SEQ ID NO: 183521

SEQ ID NO: 639159 - RNA, 64 nt, Homo Sapiens; identical to SEQ ID NO: 183522

SEQ ID NO: 639160 - RNA, 64 nt, Homo Sapiens; identical to SEQ ID NO: 183523

SEQ ID NO: 639161 - RNA, 64 nt, Homo Sapiens; identical to SEQ ID NO: 183524

SEQ ID NO: 639162 - RNA, 64 nt, Homo Sapiens; identical to SEQ ID NO: 183525

SEQ ID NO: 639163 - RNA, 64 nt, Homo Sapiens; identical to SEQ ID NO: 183526

SEQ ID NO: 639164 - RNA, 64 nt, Homo Sapiens; identical to SEQ ID NO: 183527

SEQ ID NO: 639165 - RNA, 64 nt, Homo Sapiens; identical to SEQ ID NO: 183528

SEQ ID NO: 639166 - RNA, 64 nt, Homo Sapiens; identical to SEQ ID NO: 183529

SEQ ID NO: 639167 - RNA, 64 nt, Homo Sapiens; identical to SEQ ID NO: 183530

SEQ ID NO: 639168 - RNA, 64 nt, Homo Sapiens; identical to SEQ ID NO: 183531

SEQ ID NO: 639169 - RNA, 64 nt, Homo Sapiens; identical to SEQ ID NO: 183532

SEQ ID NO: 639170 - RNA, 64 nt, Homo Sapiens; identical to SEQ ID NO: 183533

SEQ ID NO: 639171 - RNA, 64 nt, Homo Sapiens; identical to SEQ ID NO: 183534

SEQ ID NO: 639172 - RNA, 64 nt, Homo Sapiens; identical to SEQ ID NO: 183535

SEQ ID NO: 639173 - RNA, 64 nt, Homo Sapiens; identical to SEQ ID NO: 183536

SEQ ID NO: 639174 - RNA, 64 nt, Homo Sapiens; identical to SEQ ID NO: 183537

SEQ ID NO: 639175 - RNA, 64 nt, Homo Sapiens; identical to SEQ ID NO: 183538

SEQ ID NO: 639176 - RNA, 64 nt, Homo Sapiens; identical to SEQ ID NO: 183539

SEQ ID NO: 639177 - RNA, 64 nt, Homo Sapiens; identical to SEQ ID NO: 183540

SEQ ID NO: 639178 - RNA, 64 nt, Homo Sapiens; identical to SEQ ID NO: 183541

SEQ ID NO: 639179 - RNA, 64 nt, Homo Sapiens; identical to SEQ ID NO: 183542

SEQ ID NO: 639180 - RNA, 64 nt, Homo Sapiens; identical to SEQ ID NO: 183543

SEQ ID NO: 639181 - RNA, 64 nt, Homo Sapiens; identical to SEQ ID NO: 183544

SEQ ID NO: 639182 - RNA, 64 nt, Homo Sapiens; identical to SEQ ID NO: 183545

SEQ ID NO: 639183 - RNA, 64 nt, Homo Sapiens; identical to SEQ ID NO: 183546

SEQ ID NO: 639184 - RNA, 64 nt, Homo Sapiens; identical to SEQ ID NO: 183547

SEQ ID NO: 639185 - RNA, 64 nt, Homo Sapiens; identical to SEQ ID NO: 183548

SEQ ID NO: 639186 - RNA, 64 nt, Homo Sapiens; identical to SEQ ID NO: 183549

SEQ ID NO: 639187 - RNA, 64 nt, Homo Sapiens; identical to SEQ ID NO: 183550

SEQ ID NO: 639188 - RNA, 64 nt, Homo Sapiens; identical to SEQ ID NO: 183551

SEQ ID NO: 639189 - RNA, 64 nt, Homo Sapiens; identical to SEQ ID NO: 183552

SEQ ID NO: 639190 - RNA, 64 nt, Homo Sapiens; identical to SEQ ID NO: 183553

SEQ ID NO: 639191 - RNA, 64 nt, Homo Sapiens; identical to SEQ ID NO: 183554

SEQ ID NO: 639192 - RNA, 64 nt, Homo Sapiens; identical to SEQ ID NO: 183555

SEQ ID NO: 639193 - RNA, 64 nt, Homo Sapiens; identical to SEQ ID NO: 183556

SEQ ID NO: 639194 - RNA, 64 nt, Homo Sapiens; identical to SEQ ID NO: 183557

SEQ ID NO: 639195 - RNA, 64 nt, Homo Sapiens; identical to SEQ ID NO: 183558

SEQ ID NO: 639196 - RNA, 64 nt, Homo Sapiens; identical to SEQ ID NO: 183559

SEQ ID NO: 639197 - RNA, 64 nt, Homo Sapiens; identical to SEQ ID NO: 183560

SEQ ID NO: 639198 - RNA, 64 nt, Homo Sapiens; identical to SEQ ID NO: 183561

SEQ ID NO: 639199 - RNA, 64 nt, Homo Sapiens; identical to SEQ ID NO: 183562

SEQ ID NO: 639200 - RNA, 64 nt, Homo Sapiens; identical to SEQ ID NO: 183563

SEQ ID NO: 639201 - RNA, 64 nt, Homo Sapiens; identical to SEQ ID NO: 183564

SEQ ID NO: 639202 - RNA, 64 nt, Homo Sapiens; identical to SEQ ID NO: 183565

SEQ ID NO: 639203 - RNA, 64 nt, Homo Sapiens; identical to SEQ ID NO: 183566

SEQ ID NO: 639204 - RNA, 64 nt, Homo Sapiens; identical to SEQ ID NO: 183567

SEQ ID NO: 639205 - RNA, 64 nt, Homo Sapiens; identical to SEQ ID NO: 183568

SEQ ID NO: 639206 - RNA, 64 nt, Homo Sapiens; identical to SEQ ID NO: 183569

SEQ ID NO: 639207 - RNA, 64 nt, Homo Sapiens; identical to SEQ ID NO: 183570

SEQ ID NO: 639208 - RNA, 64 nt, Homo Sapiens; identical to SEQ ID NO: 183571

SEQ ID NO: 639209 - RNA, 64 nt, Homo Sapiens; identical to SEQ ID NO: 183572

SEQ ID NO: 639210 - RNA, 64 nt, Homo Sapiens; identical to SEQ ID NO: 183573

SEQ ID NO: 639211 - RNA, 64 nt, Homo Sapiens; identical to SEQ ID NO: 183574

SEQ ID NO: 639212 - RNA, 64 nt, Homo Sapiens; identical to SEQ ID NO: 183575

SEQ ID NO: 639213 - RNA, 64 nt, Homo Sapiens; identical to SEQ ID NO: 183576

SEQ ID NO: 639214 - RNA, 64 nt, Homo Sapiens; identical to SEQ ID NO: 183577

SEQ ID NO: 639215 - RNA, 64 nt, Homo Sapiens; identical to SEQ ID NO: 183578

SEQ ID NO: 639216 - RNA, 64 nt, Homo Sapiens; identical to SEQ ID NO: 183579

SEQ ID NO: 639217 - RNA, 64 nt, Homo Sapiens; identical to SEQ ID NO: 183580

SEQ ID NO: 639218 - RNA, 64 nt, Homo Sapiens; identical to SEQ ID NO: 183581

SEQ ID NO: 639219 - RNA, 64 nt, Homo Sapiens; identical to SEQ ID NO: 183582

SEQ ID NO: 639220 - RNA, 64 nt, Homo Sapiens; identical to SEQ ID NO: 183583

SEQ ID NO: 639221 - RNA, 64 nt, Homo Sapiens; identical to SEQ ID NO: 183584

SEQ ID NO: 639222 - RNA, 64 nt, Homo Sapiens; identical to SEQ ID NO: 183585

SEQ ID NO: 639223 - RNA, 64 nt, Homo Sapiens; identical to SEQ ID NO: 183586

SEQ ID NO: 639224 - RNA, 64 nt, Homo Sapiens; identical to SEQ ID NO: 183587

SEQ ID NO: 639225 - RNA, 64 nt, Homo Sapiens; identical to SEQ ID NO: 183588

SEQ ID NO: 639226 - RNA, 64 nt, Homo Sapiens; identical to SEQ ID NO: 183589

SEQ ID NO: 639227 - RNA, 64 nt, Homo Sapiens; identical to SEQ ID NO: 183590

SEQ ID NO: 639228 - RNA, 64 nt, Homo Sapiens; identical to SEQ ID NO: 183591

SEQ ID NO: 639229 - RNA, 64 nt, Homo Sapiens; identical to SEQ ID NO: 183592

SEQ ID NO: 639230 - RNA, 64 nt, Homo Sapiens; identical to SEQ ID NO: 183593

SEQ ID NO: 639231 - RNA, 64 nt, Homo Sapiens; identical to SEQ ID NO: 183594

SEQ ID NO: 639232 - RNA, 64 nt, Homo Sapiens; identical to SEQ ID NO: 183595

SEQ ID NO: 639233 - RNA, 64 nt, Homo Sapiens; identical to SEQ ID NO: 183596

SEQ ID NO: 639234 - RNA, 64 nt, Homo Sapiens; identical to SEQ ID NO: 183597

SEQ ID NO: 639235 - RNA, 64 nt, Homo Sapiens; identical to SEQ ID NO: 183598

SEQ ID NO: 639236 - RNA, 64 nt, Homo Sapiens; identical to SEQ ID NO: 183599

SEQ ID NO: 639237 - RNA, 64 nt, Homo Sapiens; identical to SEQ ID NO: 183600

SEQ ID NO: 639238 - RNA, 64 nt, Homo Sapiens; identical to SEQ ID NO: 183601

SEQ ID NO: 639239 - RNA, 64 nt, Homo Sapiens; identical to SEQ ID NO: 183602

SEQ ID NO: 639240 - RNA, 64 nt, Homo Sapiens; identical to SEQ ID NO: 183603

SEQ ID NO: 639241 - RNA, 64 nt, Homo Sapiens; identical to SEQ ID NO: 541607

SEQ ID NO: 639242 - RNA, 64 nt, Homo Sapiens; identical to SEQ ID NO: 541608

SEQ ID NO: 639243 - RNA, 64 nt, Homo Sapiens; identical to SEQ ID NO: 541609

SEQ ID NO: 639244 - RNA, 64 nt, Homo Sapiens; identical to SEQ ID NO: 541610

SEQ ID NO: 639245 - RNA, 64 nt, Homo Sapiens; identical to SEQ ID NO: 182986

SEQ ID NO: 639246 - RNA, 64 nt, Homo Sapiens; identical to SEQ ID NO: 182987

SEQ ID NO: 639247 - RNA, 64 nt, Homo Sapiens; identical to SEQ ID NO: 182988

SEQ ID NO: 639248 - RNA, 64 nt, Homo Sapiens; identical to SEQ ID NO: 182989

SEQ ID NO: 639249 - RNA, 64 nt, Homo Sapiens; identical to SEQ ID NO: 182990

SEQ ID NO: 639250 - RNA, 64 nt, Homo Sapiens; identical to SEQ ID NO: 182991

SEQ ID NO: 639251 - RNA, 64 nt, Homo Sapiens; identical to SEQ ID NO: 182992

SEQ ID NO: 639252 - RNA, 64 nt, Homo Sapiens; identical to SEQ ID NO: 182993

SEQ ID NO: 639253 - RNA, 64 nt, Homo Sapiens; identical to SEQ ID NO: 182994

SEQ ID NO: 639254 - RNA, 64 nt, Homo Sapiens; identical to SEQ ID NO: 182995

SEQ ID NO: 639255 - RNA, 64 nt, Homo Sapiens; identical to SEQ ID NO: 182996

SEQ ID NO: 639256 - RNA, 64 nt, Homo Sapiens; identical to SEQ ID NO: 182997

SEQ ID NO: 639257 - RNA, 64 nt, Homo Sapiens; identical to SEQ ID NO: 182998

SEQ ID NO: 639258 - RNA, 64 nt, Homo Sapiens; identical to SEQ ID NO: 182999

SEQ ID NO: 639259 - RNA, 64 nt, Homo Sapiens; identical to SEQ ID NO: 183000

SEQ ID NO: 639260 - RNA, 64 nt, Homo Sapiens; identical to SEQ ID NO: 183001

SEQ ID NO: 639261 - RNA, 64 nt, Homo Sapiens; identical to SEQ ID NO: 183002

SEQ ID NO: 639262 - RNA, 64 nt, Homo Sapiens; identical to SEQ ID NO: 183003

SEQ ID NO: 639263 - RNA, 64 nt, Homo Sapiens; identical to SEQ ID NO: 183004

SEQ ID NO: 639264 - RNA, 64 nt, Homo Sapiens; identical to SEQ ID NO: 183005

SEQ ID NO: 639265 - RNA, 64 nt, Homo Sapiens; identical to SEQ ID NO: 183006

SEQ ID NO: 639266 - RNA, 64 nt, Homo Sapiens; identical to SEQ ID NO: 183007

SEQ ID NO: 639267 - RNA, 64 nt, Homo Sapiens; identical to SEQ ID NO: 183008

SEQ ID NO: 639268 - RNA, 64 nt, Homo Sapiens; identical to SEQ ID NO: 183009

SEQ ID NO: 639269 - RNA, 64 nt, Homo Sapiens; identical to SEQ ID NO: 183010

SEQ ID NO: 639270 - RNA, 64 nt, Homo Sapiens; identical to SEQ ID NO: 183011

SEQ ID NO: 639271 - RNA, 64 nt, Homo Sapiens; identical to SEQ ID NO: 183012

SEQ ID NO: 639272 - RNA, 64 nt, Homo Sapiens; identical to SEQ ID NO: 183013

SEQ ID NO: 639273 - RNA, 64 nt, Homo Sapiens; identical to SEQ ID NO: 183014

SEQ ID NO: 639274 - RNA, 64 nt, Homo Sapiens; identical to SEQ ID NO: 183015

SEQ ID NO: 639275 - RNA, 64 nt, Homo Sapiens; identical to SEQ ID NO: 183016

SEQ ID NO: 639276 - RNA, 64 nt, Homo Sapiens; identical to SEQ ID NO: 183017

SEQ ID NO: 639277 - RNA, 64 nt, Homo Sapiens; identical to SEQ ID NO: 183018

SEQ ID NO: 639278 - RNA, 64 nt, Homo Sapiens; identical to SEQ ID NO: 183019

SEQ ID NO: 639279 - RNA, 64 nt, Homo Sapiens; identical to SEQ ID NO: 183020

SEQ ID NO: 639280 - RNA, 64 nt, Homo Sapiens; identical to SEQ ID NO: 183021

SEQ ID NO: 639281 - RNA, 64 nt, Homo Sapiens; identical to SEQ ID NO: 183022

SEQ ID NO: 639282 - RNA, 64 nt, Homo Sapiens; identical to SEQ ID NO: 183023

SEQ ID NO: 639283 - RNA, 64 nt, Homo Sapiens; identical to SEQ ID NO: 183024

SEQ ID NO: 639284 - RNA, 64 nt, Homo Sapiens; identical to SEQ ID NO: 183025

SEQ ID NO: 639285 - RNA, 64 nt, Homo Sapiens; identical to SEQ ID NO: 183026

SEQ ID NO: 639286 - RNA, 64 nt, Homo Sapiens; identical to SEQ ID NO: 183027

SEQ ID NO: 639287 - RNA, 64 nt, Homo Sapiens; identical to SEQ ID NO: 183028

SEQ ID NO: 639288 - RNA, 64 nt, Homo Sapiens; identical to SEQ ID NO: 183029

SEQ ID NO: 639289 - RNA, 64 nt, Homo Sapiens; identical to SEQ ID NO: 183030

SEQ ID NO: 639290 - RNA, 64 nt, Homo Sapiens; identical to SEQ ID NO: 183031

SEQ ID NO: 639291 - RNA, 64 nt, Homo Sapiens; identical to SEQ ID NO: 183032

SEQ ID NO: 639292 - RNA, 64 nt, Homo Sapiens; identical to SEQ ID NO: 183033

SEQ ID NO: 639293 - RNA, 64 nt, Homo Sapiens; identical to SEQ ID NO: 183034

SEQ ID NO: 639294 - RNA, 64 nt, Homo Sapiens; identical to SEQ ID NO: 183035

SEQ ID NO: 639295 - RNA, 64 nt, Homo Sapiens; identical to SEQ ID NO: 183036

SEQ ID NO: 639296 - RNA, 64 nt, Homo Sapiens; identical to SEQ ID NO: 183037

SEQ ID NO: 639297 - RNA, 64 nt, Homo Sapiens; identical to SEQ ID NO: 183038

SEQ ID NO: 639298 - RNA, 64 nt, Homo Sapiens; identical to SEQ ID NO: 183039

SEQ ID NO: 639299 - RNA, 64 nt, Homo Sapiens; identical to SEQ ID NO: 183040

SEQ ID NO: 639300 - RNA, 64 nt, Homo Sapiens; identical to SEQ ID NO: 183041

SEQ ID NO: 639301 - RNA, 64 nt, Homo Sapiens; identical to SEQ ID NO: 183042

SEQ ID NO: 639302 - RNA, 64 nt, Homo Sapiens; identical to SEQ ID NO: 183043

SEQ ID NO: 639303 - RNA, 64 nt, Homo Sapiens; identical to SEQ ID NO: 183044

SEQ ID NO: 639304 - RNA, 64 nt, Homo Sapiens; identical to SEQ ID NO: 183045

SEQ ID NO: 639305 - RNA, 64 nt, Homo Sapiens; identical to SEQ ID NO: 183046

SEQ ID NO: 639306 - RNA, 64 nt, Homo Sapiens; identical to SEQ ID NO: 183047

SEQ ID NO: 639307 - RNA, 64 nt, Homo Sapiens; identical to SEQ ID NO: 183048

SEQ ID NO: 639308 - RNA, 64 nt, Homo Sapiens; identical to SEQ ID NO: 183049

SEQ ID NO: 639309 - RNA, 64 nt, Homo Sapiens; identical to SEQ ID NO: 183050

SEQ ID NO: 639310 - RNA, 64 nt, Homo Sapiens; identical to SEQ ID NO: 183051

SEQ ID NO: 639311 - RNA, 64 nt, Homo Sapiens; identical to SEQ ID NO: 183052

SEQ ID NO: 639312 - RNA, 64 nt, Homo Sapiens; identical to SEQ ID NO: 183053

SEQ ID NO: 639313 - RNA, 64 nt, Homo Sapiens; identical to SEQ ID NO: 183054

SEQ ID NO: 639314 - RNA, 64 nt, Homo Sapiens; identical to SEQ ID NO: 183055

SEQ ID NO: 639315 - RNA, 64 nt, Homo Sapiens; identical to SEQ ID NO: 183056

SEQ ID NO: 639316 - RNA, 64 nt, Homo Sapiens; identical to SEQ ID NO: 183057

SEQ ID NO: 639317 - RNA, 64 nt, Homo Sapiens; identical to SEQ ID NO: 183058

SEQ ID NO: 639318 - RNA, 64 nt, Homo Sapiens; identical to SEQ ID NO: 183059

SEQ ID NO: 639319 - RNA, 64 nt, Homo Sapiens; identical to SEQ ID NO: 183060

SEQ ID NO: 639320 - RNA, 64 nt, Homo Sapiens; identical to SEQ ID NO: 183061

SEQ ID NO: 639321 - RNA, 64 nt, Homo Sapiens; identical to SEQ ID NO: 183062

SEQ ID NO: 639322 - RNA, 64 nt, Homo Sapiens; identical to SEQ ID NO: 183063

SEQ ID NO: 639323 - RNA, 64 nt, Homo Sapiens; identical to SEQ ID NO: 183064

SEQ ID NO: 639324 - RNA, 64 nt, Homo Sapiens; identical to SEQ ID NO: 183065

SEQ ID NO: 639325 - RNA, 64 nt, Homo Sapiens; identical to SEQ ID NO: 183066

SEQ ID NO: 639326 - RNA, 64 nt, Homo Sapiens; identical to SEQ ID NO: 183067

SEQ ID NO: 639327 - RNA, 64 nt, Homo Sapiens; identical to SEQ ID NO: 183068

SEQ ID NO: 639328 - RNA, 64 nt, Homo Sapiens; identical to SEQ ID NO: 183069

SEQ ID NO: 639329 - RNA, 64 nt, Homo Sapiens; identical to SEQ ID NO: 183070

SEQ ID NO: 639330 - RNA, 64 nt, Homo Sapiens; identical to SEQ ID NO: 183071

SEQ ID NO: 639331 - RNA, 64 nt, Homo Sapiens; identical to SEQ ID NO: 183072

SEQ ID NO: 639332 - RNA, 64 nt, Homo Sapiens; identical to SEQ ID NO: 183073

SEQ ID NO: 639333 - RNA, 64 nt, Homo Sapiens; identical to SEQ ID NO: 183074

SEQ ID NO: 639334 - RNA, 64 nt, Homo Sapiens; identical to SEQ ID NO: 183075

SEQ ID NO: 639335 - RNA, 64 nt, Homo Sapiens; identical to SEQ ID NO: 183076

SEQ ID NO: 639336 - RNA, 64 nt, Homo Sapiens; identical to SEQ ID NO: 183077

SEQ ID NO: 639337 - RNA, 64 nt, Homo Sapiens; identical to SEQ ID NO: 183078

SEQ ID NO: 639338 - RNA, 64 nt, Homo Sapiens; identical to SEQ ID NO: 183079

SEQ ID NO: 639339 - RNA, 64 nt, Homo Sapiens; identical to SEQ ID NO: 183080

SEQ ID NO: 639340 - RNA, 64 nt, Homo Sapiens; identical to SEQ ID NO: 183081

SEQ ID NO: 639341 - RNA, 64 nt, Homo Sapiens; identical to SEQ ID NO: 183082

SEQ ID NO: 639342 - RNA, 64 nt, Homo Sapiens; identical to SEQ ID NO: 183083

SEQ ID NO: 639343 - RNA, 64 nt, Homo Sapiens; identical to SEQ ID NO: 183084

SEQ ID NO: 639344 - RNA, 64 nt, Homo Sapiens; identical to SEQ ID NO: 183085

SEQ ID NO: 639345 - RNA, 64 nt, Homo Sapiens; identical to SEQ ID NO: 183086

SEQ ID NO: 639346 - RNA, 64 nt, Homo Sapiens; identical to SEQ ID NO: 183087

SEQ ID NO: 639347 - RNA, 64 nt, Homo Sapiens; identical to SEQ ID NO: 183088

SEQ ID NO: 639348 - RNA, 64 nt, Homo Sapiens; identical to SEQ ID NO: 183089

SEQ ID NO: 639349 - RNA, 64 nt, Homo Sapiens; identical to SEQ ID NO: 183090

SEQ ID NO: 639350 - RNA, 64 nt, Homo Sapiens; identical to SEQ ID NO: 183091

SEQ ID NO: 639351 - RNA, 64 nt, Homo Sapiens; identical to SEQ ID NO: 183092

SEQ ID NO: 639352 - RNA, 64 nt, Homo Sapiens; identical to SEQ ID NO: 183093

SEQ ID NO: 639353 - RNA, 64 nt, Homo Sapiens; identical to SEQ ID NO: 183094

SEQ ID NO: 639354 - RNA, 64 nt, Homo Sapiens; identical to SEQ ID NO: 183095

SEQ ID NO: 639355 - RNA, 64 nt, Homo Sapiens; identical to SEQ ID NO: 183096

SEQ ID NO: 639356 - RNA, 64 nt, Homo Sapiens; identical to SEQ ID NO: 183097

SEQ ID NO: 639357 - RNA, 64 nt, Homo Sapiens; identical to SEQ ID NO: 183098

SEQ ID NO: 639358 - RNA, 64 nt, Homo Sapiens; identical to SEQ ID NO: 183099

SEQ ID NO: 639359 - RNA, 64 nt, Homo Sapiens; identical to SEQ ID NO: 183100

SEQ ID NO: 639360 - RNA, 64 nt, Homo Sapiens; identical to SEQ ID NO: 183101

SEQ ID NO: 639361 - RNA, 64 nt, Homo Sapiens; identical to SEQ ID NO: 183102

SEQ ID NO: 639362 - RNA, 64 nt, Homo Sapiens; identical to SEQ ID NO: 183103

SEQ ID NO: 639363 - RNA, 64 nt, Homo Sapiens; identical to SEQ ID NO: 183104

SEQ ID NO: 639364 - RNA, 64 nt, Homo Sapiens; identical to SEQ ID NO: 183105

SEQ ID NO: 639365 - RNA, 64 nt, Homo Sapiens; identical to SEQ ID NO: 183106

SEQ ID NO: 639366 - RNA, 64 nt, Homo Sapiens; identical to SEQ ID NO: 183107

SEQ ID NO: 639367 - RNA, 64 nt, Homo Sapiens; identical to SEQ ID NO: 183108

SEQ ID NO: 639368 - RNA, 64 nt, Homo Sapiens; identical to SEQ ID NO: 183109

SEQ ID NO: 639369 - RNA, 64 nt, Homo Sapiens; identical to SEQ ID NO: 183110

SEQ ID NO: 639370 - RNA, 64 nt, Homo Sapiens; identical to SEQ ID NO: 183111

SEQ ID NO: 639371 - RNA, 64 nt, Homo Sapiens; identical to SEQ ID NO: 183112

SEQ ID NO: 639372 - RNA, 64 nt, Homo Sapiens; identical to SEQ ID NO: 183113

SEQ ID NO: 639373 - RNA, 64 nt, Homo Sapiens; identical to SEQ ID NO: 183114

SEQ ID NO: 639374 - RNA, 64 nt, Homo Sapiens; identical to SEQ ID NO: 183115

SEQ ID NO: 639375 - RNA, 64 nt, Homo Sapiens; identical to SEQ ID NO: 183116

SEQ ID NO: 639376 - RNA, 64 nt, Homo Sapiens; identical to SEQ ID NO: 183117

SEQ ID NO: 639377 - RNA, 64 nt, Homo Sapiens; identical to SEQ ID NO: 183118

SEQ ID NO: 639378 - RNA, 64 nt, Homo Sapiens; identical to SEQ ID NO: 183119

SEQ ID NO: 639379 - RNA, 64 nt, Homo Sapiens; identical to SEQ ID NO: 183120

SEQ ID NO: 639380 - RNA, 64 nt, Homo Sapiens; identical to SEQ ID NO: 183121

SEQ ID NO: 639381 - RNA, 64 nt, Homo Sapiens; identical to SEQ ID NO: 183122

SEQ ID NO: 639382 - RNA, 64 nt, Homo Sapiens; identical to SEQ ID NO: 183123

SEQ ID NO: 639383 - RNA, 64 nt, Homo Sapiens; identical to SEQ ID NO: 183124

SEQ ID NO: 639384 - RNA, 64 nt, Homo Sapiens; identical to SEQ ID NO: 183125

SEQ ID NO: 639385 - RNA, 64 nt, Homo Sapiens; identical to SEQ ID NO: 183126

SEQ ID NO: 639386 - RNA, 64 nt, Homo Sapiens; identical to SEQ ID NO: 183127

SEQ ID NO: 639387 - RNA, 64 nt, Homo Sapiens; identical to SEQ ID NO: 183128

SEQ ID NO: 639388 - RNA, 64 nt, Homo Sapiens; identical to SEQ ID NO: 183129

SEQ ID NO: 639389 - RNA, 64 nt, Homo Sapiens; identical to SEQ ID NO: 183130

SEQ ID NO: 639390 - RNA, 64 nt, Homo Sapiens; identical to SEQ ID NO: 183131

SEQ ID NO: 639391 - RNA, 64 nt, Homo Sapiens; identical to SEQ ID NO: 183132

SEQ ID NO: 639392 - RNA, 64 nt, Homo Sapiens; identical to SEQ ID NO: 183133

SEQ ID NO: 639393 - RNA, 64 nt, Homo Sapiens; identical to SEQ ID NO: 183134

SEQ ID NO: 639394 - RNA, 64 nt, Homo Sapiens; identical to SEQ ID NO: 183135

SEQ ID NO: 639395 - RNA, 64 nt, Homo Sapiens; identical to SEQ ID NO: 183136

SEQ ID NO: 639396 - RNA, 64 nt, Homo Sapiens; identical to SEQ ID NO: 183137

SEQ ID NO: 639397 - RNA, 64 nt, Homo Sapiens; identical to SEQ ID NO: 183138

SEQ ID NO: 639398 - RNA, 64 nt, Homo Sapiens; identical to SEQ ID NO: 183139

SEQ ID NO: 639399 - RNA, 64 nt, Homo Sapiens; identical to SEQ ID NO: 183140

SEQ ID NO: 639400 - RNA, 64 nt, Homo Sapiens; identical to SEQ ID NO: 183141

SEQ ID NO: 639401 - RNA, 64 nt, Homo Sapiens; identical to SEQ ID NO: 183142

SEQ ID NO: 639402 - RNA, 64 nt, Homo Sapiens; identical to SEQ ID NO: 183143

SEQ ID NO: 639403 - RNA, 64 nt, Homo Sapiens; identical to SEQ ID NO: 183144

SEQ ID NO: 639404 - RNA, 64 nt, Homo Sapiens; identical to SEQ ID NO: 183145

SEQ ID NO: 639405 - RNA, 64 nt, Homo Sapiens; identical to SEQ ID NO: 183146

SEQ ID NO: 639406 - RNA, 64 nt, Homo Sapiens; identical to SEQ ID NO: 183147

SEQ ID NO: 639407 - RNA, 64 nt, Homo Sapiens; identical to SEQ ID NO: 183148

SEQ ID NO: 639408 - RNA, 64 nt, Homo Sapiens; identical to SEQ ID NO: 183149

SEQ ID NO: 639409 - RNA, 64 nt, Homo Sapiens; identical to SEQ ID NO: 183150

SEQ ID NO: 639410 - RNA, 64 nt, Homo Sapiens; identical to SEQ ID NO: 183151

SEQ ID NO: 639411 - RNA, 64 nt, Homo Sapiens; identical to SEQ ID NO: 183152

SEQ ID NO: 639412 - RNA, 64 nt, Homo Sapiens; identical to SEQ ID NO: 183153

SEQ ID NO: 639413 - RNA, 64 nt, Homo Sapiens; identical to SEQ ID NO: 183154

SEQ ID NO: 639414 - RNA, 64 nt, Homo Sapiens; identical to SEQ ID NO: 183155

SEQ ID NO: 639415 - RNA, 64 nt, Homo Sapiens; identical to SEQ ID NO: 183156

SEQ ID NO: 639416 - RNA, 64 nt, Homo Sapiens; identical to SEQ ID NO: 183157

SEQ ID NO: 639417 - RNA, 64 nt, Homo Sapiens; identical to SEQ ID NO: 183158

SEQ ID NO: 639418 - RNA, 64 nt, Homo Sapiens; identical to SEQ ID NO: 183159

SEQ ID NO: 639419 - RNA, 64 nt, Homo Sapiens; identical to SEQ ID NO: 183160

SEQ ID NO: 639420 - RNA, 64 nt, Homo Sapiens; identical to SEQ ID NO: 183161

SEQ ID NO: 639421 - RNA, 64 nt, Homo Sapiens; identical to SEQ ID NO: 183162

SEQ ID NO: 639422 - RNA, 64 nt, Homo Sapiens; identical to SEQ ID NO: 183163

SEQ ID NO: 639423 - RNA, 64 nt, Homo Sapiens; identical to SEQ ID NO: 183164

SEQ ID NO: 639424 - RNA, 64 nt, Homo Sapiens; identical to SEQ ID NO: 183165

SEQ ID NO: 639425 - RNA, 64 nt, Homo Sapiens; identical to SEQ ID NO: 183166

SEQ ID NO: 639426 - RNA, 64 nt, Homo Sapiens; identical to SEQ ID NO: 183167

SEQ ID NO: 639427 - RNA, 64 nt, Homo Sapiens; identical to SEQ ID NO: 183168

SEQ ID NO: 639428 - RNA, 64 nt, Homo Sapiens; identical to SEQ ID NO: 183169

SEQ ID NO: 639429 - RNA, 64 nt, Homo Sapiens; identical to SEQ ID NO: 183170

SEQ ID NO: 639430 - RNA, 64 nt, Homo Sapiens; identical to SEQ ID NO: 183171

SEQ ID NO: 639431 - RNA, 64 nt, Homo Sapiens; identical to SEQ ID NO: 183172

SEQ ID NO: 639432 - RNA, 64 nt, Homo Sapiens; identical to SEQ ID NO: 183173

SEQ ID NO: 639433 - RNA, 64 nt, Homo Sapiens; identical to SEQ ID NO: 183174

SEQ ID NO: 639434 - RNA, 64 nt, Homo Sapiens; identical to SEQ ID NO: 183175

SEQ ID NO: 639435 - RNA, 64 nt, Homo Sapiens; identical to SEQ ID NO: 183176

SEQ ID NO: 639436 - RNA, 64 nt, Homo Sapiens; identical to SEQ ID NO: 183177

SEQ ID NO: 639437 - RNA, 64 nt, Homo Sapiens; identical to SEQ ID NO: 183178

SEQ ID NO: 639438 - RNA, 64 nt, Homo Sapiens; identical to SEQ ID NO: 183179

SEQ ID NO: 639439 - RNA, 64 nt, Homo Sapiens; identical to SEQ ID NO: 183180

SEQ ID NO: 639440 - RNA, 64 nt, Homo Sapiens; identical to SEQ ID NO: 183181

SEQ ID NO: 639441 - RNA, 64 nt, Homo Sapiens; identical to SEQ ID NO: 183182

SEQ ID NO: 639442 - RNA, 64 nt, Homo Sapiens; identical to SEQ ID NO: 183183

SEQ ID NO: 639443 - RNA, 64 nt, Homo Sapiens; identical to SEQ ID NO: 183184

SEQ ID NO: 639444 - RNA, 64 nt, Homo Sapiens; identical to SEQ ID NO: 183185

SEQ ID NO: 639445 - RNA, 64 nt, Homo Sapiens; identical to SEQ ID NO: 183186

SEQ ID NO: 639446 - RNA, 64 nt, Homo Sapiens; identical to SEQ ID NO: 183187

SEQ ID NO: 639447 - RNA, 64 nt, Homo Sapiens; identical to SEQ ID NO: 183188

SEQ ID NO: 639448 - RNA, 64 nt, Homo Sapiens; identical to SEQ ID NO: 183189

SEQ ID NO: 639449 - RNA, 64 nt, Homo Sapiens; identical to SEQ ID NO: 183190

SEQ ID NO: 639450 - RNA, 64 nt, Homo Sapiens; identical to SEQ ID NO: 183191

SEQ ID NO: 639451 - RNA, 64 nt, Homo Sapiens; identical to SEQ ID NO: 183192

SEQ ID NO: 639452 - RNA, 64 nt, Homo Sapiens; identical to SEQ ID NO: 183193

SEQ ID NO: 639453 - RNA, 64 nt, Homo Sapiens; identical to SEQ ID NO: 183194

SEQ ID NO: 639454 - RNA, 64 nt, Homo Sapiens; identical to SEQ ID NO: 183195

SEQ ID NO: 639455 - RNA, 64 nt, Homo Sapiens; identical to SEQ ID NO: 183196

SEQ ID NO: 639456 - RNA, 64 nt, Homo Sapiens; identical to SEQ ID NO: 183197

SEQ ID NO: 639457 - RNA, 64 nt, Homo Sapiens; identical to SEQ ID NO: 183198

SEQ ID NO: 639458 - RNA, 64 nt, Homo Sapiens; identical to SEQ ID NO: 183199

SEQ ID NO: 639459 - RNA, 64 nt, Homo Sapiens; identical to SEQ ID NO: 183200

SEQ ID NO: 639460 - RNA, 64 nt, Homo Sapiens; identical to SEQ ID NO: 183201

SEQ ID NO: 639461 - RNA, 64 nt, Homo Sapiens; identical to SEQ ID NO: 183202

SEQ ID NO: 639462 - RNA, 64 nt, Homo Sapiens; identical to SEQ ID NO: 183203

SEQ ID NO: 639463 - RNA, 64 nt, Homo Sapiens; identical to SEQ ID NO: 183204

SEQ ID NO: 639464 - RNA, 64 nt, Homo Sapiens; identical to SEQ ID NO: 183205

SEQ ID NO: 639465 - RNA, 64 nt, Homo Sapiens; identical to SEQ ID NO: 183206

SEQ ID NO: 639466 - RNA, 64 nt, Homo Sapiens; identical to SEQ ID NO: 183207

SEQ ID NO: 639467 - RNA, 64 nt, Homo Sapiens; identical to SEQ ID NO: 183208

SEQ ID NO: 639468 - RNA, 64 nt, Homo Sapiens; identical to SEQ ID NO: 183209

SEQ ID NO: 639469 - RNA, 64 nt, Homo Sapiens; identical to SEQ ID NO: 183210

SEQ ID NO: 639470 - RNA, 64 nt, Homo Sapiens; identical to SEQ ID NO: 183211

SEQ ID NO: 639471 - RNA, 64 nt, Homo Sapiens; identical to SEQ ID NO: 183212

SEQ ID NO: 639472 - RNA, 64 nt, Homo Sapiens; identical to SEQ ID NO: 183213

SEQ ID NO: 639473 - RNA, 64 nt, Homo Sapiens; identical to SEQ ID NO: 183214

SEQ ID NO: 639474 - RNA, 64 nt, Homo Sapiens; identical to SEQ ID NO: 183215

SEQ ID NO: 639475 - RNA, 64 nt, Homo Sapiens; identical to SEQ ID NO: 183216

SEQ ID NO: 639476 - RNA, 64 nt, Homo Sapiens; identical to SEQ ID NO: 183217

SEQ ID NO: 639477 - RNA, 64 nt, Homo Sapiens; identical to SEQ ID NO: 183218

SEQ ID NO: 639478 - RNA, 64 nt, Homo Sapiens; identical to SEQ ID NO: 183219

SEQ ID NO: 639479 - RNA, 64 nt, Homo Sapiens; identical to SEQ ID NO: 183220

SEQ ID NO: 639480 - RNA, 64 nt, Homo Sapiens; identical to SEQ ID NO: 183221

SEQ ID NO: 639481 - RNA, 64 nt, Homo Sapiens; identical to SEQ ID NO: 183222

SEQ ID NO: 639482 - RNA, 64 nt, Homo Sapiens; identical to SEQ ID NO: 183223

SEQ ID NO: 639483 - RNA, 64 nt, Homo Sapiens; identical to SEQ ID NO: 183224

SEQ ID NO: 639484 - RNA, 64 nt, Homo Sapiens; identical to SEQ ID NO: 183225

SEQ ID NO: 639485 - RNA, 64 nt, Homo Sapiens; identical to SEQ ID NO: 183226

SEQ ID NO: 639486 - RNA, 64 nt, Homo Sapiens; identical to SEQ ID NO: 183227

SEQ ID NO: 639487 - RNA, 64 nt, Homo Sapiens; identical to SEQ ID NO: 183228

SEQ ID NO: 639488 - RNA, 64 nt, Homo Sapiens; identical to SEQ ID NO: 183229

SEQ ID NO: 639489 - RNA, 64 nt, Homo Sapiens; identical to SEQ ID NO: 183230

SEQ ID NO: 639490 - RNA, 64 nt, Homo Sapiens; identical to SEQ ID NO: 183231

SEQ ID NO: 639491 - RNA, 64 nt, Homo Sapiens; identical to SEQ ID NO: 183232

SEQ ID NO: 639492 - RNA, 64 nt, Homo Sapiens; identical to SEQ ID NO: 183233

SEQ ID NO: 639493 - RNA, 64 nt, Homo Sapiens; identical to SEQ ID NO: 183234

SEQ ID NO: 639494 - RNA, 64 nt, Homo Sapiens; identical to SEQ ID NO: 183235

SEQ ID NO: 639495 - RNA, 64 nt, Homo Sapiens; identical to SEQ ID NO: 183236

SEQ ID NO: 639496 - RNA, 64 nt, Homo Sapiens; identical to SEQ ID NO: 183237

SEQ ID NO: 639497 - RNA, 64 nt, Homo Sapiens; identical to SEQ ID NO: 183238

SEQ ID NO: 639498 - RNA, 64 nt, Homo Sapiens; identical to SEQ ID NO: 183239

SEQ ID NO: 639499 - RNA, 64 nt, Homo Sapiens; identical to SEQ ID NO: 183240

SEQ ID NO: 639500 - RNA, 64 nt, Homo Sapiens; identical to SEQ ID NO: 183241

SEQ ID NO: 639501 - RNA, 64 nt, Homo Sapiens; identical to SEQ ID NO: 183242

SEQ ID NO: 639502 - RNA, 64 nt, Homo Sapiens; identical to SEQ ID NO: 183243

SEQ ID NO: 639503 - RNA, 64 nt, Homo Sapiens; identical to SEQ ID NO: 183244

SEQ ID NO: 639504 - RNA, 64 nt, Homo Sapiens; identical to SEQ ID NO: 183245

SEQ ID NO: 639505 - RNA, 64 nt, Homo Sapiens; identical to SEQ ID NO: 183246

SEQ ID NO: 639506 - RNA, 64 nt, Homo Sapiens; identical to SEQ ID NO: 183247

SEQ ID NO: 639507 - RNA, 64 nt, Homo Sapiens; identical to SEQ ID NO: 183248

SEQ ID NO: 639508 - RNA, 64 nt, Homo Sapiens; identical to SEQ ID NO: 183249

SEQ ID NO: 639509 - RNA, 64 nt, Homo Sapiens; identical to SEQ ID NO: 183250

SEQ ID NO: 639510 - RNA, 64 nt, Homo Sapiens; identical to SEQ ID NO: 183251

SEQ ID NO: 639511 - RNA, 64 nt, Homo Sapiens; identical to SEQ ID NO: 183252

SEQ ID NO: 639512 - RNA, 64 nt, Homo Sapiens; identical to SEQ ID NO: 183253

SEQ ID NO: 639513 - RNA, 64 nt, Homo Sapiens; identical to SEQ ID NO: 183254

SEQ ID NO: 639514 - RNA, 64 nt, Homo Sapiens; identical to SEQ ID NO: 183255

SEQ ID NO: 639515 - RNA, 64 nt, Homo Sapiens; identical to SEQ ID NO: 183256

SEQ ID NO: 639516 - RNA, 64 nt, Homo Sapiens; identical to SEQ ID NO: 183257

SEQ ID NO: 639517 - RNA, 64 nt, Homo Sapiens; identical to SEQ ID NO: 183258

SEQ ID NO: 639518 - RNA, 64 nt, Homo Sapiens; identical to SEQ ID NO: 183259

SEQ ID NO: 639519 - RNA, 64 nt, Homo Sapiens; identical to SEQ ID NO: 183260

SEQ ID NO: 639520 - RNA, 64 nt, Homo Sapiens; identical to SEQ ID NO: 183261

SEQ ID NO: 639521 - RNA, 64 nt, Homo Sapiens; identical to SEQ ID NO: 183262

SEQ ID NO: 639522 - RNA, 64 nt, Homo Sapiens; identical to SEQ ID NO: 183263

SEQ ID NO: 639523 - RNA, 64 nt, Homo Sapiens; identical to SEQ ID NO: 183264

SEQ ID NO: 639524 - RNA, 64 nt, Homo Sapiens; identical to SEQ ID NO: 183265

SEQ ID NO: 639525 - RNA, 64 nt, Homo Sapiens; identical to SEQ ID NO: 183266

SEQ ID NO: 639526 - RNA, 64 nt, Homo Sapiens; identical to SEQ ID NO: 183267

SEQ ID NO: 639527 - RNA, 64 nt, Homo Sapiens; identical to SEQ ID NO: 183268

SEQ ID NO: 639528 - RNA, 64 nt, Homo Sapiens; identical to SEQ ID NO: 183269

SEQ ID NO: 639529 - RNA, 64 nt, Homo Sapiens; identical to SEQ ID NO: 183270

SEQ ID NO: 639530 - RNA, 64 nt, Homo Sapiens; identical to SEQ ID NO: 183271

SEQ ID NO: 639531 - RNA, 64 nt, Homo Sapiens; identical to SEQ ID NO: 183272

SEQ ID NO: 639532 - RNA, 64 nt, Homo Sapiens; identical to SEQ ID NO: 183273

SEQ ID NO: 639533 - RNA, 64 nt, Homo Sapiens; identical to SEQ ID NO: 183274

SEQ ID NO: 639534 - RNA, 64 nt, Homo Sapiens; identical to SEQ ID NO: 183275

SEQ ID NO: 639535 - RNA, 64 nt, Homo Sapiens; identical to SEQ ID NO: 183276

SEQ ID NO: 639536 - RNA, 64 nt, Homo Sapiens; identical to SEQ ID NO: 183277

SEQ ID NO: 639537 - RNA, 64 nt, Homo Sapiens; identical to SEQ ID NO: 183278

SEQ ID NO: 639538 - RNA, 64 nt, Homo Sapiens; identical to SEQ ID NO: 183279

SEQ ID NO: 639539 - RNA, 64 nt, Homo Sapiens; identical to SEQ ID NO: 183280

SEQ ID NO: 639540 - RNA, 64 nt, Homo Sapiens; identical to SEQ ID NO: 183281

SEQ ID NO: 639541 - RNA, 64 nt, Homo Sapiens; identical to SEQ ID NO: 183282

SEQ ID NO: 639542 - RNA, 64 nt, Homo Sapiens; identical to SEQ ID NO: 183283

SEQ ID NO: 639543 - RNA, 64 nt, Homo Sapiens; identical to SEQ ID NO: 183284

SEQ ID NO: 639544 - RNA, 64 nt, Homo Sapiens; identical to SEQ ID NO: 183285

SEQ ID NO: 639545 - RNA, 64 nt, Homo Sapiens; identical to SEQ ID NO: 183286

SEQ ID NO: 639546 - RNA, 64 nt, Homo Sapiens; identical to SEQ ID NO: 183287

SEQ ID NO: 639547 - RNA, 64 nt, Homo Sapiens; identical to SEQ ID NO: 183288

SEQ ID NO: 639548 - RNA, 64 nt, Homo Sapiens; identical to SEQ ID NO: 183289

SEQ ID NO: 639549 - RNA, 64 nt, Homo Sapiens; identical to SEQ ID NO: 183290

SEQ ID NO: 639550 - RNA, 64 nt, Homo Sapiens; identical to SEQ ID NO: 183291

SEQ ID NO: 639551 - RNA, 64 nt, Homo Sapiens; identical to SEQ ID NO: 183292

SEQ ID NO: 639552 - RNA, 64 nt, Homo Sapiens; identical to SEQ ID NO: 183293

SEQ ID NO: 639553 - RNA, 64 nt, Homo Sapiens; identical to SEQ ID NO: 183294

SEQ ID NO: 639554 - RNA, 64 nt, Homo Sapiens; identical to SEQ ID NO: 183295

SEQ ID NO: 639555 - RNA, 64 nt, Homo Sapiens; identical to SEQ ID NO: 183296

SEQ ID NO: 639556 - RNA, 64 nt, Homo Sapiens; identical to SEQ ID NO: 183297

SEQ ID NO: 639557 - RNA, 64 nt, Homo Sapiens; identical to SEQ ID NO: 183298

SEQ ID NO: 639558 - RNA, 64 nt, Homo Sapiens; identical to SEQ ID NO: 183299

SEQ ID NO: 639559 - RNA, 64 nt, Homo Sapiens; identical to SEQ ID NO: 183300

SEQ ID NO: 639560 - RNA, 64 nt, Homo Sapiens; identical to SEQ ID NO: 183301

SEQ ID NO: 639561 - RNA, 64 nt, Homo Sapiens; identical to SEQ ID NO: 183302

SEQ ID NO: 639562 - RNA, 64 nt, Homo Sapiens; identical to SEQ ID NO: 183303

SEQ ID NO: 639563 - RNA, 64 nt, Homo Sapiens; identical to SEQ ID NO: 183304

SEQ ID NO: 639564 - RNA, 64 nt, Homo Sapiens; identical to SEQ ID NO: 183305

SEQ ID NO: 639565 - RNA, 64 nt, Homo Sapiens; identical to SEQ ID NO: 183306

SEQ ID NO: 639566 - RNA, 64 nt, Homo Sapiens; identical to SEQ ID NO: 183307

SEQ ID NO: 639567 - RNA, 64 nt, Homo Sapiens; identical to SEQ ID NO: 183308

SEQ ID NO: 639568 - RNA, 64 nt, Homo Sapiens; identical to SEQ ID NO: 183309

SEQ ID NO: 639569 - RNA, 64 nt, Homo Sapiens; identical to SEQ ID NO: 183310

SEQ ID NO: 639570 - RNA, 64 nt, Homo Sapiens; identical to SEQ ID NO: 183311

SEQ ID NO: 639571 - RNA, 64 nt, Homo Sapiens; identical to SEQ ID NO: 183312

SEQ ID NO: 639572 - RNA, 64 nt, Homo Sapiens; identical to SEQ ID NO: 183313

SEQ ID NO: 639573 - RNA, 64 nt, Homo Sapiens; identical to SEQ ID NO: 183314

SEQ ID NO: 639574 - RNA, 64 nt, Homo Sapiens; identical to SEQ ID NO: 183315

SEQ ID NO: 639575 - RNA, 64 nt, Homo Sapiens; identical to SEQ ID NO: 183316

SEQ ID NO: 639576 - RNA, 64 nt, Homo Sapiens; identical to SEQ ID NO: 183317

SEQ ID NO: 639577 - RNA, 64 nt, Homo Sapiens; identical to SEQ ID NO: 183318

SEQ ID NO: 639578 - RNA, 64 nt, Homo Sapiens; identical to SEQ ID NO: 183319

SEQ ID NO: 639579 - RNA, 64 nt, Homo Sapiens; identical to SEQ ID NO: 183320

SEQ ID NO: 639580 - RNA, 64 nt, Homo Sapiens; identical to SEQ ID NO: 183321

SEQ ID NO: 639581 - RNA, 64 nt, Homo Sapiens; identical to SEQ ID NO: 183322

SEQ ID NO: 639582 - RNA, 64 nt, Homo Sapiens; identical to SEQ ID NO: 183323

SEQ ID NO: 639583 - RNA, 64 nt, Homo Sapiens; identical to SEQ ID NO: 183324

SEQ ID NO: 639584 - RNA, 64 nt, Homo Sapiens; identical to SEQ ID NO: 183325

SEQ ID NO: 639585 - RNA, 64 nt, Homo Sapiens; identical to SEQ ID NO: 183326

SEQ ID NO: 639586 - RNA, 64 nt, Homo Sapiens; identical to SEQ ID NO: 183327

SEQ ID NO: 639587 - RNA, 64 nt, Homo Sapiens; identical to SEQ ID NO: 183328

SEQ ID NO: 639588 - RNA, 64 nt, Homo Sapiens; identical to SEQ ID NO: 183329

SEQ ID NO: 639589 - RNA, 64 nt, Homo Sapiens; identical to SEQ ID NO: 183330

SEQ ID NO: 639590 - RNA, 64 nt, Homo Sapiens; identical to SEQ ID NO: 183331

SEQ ID NO: 639591 - RNA, 64 nt, Homo Sapiens; identical to SEQ ID NO: 183332

SEQ ID NO: 639592 - RNA, 64 nt, Homo Sapiens; identical to SEQ ID NO: 183333

SEQ ID NO: 639593 - RNA, 64 nt, Homo Sapiens; identical to SEQ ID NO: 183334

SEQ ID NO: 639594 - RNA, 64 nt, Homo Sapiens; identical to SEQ ID NO: 183335

SEQ ID NO: 639595 - RNA, 64 nt, Homo Sapiens; identical to SEQ ID NO: 183336

SEQ ID NO: 639596 - RNA, 64 nt, Homo Sapiens; identical to SEQ ID NO: 183337

SEQ ID NO: 639597 - RNA, 64 nt, Homo Sapiens; identical to SEQ ID NO: 183338

SEQ ID NO: 639598 - RNA, 64 nt, Homo Sapiens; identical to SEQ ID NO: 183339

SEQ ID NO: 639599 - RNA, 64 nt, Homo Sapiens; identical to SEQ ID NO: 183340

SEQ ID NO: 639600 - RNA, 64 nt, Homo Sapiens; identical to SEQ ID NO: 183341

SEQ ID NO: 639601 - RNA, 64 nt, Homo Sapiens; identical to SEQ ID NO: 183342

SEQ ID NO: 639602 - RNA, 64 nt, Homo Sapiens; identical to SEQ ID NO: 183343

SEQ ID NO: 639603 - RNA, 64 nt, Homo Sapiens; identical to SEQ ID NO: 183344

SEQ ID NO: 639604 - RNA, 64 nt, Homo Sapiens; identical to SEQ ID NO: 183345

SEQ ID NO: 639605 - RNA, 64 nt, Homo Sapiens; identical to SEQ ID NO: 183346

SEQ ID NO: 639606 - RNA, 64 nt, Homo Sapiens; identical to SEQ ID NO: 183347

SEQ ID NO: 639607 - RNA, 64 nt, Homo Sapiens; identical to SEQ ID NO: 183348

SEQ ID NO: 639608 - RNA, 64 nt, Homo Sapiens; identical to SEQ ID NO: 183349

SEQ ID NO: 639609 - RNA, 64 nt, Homo Sapiens; identical to SEQ ID NO: 183350

SEQ ID NO: 639610 - RNA, 64 nt, Homo Sapiens; identical to SEQ ID NO: 183351

SEQ ID NO: 639611 - RNA, 64 nt, Homo Sapiens; identical to SEQ ID NO: 183352

SEQ ID NO: 639612 - RNA, 64 nt, Homo Sapiens; identical to SEQ ID NO: 183353

SEQ ID NO: 639613 - RNA, 64 nt, Homo Sapiens; identical to SEQ ID NO: 183354

SEQ ID NO: 639614 - RNA, 64 nt, Homo Sapiens; identical to SEQ ID NO: 183355

SEQ ID NO: 639615 - RNA, 64 nt, Homo Sapiens; identical to SEQ ID NO: 183356

SEQ ID NO: 639616 - RNA, 64 nt, Homo Sapiens; identical to SEQ ID NO: 183357

SEQ ID NO: 639617 - RNA, 64 nt, Homo Sapiens; identical to SEQ ID NO: 183358

SEQ ID NO: 639618 - RNA, 64 nt, Homo Sapiens; identical to SEQ ID NO: 183359

SEQ ID NO: 639619 - RNA, 64 nt, Homo Sapiens; identical to SEQ ID NO: 183360

SEQ ID NO: 639620 - RNA, 64 nt, Homo Sapiens; identical to SEQ ID NO: 183361

SEQ ID NO: 639621 - RNA, 64 nt, Homo Sapiens; identical to SEQ ID NO: 183362

SEQ ID NO: 639622 - RNA, 64 nt, Homo Sapiens; identical to SEQ ID NO: 183363

SEQ ID NO: 639623 - RNA, 64 nt, Homo Sapiens; identical to SEQ ID NO: 183364

SEQ ID NO: 639624 - RNA, 64 nt, Homo Sapiens; identical to SEQ ID NO: 183365

SEQ ID NO: 639625 - RNA, 64 nt, Homo Sapiens; identical to SEQ ID NO: 183366

SEQ ID NO: 639626 - RNA, 64 nt, Homo Sapiens; identical to SEQ ID NO: 183367

SEQ ID NO: 639627 - RNA, 64 nt, Homo Sapiens; identical to SEQ ID NO: 183368

SEQ ID NO: 639628 - RNA, 63 nt, Homo Sapiens; identical to SEQ ID NO: 183369

SEQ ID NO: 639629 - RNA, 64 nt, Homo Sapiens; identical to SEQ ID NO: 183370

SEQ ID NO: 639630 - RNA, 64 nt, Homo Sapiens; identical to SEQ ID NO: 183371

SEQ ID NO: 639631 - RNA, 64 nt, Homo Sapiens; identical to SEQ ID NO: 183372

SEQ ID NO: 639632 - RNA, 64 nt, Homo Sapiens; identical to SEQ ID NO: 183373

SEQ ID NO: 639633 - RNA, 64 nt, Homo Sapiens; identical to SEQ ID NO: 183374

SEQ ID NO: 639634 - RNA, 64 nt, Homo Sapiens; identical to SEQ ID NO: 183375

SEQ ID NO: 639635 - RNA, 64 nt, Homo Sapiens; identical to SEQ ID NO: 183376

SEQ ID NO: 639636 - RNA, 64 nt, Homo Sapiens; identical to SEQ ID NO: 183377

SEQ ID NO: 639637 - RNA, 64 nt, Homo Sapiens; identical to SEQ ID NO: 183378

SEQ ID NO: 639638 - RNA, 64 nt, Homo Sapiens; identical to SEQ ID NO: 183379

SEQ ID NO: 639639 - RNA, 64 nt, Homo Sapiens; identical to SEQ ID NO: 183380

SEQ ID NO: 639640 - RNA, 64 nt, Homo Sapiens; identical to SEQ ID NO: 183381

SEQ ID NO: 639641 - RNA, 64 nt, Homo Sapiens; identical to SEQ ID NO: 183382

SEQ ID NO: 639642 - RNA, 64 nt, Homo Sapiens; identical to SEQ ID NO: 183383

SEQ ID NO: 639643 - RNA, 64 nt, Homo Sapiens; identical to SEQ ID NO: 183384

SEQ ID NO: 639644 - RNA, 64 nt, Homo Sapiens; identical to SEQ ID NO: 183385

SEQ ID NO: 639645 - RNA, 64 nt, Homo Sapiens; identical to SEQ ID NO: 183386

SEQ ID NO: 639646 - RNA, 64 nt, Homo Sapiens; identical to SEQ ID NO: 183387

SEQ ID NO: 639647 - RNA, 64 nt, Homo Sapiens; identical to SEQ ID NO: 183388

SEQ ID NO: 639648 - RNA, 64 nt, Homo Sapiens; identical to SEQ ID NO: 183389

SEQ ID NO: 639649 - RNA, 64 nt, Homo Sapiens; identical to SEQ ID NO: 183390

SEQ ID NO: 639650 - RNA, 64 nt, Homo Sapiens; identical to SEQ ID NO: 183391

SEQ ID NO: 639651 - RNA, 64 nt, Homo Sapiens; identical to SEQ ID NO: 183392

SEQ ID NO: 639652 - RNA, 64 nt, Homo Sapiens; identical to SEQ ID NO: 183393

SEQ ID NO: 639653 - RNA, 64 nt, Homo Sapiens; identical to SEQ ID NO: 183394

SEQ ID NO: 639654 - RNA, 64 nt, Homo Sapiens; identical to SEQ ID NO: 183395

SEQ ID NO: 639655 - RNA, 64 nt, Homo Sapiens; identical to SEQ ID NO: 183396

SEQ ID NO: 639656 - RNA, 64 nt, Homo Sapiens; identical to SEQ ID NO: 183397

SEQ ID NO: 639657 - RNA, 64 nt, Homo Sapiens; identical to SEQ ID NO: 183398

SEQ ID NO: 639658 - RNA, 64 nt, Homo Sapiens; identical to SEQ ID NO: 183399

SEQ ID NO: 639659 - RNA, 64 nt, Homo Sapiens; identical to SEQ ID NO: 183400

SEQ ID NO: 639660 - RNA, 64 nt, Homo Sapiens; identical to SEQ ID NO: 183401

SEQ ID NO: 639661 - RNA, 64 nt, Homo Sapiens; identical to SEQ ID NO: 183402

SEQ ID NO: 639662 - RNA, 64 nt, Homo Sapiens; identical to SEQ ID NO: 183403

SEQ ID NO: 639663 - RNA, 64 nt, Homo Sapiens; identical to SEQ ID NO: 183404

SEQ ID NO: 639664 - RNA, 64 nt, Homo Sapiens; identical to SEQ ID NO: 183405

SEQ ID NO: 639665 - RNA, 64 nt, Homo Sapiens; identical to SEQ ID NO: 183406

SEQ ID NO: 639666 - RNA, 64 nt, Homo Sapiens; identical to SEQ ID NO: 183407

SEQ ID NO: 639667 - RNA, 64 nt, Homo Sapiens; identical to SEQ ID NO: 183408

SEQ ID NO: 639668 - RNA, 64 nt, Homo Sapiens; identical to SEQ ID NO: 183409

SEQ ID NO: 639669 - RNA, 64 nt, Homo Sapiens; identical to SEQ ID NO: 183410

SEQ ID NO: 639670 - RNA, 64 nt, Homo Sapiens; identical to SEQ ID NO: 183411

SEQ ID NO: 639671 - RNA, 64 nt, Homo Sapiens; identical to SEQ ID NO: 183412

SEQ ID NO: 639672 - RNA, 64 nt, Homo Sapiens; identical to SEQ ID NO: 183413

SEQ ID NO: 639673 - RNA, 64 nt, Homo Sapiens; identical to SEQ ID NO: 183414

SEQ ID NO: 639674 - RNA, 64 nt, Homo Sapiens; identical to SEQ ID NO: 183415

SEQ ID NO: 639675 - RNA, 64 nt, Homo Sapiens; identical to SEQ ID NO: 183416

SEQ ID NO: 639676 - RNA, 64 nt, Homo Sapiens; identical to SEQ ID NO: 183417

SEQ ID NO: 639677 - RNA, 64 nt, Homo Sapiens; identical to SEQ ID NO: 183418

SEQ ID NO: 639678 - RNA, 64 nt, Homo Sapiens; identical to SEQ ID NO: 183419

SEQ ID NO: 639679 - RNA, 64 nt, Homo Sapiens; identical to SEQ ID NO: 183420

SEQ ID NO: 639680 - RNA, 64 nt, Homo Sapiens; identical to SEQ ID NO: 183421

SEQ ID NO: 639681 - RNA, 64 nt, Homo Sapiens; identical to SEQ ID NO: 183422

SEQ ID NO: 639682 - RNA, 64 nt, Homo Sapiens; identical to SEQ ID NO: 183423

SEQ ID NO: 639683 - RNA, 64 nt, Homo Sapiens; identical to SEQ ID NO: 183424

SEQ ID NO: 639684 - RNA, 64 nt, Homo Sapiens; identical to SEQ ID NO: 183425

SEQ ID NO: 639685 - RNA, 64 nt, Homo Sapiens; identical to SEQ ID NO: 183426

SEQ ID NO: 639686 - RNA, 64 nt, Homo Sapiens; identical to SEQ ID NO: 183427

SEQ ID NO: 639687 - RNA, 64 nt, Homo Sapiens; identical to SEQ ID NO: 183428

SEQ ID NO: 639688 - RNA, 64 nt, Homo Sapiens; identical to SEQ ID NO: 183429

SEQ ID NO: 639689 - RNA, 64 nt, Homo Sapiens; identical to SEQ ID NO: 183430

SEQ ID NO: 639690 - RNA, 64 nt, Homo Sapiens; identical to SEQ ID NO: 183431

SEQ ID NO: 639691 - RNA, 64 nt, Homo Sapiens; identical to SEQ ID NO: 183432

SEQ ID NO: 639692 - RNA, 64 nt, Homo Sapiens; identical to SEQ ID NO: 183433

SEQ ID NO: 639693 - RNA, 64 nt, Homo Sapiens; identical to SEQ ID NO: 183434

SEQ ID NO: 639694 - RNA, 64 nt, Homo Sapiens; identical to SEQ ID NO: 183435

SEQ ID NO: 639695 - RNA, 64 nt, Homo Sapiens; identical to SEQ ID NO: 183436

SEQ ID NO: 639696 - RNA, 64 nt, Homo Sapiens; identical to SEQ ID NO: 183437

SEQ ID NO: 639697 - RNA, 64 nt, Homo Sapiens; identical to SEQ ID NO: 183438

SEQ ID NO: 639698 - RNA, 64 nt, Homo Sapiens; identical to SEQ ID NO: 183439

SEQ ID NO: 639699 - RNA, 64 nt, Homo Sapiens; identical to SEQ ID NO: 183440

SEQ ID NO: 639700 - RNA, 64 nt, Homo Sapiens; identical to SEQ ID NO: 183441

SEQ ID NO: 639701 - RNA, 64 nt, Homo Sapiens; identical to SEQ ID NO: 183442

SEQ ID NO: 639702 - RNA, 64 nt, Homo Sapiens; identical to SEQ ID NO: 183443

SEQ ID NO: 639703 - RNA, 64 nt, Homo Sapiens; identical to SEQ ID NO: 183444

SEQ ID NO: 639704 - RNA, 64 nt, Homo Sapiens; identical to SEQ ID NO: 183445

SEQ ID NO: 639705 - RNA, 64 nt, Homo Sapiens; identical to SEQ ID NO: 183446

SEQ ID NO: 639706 - RNA, 64 nt, Homo Sapiens; identical to SEQ ID NO: 183447

SEQ ID NO: 639707 - RNA, 64 nt, Homo Sapiens; identical to SEQ ID NO: 183448

SEQ ID NO: 639708 - RNA, 64 nt, Homo Sapiens; identical to SEQ ID NO: 183449

SEQ ID NO: 639709 - RNA, 64 nt, Homo Sapiens; identical to SEQ ID NO: 183450

SEQ ID NO: 639710 - RNA, 64 nt, Homo Sapiens; identical to SEQ ID NO: 183451

SEQ ID NO: 639711 - RNA, 64 nt, Homo Sapiens; identical to SEQ ID NO: 183452

SEQ ID NO: 639712 - RNA, 64 nt, Homo Sapiens; identical to SEQ ID NO: 183453

SEQ ID NO: 639713 - RNA, 64 nt, Homo Sapiens; identical to SEQ ID NO: 183454

SEQ ID NO: 639714 - RNA, 64 nt, Homo Sapiens; identical to SEQ ID NO: 183455

SEQ ID NO: 639715 - RNA, 64 nt, Homo Sapiens; identical to SEQ ID NO: 183456

SEQ ID NO: 639716 - RNA, 64 nt, Homo Sapiens; identical to SEQ ID NO: 183457

SEQ ID NO: 639717 - RNA, 64 nt, Homo Sapiens; identical to SEQ ID NO: 183458

SEQ ID NO: 639718 - RNA, 64 nt, Homo Sapiens; identical to SEQ ID NO: 183459

SEQ ID NO: 639719 - RNA, 64 nt, Homo Sapiens; identical to SEQ ID NO: 183460

SEQ ID NO: 639720 - RNA, 64 nt, Homo Sapiens; identical to SEQ ID NO: 183461

SEQ ID NO: 639721 - RNA, 64 nt, Homo Sapiens; identical to SEQ ID NO: 183462

SEQ ID NO: 639722 - RNA, 64 nt, Homo Sapiens; identical to SEQ ID NO: 183463

SEQ ID NO: 639723 - RNA, 64 nt, Homo Sapiens; identical to SEQ ID NO: 183464

SEQ ID NO: 639724 - RNA, 64 nt, Homo Sapiens; identical to SEQ ID NO: 183465

SEQ ID NO: 639725 - RNA, 64 nt, Homo Sapiens; identical to SEQ ID NO: 183466

SEQ ID NO: 639726 - RNA, 64 nt, Homo Sapiens; identical to SEQ ID NO: 183467

SEQ ID NO: 639727 - RNA, 64 nt, Homo Sapiens; identical to SEQ ID NO: 183468

SEQ ID NO: 639728 - RNA, 64 nt, Homo Sapiens; identical to SEQ ID NO: 183469

SEQ ID NO: 639729 - RNA, 64 nt, Homo Sapiens; identical to SEQ ID NO: 183470

SEQ ID NO: 639730 - RNA, 64 nt, Homo Sapiens; identical to SEQ ID NO: 183471

SEQ ID NO: 639731 - RNA, 64 nt, Homo Sapiens; identical to SEQ ID NO: 183472

SEQ ID NO: 639732 - RNA, 64 nt, Homo Sapiens; identical to SEQ ID NO: 183473

SEQ ID NO: 639733 - RNA, 64 nt, Homo Sapiens; identical to SEQ ID NO: 183474

SEQ ID NO: 639734 - RNA, 64 nt, Homo Sapiens; identical to SEQ ID NO: 183475

SEQ ID NO: 639735 - RNA, 64 nt, Homo Sapiens; identical to SEQ ID NO: 183476

SEQ ID NO: 639736 - RNA, 64 nt, Homo Sapiens; identical to SEQ ID NO: 183477

SEQ ID NO: 639737 - RNA, 64 nt, Homo Sapiens; identical to SEQ ID NO: 183478

SEQ ID NO: 639738 - RNA, 64 nt, Homo Sapiens; identical to SEQ ID NO: 183479

SEQ ID NO: 639739 - RNA, 64 nt, Homo Sapiens; identical to SEQ ID NO: 183480

SEQ ID NO: 639740 - RNA, 64 nt, Homo Sapiens; identical to SEQ ID NO: 183481

SEQ ID NO: 639741 - RNA, 64 nt, Homo Sapiens; identical to SEQ ID NO: 183482

SEQ ID NO: 639742 - RNA, 64 nt, Homo Sapiens; identical to SEQ ID NO: 183483

SEQ ID NO: 639743 - RNA, 64 nt, Homo Sapiens; identical to SEQ ID NO: 183484

SEQ ID NO: 639744 - RNA, 64 nt, Homo Sapiens; identical to SEQ ID NO: 183485

SEQ ID NO: 639745 - RNA, 64 nt, Homo Sapiens; identical to SEQ ID NO: 183486

SEQ ID NO: 639746 - RNA, 64 nt, Homo Sapiens; identical to SEQ ID NO: 183487

SEQ ID NO: 639747 - RNA, 64 nt, Homo Sapiens; identical to SEQ ID NO: 183488

SEQ ID NO: 639748 - RNA, 64 nt, Homo Sapiens; identical to SEQ ID NO: 183489

SEQ ID NO: 639749 - RNA, 64 nt, Homo Sapiens; identical to SEQ ID NO: 183490

SEQ ID NO: 639750 - RNA, 64 nt, Homo Sapiens; identical to SEQ ID NO: 183491

SEQ ID NO: 639751 - RNA, 64 nt, Homo Sapiens; identical to SEQ ID NO: 183492

SEQ ID NO: 639752 - RNA, 64 nt, Homo Sapiens; identical to SEQ ID NO: 183493

SEQ ID NO: 639753 - RNA, 64 nt, Homo Sapiens; identical to SEQ ID NO: 183494

SEQ ID NO: 639754 - RNA, 64 nt, Homo Sapiens; identical to SEQ ID NO: 183495

SEQ ID NO: 639755 - RNA, 64 nt, Homo Sapiens; identical to SEQ ID NO: 183496

SEQ ID NO: 639756 - RNA, 64 nt, Homo Sapiens; identical to SEQ ID NO: 183497

SEQ ID NO: 639757 - RNA, 64 nt, Homo Sapiens; identical to SEQ ID NO: 183498

SEQ ID NO: 639758 - RNA, 64 nt, Homo Sapiens; identical to SEQ ID NO: 183499

SEQ ID NO: 639759 - RNA, 64 nt, Homo Sapiens; identical to SEQ ID NO: 183500

SEQ ID NO: 639760 - RNA, 64 nt, Homo Sapiens; identical to SEQ ID NO: 183501

SEQ ID NO: 639761 - RNA, 64 nt, Homo Sapiens; identical to SEQ ID NO: 183502

SEQ ID NO: 639762 - RNA, 64 nt, Homo Sapiens; identical to SEQ ID NO: 183503

SEQ ID NO: 639763 - RNA, 64 nt, Homo Sapiens; identical to SEQ ID NO: 183504

SEQ ID NO: 639764 - RNA, 64 nt, Homo Sapiens; identical to SEQ ID NO: 183505

SEQ ID NO: 639765 - RNA, 64 nt, Homo Sapiens; identical to SEQ ID NO: 183506

SEQ ID NO: 639766 - RNA, 64 nt, Homo Sapiens; identical to SEQ ID NO: 183507

SEQ ID NO: 639767 - RNA, 64 nt, Homo Sapiens; identical to SEQ ID NO: 183508

SEQ ID NO: 639768 - RNA, 64 nt, Homo Sapiens; identical to SEQ ID NO: 183509

SEQ ID NO: 639769 - RNA, 64 nt, Homo Sapiens; identical to SEQ ID NO: 183510

SEQ ID NO: 639770 - RNA, 64 nt, Homo Sapiens; identical to SEQ ID NO: 183511

SEQ ID NO: 639771 - RNA, 64 nt, Homo Sapiens; identical to SEQ ID NO: 183512

SEQ ID NO: 639772 - RNA, 64 nt, Homo Sapiens; identical to SEQ ID NO: 183513

SEQ ID NO: 639773 - RNA, 64 nt, Homo Sapiens; identical to SEQ ID NO: 183514

SEQ ID NO: 639774 - RNA, 64 nt, Homo Sapiens; identical to SEQ ID NO: 183515

SEQ ID NO: 639775 - RNA, 64 nt, Homo Sapiens; identical to SEQ ID NO: 183516

SEQ ID NO: 639776 - RNA, 64 nt, Homo Sapiens; identical to SEQ ID NO: 183517

SEQ ID NO: 639777 - RNA, 64 nt, Homo Sapiens; identical to SEQ ID NO: 183518

SEQ ID NO: 639778 - RNA, 64 nt, Homo Sapiens; identical to SEQ ID NO: 183519

SEQ ID NO: 639779 - RNA, 64 nt, Homo Sapiens; identical to SEQ ID NO: 183520

SEQ ID NO: 639780 - RNA, 64 nt, Homo Sapiens; identical to SEQ ID NO: 183521

SEQ ID NO: 639781 - RNA, 64 nt, Homo Sapiens; identical to SEQ ID NO: 183522

SEQ ID NO: 639782 - RNA, 64 nt, Homo Sapiens; identical to SEQ ID NO: 183523

SEQ ID NO: 639783 - RNA, 64 nt, Homo Sapiens; identical to SEQ ID NO: 183524

SEQ ID NO: 639784 - RNA, 64 nt, Homo Sapiens; identical to SEQ ID NO: 183525

SEQ ID NO: 639785 - RNA, 64 nt, Homo Sapiens; identical to SEQ ID NO: 183526

SEQ ID NO: 639786 - RNA, 64 nt, Homo Sapiens; identical to SEQ ID NO: 183527

SEQ ID NO: 639787 - RNA, 64 nt, Homo Sapiens; identical to SEQ ID NO: 183528

SEQ ID NO: 639788 - RNA, 64 nt, Homo Sapiens; identical to SEQ ID NO: 183529

SEQ ID NO: 639789 - RNA, 64 nt, Homo Sapiens; identical to SEQ ID NO: 183530

SEQ ID NO: 639790 - RNA, 64 nt, Homo Sapiens; identical to SEQ ID NO: 183531

SEQ ID NO: 639791 - RNA, 64 nt, Homo Sapiens; identical to SEQ ID NO: 183532

SEQ ID NO: 639792 - RNA, 64 nt, Homo Sapiens; identical to SEQ ID NO: 183533

SEQ ID NO: 639793 - RNA, 64 nt, Homo Sapiens; identical to SEQ ID NO: 183534

SEQ ID NO: 639794 - RNA, 64 nt, Homo Sapiens; identical to SEQ ID NO: 183535

SEQ ID NO: 639795 - RNA, 64 nt, Homo Sapiens; identical to SEQ ID NO: 183536

SEQ ID NO: 639796 - RNA, 64 nt, Homo Sapiens; identical to SEQ ID NO: 183537

SEQ ID NO: 639797 - RNA, 64 nt, Homo Sapiens; identical to SEQ ID NO: 183538

SEQ ID NO: 639798 - RNA, 64 nt, Homo Sapiens; identical to SEQ ID NO: 183539

SEQ ID NO: 639799 - RNA, 64 nt, Homo Sapiens; identical to SEQ ID NO: 183540

SEQ ID NO: 639800 - RNA, 64 nt, Homo Sapiens; identical to SEQ ID NO: 183541

SEQ ID NO: 639801 - RNA, 64 nt, Homo Sapiens; identical to SEQ ID NO: 183542

SEQ ID NO: 639802 - RNA, 64 nt, Homo Sapiens; identical to SEQ ID NO: 183543

SEQ ID NO: 639803 - RNA, 64 nt, Homo Sapiens; identical to SEQ ID NO: 183544

SEQ ID NO: 639804 - RNA, 64 nt, Homo Sapiens; identical to SEQ ID NO: 183545

SEQ ID NO: 639805 - RNA, 64 nt, Homo Sapiens; identical to SEQ ID NO: 183546

SEQ ID NO: 639806 - RNA, 64 nt, Homo Sapiens; identical to SEQ ID NO: 183547

SEQ ID NO: 639807 - RNA, 64 nt, Homo Sapiens; identical to SEQ ID NO: 183548

SEQ ID NO: 639808 - RNA, 64 nt, Homo Sapiens; identical to SEQ ID NO: 183549

SEQ ID NO: 639809 - RNA, 64 nt, Homo Sapiens; identical to SEQ ID NO: 183550

SEQ ID NO: 639810 - RNA, 64 nt, Homo Sapiens; identical to SEQ ID NO: 183551

SEQ ID NO: 639811 - RNA, 64 nt, Homo Sapiens; identical to SEQ ID NO: 183552

SEQ ID NO: 639812 - RNA, 64 nt, Homo Sapiens; identical to SEQ ID NO: 183553

SEQ ID NO: 639813 - RNA, 64 nt, Homo Sapiens; identical to SEQ ID NO: 183554

SEQ ID NO: 639814 - RNA, 64 nt, Homo Sapiens; identical to SEQ ID NO: 183555

SEQ ID NO: 639815 - RNA, 64 nt, Homo Sapiens; identical to SEQ ID NO: 183556

SEQ ID NO: 639816 - RNA, 64 nt, Homo Sapiens; identical to SEQ ID NO: 183557

SEQ ID NO: 639817 - RNA, 64 nt, Homo Sapiens; identical to SEQ ID NO: 183558

SEQ ID NO: 639818 - RNA, 64 nt, Homo Sapiens; identical to SEQ ID NO: 183559

SEQ ID NO: 639819 - RNA, 64 nt, Homo Sapiens; identical to SEQ ID NO: 183560

SEQ ID NO: 639820 - RNA, 64 nt, Homo Sapiens; identical to SEQ ID NO: 183561

SEQ ID NO: 639821 - RNA, 64 nt, Homo Sapiens; identical to SEQ ID NO: 183562

SEQ ID NO: 639822 - RNA, 64 nt, Homo Sapiens; identical to SEQ ID NO: 183563

SEQ ID NO: 639823 - RNA, 64 nt, Homo Sapiens; identical to SEQ ID NO: 183564

SEQ ID NO: 639824 - RNA, 64 nt, Homo Sapiens; identical to SEQ ID NO: 183565

SEQ ID NO: 639825 - RNA, 64 nt, Homo Sapiens; identical to SEQ ID NO: 183566

SEQ ID NO: 639826 - RNA, 64 nt, Homo Sapiens; identical to SEQ ID NO: 183567

SEQ ID NO: 639827 - RNA, 64 nt, Homo Sapiens; identical to SEQ ID NO: 183568

SEQ ID NO: 639828 - RNA, 64 nt, Homo Sapiens; identical to SEQ ID NO: 183569

SEQ ID NO: 639829 - RNA, 64 nt, Homo Sapiens; identical to SEQ ID NO: 183570

SEQ ID NO: 639830 - RNA, 64 nt, Homo Sapiens; identical to SEQ ID NO: 183571

SEQ ID NO: 639831 - RNA, 64 nt, Homo Sapiens; identical to SEQ ID NO: 183572

SEQ ID NO: 639832 - RNA, 64 nt, Homo Sapiens; identical to SEQ ID NO: 183573

SEQ ID NO: 639833 - RNA, 64 nt, Homo Sapiens; identical to SEQ ID NO: 183574

SEQ ID NO: 639834 - RNA, 64 nt, Homo Sapiens; identical to SEQ ID NO: 183575

SEQ ID NO: 639835 - RNA, 64 nt, Homo Sapiens; identical to SEQ ID NO: 183576

SEQ ID NO: 639836 - RNA, 64 nt, Homo Sapiens; identical to SEQ ID NO: 183577

SEQ ID NO: 639837 - RNA, 64 nt, Homo Sapiens; identical to SEQ ID NO: 183578

SEQ ID NO: 639838 - RNA, 64 nt, Homo Sapiens; identical to SEQ ID NO: 183579

SEQ ID NO: 639839 - RNA, 64 nt, Homo Sapiens; identical to SEQ ID NO: 183580

SEQ ID NO: 639840 - RNA, 64 nt, Homo Sapiens; identical to SEQ ID NO: 183581

SEQ ID NO: 639841 - RNA, 64 nt, Homo Sapiens; identical to SEQ ID NO: 183582

SEQ ID NO: 639842 - RNA, 64 nt, Homo Sapiens; identical to SEQ ID NO: 183583

SEQ ID NO: 639843 - RNA, 64 nt, Homo Sapiens; identical to SEQ ID NO: 183584

SEQ ID NO: 639844 - RNA, 64 nt, Homo Sapiens; identical to SEQ ID NO: 183585

SEQ ID NO: 639845 - RNA, 64 nt, Homo Sapiens; identical to SEQ ID NO: 183586

SEQ ID NO: 639846 - RNA, 64 nt, Homo Sapiens; identical to SEQ ID NO: 183587

SEQ ID NO: 639847 - RNA, 64 nt, Homo Sapiens; identical to SEQ ID NO: 183588

SEQ ID NO: 639848 - RNA, 64 nt, Homo Sapiens; identical to SEQ ID NO: 183589

SEQ ID NO: 639849 - RNA, 64 nt, Homo Sapiens; identical to SEQ ID NO: 183590

SEQ ID NO: 639850 - RNA, 64 nt, Homo Sapiens; identical to SEQ ID NO: 183591

SEQ ID NO: 639851 - RNA, 64 nt, Homo Sapiens; identical to SEQ ID NO: 183592

SEQ ID NO: 639852 - RNA, 64 nt, Homo Sapiens; identical to SEQ ID NO: 183593

SEQ ID NO: 639853 - RNA, 64 nt, Homo Sapiens; identical to SEQ ID NO: 183594

SEQ ID NO: 639854 - RNA, 64 nt, Homo Sapiens; identical to SEQ ID NO: 183595

SEQ ID NO: 639855 - RNA, 64 nt, Homo Sapiens; identical to SEQ ID NO: 183596

SEQ ID NO: 639856 - RNA, 64 nt, Homo Sapiens; identical to SEQ ID NO: 183597

SEQ ID NO: 639857 - RNA, 64 nt, Homo Sapiens; identical to SEQ ID NO: 183598

SEQ ID NO: 639858 - RNA, 64 nt, Homo Sapiens; identical to SEQ ID NO: 183599

SEQ ID NO: 639859 - RNA, 64 nt, Homo Sapiens; identical to SEQ ID NO: 183600

SEQ ID NO: 639860 - RNA, 64 nt, Homo Sapiens; identical to SEQ ID NO: 183601

SEQ ID NO: 639861 - RNA, 64 nt, Homo Sapiens; identical to SEQ ID NO: 183602

SEQ ID NO: 639862 - RNA, 64 nt, Homo Sapiens; identical to SEQ ID NO: 183603

SEQ ID NO: 639863 - RNA, 64 nt, Homo Sapiens; identical to SEQ ID NO: 541607

SEQ ID NO: 639864 - RNA, 64 nt, Homo Sapiens; identical to SEQ ID NO: 541608

SEQ ID NO: 639865 - RNA, 64 nt, Homo Sapiens; identical to SEQ ID NO: 541609

SEQ ID NO: 639866 - RNA, 64 nt, Homo Sapiens; identical to SEQ ID NO: 541610

SEQ ID NO: 639867 - RNA, 64 nt, Homo Sapiens; identical to SEQ ID NO: 345901

SEQ ID NO: 639868 - RNA, 64 nt, Homo Sapiens; identical to SEQ ID NO: 345902

SEQ ID NO: 639869 - RNA, 64 nt, Homo Sapiens; identical to SEQ ID NO: 345903

SEQ ID NO: 639870 - RNA, 64 nt, Homo Sapiens; identical to SEQ ID NO: 345904

SEQ ID NO: 639871 - RNA, 64 nt, Homo Sapiens; identical to SEQ ID NO: 345905

SEQ ID NO: 639872 - RNA, 64 nt, Homo Sapiens; identical to SEQ ID NO: 345906

SEQ ID NO: 639873 - RNA, 64 nt, Homo Sapiens; identical to SEQ ID NO: 345907

SEQ ID NO: 639874 - RNA, 64 nt, Homo Sapiens; identical to SEQ ID NO: 345908

SEQ ID NO: 639875 - RNA, 64 nt, Homo Sapiens; identical to SEQ ID NO: 345909

SEQ ID NO: 639876 - RNA, 64 nt, Homo Sapiens; identical to SEQ ID NO: 345910

SEQ ID NO: 639877 - RNA, 64 nt, Homo Sapiens; identical to SEQ ID NO: 345911

SEQ ID NO: 639878 - RNA, 64 nt, Homo Sapiens; identical to SEQ ID NO: 345912

SEQ ID NO: 639879 - RNA, 64 nt, Homo Sapiens; identical to SEQ ID NO: 345913

SEQ ID NO: 639880 - RNA, 64 nt, Homo Sapiens; identical to SEQ ID NO: 345914

SEQ ID NO: 639881 - RNA, 64 nt, Homo Sapiens; identical to SEQ ID NO: 345915

SEQ ID NO: 639882 - RNA, 64 nt, Homo Sapiens; identical to SEQ ID NO: 345916

SEQ ID NO: 639883 - RNA, 64 nt, Homo Sapiens; identical to SEQ ID NO: 345917

SEQ ID NO: 639884 - RNA, 64 nt, Homo Sapiens; identical to SEQ ID NO: 345918

SEQ ID NO: 639885 - RNA, 64 nt, Homo Sapiens; identical to SEQ ID NO: 345919

SEQ ID NO: 639886 - RNA, 64 nt, Homo Sapiens; identical to SEQ ID NO: 345920

SEQ ID NO: 639887 - RNA, 64 nt, Homo Sapiens; identical to SEQ ID NO: 345921

SEQ ID NO: 639888 - RNA, 64 nt, Homo Sapiens; identical to SEQ ID NO: 345922

SEQ ID NO: 639889 - RNA, 64 nt, Homo Sapiens; identical to SEQ ID NO: 345923

SEQ ID NO: 639890 - RNA, 64 nt, Homo Sapiens; identical to SEQ ID NO: 345924

SEQ ID NO: 639891 - RNA, 64 nt, Homo Sapiens; identical to SEQ ID NO: 345925

SEQ ID NO: 639892 - RNA, 64 nt, Homo Sapiens; identical to SEQ ID NO: 345926

SEQ ID NO: 639893 - RNA, 64 nt, Homo Sapiens; identical to SEQ ID NO: 345927

SEQ ID NO: 639894 - RNA, 64 nt, Homo Sapiens; identical to SEQ ID NO: 345928

SEQ ID NO: 639895 - RNA, 64 nt, Homo Sapiens; identical to SEQ ID NO: 345929

SEQ ID NO: 639896 - RNA, 64 nt, Homo Sapiens; identical to SEQ ID NO: 345930

SEQ ID NO: 639897 - RNA, 64 nt, Homo Sapiens; identical to SEQ ID NO: 345931

SEQ ID NO: 639898 - RNA, 64 nt, Homo Sapiens; identical to SEQ ID NO: 345932

SEQ ID NO: 639899 - RNA, 64 nt, Homo Sapiens; identical to SEQ ID NO: 345933

SEQ ID NO: 639900 - RNA, 64 nt, Homo Sapiens; identical to SEQ ID NO: 345934

SEQ ID NO: 639901 - RNA, 64 nt, Homo Sapiens; identical to SEQ ID NO: 345935

SEQ ID NO: 639902 - RNA, 64 nt, Homo Sapiens; identical to SEQ ID NO: 345936

SEQ ID NO: 639903 - RNA, 64 nt, Homo Sapiens; identical to SEQ ID NO: 345937

SEQ ID NO: 639904 - RNA, 64 nt, Homo Sapiens; identical to SEQ ID NO: 345938

SEQ ID NO: 639905 - RNA, 64 nt, Homo Sapiens; identical to SEQ ID NO: 345939

SEQ ID NO: 639906 - RNA, 64 nt, Homo Sapiens; identical to SEQ ID NO: 345940

SEQ ID NO: 639907 - RNA, 64 nt, Homo Sapiens; identical to SEQ ID NO: 345941

SEQ ID NO: 639908 - RNA, 64 nt, Homo Sapiens; identical to SEQ ID NO: 345942

SEQ ID NO: 639909 - RNA, 64 nt, Homo Sapiens; identical to SEQ ID NO: 345943

SEQ ID NO: 639910 - RNA, 64 nt, Homo Sapiens; identical to SEQ ID NO: 345944

SEQ ID NO: 639911 - RNA, 64 nt, Homo Sapiens; identical to SEQ ID NO: 345945

SEQ ID NO: 639912 - RNA, 64 nt, Homo Sapiens; identical to SEQ ID NO: 345946

SEQ ID NO: 639913 - RNA, 64 nt, Homo Sapiens; identical to SEQ ID NO: 345947

SEQ ID NO: 639914 - RNA, 64 nt, Homo Sapiens; identical to SEQ ID NO: 345948

SEQ ID NO: 639915 - RNA, 64 nt, Homo Sapiens; identical to SEQ ID NO: 345949

SEQ ID NO: 639916 - RNA, 64 nt, Homo Sapiens; identical to SEQ ID NO: 345950

SEQ ID NO: 639917 - RNA, 64 nt, Homo Sapiens; identical to SEQ ID NO: 345951

SEQ ID NO: 639918 - RNA, 64 nt, Homo Sapiens; identical to SEQ ID NO: 345952

SEQ ID NO: 639919 - RNA, 64 nt, Homo Sapiens; identical to SEQ ID NO: 345953

SEQ ID NO: 639920 - RNA, 64 nt, Homo Sapiens; identical to SEQ ID NO: 345954

SEQ ID NO: 639921 - RNA, 64 nt, Homo Sapiens; identical to SEQ ID NO: 345955

SEQ ID NO: 639922 - RNA, 64 nt, Homo Sapiens; identical to SEQ ID NO: 345956

SEQ ID NO: 639923 - RNA, 64 nt, Homo Sapiens; identical to SEQ ID NO: 345957

SEQ ID NO: 639924 - RNA, 64 nt, Homo Sapiens; identical to SEQ ID NO: 345958

SEQ ID NO: 639925 - RNA, 64 nt, Homo Sapiens; identical to SEQ ID NO: 345959

SEQ ID NO: 639926 - RNA, 64 nt, Homo Sapiens; identical to SEQ ID NO: 345960

SEQ ID NO: 639927 - RNA, 64 nt, Homo Sapiens; identical to SEQ ID NO: 345961

SEQ ID NO: 639928 - RNA, 64 nt, Homo Sapiens; identical to SEQ ID NO: 345962

SEQ ID NO: 639929 - RNA, 64 nt, Homo Sapiens; identical to SEQ ID NO: 345963

SEQ ID NO: 639930 - RNA, 64 nt, Homo Sapiens; identical to SEQ ID NO: 345964

SEQ ID NO: 639931 - RNA, 64 nt, Homo Sapiens; identical to SEQ ID NO: 345965

SEQ ID NO: 639932 - RNA, 64 nt, Homo Sapiens; identical to SEQ ID NO: 345966

SEQ ID NO: 639933 - RNA, 64 nt, Homo Sapiens; identical to SEQ ID NO: 345967

SEQ ID NO: 639934 - RNA, 50 nt, Homo Sapiens; identical to SEQ ID NO: 345968

SEQ ID NO: 639935 - RNA, 64 nt, Homo Sapiens; identical to SEQ ID NO: 345969

SEQ ID NO: 639936 - RNA, 64 nt, Homo Sapiens; identical to SEQ ID NO: 345970

SEQ ID NO: 639937 - RNA, 64 nt, Homo Sapiens; identical to SEQ ID NO: 345971

SEQ ID NO: 639938 - RNA, 64 nt, Homo Sapiens; identical to SEQ ID NO: 345972

SEQ ID NO: 639939 - RNA, 64 nt, Homo Sapiens; identical to SEQ ID NO: 345973

SEQ ID NO: 639940 - RNA, 64 nt, Homo Sapiens; identical to SEQ ID NO: 345974

SEQ ID NO: 639941 - RNA, 64 nt, Homo Sapiens; identical to SEQ ID NO: 345975

SEQ ID NO: 639942 - RNA, 64 nt, Homo Sapiens; identical to SEQ ID NO: 345976

SEQ ID NO: 639943 - RNA, 64 nt, Homo Sapiens; identical to SEQ ID NO: 345977

SEQ ID NO: 639944 - RNA, 64 nt, Homo Sapiens; identical to SEQ ID NO: 345978

SEQ ID NO: 639945 - RNA, 64 nt, Homo Sapiens; identical to SEQ ID NO: 345979

SEQ ID NO: 639946 - RNA, 64 nt, Homo Sapiens; identical to SEQ ID NO: 345980

SEQ ID NO: 639947 - RNA, 64 nt, Homo Sapiens; identical to SEQ ID NO: 345981

SEQ ID NO: 639948 - RNA, 64 nt, Homo Sapiens; identical to SEQ ID NO: 345982

SEQ ID NO: 639949 - RNA, 64 nt, Homo Sapiens; identical to SEQ ID NO: 345983

SEQ ID NO: 639950 - RNA, 64 nt, Homo Sapiens; identical to SEQ ID NO: 345984

SEQ ID NO: 639951 - RNA, 64 nt, Homo Sapiens; identical to SEQ ID NO: 345985

SEQ ID NO: 639952 - RNA, 64 nt, Homo Sapiens; identical to SEQ ID NO: 345986

SEQ ID NO: 639953 - RNA, 64 nt, Homo Sapiens; identical to SEQ ID NO: 345987

SEQ ID NO: 639954 - RNA, 64 nt, Homo Sapiens; identical to SEQ ID NO: 345988

SEQ ID NO: 639955 - RNA, 64 nt, Homo Sapiens; identical to SEQ ID NO: 345989

SEQ ID NO: 639956 - RNA, 64 nt, Homo Sapiens; identical to SEQ ID NO: 345990

SEQ ID NO: 639957 - RNA, 64 nt, Homo Sapiens; identical to SEQ ID NO: 345991

SEQ ID NO: 639958 - RNA, 64 nt, Homo Sapiens; identical to SEQ ID NO: 345992

SEQ ID NO: 639959 - RNA, 51 nt, Homo Sapiens; identical to SEQ ID NO: 345993

SEQ ID NO: 639960 - RNA, 64 nt, Homo Sapiens; identical to SEQ ID NO: 345994

SEQ ID NO: 639961 - RNA, 64 nt, Homo Sapiens; identical to SEQ ID NO: 345995

SEQ ID NO: 639962 - RNA, 64 nt, Homo Sapiens; identical to SEQ ID NO: 345996

SEQ ID NO: 639963 - RNA, 64 nt, Homo Sapiens; identical to SEQ ID NO: 345997

SEQ ID NO: 639964 - RNA, 64 nt, Homo Sapiens; identical to SEQ ID NO: 345998

SEQ ID NO: 639965 - RNA, 64 nt, Homo Sapiens; identical to SEQ ID NO: 345999

SEQ ID NO: 639966 - RNA, 64 nt, Homo Sapiens; identical to SEQ ID NO: 346000

SEQ ID NO: 639967 - RNA, 64 nt, Homo Sapiens; identical to SEQ ID NO: 346001

SEQ ID NO: 639968 - RNA, 64 nt, Homo Sapiens; identical to SEQ ID NO: 346002

SEQ ID NO: 639969 - RNA, 64 nt, Homo Sapiens; identical to SEQ ID NO: 346003

SEQ ID NO: 639970 - RNA, 64 nt, Homo Sapiens; identical to SEQ ID NO: 346004

SEQ ID NO: 639971 - RNA, 64 nt, Homo Sapiens; identical to SEQ ID NO: 346005

SEQ ID NO: 639972 - RNA, 64 nt, Homo Sapiens; identical to SEQ ID NO: 346006

SEQ ID NO: 639973 - RNA, 64 nt, Homo Sapiens; identical to SEQ ID NO: 346007

SEQ ID NO: 639974 - RNA, 64 nt, Homo Sapiens; identical to SEQ ID NO: 346008

SEQ ID NO: 639975 - RNA, 64 nt, Homo Sapiens; identical to SEQ ID NO: 346009

SEQ ID NO: 639976 - RNA, 64 nt, Homo Sapiens; identical to SEQ ID NO: 346010

SEQ ID NO: 639977 - RNA, 64 nt, Homo Sapiens; identical to SEQ ID NO: 346011

SEQ ID NO: 639978 - RNA, 64 nt, Homo Sapiens; identical to SEQ ID NO: 346012

SEQ ID NO: 639979 - RNA, 64 nt, Homo Sapiens; identical to SEQ ID NO: 346013

SEQ ID NO: 639980 - RNA, 64 nt, Homo Sapiens; identical to SEQ ID NO: 346014

SEQ ID NO: 639981 - RNA, 64 nt, Homo Sapiens; identical to SEQ ID NO: 346015

SEQ ID NO: 639982 - RNA, 64 nt, Homo Sapiens; identical to SEQ ID NO: 346016

SEQ ID NO: 639983 - RNA, 64 nt, Homo Sapiens; identical to SEQ ID NO: 346017

SEQ ID NO: 639984 - RNA, 64 nt, Homo Sapiens; identical to SEQ ID NO: 346018

SEQ ID NO: 639985 - RNA, 64 nt, Homo Sapiens; identical to SEQ ID NO: 346019

SEQ ID NO: 639986 - RNA, 64 nt, Homo Sapiens; identical to SEQ ID NO: 346020

SEQ ID NO: 639987 - RNA, 64 nt, Homo Sapiens; identical to SEQ ID NO: 346021

SEQ ID NO: 639988 - RNA, 64 nt, Homo Sapiens; identical to SEQ ID NO: 346022

SEQ ID NO: 639989 - RNA, 64 nt, Homo Sapiens; identical to SEQ ID NO: 346023

SEQ ID NO: 639990 - RNA, 64 nt, Homo Sapiens; identical to SEQ ID NO: 346024

SEQ ID NO: 639991 - RNA, 64 nt, Homo Sapiens; identical to SEQ ID NO: 346025

SEQ ID NO: 639992 - RNA, 64 nt, Homo Sapiens; identical to SEQ ID NO: 346026

SEQ ID NO: 639993 - RNA, 64 nt, Homo Sapiens; identical to SEQ ID NO: 346027

SEQ ID NO: 639994 - RNA, 64 nt, Homo Sapiens; identical to SEQ ID NO: 346028

SEQ ID NO: 639995 - RNA, 64 nt, Homo Sapiens; identical to SEQ ID NO: 346029

SEQ ID NO: 639996 - RNA, 64 nt, Homo Sapiens; identical to SEQ ID NO: 346030

SEQ ID NO: 639997 - RNA, 64 nt, Homo Sapiens; identical to SEQ ID NO: 346031

SEQ ID NO: 639998 - RNA, 64 nt, Homo Sapiens; identical to SEQ ID NO: 346032

SEQ ID NO: 639999 - RNA, 64 nt, Homo Sapiens; identical to SEQ ID NO: 346033

SEQ ID NO: 640000 - RNA, 64 nt, Homo Sapiens; identical to SEQ ID NO: 346034

SEQ ID NO: 640001 - RNA, 64 nt, Homo Sapiens; identical to SEQ ID NO: 346035

SEQ ID NO: 640002 - RNA, 64 nt, Homo Sapiens; identical to SEQ ID NO: 346036

SEQ ID NO: 640003 - RNA, 64 nt, Homo Sapiens; identical to SEQ ID NO: 346037

SEQ ID NO: 640004 - RNA, 64 nt, Homo Sapiens; identical to SEQ ID NO: 346038

SEQ ID NO: 640005 - RNA, 64 nt, Homo Sapiens; identical to SEQ ID NO: 346039

SEQ ID NO: 640006 - RNA, 64 nt, Homo Sapiens; identical to SEQ ID NO: 346040

SEQ ID NO: 640007 - RNA, 64 nt, Homo Sapiens; identical to SEQ ID NO: 346041

SEQ ID NO: 640008 - RNA, 64 nt, Homo Sapiens; identical to SEQ ID NO: 346042

SEQ ID NO: 640009 - RNA, 64 nt, Homo Sapiens; identical to SEQ ID NO: 346043

SEQ ID NO: 640010 - RNA, 64 nt, Homo Sapiens; identical to SEQ ID NO: 346044

SEQ ID NO: 640011 - RNA, 64 nt, Homo Sapiens; identical to SEQ ID NO: 346045

SEQ ID NO: 640012 - RNA, 64 nt, Homo Sapiens; identical to SEQ ID NO: 346046

SEQ ID NO: 640013 - RNA, 64 nt, Homo Sapiens; identical to SEQ ID NO: 346047

SEQ ID NO: 640014 - RNA, 64 nt, Homo Sapiens; identical to SEQ ID NO: 346048

SEQ ID NO: 640015 - RNA, 64 nt, Homo Sapiens; identical to SEQ ID NO: 346049

SEQ ID NO: 640016 - RNA, 64 nt, Homo Sapiens; identical to SEQ ID NO: 346050

SEQ ID NO: 640017 - RNA, 64 nt, Homo Sapiens; identical to SEQ ID NO: 346051

SEQ ID NO: 640018 - RNA, 64 nt, Homo Sapiens; identical to SEQ ID NO: 346052

SEQ ID NO: 640019 - RNA, 64 nt, Homo Sapiens; identical to SEQ ID NO: 346053

SEQ ID NO: 640020 - RNA, 64 nt, Homo Sapiens; identical to SEQ ID NO: 346054

SEQ ID NO: 640021 - RNA, 64 nt, Homo Sapiens; identical to SEQ ID NO: 346055

SEQ ID NO: 640022 - RNA, 64 nt, Homo Sapiens; identical to SEQ ID NO: 346056

SEQ ID NO: 640023 - RNA, 64 nt, Homo Sapiens; identical to SEQ ID NO: 346057

SEQ ID NO: 640024 - RNA, 64 nt, Homo Sapiens; identical to SEQ ID NO: 346058

SEQ ID NO: 640025 - RNA, 64 nt, Homo Sapiens; identical to SEQ ID NO: 346059

SEQ ID NO: 640026 - RNA, 64 nt, Homo Sapiens; identical to SEQ ID NO: 346060

SEQ ID NO: 640027 - RNA, 64 nt, Homo Sapiens; identical to SEQ ID NO: 346061

SEQ ID NO: 640028 - RNA, 64 nt, Homo Sapiens; identical to SEQ ID NO: 346062

SEQ ID NO: 640029 - RNA, 64 nt, Homo Sapiens; identical to SEQ ID NO: 346063

SEQ ID NO: 640030 - RNA, 64 nt, Homo Sapiens; identical to SEQ ID NO: 346064

SEQ ID NO: 640031 - RNA, 64 nt, Homo Sapiens; identical to SEQ ID NO: 346065

SEQ ID NO: 640032 - RNA, 64 nt, Homo Sapiens; identical to SEQ ID NO: 346066

SEQ ID NO: 640033 - RNA, 64 nt, Homo Sapiens; identical to SEQ ID NO: 346067

SEQ ID NO: 640034 - RNA, 64 nt, Homo Sapiens; identical to SEQ ID NO: 346068

SEQ ID NO: 640035 - RNA, 64 nt, Homo Sapiens; identical to SEQ ID NO: 346069

SEQ ID NO: 640036 - RNA, 64 nt, Homo Sapiens; identical to SEQ ID NO: 346070

SEQ ID NO: 640037 - RNA, 64 nt, Homo Sapiens; identical to SEQ ID NO: 346071

SEQ ID NO: 640038 - RNA, 64 nt, Homo Sapiens; identical to SEQ ID NO: 346072

SEQ ID NO: 640039 - RNA, 64 nt, Homo Sapiens; identical to SEQ ID NO: 346073

SEQ ID NO: 640040 - RNA, 64 nt, Homo Sapiens; identical to SEQ ID NO: 346074

SEQ ID NO: 640041 - RNA, 64 nt, Homo Sapiens; identical to SEQ ID NO: 346075

SEQ ID NO: 640042 - RNA, 64 nt, Homo Sapiens; identical to SEQ ID NO: 346076

SEQ ID NO: 640043 - RNA, 64 nt, Homo Sapiens; identical to SEQ ID NO: 346077

SEQ ID NO: 640044 - RNA, 64 nt, Homo Sapiens; identical to SEQ ID NO: 346078

SEQ ID NO: 640045 - RNA, 64 nt, Homo Sapiens; identical to SEQ ID NO: 346079

SEQ ID NO: 640046 - RNA, 64 nt, Homo Sapiens; identical to SEQ ID NO: 346080

SEQ ID NO: 640047 - RNA, 64 nt, Homo Sapiens; identical to SEQ ID NO: 346081

SEQ ID NO: 640048 - RNA, 64 nt, Homo Sapiens; identical to SEQ ID NO: 346082

SEQ ID NO: 640049 - RNA, 64 nt, Homo Sapiens; identical to SEQ ID NO: 346083

SEQ ID NO: 640050 - RNA, 64 nt, Homo Sapiens; identical to SEQ ID NO: 346084

SEQ ID NO: 640051 - RNA, 64 nt, Homo Sapiens; identical to SEQ ID NO: 346085

SEQ ID NO: 640052 - RNA, 64 nt, Homo Sapiens; identical to SEQ ID NO: 346086

SEQ ID NO: 640053 - RNA, 64 nt, Homo Sapiens; identical to SEQ ID NO: 346087

SEQ ID NO: 640054 - RNA, 64 nt, Homo Sapiens; identical to SEQ ID NO: 346088

SEQ ID NO: 640055 - RNA, 64 nt, Homo Sapiens; identical to SEQ ID NO: 346089

SEQ ID NO: 640056 - RNA, 64 nt, Homo Sapiens; identical to SEQ ID NO: 346090

SEQ ID NO: 640057 - RNA, 64 nt, Homo Sapiens; identical to SEQ ID NO: 346091

SEQ ID NO: 640058 - RNA, 64 nt, Homo Sapiens; identical to SEQ ID NO: 346092

SEQ ID NO: 640059 - RNA, 64 nt, Homo Sapiens; identical to SEQ ID NO: 346093

SEQ ID NO: 640060 - RNA, 64 nt, Homo Sapiens; identical to SEQ ID NO: 346094

SEQ ID NO: 640061 - RNA, 64 nt, Homo Sapiens; identical to SEQ ID NO: 346095

SEQ ID NO: 640062 - RNA, 59 nt, Homo Sapiens; identical to SEQ ID NO: 346096

SEQ ID NO: 640063 - RNA, 64 nt, Homo Sapiens; identical to SEQ ID NO: 346097

SEQ ID NO: 640064 - RNA, 64 nt, Homo Sapiens; identical to SEQ ID NO: 346098

SEQ ID NO: 640065 - RNA, 64 nt, Homo Sapiens; identical to SEQ ID NO: 346099

SEQ ID NO: 640066 - RNA, 64 nt, Homo Sapiens; identical to SEQ ID NO: 346100

SEQ ID NO: 640067 - RNA, 64 nt, Homo Sapiens; identical to SEQ ID NO: 346101

SEQ ID NO: 640068 - RNA, 64 nt, Homo Sapiens; identical to SEQ ID NO: 346102

SEQ ID NO: 640069 - RNA, 64 nt, Homo Sapiens; identical to SEQ ID NO: 346103

SEQ ID NO: 640070 - RNA, 64 nt, Homo Sapiens; identical to SEQ ID NO: 346104

SEQ ID NO: 640071 - RNA, 64 nt, Homo Sapiens; identical to SEQ ID NO: 346105

SEQ ID NO: 640072 - RNA, 64 nt, Homo Sapiens; identical to SEQ ID NO: 346106

SEQ ID NO: 640073 - RNA, 64 nt, Homo Sapiens; identical to SEQ ID NO: 346107

SEQ ID NO: 640074 - RNA, 64 nt, Homo Sapiens; identical to SEQ ID NO: 346108

SEQ ID NO: 640075 - RNA, 64 nt, Homo Sapiens; identical to SEQ ID NO: 346109

SEQ ID NO: 640076 - RNA, 64 nt, Homo Sapiens; identical to SEQ ID NO: 346110

SEQ ID NO: 640077 - RNA, 64 nt, Homo Sapiens; identical to SEQ ID NO: 346111

SEQ ID NO: 640078 - RNA, 64 nt, Homo Sapiens; identical to SEQ ID NO: 346112

SEQ ID NO: 640079 - RNA, 64 nt, Homo Sapiens; identical to SEQ ID NO: 346113

SEQ ID NO: 640080 - RNA, 64 nt, Homo Sapiens; identical to SEQ ID NO: 346114

SEQ ID NO: 640081 - RNA, 64 nt, Homo Sapiens; identical to SEQ ID NO: 346115

SEQ ID NO: 640082 - RNA, 64 nt, Homo Sapiens; identical to SEQ ID NO: 346116

SEQ ID NO: 640083 - RNA, 64 nt, Homo Sapiens
uugcucucuuuugucuuggucgcugcuucuagaaucuaugcaggggauagcagugaggucagaa

SEQ ID NO: 640084 - RNA, 64 nt, Homo Sapiens
uguggcccacagcauagcacuggggacagagcgcucuaugcaggugaggcguaugagaacagca

SEQ ID NO: 640085 - RNA, 64 nt, Homo Sapiens
acacuauauuuccauguaauuucuuaaccugcagucuaugcacagaaagaucuugaugcagggu

SEQ ID NO: 640086 - RNA, 64 nt, Homo Sapiens
guaugacuucuauuuuaaugcauagugaguacgcucuaugcauaaaugcaacuaagaaaauacu

SEQ ID NO: 640087 - RNA, 64 nt, Homo Sapiens
aguuggucaacuucaacucaauguuagcauauuuucuaugcagcggcuuaaacuugacuguugu

SEQ ID NO: 640088 - RNA, 64 nt, Homo Sapiens
ggcuuaaacuugacuguuguagugcuuuaucuucucuaugcacauaccauuugcaguuaccaua

SEQ ID NO: 640089 - RNA, 64 nt, Homo Sapiens
guucuucauaucaucacaacaaauucaugugguuucuaugcaaaguauucgaauuuugucuuua

SEQ ID NO: 640090 - RNA, 64 nt, Homo Sapiens
ccuacuaacaaauuauacuggaaaagguguuauaucuaugcaaaaaaagauguauuauaccagu

SEQ ID NO: 640091 - RNA, 64 nt, Homo Sapiens
accccuaaacucaggagucaacguguuuaccucuucuaugcaagccuugcuagacagccagguu

SEQ ID NO: 640092 - RNA, 64 nt, Homo Sapiens
ucgucuuuauguccgcccaccuagugcuuccacuucuaugcaaaugccuccaagccauucacuu

SEQ ID NO: 640093 - RNA, 64 nt, Homo Sapiens
cugagcugagccaggcuagcuggagccugggauuucuaugcaguggccccuuaggccagugaug

SEQ ID NO: 640094 - RNA, 64 nt, Homo Sapiens
aagagcuccccuacggaccagguauagagaaaggucuaugcagaaauagguuagaguuucccua

SEQ ID NO: 640095 - RNA, 64 nt, Homo Sapiens; identical to SEQ ID NO: 523234

SEQ ID NO: 640096 - RNA, 64 nt, Homo Sapiens; identical to SEQ ID NO: 523235

SEQ ID NO: 640097 - RNA, 64 nt, Homo Sapiens; identical to SEQ ID NO: 523236

SEQ ID NO: 640098 - RNA, 64 nt, Homo Sapiens; identical to SEQ ID NO: 523237

SEQ ID NO: 640099 - RNA, 64 nt, Homo Sapiens; identical to SEQ ID NO: 523238

SEQ ID NO: 640100 - RNA, 64 nt, Homo Sapiens; identical to SEQ ID NO: 523239

SEQ ID NO: 640101 - RNA, 64 nt, Homo Sapiens; identical to SEQ ID NO: 523240

SEQ ID NO: 640102 - RNA, 64 nt, Homo Sapiens; identical to SEQ ID NO: 523241

SEQ ID NO: 640103 - RNA, 64 nt, Homo Sapiens
agccagauuaucugugugugcgguggugugcgugugcgugcaugugugaaugugagcagcauag

SEQ ID NO: 640104 - RNA, 64 nt, Homo Sapiens
gcauaguugauauuuacccacaaacaccuguauaugcgugcauauacaaccaaguggguagacc

SEQ ID NO: 640105 - RNA, 64 nt, Homo Sapiens
gcagaccuggugcugcaaagguuuccuccugggaugcgugcaagcagcaggaggcugccugugu

SEQ ID NO: 640106 - RNA, 64 nt, Homo Sapiens
cauuccucugggguugcugugggagcgugggcccugcgugcaguccgugagcgucccagaggcc

SEQ ID NO: 640107 - RNA, 64 nt, Homo Sapiens; identical to SEQ ID NO: 297037

SEQ ID NO: 640108 - RNA, 64 nt, Homo Sapiens; identical to SEQ ID NO: 297038

SEQ ID NO: 640109 - RNA, 64 nt, Homo Sapiens; identical to SEQ ID NO: 297039

SEQ ID NO: 640110 - RNA, 64 nt, Homo Sapiens; identical to SEQ ID NO: 297040

SEQ ID NO: 640111 - RNA, 64 nt, Homo Sapiens; identical to SEQ ID NO: 519022

SEQ ID NO: 640112 - RNA, 64 nt, Homo Sapiens; identical to SEQ ID NO: 519023

SEQ ID NO: 640113 - RNA, 64 nt, Homo Sapiens; identical to SEQ ID NO: 519024

SEQ ID NO: 640114 - RNA, 64 nt, Homo Sapiens; identical to SEQ ID NO: 519025

SEQ ID NO: 640115 - RNA, 64 nt, Homo Sapiens; identical to SEQ ID NO: 519026

SEQ ID NO: 640116 - RNA, 64 nt, Homo Sapiens; identical to SEQ ID NO: 519027

SEQ ID NO: 640117 - RNA, 64 nt, Homo Sapiens; identical to SEQ ID NO: 519028

SEQ ID NO: 640118 - RNA, 64 nt, Homo Sapiens; identical to SEQ ID NO: 519029

SEQ ID NO: 640119 - RNA, 64 nt, Homo Sapiens; identical to SEQ ID NO: 519030

SEQ ID NO: 640120 - RNA, 64 nt, Homo Sapiens; identical to SEQ ID NO: 519031

SEQ ID NO: 640121 - RNA, 64 nt, Homo Sapiens; identical to SEQ ID NO: 519032

SEQ ID NO: 640122 - RNA, 64 nt, Homo Sapiens; identical to SEQ ID NO: 519033

SEQ ID NO: 640123 - RNA, 64 nt, Homo Sapiens
ugugccuuccccuacucucuucucaucuucguauaugacgaagucagaaaacucaucaucaggc

SEQ ID NO: 640124 - RNA, 64 nt, Homo Sapiens
uugagcccaggaguucaagaccagccugggcuacaugacgaaacuccaucucuaucaaaaauac

SEQ ID NO: 640125 - RNA, 64 nt, Homo Sapiens
ccggucucuacuaaaaauacccagccuggccaacaugacgaaaccugaggucaggaguuuuaga

SEQ ID NO: 640126 - RNA, 64 nt, Homo Sapiens
auuggaguucugccauuugauuccuuuucccagcaugacgaaaaaaagaagcagaaguguaauu

SEQ ID NO: 640127 - RNA, 64 nt, Homo Sapiens
ccuucugccaccccagcagaagccuucauacaacaugacgaaacaagggaucauguugaagugu

SEQ ID NO: 640128 - RNA, 64 nt, Homo Sapiens
cugaggucaggaguucaagaccagccuggccaacaugacgaaaccccaucucuacuaaaaagac

SEQ ID NO: 640129 - RNA, 64 nt, Homo Sapiens
guccaauguaucucauuauuucuaaaucuuguuaaugacgaagaagagaaauuucccagccuau

SEQ ID NO: 640130 - RNA, 64 nt, Homo Sapiens
cccaucuccacaaaaaaauuacagcuuggacaucaugacgaaacuugagaacaggauuuugaga

SEQ ID NO: 640131 - RNA, 64 nt, Homo Sapiens
cguuucugacagcucccagcugggagaaaccaacaugacgaaaagacaaagaauacuggagaag

SEQ ID NO: 640132 - RNA, 64 nt, Homo Sapiens
aagucaccccugaacgccucagaugcagucacuuaugacgaaauaggaauucuccaguacggga

SEQ ID NO: 640133 - RNA, 64 nt, Homo Sapiens
uuaugaaaugugccuuuucucugucugggcugugaugacgaauaaaaaaaggucuccugcagau

SEQ ID NO: 640134 - RNA, 64 nt, Homo Sapiens
cgccaaaaacaauugcaacacaggcaaagauuucaugacgaagauaccauucaggacauaggca

SEQ ID NO: 640135 - RNA, 64 nt, Homo Sapiens
cgucauuuuuguauggauccuuucacuugaucauaugacgaaaugcuuauagagaguagcuccg

SEQ ID NO: 640136 - RNA, 64 nt, Homo Sapiens
uaaucuucaggauuucaagaccagccuagccaacaugacgaaaccccaucucuacugaaaauag

SEQ ID NO: 640137 - RNA, 64 nt, Homo Sapiens
cugaggucaggaguucgagaccaaccuggccaacaugacgaaacuccgucucuauuuaaaauac

SEQ ID NO: 640138 - RNA, 64 nt, Homo Sapiens
aaugaaucacggcaauuucuacgccaugagguuuaugacgaauacccagaggaaauuaugaauu

SEQ ID NO: 640139 - RNA, 64 nt, Homo Sapiens
auaagaaguccacacaagcaagccaaauuuuuagaugacgaaguccauaaauaacuagagaauu

SEQ ID NO: 640140 - RNA, 64 nt, Homo Sapiens
aaaaauuacgaaagaaaagaaaucucuaugcaaaaugacgaacaugguccuguggacuccucug

SEQ ID NO: 640141 - RNA, 64 nt, Homo Sapiens
cccgucucuacagagaauacgcagccugggcaacaugacgaaacuugagcccaggaguucgaga

SEQ ID NO: 640142 - RNA, 64 nt, Homo Sapiens
aagaaacagagauuuccaauucgccuuccuauguaugacgaaacguguuaaaauuugcaucacg

SEQ ID NO: 640143 - RNA, 64 nt, Homo Sapiens
uuauccacuccaucuucuagguuaucuuaguuguaugacgaacugauaaaucugucugacuggg

SEQ ID NO: 640144 - RNA, 64 nt, Homo Sapiens
gaugaacugcacauuguugaagcagaggccaugaaugacgaaggcaguccaauuaaaguaacac

SEQ ID NO: 640145 - RNA, 64 nt, Homo Sapiens
cgcuuguuuugggugcacaggagccccacugcugaugacgaacuaucucuaacuggucuugacc

SEQ ID NO: 640146 - RNA, 64 nt, Homo Sapiens
ugcucagcaacuccaccugcgcaucucucuccuaaugacgaagcucugauuuuuaagguagugg

SEQ ID NO: 640147 - RNA, 64 nt, Homo Sapiens
aacaugaauuagggggccuccaaggacaacccucaugacgaagcccucaugcaucaucagauga

SEQ ID NO: 640148 - RNA, 64 nt, Homo Sapiens
ggguauauauauuuucuuaucgcugacauacagaaugacgaaaacacgaugauaccagagucca

SEQ ID NO: 640149 - RNA, 64 nt, Homo Sapiens; identical to SEQ ID NO: 640148

SEQ ID NO: 640150 - RNA, 64 nt, Homo Sapiens
aaauuaaaauuuuaugacaguaucgaggcuugugaugacgaauccugcucuaaaauacacaagg

SEQ ID NO: 640151 - RNA, 64 nt, Homo Sapiens
cucuugagccaaacacuguguuucguuuggcucaaugacgaauguugaagaugcuuuuauguuc

SEQ ID NO: 640152 - RNA, 64 nt, Homo Sapiens
gaaguagugcaaacauagcuucacccaggcuggaaugacgaaguugggacagggucucacucug

SEQ ID NO: 640153 - RNA, 64 nt, Homo Sapiens
gaggcagggaauagaccucaagauguggugaacaaugacgaauucagccaaguggcgguagcac

SEQ ID NO: 640154 - RNA, 64 nt, Homo Sapiens
aaaaggccacguaugugccuugaauguagccaaaaugacgaacaacacccagaaaucugugauu

SEQ ID NO: 640155 - RNA, 64 nt, Homo Sapiens
gggccaguagacccccggagaagcaguaccgacaaugacgaagauaccagaucccuucccaacc

SEQ ID NO: 640156 - RNA, 64 nt, Homo Sapiens
aguaaggaucugcaaaucuugaaucguccucaaaaugacgaagcuugaauuguccucaagaugg

SEQ ID NO: 640157 - RNA, 64 nt, Homo Sapiens
cuuaauggguguacuuuuuugggcuugccagguaaugacgaaaauucuaaaaauuauaccccau

SEQ ID NO: 640158 - RNA, 61 nt, Homo Sapiens; identical to SEQ ID NO: 76426

SEQ ID NO: 640159 - RNA, 61 nt, Homo Sapiens; identical to SEQ ID NO: 76427

SEQ ID NO: 640160 - RNA, 61 nt, Homo Sapiens; identical to SEQ ID NO: 76428

SEQ ID NO: 640161 - RNA, 61 nt, Homo Sapiens; identical to SEQ ID NO: 76429

SEQ ID NO: 640162 - RNA, 61 nt, Homo Sapiens; identical to SEQ ID NO: 76430

SEQ ID NO: 640163 - RNA, 61 nt, Homo Sapiens; identical to SEQ ID NO: 76431

SEQ ID NO: 640164 - RNA, 61 nt, Homo Sapiens; identical to SEQ ID NO: 76432

SEQ ID NO: 640165 - RNA, 61 nt, Homo Sapiens; identical to SEQ ID NO: 76433

SEQ ID NO: 640166 - RNA, 61 nt, Homo Sapiens; identical to SEQ ID NO: 76434

SEQ ID NO: 640167 - RNA, 61 nt, Homo Sapiens; identical to SEQ ID NO: 76435

SEQ ID NO: 640168 - RNA, 61 nt, Homo Sapiens; identical to SEQ ID NO: 76436

SEQ ID NO: 640169 - RNA, 61 nt, Homo Sapiens; identical to SEQ ID NO: 76437

SEQ ID NO: 640170 - RNA, 61 nt, Homo Sapiens; identical to SEQ ID NO: 76438

SEQ ID NO: 640171 - RNA, 61 nt, Homo Sapiens; identical to SEQ ID NO: 76439

SEQ ID NO: 640172 - RNA, 61 nt, Homo Sapiens; identical to SEQ ID NO: 76440

SEQ ID NO: 640173 - RNA, 61 nt, Homo Sapiens; identical to SEQ ID NO: 76441

SEQ ID NO: 640174 - RNA, 61 nt, Homo Sapiens; identical to SEQ ID NO: 76442

SEQ ID NO: 640175 - RNA, 61 nt, Homo Sapiens; identical to SEQ ID NO: 76443

SEQ ID NO: 640176 - RNA, 61 nt, Homo Sapiens; identical to SEQ ID NO: 76444

SEQ ID NO: 640177 - RNA, 61 nt, Homo Sapiens; identical to SEQ ID NO: 76445

SEQ ID NO: 640178 - RNA, 61 nt, Homo Sapiens; identical to SEQ ID NO: 76446

SEQ ID NO: 640179 - RNA, 61 nt, Homo Sapiens; identical to SEQ ID NO: 76447

SEQ ID NO: 640180 - RNA, 61 nt, Homo Sapiens; identical to SEQ ID NO: 76448

SEQ ID NO: 640181 - RNA, 61 nt, Homo Sapiens; identical to SEQ ID NO: 76449

SEQ ID NO: 640182 - RNA, 61 nt, Homo Sapiens; identical to SEQ ID NO: 76450

SEQ ID NO: 640183 - RNA, 61 nt, Homo Sapiens; identical to SEQ ID NO: 76451

SEQ ID NO: 640184 - RNA, 61 nt, Homo Sapiens; identical to SEQ ID NO: 76452

SEQ ID NO: 640185 - RNA, 61 nt, Homo Sapiens; identical to SEQ ID NO: 76453

SEQ ID NO: 640186 - RNA, 61 nt, Homo Sapiens; identical to SEQ ID NO: 76454

SEQ ID NO: 640187 - RNA, 61 nt, Homo Sapiens; identical to SEQ ID NO: 76455

SEQ ID NO: 640188 - RNA, 64 nt, Homo Sapiens; identical to SEQ ID NO: 72205

SEQ ID NO: 640189 - RNA, 64 nt, Homo Sapiens; identical to SEQ ID NO: 72206

SEQ ID NO: 640190 - RNA, 64 nt, Homo Sapiens; identical to SEQ ID NO: 72207

SEQ ID NO: 640191 - RNA, 64 nt, Homo Sapiens; identical to SEQ ID NO: 72208

SEQ ID NO: 640192 - RNA, 64 nt, Homo Sapiens; identical to SEQ ID NO: 72209

SEQ ID NO: 640193 - RNA, 64 nt, Homo Sapiens; identical to SEQ ID NO: 72210

SEQ ID NO: 640194 - RNA, 64 nt, Homo Sapiens; identical to SEQ ID NO: 72211

SEQ ID NO: 640195 - RNA, 64 nt, Homo Sapiens; identical to SEQ ID NO: 72212

SEQ ID NO: 640196 - RNA, 64 nt, Homo Sapiens; identical to SEQ ID NO: 72213

SEQ ID NO: 640197 - RNA, 64 nt, Homo Sapiens; identical to SEQ ID NO: 72214

SEQ ID NO: 640198 - RNA, 64 nt, Homo Sapiens; identical to SEQ ID NO: 72215

SEQ ID NO: 640199 - RNA, 64 nt, Homo Sapiens; identical to SEQ ID NO: 72216

SEQ ID NO: 640200 - RNA, 64 nt, Homo Sapiens; identical to SEQ ID NO: 72217

SEQ ID NO: 640201 - RNA, 64 nt, Homo Sapiens; identical to SEQ ID NO: 72218

SEQ ID NO: 640202 - RNA, 64 nt, Homo Sapiens; identical to SEQ ID NO: 72219

SEQ ID NO: 640203 - RNA, 64 nt, Homo Sapiens; identical to SEQ ID NO: 72220

SEQ ID NO: 640204 - RNA, 64 nt, Homo Sapiens; identical to SEQ ID NO: 72221

SEQ ID NO: 640205 - RNA, 64 nt, Homo Sapiens; identical to SEQ ID NO: 72222

SEQ ID NO: 640206 - RNA, 64 nt, Homo Sapiens; identical to SEQ ID NO: 72223

SEQ ID NO: 640207 - RNA, 64 nt, Homo Sapiens; identical to SEQ ID NO: 72224

SEQ ID NO: 640208 - RNA, 64 nt, Homo Sapiens; identical to SEQ ID NO: 72225

SEQ ID NO: 640209 - RNA, 64 nt, Homo Sapiens; identical to SEQ ID NO: 72226

SEQ ID NO: 640210 - RNA, 64 nt, Homo Sapiens; identical to SEQ ID NO: 72227

SEQ ID NO: 640211 - RNA, 64 nt, Homo Sapiens; identical to SEQ ID NO: 72228

SEQ ID NO: 640212 - RNA, 64 nt, Homo Sapiens; identical to SEQ ID NO: 72229

SEQ ID NO: 640213 - RNA, 64 nt, Homo Sapiens; identical to SEQ ID NO: 72230

SEQ ID NO: 640214 - RNA, 64 nt, Homo Sapiens; identical to SEQ ID NO: 72231

SEQ ID NO: 640215 - RNA, 64 nt, Homo Sapiens; identical to SEQ ID NO: 72232

SEQ ID NO: 640216 - RNA, 64 nt, Homo Sapiens; identical to SEQ ID NO: 72233

SEQ ID NO: 640217 - RNA, 64 nt, Homo Sapiens; identical to SEQ ID NO: 72234

SEQ ID NO: 640218 - RNA, 64 nt, Homo Sapiens; identical to SEQ ID NO: 72235

SEQ ID NO: 640219 - RNA, 64 nt, Homo Sapiens; identical to SEQ ID NO: 72236

SEQ ID NO: 640220 - RNA, 64 nt, Homo Sapiens; identical to SEQ ID NO: 72237

SEQ ID NO: 640221 - RNA, 64 nt, Homo Sapiens; identical to SEQ ID NO: 72238

SEQ ID NO: 640222 - RNA, 64 nt, Homo Sapiens; identical to SEQ ID NO: 72239

SEQ ID NO: 640223 - RNA, 64 nt, Homo Sapiens; identical to SEQ ID NO: 72240

SEQ ID NO: 640224 - RNA, 64 nt, Homo Sapiens; identical to SEQ ID NO: 72241

SEQ ID NO: 640225 - RNA, 64 nt, Homo Sapiens; identical to SEQ ID NO: 72242

SEQ ID NO: 640226 - RNA, 64 nt, Homo Sapiens; identical to SEQ ID NO: 72243

SEQ ID NO: 640227 - RNA, 64 nt, Homo Sapiens; identical to SEQ ID NO: 72244

SEQ ID NO: 640228 - RNA, 64 nt, Homo Sapiens; identical to SEQ ID NO: 72245

SEQ ID NO: 640229 - RNA, 64 nt, Homo Sapiens; identical to SEQ ID NO: 72246

SEQ ID NO: 640230 - RNA, 64 nt, Homo Sapiens; identical to SEQ ID NO: 72247

SEQ ID NO: 640231 - RNA, 64 nt, Homo Sapiens; identical to SEQ ID NO: 72248

SEQ ID NO: 640232 - RNA, 64 nt, Homo Sapiens; identical to SEQ ID NO: 72249

SEQ ID NO: 640233 - RNA, 64 nt, Homo Sapiens; identical to SEQ ID NO: 72250

SEQ ID NO: 640234 - RNA, 64 nt, Homo Sapiens; identical to SEQ ID NO: 72251

SEQ ID NO: 640235 - RNA, 64 nt, Homo Sapiens; identical to SEQ ID NO: 72252

SEQ ID NO: 640236 - RNA, 64 nt, Homo Sapiens; identical to SEQ ID NO: 72253

SEQ ID NO: 640237 - RNA, 64 nt, Homo Sapiens; identical to SEQ ID NO: 72254

SEQ ID NO: 640238 - RNA, 64 nt, Homo Sapiens; identical to SEQ ID NO: 72255

SEQ ID NO: 640239 - RNA, 64 nt, Homo Sapiens; identical to SEQ ID NO: 72256

SEQ ID NO: 640240 - RNA, 64 nt, Homo Sapiens; identical to SEQ ID NO: 72257

SEQ ID NO: 640241 - RNA, 64 nt, Homo Sapiens; identical to SEQ ID NO: 72258

SEQ ID NO: 640242 - RNA, 64 nt, Homo Sapiens; identical to SEQ ID NO: 72259

SEQ ID NO: 640243 - RNA, 64 nt, Homo Sapiens; identical to SEQ ID NO: 72260

SEQ ID NO: 640244 - RNA, 64 nt, Homo Sapiens; identical to SEQ ID NO: 72261

SEQ ID NO: 640245 - RNA, 64 nt, Homo Sapiens; identical to SEQ ID NO: 72262

SEQ ID NO: 640246 - RNA, 64 nt, Homo Sapiens; identical to SEQ ID NO: 72263

SEQ ID NO: 640247 - RNA, 64 nt, Homo Sapiens; identical to SEQ ID NO: 72264

SEQ ID NO: 640248 - RNA, 64 nt, Homo Sapiens; identical to SEQ ID NO: 72265

SEQ ID NO: 640249 - RNA, 64 nt, Homo Sapiens; identical to SEQ ID NO: 72266

SEQ ID NO: 640250 - RNA, 64 nt, Homo Sapiens; identical to SEQ ID NO: 72267

SEQ ID NO: 640251 - RNA, 64 nt, Homo Sapiens; identical to SEQ ID NO: 72268

SEQ ID NO: 640252 - RNA, 64 nt, Homo Sapiens; identical to SEQ ID NO: 72269

SEQ ID NO: 640253 - RNA, 64 nt, Homo Sapiens; identical to SEQ ID NO: 72270

SEQ ID NO: 640254 - RNA, 64 nt, Homo Sapiens; identical to SEQ ID NO: 72271

SEQ ID NO: 640255 - RNA, 64 nt, Homo Sapiens; identical to SEQ ID NO: 72272

SEQ ID NO: 640256 - RNA, 64 nt, Homo Sapiens; identical to SEQ ID NO: 72273

SEQ ID NO: 640257 - RNA, 61 nt, Homo Sapiens; identical to SEQ ID NO: 286917

SEQ ID NO: 640258 - RNA, 64 nt, Homo Sapiens; identical to SEQ ID NO: 286918

SEQ ID NO: 640259 - RNA, 64 nt, Homo Sapiens; identical to SEQ ID NO: 286919

SEQ ID NO: 640260 - RNA, 64 nt, Homo Sapiens; identical to SEQ ID NO: 286920

SEQ ID NO: 640261 - RNA, 64 nt, Homo Sapiens; identical to SEQ ID NO: 286921

SEQ ID NO: 640262 - RNA, 64 nt, Homo Sapiens; identical to SEQ ID NO: 286922

SEQ ID NO: 640263 - RNA, 64 nt, Homo Sapiens; identical to SEQ ID NO: 286923

SEQ ID NO: 640264 - RNA, 64 nt, Homo Sapiens; identical to SEQ ID NO: 286924

SEQ ID NO: 640265 - RNA, 64 nt, Homo Sapiens; identical to SEQ ID NO: 286925

SEQ ID NO: 640266 - RNA, 64 nt, Homo Sapiens; identical to SEQ ID NO: 286926

SEQ ID NO: 640267 - RNA, 64 nt, Homo Sapiens; identical to SEQ ID NO: 286927

SEQ ID NO: 640268 - RNA, 64 nt, Homo Sapiens; identical to SEQ ID NO: 286928

SEQ ID NO: 640269 - RNA, 64 nt, Homo Sapiens; identical to SEQ ID NO: 286929

SEQ ID NO: 640270 - RNA, 64 nt, Homo Sapiens; identical to SEQ ID NO: 286930

SEQ ID NO: 640271 - RNA, 64 nt, Homo Sapiens; identical to SEQ ID NO: 286931

SEQ ID NO: 640272 - RNA, 64 nt, Homo Sapiens; identical to SEQ ID NO: 286932

SEQ ID NO: 640273 - RNA, 64 nt, Homo Sapiens; identical to SEQ ID NO: 286933

SEQ ID NO: 640274 - RNA, 64 nt, Homo Sapiens; identical to SEQ ID NO: 286934

SEQ ID NO: 640275 - RNA, 64 nt, Homo Sapiens; identical to SEQ ID NO: 286935

SEQ ID NO: 640276 - RNA, 64 nt, Homo Sapiens; identical to SEQ ID NO: 286936

SEQ ID NO: 640277 - RNA, 64 nt, Homo Sapiens; identical to SEQ ID NO: 286937

SEQ ID NO: 640278 - RNA, 64 nt, Homo Sapiens; identical to SEQ ID NO: 286938

SEQ ID NO: 640279 - RNA, 64 nt, Homo Sapiens; identical to SEQ ID NO: 286939

SEQ ID NO: 640280 - RNA, 64 nt, Homo Sapiens; identical to SEQ ID NO: 286940

SEQ ID NO: 640281 - RNA, 64 nt, Homo Sapiens; identical to SEQ ID NO: 286941

SEQ ID NO: 640282 - RNA, 64 nt, Homo Sapiens; identical to SEQ ID NO: 286942

SEQ ID NO: 640283 - RNA, 64 nt, Homo Sapiens; identical to SEQ ID NO: 286943

SEQ ID NO: 640284 - RNA, 64 nt, Homo Sapiens; identical to SEQ ID NO: 286944

SEQ ID NO: 640285 - RNA, 64 nt, Homo Sapiens; identical to SEQ ID NO: 286945

SEQ ID NO: 640286 - RNA, 64 nt, Homo Sapiens; identical to SEQ ID NO: 286946

SEQ ID NO: 640287 - RNA, 64 nt, Homo Sapiens; identical to SEQ ID NO: 286947

SEQ ID NO: 640288 - RNA, 64 nt, Homo Sapiens; identical to SEQ ID NO: 286948

SEQ ID NO: 640289 - RNA, 64 nt, Homo Sapiens; identical to SEQ ID NO: 286949

SEQ ID NO: 640290 - RNA, 64 nt, Homo Sapiens; identical to SEQ ID NO: 286950

SEQ ID NO: 640291 - RNA, 64 nt, Homo Sapiens; identical to SEQ ID NO: 286951

SEQ ID NO: 640292 - RNA, 64 nt, Homo Sapiens; identical to SEQ ID NO: 286952

SEQ ID NO: 640293 - RNA, 64 nt, Homo Sapiens; identical to SEQ ID NO: 286953

SEQ ID NO: 640294 - RNA, 64 nt, Homo Sapiens; identical to SEQ ID NO: 286954

SEQ ID NO: 640295 - RNA, 64 nt, Homo Sapiens; identical to SEQ ID NO: 286955

SEQ ID NO: 640296 - RNA, 64 nt, Homo Sapiens; identical to SEQ ID NO: 286956

SEQ ID NO: 640297 - RNA, 64 nt, Homo Sapiens; identical to SEQ ID NO: 286957

SEQ ID NO: 640298 - RNA, 64 nt, Homo Sapiens; identical to SEQ ID NO: 286958

SEQ ID NO: 640299 - RNA, 64 nt, Homo Sapiens; identical to SEQ ID NO: 286959

SEQ ID NO: 640300 - RNA, 64 nt, Homo Sapiens; identical to SEQ ID NO: 286960

SEQ ID NO: 640301 - RNA, 64 nt, Homo Sapiens; identical to SEQ ID NO: 286961

SEQ ID NO: 640302 - RNA, 64 nt, Homo Sapiens; identical to SEQ ID NO: 286962

SEQ ID NO: 640303 - RNA, 64 nt, Homo Sapiens; identical to SEQ ID NO: 286963

SEQ ID NO: 640304 - RNA, 64 nt, Homo Sapiens; identical to SEQ ID NO: 286964

SEQ ID NO: 640305 - RNA, 64 nt, Homo Sapiens; identical to SEQ ID NO: 286965

SEQ ID NO: 640306 - RNA, 64 nt, Homo Sapiens; identical to SEQ ID NO: 286966

SEQ ID NO: 640307 - RNA, 64 nt, Homo Sapiens; identical to SEQ ID NO: 286967

SEQ ID NO: 640308 - RNA, 64 nt, Homo Sapiens; identical to SEQ ID NO: 286968

SEQ ID NO: 640309 - RNA, 64 nt, Homo Sapiens; identical to SEQ ID NO: 286969

SEQ ID NO: 640310 - RNA, 64 nt, Homo Sapiens; identical to SEQ ID NO: 286970

SEQ ID NO: 640311 - RNA, 64 nt, Homo Sapiens; identical to SEQ ID NO: 286971

SEQ ID NO: 640312 - RNA, 64 nt, Homo Sapiens; identical to SEQ ID NO: 286972

SEQ ID NO: 640313 - RNA, 64 nt, Homo Sapiens; identical to SEQ ID NO: 286973

SEQ ID NO: 640314 - RNA, 64 nt, Homo Sapiens; identical to SEQ ID NO: 286974

SEQ ID NO: 640315 - RNA, 64 nt, Homo Sapiens; identical to SEQ ID NO: 286975

SEQ ID NO: 640316 - RNA, 64 nt, Homo Sapiens; identical to SEQ ID NO: 286976

SEQ ID NO: 640317 - RNA, 64 nt, Homo Sapiens; identical to SEQ ID NO: 286977

SEQ ID NO: 640318 - RNA, 64 nt, Homo Sapiens; identical to SEQ ID NO: 286978

SEQ ID NO: 640319 - RNA, 64 nt, Homo Sapiens; identical to SEQ ID NO: 286979

SEQ ID NO: 640320 - RNA, 64 nt, Homo Sapiens; identical to SEQ ID NO: 286980

SEQ ID NO: 640321 - RNA, 64 nt, Homo Sapiens; identical to SEQ ID NO: 286981

SEQ ID NO: 640322 - RNA, 64 nt, Homo Sapiens; identical to SEQ ID NO: 286982

SEQ ID NO: 640323 - RNA, 64 nt, Homo Sapiens; identical to SEQ ID NO: 286983

SEQ ID NO: 640324 - RNA, 64 nt, Homo Sapiens; identical to SEQ ID NO: 286984

SEQ ID NO: 640325 - RNA, 64 nt, Homo Sapiens; identical to SEQ ID NO: 286985

SEQ ID NO: 640326 - RNA, 64 nt, Homo Sapiens; identical to SEQ ID NO: 286986

SEQ ID NO: 640327 - RNA, 64 nt, Homo Sapiens; identical to SEQ ID NO: 286987

SEQ ID NO: 640328 - RNA, 64 nt, Homo Sapiens; identical to SEQ ID NO: 286988

SEQ ID NO: 640329 - RNA, 64 nt, Homo Sapiens; identical to SEQ ID NO: 286989

SEQ ID NO: 640330 - RNA, 64 nt, Homo Sapiens; identical to SEQ ID NO: 286990

SEQ ID NO: 640331 - RNA, 64 nt, Homo Sapiens
guccugggccuguguugggguguugggggaagcugggcaucaguggccacaugggcaucagggg

SEQ ID NO: 640332 - RNA, 64 nt, Homo Sapiens
gguguugggggaagcugggcaucaguggccacaugggcaucaggggcuggccccacagagaccc

SEQ ID NO: 640333 - RNA, 64 nt, Homo Sapiens
uugagugacagcccagggacuuaauguggccaucgggcaucaagcacaaggccaugcaggugau

SEQ ID NO: 640334 - RNA, 64 nt, Homo Sapiens
auggggagcccuaccccagaaguguaucccacgagggcaucagggacgcagugaguguugcuca

SEQ ID NO: 640335 - RNA, 64 nt, Homo Sapiens
gaauugcuugaguccaggaguuugagaugcgccugggcaacauagaaaccugugucuacaaaaa

SEQ ID NO: 640336 - RNA, 64 nt, Homo Sapiens
agugagcugagaucgcaccauuacacuccagccugggcaacagagccagacucugucucaaaaa

SEQ ID NO: 640337 - RNA, 64 nt, Homo Sapiens
acaagaacccaucucaaacacaucacuccaaccugggcaacagaagugagccaagaucaugcca

SEQ ID NO: 640338 - RNA, 64 nt, Homo Sapiens
augaaacuccgucucuacuauucaagaucagucugggcaacacgggauugccugagcucaggag

SEQ ID NO: 640339 - RNA, 64 nt, Homo Sapiens
gugagacccugucucaaacauggcacuccagccugggcaacagaguaagccaagaucacaccac

SEQ ID NO: 640340 - RNA, 64 nt, Homo Sapiens
gugagaccccaucucuauuuuuugagacuagccugggcaacauauaagcauuuuuuaaauugag

SEQ ID NO: 640341 - RNA, 64 nt, Homo Sapiens
guuauuaaaaaauuacaaaggccuagaccagccugggcaacauggugaaaccccaucucuacaa

SEQ ID NO: 640342 - RNA, 64 nt, Homo Sapiens
agugaaucaugaucaugccacuguacuccagccugggcaacagagaccaucuuaaaaaaaaaaa

SEQ ID NO: 640343 - RNA, 64 nt, Homo Sapiens
ggaucacuuagguccaggaguucgagacuagccugggcaacauagugagacaccggaucuacaa

SEQ ID NO: 640344 - RNA, 64 nt, Homo Sapiens
agugagccgugauugcaccacugcacuccagccugggcaacagagcaagacccugucuuggaga

SEQ ID NO: 640345 - RNA, 64 nt, Homo Sapiens
aguucgcuugggcccaagaguucgagaccagccugggcaacauggugaaacccuaucuccguga

SEQ ID NO: 640346 - RNA, 64 nt, Homo Sapiens
gccgaggucaugccacugcacuccagccuggccugggcaacagagcaagacccugucucaaaau

SEQ ID NO: 640347 - RNA, 64 nt, Homo Sapiens
gcaagaccccauccuccacccugcacuccagccugggcaacagaagugagcuuugaucacacca

SEQ ID NO: 640348 - RNA, 64 nt, Homo Sapiens
gggcgacccccaucucuacauuccagacuaacuugggcaacacacgaacccuugaggccaggag

SEQ ID NO: 640349 - RNA, 64 nt, Homo Sapiens
auugagcugagaucaugcuagugcgcuccagccugggcaacagagcgagacuucaucucagaaa

SEQ ID NO: 640350 - RNA, 64 nt, Homo Sapiens
agugagcugagaucgcgccaccgcacuccagccugggcaacagagcgagacuccaucucaaaca

SEQ ID NO: 640351 - RNA, 64 nt, Homo Sapiens
caggaauuugagucugggaguuugaguccagcaugggcaacauaacaagaccccaucccuuauu

SEQ ID NO: 640352 - RNA, 64 nt, Homo Sapiens
agaucaccugagcucaggaguccaagaccagccugggcaacauggcaaaacaccgucucuacaa

SEQ ID NO: 640353 - RNA, 64 nt, Homo Sapiens
gugagauccugacucaaauacugcauucuagccugggcaacagaaaugagcuaugauuucacca

SEQ ID NO: 640354 - RNA, 64 nt, Homo Sapiens
gcgagacugcaucucuacaauucaagacuagccugggcaacauaggauugcuugaggccgaggg

SEQ ID NO: 640355 - RNA, 64 nt, Homo Sapiens
gugagacccuauuucaaaaacugcacuccagccugggcaacagaagugagcacagaucacacca

SEQ ID NO: 640356 - RNA, 64 nt, Homo Sapiens
gcuaaaccccaucucuacaauucaagaccagccugggcaacaugggauugcuuaagcccaggag

SEQ ID NO: 640357 - RNA, 64 nt, Homo Sapiens
guaagacaaaaaaauauauacugcacucuagccugggcaacagaagugagccaaggucacguca

SEQ ID NO: 640358 - RNA, 64 nt, Homo Sapiens
gugaaacccuguuucuauaauucaagaccagccugggcaacaugagauuacuugagcccaggaa

SEQ ID NO: 640359 - RNA, 64 nt, Homo Sapiens
agauugccugagcucaggaguucgagaccagccagggcaacauggugaaaccccaucucuacua

SEQ ID NO: 640360 - RNA, 64 nt, Homo Sapiens
uugugccacugaacuccaaccugcacuccagccugggcaacagagcgagacuccaucucuaaau

SEQ ID NO: 640361 - RNA, 64 nt, Homo Sapiens
gaaagacccugucucaaaaagugcacucuagccugggcaacagaagagugagccgugaucacca

SEQ ID NO: 640362 - RNA, 64 nt, Homo Sapiens
gcgagaucccaucacuacaauucgagaccacccugggcaacagaggaucgcuugaggccaggag

SEQ ID NO: 640363 - RNA, 64 nt, Homo Sapiens
cauccugucucaaauaaauucuauacuccagccugggcaacagaacugagccgagaucgcgcca

SEQ ID NO: 640364 - RNA, 64 nt, Homo Sapiens
gcaagacuccaucucaaaaacuguacuccagcuugggcaacagaagugagccaagauugcgcca

SEQ ID NO: 640365 - RNA, 64 nt, Homo Sapiens
agugagccgagaucgcaccauugcacuccugccugggcaacaagagugaaacuccaucuccaaa

SEQ ID NO: 640366 - RNA, 64 nt, Homo Sapiens
agauuauuugagcucaggaguuugagaccauccugggcaacauggcgaaacccuaucucuacaa

SEQ ID NO: 640367 - RNA, 64 nt, Homo Sapiens
gugagacccugucucugaaacugcacuccagccugggcaacagaagugggcugugaucacacca

SEQ ID NO: 640368 - RNA, 64 nt, Homo Sapiens
gugagacuccugucucuacauucaagaccagccugggcaacauaggaucacuugagcccaggag

SEQ ID NO: 640369 - RNA, 64 nt, Homo Sapiens
accagugagcacugguuaguacugguccccuucugggcaacauggcccuaccagacacugcugc

SEQ ID NO: 640370 - RNA, 64 nt, Homo Sapiens
gagccaucaucauggcaucauugcauuccagccugggcaacagagcaagaccucgucucaaaaa

SEQ ID NO: 640371 - RNA, 64 nt, Homo Sapiens
gcaagaccuugucucaaaaacuacacuccagccugggcaacaaaagugagccaagaucgugcca

SEQ ID NO: 640372 - RNA, 64 nt, Homo Sapiens
acgaaaccccgucucuacaguucgagagcagccugggcaacaugagaucacuugagcccaggag

SEQ ID NO: 640373 - RNA, 64 nt, Homo Sapiens
ugcagaauaauccuguuuuacuugcccuaguugugggcaacacauacuugugaugagagauaac

SEQ ID NO: 640374 - RNA, 64 nt, Homo Sapiens
gcaagacccugucucaaagccuacacuccagccugggcaacagaagugauccacgaucguacca

SEQ ID NO: 640375 - RNA, 64 nt, Homo Sapiens
gaggaucacuugaguccagguucaagacuagccugggcaacauggcaagacccugucccuauaa

SEQ ID NO: 640376 - RNA, 64 nt, Homo Sapiens
agugaacugagaucacgacacugcacuccagccugggcaacaguaaaaccuggucuccaaaaaa

SEQ ID NO: 640377 - RNA, 64 nt, Homo Sapiens
agcgaaacucugucucaaaacugcauuccagccugggcaacaaacaguagccgagaucgcgcca

SEQ ID NO: 640378 - RNA, 64 nt, Homo Sapiens
agcgaaacucugucucaaaauugcacuccagccugggcaacaagagugagcugagaucgcacca

SEQ ID NO: 640379 - RNA, 64 nt, Homo Sapiens
gagacccugucucaaaaaaacugugcucccaccugggcaacaguagugagccaagauugcacca

SEQ ID NO: 640380 - RNA, 64 nt, Homo Sapiens
gcgaaacuccauuucuauaauucaagaccagccugggcaacaugagaucacugaagcucaggag

SEQ ID NO: 640381 - RNA, 64 nt, Homo Sapiens
uauauagccuucuguauuuaaguauguggaauaugggcaacauaaaguaccaaacauaacccag

SEQ ID NO: 640382 - RNA, 64 nt, Homo Sapiens
uauuauuaaaugaauuauuucaguuucuaauauugggcaacaaugaugccuugcagacaucauu

SEQ ID NO: 640383 - RNA, 64 nt, Homo Sapiens
ggaucgcugcagcccaggaguucgagacuagccugggcaacauagcgagaccucgucucuacaa

SEQ ID NO: 640384 - RNA, 64 nt, Homo Sapiens
ggauugcuugagcccaggaguuugagaccagccugggcaacacagcgagaccuugucucuuaaa

SEQ ID NO: 640385 - RNA, 64 nt, Homo Sapiens
ggcuugaggccagagguuugagaccgaccagccagggcaacacagugagaccccuucucaaaaa

SEQ ID NO: 640386 - RNA, 64 nt, Homo Sapiens
agugagcugagauugugccacuguacuccagccugggcaacaagagcgagacuccguuuccaaa

SEQ ID NO: 640387 - RNA, 64 nt, Homo Sapiens
auuuaguccugaaaccgaauuaucccuguggguugggcaacacugcagagccgggacuaucccu

SEQ ID NO: 640388 - RNA, 64 nt, Homo Sapiens
aaaaauguuugaauuggacccugggcccacagcugggcaacaagccauugcucaccaggccuca

SEQ ID NO: 640389 - RNA, 64 nt, Homo Sapiens
agugagucaagaucacgccauugcacuccagccugggcaacaagagcgaaacuccaucucaaaa

SEQ ID NO: 640390 - RNA, 64 nt, Homo Sapiens
ggauuacuugaaacccacaguuugagaccagccugggcaacauagugagacccugucucuaaaa

SEQ ID NO: 640391 - RNA, 64 nt, Homo Sapiens
auuuggaaacuguuuuccucuguuuuggucucuugggcaacauuuuuggcccaaguuugggcaa

SEQ ID NO: 640392 - RNA, 64 nt, Homo Sapiens
uuggucucuugggcaacauuuuuggcccaaguuugggcaacauuuggcccaaguuugggcauuu

SEQ ID NO: 640393 - RNA, 64 nt, Homo Sapiens
agugagcugagauugugccacugcacuccagccugggcaacaaagcaagacucugucucaaaaa

SEQ ID NO: 640394 - RNA, 64 nt, Homo Sapiens
agugagccaagaucaugucacugcauuccagccugggcaacagaggaagacuccgucucaaaaa

SEQ ID NO: 640395 - RNA, 64 nt, Homo Sapiens
gcaggagggccuacaaacgggcccagcaagagcugggcaacagcuggcuugugaaaugagacac

SEQ ID NO: 640396 - RNA, 64 nt, Homo Sapiens
ccagagggcucaggaugccccaggaaggaaagaagggcaacagacuacacgauuggacgugugu

SEQ ID NO: 640397 - RNA, 64 nt, Homo Sapiens
acugcgcgggccugagacugcuggauacaauguugggcaacaacucagccagccugauggcagc

SEQ ID NO: 640398 - RNA, 64 nt, Homo Sapiens
cgugagcuaugauuaugccacugcuuuccagccugggcaacauaguaagaccccaucucuuaaa

SEQ ID NO: 640399 - RNA, 64 nt, Homo Sapiens
agugagccaugaucgagccacugcacuccagccugggcaacagaugaagacccuauuucagaaa

SEQ ID NO: 640400 - RNA, 64 nt, Homo Sapiens
ggauugcuugaagccaggaguuugggaccagccugggcaacauagggggaucccaucucuacac

SEQ ID NO: 640401 - RNA, 64 nt, Homo Sapiens
agugagcuaugauuguaccacugcacuccagccugggcaacagagcaagaccuugucucaaaaa

SEQ ID NO: 640402 - RNA, 64 nt, Homo Sapiens
gcacuguggaaagacaggaguucgaaaccagccugggcaacauagugagacccugccucauggc

SEQ ID NO: 640403 - RNA, 64 nt, Homo Sapiens
agugagcugagaucgcaccacugcacucuagcuugggcaacagagcaagacucugucucuuaaa

SEQ ID NO: 640404 - RNA, 64 nt, Homo Sapiens
ggaucacuuaaggccaggaguucgagaccagccugggcaacagcaagaccucaucucuacaaaa

SEQ ID NO: 640405 - RNA, 64 nt, Homo Sapiens
agugagcuguguucacaccacugcacuccagucugggcaacagugcaagacccugucacuuaaa

SEQ ID NO: 640406 - RNA, 64 nt, Homo Sapiens
gcaagauccugucuaaaaaucugcacuccagccugggcaacacaagagagcuaugacugcauca

SEQ ID NO: 640407 - RNA, 64 nt, Homo Sapiens
gcaagacccccaccaucucuuuugagaccagccugggcaacauaggacugcuuaagcucaggag

SEQ ID NO: 640408 - RNA, 64 nt, Homo Sapiens
gggagcccccgucucaacaacugcacuccagccugggcaacagaauugagccaugauugcacca

SEQ ID NO: 640409 - RNA, 64 nt, Homo Sapiens
gugagaccccaucucuacaauucaagaccagccugggcaacaugggauugauugaggccaggag

SEQ ID NO: 640410 - RNA, 64 nt, Homo Sapiens
ggaucccuuuagcccaggaguuaaagaccagccugggcaacauagggagacccugucuuuuuuu

SEQ ID NO: 640411 - RNA, 64 nt, Homo Sapiens
aggugggaggaucccaggaguucaaauccugccugggcaacauagcaagacccugucucuuaaa

SEQ ID NO: 640412 - RNA, 64 nt, Homo Sapiens
gauauggaacacuuguauccguggcugcugugacgggcaacacaccaguagccacauguggcua

SEQ ID NO: 640413 - RNA, 64 nt, Homo Sapiens
gugaaacccaguuucuacaacuugagaccagccugggcaacaugggaucacuugagcucaggag

SEQ ID NO: 640414 - RNA, 64 nt, Homo Sapiens
gugagacucugucucaaaaacugcacuccagccugggcaacagaagugagcugagaucacgcca

SEQ ID NO: 640415 - RNA, 64 nt, Homo Sapiens
gcgagacucagucucaaaaacugcacuccagccugggcaacagaagugagcugaagucccgcca

SEQ ID NO: 640416 - RNA, 64 nt, Homo Sapiens
gccagacuccgucucuaaaccugcacuccagccugggcaacagaagugagcugagaucgugcca

SEQ ID NO: 640417 - RNA, 64 nt, Homo Sapiens
gugaaacccugucucuacuauucgggaccagccugggcaacaugagaucaccugagaucaggag

SEQ ID NO: 640418 - RNA, 64 nt, Homo Sapiens
agugaaauucugucucaaaauugcacuccagccugggcaacaagagugagccaagaucuugcca

SEQ ID NO: 640419 - RNA, 64 nt, Homo Sapiens
gaaacuccaucucaaaaaaucugcacuccagccugggcaacaguaaugagccgagaucacacca

SEQ ID NO: 640420 - RNA, 64 nt, Homo Sapiens; identical to SEQ ID NO: 24125

SEQ ID NO: 640421 - RNA, 64 nt, Homo Sapiens; identical to SEQ ID NO: 24126

SEQ ID NO: 640422 - RNA, 64 nt, Homo Sapiens; identical to SEQ ID NO: 24127

SEQ ID NO: 640423 - RNA, 64 nt, Homo Sapiens; identical to SEQ ID NO: 24128

SEQ ID NO: 640424 - RNA, 64 nt, Homo Sapiens; identical to SEQ ID NO: 24129

SEQ ID NO: 640425 - RNA, 64 nt, Homo Sapiens; identical to SEQ ID NO: 24130

SEQ ID NO: 640426 - RNA, 64 nt, Homo Sapiens; identical to SEQ ID NO: 24131

SEQ ID NO: 640427 - RNA, 64 nt, Homo Sapiens; identical to SEQ ID NO: 24132

SEQ ID NO: 640428 - RNA, 64 nt, Homo Sapiens; identical to SEQ ID NO: 24133

SEQ ID NO: 640429 - RNA, 64 nt, Homo Sapiens; identical to SEQ ID NO: 24134

SEQ ID NO: 640430 - RNA, 64 nt, Homo Sapiens; identical to SEQ ID NO: 24135

SEQ ID NO: 640431 - RNA, 64 nt, Homo Sapiens; identical to SEQ ID NO: 24136

SEQ ID NO: 640432 - RNA, 64 nt, Homo Sapiens; identical to SEQ ID NO: 24137

SEQ ID NO: 640433 - RNA, 64 nt, Homo Sapiens; identical to SEQ ID NO: 24138

SEQ ID NO: 640434 - RNA, 64 nt, Homo Sapiens; identical to SEQ ID NO: 24139

SEQ ID NO: 640435 - RNA, 64 nt, Homo Sapiens; identical to SEQ ID NO: 24140

SEQ ID NO: 640436 - RNA, 64 nt, Homo Sapiens; identical to SEQ ID NO: 24141

SEQ ID NO: 640437 - RNA, 64 nt, Homo Sapiens; identical to SEQ ID NO: 24142

SEQ ID NO: 640438 - RNA, 64 nt, Homo Sapiens; identical to SEQ ID NO: 24143

SEQ ID NO: 640439 - RNA, 64 nt, Homo Sapiens; identical to SEQ ID NO: 24144

SEQ ID NO: 640440 - RNA, 64 nt, Homo Sapiens; identical to SEQ ID NO: 24145

SEQ ID NO: 640441 - RNA, 64 nt, Homo Sapiens; identical to SEQ ID NO: 24146

SEQ ID NO: 640442 - RNA, 64 nt, Homo Sapiens; identical to SEQ ID NO: 24147

SEQ ID NO: 640443 - RNA, 64 nt, Homo Sapiens; identical to SEQ ID NO: 24148

SEQ ID NO: 640444 - RNA, 64 nt, Homo Sapiens; identical to SEQ ID NO: 24149

SEQ ID NO: 640445 - RNA, 64 nt, Homo Sapiens; identical to SEQ ID NO: 24150

SEQ ID NO: 640446 - RNA, 64 nt, Homo Sapiens; identical to SEQ ID NO: 24151

SEQ ID NO: 640447 - RNA, 64 nt, Homo Sapiens; identical to SEQ ID NO: 24152

SEQ ID NO: 640448 - RNA, 64 nt, Homo Sapiens; identical to SEQ ID NO: 24153

SEQ ID NO: 640449 - RNA, 64 nt, Homo Sapiens; identical to SEQ ID NO: 24154

SEQ ID NO: 640450 - RNA, 64 nt, Homo Sapiens; identical to SEQ ID NO: 24155

SEQ ID NO: 640451 - RNA, 64 nt, Homo Sapiens; identical to SEQ ID NO: 24156

SEQ ID NO: 640452 - RNA, 64 nt, Homo Sapiens; identical to SEQ ID NO: 24157

SEQ ID NO: 640453 - RNA, 64 nt, Homo Sapiens; identical to SEQ ID NO: 24158

SEQ ID NO: 640454 - RNA, 64 nt, Homo Sapiens; identical to SEQ ID NO: 24159

SEQ ID NO: 640455 - RNA, 64 nt, Homo Sapiens; identical to SEQ ID NO: 24160

SEQ ID NO: 640456 - RNA, 64 nt, Homo Sapiens
uaugaugauauaaauaaaaacagcucucuaucccaauacgcaccuuuguauuuucaagaacucu

SEQ ID NO: 640457 - RNA, 64 nt, Homo Sapiens
aaaggaauuuuagagauugauuguuuuaaaaaaaaauacgcacauuguccaauccagugauuuu

SEQ ID NO: 640458 - RNA, 64 nt, Homo Sapiens
auacucuucggugguaguuucaaaagacacuacuaauacgcaggaagcguuccagcuauuuaau

SEQ ID NO: 640459 - RNA, 64 nt, Homo Sapiens
uacugaccacugagcucugagggccuguagcuggaauacgcaucucuccagcauuccguccugg

SEQ ID NO: 640460 - RNA, 64 nt, Homo Sapiens
aaggugaggggguuagaggagcaagcacuauaugaauacgcaaggagagccugcaggagcgcaa

SEQ ID NO: 640461 - RNA, 64 nt, Homo Sapiens
gccuuuacugagcucaggacuccagcuaaaucaaaauacgcauguucucacccagagugacaaa

SEQ ID NO: 640462 - RNA, 64 nt, Homo Sapiens
gauuuauuuucacuguuauauuuaacuauauauaaauacgcauauauuguaauuuuaaugucug

SEQ ID NO: 640463 - RNA, 64 nt, Homo Sapiens
cuuuauauauuacauuugguaaaaucagugcuuaaauacgcaaugauuuaaacuggaaccugag

SEQ ID NO: 640464 - RNA, 64 nt, Homo Sapiens
cuguaagguaacugucugauguauuuguucaauaaauacgcaagguauuuuagcuauuuuagua

SEQ ID NO: 640465 - RNA, 64 nt, Homo Sapiens
acaugugguuuauagagggcguuguuuuguuuuaaauacgcacuauuuuuuauuguuuucaucu

SEQ ID NO: 640466 - RNA, 64 nt, Homo Sapiens
acucaagccccaagacauccccuuagaugaucugaauacgcauucagggacagaucuaggcagu

SEQ ID NO: 640467 - RNA, 64 nt, Homo Sapiens
uucagauaaguuacgcaguuacgucaacccccaaaauacgcaaucccagcccguuaaaugucaa

SEQ ID NO: 640468 - RNA, 64 nt, Homo Sapiens
aaguuuguguuuguaaaauuuccauugugacaucaauacgcaauauauuuuguaauauaggagu

SEQ ID NO: 640469 - RNA, 64 nt, Homo Sapiens
uuuuguuguuugauggaauuugagccaaaaaaaaaauacgcaggcuuuccuauuucuacaacug

SEQ ID NO: 640470 - RNA, 64 nt, Homo Sapiens
ggaauuucuuguuucuccagauuuuuaauacguuaauacgcaggcaucugauuugcauauucau

SEQ ID NO: 640471 - RNA, 64 nt, Homo Sapiens
gacacuucgugagccucccuguagccguggaccgaauacgcacucuugaaagcugcaucgagaa

SEQ ID NO: 640472 - RNA, 64 nt, Homo Sapiens
auguagaagaugccuagcccuggggaccuugugaaauacgcaggaaccagggauaccaucuggu

SEQ ID NO: 640473 - RNA, 64 nt, Homo Sapiens
ggugaacuaucucagacagaugccucuccuuuuuaauacgcauuugugcagcuaaaagacuggg

SEQ ID NO: 640474 - RNA, 64 nt, Homo Sapiens
uauuucucaauaguguuauuuaaguauugcacuuaauacgcaccauuugacaucagagauguug

SEQ ID NO: 640475 - RNA, 64 nt, Homo Sapiens
caauaaaauguuauacaaauucuuuucacuaugcaauacgcaaacaugagucuucugacucugu

SEQ ID NO: 640476 - RNA, 64 nt, Homo Sapiens
cagugaggaugacagugacacccagagggaguagaauacgcagaacuaccagguggcaaaguac

SEQ ID NO: 640477 - RNA, 64 nt, Homo Sapiens
auaaauaacugcacauucucacguuuacaaacugaauacgcauaguuuacugaauacagaggau

SEQ ID NO: 640478 - RNA, 64 nt, Homo Sapiens
cuacaaccaucuaaucuuugacaaaguugacaaaaauacgcaauggggaaagaauuccccauuc

SEQ ID NO: 640479 - RNA, 64 nt, Homo Sapiens
caaugugcaaaauuuaaaauaaagaauauuuauuaauacgcacaguaaaauuugcuguacaugu

SEQ ID NO: 640480 - RNA, 64 nt, Homo Sapiens
cuguuucuaaggcgcugccauaaaccaugauuuuaauacgcaagcuauuuuuuuuuuuuuuuuu

SEQ ID NO: 640481 - RNA, 64 nt, Homo Sapiens
gggucucucuaauucugguauuuugacauguuauaauacgcaaguaaaauaaaacaauaguuua

SEQ ID NO: 640482 - RNA, 64 nt, Homo Sapiens
uuaugaaucaauuaaauauccugcacuuguuaggaauacgcauaucccuucuuuguugaguuua

SEQ ID NO: 640483 - RNA, 64 nt, Homo Sapiens
uagcgguucuacuuaugaguaugaaugcucaggaaauacgcacuaggauauuuacuguggcuug

SEQ ID NO: 640484 - RNA, 64 nt, Homo Sapiens
aaaagauacaucuuugaugaaggucucagagcucaauacgcaucguaugacagaagcuuuaucc

SEQ ID NO: 640485 - RNA, 64 nt, Homo Sapiens
cuauuuggggcagugaaugcauagaagauauaaaaauacgcagcuuaacuauaucuuccugcgu

SEQ ID NO: 640486 - RNA, 64 nt, Homo Sapiens
uuccugucccuccgggagacuccggggucgagggaauacgcaggaaggaugugggaugguggac

SEQ ID NO: 640487 - RNA, 64 nt, Homo Sapiens
cuuuuuaugaaggcuuucaugaauuuuaguauguaauacgcacugacgacacaugaugcuugga

SEQ ID NO: 640488 - RNA, 64 nt, Homo Sapiens
gacacauaggcggggggcggcaccuggcaucagcaauacgcagucugugggagcccggccgcgc

SEQ ID NO: 640489 - RNA, 64 nt, Homo Sapiens
auguuucuuuauugugugugcguguguguuuugaaauacgcacacagccacacccacauauaua

SEQ ID NO: 640490 - RNA, 64 nt, Homo Sapiens
guuuuuuuguuguuguuagugagucucccuucaaaauacgcaguagguaguguaaauacugcuu

SEQ ID NO: 640491 - RNA, 64 nt, Homo Sapiens
cugcgccugcuccugaaaagacccucugccuugcaauacgcaaacugaaagcuucucacccucc

SEQ ID NO: 640492 - RNA, 64 nt, Homo Sapiens
gaauaaacucuuuauauucauuguuguauacccaaauacgcaccaaaaaguuguuuaauauuug

SEQ ID NO: 640493 - RNA, 64 nt, Homo Sapiens; identical to SEQ ID NO: 196485

SEQ ID NO: 640494 - RNA, 64 nt, Homo Sapiens; identical to SEQ ID NO: 196486

SEQ ID NO: 640495 - RNA, 64 nt, Homo Sapiens; identical to SEQ ID NO: 196487

SEQ ID NO: 640496 - RNA, 64 nt, Homo Sapiens; identical to SEQ ID NO: 196488

SEQ ID NO: 640497 - RNA, 64 nt, Homo Sapiens; identical to SEQ ID NO: 196489

SEQ ID NO: 640498 - RNA, 64 nt, Homo Sapiens; identical to SEQ ID NO: 196490

SEQ ID NO: 640499 - RNA, 64 nt, Homo Sapiens; identical to SEQ ID NO: 196491

SEQ ID NO: 640500 - RNA, 64 nt, Homo Sapiens; identical to SEQ ID NO: 196492

SEQ ID NO: 640501 - RNA, 64 nt, Homo Sapiens; identical to SEQ ID NO: 196493

SEQ ID NO: 640502 - RNA, 64 nt, Homo Sapiens; identical to SEQ ID NO: 196494

SEQ ID NO: 640503 - RNA, 64 nt, Homo Sapiens; identical to SEQ ID NO: 196495

SEQ ID NO: 640504 - RNA, 64 nt, Homo Sapiens; identical to SEQ ID NO: 196496

SEQ ID NO: 640505 - RNA, 64 nt, Homo Sapiens; identical to SEQ ID NO: 196497

SEQ ID NO: 640506 - RNA, 64 nt, Homo Sapiens; identical to SEQ ID NO: 196498

SEQ ID NO: 640507 - RNA, 64 nt, Homo Sapiens; identical to SEQ ID NO: 196499

SEQ ID NO: 640508 - RNA, 64 nt, Homo Sapiens; identical to SEQ ID NO: 196500

SEQ ID NO: 640509 - RNA, 64 nt, Homo Sapiens; identical to SEQ ID NO: 196501

SEQ ID NO: 640510 - RNA, 64 nt, Homo Sapiens; identical to SEQ ID NO: 196502

SEQ ID NO: 640511 - RNA, 64 nt, Homo Sapiens; identical to SEQ ID NO: 196503

SEQ ID NO: 640512 - RNA, 64 nt, Homo Sapiens; identical to SEQ ID NO: 196504

SEQ ID NO: 640513 - RNA, 64 nt, Homo Sapiens; identical to SEQ ID NO: 196505

SEQ ID NO: 640514 - RNA, 64 nt, Homo Sapiens; identical to SEQ ID NO: 196506

SEQ ID NO: 640515 - RNA, 64 nt, Homo Sapiens; identical to SEQ ID NO: 196507

SEQ ID NO: 640516 - RNA, 64 nt, Homo Sapiens; identical to SEQ ID NO: 196508

SEQ ID NO: 640517 - RNA, 64 nt, Homo Sapiens; identical to SEQ ID NO: 196509

SEQ ID NO: 640518 - RNA, 64 nt, Homo Sapiens; identical to SEQ ID NO: 196510

SEQ ID NO: 640519 - RNA, 64 nt, Homo Sapiens; identical to SEQ ID NO: 196511

SEQ ID NO: 640520 - RNA, 64 nt, Homo Sapiens; identical to SEQ ID NO: 196512

SEQ ID NO: 640521 - RNA, 64 nt, Homo Sapiens; identical to SEQ ID NO: 196513

SEQ ID NO: 640522 - RNA, 64 nt, Homo Sapiens; identical to SEQ ID NO: 196514

SEQ ID NO: 640523 - RNA, 64 nt, Homo Sapiens; identical to SEQ ID NO: 196515

SEQ ID NO: 640524 - RNA, 64 nt, Homo Sapiens; identical to SEQ ID NO: 196516

SEQ ID NO: 640525 - RNA, 64 nt, Homo Sapiens; identical to SEQ ID NO: 196517

SEQ ID NO: 640526 - RNA, 64 nt, Homo Sapiens; identical to SEQ ID NO: 196518

SEQ ID NO: 640527 - RNA, 64 nt, Homo Sapiens; identical to SEQ ID NO: 196519

SEQ ID NO: 640528 - RNA, 64 nt, Homo Sapiens; identical to SEQ ID NO: 196520

SEQ ID NO: 640529 - RNA, 64 nt, Homo Sapiens; identical to SEQ ID NO: 196521

SEQ ID NO: 640530 - RNA, 64 nt, Homo Sapiens; identical to SEQ ID NO: 196522

SEQ ID NO: 640531 - RNA, 64 nt, Homo Sapiens; identical to SEQ ID NO: 196523

SEQ ID NO: 640532 - RNA, 64 nt, Homo Sapiens; identical to SEQ ID NO: 196524

SEQ ID NO: 640533 - RNA, 64 nt, Homo Sapiens; identical to SEQ ID NO: 196525

SEQ ID NO: 640534 - RNA, 64 nt, Homo Sapiens; identical to SEQ ID NO: 196526

SEQ ID NO: 640535 - RNA, 64 nt, Homo Sapiens; identical to SEQ ID NO: 196527

SEQ ID NO: 640536 - RNA, 64 nt, Homo Sapiens; identical to SEQ ID NO: 196528

SEQ ID NO: 640537 - RNA, 64 nt, Homo Sapiens; identical to SEQ ID NO: 196529

SEQ ID NO: 640538 - RNA, 64 nt, Homo Sapiens; identical to SEQ ID NO: 196530

SEQ ID NO: 640539 - RNA, 64 nt, Homo Sapiens; identical to SEQ ID NO: 196531

SEQ ID NO: 640540 - RNA, 64 nt, Homo Sapiens; identical to SEQ ID NO: 196532

SEQ ID NO: 640541 - RNA, 64 nt, Homo Sapiens; identical to SEQ ID NO: 196533

SEQ ID NO: 640542 - RNA, 64 nt, Homo Sapiens; identical to SEQ ID NO: 196534

SEQ ID NO: 640543 - RNA, 64 nt, Homo Sapiens; identical to SEQ ID NO: 196535

SEQ ID NO: 640544 - RNA, 64 nt, Homo Sapiens; identical to SEQ ID NO: 196536

SEQ ID NO: 640545 - RNA, 64 nt, Homo Sapiens; identical to SEQ ID NO: 196537

SEQ ID NO: 640546 - RNA, 64 nt, Homo Sapiens; identical to SEQ ID NO: 196538

SEQ ID NO: 640547 - RNA, 64 nt, Homo Sapiens; identical to SEQ ID NO: 196539

SEQ ID NO: 640548 - RNA, 64 nt, Homo Sapiens; identical to SEQ ID NO: 196540

SEQ ID NO: 640549 - RNA, 64 nt, Homo Sapiens; identical to SEQ ID NO: 196541

SEQ ID NO: 640550 - RNA, 64 nt, Homo Sapiens; identical to SEQ ID NO: 196542

SEQ ID NO: 640551 - RNA, 64 nt, Homo Sapiens; identical to SEQ ID NO: 196543

SEQ ID NO: 640552 - RNA, 64 nt, Homo Sapiens; identical to SEQ ID NO: 196544

SEQ ID NO: 640553 - RNA, 64 nt, Homo Sapiens; identical to SEQ ID NO: 196545

SEQ ID NO: 640554 - RNA, 64 nt, Homo Sapiens; identical to SEQ ID NO: 196546

SEQ ID NO: 640555 - RNA, 64 nt, Homo Sapiens; identical to SEQ ID NO: 196547

SEQ ID NO: 640556 - RNA, 64 nt, Homo Sapiens; identical to SEQ ID NO: 196548

SEQ ID NO: 640557 - RNA, 64 nt, Homo Sapiens; identical to SEQ ID NO: 196549

SEQ ID NO: 640558 - RNA, 64 nt, Homo Sapiens; identical to SEQ ID NO: 196550

SEQ ID NO: 640559 - RNA, 64 nt, Homo Sapiens; identical to SEQ ID NO: 196551

SEQ ID NO: 640560 - RNA, 64 nt, Homo Sapiens; identical to SEQ ID NO: 196551

SEQ ID NO: 640561 - RNA, 64 nt, Homo Sapiens; identical to SEQ ID NO: 196553

SEQ ID NO: 640562 - RNA, 64 nt, Homo Sapiens; identical to SEQ ID NO: 196554

SEQ ID NO: 640563 - RNA, 64 nt, Homo Sapiens; identical to SEQ ID NO: 196555

SEQ ID NO: 640564 - RNA, 64 nt, Homo Sapiens; identical to SEQ ID NO: 196556

SEQ ID NO: 640565 - RNA, 64 nt, Homo Sapiens; identical to SEQ ID NO: 196557

SEQ ID NO: 640566 - RNA, 64 nt, Homo Sapiens; identical to SEQ ID NO: 196558

SEQ ID NO: 640567 - RNA, 64 nt, Homo Sapiens; identical to SEQ ID NO: 196559

SEQ ID NO: 640568 - RNA, 64 nt, Homo Sapiens; identical to SEQ ID NO: 196560

SEQ ID NO: 640569 - RNA, 64 nt, Homo Sapiens; identical to SEQ ID NO: 196561

SEQ ID NO: 640570 - RNA, 64 nt, Homo Sapiens; identical to SEQ ID NO: 196562

SEQ ID NO: 640571 - RNA, 64 nt, Homo Sapiens; identical to SEQ ID NO: 196563

SEQ ID NO: 640572 - RNA, 64 nt, Homo Sapiens; identical to SEQ ID NO: 196564

SEQ ID NO: 640573 - RNA, 64 nt, Homo Sapiens; identical to SEQ ID NO: 196565

SEQ ID NO: 640574 - RNA, 64 nt, Homo Sapiens; identical to SEQ ID NO: 196566

SEQ ID NO: 640575 - RNA, 64 nt, Homo Sapiens; identical to SEQ ID NO: 196567

SEQ ID NO: 640576 - RNA, 64 nt, Homo Sapiens; identical to SEQ ID NO: 196568

SEQ ID NO: 640577 - RNA, 64 nt, Homo Sapiens; identical to SEQ ID NO: 196569

SEQ ID NO: 640578 - RNA, 64 nt, Homo Sapiens; identical to SEQ ID NO: 196570

SEQ ID NO: 640579 - RNA, 64 nt, Homo Sapiens; identical to SEQ ID NO: 196571

SEQ ID NO: 640580 - RNA, 64 nt, Homo Sapiens; identical to SEQ ID NO: 196572

SEQ ID NO: 640581 - RNA, 64 nt, Homo Sapiens; identical to SEQ ID NO: 115778

SEQ ID NO: 640582 - RNA, 64 nt, Homo Sapiens; identical to SEQ ID NO: 115779

SEQ ID NO: 640583 - RNA, 64 nt, Homo Sapiens; identical to SEQ ID NO: 115780

SEQ ID NO: 640584 - RNA, 64 nt, Homo Sapiens; identical to SEQ ID NO: 115781

SEQ ID NO: 640585 - RNA, 64 nt, Homo Sapiens; identical to SEQ ID NO: 115782

SEQ ID NO: 640586 - RNA, 64 nt, Homo Sapiens; identical to SEQ ID NO: 115783

SEQ ID NO: 640587 - RNA, 64 nt, Homo Sapiens; identical to SEQ ID NO: 115784

SEQ ID NO: 640588 - RNA, 64 nt, Homo Sapiens; identical to SEQ ID NO: 115785

SEQ ID NO: 640589 - RNA, 64 nt, Homo Sapiens; identical to SEQ ID NO: 115786

SEQ ID NO: 640590 - RNA, 64 nt, Homo Sapiens; identical to SEQ ID NO: 115787

SEQ ID NO: 640591 - RNA, 64 nt, Homo Sapiens; identical to SEQ ID NO: 115788

SEQ ID NO: 640592 - RNA, 64 nt, Homo Sapiens; identical to SEQ ID NO: 115789

SEQ ID NO: 640593 - RNA, 64 nt, Homo Sapiens; identical to SEQ ID NO: 115790

SEQ ID NO: 640594 - RNA, 64 nt, Homo Sapiens; identical to SEQ ID NO: 115791

SEQ ID NO: 640595 - RNA, 64 nt, Homo Sapiens; identical to SEQ ID NO: 115792

SEQ ID NO: 640596 - RNA, 64 nt, Homo Sapiens; identical to SEQ ID NO: 115793

SEQ ID NO: 640597 - RNA, 64 nt, Homo Sapiens; identical to SEQ ID NO: 115794

SEQ ID NO: 640598 - RNA, 64 nt, Homo Sapiens; identical to SEQ ID NO: 115795

SEQ ID NO: 640599 - RNA, 64 nt, Homo Sapiens; identical to SEQ ID NO: 115796

SEQ ID NO: 640600 - RNA, 64 nt, Homo Sapiens; identical to SEQ ID NO: 115797

SEQ ID NO: 640601 - RNA, 64 nt, Homo Sapiens; identical to SEQ ID NO: 173467

SEQ ID NO: 640602 - RNA, 64 nt, Homo Sapiens; identical to SEQ ID NO: 173468

SEQ ID NO: 640603 - RNA, 64 nt, Homo Sapiens; identical to SEQ ID NO: 173469

SEQ ID NO: 640604 - RNA, 64 nt, Homo Sapiens; identical to SEQ ID NO: 173470

SEQ ID NO: 640605 - RNA, 64 nt, Homo Sapiens; identical to SEQ ID NO: 173471

SEQ ID NO: 640606 - RNA, 64 nt, Homo Sapiens; identical to SEQ ID NO: 173472

SEQ ID NO: 640607 - RNA, 64 nt, Homo Sapiens; identical to SEQ ID NO: 173473

SEQ ID NO: 640608 - RNA, 64 nt, Homo Sapiens; identical to SEQ ID NO: 173474

SEQ ID NO: 640609 - RNA, 64 nt, Homo Sapiens; identical to SEQ ID NO: 173475

SEQ ID NO: 640610 - RNA, 64 nt, Homo Sapiens; identical to SEQ ID NO: 173476

SEQ ID NO: 640611 - RNA, 64 nt, Homo Sapiens; identical to SEQ ID NO: 173477

SEQ ID NO: 640612 - RNA, 64 nt, Homo Sapiens; identical to SEQ ID NO: 173478

SEQ ID NO: 640613 - RNA, 64 nt, Homo Sapiens; identical to SEQ ID NO: 173479

SEQ ID NO: 640614 - RNA, 64 nt, Homo Sapiens; identical to SEQ ID NO: 173480

SEQ ID NO: 640615 - RNA, 64 nt, Homo Sapiens; identical to SEQ ID NO: 173481

SEQ ID NO: 640616 - RNA, 64 nt, Homo Sapiens; identical to SEQ ID NO: 173482

SEQ ID NO: 640617 - RNA, 64 nt, Homo Sapiens; identical to SEQ ID NO: 173483

SEQ ID NO: 640618 - RNA, 64 nt, Homo Sapiens; identical to SEQ ID NO: 173484

SEQ ID NO: 640619 - RNA, 64 nt, Homo Sapiens; identical to SEQ ID NO: 173485

SEQ ID NO: 640620 - RNA, 64 nt, Homo Sapiens; identical to SEQ ID NO: 173486

SEQ ID NO: 640621 - RNA, 64 nt, Homo Sapiens; identical to SEQ ID NO: 173487

SEQ ID NO: 640622 - RNA, 64 nt, Homo Sapiens; identical to SEQ ID NO: 173488

SEQ ID NO: 640623 - RNA, 60 nt, Homo Sapiens
agggucuguccccagaugcugugcauagaccauuuccagggucuaaccagccucagcagu

SEQ ID NO: 640624 - RNA, 60 nt, Homo Sapiens
ucuguagaguuuauugucaacacuuuugaacauuuccaguacagccagaagccaccuuga

SEQ ID NO: 640625 - RNA, 60 nt, Homo Sapiens
cauguaccauguuuuauaaaguaucuaacucauuuccaaaaguguguuuagacuuuucaa

SEQ ID NO: 640626 - RNA, 60 nt, Homo Sapiens
cuugaaauauaggugugaacugcaaauaugcauuuccaaaaauacuuuuguauugcugcu

SEQ ID NO: 640627 - RNA, 60 nt, Homo Sapiens
auuaaaaaaaaaauccauuucuagguguuucauuuccagagacaagaggaagggcaggua

SEQ ID NO: 640628 - RNA, 60 nt, Homo Sapiens
gaccacaugugagcuucuuuacagcuucagcauuuccagagaaaauaaugucuacagucc

SEQ ID NO: 640629 - RNA, 60 nt, Homo Sapiens
uuuuucagaaaaugcaucccugauuucauucauuuccagcuugaaagccagccauauuac

SEQ ID NO: 640630 - RNA, 60 nt, Homo Sapiens
ucuagucccuaccaaacugcucuagaaggucauuuccauuuuguuugugauauuuagacg

SEQ ID NO: 640631 - RNA, 60 nt, Homo Sapiens
ccauggacucaaucugagaacaacagcauucauuuccauucauuuccauacuggcuuuug

SEQ ID NO: 640632 - RNA, 60 nt, Homo Sapiens
aaucugagaacaacagcauucauuuccauucauuuccauacuggcuuuugauuauaugca

SEQ ID NO: 640633 - RNA, 60 nt, Homo Sapiens
aguagcauaaacuuacgguguacauuuguucauuuccagcacuuuucuuccuuauggggc

SEQ ID NO: 640634 - RNA, 60 nt, Homo Sapiens
ugcaaagugacuagagaaaaucaauucuuacauuuccauuugaggguagagccacaaauu

SEQ ID NO: 640635 - RNA, 60 nt, Homo Sapiens
caucuucugaaaacuaggcgggcauugaggcauuuccauacugcagcaaacguuugccug

SEQ ID NO: 640636 - RNA, 60 nt, Homo Sapiens
uacugcugcagcauuuuggucaaaauaacucauuuccaacgauugaacacuuuaguaaug

SEQ ID NO: 640637 - RNA, 60 nt, Homo Sapiens
auguuuuuuucacuuaauauuuuauauauacauuuccauguauugauguaguuaguccac

SEQ ID NO: 640638 - RNA, 60 nt, Homo Sapiens
guuuucauaggcuauuauauauucucgcagcauuuccaguuaagaggauauuagguauau

SEQ ID NO: 640639 - RNA, 60 nt, Homo Sapiens
guuacccaaacucaucuucuaaaaucugugcauuuccaugguggcugacacacuugucau

SEQ ID NO: 640640 - RNA, 60 nt, Homo Sapiens
aagugagcauuucuuuuuaaauuuucuugacauuuccaagcuuauuaugaauaauauugc

SEQ ID NO: 640641 - RNA, 60 nt, Homo Sapiens
aacuccacuguuucuauaauaucacuaaaacauuuccacuuuagauaucaguuaggauac

SEQ ID NO: 640642 - RNA, 60 nt, Homo Sapiens
ugccuuauugcuacuucaaguggaaaaugacauuuccauugaaaagauaucacaacucua

SEQ ID NO: 640643 - RNA, 60 nt, Homo Sapiens
ccaccacaaaguugccacagcacuguagcccauuuccaccucccaacuucauuucccccu

SEQ ID NO: 640644 - RNA, 60 nt, Homo Sapiens
uuguucuguauaggaacagagcguccguagcauuuccagucuggaagugcaugaggcaga

SEQ ID NO: 640645 - RNA, 60 nt, Homo Sapiens
uaacuguuguguugaaucagucacauuuuccauuuccaaaaaccagauucaugagcuuuc

SEQ ID NO: 640646 - RNA, 60 nt, Homo Sapiens
ugaaggagaggcaaggaaaaaugagugugucauuuccacaacugggcuuuaaagagcgaa

SEQ ID NO: 640647 - RNA, 60 nt, Homo Sapiens
uaccugcgcagucuaaacauagcuguggaucauuuccaacuuucaacuucacuccgggcc

SEQ ID NO: 640648 - RNA, 60 nt, Homo Sapiens
aggcugguuuccugugcagcagguggaguucauuuccaacccagagguccgugcacagaa

SEQ ID NO: 640649 - RNA, 60 nt, Homo Sapiens
gauaaaccaaggauuuuguguuuaacaauccauuuccagugucuucgccacauaaaauag

SEQ ID NO: 640650 - RNA, 60 nt, Homo Sapiens
aaaggauaguuuaugaguaaucuuuaaaaccauuuccauaccaucuguauauaaccauuu

SEQ ID NO: 640651 - RNA, 60 nt, Homo Sapiens
uuuagauccuacuccauaccgcggccagcacauuuccacugauuccaggcgugagccacu

SEQ ID NO: 640652 - RNA, 60 nt, Homo Sapiens
uuauuuguuuguuuguuuauggccuuccuacauuuccacucugugcuccuuaagccucau

SEQ ID NO: 640653 - RNA, 60 nt, Homo Sapiens
aaaaugggcagagagagaugaccucggaagcauuuccacagauggugucaggguuucaag

SEQ ID NO: 640654 - RNA, 60 nt, Homo Sapiens
caacuguggucaaaguucauaggugucguacauuuccauuauuugcuaaaaucaugcaau

SEQ ID NO: 640655 - RNA, 60 nt, Homo Sapiens
uuacuaucaaauuauaguaaguaccagaaacauuuccaauucuuugcaucagcuuaccuu

SEQ ID NO: 640656 - RNA, 60 nt, Homo Sapiens
accauggauucugccuuuggagcaucguggcauuuccagaaaugcccagaaagugccaga

SEQ ID NO: 640657 - RNA, 60 nt, Homo Sapiens
uucauuuucgagccaucaguauggcugcuacauuuccauuagauccaaaguuagcaguau

SEQ ID NO: 640658 - RNA, 60 nt, Homo Sapiens
aggaaagggaaagucaugauuuuauucuugcauuuccauauucauuguuuaaugaaauau

SEQ ID NO: 640659 - RNA, 60 nt, Homo Sapiens
ucaucacuguuggagaucauggggaggucccauuuccacugggcaaccuccuucgacgug

SEQ ID NO: 640660 - RNA, 60 nt, Homo Sapiens; identical to SEQ ID NO: 59927

SEQ ID NO: 640661 - RNA, 60 nt, Homo Sapiens
ucaacucuaaaugaagucuucagguuaugacauuuccaugguguucugaccagggaguga

SEQ ID NO: 640662 - RNA, 60 nt, Homo Sapiens
ucuuuucagugaucuggauaaggacaaauacauuuccagauauauacuuugccacuggaa

SEQ ID NO: 640663 - RNA, 60 nt, Homo Sapiens
cguccauucuuuuaaauguugucucacuugcauuuccagucuuggccaucaaaucaauga

SEQ ID NO: 640664 - RNA, 60 nt, Homo Sapiens
aaaguggcaucucauggugguuuuaauuugcauuuccauaauaucuaauuagguugagcu

SEQ ID NO: 640665 - RNA, 60 nt, Homo Sapiens
guguaggcaauuauguccugacucaccccucauuuccagaauuuaauuuugaaaaaggug

SEQ ID NO: 640666 - RNA, 60 nt, Homo Sapiens
aacguauuuauagcaugaaguucuaccaaacauuuccagaaaaaaagaaaagaaaucugu

SEQ ID NO: 640667 - RNA, 64 nt, Homo Sapiens
ggucauaaaacauuaagaaaauuauggcuguugcugucauuacauaucuauuaaaugucaucaa

SEQ ID NO: 640668 - RNA, 64 nt, Homo Sapiens
augaauaauaggaaaguuguauuaauucaguauuugucauuaugcaguauuuuaauaccuacau

SEQ ID NO: 640669 - RNA, 64 nt, Homo Sapiens
caucauagcauguacuuccaucauuaggcgauuuugucauuaaagauauguucugagaaaugug

SEQ ID NO: 640670 - RNA, 64 nt, Homo Sapiens
cgauuuugucauuaaacaucuguucugagaaaugugucauuagggucacuuaaggauggagaua

SEQ ID NO: 640671 - RNA, 64 nt, Homo Sapiens
uagaagaauugcauaaaacguaguaaauggggucugucauuagcaaaggcaaaucuaagcaauc

SEQ ID NO: 640672 - RNA, 64 nt, Homo Sapiens
guauuaaaagauuguuuaacaguauguguggugaugucauuaucuccagagaggcuucaagaaa

SEQ ID NO: 640673 - RNA, 64 nt, Homo Sapiens
caccauccaaggaugggcagaugcacggaacugaugucauuagaccaggugaggugcuguguuc

SEQ ID NO: 640674 - RNA, 64 nt, Homo Sapiens
gccacaguuuggugcuugugaguuugagguucauugucauuaugggaggccacccccaggaagg

SEQ ID NO: 640675 - RNA, 64 nt, Homo Sapiens
aauuguuuuauauggugcucacggauuccaaacaugucauuauacuuaagugauaaccaggguc

SEQ ID NO: 640676 - RNA, 64 nt, Homo Sapiens
gcugagguugagaaauacucuauccagcccaaaaugucauuagucaacucccacaacaaagaau

SEQ ID NO: 640677 - RNA, 64 nt, Homo Sapiens
aggaaauuguuugacauaacacaggguucaggggugucauuaaagacacacuuuuuuugccuug

SEQ ID NO: 640678 - RNA, 64 nt, Homo Sapiens
caugaguguaauggugauaugaaaaacuuugucuugucauuauaauaauaaaaaaaugaacauu

SEQ ID NO: 640679 - RNA, 64 nt, Homo Sapiens
uguaguaauuacucuuugaacagguuuuguguuuugucauuagcucugcccuuuuuaauuaaau

SEQ ID NO: 640680 - RNA, 64 nt, Homo Sapiens
ucaucccuacccuggcccagaugaucacugaucuugucauuauagaugaguuuugccaguucaa

SEQ ID NO: 640681 - RNA, 64 nt, Homo Sapiens
ugugaugcugugcaaaacuugcauauagcauaugugucauuacauacgguuuuucuaccugauu

SEQ ID NO: 640682 - RNA, 64 nt, Homo Sapiens
uaugaaauggauauaugcuaaaguuuagaauuuuugucauuaaauuaacauagguggcuagcca

SEQ ID NO: 640683 - RNA, 64 nt, Homo Sapiens
ccauauguggacuagugauguaaaaccugagcaaugucauuaauaaaaauguuuggacugcuuu

SEQ ID NO: 640684 - RNA, 64 nt, Homo Sapiens
aaauaaucuguguggcaaaagcuaaauuuuuuacugucauuacucucuuguuuaaguguguguu

SEQ ID NO: 640685 - RNA, 64 nt, Homo Sapiens
auuagugaauucacguaaaaguaauuguuauuauugucauuaguguauucuguaaauauuaucu

SEQ ID NO: 640686 - RNA, 64 nt, Homo Sapiens
ucccuuucuccacuugauuaucuuuagccuuaucugucauuaucauguaaugaauguaggaaaa

SEQ ID NO: 640687 - RNA, 64 nt, Homo Sapiens
aaaguucagcagugugugcacagcuuucuuuugguuggcagagauucaggaucauggaguacug

SEQ ID NO: 640688 - RNA, 64 nt, Homo Sapiens
aguacugcucucauaauugaagacguguuuguuauuggcagagaaccuuaaaaaaggccuuuac

SEQ ID NO: 640689 - RNA, 64 nt, Homo Sapiens
uucagaauaacauuuuaaacaacaauauaauucuuuggcagauaucuugguucuagcuaguaau

SEQ ID NO: 640690 - RNA, 64 nt, Homo Sapiens
auuccucuagaauguguaucuaauuguuauuuuuuuggcagauaauacauuuaaauaucuuuga

SEQ ID NO: 640691 - RNA, 64 nt, Homo Sapiens
uuucccaaauuguaauaacuugccugaaaauauauuggcagaauuucauuauuuuaaagcuaau

SEQ ID NO: 640692 - RNA, 64 nt, Homo Sapiens
ggcacugaacuguugggugagucccuucuuaugguuggcagaagaaccuuauauggugguuuua

SEQ ID NO: 640693 - RNA, 64 nt, Homo Sapiens
aacaccuuguuugcgguguuggaacaugguuccuuuggcagaagugcuuuuuuuuuaaucgcag

SEQ ID NO: 640694 - RNA, 64 nt, Homo Sapiens
cucaccucugccacccaucuacuugcauucgucuuuggcagaccucaagauaaauauggguuaa

SEQ ID NO: 640695 - RNA, 64 nt, Homo Sapiens
ggcguuuuccuagccuggagaugggaaaauaugcuuggcagagacaggaaugcugugugcuugu

SEQ ID NO: 640696 - RNA, 64 nt, Homo Sapiens
gaggguagacggcagaugccugacagagaguggguuggcagacaacacacuagcauuuucacgg

SEQ ID NO: 640697 - RNA, 64 nt, Homo Sapiens
cuucccuuccaucucuucaccccuagcugucaguuuggcagauuuucccucguuaccuccaguu

SEQ ID NO: 640698 - RNA, 64 nt, Homo Sapiens
acauuucaugcauagcuuggcucagaaggugccauuggcagacaggcacaugggaggcuggagu

SEQ ID NO: 640699 - RNA, 64 nt, Homo Sapiens
guggaagccuuuaauugaacagaauucuagaaauuuggcagauaagcaugcuagcacucuagac

SEQ ID NO: 640700 - RNA, 64 nt, Homo Sapiens
agaaaauaaggucuaaaggaaaauauuguauugcuuggcagaaaaucuuggcauaauggccaga

SEQ ID NO: 640701 - RNA, 64 nt, Homo Sapiens
ucuacucugugcaccaugcuaggaagcuuccuuuuuggcagaauauguuuggcagcaaagcuau

SEQ ID NO: 640702 - RNA, 64 nt, Homo Sapiens
cauuuuuagcucagagcaacccuuaagagaacuuuuggcagauuuuguuggcauuauugaaaua

SEQ ID NO: 640703 - RNA, 64 nt, Homo Sapiens
cacgugcccuacgauggccuaacaggagugcccauuggcagauuacacauguaaauaugaccuc

SEQ ID NO: 640704 - RNA, 64 nt, Homo Sapiens
auaauaagguggaauuugcaggucagcccaggaauuggcagaggaaguaggugucugauaaccc

SEQ ID NO: 640705 - RNA, 64 nt, Homo Sapiens
cuugcccaaggcuggauaggugugaagucccagcuuggcagagaucaauggcuggccaguguag

SEQ ID NO: 640706 - RNA, 64 nt, Homo Sapiens
agccccagcgaggacuuguuucugucuucuguguuuggcagaccgacagcccccuccccuuccc

SEQ ID NO: 640707 - RNA, 64 nt, Homo Sapiens
caggcgggccuccucccaggagacagacuuucucuuggcagaugggauagaagcccaugacuuc

SEQ ID NO: 640708 - RNA, 64 nt, Homo Sapiens
agcaagugauaugauguguaaaugggcccggccuuuggcagaggccugaauaacacguggcaca

SEQ ID NO: 640709 - RNA, 64 nt, Homo Sapiens
cuuuuuuuuuuuuuuugaaauuaauuuuucaaauuuggcagacauucugcuagacagauaacuu

SEQ ID NO: 640710 - RNA, 64 nt, Homo Sapiens
uuguguucuuaaauucagucacaaagcaucuauuuuggcagaaaaaauguaaguauccuuaaaa

SEQ ID NO: 640711 - RNA, 64 nt, Homo Sapiens
ggcauccggccugugcugggcauggguggugacauuggcagaaauggccacuggaaaggggagc

SEQ ID NO: 640712 - RNA, 64 nt, Homo Sapiens
ccuggaagguucauggggaaacucgcuccuucuguuggcagaggacagccccuggggaacccca

SEQ ID NO: 640713 - RNA, 64 nt, Homo Sapiens
auguaacuuaaagccuggcuuuaugauauccuacuuggcagaaagacauuuuucuccucaguag

SEQ ID NO: 640714 - RNA, 64 nt, Homo Sapiens
ccaguuaagucccaguguaaggguuggucuuugguuggcagaacugaacauggugguuugcacu

SEQ ID NO: 640715 - RNA, 64 nt, Homo Sapiens
gcuagagaagaaucgccuuuauggauagcugggguuggcagauguaauggcauguguuuguaaa

SEQ ID NO: 640716 - RNA, 64 nt, Homo Sapiens
uuuugcuggcucugggagccaugguuauaacacauuggcagacuacuuuucaccuacuccuuuc

SEQ ID NO: 640717 - RNA, 64 nt, Homo Sapiens; identical to SEQ ID NO: 437867

SEQ ID NO: 640718 - RNA, 64 nt, Homo Sapiens; identical to SEQ ID NO: 437868

SEQ ID NO: 640719 - RNA, 64 nt, Homo Sapiens; identical to SEQ ID NO: 437869

SEQ ID NO: 640720 - RNA, 64 nt, Homo Sapiens; identical to SEQ ID NO: 437870

SEQ ID NO: 640721 - RNA, 64 nt, Homo Sapiens; identical to SEQ ID NO: 437871

SEQ ID NO: 640722 - RNA, 64 nt, Homo Sapiens; identical to SEQ ID NO: 437872

SEQ ID NO: 640723 - RNA, 64 nt, Homo Sapiens; identical to SEQ ID NO: 437873

SEQ ID NO: 640724 - RNA, 64 nt, Homo Sapiens; identical to SEQ ID NO: 437874

SEQ ID NO: 640725 - RNA, 64 nt, Homo Sapiens; identical to SEQ ID NO: 437875

SEQ ID NO: 640726 - RNA, 64 nt, Homo Sapiens; identical to SEQ ID NO: 437876

SEQ ID NO: 640727 - RNA, 64 nt, Homo Sapiens; identical to SEQ ID NO: 437877

SEQ ID NO: 640728 - RNA, 64 nt, Homo Sapiens; identical to SEQ ID NO: 437878

SEQ ID NO: 640729 - RNA, 64 nt, Homo Sapiens; identical to SEQ ID NO: 437879

SEQ ID NO: 640730 - RNA, 64 nt, Homo Sapiens; identical to SEQ ID NO: 437880

SEQ ID NO: 640731 - RNA, 64 nt, Homo Sapiens; identical to SEQ ID NO: 437881

SEQ ID NO: 640732 - RNA, 64 nt, Homo Sapiens; identical to SEQ ID NO: 437882

SEQ ID NO: 640733 - RNA, 64 nt, Homo Sapiens; identical to SEQ ID NO: 437883

SEQ ID NO: 640734 - RNA, 64 nt, Homo Sapiens; identical to SEQ ID NO: 437884

SEQ ID NO: 640735 - RNA, 64 nt, Homo Sapiens; identical to SEQ ID NO: 437885

SEQ ID NO: 640736 - RNA, 64 nt, Homo Sapiens; identical to SEQ ID NO: 437886

SEQ ID NO: 640737 - RNA, 64 nt, Homo Sapiens; identical to SEQ ID NO: 437887

SEQ ID NO: 640738 - RNA, 64 nt, Homo Sapiens; identical to SEQ ID NO: 437888

SEQ ID NO: 640739 - RNA, 64 nt, Homo Sapiens; identical to SEQ ID NO: 437889

SEQ ID NO: 640740 - RNA, 64 nt, Homo Sapiens; identical to SEQ ID NO: 437890

SEQ ID NO: 640741 - RNA, 64 nt, Homo Sapiens; identical to SEQ ID NO: 437891

SEQ ID NO: 640742 - RNA, 64 nt, Homo Sapiens; identical to SEQ ID NO: 437892

SEQ ID NO: 640743 - RNA, 64 nt, Homo Sapiens
cuguguucagccacacccagugguagcuccaccaaaucaugaacagccuaauuuugagugucug

SEQ ID NO: 640744 - RNA, 64 nt, Homo Sapiens
ucacauauugguauguuguuaaccugguagauuaaaucaugagaaugauuagaaagacgggcaa

SEQ ID NO: 640745 - RNA, 64 nt, Homo Sapiens
ucccuuguuucaaaagacuuuaaacuuguguuugaaucaugaauauggguaaauaauuugucau

SEQ ID NO: 640746 - RNA, 64 nt, Homo Sapiens
gauuguauguaucacuuacuaagcugucugaggcaaucaugauuauuuuauacauaaaggccag

SEQ ID NO: 640747 - RNA, 64 nt, Homo Sapiens
ccugguaaacaauaaagaagcaaguuacaaaaggaaucaugaauacugaauaaaugacugagaa

SEQ ID NO: 640748 - RNA, 64 nt, Homo Sapiens
gcaaaggaucacugcuuaaagucuccaugccaugaaucaugagaauucaggaaagcugggugcu

SEQ ID NO: 640749 - RNA, 64 nt, Homo Sapiens
accagcacugcucuuccccuccuauaaucauaauaaucaugauaaccugaaacauguuacuggg

SEQ ID NO: 640750 - RNA, 64 nt, Homo Sapiens
caaagcaaaaaaaaaugcuuuaauucaaauuaaaaaucaugauacuagagaugggagucugugg

SEQ ID NO: 640751 - RNA, 64 nt, Homo Sapiens
gacuaaggcaguggcuguggauaguucaugugaaaaucaugacaacuagguaacagguucuuaa

SEQ ID NO: 640752 - RNA, 64 nt, Homo Sapiens
agagagaagguaaguggcuuggaggacuugaaggaaucaugauguaagauuuaagcugagccag

SEQ ID NO: 640753 - RNA, 64 nt, Homo Sapiens
ucaggaguucgagaccagccggcugaggugggcgaaucaugagaguaaucccagcacuuugggg

SEQ ID NO: 640754 - RNA, 64 nt, Homo Sapiens
uaucacuaguugccagaauauuuuuaaggccuauaaucaugaaauuaauuguacuuguauuaga

SEQ ID NO: 640755 - RNA, 64 nt, Homo Sapiens
uaccccagaauugaacuguuucaaaacuuaugaaaaucaugaacacauauugugauuaaugcuu

SEQ ID NO: 640756 - RNA, 64 nt, Homo Sapiens
uuauuguuaaaauuaaugaauauuugucaaauaaaaucaugaucaaagaauuuaagaaagaaua

SEQ ID NO: 640757 - RNA, 64 nt, Homo Sapiens
gcccagucucuaugaauguuauggccuagggaagaaucaugaaacucuuuagcuugauuagaug

SEQ ID NO: 640758 - RNA, 64 nt, Homo Sapiens
ggaagaagggaaggcggaggagucuauaagaaggaaucaugauuucuauuuagcagauuggaug

SEQ ID NO: 640759 - RNA, 64 nt, Homo Sapiens
gacuucugugcuuucuuuccuguucccuacagguaaucaugaauauuuucaaggacuucccccc

SEQ ID NO: 640760 - RNA, 64 nt, Homo Sapiens
cauugacuguaagaccucuguagggcaaugugaaaaucaugauugcuacagaagcacugagaua

SEQ ID NO: 640761 - RNA, 64 nt, Homo Sapiens
gccugauaugccaauagcauacaaacucaauagcaaucaugacugagccaaucacuguuucuca

SEQ ID NO: 640762 - RNA, 64 nt, Homo Sapiens
acugauacuuuugucagauaucacccuguccuuaaaucaugaucacuuaaaucaggggucagca

SEQ ID NO: 640763 - RNA, 64 nt, Homo Sapiens; identical to SEQ ID NO: 502943

SEQ ID NO: 640764 - RNA, 64 nt, Homo Sapiens; identical to SEQ ID NO: 502944

SEQ ID NO: 640765 - RNA, 64 nt, Homo Sapiens; identical to SEQ ID NO: 502945

SEQ ID NO: 640766 - RNA, 64 nt, Homo Sapiens; identical to SEQ ID NO: 502946

SEQ ID NO: 640767 - RNA, 64 nt, Homo Sapiens; identical to SEQ ID NO: 502947

SEQ ID NO: 640768 - RNA, 64 nt, Homo Sapiens; identical to SEQ ID NO: 502948

SEQ ID NO: 640769 - RNA, 64 nt, Homo Sapiens; identical to SEQ ID NO: 502949

SEQ ID NO: 640770 - RNA, 64 nt, Homo Sapiens; identical to SEQ ID NO: 502950

SEQ ID NO: 640771 - RNA, 64 nt, Homo Sapiens; identical to SEQ ID NO: 502951

SEQ ID NO: 640772 - RNA, 64 nt, Homo Sapiens; identical to SEQ ID NO: 502952

SEQ ID NO: 640773 - RNA, 64 nt, Homo Sapiens; identical to SEQ ID NO: 502953

SEQ ID NO: 640774 - RNA, 64 nt, Homo Sapiens; identical to SEQ ID NO: 502954

SEQ ID NO: 640775 - RNA, 64 nt, Homo Sapiens; identical to SEQ ID NO: 502955

SEQ ID NO: 640776 - RNA, 64 nt, Homo Sapiens; identical to SEQ ID NO: 502956

SEQ ID NO: 640777 - RNA, 64 nt, Homo Sapiens; identical to SEQ ID NO: 502957

SEQ ID NO: 640778 - RNA, 64 nt, Homo Sapiens; identical to SEQ ID NO: 502958

SEQ ID NO: 640779 - RNA, 64 nt, Homo Sapiens; identical to SEQ ID NO: 502959

SEQ ID NO: 640780 - RNA, 64 nt, Homo Sapiens; identical to SEQ ID NO: 502960

SEQ ID NO: 640781 - RNA, 64 nt, Homo Sapiens; identical to SEQ ID NO: 502961

SEQ ID NO: 640782 - RNA, 64 nt, Homo Sapiens; identical to SEQ ID NO: 502962

SEQ ID NO: 640783 - RNA, 64 nt, Homo Sapiens; identical to SEQ ID NO: 502963

SEQ ID NO: 640784 - RNA, 64 nt, Homo Sapiens; identical to SEQ ID NO: 502964

SEQ ID NO: 640785 - RNA, 64 nt, Homo Sapiens; identical to SEQ ID NO: 502965

SEQ ID NO: 640786 - RNA, 64 nt, Homo Sapiens; identical to SEQ ID NO: 502966

SEQ ID NO: 640787 - RNA, 64 nt, Homo Sapiens; identical to SEQ ID NO: 502967

SEQ ID NO: 640788 - RNA, 64 nt, Homo Sapiens; identical to SEQ ID NO: 502968

SEQ ID NO: 640789 - RNA, 64 nt, Homo Sapiens; identical to SEQ ID NO: 502969

SEQ ID NO: 640790 - RNA, 64 nt, Homo Sapiens; identical to SEQ ID NO: 502970

SEQ ID NO: 640791 - RNA, 64 nt, Homo Sapiens; identical to SEQ ID NO: 502971

SEQ ID NO: 640792 - RNA, 64 nt, Homo Sapiens; identical to SEQ ID NO: 502972

SEQ ID NO: 640793 - RNA, 64 nt, Homo Sapiens; identical to SEQ ID NO: 502973

SEQ ID NO: 640794 - RNA, 64 nt, Homo Sapiens; identical to SEQ ID NO: 502974

SEQ ID NO: 640795 - RNA, 64 nt, Homo Sapiens; identical to SEQ ID NO: 502975

SEQ ID NO: 640796 - RNA, 64 nt, Homo Sapiens; identical to SEQ ID NO: 502976

SEQ ID NO: 640797 - RNA, 64 nt, Homo Sapiens; identical to SEQ ID NO: 502977

SEQ ID NO: 640798 - RNA, 64 nt, Homo Sapiens; identical to SEQ ID NO: 502978

SEQ ID NO: 640799 - RNA, 64 nt, Homo Sapiens; identical to SEQ ID NO: 502979

SEQ ID NO: 640800 - RNA, 64 nt, Homo Sapiens; identical to SEQ ID NO: 315746

SEQ ID NO: 640801 - RNA, 64 nt, Homo Sapiens; identical to SEQ ID NO: 315747

SEQ ID NO: 640802 - RNA, 64 nt, Homo Sapiens; identical to SEQ ID NO: 315748

SEQ ID NO: 640803 - RNA, 64 nt, Homo Sapiens; identical to SEQ ID NO: 315749

SEQ ID NO: 640804 - RNA, 64 nt, Homo Sapiens; identical to SEQ ID NO: 114759

SEQ ID NO: 640805 - RNA, 64 nt, Homo Sapiens; identical to SEQ ID NO: 114760

SEQ ID NO: 640806 - RNA, 64 nt, Homo Sapiens; identical to SEQ ID NO: 114761

SEQ ID NO: 640807 - RNA, 64 nt, Homo Sapiens; identical to SEQ ID NO: 114762

SEQ ID NO: 640808 - RNA, 64 nt, Homo Sapiens; identical to SEQ ID NO: 114763

SEQ ID NO: 640809 - RNA, 64 nt, Homo Sapiens; identical to SEQ ID NO: 114764

SEQ ID NO: 640810 - RNA, 64 nt, Homo Sapiens; identical to SEQ ID NO: 114765

SEQ ID NO: 640811 - RNA, 64 nt, Homo Sapiens; identical to SEQ ID NO: 114766

SEQ ID NO: 640812 - RNA, 64 nt, Homo Sapiens; identical to SEQ ID NO: 114767

SEQ ID NO: 640813 - RNA, 64 nt, Homo Sapiens; identical to SEQ ID NO: 114768

SEQ ID NO: 640814 - RNA, 64 nt, Homo Sapiens; identical to SEQ ID NO: 114769

SEQ ID NO: 640815 - RNA, 64 nt, Homo Sapiens; identical to SEQ ID NO: 114770

SEQ ID NO: 640816 - RNA, 64 nt, Homo Sapiens; identical to SEQ ID NO: 114771

SEQ ID NO: 640817 - RNA, 64 nt, Homo Sapiens; identical to SEQ ID NO: 114772

SEQ ID NO: 640818 - RNA, 64 nt, Homo Sapiens; identical to SEQ ID NO: 114773

SEQ ID NO: 640819 - RNA, 64 nt, Homo Sapiens; identical to SEQ ID NO: 114774

SEQ ID NO: 640820 - RNA, 64 nt, Homo Sapiens; identical to SEQ ID NO: 114775

SEQ ID NO: 640821 - RNA, 64 nt, Homo Sapiens; identical to SEQ ID NO: 114776

SEQ ID NO: 640822 - RNA, 64 nt, Homo Sapiens; identical to SEQ ID NO: 114777

SEQ ID NO: 640823 - RNA, 64 nt, Homo Sapiens; identical to SEQ ID NO: 114778

SEQ ID NO: 640824 - RNA, 64 nt, Homo Sapiens; identical to SEQ ID NO: 114779

SEQ ID NO: 640825 - RNA, 64 nt, Homo Sapiens; identical to SEQ ID NO: 114780

SEQ ID NO: 640826 - RNA, 64 nt, Homo Sapiens; identical to SEQ ID NO: 114781

SEQ ID NO: 640827 - RNA, 64 nt, Homo Sapiens; identical to SEQ ID NO: 114782

SEQ ID NO: 640828 - RNA, 64 nt, Homo Sapiens; identical to SEQ ID NO: 114783

SEQ ID NO: 640829 - RNA, 64 nt, Homo Sapiens; identical to SEQ ID NO: 114784

SEQ ID NO: 640830 - RNA, 64 nt, Homo Sapiens; identical to SEQ ID NO: 114785

SEQ ID NO: 640831 - RNA, 64 nt, Homo Sapiens; identical to SEQ ID NO: 114786

SEQ ID NO: 640832 - RNA, 64 nt, Homo Sapiens; identical to SEQ ID NO: 114787

SEQ ID NO: 640833 - RNA, 64 nt, Homo Sapiens; identical to SEQ ID NO: 114788

SEQ ID NO: 640834 - RNA, 64 nt, Homo Sapiens; identical to SEQ ID NO: 114789

SEQ ID NO: 640835 - RNA, 64 nt, Homo Sapiens; identical to SEQ ID NO: 114790

SEQ ID NO: 640836 - RNA, 64 nt, Homo Sapiens; identical to SEQ ID NO: 114791

SEQ ID NO: 640837 - RNA, 64 nt, Homo Sapiens; identical to SEQ ID NO: 114792

SEQ ID NO: 640838 - RNA, 64 nt, Homo Sapiens; identical to SEQ ID NO: 114793

SEQ ID NO: 640839 - RNA, 64 nt, Homo Sapiens; identical to SEQ ID NO: 114794

SEQ ID NO: 640840 - RNA, 64 nt, Homo Sapiens; identical to SEQ ID NO: 114795

SEQ ID NO: 640841 - RNA, 64 nt, Homo Sapiens; identical to SEQ ID NO: 114796

SEQ ID NO: 640842 - RNA, 64 nt, Homo Sapiens; identical to SEQ ID NO: 114797

SEQ ID NO: 640843 - RNA, 64 nt, Homo Sapiens; identical to SEQ ID NO: 114798

SEQ ID NO: 640844 - RNA, 64 nt, Homo Sapiens; identical to SEQ ID NO: 114799

SEQ ID NO: 640845 - RNA, 64 nt, Homo Sapiens; identical to SEQ ID NO: 114800

SEQ ID NO: 640846 - RNA, 64 nt, Homo Sapiens; identical to SEQ ID NO: 114801

SEQ ID NO: 640847 - RNA, 64 nt, Homo Sapiens; identical to SEQ ID NO: 114802

SEQ ID NO: 640848 - RNA, 64 nt, Homo Sapiens; identical to SEQ ID NO: 114803

SEQ ID NO: 640849 - RNA, 64 nt, Homo Sapiens; identical to SEQ ID NO: 114804

SEQ ID NO: 640850 - RNA, 64 nt, Homo Sapiens; identical to SEQ ID NO: 114805

SEQ ID NO: 640851 - RNA, 64 nt, Homo Sapiens; identical to SEQ ID NO: 114806

SEQ ID NO: 640852 - RNA, 64 nt, Homo Sapiens; identical to SEQ ID NO: 114807

SEQ ID NO: 640853 - RNA, 64 nt, Homo Sapiens; identical to SEQ ID NO: 415046

SEQ ID NO: 640854 - RNA, 64 nt, Homo Sapiens; identical to SEQ ID NO: 415047

SEQ ID NO: 640855 - RNA, 64 nt, Homo Sapiens
cagaauaacauuuuaaacuacaauauaauucuuuggcagauauuuugguucuagcuaguaauaa

SEQ ID NO: 640856 - RNA, 64 nt, Homo Sapiens
uccucuagaauguguaucuuauuguuauuuuuuuggcagauaauacauuuaaauaucuuugaua

SEQ ID NO: 640857 - RNA, 64 nt, Homo Sapiens
cuguccccagacccugccacuucugacucagguuggcagauaaacaauuugcauccaccuuccc

SEQ ID NO: 640858 - RNA, 64 nt, Homo Sapiens
uaagaaaggaaauggcccuagugugccauuucauggcagauaugaagguuccuaugccuagccu

SEQ ID NO: 640859 - RNA, 64 nt, Homo Sapiens
gccuugcacuggcucuucuaaaggacuuuuggagggcagauaauuucaucuguuaaauccaaca

SEQ ID NO: 640860 - RNA, 64 nt, Homo Sapiens
uucacucuccuuagaauuggaacuaugcaguuaaggcagauaaaauguacagauguuucauaua

SEQ ID NO: 640861 - RNA, 64 nt, Homo Sapiens; identical to SEQ ID NO: 283920

SEQ ID NO: 640862 - RNA, 64 nt, Homo Sapiens; identical to SEQ ID NO: 283921

SEQ ID NO: 640863 - RNA, 64 nt, Homo Sapiens; identical to SEQ ID NO: 283922

SEQ ID NO: 640864 - RNA, 64 nt, Homo Sapiens; identical to SEQ ID NO: 283923

SEQ ID NO: 640865 - RNA, 64 nt, Homo Sapiens; identical to SEQ ID NO: 283924

SEQ ID NO: 640866 - RNA, 64 nt, Homo Sapiens; identical to SEQ ID NO: 283925

SEQ ID NO: 640867 - RNA, 64 nt, Homo Sapiens; identical to SEQ ID NO: 283926

SEQ ID NO: 640868 - RNA, 64 nt, Homo Sapiens; identical to SEQ ID NO: 283927

SEQ ID NO: 640869 - RNA, 64 nt, Homo Sapiens; identical to SEQ ID NO: 283928

SEQ ID NO: 640870 - RNA, 64 nt, Homo Sapiens; identical to SEQ ID NO: 283929

SEQ ID NO: 640871 - RNA, 64 nt, Homo Sapiens; identical to SEQ ID NO: 283930

SEQ ID NO: 640872 - RNA, 64 nt, Homo Sapiens; identical to SEQ ID NO: 283931

SEQ ID NO: 640873 - RNA, 64 nt, Homo Sapiens; identical to SEQ ID NO: 283932

SEQ ID NO: 640874 - RNA, 64 nt, Homo Sapiens; identical to SEQ ID NO: 283933

SEQ ID NO: 640875 - RNA, 64 nt, Homo Sapiens; identical to SEQ ID NO: 283934

SEQ ID NO: 640876 - RNA, 64 nt, Homo Sapiens; identical to SEQ ID NO: 283935

SEQ ID NO: 640877 - RNA, 64 nt, Homo Sapiens; identical to SEQ ID NO: 283930

SEQ ID NO: 640878 - RNA, 64 nt, Homo Sapiens; identical to SEQ ID NO: 283937

SEQ ID NO: 640879 - RNA, 64 nt, Homo Sapiens; identical to SEQ ID NO: 283938

SEQ ID NO: 640880 - RNA, 64 nt, Homo Sapiens; identical to SEQ ID NO: 283939

SEQ ID NO: 640881 - RNA, 64 nt, Homo Sapiens; identical to SEQ ID NO: 283940

SEQ ID NO: 640882 - RNA, 64 nt, Homo Sapiens; identical to SEQ ID NO: 283941

SEQ ID NO: 640883 - RNA, 64 nt, Homo Sapiens; identical to SEQ ID NO: 283942

SEQ ID NO: 640884 - RNA, 64 nt, Homo Sapiens; identical to SEQ ID NO: 283943

SEQ ID NO: 640885 - RNA, 64 nt, Homo Sapiens; identical to SEQ ID NO: 283944

SEQ ID NO: 640886 - RNA, 60 nt, Homo Sapiens; identical to SEQ ID NO: 283945

SEQ ID NO: 640887 - RNA, 64 nt, Homo Sapiens; identical to SEQ ID NO: 283946

SEQ ID NO: 640888 - RNA, 64 nt, Homo Sapiens; identical to SEQ ID NO: 283947

SEQ ID NO: 640889 - RNA, 64 nt, Homo Sapiens; identical to SEQ ID NO: 283948

SEQ ID NO: 640890 - RNA, 64 nt, Homo Sapiens; identical to SEQ ID NO: 283949

SEQ ID NO: 640891 - RNA, 64 nt, Homo Sapiens; identical to SEQ ID NO: 283950

SEQ ID NO: 640892 - RNA, 64 nt, Homo Sapiens; identical to SEQ ID NO: 283951

SEQ ID NO: 640893 - RNA, 64 nt, Homo Sapiens; identical to SEQ ID NO: 283952

SEQ ID NO: 640894 - RNA, 64 nt, Homo Sapiens; identical to SEQ ID NO: 283953

SEQ ID NO: 640895 - RNA, 64 nt, Homo Sapiens; identical to SEQ ID NO: 283954

SEQ ID NO: 640896 - RNA, 64 nt, Homo Sapiens; identical to SEQ ID NO: 283955

SEQ ID NO: 640897 - RNA, 64 nt, Homo Sapiens; identical to SEQ ID NO: 283956

SEQ ID NO: 640898 - RNA, 64 nt, Homo Sapiens; identical to SEQ ID NO: 283957

SEQ ID NO: 640899 - RNA, 64 nt, Homo Sapiens; identical to SEQ ID NO: 283958

SEQ ID NO: 640900 - RNA, 64 nt, Homo Sapiens; identical to SEQ ID NO: 283959

SEQ ID NO: 640901 - RNA, 64 nt, Homo Sapiens; identical to SEQ ID NO: 283960

SEQ ID NO: 640902 - RNA, 64 nt, Homo Sapiens; identical to SEQ ID NO: 283961

SEQ ID NO: 640903 - RNA, 64 nt, Homo Sapiens; identical to SEQ ID NO: 283962

SEQ ID NO: 640904 - RNA, 64 nt, Homo Sapiens; identical to SEQ ID NO: 283963

SEQ ID NO: 640905 - RNA, 64 nt, Homo Sapiens; identical to SEQ ID NO: 283964

SEQ ID NO: 640906 - RNA, 64 nt, Homo Sapiens; identical to SEQ ID NO: 283965

SEQ ID NO: 640907 - RNA, 64 nt, Homo Sapiens; identical to SEQ ID NO: 283966

SEQ ID NO: 640908 - RNA, 64 nt, Homo Sapiens; identical to SEQ ID NO: 283967

SEQ ID NO: 640909 - RNA, 64 nt, Homo Sapiens; identical to SEQ ID NO: 283968

SEQ ID NO: 640910 - RNA, 64 nt, Homo Sapiens; identical to SEQ ID NO: 283969

SEQ ID NO: 640911 - RNA, 64 nt, Homo Sapiens; identical to SEQ ID NO: 283970

SEQ ID NO: 640912 - RNA, 64 nt, Homo Sapiens; identical to SEQ ID NO: 283971

SEQ ID NO: 640913 - RNA, 64 nt, Homo Sapiens; identical to SEQ ID NO: 283972

SEQ ID NO: 640914 - RNA, 64 nt, Homo Sapiens; identical to SEQ ID NO: 283973

SEQ ID NO: 640915 - RNA, 64 nt, Homo Sapiens; identical to SEQ ID NO: 283974

SEQ ID NO: 640916 - RNA, 64 nt, Homo Sapiens; identical to SEQ ID NO: 283975

SEQ ID NO: 640917 - RNA, 64 nt, Homo Sapiens; identical to SEQ ID NO: 283976

SEQ ID NO: 640918 - RNA, 64 nt, Homo Sapiens; identical to SEQ ID NO: 283977

SEQ ID NO: 640919 - RNA, 64 nt, Homo Sapiens; identical to SEQ ID NO: 283978

SEQ ID NO: 640920 - RNA, 64 nt, Homo Sapiens; identical to SEQ ID NO: 283979

SEQ ID NO: 640921 - RNA, 64 nt, Homo Sapiens; identical to SEQ ID NO: 283980

SEQ ID NO: 640922 - RNA, 64 nt, Homo Sapiens; identical to SEQ ID NO: 283981

SEQ ID NO: 640923 - RNA, 64 nt, Homo Sapiens; identical to SEQ ID NO: 283982

SEQ ID NO: 640924 - RNA, 64 nt, Homo Sapiens; identical to SEQ ID NO: 283983

SEQ ID NO: 640925 - RNA, 64 nt, Homo Sapiens; identical to SEQ ID NO: 283984

SEQ ID NO: 640926 - RNA, 64 nt, Homo Sapiens; identical to SEQ ID NO: 311991

SEQ ID NO: 640927 - RNA, 64 nt, Homo Sapiens; identical to SEQ ID NO: 311992

SEQ ID NO: 640928 - RNA, 64 nt, Homo Sapiens; identical to SEQ ID NO: 311993

SEQ ID NO: 640929 - RNA, 64 nt, Homo Sapiens; identical to SEQ ID NO: 311994

SEQ ID NO: 640930 - RNA, 64 nt, Homo Sapiens; identical to SEQ ID NO: 311995

SEQ ID NO: 640931 - RNA, 64 nt, Homo Sapiens; identical to SEQ ID NO: 311996

SEQ ID NO: 640932 - RNA, 64 nt, Homo Sapiens; identical to SEQ ID NO: 132890

SEQ ID NO: 640933 - RNA, 64 nt, Homo Sapiens; identical to SEQ ID NO: 132891

SEQ ID NO: 640934 - RNA, 64 nt, Homo Sapiens; identical to SEQ ID NO: 132892

SEQ ID NO: 640935 - RNA, 64 nt, Homo Sapiens; identical to SEQ ID NO: 132893

SEQ ID NO: 640936 - RNA, 61 nt, Homo Sapiens; identical to SEQ ID NO: 132894

SEQ ID NO: 640937 - RNA, 64 nt, Homo Sapiens; identical to SEQ ID NO: 132895

SEQ ID NO: 640938 - RNA, 52 nt, Homo Sapiens; identical to SEQ ID NO: 132896

SEQ ID NO: 640939 - RNA, 64 nt, Homo Sapiens; identical to SEQ ID NO: 132897

SEQ ID NO: 640940 - RNA, 64 nt, Homo Sapiens; identical to SEQ ID NO: 132898

SEQ ID NO: 640941 - RNA, 64 nt, Homo Sapiens; identical to SEQ ID NO: 132899

SEQ ID NO: 640942 - RNA, 64 nt, Homo Sapiens; identical to SEQ ID NO: 132900

SEQ ID NO: 640943 - RNA, 64 nt, Homo Sapiens; identical to SEQ ID NO: 132901

SEQ ID NO: 640944 - RNA, 64 nt, Homo Sapiens; identical to SEQ ID NO: 132902

SEQ ID NO: 640945 - RNA, 64 nt, Homo Sapiens; identical to SEQ ID NO: 132903

SEQ ID NO: 640946 - RNA, 64 nt, Homo Sapiens; identical to SEQ ID NO: 132904

SEQ ID NO: 640947 - RNA, 64 nt, Homo Sapiens; identical to SEQ ID NO: 132905

SEQ ID NO: 640948 - RNA, 64 nt, Homo Sapiens; identical to SEQ ID NO: 132906

SEQ ID NO: 640949 - RNA, 64 nt, Homo Sapiens; identical to SEQ ID NO: 132907

SEQ ID NO: 640950 - RNA, 64 nt, Homo Sapiens; identical to SEQ ID NO: 132908

SEQ ID NO: 640951 - RNA, 64 nt, Homo Sapiens; identical to SEQ ID NO: 132909

SEQ ID NO: 640952 - RNA, 64 nt, Homo Sapiens; identical to SEQ ID NO: 132910

SEQ ID NO: 640953 - RNA, 64 nt, Homo Sapiens; identical to SEQ ID NO: 132911

SEQ ID NO: 640954 - RNA, 64 nt, Homo Sapiens; identical to SEQ ID NO: 132912

SEQ ID NO: 640955 - RNA, 64 nt, Homo Sapiens; identical to SEQ ID NO: 132913

SEQ ID NO: 640956 - RNA, 64 nt, Homo Sapiens; identical to SEQ ID NO: 132914

SEQ ID NO: 640957 - RNA, 63 nt, Homo Sapiens; identical to SEQ ID NO: 132915

SEQ ID NO: 640958 - RNA, 64 nt, Homo Sapiens; identical to SEQ ID NO: 132916

SEQ ID NO: 640959 - RNA, 64 nt, Homo Sapiens; identical to SEQ ID NO: 132917

SEQ ID NO: 640960 - RNA, 64 nt, Homo Sapiens; identical to SEQ ID NO: 132918

SEQ ID NO: 640961 - RNA, 64 nt, Homo Sapiens; identical to SEQ ID NO: 132919

SEQ ID NO: 640962 - RNA, 64 nt, Homo Sapiens; identical to SEQ ID NO: 132920

SEQ ID NO: 640963 - RNA, 64 nt, Homo Sapiens; identical to SEQ ID NO: 132921

SEQ ID NO: 640964 - RNA, 53 nt, Homo Sapiens; identical to SEQ ID NO: 132922

SEQ ID NO: 640965 - RNA, 64 nt, Homo Sapiens; identical to SEQ ID NO: 132923

SEQ ID NO: 640966 - RNA, 64 nt, Homo Sapiens; identical to SEQ ID NO: 119443

SEQ ID NO: 640967 - RNA, 64 nt, Homo Sapiens; identical to SEQ ID NO: 119444

SEQ ID NO: 640968 - RNA, 64 nt, Homo Sapiens; identical to SEQ ID NO: 119445

SEQ ID NO: 640969 - RNA, 64 nt, Homo Sapiens; identical to SEQ ID NO: 119446

SEQ ID NO: 640970 - RNA, 64 nt, Homo Sapiens; identical to SEQ ID NO: 119447

SEQ ID NO: 640971 - RNA, 64 nt, Homo Sapiens; identical to SEQ ID NO: 119448

SEQ ID NO: 640972 - RNA, 64 nt, Homo Sapiens; identical to SEQ ID NO: 119449

SEQ ID NO: 640973 - RNA, 64 nt, Homo Sapiens; identical to SEQ ID NO: 119450

SEQ ID NO: 640974 - RNA, 64 nt, Homo Sapiens; identical to SEQ ID NO: 119451

SEQ ID NO: 640975 - RNA, 64 nt, Homo Sapiens; identical to SEQ ID NO: 119452

SEQ ID NO: 640976 - RNA, 64 nt, Homo Sapiens; identical to SEQ ID NO: 119453

SEQ ID NO: 640977 - RNA, 64 nt, Homo Sapiens; identical to SEQ ID NO: 119454

SEQ ID NO: 640978 - RNA, 64 nt, Homo Sapiens; identical to SEQ ID NO: 119455

SEQ ID NO: 640979 - RNA, 64 nt, Homo Sapiens; identical to SEQ ID NO: 119456

SEQ ID NO: 640980 - RNA, 64 nt, Homo Sapiens; identical to SEQ ID NO: 119457

SEQ ID NO: 640981 - RNA, 64 nt, Homo Sapiens; identical to SEQ ID NO: 119458

SEQ ID NO: 640982 - RNA, 64 nt, Homo Sapiens; identical to SEQ ID NO: 119459

SEQ ID NO: 640983 - RNA, 64 nt, Homo Sapiens; identical to SEQ ID NO: 119460

SEQ ID NO: 640984 - RNA, 51 nt, Homo Sapiens; identical to SEQ ID NO: 119461

SEQ ID NO: 640985 - RNA, 64 nt, Homo Sapiens; identical to SEQ ID NO: 119462

SEQ ID NO: 640986 - RNA, 64 nt, Homo Sapiens; identical to SEQ ID NO: 119463

SEQ ID NO: 640987 - RNA, 64 nt, Homo Sapiens; identical to SEQ ID NO: 119464

SEQ ID NO: 640988 - RNA, 64 nt, Homo Sapiens; identical to SEQ ID NO: 119465

SEQ ID NO: 640989 - RNA, 64 nt, Homo Sapiens; identical to SEQ ID NO: 119466

SEQ ID NO: 640990 - RNA, 64 nt, Homo Sapiens; identical to SEQ ID NO: 119467

SEQ ID NO: 640991 - RNA, 64 nt, Homo Sapiens; identical to SEQ ID NO: 119468

SEQ ID NO: 640992 - RNA, 64 nt, Homo Sapiens; identical to SEQ ID NO: 119469

SEQ ID NO: 640993 - RNA, 64 nt, Homo Sapiens; identical to SEQ ID NO: 119470

SEQ ID NO: 640994 - RNA, 64 nt, Homo Sapiens; identical to SEQ ID NO: 119471

SEQ ID NO: 640995 - RNA, 64 nt, Homo Sapiens; identical to SEQ ID NO: 119472

SEQ ID NO: 640996 - RNA, 64 nt, Homo Sapiens; identical to SEQ ID NO: 119473

SEQ ID NO: 640997 - RNA, 64 nt, Homo Sapiens; identical to SEQ ID NO: 119474

SEQ ID NO: 640998 - RNA, 64 nt, Homo Sapiens; identical to SEQ ID NO: 119475

SEQ ID NO: 640999 - RNA, 64 nt, Homo Sapiens; identical to SEQ ID NO: 119476

SEQ ID NO: 641000 - RNA, 64 nt, Homo Sapiens; identical to SEQ ID NO: 119477

SEQ ID NO: 641001 - RNA, 64 nt, Homo Sapiens; identical to SEQ ID NO: 119478

SEQ ID NO: 641002 - RNA, 64 nt, Homo Sapiens; identical to SEQ ID NO: 119479

SEQ ID NO: 641003 - RNA, 64 nt, Homo Sapiens; identical to SEQ ID NO: 119480

SEQ ID NO: 641004 - RNA, 64 nt, Homo Sapiens; identical to SEQ ID NO: 119481

SEQ ID NO: 641005 - RNA, 64 nt, Homo Sapiens; identical to SEQ ID NO: 171819

SEQ ID NO: 641006 - RNA, 64 nt, Homo Sapiens; identical to SEQ ID NO: 171820

SEQ ID NO: 641007 - RNA, 64 nt, Homo Sapiens; identical to SEQ ID NO: 171821

SEQ ID NO: 641008 - RNA, 64 nt, Homo Sapiens; identical to SEQ ID NO: 171822

SEQ ID NO: 641009 - RNA, 64 nt, Homo Sapiens; identical to SEQ ID NO: 171823

SEQ ID NO: 641010 - RNA, 64 nt, Homo Sapiens; identical to SEQ ID NO: 171824

SEQ ID NO: 641011 - RNA, 64 nt, Homo Sapiens; identical to SEQ ID NO: 171825

SEQ ID NO: 641012 - RNA, 64 nt, Homo Sapiens; identical to SEQ ID NO: 171826

SEQ ID NO: 641013 - RNA, 64 nt, Homo Sapiens; identical to SEQ ID NO: 171827

SEQ ID NO: 641014 - RNA, 64 nt, Homo Sapiens; identical to SEQ ID NO: 171828

SEQ ID NO: 641015 - RNA, 64 nt, Homo Sapiens; identical to SEQ ID NO: 171829

SEQ ID NO: 641016 - RNA, 64 nt, Homo Sapiens
gaagcaggcgagagagaaacagcuacugcgugcgugcgcgcacgcauacacacacacacacaca

SEQ ID NO: 641017 - RNA, 64 nt, Homo Sapiens
caucgcggccuuccuggcuugugagugcacacacugcgcgcacaagucagguggcccguccuug

SEQ ID NO: 641018 - RNA, 64 nt, Homo Sapiens
uguugugauccugccauuauguugguuagcuauuugcgcgcaaagccucucgguggcagucuug

SEQ ID NO: 641019 - RNA, 64 nt, Homo Sapiens
uguguguagguggguauguguguguguaugugugugcgcgcacgcagaggggucacuagcaccu

SEQ ID NO: 641020 - RNA, 64 nt, Homo Sapiens
uguauauagacaggcacaucugugcgugugugugugcgcgcauaaccuuguggaccuaauuuug

SEQ ID NO: 641021 - RNA, 64 nt, Homo Sapiens
acacacacugccuggaugcauguaugcacacacaugcgcgcacacgugcucccugaaggcacac

SEQ ID NO: 641022 - RNA, 64 nt, Homo Sapiens
uggcgcguguguggccuaauccugcgggguucccugcgcgcagcgggcagcuccucgggugggg

SEQ ID NO: 641023 - RNA, 64 nt, Homo Sapiens
uacuaaaaauacaaaaauuagccggacgugguggugcgcgcauguaaucccagcuacucgggag

SEQ ID NO: 641024 - RNA, 64 nt, Homo Sapiens
aaccaugcugcccguaagagucacaaccugugugugcgcgcaagguuagcaacaaacguacccg

SEQ ID NO: 641025 - RNA, 64 nt, Homo Sapiens
cacacacacacacacacacauaugcgugcaugcgugcgcgcacagcaucuauauguguauuaug

SEQ ID NO: 641026 - RNA, 64 nt, Homo Sapiens
cuaagaguugauuguggaaaacacgugaaucuauugcgcgcauuugucauuuagcaagauggca

SEQ ID NO: 641027 - RNA, 64 nt, Homo Sapiens
ugucacucagggacuuucuacccagccccaagccugcgcgcaucgagcacuuuccaaggcaucc

SEQ ID NO: 641028 - RNA, 64 nt, Homo Sapiens
agaccccuuuuuucugauacaaugcacgauucucugcgcgcaaggacccucgacucacccccau

SEQ ID NO: 641029 - RNA, 64 nt, Homo Sapiens
gcagcucugccuccgcagccucagugcgcuuuccugcgcgcacugcggagggcgcccuaagcgu

SEQ ID NO: 641030 - RNA, 62 nt, Homo Sapiens
cagguggaacuguaguguagcgaccucacugcugcgcgcacagucucccgggacuuggacuc

SEQ ID NO: 641031 - RNA, 64 nt, Homo Sapiens
aggagcaaaggcugagaacacugugaaaacauuuugcgcgcacaauaguaaccuggguaaaugc

SEQ ID NO: 641032 - RNA, 64 nt, Homo Sapiens
gugcggagggagaggggcgggcaggaaccggggcugcgcgcagcgcuugcgggccagagugagu

SEQ ID NO: 641033 - RNA, 64 nt, Homo Sapiens
caacaaaucagaaucacguuuuuaguugugcgugugcgcgcacacguguguaaaaagcacuuuc

SEQ ID NO: 641034 - RNA, 64 nt, Homo Sapiens
guuuuagcuuucagcaacuggggaaggucgcccuugcgcgcaagagcgucucuccucccuccug

SEQ ID NO: 641035 - RNA, 64 nt, Homo Sapiens
gaguuuccccagacaccgccacauggcuuccuccugcgcgcaugugcgcacacacacacacaca

SEQ ID NO: 641036 - RNA, 64 nt, Homo Sapiens
gaggccgcacaccguuccuuggagcgggugggugugcgcgcaagccgcucagccccggcgggga

SEQ ID NO: 641037 - RNA, 64 nt, Homo Sapiens
gagcugcggcggcccagguacgaagcugcaacucugcgcgcagugggcgagaucucaucagccc

SEQ ID NO: 641038 - RNA, 64 nt, Homo Sapiens
cccugcguggacguggccugugcuucgcccgcacugcgcgcauccccaaccucuguccgcaugc

SEQ ID NO: 641039 - RNA, 64 nt, Homo Sapiens
augggggugacugcccagacagcccuuugcuaucugcgcgcaggugugucugacaccugccagc

SEQ ID NO: 641040 - RNA, 64 nt, Homo Sapiens; identical to SEQ ID NO: 443174

SEQ ID NO: 641041 - RNA, 64 nt, Homo Sapiens; identical to SEQ ID NO: 443175

SEQ ID NO: 641042 - RNA, 64 nt, Homo Sapiens; identical to SEQ ID NO: 443176

SEQ ID NO: 641043 - RNA, 64 nt, Homo Sapiens; identical to SEQ ID NO: 443177

SEQ ID NO: 641044 - RNA, 64 nt, Homo Sapiens; identical to SEQ ID NO: 443178

SEQ ID NO: 641045 - RNA, 64 nt, Homo Sapiens; identical to SEQ ID NO: 443179

SEQ ID NO: 641046 - RNA, 64 nt, Homo Sapiens; identical to SEQ ID NO: 443180

SEQ ID NO: 641047 - RNA, 64 nt, Homo Sapiens; identical to SEQ ID NO: 443181

SEQ ID NO: 641048 - RNA, 64 nt, Homo Sapiens; identical to SEQ ID NO: 443182

SEQ ID NO: 641049 - RNA, 64 nt, Homo Sapiens; identical to SEQ ID NO: 443183

SEQ ID NO: 641050 - RNA, 64 nt, Homo Sapiens; identical to SEQ ID NO: 443184

SEQ ID NO: 641051 - RNA, 64 nt, Homo Sapiens; identical to SEQ ID NO: 443185

SEQ ID NO: 641052 - RNA, 64 nt, Homo Sapiens; identical to SEQ ID NO: 443186

SEQ ID NO: 641053 - RNA, 64 nt, Homo Sapiens; identical to SEQ ID NO: 443187

SEQ ID NO: 641054 - RNA, 64 nt, Homo Sapiens; identical to SEQ ID NO: 443188

SEQ ID NO: 641055 - RNA, 64 nt, Homo Sapiens; identical to SEQ ID NO: 443189

SEQ ID NO: 641056 - RNA, 64 nt, Homo Sapiens; identical to SEQ ID NO: 443190

SEQ ID NO: 641057 - RNA, 64 nt, Homo Sapiens; identical to SEQ ID NO: 443191

SEQ ID NO: 641058 - RNA, 64 nt, Homo Sapiens; identical to SEQ ID NO: 443192

SEQ ID NO: 641059 - RNA, 64 nt, Homo Sapiens; identical to SEQ ID NO: 443193

SEQ ID NO: 641060 - RNA, 64 nt, Homo Sapiens; identical to SEQ ID NO: 443194

SEQ ID NO: 641061 - RNA, 64 nt, Homo Sapiens; identical to SEQ ID NO: 443195

SEQ ID NO: 641062 - RNA, 64 nt, Homo Sapiens; identical to SEQ ID NO: 443196

SEQ ID NO: 641063 - RNA, 64 nt, Homo Sapiens; identical to SEQ ID NO: 443197

SEQ ID NO: 641064 - RNA, 64 nt, Homo Sapiens; identical to SEQ ID NO: 443198

SEQ ID NO: 641065 - RNA, 64 nt, Homo Sapiens; identical to SEQ ID NO: 443199

SEQ ID NO: 641066 - RNA, 64 nt, Homo Sapiens; identical to SEQ ID NO: 443200

SEQ ID NO: 641067 - RNA, 64 nt, Homo Sapiens; identical to SEQ ID NO: 443201

SEQ ID NO: 641068 - RNA, 64 nt, Homo Sapiens; identical to SEQ ID NO: 443202

SEQ ID NO: 641069 - RNA, 64 nt, Homo Sapiens; identical to SEQ ID NO: 443203

SEQ ID NO: 641070 - RNA, 64 nt, Homo Sapiens; identical to SEQ ID NO: 443204

SEQ ID NO: 641071 - RNA, 64 nt, Homo Sapiens; identical to SEQ ID NO: 443205

SEQ ID NO: 641072 - RNA, 64 nt, Homo Sapiens; identical to SEQ ID NO: 443206

SEQ ID NO: 641073 - RNA, 64 nt, Homo Sapiens; identical to SEQ ID NO: 443207

SEQ ID NO: 641074 - RNA, 64 nt, Homo Sapiens; identical to SEQ ID NO: 443208

SEQ ID NO: 641075 - RNA, 64 nt, Homo Sapiens; identical to SEQ ID NO: 443209

SEQ ID NO: 641076 - RNA, 64 nt, Homo Sapiens; identical to SEQ ID NO: 443210

SEQ ID NO: 641077 - RNA, 64 nt, Homo Sapiens; identical to SEQ ID NO: 443211

SEQ ID NO: 641078 - RNA, 64 nt, Homo Sapiens; identical to SEQ ID NO: 443212

SEQ ID NO: 641079 - RNA, 64 nt, Homo Sapiens; identical to SEQ ID NO: 443213

SEQ ID NO: 641080 - RNA, 64 nt, Homo Sapiens; identical to SEQ ID NO: 443214

SEQ ID NO: 641081 - RNA, 64 nt, Homo Sapiens; identical to SEQ ID NO: 443215

SEQ ID NO: 641082 - RNA, 64 nt, Homo Sapiens; identical to SEQ ID NO: 443216

SEQ ID NO: 641083 - RNA, 64 nt, Homo Sapiens; identical to SEQ ID NO: 443217

SEQ ID NO: 641084 - RNA, 64 nt, Homo Sapiens; identical to SEQ ID NO: 443218

SEQ ID NO: 641085 - RNA, 64 nt, Homo Sapiens; identical to SEQ ID NO: 443219

SEQ ID NO: 641086 - RNA, 64 nt, Homo Sapiens; identical to SEQ ID NO: 443220

SEQ ID NO: 641087 - RNA, 64 nt, Homo Sapiens; identical to SEQ ID NO: 443221

SEQ ID NO: 641088 - RNA, 64 nt, Homo Sapiens; identical to SEQ ID NO: 443222

SEQ ID NO: 641089 - RNA, 64 nt, Homo Sapiens; identical to SEQ ID NO: 443223

SEQ ID NO: 641090 - RNA, 64 nt, Homo Sapiens; identical to SEQ ID NO: 443224

SEQ ID NO: 641091 - RNA, 64 nt, Homo Sapiens; identical to SEQ ID NO: 443225

SEQ ID NO: 641092 - RNA, 64 nt, Homo Sapiens; identical to SEQ ID NO: 443226

SEQ ID NO: 641093 - RNA, 64 nt, Homo Sapiens; identical to SEQ ID NO: 443227

SEQ ID NO: 641094 - RNA, 64 nt, Homo Sapiens; identical to SEQ ID NO: 443228

SEQ ID NO: 641095 - RNA, 64 nt, Homo Sapiens; identical to SEQ ID NO: 443229

SEQ ID NO: 641096 - RNA, 64 nt, Homo Sapiens; identical to SEQ ID NO: 443230

SEQ ID NO: 641097 - RNA, 64 nt, Homo Sapiens; identical to SEQ ID NO: 443231

SEQ ID NO: 641098 - RNA, 64 nt, Homo Sapiens; identical to SEQ ID NO: 443232

SEQ ID NO: 641099 - RNA, 64 nt, Homo Sapiens; identical to SEQ ID NO: 443233

SEQ ID NO: 641100 - RNA, 64 nt, Homo Sapiens; identical to SEQ ID NO: 443234

SEQ ID NO: 641101 - RNA, 64 nt, Homo Sapiens; identical to SEQ ID NO: 443235

SEQ ID NO: 641102 - RNA, 64 nt, Homo Sapiens; identical to SEQ ID NO: 443236

SEQ ID NO: 641103 - RNA, 64 nt, Homo Sapiens; identical to SEQ ID NO: 443237

SEQ ID NO: 641104 - RNA, 64 nt, Homo Sapiens; identical to SEQ ID NO: 443238

SEQ ID NO: 641105 - RNA, 64 nt, Homo Sapiens; identical to SEQ ID NO: 443239

SEQ ID NO: 641106 - RNA, 64 nt, Homo Sapiens; identical to SEQ ID NO: 131663

SEQ ID NO: 641107 - RNA, 64 nt, Homo Sapiens; identical to SEQ ID NO: 131664

SEQ ID NO: 641108 - RNA, 64 nt, Homo Sapiens; identical to SEQ ID NO: 131665

SEQ ID NO: 641109 - RNA, 64 nt, Homo Sapiens; identical to SEQ ID NO: 131666

SEQ ID NO: 641110 - RNA, 64 nt, Homo Sapiens; identical to SEQ ID NO: 131667

SEQ ID NO: 641111 - RNA, 64 nt, Homo Sapiens; identical to SEQ ID NO: 131668

SEQ ID NO: 641112 - RNA, 64 nt, Homo Sapiens; identical to SEQ ID NO: 131669

SEQ ID NO: 641113 - RNA, 64 nt, Homo Sapiens; identical to SEQ ID NO: 131670

SEQ ID NO: 641114 - RNA, 64 nt, Homo Sapiens; identical to SEQ ID NO: 131671

SEQ ID NO: 641115 - RNA, 64 nt, Homo Sapiens; identical to SEQ ID NO: 131672

SEQ ID NO: 641116 - RNA, 64 nt, Homo Sapiens; identical to SEQ ID NO: 131673

SEQ ID NO: 641117 - RNA, 64 nt, Homo Sapiens; identical to SEQ ID NO: 131674

SEQ ID NO: 641118 - RNA, 64 nt, Homo Sapiens; identical to SEQ ID NO: 131675

SEQ ID NO: 641119 - RNA, 64 nt, Homo Sapiens; identical to SEQ ID NO: 131676

SEQ ID NO: 641120 - RNA, 64 nt, Homo Sapiens; identical to SEQ ID NO: 131677

SEQ ID NO: 641121 - RNA, 64 nt, Homo Sapiens; identical to SEQ ID NO: 131678

SEQ ID NO: 641122 - RNA, 64 nt, Homo Sapiens; identical to SEQ ID NO: 131679

SEQ ID NO: 641123 - RNA, 63 nt, Homo Sapiens; identical to SEQ ID NO: 332886

SEQ ID NO: 641124 - RNA, 63 nt, Homo Sapiens; identical to SEQ ID NO: 332887

SEQ ID NO: 641125 - RNA, 63 nt, Homo Sapiens; identical to SEQ ID NO: 332888

SEQ ID NO: 641126 - RNA, 63 nt, Homo Sapiens; identical to SEQ ID NO: 332889

SEQ ID NO: 641127 - RNA, 53 nt, Homo Sapiens; identical to SEQ ID NO: 55194

SEQ ID NO: 641128 - RNA, 63 nt, Homo Sapiens; identical to SEQ ID NO: 332891

SEQ ID NO: 641129 - RNA, 63 nt, Homo Sapiens; identical to SEQ ID NO: 332892

SEQ ID NO: 641130 - RNA, 63 nt, Homo Sapiens; identical to SEQ ID NO: 332893

SEQ ID NO: 641131 - RNA, 63 nt, Homo Sapiens; identical to SEQ ID NO: 332894

SEQ ID NO: 641132 - RNA, 63 nt, Homo Sapiens; identical to SEQ ID NO: 332895

SEQ ID NO: 641133 - RNA, 63 nt, Homo Sapiens; identical to SEQ ID NO: 332896

SEQ ID NO: 641134 - RNA, 63 nt, Homo Sapiens; identical to SEQ ID NO: 332897

SEQ ID NO: 641135 - RNA, 63 nt, Homo Sapiens; identical to SEQ ID NO: 332898

SEQ ID NO: 641136 - RNA, 63 nt, Homo Sapiens; identical to SEQ ID NO: 332899

SEQ ID NO: 641137 - RNA, 63 nt, Homo Sapiens; identical to SEQ ID NO: 332900

SEQ ID NO: 641138 - RNA, 63 nt, Homo Sapiens; identical to SEQ ID NO: 332901

SEQ ID NO: 641139 - RNA, 63 nt, Homo Sapiens; identical to SEQ ID NO: 332902

SEQ ID NO: 641140 - RNA, 63 nt, Homo Sapiens; identical to SEQ ID NO: 332903

SEQ ID NO: 641141 - RNA, 63 nt, Homo Sapiens; identical to SEQ ID NO: 332904

SEQ ID NO: 641142 - RNA, 63 nt, Homo Sapiens; identical to SEQ ID NO: 332905

SEQ ID NO: 641143 - RNA, 63 nt, Homo Sapiens; identical to SEQ ID NO: 332906

SEQ ID NO: 641144 - RNA, 63 nt, Homo Sapiens; identical to SEQ ID NO: 332907

SEQ ID NO: 641145 - RNA, 63 nt, Homo Sapiens; identical to SEQ ID NO: 332908

SEQ ID NO: 641146 - RNA, 63 nt, Homo Sapiens; identical to SEQ ID NO: 332909

SEQ ID NO: 641147 - RNA, 63 nt, Homo Sapiens; identical to SEQ ID NO: 332910

SEQ ID NO: 641148 - RNA, 63 nt, Homo Sapiens; identical to SEQ ID NO: 332911

SEQ ID NO: 641149 - RNA, 63 nt, Homo Sapiens; identical to SEQ ID NO: 332912

SEQ ID NO: 641150 - RNA, 64 nt, Homo Sapiens; identical to SEQ ID NO: 155105

SEQ ID NO: 641151 - RNA, 64 nt, Homo Sapiens; identical to SEQ ID NO: 155106

SEQ ID NO: 641152 - RNA, 64 nt, Homo Sapiens; identical to SEQ ID NO: 155107

SEQ ID NO: 641153 - RNA, 64 nt, Homo Sapiens; identical to SEQ ID NO: 155108

SEQ ID NO: 641154 - RNA, 64 nt, Homo Sapiens; identical to SEQ ID NO: 426252

SEQ ID NO: 641155 - RNA, 64 nt, Homo Sapiens; identical to SEQ ID NO: 426253

SEQ ID NO: 641156 - RNA, 64 nt, Homo Sapiens; identical to SEQ ID NO: 426254

SEQ ID NO: 641157 - RNA, 64 nt, Homo Sapiens; identical to SEQ ID NO: 426255

SEQ ID NO: 641158 - RNA, 64 nt, Homo Sapiens; identical to SEQ ID NO: 426256

SEQ ID NO: 641159 - RNA, 64 nt, Homo Sapiens; identical to SEQ ID NO: 426257

SEQ ID NO: 641160 - RNA, 64 nt, Homo Sapiens; identical to SEQ ID NO: 426258

SEQ ID NO: 641161 - RNA, 64 nt, Homo Sapiens; identical to SEQ ID NO: 426259

SEQ ID NO: 641162 - RNA, 64 nt, Homo Sapiens; identical to SEQ ID NO: 426260

SEQ ID NO: 641163 - RNA, 64 nt, Homo Sapiens; identical to SEQ ID NO: 426261

SEQ ID NO: 641164 - RNA, 64 nt, Homo Sapiens; identical to SEQ ID NO: 426262

SEQ ID NO: 641165 - RNA, 64 nt, Homo Sapiens; identical to SEQ ID NO: 426263

SEQ ID NO: 641166 - RNA, 64 nt, Homo Sapiens; identical to SEQ ID NO: 426264

SEQ ID NO: 641167 - RNA, 64 nt, Homo Sapiens; identical to SEQ ID NO: 426265

SEQ ID NO: 641168 - RNA, 64 nt, Homo Sapiens; identical to SEQ ID NO: 426266

SEQ ID NO: 641169 - RNA, 64 nt, Homo Sapiens; identical to SEQ ID NO: 426267

SEQ ID NO: 641170 - RNA, 64 nt, Homo Sapiens; identical to SEQ ID NO: 426268

SEQ ID NO: 641171 - RNA, 64 nt, Homo Sapiens; identical to SEQ ID NO: 426269

SEQ ID NO: 641172 - RNA, 64 nt, Homo Sapiens; identical to SEQ ID NO: 426270

SEQ ID NO: 641173 - RNA, 64 nt, Homo Sapiens; identical to SEQ ID NO: 426271

SEQ ID NO: 641174 - RNA, 64 nt, Homo Sapiens; identical to SEQ ID NO: 426272

SEQ ID NO: 641175 - RNA, 64 nt, Homo Sapiens; identical to SEQ ID NO: 426273

SEQ ID NO: 641176 - RNA, 64 nt, Homo Sapiens; identical to SEQ ID NO: 426274

SEQ ID NO: 641177 - RNA, 64 nt, Homo Sapiens; identical to SEQ ID NO: 426275

SEQ ID NO: 641178 - RNA, 60 nt, Homo Sapiens; identical to SEQ ID NO: 90161

SEQ ID NO: 641179 - RNA, 64 nt, Homo Sapiens; identical to SEQ ID NO: 426277

SEQ ID NO: 641180 - RNA, 64 nt, Homo Sapiens; identical to SEQ ID NO: 426278

SEQ ID NO: 641181 - RNA, 64 nt, Homo Sapiens; identical to SEQ ID NO: 426279

SEQ ID NO: 641182 - RNA, 64 nt, Homo Sapiens; identical to SEQ ID NO: 426280

SEQ ID NO: 641183 - RNA, 64 nt, Homo Sapiens; identical to SEQ ID NO: 426281

SEQ ID NO: 641184 - RNA, 64 nt, Homo Sapiens; identical to SEQ ID NO: 426282

SEQ ID NO: 641185 - RNA, 64 nt, Homo Sapiens; identical to SEQ ID NO: 426283

SEQ ID NO: 641186 - RNA, 64 nt, Homo Sapiens; identical to SEQ ID NO: 426284

SEQ ID NO: 641187 - RNA, 64 nt, Homo Sapiens; identical to SEQ ID NO: 426285

SEQ ID NO: 641188 - RNA, 64 nt, Homo Sapiens; identical to SEQ ID NO: 426286

SEQ ID NO: 641189 - RNA, 64 nt, Homo Sapiens; identical to SEQ ID NO: 426287

SEQ ID NO: 641190 - RNA, 64 nt, Homo Sapiens; identical to SEQ ID NO: 426288

SEQ ID NO: 641191 - RNA, 64 nt, Homo Sapiens; identical to SEQ ID NO: 426289

SEQ ID NO: 641192 - RNA, 64 nt, Homo Sapiens; identical to SEQ ID NO: 426290

SEQ ID NO: 641193 - RNA, 64 nt, Homo Sapiens; identical to SEQ ID NO: 426291

SEQ ID NO: 641194 - RNA, 64 nt, Homo Sapiens; identical to SEQ ID NO: 426292

SEQ ID NO: 641195 - RNA, 64 nt, Homo Sapiens; identical to SEQ ID NO: 426293

SEQ ID NO: 641196 - RNA, 64 nt, Homo Sapiens; identical to SEQ ID NO: 426294

SEQ ID NO: 641197 - RNA, 64 nt, Homo Sapiens; identical to SEQ ID NO: 426295

SEQ ID NO: 641198 - RNA, 64 nt, Homo Sapiens; identical to SEQ ID NO: 426296

SEQ ID NO: 641199 - RNA, 64 nt, Homo Sapiens; identical to SEQ ID NO: 426297

SEQ ID NO: 641200 - RNA, 64 nt, Homo Sapiens; identical to SEQ ID NO: 426298

SEQ ID NO: 641201 - RNA, 64 nt, Homo Sapiens; identical to SEQ ID NO: 426299

SEQ ID NO: 641202 - RNA, 64 nt, Homo Sapiens; identical to SEQ ID NO: 426300

SEQ ID NO: 641203 - RNA, 64 nt, Homo Sapiens; identical to SEQ ID NO: 426301

SEQ ID NO: 641204 - RNA, 64 nt, Homo Sapiens; identical to SEQ ID NO: 426302

SEQ ID NO: 641205 - RNA, 64 nt, Homo Sapiens; identical to SEQ ID NO: 426303

SEQ ID NO: 641206 - RNA, 64 nt, Homo Sapiens
gaguggggaacagggccagcaagacagaccaccagccagaaaucucugauaucaaccucauguc

SEQ ID NO: 641207 - RNA, 64 nt, Homo Sapiens
ggggaagaaauaccccagacccaacaaaccuccagccagaaagccagcuauuuugcauuugaag

SEQ ID NO: 641208 - RNA, 64 nt, Homo Sapiens
agagaauagaaaauguaaucucuggcuugcaugugccagaaagcuugaggguuuccuguccaua

SEQ ID NO: 641209 - RNA, 64 nt, Homo Sapiens
uuagaaauccaaaaucuugguacucucucauacagccagaaauguuaauaaagugccaacccuu

SEQ ID NO: 641210 - RNA, 64 nt, Homo Sapiens
auuuuaagaggacucaccaacucagauugguaaugccagaaaaauauauugauaaaaagugacu

SEQ ID NO: 641211 - RNA, 64 nt, Homo Sapiens
uggaaacagaggaaccgguguuagaugccagucugccagaaaucugcuucuaacaugaaggccu

SEQ ID NO: 641212 - RNA, 64 nt, Homo Sapiens
ucuuguacagaauaaugauuaaguaauauuuagggccagaaaaauugaauccaaacaauguguu

SEQ ID NO: 641213 - RNA, 64 nt, Homo Sapiens
acaaagaaauauccagaaaguuggacaucuggaagccagaaaaguugaagcuggaaagugugca

SEQ ID NO: 641214 - RNA, 64 nt, Homo Sapiens
cgacagcagaaggauguugcuuuuuuaagggagggccagaaagaaaguuaguggauugcaaagu

SEQ ID NO: 641215 - RNA, 64 nt, Homo Sapiens
gccugguggaaguuagaacagaccaacauuuugugccagaaauuuaagaguuccauagguggag

SEQ ID NO: 641216 - RNA, 64 nt, Homo Sapiens
agaucuggaggcagcagugcgcuggguggagagagccagaaaacauagauccgagggcagcagu

SEQ ID NO: 641217 - RNA, 64 nt, Homo Sapiens
auagauccgagggcagcaguggggcgaggagagagccagaaaacggggcuaaauuaauuggagu

SEQ ID NO: 641218 - RNA, 64 nt, Homo Sapiens
ugguaagcggagcaagugcccugcuucccuuccagccagaaaagacaaacccuaucaagagcug

SEQ ID NO: 641219 - RNA, 64 nt, Homo Sapiens
caauuuggcuaaaaaaugaaaacaaaagcucugggccagaaaggaaugcauaccaugcuuucag

SEQ ID NO: 641220 - RNA, 64 nt, Homo Sapiens
uacauacacugcauccuguauacaguuacagcaggccagaaacagcauaaauguuauauuuaua

SEQ ID NO: 641221 - RNA, 64 nt, Homo Sapiens
acauucuuuacagcaaauguagccaccgugcccggccagaaaaugugcugggauuacaggcgug

SEQ ID NO: 641222 - RNA, 64 nt, Homo Sapiens
auugagccauuaucuccucuuggaaacgaaucuugccagaaaaacgggauuucagggccuuccc

SEQ ID NO: 641223 - RNA, 64 nt, Homo Sapiens
gcugcuuuugaaccugagguuccugcgucguugagccagaaaucagaccaccgaagcucacucc

SEQ ID NO: 641224 - RNA, 64 nt, Homo Sapiens
ggaaaguagcuuacccuagaaaacagcugcaaaugccagaaagaugaucccuaaaaauguugag

SEQ ID NO: 641225 - RNA, 64 nt, Homo Sapiens
cuaagaauuuauaugaaagauuuguaucauuagagccagaaauaauuuuauauuaauauauaau

SEQ ID NO: 641226 - RNA, 64 nt, Homo Sapiens
acaccaaauuaaaauuuucaugucaaacuucaaagccagaaagcugcuaaauacgugucuggca

SEQ ID NO: 641227 - RNA, 64 nt, Homo Sapiens
uuauccucccuguuauacuuuggagcacagcacagccagaaaggggcugcauuugugcccaggu

SEQ ID NO: 641228 - RNA, 64 nt, Homo Sapiens; identical to SEQ ID NO: 475135

SEQ ID NO: 641229 - RNA, 64 nt, Homo Sapiens; identical to SEQ ID NO: 475136

SEQ ID NO: 641230 - RNA, 64 nt, Homo Sapiens; identical to SEQ ID NO: 475137

SEQ ID NO: 641231 - RNA, 64 nt, Homo Sapiens; identical to SEQ ID NO: 475138

SEQ ID NO: 641232 - RNA, 64 nt, Homo Sapiens; identical to SEQ ID NO: 475139

SEQ ID NO: 641233 - RNA, 64 nt, Homo Sapiens; identical to SEQ ID NO: 475140

SEQ ID NO: 641234 - RNA, 64 nt, Homo Sapiens
gcuugaugcauauugugugauguaucucaagggucuagcacaauuuauuuuucuuauucauguc

SEQ ID NO: 641235 - RNA, 64 nt, Homo Sapiens
accugaaaacgauggcauuuauaauguaaugugccuagcacacuggguauuaggauaauuaaaa

SEQ ID NO: 641236 - RNA, 64 nt, Homo Sapiens
gcagugaggccaggcaccucaacaccucuuaagucuagcacacucuuguggccgaauaaaaaau

SEQ ID NO: 641237 - RNA, 64 nt, Homo Sapiens
ggccuugccaucuuguggccuggcuuaccauucccuagcacacucagaucucuauuucauuuug

SEQ ID NO: 641238 - RNA, 64 nt, Homo Sapiens; identical to SEQ ID NO: 361949

SEQ ID NO: 641239 - RNA, 64 nt, Homo Sapiens; identical to SEQ ID NO: 361950

SEQ ID NO: 641240 - RNA, 64 nt, Homo Sapiens; identical to SEQ ID NO: 361951

SEQ ID NO: 641241 - RNA, 64 nt, Homo Sapiens; identical to SEQ ID NO: 361952

SEQ ID NO: 641242 - RNA, 64 nt, Homo Sapiens; identical to SEQ ID NO: 361953

SEQ ID NO: 641243 - RNA, 64 nt, Homo Sapiens; identical to SEQ ID NO: 361954

SEQ ID NO: 641244 - RNA, 64 nt, Homo Sapiens; identical to SEQ ID NO: 361955

SEQ ID NO: 641245 - RNA, 64 nt, Homo Sapiens; identical to SEQ ID NO: 361956

SEQ ID NO: 641246 - RNA, 64 nt, Homo Sapiens; identical to SEQ ID NO: 361957

SEQ ID NO: 641247 - RNA, 64 nt, Homo Sapiens; identical to SEQ ID NO: 361958

SEQ ID NO: 641248 - RNA, 64 nt, Homo Sapiens; identical to SEQ ID NO: 361959

SEQ ID NO: 641249 - RNA, 64 nt, Homo Sapiens; identical to SEQ ID NO: 361960

SEQ ID NO: 641250 - RNA, 64 nt, Homo Sapiens; identical to SEQ ID NO: 361961

SEQ ID NO: 641251 - RNA, 64 nt, Homo Sapiens; identical to SEQ ID NO: 361962

SEQ ID NO: 641252 - RNA, 64 nt, Homo Sapiens; identical to SEQ ID NO: 361963

SEQ ID NO: 641253 - RNA, 64 nt, Homo Sapiens; identical to SEQ ID NO: 361964

SEQ ID NO: 641254 - RNA, 64 nt, Homo Sapiens; identical to SEQ ID NO: 361965

SEQ ID NO: 641255 - RNA, 64 nt, Homo Sapiens; identical to SEQ ID NO: 361966

SEQ ID NO: 641256 - RNA, 64 nt, Homo Sapiens; identical to SEQ ID NO: 361967

SEQ ID NO: 641257 - RNA, 64 nt, Homo Sapiens; identical to SEQ ID NO: 361968

SEQ ID NO: 641258 - RNA, 64 nt, Homo Sapiens; identical to SEQ ID NO: 361969

SEQ ID NO: 641259 - RNA, 64 nt, Homo Sapiens; identical to SEQ ID NO: 361970

SEQ ID NO: 641260 - RNA, 64 nt, Homo Sapiens; identical to SEQ ID NO: 361971

SEQ ID NO: 641261 - RNA, 64 nt, Homo Sapiens
gcaguuuaauaauuaaacugauacuaaaaaaauccagcuagauuccauauuaguuauucugaau

SEQ ID NO: 641262 - RNA, 64 nt, Homo Sapiens
ugugagaguauacauaggcaaaaagggacugucccagcuagaacacaacuuacugcagggccaa

SEQ ID NO: 641263 - RNA, 64 nt, Homo Sapiens
uccuguccccacucuccugguagaaguccucucccagcuagaagaagaaugggccacacacagc

SEQ ID NO: 641264 - RNA, 64 nt, Homo Sapiens
uccucucccagcuagaagucgaaugggccacacacagcuagaagcccuuucagccauucuucaa

SEQ ID NO: 641265 - RNA, 64 nt, Homo Sapiens
aguggaccaggaagcaagaggggaagcgggaucccagcuagacuuagaacuuggacuuuucccc

SEQ ID NO: 641266 - RNA, 64 nt, Homo Sapiens
cagcuacaguagggccuccucaccccguaccccacagcuagacagugucagcacucaucuccuc

SEQ ID NO: 641267 - RNA, 64 nt, Homo Sapiens; identical to SEQ ID NO: 94908

SEQ ID NO: 641268 - RNA, 64 nt, Homo Sapiens; identical to SEQ ID NO: 94909

SEQ ID NO: 641269 - RNA, 64 nt, Homo Sapiens; identical to SEQ ID NO: 94910

SEQ ID NO: 641270 - RNA, 64 nt, Homo Sapiens; identical to SEQ ID NO: 94911

SEQ ID NO: 641271 - RNA, 64 nt, Homo Sapiens; identical to SEQ ID NO: 94912

SEQ ID NO: 641272 - RNA, 64 nt, Homo Sapiens; identical to SEQ ID NO: 94913

SEQ ID NO: 641273 - RNA, 64 nt, Homo Sapiens; identical to SEQ ID NO: 94914

SEQ ID NO: 641274 - RNA, 64 nt, Homo Sapiens; identical to SEQ ID NO: 94915

SEQ ID NO: 641275 - RNA, 64 nt, Homo Sapiens; identical to SEQ ID NO: 94916

SEQ ID NO: 641276 - RNA, 64 nt, Homo Sapiens; identical to SEQ ID NO: 94917

SEQ ID NO: 641277 - RNA, 64 nt, Homo Sapiens; identical to SEQ ID NO: 94918

SEQ ID NO: 641278 - RNA, 64 nt, Homo Sapiens; identical to SEQ ID NO: 94919

SEQ ID NO: 641279 - RNA, 64 nt, Homo Sapiens; identical to SEQ ID NO: 94920

SEQ ID NO: 641280 - RNA, 64 nt, Homo Sapiens; identical to SEQ ID NO: 94921

SEQ ID NO: 641281 - RNA, 64 nt, Homo Sapiens; identical to SEQ ID NO: 94922

SEQ ID NO: 641282 - RNA, 64 nt, Homo Sapiens; identical to SEQ ID NO: 94923

SEQ ID NO: 641283 - RNA, 64 nt, Homo Sapiens; identical to SEQ ID NO: 94924

SEQ ID NO: 641284 - RNA, 64 nt, Homo Sapiens; identical to SEQ ID NO: 94925

SEQ ID NO: 641285 - RNA, 64 nt, Homo Sapiens; identical to SEQ ID NO: 94926

SEQ ID NO: 641286 - RNA, 64 nt, Homo Sapiens; identical to SEQ ID NO: 94927

SEQ ID NO: 641287 - RNA, 64 nt, Homo Sapiens; identical to SEQ ID NO: 94928

SEQ ID NO: 641288 - RNA, 64 nt, Homo Sapiens; identical to SEQ ID NO: 94929

SEQ ID NO: 641289 - RNA, 64 nt, Homo Sapiens; identical to SEQ ID NO: 94930

SEQ ID NO: 641290 - RNA, 64 nt, Homo Sapiens; identical to SEQ ID NO: 94931

SEQ ID NO: 641291 - RNA, 64 nt, Homo Sapiens; identical to SEQ ID NO: 416970

SEQ ID NO: 641292 - RNA, 64 nt, Homo Sapiens; identical to SEQ ID NO: 416971

SEQ ID NO: 641293 - RNA, 64 nt, Homo Sapiens; identical to SEQ ID NO: 416972

SEQ ID NO: 641294 - RNA, 64 nt, Homo Sapiens; identical to SEQ ID NO: 416973

SEQ ID NO: 641295 - RNA, 64 nt, Homo Sapiens; identical to SEQ ID NO: 416974

SEQ ID NO: 641296 - RNA, 64 nt, Homo Sapiens; identical to SEQ ID NO: 416975

SEQ ID NO: 641297 - RNA, 64 nt, Homo Sapiens; identical to SEQ ID NO: 416976

SEQ ID NO: 641298 - RNA, 64 nt, Homo Sapiens; identical to SEQ ID NO: 416977

SEQ ID NO: 641299 - RNA, 64 nt, Homo Sapiens; identical to SEQ ID NO: 416978

SEQ ID NO: 641300 - RNA, 64 nt, Homo Sapiens; identical to SEQ ID NO: 416979

SEQ ID NO: 641301 - RNA, 64 nt, Homo Sapiens; identical to SEQ ID NO: 416980

SEQ ID NO: 641302 - RNA, 64 nt, Homo Sapiens; identical to SEQ ID NO: 416981

SEQ ID NO: 641303 - RNA, 64 nt, Homo Sapiens; identical to SEQ ID NO: 416982

SEQ ID NO: 641304 - RNA, 64 nt, Homo Sapiens; identical to SEQ ID NO: 416983

SEQ ID NO: 641305 - RNA, 51 nt, Homo Sapiens; identical to SEQ ID NO: 416984

SEQ ID NO: 641306 - RNA, 64 nt, Homo Sapiens; identical to SEQ ID NO: 416985

SEQ ID NO: 641307 - RNA, 64 nt, Homo Sapiens; identical to SEQ ID NO: 416986

SEQ ID NO: 641308 - RNA, 64 nt, Homo Sapiens; identical to SEQ ID NO: 416987

SEQ ID NO: 641309 - RNA, 64 nt, Homo Sapiens; identical to SEQ ID NO: 416988

SEQ ID NO: 641310 - RNA, 60 nt, Homo Sapiens; identical to SEQ ID NO: 416989

SEQ ID NO: 641311 - RNA, 64 nt, Homo Sapiens; identical to SEQ ID NO: 416990

SEQ ID NO: 641312 - RNA, 64 nt, Homo Sapiens; identical to SEQ ID NO: 416991

SEQ ID NO: 641313 - RNA, 64 nt, Homo Sapiens; identical to SEQ ID NO: 416992

SEQ ID NO: 641314 - RNA, 64 nt, Homo Sapiens; identical to SEQ ID NO: 416993

SEQ ID NO: 641315 - RNA, 64 nt, Homo Sapiens; identical to SEQ ID NO: 416994

SEQ ID NO: 641316 - RNA, 64 nt, Homo Sapiens; identical to SEQ ID NO: 416995

SEQ ID NO: 641317 - RNA, 64 nt, Homo Sapiens; identical to SEQ ID NO: 416996

SEQ ID NO: 641318 - RNA, 64 nt, Homo Sapiens; identical to SEQ ID NO: 416997

SEQ ID NO: 641319 - RNA, 64 nt, Homo Sapiens; identical to SEQ ID NO: 416998

SEQ ID NO: 641320 - RNA, 64 nt, Homo Sapiens; identical to SEQ ID NO: 416999

SEQ ID NO: 641321 - RNA, 64 nt, Homo Sapiens; identical to SEQ ID NO: 417000

SEQ ID NO: 641322 - RNA, 64 nt, Homo Sapiens; identical to SEQ ID NO: 417001

SEQ ID NO: 641323 - RNA, 64 nt, Homo Sapiens; identical to SEQ ID NO: 417002

SEQ ID NO: 641324 - RNA, 64 nt, Homo Sapiens; identical to SEQ ID NO: 417003

SEQ ID NO: 641325 - RNA, 64 nt, Homo Sapiens; identical to SEQ ID NO: 417004

SEQ ID NO: 641326 - RNA, 64 nt, Homo Sapiens; identical to SEQ ID NO: 417005

SEQ ID NO: 641327 - RNA, 64 nt, Homo Sapiens; identical to SEQ ID NO: 417006

SEQ ID NO: 641328 - RNA, 64 nt, Homo Sapiens; identical to SEQ ID NO: 417007

SEQ ID NO: 641329 - RNA, 64 nt, Homo Sapiens; identical to SEQ ID NO: 417008

SEQ ID NO: 641330 - RNA, 64 nt, Homo Sapiens; identical to SEQ ID NO: 417009

SEQ ID NO: 641331 - RNA, 64 nt, Homo Sapiens; identical to SEQ ID NO: 417010

SEQ ID NO: 641332 - RNA, 64 nt, Homo Sapiens; identical to SEQ ID NO: 417011

SEQ ID NO: 641333 - RNA, 64 nt, Homo Sapiens; identical to SEQ ID NO: 417012

SEQ ID NO: 641334 - RNA, 64 nt, Homo Sapiens; identical to SEQ ID NO: 417013

SEQ ID NO: 641335 - RNA, 64 nt, Homo Sapiens; identical to SEQ ID NO: 417014

SEQ ID NO: 641336 - RNA, 64 nt, Homo Sapiens; identical to SEQ ID NO: 417015

SEQ ID NO: 641337 - RNA, 64 nt, Homo Sapiens; identical to SEQ ID NO: 417016

SEQ ID NO: 641338 - RNA, 64 nt, Homo Sapiens; identical to SEQ ID NO: 417017

SEQ ID NO: 641339 - RNA, 64 nt, Homo Sapiens; identical to SEQ ID NO: 417018

SEQ ID NO: 641340 - RNA, 64 nt, Homo Sapiens; identical to SEQ ID NO: 417019

SEQ ID NO: 641341 - RNA, 64 nt, Homo Sapiens; identical to SEQ ID NO: 417020

SEQ ID NO: 641342 - RNA, 64 nt, Homo Sapiens; identical to SEQ ID NO: 417021

SEQ ID NO: 641343 - RNA, 64 nt, Homo Sapiens; identical to SEQ ID NO: 417022

SEQ ID NO: 641344 - RNA, 64 nt, Homo Sapiens; identical to SEQ ID NO: 417023

SEQ ID NO: 641345 - RNA, 64 nt, Homo Sapiens; identical to SEQ ID NO: 417024

SEQ ID NO: 641346 - RNA, 64 nt, Homo Sapiens; identical to SEQ ID NO: 417025

SEQ ID NO: 641347 - RNA, 64 nt, Homo Sapiens; identical to SEQ ID NO: 417026

SEQ ID NO: 641348 - RNA, 64 nt, Homo Sapiens; identical to SEQ ID NO: 417027

SEQ ID NO: 641349 - RNA, 64 nt, Homo Sapiens; identical to SEQ ID NO: 417028

SEQ ID NO: 641350 - RNA, 64 nt, Homo Sapiens; identical to SEQ ID NO: 417029

SEQ ID NO: 641351 - RNA, 64 nt, Homo Sapiens; identical to SEQ ID NO: 417030

SEQ ID NO: 641352 - RNA, 64 nt, Homo Sapiens; identical to SEQ ID NO: 417031

SEQ ID NO: 641353 - RNA, 64 nt, Homo Sapiens; identical to SEQ ID NO: 417032

SEQ ID NO: 641354 - RNA, 64 nt, Homo Sapiens; identical to SEQ ID NO: 71989

SEQ ID NO: 641355 - RNA, 64 nt, Homo Sapiens; identical to SEQ ID NO: 71990

SEQ ID NO: 641356 - RNA, 64 nt, Homo Sapiens; identical to SEQ ID NO: 71991

SEQ ID NO: 641357 - RNA, 64 nt, Homo Sapiens; identical to SEQ ID NO: 71992

SEQ ID NO: 641358 - RNA, 64 nt, Homo Sapiens; identical to SEQ ID NO: 71993

SEQ ID NO: 641359 - RNA, 64 nt, Homo Sapiens; identical to SEQ ID NO: 71994

SEQ ID NO: 641360 - RNA, 64 nt, Homo Sapiens; identical to SEQ ID NO: 71995

SEQ ID NO: 641361 - RNA, 64 nt, Homo Sapiens; identical to SEQ ID NO: 71996

SEQ ID NO: 641362 - RNA, 64 nt, Homo Sapiens; identical to SEQ ID NO: 71997

SEQ ID NO: 641363 - RNA, 64 nt, Homo Sapiens; identical to SEQ ID NO: 71998

SEQ ID NO: 641364 - RNA, 64 nt, Homo Sapiens; identical to SEQ ID NO: 71999

SEQ ID NO: 641365 - RNA, 64 nt, Homo Sapiens; identical to SEQ ID NO: 72000

SEQ ID NO: 641366 - RNA, 64 nt, Homo Sapiens; identical to SEQ ID NO: 72001

SEQ ID NO: 641367 - RNA, 64 nt, Homo Sapiens; identical to SEQ ID NO: 72002

SEQ ID NO: 641368 - RNA, 64 nt, Homo Sapiens; identical to SEQ ID NO: 72003

SEQ ID NO: 641369 - RNA, 64 nt, Homo Sapiens; identical to SEQ ID NO: 72004

SEQ ID NO: 641370 - RNA, 64 nt, Homo Sapiens; identical to SEQ ID NO: 72005

SEQ ID NO: 641371 - RNA, 64 nt, Homo Sapiens; identical to SEQ ID NO: 72006

SEQ ID NO: 641372 - RNA, 64 nt, Homo Sapiens; identical to SEQ ID NO: 72007

SEQ ID NO: 641373 - RNA, 64 nt, Homo Sapiens; identical to SEQ ID NO: 72008

SEQ ID NO: 641374 - RNA, 64 nt, Homo Sapiens; identical to SEQ ID NO: 72009

SEQ ID NO: 641375 - RNA, 64 nt, Homo Sapiens; identical to SEQ ID NO: 72010

SEQ ID NO: 641376 - RNA, 64 nt, Homo Sapiens; identical to SEQ ID NO: 72011

SEQ ID NO: 641377 - RNA, 64 nt, Homo Sapiens; identical to SEQ ID NO: 72012

SEQ ID NO: 641378 - RNA, 64 nt, Homo Sapiens; identical to SEQ ID NO: 72013

SEQ ID NO: 641379 - RNA, 64 nt, Homo Sapiens; identical to SEQ ID NO: 72014

SEQ ID NO: 641380 - RNA, 64 nt, Homo Sapiens; identical to SEQ ID NO: 72015

SEQ ID NO: 641381 - RNA, 64 nt, Homo Sapiens; identical to SEQ ID NO: 72016

SEQ ID NO: 641382 - RNA, 64 nt, Homo Sapiens; identical to SEQ ID NO: 72017

SEQ ID NO: 641383 - RNA, 64 nt, Homo Sapiens; identical to SEQ ID NO: 72018

SEQ ID NO: 641384 - RNA, 64 nt, Homo Sapiens; identical to SEQ ID NO: 72019

SEQ ID NO: 641385 - RNA, 64 nt, Homo Sapiens; identical to SEQ ID NO: 72020

SEQ ID NO: 641386 - RNA, 64 nt, Homo Sapiens; identical to SEQ ID NO: 72021

SEQ ID NO: 641387 - RNA, 64 nt, Homo Sapiens; identical to SEQ ID NO: 72022

SEQ ID NO: 641388 - RNA, 64 nt, Homo Sapiens; identical to SEQ ID NO: 72023

SEQ ID NO: 641389 - RNA, 64 nt, Homo Sapiens; identical to SEQ ID NO: 219832

SEQ ID NO: 641390 - RNA, 64 nt, Homo Sapiens; identical to SEQ ID NO: 219833

SEQ ID NO: 641391 - RNA, 64 nt, Homo Sapiens; identical to SEQ ID NO: 219834

SEQ ID NO: 641392 - RNA, 64 nt, Homo Sapiens; identical to SEQ ID NO: 219835

SEQ ID NO: 641393 - RNA, 64 nt, Homo Sapiens; identical to SEQ ID NO: 219836

SEQ ID NO: 641394 - RNA, 64 nt, Homo Sapiens; identical to SEQ ID NO: 219837

SEQ ID NO: 641395 - RNA, 64 nt, Homo Sapiens; identical to SEQ ID NO: 219838

SEQ ID NO: 641396 - RNA, 64 nt, Homo Sapiens; identical to SEQ ID NO: 219839

SEQ ID NO: 641397 - RNA, 64 nt, Homo Sapiens; identical to SEQ ID NO: 76961

SEQ ID NO: 641398 - RNA, 64 nt, Homo Sapiens; identical to SEQ ID NO: 76962

SEQ ID NO: 641399 - RNA, 64 nt, Homo Sapiens; identical to SEQ ID NO: 76963

SEQ ID NO: 641400 - RNA, 64 nt, Homo Sapiens; identical to SEQ ID NO: 76964

SEQ ID NO: 641401 - RNA, 64 nt, Homo Sapiens; identical to SEQ ID NO: 76965

SEQ ID NO: 641402 - RNA, 64 nt, Homo Sapiens; identical to SEQ ID NO: 76966

SEQ ID NO: 641403 - RNA, 64 nt, Homo Sapiens; identical to SEQ ID NO: 76967

SEQ ID NO: 641404 - RNA, 64 nt, Homo Sapiens; identical to SEQ ID NO: 76968

SEQ ID NO: 641405 - RNA, 64 nt, Homo Sapiens; identical to SEQ ID NO: 76969

SEQ ID NO: 641406 - RNA, 64 nt, Homo Sapiens; identical to SEQ ID NO: 76970

SEQ ID NO: 641407 - RNA, 64 nt, Homo Sapiens; identical to SEQ ID NO: 76971

SEQ ID NO: 641408 - RNA, 64 nt, Homo Sapiens; identical to SEQ ID NO: 76972

SEQ ID NO: 641409 - RNA, 64 nt, Homo Sapiens; identical to SEQ ID NO: 76973

SEQ ID NO: 641410 - RNA, 64 nt, Homo Sapiens; identical to SEQ ID NO: 76974

SEQ ID NO: 641411 - RNA, 64 nt, Homo Sapiens; identical to SEQ ID NO: 76975

SEQ ID NO: 641412 - RNA, 64 nt, Homo Sapiens; identical to SEQ ID NO: 76976

SEQ ID NO: 641413 - RNA, 64 nt, Homo Sapiens; identical to SEQ ID NO: 76977

SEQ ID NO: 641414 - RNA, 64 nt, Homo Sapiens; identical to SEQ ID NO: 76978

SEQ ID NO: 641415 - RNA, 64 nt, Homo Sapiens; identical to SEQ ID NO: 76979

SEQ ID NO: 641416 - RNA, 64 nt, Homo Sapiens; identical to SEQ ID NO: 76980

SEQ ID NO: 641417 - RNA, 64 nt, Homo Sapiens; identical to SEQ ID NO: 76981

SEQ ID NO: 641418 - RNA, 64 nt, Homo Sapiens; identical to SEQ ID NO: 76982

SEQ ID NO: 641419 - RNA, 64 nt, Homo Sapiens; identical to SEQ ID NO: 76983

SEQ ID NO: 641420 - RNA, 64 nt, Homo Sapiens; identical to SEQ ID NO: 76984

SEQ ID NO: 641421 - RNA, 64 nt, Homo Sapiens; identical to SEQ ID NO: 76985

SEQ ID NO: 641422 - RNA, 64 nt, Homo Sapiens; identical to SEQ ID NO: 76986

SEQ ID NO: 641423 - RNA, 64 nt, Homo Sapiens; identical to SEQ ID NO: 76987

SEQ ID NO: 641424 - RNA, 64 nt, Homo Sapiens; identical to SEQ ID NO: 76988

SEQ ID NO: 641425 - RNA, 64 nt, Homo Sapiens; identical to SEQ ID NO: 76989

SEQ ID NO: 641426 - RNA, 64 nt, Homo Sapiens; identical to SEQ ID NO: 76990

SEQ ID NO: 641427 - RNA, 64 nt, Homo Sapiens; identical to SEQ ID NO: 76991

SEQ ID NO: 641428 - RNA, 64 nt, Homo Sapiens; identical to SEQ ID NO: 76992

SEQ ID NO: 641429 - RNA, 64 nt, Homo Sapiens; identical to SEQ ID NO: 76993

SEQ ID NO: 641430 - RNA, 64 nt, Homo Sapiens; identical to SEQ ID NO: 76994

SEQ ID NO: 641431 - RNA, 64 nt, Homo Sapiens; identical to SEQ ID NO: 76995

SEQ ID NO: 641432 - RNA, 64 nt, Homo Sapiens; identical to SEQ ID NO: 76996

SEQ ID NO: 641433 - RNA, 64 nt, Homo Sapiens; identical to SEQ ID NO: 76997

SEQ ID NO: 641434 - RNA, 64 nt, Homo Sapiens; identical to SEQ ID NO: 76998

SEQ ID NO: 641435 - RNA, 64 nt, Homo Sapiens; identical to SEQ ID NO: 76999

SEQ ID NO: 641436 - RNA, 64 nt, Homo Sapiens; identical to SEQ ID NO: 77000

SEQ ID NO: 641437 - RNA, 64 nt, Homo Sapiens; identical to SEQ ID NO: 77001

SEQ ID NO: 641438 - RNA, 64 nt, Homo Sapiens; identical to SEQ ID NO: 77002

SEQ ID NO: 641439 - RNA, 64 nt, Homo Sapiens; identical to SEQ ID NO: 77003

SEQ ID NO: 641440 - RNA, 64 nt, Homo Sapiens; identical to SEQ ID NO: 77004

SEQ ID NO: 641441 - RNA, 64 nt, Homo Sapiens; identical to SEQ ID NO: 77005

SEQ ID NO: 641442 - RNA, 64 nt, Homo Sapiens; identical to SEQ ID NO: 77006

SEQ ID NO: 641443 - RNA, 64 nt, Homo Sapiens; identical to SEQ ID NO: 77007

SEQ ID NO: 641444 - RNA, 64 nt, Homo Sapiens; identical to SEQ ID NO: 77008

SEQ ID NO: 641445 - RNA, 64 nt, Homo Sapiens; identical to SEQ ID NO: 77009

SEQ ID NO: 641446 - RNA, 64 nt, Homo Sapiens; identical to SEQ ID NO: 77010

SEQ ID NO: 641447 - RNA, 64 nt, Homo Sapiens; identical to SEQ ID NO: 77011

SEQ ID NO: 641448 - RNA, 64 nt, Homo Sapiens; identical to SEQ ID NO: 77012

SEQ ID NO: 641449 - RNA, 64 nt, Homo Sapiens; identical to SEQ ID NO: 77013

SEQ ID NO: 641450 - RNA, 64 nt, Homo Sapiens; identical to SEQ ID NO: 77014

SEQ ID NO: 641451 - RNA, 64 nt, Homo Sapiens; identical to SEQ ID NO: 77015

SEQ ID NO: 641452 - RNA, 64 nt, Homo Sapiens; identical to SEQ ID NO: 74916

SEQ ID NO: 641453 - RNA, 64 nt, Homo Sapiens; identical to SEQ ID NO: 74917

SEQ ID NO: 641454 - RNA, 64 nt, Homo Sapiens; identical to SEQ ID NO: 74918

SEQ ID NO: 641455 - RNA, 64 nt, Homo Sapiens; identical to SEQ ID NO: 74919

SEQ ID NO: 641456 - RNA, 64 nt, Homo Sapiens; identical to SEQ ID NO: 74920

SEQ ID NO: 641457 - RNA, 64 nt, Homo Sapiens; identical to SEQ ID NO: 74921

SEQ ID NO: 641458 - RNA, 64 nt, Homo Sapiens; identical to SEQ ID NO: 74922

SEQ ID NO: 641459 - RNA, 64 nt, Homo Sapiens; identical to SEQ ID NO: 74923

SEQ ID NO: 641460 - RNA, 64 nt, Homo Sapiens; identical to SEQ ID NO: 74924

SEQ ID NO: 641461 - RNA, 64 nt, Homo Sapiens; identical to SEQ ID NO: 74925

SEQ ID NO: 641462 - RNA, 64 nt, Homo Sapiens; identical to SEQ ID NO: 74926

SEQ ID NO: 641463 - RNA, 64 nt, Homo Sapiens; identical to SEQ ID NO: 74927

SEQ ID NO: 641464 - RNA, 64 nt, Homo Sapiens; identical to SEQ ID NO: 74928

SEQ ID NO: 641465 - RNA, 64 nt, Homo Sapiens; identical to SEQ ID NO: 74929

SEQ ID NO: 641466 - RNA, 64 nt, Homo Sapiens; identical to SEQ ID NO: 74930

SEQ ID NO: 641467 - RNA, 64 nt, Homo Sapiens; identical to SEQ ID NO: 74931

SEQ ID NO: 641468 - RNA, 64 nt, Homo Sapiens; identical to SEQ ID NO: 74932

SEQ ID NO: 641469 - RNA, 64 nt, Homo Sapiens; identical to SEQ ID NO: 74933

SEQ ID NO: 641470 - RNA, 64 nt, Homo Sapiens; identical to SEQ ID NO: 74934

SEQ ID NO: 641471 - RNA, 64 nt, Homo Sapiens; identical to SEQ ID NO: 74935

SEQ ID NO: 641472 - RNA, 64 nt, Homo Sapiens; identical to SEQ ID NO: 74936

SEQ ID NO: 641473 - RNA, 64 nt, Homo Sapiens; identical to SEQ ID NO: 74937

SEQ ID NO: 641474 - RNA, 64 nt, Homo Sapiens; identical to SEQ ID NO: 74938

SEQ ID NO: 641475 - RNA, 64 nt, Homo Sapiens; identical to SEQ ID NO: 74939

SEQ ID NO: 641476 - RNA, 64 nt, Homo Sapiens; identical to SEQ ID NO: 74940

SEQ ID NO: 641477 - RNA, 64 nt, Homo Sapiens; identical to SEQ ID NO: 74941

SEQ ID NO: 641478 - RNA, 64 nt, Homo Sapiens; identical to SEQ ID NO: 74942

SEQ ID NO: 641479 - RNA, 64 nt, Homo Sapiens; identical to SEQ ID NO: 74943

SEQ ID NO: 641480 - RNA, 64 nt, Homo Sapiens; identical to SEQ ID NO: 74944

SEQ ID NO: 641481 - RNA, 64 nt, Homo Sapiens; identical to SEQ ID NO: 74945

SEQ ID NO: 641482 - RNA, 64 nt, Homo Sapiens; identical to SEQ ID NO: 74946

SEQ ID NO: 641483 - RNA, 64 nt, Homo Sapiens; identical to SEQ ID NO: 74947

SEQ ID NO: 641484 - RNA, 64 nt, Homo Sapiens; identical to SEQ ID NO: 74948

SEQ ID NO: 641485 - RNA, 64 nt, Homo Sapiens; identical to SEQ ID NO: 74949

SEQ ID NO: 641486 - RNA, 64 nt, Homo Sapiens; identical to SEQ ID NO: 74950

SEQ ID NO: 641487 - RNA, 64 nt, Homo Sapiens; identical to SEQ ID NO: 74951

SEQ ID NO: 641488 - RNA, 64 nt, Homo Sapiens; identical to SEQ ID NO: 74952

SEQ ID NO: 641489 - RNA, 64 nt, Homo Sapiens; identical to SEQ ID NO: 74953

SEQ ID NO: 641490 - RNA, 64 nt, Homo Sapiens; identical to SEQ ID NO: 74954

SEQ ID NO: 641491 - RNA, 64 nt, Homo Sapiens; identical to SEQ ID NO: 74955

SEQ ID NO: 641492 - RNA, 64 nt, Homo Sapiens; identical to SEQ ID NO: 74956

SEQ ID NO: 641493 - RNA, 64 nt, Homo Sapiens; identical to SEQ ID NO: 74957

SEQ ID NO: 641494 - RNA, 64 nt, Homo Sapiens; identical to SEQ ID NO: 74958

SEQ ID NO: 641495 - RNA, 64 nt, Homo Sapiens; identical to SEQ ID NO: 74959

SEQ ID NO: 641496 - RNA, 64 nt, Homo Sapiens; identical to SEQ ID NO: 74960

SEQ ID NO: 641497 - RNA, 64 nt, Homo Sapiens; identical to SEQ ID NO: 74961

SEQ ID NO: 641498 - RNA, 64 nt, Homo Sapiens; identical to SEQ ID NO: 74962

SEQ ID NO: 641499 - RNA, 64 nt, Homo Sapiens; identical to SEQ ID NO: 74963

SEQ ID NO: 641500 - RNA, 64 nt, Homo Sapiens; identical to SEQ ID NO: 74964

SEQ ID NO: 641501 - RNA, 64 nt, Homo Sapiens; identical to SEQ ID NO: 74965

SEQ ID NO: 641502 - RNA, 64 nt, Homo Sapiens; identical to SEQ ID NO: 74966

SEQ ID NO: 641503 - RNA, 64 nt, Homo Sapiens; identical to SEQ ID NO: 74967

SEQ ID NO: 641504 - RNA, 64 nt, Homo Sapiens; identical to SEQ ID NO: 74968

SEQ ID NO: 641505 - RNA, 64 nt, Homo Sapiens; identical to SEQ ID NO: 74969

SEQ ID NO: 641506 - RNA, 64 nt, Homo Sapiens; identical to SEQ ID NO: 74970

SEQ ID NO: 641507 - RNA, 64 nt, Homo Sapiens; identical to SEQ ID NO: 74971

SEQ ID NO: 641508 - RNA, 64 nt, Homo Sapiens; identical to SEQ ID NO: 74972

SEQ ID NO: 641509 - RNA, 64 nt, Homo Sapiens; identical to SEQ ID NO: 74973

SEQ ID NO: 641510 - RNA, 64 nt, Homo Sapiens; identical to SEQ ID NO: 74974

SEQ ID NO: 641511 - RNA, 64 nt, Homo Sapiens; identical to SEQ ID NO: 74975

SEQ ID NO: 641512 - RNA, 64 nt, Homo Sapiens; identical to SEQ ID NO: 74976

SEQ ID NO: 641513 - RNA, 64 nt, Homo Sapiens; identical to SEQ ID NO: 74977

SEQ ID NO: 641514 - RNA, 64 nt, Homo Sapiens; identical to SEQ ID NO: 74978

SEQ ID NO: 641515 - RNA, 64 nt, Homo Sapiens; identical to SEQ ID NO: 74979

SEQ ID NO: 641516 - RNA, 64 nt, Homo Sapiens; identical to SEQ ID NO: 74980

SEQ ID NO: 641517 - RNA, 64 nt, Homo Sapiens; identical to SEQ ID NO: 74981

SEQ ID NO: 641518 - RNA, 64 nt, Homo Sapiens; identical to SEQ ID NO: 74982

SEQ ID NO: 641519 - RNA, 64 nt, Homo Sapiens; identical to SEQ ID NO: 74983

SEQ ID NO: 641520 - RNA, 64 nt, Homo Sapiens; identical to SEQ ID NO: 74984

SEQ ID NO: 641521 - RNA, 64 nt, Homo Sapiens; identical to SEQ ID NO: 74985

SEQ ID NO: 641522 - RNA, 64 nt, Homo Sapiens; identical to SEQ ID NO: 74986

SEQ ID NO: 641523 - RNA, 64 nt, Homo Sapiens; identical to SEQ ID NO: 74987

SEQ ID NO: 641524 - RNA, 64 nt, Homo Sapiens; identical to SEQ ID NO: 74988

SEQ ID NO: 641525 - RNA, 64 nt, Homo Sapiens; identical to SEQ ID NO: 74989

SEQ ID NO: 641526 - RNA, 64 nt, Homo Sapiens; identical to SEQ ID NO: 74990

SEQ ID NO: 641527 - RNA, 64 nt, Homo Sapiens; identical to SEQ ID NO: 74991

SEQ ID NO: 641528 - RNA, 64 nt, Homo Sapiens; identical to SEQ ID NO: 74992

SEQ ID NO: 641529 - RNA, 64 nt, Homo Sapiens; identical to SEQ ID NO: 74993

SEQ ID NO: 641530 - RNA, 64 nt, Homo Sapiens; identical to SEQ ID NO: 74994

SEQ ID NO: 641531 - RNA, 64 nt, Homo Sapiens; identical to SEQ ID NO: 74995

SEQ ID NO: 641532 - RNA, 64 nt, Homo Sapiens; identical to SEQ ID NO: 349170

SEQ ID NO: 641533 - RNA, 64 nt, Homo Sapiens; identical to SEQ ID NO: 349171

SEQ ID NO: 641534 - RNA, 64 nt, Homo Sapiens; identical to SEQ ID NO: 349172

SEQ ID NO: 641535 - RNA, 64 nt, Homo Sapiens; identical to SEQ ID NO: 349173

SEQ ID NO: 641536 - RNA, 64 nt, Homo Sapiens; identical to SEQ ID NO: 74555

SEQ ID NO: 641537 - RNA, 64 nt, Homo Sapiens; identical to SEQ ID NO: 74556

SEQ ID NO: 641538 - RNA, 64 nt, Homo Sapiens; identical to SEQ ID NO: 74557

SEQ ID NO: 641539 - RNA, 64 nt, Homo Sapiens; identical to SEQ ID NO: 74558

SEQ ID NO: 641540 - RNA, 64 nt, Homo Sapiens; identical to SEQ ID NO: 74559

SEQ ID NO: 641541 - RNA, 64 nt, Homo Sapiens; identical to SEQ ID NO: 74560

SEQ ID NO: 641542 - RNA, 64 nt, Homo Sapiens; identical to SEQ ID NO: 284001

SEQ ID NO: 641543 - RNA, 64 nt, Homo Sapiens; identical to SEQ ID NO: 284002

SEQ ID NO: 641544 - RNA, 64 nt, Homo Sapiens; identical to SEQ ID NO: 284003

SEQ ID NO: 641545 - RNA, 64 nt, Homo Sapiens; identical to SEQ ID NO: 284004

SEQ ID NO: 641546 - RNA, 64 nt, Homo Sapiens; identical to SEQ ID NO: 284005

SEQ ID NO: 641547 - RNA, 64 nt, Homo Sapiens; identical to SEQ ID NO: 284006

SEQ ID NO: 641548 - RNA, 64 nt, Homo Sapiens; identical to SEQ ID NO: 284007

SEQ ID NO: 641549 - RNA, 64 nt, Homo Sapiens; identical to SEQ ID NO: 284008

SEQ ID NO: 641550 - RNA, 64 nt, Homo Sapiens; identical to SEQ ID NO: 284009

SEQ ID NO: 641551 - RNA, 64 nt, Homo Sapiens; identical to SEQ ID NO: 284010

SEQ ID NO: 641552 - RNA, 64 nt, Homo Sapiens; identical to SEQ ID NO: 284011

SEQ ID NO: 641553 - RNA, 64 nt, Homo Sapiens; identical to SEQ ID NO: 284012

SEQ ID NO: 641554 - RNA, 64 nt, Homo Sapiens; identical to SEQ ID NO: 284013

SEQ ID NO: 641555 - RNA, 64 nt, Homo Sapiens; identical to SEQ ID NO: 284014

SEQ ID NO: 641556 - RNA, 64 nt, Homo Sapiens; identical to SEQ ID NO: 284015

SEQ ID NO: 641557 - RNA, 64 nt, Homo Sapiens; identical to SEQ ID NO: 284016

SEQ ID NO: 641558 - RNA, 64 nt, Homo Sapiens; identical to SEQ ID NO: 284017

SEQ ID NO: 641559 - RNA, 64 nt, Homo Sapiens; identical to SEQ ID NO: 284018

SEQ ID NO: 641560 - RNA, 64 nt, Homo Sapiens; identical to SEQ ID NO: 284019

SEQ ID NO: 641561 - RNA, 64 nt, Homo Sapiens; identical to SEQ ID NO: 284020

SEQ ID NO: 641562 - RNA, 64 nt, Homo Sapiens; identical to SEQ ID NO: 284021

SEQ ID NO: 641563 - RNA, 64 nt, Homo Sapiens; identical to SEQ ID NO: 284022

SEQ ID NO: 641564 - RNA, 64 nt, Homo Sapiens; identical to SEQ ID NO: 284023

SEQ ID NO: 641565 - RNA, 64 nt, Homo Sapiens; identical to SEQ ID NO: 284024

SEQ ID NO: 641566 - RNA, 64 nt, Homo Sapiens; identical to SEQ ID NO: 284025

SEQ ID NO: 641567 - RNA, 64 nt, Homo Sapiens; identical to SEQ ID NO: 284026

SEQ ID NO: 641568 - RNA, 64 nt, Homo Sapiens; identical to SEQ ID NO: 284027

SEQ ID NO: 641569 - RNA, 64 nt, Homo Sapiens; identical to SEQ ID NO: 284028

SEQ ID NO: 641570 - RNA, 64 nt, Homo Sapiens; identical to SEQ ID NO: 284029

SEQ ID NO: 641571 - RNA, 54 nt, Homo Sapiens; identical to SEQ ID NO: 284030

SEQ ID NO: 641572 - RNA, 64 nt, Homo Sapiens; identical to SEQ ID NO: 284031

SEQ ID NO: 641573 - RNA, 64 nt, Homo Sapiens; identical to SEQ ID NO: 284032

SEQ ID NO: 641574 - RNA, 64 nt, Homo Sapiens; identical to SEQ ID NO: 284033

SEQ ID NO: 641575 - RNA, 64 nt, Homo Sapiens; identical to SEQ ID NO: 284034

SEQ ID NO: 641576 - RNA, 64 nt, Homo Sapiens; identical to SEQ ID NO: 284035

SEQ ID NO: 641577 - RNA, 64 nt, Homo Sapiens; identical to SEQ ID NO: 284036

SEQ ID NO: 641578 - RNA, 64 nt, Homo Sapiens; identical to SEQ ID NO: 284037

SEQ ID NO: 641579 - RNA, 64 nt, Homo Sapiens; identical to SEQ ID NO: 284038

SEQ ID NO: 641580 - RNA, 64 nt, Homo Sapiens; identical to SEQ ID NO: 23330

SEQ ID NO: 641581 - RNA, 64 nt, Homo Sapiens; identical to SEQ ID NO: 23331

SEQ ID NO: 641582 - RNA, 64 nt, Homo Sapiens; identical to SEQ ID NO: 23332

SEQ ID NO: 641583 - RNA, 64 nt, Homo Sapiens; identical to SEQ ID NO: 23333

SEQ ID NO: 641584 - RNA, 64 nt, Homo Sapiens; identical to SEQ ID NO: 23334

SEQ ID NO: 641585 - RNA, 64 nt, Homo Sapiens; identical to SEQ ID NO: 23335

SEQ ID NO: 641586 - RNA, 64 nt, Homo Sapiens; identical to SEQ ID NO: 23336

SEQ ID NO: 641587 - RNA, 64 nt, Homo Sapiens; identical to SEQ ID NO: 23337

SEQ ID NO: 641588 - RNA, 64 nt, Homo Sapiens; identical to SEQ ID NO: 23338

SEQ ID NO: 641589 - RNA, 64 nt, Homo Sapiens; identical to SEQ ID NO: 23339

SEQ ID NO: 641590 - RNA, 64 nt, Homo Sapiens; identical to SEQ ID NO: 138795

SEQ ID NO: 641591 - RNA, 64 nt, Homo Sapiens; identical to SEQ ID NO: 138796

SEQ ID NO: 641592 - RNA, 64 nt, Homo Sapiens; identical to SEQ ID NO: 138797

SEQ ID NO: 641593 - RNA, 64 nt, Homo Sapiens; identical to SEQ ID NO: 138798

SEQ ID NO: 641594 - RNA, 64 nt, Homo Sapiens; identical to SEQ ID NO: 138799

SEQ ID NO: 641595 - RNA, 64 nt, Homo Sapiens; identical to SEQ ID NO: 138800

SEQ ID NO: 641596 - RNA, 64 nt, Homo Sapiens; identical to SEQ ID NO: 138801

SEQ ID NO: 641597 - RNA, 64 nt, Homo Sapiens; identical to SEQ ID NO: 138802

SEQ ID NO: 641598 - RNA, 64 nt, Homo Sapiens; identical to SEQ ID NO: 138803

SEQ ID NO: 641599 - RNA, 64 nt, Homo Sapiens; identical to SEQ ID NO: 138804

SEQ ID NO: 641600 - RNA, 64 nt, Homo Sapiens; identical to SEQ ID NO: 138805

SEQ ID NO: 641601 - RNA, 64 nt, Homo Sapiens; identical to SEQ ID NO: 138806

SEQ ID NO: 641602 - RNA, 64 nt, Homo Sapiens; identical to SEQ ID NO: 138807

SEQ ID NO: 641603 - RNA, 64 nt, Homo Sapiens; identical to SEQ ID NO: 138808

SEQ ID NO: 641604 - RNA, 64 nt, Homo Sapiens
guguuuacaguauucaauuuauugcaguuauagaauuggucagagagcauuuucauagugugcu

SEQ ID NO: 641605 - RNA, 64 nt, Homo Sapiens
uguuaauagaggaucagagcagaguugggaguauauuggucaggaucauagaaaagaagacaaa

SEQ ID NO: 641606 - RNA, 64 nt, Homo Sapiens
cuggucuugaacuccugacccaggguuucaccauauuggucagguuuuguauuuuuaguagaga

SEQ ID NO: 641607 - RNA, 64 nt, Homo Sapiens; identical to SEQ ID NO: 641606

SEQ ID NO: 641608 - RNA, 63 nt, Homo Sapiens
uccucuuagaagaaaagccugaaacugaguugaauagagaagugugacccugugacaaaauga

SEQ ID NO: 641609 - RNA, 63 nt, Homo Sapiens
caaauaacugaugaaggauucauaaucacaaauauagagaauuccuauuuaaaaaaauagaaa

SEQ ID NO: 641610 - RNA, 63 nt, Homo Sapiens
aaagaagaaaaaacugaagguacuuuacucccuauagagaaaccauugccaucauuguagcaa

SEQ ID NO: 641611 - RNA, 63 nt, Homo Sapiens
guaaaucuuuuaucaacuguauacugguguuuaauagagaaugauugucuuccgaguuuuuug

SEQ ID NO: 641612 - RNA, 63 nt, Homo Sapiens
agcaauugauaaaguaaaugcugauacacauaaauagagaaagagguaacauuuaacaauaau

SEQ ID NO: 641613 - RNA, 63 nt, Homo Sapiens
gagaagguuucucuuuugcagauagauagauagauagagaaaugauagauagauagauagaua

SEQ ID NO: 641614 - RNA, 63 nt, Homo Sapiens
ucacaauggaaccuuaaauacuucugguaaaccauagagaauggaggauggcugugaugaagc

SEQ ID NO: 641615 - RNA, 63 nt, Homo Sapiens
uacuaucagaacaaauacauaaaauaacuucccauagagaacaggauauagcaauaauagcuc

SEQ ID NO: 641616 - RNA, 63 nt, Homo Sapiens
auaaaaguguguucuuaacuaucucuuugagaaauagagaaaugugugugauuuacuuuucug

SEQ ID NO: 641617 - RNA, 63 nt, Homo Sapiens
ggcuaugccuguaauuuuuaauaaauauagaaaauagagaaaagaagcaugaauuauuuucau

SEQ ID NO: 641618 - RNA, 63 nt, Homo Sapiens
uccucugguuagucucucaagcauguaauuugcauagagaagguuuucuuuuaagguguauug

SEQ ID NO: 641619 - RNA, 63 nt, Homo Sapiens
gguuuugucaaauguuuucugaccauaacuuuuauagagaaaguauaaaacaacauaaauuua

SEQ ID NO: 641620 - RNA, 63 nt, Homo Sapiens
aucauguugacuuugugaauuagagaauagcauauagagaauacuaaaauuuuauuugacuua

SEQ ID NO: 641621 - RNA, 63 nt, Homo Sapiens
gcauauagagaauaaucauguuuuauuugacuuauagagaauauaaaaacauuaccacuaaaa

SEQ ID NO: 641622 - RNA, 64 nt, Homo Sapiens; identical to SEQ ID NO: 641604

SEQ ID NO: 641623 - RNA, 64 nt, Homo Sapiens; identical to SEQ ID NO: 641605

SEQ ID NO: 641624 - RNA, 64 nt, Homo Sapiens; identical to SEQ ID NO: 641606

SEQ ID NO: 641625 - RNA, 64 nt, Homo Sapiens; identical to SEQ ID NO: 641606

SEQ ID NO: 641626 - RNA, 63 nt, Homo Sapiens; identical to SEQ ID NO: 641608

SEQ ID NO: 641627 - RNA, 63 nt, Homo Sapiens; identical to SEQ ID NO: 641609

SEQ ID NO: 641628 - RNA, 63 nt, Homo Sapiens; identical to SEQ ID NO: 641610

SEQ ID NO: 641629 - RNA, 63 nt, Homo Sapiens; identical to SEQ ID NO: 641611

SEQ ID NO: 641630 - RNA, 63 nt, Homo Sapiens; identical to SEQ ID NO: 641612

SEQ ID NO: 641631 - RNA, 63 nt, Homo Sapiens; identical to SEQ ID NO: 641613

SEQ ID NO: 641632 - RNA, 63 nt, Homo Sapiens; identical to SEQ ID NO: 641614

SEQ ID NO: 641633 - RNA, 63 nt, Homo Sapiens; identical to SEQ ID NO: 641615

SEQ ID NO: 641634 - RNA, 63 nt, Homo Sapiens; identical to SEQ ID NO: 641616

SEQ ID NO: 641635 - RNA, 63 nt, Homo Sapiens; identical to SEQ ID NO: 641617

SEQ ID NO: 641636 - RNA, 63 nt, Homo Sapiens; identical to SEQ ID NO: 641618

SEQ ID NO: 641637 - RNA, 63 nt, Homo Sapiens; identical to SEQ ID NO: 641619

SEQ ID NO: 641638 - RNA, 63 nt, Homo Sapiens; identical to SEQ ID NO: 641620

SEQ ID NO: 641639 - RNA, 63 nt, Homo Sapiens; identical to SEQ ID NO: 641621

SEQ ID NO: 641640 - RNA, 64 nt, Homo Sapiens
gaaaggauaaggcaaaugacugaacaguucccucaggacucacguacugaucucccaaaagaag

SEQ ID NO: 641641 - RNA, 64 nt, Homo Sapiens
gacuauuucacacucuccaugcuuaugucaaugcaggacucaucacaucuauucggauauucug

SEQ ID NO: 641642 - RNA, 64 nt, Homo Sapiens
ggauagauauuauucgacucgccugaagucuuacaggacucacugugcugauggaaguggaagu

SEQ ID NO: 641643 - RNA, 64 nt, Homo Sapiens
ggauguuauucaacuccuucgccugaagucuugcaggacucacugagcugcuggagguaguaga

SEQ ID NO: 641644 - RNA, 64 nt, Homo Sapiens
ggauagauguuauucgacucgccugaagucuugcaggacucacugagcugcuggcugagaaaga

SEQ ID NO: 641645 - RNA, 64 nt, Homo Sapiens
ggauagauguuauucaacucgccugaagucuugcaggacucacugagcugcuggaugagaaaga

SEQ ID NO: 641646 - RNA, 64 nt, Homo Sapiens
gagaggccugggggcggugcucacugggagggccaggacucaguuccugcucucauccuccccu

SEQ ID NO: 641647 - RNA, 64 nt, Homo Sapiens
ccagccccaaugucagcaggauagggagagccccaggacucaggagugcugggcugguccuacu

SEQ ID NO: 641648 - RNA, 64 nt, Homo Sapiens
ucauggaggaaacuuguccugucauugcucagccaggacucaguucugaaucccugcaggccaa

SEQ ID NO: 641649 - RNA, 64 nt, Homo Sapiens
cugaccagacgccacaccuuaucccugacugcugaggacucacagggaaacagcaggaggaggg

SEQ ID NO: 641650 - RNA, 64 nt, Homo Sapiens
cuguacagggagaugaagugccaggacgcccugcaggacucagcuccagugguggucaguagau

SEQ ID NO: 641651 - RNA, 64 nt, Homo Sapiens
cgaguuuuauugacucauuuggauugggccaacaaggacucagauuuuggcaacaggagagaca

SEQ ID NO: 641652 - RNA, 64 nt, Homo Sapiens
gacucaggccagucacccuguguucaguaguuccaggacucagguuagguaaucauuccaggug

SEQ ID NO: 641653 - RNA, 64 nt, Homo Sapiens
ugaguuuuauugacucauucggauugggccaacaaggacucagauuuuggcaacaggagagaca

SEQ ID NO: 641654 - RNA, 64 nt, Homo Sapiens
ucccuuccuucucagggggucauagcauuccaccaggacucaucuuuuaggcaccuacugugug

SEQ ID NO: 641655 - RNA, 64 nt, Homo Sapiens
ugggccccguuucuaggaagcagggaggggucccaggacucaacgaggacccugagggcucagc

SEQ ID NO: 641656 - RNA, 64 nt, Homo Sapiens
gauauugggucaguguccaaagcagggucugggcaggacucagcuccccagaguccucuaugaa

SEQ ID NO: 641657 - RNA, 64 nt, Homo Sapiens
ucacaucuuggcacauuuaagagacagucaccccaggacucaaaaauagggaaguaacaguaac

SEQ ID NO: 641658 - RNA, 64 nt, Homo Sapiens
ccuuucugugguucucagccaagacauaaaaacuaggacucagagcacauacaaaaccaguuau

SEQ ID NO: 641659 - RNA, 64 nt, Homo Sapiens
gagugagaacuacaaaaauacaaaaugcuuguccaggacucagccaugcacaccuugagcagcg

SEQ ID NO: 641660 - RNA, 64 nt, Homo Sapiens
cuuuguuuccuucacuuccuuucgauaucaugaaaggacucacacuggagagaaccccuaugag

SEQ ID NO: 641661 - RNA, 64 nt, Homo Sapiens
cuuuauuucuuccacuucuuuucaauaucaugaaaggacucacaugggagagaaacccuaugag

SEQ ID NO: 641662 - RNA, 64 nt, Homo Sapiens
cuucauuucuucuaguucccuucaauaucaugaaaggacucacacuggagagaagcccuaugaa

SEQ ID NO: 641663 - RNA, 64 nt, Homo Sapiens
cuucagaucagccucgcaccuucaaaugcauggaaggacucacacuggagaaaaacccuaugaa

SEQ ID NO: 641664 - RNA, 64 nt, Homo Sapiens
gccuuaauuguuccaguuccuuucgauaucuaaaaggacucacaguggagaaaaacucuaugag

SEQ ID NO: 641665 - RNA, 64 nt, Homo Sapiens
auucaauuauuuuucuuccuugcauauacaugaaaggacucauacgagagagaauccguaugaa

SEQ ID NO: 641666 - RNA, 64 nt, Homo Sapiens
uuucacuucuuccaguucuuuucaauaucaugaaaggacucacacuggggagaaaccguaucaa

SEQ ID NO: 641667 - RNA, 64 nt, Homo Sapiens
cuucaaucuuuccaguuccuuucaguaucaugaaaggacucacacuggagagaaacccuaugag

SEQ ID NO: 641668 - RNA, 64 nt, Homo Sapiens
cuucagaugugccccacaccuucgaaggcaugguaggacucacuggagagaaacccuaugagug

SEQ ID NO: 641669 - RNA, 64 nt, Homo Sapiens
cuucaguaguuccaguuccuuuugguaccaugaaaggacucacacuggagagaaacccuaugag

SEQ ID NO: 641670 - RNA, 64 nt, Homo Sapiens
cuuuauuucuuucacuucuuuucgauaacaugaaaggacucacacuggagagaaacccuaugag

SEQ ID NO: 641671 - RNA, 64 nt, Homo Sapiens
cuucagaucuaccucacaccuucgaaaacaugguaggacucacacuggauagaaaccaaagcag

SEQ ID NO: 641672 - RNA, 64 nt, Homo Sapiens
cuggagagaaacccuacaaacucaaagacaugaaaggacucauaauuuagauacuacuacucag

SEQ ID NO: 641673 - RNA, 64 nt, Homo Sapiens
cuggagauaaacccuuuaaguccaaauacauggaaggacucacacuucaguugucaacguucuu

SEQ ID NO: 641674 - RNA, 64 nt, Homo Sapiens
ggaaagauacucuauaaaugugcacagacacaaaaggacucauuauugaguucucucagcuccu

SEQ ID NO: 641675 - RNA, 64 nt, Homo Sapiens
cuagggagaaaaucuauaaauucaaagacaugaaaggacucacacuuuguuuauuucauuggau

SEQ ID NO: 641676 - RNA, 64 nt, Homo Sapiens
gugucacccuaggccugauaagcgaucagaggaaaggacucauucaugucacgcuuccuugagc

SEQ ID NO: 641677 - RNA, 64 nt, Homo Sapiens
augcaucuggcaccaauuagguauuucuuaaaacaggacucaucugucagagugcacaugaaaa

SEQ ID NO: 641678 - RNA, 57 nt, Homo Sapiens
ccagcacuacagaagugugugaacuaccugacucauucgacuccaucaauguacuuu

SEQ ID NO: 641679 - RNA, 57 nt, Homo Sapiens
ccagcccuacagaagugccuggacugacugacucaugcaacuccuucaguuuaucuu

SEQ ID NO: 641680 - RNA, 57 nt, Homo Sapiens
ccauaacuggagaaagaagccguuuugcugacucauuuccaaggaucagaaacuccc

SEQ ID NO: 641681 - RNA, 57 nt, Homo Sapiens
ccuuagauguaguuucaccccaaaauacugacucaguuucauuugucucugguggga

SEQ ID NO: 641682 - RNA, 57 nt, Homo Sapiens
acuguccccuuaggauuggacuguuggcugacucaccgccugccccuucugcugcuc

SEQ ID NO: 641683 - RNA, 57 nt, Homo Sapiens
uucaggagguugggggaaaaucugcaacugacucauuagaucuucuggccuucagau

SEQ ID NO: 641684 - RNA, 57 nt, Homo Sapiens
cugaaggagccccauuccugagcuucccugacucauugugcucugaucccucuacag

SEQ ID NO: 641685 - RNA, 57 nt, Homo Sapiens
gcuccuggguuuuguauucucacuccucugacucaggagagugucuuuccacggagc

SEQ ID NO: 641686 - RNA, 57 nt, Homo Sapiens
cuggagcccucugcucacuggcacuuccugacucaaaggcacuaacagugcucaugu

SEQ ID NO: 641687 - RNA, 57 nt, Homo Sapiens
ggcgcacuaccuauuuugucaccagagcugacucaggcuuccuggacccucaacccc

SEQ ID NO: 641688 - RNA, 57 nt, Homo Sapiens
cagaaugccucauaaauuagaauagcccugacucaggcaucaaaccuuccacuuagc

SEQ ID NO: 641689 - RNA, 57 nt, Homo Sapiens
gguggaucucccagaaauagccauguccugacucaugcaagaagacgcccucugaag

SEQ ID NO: 641690 - RNA, 57 nt, Homo Sapiens
ggcuguccuagaaugggcagagaggaacugacucaccugggcucccccuacucccuc

SEQ ID NO: 641691 - RNA, 57 nt, Homo Sapiens
uuccccgaaggaggccucugggaaucccugacucaacugggugccaaggaagcugga

SEQ ID NO: 641692 - RNA, 57 nt, Homo Sapiens
cuguucacugguugagcuuucuggaagcugacucagucuuacagccguggauguuuc

SEQ ID NO: 641693 - RNA, 57 nt, Homo Sapiens
acaaggaccacgggaggcccggcuucccugacucaggaggccccuggaacacacuca

SEQ ID NO: 641694 - RNA, 64 nt, Homo Sapiens
aaggaaauaacauugaagaaggaaaacaauauguagaaaguauuuuagaaaguaaccugucuuu

SEQ ID NO: 641695 - RNA, 64 nt, Homo Sapiens
uugaagaaggaaaacaauauguagaaaguauuuuagaaaguaaccugucuuugaugaugcuucu

SEQ ID NO: 641696 - RNA, 64 nt, Homo Sapiens
uugugugaaaucaccuuaucaaauuaaaaugggaagaaaguaauuuuaauaauuuuuaauaauc

SEQ ID NO: 641697 - RNA, 64 nt, Homo Sapiens
ggacugagauauuugguuacguauugugcauaauagaaaguauucacuuucaauugaagucagg

SEQ ID NO: 641698 - RNA, 64 nt, Homo Sapiens
aaccagauagagaugaaaaguuuuucauagaggcagaaaguaggaguguugagcuuuauuuugc

SEQ ID NO: 641699 - RNA, 64 nt, Homo Sapiens
caguguaauauuguauuaaucuaaacuacugguuagaaaguauuugccuagaaauuauguaaag

SEQ ID NO: 641700 - RNA, 64 nt, Homo Sapiens
aguucuuaaaaguuaugccuauggaaaauuaaccagaaaguaucgaauguauaauuggcauauc

SEQ ID NO: 641701 - RNA, 64 nt, Homo Sapiens
auaugucaaagguagagacaggucuucaugugugagaaaguauagcgagagcagaucaucuuua

SEQ ID NO: 641702 - RNA, 64 nt, Homo Sapiens
aggacagcagcucugcuagcuuggcuagugcuggagaaaguaccgggaagaaggagguggcuga

SEQ ID NO: 641703 - RNA, 64 nt, Homo Sapiens
ugaugauuucagaggaguaaauuuucugguuuuuagaaaguagagaaauuuaaaucacaaacuc

SEQ ID NO: 641704 - RNA, 64 nt, Homo Sapiens
cacauacucuuuuuuuuuuuguuucugaguucuuagaaaguaccccucugauuuugguuuucuu

SEQ ID NO: 641705 - RNA, 64 nt, Homo Sapiens
aaauauugccuccaacaugccuucagaacccuuuagaaaguauacccacucuuccuuauugccu

SEQ ID NO: 641706 - RNA, 64 nt, Homo Sapiens
aagaugucuuuacacugacaaguuuuuauuuuaaagaaaguaacaccauuaauuuccacgcugc

SEQ ID NO: 641707 - RNA, 64 nt, Homo Sapiens
cauaaaaaucgaguaauguagguugaaauguaaaagaaaguaagcauggaaaaauuaauuauau

SEQ ID NO: 641708 - RNA, 64 nt, Homo Sapiens
uuucaauaugucaguauagaagaaaaggcuaagcagaaaguaaauguacaauuguuuacauaac

SEQ ID NO: 641709 - RNA, 64 nt, Homo Sapiens
aaagcucacuuuaccauuccacagagagugaagaagaaaguauuuggaccccuucugcucuacu

SEQ ID NO: 641710 - RNA, 64 nt, Homo Sapiens
ugaaaauauacuggaaauaugaguauuagagauaagaaaguauaauaauaguuuccuuuaauag

SEQ ID NO: 641711 - RNA, 64 nt, Homo Sapiens
aaaaaaaaaaucagaaaacccccaccuaauccacagaaaguaaugucuuuccccuccccuugga

SEQ ID NO: 641712 - RNA, 64 nt, Homo Sapiens
uuuuuuccccuuuccuggugauugauuuuacaaaagaaaguaagcugcuuagaaggcccuggaa

SEQ ID NO: 641713 - RNA, 64 nt, Homo Sapiens
gguaggaugcucagguuuucuaaugcgaauguauagaaaguaaauuuugaaaagaaaaaauugg

SEQ ID NO: 641714 - RNA, 64 nt, Homo Sapiens
acuugaugcaagggauguuuucuuaagagcuguuagaaaguagcuuguucuggugaacagagaa

SEQ ID NO: 641715 - RNA, 64 nt, Homo Sapiens
cuuacuuagcuccuugcgauacugugagccagagagaaaguaaaagcacuucacaaaaaaauga

SEQ ID NO: 641716 - RNA, 64 nt, Homo Sapiens
cauuuauccggcauuauuucaacaccuccugugaagaaaguacuuuucuggcauagcuaccgug

SEQ ID NO: 641717 - RNA, 64 nt, Homo Sapiens
uuggugaucaucuccagccuaggaucuuagagauagaaaguaccgagugucuuucaaggguugc

SEQ ID NO: 641718 - RNA, 64 nt, Homo Sapiens
uuuuaacagcauuacauuucuuuguaaccauaagagaaaguauacaggcgugagccacuuagua

SEQ ID NO: 641719 - RNA, 64 nt, Homo Sapiens
ccuacuggaaaaagaguggaaauuuauuaaaaucagaaaguaugagauccuguuauguuaaggg

SEQ ID NO: 641720 - RNA, 64 nt, Homo Sapiens
aaaccuuucuuuguguaugcauguuugaauuaaaagaaaguaauggaagaauugaucgaugaau

SEQ ID NO: 641721 - RNA, 64 nt, Homo Sapiens
gacugaaagguuuauuaaaaugauuguaauauauagaaaguaucuguguuuaagaagauaauua

SEQ ID NO: 641722 - RNA, 64 nt, Homo Sapiens
auguggaagcgaacccccagggcauaacauaguaagaaaguaugguucuguauggcaauagguu

SEQ ID NO: 641723 - RNA, 64 nt, Homo Sapiens
cuuugguuaauuuguggauuaaacuggaaugugcagaaaguaggucaauguuaaauaaaagcca

SEQ ID NO: 641724 - RNA, 64 nt, Homo Sapiens
uauguauaaaauuugaaggacuuuucucuuuaacagaaaguaaauuuuuuuauaccauuuuauc

SEQ ID NO: 641725 - RNA, 64 nt, Homo Sapiens
gucgcugaucauccucuuccucaucuguaaaugaagaaaguaggcccugucuaccucacaugca

SEQ ID NO: 641726 - RNA, 64 nt, Homo Sapiens
uucugcagcccaguucugugggugcagcucuuccagaaaguauuaggagccucacaucuacucu

SEQ ID NO: 641727 - RNA, 64 nt, Homo Sapiens
cauacagaaauuaccuagcagguguauaagaaaaagaaaguauuuaacagcaggaaggacuuaa

SEQ ID NO: 641728 - RNA, 64 nt, Homo Sapiens
auaugccugcuugauagcauaguuuuuggugagaagaaaguacugguaacaucaggacagacag

SEQ ID NO: 641729 - RNA, 64 nt, Homo Sapiens
ccauugauuuuacagggauuuuaguucguaauccagaaaguaauaaucagggauuuuauuuuaa

SEQ ID NO: 641730 - RNA, 64 nt, Homo Sapiens
uauucuuuuuaaacuauaaauaccauuuugagugagaaaguacuuuuaaacaagaaagaaauug

SEQ ID NO: 641731 - RNA, 64 nt, Homo Sapiens
guaucacauuuauaaauaccauagaaguacccacagaaaguaaaucugauccuguagugccucu

SEQ ID NO: 641732 - RNA, 64 nt, Homo Sapiens
aaaggaauuggccauuagacgacugcaaaggcaaagaaaguaaaccuggacccuaaagaacagu

SEQ ID NO: 641733 - RNA, 64 nt, Homo Sapiens
agugacuucuagauuucuggugugaaggagaaguagaaaguaacauaguaacauugauauuucu

SEQ ID NO: 641734 - RNA, 64 nt, Homo Sapiens
gccguggauacggugggacugaaaccucaaucacagaaaguaaaacaguugaccacagguaacg

SEQ ID NO: 641735 - RNA, 64 nt, Homo Sapiens
cauucugccugcccaggccccugccacccuggggagaaaguacuucuuuuuuuuuauuuuuaga

SEQ ID NO: 641736 - RNA, 64 nt, Homo Sapiens
gauuacaagcgugagccacugcaccgggccacagagaaaguacuucuccacccugcucuccgac

SEQ ID NO: 641737 - RNA, 64 nt, Homo Sapiens
uauuuuuggcuaaauaaaugaaccaaauuguacgagaaaguaucgagaaauguacauaugugug

SEQ ID NO: 641738 - RNA, 64 nt, Homo Sapiens
aaaaagaaauaaaaccagucgcaaaacuaaacaaagaaaguaagccguguauaaauaccuaaaa

SEQ ID NO: 641739 - RNA, 64 nt, Homo Sapiens
uaaagauacauaccugguuugcuuggcuuacguaagaaaguagaagaaaguaaacuguaauaaa

SEQ ID NO: 641740 - RNA, 64 nt, Homo Sapiens
uaccugguuugcuuggcuuacguaagaaaguagaagaaaguaaacuguaauaaauaaaaguguc

SEQ ID NO: 641741 - RNA, 64 nt, Homo Sapiens; identical to SEQ ID NO: 302274

SEQ ID NO: 641742 - RNA, 64 nt, Homo Sapiens; identical to SEQ ID NO: 302275

SEQ ID NO: 641743 - RNA, 64 nt, Homo Sapiens; identical to SEQ ID NO: 302276

SEQ ID NO: 641744 - RNA, 64 nt, Homo Sapiens; identical to SEQ ID NO: 302277

SEQ ID NO: 641745 - RNA, 64 nt, Homo Sapiens; identical to SEQ ID NO: 302278

SEQ ID NO: 641746 - RNA, 64 nt, Homo Sapiens; identical to SEQ ID NO: 302279

SEQ ID NO: 641747 - RNA, 64 nt, Homo Sapiens; identical to SEQ ID NO: 302280

SEQ ID NO: 641748 - RNA, 64 nt, Homo Sapiens; identical to SEQ ID NO: 302281

SEQ ID NO: 641749 - RNA, 64 nt, Homo Sapiens; identical to SEQ ID NO: 302282

SEQ ID NO: 641750 - RNA, 64 nt, Homo Sapiens; identical to SEQ ID NO: 302283

SEQ ID NO: 641751 - RNA, 64 nt, Homo Sapiens; identical to SEQ ID NO: 302284

SEQ ID NO: 641752 - RNA, 64 nt, Homo Sapiens; identical to SEQ ID NO: 302285

SEQ ID NO: 641753 - RNA, 64 nt, Homo Sapiens; identical to SEQ ID NO: 302286

SEQ ID NO: 641754 - RNA, 64 nt, Homo Sapiens; identical to SEQ ID NO: 302287

SEQ ID NO: 641755 - RNA, 64 nt, Homo Sapiens; identical to SEQ ID NO: 302288

SEQ ID NO: 641756 - RNA, 64 nt, Homo Sapiens; identical to SEQ ID NO: 302289

SEQ ID NO: 641757 - RNA, 64 nt, Homo Sapiens; identical to SEQ ID NO: 302290

SEQ ID NO: 641758 - RNA, 64 nt, Homo Sapiens; identical to SEQ ID NO: 302291

SEQ ID NO: 641759 - RNA, 64 nt, Homo Sapiens; identical to SEQ ID NO: 302292

SEQ ID NO: 641760 - RNA, 64 nt, Homo Sapiens; identical to SEQ ID NO: 302293

SEQ ID NO: 641761 - RNA, 64 nt, Homo Sapiens; identical to SEQ ID NO: 302294

SEQ ID NO: 641762 - RNA, 64 nt, Homo Sapiens; identical to SEQ ID NO: 302295

SEQ ID NO: 641763 - RNA, 64 nt, Homo Sapiens; identical to SEQ ID NO: 302296

SEQ ID NO: 641764 - RNA, 64 nt, Homo Sapiens; identical to SEQ ID NO: 302297

SEQ ID NO: 641765 - RNA, 64 nt, Homo Sapiens; identical to SEQ ID NO: 302298

SEQ ID NO: 641766 - RNA, 64 nt, Homo Sapiens; identical to SEQ ID NO: 302299

SEQ ID NO: 641767 - RNA, 64 nt, Homo Sapiens; identical to SEQ ID NO: 380024

SEQ ID NO: 641768 - RNA, 64 nt, Homo Sapiens; identical to SEQ ID NO: 380025

SEQ ID NO: 641769 - RNA, 64 nt, Homo Sapiens; identical to SEQ ID NO: 380026

SEQ ID NO: 641770 - RNA, 64 nt, Homo Sapiens; identical to SEQ ID NO: 380027

SEQ ID NO: 641771 - RNA, 64 nt, Homo Sapiens; identical to SEQ ID NO: 380028

SEQ ID NO: 641772 - RNA, 64 nt, Homo Sapiens; identical to SEQ ID NO: 380029

SEQ ID NO: 641773 - RNA, 64 nt, Homo Sapiens; identical to SEQ ID NO: 110317

SEQ ID NO: 641774 - RNA, 64 nt, Homo Sapiens; identical to SEQ ID NO: 110318

SEQ ID NO: 641775 - RNA, 64 nt, Homo Sapiens; identical to SEQ ID NO: 110319

SEQ ID NO: 641776 - RNA, 64 nt, Homo Sapiens; identical to SEQ ID NO: 110320

SEQ ID NO: 641777 - RNA, 64 nt, Homo Sapiens; identical to SEQ ID NO: 110321

SEQ ID NO: 641778 - RNA, 64 nt, Homo Sapiens; identical to SEQ ID NO: 110322

SEQ ID NO: 641779 - RNA, 51 nt, Homo Sapiens; identical to SEQ ID NO: 110323

SEQ ID NO: 641780 - RNA, 64 nt, Homo Sapiens; identical to SEQ ID NO: 110324

SEQ ID NO: 641781 - RNA, 64 nt, Homo Sapiens; identical to SEQ ID NO: 110325

SEQ ID NO: 641782 - RNA, 64 nt, Homo Sapiens; identical to SEQ ID NO: 110326

SEQ ID NO: 641783 - RNA, 64 nt, Homo Sapiens; identical to SEQ ID NO: 110327

SEQ ID NO: 641784 - RNA, 64 nt, Homo Sapiens; identical to SEQ ID NO: 110328

SEQ ID NO: 641785 - RNA, 64 nt, Homo Sapiens; identical to SEQ ID NO: 110329

SEQ ID NO: 641786 - RNA, 64 nt, Homo Sapiens; identical to SEQ ID NO: 110330

SEQ ID NO: 641787 - RNA, 64 nt, Homo Sapiens; identical to SEQ ID NO: 110331

SEQ ID NO: 641788 - RNA, 64 nt, Homo Sapiens; identical to SEQ ID NO: 110332

SEQ ID NO: 641789 - RNA, 64 nt, Homo Sapiens; identical to SEQ ID NO: 110333

SEQ ID NO: 641790 - RNA, 64 nt, Homo Sapiens; identical to SEQ ID NO: 110334

SEQ ID NO: 641791 - RNA, 64 nt, Homo Sapiens; identical to SEQ ID NO: 110335

SEQ ID NO: 641792 - RNA, 64 nt, Homo Sapiens; identical to SEQ ID NO: 110336

SEQ ID NO: 641793 - RNA, 64 nt, Homo Sapiens; identical to SEQ ID NO: 110337

SEQ ID NO: 641794 - RNA, 64 nt, Homo Sapiens; identical to SEQ ID NO: 110338

SEQ ID NO: 641795 - RNA, 64 nt, Homo Sapiens; identical to SEQ ID NO: 110339

SEQ ID NO: 641796 - RNA, 64 nt, Homo Sapiens; identical to SEQ ID NO: 110340

SEQ ID NO: 641797 - RNA, 64 nt, Homo Sapiens; identical to SEQ ID NO: 110341

SEQ ID NO: 641798 - RNA, 64 nt, Homo Sapiens; identical to SEQ ID NO: 110342

SEQ ID NO: 641799 - RNA, 64 nt, Homo Sapiens; identical to SEQ ID NO: 110343

SEQ ID NO: 641800 - RNA, 64 nt, Homo Sapiens; identical to SEQ ID NO: 110344

SEQ ID NO: 641801 - RNA, 64 nt, Homo Sapiens; identical to SEQ ID NO: 110345

SEQ ID NO: 641802 - RNA, 64 nt, Homo Sapiens; identical to SEQ ID NO: 110346

SEQ ID NO: 641803 - RNA, 64 nt, Homo Sapiens; identical to SEQ ID NO: 110347

SEQ ID NO: 641804 - RNA, 64 nt, Homo Sapiens; identical to SEQ ID NO: 110348

SEQ ID NO: 641805 - RNA, 64 nt, Homo Sapiens; identical to SEQ ID NO: 110349

SEQ ID NO: 641806 - RNA, 64 nt, Homo Sapiens; identical to SEQ ID NO: 110350

SEQ ID NO: 641807 - RNA, 64 nt, Homo Sapiens; identical to SEQ ID NO: 110351

SEQ ID NO: 641808 - RNA, 64 nt, Homo Sapiens; identical to SEQ ID NO: 110352

SEQ ID NO: 641809 - RNA, 64 nt, Homo Sapiens; identical to SEQ ID NO: 110353

SEQ ID NO: 641810 - RNA, 64 nt, Homo Sapiens; identical to SEQ ID NO: 110354

SEQ ID NO: 641811 - RNA, 64 nt, Homo Sapiens; identical to SEQ ID NO: 110355

SEQ ID NO: 641812 - RNA, 64 nt, Homo Sapiens; identical to SEQ ID NO: 110356

SEQ ID NO: 641813 - RNA, 64 nt, Homo Sapiens; identical to SEQ ID NO: 110357

SEQ ID NO: 641814 - RNA, 64 nt, Homo Sapiens; identical to SEQ ID NO: 110358

SEQ ID NO: 641815 - RNA, 64 nt, Homo Sapiens; identical to SEQ ID NO: 110359

SEQ ID NO: 641816 - RNA, 64 nt, Homo Sapiens
gccggagucagcaggugccacugugugaugaagugacagggaggaaccaaaguuuuaagauuug

SEQ ID NO: 641817 - RNA, 64 nt, Homo Sapiens
aguggcauuuguuuccuagcuugcuguucuuuaugacagggaucgcugccuucuuguagaugac

SEQ ID NO: 641818 - RNA, 64 nt, Homo Sapiens
ccuuucuaagcccuggggcgcccaagucccaugggacagggaaacgugguccucagugaggcug

SEQ ID NO: 641819 - RNA, 64 nt, Homo Sapiens
ccacaucccuauuaacagaggcagcuccacuucagacagggacaaggcuuccugcugugccuuu

SEQ ID NO: 641820 - RNA, 64 nt, Homo Sapiens
aggauaccacucugucacuggggaagaagucagggacagggaccgcccaggaggaggagcccua

SEQ ID NO: 641821 - RNA, 64 nt, Homo Sapiens
auggagcccaaguagccucuggcccaggcagggggacagggaaaugaccacggccuggaggacu

SEQ ID NO: 641822 - RNA, 64 nt, Homo Sapiens
gcaaguucaugguacauacggaaggagacucuaagacagggaaaaaccuguuauguugcuuuug

SEQ ID NO: 641823 - RNA, 64 nt, Homo Sapiens
ggggagaagaaagacccccaaggcagcggggauagacagggaauggaggccugcccagacuagg

SEQ ID NO: 641824 - RNA, 64 nt, Homo Sapiens
uucaggaacuucugaccucaccgccaacggggacgacagggauccagcuccacaaugggcuccc

SEQ ID NO: 641825 - RNA, 64 nt, Homo Sapiens
gaaaggacaggucccaagggauagaagccaaagggacagggacgaucuaagacaaggaaguccu

SEQ ID NO: 641826 - RNA, 64 nt, Homo Sapiens
ucagagauugcacguuugaaacaccuggacaguagacagggacuuuuauaaaaauccaugcuuu

SEQ ID NO: 641827 - RNA, 64 nt, Homo Sapiens
cgagugccccucagagucccggcagcggggcagggacagggagccaguauguuaggaggggcca

SEQ ID NO: 641828 - RNA, 64 nt, Homo Sapiens
agugggaucaaagcuaggaaagagggaguacaaagacagggaaucggcuggaaagaggagaagg

SEQ ID NO: 641829 - RNA, 64 nt, Homo Sapiens
guauaaacaagccuaacauucuauuugcuuuagagacagggacuaggagaggaugcacaguuug

SEQ ID NO: 641830 - RNA, 64 nt, Homo Sapiens
uggagcagugucauugucaggacugacauuugaggacagggagagcuaccugggugguugaggg

SEQ ID NO: 641831 - RNA, 64 nt, Homo Sapiens
gauaauuacugauaaaugaaggcaaggaagaagggacagggaaaucuuugccagaugaugggaa

SEQ ID NO: 641832 - RNA, 64 nt, Homo Sapiens
uucuccccagcucugcccucuggguccacaugaggacagggaagcucgggaaggggaagggaga

SEQ ID NO: 641833 - RNA, 64 nt, Homo Sapiens
cccccgcugggcacucucugucccaucccucuaggacagggaagcuggccugguccagggcacu

SEQ ID NO: 641834 - RNA, 64 nt, Homo Sapiens
agccccaaauugucaccugcaacagugcaccugggacagggagccauuccaggcccgaagcaug

SEQ ID NO: 641835 - RNA, 64 nt, Homo Sapiens
ugugaggcaggagagacagucccaaccacguugggacagggaggcuccccccaccucccccacu

SEQ ID NO: 641836 - RNA, 64 nt, Homo Sapiens; identical to SEQ ID NO: 234645

SEQ ID NO: 641837 - RNA, 64 nt, Homo Sapiens; identical to SEQ ID NO: 234646

SEQ ID NO: 641838 - RNA, 64 nt, Homo Sapiens; identical to SEQ ID NO: 234647

SEQ ID NO: 641839 - RNA, 64 nt, Homo Sapiens; identical to SEQ ID NO: 234648

SEQ ID NO: 641840 - RNA, 64 nt, Homo Sapiens; identical to SEQ ID NO: 234649

SEQ ID NO: 641841 - RNA, 64 nt, Homo Sapiens; identical to SEQ ID NO: 234650

SEQ ID NO: 641842 - RNA, 64 nt, Homo Sapiens; identical to SEQ ID NO: 234651

SEQ ID NO: 641843 - RNA, 64 nt, Homo Sapiens; identical to SEQ ID NO: 234652

SEQ ID NO: 641844 - RNA, 64 nt, Homo Sapiens; identical to SEQ ID NO: 234653

SEQ ID NO: 641845 - RNA, 64 nt, Homo Sapiens; identical to SEQ ID NO: 234654

SEQ ID NO: 641846 - RNA, 64 nt, Homo Sapiens; identical to SEQ ID NO: 234655

SEQ ID NO: 641847 - RNA, 64 nt, Homo Sapiens; identical to SEQ ID NO: 234656

SEQ ID NO: 641848 - RNA, 64 nt, Homo Sapiens; identical to SEQ ID NO: 234657

SEQ ID NO: 641849 - RNA, 64 nt, Homo Sapiens; identical to SEQ ID NO: 234658

SEQ ID NO: 641850 - RNA, 64 nt, Homo Sapiens; identical to SEQ ID NO: 234659

SEQ ID NO: 641851 - RNA, 64 nt, Homo Sapiens; identical to SEQ ID NO: 234660

SEQ ID NO: 641852 - RNA, 64 nt, Homo Sapiens; identical to SEQ ID NO: 234661

SEQ ID NO: 641853 - RNA, 64 nt, Homo Sapiens; identical to SEQ ID NO: 234662

SEQ ID NO: 641854 - RNA, 64 nt, Homo Sapiens; identical to SEQ ID NO: 234663

SEQ ID NO: 641855 - RNA, 64 nt, Homo Sapiens; identical to SEQ ID NO: 234664

SEQ ID NO: 641856 - RNA, 64 nt, Homo Sapiens; identical to SEQ ID NO: 234665

SEQ ID NO: 641857 - RNA, 63 nt, Homo Sapiens; identical to SEQ ID NO: 234666

SEQ ID NO: 641858 - RNA, 64 nt, Homo Sapiens; identical to SEQ ID NO: 234667

SEQ ID NO: 641859 - RNA, 64 nt, Homo Sapiens; identical to SEQ ID NO: 234668

SEQ ID NO: 641860 - RNA, 64 nt, Homo Sapiens; identical to SEQ ID NO: 234669

SEQ ID NO: 641861 - RNA, 64 nt, Homo Sapiens; identical to SEQ ID NO: 234670

SEQ ID NO: 641862 - RNA, 64 nt, Homo Sapiens; identical to SEQ ID NO: 234671

SEQ ID NO: 641863 - RNA, 64 nt, Homo Sapiens; identical to SEQ ID NO: 234672

SEQ ID NO: 641864 - RNA, 64 nt, Homo Sapiens; identical to SEQ ID NO: 234673

SEQ ID NO: 641865 - RNA, 64 nt, Homo Sapiens; identical to SEQ ID NO: 234674

SEQ ID NO: 641866 - RNA, 64 nt, Homo Sapiens; identical to SEQ ID NO: 234675

SEQ ID NO: 641867 - RNA, 64 nt, Homo Sapiens; identical to SEQ ID NO: 234676

SEQ ID NO: 641868 - RNA, 64 nt, Homo Sapiens; identical to SEQ ID NO: 234677

SEQ ID NO: 641869 - RNA, 64 nt, Homo Sapiens; identical to SEQ ID NO: 234678

SEQ ID NO: 641870 - RNA, 64 nt, Homo Sapiens; identical to SEQ ID NO: 234679

SEQ ID NO: 641871 - RNA, 64 nt, Homo Sapiens; identical to SEQ ID NO: 234680

SEQ ID NO: 641872 - RNA, 64 nt, Homo Sapiens; identical to SEQ ID NO: 234681

SEQ ID NO: 641873 - RNA, 64 nt, Homo Sapiens; identical to SEQ ID NO: 234682

SEQ ID NO: 641874 - RNA, 64 nt, Homo Sapiens; identical to SEQ ID NO: 234683

SEQ ID NO: 641875 - RNA, 64 nt, Homo Sapiens; identical to SEQ ID NO: 234684

SEQ ID NO: 641876 - RNA, 64 nt, Homo Sapiens; identical to SEQ ID NO: 234685

SEQ ID NO: 641877 - RNA, 64 nt, Homo Sapiens; identical to SEQ ID NO: 234686

SEQ ID NO: 641878 - RNA, 64 nt, Homo Sapiens; identical to SEQ ID NO: 234687

SEQ ID NO: 641879 - RNA, 64 nt, Homo Sapiens; identical to SEQ ID NO: 234688

SEQ ID NO: 641880 - RNA, 64 nt, Homo Sapiens; identical to SEQ ID NO: 234689

SEQ ID NO: 641881 - RNA, 64 nt, Homo Sapiens; identical to SEQ ID NO: 234690

SEQ ID NO: 641882 - RNA, 64 nt, Homo Sapiens; identical to SEQ ID NO: 234691

SEQ ID NO: 641883 - RNA, 64 nt, Homo Sapiens; identical to SEQ ID NO: 234692

SEQ ID NO: 641884 - RNA, 64 nt, Homo Sapiens; identical to SEQ ID NO: 234693

SEQ ID NO: 641885 - RNA, 64 nt, Homo Sapiens; identical to SEQ ID NO: 234694

SEQ ID NO: 641886 - RNA, 64 nt, Homo Sapiens; identical to SEQ ID NO: 234695

SEQ ID NO: 641887 - RNA, 64 nt, Homo Sapiens; identical to SEQ ID NO: 234696

SEQ ID NO: 641888 - RNA, 64 nt, Homo Sapiens; identical to SEQ ID NO: 555802

SEQ ID NO: 641889 - RNA, 64 nt, Homo Sapiens; identical to SEQ ID NO: 555803

SEQ ID NO: 641890 - RNA, 64 nt, Homo Sapiens; identical to SEQ ID NO: 555804

SEQ ID NO: 641891 - RNA, 64 nt, Homo Sapiens; identical to SEQ ID NO: 555805

SEQ ID NO: 641892 - RNA, 64 nt, Homo Sapiens; identical to SEQ ID NO: 555806

SEQ ID NO: 641893 - RNA, 64 nt, Homo Sapiens; identical to SEQ ID NO: 555807

SEQ ID NO: 641894 - RNA, 64 nt, Homo Sapiens; identical to SEQ ID NO: 555808

SEQ ID NO: 641895 - RNA, 64 nt, Homo Sapiens; identical to SEQ ID NO: 555809

SEQ ID NO: 641896 - RNA, 64 nt, Homo Sapiens
aaaaacaaaaaaugugcuguaggaggaguuagccaaacaacaacuaaaccagaaaggugauucc

SEQ ID NO: 641897 - RNA, 64 nt, Homo Sapiens
uaagggaaugugagcacaaucugagcaccuuuggaaacaacauugaauccagcugggcuagagg

SEQ ID NO: 641898 - RNA, 64 nt, Homo Sapiens
aaaaacagcaguuugugauagugggucuuuaauaaaacaacaacccugaagaugaguaaaacug

SEQ ID NO: 641899 - RNA, 64 nt, Homo Sapiens
aggggauucuucuuuuguguggauguuagccugcaaacaacauuaaccagguugcaguagcagu

SEQ ID NO: 641900 - RNA, 64 nt, Homo Sapiens
acuacagagugagacuccaucucaaaacaaaacaaaacaacaacagcaaaaaacaacaaaacaa

SEQ ID NO: 641901 - RNA, 64 nt, Homo Sapiens
ccaucucaaaacaaaacaaaacaacaacagcaaaaaacaacaaaacaaaacacaaauacucuca

SEQ ID NO: 641902 - RNA, 64 nt, Homo Sapiens
acugguacgguagucuguggaaaccaggaagauaaaacaacagccacaaaagagaaaaucaaga

SEQ ID NO: 641903 - RNA, 64 nt, Homo Sapiens
uuaugagaauuucacauuggaauucauaaugguaaaacaacauacaucugccaauauacguuuu

SEQ ID NO: 641904 - RNA, 64 nt, Homo Sapiens
aacaaaauuauaaagguagacaaaaaacaaaaacaaacaacaacacugcaucucaaaaaaaacc

SEQ ID NO: 641905 - RNA, 64 nt, Homo Sapiens
aacaaaaacacaaauuaguccugucucuacugaaaaacaacaaacuggccaacaugguaaaacc

SEQ ID NO: 641906 - RNA, 64 nt, Homo Sapiens
aagcauugauacacacugaaauuuaacauucuccaaacaacaucuagaagcaauauuuucacuu

SEQ ID NO: 641907 - RNA, 64 nt, Homo Sapiens
cauaccugaaaagaauaaaucaaagacacugaugaaacaacacccaauuacaccaguucugggg

SEQ ID NO: 641908 - RNA, 64 nt, Homo Sapiens
acucagauuucuacaggagaauucuuuuguaguaaaacaacauauguaauuuaauguguuuuau

SEQ ID NO: 641909 - RNA, 64 nt, Homo Sapiens
uggaguugugcuauguuguacaaagcacaacgaaaaacaacaaaauagcaagaccccgucucua

SEQ ID NO: 641910 - RNA, 64 nt, Homo Sapiens
uauauguaaaguauuauuuauuugaaucuacaaaaaacaacaaauaauuuuuaaauauaaggau

SEQ ID NO: 641911 - RNA, 64 nt, Homo Sapiens
caauuggguacccaguuaaauuuucauuucagauaaacaacaaauaauuuuuuaguauaaguac

SEQ ID NO: 641912 - RNA, 64 nt, Homo Sapiens
ccagaauuuuguaucuccuucuuguauuugucuaaaacaacaaguugugucuaguuugaagcuu

SEQ ID NO: 641913 - RNA, 64 nt, Homo Sapiens
uguguuauaacuucgucuuggcaugggucagaggaaacaacauucauuuccuuacacguuucua

SEQ ID NO: 641914 - RNA, 64 nt, Homo Sapiens
acuaguaaguucaucuaguccuuuucaaauagaaaaacaacaaaacccaugaaauggaaaagag

SEQ ID NO: 641915 - RNA, 64 nt, Homo Sapiens
cugcauaaagauauccagcuuggguacccuacuaaaacaacaucaccaucuuuuucauuauaua

SEQ ID NO: 641916 - RNA, 64 nt, Homo Sapiens
aauauuuuuuuuuugagcauggcuaguggauuuaaaacaacacauaccugucacugcuggaguc

SEQ ID NO: 641917 - RNA, 64 nt, Homo Sapiens
ggaauaguuuaacccagcaacuuuccuuuuuauaaaacaacaaaugguucaacucugucugcaa

SEQ ID NO: 641918 - RNA, 64 nt, Homo Sapiens
cuuggucuuacaucuguguguccuuauuguuuguaaacaacaaaaauaggcaaaauguuuauuu

SEQ ID NO: 641919 - RNA, 64 nt, Homo Sapiens
uuugggguuugcuuguaaaaggcucagcauaaguaaacaacauaaaaguuuaacacaauuuaag

SEQ ID NO: 641920 - RNA, 64 nt, Homo Sapiens
aaaaaaauuaaaaaaaaaaaaaacaacaaaaaacaaacaacaaaaguccugcuauguuaaaaac

SEQ ID NO: 641921 - RNA, 64 nt, Homo Sapiens
aaacaaacaacaaaaaaaaagcuauguuaaaaacaaacaacaaaaauaucaccaaagaaguccu

SEQ ID NO: 641922 - RNA, 64 nt, Homo Sapiens
acaauuacuaaugagguacgauuagaaaaaaaugaaacaacaaaugagcugguagaggggagac

SEQ ID NO: 641923 - RNA, 64 nt, Homo Sapiens
gacagugaaaguuuuaauaccuggugagacaaugaaacaacagauggaaaucucagauucuuca

SEQ ID NO: 641924 - RNA, 64 nt, Homo Sapiens
ggggaacuauaucacccaugauauuuaagaaauaaaacaacaaaaauauuccuuaguagaaugu

SEQ ID NO: 641925 - RNA, 64 nt, Homo Sapiens
agaguguuuauccugagauuugcuuauuccuuaaaaacaacagauccuugagaagcagcuuuca

SEQ ID NO: 641926 - RNA, 64 nt, Homo Sapiens
uaggacaguaaaacguuaaaguacuggauuaagaaaacaacaacaggcugggcgcaguggcuca

SEQ ID NO: 641927 - RNA, 64 nt, Homo Sapiens
ccucugucucaaaaaauaauaauaauaauaaauaaaacaacaacaaaaugcaucagagagccaa

SEQ ID NO: 641928 - RNA, 64 nt, Homo Sapiens
ugucacuguacaguuuuguggacugagcgaggaaaaacaacaaauaauuuaaguuggcuagagc

SEQ ID NO: 641929 - RNA, 64 nt, Homo Sapiens
uuuaugaccagagcaaaaauguaaaaaacaaaaaaaacaacaaaaaaaguuuguuacuuugaau

SEQ ID NO: 641930 - RNA, 64 nt, Homo Sapiens
aacauuuuuagguuuuacagagauuuuaaccuuuaaacaacagaucuuuaaaaaacaggugaau

SEQ ID NO: 641931 - RNA, 64 nt, Homo Sapiens
aucuuuguccuaacaugagugcuuguaacaaaauaaacaacaaaaacaaagccaaaaacuaccu

SEQ ID NO: 641932 - RNA, 64 nt, Homo Sapiens
agucuauaaaaacaguuuuacuugcaauccauuaaaacaacaaacgaaaccuagugaagcaucu

SEQ ID NO: 641933 - RNA, 64 nt, Homo Sapiens
gaaagacugguuauuucuccuuuguguaagugauaaacaacagcaaauauacuugaauaaaaug

SEQ ID NO: 641934 - RNA, 64 nt, Homo Sapiens
uauuaugucaacuuacuucaaaaaauuugagaagaaacaacaaggcauacuguggagaaccauu

SEQ ID NO: 641935 - RNA, 64 nt, Homo Sapiens
aacaccaguuaaacuaauuacaguugcuguuugcaaacaacaggcucagugcugucugaagaug

SEQ ID NO: 641936 - RNA, 64 nt, Homo Sapiens
caaaaaaugccuugcugauuaauaauacuuuuuuaaacaacaacgaaaacuguuucuauaagga

SEQ ID NO: 641937 - RNA, 64 nt, Homo Sapiens
aaccauauuugucacagaaaucucgguauuuuaaaaacaacaacccacauuaacuauaucaugu

SEQ ID NO: 641938 - RNA, 64 nt, Homo Sapiens
gaaagucagaauuggauuuguuuuuucgguguugaaacaacauuccaaagaauaagccaucaua

SEQ ID NO: 641939 - RNA, 64 nt, Homo Sapiens
acuuugcccuggauugacuauuuuacaaauaggcaaacaacauauuauuuucuguauguguuaa

SEQ ID NO: 641940 - RNA, 64 nt, Homo Sapiens
cugucuuaggaauuauuaggaguugauuccugagaaacaacacauuuuuccccaugaacggugc

SEQ ID NO: 641941 - RNA, 64 nt, Homo Sapiens
ugggagagacucagugagccagcaaaggccauagaaacaacaauuuauuaaauguauuuauggc

SEQ ID NO: 641942 - RNA, 64 nt, Homo Sapiens
guauguagaagccuaggauccacacucagugauaaaacaacaugcauuugaacucaacuuagcu

SEQ ID NO: 641943 - RNA, 64 nt, Homo Sapiens
aaaucuuuuuuuuguuguuucaaccuaguagaacaaacaacaggaguagucuggcccacauuuu

SEQ ID NO: 641944 - RNA, 64 nt, Homo Sapiens
ugccucagagauguauauaucaaaccaucuauugaaacaacaaguuuguaauuacggagaggaa

SEQ ID NO: 641945 - RNA, 64 nt, Homo Sapiens
auuaucuauuuuccagagauuucugacaguauacaaacaacaaaaucguacauuauuaaaauua

SEQ ID NO: 641946 - RNA, 64 nt, Homo Sapiens
gccccuaaguuaauauuucaaacaaucgaagguaaaacaacauauuguguugggccaccuguac

SEQ ID NO: 641947 - RNA, 64 nt, Homo Sapiens
uuuuugaaggacuugggagcucucuuugaaaggcaaacaacaagggaaacaguaccuuuaucuc

SEQ ID NO: 641948 - RNA, 64 nt, Homo Sapiens
gaaauuuaccacauuaacugguaacaauuuguuaaaacaacaauugcuaaauauugaagugguu

SEQ ID NO: 641949 - RNA, 64 nt, Homo Sapiens
aaaacaaaacaaaaaaaaaaaaguucuuguuuccaaacaacaacuccagccugggcgacacagc

SEQ ID NO: 641950 - RNA, 64 nt, Homo Sapiens; identical to SEQ ID NO: 125939

SEQ ID NO: 641951 - RNA, 64 nt, Homo Sapiens; identical to SEQ ID NO: 125940

SEQ ID NO: 641952 - RNA, 64 nt, Homo Sapiens; identical to SEQ ID NO: 125941

SEQ ID NO: 641953 - RNA, 64 nt, Homo Sapiens; identical to SEQ ID NO: 125942

SEQ ID NO: 641954 - RNA, 64 nt, Homo Sapiens; identical to SEQ ID NO: 125943

SEQ ID NO: 641955 - RNA, 64 nt, Homo Sapiens; identical to SEQ ID NO: 125944

SEQ ID NO: 641956 - RNA, 64 nt, Homo Sapiens; identical to SEQ ID NO: 125945

SEQ ID NO: 641957 - RNA, 64 nt, Homo Sapiens; identical to SEQ ID NO: 125946

SEQ ID NO: 641958 - RNA, 64 nt, Homo Sapiens; identical to SEQ ID NO: 125947

SEQ ID NO: 641959 - RNA, 64 nt, Homo Sapiens; identical to SEQ ID NO: 125948

SEQ ID NO: 641960 - RNA, 64 nt, Homo Sapiens; identical to SEQ ID NO: 125949

SEQ ID NO: 641961 - RNA, 64 nt, Homo Sapiens; identical to SEQ ID NO: 125950

SEQ ID NO: 641962 - RNA, 64 nt, Homo Sapiens; identical to SEQ ID NO: 125951

SEQ ID NO: 641963 - RNA, 64 nt, Homo Sapiens; identical to SEQ ID NO: 125952

SEQ ID NO: 641964 - RNA, 64 nt, Homo Sapiens; identical to SEQ ID NO: 93178

SEQ ID NO: 641965 - RNA, 64 nt, Homo Sapiens; identical to SEQ ID NO: 93179

SEQ ID NO: 641966 - RNA, 64 nt, Homo Sapiens; identical to SEQ ID NO: 93180

SEQ ID NO: 641967 - RNA, 64 nt, Homo Sapiens; identical to SEQ ID NO: 93181

SEQ ID NO: 641968 - RNA, 64 nt, Homo Sapiens; identical to SEQ ID NO: 294262

SEQ ID NO: 641969 - RNA, 64 nt, Homo Sapiens; identical to SEQ ID NO: 294263

SEQ ID NO: 641970 - RNA, 64 nt, Homo Sapiens; identical to SEQ ID NO: 294264

SEQ ID NO: 641971 - RNA, 64 nt, Homo Sapiens; identical to SEQ ID NO: 294265

SEQ ID NO: 641972 - RNA, 64 nt, Homo Sapiens; identical to SEQ ID NO: 294266

SEQ ID NO: 641973 - RNA, 64 nt, Homo Sapiens; identical to SEQ ID NO: 294267

SEQ ID NO: 641974 - RNA, 64 nt, Homo Sapiens; identical to SEQ ID NO: 294268

SEQ ID NO: 641975 - RNA, 64 nt, Homo Sapiens; identical to SEQ ID NO: 294269

SEQ ID NO: 641976 - RNA, 64 nt, Homo Sapiens; identical to SEQ ID NO: 294270

SEQ ID NO: 641977 - RNA, 64 nt, Homo Sapiens; identical to SEQ ID NO: 294271

SEQ ID NO: 641978 - RNA, 64 nt, Homo Sapiens; identical to SEQ ID NO: 294272

SEQ ID NO: 641979 - RNA, 64 nt, Homo Sapiens; identical to SEQ ID NO: 294273

SEQ ID NO: 641980 - RNA, 64 nt, Homo Sapiens; identical to SEQ ID NO: 294274

SEQ ID NO: 641981 - RNA, 64 nt, Homo Sapiens; identical to SEQ ID NO: 294275

SEQ ID NO: 641982 - RNA, 64 nt, Homo Sapiens; identical to SEQ ID NO: 294276

SEQ ID NO: 641983 - RNA, 64 nt, Homo Sapiens; identical to SEQ ID NO: 294277

SEQ ID NO: 641984 - RNA, 64 nt, Homo Sapiens; identical to SEQ ID NO: 294278

SEQ ID NO: 641985 - RNA, 64 nt, Homo Sapiens; identical to SEQ ID NO: 294279

SEQ ID NO: 641986 - RNA, 64 nt, Homo Sapiens; identical to SEQ ID NO: 294280

SEQ ID NO: 641987 - RNA, 64 nt, Homo Sapiens; identical to SEQ ID NO: 294281

SEQ ID NO: 641988 - RNA, 64 nt, Homo Sapiens; identical to SEQ ID NO: 294282

SEQ ID NO: 641989 - RNA, 64 nt, Homo Sapiens; identical to SEQ ID NO: 294283

SEQ ID NO: 641990 - RNA, 64 nt, Homo Sapiens; identical to SEQ ID NO: 294284

SEQ ID NO: 641991 - RNA, 64 nt, Homo Sapiens; identical to SEQ ID NO: 294285

SEQ ID NO: 641992 - RNA, 64 nt, Homo Sapiens; identical to SEQ ID NO: 294286

SEQ ID NO: 641993 - RNA, 64 nt, Homo Sapiens; identical to SEQ ID NO: 294287

SEQ ID NO: 641994 - RNA, 64 nt, Homo Sapiens; identical to SEQ ID NO: 294288

SEQ ID NO: 641995 - RNA, 64 nt, Homo Sapiens; identical to SEQ ID NO: 294289

SEQ ID NO: 641996 - RNA, 64 nt, Homo Sapiens; identical to SEQ ID NO: 294290

SEQ ID NO: 641997 - RNA, 64 nt, Homo Sapiens; identical to SEQ ID NO: 294291

SEQ ID NO: 641998 - RNA, 64 nt, Homo Sapiens; identical to SEQ ID NO: 294292

SEQ ID NO: 641999 - RNA, 64 nt, Homo Sapiens; identical to SEQ ID NO: 294293

SEQ ID NO: 642000 - RNA, 64 nt, Homo Sapiens; identical to SEQ ID NO: 294294

SEQ ID NO: 642001 - RNA, 64 nt, Homo Sapiens; identical to SEQ ID NO: 294295

SEQ ID NO: 642002 - RNA, 64 nt, Homo Sapiens; identical to SEQ ID NO: 294296

SEQ ID NO: 642003 - RNA, 64 nt, Homo Sapiens; identical to SEQ ID NO: 294297

SEQ ID NO: 642004 - RNA, 64 nt, Homo Sapiens; identical to SEQ ID NO: 294298

SEQ ID NO: 642005 - RNA, 64 nt, Homo Sapiens; identical to SEQ ID NO: 294299

SEQ ID NO: 642006 - RNA, 64 nt, Homo Sapiens; identical to SEQ ID NO: 313491

SEQ ID NO: 642007 - RNA, 64 nt, Homo Sapiens; identical to SEQ ID NO: 313492

SEQ ID NO: 642008 - RNA, 64 nt, Homo Sapiens; identical to SEQ ID NO: 579141

SEQ ID NO: 642009 - RNA, 64 nt, Homo Sapiens; identical to SEQ ID NO: 579142

SEQ ID NO: 642010 - RNA, 64 nt, Homo Sapiens; identical to SEQ ID NO: 579143

SEQ ID NO: 642011 - RNA, 64 nt, Homo Sapiens; identical to SEQ ID NO: 579144

SEQ ID NO: 642012 - RNA, 64 nt, Homo Sapiens; identical to SEQ ID NO: 579145

SEQ ID NO: 642013 - RNA, 64 nt, Homo Sapiens; identical to SEQ ID NO: 579146

SEQ ID NO: 642014 - RNA, 64 nt, Homo Sapiens; identical to SEQ ID NO: 579147

SEQ ID NO: 642015 - RNA, 64 nt, Homo Sapiens; identical to SEQ ID NO: 579148

SEQ ID NO: 642016 - RNA, 58 nt, Homo Sapiens; identical to SEQ ID NO: 579149

SEQ ID NO: 642017 - RNA, 64 nt, Homo Sapiens; identical to SEQ ID NO: 579150

SEQ ID NO: 642018 - RNA, 64 nt, Homo Sapiens; identical to SEQ ID NO: 579151

SEQ ID NO: 642019 - RNA, 64 nt, Homo Sapiens; identical to SEQ ID NO: 579152

SEQ ID NO: 642020 - RNA, 64 nt, Homo Sapiens; identical to SEQ ID NO: 579153

SEQ ID NO: 642021 - RNA, 64 nt, Homo Sapiens; identical to SEQ ID NO: 579154

SEQ ID NO: 642022 - RNA, 64 nt, Homo Sapiens; identical to SEQ ID NO: 579155

SEQ ID NO: 642023 - RNA, 64 nt, Homo Sapiens; identical to SEQ ID NO: 579156

SEQ ID NO: 642024 - RNA, 64 nt, Homo Sapiens; identical to SEQ ID NO: 579157

SEQ ID NO: 642025 - RNA, 64 nt, Homo Sapiens; identical to SEQ ID NO: 579158

SEQ ID NO: 642026 - RNA, 64 nt, Homo Sapiens; identical to SEQ ID NO: 579159

SEQ ID NO: 642027 - RNA, 64 nt, Homo Sapiens; identical to SEQ ID NO: 579160

SEQ ID NO: 642028 - RNA, 64 nt, Homo Sapiens; identical to SEQ ID NO: 579161

SEQ ID NO: 642029 - RNA, 64 nt, Homo Sapiens; identical to SEQ ID NO: 579162

SEQ ID NO: 642030 - RNA, 64 nt, Homo Sapiens; identical to SEQ ID NO: 579163

SEQ ID NO: 642031 - RNA, 64 nt, Homo Sapiens; identical to SEQ ID NO: 579164

SEQ ID NO: 642032 - RNA, 64 nt, Homo Sapiens; identical to SEQ ID NO: 579165

SEQ ID NO: 642033 - RNA, 64 nt, Homo Sapiens; identical to SEQ ID NO: 579166

SEQ ID NO: 642034 - RNA, 64 nt, Homo Sapiens; identical to SEQ ID NO: 579167

SEQ ID NO: 642035 - RNA, 64 nt, Homo Sapiens; identical to SEQ ID NO: 579168

SEQ ID NO: 642036 - RNA, 64 nt, Homo Sapiens; identical to SEQ ID NO: 579169

SEQ ID NO: 642037 - RNA, 64 nt, Homo Sapiens; identical to SEQ ID NO: 579170

SEQ ID NO: 642038 - RNA, 64 nt, Homo Sapiens; identical to SEQ ID NO: 105816

SEQ ID NO: 642039 - RNA, 64 nt, Homo Sapiens; identical to SEQ ID NO: 105817

SEQ ID NO: 642040 - RNA, 64 nt, Homo Sapiens; identical to SEQ ID NO: 105818

SEQ ID NO: 642041 - RNA, 64 nt, Homo Sapiens; identical to SEQ ID NO: 105819

SEQ ID NO: 642042 - RNA, 64 nt, Homo Sapiens; identical to SEQ ID NO: 105820

SEQ ID NO: 642043 - RNA, 64 nt, Homo Sapiens; identical to SEQ ID NO: 105821

SEQ ID NO: 642044 - RNA, 64 nt, Homo Sapiens; identical to SEQ ID NO: 105822

SEQ ID NO: 642045 - RNA, 64 nt, Homo Sapiens; identical to SEQ ID NO: 105823

SEQ ID NO: 642046 - RNA, 64 nt, Homo Sapiens; identical to SEQ ID NO: 105824

SEQ ID NO: 642047 - RNA, 64 nt, Homo Sapiens; identical to SEQ ID NO: 105825

SEQ ID NO: 642048 - RNA, 64 nt, Homo Sapiens; identical to SEQ ID NO: 105826

SEQ ID NO: 642049 - RNA, 64 nt, Homo Sapiens; identical to SEQ ID NO: 105827

SEQ ID NO: 642050 - RNA, 64 nt, Homo Sapiens; identical to SEQ ID NO: 105828

SEQ ID NO: 642051 - RNA, 64 nt, Homo Sapiens; identical to SEQ ID NO: 105829

SEQ ID NO: 642052 - RNA, 64 nt, Homo Sapiens; identical to SEQ ID NO: 105830

SEQ ID NO: 642053 - RNA, 64 nt, Homo Sapiens; identical to SEQ ID NO: 105831

SEQ ID NO: 642054 - RNA, 64 nt, Homo Sapiens; identical to SEQ ID NO: 105832

SEQ ID NO: 642055 - RNA, 64 nt, Homo Sapiens; identical to SEQ ID NO: 105833

SEQ ID NO: 642056 - RNA, 64 nt, Homo Sapiens; identical to SEQ ID NO: 105834

SEQ ID NO: 642057 - RNA, 64 nt, Homo Sapiens; identical to SEQ ID NO: 105835

SEQ ID NO: 642058 - RNA, 64 nt, Homo Sapiens; identical to SEQ ID NO: 105836

SEQ ID NO: 642059 - RNA, 64 nt, Homo Sapiens; identical to SEQ ID NO: 105837

SEQ ID NO: 642060 - RNA, 64 nt, Homo Sapiens; identical to SEQ ID NO: 105838

SEQ ID NO: 642061 - RNA, 64 nt, Homo Sapiens; identical to SEQ ID NO: 105839

SEQ ID NO: 642062 - RNA, 64 nt, Homo Sapiens; identical to SEQ ID NO: 105840

SEQ ID NO: 642063 - RNA, 64 nt, Homo Sapiens; identical to SEQ ID NO: 105841

SEQ ID NO: 642064 - RNA, 64 nt, Homo Sapiens; identical to SEQ ID NO: 105842

SEQ ID NO: 642065 - RNA, 64 nt, Homo Sapiens; identical to SEQ ID NO: 105843

SEQ ID NO: 642066 - RNA, 64 nt, Homo Sapiens; identical to SEQ ID NO: 105844

SEQ ID NO: 642067 - RNA, 64 nt, Homo Sapiens; identical to SEQ ID NO: 105845

SEQ ID NO: 642068 - RNA, 64 nt, Homo Sapiens; identical to SEQ ID NO: 105846

SEQ ID NO: 642069 - RNA, 64 nt, Homo Sapiens; identical to SEQ ID NO: 105847

SEQ ID NO: 642070 - RNA, 64 nt, Homo Sapiens; identical to SEQ ID NO: 105848

SEQ ID NO: 642071 - RNA, 64 nt, Homo Sapiens; identical to SEQ ID NO: 105849

SEQ ID NO: 642072 - RNA, 64 nt, Homo Sapiens; identical to SEQ ID NO: 105850

SEQ ID NO: 642073 - RNA, 64 nt, Homo Sapiens; identical to SEQ ID NO: 105851

SEQ ID NO: 642074 - RNA, 64 nt, Homo Sapiens; identical to SEQ ID NO: 105852

SEQ ID NO: 642075 - RNA, 64 nt, Homo Sapiens; identical to SEQ ID NO: 105853

SEQ ID NO: 642076 - RNA, 64 nt, Homo Sapiens; identical to SEQ ID NO: 105854

SEQ ID NO: 642077 - RNA, 64 nt, Homo Sapiens; identical to SEQ ID NO: 105855

SEQ ID NO: 642078 - RNA, 64 nt, Homo Sapiens; identical to SEQ ID NO: 105856

SEQ ID NO: 642079 - RNA, 64 nt, Homo Sapiens; identical to SEQ ID NO: 105857

SEQ ID NO: 642080 - RNA, 64 nt, Homo Sapiens; identical to SEQ ID NO: 105858

SEQ ID NO: 642081 - RNA, 64 nt, Homo Sapiens; identical to SEQ ID NO: 105859

SEQ ID NO: 642082 - RNA, 64 nt, Homo Sapiens; identical to SEQ ID NO: 105860

SEQ ID NO: 642083 - RNA, 64 nt, Homo Sapiens; identical to SEQ ID NO: 105861

SEQ ID NO: 642084 - RNA, 64 nt, Homo Sapiens; identical to SEQ ID NO: 105862

SEQ ID NO: 642085 - RNA, 64 nt, Homo Sapiens; identical to SEQ ID NO: 105863

SEQ ID NO: 642086 - RNA, 64 nt, Homo Sapiens; identical to SEQ ID NO: 105864

SEQ ID NO: 642087 - RNA, 64 nt, Homo Sapiens; identical to SEQ ID NO: 105865

SEQ ID NO: 642088 - RNA, 64 nt, Homo Sapiens; identical to SEQ ID NO: 105866

SEQ ID NO: 642089 - RNA, 64 nt, Homo Sapiens; identical to SEQ ID NO: 105867

SEQ ID NO: 642090 - RNA, 64 nt, Homo Sapiens; identical to SEQ ID NO: 105868

SEQ ID NO: 642091 - RNA, 64 nt, Homo Sapiens; identical to SEQ ID NO: 105869

SEQ ID NO: 642092 - RNA, 64 nt, Homo Sapiens; identical to SEQ ID NO: 105870

SEQ ID NO: 642093 - RNA, 64 nt, Homo Sapiens; identical to SEQ ID NO: 105871

SEQ ID NO: 642094 - RNA, 64 nt, Homo Sapiens; identical to SEQ ID NO: 105872

SEQ ID NO: 642095 - RNA, 64 nt, Homo Sapiens; identical to SEQ ID NO: 105873

SEQ ID NO: 642096 - RNA, 64 nt, Homo Sapiens; identical to SEQ ID NO: 105874

SEQ ID NO: 642097 - RNA, 64 nt, Homo Sapiens; identical to SEQ ID NO: 105875

SEQ ID NO: 642098 - RNA, 64 nt, Homo Sapiens; identical to SEQ ID NO: 105876

SEQ ID NO: 642099 - RNA, 64 nt, Homo Sapiens; identical to SEQ ID NO: 105877

SEQ ID NO: 642100 - RNA, 64 nt, Homo Sapiens; identical to SEQ ID NO: 105878

SEQ ID NO: 642101 - RNA, 64 nt, Homo Sapiens; identical to SEQ ID NO: 105879

SEQ ID NO: 642102 - RNA, 64 nt, Homo Sapiens; identical to SEQ ID NO: 105880

SEQ ID NO: 642103 - RNA, 64 nt, Homo Sapiens; identical to SEQ ID NO: 105881

SEQ ID NO: 642104 - RNA, 64 nt, Homo Sapiens; identical to SEQ ID NO: 105882

SEQ ID NO: 642105 - RNA, 64 nt, Homo Sapiens; identical to SEQ ID NO: 105883

SEQ ID NO: 642106 - RNA, 64 nt, Homo Sapiens; identical to SEQ ID NO: 105884

SEQ ID NO: 642107 - RNA, 64 nt, Homo Sapiens; identical to SEQ ID NO: 105885

SEQ ID NO: 642108 - RNA, 64 nt, Homo Sapiens; identical to SEQ ID NO: 105886

SEQ ID NO: 642109 - RNA, 64 nt, Homo Sapiens; identical to SEQ ID NO: 105887

SEQ ID NO: 642110 - RNA, 64 nt, Homo Sapiens; identical to SEQ ID NO: 105888

SEQ ID NO: 642111 - RNA, 64 nt, Homo Sapiens; identical to SEQ ID NO: 105889

SEQ ID NO: 642112 - RNA, 64 nt, Homo Sapiens; identical to SEQ ID NO: 105890

SEQ ID NO: 642113 - RNA, 64 nt, Homo Sapiens; identical to SEQ ID NO: 105891

SEQ ID NO: 642114 - RNA, 64 nt, Homo Sapiens; identical to SEQ ID NO: 105892

SEQ ID NO: 642115 - RNA, 64 nt, Homo Sapiens; identical to SEQ ID NO: 105893

SEQ ID NO: 642116 - RNA, 64 nt, Homo Sapiens; identical to SEQ ID NO: 105894

SEQ ID NO: 642117 - RNA, 64 nt, Homo Sapiens; identical to SEQ ID NO: 105895

SEQ ID NO: 642118 - RNA, 64 nt, Homo Sapiens; identical to SEQ ID NO: 105896

SEQ ID NO: 642119 - RNA, 64 nt, Homo Sapiens; identical to SEQ ID NO: 105897

SEQ ID NO: 642120 - RNA, 64 nt, Homo Sapiens; identical to SEQ ID NO: 105898

SEQ ID NO: 642121 - RNA, 64 nt, Homo Sapiens; identical to SEQ ID NO: 105899

SEQ ID NO: 642122 - RNA, 64 nt, Homo Sapiens; identical to SEQ ID NO: 105900

SEQ ID NO: 642123 - RNA, 64 nt, Homo Sapiens; identical to SEQ ID NO: 105901

SEQ ID NO: 642124 - RNA, 64 nt, Homo Sapiens; identical to SEQ ID NO: 105902

SEQ ID NO: 642125 - RNA, 64 nt, Homo Sapiens; identical to SEQ ID NO: 105903

SEQ ID NO: 642126 - RNA, 64 nt, Homo Sapiens; identical to SEQ ID NO: 105904

SEQ ID NO: 642127 - RNA, 64 nt, Homo Sapiens; identical to SEQ ID NO: 105905

SEQ ID NO: 642128 - RNA, 64 nt, Homo Sapiens; identical to SEQ ID NO: 105906

SEQ ID NO: 642129 - RNA, 64 nt, Homo Sapiens; identical to SEQ ID NO: 105907

SEQ ID NO: 642130 - RNA, 64 nt, Homo Sapiens; identical to SEQ ID NO: 105908

SEQ ID NO: 642131 - RNA, 64 nt, Homo Sapiens; identical to SEQ ID NO: 105909

SEQ ID NO: 642132 - RNA, 64 nt, Homo Sapiens; identical to SEQ ID NO: 105910

SEQ ID NO: 642133 - RNA, 64 nt, Homo Sapiens; identical to SEQ ID NO: 105911

SEQ ID NO: 642134 - RNA, 64 nt, Homo Sapiens; identical to SEQ ID NO: 105912

SEQ ID NO: 642135 - RNA, 64 nt, Homo Sapiens; identical to SEQ ID NO: 105913

SEQ ID NO: 642136 - RNA, 64 nt, Homo Sapiens; identical to SEQ ID NO: 105914

SEQ ID NO: 642137 - RNA, 64 nt, Homo Sapiens; identical to SEQ ID NO: 105915

SEQ ID NO: 642138 - RNA, 64 nt, Homo Sapiens; identical to SEQ ID NO: 105916

SEQ ID NO: 642139 - RNA, 64 nt, Homo Sapiens; identical to SEQ ID NO: 105917

SEQ ID NO: 642140 - RNA, 64 nt, Homo Sapiens; identical to SEQ ID NO: 105918

SEQ ID NO: 642141 - RNA, 64 nt, Homo Sapiens; identical to SEQ ID NO: 105919

SEQ ID NO: 642142 - RNA, 64 nt, Homo Sapiens; identical to SEQ ID NO: 105920

SEQ ID NO: 642143 - RNA, 64 nt, Homo Sapiens; identical to SEQ ID NO: 105921

SEQ ID NO: 642144 - RNA, 64 nt, Homo Sapiens; identical to SEQ ID NO: 105922

SEQ ID NO: 642145 - RNA, 64 nt, Homo Sapiens; identical to SEQ ID NO: 105923

SEQ ID NO: 642146 - RNA, 64 nt, Homo Sapiens; identical to SEQ ID NO: 105924

SEQ ID NO: 642147 - RNA, 64 nt, Homo Sapiens; identical to SEQ ID NO: 105925

SEQ ID NO: 642148 - RNA, 64 nt, Homo Sapiens; identical to SEQ ID NO: 105926

SEQ ID NO: 642149 - RNA, 64 nt, Homo Sapiens; identical to SEQ ID NO: 105927

SEQ ID NO: 642150 - RNA, 64 nt, Homo Sapiens; identical to SEQ ID NO: 105928

SEQ ID NO: 642151 - RNA, 64 nt, Homo Sapiens; identical to SEQ ID NO: 105929

SEQ ID NO: 642152 - RNA, 61 nt, Homo Sapiens; identical to SEQ ID NO: 105930

SEQ ID NO: 642153 - RNA, 64 nt, Homo Sapiens; identical to SEQ ID NO: 105931

SEQ ID NO: 642154 - RNA, 64 nt, Homo Sapiens; identical to SEQ ID NO: 105932

SEQ ID NO: 642155 - RNA, 64 nt, Homo Sapiens; identical to SEQ ID NO: 105933

SEQ ID NO: 642156 - RNA, 64 nt, Homo Sapiens; identical to SEQ ID NO: 105934

SEQ ID NO: 642157 - RNA, 64 nt, Homo Sapiens; identical to SEQ ID NO: 105935

SEQ ID NO: 642158 - RNA, 64 nt, Homo Sapiens; identical to SEQ ID NO: 105936

SEQ ID NO: 642159 - RNA, 64 nt, Homo Sapiens; identical to SEQ ID NO: 105937

SEQ ID NO: 642160 - RNA, 64 nt, Homo Sapiens; identical to SEQ ID NO: 105938

SEQ ID NO: 642161 - RNA, 64 nt, Homo Sapiens; identical to SEQ ID NO: 105939

SEQ ID NO: 642162 - RNA, 64 nt, Homo Sapiens; identical to SEQ ID NO: 105940

SEQ ID NO: 642163 - RNA, 64 nt, Homo Sapiens; identical to SEQ ID NO: 105941

SEQ ID NO: 642164 - RNA, 64 nt, Homo Sapiens; identical to SEQ ID NO: 105942

SEQ ID NO: 642165 - RNA, 64 nt, Homo Sapiens; identical to SEQ ID NO: 105943

SEQ ID NO: 642166 - RNA, 64 nt, Homo Sapiens; identical to SEQ ID NO: 105944

SEQ ID NO: 642167 - RNA, 64 nt, Homo Sapiens; identical to SEQ ID NO: 105945

SEQ ID NO: 642168 - RNA, 64 nt, Homo Sapiens; identical to SEQ ID NO: 105946

SEQ ID NO: 642169 - RNA, 64 nt, Homo Sapiens; identical to SEQ ID NO: 105947

SEQ ID NO: 642170 - RNA, 64 nt, Homo Sapiens; identical to SEQ ID NO: 105948

SEQ ID NO: 642171 - RNA, 64 nt, Homo Sapiens; identical to SEQ ID NO: 105949

SEQ ID NO: 642172 - RNA, 64 nt, Homo Sapiens; identical to SEQ ID NO: 105950

SEQ ID NO: 642173 - RNA, 64 nt, Homo Sapiens; identical to SEQ ID NO: 105951

SEQ ID NO: 642174 - RNA, 64 nt, Homo Sapiens; identical to SEQ ID NO: 105952

SEQ ID NO: 642175 - RNA, 64 nt, Homo Sapiens; identical to SEQ ID NO: 105953

SEQ ID NO: 642176 - RNA, 64 nt, Homo Sapiens; identical to SEQ ID NO: 105954

SEQ ID NO: 642177 - RNA, 61 nt, Homo Sapiens; identical to SEQ ID NO: 105955

SEQ ID NO: 642178 - RNA, 64 nt, Homo Sapiens; identical to SEQ ID NO: 105956

SEQ ID NO: 642179 - RNA, 64 nt, Homo Sapiens; identical to SEQ ID NO: 105957

SEQ ID NO: 642180 - RNA, 64 nt, Homo Sapiens; identical to SEQ ID NO: 105958

SEQ ID NO: 642181 - RNA, 64 nt, Homo Sapiens; identical to SEQ ID NO: 105959

SEQ ID NO: 642182 - RNA, 64 nt, Homo Sapiens; identical to SEQ ID NO: 105960

SEQ ID NO: 642183 - RNA, 64 nt, Homo Sapiens; identical to SEQ ID NO: 105961

SEQ ID NO: 642184 - RNA, 64 nt, Homo Sapiens; identical to SEQ ID NO: 105962

SEQ ID NO: 642185 - RNA, 64 nt, Homo Sapiens; identical to SEQ ID NO: 105963

SEQ ID NO: 642186 - RNA, 64 nt, Homo Sapiens; identical to SEQ ID NO: 105964

SEQ ID NO: 642187 - RNA, 64 nt, Homo Sapiens; identical to SEQ ID NO: 105965

SEQ ID NO: 642188 - RNA, 64 nt, Homo Sapiens; identical to SEQ ID NO: 105966

SEQ ID NO: 642189 - RNA, 64 nt, Homo Sapiens; identical to SEQ ID NO: 105967

SEQ ID NO: 642190 - RNA, 64 nt, Homo Sapiens; identical to SEQ ID NO: 105968

SEQ ID NO: 642191 - RNA, 64 nt, Homo Sapiens; identical to SEQ ID NO: 105969

SEQ ID NO: 642192 - RNA, 64 nt, Homo Sapiens; identical to SEQ ID NO: 105970

SEQ ID NO: 642193 - RNA, 64 nt, Homo Sapiens; identical to SEQ ID NO: 105971

SEQ ID NO: 642194 - RNA, 64 nt, Homo Sapiens; identical to SEQ ID NO: 105972

SEQ ID NO: 642195 - RNA, 59 nt, Homo Sapiens; identical to SEQ ID NO: 105973

SEQ ID NO: 642196 - RNA, 64 nt, Homo Sapiens; identical to SEQ ID NO: 105974

SEQ ID NO: 642197 - RNA, 64 nt, Homo Sapiens; identical to SEQ ID NO: 105975

SEQ ID NO: 642198 - RNA, 64 nt, Homo Sapiens; identical to SEQ ID NO: 105976

SEQ ID NO: 642199 - RNA, 64 nt, Homo Sapiens; identical to SEQ ID NO: 105977

SEQ ID NO: 642200 - RNA, 64 nt, Homo Sapiens; identical to SEQ ID NO: 105978

SEQ ID NO: 642201 - RNA, 64 nt, Homo Sapiens; identical to SEQ ID NO: 105979

SEQ ID NO: 642202 - RNA, 64 nt, Homo Sapiens; identical to SEQ ID NO: 105980

SEQ ID NO: 642203 - RNA, 64 nt, Homo Sapiens; identical to SEQ ID NO: 105981

SEQ ID NO: 642204 - RNA, 64 nt, Homo Sapiens; identical to SEQ ID NO: 105982

SEQ ID NO: 642205 - RNA, 64 nt, Homo Sapiens; identical to SEQ ID NO: 105983

SEQ ID NO: 642206 - RNA, 64 nt, Homo Sapiens; identical to SEQ ID NO: 105984

SEQ ID NO: 642207 - RNA, 64 nt, Homo Sapiens; identical to SEQ ID NO: 105985

SEQ ID NO: 642208 - RNA, 64 nt, Homo Sapiens; identical to SEQ ID NO: 105986

SEQ ID NO: 642209 - RNA, 64 nt, Homo Sapiens; identical to SEQ ID NO: 105987

SEQ ID NO: 642210 - RNA, 64 nt, Homo Sapiens; identical to SEQ ID NO: 105988

SEQ ID NO: 642211 - RNA, 64 nt, Homo Sapiens; identical to SEQ ID NO: 105989

SEQ ID NO: 642212 - RNA, 64 nt, Homo Sapiens; identical to SEQ ID NO: 105990

SEQ ID NO: 642213 - RNA, 64 nt, Homo Sapiens; identical to SEQ ID NO: 105991

SEQ ID NO: 642214 - RNA, 64 nt, Homo Sapiens; identical to SEQ ID NO: 105992

SEQ ID NO: 642215 - RNA, 64 nt, Homo Sapiens; identical to SEQ ID NO: 105993

SEQ ID NO: 642216 - RNA, 64 nt, Homo Sapiens; identical to SEQ ID NO: 105994

SEQ ID NO: 642217 - RNA, 64 nt, Homo Sapiens; identical to SEQ ID NO: 105995

SEQ ID NO: 642218 - RNA, 64 nt, Homo Sapiens; identical to SEQ ID NO: 105996

SEQ ID NO: 642219 - RNA, 64 nt, Homo Sapiens; identical to SEQ ID NO: 105997

SEQ ID NO: 642220 - RNA, 64 nt, Homo Sapiens; identical to SEQ ID NO: 105998

SEQ ID NO: 642221 - RNA, 64 nt, Homo Sapiens; identical to SEQ ID NO: 105999

SEQ ID NO: 642222 - RNA, 64 nt, Homo Sapiens; identical to SEQ ID NO: 106000

SEQ ID NO: 642223 - RNA, 64 nt, Homo Sapiens; identical to SEQ ID NO: 106001

SEQ ID NO: 642224 - RNA, 64 nt, Homo Sapiens; identical to SEQ ID NO: 106002

SEQ ID NO: 642225 - RNA, 64 nt, Homo Sapiens; identical to SEQ ID NO: 106003

SEQ ID NO: 642226 - RNA, 64 nt, Homo Sapiens; identical to SEQ ID NO: 106004

SEQ ID NO: 642227 - RNA, 64 nt, Homo Sapiens; identical to SEQ ID NO: 106005

SEQ ID NO: 642228 - RNA, 64 nt, Homo Sapiens; identical to SEQ ID NO: 106006

SEQ ID NO: 642229 - RNA, 64 nt, Homo Sapiens; identical to SEQ ID NO: 106007

SEQ ID NO: 642230 - RNA, 64 nt, Homo Sapiens; identical to SEQ ID NO: 106008

SEQ ID NO: 642231 - RNA, 64 nt, Homo Sapiens; identical to SEQ ID NO: 106009

SEQ ID NO: 642232 - RNA, 64 nt, Homo Sapiens; identical to SEQ ID NO: 106010

SEQ ID NO: 642233 - RNA, 64 nt, Homo Sapiens; identical to SEQ ID NO: 106011

SEQ ID NO: 642234 - RNA, 64 nt, Homo Sapiens; identical to SEQ ID NO: 106012

SEQ ID NO: 642235 - RNA, 64 nt, Homo Sapiens; identical to SEQ ID NO: 106013

SEQ ID NO: 642236 - RNA, 64 nt, Homo Sapiens; identical to SEQ ID NO: 130638

SEQ ID NO: 642237 - RNA, 64 nt, Homo Sapiens; identical to SEQ ID NO: 130639

SEQ ID NO: 642238 - RNA, 64 nt, Homo Sapiens; identical to SEQ ID NO: 130640

SEQ ID NO: 642239 - RNA, 64 nt, Homo Sapiens; identical to SEQ ID NO: 130641

SEQ ID NO: 642240 - RNA, 64 nt, Homo Sapiens; identical to SEQ ID NO: 130642

SEQ ID NO: 642241 - RNA, 64 nt, Homo Sapiens; identical to SEQ ID NO: 130643

SEQ ID NO: 642242 - RNA, 64 nt, Homo Sapiens; identical to SEQ ID NO: 130644

SEQ ID NO: 642243 - RNA, 64 nt, Homo Sapiens; identical to SEQ ID NO: 130645

SEQ ID NO: 642244 - RNA, 64 nt, Homo Sapiens; identical to SEQ ID NO: 130646

SEQ ID NO: 642245 - RNA, 64 nt, Homo Sapiens; identical to SEQ ID NO: 130647

SEQ ID NO: 642246 - RNA, 64 nt, Homo Sapiens; identical to SEQ ID NO: 130648

SEQ ID NO: 642247 - RNA, 64 nt, Homo Sapiens; identical to SEQ ID NO: 130649

SEQ ID NO: 642248 - RNA, 64 nt, Homo Sapiens; identical to SEQ ID NO: 130650

SEQ ID NO: 642249 - RNA, 64 nt, Homo Sapiens; identical to SEQ ID NO: 130651

SEQ ID NO: 642250 - RNA, 64 nt, Homo Sapiens; identical to SEQ ID NO: 130652

SEQ ID NO: 642251 - RNA, 64 nt, Homo Sapiens; identical to SEQ ID NO: 130653

SEQ ID NO: 642252 - RNA, 64 nt, Homo Sapiens; identical to SEQ ID NO: 130654

SEQ ID NO: 642253 - RNA, 64 nt, Homo Sapiens; identical to SEQ ID NO: 130655

SEQ ID NO: 642254 - RNA, 64 nt, Homo Sapiens; identical to SEQ ID NO: 130656

SEQ ID NO: 642255 - RNA, 64 nt, Homo Sapiens; identical to SEQ ID NO: 130657

SEQ ID NO: 642256 - RNA, 64 nt, Homo Sapiens; identical to SEQ ID NO: 130658

SEQ ID NO: 642257 - RNA, 64 nt, Homo Sapiens; identical to SEQ ID NO: 130659

SEQ ID NO: 642258 - RNA, 64 nt, Homo Sapiens; identical to SEQ ID NO: 611214

SEQ ID NO: 642259 - RNA, 64 nt, Homo Sapiens; identical to SEQ ID NO: 611215

SEQ ID NO: 642260 - RNA, 64 nt, Homo Sapiens; identical to SEQ ID NO: 341042

SEQ ID NO: 642261 - RNA, 64 nt, Homo Sapiens; identical to SEQ ID NO: 341043

SEQ ID NO: 642262 - RNA, 64 nt, Homo Sapiens
auucuggaaguaaagaaaaugaauuuacugcuuuuuccaggacacaaguagcugaggagagguc

SEQ ID NO: 642263 - RNA, 64 nt, Homo Sapiens
aagagccuuugugcauuugacucacaguacugguuuccaggaggaaaagcccuggguggugagg

SEQ ID NO: 642264 - RNA, 64 nt, Homo Sapiens
aacuacauuuucucauauacgucuuuuuuuuuuuuuccaggaacguaaacuugguaaaauccaa

SEQ ID NO: 642265 - RNA, 64 nt, Homo Sapiens
aagaaugcacauugaauggaguggguaacagauauuccaggaaagguucuuguuccugagaagg

SEQ ID NO: 642266 - RNA, 64 nt, Homo Sapiens
aguuauuaccguuuaugauacaaauuuuauggucuuccaggaaagcuauauuacaagcaauccc

SEQ ID NO: 642267 - RNA, 64 nt, Homo Sapiens
uguuuucagaaacaagaauuucuggaagugaugcuuccaggauucugcuagggacagaaguguu

SEQ ID NO: 642268 - RNA, 64 nt, Homo Sapiens
agcuuccuccuucugucacugcccacugcucaguuuccaggaucgcaguaggauuuaaaaagca

SEQ ID NO: 642269 - RNA, 64 nt, Homo Sapiens
aaaauuccaagaguuacaauauauaacuaaaugcuuccaggagacauuuugaaaggggacagaa

SEQ ID NO: 642270 - RNA, 64 nt, Homo Sapiens
uaccaccacauugcauuucuguuugcaccaugucuuccaggagacuagacuacuguuguccagg

SEQ ID NO: 642271 - RNA, 64 nt, Homo Sapiens
ucucuagggguuucaaaagacucaguuaauugauuuccaggaaguacucauagcaaguucauaa

SEQ ID NO: 642272 - RNA, 64 nt, Homo Sapiens
ugaagagucugaacacuggccugugauugguccauuccaggaccuucauuugcauaagguauca

SEQ ID NO: 642273 - RNA, 64 nt, Homo Sapiens
ggccagaccugcacucuggccaaugauugguucauuccaggacauucauuugcauaaggaguca

SEQ ID NO: 642274 - RNA, 64 nt, Homo Sapiens
uaugcuggaaacugauaguucagagcguacuuuguuccaggaacuucauucgcuacuaguuauu

SEQ ID NO: 642275 - RNA, 64 nt, Homo Sapiens
uaugcuagaaacugucucuccagagccuacuguguuccaggaacuuauuuacuacauaguuauu

SEQ ID NO: 642276 - RNA, 64 nt, Homo Sapiens
cccuuguccugguggccuucagugucucuuccaguuccaggagcugcugggaagcuggccuuca

SEQ ID NO: 642277 - RNA, 64 nt, Homo Sapiens
acauggcuggcugguccugaggccacccaccuuguuccaggacaugggcccgggcccggugugg

SEQ ID NO: 642278 - RNA, 64 nt, Homo Sapiens
auuuauuuaacaggcucccaagggcuuggcucccuuccaggaagauagacaacacacaaacgag

SEQ ID NO: 642279 - RNA, 64 nt, Homo Sapiens
cccagcuggaaaccuggcuucugcguccuggcgauuccaggagacucagccaagauugguaaag

SEQ ID NO: 642280 - RNA, 64 nt, Homo Sapiens
ggagugaauguaaaaauaaaucagggcggcuggauuccaggacauggugcugucuccgcggaag

SEQ ID NO: 642281 - RNA, 64 nt, Homo Sapiens
gaagauaacauuuacaaguacagaacucaaaauauuccaggagaaugauugguuaagugaaaac

SEQ ID NO: 642282 - RNA, 64 nt, Homo Sapiens
gggaagaaaacacucaguuggcauccauugccuuuuccaggaaauuucagaaaucagggcacuu

SEQ ID NO: 642283 - RNA, 64 nt, Homo Sapiens
auuugagauuggaagcuacaacaguguccacagguuccaggaccucccagcugauggugagcug

SEQ ID NO: 642284 - RNA, 64 nt, Homo Sapiens
ucgcuuuccaucuguucuugaaggcaccugcugguuccaggacccgggggccuugggagaguuu

SEQ ID NO: 642285 - RNA, 64 nt, Homo Sapiens
guccaaguagagauuacacccagaacaccauuccuuccaggagcaguaggugggagguuugacc

SEQ ID NO: 642286 - RNA, 64 nt, Homo Sapiens
ugggagguuugacccagagaagccaauccuugcauuccaggaguggccugugccucccaccucu

SEQ ID NO: 642287 - RNA, 64 nt, Homo Sapiens
aaagauccaauguuuuuucuucuccaagcuccuauuccaggaaacaacugaugauauccuaucc

SEQ ID NO: 642288 - RNA, 64 nt, Homo Sapiens
ucuaugacacuucaucagauuuaccuccccacauuuccaggaccuuacauuugacauaagcaau

SEQ ID NO: 642289 - RNA, 64 nt, Homo Sapiens
cauaacauuuaggggaauuagggaacuuaucuuuuuccaggaucugaggagcugugcugauguu

SEQ ID NO: 642290 - RNA, 64 nt, Homo Sapiens
ucugccccaccccuacucaagcacuucccagccuuuccaggagcaugccccauucccugcccca

SEQ ID NO: 642291 - RNA, 64 nt, Homo Sapiens
uuaugaugcagucuaguacgaguauugcaucuaauuccaggagcauuguuuuaaguugauugac

SEQ ID NO: 642292 - RNA, 64 nt, Homo Sapiens
ccuuggaguuuuuuuucauucauauuuuuguuguuuccaggaauuuauuugauauuaaugggcg

SEQ ID NO: 642293 - RNA, 64 nt, Homo Sapiens
cagggcucagcagugaugggagaacagaggacaguuccaggauaaacugcugccuggggcugug

SEQ ID NO: 642294 - RNA, 64 nt, Homo Sapiens
ugaaucagucaccccgaaucuuggaaaaacccccuuccaggagaggaugggcaggcauuuaaaa

SEQ ID NO: 642295 - RNA, 64 nt, Homo Sapiens
agaggaccuagcuuuaaaucguucugguccuggauuccaggaguuuaugcaugagucacgcaau

SEQ ID NO: 642296 - RNA, 64 nt, Homo Sapiens
uucugaacaucugauucugucacacacaggaggguuccaggacugugugcagucugagcuuagg

SEQ ID NO: 642297 - RNA, 64 nt, Homo Sapiens
agaugaaauuggaaauaaaccaacauuguuuacauuccaggagacuuguagcucagccacacac

SEQ ID NO: 642298 - RNA, 64 nt, Homo Sapiens
guccacuugcgggguaagagauaaacaguaacccuuccaggagcccacugacguuggagugcua

SEQ ID NO: 642299 - RNA, 64 nt, Homo Sapiens
agggauggggagcccucuggggaugagcaaggccuuccaggacaggcucgguucugguccccug

SEQ ID NO: 642300 - RNA, 64 nt, Homo Sapiens
ucccaacguugcucaucaaauuaugaccauaaauuuccaggaucagacuaacggcuaaagagac

SEQ ID NO: 642301 - RNA, 64 nt, Homo Sapiens
guaggacggaaagcuccuuucauucaguuuaucuuuccaggauauaugaaaagggaccagcugg

SEQ ID NO: 642302 - RNA, 64 nt, Homo Sapiens
ggaagccuggaaugaccucuugcacaagccuaaauuccaggaaucuuccccaaaucccagaucc

SEQ ID NO: 642303 - RNA, 64 nt, Homo Sapiens
cauguacugaguuccuucagaucagccacaccuuuuccaggaguucugaagcugacagcacuac

SEQ ID NO: 642304 - RNA, 64 nt, Homo Sapiens
ucagccaaaagaacaaaagagaugucaggacagauuccaggagugucggagcacauguguggca

SEQ ID NO: 642305 - RNA, 64 nt, Homo Sapiens
uuaauucaagaaaugacagucugcauauguuuuccacauaaauuuaggggccaauaaaauguau

SEQ ID NO: 642306 - RNA, 64 nt, Homo Sapiens
aauucaagaaguauuuuuuuuaguuaaaacucaucacauaaagauacauccguaggacaaguuu

SEQ ID NO: 642307 - RNA, 64 nt, Homo Sapiens
cagauauuuaaauuuguucuucuugcaaaucauccacauaaaauuccuauggcaagaaaaauuu

SEQ ID NO: 642308 - RNA, 64 nt, Homo Sapiens
ucucuguucuugcauuuaugcaacacauaacuuacacauaaaugcaccaaacuuuuugacaagg

SEQ ID NO: 642309 - RNA, 64 nt, Homo Sapiens
acugauuauaaaaauauuguauagugaccaaguacacauaaaauagugacaagaagucacuugu

SEQ ID NO: 642310 - RNA, 64 nt, Homo Sapiens
caagcaagaaauauguucagguccacacaaaagccacauaaacuucccccaugaacuucagccu

SEQ ID NO: 642311 - RNA, 64 nt, Homo Sapiens
uccauguguaagcuucucuaaagaaaaaaaaacacacauaaaguuuaaccuguauuuguuaaaa

SEQ ID NO: 642312 - RNA, 64 nt, Homo Sapiens
gcaacaagacaaguaauaguuagccuguggucuccacauaaacacucaccucaaagacaauuca

SEQ ID NO: 642313 - RNA, 64 nt, Homo Sapiens
uaguugccucucccuguggaaacagcacuuuuuccacauaaaucaauaaaacacagcuccuuca

SEQ ID NO: 642314 - RNA, 64 nt, Homo Sapiens
ggauggauaauuaucguauaggcuguaccuucuccacauaaaugcccaaaguaaugaaucaugu

SEQ ID NO: 642315 - RNA, 64 nt, Homo Sapiens
guucguaauaaaucaugugccacaucuugucuuacacauaaaagccacugcuuuuaacauccca

SEQ ID NO: 642316 - RNA, 64 nt, Homo Sapiens
agccacugcuuuuaacaucccauuguacauuuaacacauaaaugguguuaacaucccauuguac

SEQ ID NO: 642317 - RNA, 64 nt, Homo Sapiens
cauaaaugguguuaacaucccauuguacauuuaacacauaaauggccauugucuuugucucagu

SEQ ID NO: 642318 - RNA, 64 nt, Homo Sapiens
ugaugaaaauguugcacauucuauaguugcaaaacacauaaaaggggacuuaacauuucacguu

SEQ ID NO: 642319 - RNA, 64 nt, Homo Sapiens
gucuuauauccccauauggaauuuauccaucaaccacauaaaaacaaacagugccuucugcccu

SEQ ID NO: 642320 - RNA, 64 nt, Homo Sapiens
cagcugacucaaaauugagggggaaggaaacaaucacauaaaaugcaguguacuggggguggga

SEQ ID NO: 642321 - RNA, 64 nt, Homo Sapiens
caguguacugggggugggagaauacaaaugcagccacauaaaggugguuuucuaagcagagacu

SEQ ID NO: 642322 - RNA, 64 nt, Homo Sapiens
uuaucaaggagucuagauugaaaacucaaaugaccacauaaagcccauuagagaaaccauuugu

SEQ ID NO: 642323 - RNA, 64 nt, Homo Sapiens
auuuuggcauaccauuagagcuaucuggagagaacacauaaaugugcuguauguuacaguaaag

SEQ ID NO: 642324 - RNA, 64 nt, Homo Sapiens; identical to SEQ ID NO: 305774

SEQ ID NO: 642325 - RNA, 64 nt, Homo Sapiens; identical to SEQ ID NO: 305775

SEQ ID NO: 642326 - RNA, 64 nt, Homo Sapiens; identical to SEQ ID NO: 305776

SEQ ID NO: 642327 - RNA, 64 nt, Homo Sapiens; identical to SEQ ID NO: 305777

SEQ ID NO: 642328 - RNA, 64 nt, Homo Sapiens; identical to SEQ ID NO: 305778

SEQ ID NO: 642329 - RNA, 64 nt, Homo Sapiens; identical to SEQ ID NO: 305779

SEQ ID NO: 642330 - RNA, 64 nt, Homo Sapiens; identical to SEQ ID NO: 305780

SEQ ID NO: 642331 - RNA, 64 nt, Homo Sapiens; identical to SEQ ID NO: 305781

SEQ ID NO: 642332 - RNA, 64 nt, Homo Sapiens; identical to SEQ ID NO: 305782

SEQ ID NO: 642333 - RNA, 64 nt, Homo Sapiens; identical to SEQ ID NO: 305783

SEQ ID NO: 642334 - RNA, 64 nt, Homo Sapiens; identical to SEQ ID NO: 305784

SEQ ID NO: 642335 - RNA, 64 nt, Homo Sapiens; identical to SEQ ID NO: 305785

SEQ ID NO: 642336 - RNA, 64 nt, Homo Sapiens; identical to SEQ ID NO: 305786

SEQ ID NO: 642337 - RNA, 64 nt, Homo Sapiens; identical to SEQ ID NO: 305787

SEQ ID NO: 642338 - RNA, 64 nt, Homo Sapiens; identical to SEQ ID NO: 305788

SEQ ID NO: 642339 - RNA, 64 nt, Homo Sapiens; identical to SEQ ID NO: 305789

SEQ ID NO: 642340 - RNA, 64 nt, Homo Sapiens; identical to SEQ ID NO: 305790

SEQ ID NO: 642341 - RNA, 64 nt, Homo Sapiens; identical to SEQ ID NO: 305791

SEQ ID NO: 642342 - RNA, 64 nt, Homo Sapiens; identical to SEQ ID NO: 305792

SEQ ID NO: 642343 - RNA, 64 nt, Homo Sapiens; identical to SEQ ID NO: 305793

SEQ ID NO: 642344 - RNA, 63 nt, Homo Sapiens; identical to SEQ ID NO: 305794

SEQ ID NO: 642345 - RNA, 64 nt, Homo Sapiens; identical to SEQ ID NO: 305795

SEQ ID NO: 642346 - RNA, 64 nt, Homo Sapiens; identical to SEQ ID NO: 305796

SEQ ID NO: 642347 - RNA, 64 nt, Homo Sapiens; identical to SEQ ID NO: 305797

SEQ ID NO: 642348 - RNA, 64 nt, Homo Sapiens; identical to SEQ ID NO: 305798

SEQ ID NO: 642349 - RNA, 64 nt, Homo Sapiens; identical to SEQ ID NO: 305799

SEQ ID NO: 642350 - RNA, 64 nt, Homo Sapiens; identical to SEQ ID NO: 305800

SEQ ID NO: 642351 - RNA, 64 nt, Homo Sapiens; identical to SEQ ID NO: 305801

SEQ ID NO: 642352 - RNA, 64 nt, Homo Sapiens; identical to SEQ ID NO: 305802

SEQ ID NO: 642353 - RNA, 64 nt, Homo Sapiens; identical to SEQ ID NO: 305803

SEQ ID NO: 642354 - RNA, 64 nt, Homo Sapiens; identical to SEQ ID NO: 305804

SEQ ID NO: 642355 - RNA, 64 nt, Homo Sapiens; identical to SEQ ID NO: 305805

SEQ ID NO: 642356 - RNA, 64 nt, Homo Sapiens; identical to SEQ ID NO: 305806

SEQ ID NO: 642357 - RNA, 64 nt, Homo Sapiens; identical to SEQ ID NO: 305807

SEQ ID NO: 642358 - RNA, 64 nt, Homo Sapiens; identical to SEQ ID NO: 305808

SEQ ID NO: 642359 - RNA, 64 nt, Homo Sapiens; identical to SEQ ID NO: 305809

SEQ ID NO: 642360 - RNA, 64 nt, Homo Sapiens; identical to SEQ ID NO: 305810

SEQ ID NO: 642361 - RNA, 64 nt, Homo Sapiens; identical to SEQ ID NO: 305811

SEQ ID NO: 642362 - RNA, 64 nt, Homo Sapiens; identical to SEQ ID NO: 305812

SEQ ID NO: 642363 - RNA, 64 nt, Homo Sapiens; identical to SEQ ID NO: 305813

SEQ ID NO: 642364 - RNA, 64 nt, Homo Sapiens; identical to SEQ ID NO: 305814

SEQ ID NO: 642365 - RNA, 64 nt, Homo Sapiens; identical to SEQ ID NO: 305815

SEQ ID NO: 642366 - RNA, 64 nt, Homo Sapiens; identical to SEQ ID NO: 305816

SEQ ID NO: 642367 - RNA, 64 nt, Homo Sapiens; identical to SEQ ID NO: 305817

SEQ ID NO: 642368 - RNA, 64 nt, Homo Sapiens
cugccuagauucccacagcacagcucuucuuggucuuggcuagaaucaauagcuuguagaagcu

SEQ ID NO: 642369 - RNA, 64 nt, Homo Sapiens
uuuuguauuuuuaguagagacacccaccaucaugcuuggcuaaucgaguagcugggacuacagg

SEQ ID NO: 642370 - RNA, 64 nt, Homo Sapiens
agucagccguaggaauucaaaauggcuggccuaccuuggcuaccagacauauugggguuuuugu

SEQ ID NO: 642371 - RNA, 64 nt, Homo Sapiens
aauacaggguuuuuccaagccaggaaacgcccuccuuggcuacuaggagcaccuaucccauauc

SEQ ID NO: 642372 - RNA, 64 nt, Homo Sapiens
gaacuaggcaaagaugaaaguauagccaacuauucuuggcuauauauauauauucaagugggcc

SEQ ID NO: 642373 - RNA, 64 nt, Homo Sapiens
aauccuaacuccugauuccgucuccuauuucuugcuuggcuacgccaguucccaaaucugguag

SEQ ID NO: 642374 - RNA, 64 nt, Homo Sapiens
aguggccaagaguguuuaucccaacccuuccauuuaacaggauuucacucacauuucuggaacu

SEQ ID NO: 642375 - RNA, 64 nt, Homo Sapiens
aauucugaguuccagcacaauuuucuuuggaaucuaacaggaaucuagccugaggaagaaggga

SEQ ID NO: 642376 - RNA, 64 nt, Homo Sapiens
gaagccaagaagggagaguuucgugcacugugguuaacaggagggcugccuggaggcaguggcu

SEQ ID NO: 642377 - RNA, 64 nt, Homo Sapiens
cuccagggaggccuggccuggaggaggaguccacuaacaggaaacacuucucacccccucacac

SEQ ID NO: 642378 - RNA, 64 nt, Homo Sapiens
aacaccucggcuguggucucucugcuuuaaauccuaacaggacuuccuagagcguugacagaaa

SEQ ID NO: 642379 - RNA, 64 nt, Homo Sapiens
agcaacgagggcuugcucuaaaucguuuagaggauaacaggaucuagagaugcucucugcuuga

SEQ ID NO: 642380 - RNA, 64 nt, Homo Sapiens; identical to SEQ ID NO: 346161

SEQ ID NO: 642381 - RNA, 64 nt, Homo Sapiens; identical to SEQ ID NO: 346162

SEQ ID NO: 642382 - RNA, 63 nt, Homo Sapiens
uaguagguucuguuacaguuuuucuuuugaucgugcacuuauagucuucauuuaauuccucau

SEQ ID NO: 642383 - RNA, 63 nt, Homo Sapiens
guauuuguggaaauugguauuaucucuguuuuaugcacuuacauuuaucccuuacauuuuguu

SEQ ID NO: 642384 - RNA, 63 nt, Homo Sapiens
gcaauuuucaaauguacucaugcugucuagucaugcacuuaaacauaugcaaucacucguuua

SEQ ID NO: 642385 - RNA, 63 nt, Homo Sapiens
uuucaguaguagucuugacuuucuugauagaacugcacuuaaucgcgugcaguucauuucuag

SEQ ID NO: 642386 - RNA, 63 nt, Homo Sapiens
ccagcucugcccuuggggggacagaagagcuggugcacuuaauaagaucuggggcugcagaga

SEQ ID NO: 642387 - RNA, 63 nt, Homo Sapiens
cguacucaagggagcgcgccgccuggugaauucugcacuuacaggccguggggucucaggggu

SEQ ID NO: 642388 - RNA, 63 nt, Homo Sapiens
uuuuuuuccuauuuuucuucuuuuugcuuuuuuugcacuuaucagaaauauuugaugugugca

SEQ ID NO: 642389 - RNA, 63 nt, Homo Sapiens
ugauuuagaagagacucuuugcugaaauugaauugcacuuauacauguaaauugucaacaugu

SEQ ID NO: 642390 - RNA, 63 nt, Homo Sapiens
aucaaaguaguucaacaugcgacuaucuauauuugcacuuaaaugcaagugacaaucagaggu

SEQ ID NO: 642391 - RNA, 63 nt, Homo Sapiens
uuuuuuuuuuuuuuuuuagucuccaagaguaguugcacuuaacuuugacuccccuuauucccu

SEQ ID NO: 642392 - RNA, 63 nt, Homo Sapiens
aauauaaaugaagauauuuuaccaugaagagauugcacuuauccuugagaacagucuaaauau

SEQ ID NO: 642393 - RNA, 63 nt, Homo Sapiens
aauauaaaugaagauauuuuaccaugaagagauugcacuuauccuugagaacagucuaaugau

SEQ ID NO: 642394 - RNA, 63 nt, Homo Sapiens
gucgguguggaaugucacuccauccggggacugugcacuuacauugagggugaugacaagaga

SEQ ID NO: 642395 - RNA, 63 nt, Homo Sapiens
cucuccucucuucuccuaucugagggagguaggugcacuuaccgggagaccagcaguuaacgg

SEQ ID NO: 642396 - RNA, 64 nt, Homo Sapiens; identical to SEQ ID NO: 628794

SEQ ID NO: 642397 - RNA, 64 nt, Homo Sapiens; identical to SEQ ID NO: 628795

SEQ ID NO: 642398 - RNA, 64 nt, Homo Sapiens; identical to SEQ ID NO: 628796

SEQ ID NO: 642399 - RNA, 64 nt, Homo Sapiens; identical to SEQ ID NO: 628797

SEQ ID NO: 642400 - RNA, 64 nt, Homo Sapiens; identical to SEQ ID NO: 628798

SEQ ID NO: 642401 - RNA, 64 nt, Homo Sapiens; identical to SEQ ID NO: 628799

SEQ ID NO: 642402 - RNA, 64 nt, Homo Sapiens; identical to SEQ ID NO: 628800

SEQ ID NO: 642403 - RNA, 64 nt, Homo Sapiens; identical to SEQ ID NO: 628801

SEQ ID NO: 642404 - RNA, 64 nt, Homo Sapiens; identical to SEQ ID NO: 628802

SEQ ID NO: 642405 - RNA, 64 nt, Homo Sapiens; identical to SEQ ID NO: 628803

SEQ ID NO: 642406 - RNA, 64 nt, Homo Sapiens; identical to SEQ ID NO: 628804

SEQ ID NO: 642407 - RNA, 64 nt, Homo Sapiens; identical to SEQ ID NO: 628805

SEQ ID NO: 642408 - RNA, 64 nt, Homo Sapiens; identical to SEQ ID NO: 628806

SEQ ID NO: 642409 - RNA, 64 nt, Homo Sapiens; identical to SEQ ID NO: 628807

SEQ ID NO: 642410 - RNA, 64 nt, Homo Sapiens
ggcggagggugggagcaggugugccagggcucagggcucagacuugggagggccuaggcagaag

SEQ ID NO: 642411 - RNA, 64 nt, Homo Sapiens
gacacccucacgaagggucgcaagucacucuuguggcucagauugcucuuaggaccuggaggga

SEQ ID NO: 642412 - RNA, 64 nt, Homo Sapiens
gcauccauggggcuuauaugagacaugaagcauuggcucagaaguagagggagaagaggaaccc

SEQ ID NO: 642413 - RNA, 64 nt, Homo Sapiens
cuaaacccuauccuaagcuccaguuccauggcaaggcucagacuuuuaaugccaucuuaaucug

SEQ ID NO: 642414 - RNA, 64 nt, Homo Sapiens
cggagaagcuggaaagugugaaugcugaacugaaggcucagauugaggagcucaagaacgagaa

SEQ ID NO: 642415 - RNA, 64 nt, Homo Sapiens
ugcucaaccuucaucggcccacguguauuguccgggcucagaaugggaggacuccagaagauga

SEQ ID NO: 642416 - RNA, 64 nt, Homo Sapiens
cuagagaaagugaucaccaaagguugaacagcauggcucagaguugauacugauugccacauua

SEQ ID NO: 642417 - RNA, 64 nt, Homo Sapiens
cuuguucaagagaaagugauagguugaacaacauggcucagaguugauacugauucccacauua

SEQ ID NO: 642418 - RNA, 64 nt, Homo Sapiens
ccugcacuaugaagugcugcuggcugggcuugguggcucagaacaaggcacugucacugcccac

SEQ ID NO: 642419 - RNA, 64 nt, Homo Sapiens
gccagggccucggcggcugcugaagggauucuauggcucagaggcccaggguguggugaaggac

SEQ ID NO: 642420 - RNA, 64 nt, Homo Sapiens
uguaauucucccaggagcugccagagaugcccugggcucagauccaggaacccuuuccaaaagc

SEQ ID NO: 642421 - RNA, 64 nt, Homo Sapiens
augcccagcccuuccucaaaacgugccccucugaggcucagaaacagcuccccagggcagacuc

SEQ ID NO: 642422 - RNA, 64 nt, Homo Sapiens
guuguuguuacuucccuccaagaggcuggaaaagggcucagagcugcugagcaggaaccggagg

SEQ ID NO: 642423 - RNA, 64 nt, Homo Sapiens
caacaggcccuugguagagcuggugccagaugugggcucagauccugggcaugaugggccgagc

SEQ ID NO: 642424 - RNA, 64 nt, Homo Sapiens
uuuacgacgugaucuaaaccaguccuuagcaaggggcucagaacaccccgcucuggcaguaggu

SEQ ID NO: 642425 - RNA, 64 nt, Homo Sapiens
gagagcugcugagggaccuuggagagcucaggauggcucagacgaggacacucgcuugccgggc

SEQ ID NO: 642426 - RNA, 64 nt, Homo Sapiens
cagccucuauuguccagagcacccacugacucagggcucagacuucccgaggaaucugccuccc

SEQ ID NO: 642427 - RNA, 64 nt, Homo Sapiens
aaggguggagcaacccuccugguggggagaccauggcucagaggcugcucaccccacagacacu

SEQ ID NO: 642428 - RNA, 64 nt, Homo Sapiens
gagaucaugaacccauuuaacagacgaggagacaggcucagagaggcaccgucccuugccuaac

SEQ ID NO: 642429 - RNA, 64 nt, Homo Sapiens
uagcccaacucccuguuucaugaaagagaaaagaggcucagaaaaguuuagagagcagcucagu

SEQ ID NO: 642430 - RNA, 64 nt, Homo Sapiens
ggggcaaggagcauagagauguuuuccaggaaggggcucagaagcugcacuaggccccgagucc

SEQ ID NO: 642431 - RNA, 64 nt, Homo Sapiens
acgucuccgugcagcccccagagagaggcccaugggcucagaccaggcuuuguuguccugcucu

SEQ ID NO: 642432 - RNA, 64 nt, Homo Sapiens
acauauggcaggccgaucagagagcagccgauggggcucagacugauguuagagaggccugggg

SEQ ID NO: 642433 - RNA, 64 nt, Homo Sapiens
uuccuggcuuugggagcagacugucaugggcuggggcucagauucauucuucucuacccagaac

SEQ ID NO: 642434 - RNA, 64 nt, Homo Sapiens
cacaguccuuacuucucuaccugccucaagaaggggcucagagcagagacuugugaauuccuua

SEQ ID NO: 642435 - RNA, 64 nt, Homo Sapiens
ucaaaggaccggcucauggcguuggucacuggcaggcucagagacauucugcugugggcgcagg

SEQ ID NO: 642436 - RNA, 64 nt, Homo Sapiens
cacacacacacucacugcggagaaccuugugccuggcucagagccagucuuuuuggugagggua

SEQ ID NO: 642437 - RNA, 64 nt, Homo Sapiens
aaccugccagggagacagagcucacaauaaaaauggcucagaugccacuucaaagaaccaguga

SEQ ID NO: 642438 - RNA, 64 nt, Homo Sapiens
gcucuggacagaguucuuauaaauguauaaauuaggcucagaaaccacugcauucugaccugcu

SEQ ID NO: 642439 - RNA, 64 nt, Homo Sapiens
ggagucaagucaggaugcucucaaggaccccucgggcucagagcccuaaagugggcccugguga

SEQ ID NO: 642440 - RNA, 64 nt, Homo Sapiens
ggacuauuugcaaggugacagggacuggagccauggcucagaggugauucgggcagccagggac

SEQ ID NO: 642441 - RNA, 64 nt, Homo Sapiens
ucaguugugagccuucuagggccccaggcugggaggcucagaggacugaaucugggaccugugu

SEQ ID NO: 642442 - RNA, 64 nt, Homo Sapiens
agguaccagaaaccaccaggguagagccaccagguacgacgaccccccucgacccccagccugg

SEQ ID NO: 642443 - RNA, 64 nt, Homo Sapiens
gcaggugaccgggcgccgccucuggaagaacguguacgacgagcuggggggcagcccaggcagc

SEQ ID NO: 642444 - RNA, 64 nt, Homo Sapiens
gcuugaguugucaaaauauauuaacaaaauaacauacgacgagauaaugauuaugaacuuuugc

SEQ ID NO: 642445 - RNA, 64 nt, Homo Sapiens
uaugcuuucauucagucagucucuguugacuaaauacgacgaaaauucauacuuuaugcaggag

SEQ ID NO: 642446 - RNA, 64 nt, Homo Sapiens
uguuccacuuccuugagugucagagacgccuggcuacgacgauuauuucggguuuccggagagg

SEQ ID NO: 642447 - RNA, 64 nt, Homo Sapiens
uggggacaucacugaccugggccugacgcugucuuacgacgaggacgucaugggucagguaggu

SEQ ID NO: 642448 - RNA, 64 nt, Homo Sapiens
cccucugccugguccccuuugcccccaggaugaauacgacgacauugugguucacagcagccgc

SEQ ID NO: 642449 - RNA, 64 nt, Homo Sapiens
ccgauggcccgggcagcgggaccggggcuccgacuacgacgagguccccggcaccauggcuacu

SEQ ID NO: 642450 - RNA, 64 nt, Homo Sapiens
gcgacccugagcucuucagcgguacccccccuucuacgacgagaugugggugccaggcugugug

SEQ ID NO: 642451 - RNA, 62 nt, Homo Sapiens
cauacauucgugccuggagacccugcaggccagaguccaaauauuuaacaaucagaaggggc

SEQ ID NO: 642452 - RNA, 62 nt, Homo Sapiens
aguaauauggacaccauggaaguacaggaucugaguccaacauugccaugggggagggaaga

SEQ ID NO: 642453 - RNA, 62 nt, Homo Sapiens
uuugccugaacaccccaacacucuugguuuuagaguccaagaguaaguugugcagagacaug

SEQ ID NO: 642454 - RNA, 62 nt, Homo Sapiens
uguuuacucuguuccucuccacuguuucagcugaguccaagucauuuucugugccuuaucuc

SEQ ID NO: 642455 - RNA, 62 nt, Homo Sapiens
cauuaaaaaagaagaaucuccauguuuucuuugaguccaacugggugaggcuguccaggcac

SEQ ID NO: 642456 - RNA, 62 nt, Homo Sapiens
gcccucccagguguuaacauuccaagacucuagaguccaagguuuaaagagucuagauucaa

SEQ ID NO: 642457 - RNA, 62 nt, Homo Sapiens
gcugcauucugccucucuaggaccaugguuaagaguccaagaauccacauuucuaaaaucuu

SEQ ID NO: 642458 - RNA, 62 nt, Homo Sapiens
uguuuguaacuuaugaacacacgugaaguguugaguccaaaagacaaaggggcaucggcaug

SEQ ID NO: 642459 - RNA, 62 nt, Homo Sapiens
agcgugcuuucauuuucaaguagcauaugcaagaguccaaacaggcuacccaauguuacuac

SEQ ID NO: 642460 - RNA, 64 nt, Homo Sapiens; identical to SEQ ID NO: 504475

SEQ ID NO: 642461 - RNA, 64 nt, Homo Sapiens; identical to SEQ ID NO: 504476

SEQ ID NO: 642462 - RNA, 64 nt, Homo Sapiens; identical to SEQ ID NO: 504477

SEQ ID NO: 642463 - RNA, 64 nt, Homo Sapiens; identical to SEQ ID NO: 504478

SEQ ID NO: 642464 - RNA, 64 nt, Homo Sapiens; identical to SEQ ID NO: 504479

SEQ ID NO: 642465 - RNA, 64 nt, Homo Sapiens; identical to SEQ ID NO: 504480

SEQ ID NO: 642466 - RNA, 64 nt, Homo Sapiens; identical to SEQ ID NO: 504481

SEQ ID NO: 642467 - RNA, 64 nt, Homo Sapiens; identical to SEQ ID NO: 504482

SEQ ID NO: 642468 - RNA, 64 nt, Homo Sapiens; identical to SEQ ID NO: 504483

SEQ ID NO: 642469 - RNA, 64 nt, Homo Sapiens; identical to SEQ ID NO: 504484

SEQ ID NO: 642470 - RNA, 64 nt, Homo Sapiens; identical to SEQ ID NO: 504485

SEQ ID NO: 642471 - RNA, 64 nt, Homo Sapiens; identical to SEQ ID NO: 504486

SEQ ID NO: 642472 - RNA, 64 nt, Homo Sapiens; identical to SEQ ID NO: 504487

SEQ ID NO: 642473 - RNA, 64 nt, Homo Sapiens; identical to SEQ ID NO: 504488

SEQ ID NO: 642474 - RNA, 64 nt, Homo Sapiens; identical to SEQ ID NO: 504489

SEQ ID NO: 642475 - RNA, 64 nt, Homo Sapiens; identical to SEQ ID NO: 504490

SEQ ID NO: 642476 - RNA, 64 nt, Homo Sapiens; identical to SEQ ID NO: 504491

SEQ ID NO: 642477 - RNA, 64 nt, Homo Sapiens; identical to SEQ ID NO: 504492

SEQ ID NO: 642478 - RNA, 64 nt, Homo Sapiens; identical to SEQ ID NO: 504493

SEQ ID NO: 642479 - RNA, 64 nt, Homo Sapiens; identical to SEQ ID NO: 504494

SEQ ID NO: 642480 - RNA, 64 nt, Homo Sapiens; identical to SEQ ID NO: 504495

SEQ ID NO: 642481 - RNA, 64 nt, Homo Sapiens; identical to SEQ ID NO: 504496

SEQ ID NO: 642482 - RNA, 64 nt, Homo Sapiens; identical to SEQ ID NO: 504497

SEQ ID NO: 642483 - RNA, 64 nt, Homo Sapiens; identical to SEQ ID NO: 504498

SEQ ID NO: 642484 - RNA, 64 nt, Homo Sapiens; identical to SEQ ID NO: 504499

SEQ ID NO: 642485 - RNA, 64 nt, Homo Sapiens; identical to SEQ ID NO: 504500

SEQ ID NO: 642486 - RNA, 64 nt, Homo Sapiens; identical to SEQ ID NO: 504501

SEQ ID NO: 642487 - RNA, 64 nt, Homo Sapiens; identical to SEQ ID NO: 504502

SEQ ID NO: 642488 - RNA, 64 nt, Homo Sapiens; identical to SEQ ID NO: 504503

SEQ ID NO: 642489 - RNA, 64 nt, Homo Sapiens; identical to SEQ ID NO: 504504

SEQ ID NO: 642490 - RNA, 64 nt, Homo Sapiens; identical to SEQ ID NO: 504505

SEQ ID NO: 642491 - RNA, 64 nt, Homo Sapiens; identical to SEQ ID NO: 504506

SEQ ID NO: 642492 - RNA, 64 nt, Homo Sapiens; identical to SEQ ID NO: 504507

SEQ ID NO: 642493 - RNA, 64 nt, Homo Sapiens; identical to SEQ ID NO: 504508

SEQ ID NO: 642494 - RNA, 64 nt, Homo Sapiens; identical to SEQ ID NO: 504509

SEQ ID NO: 642495 - RNA, 64 nt, Homo Sapiens; identical to SEQ ID NO: 504510

SEQ ID NO: 642496 - RNA, 64 nt, Homo Sapiens; identical to SEQ ID NO: 504511

SEQ ID NO: 642497 - RNA, 64 nt, Homo Sapiens; identical to SEQ ID NO: 504512

SEQ ID NO: 642498 - RNA, 64 nt, Homo Sapiens; identical to SEQ ID NO: 504513

SEQ ID NO: 642499 - RNA, 64 nt, Homo Sapiens; identical to SEQ ID NO: 504514

SEQ ID NO: 642500 - RNA, 64 nt, Homo Sapiens; identical to SEQ ID NO: 504515

SEQ ID NO: 642501 - RNA, 64 nt, Homo Sapiens; identical to SEQ ID NO: 504516

SEQ ID NO: 642502 - RNA, 64 nt, Homo Sapiens; identical to SEQ ID NO: 504517

SEQ ID NO: 642503 - RNA, 64 nt, Homo Sapiens; identical to SEQ ID NO: 504518

SEQ ID NO: 642504 - RNA, 64 nt, Homo Sapiens; identical to SEQ ID NO: 504519

SEQ ID NO: 642505 - RNA, 64 nt, Homo Sapiens; identical to SEQ ID NO: 504520

SEQ ID NO: 642506 - RNA, 64 nt, Homo Sapiens; identical to SEQ ID NO: 504521

SEQ ID NO: 642507 - RNA, 64 nt, Homo Sapiens; identical to SEQ ID NO: 504522

SEQ ID NO: 642508 - RNA, 64 nt, Homo Sapiens; identical to SEQ ID NO: 504523

SEQ ID NO: 642509 - RNA, 64 nt, Homo Sapiens; identical to SEQ ID NO: 504524

SEQ ID NO: 642510 - RNA, 64 nt, Homo Sapiens; identical to SEQ ID NO: 504525

SEQ ID NO: 642511 - RNA, 64 nt, Homo Sapiens; identical to SEQ ID NO: 504526

SEQ ID NO: 642512 - RNA, 64 nt, Homo Sapiens; identical to SEQ ID NO: 504527

SEQ ID NO: 642513 - RNA, 64 nt, Homo Sapiens; identical to SEQ ID NO: 504528

SEQ ID NO: 642514 - RNA, 64 nt, Homo Sapiens; identical to SEQ ID NO: 504529

SEQ ID NO: 642515 - RNA, 64 nt, Homo Sapiens; identical to SEQ ID NO: 504530

SEQ ID NO: 642516 - RNA, 64 nt, Homo Sapiens; identical to SEQ ID NO: 504531

SEQ ID NO: 642517 - RNA, 64 nt, Homo Sapiens; identical to SEQ ID NO: 504532

SEQ ID NO: 642518 - RNA, 64 nt, Homo Sapiens; identical to SEQ ID NO: 504533

SEQ ID NO: 642519 - RNA, 64 nt, Homo Sapiens; identical to SEQ ID NO: 504534

SEQ ID NO: 642520 - RNA, 64 nt, Homo Sapiens; identical to SEQ ID NO: 504535

SEQ ID NO: 642521 - RNA, 64 nt, Homo Sapiens; identical to SEQ ID NO: 504536

SEQ ID NO: 642522 - RNA, 64 nt, Homo Sapiens; identical to SEQ ID NO: 504537

SEQ ID NO: 642523 - RNA, 64 nt, Homo Sapiens; identical to SEQ ID NO: 504538

SEQ ID NO: 642524 - RNA, 64 nt, Homo Sapiens; identical to SEQ ID NO: 504539

SEQ ID NO: 642525 - RNA, 64 nt, Homo Sapiens; identical to SEQ ID NO: 504540

SEQ ID NO: 642526 - RNA, 64 nt, Homo Sapiens; identical to SEQ ID NO: 504541

SEQ ID NO: 642527 - RNA, 64 nt, Homo Sapiens; identical to SEQ ID NO: 504542

SEQ ID NO: 642528 - RNA, 64 nt, Homo Sapiens; identical to SEQ ID NO: 504543

SEQ ID NO: 642529 - RNA, 64 nt, Homo Sapiens; identical to SEQ ID NO: 504544

SEQ ID NO: 642530 - RNA, 64 nt, Homo Sapiens; identical to SEQ ID NO: 504545

SEQ ID NO: 642531 - RNA, 64 nt, Homo Sapiens; identical to SEQ ID NO: 504546

SEQ ID NO: 642532 - RNA, 64 nt, Homo Sapiens; identical to SEQ ID NO: 504547

SEQ ID NO: 642533 - RNA, 64 nt, Homo Sapiens; identical to SEQ ID NO: 504548

SEQ ID NO: 642534 - RNA, 64 nt, Homo Sapiens; identical to SEQ ID NO: 504549

SEQ ID NO: 642535 - RNA, 64 nt, Homo Sapiens; identical to SEQ ID NO: 504550

SEQ ID NO: 642536 - RNA, 64 nt, Homo Sapiens; identical to SEQ ID NO: 504551

SEQ ID NO: 642537 - RNA, 64 nt, Homo Sapiens; identical to SEQ ID NO: 504552

SEQ ID NO: 642538 - RNA, 64 nt, Homo Sapiens; identical to SEQ ID NO: 504553

SEQ ID NO: 642539 - RNA, 64 nt, Homo Sapiens; identical to SEQ ID NO: 504554

SEQ ID NO: 642540 - RNA, 64 nt, Homo Sapiens; identical to SEQ ID NO: 504555

SEQ ID NO: 642541 - RNA, 64 nt, Homo Sapiens; identical to SEQ ID NO: 504556

SEQ ID NO: 642542 - RNA, 64 nt, Homo Sapiens; identical to SEQ ID NO: 504557

SEQ ID NO: 642543 - RNA, 64 nt, Homo Sapiens; identical to SEQ ID NO: 504558

SEQ ID NO: 642544 - RNA, 64 nt, Homo Sapiens; identical to SEQ ID NO: 504559

SEQ ID NO: 642545 - RNA, 64 nt, Homo Sapiens; identical to SEQ ID NO: 504560

SEQ ID NO: 642546 - RNA, 64 nt, Homo Sapiens; identical to SEQ ID NO: 504561

SEQ ID NO: 642547 - RNA, 64 nt, Homo Sapiens; identical to SEQ ID NO: 504562

SEQ ID NO: 642548 - RNA, 64 nt, Homo Sapiens; identical to SEQ ID NO: 504563

SEQ ID NO: 642549 - RNA, 64 nt, Homo Sapiens; identical to SEQ ID NO: 504564

SEQ ID NO: 642550 - RNA, 64 nt, Homo Sapiens; identical to SEQ ID NO: 504565

SEQ ID NO: 642551 - RNA, 64 nt, Homo Sapiens; identical to SEQ ID NO: 504566

SEQ ID NO: 642552 - RNA, 64 nt, Homo Sapiens; identical to SEQ ID NO: 504567

SEQ ID NO: 642553 - RNA, 64 nt, Homo Sapiens; identical to SEQ ID NO: 504568

SEQ ID NO: 642554 - RNA, 64 nt, Homo Sapiens; identical to SEQ ID NO: 504569

SEQ ID NO: 642555 - RNA, 64 nt, Homo Sapiens; identical to SEQ ID NO: 504570

SEQ ID NO: 642556 - RNA, 64 nt, Homo Sapiens; identical to SEQ ID NO: 504571

SEQ ID NO: 642557 - RNA, 64 nt, Homo Sapiens; identical to SEQ ID NO: 504572

SEQ ID NO: 642558 - RNA, 64 nt, Homo Sapiens; identical to SEQ ID NO: 504573

SEQ ID NO: 642559 - RNA, 64 nt, Homo Sapiens; identical to SEQ ID NO: 504574

SEQ ID NO: 642560 - RNA, 64 nt, Homo Sapiens; identical to SEQ ID NO: 504575

SEQ ID NO: 642561 - RNA, 64 nt, Homo Sapiens; identical to SEQ ID NO: 504576

SEQ ID NO: 642562 - RNA, 64 nt, Homo Sapiens; identical to SEQ ID NO: 504577

SEQ ID NO: 642563 - RNA, 64 nt, Homo Sapiens; identical to SEQ ID NO: 504578

SEQ ID NO: 642564 - RNA, 64 nt, Homo Sapiens; identical to SEQ ID NO: 504579

SEQ ID NO: 642565 - RNA, 64 nt, Homo Sapiens; identical to SEQ ID NO: 504580

SEQ ID NO: 642566 - RNA, 64 nt, Homo Sapiens; identical to SEQ ID NO: 504581

SEQ ID NO: 642567 - RNA, 64 nt, Homo Sapiens; identical to SEQ ID NO: 504582

SEQ ID NO: 642568 - RNA, 64 nt, Homo Sapiens; identical to SEQ ID NO: 504583

SEQ ID NO: 642569 - RNA, 64 nt, Homo Sapiens; identical to SEQ ID NO: 504584

SEQ ID NO: 642570 - RNA, 64 nt, Homo Sapiens; identical to SEQ ID NO: 504585

SEQ ID NO: 642571 - RNA, 64 nt, Homo Sapiens; identical to SEQ ID NO: 504586

SEQ ID NO: 642572 - RNA, 64 nt, Homo Sapiens; identical to SEQ ID NO: 504587

SEQ ID NO: 642573 - RNA, 64 nt, Homo Sapiens; identical to SEQ ID NO: 504588

SEQ ID NO: 642574 - RNA, 64 nt, Homo Sapiens; identical to SEQ ID NO: 504589

SEQ ID NO: 642575 - RNA, 64 nt, Homo Sapiens; identical to SEQ ID NO: 504590

SEQ ID NO: 642576 - RNA, 64 nt, Homo Sapiens; identical to SEQ ID NO: 504591

SEQ ID NO: 642577 - RNA, 64 nt, Homo Sapiens; identical to SEQ ID NO: 504592

SEQ ID NO: 642578 - RNA, 64 nt, Homo Sapiens; identical to SEQ ID NO: 504593

SEQ ID NO: 642579 - RNA, 64 nt, Homo Sapiens; identical to SEQ ID NO: 504594

SEQ ID NO: 642580 - RNA, 64 nt, Homo Sapiens; identical to SEQ ID NO: 504595

SEQ ID NO: 642581 - RNA, 64 nt, Homo Sapiens; identical to SEQ ID NO: 504596

SEQ ID NO: 642582 - RNA, 64 nt, Homo Sapiens; identical to SEQ ID NO: 504597

SEQ ID NO: 642583 - RNA, 64 nt, Homo Sapiens; identical to SEQ ID NO: 504598

SEQ ID NO: 642584 - RNA, 64 nt, Homo Sapiens; identical to SEQ ID NO: 504599

SEQ ID NO: 642585 - RNA, 64 nt, Homo Sapiens; identical to SEQ ID NO: 504600

SEQ ID NO: 642586 - RNA, 64 nt, Homo Sapiens; identical to SEQ ID NO: 504601

SEQ ID NO: 642587 - RNA, 64 nt, Homo Sapiens; identical to SEQ ID NO: 504602

SEQ ID NO: 642588 - RNA, 64 nt, Homo Sapiens; identical to SEQ ID NO: 504603

SEQ ID NO: 642589 - RNA, 64 nt, Homo Sapiens; identical to SEQ ID NO: 504604

SEQ ID NO: 642590 - RNA, 64 nt, Homo Sapiens; identical to SEQ ID NO: 504605

SEQ ID NO: 642591 - RNA, 64 nt, Homo Sapiens; identical to SEQ ID NO: 504606

SEQ ID NO: 642592 - RNA, 64 nt, Homo Sapiens; identical to SEQ ID NO: 504607

SEQ ID NO: 642593 - RNA, 64 nt, Homo Sapiens; identical to SEQ ID NO: 504608

SEQ ID NO: 642594 - RNA, 64 nt, Homo Sapiens; identical to SEQ ID NO: 504609

SEQ ID NO: 642595 - RNA, 64 nt, Homo Sapiens; identical to SEQ ID NO: 504610

SEQ ID NO: 642596 - RNA, 50 nt, Homo Sapiens; identical to SEQ ID NO: 504611

SEQ ID NO: 642597 - RNA, 64 nt, Homo Sapiens; identical to SEQ ID NO: 504612

SEQ ID NO: 642598 - RNA, 64 nt, Homo Sapiens; identical to SEQ ID NO: 504613

SEQ ID NO: 642599 - RNA, 64 nt, Homo Sapiens; identical to SEQ ID NO: 504614

SEQ ID NO: 642600 - RNA, 64 nt, Homo Sapiens; identical to SEQ ID NO: 504615

SEQ ID NO: 642601 - RNA, 64 nt, Homo Sapiens; identical to SEQ ID NO: 504616

SEQ ID NO: 642602 - RNA, 64 nt, Homo Sapiens; identical to SEQ ID NO: 504617

SEQ ID NO: 642603 - RNA, 64 nt, Homo Sapiens; identical to SEQ ID NO: 504618

SEQ ID NO: 642604 - RNA, 64 nt, Homo Sapiens; identical to SEQ ID NO: 504619

SEQ ID NO: 642605 - RNA, 64 nt, Homo Sapiens; identical to SEQ ID NO: 504620

SEQ ID NO: 642606 - RNA, 64 nt, Homo Sapiens; identical to SEQ ID NO: 504621

SEQ ID NO: 642607 - RNA, 64 nt, Homo Sapiens; identical to SEQ ID NO: 504622

SEQ ID NO: 642608 - RNA, 64 nt, Homo Sapiens; identical to SEQ ID NO: 504623

SEQ ID NO: 642609 - RNA, 64 nt, Homo Sapiens; identical to SEQ ID NO: 504624

SEQ ID NO: 642610 - RNA, 64 nt, Homo Sapiens; identical to SEQ ID NO: 504625

SEQ ID NO: 642611 - RNA, 64 nt, Homo Sapiens; identical to SEQ ID NO: 504626

SEQ ID NO: 642612 - RNA, 64 nt, Homo Sapiens; identical to SEQ ID NO: 210199

SEQ ID NO: 642613 - RNA, 64 nt, Homo Sapiens; identical to SEQ ID NO: 210200

SEQ ID NO: 642614 - RNA, 64 nt, Homo Sapiens; identical to SEQ ID NO: 210201

SEQ ID NO: 642615 - RNA, 64 nt, Homo Sapiens; identical to SEQ ID NO: 210202

SEQ ID NO: 642616 - RNA, 64 nt, Homo Sapiens; identical to SEQ ID NO: 210203

SEQ ID NO: 642617 - RNA, 64 nt, Homo Sapiens; identical to SEQ ID NO: 210204

SEQ ID NO: 642618 - RNA, 64 nt, Homo Sapiens; identical to SEQ ID NO: 210205

SEQ ID NO: 642619 - RNA, 64 nt, Homo Sapiens; identical to SEQ ID NO: 210206

SEQ ID NO: 642620 - RNA, 64 nt, Homo Sapiens; identical to SEQ ID NO: 210207

SEQ ID NO: 642621 - RNA, 64 nt, Homo Sapiens; identical to SEQ ID NO: 210208

SEQ ID NO: 642622 - RNA, 64 nt, Homo Sapiens; identical to SEQ ID NO: 210209

SEQ ID NO: 642623 - RNA, 64 nt, Homo Sapiens; identical to SEQ ID NO: 210210

SEQ ID NO: 642624 - RNA, 64 nt, Homo Sapiens; identical to SEQ ID NO: 210211

SEQ ID NO: 642625 - RNA, 60 nt, Homo Sapiens; identical to SEQ ID NO: 44968

SEQ ID NO: 642626 - RNA, 64 nt, Homo Sapiens; identical to SEQ ID NO: 210213

SEQ ID NO: 642627 - RNA, 64 nt, Homo Sapiens; identical to SEQ ID NO: 210214

SEQ ID NO: 642628 - RNA, 64 nt, Homo Sapiens; identical to SEQ ID NO: 210215

SEQ ID NO: 642629 - RNA, 64 nt, Homo Sapiens; identical to SEQ ID NO: 210216

SEQ ID NO: 642630 - RNA, 64 nt, Homo Sapiens; identical to SEQ ID NO: 532477

SEQ ID NO: 642631 - RNA, 64 nt, Homo Sapiens; identical to SEQ ID NO: 532478

SEQ ID NO: 642632 - RNA, 64 nt, Homo Sapiens; identical to SEQ ID NO: 532479

SEQ ID NO: 642633 - RNA, 64 nt, Homo Sapiens; identical to SEQ ID NO: 532480

SEQ ID NO: 642634 - RNA, 64 nt, Homo Sapiens; identical to SEQ ID NO: 532481

SEQ ID NO: 642635 - RNA, 64 nt, Homo Sapiens; identical to SEQ ID NO: 532482

SEQ ID NO: 642636 - RNA, 64 nt, Homo Sapiens; identical to SEQ ID NO: 532483

SEQ ID NO: 642637 - RNA, 64 nt, Homo Sapiens; identical to SEQ ID NO: 532484

SEQ ID NO: 642638 - RNA, 64 nt, Homo Sapiens; identical to SEQ ID NO: 532485

SEQ ID NO: 642639 - RNA, 64 nt, Homo Sapiens; identical to SEQ ID NO: 532486

SEQ ID NO: 642640 - RNA, 64 nt, Homo Sapiens; identical to SEQ ID NO: 532487

SEQ ID NO: 642641 - RNA, 64 nt, Homo Sapiens; identical to SEQ ID NO: 532488

SEQ ID NO: 642642 - RNA, 64 nt, Homo Sapiens; identical to SEQ ID NO: 532489

SEQ ID NO: 642643 - RNA, 64 nt, Homo Sapiens; identical to SEQ ID NO: 532490

SEQ ID NO: 642644 - RNA, 64 nt, Homo Sapiens; identical to SEQ ID NO: 532491

SEQ ID NO: 642645 - RNA, 64 nt, Homo Sapiens; identical to SEQ ID NO: 532492

SEQ ID NO: 642646 - RNA, 64 nt, Homo Sapiens; identical to SEQ ID NO: 532493

SEQ ID NO: 642647 - RNA, 64 nt, Homo Sapiens; identical to SEQ ID NO: 532494

SEQ ID NO: 642648 - RNA, 64 nt, Homo Sapiens; identical to SEQ ID NO: 532495

SEQ ID NO: 642649 - RNA, 64 nt, Homo Sapiens; identical to SEQ ID NO: 532496

SEQ ID NO: 642650 - RNA, 64 nt, Homo Sapiens; identical to SEQ ID NO: 532497

SEQ ID NO: 642651 - RNA, 64 nt, Homo Sapiens
aaguacucaguaauacaguacaguauucaguaaggcagugaaguacucaguaauacaauacagu

SEQ ID NO: 642652 - RNA, 64 nt, Homo Sapiens
cagugcucaauaaggcagugcagugcucaguaaggcagugaauugcuuaguaacacaguguagu

SEQ ID NO: 642653 - RNA, 64 nt, Homo Sapiens
gauuccaucauugaaaauuuugacccaaggcacagcagugaaauuuauaguucucaauuuaguu

SEQ ID NO: 642654 - RNA, 64 nt, Homo Sapiens
uucacugugguacauuuuaaaauaaaauauuuuagcagugaauauggauuaagguguuuugggu

SEQ ID NO: 642655 - RNA, 64 nt, Homo Sapiens
uauggaagagcgguagggaguccacggagaagaugcagugaaugcuugcaugcauucacacgug

SEQ ID NO: 642656 - RNA, 64 nt, Homo Sapiens
cgugcgugguggaggcuggccucucuggcugggugcagugaauggccagcggguuucuuuucug

SEQ ID NO: 642657 - RNA, 64 nt, Homo Sapiens
cccaugaacauuuguccuaacucagauuuugugagcagugaaguuuaacagagcagugacauuu

SEQ ID NO: 642658 - RNA, 64 nt, Homo Sapiens
agugaaguuuaacagagcagugacauuuaacaaagcagugaaguuuaacagaguucugagaaua

SEQ ID NO: 642659 - RNA, 64 nt, Homo Sapiens
agaacccucauaauuuuuaaaugaucugaauuuggcagugaauuuuuuuuuaagccacuuaauu

SEQ ID NO: 642660 - RNA, 64 nt, Homo Sapiens
gaagcacuguacaaguuugugguuccuaagccccgcagugaauguucaaagccagagcagcugg

SEQ ID NO: 642661 - RNA, 64 nt, Homo Sapiens
uaucaagaggcugcgccugugcggauagacuuccgcagugaagagugcgccaggugcuggcccu

SEQ ID NO: 642662 - RNA, 64 nt, Homo Sapiens
caucuccacucugaagaagacaacguggaagucugcagugaaaaaucucccaggugacucugaa

SEQ ID NO: 642663 - RNA, 64 nt, Homo Sapiens
ggaagacuugacugcaaauaguuuucuucacagugcagugaauuacaaaauguucugcuagcuu

SEQ ID NO: 642664 - RNA, 64 nt, Homo Sapiens
gauaaagaaaaaaaaguacaugauaguuguucuagcagugaagaaauuguacugaauugcaaau

SEQ ID NO: 642665 - RNA, 64 nt, Homo Sapiens
cagaaaauucacacuggagagaaaccuuaugaaugcagugaaugugggaaagcuuuuauucaga

SEQ ID NO: 642666 - RNA, 64 nt, Homo Sapiens
auucaaaugauagaauaguauacagcacuuaaaagcagugaaccagauccauauuguguaacau

SEQ ID NO: 642667 - RNA, 64 nt, Homo Sapiens
cagagaguucacucuggagagaggccuuaugaaugcagugaauguggcaaauucuuuguggaca

SEQ ID NO: 642668 - RNA, 64 nt, Homo Sapiens
gagagaguucauacuggagaaaagccuuaugagugcagugaaugugggaaagucuuuagauaca

SEQ ID NO: 642669 - RNA, 64 nt, Homo Sapiens
cggagaauucacacuggagagagaccuuaucagugcagugaauguggaagagucuuuaaccaaa

SEQ ID NO: 642670 - RNA, 64 nt, Homo Sapiens
aguuaagaugucaccguagcguauagauugcugggcagugaaacguguccccaagugacaauac

SEQ ID NO: 642671 - RNA, 52 nt, Homo Sapiens
ugggaaaucguuugcugaaagugcagugaauaacaggagaaaggccuuauga

SEQ ID NO: 642672 - RNA, 64 nt, Homo Sapiens
uccuugcccacuguuucuucgcccuccuguggacuagcacaacuuugccauuucuucugaaccg

SEQ ID NO: 642673 - RNA, 64 nt, Homo Sapiens
aguuuugcuuuuacuggccaccgaguguuccguauagcacaaagucccugguuuuguaauacuc

SEQ ID NO: 642674 - RNA, 64 nt, Homo Sapiens
aaacgaaaugauggaaaugcaucugucaucuucauagcacaacaauaguuaccauuuuuuccug

SEQ ID NO: 642675 - RNA, 64 nt, Homo Sapiens
aaucuaauuuauagcaaguguuuuauugugugguuagcacaaggguaugguuugggggaggcua

SEQ ID NO: 642676 - RNA, 64 nt, Homo Sapiens
uauaauuuuuaccuucauauuacauuaaaaacuguagcacaaucuaauuuaucaaugcaaacag

SEQ ID NO: 642677 - RNA, 64 nt, Homo Sapiens
aauuuccuuaaaauuucauaaaugcuuccugaaauagcacaauaguuggaaaauauuuuuuuga

SEQ ID NO: 642678 - RNA, 64 nt, Homo Sapiens
aggaaguuggacagaacauuacugugcucucuaguagcacaaggccuugacacaaggacuccac

SEQ ID NO: 642679 - RNA, 64 nt, Homo Sapiens
acuugcaugcagagaucccugguaggguggucuuuagcacaaaggacuucuuggaauuaucaga

SEQ ID NO: 642680 - RNA, 64 nt, Homo Sapiens
caaauuccauccaagaggagcacaaaagucuugauagcacaacagucccuguuugaaagauuag

SEQ ID NO: 642681 - RNA, 64 nt, Homo Sapiens
gucuugauagcacaacacaaccuguuugaaagauuagcacaaaaaagguuugccucaaaauguc

SEQ ID NO: 642682 - RNA, 64 nt, Homo Sapiens; identical to SEQ ID NO: 165822

SEQ ID NO: 642683 - RNA, 64 nt, Homo Sapiens; identical to SEQ ID NO: 165823

SEQ ID NO: 642684 - RNA, 64 nt, Homo Sapiens; identical to SEQ ID NO: 189259

SEQ ID NO: 642685 - RNA, 64 nt, Homo Sapiens; identical to SEQ ID NO: 189260

SEQ ID NO: 642686 - RNA, 64 nt, Homo Sapiens; identical to SEQ ID NO: 189261

SEQ ID NO: 642687 - RNA, 64 nt, Homo Sapiens; identical to SEQ ID NO: 189262

SEQ ID NO: 642688 - RNA, 56 nt, Homo Sapiens; identical to SEQ ID NO: 189263

SEQ ID NO: 642689 - RNA, 64 nt, Homo Sapiens; identical to SEQ ID NO: 189264

SEQ ID NO: 642690 - RNA, 64 nt, Homo Sapiens; identical to SEQ ID NO: 189265

SEQ ID NO: 642691 - RNA, 64 nt, Homo Sapiens; identical to SEQ ID NO: 189266

SEQ ID NO: 642692 - RNA, 64 nt, Homo Sapiens; identical to SEQ ID NO: 189267

SEQ ID NO: 642693 - RNA, 64 nt, Homo Sapiens; identical to SEQ ID NO: 189268

SEQ ID NO: 642694 - RNA, 64 nt, Homo Sapiens; identical to SEQ ID NO: 189269

SEQ ID NO: 642695 - RNA, 64 nt, Homo Sapiens; identical to SEQ ID NO: 189270

SEQ ID NO: 642696 - RNA, 64 nt, Homo Sapiens; identical to SEQ ID NO: 189271

SEQ ID NO: 642697 - RNA, 64 nt, Homo Sapiens; identical to SEQ ID NO: 189272

SEQ ID NO: 642698 - RNA, 64 nt, Homo Sapiens; identical to SEQ ID NO: 189273

SEQ ID NO: 642699 - RNA, 64 nt, Homo Sapiens; identical to SEQ ID NO: 189274

SEQ ID NO: 642700 - RNA, 64 nt, Homo Sapiens; identical to SEQ ID NO: 189275

SEQ ID NO: 642701 - RNA, 64 nt, Homo Sapiens; identical to SEQ ID NO: 189276

SEQ ID NO: 642702 - RNA, 64 nt, Homo Sapiens; identical to SEQ ID NO: 189277

SEQ ID NO: 642703 - RNA, 64 nt, Homo Sapiens; identical to SEQ ID NO: 189278

SEQ ID NO: 642704 - RNA, 64 nt, Homo Sapiens; identical to SEQ ID NO: 189279

SEQ ID NO: 642705 - RNA, 64 nt, Homo Sapiens; identical to SEQ ID NO: 189280

SEQ ID NO: 642706 - RNA, 64 nt, Homo Sapiens; identical to SEQ ID NO: 524136

SEQ ID NO: 642707 - RNA, 64 nt, Homo Sapiens; identical to SEQ ID NO: 524137

SEQ ID NO: 642708 - RNA, 64 nt, Homo Sapiens
uuucuauuuggcauagcuaacuacacuuugauacuaacuccaguuuuacuauuauuauuuuggu

SEQ ID NO: 642709 - RNA, 64 nt, Homo Sapiens
uucucauaacauauaugagguauacaaaauuuucuaacuccagauuguagucauuuugagaggu

SEQ ID NO: 642710 - RNA, 64 nt, Homo Sapiens
gaccaaucucuugaaucccauaucuacccagaauuaacuccauuccagucucugcauguaauca

SEQ ID NO: 642711 - RNA, 64 nt, Homo Sapiens
aguugauggugguaaacauucucucaggagacaauaacuccagugauguucuucaaagauuuua

SEQ ID NO: 642712 - RNA, 64 nt, Homo Sapiens; identical to SEQ ID NO: 110784

SEQ ID NO: 642713 - RNA, 64 nt, Homo Sapiens; identical to SEQ ID NO: 110785

SEQ ID NO: 642714 - RNA, 64 nt, Homo Sapiens; identical to SEQ ID NO: 110786

SEQ ID NO: 642715 - RNA, 64 nt, Homo Sapiens; identical to SEQ ID NO: 110787

SEQ ID NO: 642716 - RNA, 64 nt, Homo Sapiens; identical to SEQ ID NO: 110788

SEQ ID NO: 642717 - RNA, 64 nt, Homo Sapiens; identical to SEQ ID NO: 110789

SEQ ID NO: 642718 - RNA, 64 nt, Homo Sapiens; identical to SEQ ID NO: 110790

SEQ ID NO: 642719 - RNA, 64 nt, Homo Sapiens; identical to SEQ ID NO: 110791

SEQ ID NO: 642720 - RNA, 64 nt, Homo Sapiens; identical to SEQ ID NO: 110792

SEQ ID NO: 642721 - RNA, 64 nt, Homo Sapiens; identical to SEQ ID NO: 110793

SEQ ID NO: 642722 - RNA, 64 nt, Homo Sapiens; identical to SEQ ID NO: 110794

SEQ ID NO: 642723 - RNA, 64 nt, Homo Sapiens; identical to SEQ ID NO: 110795

SEQ ID NO: 642724 - RNA, 64 nt, Homo Sapiens; identical to SEQ ID NO: 110796

SEQ ID NO: 642725 - RNA, 64 nt, Homo Sapiens; identical to SEQ ID NO: 110797

SEQ ID NO: 642726 - RNA, 64 nt, Homo Sapiens; identical to SEQ ID NO: 110798

SEQ ID NO: 642727 - RNA, 64 nt, Homo Sapiens; identical to SEQ ID NO: 110799

SEQ ID NO: 642728 - RNA, 64 nt, Homo Sapiens; identical to SEQ ID NO: 47675

SEQ ID NO: 642729 - RNA, 64 nt, Homo Sapiens; identical to SEQ ID NO: 47676

SEQ ID NO: 642730 - RNA, 64 nt, Homo Sapiens; identical to SEQ ID NO: 47677

SEQ ID NO: 642731 - RNA, 64 nt, Homo Sapiens; identical to SEQ ID NO: 47678

SEQ ID NO: 642732 - RNA, 64 nt, Homo Sapiens; identical to SEQ ID NO: 47679

SEQ ID NO: 642733 - RNA, 64 nt, Homo Sapiens; identical to SEQ ID NO: 47680

SEQ ID NO: 642734 - RNA, 64 nt, Homo Sapiens; identical to SEQ ID NO: 47681

SEQ ID NO: 642735 - RNA, 64 nt, Homo Sapiens; identical to SEQ ID NO: 47682

SEQ ID NO: 642736 - RNA, 64 nt, Homo Sapiens; identical to SEQ ID NO: 47683

SEQ ID NO: 642737 - RNA, 64 nt, Homo Sapiens; identical to SEQ ID NO: 47684

SEQ ID NO: 642738 - RNA, 64 nt, Homo Sapiens; identical to SEQ ID NO: 47685

SEQ ID NO: 642739 - RNA, 64 nt, Homo Sapiens; identical to SEQ ID NO: 47686

SEQ ID NO: 642740 - RNA, 64 nt, Homo Sapiens; identical to SEQ ID NO: 47687

SEQ ID NO: 642741 - RNA, 64 nt, Homo Sapiens; identical to SEQ ID NO: 47688

SEQ ID NO: 642742 - RNA, 64 nt, Homo Sapiens; identical to SEQ ID NO: 390683

SEQ ID NO: 642743 - RNA, 64 nt, Homo Sapiens; identical to SEQ ID NO: 390684

SEQ ID NO: 642744 - RNA, 64 nt, Homo Sapiens; identical to SEQ ID NO: 390685

SEQ ID NO: 642745 - RNA, 64 nt, Homo Sapiens; identical to SEQ ID NO: 390686

SEQ ID NO: 642746 - RNA, 64 nt, Homo Sapiens; identical to SEQ ID NO: 390687

SEQ ID NO: 642747 - RNA, 64 nt, Homo Sapiens; identical to SEQ ID NO: 390688

SEQ ID NO: 642748 - RNA, 64 nt, Homo Sapiens; identical to SEQ ID NO: 390689

SEQ ID NO: 642749 - RNA, 64 nt, Homo Sapiens; identical to SEQ ID NO: 390690

SEQ ID NO: 642750 - RNA, 64 nt, Homo Sapiens; identical to SEQ ID NO: 390691

SEQ ID NO: 642751 - RNA, 64 nt, Homo Sapiens; identical to SEQ ID NO: 390692

SEQ ID NO: 642752 - RNA, 64 nt, Homo Sapiens; identical to SEQ ID NO: 390693

SEQ ID NO: 642753 - RNA, 64 nt, Homo Sapiens; identical to SEQ ID NO: 390694

SEQ ID NO: 642754 - RNA, 64 nt, Homo Sapiens; identical to SEQ ID NO: 390695

SEQ ID NO: 642755 - RNA, 64 nt, Homo Sapiens; identical to SEQ ID NO: 390696

SEQ ID NO: 642756 - RNA, 64 nt, Homo Sapiens; identical to SEQ ID NO: 390697

SEQ ID NO: 642757 - RNA, 64 nt, Homo Sapiens; identical to SEQ ID NO: 390698

SEQ ID NO: 642758 - RNA, 64 nt, Homo Sapiens; identical to SEQ ID NO: 390699

SEQ ID NO: 642759 - RNA, 64 nt, Homo Sapiens; identical to SEQ ID NO: 390700

SEQ ID NO: 642760 - RNA, 64 nt, Homo Sapiens; identical to SEQ ID NO: 390701

SEQ ID NO: 642761 - RNA, 64 nt, Homo Sapiens; identical to SEQ ID NO: 390702

SEQ ID NO: 642762 - RNA, 64 nt, Homo Sapiens; identical to SEQ ID NO: 390703

SEQ ID NO: 642763 - RNA, 64 nt, Homo Sapiens; identical to SEQ ID NO: 390704

SEQ ID NO: 642764 - RNA, 64 nt, Homo Sapiens; identical to SEQ ID NO: 390705

SEQ ID NO: 642765 - RNA, 64 nt, Homo Sapiens; identical to SEQ ID NO: 390706

SEQ ID NO: 642766 - RNA, 64 nt, Homo Sapiens; identical to SEQ ID NO: 390707

SEQ ID NO: 642767 - RNA, 64 nt, Homo Sapiens; identical to SEQ ID NO: 390708

SEQ ID NO: 642768 - RNA, 64 nt, Homo Sapiens; identical to SEQ ID NO: 390709

SEQ ID NO: 642769 - RNA, 64 nt, Homo Sapiens; identical to SEQ ID NO: 390710

SEQ ID NO: 642770 - RNA, 64 nt, Homo Sapiens; identical to SEQ ID NO: 390711

SEQ ID NO: 642771 - RNA, 64 nt, Homo Sapiens; identical to SEQ ID NO: 390712

SEQ ID NO: 642772 - RNA, 64 nt, Homo Sapiens; identical to SEQ ID NO: 390713

SEQ ID NO: 642773 - RNA, 64 nt, Homo Sapiens; identical to SEQ ID NO: 390714

SEQ ID NO: 642774 - RNA, 64 nt, Homo Sapiens; identical to SEQ ID NO: 390715

SEQ ID NO: 642775 - RNA, 64 nt, Homo Sapiens; identical to SEQ ID NO: 390716

SEQ ID NO: 642776 - RNA, 64 nt, Homo Sapiens; identical to SEQ ID NO: 390717

SEQ ID NO: 642777 - RNA, 64 nt, Homo Sapiens; identical to SEQ ID NO: 390718

SEQ ID NO: 642778 - RNA, 64 nt, Homo Sapiens; identical to SEQ ID NO: 390719

SEQ ID NO: 642779 - RNA, 64 nt, Homo Sapiens; identical to SEQ ID NO: 390720

SEQ ID NO: 642780 - RNA, 64 nt, Homo Sapiens; identical to SEQ ID NO: 390721

SEQ ID NO: 642781 - RNA, 64 nt, Homo Sapiens; identical to SEQ ID NO: 390722

SEQ ID NO: 642782 - RNA, 64 nt, Homo Sapiens; identical to SEQ ID NO: 390723

SEQ ID NO: 642783 - RNA, 64 nt, Homo Sapiens; identical to SEQ ID NO: 390724

SEQ ID NO: 642784 - RNA, 64 nt, Homo Sapiens; identical to SEQ ID NO: 390725

SEQ ID NO: 642785 - RNA, 64 nt, Homo Sapiens; identical to SEQ ID NO: 390726

SEQ ID NO: 642786 - RNA, 64 nt, Homo Sapiens; identical to SEQ ID NO: 390727

SEQ ID NO: 642787 - RNA, 64 nt, Homo Sapiens; identical to SEQ ID NO: 390728

SEQ ID NO: 642788 - RNA, 64 nt, Homo Sapiens; identical to SEQ ID NO: 390729

SEQ ID NO: 642789 - RNA, 64 nt, Homo Sapiens; identical to SEQ ID NO: 390730

SEQ ID NO: 642790 - RNA, 64 nt, Homo Sapiens; identical to SEQ ID NO: 390731

SEQ ID NO: 642791 - RNA, 64 nt, Homo Sapiens; identical to SEQ ID NO: 390732

SEQ ID NO: 642792 - RNA, 64 nt, Homo Sapiens; identical to SEQ ID NO: 390733

SEQ ID NO: 642793 - RNA, 64 nt, Homo Sapiens; identical to SEQ ID NO: 390734

SEQ ID NO: 642794 - RNA, 64 nt, Homo Sapiens; identical to SEQ ID NO: 390735

SEQ ID NO: 642795 - RNA, 64 nt, Homo Sapiens; identical to SEQ ID NO: 390736

SEQ ID NO: 642796 - RNA, 64 nt, Homo Sapiens; identical to SEQ ID NO: 390737

SEQ ID NO: 642797 - RNA, 64 nt, Homo Sapiens; identical to SEQ ID NO: 390738

SEQ ID NO: 642798 - RNA, 64 nt, Homo Sapiens; identical to SEQ ID NO: 390739

SEQ ID NO: 642799 - RNA, 64 nt, Homo Sapiens; identical to SEQ ID NO: 390740

SEQ ID NO: 642800 - RNA, 64 nt, Homo Sapiens; identical to SEQ ID NO: 390741

SEQ ID NO: 642801 - RNA, 64 nt, Homo Sapiens; identical to SEQ ID NO: 390742

SEQ ID NO: 642802 - RNA, 64 nt, Homo Sapiens; identical to SEQ ID NO: 390743

SEQ ID NO: 642803 - RNA, 64 nt, Homo Sapiens; identical to SEQ ID NO: 47675

SEQ ID NO: 642804 - RNA, 64 nt, Homo Sapiens; identical to SEQ ID NO: 47676

SEQ ID NO: 642805 - RNA, 64 nt, Homo Sapiens; identical to SEQ ID NO: 47677

SEQ ID NO: 642806 - RNA, 64 nt, Homo Sapiens; identical to SEQ ID NO: 47678

SEQ ID NO: 642807 - RNA, 64 nt, Homo Sapiens; identical to SEQ ID NO: 47679

SEQ ID NO: 642808 - RNA, 64 nt, Homo Sapiens; identical to SEQ ID NO: 47680

SEQ ID NO: 642809 - RNA, 64 nt, Homo Sapiens; identical to SEQ ID NO: 47681

SEQ ID NO: 642810 - RNA, 64 nt, Homo Sapiens; identical to SEQ ID NO: 47682

SEQ ID NO: 642811 - RNA, 64 nt, Homo Sapiens; identical to SEQ ID NO: 47683

SEQ ID NO: 642812 - RNA, 64 nt, Homo Sapiens; identical to SEQ ID NO: 47684

SEQ ID NO: 642813 - RNA, 64 nt, Homo Sapiens; identical to SEQ ID NO: 47685

SEQ ID NO: 642814 - RNA, 64 nt, Homo Sapiens; identical to SEQ ID NO: 47686

SEQ ID NO: 642815 - RNA, 64 nt, Homo Sapiens; identical to SEQ ID NO: 47687

SEQ ID NO: 642816 - RNA, 64 nt, Homo Sapiens; identical to SEQ ID NO: 47688

SEQ ID NO: 642817 - RNA, 64 nt, Homo Sapiens; identical to SEQ ID NO: 390683

SEQ ID NO: 642818 - RNA, 64 nt, Homo Sapiens; identical to SEQ ID NO: 390684

SEQ ID NO: 642819 - RNA, 64 nt, Homo Sapiens; identical to SEQ ID NO: 390685

SEQ ID NO: 642820 - RNA, 64 nt, Homo Sapiens; identical to SEQ ID NO: 390686

SEQ ID NO: 642821 - RNA, 64 nt, Homo Sapiens; identical to SEQ ID NO: 390687

SEQ ID NO: 642822 - RNA, 64 nt, Homo Sapiens; identical to SEQ ID NO: 390688

SEQ ID NO: 642823 - RNA, 64 nt, Homo Sapiens; identical to SEQ ID NO: 390689

SEQ ID NO: 642824 - RNA, 64 nt, Homo Sapiens; identical to SEQ ID NO: 390690

SEQ ID NO: 642825 - RNA, 64 nt, Homo Sapiens; identical to SEQ ID NO: 390691

SEQ ID NO: 642826 - RNA, 64 nt, Homo Sapiens; identical to SEQ ID NO: 390692

SEQ ID NO: 642827 - RNA, 64 nt, Homo Sapiens; identical to SEQ ID NO: 390693

SEQ ID NO: 642828 - RNA, 64 nt, Homo Sapiens; identical to SEQ ID NO: 390694

SEQ ID NO: 642829 - RNA, 64 nt, Homo Sapiens; identical to SEQ ID NO: 390695

SEQ ID NO: 642830 - RNA, 64 nt, Homo Sapiens; identical to SEQ ID NO: 390696

SEQ ID NO: 642831 - RNA, 64 nt, Homo Sapiens; identical to SEQ ID NO: 390697

SEQ ID NO: 642832 - RNA, 64 nt, Homo Sapiens; identical to SEQ ID NO: 390698

SEQ ID NO: 642833 - RNA, 64 nt, Homo Sapiens; identical to SEQ ID NO: 390699

SEQ ID NO: 642834 - RNA, 64 nt, Homo Sapiens; identical to SEQ ID NO: 390700

SEQ ID NO: 642835 - RNA, 64 nt, Homo Sapiens; identical to SEQ ID NO: 390701

SEQ ID NO: 642836 - RNA, 64 nt, Homo Sapiens; identical to SEQ ID NO: 390702

SEQ ID NO: 642837 - RNA, 64 nt, Homo Sapiens; identical to SEQ ID NO: 390703

SEQ ID NO: 642838 - RNA, 64 nt, Homo Sapiens; identical to SEQ ID NO: 390704

SEQ ID NO: 642839 - RNA, 64 nt, Homo Sapiens; identical to SEQ ID NO: 390705

SEQ ID NO: 642840 - RNA, 64 nt, Homo Sapiens; identical to SEQ ID NO: 390706

SEQ ID NO: 642841 - RNA, 64 nt, Homo Sapiens; identical to SEQ ID NO: 390707

SEQ ID NO: 642842 - RNA, 64 nt, Homo Sapiens; identical to SEQ ID NO: 390708

SEQ ID NO: 642843 - RNA, 64 nt, Homo Sapiens; identical to SEQ ID NO: 390709

SEQ ID NO: 642844 - RNA, 64 nt, Homo Sapiens; identical to SEQ ID NO: 390710

SEQ ID NO: 642845 - RNA, 64 nt, Homo Sapiens; identical to SEQ ID NO: 390711

SEQ ID NO: 642846 - RNA, 64 nt, Homo Sapiens; identical to SEQ ID NO: 390712

SEQ ID NO: 642847 - RNA, 64 nt, Homo Sapiens; identical to SEQ ID NO: 390713

SEQ ID NO: 642848 - RNA, 64 nt, Homo Sapiens; identical to SEQ ID NO: 390714

SEQ ID NO: 642849 - RNA, 64 nt, Homo Sapiens; identical to SEQ ID NO: 390715

SEQ ID NO: 642850 - RNA, 64 nt, Homo Sapiens; identical to SEQ ID NO: 390716

SEQ ID NO: 642851 - RNA, 64 nt, Homo Sapiens; identical to SEQ ID NO: 390717

SEQ ID NO: 642852 - RNA, 64 nt, Homo Sapiens; identical to SEQ ID NO: 390718

SEQ ID NO: 642853 - RNA, 64 nt, Homo Sapiens; identical to SEQ ID NO: 390719

SEQ ID NO: 642854 - RNA, 64 nt, Homo Sapiens; identical to SEQ ID NO: 390720

SEQ ID NO: 642855 - RNA, 64 nt, Homo Sapiens; identical to SEQ ID NO: 390721

SEQ ID NO: 642856 - RNA, 64 nt, Homo Sapiens; identical to SEQ ID NO: 390722

SEQ ID NO: 642857 - RNA, 64 nt, Homo Sapiens; identical to SEQ ID NO: 390723

SEQ ID NO: 642858 - RNA, 64 nt, Homo Sapiens; identical to SEQ ID NO: 390724

SEQ ID NO: 642859 - RNA, 64 nt, Homo Sapiens; identical to SEQ ID NO: 390725

SEQ ID NO: 642860 - RNA, 64 nt, Homo Sapiens; identical to SEQ ID NO: 390726

SEQ ID NO: 642861 - RNA, 64 nt, Homo Sapiens; identical to SEQ ID NO: 390727

SEQ ID NO: 642862 - RNA, 64 nt, Homo Sapiens; identical to SEQ ID NO: 390728

SEQ ID NO: 642863 - RNA, 64 nt, Homo Sapiens; identical to SEQ ID NO: 390729

SEQ ID NO: 642864 - RNA, 64 nt, Homo Sapiens; identical to SEQ ID NO: 390730

SEQ ID NO: 642865 - RNA, 64 nt, Homo Sapiens; identical to SEQ ID NO: 390731

SEQ ID NO: 642866 - RNA, 64 nt, Homo Sapiens; identical to SEQ ID NO: 390732

SEQ ID NO: 642867 - RNA, 64 nt, Homo Sapiens; identical to SEQ ID NO: 390733

SEQ ID NO: 642868 - RNA, 64 nt, Homo Sapiens; identical to SEQ ID NO: 390734

SEQ ID NO: 642869 - RNA, 64 nt, Homo Sapiens; identical to SEQ ID NO: 390735

SEQ ID NO: 642870 - RNA, 64 nt, Homo Sapiens; identical to SEQ ID NO: 390736

SEQ ID NO: 642871 - RNA, 64 nt, Homo Sapiens; identical to SEQ ID NO: 390737

SEQ ID NO: 642872 - RNA, 64 nt, Homo Sapiens; identical to SEQ ID NO: 390738

SEQ ID NO: 642873 - RNA, 64 nt, Homo Sapiens; identical to SEQ ID NO: 390739

SEQ ID NO: 642874 - RNA, 64 nt, Homo Sapiens; identical to SEQ ID NO: 390740

SEQ ID NO: 642875 - RNA, 64 nt, Homo Sapiens; identical to SEQ ID NO: 390741

SEQ ID NO: 642876 - RNA, 64 nt, Homo Sapiens; identical to SEQ ID NO: 390742

SEQ ID NO: 642877 - RNA, 64 nt, Homo Sapiens; identical to SEQ ID NO: 390743

SEQ ID NO: 642878 - RNA, 64 nt, Homo Sapiens
uccauucuuucagcugugucccuuccucucucuaccagucuauuuaccuucauguggcucagug

SEQ ID NO: 642879 - RNA, 64 nt, Homo Sapiens
uccacugaacaaaaccuacgccuuccucucucuaccagucuauuuaccuucaugugguucagug

SEQ ID NO: 642880 - RNA, 64 nt, Homo Sapiens
uccacugaacaaaaccuacaccuuccucucucuaccagucuauuuaccuucaugugauucacug

SEQ ID NO: 642881 - RNA, 64 nt, Homo Sapiens
auuauuugggaaaauuguuuuguguauagagaccccagucuacuuuguaaagugacuaccuuaa

SEQ ID NO: 642882 - RNA, 64 nt, Homo Sapiens
uuauaaagacaaauggauuaauuuuacuuagaugccagucuacuuuucuauaaaagaaaugguc

SEQ ID NO: 642883 - RNA, 64 nt, Homo Sapiens
cugguguuagaaaccguuuccuuccaguugacuuccagucuaccugugguaacaagcuaauaug

SEQ ID NO: 642884 - RNA, 64 nt, Homo Sapiens
ugaggagcugaucuagacagcccucagagagguuccagucuagaaaccuacaaaaugggcccug

SEQ ID NO: 642885 - RNA, 64 nt, Homo Sapiens
uuacaugagggguucuucacgauucuccuggaacccagucuagcaaaaugagaggaaaggcccu

SEQ ID NO: 642886 - RNA, 64 nt, Homo Sapiens
auucuccucauggauauuuucagucucaauguugccagucuaauaguauaguaugugguugcuu

SEQ ID NO: 642887 - RNA, 64 nt, Homo Sapiens; identical to SEQ ID NO: 266633

SEQ ID NO: 642888 - RNA, 64 nt, Homo Sapiens; identical to SEQ ID NO: 266634

SEQ ID NO: 642889 - RNA, 64 nt, Homo Sapiens; identical to SEQ ID NO: 266635

SEQ ID NO: 642890 - RNA, 64 nt, Homo Sapiens; identical to SEQ ID NO: 266636

SEQ ID NO: 642891 - RNA, 64 nt, Homo Sapiens; identical to SEQ ID NO: 266637

SEQ ID NO: 642892 - RNA, 64 nt, Homo Sapiens; identical to SEQ ID NO: 266638

SEQ ID NO: 642893 - RNA, 64 nt, Homo Sapiens; identical to SEQ ID NO: 266639

SEQ ID NO: 642894 - RNA, 64 nt, Homo Sapiens; identical to SEQ ID NO: 266640

SEQ ID NO: 642895 - RNA, 64 nt, Homo Sapiens; identical to SEQ ID NO: 266641

SEQ ID NO: 642896 - RNA, 64 nt, Homo Sapiens; identical to SEQ ID NO: 266642

SEQ ID NO: 642897 - RNA, 64 nt, Homo Sapiens; identical to SEQ ID NO: 266643

SEQ ID NO: 642898 - RNA, 64 nt, Homo Sapiens; identical to SEQ ID NO: 266644

SEQ ID NO: 642899 - RNA, 64 nt, Homo Sapiens; identical to SEQ ID NO: 266645

SEQ ID NO: 642900 - RNA, 64 nt, Homo Sapiens; identical to SEQ ID NO: 266646

SEQ ID NO: 642901 - RNA, 63 nt, Homo Sapiens; identical to SEQ ID NO: 266647

SEQ ID NO: 642902 - RNA, 64 nt, Homo Sapiens; identical to SEQ ID NO: 266648

SEQ ID NO: 642903 - RNA, 64 nt, Homo Sapiens; identical to SEQ ID NO: 266649

SEQ ID NO: 642904 - RNA, 64 nt, Homo Sapiens; identical to SEQ ID NO: 266650

SEQ ID NO: 642905 - RNA, 64 nt, Homo Sapiens; identical to SEQ ID NO: 199907

SEQ ID NO: 642906 - RNA, 64 nt, Homo Sapiens; identical to SEQ ID NO: 199908

SEQ ID NO: 642907 - RNA, 64 nt, Homo Sapiens; identical to SEQ ID NO: 199909

SEQ ID NO: 642908 - RNA, 64 nt, Homo Sapiens; identical to SEQ ID NO: 199910

SEQ ID NO: 642909 - RNA, 64 nt, Homo Sapiens; identical to SEQ ID NO: 199911

SEQ ID NO: 642910 - RNA, 64 nt, Homo Sapiens; identical to SEQ ID NO: 199912

SEQ ID NO: 642911 - RNA, 64 nt, Homo Sapiens; identical to SEQ ID NO: 199913

SEQ ID NO: 642912 - RNA, 64 nt, Homo Sapiens; identical to SEQ ID NO: 199914

SEQ ID NO: 642913 - RNA, 64 nt, Homo Sapiens; identical to SEQ ID NO: 199915

SEQ ID NO: 642914 - RNA, 64 nt, Homo Sapiens; identical to SEQ ID NO: 199916

SEQ ID NO: 642915 - RNA, 64 nt, Homo Sapiens; identical to SEQ ID NO: 199917

SEQ ID NO: 642916 - RNA, 64 nt, Homo Sapiens; identical to SEQ ID NO: 199918

SEQ ID NO: 642917 - RNA, 64 nt, Homo Sapiens; identical to SEQ ID NO: 199919

SEQ ID NO: 642918 - RNA, 64 nt, Homo Sapiens; identical to SEQ ID NO: 199920

SEQ ID NO: 642919 - RNA, 64 nt, Homo Sapiens; identical to SEQ ID NO: 199921

SEQ ID NO: 642920 - RNA, 64 nt, Homo Sapiens; identical to SEQ ID NO: 199922

SEQ ID NO: 642921 - RNA, 64 nt, Homo Sapiens; identical to SEQ ID NO: 199923

SEQ ID NO: 642922 - RNA, 64 nt, Homo Sapiens; identical to SEQ ID NO: 199924

SEQ ID NO: 642923 - RNA, 64 nt, Homo Sapiens; identical to SEQ ID NO: 199925

SEQ ID NO: 642924 - RNA, 64 nt, Homo Sapiens; identical to SEQ ID NO: 199926

SEQ ID NO: 642925 - RNA, 64 nt, Homo Sapiens; identical to SEQ ID NO: 199927

SEQ ID NO: 642926 - RNA, 64 nt, Homo Sapiens; identical to SEQ ID NO: 199928

SEQ ID NO: 642927 - RNA, 64 nt, Homo Sapiens; identical to SEQ ID NO: 199929

SEQ ID NO: 642928 - RNA, 64 nt, Homo Sapiens; identical to SEQ ID NO: 199930

SEQ ID NO: 642929 - RNA, 64 nt, Homo Sapiens; identical to SEQ ID NO: 199931

SEQ ID NO: 642930 - RNA, 64 nt, Homo Sapiens; identical to SEQ ID NO: 199932

SEQ ID NO: 642931 - RNA, 64 nt, Homo Sapiens; identical to SEQ ID NO: 199933

SEQ ID NO: 642932 - RNA, 64 nt, Homo Sapiens; identical to SEQ ID NO: 199934

SEQ ID NO: 642933 - RNA, 64 nt, Homo Sapiens; identical to SEQ ID NO: 199935

SEQ ID NO: 642934 - RNA, 64 nt, Homo Sapiens; identical to SEQ ID NO: 199936

SEQ ID NO: 642935 - RNA, 64 nt, Homo Sapiens; identical to SEQ ID NO: 199937

SEQ ID NO: 642936 - RNA, 64 nt, Homo Sapiens; identical to SEQ ID NO: 199938

SEQ ID NO: 642937 - RNA, 64 nt, Homo Sapiens; identical to SEQ ID NO: 199939

SEQ ID NO: 642938 - RNA, 64 nt, Homo Sapiens; identical to SEQ ID NO: 199940

SEQ ID NO: 642939 - RNA, 64 nt, Homo Sapiens; identical to SEQ ID NO: 199941

SEQ ID NO: 642940 - RNA, 64 nt, Homo Sapiens; identical to SEQ ID NO: 199942

SEQ ID NO: 642941 - RNA, 64 nt, Homo Sapiens; identical to SEQ ID NO: 390131

SEQ ID NO: 642942 - RNA, 64 nt, Homo Sapiens; identical to SEQ ID NO: 390132

SEQ ID NO: 642943 - RNA, 64 nt, Homo Sapiens; identical to SEQ ID NO: 390133

SEQ ID NO: 642944 - RNA, 64 nt, Homo Sapiens; identical to SEQ ID NO: 390134

SEQ ID NO: 642945 - RNA, 64 nt, Homo Sapiens; identical to SEQ ID NO: 390135

SEQ ID NO: 642946 - RNA, 64 nt, Homo Sapiens; identical to SEQ ID NO: 390136

SEQ ID NO: 642947 - RNA, 64 nt, Homo Sapiens; identical to SEQ ID NO: 390137

SEQ ID NO: 642948 - RNA, 64 nt, Homo Sapiens; identical to SEQ ID NO: 390138

SEQ ID NO: 642949 - RNA, 64 nt, Homo Sapiens; identical to SEQ ID NO: 390139

SEQ ID NO: 642950 - RNA, 64 nt, Homo Sapiens; identical to SEQ ID NO: 390140

SEQ ID NO: 642951 - RNA, 64 nt, Homo Sapiens; identical to SEQ ID NO: 390141

SEQ ID NO: 642952 - RNA, 64 nt, Homo Sapiens; identical to SEQ ID NO: 390142

SEQ ID NO: 642953 - RNA, 64 nt, Homo Sapiens; identical to SEQ ID NO: 390143

SEQ ID NO: 642954 - RNA, 57 nt, Homo Sapiens; identical to SEQ ID NO: 390144

SEQ ID NO: 642955 - RNA, 64 nt, Homo Sapiens; identical to SEQ ID NO: 390145

SEQ ID NO: 642956 - RNA, 64 nt, Homo Sapiens; identical to SEQ ID NO: 390146

SEQ ID NO: 642957 - RNA, 64 nt, Homo Sapiens; identical to SEQ ID NO: 390147

SEQ ID NO: 642958 - RNA, 64 nt, Homo Sapiens; identical to SEQ ID NO: 390148

SEQ ID NO: 642959 - RNA, 64 nt, Homo Sapiens; identical to SEQ ID NO: 390149

SEQ ID NO: 642960 - RNA, 64 nt, Homo Sapiens; identical to SEQ ID NO: 390150

SEQ ID NO: 642961 - RNA, 64 nt, Homo Sapiens; identical to SEQ ID NO: 390151

SEQ ID NO: 642962 - RNA, 64 nt, Homo Sapiens; identical to SEQ ID NO: 390152

SEQ ID NO: 642963 - RNA, 64 nt, Homo Sapiens; identical to SEQ ID NO: 390153

SEQ ID NO: 642964 - RNA, 64 nt, Homo Sapiens; identical to SEQ ID NO: 390154

SEQ ID NO: 642965 - RNA, 64 nt, Homo Sapiens; identical to SEQ ID NO: 390155

SEQ ID NO: 642966 - RNA, 64 nt, Homo Sapiens; identical to SEQ ID NO: 390156

SEQ ID NO: 642967 - RNA, 64 nt, Homo Sapiens; identical to SEQ ID NO: 390157

SEQ ID NO: 642968 - RNA, 64 nt, Homo Sapiens; identical to SEQ ID NO: 390158

SEQ ID NO: 642969 - RNA, 64 nt, Homo Sapiens; identical to SEQ ID NO: 390159

SEQ ID NO: 642970 - RNA, 64 nt, Homo Sapiens; identical to SEQ ID NO: 390160

SEQ ID NO: 642971 - RNA, 64 nt, Homo Sapiens; identical to SEQ ID NO: 390161

SEQ ID NO: 642972 - RNA, 64 nt, Homo Sapiens; identical to SEQ ID NO: 390162

SEQ ID NO: 642973 - RNA, 64 nt, Homo Sapiens; identical to SEQ ID NO: 390163

SEQ ID NO: 642974 - RNA, 64 nt, Homo Sapiens; identical to SEQ ID NO: 390164

SEQ ID NO: 642975 - RNA, 64 nt, Homo Sapiens; identical to SEQ ID NO: 390165

SEQ ID NO: 642976 - RNA, 64 nt, Homo Sapiens; identical to SEQ ID NO: 390166

SEQ ID NO: 642977 - RNA, 64 nt, Homo Sapiens; identical to SEQ ID NO: 390167

SEQ ID NO: 642978 - RNA, 64 nt, Homo Sapiens; identical to SEQ ID NO: 390168

SEQ ID NO: 642979 - RNA, 64 nt, Homo Sapiens; identical to SEQ ID NO: 390169

SEQ ID NO: 642980 - RNA, 64 nt, Homo Sapiens; identical to SEQ ID NO: 390170

SEQ ID NO: 642981 - RNA, 64 nt, Homo Sapiens; identical to SEQ ID NO: 390171

SEQ ID NO: 642982 - RNA, 64 nt, Homo Sapiens; identical to SEQ ID NO: 390172

SEQ ID NO: 642983 - RNA, 64 nt, Homo Sapiens; identical to SEQ ID NO: 390173

SEQ ID NO: 642984 - RNA, 64 nt, Homo Sapiens; identical to SEQ ID NO: 390174

SEQ ID NO: 642985 - RNA, 64 nt, Homo Sapiens; identical to SEQ ID NO: 390175

SEQ ID NO: 642986 - RNA, 64 nt, Homo Sapiens; identical to SEQ ID NO: 390176

SEQ ID NO: 642987 - RNA, 64 nt, Homo Sapiens; identical to SEQ ID NO: 390177

SEQ ID NO: 642988 - RNA, 64 nt, Homo Sapiens; identical to SEQ ID NO: 390178

SEQ ID NO: 642989 - RNA, 64 nt, Homo Sapiens; identical to SEQ ID NO: 390179

SEQ ID NO: 642990 - RNA, 64 nt, Homo Sapiens; identical to SEQ ID NO: 390180

SEQ ID NO: 642991 - RNA, 64 nt, Homo Sapiens; identical to SEQ ID NO: 390181

SEQ ID NO: 642992 - RNA, 64 nt, Homo Sapiens; identical to SEQ ID NO: 390182

SEQ ID NO: 642993 - RNA, 64 nt, Homo Sapiens; identical to SEQ ID NO: 390183

SEQ ID NO: 642994 - RNA, 64 nt, Homo Sapiens; identical to SEQ ID NO: 390184

SEQ ID NO: 642995 - RNA, 64 nt, Homo Sapiens; identical to SEQ ID NO: 390185

SEQ ID NO: 642996 - RNA, 64 nt, Homo Sapiens; identical to SEQ ID NO: 390186

SEQ ID NO: 642997 - RNA, 64 nt, Homo Sapiens; identical to SEQ ID NO: 390187

SEQ ID NO: 642998 - RNA, 64 nt, Homo Sapiens; identical to SEQ ID NO: 390188

SEQ ID NO: 642999 - RNA, 64 nt, Homo Sapiens; identical to SEQ ID NO: 390189

SEQ ID NO: 643000 - RNA, 64 nt, Homo Sapiens; identical to SEQ ID NO: 390190

SEQ ID NO: 643001 - RNA, 64 nt, Homo Sapiens; identical to SEQ ID NO: 390191

SEQ ID NO: 643002 - RNA, 64 nt, Homo Sapiens; identical to SEQ ID NO: 390192

SEQ ID NO: 643003 - RNA, 64 nt, Homo Sapiens; identical to SEQ ID NO: 390193

SEQ ID NO: 643004 - RNA, 64 nt, Homo Sapiens; identical to SEQ ID NO: 390194

SEQ ID NO: 643005 - RNA, 64 nt, Homo Sapiens; identical to SEQ ID NO: 390195

SEQ ID NO: 643006 - RNA, 64 nt, Homo Sapiens; identical to SEQ ID NO: 390196

SEQ ID NO: 643007 - RNA, 64 nt, Homo Sapiens; identical to SEQ ID NO: 390197

SEQ ID NO: 643008 - RNA, 64 nt, Homo Sapiens; identical to SEQ ID NO: 390198

SEQ ID NO: 643009 - RNA, 64 nt, Homo Sapiens; identical to SEQ ID NO: 390199

SEQ ID NO: 643010 - RNA, 64 nt, Homo Sapiens; identical to SEQ ID NO: 390200

SEQ ID NO: 643011 - RNA, 64 nt, Homo Sapiens; identical to SEQ ID NO: 390201

SEQ ID NO: 643012 - RNA, 64 nt, Homo Sapiens; identical to SEQ ID NO: 390202

SEQ ID NO: 643013 - RNA, 64 nt, Homo Sapiens; identical to SEQ ID NO: 390203

SEQ ID NO: 643014 - RNA, 64 nt, Homo Sapiens; identical to SEQ ID NO: 390204

SEQ ID NO: 643015 - RNA, 60 nt, Homo Sapiens; identical to SEQ ID NO: 390205

SEQ ID NO: 643016 - RNA, 64 nt, Homo Sapiens; identical to SEQ ID NO: 390206

SEQ ID NO: 643017 - RNA, 64 nt, Homo Sapiens; identical to SEQ ID NO: 390207

SEQ ID NO: 643018 - RNA, 64 nt, Homo Sapiens; identical to SEQ ID NO: 390208

SEQ ID NO: 643019 - RNA, 64 nt, Homo Sapiens; identical to SEQ ID NO: 390209

SEQ ID NO: 643020 - RNA, 64 nt, Homo Sapiens; identical to SEQ ID NO: 390210

SEQ ID NO: 643021 - RNA, 64 nt, Homo Sapiens; identical to SEQ ID NO: 390211

SEQ ID NO: 643022 - RNA, 64 nt, Homo Sapiens; identical to SEQ ID NO: 390212

SEQ ID NO: 643023 - RNA, 64 nt, Homo Sapiens; identical to SEQ ID NO: 390213

SEQ ID NO: 643024 - RNA, 64 nt, Homo Sapiens; identical to SEQ ID NO: 390214

SEQ ID NO: 643025 - RNA, 64 nt, Homo Sapiens; identical to SEQ ID NO: 390215

SEQ ID NO: 643026 - RNA, 64 nt, Homo Sapiens; identical to SEQ ID NO: 390216

SEQ ID NO: 643027 - RNA, 64 nt, Homo Sapiens; identical to SEQ ID NO: 390217

SEQ ID NO: 643028 - RNA, 64 nt, Homo Sapiens; identical to SEQ ID NO: 390218

SEQ ID NO: 643029 - RNA, 64 nt, Homo Sapiens; identical to SEQ ID NO: 390219

SEQ ID NO: 643030 - RNA, 64 nt, Homo Sapiens; identical to SEQ ID NO: 390220

SEQ ID NO: 643031 - RNA, 64 nt, Homo Sapiens; identical to SEQ ID NO: 390221

SEQ ID NO: 643032 - RNA, 64 nt, Homo Sapiens; identical to SEQ ID NO: 390222

SEQ ID NO: 643033 - RNA, 64 nt, Homo Sapiens; identical to SEQ ID NO: 390223

SEQ ID NO: 643034 - RNA, 64 nt, Homo Sapiens; identical to SEQ ID NO: 390224

SEQ ID NO: 643035 - RNA, 64 nt, Homo Sapiens; identical to SEQ ID NO: 390225

SEQ ID NO: 643036 - RNA, 64 nt, Homo Sapiens; identical to SEQ ID NO: 390226

SEQ ID NO: 643037 - RNA, 64 nt, Homo Sapiens; identical to SEQ ID NO: 390227

SEQ ID NO: 643038 - RNA, 64 nt, Homo Sapiens; identical to SEQ ID NO: 390228

SEQ ID NO: 643039 - RNA, 64 nt, Homo Sapiens; identical to SEQ ID NO: 390229

SEQ ID NO: 643040 - RNA, 64 nt, Homo Sapiens; identical to SEQ ID NO: 390230

SEQ ID NO: 643041 - RNA, 64 nt, Homo Sapiens; identical to SEQ ID NO: 390231

SEQ ID NO: 643042 - RNA, 64 nt, Homo Sapiens; identical to SEQ ID NO: 390232

SEQ ID NO: 643043 - RNA, 64 nt, Homo Sapiens; identical to SEQ ID NO: 390233

SEQ ID NO: 643044 - RNA, 64 nt, Homo Sapiens; identical to SEQ ID NO: 390234

SEQ ID NO: 643045 - RNA, 64 nt, Homo Sapiens; identical to SEQ ID NO: 390235

SEQ ID NO: 643046 - RNA, 64 nt, Homo Sapiens; identical to SEQ ID NO: 390236

SEQ ID NO: 643047 - RNA, 64 nt, Homo Sapiens; identical to SEQ ID NO: 390237

SEQ ID NO: 643048 - RNA, 64 nt, Homo Sapiens; identical to SEQ ID NO: 390238

SEQ ID NO: 643049 - RNA, 64 nt, Homo Sapiens; identical to SEQ ID NO: 390239

SEQ ID NO: 643050 - RNA, 64 nt, Homo Sapiens; identical to SEQ ID NO: 390240

SEQ ID NO: 643051 - RNA, 64 nt, Homo Sapiens; identical to SEQ ID NO: 390241

SEQ ID NO: 643052 - RNA, 64 nt, Homo Sapiens; identical to SEQ ID NO: 390242

SEQ ID NO: 643053 - RNA, 64 nt, Homo Sapiens; identical to SEQ ID NO: 390243

SEQ ID NO: 643054 - RNA, 64 nt, Homo Sapiens; identical to SEQ ID NO: 390244

SEQ ID NO: 643055 - RNA, 64 nt, Homo Sapiens; identical to SEQ ID NO: 390245

SEQ ID NO: 643056 - RNA, 64 nt, Homo Sapiens; identical to SEQ ID NO: 390246

SEQ ID NO: 643057 - RNA, 64 nt, Homo Sapiens; identical to SEQ ID NO: 390247

SEQ ID NO: 643058 - RNA, 64 nt, Homo Sapiens; identical to SEQ ID NO: 390248

SEQ ID NO: 643059 - RNA, 64 nt, Homo Sapiens; identical to SEQ ID NO: 390249

SEQ ID NO: 643060 - RNA, 64 nt, Homo Sapiens; identical to SEQ ID NO: 390250

SEQ ID NO: 643061 - RNA, 64 nt, Homo Sapiens; identical to SEQ ID NO: 390251

SEQ ID NO: 643062 - RNA, 64 nt, Homo Sapiens; identical to SEQ ID NO: 390252

SEQ ID NO: 643063 - RNA, 64 nt, Homo Sapiens; identical to SEQ ID NO: 390253

SEQ ID NO: 643064 - RNA, 64 nt, Homo Sapiens; identical to SEQ ID NO: 390254

SEQ ID NO: 643065 - RNA, 64 nt, Homo Sapiens; identical to SEQ ID NO: 390255

SEQ ID NO: 643066 - RNA, 64 nt, Homo Sapiens; identical to SEQ ID NO: 390256

SEQ ID NO: 643067 - RNA, 64 nt, Homo Sapiens; identical to SEQ ID NO: 390257

SEQ ID NO: 643068 - RNA, 64 nt, Homo Sapiens; identical to SEQ ID NO: 390258

SEQ ID NO: 643069 - RNA, 64 nt, Homo Sapiens; identical to SEQ ID NO: 390259

SEQ ID NO: 643070 - RNA, 64 nt, Homo Sapiens; identical to SEQ ID NO: 472962

SEQ ID NO: 643071 - RNA, 55 nt, Homo Sapiens; identical to SEQ ID NO: 472963

SEQ ID NO: 643072 - RNA, 64 nt, Homo Sapiens; identical to SEQ ID NO: 472964

SEQ ID NO: 643073 - RNA, 64 nt, Homo Sapiens; identical to SEQ ID NO: 472965

SEQ ID NO: 643074 - RNA, 64 nt, Homo Sapiens; identical to SEQ ID NO: 472966

SEQ ID NO: 643075 - RNA, 64 nt, Homo Sapiens; identical to SEQ ID NO: 472967

SEQ ID NO: 643076 - RNA, 64 nt, Homo Sapiens; identical to SEQ ID NO: 472968

SEQ ID NO: 643077 - RNA, 64 nt, Homo Sapiens; identical to SEQ ID NO: 472969

SEQ ID NO: 643078 - RNA, 64 nt, Homo Sapiens; identical to SEQ ID NO: 472970

SEQ ID NO: 643079 - RNA, 64 nt, Homo Sapiens; identical to SEQ ID NO: 472971

SEQ ID NO: 643080 - RNA, 64 nt, Homo Sapiens; identical to SEQ ID NO: 61495

SEQ ID NO: 643081 - RNA, 64 nt, Homo Sapiens; identical to SEQ ID NO: 61496

SEQ ID NO: 643082 - RNA, 64 nt, Homo Sapiens; identical to SEQ ID NO: 61497

SEQ ID NO: 643083 - RNA, 64 nt, Homo Sapiens; identical to SEQ ID NO: 61498

SEQ ID NO: 643084 - RNA, 64 nt, Homo Sapiens; identical to SEQ ID NO: 61499

SEQ ID NO: 643085 - RNA, 64 nt, Homo Sapiens; identical to SEQ ID NO: 61500

SEQ ID NO: 643086 - RNA, 64 nt, Homo Sapiens; identical to SEQ ID NO: 61501

SEQ ID NO: 643087 - RNA, 64 nt, Homo Sapiens; identical to SEQ ID NO: 61502

SEQ ID NO: 643088 - RNA, 64 nt, Homo Sapiens; identical to SEQ ID NO: 61503

SEQ ID NO: 643089 - RNA, 64 nt, Homo Sapiens; identical to SEQ ID NO: 61504

SEQ ID NO: 643090 - RNA, 64 nt, Homo Sapiens; identical to SEQ ID NO: 61505

SEQ ID NO: 643091 - RNA, 64 nt, Homo Sapiens; identical to SEQ ID NO: 61506

SEQ ID NO: 643092 - RNA, 64 nt, Homo Sapiens; identical to SEQ ID NO: 61507

SEQ ID NO: 643093 - RNA, 64 nt, Homo Sapiens; identical to SEQ ID NO: 61508

SEQ ID NO: 643094 - RNA, 64 nt, Homo Sapiens; identical to SEQ ID NO: 61509

SEQ ID NO: 643095 - RNA, 64 nt, Homo Sapiens; identical to SEQ ID NO: 61510

SEQ ID NO: 643096 - RNA, 64 nt, Homo Sapiens; identical to SEQ ID NO: 61511

SEQ ID NO: 643097 - RNA, 64 nt, Homo Sapiens; identical to SEQ ID NO: 61512

SEQ ID NO: 643098 - RNA, 64 nt, Homo Sapiens; identical to SEQ ID NO: 61513

SEQ ID NO: 643099 - RNA, 64 nt, Homo Sapiens; identical to SEQ ID NO: 61514

SEQ ID NO: 643100 - RNA, 64 nt, Homo Sapiens; identical to SEQ ID NO: 61515

SEQ ID NO: 643101 - RNA, 64 nt, Homo Sapiens; identical to SEQ ID NO: 61516

SEQ ID NO: 643102 - RNA, 64 nt, Homo Sapiens; identical to SEQ ID NO: 61517

SEQ ID NO: 643103 - RNA, 64 nt, Homo Sapiens
aaaagaaaaaacaaacaacaacaaaaaaaacucuucggaauaaagagggcuguaaauuuugaau

SEQ ID NO: 643104 - RNA, 64 nt, Homo Sapiens
aaaugucuuucauaaaaugugcuacaauuagccuucggaauauuugcugggugauuuaaaugug

SEQ ID NO: 643105 - RNA, 64 nt, Homo Sapiens
ccacguugacuucagguggucuucuaccagcagcucggaauaguugcacugaaucuauacuuug

SEQ ID NO: 643106 - RNA, 64 nt, Homo Sapiens
cuaauuuuugcuccucuauaaggccaaaauuuguucggaauacaguguuacaaaaaauauuauc

SEQ ID NO: 643107 - RNA, 64 nt, Homo Sapiens
uuuacauuuugacaauuguuuucaaaauaaauguucggaauacagugcagcccuuacgacaggc

SEQ ID NO: 643108 - RNA, 64 nt, Homo Sapiens
aaucucacacauuuacuuacuaaagauugaggauucggaauauuuagaauaaauuaguuuucug

SEQ ID NO: 643109 - RNA, 64 nt, Homo Sapiens
aggggcucuguuagucauuauaaaccaggacaucucggaauaaaagcgauauaaauuuaucaua

SEQ ID NO: 643110 - RNA, 64 nt, Homo Sapiens
uuaacauccuauuuuguuguacuaaagugacaaaucggaauaauauaauugguauggccauuag

SEQ ID NO: 643111 - RNA, 64 nt, Homo Sapiens
uuaacuuccuuuguaauuuaauccacauccaccuucggaauacacugacaggguuauuugccuc

SEQ ID NO: 643112 - RNA, 64 nt, Homo Sapiens
agccuaaacaggaacaacuucuguucgagagaaaucggaauaaaauaaacaugcguguuaaugg

SEQ ID NO: 643113 - RNA, 64 nt, Homo Sapiens
ugaugaucuucugaagcucuuggaugucauuugaucggaauaugcaguggaauaggugacucac

SEQ ID NO: 643114 - RNA, 64 nt, Homo Sapiens
ggaacuguucccuuucugauuaauuucagcagcaucggaauauauuuggagcacacccuaguaa

SEQ ID NO: 643115 - RNA, 64 nt, Homo Sapiens
gcucuuuugaaaguacucgaauuuuguaggcaacucggaauauaacucuauaauaaaacaaaag

SEQ ID NO: 643116 - RNA, 64 nt, Homo Sapiens
uggauuuagccauacugcucuuuugcuuuuuauuucggaauaaaggugaugcgacuccuguuua

SEQ ID NO: 643117 - RNA, 64 nt, Homo Sapiens
uugcauauuuuaaauuuuucaugugcaguauggcucggaauauguuuggccuuuugcauguuuc

SEQ ID NO: 643118 - RNA, 64 nt, Homo Sapiens
ucugcagugacagaauuugaguggaaaaguacuaucggaauaacaacaugugugaugugccaug

SEQ ID NO: 643119 - RNA, 64 nt, Homo Sapiens
auguuggguggcuuuuguucuuucacugagaaauucggaauacauuugucucaccccugauauu

SEQ ID NO: 643120 - RNA, 64 nt, Homo Sapiens
ccuuucuagguaaaccgcuugccuucaucuugagucggaauauauuuaaauaaauuguguuauc

SEQ ID NO: 643121 - RNA, 64 nt, Homo Sapiens
uagaauuuccaaaaucuucauauuacugaaacugucggaauauaugggucuugaaauucagaag

SEQ ID NO: 643122 - RNA, 64 nt, Homo Sapiens
agaauaaaaaggauuauggguacuuaaaagcaugucggaauauagcuuauccucuuuguaguac

SEQ ID NO: 643123 - RNA, 64 nt, Homo Sapiens
auggucagggagagggcuagagcucacacccagcucggaauagaucuucccugaugacauuuca

SEQ ID NO: 643124 - RNA, 64 nt, Homo Sapiens
ucugcuuucuggguaaaacuacauuaggaguggaucggaauacuugaugaacuauuuuauguag

SEQ ID NO: 643125 - RNA, 64 nt, Homo Sapiens
ggcucaagaaccuaugucaauauaaugaaacgguucggaauacuuguuuaaauaaaaggaacuu

SEQ ID NO: 643126 - RNA, 64 nt, Homo Sapiens
aaauugggcuuggcacucaagucaaagaugaacaucggaauaacaaacauuguccucuccagaa

SEQ ID NO: 643127 - RNA, 64 nt, Homo Sapiens
gcaucaagcacaaggccaugcaggugaugauacgucggaauagaggcaccagcccugguaacug

SEQ ID NO: 643128 - RNA, 64 nt, Homo Sapiens
ugcacaguaacauuuggacuagugcuaaugaauaucggaauaugcacaaaauuagcauaauugc

SEQ ID NO: 643129 - RNA, 50 nt, Homo Sapiens
aagaggagaucgauggauagucggaauagagccgccccaacucagauccu

SEQ ID NO: 643130 - RNA, 64 nt, Homo Sapiens
ugaaaucccccagcgaugggcggccacuucccguucggaauaaccaaaagggauggaggcuuua

SEQ ID NO: 643131 - RNA, 64 nt, Homo Sapiens
uacugugaagaguaggggugccccccuccuuugaucggaauauguuagggaguccccaacacuc

SEQ ID NO: 643132 - RNA, 64 nt, Homo Sapiens
ugcucucuucaugucauauuagaacuugaaauugucggaauaugaggacuggaaggcuaugaaa

SEQ ID NO: 643133 - RNA, 64 nt, Homo Sapiens
agcagcccuccccuucccccagcugaaucuucaaucggaauaaaaggggugcgggguggggggg

SEQ ID NO: 643134 - RNA, 64 nt, Homo Sapiens
agaugaucuccugucaaagacaguuaacaaauccucggaauauugcuucauguacaguuauugg

SEQ ID NO: 643135 - RNA, 64 nt, Homo Sapiens; identical to SEQ ID NO: 368444

SEQ ID NO: 643136 - RNA, 64 nt, Homo Sapiens; identical to SEQ ID NO: 368445

SEQ ID NO: 643137 - RNA, 64 nt, Homo Sapiens; identical to SEQ ID NO: 368446

SEQ ID NO: 643138 - RNA, 64 nt, Homo Sapiens; identical to SEQ ID NO: 368447

SEQ ID NO: 643139 - RNA, 64 nt, Homo Sapiens; identical to SEQ ID NO: 368448

SEQ ID NO: 643140 - RNA, 64 nt, Homo Sapiens; identical to SEQ ID NO: 368449

SEQ ID NO: 643141 - RNA, 64 nt, Homo Sapiens; identical to SEQ ID NO: 368450

SEQ ID NO: 643142 - RNA, 64 nt, Homo Sapiens; identical to SEQ ID NO: 368451

SEQ ID NO: 643143 - RNA, 64 nt, Homo Sapiens; identical to SEQ ID NO: 368452

SEQ ID NO: 643144 - RNA, 64 nt, Homo Sapiens; identical to SEQ ID NO: 368453

SEQ ID NO: 643145 - RNA, 64 nt, Homo Sapiens; identical to SEQ ID NO: 368454

SEQ ID NO: 643146 - RNA, 64 nt, Homo Sapiens; identical to SEQ ID NO: 368455

SEQ ID NO: 643147 - RNA, 64 nt, Homo Sapiens; identical to SEQ ID NO: 415214

SEQ ID NO: 643148 - RNA, 64 nt, Homo Sapiens; identical to SEQ ID NO: 415215

SEQ ID NO: 643149 - RNA, 64 nt, Homo Sapiens; identical to SEQ ID NO: 415216

SEQ ID NO: 643150 - RNA, 64 nt, Homo Sapiens; identical to SEQ ID NO: 415217

SEQ ID NO: 643151 - RNA, 64 nt, Homo Sapiens; identical to SEQ ID NO: 415218

SEQ ID NO: 643152 - RNA, 64 nt, Homo Sapiens; identical to SEQ ID NO: 415219

SEQ ID NO: 643153 - RNA, 64 nt, Homo Sapiens; identical to SEQ ID NO: 415220

SEQ ID NO: 643154 - RNA, 64 nt, Homo Sapiens; identical to SEQ ID NO: 415221

SEQ ID NO: 643155 - RNA, 55 nt, Homo Sapiens; identical to SEQ ID NO: 415222

SEQ ID NO: 643156 - RNA, 64 nt, Homo Sapiens; identical to SEQ ID NO: 415223

SEQ ID NO: 643157 - RNA, 64 nt, Homo Sapiens; identical to SEQ ID NO: 415224

SEQ ID NO: 643158 - RNA, 64 nt, Homo Sapiens; identical to SEQ ID NO: 415225

SEQ ID NO: 643159 - RNA, 64 nt, Homo Sapiens; identical to SEQ ID NO: 415226

SEQ ID NO: 643160 - RNA, 64 nt, Homo Sapiens; identical to SEQ ID NO: 415227

SEQ ID NO: 643161 - RNA, 64 nt, Homo Sapiens; identical to SEQ ID NO: 415228

SEQ ID NO: 643162 - RNA, 50 nt, Homo Sapiens; identical to SEQ ID NO: 415229

SEQ ID NO: 643163 - RNA, 64 nt, Homo Sapiens; identical to SEQ ID NO: 415230

SEQ ID NO: 643164 - RNA, 64 nt, Homo Sapiens; identical to SEQ ID NO: 415231

SEQ ID NO: 643165 - RNA, 64 nt, Homo Sapiens; identical to SEQ ID NO: 415232

SEQ ID NO: 643166 - RNA, 64 nt, Homo Sapiens; identical to SEQ ID NO: 415233

SEQ ID NO: 643167 - RNA, 64 nt, Homo Sapiens; identical to SEQ ID NO: 415234

SEQ ID NO: 643168 - RNA, 64 nt, Homo Sapiens; identical to SEQ ID NO: 415235

SEQ ID NO: 643169 - RNA, 64 nt, Homo Sapiens; identical to SEQ ID NO: 415236

SEQ ID NO: 643170 - RNA, 64 nt, Homo Sapiens; identical to SEQ ID NO: 415237

SEQ ID NO: 643171 - RNA, 64 nt, Homo Sapiens; identical to SEQ ID NO: 415238

SEQ ID NO: 643172 - RNA, 64 nt, Homo Sapiens; identical to SEQ ID NO: 415239

SEQ ID NO: 643173 - RNA, 64 nt, Homo Sapiens; identical to SEQ ID NO: 415240

SEQ ID NO: 643174 - RNA, 64 nt, Homo Sapiens; identical to SEQ ID NO: 415241

SEQ ID NO: 643175 - RNA, 64 nt, Homo Sapiens; identical to SEQ ID NO: 415242

SEQ ID NO: 643176 - RNA, 64 nt, Homo Sapiens; identical to SEQ ID NO: 415243

SEQ ID NO: 643177 - RNA, 64 nt, Homo Sapiens; identical to SEQ ID NO: 415244

SEQ ID NO: 643178 - RNA, 64 nt, Homo Sapiens; identical to SEQ ID NO: 415245

SEQ ID NO: 643179 - RNA, 64 nt, Homo Sapiens; identical to SEQ ID NO: 415246

SEQ ID NO: 643180 - RNA, 64 nt, Homo Sapiens; identical to SEQ ID NO: 415247

SEQ ID NO: 643181 - RNA, 64 nt, Homo Sapiens; identical to SEQ ID NO: 415248

SEQ ID NO: 643182 - RNA, 64 nt, Homo Sapiens; identical to SEQ ID NO: 415249

SEQ ID NO: 643183 - RNA, 64 nt, Homo Sapiens; identical to SEQ ID NO: 415250

SEQ ID NO: 643184 - RNA, 64 nt, Homo Sapiens; identical to SEQ ID NO: 415251

SEQ ID NO: 643185 - RNA, 64 nt, Homo Sapiens; identical to SEQ ID NO: 415252

SEQ ID NO: 643186 - RNA, 64 nt, Homo Sapiens; identical to SEQ ID NO: 415253

SEQ ID NO: 643187 - RNA, 64 nt, Homo Sapiens; identical to SEQ ID NO: 415254

SEQ ID NO: 643188 - RNA, 64 nt, Homo Sapiens; identical to SEQ ID NO: 415255

SEQ ID NO: 643189 - RNA, 64 nt, Homo Sapiens; identical to SEQ ID NO: 415256

SEQ ID NO: 643190 - RNA, 64 nt, Homo Sapiens; identical to SEQ ID NO: 370820

SEQ ID NO: 643191 - RNA, 64 nt, Homo Sapiens; identical to SEQ ID NO: 370821

SEQ ID NO: 643192 - RNA, 64 nt, Homo Sapiens; identical to SEQ ID NO: 370822

SEQ ID NO: 643193 - RNA, 64 nt, Homo Sapiens; identical to SEQ ID NO: 370823

SEQ ID NO: 643194 - RNA, 64 nt, Homo Sapiens; identical to SEQ ID NO: 370824

SEQ ID NO: 643195 - RNA, 64 nt, Homo Sapiens; identical to SEQ ID NO: 370825

SEQ ID NO: 643196 - RNA, 64 nt, Homo Sapiens; identical to SEQ ID NO: 370826

SEQ ID NO: 643197 - RNA, 64 nt, Homo Sapiens; identical to SEQ ID NO: 370827

SEQ ID NO: 643198 - RNA, 64 nt, Homo Sapiens; identical to SEQ ID NO: 370828

SEQ ID NO: 643199 - RNA, 64 nt, Homo Sapiens; identical to SEQ ID NO: 370829

SEQ ID NO: 643200 - RNA, 64 nt, Homo Sapiens; identical to SEQ ID NO: 370830

SEQ ID NO: 643201 - RNA, 64 nt, Homo Sapiens; identical to SEQ ID NO: 370831

SEQ ID NO: 643202 - RNA, 64 nt, Homo Sapiens; identical to SEQ ID NO: 370832

SEQ ID NO: 643203 - RNA, 64 nt, Homo Sapiens; identical to SEQ ID NO: 370833

SEQ ID NO: 643204 - RNA, 64 nt, Homo Sapiens; identical to SEQ ID NO: 370834

SEQ ID NO: 643205 - RNA, 64 nt, Homo Sapiens; identical to SEQ ID NO: 370835

SEQ ID NO: 643206 - RNA, 64 nt, Homo Sapiens; identical to SEQ ID NO: 370836

SEQ ID NO: 643207 - RNA, 64 nt, Homo Sapiens; identical to SEQ ID NO: 370837

SEQ ID NO: 643208 - RNA, 64 nt, Homo Sapiens; identical to SEQ ID NO: 370838

SEQ ID NO: 643209 - RNA, 64 nt, Homo Sapiens; identical to SEQ ID NO: 370839

SEQ ID NO: 643210 - RNA, 64 nt, Homo Sapiens; identical to SEQ ID NO: 370840

SEQ ID NO: 643211 - RNA, 64 nt, Homo Sapiens; identical to SEQ ID NO: 370841

SEQ ID NO: 643212 - RNA, 64 nt, Homo Sapiens; identical to SEQ ID NO: 370842

SEQ ID NO: 643213 - RNA, 64 nt, Homo Sapiens; identical to SEQ ID NO: 370843

SEQ ID NO: 643214 - RNA, 64 nt, Homo Sapiens; identical to SEQ ID NO: 370844

SEQ ID NO: 643215 - RNA, 64 nt, Homo Sapiens; identical to SEQ ID NO: 370845

SEQ ID NO: 643216 - RNA, 64 nt, Homo Sapiens; identical to SEQ ID NO: 370846

SEQ ID NO: 643217 - RNA, 64 nt, Homo Sapiens; identical to SEQ ID NO: 370847

SEQ ID NO: 643218 - RNA, 64 nt, Homo Sapiens; identical to SEQ ID NO: 370848

SEQ ID NO: 643219 - RNA, 64 nt, Homo Sapiens; identical to SEQ ID NO: 370849

SEQ ID NO: 643220 - RNA, 64 nt, Homo Sapiens; identical to SEQ ID NO: 370850

SEQ ID NO: 643221 - RNA, 64 nt, Homo Sapiens; identical to SEQ ID NO: 370851

SEQ ID NO: 643222 - RNA, 64 nt, Homo Sapiens; identical to SEQ ID NO: 370852

SEQ ID NO: 643223 - RNA, 64 nt, Homo Sapiens; identical to SEQ ID NO: 370853

SEQ ID NO: 643224 - RNA, 64 nt, Homo Sapiens; identical to SEQ ID NO: 370854

SEQ ID NO: 643225 - RNA, 60 nt, Homo Sapiens; identical to SEQ ID NO: 370855

SEQ ID NO: 643226 - RNA, 64 nt, Homo Sapiens; identical to SEQ ID NO: 370856

SEQ ID NO: 643227 - RNA, 64 nt, Homo Sapiens; identical to SEQ ID NO: 370857

SEQ ID NO: 643228 - RNA, 64 nt, Homo Sapiens; identical to SEQ ID NO: 370858

SEQ ID NO: 643229 - RNA, 64 nt, Homo Sapiens; identical to SEQ ID NO: 370859

SEQ ID NO: 643230 - RNA, 64 nt, Homo Sapiens; identical to SEQ ID NO: 370860

SEQ ID NO: 643231 - RNA, 64 nt, Homo Sapiens; identical to SEQ ID NO: 370861

SEQ ID NO: 643232 - RNA, 64 nt, Homo Sapiens; identical to SEQ ID NO: 370862

SEQ ID NO: 643233 - RNA, 64 nt, Homo Sapiens; identical to SEQ ID NO: 370863

SEQ ID NO: 643234 - RNA, 64 nt, Homo Sapiens; identical to SEQ ID NO: 370864

SEQ ID NO: 643235 - RNA, 64 nt, Homo Sapiens; identical to SEQ ID NO: 370865

SEQ ID NO: 643236 - RNA, 64 nt, Homo Sapiens; identical to SEQ ID NO: 370866

SEQ ID NO: 643237 - RNA, 64 nt, Homo Sapiens; identical to SEQ ID NO: 370867

SEQ ID NO: 643238 - RNA, 64 nt, Homo Sapiens; identical to SEQ ID NO: 370868

SEQ ID NO: 643239 - RNA, 64 nt, Homo Sapiens; identical to SEQ ID NO: 370869

SEQ ID NO: 643240 - RNA, 64 nt, Homo Sapiens; identical to SEQ ID NO: 384913

SEQ ID NO: 643241 - RNA, 64 nt, Homo Sapiens; identical to SEQ ID NO: 384914

SEQ ID NO: 643242 - RNA, 64 nt, Homo Sapiens; identical to SEQ ID NO: 384915

SEQ ID NO: 643243 - RNA, 64 nt, Homo Sapiens; identical to SEQ ID NO: 384916

SEQ ID NO: 643244 - RNA, 64 nt, Homo Sapiens; identical to SEQ ID NO: 384917

SEQ ID NO: 643245 - RNA, 64 nt, Homo Sapiens; identical to SEQ ID NO: 384918

SEQ ID NO: 643246 - RNA, 64 nt, Homo Sapiens; identical to SEQ ID NO: 384919

SEQ ID NO: 643247 - RNA, 64 nt, Homo Sapiens; identical to SEQ ID NO: 384920

SEQ ID NO: 643248 - RNA, 64 nt, Homo Sapiens; identical to SEQ ID NO: 384921

SEQ ID NO: 643249 - RNA, 64 nt, Homo Sapiens; identical to SEQ ID NO: 384922

SEQ ID NO: 643250 - RNA, 64 nt, Homo Sapiens; identical to SEQ ID NO: 384923

SEQ ID NO: 643251 - RNA, 64 nt, Homo Sapiens; identical to SEQ ID NO: 384924

SEQ ID NO: 643252 - RNA, 64 nt, Homo Sapiens; identical to SEQ ID NO: 384925

SEQ ID NO: 643253 - RNA, 64 nt, Homo Sapiens; identical to SEQ ID NO: 384926

SEQ ID NO: 643254 - RNA, 64 nt, Homo Sapiens; identical to SEQ ID NO: 384927

SEQ ID NO: 643255 - RNA, 64 nt, Homo Sapiens; identical to SEQ ID NO: 384928

SEQ ID NO: 643256 - RNA, 64 nt, Homo Sapiens; identical to SEQ ID NO: 384929

SEQ ID NO: 643257 - RNA, 64 nt, Homo Sapiens; identical to SEQ ID NO: 384930

SEQ ID NO: 643258 - RNA, 64 nt, Homo Sapiens; identical to SEQ ID NO: 384931

SEQ ID NO: 643259 - RNA, 64 nt, Homo Sapiens; identical to SEQ ID NO: 384932

SEQ ID NO: 643260 - RNA, 64 nt, Homo Sapiens; identical to SEQ ID NO: 384933

SEQ ID NO: 643261 - RNA, 64 nt, Homo Sapiens; identical to SEQ ID NO: 384934

SEQ ID NO: 643262 - RNA, 64 nt, Homo Sapiens; identical to SEQ ID NO: 384935

SEQ ID NO: 643263 - RNA, 64 nt, Homo Sapiens; identical to SEQ ID NO: 384936

SEQ ID NO: 643264 - RNA, 64 nt, Homo Sapiens; identical to SEQ ID NO: 384937

SEQ ID NO: 643265 - RNA, 64 nt, Homo Sapiens; identical to SEQ ID NO: 384938

SEQ ID NO: 643266 - RNA, 64 nt, Homo Sapiens; identical to SEQ ID NO: 384939

SEQ ID NO: 643267 - RNA, 64 nt, Homo Sapiens; identical to SEQ ID NO: 384940

SEQ ID NO: 643268 - RNA, 64 nt, Homo Sapiens; identical to SEQ ID NO: 384941

SEQ ID NO: 643269 - RNA, 64 nt, Homo Sapiens; identical to SEQ ID NO: 384942

SEQ ID NO: 643270 - RNA, 64 nt, Homo Sapiens; identical to SEQ ID NO: 384943

SEQ ID NO: 643271 - RNA, 64 nt, Homo Sapiens; identical to SEQ ID NO: 384944

SEQ ID NO: 643272 - RNA, 64 nt, Homo Sapiens; identical to SEQ ID NO: 384945

SEQ ID NO: 643273 - RNA, 64 nt, Homo Sapiens; identical to SEQ ID NO: 384946

SEQ ID NO: 643274 - RNA, 64 nt, Homo Sapiens; identical to SEQ ID NO: 384947

SEQ ID NO: 643275 - RNA, 64 nt, Homo Sapiens; identical to SEQ ID NO: 384948

SEQ ID NO: 643276 - RNA, 64 nt, Homo Sapiens; identical to SEQ ID NO: 384949

SEQ ID NO: 643277 - RNA, 64 nt, Homo Sapiens; identical to SEQ ID NO: 384950

SEQ ID NO: 643278 - RNA, 64 nt, Homo Sapiens; identical to SEQ ID NO: 384951

SEQ ID NO: 643279 - RNA, 64 nt, Homo Sapiens; identical to SEQ ID NO: 384952

SEQ ID NO: 643280 - RNA, 64 nt, Homo Sapiens; identical to SEQ ID NO: 384953

SEQ ID NO: 643281 - RNA, 64 nt, Homo Sapiens; identical to SEQ ID NO: 384954

SEQ ID NO: 643282 - RNA, 64 nt, Homo Sapiens; identical to SEQ ID NO: 384955

SEQ ID NO: 643283 - RNA, 64 nt, Homo Sapiens; identical to SEQ ID NO: 384956

SEQ ID NO: 643284 - RNA, 64 nt, Homo Sapiens; identical to SEQ ID NO: 384957

SEQ ID NO: 643285 - RNA, 64 nt, Homo Sapiens; identical to SEQ ID NO: 384958

SEQ ID NO: 643286 - RNA, 64 nt, Homo Sapiens; identical to SEQ ID NO: 384959

SEQ ID NO: 643287 - RNA, 64 nt, Homo Sapiens
auagaugcagaaacaaggaagaaauggagucugcuccugagaagcuucaaauucaggccaggag

SEQ ID NO: 643288 - RNA, 64 nt, Homo Sapiens
gcccucugggguugucugguucccagugagaggcuccugagaaaaauaaagcugguucccagag

SEQ ID NO: 643289 - RNA, 64 nt, Homo Sapiens
gugagcauaugaggaugugacccuacuggcucacuccugagaaugggcuccuguuagaugggca

SEQ ID NO: 643290 - RNA, 64 nt, Homo Sapiens; identical to SEQ ID NO: 132769

SEQ ID NO: 643291 - RNA, 64 nt, Homo Sapiens; identical to SEQ ID NO: 132770

SEQ ID NO: 643292 - RNA, 64 nt, Homo Sapiens
gggagggacagaguguuggagggccagagacuaguccugagauggaaacagcaacuuguacagu

SEQ ID NO: 643293 - RNA, 64 nt, Homo Sapiens
auggcuuugccacaagcuuaccuguggguuucaguccugagaggccaccaccaguucccaucag

SEQ ID NO: 643294 - RNA, 64 nt, Homo Sapiens
acuguacaagguaccccuuucuggcucucccauuuccugagaccacagagagaggggagaagcc

SEQ ID NO: 643295 - RNA, 64 nt, Homo Sapiens
agaggccuguggcuuaugucacccaacagagggguccugagaagucuggcugccugggaugccc

SEQ ID NO: 643296 - RNA, 64 nt, Homo Sapiens
uuucccucuguggcaguuacgauuuugacuucaguccugagaaaaacuucagguuuugaaaauc

SEQ ID NO: 643297 - RNA, 64 nt, Homo Sapiens
uguacacagcagaucaguacuguucaacagaacuuccugagaugauggaaauguucuaccucug

SEQ ID NO: 643298 - RNA, 64 nt, Homo Sapiens
aaggcuucauuaaauuaaucucacuuugaauaucuccugagagauggacaaugaaauaucaguu

SEQ ID NO: 643299 - RNA, 64 nt, Homo Sapiens
uuaacaugcuggauugcccuagucuucagaaugguccugagaaaacaucacuacuucgauguuc

SEQ ID NO: 643300 - RNA, 64 nt, Homo Sapiens
gaugugccgauccuugucaaaaugagauuccagguccugagagcugcuuugaggcaguuccagg

SEQ ID NO: 643301 - RNA, 64 nt, Homo Sapiens; identical to SEQ ID NO: 132771

SEQ ID NO: 643302 - RNA, 64 nt, Homo Sapiens; identical to SEQ ID NO: 132772

SEQ ID NO: 643303 - RNA, 64 nt, Homo Sapiens
gauuugugcugagggucagcuuuuggcuccuucuuccugagacaguggaaacaaugccagcucu

SEQ ID NO: 643304 - RNA, 64 nt, Homo Sapiens
ucugucugauacaauguaaaugacaaaacauaauuccugagaggcccagaacaaacuggagucu

SEQ ID NO: 643305 - RNA, 64 nt, Homo Sapiens
uuccuuuccugaucaaggugcucuucucauuuuuuccugagaaccuuagccaucagaugaggcu

SEQ ID NO: 643306 - RNA, 64 nt, Homo Sapiens
aggagcgcaaacucauccuuuauaaagacaccacuccugagauaacaauccaaucccaugauaa

SEQ ID NO: 643307 - RNA, 64 nt, Homo Sapiens
cgcggcccagccauuuccacccucgggaggcggcuccugagaaacagggaggaaggggcggagc

SEQ ID NO: 643308 - RNA, 64 nt, Homo Sapiens
agggaaagcagugccugccagcuguugugcaccuuccugagaaauaaauauccucuaaauuuuc

SEQ ID NO: 643309 - RNA, 64 nt, Homo Sapiens
gugugggggaguaggugacgaaacacuagaccucuccugagagagaauugcugcuuccugaauc

SEQ ID NO: 643310 - RNA, 64 nt, Homo Sapiens
ccucucucugaaauacgguaaagauuuaaauagguccugagacuguugauagccccagacauac

SEQ ID NO: 643311 - RNA, 64 nt, Homo Sapiens; identical to SEQ ID NO: 132773

SEQ ID NO: 643312 - RNA, 64 nt, Homo Sapiens; identical to SEQ ID NO: 132774

SEQ ID NO: 643313 - RNA, 64 nt, Homo Sapiens; identical to SEQ ID NO: 132775

SEQ ID NO: 643314 - RNA, 64 nt, Homo Sapiens
gguuuggaucucccugcauguugucgagaggauuuccugagacuauccacauaguaguguucgu

SEQ ID NO: 643315 - RNA, 64 nt, Homo Sapiens
gcgaggagagugguuguugccaguggguggcaccuccugagaaguugcguccugcagaggacca

SEQ ID NO: 643316 - RNA, 64 nt, Homo Sapiens
gggguuugaaaggaaggugaaguuucagacccuauccugagaauaagccuuuucugcaggcagg

SEQ ID NO: 643317 - RNA, 64 nt, Homo Sapiens
gaaaaguguccuucuugcucugccuugcuguuuguccugagaugaucuuagaagcacuacaccu

SEQ ID NO: 643318 - RNA, 64 nt, Homo Sapiens
uccuguuacaguaaacaaaagagugucuaaggacuccugagaaucuggagaucaacccacauua

SEQ ID NO: 643319 - RNA, 64 nt, Homo Sapiens
gcaaguaaggaauuaauaggauuuuuugucuugauccugagaauauaaguuuuugcuugcucau

SEQ ID NO: 643320 - RNA, 64 nt, Homo Sapiens
uauccacauacaggaaacagccagcuucaucuuguccugagauugguaguaggaggagccuguc

SEQ ID NO: 643321 - RNA, 64 nt, Homo Sapiens
ccaggaagucaggaaaagccucaccucuggcuauuccugagaccaguaaaaaaggcaaaucuuu

SEQ ID NO: 643322 - RNA, 64 nt, Homo Sapiens
guucuacaguuucuuugacuuuuuauuguuuacauccugagacuuauaacuccuuggucaguga

SEQ ID NO: 643323 - RNA, 64 nt, Homo Sapiens
uaagagaaauaauguuccuauaacuaaauauguuuccugagagauuuaguuuuuuuucauauua

SEQ ID NO: 643324 - RNA, 64 nt, Homo Sapiens
aaaaaauaaaucuuuuauucuaacuuucuguuuuuccugagaaaucaaauguaguguguuuccc

SEQ ID NO: 643325 - RNA, 64 nt, Homo Sapiens
auuaauugugguauucuggucuauuaauaaucuauccugagaauccauucuuauuccuaggcaa

SEQ ID NO: 643326 - RNA, 64 nt, Homo Sapiens
aaguguguuuauucuuuugcgauggugguuccuauccugagagcgcuuugcugucugugaugua

SEQ ID NO: 643327 - RNA, 64 nt, Homo Sapiens
ucaggcaggauuggagaucagccgaagcacgggguccugagaccgggcaaggggcccaggggca

SEQ ID NO: 643328 - RNA, 64 nt, Homo Sapiens
ugguauaaaaugaagaaauccuucccucagccauuccugagacuuucugaucaaauaaccaugg

SEQ ID NO: 643329 - RNA, 64 nt, Homo Sapiens
gguggguaacagauauuccaguccugguucuuguuccugagaaguuugacacauacuccccguc

SEQ ID NO: 643330 - RNA, 64 nt, Homo Sapiens
cauaagaaaaaugacugguguagaaaacaguagguccugagaacaaacagugauaaucucaagu

SEQ ID NO: 643331 - RNA, 64 nt, Homo Sapiens
ggucauuucucccacacacgauuauauucccacauccugagaaaggucaucaggaguacagccu

SEQ ID NO: 643332 - RNA, 64 nt, Homo Sapiens
gagucucgcucuguagccuauuucucuuuuuuuuuccugagacguuccuaucuucuaaaccaga

SEQ ID NO: 643333 - RNA, 64 nt, Homo Sapiens
ggucacugaacacacgaauaacuuggauagcaaauccugagacaauggaaaaccauuaacuuua

SEQ ID NO: 643334 - RNA, 64 nt, Homo Sapiens
uaaauauggcauuuuccccccuucagcugcagguuccugagauuuggugccugugagcucugau

SEQ ID NO: 643335 - RNA, 64 nt, Homo Sapiens
ccucuuuuauauauggaguucucuccucuuuauauccugagacuuugacaccagauguagauau

SEQ ID NO: 643336 - RNA, 64 nt, Homo Sapiens
auccagggauuacuggccuccagagucuucaagauccugagaacuuggaauuccuuguaacugg

SEQ ID NO: 643337 - RNA, 64 nt, Homo Sapiens
ggacccuguagagucacugacccuggagcggcucuccugagaggugcugcaggcaaagugagac

SEQ ID NO: 643338 - RNA, 64 nt, Homo Sapiens
ucccagucaucugguuuguuuguuucuuuguucguccugagacggagucucgcucugucgccag

SEQ ID NO: 643339 - RNA, 64 nt, Homo Sapiens
uaacuaguggauuugggaaagguucuuaaguagauccugagacuauuugcaugcuucugucuaa

SEQ ID NO: 643340 - RNA, 64 nt, Homo Sapiens
cacuagagaauucuacaaaacaagcaaaaacacauccugagacaccucagggcugcauucagcu

SEQ ID NO: 643341 - RNA, 64 nt, Homo Sapiens
agaaugcuugugauuuuuguacauugauuuuguauccugagacuuugcugaaguugcuuaucag

SEQ ID NO: 643342 - RNA, 64 nt, Homo Sapiens
aaaaaacacauuuauuaauggaugcuaaagugauuccugagaaaaauaauguguaugguuaaua

SEQ ID NO: 643343 - RNA, 64 nt, Homo Sapiens
aagcaccacucagaugggcagcuggacucugguguccugagacucugcccucuucccacagccu

SEQ ID NO: 643344 - RNA, 64 nt, Homo Sapiens
ggcgcgugcaggcagcaggauagagugggacaguuccugagaccagccaaccugggggcuuuag

SEQ ID NO: 643345 - RNA, 64 nt, Homo Sapiens
cuuuggagaacaugcucucuuuucaccccccaccuccugagagccacuaauguaagauacagaa

SEQ ID NO: 643346 - RNA, 64 nt, Homo Sapiens
cugauacauacacucauacaaaaaagcuauauuuuccugagagaaugauggcccaaaauuuauu

SEQ ID NO: 643347 - RNA, 64 nt, Homo Sapiens
ucaguccaauugccagagaaaagugcuagcgcuuuccugagaaguaugauccuggauuuagcca

SEQ ID NO: 643348 - RNA, 64 nt, Homo Sapiens
ggucaccuauugcugccugcgaccccauuacuuuuccugagacuuuggucugugugaauuaugg

SEQ ID NO: 643349 - RNA, 64 nt, Homo Sapiens
uauuuuuucuuuaagucuugucagcuacacuuaguccugagauggaauuuuuguguuuuucuuu

SEQ ID NO: 643350 - RNA, 64 nt, Homo Sapiens
uagcuaugaucaguauguucaugauacuaacaguuccugagacuaggaaaaguuauuaccguuu

SEQ ID NO: 643351 - RNA, 64 nt, Homo Sapiens
cugagaaauguccugaagucagagauaccugacauccugagacauuguuccuuucauuuacaaa

SEQ ID NO: 643352 - RNA, 64 nt, Homo Sapiens
uuuacaacugggagaaaugugauagaauuuuagcuccugagauacuacuucauuauuaaaaauu

SEQ ID NO: 643353 - RNA, 64 nt, Homo Sapiens
cuugaaguaauggcugaucccuguuugaaguugauccugagacugccauucacaagaacuuuga

SEQ ID NO: 643354 - RNA, 64 nt, Homo Sapiens
gcucugcagauaagaaaauaguuaugauuucauauccugagauaaaauuacuaguugcuagcau

SEQ ID NO: 643355 - RNA, 64 nt, Homo Sapiens
gcuccggcccagaaugggaaacccauccacucacuccugagaggaaggugggacaguaccccgg

SEQ ID NO: 643356 - RNA, 64 nt, Homo Sapiens
aagcccuggcuuccaaggcuccugagucuuguccuccugagaggaaacuuguccugcugcaguc

SEQ ID NO: 643357 - RNA, 64 nt, Homo Sapiens
ucauccacucacuggggagauuggacuagaggaguccugagaggacacuuccaacaagagacau

SEQ ID NO: 643358 - RNA, 64 nt, Homo Sapiens
ggaguaaccuguuuuuguaguuuggaugaauauguccugagaaauuuccauccacuuugguuca

SEQ ID NO: 643359 - RNA, 64 nt, Homo Sapiens
gaagcggccaagaaugucauucucaaugcccagauccugagauuggacccauacccugucucca

SEQ ID NO: 643360 - RNA, 64 nt, Homo Sapiens
cccaauagaaaaauggggauauuuccuaggguuguccugagaauaaaaugaguucugugugaca

SEQ ID NO: 643361 - RNA, 64 nt, Homo Sapiens
cuuucaugaccccaggcaacagccagggccccacuccugagagacacuggcaacaccucuuagu

SEQ ID NO: 643362 - RNA, 64 nt, Homo Sapiens
cagagcaagacccaucucaaaaaaaaaauuuuuuuccugagaggaagccugagguugaccagcu

SEQ ID NO: 643363 - RNA, 64 nt, Homo Sapiens
auguggcaacacccucugccaagagacagagcuguccugagaaugcuuuguccuucugagccca

SEQ ID NO: 643364 - RNA, 64 nt, Homo Sapiens
gggugauuuuaauucuaucugcuuccuccauuucuccugagaguagcagacuuucaguguaaau

SEQ ID NO: 643365 - RNA, 64 nt, Homo Sapiens
ggugaaagagggcuugguuucugugcuaccugauuccugagauuugugaaguuagagugcuugg

SEQ ID NO: 643366 - RNA, 64 nt, Homo Sapiens
aguauuuccuggagcugugcgacaaguugcuggcuccugagacccugagggcucaaaacuccug

SEQ ID NO: 643367 - RNA, 64 nt, Homo Sapiens
ucuugcuggaaccaaggcaacuguggaaagcccauccugagacacuggcuucucugguucuucc

SEQ ID NO: 643368 - RNA, 64 nt, Homo Sapiens
guggcucccccucuggaggacugcuccuucgggguccugagauuaaggagccacuugaaaaugu

SEQ ID NO: 643369 - RNA, 64 nt, Homo Sapiens
acccccuccccauugucagggggaugccugccccuccugagagguuccccaggccaggguugcu

SEQ ID NO: 643370 - RNA, 64 nt, Homo Sapiens
cugggaaaggugcucaaagagggggucuauacauuccugagauugcggguaugaaguguggggc

SEQ ID NO: 643371 - RNA, 64 nt, Homo Sapiens
ggcacuguguaaguuuuagugugagcuacugaccuccugagacucaguuuaucuguugaguucu

SEQ ID NO: 643372 - RNA, 64 nt, Homo Sapiens
guuugcuaauuuaaaaaugugauaccuuuaucauuccugagacauauccccuugcuacuuuacu

SEQ ID NO: 643373 - RNA, 64 nt, Homo Sapiens
agcacaggaaucuucuucuuagugggacauauuuuccugagagccuuuauugaauuagaaaaca

SEQ ID NO: 643374 - RNA, 64 nt, Homo Sapiens
uuucugcgugauggcuaugcgguguaguucugaguccugagacuuaaaaagauccugcauuuau

SEQ ID NO: 643375 - RNA, 64 nt, Homo Sapiens
gccaagcgggagaaugggcaggcuccagccuuuguccugagauauuacggacaaaccuacugug

SEQ ID NO: 643376 - RNA, 64 nt, Homo Sapiens; identical to SEQ ID NO: 132776

SEQ ID NO: 643377 - RNA, 64 nt, Homo Sapiens; identical to SEQ ID NO: 132777

SEQ ID NO: 643378 - RNA, 64 nt, Homo Sapiens
ggauguauauaaaauuaagaugauaagaaagugcuccugagaaggcucuugccagaagccugau

SEQ ID NO: 643379 - RNA, 64 nt, Homo Sapiens
cagccagguucuccagugguaucugccuccauuuuccugagaucaaaaagacuguuucgaaacc

SEQ ID NO: 643380 - RNA, 64 nt, Homo Sapiens
uccccccgaggcgcucugggcaggcauccugguguccugagaggcucuugcaggaaugauacgu

SEQ ID NO: 643381 - RNA, 64 nt, Homo Sapiens
gaggaacugugauuggcacgugcagauacaaugcuccugagaagacagcauuuuccacaggagg

SEQ ID NO: 643382 - RNA, 64 nt, Homo Sapiens
cagcaagaaagauugugaugcaagauuucuuucuuccugagacaaaaaaaaaaaaagaaaaaaa

SEQ ID NO: 643383 - RNA, 64 nt, Homo Sapiens
aaggcuuccuaucuguguggugaugaaucgcauuuccugagaacaaaauaaaaggauuuuucug

SEQ ID NO: 643384 - RNA, 64 nt, Homo Sapiens
caguuaaaggugggucaguagccuugcagaacuguccugagaaguuauugcuggugcuggccag

SEQ ID NO: 643385 - RNA, 50 nt, Homo Sapiens
uuggcagacucguauuuugauccugagagaguccaaaaugcacuggucac

SEQ ID NO: 643386 - RNA, 64 nt, Homo Sapiens; identical to SEQ ID NO: 132778

SEQ ID NO: 643387 - RNA, 64 nt, Homo Sapiens; identical to SEQ ID NO: 132779

SEQ ID NO: 643388 - RNA, 64 nt, Homo Sapiens
auuuaaaauguuuuuucuuuaucuuguuauuguuuccugagauuuauuuauuuucggggagagg

SEQ ID NO: 643389 - RNA, 64 nt, Homo Sapiens
uaccucacauuccaaugccaauugccacucuguuuccugagagaggguagguuucauccuaccc

SEQ ID NO: 643390 - RNA, 64 nt, Homo Sapiens
uucccagccaugcaaaacugcaugauuguaaguauccugagaccguguuuguuuccccuuuggu

SEQ ID NO: 643391 - RNA, 64 nt, Homo Sapiens
gauuuaauucuugaugcuggcuggguucugugaguccugagaugcucaaagguggcaaguuguc

SEQ ID NO: 643392 - RNA, 64 nt, Homo Sapiens
aaauucagauuaggagauauggaauaguuuccuguccugagacgaagccugcgaggaagccuau

SEQ ID NO: 643393 - RNA, 64 nt, Homo Sapiens
ugucaaaauuguuuaaaaauucuugaaagaauuuuccugagacaaauuuuaacuucuugucuau

SEQ ID NO: 643394 - RNA, 64 nt, Homo Sapiens
caguggcugacaaggcauauagggauauaugccauccugagaggaguaaaguguuuagauucug

SEQ ID NO: 643395 - RNA, 64 nt, Homo Sapiens
aauuugaccuaggcaaguuuguucaaaagguagauccugagaugauuuggucagauugggauaa

SEQ ID NO: 643396 - RNA, 64 nt, Homo Sapiens
uagugaauguaggcuggcuuucagaguaggcuauuccugagagcugcauguguccgcccccgau

SEQ ID NO: 643397 - RNA, 64 nt, Homo Sapiens
uaucuaacagacaagagugguauauacaaguagauccugagaaguaccuuuguuacagcuacua

SEQ ID NO: 643398 - RNA, 64 nt, Homo Sapiens
aaugaaugguuuaggauuucaaauagugauacccuccugagacaugagcauuuggagaggccug

SEQ ID NO: 643399 - RNA, 64 nt, Homo Sapiens
cccgugcuguaucagcuguaaagaauaugaaucuuccugagaucccaagaaauauuaacauugg

SEQ ID NO: 643400 - RNA, 64 nt, Homo Sapiens
ccuagagacugcuucuuguguuugugucauucuguccugagaaaugaagucaucugaaaaauaa

SEQ ID NO: 643401 - RNA, 64 nt, Homo Sapiens
agugucauuccaaauccaugcaugcuguugauuuuccugagauuuuuuucucuucuuguuggua

SEQ ID NO: 643402 - RNA, 64 nt, Homo Sapiens
aucagaagucuaauaccugggcagguuuauaacauccugagagccagccugacauuagacagaa

SEQ ID NO: 643403 - RNA, 64 nt, Homo Sapiens
aaagcuaccacagauauaaggguguuaugcugaauccugagaagcuuucaagaaccagagaacc

SEQ ID NO: 643404 - RNA, 64 nt, Homo Sapiens
gccuccucuucugcacagaaugcuuccaccagcauccugagaagaaaugauuacuucugaaaaa

SEQ ID NO: 643405 - RNA, 64 nt, Homo Sapiens
auuuuuguaagaccaauaccugggaugagaagaauccugagacugccuggaggugagguagaaa

SEQ ID NO: 643406 - RNA, 64 nt, Homo Sapiens
augcgguggcugccuauguuggcucgcuuugcuuuccugagaaguggacugugaggguagagua

SEQ ID NO: 643407 - RNA, 64 nt, Homo Sapiens
ucggcagauaauaaaacagaaguacugaccaaaguccugagaacaguguguauacaggauguca

SEQ ID NO: 643408 - RNA, 64 nt, Homo Sapiens
uugugucccugagucuccuuaggugaacugugcauccugagaccagcccagguacaugaggcca

SEQ ID NO: 643409 - RNA, 64 nt, Homo Sapiens
acuuuacaagucuguacgaauaagcauaaaagauuccugagaugaaauggggcugaggaaacuu

SEQ ID NO: 643410 - RNA, 64 nt, Homo Sapiens
aagaaaguuucacccaauaaagaaccaaaaguuuuccugagaauagcauaauaaauuauauuaa

SEQ ID NO: 643411 - RNA, 64 nt, Homo Sapiens
cgaaccuugguucccuaaccaugaaauugugauuuccugagaauaauucauauugaguaaauga

SEQ ID NO: 643412 - RNA, 64 nt, Homo Sapiens
ucuagacuggugcguugugggagcuggggcaggcuccugagaugccucaccucccacccccuga

SEQ ID NO: 643413 - RNA, 52 nt, Homo Sapiens
cugcagaaauuauggccuaacuuccugagagaccgaacccccucaccugaau

SEQ ID NO: 643414 - RNA, 64 nt, Homo Sapiens
uggcuucggcggcugaaucuaagaauacgcggucuccugagaacuucaaaaaacaaaaacaaaa

SEQ ID NO: 643415 - RNA, 64 nt, Homo Sapiens
cucuggggaucaggaaccacacaauccccaggguuccugagaccccaggccuaaaccugagacu

SEQ ID NO: 643416 - RNA, 64 nt, Homo Sapiens
aucuguccaccuguuccccaguauugcccucaauuccugagagcccuggagcgguuuccuacca

SEQ ID NO: 643417 - RNA, 64 nt, Homo Sapiens
uccucugagaguccuuccaguguccuccccagccuccugagacuccggugggcugccaugcccu

SEQ ID NO: 643418 - RNA, 64 nt, Homo Sapiens
aagccuuuuauuauaacacuaaaacuggacagucuccugagacaagaccuccuacuguacucuu

SEQ ID NO: 643419 - RNA, 64 nt, Homo Sapiens
ggaaccauguguccacuggcguuggggaguugguuccugagaggucugagggccagagcugccc

SEQ ID NO: 643420 - RNA, 64 nt, Homo Sapiens
ggaaguucuaucuugugauacggaaacaauaaauuccugagauacauucuuccaaucuguggua

SEQ ID NO: 643421 - RNA, 64 nt, Homo Sapiens
gaaccccccacauacaccccucacaagccaccccuccugagaggcagggggcccuccgcccccu

SEQ ID NO: 643422 - RNA, 64 nt, Homo Sapiens
cccaagcuucugcagggggugauuuuugcucuuguccugagaaauaacagugcuguuuuaaaaa

SEQ ID NO: 643423 - RNA, 64 nt, Homo Sapiens
ccugaugagcucugagcccacccagcauccucuguccugagaccccugauuuugaagcugagga

SEQ ID NO: 643424 - RNA, 64 nt, Homo Sapiens
uuucuucagcucuggggaaaaugccacaguguucuccugagagaacauccuugcuuugagucag

SEQ ID NO: 643425 - RNA, 64 nt, Homo Sapiens
gcuucucuugugugugccucagcucugaagaaguuccugagaauggguuacagaugucauguua

SEQ ID NO: 643426 - RNA, 64 nt, Homo Sapiens
agguagagucccauuucuuaugggaccugugugcuccugagaacucuuacuugagacaucaaaa

SEQ ID NO: 643427 - RNA, 64 nt, Homo Sapiens
cagauuuguguacaauauacccauugaauguauauccugagaaaaauuggggccaaagaagcag

SEQ ID NO: 643428 - RNA, 64 nt, Homo Sapiens
uuggagaguguaaacaucauauaugauucuguguuccugagaucuggguuuaacgaucugggcu

SEQ ID NO: 643429 - RNA, 64 nt, Homo Sapiens
ugcccguugcugagcacaaugguuuugucgccguuccugagaggagaaacacaugguaaggcgg

SEQ ID NO: 643430 - RNA, 64 nt, Homo Sapiens
gccagaauacuggagaccagugcauuugcccucauccugagaaggggaagagaaggagcuuggg

SEQ ID NO: 643431 - RNA, 64 nt, Homo Sapiens
agaaauacauauuaugaagcgcuuugccaguaguuccugagaccgcugucagaagacuuaggaa

SEQ ID NO: 643432 - RNA, 64 nt, Homo Sapiens
gaaaggaucugcccugaccacccccucaacagccuccugagaaguguuuagagcaugacacucu

SEQ ID NO: 643433 - RNA, 59 nt, Homo Sapiens
ugggaaggaucagauaugacgccugauuguccugagaaaccccagucccaggaggcuga

SEQ ID NO: 643434 - RNA, 64 nt, Homo Sapiens
gggaagaugauuccuuggagagcagaugcacacauccugagagaaagguaagagugggaggcug

SEQ ID NO: 643435 - RNA, 64 nt, Homo Sapiens
cugccucccuggagcccaugugcugguaccagucuccugagacacauuaggcccagacugcugc

SEQ ID NO: 643436 - RNA, 64 nt, Homo Sapiens; identical to SEQ ID NO: 132780

SEQ ID NO: 643437 - RNA, 64 nt, Homo Sapiens; identical to SEQ ID NO: 132781

SEQ ID NO: 643438 - RNA, 64 nt, Homo Sapiens
aacuuuguauguuaagguuuaggaaauaugauccuccugagacuauuuauaagaaaugaaugga

SEQ ID NO: 643439 - RNA, 64 nt, Homo Sapiens
caaucacagaccacaugagaggaaaauaagggaauccugagaaacucaaaacuguaaaaaucau

SEQ ID NO: 643440 - RNA, 64 nt, Homo Sapiens
gccucauagguagacaguucucacacgucccagguccugagagccugcuccccggauaccguga

SEQ ID NO: 643441 - RNA, 64 nt, Homo Sapiens
cuggacuuuuuacaagucuugauaauuuucauauuccugagaaagccccaaccagguuucugaa

SEQ ID NO: 643442 - RNA, 64 nt, Homo Sapiens
acaucuggacuuaagaguuuaccagguuuaguuauccugagaaaacuucuauauaggugauuuu

SEQ ID NO: 643443 - RNA, 64 nt, Homo Sapiens
ugugcugguggagagguccugagaccagcaggacuccugagaacgacccuuagaacagcacugg

SEQ ID NO: 643444 - RNA, 64 nt, Homo Sapiens
aaaucuuuuucuuagaaaaaaucuauuuucguauuccugagaacugucugggucaguuccuugu

SEQ ID NO: 643445 - RNA, 64 nt, Homo Sapiens
cgagaacguccucugaacacugcuuugguuucacuccugagauaugggggaaagauguacagga

SEQ ID NO: 643446 - RNA, 64 nt, Homo Sapiens
uuugggcacugcagcucuggacuuuucuggccccuccugagaugaccugauggagcugaugcuu

SEQ ID NO: 643447 - RNA, 64 nt, Homo Sapiens
cuuguuuuacauuauauauauguucguaauuguuuccugagaauuacaaugaauaauaauuugc

SEQ ID NO: 643448 - RNA, 64 nt, Homo Sapiens
aaaucucuguagaguuagucuucuccuuuucucuuccugagaaguucuccugccugcauaacca

SEQ ID NO: 643449 - RNA, 64 nt, Homo Sapiens; identical to SEQ ID NO: 132782

SEQ ID NO: 643450 - RNA, 64 nt, Homo Sapiens; identical to SEQ ID NO: 132783

SEQ ID NO: 643451 - RNA, 64 nt, Homo Sapiens
gaggcacaguguugauggggcagugaccagacaguccugagacccagaaggcccagguggccca

SEQ ID NO: 643452 - RNA, 64 nt, Homo Sapiens
ucugugcaaccuuacuaugugcaauauuuuuaaauccugagaaaugugugcuuuuguuuucgga

SEQ ID NO: 643453 - RNA, 64 nt, Homo Sapiens
cuccaguggugaagaaaacuccuuuagcaggugguccugagaccugacaagcacugcuaggcga

SEQ ID NO: 643454 - RNA, 64 nt, Homo Sapiens
cuagaugugaaaaugaagagagaggguuuuaccauccugagaagaaauaaugauggaaacaugu

SEQ ID NO: 643455 - RNA, 64 nt, Homo Sapiens
cuagacucuguaaccaccucucugucuuuuuccuuccugagaaacguccaucucucucccuuac

SEQ ID NO: 643456 - RNA, 64 nt, Homo Sapiens
aguguggaggagaaacucuuggccuaucaagugcuccugagagaaaccaugcaauuuaacacuu

SEQ ID NO: 643457 - RNA, 64 nt, Homo Sapiens
ggugcccucccuacgaggaguguagugcgccguguccugagagacuaaaaacagucucacccca

SEQ ID NO: 643458 - RNA, 64 nt, Homo Sapiens
aguaugaggccugcaagaaaacccuuuaugugauuccugagagcguuuuaaaccuaacucaaca

SEQ ID NO: 643459 - RNA, 64 nt, Homo Sapiens; identical to SEQ ID NO: 132784

SEQ ID NO: 643460 - RNA, 64 nt, Homo Sapiens; identical to SEQ ID NO: 132785

SEQ ID NO: 643461 - RNA, 64 nt, Homo Sapiens
uaggaaacuaaaacuucuuucaaaauagucauauuccugagaaguggcaaacaucccagcuaau

SEQ ID NO: 643462 - RNA, 64 nt, Homo Sapiens
gucucuacccauguuuaaccccaagagguccucauccugagacgagcagagguuuguacuuucc

SEQ ID NO: 643463 - RNA, 64 nt, Homo Sapiens
gguuggugacagcagccgggccuucugccuaccuuccugagagucuacaguuucuccugcguaa

SEQ ID NO: 643464 - RNA, 64 nt, Homo Sapiens
agccacaaaagaugugcaaacaaggcccacauuuuccugagagagcacuagcauuggaugucgc

SEQ ID NO: 643465 - RNA, 64 nt, Homo Sapiens
ccggccucucaugcucccggcaccagcaucucccuccugagauguguggccauggcucugugcc

SEQ ID NO: 643466 - RNA, 64 nt, Homo Sapiens
accuggaugagaagaauaaaugacacggauacacuccugagaagacacucguuaaacauugcau

SEQ ID NO: 643467 - RNA, 64 nt, Homo Sapiens
ccuggguuccgucugauuuuagguuccaggaacuuccugagaacacccgaucgcagaggguaau

SEQ ID NO: 643468 - RNA, 64 nt, Homo Sapiens
ugauuccgggugguuggcaaacucaucgugucuguccugagaggcuccacaaugcccacccgca

SEQ ID NO: 643469 - RNA, 64 nt, Homo Sapiens
uaguucuuauaguguacuccaccuuuuacuuuuuuccugagacaaaucuacccuuauucuuucu

SEQ ID NO: 643470 - RNA, 64 nt, Homo Sapiens
ggagagcaaauuugaacaaaagguuuuucuuauauccugagauugagggguaggggguguccaa

SEQ ID NO: 643471 - RNA, 64 nt, Homo Sapiens
uaguaauagcuucaaaagaacacauacagaguaauccugagaguaagcaaaggaaccaugagaa

SEQ ID NO: 643472 - RNA, 64 nt, Homo Sapiens
uuggaaaagguggaaggaagauuaccuccccuaauccugagacuucaguuucuuuccaaaacuu

SEQ ID NO: 643473 - RNA, 64 nt, Homo Sapiens
guaagaaaagcauuuuuuaauuaacugaagaauauccugagauuuuuucugauugugguucagu

SEQ ID NO: 643474 - RNA, 64 nt, Homo Sapiens
guguguugguggcugugcgcugugaaacgggaaguccugagaguugccuuaaaaguucccugua

SEQ ID NO: 643475 - RNA, 64 nt, Homo Sapiens
gguauugcacuauuuuauuucagaagaguguuuauccugagauuugcuuauuccuuaaaaacaa

SEQ ID NO: 643476 - RNA, 64 nt, Homo Sapiens
uaaucaagaacauauuuaauagaagaguuacuauuccugagaaaagagaaauaccagguaggaa

SEQ ID NO: 643477 - RNA, 64 nt, Homo Sapiens
ggggcugacccugccuugggaggaaccccccgucuccugagagucacaaaggccccgguaguga

SEQ ID NO: 643478 - RNA, 64 nt, Homo Sapiens
ccuggccuccggcgucagccccccccacacucacuccugagaccgaucugugcuuuccagcuca

SEQ ID NO: 643479 - RNA, 64 nt, Homo Sapiens
cgaaauuggaagguucccuggugcugccucacacuccugagauccagaccacgagaagugaccu

SEQ ID NO: 643480 - RNA, 64 nt, Homo Sapiens
aguuuguagacgaaaugugccauuauauuagcuuuccugagacuguaucuaaugggcaagucag

SEQ ID NO: 643481 - RNA, 58 nt, Homo Sapiens
augaacuuucgucuaagugauucacucauccugagacuuucuuuuugcaguggagaga

SEQ ID NO: 643482 - RNA, 56 nt, Homo Sapiens
cagcugcuggucgccaguaauaaguauccugagagcccagaaaagguacacuuugc

SEQ ID NO: 643483 - RNA, 64 nt, Homo Sapiens
aauugauaggagggaacauguccuaauucuucuguccugagaagcauguaauguuaauguuaua

SEQ ID NO: 643484 - RNA, 64 nt, Homo Sapiens
uuuuuucuuaugcgggucuuuuauauauuagggauccugagauacccgauucuauauguaaaag

SEQ ID NO: 643485 - RNA, 64 nt, Homo Sapiens
uauaaaauaucuaucuuuucaucaugucuauaguuccugagauuuuaaaaaaauuugcuuagua

SEQ ID NO: 643486 - RNA, 64 nt, Homo Sapiens
gguaguuaggcacccaugaaugucuccagagacauccugagaggcaagauuccucuuaauugau

SEQ ID NO: 643487 - RNA, 64 nt, Homo Sapiens
ucuuccuagcccuucaggcuagaguaggcuuugauccugagaaccuugcuguugcucugaggag

SEQ ID NO: 643488 - RNA, 64 nt, Homo Sapiens
cugccagccgaucgggucaggcaaguccaucccguccugagagccccaggccccccuucgaccu

SEQ ID NO: 643489 - RNA, 64 nt, Homo Sapiens
acauuuuaacuuaccaugacuuugcuccuuccuuuccugagaaaauauuuccacuggauuuuuu

SEQ ID NO: 643490 - RNA, 64 nt, Homo Sapiens
ugagguuguggcuuauacugcagcagacuggcuuuccugagacuuuucucaguaacuuacuauc

SEQ ID NO: 643491 - RNA, 64 nt, Homo Sapiens
uguuaaagguucacaggggugguuuaccacuaacuccugagaaauuuaaaaauacauguucaug

SEQ ID NO: 643492 - RNA, 64 nt, Homo Sapiens
cauuccccacucacuuugugaggcaagcagugacuccugagagacccaggaacagcagaggugg

SEQ ID NO: 643493 - RNA, 64 nt, Homo Sapiens
ccugcccucucugcgcugaggcugcucagccucauccugagagaagguggccaggcaggcgggg

SEQ ID NO: 643494 - RNA, 64 nt, Homo Sapiens
caacaaaaugugugccuucaucugaaaugggaguuccugagauagggucggaagacaaggggcu

SEQ ID NO: 643495 - RNA, 64 nt, Homo Sapiens
aaggggaaauuaauucuauucuaugcugcaggaauccugagaaagcuggacagaguuuuaagca

SEQ ID NO: 643496 - RNA, 64 nt, Homo Sapiens
gaaagcacaaauuuaauacaggacagcccccuguuccugagaugccccagggaaaaccaggcug

SEQ ID NO: 643497 - RNA, 64 nt, Homo Sapiens
agaagaggggaaagcaagaguuguauuuaauucuuccugagaacaggucuaaaauuccaugauu

SEQ ID NO: 643498 - RNA, 64 nt, Homo Sapiens
cagcuggccggcacaacaggugucugcagucagcuccugagacacuugagggacccagaccagg

SEQ ID NO: 643499 - RNA, 64 nt, Homo Sapiens
cagcccuuagaggcuccuucgaguggggccuugguccugagaaucucagggcugggucuccaga

SEQ ID NO: 643500 - RNA, 64 nt, Homo Sapiens
uguuuuugggugaguuuccccccuccuuauucuguccugagaccacgggcaaagcucuucauuu

SEQ ID NO: 643501 - RNA, 64 nt, Homo Sapiens
accguaaguacugaggguaguuucccuaagucuguccugagaaaaagcauacuuaguacuccug

SEQ ID NO: 643502 - RNA, 64 nt, Homo Sapiens
caaggcagauauuccagucauauuaacagaacacuccugagacaguugaagaagaaauagcaca

SEQ ID NO: 643503 - RNA, 64 nt, Homo Sapiens
caagcccaggagugcagacacugcccuaauugcuuccugagaauucccauauuaauaaagaaga

SEQ ID NO: 643504 - RNA, 64 nt, Homo Sapiens
acaaaccaaacucuaaacuuucucagauuaaaaguccugagaccugaagauuguaauauucaug

SEQ ID NO: 643505 - RNA, 64 nt, Homo Sapiens
gggaauggggaacccgcucucccagaccuagggauccugagagggagagacugcaauuucucca

SEQ ID NO: 643506 - RNA, 64 nt, Homo Sapiens
ugugagcuuguccgccaugcuguacccugcaacauccugagaccaaagaccuugugcccuuccc

SEQ ID NO: 643507 - RNA, 64 nt, Homo Sapiens
caggagucuucuucccaacacgagcgcauccauguccugagaaaaagucugugguuuagaaaau

SEQ ID NO: 643508 - RNA, 64 nt, Homo Sapiens
gcaaauguaugucucugaguaggacuuggaccuuuccugagauuuauuuuauccgugauguauu

SEQ ID NO: 643509 - RNA, 64 nt, Homo Sapiens
ugucuaaaaacaccaaaaagucaaugcguacguuuccugagaagguggacacacaaggugcaaa

SEQ ID NO: 643510 - RNA, 64 nt, Homo Sapiens
auaacagugaaacagcguuaccagaguucggauuuccugagaagcaaaucuccuuggauuuccu

SEQ ID NO: 643511 - RNA, 64 nt, Homo Sapiens
aaagguuccgcuuggagcaguauuagagauuaccuccugagaaaccagagggcacucugcuugu

SEQ ID NO: 643512 - RNA, 64 nt, Homo Sapiens
agaaacauaguuuuauacaucaggugucaccaccuccugagauauugaauaucacacugaauag

SEQ ID NO: 643513 - RNA, 64 nt, Homo Sapiens
cugacuagcaaccauggaauuuuaaauucugagcuccugagauacuucguugacugaaaggagu

SEQ ID NO: 643514 - RNA, 64 nt, Homo Sapiens
ugaccuggaugcggcccucuaucuauuuauugcuuccugagaacgagaagagaagacaaccucc

SEQ ID NO: 643515 - RNA, 64 nt, Homo Sapiens
aaguuaggaucagaaagaagcaggcuagaccgucuccugagaggcauugcacccucugagggug

SEQ ID NO: 643516 - RNA, 64 nt, Homo Sapiens
guuuccuaacagcuuuguaacaguauaaauugguuccugagaggagagagaggaauggaaucga

SEQ ID NO: 643517 - RNA, 64 nt, Homo Sapiens
ccagagaggaaguuuguucaauguccacccugauuccugagaggaggcccugcuguugugagcc

SEQ ID NO: 643518 - RNA, 64 nt, Homo Sapiens
uaaaugucuuuuuuauucuuucucuaacacuuguuccugagaaccuggaggguuguguaucagu

SEQ ID NO: 643519 - RNA, 64 nt, Homo Sapiens
cugugcugcccgagcaccucccccgccccuuuacuccugagaacuuugcagcugcccuucccuc

SEQ ID NO: 643520 - RNA, 64 nt, Homo Sapiens
gcaaucaacugagguuucuuaauugugauuauauuccugagaaugaaugaguaggaaaggaaua

SEQ ID NO: 643521 - RNA, 64 nt, Homo Sapiens
cauaaaugacaccugagguccguagaagcuaagcuccugagacccagggggaccugccacuggu

SEQ ID NO: 643522 - RNA, 64 nt, Homo Sapiens
cuccuguagcuguccaucacacugacaggcuucuuccugagauauccucagguuuucucagcca

SEQ ID NO: 643523 - RNA, 64 nt, Homo Sapiens; identical to SEQ ID NO: 132786

SEQ ID NO: 643524 - RNA, 64 nt, Homo Sapiens; identical to SEQ ID NO: 132787

SEQ ID NO: 643525 - RNA, 64 nt, Homo Sapiens
gcucagaccaggcuuuguuguccugcucugaguauccugagauuaaacugaauugcugaaugaa

SEQ ID NO: 643526 - RNA, 64 nt, Homo Sapiens
ccaugagcaaaaagccgagagccagaccuguuuguccugagaaaacuguccgcucuucacuuga

SEQ ID NO: 643527 - RNA, 64 nt, Homo Sapiens
ugagcugcugcugaaggcugucccccaaccccacuccugagacauagggcccauccguccuggg

SEQ ID NO: 643528 - RNA, 64 nt, Homo Sapiens
ggugcacacaggauggcaggaggcauccaaaggcuccugagacacaugggugcuauugggguug

SEQ ID NO: 643529 - RNA, 64 nt, Homo Sapiens
ggacuuuguuguuuggauuccucacagccuuggcuccugagaaaggugaggagggcaguccaag

SEQ ID NO: 643530 - RNA, 64 nt, Homo Sapiens
gugaauagaguguaguguaaguggagaaccaggauccugagaugagcuugagcuuuaaaaacuu

SEQ ID NO: 643531 - RNA, 64 nt, Homo Sapiens
cacuuugcaacagcacugaaauggcuguaaggacuccugagauauguguccagcaaggaguuua

SEQ ID NO: 643532 - RNA, 64 nt, Homo Sapiens
aagaaaccucucagguuagcuuugaacugccucuuccugagaugacuaggacagucuguaccca

SEQ ID NO: 643533 - RNA, 64 nt, Homo Sapiens
cuugacuucacaauccacaacacugcuccuaagauccugagacaugggccagccagucucuccc

SEQ ID NO: 643534 - RNA, 64 nt, Homo Sapiens
gugaaugugcccuaaccugcagggagccacagaauccugagaaggcucucucccuucuccaaug

SEQ ID NO: 643535 - RNA, 64 nt, Homo Sapiens
uguuuuagcaaacagauggacacccucugcaagcuccugagauuccccggauggggacccuucc

SEQ ID NO: 643536 - RNA, 64 nt, Homo Sapiens
ggaucuguucaaacagcaaacaggucuuccucuuuccugagacugauggguugcagacggaggu

SEQ ID NO: 643537 - RNA, 64 nt, Homo Sapiens
uguuucaggccuggggagggaaggucagaaguaauccugagaaacccuggcccugcuggggcug

SEQ ID NO: 643538 - RNA, 64 nt, Homo Sapiens
uccuggucuuccuuggugccucuccugccugcuuuccugagaugcccucccuuuacuccaaccc

SEQ ID NO: 643539 - RNA, 64 nt, Homo Sapiens
aacuugcugucccggugucaugucauggaugcuguccugagaauauucccccugaggccaguuc

SEQ ID NO: 643540 - RNA, 64 nt, Homo Sapiens
uccguccucugcuuuccggggcacucuagauaccuccugagaccucuuguaggcagacaccagu

SEQ ID NO: 643541 - RNA, 64 nt, Homo Sapiens
uuuauuaaaacuucucccuucuuuucuuugccuuuccugagaguuaagcaggcauauucacuca

SEQ ID NO: 643542 - RNA, 64 nt, Homo Sapiens
accaagauaucaggaaugagcugugagauugauguccugagaaggaagcacuuaugggaacagu

SEQ ID NO: 643543 - RNA, 64 nt, Homo Sapiens
gucagccaagggccuacccugccccgacagcaccuccugagaaagguggccggcgggaagacca

SEQ ID NO: 643544 - RNA, 64 nt, Homo Sapiens
uuugggucugggacuggagauuggccauuaggccuccugagauuccagcucccuuccaccaagc

SEQ ID NO: 643545 - RNA, 64 nt, Homo Sapiens
uucuucccaauucucuaaaugcuuuaucauuuuuuccugagaugcuucugagggaugcugaccu

SEQ ID NO: 643546 - RNA, 64 nt, Homo Sapiens
aacuuccuccccacaaaaaugccuuuaaaaaccuuccugagacuuaagcauucugccccacuua

SEQ ID NO: 643547 - RNA, 64 nt, Homo Sapiens
gcuugcagcuuccaaaaaccugcaaaccagcgcuuccugagacggggccagcggaggcagagcc

SEQ ID NO: 643548 - RNA, 64 nt, Homo Sapiens
ggaagcugguauuugacauaguguguuaaacagcuccugagaaccuuugggacacucugccaug

SEQ ID NO: 643549 - RNA, 64 nt, Homo Sapiens
ccacuuuuuccacucuuauuagcacugcaaaagcuccugagaauuuaaaaacacaguaauucuc

SEQ ID NO: 643550 - RNA, 64 nt, Homo Sapiens
ucaaugaagcagaaauguacgaaagcuuacauuuuccugagaccgcagcgaccucaaguguccu

SEQ ID NO: 643551 - RNA, 64 nt, Homo Sapiens
uuaccagaaaaaaaaaagaucacuuuucucauuuuccugagaauaaacucguuuuuauuuugca

SEQ ID NO: 643552 - RNA, 64 nt, Homo Sapiens; identical to SEQ ID NO: 132788

SEQ ID NO: 643553 - RNA, 64 nt, Homo Sapiens; identical to SEQ ID NO: 132789

SEQ ID NO: 643554 - RNA, 64 nt, Homo Sapiens
uucucccaucuuggccucuucccaccugaaaaaauccugagaaucucccucccaggugguaucg

SEQ ID NO: 643555 - RNA, 64 nt, Homo Sapiens
ugcuccccuaacucagaucccugugcauuuucacuccugagaagcaacuccagccaccacuuuc

SEQ ID NO: 643556 - RNA, 64 nt, Homo Sapiens
aaugauacuguuuaugaugaaaaaauaaguuucuuccugagaagauuuauuaaaauauaguucu

SEQ ID NO: 643557 - RNA, 64 nt, Homo Sapiens
uuaacuuacuacuggaaaucgcuauccauuccucuccugagauugugaacacauuguuuguagu

SEQ ID NO: 643558 - RNA, 64 nt, Homo Sapiens
guuuuguaucuuaaagacugcccaggaugugguguccugagauaugaccacucugcaggcuggg

SEQ ID NO: 643559 - RNA, 64 nt, Homo Sapiens
cuuagcuucccucucccucaacguuugagcugaguccugagacauuuuauuuuuaauuuucuac

SEQ ID NO: 643560 - RNA, 64 nt, Homo Sapiens
cuggcccugugcuguggucuaaccagcugcuguguccugagagcauuccaguaacuggggaaag

SEQ ID NO: 643561 - RNA, 64 nt, Homo Sapiens
caggucuuccguccucagagacuggucuggccuuuccugagaggggcugcggaggccucucccu

SEQ ID NO: 643562 - RNA, 64 nt, Homo Sapiens
aaucuugcucuugccauguuauuuaugguuuccuuccugagaacggauuuuacauaaaugccau

SEQ ID NO: 643563 - RNA, 64 nt, Homo Sapiens
uggaguaauucuuacaaauucucgaggaaauuauuccugagacagagguucaguacucucggga

SEQ ID NO: 643564 - RNA, 64 nt, Homo Sapiens
caauuaugugauucaguuucaacuuucaaguacuuccugagagguuaguacauuauuauugagc

SEQ ID NO: 643565 - RNA, 64 nt, Homo Sapiens
ggauccuauguguuuggaaaaacacugguccugcuccugagaugagugaaguuuaaucuagcua

SEQ ID NO: 643566 - RNA, 64 nt, Homo Sapiens
cugcuguauuuuuuaauugcgaauaauguuuauuuccugagauauacacuuuuuuguaaaauga

SEQ ID NO: 643567 - RNA, 64 nt, Homo Sapiens
agcuuuagucauggaauacuaaaucuucaguauguccugagaacauaggcacucaauuuauuau

SEQ ID NO: 643568 - RNA, 64 nt, Homo Sapiens
ggaguucuuaaaggcaagggccuggaagugcuguuccugagauggauucucuugacuuaccagu

SEQ ID NO: 643569 - RNA, 64 nt, Homo Sapiens
uuggugaugaguuuaaauccaguagcuaaucccuuccugagacucaaagaucgugacgcugguu

SEQ ID NO: 643570 - RNA, 64 nt, Homo Sapiens
aaaguggacaaguccgcuuugugagaugaauacuuccugagaaacuugacaaguaucucuccau

SEQ ID NO: 643571 - RNA, 52 nt, Homo Sapiens
gcugcggacacuggcuccuucguccugagacgcaggccaccgagcucucuga

SEQ ID NO: 643572 - RNA, 64 nt, Homo Sapiens
ccaggcuuguggcccagguaucaccuucccuuccuccugagaguugaggccuguaaauacaagg

SEQ ID NO: 643573 - RNA, 50 nt, Homo Sapiens
ucaaugcagacuuucacuaguccugagacccuucgcccccuuuuccugca

SEQ ID NO: 643574 - RNA, 64 nt, Homo Sapiens
agccccucuuggagaagucucagcuaagcucacguccugagaaagcucaaagguuuggaaggag

SEQ ID NO: 643575 - RNA, 64 nt, Homo Sapiens
ggggauggcccuggcugaacuggacagacaguguuccugagaggcugggcacuuagcuggaaac

SEQ ID NO: 643576 - RNA, 64 nt, Homo Sapiens
cuuccccaaggcugagugucccaguuuuaucugcuccugagacugagcccagauccccaaaucu

SEQ ID NO: 643577 - RNA, 64 nt, Homo Sapiens
ccuuauuagaccuaauuuaugcauaaaguaguauuccugagaacuuuauuuuggaaaauuuaua

SEQ ID NO: 643578 - RNA, 64 nt, Homo Sapiens; identical to SEQ ID NO: 132790

SEQ ID NO: 643579 - RNA, 64 nt, Homo Sapiens; identical to SEQ ID NO: 132791

SEQ ID NO: 643580 - RNA, 64 nt, Homo Sapiens
caacuccaaguuacagcugaaucugucgugacuuuccugagaucuacccggggcuuggcugucu

SEQ ID NO: 643581 - RNA, 64 nt, Homo Sapiens
uccuuugagucacaagccaaguuuucgcccugucuccugagaccauuucccuacgcuuugcugc

SEQ ID NO: 643582 - RNA, 64 nt, Homo Sapiens
uguuuaggcacagcagaggggugcugccaaguguuccugagagggaccuggaacugacaauggc

SEQ ID NO: 643583 - RNA, 64 nt, Homo Sapiens
ugacaucaucuucaggauaaaagucauuuucaaguccugagaaauuuuuaccuuuaguucagcc

SEQ ID NO: 643584 - RNA, 64 nt, Homo Sapiens
ucagcaguacagucuucaucgagaggggcagguuuccugagaguuuaaugacuuugaucaccga

SEQ ID NO: 643585 - RNA, 64 nt, Homo Sapiens
cccagcaauaccauaagaaucaaaugauacauauuccugagagauaaccccacaugcucaaaau

SEQ ID NO: 643586 - RNA, 64 nt, Homo Sapiens
agagguagccgggcucugcagauacuggacgcuguccugagaugggccaggcaagugggaccag

SEQ ID NO: 643587 - RNA, 64 nt, Homo Sapiens
ucaggaaaguucucuugugcgccaugcaagggcuuccugagagugacugagcuguccucgauag

SEQ ID NO: 643588 - RNA, 64 nt, Homo Sapiens
cccugaucagucaaccagcucaaccaacauccaguccugagaaguacuucuggaauccucaauu

SEQ ID NO: 643589 - RNA, 64 nt, Homo Sapiens
cccagucccucagcaccuggccccaggacugagguccugagaaggggauagcacugcccaggac

SEQ ID NO: 643590 - RNA, 64 nt, Homo Sapiens; identical to SEQ ID NO: 132792

SEQ ID NO: 643591 - RNA, 64 nt, Homo Sapiens; identical to SEQ ID NO: 132793

SEQ ID NO: 643592 - RNA, 64 nt, Homo Sapiens
cuaaggggcucagaugugucuugugcccaccucuuccugagaagagauggaaguggagcuguga

SEQ ID NO: 643593 - RNA, 64 nt, Homo Sapiens
ucuguguaaccugggaauuccaauucuuuuucucuccugagaucuaugacuuugccuaguggua

SEQ ID NO: 643594 - RNA, 64 nt, Homo Sapiens
uaagcagguuugcaaggcucuaaaguuccuauaguccugagacccccugccagcaaagagugac

SEQ ID NO: 643595 - RNA, 64 nt, Homo Sapiens
acaacaguuucuaaccaaguuucucugaauccuuuccugagagguggugggcaggagggaggag

SEQ ID NO: 643596 - RNA, 64 nt, Homo Sapiens; identical to SEQ ID NO: 132794

SEQ ID NO: 643597 - RNA, 64 nt, Homo Sapiens; identical to SEQ ID NO: 132795

SEQ ID NO: 643598 - RNA, 64 nt, Homo Sapiens
gaccaccggugucagauaucagagcauucuggacuccugagaggcaguggccucuugagugaac

SEQ ID NO: 643599 - RNA, 64 nt, Homo Sapiens
acacaaaaacccauauuucugaaauaaugcugauuccugagauaagaaaguggauuugaucccc

SEQ ID NO: 643600 - RNA, 64 nt, Homo Sapiens
caggaaugcgguucaaacccaguggcuugaaacuuccugagaaacuguagcauauccagccccc

SEQ ID NO: 643601 - RNA, 64 nt, Homo Sapiens
ggagcccugcugcccacaugcaaggaccagcaucuccugagaggacgccugggcuuaccugggg

SEQ ID NO: 643602 - RNA, 64 nt, Homo Sapiens
cuggcugagaacuuggcccauccugucucccagauccugagaccgcuuggcaguuccugugcug

SEQ ID NO: 643603 - RNA, 64 nt, Homo Sapiens
ccagggcaccuccccccauuccagggucccggcguccugagaguacccaucaggacagccagag

SEQ ID NO: 643604 - RNA, 64 nt, Homo Sapiens
uuucacccaaguuccaaguggaagaaugacagcuuccugagagggggugaggugggguauagga

SEQ ID NO: 643605 - RNA, 64 nt, Homo Sapiens
uguuccccaccgcccugccuccugggcugccuccuccugagagcacucagcaacuuucccuugc

SEQ ID NO: 643606 - RNA, 64 nt, Homo Sapiens
uucugugugucaggcugcugacuaccugccuucguccugagagcucuaaauugauugccuggaa

SEQ ID NO: 643607 - RNA, 64 nt, Homo Sapiens
cagagaguuuuuaugggggucuguuguuugaccguccugagaccgagggaagggcucagcugaa

SEQ ID NO: 643608 - RNA, 64 nt, Homo Sapiens
gucuuuuuguuuguuugcuuguuuguuuuuagauuccugagagaugucucuggaagggaaaguu

SEQ ID NO: 643609 - RNA, 64 nt, Homo Sapiens
cuuucuuuccacacucacacaacgccaugccuuuuccugagauggcgcugggaguucccacaug

SEQ ID NO: 643610 - RNA, 64 nt, Homo Sapiens
cuaaacugauugacuuucagccuuuuuggcuagauccugagaggcuauuuuucuuacgaauaua

SEQ ID NO: 643611 - RNA, 64 nt, Homo Sapiens
auggugcaauaucuuuguuuuuuuuuuaugaggcuccugagaaucaacccaacugaagcauuuc

SEQ ID NO: 643612 - RNA, 64 nt, Homo Sapiens; identical to SEQ ID NO: 132796

SEQ ID NO: 643613 - RNA, 64 nt, Homo Sapiens; identical to SEQ ID NO: 132797

SEQ ID NO: 643614 - RNA, 64 nt, Homo Sapiens
uagggaggaauucuacuucccauaaaaggaccucuccugagaggcaaaaccuguugccuccacc

SEQ ID NO: 643615 - RNA, 64 nt, Homo Sapiens
acagggcaggacccuaagaucuggggaaaggagguccugagaaccuugagguacccuuagaucc

SEQ ID NO: 643616 - RNA, 64 nt, Homo Sapiens
auggccagagaugcuggacuugccuaaaauauauuccugagauuuccuccuggccuuuccuggu

SEQ ID NO: 643617 - RNA, 64 nt, Homo Sapiens
auacaggaaaacuguccaaauuaucuaaagauccuccugagaagcuuaaaacaucuuaaaauac

SEQ ID NO: 643618 - RNA, 64 nt, Homo Sapiens
agcuacuacacaagccuuugacccccaugcugcuuccugagagucuuuuuuugcacuguugaaa

SEQ ID NO: 643619 - RNA, 64 nt, Homo Sapiens
uuauaauaaaccacucaguaaaagcaaaagcuuguccugagaaguagagugaguucuuuuucac

SEQ ID NO: 643620 - RNA, 64 nt, Homo Sapiens
gcccuucagggcuucugguuccuucugccgcccuuccugagaccuuagaaaccagaagagccau

SEQ ID NO: 643621 - RNA, 64 nt, Homo Sapiens
uucgcuggaaaccucuggaggucaucucggcuguuccugagaaauaaaaagccugucauuucaa

SEQ ID NO: 643622 - RNA, 64 nt, Homo Sapiens
gcuugucuguuucucaggcuccugugagccucaguccugagaccagagucaagaggaaguacac

SEQ ID NO: 643623 - RNA, 64 nt, Homo Sapiens
agugaggcccgaccuggcucucgcuggaggggcauccugagacuccuuccucaugcuggcgccg

SEQ ID NO: 643624 - RNA, 63 nt, Homo Sapiens
uuauuuaaaacucagccuuccguggcuccggccuccugagacgucaaaccggagcccaucuag

SEQ ID NO: 643625 - RNA, 64 nt, Homo Sapiens
gacgguguaaugcaaggaaagcuucucauagacguccugagaagcccuguccaggcugcccagg

SEQ ID NO: 643626 - RNA, 64 nt, Homo Sapiens
cacuauacuuaaaaccauucauuuuaauuccuccuccugagauguggcaguauauaguuuucac

SEQ ID NO: 643627 - RNA, 64 nt, Homo Sapiens
uaccagaagcaucuucaguuacagaauuggaagguccugagagcuacaagccccgcuacagaca

SEQ ID NO: 643628 - RNA, 64 nt, Homo Sapiens
ucuauaaauauaaauguaugaugcugcaauuucuuccugagauugcuuugcuguccaucuuccc

SEQ ID NO: 643629 - RNA, 64 nt, Homo Sapiens
auugaaaaaguaacaagcugugugucugcaaaauuccugagaucgagcugaauaauggagauuu

SEQ ID NO: 643630 - RNA, 64 nt, Homo Sapiens
ccacacacaggcucguggcagaauaaacgguguguccugagaaacuccagugccuucccccgug

SEQ ID NO: 643631 - RNA, 64 nt, Homo Sapiens
ggagcguaugugaaaacaucaaucuugaauguuuuccugagacacaaccaccugggggcuagcu

SEQ ID NO: 643632 - RNA, 64 nt, Homo Sapiens
gcccaccugggcugggcgcgcugcuuccauggcuuccugagaaagguagaaggaaagcaugucu

SEQ ID NO: 643633 - RNA, 64 nt, Homo Sapiens
agcugugagccuagguggccgcugucuccucugguccugagaugacacugaaguuuuguccucu

SEQ ID NO: 643634 - RNA, 64 nt, Homo Sapiens
aaaggucaaggacccccucuuggcacgggcuccuuccugagagcacuccuacuccaguaucagc

SEQ ID NO: 643635 - RNA, 64 nt, Homo Sapiens
uggauuucacuuucauacguccauaacuguaucuuccugagagaucagcaucagauacauucaa

SEQ ID NO: 643636 - RNA, 64 nt, Homo Sapiens
ggaaaauccuccggagccgcccuccauuguggguuccugagaguaggacacauugccaugguuu

SEQ ID NO: 643637 - RNA, 64 nt, Homo Sapiens
uccagccgcugaauacaguguuaggacugggggcuccugagaugagaguuugagauucagggaa

SEQ ID NO: 643638 - RNA, 64 nt, Homo Sapiens
agccccacagccauacagcccauuggugacaagguccugagaacacaguggccaggugucccca

SEQ ID NO: 643639 - RNA, 64 nt, Homo Sapiens
ccuuucugagugcaggggggcugcaugcguugccuccugagaucgaggcugcaggauaugcuca

SEQ ID NO: 643640 - RNA, 64 nt, Homo Sapiens
uccucugccucaaagacucuuguccucuugucccuccugagaaaaaagaaaacgaaaagugggg

SEQ ID NO: 643641 - RNA, 64 nt, Homo Sapiens
aucugccuggagucccgucccugcccagaacccuuccugagaccucgccggccuuguuuuauuc

SEQ ID NO: 643642 - RNA, 64 nt, Homo Sapiens
cuuuuuuucuuuuacuuuucuuuuuuuuuuuuuuuccugagacagagucucgcgcuguugccca

SEQ ID NO: 643643 - RNA, 64 nt, Homo Sapiens
gaaaugcccccuccacaccccugguagcucuguguccugagaaauccagagugugggagacauc

SEQ ID NO: 643644 - RNA, 64 nt, Homo Sapiens
ucaguuguccugcccuguggaaugggcucaagguuccugagacacccgauuccugcccaaacag

SEQ ID NO: 643645 - RNA, 64 nt, Homo Sapiens
gacaugaagccugagccagagaaccagcuauaaguccugagaagacacuggugucuggggacag

SEQ ID NO: 643646 - RNA, 64 nt, Homo Sapiens
ggaauuuugagccaagcuuuaagcaagucuggacuccugagaccuccugggucuagucaguaaa

SEQ ID NO: 643647 - RNA, 64 nt, Homo Sapiens
guucagggaacuucagggaagaggcuuggucaauuccugagagcauccucugugcuggggacac

SEQ ID NO: 643648 - RNA, 64 nt, Homo Sapiens
cugcuucccugcaguuuagaucccgggauggcauuccugagaaagcaacccgaaccagcugucc

SEQ ID NO: 643649 - RNA, 64 nt, Homo Sapiens
uacuggaccuuaauuccucugcuucugugcucccuccugagaacccuuuaugagccugauuccu

SEQ ID NO: 643650 - RNA, 64 nt, Homo Sapiens
guguuauuuuuucaugucuggaccucagccuauauccugagacuaaguggaagugggaaaagag

SEQ ID NO: 643651 - RNA, 64 nt, Homo Sapiens
gaauggugcauauugaauguauaaagcccaccgguccugagaguuugcucacuggagacuuucu

SEQ ID NO: 643652 - RNA, 64 nt, Homo Sapiens
ggaggcaagaugagaauuccugacagauuguccuuccugagaagacagcccucugccuuggagc

SEQ ID NO: 643653 - RNA, 64 nt, Homo Sapiens
uuguagagcugccuuuuccaaggauaccauaaacuccugagagcaggggccaugucuuacucuc

SEQ ID NO: 643654 - RNA, 64 nt, Homo Sapiens
cccaccguuacccccaggaguccccccgugccacuccugagacucccgcugcaggucgggcguc

SEQ ID NO: 643655 - RNA, 64 nt, Homo Sapiens
uugcuguugaccaaggagagcagaggccaccuucuccugagaagagaggucauugucacccaag

SEQ ID NO: 643656 - RNA, 64 nt, Homo Sapiens
agcccccucccuguggagccaaugcccucaccccuccugagagguuccccccagcaaaugcaau

SEQ ID NO: 643657 - RNA, 64 nt, Homo Sapiens
acuuggaaacagaccaacugagacuggccacgccuccugagacccagaacccgcaggcuccuga

SEQ ID NO: 643658 - RNA, 64 nt, Homo Sapiens
aaacucccugaagugcaacuccugagaugaaacuuccugagaugagaugaagcuuccaaaggug

SEQ ID NO: 643659 - RNA, 64 nt, Homo Sapiens
aggagaacccuuuuuaggcuauagggguagaggcuccugagauugguggugcacccccaacuuc

SEQ ID NO: 643660 - RNA, 64 nt, Homo Sapiens
gauuuauugugcauuauuuguuaagugucuuagauccugagaaacaacaaauuugauuauauuu

SEQ ID NO: 643661 - RNA, 64 nt, Homo Sapiens
uggugcucuggguagugagggaugaccagucuuguccugagaaauguuucucuuagucuuuaag

SEQ ID NO: 643662 - RNA, 64 nt, Homo Sapiens
auguguuucugggcagcuuuucugcucagugugauccugagauggcuuccccgccgccacccag

SEQ ID NO: 643663 - RNA, 64 nt, Homo Sapiens
uggcaauggagaauugcaucugaugguucaaguguccugagauuguuugcuaccuacccccagu

SEQ ID NO: 643664 - RNA, 64 nt, Homo Sapiens
ggucucaaaugcugcaguuuuaauaaucugugacuccugagagcccaugguuuuuugaccuugu

SEQ ID NO: 643665 - RNA, 64 nt, Homo Sapiens
cucuaccuauauacuuaguuugaaguuaguaacuuccugagaugcuaaagacuuacagccugcg

SEQ ID NO: 643666 - RNA, 64 nt, Homo Sapiens
cucagcuugagagaaugagccugccuccuuccuuuccugagaggacgugggacccucaucucug

SEQ ID NO: 643667 - RNA, 64 nt, Homo Sapiens
ugacuccucuugguuugguuuaacacuaaauucuuccugagaaacuuaagagaguucuaauuaa

SEQ ID NO: 643668 - RNA, 64 nt, Homo Sapiens
uuaaauccugaagugugggucaguugaugcagcauccugagauuuuagcacaguucauagucca

SEQ ID NO: 643669 - RNA, 64 nt, Homo Sapiens
ccacuucucaugcuucucccuuuggcacuagaacuccugagacacccacuugcaccucuccacc

SEQ ID NO: 643670 - RNA, 64 nt, Homo Sapiens
cuggcuuagugcugggccuuuguuguuugaauuuuccugagagcauugaagggcaaagaggaac

SEQ ID NO: 643671 - RNA, 64 nt, Homo Sapiens
ugagauucaaaagcugcauugaucacucaugcuguccugagaaacaugguagugagccucccag

SEQ ID NO: 643672 - RNA, 64 nt, Homo Sapiens
uggaauauggaagaagcaauccugccccugaggguccugagacuggggucacucucacuuggca

SEQ ID NO: 643673 - RNA, 64 nt, Homo Sapiens
ggaggccugguggcuuagccugggacccucccucuccugagaggcccagcuggggccuguuguc

SEQ ID NO: 643674 - RNA, 64 nt, Homo Sapiens
ggaguuacagucccuuuuggccaucuauccccauuccugagacaccuggggcuucaagaaccuc

SEQ ID NO: 643675 - RNA, 64 nt, Homo Sapiens
ucuaguuuucuaguuuuccaaaugccuggcccacuccugagagcuuucacauuucagaaucggc

SEQ ID NO: 643676 - RNA, 64 nt, Homo Sapiens
ugaaagugggaugacuuaugcuggcugcgaguguuccugagaguauggcgaggacagcguggca

SEQ ID NO: 643677 - RNA, 64 nt, Homo Sapiens
uccucagcgucugacucucgggccaggggccccguccugagagguggccgaggagacuggcucu

SEQ ID NO: 643678 - RNA, 64 nt, Homo Sapiens
uggccuuggacucacaaggagcugucuguggcuguccugagacccccagagccugucuggaagg

SEQ ID NO: 643679 - RNA, 64 nt, Homo Sapiens
gaugaagcagccuugaagcaaggagacucaguuguccugagagacaggcgcuccucccucacgc

SEQ ID NO: 643680 - RNA, 64 nt, Homo Sapiens
gaaggguguuugguuuaaaacgugggaugcgggauccugagaccagacccacugugggucuucc

SEQ ID NO: 643681 - RNA, 64 nt, Homo Sapiens
agauaacugcuguauucaugaaucuugagaguguuccugagacagaauuaauggucauuuggga

SEQ ID NO: 643682 - RNA, 64 nt, Homo Sapiens
ccagcccaaccccuuggaaucuuuccuccaggcuuccugagagcccugggggugggaggcugug

SEQ ID NO: 643683 - RNA, 64 nt, Homo Sapiens
gggagcagcuuggcugugagcaccaggccaagacuccugagaacaggcagcccaguccugcgac

SEQ ID NO: 643684 - RNA, 64 nt, Homo Sapiens
acguauccuguucuccagagacuucagaacccacuccugagaacagcggagccaggcgcuuaga

SEQ ID NO: 643685 - RNA, 64 nt, Homo Sapiens
aaccagucaccuuucacuucuuggccaaauuuuauccugagaaugcugaagaggagcugguuca

SEQ ID NO: 643686 - RNA, 64 nt, Homo Sapiens
ccuuucccuagcucccuggugggugaaugccaccuccugagauccucaccucuuggaauuaaaa

SEQ ID NO: 643687 - RNA, 64 nt, Homo Sapiens
uccuauuuaacaauuaacguggcagucccggccguccugagagucgggccgagccccguguguu

SEQ ID NO: 643688 - RNA, 64 nt, Homo Sapiens
accugguucucaacagacccagugagcccuucacuccugagaaaaaggaaagaugaaauaaaua

SEQ ID NO: 643689 - RNA, 64 nt, Homo Sapiens
cugacccagcauggagcccacgcccucccucugcuccugagaugacacagccaucagcagcuug

SEQ ID NO: 643690 - RNA, 64 nt, Homo Sapiens
ucgugucauucgugacuuuuauagaaauguguuuuccugagaguuacagguguuuccagagacc

SEQ ID NO: 643691 - RNA, 64 nt, Homo Sapiens
uuaccagcagaaauccucauugugucugugucuguccugagaacucuugcuuggaaaguggacc

SEQ ID NO: 643692 - RNA, 64 nt, Homo Sapiens
uuguguacauccugucccugccacauccauaagcuccugagagaaaggucugacuuguugauug

SEQ ID NO: 643693 - RNA, 64 nt, Homo Sapiens
ccgacucugguagcugggacgcugguuuauggcauccugagacaguugcacagugccagcggag

SEQ ID NO: 643694 - RNA, 64 nt, Homo Sapiens
acagccagucaggggccuggugguggggggcgucuccugagacaggccagcuuggauggccucc

SEQ ID NO: 643695 - RNA, 64 nt, Homo Sapiens
ccccuccucuccccuaccacugucuucuucaggguccugagauuuacacgguuggaguguuaug

SEQ ID NO: 643696 - RNA, 64 nt, Homo Sapiens
uaauuaugucacacacacaaaaaauccuuuucaauccugagaaaauuaaaggcguuuuacucac

SEQ ID NO: 643697 - RNA, 64 nt, Homo Sapiens
uguaguuaguacaggaugaauuuaaauguguuuuuccugagagacaaggaagacuuggguauuu

SEQ ID NO: 643698 - RNA, 64 nt, Homo Sapiens; identical to SEQ ID NO: 132798

SEQ ID NO: 643699 - RNA, 64 nt, Homo Sapiens; identical to SEQ ID NO: 132799

SEQ ID NO: 643700 - RNA, 64 nt, Homo Sapiens
caaagaaugggaagcacuugugauaaagacaggcuccugagaaaugcaacaaguggucuuacau

SEQ ID NO: 643701 - RNA, 64 nt, Homo Sapiens
ugaugauaugcacugaucacacaagacugcccuuuccugagaagcugcgggcuucgguguggag

SEQ ID NO: 643702 - RNA, 64 nt, Homo Sapiens
agcaucgugauagaguucacaaucugaaugugucuccugagacaagacauuaaaauucuugcag

SEQ ID NO: 643703 - RNA, 64 nt, Homo Sapiens
ggaguuuccaucccauguugcugugauuuuagccuccugagauucucuucaaucccaaccugcg

SEQ ID NO: 643704 - RNA, 64 nt, Homo Sapiens
aauuuuuuguggucauaaucaaggcacauuugacuccugagaugagcacauaauuuuuaaggcc

SEQ ID NO: 643705 - RNA, 64 nt, Homo Sapiens
gaauuuuuuuuuuuuuggaugaaggggagguauuuccugagaauauguaguuuuuguuuguaag

SEQ ID NO: 643706 - RNA, 64 nt, Homo Sapiens
ggggcucacugaaccucucugcuuucagcuuuuauccugagaguuaguuuuguuuuagaauuuu

SEQ ID NO: 643707 - RNA, 64 nt, Homo Sapiens
uauuucucagggucauguuggccuuccauuaggcuccugagaguuuuucccacuaaguaguauu

SEQ ID NO: 643708 - RNA, 64 nt, Homo Sapiens
uaaaaaacugaaaggaauuuugcagucuugaaaauccugagagcuuuguuuugucugacaguau

SEQ ID NO: 643709 - RNA, 64 nt, Homo Sapiens
ccggccucucccuccaguacacgugccugcugcuuccugagagcgcagcuggcuuccaccuggc

SEQ ID NO: 643710 - RNA, 64 nt, Homo Sapiens
aauuaugucacacacacaaaaaaauccuuuucaauccugagaaaauuaaagguguuuuacucac

SEQ ID NO: 643711 - RNA, 64 nt, Homo Sapiens
ugaaguuucuggagcccuugucugagacugaaccuccugagaaggggccccuagcagcggucag

SEQ ID NO: 643712 - RNA, 61 nt, Homo Sapiens
ccagguucaagugauucuucugccucagccuccugaguagcugggauuacaggugugcacc

SEQ ID NO: 643713 - RNA, 61 nt, Homo Sapiens
augucaaaaagcaauucuccugccucagccuccugaguagcugggacuacagguuccuacc

SEQ ID NO: 643714 - RNA, 61 nt, Homo Sapiens
cauccuuuagugaauuagaggauuuggcuacccugaguauauuuauauucauuucuucugu

SEQ ID NO: 643715 - RNA, 61 nt, Homo Sapiens
cuggguucaagcaauucucccaccucagccuccugaguagcugggauuacaggcacaugcc

SEQ ID NO: 643716 - RNA, 61 nt, Homo Sapiens
cuggguucaagggauucuccugucuuagccuccugaguagcugugauuacaggcaugcgcc

SEQ ID NO: 643717 - RNA, 61 nt, Homo Sapiens
uagaagcugcuuccugugaagaucaaaucuuccugaguaauuaaauggaccaacaaugagc

SEQ ID NO: 643718 - RNA, 61 nt, Homo Sapiens
ccggguucaagugauucuccugucucagcucccugaguaacuggaauuacaggugcacgcc

SEQ ID NO: 643719 - RNA, 61 nt, Homo Sapiens
cagcuccuuuguuucauacggaacuccagauccugaguaauccuuuuagagcccgaagagu

SEQ ID NO: 643720 - RNA, 61 nt, Homo Sapiens
cacugcaaccuccgccuccagggcgcagccuccugaguagcugggaggacaggcauaugcc

SEQ ID NO: 643721 - RNA, 61 nt, Homo Sapiens
cugggcucaggugauccuuccgccucacccuccugaguagcugggacuacaggugugcacc

SEQ ID NO: 643722 - RNA, 61 nt, Homo Sapiens
cuggguucaagcgauucuccugccucagccuccugaguagcugggauuacaggcacacacc

SEQ ID NO: 643723 - RNA, 61 nt, Homo Sapiens
uccauguuuguacuccugugcuggacuguuuccugaguaccagcaggucccuuuuugucuc

SEQ ID NO: 643724 - RNA, 61 nt, Homo Sapiens
cuuaaaaggauucauagcaacauaaugugucccugaguagaggaugcugcuaugcgugagu

SEQ ID NO: 643725 - RNA, 61 nt, Homo Sapiens
gagagucacaaauuuuucuucaguguuucagccugaguaaguuacauaaaccucgcuuagc

SEQ ID NO: 643726 - RNA, 61 nt, Homo Sapiens
cuggguucaagcgauucuccugccucagccuccugaguagcugggauuacaggugugcacc

SEQ ID NO: 643727 - RNA, 61 nt, Homo Sapiens
ccggguugacaccauuuuccugccucagccuccugaguaguugggauuaccaguagauggg

SEQ ID NO: 643728 - RNA, 61 nt, Homo Sapiens
ccgaauucaagugauucuccugccucagccuccugaguagcugggauuacaggcgcccguc

SEQ ID NO: 643729 - RNA, 61 nt, Homo Sapiens
uggaacuacaaggaagggccugccucagucuccugaguagcgggagcucaagugauccucc

SEQ ID NO: 643730 - RNA, 61 nt, Homo Sapiens
ugggauuacaggugccugccugccucagccuccugaguaccccgaguucaaucgauucucc

SEQ ID NO: 643731 - RNA, 61 nt, Homo Sapiens
ugggauuauaggcgugcaccugccucagccuccugaguagccuggguucaagcaauucucc

SEQ ID NO: 643732 - RNA, 61 nt, Homo Sapiens
ugggauuacaggcacccaccugugucagucuccugaguagcccagguucaagcgauucucc

SEQ ID NO: 643733 - RNA, 61 nt, Homo Sapiens
uaaauuuucuuuucaaacagaaugcuuagugccugaguauuccuagaguuucagguaggcu

SEQ ID NO: 643734 - RNA, 61 nt, Homo Sapiens
uugcaaaugcacagagaaaauuuauguugguccugaguauuuccacaggagguauuucuuu

SEQ ID NO: 643735 - RNA, 61 nt, Homo Sapiens
uucuacaggcccggcccagcaaccugcaguuccugaguaccuucauggaggggaaacgcaa

SEQ ID NO: 643736 - RNA, 61 nt, Homo Sapiens
aggcuuggaaguuggaauuagggggagacagccugaguaaaauuauucggaggaagggaau

SEQ ID NO: 643737 - RNA, 61 nt, Homo Sapiens
ugggauuacgggugcgugccugccucagucuccugaguagcccggguucaagccauucucc

SEQ ID NO: 643738 - RNA, 61 nt, Homo Sapiens
ugggauuacaggcuccugccugccucagccuccugaguagcccggguucaagugauucuca

SEQ ID NO: 643739 - RNA, 61 nt, Homo Sapiens
aggauacuuuuaucaaaaucgagaaauagucccugaguauucucuugggauucuggucuuu

SEQ ID NO: 643740 - RNA, 61 nt, Homo Sapiens
ugggauuacaggugcgugccugcuucaaccuccugaguagcccagguucaagcgauucucc

SEQ ID NO: 643741 - RNA, 61 nt, Homo Sapiens
ugggaucauaggcacgcgccugccucagccuccugaguagccuggguucaagcgauucucc

SEQ ID NO: 643742 - RNA, 61 nt, Homo Sapiens
cccgucggaggggauggacaugggugcugggccugaguacugggaagcucaucagagaaaa

SEQ ID NO: 643743 - RNA, 61 nt, Homo Sapiens
cagauaacuuuuuuuuuucuuuauaagaaagccugaguacuccacacugcacaauaacucc

SEQ ID NO: 643744 - RNA, 61 nt, Homo Sapiens
cugggcuugagcaguccucccgucucagccuccugaguagcugagacuacaggugcacacc

SEQ ID NO: 643745 - RNA, 61 nt, Homo Sapiens
ucaucacccuuuuucacuaugacccuuagacccugaguauuuucaaauauaugauugcuga

SEQ ID NO: 643746 - RNA, 61 nt, Homo Sapiens
cugggcucaagcaguccucccaccucagucuccugaguagcugagacuacagcugugcgcc

SEQ ID NO: 643747 - RNA, 61 nt, Homo Sapiens
uuagguucaagcgauucuccugccucagccuccugaguagcugggauuacaggcacgcacc

SEQ ID NO: 643748 - RNA, 61 nt, Homo Sapiens
uucaggaagacugacuuaaauuacuugcuacccugaguacuauauaaucguuugcauuuug

SEQ ID NO: 643749 - RNA, 61 nt, Homo Sapiens
ugggauuacacgcacaugccugccucagccaccugaguagcccagguucaagcgauucucc

SEQ ID NO: 643750 - RNA, 61 nt, Homo Sapiens
uggauuacaggcaugugccaugccucagccuccugaguagcuuggguucaagugauucucc

SEQ ID NO: 643751 - RNA, 61 nt, Homo Sapiens
guccauuucuucccaggaauucaaggcuuccccugaguaagggcucagacuaaaucagagg

SEQ ID NO: 643752 - RNA, 61 nt, Homo Sapiens
ugcaacuacagacacaugccagccuccucuuccugaguagcgggcucaauacucuugccuc

SEQ ID NO: 643753 - RNA, 61 nt, Homo Sapiens
ugggauuacaggcaacugccugccucagccuccugaguagcccagguucaagcgauucucc

SEQ ID NO: 643754 - RNA, 61 nt, Homo Sapiens
ugggaccacaggcgacugccugccucagccuccugaguagcccagguucaagcgauucucc

SEQ ID NO: 643755 - RNA, 61 nt, Homo Sapiens
gaagaaacaacgacacaaucuuagaaucacuccugaguaucucgaguuguggcauuuguua

SEQ ID NO: 643756 - RNA, 61 nt, Homo Sapiens
caaccucugccuccuggguucacguaauccuccugaguagcugggauuacaggcgccugcc

SEQ ID NO: 643757 - RNA, 61 nt, Homo Sapiens
ucagguucaagugauucuccugccucagccuccugaguagaugggacuguaggcaccugcc

SEQ ID NO: 643758 - RNA, 61 nt, Homo Sapiens
ccggguucaagugauucucuugccucagccuccugaguagugugugccaccacgcccagcu

SEQ ID NO: 643759 - RNA, 61 nt, Homo Sapiens
guggugucaucaccugcuggccccacuacagccugaguaggccugaguggccguggccagg

SEQ ID NO: 643760 - RNA, 61 nt, Homo Sapiens
ccggauucaagcgauucuccugccucagccuccugaguagcuggaacuacaugcgcgugcc

SEQ ID NO: 643761 - RNA, 61 nt, Homo Sapiens
ccaugcucagaaugucugguccuggcuugggccugaguagggcagagagggccuuuccugg

SEQ ID NO: 643762 - RNA, 61 nt, Homo Sapiens
ucaguuugggcuguggacgcugccacacaagccugaguagagcccaugcaaaggaagggau

SEQ ID NO: 643763 - RNA, 61 nt, Homo Sapiens
aaugcaagcuuguucagggggcugagaagauccugaguacacuaggugcaaaccagaacuc

SEQ ID NO: 643764 - RNA, 61 nt, Homo Sapiens
ggcagacuccuccauguuuuguucccuucccccugaguaugcaugugccuguucagagucu

SEQ ID NO: 643765 - RNA, 61 nt, Homo Sapiens
cugggcucaggugauccucccaccucagccuccugaguagcuaggacuacagaugcucgcc

SEQ ID NO: 643766 - RNA, 61 nt, Homo Sapiens
ugggguucaagugauucuccugugucagccuccugaguagcugggauuacaggcgugugcc

SEQ ID NO: 643767 - RNA, 61 nt, Homo Sapiens
ccggguucaagcgauucuccugccucagccuccugaguagcugggauuacaggugugugcc

SEQ ID NO: 643768 - RNA, 61 nt, Homo Sapiens
gaagcuucuuuggccuagauuuuagcacaaaccugaguauaucucuucuacuuucaucaug

SEQ ID NO: 643769 - RNA, 61 nt, Homo Sapiens
uguuaaaauauuguuuaauauuuuugaaaucccugaguaucaggccuuguuauaaauaagc

SEQ ID NO: 643770 - RNA, 61 nt, Homo Sapiens
ccuccagggacuggccaggucuccccccuuuccugaguaccaacuaucauauccccaaaga

SEQ ID NO: 643771 - RNA, 61 nt, Homo Sapiens
gcauaucugccuuuauuguguuugucauuagccugaguagaaaggccuuuaaaauuuuuuu

SEQ ID NO: 643772 - RNA, 61 nt, Homo Sapiens
cuggguucaagcaauucucaugccucagccuccugaguagcugagaccacaggcacccgcc

SEQ ID NO: 643773 - RNA, 61 nt, Homo Sapiens
ugauacuacaggcacccaccugccucagccuccugaguagcccagguucaugccauucucc

SEQ ID NO: 643774 - RNA, 61 nt, Homo Sapiens
gcuuaguuuuauucuggaaaucaccauuuuuccugaguaggugucugugagcugccuuuca

SEQ ID NO: 643775 - RNA, 61 nt, Homo Sapiens
gagacugguuccccccagacccuugagaaguccugaguacagguuugggagaugaugccug

SEQ ID NO: 643776 - RNA, 61 nt, Homo Sapiens
uaauuggcaccugccuucuuucucuucuuuaccugaguaaaaaaaccuuuggugccuuuuc

SEQ ID NO: 643777 - RNA, 61 nt, Homo Sapiens
uagguacaggcaccugccacugccucagccuccugaguagccuggguucaaaugauucucc

SEQ ID NO: 643778 - RNA, 61 nt, Homo Sapiens
ugaauuugauuucuaaaaacccccaguucuuccugaguauaugcuugcuuaaucuucucug

SEQ ID NO: 643779 - RNA, 61 nt, Homo Sapiens
ugggacuacaggugccugccugccucagccuccugaguagcccggguucacgccauccucc

SEQ ID NO: 643780 - RNA, 61 nt, Homo Sapiens
ugggauuauaggcaugcaccugccucagccuccugaguagcccgaguucaagcaauucucc

SEQ ID NO: 643781 - RNA, 61 nt, Homo Sapiens
ugggacuacaggcgcccgccugccucagccuccugaguagcccggguucacgccauucucc

SEQ ID NO: 643782 - RNA, 61 nt, Homo Sapiens
ugggaugacaggcgugcacccaucucagccuccugaguagcccagccucaacugauccucg

SEQ ID NO: 643783 - RNA, 61 nt, Homo Sapiens
ccagguucaagcgauucucgugccucagccuccugaguagcugggacuacaggcgcccacc

SEQ ID NO: 643784 - RNA, 61 nt, Homo Sapiens
cuggguucaagcaauucuccugccucagccuccugaguagcugggauuacaggcaugaacc

SEQ ID NO: 643785 - RNA, 61 nt, Homo Sapiens
caccauagcagcugacugaaaaucagcacugccugaguaguuuugaucaguuuaacuugaa

SEQ ID NO: 643786 - RNA, 61 nt, Homo Sapiens
accugaccacaaaaccucuuguaaaaacagcccugaguagguauuuccagggcuccacaaa

SEQ ID NO: 643787 - RNA, 61 nt, Homo Sapiens
ccggguucaagugauucuugugccucagccuccugaguagcugggauuauaggcaugcacc

SEQ ID NO: 643788 - RNA, 61 nt, Homo Sapiens
ccgaguucaagcgauucuugugcuucagccuccugaguagcugggacuauaggccuguacc

SEQ ID NO: 643789 - RNA, 61 nt, Homo Sapiens
ccagguucaagugauucuccugccucagccuccugaguagcugggacuacaggcgccugcc

SEQ ID NO: 643790 - RNA, 61 nt, Homo Sapiens
gugggugcaaguagggccucgugcugccucuccugaguaggauguguuggugggccuggcc

SEQ ID NO: 643791 - RNA, 61 nt, Homo Sapiens
guaguccuauuaauuccagauuuggcaaaauccugaguagugaaauauauauauuuuuaag

SEQ ID NO: 643792 - RNA, 61 nt, Homo Sapiens
ugggacuacaggugugugcccaccucagccuccugaguagccugggcugaacugauccuuc

SEQ ID NO: 643793 - RNA, 61 nt, Homo Sapiens
ugggauuacaggcaugcaccugccucagccuccugaguagccgccucccaggcgauucucc

SEQ ID NO: 643794 - RNA, 61 nt, Homo Sapiens; identical to SEQ ID NO: 643781

SEQ ID NO: 643795 - RNA, 61 nt, Homo Sapiens
caaucaagcuucagugugcaggucauuguagccugaguauaauggggguuacaucagugcu

SEQ ID NO: 643796 - RNA, 61 nt, Homo Sapiens
auucuuuguuguuuagcacucuuaugaaucaccugaguacaaucaaugauauguaagguga

SEQ ID NO: 643797 - RNA, 61 nt, Homo Sapiens
aacaaaaaugacagauacaaacuauuucuauccugaguaguaaucucacacuucauccuau

SEQ ID NO: 643798 - RNA, 61 nt, Homo Sapiens
acagguucaggcgauucccgugccucagccuccugaguagcugggacuacaggcacgcacc

SEQ ID NO: 643799 - RNA, 61 nt, Homo Sapiens
ccggguucaagcgauucuccugccucagccuccugaguagcuggaauuacaggcacccacc

SEQ ID NO: 643800 - RNA, 61 nt, Homo Sapiens
ccggguucaagcgauucuccagccucagcuuccugaguagaugggauuacaggcgccugcc

SEQ ID NO: 643801 - RNA, 61 nt, Homo Sapiens
ccggguuuaagcaguucuccugccucagccuccugaguagcugggauuacaggugugcccc

SEQ ID NO: 643802 - RNA, 61 nt, Homo Sapiens
aguggcuuauaaggaaccagcaguguuuuucccugaguaauuaugaacuuagucaagauca

SEQ ID NO: 643803 - RNA, 61 nt, Homo Sapiens
cccagguucaagcgaucaugugccuaagccuccugaguagcugggaucacagguguguacc

SEQ ID NO: 643804 - RNA, 61 nt, Homo Sapiens
ccagguucaggugauucuccugccucagccuccugaguagcugggauuacaagcacguguc

SEQ ID NO: 643805 - RNA, 61 nt, Homo Sapiens
cuggguucaagcaauucuccugccucagccuccugaguagcugggauuauaggcacaugcc

SEQ ID NO: 643806 - RNA, 61 nt, Homo Sapiens
acuuucauuucccagaaaaaagauuaaugguccugaguaggaauauuacauaauuuugauu

SEQ ID NO: 643807 - RNA, 61 nt, Homo Sapiens
cugggcucaaguuauccuuccauuuuggccuccugaguagcuagaccauagguaugcauca

SEQ ID NO: 643808 - RNA, 61 nt, Homo Sapiens
aaagaaguauugcaugucuaaaagcuagugcccugaguacucaugaauucgauuccaagag

SEQ ID NO: 643809 - RNA, 61 nt, Homo Sapiens
gcuuaucccgcaugagcaggagcgugcuggcccugaguacugaacuuucugaguaacaaug

SEQ ID NO: 643810 - RNA, 61 nt, Homo Sapiens
uggauauacaaccucagcaaggaauuugcuuccugaguaaggucaguucuugcaaccuugu

SEQ ID NO: 643811 - RNA, 61 nt, Homo Sapiens
uggaacuacaggcgugugcccgccucagcuuccugaguagcccggguucaagugauucucc

SEQ ID NO: 643812 - RNA, 61 nt, Homo Sapiens
uuaaaacaauucuauuucauuugaauugaaaccugaguagggaaacaguuucaaguaagcc

SEQ ID NO: 643813 - RNA, 61 nt, Homo Sapiens
ccaccccagcuaaaggcaaaccuuugaggucccugaguaaugaaauaaaucaucaccaaua

SEQ ID NO: 643814 - RNA, 61 nt, Homo Sapiens
uagcugagggugggugagaguugccuucagaccugaguacuagccuccauaaucagugugg

SEQ ID NO: 643815 - RNA, 61 nt, Homo Sapiens
ugcauuucugucugucucaauuaacuguaguccugaguaggcuuugguuaauaguaaaugc

SEQ ID NO: 643816 - RNA, 61 nt, Homo Sapiens
aguggucaccucccauaguaucauaaguacuccugaguacauuuuguucuuauucuuuuuc

SEQ ID NO: 643817 - RNA, 61 nt, Homo Sapiens
uggugcgcacgaccauaccccgcuucagccuccugaguagccugggcucaagcaauccucc

SEQ ID NO: 643818 - RNA, 61 nt, Homo Sapiens
uacucaaauguaccuuaauuuuuuuuuuuucccugaguaaaagcaagaaauuucuuccuuu

SEQ ID NO: 643819 - RNA, 61 nt, Homo Sapiens
agaaaaucucaguucccaccaguaaaauuauccugaguagcuaaugcaccuugagaaaaau

SEQ ID NO: 643820 - RNA, 61 nt, Homo Sapiens
aggccagugcccacuugcccaccgaccugagccugaguaaguggcugucaccugagccugu

SEQ ID NO: 643821 - RNA, 61 nt, Homo Sapiens
ccggguucacgccauucuccugccucagccuccugaguagcuggggcuacaggcgucugcc

SEQ ID NO: 643822 - RNA, 61 nt, Homo Sapiens
cugggcucaggcaauccuccugccucagccuccugaguagcugggacuacaguuucgugug

SEQ ID NO: 643823 - RNA, 61 nt, Homo Sapiens
cuggguucaagcgauucuccagccucagccuccugaguagcuggaauuacagguacgcacc

SEQ ID NO: 643824 - RNA, 61 nt, Homo Sapiens
ccucacacugcuguccucucccccuucagcuccugaguagcugggccugugcacugggcag

SEQ ID NO: 643825 - RNA, 61 nt, Homo Sapiens
ugguagaauauuuauucauaugacaaggauaccugaguaaaacuauccuuuuuaaaaucac

SEQ ID NO: 643826 - RNA, 61 nt, Homo Sapiens
ggguggggugguucaaauggaugacugaucuccugaguacacugaagccacaggcuggugg

SEQ ID NO: 643827 - RNA, 61 nt, Homo Sapiens
ccagguucaagcgauuguccugccucagucuccugaguagcugggacuacaggugugcacc

SEQ ID NO: 643828 - RNA, 61 nt, Homo Sapiens
caggaaaacaauauuguauaacagaccacuuccugaguagaagaguuucuuugugaaaagg

SEQ ID NO: 643829 - RNA, 61 nt, Homo Sapiens
auagguucaagucauucuccugccucagccuccugaguagcugggacuacaggugagugcc

SEQ ID NO: 643830 - RNA, 61 nt, Homo Sapiens
agaaugcugaugccauaacuuucugaccgugccugaguaagcgugaugaaagcagcguuac

SEQ ID NO: 643831 - RNA, 61 nt, Homo Sapiens
ugggauuacaggugugcgccugccucagccuccugaguagcccagguucaggugauucucc

SEQ ID NO: 643832 - RNA, 61 nt, Homo Sapiens
uaggacuacaggcacacacucaccucagucuccugaguagccugggcuuaagugacccucc

SEQ ID NO: 643833 - RNA, 61 nt, Homo Sapiens
gaguggcucagccccacguuccaucuggaggccugaguaagcucggugcccacgccucugc

SEQ ID NO: 643834 - RNA, 61 nt, Homo Sapiens
ugggacuacaggcgcccgccgguucaagccuccugaguaacucugcaaccucugccuccca

SEQ ID NO: 643835 - RNA, 61 nt, Homo Sapiens
caagagcagugagauccacuguagauaaagcccugaguaggcucugaggggcuaucaaugu

SEQ ID NO: 643836 - RNA, 61 nt, Homo Sapiens
aaguaaugcauguguuuggauaacauccuucccugaguagacucuauacagucauuagaug

SEQ ID NO: 643837 - RNA, 61 nt, Homo Sapiens
aaucuggugaccuaaggcucucacugccucuccugaguagauccaaacuggccccuccugc

SEQ ID NO: 643838 - RNA, 61 nt, Homo Sapiens
acauuccccagcuacuuagaucauucagcuuccugaguaccauuauggauauauguugagg

SEQ ID NO: 643839 - RNA, 61 nt, Homo Sapiens
uggaacuacaggugugcgccugccucagucuccugaguagcccagguucaagcaauucucc

SEQ ID NO: 643840 - RNA, 61 nt, Homo Sapiens
ccgaguucaagcuauccuuccaccuccgccuccugaguagcugggaccacagguucacaua

SEQ ID NO: 643841 - RNA, 61 nt, Homo Sapiens
ccguauucaagcgauucuccugucucagccuccugaguagcugggacuacaggugugcacc

SEQ ID NO: 643842 - RNA, 61 nt, Homo Sapiens
cuggguucaagugauucuagugccucagccuccugaguagcugggauaaugggcgugugcc

SEQ ID NO: 643843 - RNA, 61 nt, Homo Sapiens
cugggcccaagcaauucucccaccucagccuccugaguagcugggacuacaagugugcacc

SEQ ID NO: 643844 - RNA, 61 nt, Homo Sapiens
cugggcucaagcaauccuccugccucagcuuccugaguagcuggaaccacaggugugugcu

SEQ ID NO: 643845 - RNA, 61 nt, Homo Sapiens
gagugaauagcuuuauggaaucaaguaugucccugaguagcaagauuaggccucaccaaag

SEQ ID NO: 643846 - RNA, 61 nt, Homo Sapiens
cuuccccauccugcuccgcuucauguccccuccugaguagucaugugauaauaaacucuca

SEQ ID NO: 643847 - RNA, 61 nt, Homo Sapiens
ccggccuugucaaugagugcugaaacaccuuccugaguagucgcguagcaggggaguuguu

SEQ ID NO: 643848 - RNA, 61 nt, Homo Sapiens
ugggacugcaguuguaagccugccucagccuccugaguagcccgggcucaagacauccucc

SEQ ID NO: 643849 - RNA, 61 nt, Homo Sapiens
ugggauuacagucgugugccuucuccuaccuccugaguaacugccuccuagguucaaguga

SEQ ID NO: 643850 - RNA, 61 nt, Homo Sapiens
ugggauuacaggcacccgccugccucagccuccugaguagcccaguugcaagugauucucc

SEQ ID NO: 643851 - RNA, 61 nt, Homo Sapiens
aaagcugugugcucuccaagcccccaggaccccugaguaaacucuacugggagccuaccca

SEQ ID NO: 643852 - RNA, 61 nt, Homo Sapiens
uaggacuacaggugugcaccugucucagccuccugaguagcccguauucaagcgauucucc

SEQ ID NO: 643853 - RNA, 61 nt, Homo Sapiens
aagcagcaguuuugcaaggaccuagagaacaccugaguacuuuguaaauguuccagaacaa

SEQ ID NO: 643854 - RNA, 61 nt, Homo Sapiens
aguuuaauuuucaucaaacaaauugcaguauccugaguagcugaucauucccucuccuugu

SEQ ID NO: 643855 - RNA, 61 nt, Homo Sapiens
ccagaccccccaccgugguuacuggauaagaccugaguaacauucagagaacuaauuuuuc

SEQ ID NO: 643856 - RNA, 61 nt, Homo Sapiens
ugaucgcuugagcccaggaguuuaagaccggccugaguagcauagcaagacccugucucua

SEQ ID NO: 643857 - RNA, 61 nt, Homo Sapiens
ccggguucaagcgauucucccgccucagccuccugaguagcugggauuacaggcacccgcc

SEQ ID NO: 643858 - RNA, 61 nt, Homo Sapiens
ccagguucaagugauucuccugccucagccuccugaguagcugggauuacaggcacacacc

SEQ ID NO: 643859 - RNA, 61 nt, Homo Sapiens
auguaaagaaaaaaacuugaaaauaguaauaccugaguacccaugggaauaauagacacug

SEQ ID NO: 643860 - RNA, 61 nt, Homo Sapiens
ggcaguauucaggcucaacguacaguuugauccugaguaugcuugguguuugccuucagaa

SEQ ID NO: 643861 - RNA, 61 nt, Homo Sapiens
ccagguucaagugauucuccugccucauccuccugaguagcugggauuacaggcgugugcc

SEQ ID NO: 643862 - RNA, 61 nt, Homo Sapiens
uuuaacucacauucagaggaaguccagaucuccugaguagugauuuuggugacaaguuuuu

SEQ ID NO: 643863 - RNA, 61 nt, Homo Sapiens
ccaggcucaagcguuucucccaccuuagccuccugaguagcugggacuaaggcacacacac

SEQ ID NO: 643864 - RNA, 61 nt, Homo Sapiens
uggaauuuuauuuuuucaaguuugugucucaccugaguauccucaaagcaggaacaguggg

SEQ ID NO: 643865 - RNA, 61 nt, Homo Sapiens
ugggacuacaggcaccugccugccucagccuccugaguagcccggguucacgccauucucc

SEQ ID NO: 643866 - RNA, 61 nt, Homo Sapiens
guuaaaagaauguaaaauauuauauuuauagccugaguaaacugauugaaugauauauaaa

SEQ ID NO: 643867 - RNA, 61 nt, Homo Sapiens
ugggacuagaggcacgcacccgccccagccuccugaguagcccuggcuugagugauccucc

SEQ ID NO: 643868 - RNA, 61 nt, Homo Sapiens
ccagguucaagcaauucuccugccuuagccuccugaguagcugggauuacaggcgugcgcc

SEQ ID NO: 643869 - RNA, 61 nt, Homo Sapiens
ccagauucaagcgauucuccugucucagccuccugaguagcugggauuauagguacaugcc

SEQ ID NO: 643870 - RNA, 61 nt, Homo Sapiens
gucuacuuguucaguuuuucaaaucuguuuuccugaguauaaauaagaguauuuaaagaaa

SEQ ID NO: 643871 - RNA, 61 nt, Homo Sapiens
uccuuaggcaagacuuugccucucuccuaguccugaguauaaauccugugcauagauuccu

SEQ ID NO: 643872 - RNA, 61 nt, Homo Sapiens
guuagagacucgccugggaaauugcuccauuccugaguaaacagauauuuucgcccaccua

SEQ ID NO: 643873 - RNA, 61 nt, Homo Sapiens
ccucuuuugcacuggaaggcccucccuuuggccugaguacuuuucccguucacgccucagu

SEQ ID NO: 643874 - RNA, 61 nt, Homo Sapiens
caggacuauggcauguaccaaaccuuagccuccugaguagcccuugccucaagugagcuuc

SEQ ID NO: 643875 - RNA, 61 nt, Homo Sapiens
auugcaugaauuuuuaucucuaaaaaaaaaaccugaguaucucaaauauuggauuuaccuu

SEQ ID NO: 643876 - RNA, 61 nt, Homo Sapiens
uaauggacaucuucucaugcuugcccucuauccugaguaacacuuuuuguauauaaucucu

SEQ ID NO: 643877 - RNA, 61 nt, Homo Sapiens
ugggauuauaggcgucugccugccucagccuccugaguagcccagguucaagcgacucucc

SEQ ID NO: 643878 - RNA, 61 nt, Homo Sapiens
ugggacuacagaugcgugcccgccugagccuccugaguauccugggcucaggugauccucc

SEQ ID NO: 643879 - RNA, 61 nt, Homo Sapiens
ugggcacgguguuguaccucugccucagccuccugaguagccuggguucaagcaguucucc

SEQ ID NO: 643880 - RNA, 61 nt, Homo Sapiens
ucacggcauuugggggcucaaggcuccacucccugaguaaugcgacacuuggagccaucuc

SEQ ID NO: 643881 - RNA, 61 nt, Homo Sapiens
ugggacuacaggcgcccgccugccucagccuccugaguagcccgggcucaccccauucucc

SEQ ID NO: 643882 - RNA, 61 nt, Homo Sapiens
uggcauuauaggugcccaccugccucagccuccugaguagcccagguucaagcaguucucc

SEQ ID NO: 643883 - RNA, 61 nt, Homo Sapiens
ugggauuacaggcgcguauccgccucagccuccugaguagcccggguucaagcgauucucc

SEQ ID NO: 643884 - RNA, 61 nt, Homo Sapiens
cuggguucaugccauucuccugccucagccuccugaguagcugggacuacaggcgcucgcc

SEQ ID NO: 643885 - RNA, 61 nt, Homo Sapiens
acauaaagugcuagaaaaucauguuccuuguccugaguaagaguuaaucagaguaaaugca

SEQ ID NO: 643886 - RNA, 61 nt, Homo Sapiens
uugggauccuucagcacaggaauucucaagaccugaguauuuuuuauaauaggaaugucca

SEQ ID NO: 643887 - RNA, 61 nt, Homo Sapiens
cacuccuagccagugagucauggucauauuuccugaguaaagucauucugaguuacuuacu

SEQ ID NO: 643888 - RNA, 61 nt, Homo Sapiens
ucauuggaaaggguuuuaaacggagucggaaccugaguagauuuccaaauuuuacagccag

SEQ ID NO: 643889 - RNA, 61 nt, Homo Sapiens
uacagaagugcaucauucuagaauguguagaccugaguagcuuauacacuacagagcacuu

SEQ ID NO: 643890 - RNA, 61 nt, Homo Sapiens
ugggauuacgggcgcgugccugccucagccuccugaguagccuggguucaaacgauucugc

SEQ ID NO: 643891 - RNA, 61 nt, Homo Sapiens
ugaaggaaucugggaauuaguuaaaugccagccugaguacccauugcuagugacuagcccc

SEQ ID NO: 643892 - RNA, 61 nt, Homo Sapiens
cggggagcuacaagcaugcaugccucagccuccugaguagccuggguucaagagguucucc

SEQ ID NO: 643893 - RNA, 61 nt, Homo Sapiens
cgaucacccacucuuaccuguagcucugacaccugaguacagccugcccacgcuccuucuu

SEQ ID NO: 643894 - RNA, 61 nt, Homo Sapiens
aaagcuagcuuagcaaaauaauuguauuugcccugaguauuguaacgugggaaccauugag

SEQ ID NO: 643895 - RNA, 61 nt, Homo Sapiens
aacguuucuguucaguuucccauucucuccuccugaguaggcuagagugucagaacagagc

SEQ ID NO: 643896 - RNA, 61 nt, Homo Sapiens
acaccaagaugcugcugucugguaagcuguuccugaguauacuuuuuacccuauggaaggg

SEQ ID NO: 643897 - RNA, 61 nt, Homo Sapiens
aacugguuagcuucucuggauguacaucagcccugaguagucauuuuggcguugcaucuau

SEQ ID NO: 643898 - RNA, 61 nt, Homo Sapiens
uuucaacaagcuccuguuaaaaguauaugaaccugaguacuagucuucuuacauuuacaag

SEQ ID NO: 643899 - RNA, 61 nt, Homo Sapiens
uuuuucuuuguuagguacauguauacaccugccugaguauaaauacucucucuaccuaaua

SEQ ID NO: 643900 - RNA, 61 nt, Homo Sapiens
ccagguucaagcgauacuccugccucagucuccugaguagcugggaucacaggugcacacc

SEQ ID NO: 643901 - RNA, 61 nt, Homo Sapiens
ucugucucaagcgauucuccugccucagccuccugaguagcugggauuacaggugcaugcc

SEQ ID NO: 643902 - RNA, 61 nt, Homo Sapiens
ggacuguuugagcccaggaguuugagaccaaccugaguaagguggcaaaaccccaucucua

SEQ ID NO: 643903 - RNA, 56 nt, Homo Sapiens
gaaaugguacaaagucaugaugauucccugaguaacaaagggaaaugaaaacuguu

SEQ ID NO: 643904 - RNA, 61 nt, Homo Sapiens
ucaggugauugucaguaccuuaccucagccuccugaguagcuggaacugcagaugugcgcc

SEQ ID NO: 643905 - RNA, 61 nt, Homo Sapiens
ucauauaacaaauauuuucccacuauuacagccugaguaauacccguauuaaaagagccuc

SEQ ID NO: 643906 - RNA, 61 nt, Homo Sapiens
ugggacuauaggugcaugccugccucagccuccugaguagccuggguucaagcaauucucc

SEQ ID NO: 643907 - RNA, 61 nt, Homo Sapiens
ugggacuacaggcaugcaccugccuuagccuccugaguagccuggguucaagugauucccc

SEQ ID NO: 643908 - RNA, 61 nt, Homo Sapiens
ugggacuacaggugugcgccugccucagccuccugaguagcccagguucaagcuauucucc

SEQ ID NO: 643909 - RNA, 61 nt, Homo Sapiens
ggcugcccugcccacgugggauucacaggggccugaguagggcccggggaagcagagcccu

SEQ ID NO: 643910 - RNA, 61 nt, Homo Sapiens
gaggaguguucauuguauaauaaguuauucaccugaguaugcaauaaagaugugguggcca

SEQ ID NO: 643911 - RNA, 61 nt, Homo Sapiens
uguugacucaaaacuugcuaguuacugccuaccugaguagaaucuuauuuaugaacuccug

SEQ ID NO: 643912 - RNA, 61 nt, Homo Sapiens
gggaacagccugagccgaacauguuauuuaaccugaguauaguauuuaacgaagccuagaa

SEQ ID NO: 643913 - RNA, 61 nt, Homo Sapiens
uuugugccuggugauauauuuuuuuuuccucccugaguauaaaugcaaugcgacugcaaaa

SEQ ID NO: 643914 - RNA, 61 nt, Homo Sapiens
uccuccaucccagcauagagaauggggacucccugaguaaugggaguucuuucauggccuc

SEQ ID NO: 643915 - RNA, 61 nt, Homo Sapiens
ggaaaagugguacuaacccacgauucugagcccugaguaugccuggacauugaugcuaaca

SEQ ID NO: 643916 - RNA, 61 nt, Homo Sapiens
ccgaguucaagcaauucuccugccucagccuccugaguagcugggauuacaggcguccgcu

SEQ ID NO: 643917 - RNA, 61 nt, Homo Sapiens
ggaugcccucagugaccuuuugcgcacaaguccugaguaugccagaagaaguuaaagcucg

SEQ ID NO: 643918 - RNA, 61 nt, Homo Sapiens
gauuuauaguaaaacaagugcaccucagcuuccugaguaggccaggcucaagugauccucc

SEQ ID NO: 643919 - RNA, 61 nt, Homo Sapiens
aaagauacaaaauguuacugaaaaaucccuuccugaguaaugaaguggguggguagauuua

SEQ ID NO: 643920 - RNA, 61 nt, Homo Sapiens
ugggauuacaggcgugugccugccucggccuccugaguagcccagguucaagcgauucucg

SEQ ID NO: 643921 - RNA, 61 nt, Homo Sapiens
ugggauuacaggcacacacccaucucagccuccugaguagcccggguucaagcaauucucc

SEQ ID NO: 643922 - RNA, 61 nt, Homo Sapiens
ugggauuauaggcacgcaccugccuccgccuccugaguagccuggguucaagcgauucucc

SEQ ID NO: 643923 - RNA, 61 nt, Homo Sapiens
ucuguggugagagaagcuucuuuccacuugcccugaguaaaguaagcauucuuaacaugua

SEQ ID NO: 643924 - RNA, 61 nt, Homo Sapiens
ugggacuacaugcgcacaccugccucagccuccugaguagccuggguucaagcgauucucu

SEQ ID NO: 643925 - RNA, 61 nt, Homo Sapiens
agcagcacugguuuugaguuaagaaaaucaaccugaguaaaugcugaagaaagaagaauag

SEQ ID NO: 643926 - RNA, 61 nt, Homo Sapiens
ugggacuacaggcaugcaccugccucagccuccugaguagccuagguucaagcaauucucc

SEQ ID NO: 643927 - RNA, 61 nt, Homo Sapiens
cuggguucaagugauucuccugccucagccuccugaguagcugggauuacagacacccgcc

SEQ ID NO: 643928 - RNA, 61 nt, Homo Sapiens
ccagguucaagugauuauccugccuuagccuccugaguagcugggauuacaggcgcgugcc

SEQ ID NO: 643929 - RNA, 61 nt, Homo Sapiens
uggaacaugagacaguaucuacuggcuguguccugaguaacugcuccugccgucucccccg

SEQ ID NO: 643930 - RNA, 61 nt, Homo Sapiens
ugggauuacaguugccgccaugccucggccuccugaguagcccagguucaagccauucucc

SEQ ID NO: 643931 - RNA, 61 nt, Homo Sapiens
cccuuggcuguaugucugaccugaaaauacuccugaguacugauaauaaauguauuuagga

SEQ ID NO: 643932 - RNA, 61 nt, Homo Sapiens
aaggaaaaacagcaaaacaaaagcaagagucccugaguauaugaacuucuguuuaaguuga

SEQ ID NO: 643933 - RNA, 61 nt, Homo Sapiens
uaaccaaaagaauugaaaucgcaaucccaugccugaguaugagagagaugacagucuuccu

SEQ ID NO: 643934 - RNA, 61 nt, Homo Sapiens
ccuagaguccagaggggaggugagguuaaaaccugaguaauggaaaagcuuuuagaguaga

SEQ ID NO: 643935 - RNA, 61 nt, Homo Sapiens
cuggguucaagcgcuucuccagccucagccuccugaguagcugggauuacagguaugugcc

SEQ ID NO: 643936 - RNA, 61 nt, Homo Sapiens
caauucucuuguuacauucucccuuuagcaaccugaguaagagacucucugccacugggcu

SEQ ID NO: 643937 - RNA, 61 nt, Homo Sapiens
gaagagaccuucaggugcuugauaaucuugaccugaguagaauuccagacuaaacauaaaa

SEQ ID NO: 643938 - RNA, 61 nt, Homo Sapiens
aauaauaaaguuuaaaaaugauuccuaauguccugaguauucuacugaaaaaaaucuggaa

SEQ ID NO: 643939 - RNA, 61 nt, Homo Sapiens
cauguaacauucuaaaauuggguuagucaggccugaguauuuguuguuuuuuggaggggaa

SEQ ID NO: 643940 - RNA, 61 nt, Homo Sapiens
ugggauuauaggcacacaccugccucagccuccugaguagcuuggguuaaaagaauucucc

SEQ ID NO: 643941 - RNA, 61 nt, Homo Sapiens
cucccuuuauuuuugaccagacugacuccauccugaguaauuagaaacaaguuuguuuaag

SEQ ID NO: 643942 - RNA, 61 nt, Homo Sapiens
ugggaauauaggugcacaccugccucagccuccugaguagccuggguucaagcaauucucc

SEQ ID NO: 643943 - RNA, 61 nt, Homo Sapiens
ugggaguacaggcauguggcugccucagccaccugaguagcccagguucaagcgauucucc

SEQ ID NO: 643944 - RNA, 61 nt, Homo Sapiens
ugggacuacaggugugcaccccgcucagccuccugaguagccugggcucaagcgauccucc

SEQ ID NO: 643945 - RNA, 61 nt, Homo Sapiens
cccugguucaagcaauucuccugccuugccuccugaguagcugggauuacaggcguguguc

SEQ ID NO: 643946 - RNA, 61 nt, Homo Sapiens
aagcucugcagacuuuugcaggauugucuagccugaguaccgggcuacuucuuaaaugccg

SEQ ID NO: 643947 - RNA, 61 nt, Homo Sapiens
auauauaucuauaccugcauauauauauugaccugaguauuuauaacugugugguguucau

SEQ ID NO: 643948 - RNA, 61 nt, Homo Sapiens
ggguuaucagauauguuuuuaaaucucucgcccugaguacucuucuugggaguugcugcug

SEQ ID NO: 643949 - RNA, 61 nt, Homo Sapiens
cuauggaggaccucggucuucauccaaguggccugaguauuucacuggcagguugugaauu

SEQ ID NO: 643950 - RNA, 61 nt, Homo Sapiens
ugggauuacaggugccugccugccucagccuccugaguagcccagauuccagcgauucucc

SEQ ID NO: 643951 - RNA, 61 nt, Homo Sapiens
uuggccacuaauaauuaaccaaaauuagucaccugaguaacuggugaauguguaccaagaa

SEQ ID NO: 643952 - RNA, 61 nt, Homo Sapiens
aaaaugagacccuaucucaauugcacugcagccugaguaacagugagccauguccacacca

SEQ ID NO: 643953 - RNA, 61 nt, Homo Sapiens
ugggauuacaggcacaugccugccucagccuccugaguagccuggauucaaacaauucucc

SEQ ID NO: 643954 - RNA, 61 nt, Homo Sapiens
ugggacuacaggcaccugccugccucagccuccugaguagccuggguucaaacaauucucc

SEQ ID NO: 643955 - RNA, 61 nt, Homo Sapiens
uuuacaaagcugcaaguggauucaugugaaaccugaguacaggcuuccaaguuuucuaagg

SEQ ID NO: 643956 - RNA, 61 nt, Homo Sapiens
ugggauuacaggugugugccugccucagccuccugaguagcucggguucaagcuguucuac

SEQ ID NO: 643957 - RNA, 61 nt, Homo Sapiens
ggcuuuucagucccugggcaccccaggggcuccugaguauaucuuucuuugcuuccuguca

SEQ ID NO: 643958 - RNA, 61 nt, Homo Sapiens
ugggauuacaggcacacgccugccucagccuccugaguagcccagguucaagcaauucucc

SEQ ID NO: 643959 - RNA, 61 nt, Homo Sapiens
gauucuccugccucccugccucagccugggaccugaguagcugggaccacaggcaugcgcc

SEQ ID NO: 643960 - RNA, 61 nt, Homo Sapiens
ccggguucaagugaucguccugccuuaggcuccugaguagcuggggauuacaggugccuac

SEQ ID NO: 643961 - RNA, 61 nt, Homo Sapiens
ccaauguggggagaaaggaagcuuuccgaggccugaguauugcaauacaugcaguaguaca

SEQ ID NO: 643962 - RNA, 61 nt, Homo Sapiens
auuuaaauaaaaacaacagcagcaggcugucccugaguaguuuugcugccauagguuaagu

SEQ ID NO: 643963 - RNA, 61 nt, Homo Sapiens
cuggguucaagcaauucuccugccucaggcuccugaguagcugggauuacaggcacgugac

SEQ ID NO: 643964 - RNA, 61 nt, Homo Sapiens
ccagguucgagcacuuuucaugccucagccuccugaguagcugggauuacaggcgugcacc

SEQ ID NO: 643965 - RNA, 61 nt, Homo Sapiens
ccggguucaaguaauucugcugucucagccuccugaguagcugggacuacaggcacacgcc

SEQ ID NO: 643966 - RNA, 61 nt, Homo Sapiens
cuggguucaagugauucucuugccucagccuccugaguagcugggauuacagguuccugcu

SEQ ID NO: 643967 - RNA, 61 nt, Homo Sapiens
gaagaccuuuaauggcuucccucuuucaucuccugaguauguaacuugcaaugggcagcua

SEQ ID NO: 643968 - RNA, 61 nt, Homo Sapiens
ccggguucaagcaauucuccugccucagccuccugaguagcugggaugacaggugcacgcc

SEQ ID NO: 643969 - RNA, 61 nt, Homo Sapiens
ugggguuacaggugugugccugccucauccuccugaguagccugggcucaaguguuccucc

SEQ ID NO: 643970 - RNA, 61 nt, Homo Sapiens
cuccaaacuguggauacagucuuggaucuacccugaguaucccuucaaaacacgaggcacu

SEQ ID NO: 643971 - RNA, 61 nt, Homo Sapiens
caaguauagugcagauucuaaucuuauuuucccugaguauccuaaaacuacaauauauguc

SEQ ID NO: 643972 - RNA, 61 nt, Homo Sapiens
gguugugcucauuaccccaggagcacccuguccugaguagggaaggccaccauccuccaca

SEQ ID NO: 643973 - RNA, 61 nt, Homo Sapiens
aguacaugccuagaccugggaagacaucaaaccugaguauccaauggauuuaucccccgca

SEQ ID NO: 643974 - RNA, 61 nt, Homo Sapiens
ugggacuacaggcgcccgccugcuucagccuccugaguagccuggguucaugccauuuucc

SEQ ID NO: 643975 - RNA, 61 nt, Homo Sapiens
ggugggggcaggcaggaggcauggaugggaaccugaguagguaguguggccaagagaucag

SEQ ID NO: 643976 - RNA, 61 nt, Homo Sapiens
aaaguaagguugggaccuggguacguggaucccugaguagaucccagcaucugggccaugg

SEQ ID NO: 643977 - RNA, 61 nt, Homo Sapiens
cugggcucaagugauccucccaccucagccuccugaguagcugagaccacaggcgugugcc

SEQ ID NO: 643978 - RNA, 61 nt, Homo Sapiens
guaauuucccccacaguaaaauacacugacuccugaguaaauugauuuuccaguuuuaugg

SEQ ID NO: 643979 - RNA, 61 nt, Homo Sapiens
ccaggcucaagcgauccucccgccuuaacugccugaguagcugggacuacaggcaugcacc

SEQ ID NO: 643980 - RNA, 61 nt, Homo Sapiens
ccggguucaagcaauucuccugccucagccuccugaguagcuggcacuguaggcauguacc

SEQ ID NO: 643981 - RNA, 61 nt, Homo Sapiens
caauaauccuauuguacgcuagagcaugcugccugaguauuacuaguggacguaggauauu

SEQ ID NO: 643982 - RNA, 61 nt, Homo Sapiens
ugaggugagaggcccaggugguccuggcaacccugaguagaaggagagacgggguagggaa

SEQ ID NO: 643983 - RNA, 61 nt, Homo Sapiens
ugggauuacagaugcccgcccaccucagccuccugaguaggccgggcucaagcgauucucu

SEQ ID NO: 643984 - RNA, 61 nt, Homo Sapiens
agaauguuguacccaucuccggcaggaggaaccugaguauggaagcaggcugaagaggaaa

SEQ ID NO: 643985 - RNA, 61 nt, Homo Sapiens
ugggacuacaggcucaugcccaccucagccuccugaguagccugggcucaaaugauccucc

SEQ ID NO: 643986 - RNA, 61 nt, Homo Sapiens
ugggacuacaggugcucaccuccugccuccuccugaguagccucccagguucaagcgauuc

SEQ ID NO: 643987 - RNA, 61 nt, Homo Sapiens
ugggauuacaggcgucggccugccucaggcuccugaguagcccacguucaagcgauccucc

SEQ ID NO: 643988 - RNA, 61 nt, Homo Sapiens
ugaaaagaaaaugcugaaaugauuuuccucaccugaguacagucauuggauauaaaagagu

SEQ ID NO: 643989 - RNA, 61 nt, Homo Sapiens
ugggacuacaggcuugcgcccaccccagccuccugaguagcccaggcucaagugauccucc

SEQ ID NO: 643990 - RNA, 61 nt, Homo Sapiens
ugagauuacaggcacaagcuugccuuagccuccugaguaaccugaccucacacaauccucc

SEQ ID NO: 643991 - RNA, 61 nt, Homo Sapiens
ugggacuacaggcacaggcccaucucagccuccugaguagcccaggcucaagcgauccucc

SEQ ID NO: 643992 - RNA, 54 nt, Homo Sapiens
agccccugucacaucugacucgcuccugaguaccaaaaagaugacaagaacuaa

SEQ ID NO: 643993 - RNA, 61 nt, Homo Sapiens
ucacaguccauauccugaugcucuuguccucccugaguaucagcuaucagcaucugccagu

SEQ ID NO: 643994 - RNA, 61 nt, Homo Sapiens
ugggauuacagguguaugccuaccucagccuccugaguagcaugggcucaugggauucucc

SEQ ID NO: 643995 - RNA, 61 nt, Homo Sapiens
ugggacuacagguguguaccccuccucucagccugaguaacaccucccaggcgcacaaaau

SEQ ID NO: 643996 - RNA, 61 nt, Homo Sapiens
cuggguucaagugauucucauggcucagccgccugaguagcugggauuacaggugugagcc

SEQ ID NO: 643997 - RNA, 61 nt, Homo Sapiens
ugggaugacaggcacccgccugccucagccuccugaguagcccagguucaagcaguucucc

SEQ ID NO: 643998 - RNA, 61 nt, Homo Sapiens
ugggacuacaggcgcccaccugccucagccuccugaguagcccggguucacgccauucucc

SEQ ID NO: 643999 - RNA, 61 nt, Homo Sapiens
ugggauuacaggcacccaccugccucagccuccugaguagcccggguucaagugauucucc

SEQ ID NO: 644000 - RNA, 61 nt, Homo Sapiens
ccgggcucaagcgauucuccagccucagccuccugaguagcuaggacugcaggugcuccac

SEQ ID NO: 644001 - RNA, 61 nt, Homo Sapiens
uugggcucaagugauccucccaccucagccuccugaguagcugggaccauaggcucacaac

SEQ ID NO: 644002 - RNA, 61 nt, Homo Sapiens
ggcguccuuuuuccuuguagcuaacguuaggccugaguagcuccccuccauccuuguagac

SEQ ID NO: 644003 - RNA, 61 nt, Homo Sapiens
caggguucaagcaauucuccugccucagucuccugaguagcugggacuacaggcaugcgcc

SEQ ID NO: 644004 - RNA, 61 nt, Homo Sapiens
caggguucaagcaacucuccugcuucagccuccugaguagcugggacuacaggcaugcacc

SEQ ID NO: 644005 - RNA, 61 nt, Homo Sapiens
ccaggcucaagcaguucuccugccucagccuccugaguagcugggacuacaggcacccgcc

SEQ ID NO: 644006 - RNA, 61 nt, Homo Sapiens
cggggcucaagcgcuucuccugccucagccuccugaguagcugggauuacaggcaugugcc

SEQ ID NO: 644007 - RNA, 61 nt, Homo Sapiens
ugggguucaagugauccucccaccucagccuccugaguagcugggauuacaggcacccgcc

SEQ ID NO: 644008 - RNA, 61 nt, Homo Sapiens
ugaucuccaagugacccuccugccucagccuccugaguacccuccuggggacuacaggugc

SEQ ID NO: 644009 - RNA, 61 nt, Homo Sapiens
ucaacgccaagucauccucccaccucagccuccugaguagcuaugacuacagguaugugcc

SEQ ID NO: 644010 - RNA, 61 nt, Homo Sapiens
ccggguucacgccauucuccugccucagccuccugaguagcugggacuacaggccccugcc

SEQ ID NO: 644011 - RNA, 61 nt, Homo Sapiens
cuggguugaagugauucucgugccucagccuccugaguagcugggacugcaggcacgcgcc

SEQ ID NO: 644012 - RNA, 61 nt, Homo Sapiens
cuggguucaagcgauucuccugccucagccuccugaguagcugggauuacaggugugcgcc

SEQ ID NO: 644013 - RNA, 61 nt, Homo Sapiens
cugggaucaagugauucuccugccacagccuccugaguaccugagauuacaggcacccacc

SEQ ID NO: 644014 - RNA, 61 nt, Homo Sapiens
gagccaacacaugcucacugccagcuccuguccugaguacugggaaguuucuccugaagcc

SEQ ID NO: 644015 - RNA, 61 nt, Homo Sapiens
cccagcucagguggugagucgcaccccaggaccugaguaucgaugcagccccaucuccuca

SEQ ID NO: 644016 - RNA, 61 nt, Homo Sapiens; identical to SEQ ID NO: 643865

SEQ ID NO: 644017 - RNA, 61 nt, Homo Sapiens
ugggacuauaggcgcgugccugccucagccuccugaguagcucagguucaagcaauucucc

SEQ ID NO: 644018 - RNA, 61 nt, Homo Sapiens
ugggauuacagcacccgccaugccucagccuccugaguagccuggguucaagugauucucc

SEQ ID NO: 644019 - RNA, 61 nt, Homo Sapiens
accuucaggcuagucccuaugaaagagauucccugaguagcuacagaccccaugucaccca

SEQ ID NO: 644020 - RNA, 61 nt, Homo Sapiens
ugggacuacaggcaugcgcaugccucagccuccugaguagcacccagguuaaaaauucucc

SEQ ID NO: 644021 - RNA, 61 nt, Homo Sapiens
ugggacuacaggcgccugccugccucagccuccugaguagccuggguucacaccauucucc

SEQ ID NO: 644022 - RNA, 61 nt, Homo Sapiens
uaggacuacaggugcaugccugccucagccuccugaguagcccgggcucaagcgauucucu

SEQ ID NO: 644023 - RNA, 61 nt, Homo Sapiens
ugggacuacaggcgcccgccugccucagccuccugaguagccucccggguucaugccauuc

SEQ ID NO: 644024 - RNA, 61 nt, Homo Sapiens
ugggacuacaggcacaggccugucucagccuccugaguagacuguguucaagcgauucucc

SEQ ID NO: 644025 - RNA, 61 nt, Homo Sapiens
gcagugggaacucggaauuuaaauuaucaaaccugaguaggaguuuugugagcccuguagc

SEQ ID NO: 644026 - RNA, 61 nt, Homo Sapiens
ugggacuacaggugcgugccugccucagucuccugaguagcccagguucaugcaauucucc

SEQ ID NO: 644027 - RNA, 61 nt, Homo Sapiens
auccugugauugcagcaaaugagaauacacaccugaguaaguccagucucauuaaauauug

SEQ ID NO: 644028 - RNA, 61 nt, Homo Sapiens
ugggcugacaggcacccaccugccucagccuccugaguagccuggguucaagugauucucg

SEQ ID NO: 644029 - RNA, 61 nt, Homo Sapiens
ugggacuacaggcaugagcccaccucagccuccugaguagccuggccuuaagugauccucc

SEQ ID NO: 644030 - RNA, 61 nt, Homo Sapiens
cacacccugcucaguauggcuagccagcaguccugaguaggaguccaggacucccacuguc

SEQ ID NO: 644031 - RNA, 61 nt, Homo Sapiens
ccuagguuauugcuagccaaaauauuuuuguccugaguagugucacugggccaaaagauag

SEQ ID NO: 644032 - RNA, 61 nt, Homo Sapiens
gacgcaacccacguguaacugucagccgggcccugaguaaucgcuuaaagauguuccuacg

SEQ ID NO: 644033 - RNA, 61 nt, Homo Sapiens
ccagguucaagcgauucuccugccucagccuccugaguagcugggauuacaggcgcacgcc

SEQ ID NO: 644034 - RNA, 61 nt, Homo Sapiens
uuguuccuggucuaauuuggcacccuuccaaccugaguauuguaggggaaggaaauuuaca

SEQ ID NO: 644035 - RNA, 61 nt, Homo Sapiens
ugggauuacaggcauguaccugccucagccuccugaguagccaggguucaagugauucucc

SEQ ID NO: 644036 - RNA, 61 nt, Homo Sapiens
cagccccaagcauggccaggaugcccugaacccugaguagagaaacacugccccauccucc

SEQ ID NO: 644037 - RNA, 61 nt, Homo Sapiens
auuaaauagguuuuauguauugauucccacuccugaguaaagaaacagaacccagguuucu

SEQ ID NO: 644038 - RNA, 61 nt, Homo Sapiens
ucugggaggccucaugucucacuagaaguuaccugaguaucggucaccgauggucagaguc

SEQ ID NO: 644039 - RNA, 61 nt, Homo Sapiens
uucccuuggcaaaauucccauuauuagcgguccugaguaauuguugcagaagccggcguuu

SEQ ID NO: 644040 - RNA, 61 nt, Homo Sapiens
agugauuguuaugccuugcuacacaguguuuccugaguagcuugaugauuaaaaagaauaa

SEQ ID NO: 644041 - RNA, 61 nt, Homo Sapiens
ugggacuacaggcacccgccugccucagccuccugaguagcccguguucacaccauucucc

SEQ ID NO: 644042 - RNA, 61 nt, Homo Sapiens
ccagguuccaacgauugucuugucucagccuccugaguagcugagauuauaagcacgcacc

SEQ ID NO: 644043 - RNA, 61 nt, Homo Sapiens
uacccaaagaacgaagcugacacugcaggguccugaguaaauguguucuguauaaacaaau

SEQ ID NO: 644044 - RNA, 61 nt, Homo Sapiens
uuauguucaagcaauucuccuuccuuagccuccugaguagcugggauuacaggcaugcgcc

SEQ ID NO: 644045 - RNA, 61 nt, Homo Sapiens
ugagacuacaggugagugccccccucagccuccugaguagccccuggcucaagcgaucccu

SEQ ID NO: 644046 - RNA, 61 nt, Homo Sapiens
ugggacuacaggcaugcaccacuuuaagccuccugaguagcaaguacaauuguuaacagug

SEQ ID NO: 644047 - RNA, 61 nt, Homo Sapiens
gggaaguggaacauaggcagaugcagcuggcccugaguacaucugcugcuuggaauaaaaa

SEQ ID NO: 644048 - RNA, 61 nt, Homo Sapiens
caucaccuacauggccauuaaagacaguuucccugaguaaugguagcugucacuucaaaag

SEQ ID NO: 644049 - RNA, 61 nt, Homo Sapiens
ggguggugucauggagccgcucgugagcucgccugaguauguggagccucaugccccuggg

SEQ ID NO: 644050 - RNA, 61 nt, Homo Sapiens
gcccuggugccugcugaagauucccucuaucccugaguacuuagucuucucccccuucccu

SEQ ID NO: 644051 - RNA, 61 nt, Homo Sapiens
agaguuaaaaaaaaaaaaaaaaaucuguaugccugaguaccauccuggaugaaucuagaag

SEQ ID NO: 644052 - RNA, 61 nt, Homo Sapiens
uucuccaaggacagauggcaguggagcuagaccugaguagggggcagggaguucaggacaa

SEQ ID NO: 644053 - RNA, 61 nt, Homo Sapiens
ugggauuacaggcaugcaccugccucagccuccugaguagccggguucaagcggauucucg

SEQ ID NO: 644054 - RNA, 61 nt, Homo Sapiens
ugggacuacaggugcgugccugcuucagccuccugaguagccuggguucaagcgauucccc

SEQ ID NO: 644055 - RNA, 61 nt, Homo Sapiens
cuuggaaaggggcucccuccagcacccuuggccugaguaaacccccuccuuuguguguccc

SEQ ID NO: 644056 - RNA, 61 nt, Homo Sapiens
uguguggguguggcgcauguccugucaguccccugaguaugcgggucugugucccaugugu

SEQ ID NO: 644057 - RNA, 61 nt, Homo Sapiens
cuggguucaagcgauucuccugccucagccuccugaguagcugggaauacaggcaugcgcc

SEQ ID NO: 644058 - RNA, 61 nt, Homo Sapiens
uuuaaagacaaauuaugggacguuuguagaaccugaguauuuuucuuuuuaccaguuuuuu

SEQ ID NO: 644059 - RNA, 61 nt, Homo Sapiens
cggauucaaggaauucucccugccucagccuccugaguagcuaggauuacaggugccugcc

SEQ ID NO: 644060 - RNA, 61 nt, Homo Sapiens
gccgcugaucagccuuauguucccaaagagcccugaguagugcuuugguguucacagucug

SEQ ID NO: 644061 - RNA, 61 nt, Homo Sapiens
cuggguucaagcgauucuccugccugagccuccugaguagcugggacuacaggcacgugcc

SEQ ID NO: 644062 - RNA, 61 nt, Homo Sapiens
ccggauucaagugauucuccagccucagccuccugaguagcugggauuacaggcacacacc

SEQ ID NO: 644063 - RNA, 61 nt, Homo Sapiens
cuggguucaagcgauucucgugccucagcuuccugaguagcuggaauuacaggcaggugcc

SEQ ID NO: 644064 - RNA, 61 nt, Homo Sapiens
gaugccgugggaguacaaaaguggaguguggccugaguaaugcauuaugggugguuuacca

SEQ ID NO: 644065 - RNA, 61 nt, Homo Sapiens
ugggacuacaggcgccagccugccucagccuccugaguagccuggguucaagcgauucucc

SEQ ID NO: 644066 - RNA, 61 nt, Homo Sapiens
ugaagcagaagaucagcaagcugguauucuaccugaguagaagccacagcagcagcuugac

SEQ ID NO: 644067 - RNA, 61 nt, Homo Sapiens
ugggacuacaguugugcacccgccucagccuccugaguagccugggcuuaagggauccuuc

SEQ ID NO: 644068 - RNA, 61 nt, Homo Sapiens
aagcauggugucaguuuuguuaucuuuaccuccugaguaauaauauaaucugaauuauugu

SEQ ID NO: 644069 - RNA, 61 nt, Homo Sapiens
ggcuuggagaaauggcuaggcacagagggagccugaguacaggacagucuucucuguugau

SEQ ID NO: 644070 - RNA, 61 nt, Homo Sapiens
cacuaccacaaugucuucugguugcuucucuccugaguaccgggagaauugucccauucuu

SEQ ID NO: 644071 - RNA, 65 nt, Homo Sapiens
ccucccagguucaagugauucuucugccucagccuccugaguagcugggauuacaggugugcacc

SEQ ID NO: 644072 - RNA, 65 nt, Homo Sapiens
caggaugucaaaaagcaauucuccugccucagccuccugaguagcugggacuacagguuccuacc

SEQ ID NO: 644073 - RNA, 65 nt, Homo Sapiens
gguucauccuuuagugaauuagaggauuuggcuacccugaguauauuuauauucauuucuucugu

SEQ ID NO: 644074 - RNA, 65 nt, Homo Sapiens
ccuccuggguucaagcaauucucccaccucagccuccugaguagcugggauuacaggcacaugcc

SEQ ID NO: 644075 - RNA, 65 nt, Homo Sapiens
ccuccuggguucaagggauucuccugucuuagccuccugaguagcugugauuacaggcaugcgcc

SEQ ID NO: 644076 - RNA, 65 nt, Homo Sapiens
cuauuagaagcugcuuccugugaagaucaaaucuuccugaguaauuaaauggaccaacaaugagc

SEQ ID NO: 644077 - RNA, 65 nt, Homo Sapiens
ccucccggguucaagugauucuccugucucagcucccugaguaacuggaauuacaggugcacgcc

SEQ ID NO: 644078 - RNA, 65 nt, Homo Sapiens
cuuucagcuccuuuguuucauacggaacuccagauccugaguaauccuuuuagagcccgaagagu

SEQ ID NO: 644079 - RNA, 65 nt, Homo Sapiens
ggcucacugcaaccuccgccuccagggcgcagccuccugaguagcugggaggacaggcauaugcc

SEQ ID NO: 644080 - RNA, 65 nt, Homo Sapiens
aauucugggcucaggugauccuuccgccucacccuccugaguagcugggacuacaggugugcacc

SEQ ID NO: 644081 - RNA, 65 nt, Homo Sapiens
ccuccuggguucaagcgauucuccugccucagccuccugaguagcugggauuacaggcacacacc

SEQ ID NO: 644082 - RNA, 65 nt, Homo Sapiens
gaguuccauguuuguacuccugugcuggacuguuuccugaguaccagcaggucccuuuuugucuc

SEQ ID NO: 644083 - RNA, 65 nt, Homo Sapiens
aauucuuaaaaggauucauagcaacauaaugugucccugaguagaggaugcugcuaugcgugagu

SEQ ID NO: 644084 - RNA, 65 nt, Homo Sapiens
aaaugagagucacaaauuuuucuucaguguuucagccugaguaaguuacauaaaccucgcuuagc

SEQ ID NO: 644085 - RNA, 65 nt, Homo Sapiens
ccuccuggguucaagcgauucuccugccucagccuccugaguagcugggauuacaggugugcacc

SEQ ID NO: 644086 - RNA, 65 nt, Homo Sapiens
ccucccggguugacaccauuuuccugccucagccuccugaguaguugggauuaccaguagauggg

SEQ ID NO: 644087 - RNA, 65 nt, Homo Sapiens
ccucccgaauucaagugauucuccugccucagccuccugaguagcugggauuacaggcgcccguc

SEQ ID NO: 644088 - RNA, 65 nt, Homo Sapiens
uggaacuacaaggaagggcccuccugccucagucuccugaguagccucugggagcucaagugauc

SEQ ID NO: 644089 - RNA, 65 nt, Homo Sapiens
ugggauuacaggugccugcccuccugccucagccuccugaguaccccucccgaguucaaucgauu

SEQ ID NO: 644090 - RNA, 65 nt, Homo Sapiens
ugggauuauaggcgugcacccuccugccucagccuccugaguagcccuccuggguucaagcaauu

SEQ ID NO: 644091 - RNA, 65 nt, Homo Sapiens
ugggauuacaggcacccacccuccugugucagucuccugaguagcccucccagguucaagcgauu

SEQ ID NO: 644092 - RNA, 65 nt, Homo Sapiens
uaaauuuucuuuucaaacagggcuaaugcuuagugccugaguauuucauccuagaguuucaggua

SEQ ID NO: 644093 - RNA, 65 nt, Homo Sapiens
uugcaaaugcacagagaaaacuuuuuuauguugguccugaguauuuuuuuccacaggagguauuu

SEQ ID NO: 644094 - RNA, 65 nt, Homo Sapiens
uucuacaggcccggcccagcgcaaaaccugcaguuccugaguacccaguuucauggaggggaaac

SEQ ID NO: 644095 - RNA, 65 nt, Homo Sapiens
aggcuuggaaguuggaauuagaaugggggagacagccugaguaaaugagauuauucggaggaagg

SEQ ID NO: 644096 - RNA, 65 nt, Homo Sapiens
ugggauuacgggugcgugcccuccugccucagucuccugaguagcccucccggguucaagccauu

SEQ ID NO: 644097 - RNA, 65 nt, Homo Sapiens
ugggauuacaggcuccugcccucaugccucagccuccugaguagcccucccggguucaagugauu

SEQ ID NO: 644098 - RNA, 65 nt, Homo Sapiens
aggauacuuuuaucaaaauccuuugagaaauagucccugaguauucuggcucuugggauucuggu

SEQ ID NO: 644099 - RNA, 65 nt, Homo Sapiens
ugggauuacaggugcgugcccuccugcuucaaccuccugaguagcccucccagguucaagcgauu

SEQ ID NO: 644100 - RNA, 65 nt, Homo Sapiens
ugggaucauaggcacgcgcccuccugccucagccuccugaguagcccuccuggguucaagcgauu

SEQ ID NO: 644101 - RNA, 65 nt, Homo Sapiens
cccgucggaggggauggacaaaaaugggugcugggccugaguacucacugggaagcucaucagag

SEQ ID NO: 644102 - RNA, 65 nt, Homo Sapiens
guaccagauaacuuuuuuuuuucuuuauaagaaagccugaguacuccacacugcacaauaacucc

SEQ ID NO: 644103 - RNA, 65 nt, Homo Sapiens
auuucugggcuugagcaguccucccgucucagccuccugaguagcugagacuacaggugcacacc

SEQ ID NO: 644104 - RNA, 65 nt, Homo Sapiens
uaacucaucacccuuuuucacuaugacccuuagacccugaguauuuucaaauauaugauugcuga

SEQ ID NO: 644105 - RNA, 65 nt, Homo Sapiens
ccuccugggcucaagcaguccucccaccucagucuccugaguagcugagacuacagcugugcgcc

SEQ ID NO: 644106 - RNA, 65 nt, Homo Sapiens
cuucuuagguucaagcgauucuccugccucagccuccugaguagcugggauuacaggcacgcacc

SEQ ID NO: 644107 - RNA, 65 nt, Homo Sapiens
uucaggaagacugacuuaaauuuguuacuugcuacccugaguacucuuuauauaaucguuugcau

SEQ ID NO: 644108 - RNA, 65 nt, Homo Sapiens
ugggauuacacgcacaugcccuccugccucagccaccugaguagcccucccagguucaagcgauu

SEQ ID NO: 644109 - RNA, 65 nt, Homo Sapiens
uggauuacaggcaugugccacuccugccucagccuccugaguagcccucuuggguucaagugauu

SEQ ID NO: 644110 - RNA, 65 nt, Homo Sapiens
guccauuucuucccaggaaugaggucaaggcuuccccugaguaagcacaggcucagacuaaauca

SEQ ID NO: 644111 - RNA, 65 nt, Homo Sapiens
ugcaacuacagacacaugccccucagccuccucuuccugaguagcuccugggcucaauacucuug

SEQ ID NO: 644112 - RNA, 65 nt, Homo Sapiens
ugggauuacaggcaacugcccuccugccucagccuccugaguagcccucccagguucaagcgauu

SEQ ID NO: 644113 - RNA, 65 nt, Homo Sapiens
ugggaccacaggcgacugcccuccugccucagccuccugaguagcccucccagguucaagcgauu

SEQ ID NO: 644114 - RNA, 65 nt, Homo Sapiens
cccagaagaaacaacgacacaaucuuagaaucacuccugaguaucucgaguuguggcauuuguua

SEQ ID NO: 644115 - RNA, 65 nt, Homo Sapiens
acugcaaccucugccuccuggguucacguaauccuccugaguagcugggauuacaggcgccugcc

SEQ ID NO: 644116 - RNA, 65 nt, Homo Sapiens
ccucucagguucaagugauucuccugccucagccuccugaguagaugggacuguaggcaccugcc

SEQ ID NO: 644117 - RNA, 65 nt, Homo Sapiens
ccucccggguucaagugauucucuugccucagccuccugaguagugugugccaccacgcccagcu

SEQ ID NO: 644118 - RNA, 65 nt, Homo Sapiens
acugguggugucaucaccugcuggccccacuacagccugaguaggccugaguggccguggccagg

SEQ ID NO: 644119 - RNA, 65 nt, Homo Sapiens
ccucccggauucaagcgauucuccugccucagccuccugaguagcuggaacuacaugcgcgugcc

SEQ ID NO: 644120 - RNA, 65 nt, Homo Sapiens
ugagccaugcucagaaugucugguccuggcuugggccugaguagggcagagagggccuuuccugg

SEQ ID NO: 644121 - RNA, 65 nt, Homo Sapiens
agcuucaguuugggcuguggacgcugccacacaagccugaguagagcccaugcaaaggaagggau

SEQ ID NO: 644122 - RNA, 65 nt, Homo Sapiens
aagaaaugcaagcuuguucagggggcugagaagauccugaguacacuaggugcaaaccagaacuc

SEQ ID NO: 644123 - RNA, 65 nt, Homo Sapiens
cuuuggcagacuccuccauguuuuguucccuucccccugaguaugcaugugccuguucagagucu

SEQ ID NO: 644124 - RNA, 65 nt, Homo Sapiens
ccuccugggcucaggugauccucccaccucagccuccugaguagcuaggacuacagaugcucgcc

SEQ ID NO: 644125 - RNA, 65 nt, Homo Sapiens
cuccugggguucaagugauucuccugugucagccuccugaguagcugggauuacaggcgugugcc

SEQ ID NO: 644126 - RNA, 65 nt, Homo Sapiens
cuucccggguucaagcgauucuccugccucagccuccugaguagcugggauuacaggugugugcc

SEQ ID NO: 644127 - RNA, 65 nt, Homo Sapiens
aucugaagcuucuuuggccuagauuuuagcacaaaccugaguauaucucuucuacuuucaucaug

SEQ ID NO: 644128 - RNA, 65 nt, Homo Sapiens
caaauguuaaaauauuguuuaauauuuuugaaaucccugaguaucaggccuuguuauaaauaagc

SEQ ID NO: 644129 - RNA, 65 nt, Homo Sapiens
cuugccuccagggacuggccaggucuccccccuuuccugaguaccaacuaucauauccccaaaga

SEQ ID NO: 644130 - RNA, 65 nt, Homo Sapiens
acuagcauaucugccuuuauuguguuugucauuagccugaguagaaaggccuuuaaaauuuuuuu

SEQ ID NO: 644131 - RNA, 65 nt, Homo Sapiens
cuuccuggguucaagcaauucucaugccucagccuccugaguagcugagaccacaggcacccgcc

SEQ ID NO: 644132 - RNA, 65 nt, Homo Sapiens
ugauacuacaggcacccacccuccugccucagccuccugaguagcccucccagguucaugccauu

SEQ ID NO: 644133 - RNA, 65 nt, Homo Sapiens
gcuuaguuuuauucuggaaauucaucaccauuuuuccugaguaggugcaugucugugagcugccu

SEQ ID NO: 644134 - RNA, 65 nt, Homo Sapiens
gagacugguuccccccagacccugccuugagaaguccugaguacaacuugguuugggagaugaug

SEQ ID NO: 644135 - RNA, 65 nt, Homo Sapiens
uaauuggcaccugccuucuuuuucucucuucuuuaccugaguaaaaaaaaaaaccuuuggugccu

SEQ ID NO: 644136 - RNA, 65 nt, Homo Sapiens
uagguacaggcaccugccaccuccugccucagccuccugaguagcccuccuggguucaaaugauu

SEQ ID NO: 644137 - RNA, 65 nt, Homo Sapiens
ugaauuugauuucuaaaaacucugccccaguucuuccugaguauauuuuugcuugcuuaaucuuc

SEQ ID NO: 644138 - RNA, 65 nt, Homo Sapiens
ugggacuacaggugccugcccuccugccucagccuccugaguagcccucccggguucacgccauc

SEQ ID NO: 644139 - RNA, 65 nt, Homo Sapiens
ugggauuauaggcaugcacccuccugccucagccuccugaguagccuucccgaguucaagcaauu

SEQ ID NO: 644140 - RNA, 65 nt, Homo Sapiens
ugggacuacaggcgcccgcccuccugccucagccuccugaguagcccucccggguucacgccauu

SEQ ID NO: 644141 - RNA, 65 nt, Homo Sapiens
ugggaugacaggcgugcacccucgcaucucagccuccugaguagcacccccagccucaacugauc

SEQ ID NO: 644142 - RNA, 65 nt, Homo Sapiens
ccucccagguucaagcgauucucgugccucagccuccugaguagcugggacuacaggcgcccacc

SEQ ID NO: 644143 - RNA, 65 nt, Homo Sapiens
ccuccuggguucaagcaauucuccugccucagccuccugaguagcugggauuacaggcaugaacc

SEQ ID NO: 644144 - RNA, 65 nt, Homo Sapiens
cagucaccauagcagcugacugaaaaucagcacugccugaguaguuuugaucaguuuaacuugaa

SEQ ID NO: 644145 - RNA, 65 nt, Homo Sapiens
aagcaccugaccacaaaaccucuuguaaaaacagcccugaguagguauuuccagggcuccacaaa

SEQ ID NO: 644146 - RNA, 65 nt, Homo Sapiens
ccuaccggguucaagugauucuugugccucagccuccugaguagcugggauuauaggcaugcacc

SEQ ID NO: 644147 - RNA, 65 nt, Homo Sapiens
ccuaccgaguucaagcgauucuugugcuucagccuccugaguagcugggacuauaggccuguacc

SEQ ID NO: 644148 - RNA, 65 nt, Homo Sapiens
ccucccagguucaagugauucuccugccucagccuccugaguagcugggacuacaggcgccugcc

SEQ ID NO: 644149 - RNA, 65 nt, Homo Sapiens
gugggugcaaguagggccucggccgugcugccucuccugaguaggacuaauguguuggugggccu

SEQ ID NO: 644150 - RNA, 65 nt, Homo Sapiens
guaguccuauuaauuccagauaaguuuggcaaaauccugaguaguagaggaaauauauauauuuu

SEQ ID NO: 644151 - RNA, 65 nt, Homo Sapiens
ugggacuacaggugugugcccuuccaccucagccuccugaguagccuuccugggcugaacugauc

SEQ ID NO: 644152 - RNA, 65 nt, Homo Sapiens
ugggauuacaggcaugcacccuccugccucagccuccugaguagcaguccgccucccaggcgauu

SEQ ID NO: 644153 - RNA, 65 nt, Homo Sapiens; identical to SEQ ID NO: 644140

SEQ ID NO: 644154 - RNA, 65 nt, Homo Sapiens
caaucaagcuucagugugcaugcuggucauuguagccugaguauaagauauggggguuacaucag

SEQ ID NO: 644155 - RNA, 65 nt, Homo Sapiens
auucuuuguuguuuagcacugugacuuaugaaucaccugaguacaucucaucaaugauauguaag

SEQ ID NO: 644156 - RNA, 65 nt, Homo Sapiens
cuugaacaaaaaugacagauacaaacuauuucuauccugaguaguaaucucacacuucauccuau

SEQ ID NO: 644157 - RNA, 65 nt, Homo Sapiens
ucccacagguucaggcgauucccgugccucagccuccugaguagcugggacuacaggcacgcacc

SEQ ID NO: 644158 - RNA, 65 nt, Homo Sapiens
ccucccggguucaagcgauucuccugccucagccuccugaguagcuggaauuacaggcacccacc

SEQ ID NO: 644159 - RNA, 65 nt, Homo Sapiens
ccucccggguucaagcgauucuccagccucagcuuccugaguagaugggauuacaggcgccugcc

SEQ ID NO: 644160 - RNA, 65 nt, Homo Sapiens
ccucccggguuuaagcaguucuccugccucagccuccugaguagcugggauuacaggugugcccc

SEQ ID NO: 644161 - RNA, 65 nt, Homo Sapiens
gcacaguggcuuauaaggaaccagcaguguuuuucccugaguaauuaugaacuuagucaagauca

SEQ ID NO: 644162 - RNA, 65 nt, Homo Sapiens
aucucccagguucaagcgaucaugugccuaagccuccugaguagcugggaucacagguguguacc

SEQ ID NO: 644163 - RNA, 65 nt, Homo Sapiens
ccucccagguucaggugauucuccugccucagccuccugaguagcugggauuacaagcacguguc

SEQ ID NO: 644164 - RNA, 65 nt, Homo Sapiens
ccuccuggguucaagcaauucuccugccucagccuccugaguagcugggauuauaggcacaugcc

SEQ ID NO: 644165 - RNA, 65 nt, Homo Sapiens
uaugacuuucauuucccagaaaaaagauuaaugguccugaguaggaauauuacauaauuuugauu

SEQ ID NO: 644166 - RNA, 65 nt, Homo Sapiens
acuccugggcucaaguuauccuuccauuuuggccuccugaguagcuagaccauagguaugcauca

SEQ ID NO: 644167 - RNA, 65 nt, Homo Sapiens
ucaaaaagaaguauugcaugucuaaaagcuagugcccugaguacucaugaauucgauuccaagag

SEQ ID NO: 644168 - RNA, 65 nt, Homo Sapiens
aguggcuuaucccgcaugagcaggagcgugcuggcccugaguacugaacuuucugaguaacaaug

SEQ ID NO: 644169 - RNA, 65 nt, Homo Sapiens
uggauauacaaccucagcaauuguggaauuugcuuccugaguaaggggggucaguucuugcaacc

SEQ ID NO: 644170 - RNA, 65 nt, Homo Sapiens
uggaacuacaggcgugugcccucccgccucagcuuccugaguagcccucccggguucaagugauu

SEQ ID NO: 644171 - RNA, 65 nt, Homo Sapiens
uuaaaacaauucuauuucauagccuugaauugaaaccugaguaggggaugaaacaguuucaagua

SEQ ID NO: 644172 - RNA, 65 nt, Homo Sapiens
ccaccccagcuaaaggcaaaaauaccuuugaggucccugaguaauucaagaaauaaaucaucacc

SEQ ID NO: 644173 - RNA, 65 nt, Homo Sapiens
uagcugagggugggugagaggugguugccuucagaccugaguacuguggagccuccauaaucagu

SEQ ID NO: 644174 - RNA, 65 nt, Homo Sapiens
ugcauuucugucugucucaaaugcuuaacuguaguccugaguaggaacucuuugguuaauaguaa

SEQ ID NO: 644175 - RNA, 65 nt, Homo Sapiens
aguggucaccucccauaguauuucucauaaguacuccugaguacacauuuuuuguucuuauucuu

SEQ ID NO: 644176 - RNA, 65 nt, Homo Sapiens
uggugcgcacgaccauaccccucccgcuucagccuccugaguagccgaccugggcucaagcaauc

SEQ ID NO: 644177 - RNA, 65 nt, Homo Sapiens
auucuacucaaauguaccuuaauuuuuuuuuuuucccugaguaaaagcaagaaauuucuuccuuu

SEQ ID NO: 644178 - RNA, 65 nt, Homo Sapiens
gucuagaaaaucucaguucccaccaguaaaauuauccugaguagcuaaugcaccuugagaaaaau

SEQ ID NO: 644179 - RNA, 65 nt, Homo Sapiens
gaggaggccagugcccacuugcccaccgaccugagccugaguaaguggcugucaccugagccugu

SEQ ID NO: 644180 - RNA, 65 nt, Homo Sapiens
ccucccggguucacgccauucuccugccucagccuccugaguagcuggggcuacaggcgucugcc

SEQ ID NO: 644181 - RNA, 65 nt, Homo Sapiens
auuccugggcucaggcaauccuccugccucagccuccugaguagcugggacuacaguuucgugug

SEQ ID NO: 644182 - RNA, 65 nt, Homo Sapiens
ccuccuggguucaagcgauucuccagccucagccuccugaguagcuggaauuacagguacgcacc

SEQ ID NO: 644183 - RNA, 65 nt, Homo Sapiens
ucuuccucacacugcuguccucucccccuucagcuccugaguagcugggccugugcacugggcag

SEQ ID NO: 644184 - RNA, 65 nt, Homo Sapiens
aaacugguagaauauuuauucauaugacaaggauaccugaguaaaacuauccuuuuuaaaaucac

SEQ ID NO: 644185 - RNA, 65 nt, Homo Sapiens
ggugggguggggugguucaaauggaugacugaucuccugaguacacugaagccacaggcuggugg

SEQ ID NO: 644186 - RNA, 65 nt, Homo Sapiens
ccucccagguucaagcgauuguccugccucagucuccugaguagcugggacuacaggugugcacc

SEQ ID NO: 644187 - RNA, 65 nt, Homo Sapiens
cagacaggaaaacaauauuguauaacagaccacuuccugaguagaagaguuucuuugugaaaagg

SEQ ID NO: 644188 - RNA, 65 nt, Homo Sapiens
ccucauagguucaagucauucuccugccucagccuccugaguagcugggacuacaggugagugcc

SEQ ID NO: 644189 - RNA, 65 nt, Homo Sapiens
agaaugcugaugccauaacuuuacuucugaccgugccugaguaaguagccgugaugaaagcagcg

SEQ ID NO: 644190 - RNA, 65 nt, Homo Sapiens
ugggauuacaggugugcgcccuccugccucagccuccugaguagcccucccagguucaggugauu

SEQ ID NO: 644191 - RNA, 65 nt, Homo Sapiens
uaggacuacaggcacacacucucccaccucagucuccugaguagcacuccugggcuuaagugacc

SEQ ID NO: 644192 - RNA, 65 nt, Homo Sapiens
gaguggcucagccccacguucugcccaucuggaggccugaguaagggcccucggugcccacgccu

SEQ ID NO: 644193 - RNA, 65 nt, Homo Sapiens
ugggacuacaggcgcccgcccccagguucaagccuccugaguaacgcucucugcaaccucugccu

SEQ ID NO: 644194 - RNA, 65 nt, Homo Sapiens
caagagcagugagauccacuauguguagauaaagcccugaguagguuuccucugaggggcuauca

SEQ ID NO: 644195 - RNA, 65 nt, Homo Sapiens
aaguaaugcauguguuuggagauguaacauccuucccugaguagaaucacucuauacagucauua

SEQ ID NO: 644196 - RNA, 65 nt, Homo Sapiens
aaucuggugaccuaaggcuccugcucacugccucuccugaguagagcccuccaaacuggccccuc

SEQ ID NO: 644197 - RNA, 65 nt, Homo Sapiens
acauuccccagcuacuuagagaggucauucagcuuccugaguaccaggaauuauggauauauguu

SEQ ID NO: 644198 - RNA, 65 nt, Homo Sapiens
uggaacuacaggugugcgcccuccugccucagucuccugaguagcccucccagguucaagcaauu

SEQ ID NO: 644199 - RNA, 65 nt, Homo Sapiens
uccuccgaguucaagcuauccuuccaccuccgccuccugaguagcugggaccacagguucacaua

SEQ ID NO: 644200 - RNA, 65 nt, Homo Sapiens
ccucccguauucaagcgauucuccugucucagccuccugaguagcugggacuacaggugugcacc

SEQ ID NO: 644201 - RNA, 65 nt, Homo Sapiens
ccuccuggguucaagugauucuagugccucagccuccugaguagcugggauaaugggcgugugcc

SEQ ID NO: 644202 - RNA, 65 nt, Homo Sapiens
auuccugggcccaagcaauucucccaccucagccuccugaguagcugggacuacaagugugcacc

SEQ ID NO: 644203 - RNA, 65 nt, Homo Sapiens
acuccugggcucaagcaauccuccugccucagcuuccugaguagcuggaaccacaggugugugcu

SEQ ID NO: 644204 - RNA, 65 nt, Homo Sapiens
uuaagagugaauagcuuuauggaaucaaguaugucccugaguagcaagauuaggccucaccaaag

SEQ ID NO: 644205 - RNA, 65 nt, Homo Sapiens
accccuuccccauccugcuccgcuucauguccccuccugaguagucaugugauaauaaacucuca

SEQ ID NO: 644206 - RNA, 65 nt, Homo Sapiens
ccggccuugucaaugagugcuguuugaaacaccuuccugaguagugauucgcguagcaggggagu

SEQ ID NO: 644207 - RNA, 65 nt, Homo Sapiens
ugggacugcaguuguaagcccuccugccucagccuccugaguagcccucccgggcucaagacauc

SEQ ID NO: 644208 - RNA, 65 nt, Homo Sapiens
ugggauuacagucgugugccgugauucuccuaccuccugaguaacccuuugccuccuagguucaa

SEQ ID NO: 644209 - RNA, 65 nt, Homo Sapiens
ugggauuacaggcacccgcccuccugccucagccuccugaguagcccuuccaguugcaagugauu

SEQ ID NO: 644210 - RNA, 65 nt, Homo Sapiens
aaagcugugugcucuccaagcccacccccaggaccccugaguaaacucccucuacugggagccua

SEQ ID NO: 644211 - RNA, 65 nt, Homo Sapiens
uaggacuacaggugugcacccuccugucucagccuccugaguagcccucccguauucaagcgauu

SEQ ID NO: 644212 - RNA, 65 nt, Homo Sapiens
aagcagcaguuuugcaaggaacaaccuagagaacaccugaguacuaaguuuguaaauguuccaga

SEQ ID NO: 644213 - RNA, 65 nt, Homo Sapiens
aguuuaauuuucaucaaacauuguaauugcaguauccugaguagcgggcugaucauucccucucc

SEQ ID NO: 644214 - RNA, 65 nt, Homo Sapiens
ccagaccccccaccgugguuuuucacuggauaagaccugaguaacaaagauucagagaacuaauu

SEQ ID NO: 644215 - RNA, 65 nt, Homo Sapiens
aagcugaucgcuugagcccaggaguuuaagaccggccugaguagcauagcaagacccugucucua

SEQ ID NO: 644216 - RNA, 65 nt, Homo Sapiens
ccucccggguucaagcgauucucccgccucagccuccugaguagcugggauuacaggcacccgcc

SEQ ID NO: 644217 - RNA, 65 nt, Homo Sapiens
ccucccagguucaagugauucuccugccucagccuccugaguagcugggauuacaggcacacacc

SEQ ID NO: 644218 - RNA, 65 nt, Homo Sapiens
uuucauguaaagaaaaaaacuugaaaauaguaauaccugaguacccaugggaauaauagacacug

SEQ ID NO: 644219 - RNA, 65 nt, Homo Sapiens
gaauggcaguauucaggcucaacguacaguuugauccugaguaugcuugguguuugccuucagaa

SEQ ID NO: 644220 - RNA, 65 nt, Homo Sapiens
ccucccagguucaagugauucuccugccucauccuccugaguagcugggauuacaggcgugugcc

SEQ ID NO: 644221 - RNA, 65 nt, Homo Sapiens
guucuuuaacucacauucagaggaaguccagaucuccugaguagugauuuuggugacaaguuuuu

SEQ ID NO: 644222 - RNA, 65 nt, Homo Sapiens
gcucccaggcucaagcguuucucccaccuuagccuccugaguagcugggacuaaggcacacacac

SEQ ID NO: 644223 - RNA, 65 nt, Homo Sapiens
uggaauuuuauuuuuucaaguggguuugugucucaccugaguaucaggucucaaagcaggaacag

SEQ ID NO: 644224 - RNA, 65 nt, Homo Sapiens
ugggacuacaggcaccugcccuccugccucagccuccugaguagcccucccggguucacgccauu

SEQ ID NO: 644225 - RNA, 65 nt, Homo Sapiens
guuaaaagaauguaaaauauuaaauauauuuauagccugaguaaaaaaacugauugaaugauaua

SEQ ID NO: 644226 - RNA, 65 nt, Homo Sapiens
ugggacuagaggcacgcacccucccgccccagccuccugaguagcccucccuggcuugagugauc

SEQ ID NO: 644227 - RNA, 65 nt, Homo Sapiens
ccucccagguucaagcaauucuccugccuuagccuccugaguagcugggauuacaggcgugcgcc

SEQ ID NO: 644228 - RNA, 65 nt, Homo Sapiens
ccucccagauucaagcgauucuccugucucagccuccugaguagcugggauuauagguacaugcc

SEQ ID NO: 644229 - RNA, 65 nt, Homo Sapiens
agaugucuacuuguucaguuuuucaaaucuguuuuccugaguauaaauaagaguauuuaaagaaa

SEQ ID NO: 644230 - RNA, 65 nt, Homo Sapiens
uaucuccuuaggcaagacuuugccucucuccuaguccugaguauaaauccugugcauagauuccu

SEQ ID NO: 644231 - RNA, 65 nt, Homo Sapiens
gcuaguuagagacucgccugggaaauugcuccauuccugaguaaacagauauuuucgcccaccua

SEQ ID NO: 644232 - RNA, 65 nt, Homo Sapiens
cucgccucuuuugcacuggaaggcccucccuuuggccugaguacuuuucccguucacgccucagu

SEQ ID NO: 644233 - RNA, 65 nt, Homo Sapiens
caggacuauggcauguaccacuucaaccuuagccuccugaguagcaaccccuugccucaagugag

SEQ ID NO: 644234 - RNA, 65 nt, Homo Sapiens
auugcaugaauuuuuaucucccuuuaaaaaaaaaaccugaguaucaugaucaaauauuggauuua

SEQ ID NO: 644235 - RNA, 65 nt, Homo Sapiens
uaauggacaucuucucaugccucuuugcccucuauccugaguaacaaauacuuuuuguauauaau

SEQ ID NO: 644236 - RNA, 65 nt, Homo Sapiens
ugggauuauaggcgucugcccuccugccucagccuccugaguagcucucccagguucaagcgacu

SEQ ID NO: 644237 - RNA, 65 nt, Homo Sapiens
ugggacuacagaugcgugcccucccgccugagccuccugaguaucaauccugggcucaggugauc

SEQ ID NO: 644238 - RNA, 65 nt, Homo Sapiens
ugggcacgguguuguaccuccuccugccucagccuccugaguagcccuccuggguucaagcaguu

SEQ ID NO: 644239 - RNA, 65 nt, Homo Sapiens
ucacggcauuugggggcucaucucaggcuccacucccugaguaauucuggcgacacuuggagcca

SEQ ID NO: 644240 - RNA, 65 nt, Homo Sapiens
ugggacuacaggcgcccgcccuccugccucagccuccugaguagcccucccgggcucaccccauu

SEQ ID NO: 644241 - RNA, 65 nt, Homo Sapiens
uggcauuauaggugcccacccuccugccucagccuccugaguagcccucccagguucaagcaguu

SEQ ID NO: 644242 - RNA, 65 nt, Homo Sapiens
ugggauuacaggcgcguauccucccgccucagccuccugaguagcccucccggguucaagcgauu

SEQ ID NO: 644243 - RNA, 65 nt, Homo Sapiens
ccuccuggguucaugccauucuccugccucagccuccugaguagcugggacuacaggcgcucgcc

SEQ ID NO: 644244 - RNA, 65 nt, Homo Sapiens
uuguacauaaagugcuagaaaaucauguuccuuguccugaguaagaguuaaucagaguaaaugca

SEQ ID NO: 644245 - RNA, 65 nt, Homo Sapiens
cauuuugggauccuucagcacaggaauucucaagaccugaguauuuuuuauaauaggaaugucca

SEQ ID NO: 644246 - RNA, 65 nt, Homo Sapiens
ggggcacuccuagccagugagucauggucauauuuccugaguaaagucauucugaguuacuuacu

SEQ ID NO: 644247 - RNA, 65 nt, Homo Sapiens
cuguucauuggaaaggguuuuaaacggagucggaaccugaguagauuuccaaauuuuacagccag

SEQ ID NO: 644248 - RNA, 65 nt, Homo Sapiens
ggacuacagaagugcaucauucuagaauguguagaccugaguagcuuauacacuacagagcacuu

SEQ ID NO: 644249 - RNA, 65 nt, Homo Sapiens
ugggauuacgggcgcgugcccugcugccucagccuccugaguagcccuccuggguucaaacgauu

SEQ ID NO: 644250 - RNA, 65 nt, Homo Sapiens
ugaaggaaucugggaauuagccccuuaaaugccagccugaguacccuuucauugcuagugacuag

SEQ ID NO: 644251 - RNA, 65 nt, Homo Sapiens
cggggagcuacaagcaugcacuccugccucagccuccugaguagcccuccuggguucaagagguu

SEQ ID NO: 644252 - RNA, 65 nt, Homo Sapiens
cgaucacccacucuuaccugucuuuagcucugacaccugaguacaaccugccugcccacgcuccu

SEQ ID NO: 644253 - RNA, 65 nt, Homo Sapiens
aaagcuagcuuagcaaaauaugagauuguauuugcccugaguauucaguguaacgugggaaccau

SEQ ID NO: 644254 - RNA, 65 nt, Homo Sapiens
aacguuucuguucaguuuccgagccauucucuccuccugaguagggauccuagagugucagaaca

SEQ ID NO: 644255 - RNA, 65 nt, Homo Sapiens
acaccaagaugcugcugucuaggggguaagcuguuccugaguauagccacuuuuuacccuaugga

SEQ ID NO: 644256 - RNA, 65 nt, Homo Sapiens
aacugguuagcuucucuggacuauuguacaucagcccugaguaguaucucauuuuggcguugcau

SEQ ID NO: 644257 - RNA, 65 nt, Homo Sapiens
uuucuuucaacaagcuccuguuaaaaguauaugaaccugaguacuagucuucuuacauuuacaag

SEQ ID NO: 644258 - RNA, 65 nt, Homo Sapiens
uuucuuuuucuuuguuagguacauguauacaccugccugaguauaaauacucucucuaccuaaua

SEQ ID NO: 644259 - RNA, 65 nt, Homo Sapiens
ucucccagguucaagcgauacuccugccucagucuccugaguagcugggaucacaggugcacacc

SEQ ID NO: 644260 - RNA, 65 nt, Homo Sapiens
aaccucugucucaagcgauucuccugccucagccuccugaguagcugggauuacaggugcaugcc

SEQ ID NO: 644261 - RNA, 65 nt, Homo Sapiens
aggaggacuguuugagcccaggaguuugagaccaaccugaguaagguggcaaaaccccaucucua

SEQ ID NO: 644262 - RNA, 56 nt, Homo Sapiens; identical to SEQ ID NO: 643903

SEQ ID NO: 644263 - RNA, 65 nt, Homo Sapiens
ggguucaggugauugucaguaccuuaccucagccuccugaguagcuggaacugcagaugugcgcc

SEQ ID NO: 644264 - RNA, 65 nt, Homo Sapiens
uuuaucauauaacaaauauuuucccacuauuacagccugaguaauacccguauuaaaagagccuc

SEQ ID NO: 644265 - RNA, 65 nt, Homo Sapiens
ugggacuauaggugcaugcccuccugccucagccuccugaguagcccuucuggguucaagcaauu

SEQ ID NO: 644266 - RNA, 65 nt, Homo Sapiens
ugggacuacaggcaugcaccccccugccuuagccuccugaguagcccuccuggguucaagugauu

SEQ ID NO: 644267 - RNA, 65 nt, Homo Sapiens
ugggacuacaggugugcgcccuccugccucagccuccugaguagcccucccagguucaagcuauu

SEQ ID NO: 644268 - RNA, 65 nt, Homo Sapiens
uugaggcugcccugcccacgugggauucacaggggccugaguagggcccggggaagcagagcccu

SEQ ID NO: 644269 - RNA, 65 nt, Homo Sapiens
aauggaggaguguucauuguauaauaaguuauucaccugaguaugcaauaaagaugugguggcca

SEQ ID NO: 644270 - RNA, 65 nt, Homo Sapiens
acuuuguugacucaaaacuugcuaguuacugccuaccugaguagaaucuuauuuaugaacuccug

SEQ ID NO: 644271 - RNA, 65 nt, Homo Sapiens
ugaagggaacagccugagccgaacauguuauuuaaccugaguauaguauuuaacgaagccuagaa

SEQ ID NO: 644272 - RNA, 65 nt, Homo Sapiens
ucccuuugugccuggugauauauuuuuuuuuccucccugaguauaaaugcaaugcgacugcaaaa

SEQ ID NO: 644273 - RNA, 65 nt, Homo Sapiens
cacauccuccaucccagcauagagaauggggacucccugaguaaugggaguucuuucauggccuc

SEQ ID NO: 644274 - RNA, 65 nt, Homo Sapiens
agugggaaaagugguacuaacccacgauucugagcccugaguaugccuggacauugaugcuaaca

SEQ ID NO: 644275 - RNA, 65 nt, Homo Sapiens
ccucccgaguucaagcaauucuccugccucagccuccugaguagcugggauuacaggcguccgcu

SEQ ID NO: 644276 - RNA, 65 nt, Homo Sapiens
ggaugcccucagugaccuuucucgugcgcacaaguccugaguaugcugcccagaagaaguuaaag

SEQ ID NO: 644277 - RNA, 65 nt, Homo Sapiens
gauuuauaguaaaacaagugcucccaccucagcuuccugaguaggcaucccaggcucaagugauc

SEQ ID NO: 644278 - RNA, 65 nt, Homo Sapiens
aaagauacaaaauguuacuguuuaaaaaaucccuuccugaguaauuggggaaguggguggguaga

SEQ ID NO: 644279 - RNA, 65 nt, Homo Sapiens
ugggauuacaggcgugugcccucgugccucggccuccugaguagcucucccagguucaagcgauu

SEQ ID NO: 644280 - RNA, 65 nt, Homo Sapiens
ugggauuacaggcacacacccucccaucucagccuccugaguagcucucccggguucaagcaauu

SEQ ID NO: 644281 - RNA, 65 nt, Homo Sapiens
ugggauuauaggcacgcacccuccugccuccgccuccugaguagcccuccuggguucaagcgauu

SEQ ID NO: 644282 - RNA, 65 nt, Homo Sapiens
ucuguggugagagaagcuucuguauuuccacuugcccugaguaaauaggguaagcauucuuaaca

SEQ ID NO: 644283 - RNA, 65 nt, Homo Sapiens
ugggacuacaugcgcacacccucuugccucagccuccugaguagcccuccuggguucaagcgauu

SEQ ID NO: 644284 - RNA, 65 nt, Homo Sapiens
agcagcacugguuuugaguuauagaagaaaaucaaccugaguaaaaaucugcugaagaaagaaga

SEQ ID NO: 644285 - RNA, 65 nt, Homo Sapiens
ugggacuacaggcaugcacccuccugccucagccuccugaguagcccuccuagguucaagcaauu

SEQ ID NO: 644286 - RNA, 65 nt, Homo Sapiens
ccuccuggguucaagugauucuccugccucagccuccugaguagcugggauuacagacacccgcc

SEQ ID NO: 644287 - RNA, 65 nt, Homo Sapiens
ccucccagguucaagugauuauccugccuuagccuccugaguagcugggauuacaggcgcgugcc

SEQ ID NO: 644288 - RNA, 65 nt, Homo Sapiens
uggaacaugagacaguaucucccgacuggcuguguccugaguaacuugcugcuccugccgucucc

SEQ ID NO: 644289 - RNA, 65 nt, Homo Sapiens
ugggauuacaguugccgccacuccugccucggccuccugaguagcccucccagguucaagccauu

SEQ ID NO: 644290 - RNA, 65 nt, Homo Sapiens
cccuuggcuguaugucugacaggacugaaaauacuccugaguacuuccugauaauaaauguauuu

SEQ ID NO: 644291 - RNA, 65 nt, Homo Sapiens
aaggaaaaacagcaaaacaauugaaagcaagagucccugaguauagacuugaacuucuguuuaag

SEQ ID NO: 644292 - RNA, 65 nt, Homo Sapiens
uaaccaaaagaauugaaaucuccugcaaucccaugccugaguauggaugagagagaugacagucu

SEQ ID NO: 644293 - RNA, 65 nt, Homo Sapiens
uauuccuagaguccagaggggaggugagguuaaaaccugaguaauggaaaagcuuuuagaguaga

SEQ ID NO: 644294 - RNA, 65 nt, Homo Sapiens
ccuccuggguucaagcgcuucuccagccucagccuccugaguagcugggauuacagguaugugcc

SEQ ID NO: 644295 - RNA, 65 nt, Homo Sapiens
augucaauucucuuguuacauucucccuuuagcaaccugaguaagagacucucugccacugggcu

SEQ ID NO: 644296 - RNA, 65 nt, Homo Sapiens
gaagagaccuucaggugcuuaaaagauaaucuugaccugaguagaacuuauuccagacuaaacau

SEQ ID NO: 644297 - RNA, 65 nt, Homo Sapiens
aauaauaaaguuuaaaaaugggaaauuccuaauguccugaguauuaaugcuacugaaaaaaaucu

SEQ ID NO: 644298 - RNA, 65 nt, Homo Sapiens
cauguaacauucuaaaauugggaagguuagucaggccugaguauuguuuuguuguuuuuuggagg

SEQ ID NO: 644299 - RNA, 65 nt, Homo Sapiens
ugggauuauaggcacacacccuccugccucagccuccugaguagcccucuuggguuaaaagaauu

SEQ ID NO: 644300 - RNA, 65 nt, Homo Sapiens
cucccuuuauuuuugaccaguaagacugacuccauccugaguaauccguuagaaacaaguuuguu

SEQ ID NO: 644301 - RNA, 65 nt, Homo Sapiens
ugggaauauaggugcacacccuccugccucagccuccugaguagcccuccuggguucaagcaauu

SEQ ID NO: 644302 - RNA, 65 nt, Homo Sapiens
ugggaguacaggcauguggccuccugccucagccaccugaguagcccucccagguucaagcgauu

SEQ ID NO: 644303 - RNA, 65 nt, Homo Sapiens
ugggacuacaggugugcacccuccccgcucagccuccugaguagcacuccugggcucaagcgauc

SEQ ID NO: 644304 - RNA, 65 nt, Homo Sapiens
gccucccugguucaagcaauucuccugccuugccuccugaguagcugggauuacaggcguguguc

SEQ ID NO: 644305 - RNA, 65 nt, Homo Sapiens
agccaagcucugcagacuuuugcaggauugucuagccugaguaccgggcuacuucuuaaaugccg

SEQ ID NO: 644306 - RNA, 65 nt, Homo Sapiens
gaauauauauaucuauaccugcauauauauauugaccugaguauuuauaacugugugguguucau

SEQ ID NO: 644307 - RNA, 65 nt, Homo Sapiens
aaugggguuaucagauauguuuuuaaaucucucgcccugaguacucuucuugggaguugcugcug

SEQ ID NO: 644308 - RNA, 65 nt, Homo Sapiens
gauucuauggaggaccucggucuucauccaaguggccugaguauuucacuggcagguugugaauu

SEQ ID NO: 644309 - RNA, 65 nt, Homo Sapiens
ugggauuacaggugccugcccuccugccucagccuccugaguagccaucccagauuccagcgauu

SEQ ID NO: 644310 - RNA, 65 nt, Homo Sapiens
uuggccacuaauaauuaaccagaaaaaauuagucaccugaguaacauuuuggugaauguguacca

SEQ ID NO: 644311 - RNA, 65 nt, Homo Sapiens
aaaaugagacccuaucucaaaccauugcacugcagccugaguaaccugcagugagccauguccac

SEQ ID NO: 644312 - RNA, 65 nt, Homo Sapiens
ugggauuacaggcacaugcccuccugccucagccuccugaguagcccuccuggauucaaacaauu

SEQ ID NO: 644313 - RNA, 65 nt, Homo Sapiens
ugggacuacaggcaccugcccuccugccucagccuccugaguagccuuccuggguucaaacaauu

SEQ ID NO: 644314 - RNA, 65 nt, Homo Sapiens
uuuacaaagcugcaaguggaaagguucaugugaaaccugaguacacaguggcuuccaaguuuucu

SEQ ID NO: 644315 - RNA, 65 nt, Homo Sapiens
ugggauuacaggugugugcccuacugccucagccuccugaguagcccucucggguucaagcuguu

SEQ ID NO: 644316 - RNA, 65 nt, Homo Sapiens
ggcuuuucagucccugggcagucaccccaggggcuccugaguauaauuuucuuucuuugcuuccu

SEQ ID NO: 644317 - RNA, 65 nt, Homo Sapiens
ugggauuacaggcacacgcccuccugccucagccuccugaguagcccucccagguucaagcaauu

SEQ ID NO: 644318 - RNA, 65 nt, Homo Sapiens
cagcgauucuccugccucccugccucagccugggaccugaguagcugggaccacaggcaugcgcc

SEQ ID NO: 644319 - RNA, 65 nt, Homo Sapiens
ccucccggguucaagugaucguccugccuuaggcuccugaguagcuggggauuacaggugccuac

SEQ ID NO: 644320 - RNA, 65 nt, Homo Sapiens
ccuuccaauguggggagaaaggaagcuuuccgaggccugaguauugcaauacaugcaguaguaca

SEQ ID NO: 644321 - RNA, 65 nt, Homo Sapiens
uuguauuuaaauaaaaacaacagcagcaggcugucccugaguaguuuugcugccauagguuaagu

SEQ ID NO: 644322 - RNA, 65 nt, Homo Sapiens
uccucuggguucaagcaauucuccugccucaggcuccugaguagcugggauuacaggcacgugac

SEQ ID NO: 644323 - RNA, 65 nt, Homo Sapiens
ccucccagguucgagcacuuuucaugccucagccuccugaguagcugggauuacaggcgugcacc

SEQ ID NO: 644324 - RNA, 65 nt, Homo Sapiens
ccucccggguucaaguaauucugcugucucagccuccugaguagcugggacuacaggcacacgcc

SEQ ID NO: 644325 - RNA, 65 nt, Homo Sapiens
ccuccuggguucaagugauucucuugccucagccuccugaguagcugggauuacagguuccugcu

SEQ ID NO: 644326 - RNA, 65 nt, Homo Sapiens
cucugaagaccuuuaauggcuucccucuuucaucuccugaguauguaacuugcaaugggcagcua

SEQ ID NO: 644327 - RNA, 65 nt, Homo Sapiens
ccucccggguucaagcaauucuccugccucagccuccugaguagcugggaugacaggugcacgcc

SEQ ID NO: 644328 - RNA, 65 nt, Homo Sapiens
ugggguuacaggugugugcccuccugccucauccuccugaguagcaucccugggcucaaguguuc

SEQ ID NO: 644329 - RNA, 65 nt, Homo Sapiens
cuccaaacuguggauacagucacucuuggaucuacccugaguaucaaagccuucaaaacacgagg

SEQ ID NO: 644330 - RNA, 65 nt, Homo Sapiens
caaguauagugcagauucuaugucaucuuauuuucccugaguauccguucuaaaacuacaauaua

SEQ ID NO: 644331 - RNA, 65 nt, Homo Sapiens
gguugugcucauuaccccagcacagagcacccuguccugaguagggacagaaggccaccauccuc

SEQ ID NO: 644332 - RNA, 65 nt, Homo Sapiens
aguacaugccuagaccugggcgcaaagacaucaaaccugaguaucguaucaauggauuuaucccc

SEQ ID NO: 644333 - RNA, 65 nt, Homo Sapiens
ugggacuacaggcgcccgccuuccugcuucagccuccugaguagcccuccuggguucaugccauu

SEQ ID NO: 644334 - RNA, 65 nt, Homo Sapiens
ugggggugggggcaggcaggaggcauggaugggaaccugaguagguaguguggccaagagaucag

SEQ ID NO: 644335 - RNA, 65 nt, Homo Sapiens
cugaaaaguaagguugggaccuggguacguggaucccugaguagaucccagcaucugggccaugg

SEQ ID NO: 644336 - RNA, 65 nt, Homo Sapiens
ccuccugggcucaagugauccucccaccucagccuccugaguagcugagaccacaggcgugugcc

SEQ ID NO: 644337 - RNA, 65 nt, Homo Sapiens
uaaaguaauuucccccacaguaaaauacacugacuccugaguaaauugauuuuccaguuuuaugg

SEQ ID NO: 644338 - RNA, 65 nt, Homo Sapiens
acucccaggcucaagcgauccucccgccuuaacugccugaguagcugggacuacaggcaugcacc

SEQ ID NO: 644339 - RNA, 65 nt, Homo Sapiens
ccucccggguucaagcaauucuccugccucagccuccugaguagcuggcacuguaggcauguacc

SEQ ID NO: 644340 - RNA, 65 nt, Homo Sapiens
aaagcaauaauccuauuguacgcuagagcaugcugccugaguauuacuaguggacguaggauauu

SEQ ID NO: 644341 - RNA, 65 nt, Homo Sapiens
uuuuugaggugagaggcccaggugguccuggcaacccugaguagaaggagagacgggguagggaa

SEQ ID NO: 644342 - RNA, 65 nt, Homo Sapiens
ugggauuacagaugcccgcccucucaccucagccuccugaguaggccucccgggcucaagcgauu

SEQ ID NO: 644343 - RNA, 65 nt, Homo Sapiens
agaauguuguacccaucuccgaaaggcaggaggaaccugaguaugcccagaagcaggcugaagag

SEQ ID NO: 644344 - RNA, 65 nt, Homo Sapiens
ugggacuacaggcucaugcccucccaccucagccuccugaguagccguccugggcucaaaugauc

SEQ ID NO: 644345 - RNA, 65 nt, Homo Sapiens
ugggacuacaggugcucaccauucuccugccuccuccugaguagcccaucucccagguucaagcg

SEQ ID NO: 644346 - RNA, 65 nt, Homo Sapiens
ugggauuacaggcgucggcccuccugccucaggcuccugaguagcccucccacguucaagcgauc

SEQ ID NO: 644347 - RNA, 65 nt, Homo Sapiens
ugaaaagaaaaugcugaaaugagugauuuuccucaccugaguacauaaagucauuggauauaaaa

SEQ ID NO: 644348 - RNA, 65 nt, Homo Sapiens
ugggacuacaggcuugcgcccucccaccccagccuccugaguagcccucccaggcucaagugauc

SEQ ID NO: 644349 - RNA, 65 nt, Homo Sapiens
ugagauuacaggcacaagcucuccugccuuagccuccugaguaacacuccugaccucacacaauc

SEQ ID NO: 644350 - RNA, 65 nt, Homo Sapiens
ugggacuacaggcacaggcccucccaucucagccuccugaguagcacucccaggcucaagcgauc

SEQ ID NO: 644351 - RNA, 54 nt, Homo Sapiens; identical to SEQ ID NO: 643992

SEQ ID NO: 644352 - RNA, 65 nt, Homo Sapiens
ucacaguccauauccugaugcagucucuuguccucccugaguaucugugagcuaucagcaucugc

SEQ ID NO: 644353 - RNA, 65 nt, Homo Sapiens
ugggauuacagguguaugcccuccuaccucagccuccugaguagcggucaugggcucaugggauu

SEQ ID NO: 644354 - RNA, 65 nt, Homo Sapiens
ugggacuacagguguguaccaaauccuccucucagccugaguaaccuugaccucccaggcgcaca

SEQ ID NO: 644355 - RNA, 65 nt, Homo Sapiens
ccuccuggguucaagugauucucauggcucagccgccugaguagcugggauuacaggugugagcc

SEQ ID NO: 644356 - RNA, 65 nt, Homo Sapiens
ugggaugacaggcacccgcccuccugccucagccuccugaguagcccucccagguucaagcaguu

SEQ ID NO: 644357 - RNA, 65 nt, Homo Sapiens
ugggacuacaggcgcccacccuccugccucagccuccugaguagcccucccggguucacgccauu

SEQ ID NO: 644358 - RNA, 65 nt, Homo Sapiens
ugggauuacaggcacccacccuccugccucagccuccugaguagcccucccggguucaagugauu

SEQ ID NO: 644359 - RNA, 65 nt, Homo Sapiens
ccuuccgggcucaagcgauucuccagccucagccuccugaguagcuaggacugcaggugcuccac

SEQ ID NO: 644360 - RNA, 65 nt, Homo Sapiens
ccuuuugggcucaagugauccucccaccucagccuccugaguagcugggaccauaggcucacaac

SEQ ID NO: 644361 - RNA, 65 nt, Homo Sapiens
ggaaggcguccuuuuuccuuguagcuaacguuaggccugaguagcuccccuccauccuuguagac

SEQ ID NO: 644362 - RNA, 65 nt, Homo Sapiens
ccuccaggguucaagcaauucuccugccucagucuccugaguagcugggacuacaggcaugcgcc

SEQ ID NO: 644363 - RNA, 65 nt, Homo Sapiens
ccuccaggguucaagcaacucuccugcuucagccuccugaguagcugggacuacaggcaugcacc

SEQ ID NO: 644364 - RNA, 65 nt, Homo Sapiens
cuugccaggcucaagcaguucuccugccucagccuccugaguagcugggacuacaggcacccgcc

SEQ ID NO: 644365 - RNA, 65 nt, Homo Sapiens
ucuccggggcucaagcgcuucuccugccucagccuccugaguagcugggauuacaggcaugugcc

SEQ ID NO: 644366 - RNA, 65 nt, Homo Sapiens
cuccugggguucaagugauccucccaccucagccuccugaguagcugggauuacaggcacccgcc

SEQ ID NO: 644367 - RNA, 65 nt, Homo Sapiens
caagugaucuccaagugacccuccugccucagccuccugaguacccuccuggggacuacaggugc

SEQ ID NO: 644368 - RNA, 65 nt, Homo Sapiens
cuucucaacgccaagucauccucccaccucagccuccugaguagcuaugacuacagguaugugcc

SEQ ID NO: 644369 - RNA, 65 nt, Homo Sapiens
ccucccggguucacgccauucuccugccucagccuccugaguagcugggacuacaggccccugcc

SEQ ID NO: 644370 - RNA, 65 nt, Homo Sapiens
ccuccuggguugaagugauucucgugccucagccuccugaguagcugggacugcaggcacgcgcc

SEQ ID NO: 644371 - RNA, 65 nt, Homo Sapiens
ccuccuggguucaagcgauucuccugccucagccuccugaguagcugggauuacaggugugcgcc

SEQ ID NO: 644372 - RNA, 65 nt, Homo Sapiens
ccuccugggaucaagugauucuccugccacagccuccugaguaccugagauuacaggcacccacc

SEQ ID NO: 644373 - RNA, 65 nt, Homo Sapiens
augagagccaacacaugcucacugccagcuccuguccugaguacugggaaguuucuccugaagcc

SEQ ID NO: 644374 - RNA, 65 nt, Homo Sapiens
cccagcucagguggugaguccucagcaccccaggaccugaguaucuccagaugcagccccaucuc

SEQ ID NO: 644375 - RNA, 65 nt, Homo Sapiens; identical to SEQ ID NO: 644224

SEQ ID NO: 644376 - RNA, 65 nt, Homo Sapiens
ugggacuauaggcgcgugcccuccugccucagccuccugaguagccuucucagguucaagcaauu

SEQ ID NO: 644377 - RNA, 65 nt, Homo Sapiens
ugggauuacagcacccgccacuccugccucagccuccugaguagcccuccuggguucaagugauu

SEQ ID NO: 644378 - RNA, 65 nt, Homo Sapiens
accuucaggcuagucccuaucccagaaagagauucccugaguagccaaauacagaccccauguca

SEQ ID NO: 644379 - RNA, 65 nt, Homo Sapiens
ugggacuacaggcaugcgcacuccugccucagccuccugaguagccgccacccagguuaaaaauu

SEQ ID NO: 644380 - RNA, 65 nt, Homo Sapiens
ugggacuacaggcgccugcccuccugccucagccuccugaguagcccuccuggguucacaccauu

SEQ ID NO: 644381 - RNA, 65 nt, Homo Sapiens
uaggacuacaggugcaugcccucuugccucagccuccugaguagcucucccgggcucaagcgauu

SEQ ID NO: 644382 - RNA, 65 nt, Homo Sapiens
ugggacuacaggcgcccgccauucugccucagccuccugaguagccugccucccggguucaugcc

SEQ ID NO: 644383 - RNA, 65 nt, Homo Sapiens
ugggacuacaggcacaggcccuccugucucagccuccugaguagaccuccuguguucaagcgauu

SEQ ID NO: 644384 - RNA, 65 nt, Homo Sapiens
gcagugggaacucggaauuuuagcaaauuaucaaaccugaguaggcuugaguuuugugagcccug

SEQ ID NO: 644385 - RNA, 65 nt, Homo Sapiens
ugggacuacaggugcgugcccuccugccucagucuccugaguagcccucccagguucaugcaauu

SEQ ID NO: 644386 - RNA, 65 nt, Homo Sapiens
auccugugauugcagcaaauauuggagaauacacaccugaguaagugaguccagucucauuaaau

SEQ ID NO: 644387 - RNA, 65 nt, Homo Sapiens
ugggcugacaggcacccacccucgugccucagccuccugaguagcccuccuggguucaagugauu

SEQ ID NO: 644388 - RNA, 65 nt, Homo Sapiens
ugggacuacaggcaugagcccucccaccucagccuccugaguagcacuccuggccuuaagugauc

SEQ ID NO: 644389 - RNA, 65 nt, Homo Sapiens
auuucacacccugcucaguauggcuagccagcaguccugaguaggaguccaggacucccacuguc

SEQ ID NO: 644390 - RNA, 65 nt, Homo Sapiens
uaauccuagguuauugcuagccaaaauauuuuuguccugaguagugucacugggccaaaagauag

SEQ ID NO: 644391 - RNA, 65 nt, Homo Sapiens
gacugacgcaacccacguguaacugucagccgggcccugaguaaucgcuuaaagauguuccuacg

SEQ ID NO: 644392 - RNA, 65 nt, Homo Sapiens
ccucccagguucaagcgauucuccugccucagccuccugaguagcugggauuacaggcgcacgcc

SEQ ID NO: 644393 - RNA, 65 nt, Homo Sapiens
aaauuuguuccuggucuaauuuggcacccuuccaaccugaguauuguaggggaaggaaauuuaca

SEQ ID NO: 644394 - RNA, 65 nt, Homo Sapiens
ugggauuacaggcauguacccuccugccucagccuccugaguagcccuccaggguucaagugauu

SEQ ID NO: 644395 - RNA, 65 nt, Homo Sapiens
cagccccaagcauggccaggcuccaugcccugaacccugaguagauugagaaacacugccccauc

SEQ ID NO: 644396 - RNA, 65 nt, Homo Sapiens
auuaaauagguuuuauguauuucuugauucccacuccugaguaaagucagaaacagaacccaggu

SEQ ID NO: 644397 - RNA, 65 nt, Homo Sapiens
ucugggaggccucaugucucagucacuagaaguuaccugaguaucugggggucaccgauggucag

SEQ ID NO: 644398 - RNA, 65 nt, Homo Sapiens
uucccuuggcaaaauucccaguuuuuauuagcgguccugaguaauugcauguugcagaagccggc

SEQ ID NO: 644399 - RNA, 65 nt, Homo Sapiens
agugauuguuaugccuugcuauaaacacaguguuuccugaguagcgauuuugaugauuaaaaaga

SEQ ID NO: 644400 - RNA, 65 nt, Homo Sapiens
ugggacuacaggcacccgcccuccugccucagccuccugaguagcccucccguguucacaccauu

SEQ ID NO: 644401 - RNA, 65 nt, Homo Sapiens
ccucccagguuccaacgauugucuugucucagccuccugaguagcugagauuauaagcacgcacc

SEQ ID NO: 644402 - RNA, 61 nt, Homo Sapiens; identical to SEQ ID NO: 644043

SEQ ID NO: 644403 - RNA, 65 nt, Homo Sapiens
ccucuuauguucaagcaauucuccuuccuuagccuccugaguagcugggauuacaggcaugcgcc

SEQ ID NO: 644404 - RNA, 65 nt, Homo Sapiens
ugagacuacaggugagugcccccuccccucagccuccugaguagcaccucccuggcucaagcgau

SEQ ID NO: 644405 - RNA, 65 nt, Homo Sapiens
ugggacuacaggcaugcaccagugacuuuaagccuccugaguagccaaaaaguacaauuguuaac

SEQ ID NO: 644406 - RNA, 65 nt, Homo Sapiens
gggaaguggaacauaggcagaaaaaugcagcuggcccugaguacauucaucugcugcuuggaaua

SEQ ID NO: 644407 - RNA, 65 nt, Homo Sapiens
caucaccuacauggccauuaaaagaagacaguuucccugaguaauucuugguagcugucacuuca

SEQ ID NO: 644408 - RNA, 65 nt, Homo Sapiens
ggguggugucauggagccgcugggucgugagcucgccugaguauggucauggagccucaugcccc

SEQ ID NO: 644409 - RNA, 65 nt, Homo Sapiens
cugggcccuggugccugcugaagauucccucuaucccugaguacuuagucuucucccccuucccu

SEQ ID NO: 644410 - RNA, 65 nt, Homo Sapiens
aaugagaguuaaaaaaaaaaaaaaaaaucuguaugccugaguaccauccuggaugaaucuagaag

SEQ ID NO: 644411 - RNA, 65 nt, Homo Sapiens
gagauucuccaaggacagauggcaguggagcuagaccugaguagggggcagggaguucaggacaa

SEQ ID NO: 644412 - RNA, 65 nt, Homo Sapiens
ugggauuacaggcaugcacccucgugccucagccuccugaguagccucccggguucaagcggauu

SEQ ID NO: 644413 - RNA, 65 nt, Homo Sapiens
ugggacuacaggugcgugccccccugcuucagccuccugaguagcccuccuggguucaagcgauu

SEQ ID NO: 644414 - RNA, 65 nt, Homo Sapiens
cuuggaaaggggcucccuccucccagcacccuuggccugaguaaaaguccccccuccuuugugug

SEQ ID NO: 644415 - RNA, 65 nt, Homo Sapiens
uguguggguguggcgcauguguguccugucaguccccugaguaugagggcgggucugugucccau

SEQ ID NO: 644416 - RNA, 65 nt, Homo Sapiens
ccuccuggguucaagcgauucuccugccucagccuccugaguagcugggaauacaggcaugcgcc

SEQ ID NO: 644417 - RNA, 65 nt, Homo Sapiens
ccuauuuaaagacaaauuaugggacguuuguagaaccugaguauuuuucuuuuuaccaguuuuuu

SEQ ID NO: 644418 - RNA, 65 nt, Homo Sapiens
cuaccggauucaaggaauucucccugccucagccuccugaguagcuaggauuacaggugccugcc

SEQ ID NO: 644419 - RNA, 65 nt, Homo Sapiens
accugccgcugaucagccuuauguucccaaagagcccugaguagugcuuugguguucacagucug

SEQ ID NO: 644420 - RNA, 65 nt, Homo Sapiens
cucccuggguucaagcgauucuccugccugagccuccugaguagcugggacuacaggcacgugcc

SEQ ID NO: 644421 - RNA, 65 nt, Homo Sapiens
ccucccggauucaagugauucuccagccucagccuccugaguagcugggauuacaggcacacacc

SEQ ID NO: 644422 - RNA, 65 nt, Homo Sapiens
ccuucuggguucaagcgauucucgugccucagcuuccugaguagcuggaauuacaggcaggugcc

SEQ ID NO: 644423 - RNA, 65 nt, Homo Sapiens
uauggaugccgugggaguacaaaaguggaguguggccugaguaaugcauuaugggugguuuacca

SEQ ID NO: 644424 - RNA, 65 nt, Homo Sapiens
ugggacuacaggcgccagcccuccugccucagccuccugaguagcccuccuggguucaagcgauu

SEQ ID NO: 644425 - RNA, 65 nt, Homo Sapiens
ugaagcagaagaucagcaagugaccugguauucuaccugaguagagagcagccacagcagcagcu

SEQ ID NO: 644426 - RNA, 65 nt, Homo Sapiens
ugggacuacaguugugcacccuuccgccucagccuccugaguagcacuccugggcuuaagggauc

SEQ ID NO: 644427 - RNA, 65 nt, Homo Sapiens
aagcauggugucaguuuuguuuguuaucuuuaccuccugaguaauaaucaauauaaucugaauua

SEQ ID NO: 644428 - RNA, 65 nt, Homo Sapiens
ggcuuggagaaauggcuaggugaucacagagggagccugaguacaaaauggacagucuucucugu

SEQ ID NO: 644429 - RNA, 65 nt, Homo Sapiens
cacuaccacaaugucuucugucuuguugcuucucuccugaguacccccugggagaauugucccau

SEQ ID NO: 644430 - RNA, 64 nt, Homo Sapiens; identical to SEQ ID NO: 77753

SEQ ID NO: 644431 - RNA, 64 nt, Homo Sapiens; identical to SEQ ID NO: 77754

SEQ ID NO: 644432 - RNA, 64 nt, Homo Sapiens; identical to SEQ ID NO: 77755

SEQ ID NO: 644433 - RNA, 64 nt, Homo Sapiens; identical to SEQ ID NO: 77756

SEQ ID NO: 644434 - RNA, 64 nt, Homo Sapiens; identical to SEQ ID NO: 77757

SEQ ID NO: 644435 - RNA, 64 nt, Homo Sapiens; identical to SEQ ID NO: 77758

SEQ ID NO: 644436 - RNA, 64 nt, Homo Sapiens; identical to SEQ ID NO: 77759

SEQ ID NO: 644437 - RNA, 64 nt, Homo Sapiens; identical to SEQ ID NO: 77760

SEQ ID NO: 644438 - RNA, 64 nt, Homo Sapiens; identical to SEQ ID NO: 77761

SEQ ID NO: 644439 - RNA, 64 nt, Homo Sapiens; identical to SEQ ID NO: 77762

SEQ ID NO: 644440 - RNA, 64 nt, Homo Sapiens; identical to SEQ ID NO: 77763

SEQ ID NO: 644441 - RNA, 64 nt, Homo Sapiens; identical to SEQ ID NO: 77764

SEQ ID NO: 644442 - RNA, 64 nt, Homo Sapiens; identical to SEQ ID NO: 77765

SEQ ID NO: 644443 - RNA, 64 nt, Homo Sapiens; identical to SEQ ID NO: 77766

SEQ ID NO: 644444 - RNA, 64 nt, Homo Sapiens; identical to SEQ ID NO: 77767

SEQ ID NO: 644445 - RNA, 64 nt, Homo Sapiens; identical to SEQ ID NO: 77768

SEQ ID NO: 644446 - RNA, 64 nt, Homo Sapiens; identical to SEQ ID NO: 77769

SEQ ID NO: 644447 - RNA, 64 nt, Homo Sapiens; identical to SEQ ID NO: 77770

SEQ ID NO: 644448 - RNA, 64 nt, Homo Sapiens; identical to SEQ ID NO: 77771

SEQ ID NO: 644449 - RNA, 64 nt, Homo Sapiens; identical to SEQ ID NO: 77772

SEQ ID NO: 644450 - RNA, 64 nt, Homo Sapiens; identical to SEQ ID NO: 77773

SEQ ID NO: 644451 - RNA, 64 nt, Homo Sapiens; identical to SEQ ID NO: 77774

SEQ ID NO: 644452 - RNA, 64 nt, Homo Sapiens; identical to SEQ ID NO: 77775

SEQ ID NO: 644453 - RNA, 64 nt, Homo Sapiens; identical to SEQ ID NO: 77776

SEQ ID NO: 644454 - RNA, 64 nt, Homo Sapiens; identical to SEQ ID NO: 77777

SEQ ID NO: 644455 - RNA, 64 nt, Homo Sapiens; identical to SEQ ID NO: 77778

SEQ ID NO: 644456 - RNA, 64 nt, Homo Sapiens; identical to SEQ ID NO: 77779

SEQ ID NO: 644457 - RNA, 64 nt, Homo Sapiens; identical to SEQ ID NO: 77780

SEQ ID NO: 644458 - RNA, 64 nt, Homo Sapiens; identical to SEQ ID NO: 77781

SEQ ID NO: 644459 - RNA, 64 nt, Homo Sapiens; identical to SEQ ID NO: 77782

SEQ ID NO: 644460 - RNA, 64 nt, Homo Sapiens; identical to SEQ ID NO: 77783

SEQ ID NO: 644461 - RNA, 64 nt, Homo Sapiens; identical to SEQ ID NO: 77784

SEQ ID NO: 644462 - RNA, 64 nt, Homo Sapiens; identical to SEQ ID NO: 77785

SEQ ID NO: 644463 - RNA, 64 nt, Homo Sapiens; identical to SEQ ID NO: 516300

SEQ ID NO: 644464 - RNA, 64 nt, Homo Sapiens; identical to SEQ ID NO: 516301

SEQ ID NO: 644465 - RNA, 64 nt, Homo Sapiens; identical to SEQ ID NO: 516302

SEQ ID NO: 644466 - RNA, 64 nt, Homo Sapiens; identical to SEQ ID NO: 516303

SEQ ID NO: 644467 - RNA, 64 nt, Homo Sapiens; identical to SEQ ID NO: 411751

SEQ ID NO: 644468 - RNA, 64 nt, Homo Sapiens; identical to SEQ ID NO: 411752

SEQ ID NO: 644469 - RNA, 64 nt, Homo Sapiens; identical to SEQ ID NO: 411753

SEQ ID NO: 644470 - RNA, 64 nt, Homo Sapiens; identical to SEQ ID NO: 411754

SEQ ID NO: 644471 - RNA, 64 nt, Homo Sapiens; identical to SEQ ID NO: 411755

SEQ ID NO: 644472 - RNA, 64 nt, Homo Sapiens; identical to SEQ ID NO: 411756

SEQ ID NO: 644473 - RNA, 64 nt, Homo Sapiens; identical to SEQ ID NO: 411757

SEQ ID NO: 644474 - RNA, 64 nt, Homo Sapiens; identical to SEQ ID NO: 411758

SEQ ID NO: 644475 - RNA, 64 nt, Homo Sapiens; identical to SEQ ID NO: 411759

SEQ ID NO: 644476 - RNA, 64 nt, Homo Sapiens; identical to SEQ ID NO: 411760

SEQ ID NO: 644477 - RNA, 64 nt, Homo Sapiens; identical to SEQ ID NO: 411761

SEQ ID NO: 644478 - RNA, 64 nt, Homo Sapiens; identical to SEQ ID NO: 411762

SEQ ID NO: 644479 - RNA, 64 nt, Homo Sapiens; identical to SEQ ID NO: 411763

SEQ ID NO: 644480 - RNA, 64 nt, Homo Sapiens; identical to SEQ ID NO: 411764

SEQ ID NO: 644481 - RNA, 64 nt, Homo Sapiens; identical to SEQ ID NO: 411765

SEQ ID NO: 644482 - RNA, 64 nt, Homo Sapiens; identical to SEQ ID NO: 411766

SEQ ID NO: 644483 - RNA, 64 nt, Homo Sapiens; identical to SEQ ID NO: 411767

SEQ ID NO: 644484 - RNA, 64 nt, Homo Sapiens; identical to SEQ ID NO: 411768

SEQ ID NO: 644485 - RNA, 64 nt, Homo Sapiens; identical to SEQ ID NO: 411769

SEQ ID NO: 644486 - RNA, 64 nt, Homo Sapiens; identical to SEQ ID NO: 411770

SEQ ID NO: 644487 - RNA, 64 nt, Homo Sapiens; identical to SEQ ID NO: 98813

SEQ ID NO: 644488 - RNA, 64 nt, Homo Sapiens; identical to SEQ ID NO: 98814

SEQ ID NO: 644489 - RNA, 64 nt, Homo Sapiens; identical to SEQ ID NO: 98815

SEQ ID NO: 644490 - RNA, 64 nt, Homo Sapiens; identical to SEQ ID NO: 98816

SEQ ID NO: 644491 - RNA, 64 nt, Homo Sapiens; identical to SEQ ID NO: 98817

SEQ ID NO: 644492 - RNA, 64 nt, Homo Sapiens; identical to SEQ ID NO: 98818

SEQ ID NO: 644493 - RNA, 64 nt, Homo Sapiens; identical to SEQ ID NO: 98819

SEQ ID NO: 644494 - RNA, 64 nt, Homo Sapiens; identical to SEQ ID NO: 98820

SEQ ID NO: 644495 - RNA, 64 nt, Homo Sapiens; identical to SEQ ID NO: 98821

SEQ ID NO: 644496 - RNA, 64 nt, Homo Sapiens; identical to SEQ ID NO: 98822

SEQ ID NO: 644497 - RNA, 64 nt, Homo Sapiens; identical to SEQ ID NO: 98823

SEQ ID NO: 644498 - RNA, 64 nt, Homo Sapiens; identical to SEQ ID NO: 98824

SEQ ID NO: 644499 - RNA, 64 nt, Homo Sapiens; identical to SEQ ID NO: 98825

SEQ ID NO: 644500 - RNA, 64 nt, Homo Sapiens; identical to SEQ ID NO: 98826

SEQ ID NO: 644501 - RNA, 64 nt, Homo Sapiens; identical to SEQ ID NO: 98827

SEQ ID NO: 644502 - RNA, 64 nt, Homo Sapiens; identical to SEQ ID NO: 98828

SEQ ID NO: 644503 - RNA, 64 nt, Homo Sapiens; identical to SEQ ID NO: 98829

SEQ ID NO: 644504 - RNA, 64 nt, Homo Sapiens; identical to SEQ ID NO: 98830

SEQ ID NO: 644505 - RNA, 64 nt, Homo Sapiens; identical to SEQ ID NO: 98831

SEQ ID NO: 644506 - RNA, 64 nt, Homo Sapiens; identical to SEQ ID NO: 98832

SEQ ID NO: 644507 - RNA, 64 nt, Homo Sapiens; identical to SEQ ID NO: 98833

SEQ ID NO: 644508 - RNA, 64 nt, Homo Sapiens; identical to SEQ ID NO: 98834

SEQ ID NO: 644509 - RNA, 64 nt, Homo Sapiens; identical to SEQ ID NO: 98835

SEQ ID NO: 644510 - RNA, 64 nt, Homo Sapiens; identical to SEQ ID NO: 98836

SEQ ID NO: 644511 - RNA, 64 nt, Homo Sapiens; identical to SEQ ID NO: 98837

SEQ ID NO: 644512 - RNA, 64 nt, Homo Sapiens; identical to SEQ ID NO: 98838

SEQ ID NO: 644513 - RNA, 64 nt, Homo Sapiens; identical to SEQ ID NO: 98839

SEQ ID NO: 644514 - RNA, 64 nt, Homo Sapiens; identical to SEQ ID NO: 98840

SEQ ID NO: 644515 - RNA, 64 nt, Homo Sapiens; identical to SEQ ID NO: 98841

SEQ ID NO: 644516 - RNA, 64 nt, Homo Sapiens; identical to SEQ ID NO: 98842

SEQ ID NO: 644517 - RNA, 64 nt, Homo Sapiens; identical to SEQ ID NO: 98843

SEQ ID NO: 644518 - RNA, 64 nt, Homo Sapiens; identical to SEQ ID NO: 98844

SEQ ID NO: 644519 - RNA, 64 nt, Homo Sapiens; identical to SEQ ID NO: 98845

SEQ ID NO: 644520 - RNA, 64 nt, Homo Sapiens; identical to SEQ ID NO: 98846

SEQ ID NO: 644521 - RNA, 64 nt, Homo Sapiens; identical to SEQ ID NO: 98847

SEQ ID NO: 644522 - RNA, 64 nt, Homo Sapiens; identical to SEQ ID NO: 98848

SEQ ID NO: 644523 - RNA, 64 nt, Homo Sapiens; identical to SEQ ID NO: 98849

SEQ ID NO: 644524 - RNA, 64 nt, Homo Sapiens; identical to SEQ ID NO: 98850

SEQ ID NO: 644525 - RNA, 64 nt, Homo Sapiens; identical to SEQ ID NO: 98851

SEQ ID NO: 644526 - RNA, 64 nt, Homo Sapiens; identical to SEQ ID NO: 98852

SEQ ID NO: 644527 - RNA, 64 nt, Homo Sapiens; identical to SEQ ID NO: 98853

SEQ ID NO: 644528 - RNA, 64 nt, Homo Sapiens; identical to SEQ ID NO: 98854

SEQ ID NO: 644529 - RNA, 64 nt, Homo Sapiens; identical to SEQ ID NO: 98855

SEQ ID NO: 644530 - RNA, 64 nt, Homo Sapiens; identical to SEQ ID NO: 98856

SEQ ID NO: 644531 - RNA, 64 nt, Homo Sapiens; identical to SEQ ID NO: 98857

SEQ ID NO: 644532 - RNA, 64 nt, Homo Sapiens; identical to SEQ ID NO: 98858

SEQ ID NO: 644533 - RNA, 64 nt, Homo Sapiens; identical to SEQ ID NO: 98859

SEQ ID NO: 644534 - RNA, 64 nt, Homo Sapiens; identical to SEQ ID NO: 98860

SEQ ID NO: 644535 - RNA, 64 nt, Homo Sapiens; identical to SEQ ID NO: 98861

SEQ ID NO: 644536 - RNA, 64 nt, Homo Sapiens; identical to SEQ ID NO: 98862

SEQ ID NO: 644537 - RNA, 64 nt, Homo Sapiens; identical to SEQ ID NO: 98863

SEQ ID NO: 644538 - RNA, 64 nt, Homo Sapiens; identical to SEQ ID NO: 98864

SEQ ID NO: 644539 - RNA, 64 nt, Homo Sapiens; identical to SEQ ID NO: 98865

SEQ ID NO: 644540 - RNA, 64 nt, Homo Sapiens; identical to SEQ ID NO: 98866

SEQ ID NO: 644541 - RNA, 64 nt, Homo Sapiens; identical to SEQ ID NO: 98867

SEQ ID NO: 644542 - RNA, 64 nt, Homo Sapiens; identical to SEQ ID NO: 98868

SEQ ID NO: 644543 - RNA, 64 nt, Homo Sapiens; identical to SEQ ID NO: 98869

SEQ ID NO: 644544 - RNA, 64 nt, Homo Sapiens; identical to SEQ ID NO: 98870

SEQ ID NO: 644545 - RNA, 64 nt, Homo Sapiens; identical to SEQ ID NO: 98871

SEQ ID NO: 644546 - RNA, 64 nt, Homo Sapiens; identical to SEQ ID NO: 98872

SEQ ID NO: 644547 - RNA, 64 nt, Homo Sapiens; identical to SEQ ID NO: 98873

SEQ ID NO: 644548 - RNA, 64 nt, Homo Sapiens; identical to SEQ ID NO: 98874

SEQ ID NO: 644549 - RNA, 64 nt, Homo Sapiens; identical to SEQ ID NO: 98875

SEQ ID NO: 644550 - RNA, 64 nt, Homo Sapiens; identical to SEQ ID NO: 98876

SEQ ID NO: 644551 - RNA, 64 nt, Homo Sapiens; identical to SEQ ID NO: 98877

SEQ ID NO: 644552 - RNA, 64 nt, Homo Sapiens; identical to SEQ ID NO: 98878

SEQ ID NO: 644553 - RNA, 64 nt, Homo Sapiens; identical to SEQ ID NO: 98879

SEQ ID NO: 644554 - RNA, 64 nt, Homo Sapiens; identical to SEQ ID NO: 98880

SEQ ID NO: 644555 - RNA, 64 nt, Homo Sapiens; identical to SEQ ID NO: 98881

SEQ ID NO: 644556 - RNA, 64 nt, Homo Sapiens; identical to SEQ ID NO: 98882

SEQ ID NO: 644557 - RNA, 64 nt, Homo Sapiens; identical to SEQ ID NO: 98883

SEQ ID NO: 644558 - RNA, 64 nt, Homo Sapiens; identical to SEQ ID NO: 98884

SEQ ID NO: 644559 - RNA, 64 nt, Homo Sapiens; identical to SEQ ID NO: 98885

SEQ ID NO: 644560 - RNA, 64 nt, Homo Sapiens; identical to SEQ ID NO: 98886

SEQ ID NO: 644561 - RNA, 64 nt, Homo Sapiens; identical to SEQ ID NO: 98887

SEQ ID NO: 644562 - RNA, 64 nt, Homo Sapiens; identical to SEQ ID NO: 98888

SEQ ID NO: 644563 - RNA, 64 nt, Homo Sapiens; identical to SEQ ID NO: 98889

SEQ ID NO: 644564 - RNA, 64 nt, Homo Sapiens; identical to SEQ ID NO: 98890

SEQ ID NO: 644565 - RNA, 64 nt, Homo Sapiens; identical to SEQ ID NO: 98891

SEQ ID NO: 644566 - RNA, 64 nt, Homo Sapiens; identical to SEQ ID NO: 98892

SEQ ID NO: 644567 - RNA, 64 nt, Homo Sapiens; identical to SEQ ID NO: 98893

SEQ ID NO: 644568 - RNA, 64 nt, Homo Sapiens; identical to SEQ ID NO: 98894

SEQ ID NO: 644569 - RNA, 64 nt, Homo Sapiens; identical to SEQ ID NO: 98895

SEQ ID NO: 644570 - RNA, 64 nt, Homo Sapiens; identical to SEQ ID NO: 98896

SEQ ID NO: 644571 - RNA, 64 nt, Homo Sapiens; identical to SEQ ID NO: 98897

SEQ ID NO: 644572 - RNA, 64 nt, Homo Sapiens; identical to SEQ ID NO: 98898

SEQ ID NO: 644573 - RNA, 64 nt, Homo Sapiens; identical to SEQ ID NO: 98899

SEQ ID NO: 644574 - RNA, 64 nt, Homo Sapiens; identical to SEQ ID NO: 98900

SEQ ID NO: 644575 - RNA, 64 nt, Homo Sapiens; identical to SEQ ID NO: 98901

SEQ ID NO: 644576 - RNA, 64 nt, Homo Sapiens; identical to SEQ ID NO: 98902

SEQ ID NO: 644577 - RNA, 64 nt, Homo Sapiens; identical to SEQ ID NO: 98903

SEQ ID NO: 644578 - RNA, 64 nt, Homo Sapiens; identical to SEQ ID NO: 98904

SEQ ID NO: 644579 - RNA, 64 nt, Homo Sapiens; identical to SEQ ID NO: 98905

SEQ ID NO: 644580 - RNA, 64 nt, Homo Sapiens; identical to SEQ ID NO: 98906

SEQ ID NO: 644581 - RNA, 64 nt, Homo Sapiens; identical to SEQ ID NO: 98907

SEQ ID NO: 644582 - RNA, 64 nt, Homo Sapiens; identical to SEQ ID NO: 98908

SEQ ID NO: 644583 - RNA, 64 nt, Homo Sapiens; identical to SEQ ID NO: 98909

SEQ ID NO: 644584 - RNA, 64 nt, Homo Sapiens; identical to SEQ ID NO: 98910

SEQ ID NO: 644585 - RNA, 64 nt, Homo Sapiens; identical to SEQ ID NO: 98911

SEQ ID NO: 644586 - RNA, 64 nt, Homo Sapiens; identical to SEQ ID NO: 98912

SEQ ID NO: 644587 - RNA, 64 nt, Homo Sapiens; identical to SEQ ID NO: 434057

SEQ ID NO: 644588 - RNA, 64 nt, Homo Sapiens; identical to SEQ ID NO: 434058

SEQ ID NO: 644589 - RNA, 64 nt, Homo Sapiens; identical to SEQ ID NO: 434059

SEQ ID NO: 644590 - RNA, 64 nt, Homo Sapiens; identical to SEQ ID NO: 434060

SEQ ID NO: 644591 - RNA, 64 nt, Homo Sapiens; identical to SEQ ID NO: 434061

SEQ ID NO: 644592 - RNA, 64 nt, Homo Sapiens; identical to SEQ ID NO: 434062

SEQ ID NO: 644593 - RNA, 64 nt, Homo Sapiens; identical to SEQ ID NO: 434063

SEQ ID NO: 644594 - RNA, 64 nt, Homo Sapiens; identical to SEQ ID NO: 434064

SEQ ID NO: 644595 - RNA, 64 nt, Homo Sapiens; identical to SEQ ID NO: 434065

SEQ ID NO: 644596 - RNA, 64 nt, Homo Sapiens; identical to SEQ ID NO: 434066

SEQ ID NO: 644597 - RNA, 63 nt, Homo Sapiens
cuggaacugggacuggucucggucugcugacgucagggucagcucccccgcggagcugacuuc

SEQ ID NO: 644598 - RNA, 63 nt, Homo Sapiens
accggguccagucuggggucuagucucgagcaucagggucaggcucggggcagggcuggguua

SEQ ID NO: 644599 - RNA, 63 nt, Homo Sapiens
cggggcagcuggcuguguccauggccagguggccagggucagggcugcaagccagggguccag

SEQ ID NO: 644600 - RNA, 63 nt, Homo Sapiens
aauucuucaacccuugggugugugaguuugaggcagggucauuugugugauguguuuggccuu

SEQ ID NO: 644601 - RNA, 63 nt, Homo Sapiens
agacggaggugccugaggguggggugggauuugcagggucauuaucagaacaugaggauaacu

SEQ ID NO: 644602 - RNA, 63 nt, Homo Sapiens
aacuugagucucagggaagugaagugacuugcccagggucacucagguagaguugagauucaa

SEQ ID NO: 644603 - RNA, 63 nt, Homo Sapiens
uccuacuugccauucacccaucaaugugaaagucagggucacagcuggucuguguguccaguu

SEQ ID NO: 644604 - RNA, 63 nt, Homo Sapiens
aaauggugaggagggggaagagaauuacauuuccagggucagaaacuuggcaacaguuuuccu

SEQ ID NO: 644605 - RNA, 63 nt, Homo Sapiens
cugcauggcugcaaugaucccacuguuagcuggcagggucaggcuuagcuccuugacugcaga

SEQ ID NO: 644606 - RNA, 63 nt, Homo Sapiens
uaaccuuuaguggcagggauauaaaaaauugcucagggucacuugcagauauuuuauuuuuaa

SEQ ID NO: 644607 - RNA, 63 nt, Homo Sapiens
uucuuauuuucagcacuuacaucauuugguacacagggucaaauagggcaaauaauuuugucu

SEQ ID NO: 644608 - RNA, 63 nt, Homo Sapiens
ucacagcaaugcucuccuugucaaggcauggaccagggucauucagacacauucagauacugc

SEQ ID NO: 644609 - RNA, 63 nt, Homo Sapiens
gcacuggcgggucucuccaugcaggccacaacacagggucaguguucaccuggugucacuucc

SEQ ID NO: 644610 - RNA, 63 nt, Homo Sapiens
gcugccgcuuuggacaccaacacucccuucucccagggucaugcagggaucugcucccuccug

SEQ ID NO: 644611 - RNA, 63 nt, Homo Sapiens
uccugacugggaaggacauaaaagguuuaaugucagggucaaacuacauugagccccugagga

SEQ ID NO: 644612 - RNA, 63 nt, Homo Sapiens
caugcugcugauccccaccugcgcacuauagcucagggucagcaguggaaugaagggccuuag

SEQ ID NO: 644613 - RNA, 63 nt, Homo Sapiens
aaggaggagcgagggaaugacggagguagggugcagggucagggcucccgcaggggccugcau

SEQ ID NO: 644614 - RNA, 63 nt, Homo Sapiens
gagcguaggauuuguugcauuaugcuagagcaccagggucagggugcaaggaagaggcuuaag

SEQ ID NO: 644615 - RNA, 63 nt, Homo Sapiens
gggccccgaugugcacagcuggaccauggcccgcagggucaaggucccagccagggcagggag

SEQ ID NO: 644616 - RNA, 63 nt, Homo Sapiens
cccccuccucuccccaguuucagcugggggauccagggucaggucccucuagccuguggacac

SEQ ID NO: 644617 - RNA, 63 nt, Homo Sapiens
uuuguuugauuuguccagucagaaggagcucuacagggucagcccuuagaagaagugggaaga

SEQ ID NO: 644618 - RNA, 63 nt, Homo Sapiens
gggcuacuuucuggaagucuauccccaccuccucagggucaaauauuacuuucaucacgacug

SEQ ID NO: 644619 - RNA, 63 nt, Homo Sapiens
uuccagggcauggcucuggagcuugggaauaggcagggucagaaagcuggucuuaaggguugg

SEQ ID NO: 644620 - RNA, 63 nt, Homo Sapiens
acaagucaggucaggcuucaaaaaggccugggacagggucaguuagccagguaggcgagacac

SEQ ID NO: 644621 - RNA, 63 nt, Homo Sapiens
gccuggcacaggcuacagggggacaaccuguaccagggucacauagucuacauggaccaguag

SEQ ID NO: 644622 - RNA, 63 nt, Homo Sapiens
gaccuuggacuugucucuuaugccccagguagucagggucagguggaguuccgcuuuuccaac

SEQ ID NO: 644623 - RNA, 63 nt, Homo Sapiens
gagccccugguguggaaagauaggagcaguccccagggucaggccugaggcuuggcccagcuc

SEQ ID NO: 644624 - RNA, 63 nt, Homo Sapiens
ucauguacauuacagauauuaaaaaaggauauucagggucaaaaaugauguuugaagugaaaa

SEQ ID NO: 644625 - RNA, 63 nt, Homo Sapiens
ugguaauuaacaauagccauacacccaucucaacagggucacuguaugauagauggggccugg

SEQ ID NO: 644626 - RNA, 63 nt, Homo Sapiens
uacauagaagcugcuucuugguuuuuauccccucagggucagugagaugguggaaucuucccu

SEQ ID NO: 644627 - RNA, 63 nt, Homo Sapiens
guucgugugcuccuccuccucugcaccgaguagcagggucagggaagcaaggccuggaguggc

SEQ ID NO: 644628 - RNA, 63 nt, Homo Sapiens
accauccaugcagacauggauuccaaaaacaaucagggucauacaccuagagagcuuggcugu

SEQ ID NO: 644629 - RNA, 63 nt, Homo Sapiens
ugaaauaugggccuccuggacauccagcaaaugcagggucacaaaugacuugaaaaaaaguca

SEQ ID NO: 644630 - RNA, 63 nt, Homo Sapiens
ccauuugaagaaaaaguuggcgaaauguuaaaacagggucaauaaaugcuuugaaggaauaaa

SEQ ID NO: 644631 - RNA, 63 nt, Homo Sapiens
aggcggcugucugagggcuguccccgccuaggacagggucaaucgaggaaugccagaugugca

SEQ ID NO: 644632 - RNA, 63 nt, Homo Sapiens
uauccuccucacaccguguauuucccacccacucagggucacagccuacuaauuccucaaacu

SEQ ID NO: 644633 - RNA, 63 nt, Homo Sapiens
cugaggugggaggaucuuuugaacccaggaguucagggucauagcaugcugugauugugccua

SEQ ID NO: 644634 - RNA, 63 nt, Homo Sapiens
ggggccaaacuggagcccagauggguuaauuuccagggucagacauuacggucucuccucccc

SEQ ID NO: 644635 - RNA, 63 nt, Homo Sapiens
agacucaggggcuccaccaaugccaucccaaaacagggucagacacugcccagcuucccucca

SEQ ID NO: 644636 - RNA, 63 nt, Homo Sapiens
guguuuucccuuuucuuucuggggccaggaagucagggucaacucccaggccucagaugcagg

SEQ ID NO: 644637 - RNA, 63 nt, Homo Sapiens
guccccacaaugugccagucagaacaggacuuacagggucauuaaaaaaaaaauauuuuuagc

SEQ ID NO: 644638 - RNA, 63 nt, Homo Sapiens
ccaguaacaaaaggucugaagugugaaguggagcagggucagaggaccuaucgaugucuauuu

SEQ ID NO: 644639 - RNA, 63 nt, Homo Sapiens
accuccccacccccaggggaggacugggcccugcagggucagagacaucggugugaagggaag

SEQ ID NO: 644640 - RNA, 63 nt, Homo Sapiens
uaaugcuacaguuacuguauagcagggccagugcagggucagugucaguaauuucugcuuuuu

SEQ ID NO: 644641 - RNA, 63 nt, Homo Sapiens
cccuucagagccagggcagaagggggugcagcccagggucaggauggucuuccauccccagca

SEQ ID NO: 644642 - RNA, 63 nt, Homo Sapiens
ccacccugcccaccacccucccugggaggcugacagggucaagggagccguggucccgaguuc

SEQ ID NO: 644643 - RNA, 60 nt, Homo Sapiens
cacggacagagaccaagagagaggcuggagcagggucaccgcaggaccagcaucaucuga

SEQ ID NO: 644644 - RNA, 63 nt, Homo Sapiens
auagcccauuaguggaaggaggaauaaugugcucagggucaccaaacugaaucaccuagaagu

SEQ ID NO: 644645 - RNA, 63 nt, Homo Sapiens
cacacuggaguguggaggggucgaugacuugugcagggucauaugguaccuaaggggcagauc

SEQ ID NO: 644646 - RNA, 63 nt, Homo Sapiens
caguauuuuaacacccacauuaguauaugcguccagggucauaacccccuaaaauccaucaug

SEQ ID NO: 644647 - RNA, 63 nt, Homo Sapiens
ccaugucuuccaggagacuagacuacuguuguccagggucaauuugaguguaaagaaaaugua

SEQ ID NO: 644648 - RNA, 63 nt, Homo Sapiens
ggugugacugcucugacaaccuguggcaugcugcagggucaggcuccugauaggaggauuuca

SEQ ID NO: 644649 - RNA, 63 nt, Homo Sapiens
agaauaugcucacugcuaagcuacaaacucggacagggucagaaacagaggugucccauccca

SEQ ID NO: 644650 - RNA, 63 nt, Homo Sapiens
gccacaaauuccaggccuaguucagucugggggcagggucaguccuucucccaggccagcccu

SEQ ID NO: 644651 - RNA, 63 nt, Homo Sapiens
gccagacccacaaggccagguccugugcuaucacagggucaccucuuuuacaguuagaaacac

SEQ ID NO: 644652 - RNA, 63 nt, Homo Sapiens
uuugugccaguauucaagugguauagcucugagcagggucacauuuggccaaaccugacacug

SEQ ID NO: 644653 - RNA, 63 nt, Homo Sapiens
cacugucuugcugcauucuccuuuggcaaacaucagggucagaauucaggauagcccuuccua

SEQ ID NO: 644654 - RNA, 63 nt, Homo Sapiens
cugaaaugugcucaggcccuggccaggagggcccagggucauucuuuuaacaaaaggauuauu

SEQ ID NO: 644655 - RNA, 63 nt, Homo Sapiens
gggagacagccucugggauuggaggccagaggccagggucagacccagccaggacuccucauu

SEQ ID NO: 644656 - RNA, 63 nt, Homo Sapiens
ccuagggaaaaaauuuaaggagguauucacacucagggucaugcacuugcacaauguugagaa

SEQ ID NO: 644657 - RNA, 63 nt, Homo Sapiens
auauuaaaaauuagcaaacaaaagugacuugcucagggucaugcagcugggugaugauagaag

SEQ ID NO: 644658 - RNA, 63 nt, Homo Sapiens
ucuaccccugcuaaggaguucucaucccucugucagggucaguaaggaaaacgguggccuagg

SEQ ID NO: 644659 - RNA, 63 nt, Homo Sapiens
uguuucuuggggaaggagaggagggaaaaggaccagggucaagggggaccagagguugaccac

SEQ ID NO: 644660 - RNA, 63 nt, Homo Sapiens
caucccuccaucuucuccuccauuaucaucuagcagggucagacugggaaaccugguuggcca

SEQ ID NO: 644661 - RNA, 63 nt, Homo Sapiens
gccucaguggggucgccguaccaggggcccuggcagggucagcugcaagaacaucaaaccaga

SEQ ID NO: 644662 - RNA, 63 nt, Homo Sapiens
cacuugucuguucuucagugcuggagguccuggcagggucaggcugggguaagccgggguucc

SEQ ID NO: 644663 - RNA, 63 nt, Homo Sapiens
gaauucugaagccauugucuccuugaguaccaacagggucagggaagacugggccuccugaau

SEQ ID NO: 644664 - RNA, 63 nt, Homo Sapiens
uuuaaauaugccuuuaaaauaagucacuguugacagggucaugaguuuccgaguauaguuuuc

SEQ ID NO: 644665 - RNA, 63 nt, Homo Sapiens
acccauguauugggcuuaguaucugggcuaccucagggucaccucuaaaauucagagcauauc

SEQ ID NO: 644666 - RNA, 63 nt, Homo Sapiens
uggcgaagccugagcaggcacacccugagguaacagggucaaccuuuuaacauagagaacugu

SEQ ID NO: 644667 - RNA, 63 nt, Homo Sapiens
ggaaacagugaagugccauuacguaaaacauuucagggucacuuuaaagcccaggccccacuu

SEQ ID NO: 644668 - RNA, 63 nt, Homo Sapiens
uuugcaggggugacggcccuccugcaaacagaacagggucauggaagugaaaaucuuggagac

SEQ ID NO: 644669 - RNA, 63 nt, Homo Sapiens
guaucuaauuccccgagaccauugaaugcugcccagggucaguuguuuuuguguagaguggcg

SEQ ID NO: 644670 - RNA, 63 nt, Homo Sapiens
cuuuuccaaguuuaucagugcaugaugaaauuccagggucacacugcugcaguaaauauuuug

SEQ ID NO: 644671 - RNA, 63 nt, Homo Sapiens
ggaagggggcccugugcuucggcaguagccagacagggucaugaggcagcuucaugaugugca

SEQ ID NO: 644672 - RNA, 63 nt, Homo Sapiens
cagcaguccuccagcaagguacagcuggcuauucagggucacccggaaaaaaaccaugcugau

SEQ ID NO: 644673 - RNA, 63 nt, Homo Sapiens
aaccagcccgcucaaugcagaggaaauccucaacagggucaccugaucucagggcucaguggc

SEQ ID NO: 644674 - RNA, 63 nt, Homo Sapiens
gccuggucuggugaaguaugaaugccuagacaucagggucagggcuaagggauaaacaaaagc

SEQ ID NO: 644675 - RNA, 63 nt, Homo Sapiens
caucuaaagucuagugaccuccuuauaaaccugcagggucacucaagacugcugagcagaaug

SEQ ID NO: 644676 - RNA, 63 nt, Homo Sapiens
gguguugagccgcucauagccauaacgcuuuugcagggucaaugaagaacgugcuucuuaggu

SEQ ID NO: 644677 - RNA, 63 nt, Homo Sapiens
augucaacuccauugaaaaaucuaugaauauuucagggucagcuauucuugguucuuugcaau

SEQ ID NO: 644678 - RNA, 63 nt, Homo Sapiens
aguucguucaguaacgcagcucagcucagagcccagggucaggcaccuucuggagccagcuca

SEQ ID NO: 644679 - RNA, 63 nt, Homo Sapiens
ugauuugcuagcugguggcauuguuuuacagagcagggucacuuugauccuagggugcuccuu

SEQ ID NO: 644680 - RNA, 63 nt, Homo Sapiens
uuccccugugaugagcagaugaccaccgcccuccagggucagcguuuggcuguuugugugccu

SEQ ID NO: 644681 - RNA, 63 nt, Homo Sapiens
ugauccaggcgcuggagggauggccuaggacaccagggucacaccaggaacaugggagggccg

SEQ ID NO: 644682 - RNA, 63 nt, Homo Sapiens
ucuggcucugggagccccuaucucaggaauuuucagggucauuugugacuuuucauuucuuaa

SEQ ID NO: 644683 - RNA, 63 nt, Homo Sapiens
gauuccaaacaugucauuaucuuaagugauaaccagggucacgaacuauacuauauagagaau

SEQ ID NO: 644684 - RNA, 63 nt, Homo Sapiens
uugaauugugcacauaagaaaacagcauucugucagggucacuccaacccugcauucaagugu

SEQ ID NO: 644685 - RNA, 63 nt, Homo Sapiens
aagaaaaauaauagacaaaaggaagccauagcucagggucaucaauaguguuggaacugagga

SEQ ID NO: 644686 - RNA, 63 nt, Homo Sapiens
ugggguccuggggccucggagccucauccgaggcagggucaggagaggggcagaacagccgcu

SEQ ID NO: 644687 - RNA, 63 nt, Homo Sapiens
gacaggccugaacucuagagggaacuugaaauccagggucaaagguuaaggggcagcagcugg

SEQ ID NO: 644688 - RNA, 63 nt, Homo Sapiens
guggagggcuguaggggagggccagugcccagacagggucauggggcucagaccagcccacug

SEQ ID NO: 644689 - RNA, 63 nt, Homo Sapiens
gagcaaauuucucuuucuagaaggggagggucacagggucacagauucaccaaagcugaaagg

SEQ ID NO: 644690 - RNA, 63 nt, Homo Sapiens
accucucaucaccccaccuucaucaucaugcuccagggucacccuggccagcucuugugcugg

SEQ ID NO: 644691 - RNA, 63 nt, Homo Sapiens
uucuucuuucuuuuaagcagacccauaccuuuccagggucaaaguacagaauagaauacauug

SEQ ID NO: 644692 - RNA, 63 nt, Homo Sapiens
uuuguaauuauauaaccccacugaaaacuugcacagggucaucucuacaguauuuuggaaggu

SEQ ID NO: 644693 - RNA, 63 nt, Homo Sapiens
gggguugggcuggggagaggccacucuggaugccagggucacucccuggcuccaugacccacc

SEQ ID NO: 644694 - RNA, 63 nt, Homo Sapiens
gaucugucagaggaaaaugguccauggaagacacagggucagaaggacaugcuccauuuauuu

SEQ ID NO: 644695 - RNA, 63 nt, Homo Sapiens
ccagcgaggagucccugcaaccagagcuggugccagggucagccuucgcuccugccugcauuu

SEQ ID NO: 644696 - RNA, 63 nt, Homo Sapiens
aaacaaaauaggugaggggauagcgaaugcacucagggucagcaguggaguuuaaaaauuguc

SEQ ID NO: 644697 - RNA, 63 nt, Homo Sapiens
uauaaaagaguucaaacuauugcccauguuccccagggucagaaguucuaauuaugaugauag

SEQ ID NO: 644698 - RNA, 63 nt, Homo Sapiens
acagguugggaugugggaaugacuggggugaggcagggucaagugcuacgggccuccuucccg

SEQ ID NO: 644699 - RNA, 63 nt, Homo Sapiens
gggacuagaagagcugcaugaugguggcugagacagggucaccuugggaaggcuugggagcca

SEQ ID NO: 644700 - RNA, 63 nt, Homo Sapiens
agaauaaacugcagacugaaagaaacaugccugcagggucaggaacugggccacuguucccag

SEQ ID NO: 644701 - RNA, 63 nt, Homo Sapiens
gcauuauaaaaugaagagacagacaugauuacucagggucagcaaccuagugaguuagaaaaa

SEQ ID NO: 644702 - RNA, 63 nt, Homo Sapiens
gcaguccuuugcauuugccaauucaagguaaaacagggucagugacaucugcagugucccagu

SEQ ID NO: 644703 - RNA, 63 nt, Homo Sapiens
aucuuguaaucauagcaaaaagucugcaaaccccagggucaagccugcucugccacaggguug

SEQ ID NO: 644704 - RNA, 63 nt, Homo Sapiens
gaccaacaacaacgaggagggacaccaugaagacagggucaucaauggcagucggaggcgcag

SEQ ID NO: 644705 - RNA, 60 nt, Homo Sapiens
ggggugggggcucucacaagucuugccccucagggucacaacucugauaccuccaacuga

SEQ ID NO: 644706 - RNA, 63 nt, Homo Sapiens
ggucaggugguuguagucugcauccugcagucacagggucagggggagagggggcguguugaa

SEQ ID NO: 644707 - RNA, 63 nt, Homo Sapiens
ugccuguuaccacacccccacagggugcuguugcagggucaccgagagccagggauauggauc

SEQ ID NO: 644708 - RNA, 63 nt, Homo Sapiens
ccucagggugcuggggcccuaaaacgggguguucagggucagccugaggcauuuuguggccuu

SEQ ID NO: 644709 - RNA, 63 nt, Homo Sapiens
cucucccaagacugaagugcagccucugggcugcagggucagcgcugugaccaggcagcuaag

SEQ ID NO: 644710 - RNA, 63 nt, Homo Sapiens
uugagaagaagcaaagcuggugcgggccacaggcagggucagaaagcuacaguuuuuagcugg

SEQ ID NO: 644711 - RNA, 63 nt, Homo Sapiens
ccagcucuggagccccucucgguggagccuucucagggucaguuccucccugugcugcucuga

SEQ ID NO: 644712 - RNA, 63 nt, Homo Sapiens
gugcccagcguuuaucagagcccucccuggcuucagggucagaccaggcagcugccaagcacu

SEQ ID NO: 644713 - RNA, 63 nt, Homo Sapiens
uuugagcaaacuguaaacugacauauaugcuuucagggucaaagucaagaaaacaagauggca

SEQ ID NO: 644714 - RNA, 63 nt, Homo Sapiens
agaauucgacagccagaugcccaguguguguaacagggucacaacgacuucugcccauucucu

SEQ ID NO: 644715 - RNA, 63 nt, Homo Sapiens
acugguggugauaagaggagccgucuggugugucagggucacgaacccguuacauuucaggac

SEQ ID NO: 644716 - RNA, 63 nt, Homo Sapiens
cccugaggacucccacccucacccccacccccacagggucagcaacugcuuccgguuacaccc

SEQ ID NO: 644717 - RNA, 63 nt, Homo Sapiens
agcggccccggcuccagcccagccagcacucugcagggucacacgcaccguguccccacccag

SEQ ID NO: 644718 - RNA, 63 nt, Homo Sapiens
caggagcuacuuugaguuugguguuacuaggaucagggucagucuuuggcuuaucaauaaauu

SEQ ID NO: 644719 - RNA, 63 nt, Homo Sapiens
gccgucuagaagcgaugcuuuaguggccuaacccagggucaaauacagcucuuucuagcaaaa

SEQ ID NO: 644720 - RNA, 63 nt, Homo Sapiens
cagcacugcggggugcgacuagggcugcgcugccagggucacuucccgccuccuccuuuugcc

SEQ ID NO: 644721 - RNA, 63 nt, Homo Sapiens
gaccucaucuuccugagggcucugucuugccugcagggucauagcucagacucuucccccacc

SEQ ID NO: 644722 - RNA, 63 nt, Homo Sapiens
aucugcucuguggaaagaaagaacugucucuaccagggucaagagcaugaacgcaucaauaga

SEQ ID NO: 644723 - RNA, 63 nt, Homo Sapiens
ggccagacacagucacccaguuuuuguucauaccagggucaugcguugagcuacugacaaacu

SEQ ID NO: 644724 - RNA, 63 nt, Homo Sapiens
cggcaggauuaugcgaucacggaucagucagagcagggucaggagacggggcugacggcacgg

SEQ ID NO: 644725 - RNA, 63 nt, Homo Sapiens
cggagcugcugagugacagcccaguccaugcuccagggucaggcugaccaagugcuggcccac

SEQ ID NO: 644726 - RNA, 63 nt, Homo Sapiens
uauguucucuaaugcaguccucugcaaaccuaacagggucacauuaugguuuauggccucgau

SEQ ID NO: 644727 - RNA, 63 nt, Homo Sapiens
gagguggcucagaguccacccgcuugaaugauucagggucaggucaagagcuccucugcuccu

SEQ ID NO: 644728 - RNA, 63 nt, Homo Sapiens
accaucucuuuauuaauuguugcaaugcgaucacagggucauuuuuuucucccuaaccccaga

SEQ ID NO: 644729 - RNA, 63 nt, Homo Sapiens
uggaaaucaccugagacaggaaaaagggaacaucagggucaaagcacggaauaagcacauagu

SEQ ID NO: 644730 - RNA, 63 nt, Homo Sapiens
aguggggagagagcccuuccucggucuccaccccagggucauaaggccagccugcuugggcgc

SEQ ID NO: 644731 - RNA, 63 nt, Homo Sapiens
uggcguguaggacucugucauguuuucagagugcagggucaagcccagacuggcuggaaacca

SEQ ID NO: 644732 - RNA, 60 nt, Homo Sapiens
accuggagcuguuugagugacagccuccaucagggucauccuacagccuccaagcgggcu

SEQ ID NO: 644733 - RNA, 63 nt, Homo Sapiens
ccgcucuacuacaucuaggacgccuccggugagcagggucaguggaagccccaacgggaaagg

SEQ ID NO: 644734 - RNA, 63 nt, Homo Sapiens
caaugcccacccgcaucgccauucuguagucuucagggucagcuguugauaaaggggcaggcu

SEQ ID NO: 644735 - RNA, 63 nt, Homo Sapiens
cagguacuccaaauugacuuugcagcaggguggcagggucaggagagucugguccugccuagc

SEQ ID NO: 644736 - RNA, 63 nt, Homo Sapiens
agugaaugccacaaaaguucuugcaagcagagucagggucaccgugcaacagcagaaagaugc

SEQ ID NO: 644737 - RNA, 63 nt, Homo Sapiens
guccuugaacccaacaguccaacaguaguuucucagggucacucgacuaaccuaucuaugaac

SEQ ID NO: 644738 - RNA, 55 nt, Homo Sapiens
cagaugucccuuugauggccgaacccagggucaccaugaccucucuguacucuag

SEQ ID NO: 644739 - RNA, 63 nt, Homo Sapiens
uguacacuuuauugaccaguaaaaauuuauucucagggucagcacuuaaucuuuuaagcaagc

SEQ ID NO: 644740 - RNA, 63 nt, Homo Sapiens
cuaaggagaugggaauaaagcccuggcacuugucagggucagcacugcuugguccaagccugg

SEQ ID NO: 644741 - RNA, 63 nt, Homo Sapiens
acuccugagauccagaccacgagaagugaccuucagggucaucaggcugucccagagaggucc

SEQ ID NO: 644742 - RNA, 63 nt, Homo Sapiens
augguaggaaauauagagagcaaguucuucugccagggucacacuguggucucugaacugacc

SEQ ID NO: 644743 - RNA, 63 nt, Homo Sapiens
ggucagguggcagcuauuccccaccaagagauucagggucacagguuuuuccccacaccucug

SEQ ID NO: 644744 - RNA, 63 nt, Homo Sapiens
cucaguuccaggccugaucuugccugucuggcucagggucaaagacagaaugguggaguguag

SEQ ID NO: 644745 - RNA, 63 nt, Homo Sapiens
uuccagcgaagaccacaggcauuccuuaggguccagggucagcaggcuccgggcucacaugug

SEQ ID NO: 644746 - RNA, 63 nt, Homo Sapiens
cccacggcuuguggcugcccuuggcuggaaguccagggucauacgacgccauugccagaauga

SEQ ID NO: 644747 - RNA, 63 nt, Homo Sapiens
cagacuauccauuccccagcugacuguggcacucagggucaaacuugccuguccccuaaaacu

SEQ ID NO: 644748 - RNA, 63 nt, Homo Sapiens
uguagggccaccccacagcuugccuuggugcagcagggucaucgcaccucuuugagccuuggc

SEQ ID NO: 644749 - RNA, 63 nt, Homo Sapiens
cuuaugagacucuuaaauauagccaugggucuacagggucaucuuauauuguccuaugcuucg

SEQ ID NO: 644750 - RNA, 63 nt, Homo Sapiens
aacaggaccggguggaagggcucucuuuuucuccagggucagagagaccuggacacaggccug

SEQ ID NO: 644751 - RNA, 63 nt, Homo Sapiens
caacacacucugccuugagcaccaagcccuacccagggucaccaaccaugugguaaguggcca

SEQ ID NO: 644752 - RNA, 63 nt, Homo Sapiens
ugcccagacuggggcggaugccuucucugcccucagggucagcaagguuggagcaagcaaagu

SEQ ID NO: 644753 - RNA, 63 nt, Homo Sapiens
gaggaggaacgguggggguguccccgagguuugcagggucaggcuuucccgggccugaaagcu

SEQ ID NO: 644754 - RNA, 63 nt, Homo Sapiens
cccugccagaggcuggagggcccaggauggggucagggucaggcugcccuggcaugagcagag

SEQ ID NO: 644755 - RNA, 63 nt, Homo Sapiens
gaacuaggccaggccugacuggggucugaagaucagggucaguguggcugugccugggaauuc

SEQ ID NO: 644756 - RNA, 63 nt, Homo Sapiens
guccaggcagcucccuccugcacacagaaugcucagggucacugaaccacugcuucucuuuug

SEQ ID NO: 644757 - RNA, 63 nt, Homo Sapiens
ugcggccugugccagagaggcugccuguacagccagggucaguuuggccccaaacagggauuc

SEQ ID NO: 644758 - RNA, 63 nt, Homo Sapiens
ugucuggaggcccagcuggguccuggccaaccccagggucacugugguuuugugcuucugguu

SEQ ID NO: 644759 - RNA, 63 nt, Homo Sapiens
cgcagccgcucagcacaggaaaggucaugaguucagggucagacggucugaggaagggaacag

SEQ ID NO: 644760 - RNA, 63 nt, Homo Sapiens
caguaugccaaccuccuggccugccacaaccuacagggucacuucauggggugagcccaggcc

SEQ ID NO: 644761 - RNA, 63 nt, Homo Sapiens
gguccagccucuauacccgucgggauaaggggccagggucagaucccuggggagguagaggca

SEQ ID NO: 644762 - RNA, 63 nt, Homo Sapiens
ccugcccugucccgaagugagaaggugccaucgcagggucaggcagcuucuggcucaagaguu

SEQ ID NO: 644763 - RNA, 63 nt, Homo Sapiens
ucuuagaauuguauauaaaaauuuauugaauaccagggucauaccacuuacgcuucaaguuuc

SEQ ID NO: 644764 - RNA, 63 nt, Homo Sapiens
uauauauuagaacaguuagaauaaaaaucuggucagggucauuuaaaauuuccccuuuuuuuc

SEQ ID NO: 644765 - RNA, 63 nt, Homo Sapiens
cagagacggggacagcccagucugcugaccucacagggucagcugggccccccuggugcuuca

SEQ ID NO: 644766 - RNA, 63 nt, Homo Sapiens
ccucuugucauuuuggccugaaggcuacaaauucagggucagcuguaugcacuaagucaaaua

SEQ ID NO: 644767 - RNA, 63 nt, Homo Sapiens
cacaagggaaccaugcuucucuuagagguuaagcagggucauuaacauccucccccagucccu

SEQ ID NO: 644768 - RNA, 63 nt, Homo Sapiens
aagggcccccagucuuuuggaauguccuggucacagggucaugucagcugccaguucucgucu

SEQ ID NO: 644769 - RNA, 63 nt, Homo Sapiens
cugcgggcccacgugguuggggcccugcccuggcagggucauccugugcucggaggccaucuc

SEQ ID NO: 644770 - RNA, 63 nt, Homo Sapiens
cagagcaggaggauucuacgaagccuuggggaucagggucagugugagcagcuaacauccuac

SEQ ID NO: 644771 - RNA, 63 nt, Homo Sapiens
guguuuucucugaacacauucuguaaacacagacagggucaaacaguacacugucagcaggga

SEQ ID NO: 644772 - RNA, 63 nt, Homo Sapiens
gagcuuuguguccccaggaaccagacagggacacagggucacuugagccacacacuucucccc

SEQ ID NO: 644773 - RNA, 63 nt, Homo Sapiens
guggucaagggauaugauuagaugggcaguaaacagggucaggauuggucuuuauuuccagua

SEQ ID NO: 644774 - RNA, 63 nt, Homo Sapiens
gaaggccuggcccacagcagugccaccaaaggccagggucacuucuugguccuguguuuuuuc

SEQ ID NO: 644775 - RNA, 63 nt, Homo Sapiens
uuuccaggcuguucccaaaucugggagauucugcagggucagcccauagccacaccaaggcuu

SEQ ID NO: 644776 - RNA, 63 nt, Homo Sapiens
ggccccaagaaggcuuccagauucaaaccauagcagggucauagagcgugggaggggacaaac

SEQ ID NO: 644777 - RNA, 63 nt, Homo Sapiens
cuccugccaugcgagggcacgcugccccugccucagggucauucauaggccauguggggagug

SEQ ID NO: 644778 - RNA, 63 nt, Homo Sapiens
gcaaggcugggaccauggcagaggcuaccugcccagggucacauaggugaaagucuagagaaa

SEQ ID NO: 644779 - RNA, 63 nt, Homo Sapiens
gaaguccccacacgcuggcucuguguacccccccagggucaccgcacguguucacacacccuc

SEQ ID NO: 644780 - RNA, 63 nt, Homo Sapiens
uuuuaacaaaagagguauguagcacucaaaacucagggucaagcauuuuacaguuuauauucc

SEQ ID NO: 644781 - RNA, 63 nt, Homo Sapiens
auuuaggacucauagccugauucucuuuuaggacagggucagggaagacuuuggaaauuuccu

SEQ ID NO: 644782 - RNA, 63 nt, Homo Sapiens
gagggggccaugaggcuggagcccuccccuccccagggucauagugcuggugaggguucgcca

SEQ ID NO: 644783 - RNA, 63 nt, Homo Sapiens
ggugcagaggccaggcagagaggggcaauacaacagggucaagagggagaaacagcagggaag

SEQ ID NO: 644784 - RNA, 63 nt, Homo Sapiens
ccuggcagcucucacuacggccaaccaggacggcagggucauccugagccgccaagguaauca

SEQ ID NO: 644785 - RNA, 63 nt, Homo Sapiens
caggcuguuggacgcagccuggguggcagagggcagggucaucacccucuagcaucagugccu

SEQ ID NO: 644786 - RNA, 63 nt, Homo Sapiens
ugaauuuucaucuaguuccccaaucgaugcucucagggucaucucggggaucacagggauccu

SEQ ID NO: 644787 - RNA, 63 nt, Homo Sapiens
caacaagaaaugaacuugcccaaggucaucugccagggucagugcugagacuguugaagcucu

SEQ ID NO: 644788 - RNA, 63 nt, Homo Sapiens
agugguggggccauggacccaugcgggggguuccagggucacacgccacauaacagacaaaaa

SEQ ID NO: 644789 - RNA, 63 nt, Homo Sapiens
ucuagaaauagcccaccaagcagcacacagggucagggucacuuuaacaugagaaggcgccaa

SEQ ID NO: 644790 - RNA, 63 nt, Homo Sapiens
gucacuucuagaaauagccccgccaacagcacacagggucaggagugguuuaacaugagaagg

SEQ ID NO: 644791 - RNA, 63 nt, Homo Sapiens
uuuuguucaugcccaaaucauuuaacuguauaucagggucaguaugcaaaauagugccagauc

SEQ ID NO: 644792 - RNA, 63 nt, Homo Sapiens
caggaggguggaugccagguaagggacacggaacagggucaccucuccagcagcugaggaaag

SEQ ID NO: 644793 - RNA, 63 nt, Homo Sapiens
gccaaagucuaugcguuccaacaguguaggcagcagggucagggaggggggguggcagguacc

SEQ ID NO: 644794 - RNA, 63 nt, Homo Sapiens
gaggcugcccccaggccugugauggggugaccccagggucaggaguggggaucugaucccaaa

SEQ ID NO: 644795 - RNA, 63 nt, Homo Sapiens
ucaaccgccagaaguggagugcaguuacccggccagggucacagaacuugugccccagaaagg

SEQ ID NO: 644796 - RNA, 63 nt, Homo Sapiens
ugcacuugaugacugcucccccuggagaacaaccagggucaucguuuugacacgccccagugc

SEQ ID NO: 644797 - RNA, 63 nt, Homo Sapiens
cuguggguuccucuucuccuggaacuauaauagcagggucagaaguuuagcauggcuaggucu

SEQ ID NO: 644798 - RNA, 63 nt, Homo Sapiens
gccuugguuggaccugcccaucucucaggcccucagggucaaguguggccacggcaggcccgc

SEQ ID NO: 644799 - RNA, 63 nt, Homo Sapiens
agugcauuauguggcguguuacugcuuacaaaacagggucaccaaggcagugaaguugggagu

SEQ ID NO: 644800 - RNA, 63 nt, Homo Sapiens
augucauaacaggcauugccaaccucacugacacagggucauaguguauaauaauauacugua

SEQ ID NO: 644801 - RNA, 63 nt, Homo Sapiens
acuuaacuguuuaccuauaaaccccauacaaagcagggucauaauuugugaucugugguggau

SEQ ID NO: 644802 - RNA, 63 nt, Homo Sapiens
caaauugugacagagcugagugcuccuaucuuacagggucaaugaacuacuuauuaagccuua

SEQ ID NO: 644803 - RNA, 63 nt, Homo Sapiens
cauuuuaaagaagguucuuauuguguuguggaucagggucacagauuggguagcuuggacacc

SEQ ID NO: 644804 - RNA, 63 nt, Homo Sapiens
ggcauaaccuacauccuucucugauuucuucagcagggucaaaagacaguuacuagcaauggg

SEQ ID NO: 644805 - RNA, 63 nt, Homo Sapiens
ggaagcuaaggccuagaagguuaaggauguccccagggucacacagugagcggggcucagagc

SEQ ID NO: 644806 - RNA, 63 nt, Homo Sapiens
aucgcaccacuugcacugcagaggcagagguugcagggucaagagaggauggcuugagcccaa

SEQ ID NO: 644807 - RNA, 63 nt, Homo Sapiens
aucuaauuuacuguuguguucaaaguuggcauacagggucaauuuauuguaguauuuauauua

SEQ ID NO: 644808 - RNA, 63 nt, Homo Sapiens
cuaggugagcuuacacauucagggauuucuguacagggucauuucugccaggcaugcugugga

SEQ ID NO: 644809 - RNA, 63 nt, Homo Sapiens
ucucuuuaaagcaucuucagccaacaacucugacagggucagauuuucccuccucugaagcuc

SEQ ID NO: 644810 - RNA, 63 nt, Homo Sapiens
ccaugcaccugcccuggguguggaggcucccaucagggucagcccuucucaaggcaguguucc

SEQ ID NO: 644811 - RNA, 63 nt, Homo Sapiens
uggagccagacagccaagccccuuccacaucuacagggucacugucauccucaccacagccag

SEQ ID NO: 644812 - RNA, 63 nt, Homo Sapiens
aauuuguaugcucuuagagcccaacagccaaggcagggucaagaagauaaguaauaaaagagg

SEQ ID NO: 644813 - RNA, 63 nt, Homo Sapiens
ucugggagcugggcuaacaggcugacacuucggcagggucaccaggaggcacagcuaggggca

SEQ ID NO: 644814 - RNA, 63 nt, Homo Sapiens
cccccauuuccuaacucccccagugugaauucucagggucacuucugccuccucccguuuccc

SEQ ID NO: 644815 - RNA, 63 nt, Homo Sapiens
guaagggaggcuaaguggguaacagcccagcaucagggucacuguggcaacagcaggcucuag

SEQ ID NO: 644816 - RNA, 63 nt, Homo Sapiens
uguacccggccccgagauccucugcuguaacugcagggucacaggcaucccgggagaaugggc

SEQ ID NO: 644817 - RNA, 63 nt, Homo Sapiens
ucucauuuucuuugcugacuguuguauuaacagcagggucacuccaaaacaaggacaaaucuu

SEQ ID NO: 644818 - RNA, 63 nt, Homo Sapiens
acagcccuucuaauucacaagaagccugauauucagggucaaaagaaaugccugggaggaagg

SEQ ID NO: 644819 - RNA, 63 nt, Homo Sapiens
caccuccgagcaguuugggagggaugguccuaacagggucaguccuggcacuuugauuuucau

SEQ ID NO: 644820 - RNA, 63 nt, Homo Sapiens
cuuguggggccuggacaugaugagaaccugagccagggucacccugggccagcuucuggagca

SEQ ID NO: 644821 - RNA, 63 nt, Homo Sapiens
cuaccuggcuuccugcaaggccuucacgccugccagggucagcugcagcccccacucugccaa

SEQ ID NO: 644822 - RNA, 63 nt, Homo Sapiens
caguggacagaagggauuauccucagccagucgcagggucagcuuaaguuaguuagaucacuc

SEQ ID NO: 644823 - RNA, 63 nt, Homo Sapiens
uccaggccaaguagagccccgcagggccuccagcagggucagccauucacacccauccacuca

SEQ ID NO: 644824 - RNA, 63 nt, Homo Sapiens
agugucauccagggccugugucccucccgaacccagggucaaccugccuaccacaggcacuag

SEQ ID NO: 644825 - RNA, 63 nt, Homo Sapiens
cacugaaggccagcagacaggccuaggcuggggcagggucacggcuggccuuuaccugcucag

SEQ ID NO: 644826 - RNA, 63 nt, Homo Sapiens
caggccacgugugacuucuguucuuagcacugccagggucauugacuuccaucuaagcuugca

SEQ ID NO: 644827 - RNA, 63 nt, Homo Sapiens
acugggucagcgacuccaaucccagccaagggucagggucagcgguggagucugcagagugga

SEQ ID NO: 644828 - RNA, 63 nt, Homo Sapiens
ggugaaggaaagcaagcucauggccugcaaccccagggucaagcagggauacgcccaacacca

SEQ ID NO: 644829 - RNA, 63 nt, Homo Sapiens
gcugaggccugggcagggccgggccuaggggugcagggucagucucuuaggggucauccagcu

SEQ ID NO: 644830 - RNA, 63 nt, Homo Sapiens
cugcaagccugaagcuggggcugggucacagagcagggucacccucuggggcugaagccgccg

SEQ ID NO: 644831 - RNA, 63 nt, Homo Sapiens
cucaggaucucuccaagaaacuuuuuuucccuacagggucaccauagauguuuuuuaaguuuu

SEQ ID NO: 644832 - RNA, 63 nt, Homo Sapiens
gcugaggggcuguucaccaccauccucguucuccagggucaaggaaguguuuuaacaugucgu

SEQ ID NO: 644833 - RNA, 63 nt, Homo Sapiens
gcaaaggagaagcacagcuccugccagggugagcagggucaagccucuuauuccaggagaagg

SEQ ID NO: 644834 - RNA, 63 nt, Homo Sapiens
acaaauacacguauguuauaaccaucagcccgccagggucagggaaaggacucaccugacuuu

SEQ ID NO: 644835 - RNA, 63 nt, Homo Sapiens
uuuccagcauacccugccccuggaugggaaaggcagggucagggcccacugagacccaugcag

SEQ ID NO: 644836 - RNA, 63 nt, Homo Sapiens
aaaaaaaaagaaggaaaaggaauuauagacccccagggucagccaguuaagagcucuacccac

SEQ ID NO: 644837 - RNA, 63 nt, Homo Sapiens
uagccccucuccaccucaccccauguugaugcccagggucacucuugcuacccgcugggcccc

SEQ ID NO: 644838 - RNA, 63 nt, Homo Sapiens
aucgugggcauguguauagcgagagguccgggacagggucaguggcucuggccuucucaugca

SEQ ID NO: 644839 - RNA, 63 nt, Homo Sapiens
gccccaacagaagcagcaguuccaucagaauuccagggucacagccccuucagaccagcugcu

SEQ ID NO: 644840 - RNA, 63 nt, Homo Sapiens
caggacucggacacugcccuagguugacccccacagggucacgugcugaccgaaugcucauag

SEQ ID NO: 644841 - RNA, 63 nt, Homo Sapiens
cccccucccucuuguccaccgagggguguguaacagggucauaccaaccuccaggagcuagug

SEQ ID NO: 644842 - RNA, 63 nt, Homo Sapiens
uucuuuuuucuuuuuuuuuucuuguuuuaugcucagggucaauaugaucuggauccaccaaga

SEQ ID NO: 644843 - RNA, 63 nt, Homo Sapiens
gucugaacuacucagauuggaucccaugcuaagcagggucaugcugccucugcuuucuccugc

SEQ ID NO: 644844 - RNA, 63 nt, Homo Sapiens
ucccagguucuaugaccaaaugucagcucuguacagggucagacucuaugagugggccccuag

SEQ ID NO: 644845 - RNA, 63 nt, Homo Sapiens
uacagauagcuauaauaaaguaaucuuugaaaucagggucaauucgcaggaaauagauuguuc

SEQ ID NO: 644846 - RNA, 63 nt, Homo Sapiens
cugggcaaagagaagguccuugcuauuuaucuucagggucacuauuauggaaagugauuguga

SEQ ID NO: 644847 - RNA, 63 nt, Homo Sapiens
agagaccccucuguauccccagcccaaagaucccagggucaggauuuccccaauccuggcaaa

SEQ ID NO: 644848 - RNA, 63 nt, Homo Sapiens
ucccucggcugggaccucccggcacagagagagcagggucagcccaccugggagauagcaggg

SEQ ID NO: 644849 - RNA, 63 nt, Homo Sapiens
cugucuccuguaccuccuggugguaaaugugugcagggucaucgagagcacccuguugucuuc

SEQ ID NO: 644850 - RNA, 63 nt, Homo Sapiens
uggucagggagucugggaagaguggagaagaggcagggucaggccucagcaucucacauccac

SEQ ID NO: 644851 - RNA, 63 nt, Homo Sapiens
ggccuggacacugucacacucaacaucaccucucagggucagcaguucccagcgcuccucacg

SEQ ID NO: 644852 - RNA, 63 nt, Homo Sapiens
guuaaauagaguauaugcacucuuuacacuggccagggucagacaguccucuguauguacucc

SEQ ID NO: 644853 - RNA, 63 nt, Homo Sapiens
gcacaauacugggcaauucauagagcugagaagcagggucaaaguaaacuaaggguucacuuc

SEQ ID NO: 644854 - RNA, 63 nt, Homo Sapiens
gugcuccggguuuucugacaggcugugcggacgcagggucaccccugguacacacggaaaggc

SEQ ID NO: 644855 - RNA, 63 nt, Homo Sapiens
gcguccuggccuagggugccggggccugaaggucagggucacccaagcaacaaagucccgagc

SEQ ID NO: 644856 - RNA, 63 nt, Homo Sapiens
gcuaugcuggggucccaggguggccgcagcagucagggucacugugggagcccugggguggag

SEQ ID NO: 644857 - RNA, 63 nt, Homo Sapiens
gcugugacuccguggggcucagccaggcuccagcagggucagacgugcuguuaagagcaaagc

SEQ ID NO: 644858 - RNA, 63 nt, Homo Sapiens
aaacagagccccacgcagguucaccaugaaccucagggucagggaaugagccaggcacggggg

SEQ ID NO: 644859 - RNA, 63 nt, Homo Sapiens
ucccacccacagcgcuggccacagggcucccugcagggucagggaccagaccacgcccagagg

SEQ ID NO: 644860 - RNA, 63 nt, Homo Sapiens
aagugcaaugauuuuucaguucgguuggcuaaacagggucagagcugagagcgaagcagaagg

SEQ ID NO: 644861 - RNA, 63 nt, Homo Sapiens
ccuuuccuggccuugacuuccccaucugcaaaucagggucauuggcucacccuccagggcuga

SEQ ID NO: 644862 - RNA, 63 nt, Homo Sapiens
uaguuauuuuuaaauuuacaauguuauugauuacagggucauuuuuauggucauaauaaaaaa

SEQ ID NO: 644863 - RNA, 63 nt, Homo Sapiens
aaccauaccccaagagcucccaaagccugagaccagggucauuuguccccaacuccccaucug

SEQ ID NO: 644864 - RNA, 63 nt, Homo Sapiens
ugaaggggcugagggaagggggucaaaggauuccagggucauucaguguccccgccucuguag

SEQ ID NO: 644865 - RNA, 63 nt, Homo Sapiens
gcauaucacauaagaccagaaguggcccagguccagggucaguuaauuuagcggcuccacaaa

SEQ ID NO: 644866 - RNA, 63 nt, Homo Sapiens
ccuugcccuggguggcucccgcuggauggcuuccagggucacuccacuuccacuuuccaggag

SEQ ID NO: 644867 - RNA, 63 nt, Homo Sapiens
gucacagccacaacuucagaggaguuuguccaacagggucaguucaagccacuggcuguggaa

SEQ ID NO: 644868 - RNA, 63 nt, Homo Sapiens
uggaccauggugaacauguguggggaccgcagucagggucaccccugugccucacagaagagg

SEQ ID NO: 644869 - RNA, 63 nt, Homo Sapiens
cccugcaucuauuccaaggggucuuuccauagucagggucaggacccuccauccaagcccugu

SEQ ID NO: 644870 - RNA, 63 nt, Homo Sapiens
gacccucugccucuggcagcucugucuccgggccagggucaggcagagggccugccugggcag

SEQ ID NO: 644871 - RNA, 63 nt, Homo Sapiens
aagcagacagggagcccgcgcgcauaggaccaacagggucaccuuaauucccuggcgcagaua

SEQ ID NO: 644872 - RNA, 63 nt, Homo Sapiens
gcgcgcugcccgucgcgcugggccaacuacugccagggucaguaucgcgccgcgcggcuuccu

SEQ ID NO: 644873 - RNA, 53 nt, Homo Sapiens
cccgagaggacaacaggcauuuccagggucaccugucuuuucugucguucuag

SEQ ID NO: 644874 - RNA, 63 nt, Homo Sapiens
gggcaccagguugcucuggaggcggccuucacucagggucagcgagugucugaguccccggca

SEQ ID NO: 644875 - RNA, 63 nt, Homo Sapiens
ccccguggucacauggagguacuacaggaacuucagggucacuccuccuccucaccuggagag

SEQ ID NO: 644876 - RNA, 63 nt, Homo Sapiens
gcagguuaugagauccuuggcagggucaauacucagggucaguacucgggcucagaggucacu

SEQ ID NO: 644877 - RNA, 63 nt, Homo Sapiens
acucagggucagugcagguucucagaggucacucagggucaauaagcaucagggccacucggg

SEQ ID NO: 644878 - RNA, 63 nt, Homo Sapiens
agaaguucaucaaauucaaagugaaccaaauuucagggucaccauuuaguuuccuuuucccau

SEQ ID NO: 644879 - RNA, 63 nt, Homo Sapiens
cugggucggcauguggagcacacccaagccggacagggucacaggagugggccccugguguga

SEQ ID NO: 644880 - RNA, 63 nt, Homo Sapiens
guuacacucauccauguucacuuuaugcaugagcagggucacuauucuagaacauucauuccc

SEQ ID NO: 644881 - RNA, 63 nt, Homo Sapiens
cugggcaaggucccuagcuccgcuugccugccccagggucagggguggugggggcuggggggc

SEQ ID NO: 644882 - RNA, 63 nt, Homo Sapiens
ggaaagcaacuuaaaggagggccugcaagcagccagggucagagacagggcuugguucugcuu

SEQ ID NO: 644883 - RNA, 63 nt, Homo Sapiens
cagguagaugaaaacuaaacugaugccuaggcccagggucagucucagauggaagcugggccu

SEQ ID NO: 644884 - RNA, 63 nt, Homo Sapiens
ugcccaccagggggcuggugcaccugcugaccucagggucacaguugagucauuugccaguug

SEQ ID NO: 644885 - RNA, 63 nt, Homo Sapiens
gcagcccccaggaaggccuuccagaucuggcuccagggucaccaccugucacagcaauaccug

SEQ ID NO: 644886 - RNA, 63 nt, Homo Sapiens
caacagaccugaaaaugagccauggcauugggacagggucacuucugacaggggaaguggguc

SEQ ID NO: 644887 - RNA, 63 nt, Homo Sapiens
caaaaguggaccuugggagcgagucucugccuucagggucaucgauuguggcccagaucucag

SEQ ID NO: 644888 - RNA, 63 nt, Homo Sapiens
gaggacccaggacccuccaaaccagcaaccccccagggucaugcucaagaaccaagauggggg

SEQ ID NO: 644889 - RNA, 63 nt, Homo Sapiens
uauugcccccagaggccucuaauaauuuggguccagggucaccaggugaccuggccaaguagc

SEQ ID NO: 644890 - RNA, 63 nt, Homo Sapiens
agucucugguaccaaaagggagagguucgaguccagggucacacaggcgagugcuugggcaga

SEQ ID NO: 644891 - RNA, 63 nt, Homo Sapiens
aacccagaucuccaggcccacuuuaccacggagcagggucaccugagaaacccagggucucug

SEQ ID NO: 644892 - RNA, 63 nt, Homo Sapiens
aucaaaaaaugaaaagucuguauauuucucuuucagggucaugugcugaguuuugaugucaaa

SEQ ID NO: 644893 - RNA, 63 nt, Homo Sapiens
uaagagauggccuucuuggcgcuuuguucuccacagggucagggaccucaucauuaugugggg

SEQ ID NO: 644894 - RNA, 63 nt, Homo Sapiens
caggaccuguuacagcccugccccugacauucccagggucagcuccuucuuacuucccagaau

SEQ ID NO: 644895 - RNA, 63 nt, Homo Sapiens
gagccccccucacccucuugccucagggguccucagggucaggccguggaaggugcagcagug

SEQ ID NO: 644896 - RNA, 63 nt, Homo Sapiens
cuguggugaucccauaaaaggccaguccauuugcagggucaucagacagucaccuuuggccuc

SEQ ID NO: 644897 - RNA, 63 nt, Homo Sapiens
ggaggccaaauaagccgccacugcaaaaaaaaacagggucagaaaauuacuuggguggguaga

SEQ ID NO: 644898 - RNA, 63 nt, Homo Sapiens
uccccacccacccccacauuugcacaccuuccacagggucaggauggaguagcugccuugcga

SEQ ID NO: 644899 - RNA, 63 nt, Homo Sapiens
aggacgagaagagccaagguccgccuacugccacagggucaaaggagguuuucgaucagccca

SEQ ID NO: 644900 - RNA, 63 nt, Homo Sapiens
cagcgaaccugggcuccugcccaggacaggcaccagggucauggccugggaccuggacacugg

SEQ ID NO: 644901 - RNA, 63 nt, Homo Sapiens
aaugccucuguggugcuguuuggucucuagaaacagggucacuuuuuuaauguaguaaagaag

SEQ ID NO: 644902 - RNA, 63 nt, Homo Sapiens
gaugcauccugggcugugcugggcccacucuuccagggucaucggaacuucacgggucacugg

SEQ ID NO: 644903 - RNA, 63 nt, Homo Sapiens
gccauuucagcuugaccuccuuggacacacggucagggucaggcuggcucucacgcugggguu

SEQ ID NO: 644904 - RNA, 63 nt, Homo Sapiens
aacuuuuuucuuuagugaagggagcccggggagcagggucaugcauugaggcaagccuggaga

SEQ ID NO: 644905 - RNA, 63 nt, Homo Sapiens
aacuuuuucuucuuugcaaaggagccaagggagcagggucauuaggccaggcaagcauggaca

SEQ ID NO: 644906 - RNA, 63 nt, Homo Sapiens
cuggggagggugaggcagggcagggacagucuccagggucagucccuggaugggugguuaccu

SEQ ID NO: 644907 - RNA, 63 nt, Homo Sapiens
cgcauuaguuuuggcgcaagcgagccuaugcugcagggucacuuuuggcuggucagagaagga

SEQ ID NO: 644908 - RNA, 63 nt, Homo Sapiens
acuuggagccaacaguaacuugccaccuuaaggcagggucauccccgggccaggaggaugagg

SEQ ID NO: 644909 - RNA, 63 nt, Homo Sapiens
uggaguuuuugguauuaauauccugggccuguccagggucaaaucauugugaagaaucccgaa

SEQ ID NO: 644910 - RNA, 63 nt, Homo Sapiens
uugcaucuuggagccacauggagaguuauuucucagggucauguugccuuccauuaggcuccu

SEQ ID NO: 644911 - RNA, 63 nt, Homo Sapiens
gcaagaguucucauuuccuauggagcacguggucagggucaaucacucgcugcuugaaaguac

SEQ ID NO: 644912 - RNA, 63 nt, Homo Sapiens
gacucgugacuccuagcucuaaaaucacuuggccagggucaagauaguaaacuaagagccaug

SEQ ID NO: 644913 - RNA, 62 nt, Homo Sapiens
cucugcucagcaccccagccggggcucuggacccaggguaacagccccaguucaucccaacc

SEQ ID NO: 644914 - RNA, 62 nt, Homo Sapiens
cagaggacugagggaauccuguacaggaugucccaggguagauggggagcaggauugggacc

SEQ ID NO: 644915 - RNA, 62 nt, Homo Sapiens
gucugaaagagcagugggaugggagcuggugaccaggguaccccaggaggcaugaugugccg

SEQ ID NO: 644916 - RNA, 62 nt, Homo Sapiens
ccucucacacugaccuccccccuuacggcccaccaggguauguaaauaucucuuuucuacca

SEQ ID NO: 644917 - RNA, 62 nt, Homo Sapiens
aaagaggcccacaccuugauauccaggccauaccaggguaucccuugucccuucacccccau

SEQ ID NO: 644918 - RNA, 62 nt, Homo Sapiens
uauaugcugaauguucugcuguugcaaacuugccaggguauuagccaguguuugugccaagc

SEQ ID NO: 644919 - RNA, 62 nt, Homo Sapiens
ccgaugucuggcuccccugcaggagggaggcuccaggguaagacagggcuggcaggagcaga

SEQ ID NO: 644920 - RNA, 62 nt, Homo Sapiens
cucccuccccgcaacccugccccaccuugcauccaggguaugguguaaauaaaccuguguug

SEQ ID NO: 644921 - RNA, 62 nt, Homo Sapiens
ucaguauuucuucuacuuagaaggcuuggggcccaggguaaugaggcaccagaugaagauaa

SEQ ID NO: 644922 - RNA, 55 nt, Homo Sapiens
cuaccuggccguccaaauagaucccccaggguaccacggaggcgaaggaguugga

SEQ ID NO: 644923 - RNA, 62 nt, Homo Sapiens
guuuccucaucccauuuacaguuuuucuaacuccaggguaguguuuaguguuaauauuuggg

SEQ ID NO: 644924 - RNA, 62 nt, Homo Sapiens
guguaacucagacugaccugcccuccagguguccaggguaaacuccuggccuugaucccugc

SEQ ID NO: 644925 - RNA, 62 nt, Homo Sapiens
aguaacaugacaaacggcugacuuuuuaaaagccaggguagccuaaaguccugcucccuguc

SEQ ID NO: 644926 - RNA, 62 nt, Homo Sapiens
ggggcuggccuggcauuaguuccauacccaccccaggguaaccggaggggagcccagggcca

SEQ ID NO: 644927 - RNA, 62 nt, Homo Sapiens
uaggaaggcagaacaagacaguucuggcccuuccaggguaauaguauucucagguguucuuc

SEQ ID NO: 644928 - RNA, 62 nt, Homo Sapiens
gaggaagaugccuguucucccuguuggaaauuccaggguaagucagcacuuuuuggugggaa

SEQ ID NO: 644929 - RNA, 62 nt, Homo Sapiens
aagaauuagagguuaaugcaaugcuuucuuggccaggguaguggaaagcgcaggaggugaaa

SEQ ID NO: 644930 - RNA, 62 nt, Homo Sapiens
auuccaacuuguccaaaagcuuuuggagacuaccaggguaaguuaaaaaaaaaaaaaaaaga

SEQ ID NO: 644931 - RNA, 62 nt, Homo Sapiens
cucuucuccauucccuccacagcccucagaucccaggguacacagucuaguccuggggguaa

SEQ ID NO: 644932 - RNA, 62 nt, Homo Sapiens
ggaagaagccccguuuccagggcauccgcagcccaggguagggagaaauauucucuccacuu

SEQ ID NO: 644933 - RNA, 62 nt, Homo Sapiens
cccugcugcccaccccucugagccuuuucuccccaggguauggcuccugcugaguuucuugu

SEQ ID NO: 644934 - RNA, 62 nt, Homo Sapiens
ccagcaccaccucagagacacuguucccugcuccaggguagaccugagaugaaccucccugg

SEQ ID NO: 644935 - RNA, 62 nt, Homo Sapiens
uucuaagauaagccuuaaaccugguuguuccuccaggguacucucauuuagaaauaaaucau

SEQ ID NO: 644936 - RNA, 62 nt, Homo Sapiens
gacggcccugcuaggccccaggcccugccucuccaggguauaagcucuaaagggagaaguca

SEQ ID NO: 644937 - RNA, 62 nt, Homo Sapiens
ucuguggcccuuagacaguguuagaaaacaccccaggguaggucugcaauacuuuaaaacau

SEQ ID NO: 644938 - RNA, 62 nt, Homo Sapiens
aauaauaagguugaaucauuaaacucugucuuccaggguaaauuuucauuacauacuuguuu

SEQ ID NO: 644939 - RNA, 62 nt, Homo Sapiens
acccuauuaagcauuaauuucccagauccuuuccaggguaccgaccagaaauucuaccacuu

SEQ ID NO: 644940 - RNA, 62 nt, Homo Sapiens
ugacccuugggcuggcaggggcagugacccuuccaggguaccacugagggaagggccugggu

SEQ ID NO: 644941 - RNA, 62 nt, Homo Sapiens
gguguacgaugucaagauggauucuuugagagccaggguagaucauaugacugccuuucugu

SEQ ID NO: 644942 - RNA, 62 nt, Homo Sapiens
cuguuuucuucucuuuucacuuuuuguuucuaccaggguagaggccauguugaacuggccuc

SEQ ID NO: 644943 - RNA, 62 nt, Homo Sapiens
agggcccaggagugggagcccaggcccucccuccaggguagagaugcaccgaauggaaauug

SEQ ID NO: 644944 - RNA, 62 nt, Homo Sapiens
gucaguuggguacagcaggacacgccaccauuccaggguagcugguaccgccagaaacagga

SEQ ID NO: 644945 - RNA, 62 nt, Homo Sapiens
ugcucaaacacaccagagggggcaggcaccagccaggguaugauggcuacuacccuuuucug

SEQ ID NO: 644946 - RNA, 62 nt, Homo Sapiens
gggcucauuuugguuauucuacugccucuaggccaggguaguccuaacacagccugacauag

SEQ ID NO: 644947 - RNA, 62 nt, Homo Sapiens
uggcagccuacucuccuugaguguaugaguagccaggguaagggguaaaaggauaguaagca

SEQ ID NO: 644948 - RNA, 62 nt, Homo Sapiens
uuuccuauuugaaacagugggguggaagucucccaggguaggaucagguccuucugcacuuu

SEQ ID NO: 644949 - RNA, 62 nt, Homo Sapiens
cugaagaucgaagccuguguuuucuacugaauccaggguauuaaaacuucauuuaaaagguu

SEQ ID NO: 644950 - RNA, 62 nt, Homo Sapiens
ugcugguaauaucgggaaagauuuuaaugaaaccaggguagaauuguuuggcaaugcacuga

SEQ ID NO: 644951 - RNA, 62 nt, Homo Sapiens
cugcggggaggacccgggaccacagcugcuggccaggguagacuuggagcuguccuccagag

SEQ ID NO: 644952 - RNA, 62 nt, Homo Sapiens
cugacacgucuacauaacugcccuguuguccuccaggguaagagcgagcuuaauugcguaau

SEQ ID NO: 644953 - RNA, 62 nt, Homo Sapiens
ugggaaggggaaggguauuagccaguugaaggccaggguauuaugggaccauguuagcugau

SEQ ID NO: 644954 - RNA, 62 nt, Homo Sapiens
augguagcuucauccaauauagaguucgggacccaggguaaauugcaaaacagaaguaaaua

SEQ ID NO: 644955 - RNA, 62 nt, Homo Sapiens
auuauagaauauuauucucguggcucauagggccaggguauuuauguccuaauauaaaguac

SEQ ID NO: 644956 - RNA, 62 nt, Homo Sapiens
gggguauaccugggaggauccagcaguaauccccaggguacuaggauuacuaguacucugau

SEQ ID NO: 644957 - RNA, 62 nt, Homo Sapiens
gccaacaguaccaaaagugauuuuugagugugccaggguaaaggcuuccaguucagccucag

SEQ ID NO: 644958 - RNA, 62 nt, Homo Sapiens
ccccucagcucucccucacaccucccuucaucccaggguauccaccugcaccccacucccaa

SEQ ID NO: 644959 - RNA, 62 nt, Homo Sapiens
auugagggaugcugggcacugcugccggguggccaggguauggggcaugugcccagcaaugu

SEQ ID NO: 644960 - RNA, 62 nt, Homo Sapiens
caaucaaugucacaugaacaaacaagcugcccccaggguaccauuuggggaggggaaaucuu

SEQ ID NO: 644961 - RNA, 62 nt, Homo Sapiens
cugcauagcauuguauauucaugagucagucaccaggguauuccuuuuagacuuccaucuga

SEQ ID NO: 644962 - RNA, 62 nt, Homo Sapiens
uuuaaagaagacccuuggagguuaacugaguaccaggguacccuagcugccugggaggaauu

SEQ ID NO: 644963 - RNA, 62 nt, Homo Sapiens
guguauguugacuuuuuaaaauucugagugauccaggguaugaccuagggaaugaacuagcu

SEQ ID NO: 644964 - RNA, 62 nt, Homo Sapiens
uggaggcuggggugcuggggcuugggguggccccaggguagguaacagucuuaggacuuagc

SEQ ID NO: 644965 - RNA, 62 nt, Homo Sapiens
acuggccaccuagagcccuuggcugugguaauccaggguaauugcgcagaggcaucugaugu

SEQ ID NO: 644966 - RNA, 62 nt, Homo Sapiens
auuucaguggaaauacaaaaccacuucagagaccaggguaucuccucuggaaggaucuaaga

SEQ ID NO: 644967 - RNA, 62 nt, Homo Sapiens
agaaauguaaccaaaaaaauguuaaguguucaccaggguauuaaaauacagaggaguauggu

SEQ ID NO: 644968 - RNA, 62 nt, Homo Sapiens
cauggacucuacucuccuucgaccccagaaacccaggguagaugcugacuuucaggucccug

SEQ ID NO: 644969 - RNA, 62 nt, Homo Sapiens
gucuccccagggcuccucccucuggaaggccaccaggguagggcgaccucgguucugugggc

SEQ ID NO: 644970 - RNA, 62 nt, Homo Sapiens
aaucaucuuggaggaaccauaagaaaagguguccaggguaucuauauaaagaggguuaaauu

SEQ ID NO: 644971 - RNA, 62 nt, Homo Sapiens
cccaaggcagcuacugccccuaacccuucccaccaggguagcuuugggcacugcagcucugg

SEQ ID NO: 644972 - RNA, 62 nt, Homo Sapiens
ggaagggguugcuaggggguggggacggcuaaccaggguaagaauguucagggggcugccca

SEQ ID NO: 644973 - RNA, 62 nt, Homo Sapiens
uggcuagaauuauucagacgauuuggcagcguccaggguaagcugguguuauaauacgcugc

SEQ ID NO: 644974 - RNA, 62 nt, Homo Sapiens
aauguuggucauuuuauguuaagggaagaauuccaggguauggccauggaguguacaaguau

SEQ ID NO: 644975 - RNA, 62 nt, Homo Sapiens
guucccuuuucugaguggauuucaagcauuugccaggguaugcuggaggagggacuccuaaa

SEQ ID NO: 644976 - RNA, 62 nt, Homo Sapiens
ugccguagacacaaagaagggaacaauagacaccaggguauacuugaggguggaggguggca

SEQ ID NO: 644977 - RNA, 62 nt, Homo Sapiens
ugcaugcacuggcauuugaaccugcuguaaagccaggguagcuauccuugccauuuauguuu

SEQ ID NO: 644978 - RNA, 62 nt, Homo Sapiens
uguggcagccuuugccauauuguuuuucucauccaggguauacagaauuuaauuucucgagc

SEQ ID NO: 644979 - RNA, 62 nt, Homo Sapiens
uauauaaagaggguuaaauuaagaaaaaguguccaggguaucaaucaucuuggaggaaccau

SEQ ID NO: 644980 - RNA, 62 nt, Homo Sapiens
aaugggaucgguggagagccgugagaccugguccaggguaaggugacuuccccaagccgcag

SEQ ID NO: 644981 - RNA, 62 nt, Homo Sapiens
ugaauauauagaaaucugugccuggccggaguccaggguaaauuaguagcaugguguuagau

SEQ ID NO: 644982 - RNA, 62 nt, Homo Sapiens
ggaccguggacaggcccagcgcggccagcgucccaggguacccgccugagcuccugcugcgg

SEQ ID NO: 644983 - RNA, 62 nt, Homo Sapiens
uaaaaggacuuugcaaccaaaugaccaaagacccaggguaccuugccaacucccuguuucua

SEQ ID NO: 644984 - RNA, 62 nt, Homo Sapiens
ggggggcaaugcuaugauuauguagcaggauaccaggguacuccaaauggugugaugcuccu

SEQ ID NO: 644985 - RNA, 62 nt, Homo Sapiens
auucaaucagagcuccaguuaucaaguucuccccaggguagacuugguaccuguggguuagc

SEQ ID NO: 644986 - RNA, 62 nt, Homo Sapiens
cauggccggguaaagcaaggacgcuccaaaccccaggguagcgcucccuucccuccauagcc

SEQ ID NO: 644987 - RNA, 62 nt, Homo Sapiens
gaguguugaaauucaauaccgcagcugugcgaccaggguagauuguuuacagcuuuucuaga

SEQ ID NO: 644988 - RNA, 62 nt, Homo Sapiens
cuguacaucucuacuuauuuggugucucauacccaggguaauguaaagaagguuuacuuuuu

SEQ ID NO: 644989 - RNA, 62 nt, Homo Sapiens
ccgccugccaguccuagcugccuccugucuucccaggguagccaagcugggccccagcccac

SEQ ID NO: 644990 - RNA, 62 nt, Homo Sapiens
auuuaaaaacaagaacagccaaggguuguucgccaggguaggaugugucuuaaagauugguc

SEQ ID NO: 644991 - RNA, 62 nt, Homo Sapiens
aucaauguuacaaaauuuaauauggacuaaauccaggguaaauaagucuguacauugacgug

SEQ ID NO: 644992 - RNA, 62 nt, Homo Sapiens
cagauucugggguuuuucauucauuaagaaauccaggguauuacagauuuuaaaugccaugu

SEQ ID NO: 644993 - RNA, 62 nt, Homo Sapiens
aguguuuuucuagcaagaaucucucuaggucuccaggguaggagcagcuccucucaagcuca

SEQ ID NO: 644994 - RNA, 62 nt, Homo Sapiens
ugcuuuaaaaccgacccgcacaccuucacucuccaggguacaaucaguauaccuaucugcug

SEQ ID NO: 644995 - RNA, 62 nt, Homo Sapiens
ccagacuccaguuucauccuccaccugccagcccaggguaccgccagcugggcgccuuccuc

SEQ ID NO: 644996 - RNA, 62 nt, Homo Sapiens
agggggcaccugaggagcagcugagcgcgcccccaggguagucuccgcccaggcaugguagc

SEQ ID NO: 644997 - RNA, 62 nt, Homo Sapiens
aguccugaaauaaagugaugggcuuugcaaauccaggguagaggcccuaacaggcacagaga

SEQ ID NO: 644998 - RNA, 62 nt, Homo Sapiens
guccuguagguuuauuuuggaagggacuguggccaggguaguucucagguugugcuagagca

SEQ ID NO: 644999 - RNA, 62 nt, Homo Sapiens
uucggcagcggcggcagcgcacagccguugcaccaggguacugcagccggggccgcgugcgc

SEQ ID NO: 645000 - RNA, 62 nt, Homo Sapiens
ccuccuuccccuuugccaacaaggccugaaggccaggguagauuggggggugggacaaugaa

SEQ ID NO: 645001 - RNA, 62 nt, Homo Sapiens
uccugccagcacccagcaacuuggcaaagcaaccaggguaggggagaaccacgagagaagca

SEQ ID NO: 645002 - RNA, 62 nt, Homo Sapiens
uuacacuuaaugcuagggagaaauagucaaacccaggguaguccuguuaaaaggaggaggca

SEQ ID NO: 645003 - RNA, 62 nt, Homo Sapiens
caugaaagaaggcucagagaaccccauuuuucccaggguaauuuggcacaaagcaugaagaa

SEQ ID NO: 645004 - RNA, 62 nt, Homo Sapiens
agggguucucccugccccccucacccacucauccaggguaggcacguucucuagcucuccag

SEQ ID NO: 645005 - RNA, 62 nt, Homo Sapiens
cgccagaggacaaggaagugggggccgcuggcccaggguaggggaggguggggcaaugggga

SEQ ID NO: 645006 - RNA, 62 nt, Homo Sapiens
ccauuuccuaugugccaagcugugccagcaguccaggguacccugacugucccucuguagac

SEQ ID NO: 645007 - RNA, 62 nt, Homo Sapiens
agggagcccuuuccucgguucuggccuccagaccaggguaagggcaggccccuccaacaggu

SEQ ID NO: 645008 - RNA, 62 nt, Homo Sapiens
aggucugcccgacccaugucuaugcucuacccccaggguagcaucucagcuuccgaacccug

SEQ ID NO: 645009 - RNA, 62 nt, Homo Sapiens
guggacacugcuggcuugcgggcagucggucuccaggguaccuguugucucuuuuccgaugu

SEQ ID NO: 645010 - RNA, 62 nt, Homo Sapiens
aauuauuguuaaacauaucauaacuaaucauaccaggguacugcaauaccacuguuuauaag

SEQ ID NO: 645011 - RNA, 62 nt, Homo Sapiens
cuuuuuccaucccuagccauucccccaaagaaccaggguauuauaaagcuccuuuggcagaa

SEQ ID NO: 645012 - RNA, 62 nt, Homo Sapiens
caauuuaaguugccacuuauuauuuuccuaaaccaggguacaucauaaguugcaaauauuac

SEQ ID NO: 645013 - RNA, 62 nt, Homo Sapiens
acaugucacaggcggccuuauccaguuggaggccaggguaccaaacuauaaaugcaguugug

SEQ ID NO: 645014 - RNA, 62 nt, Homo Sapiens
ccucuaauaaccuuuaucuagaacaaauggauccaggguauacagcauaugugccauaaaca

SEQ ID NO: 645015 - RNA, 62 nt, Homo Sapiens
cuccaccccagcugccaagcguggcuggaucuccaggguaccucagaaagggacuguucugg

SEQ ID NO: 645016 - RNA, 62 nt, Homo Sapiens
aggugccagggaaguuguggggccucagccacccaggguaaaaggagcgccucaucuuccca

SEQ ID NO: 645017 - RNA, 62 nt, Homo Sapiens
uguggguugccaggcuggggcugcccccuuucccaggguaucaguauuacggugccucuucu

SEQ ID NO: 645018 - RNA, 62 nt, Homo Sapiens
gaauaagucuaggaaaggggggagucaggugcccaggguaggucugccccaccccuacucaa

SEQ ID NO: 645019 - RNA, 62 nt, Homo Sapiens
ggauguggucucuacacuaaccuucuugauguccaggguagauaaagggucgaaucucucug

SEQ ID NO: 645020 - RNA, 62 nt, Homo Sapiens
aaacuagucucaugaagaauucuggcgugcagccaggguagcugaaguuugggucugggacu

SEQ ID NO: 645021 - RNA, 62 nt, Homo Sapiens
cagguuuugcccaaggcuuugauaccugucacccaggguaucuuaaaagcaaguuguucucc

SEQ ID NO: 645022 - RNA, 62 nt, Homo Sapiens
ucugcaccucuuccucagcugcuccagaccggccaggguaaccagcuaaccaugccuggcau

SEQ ID NO: 645023 - RNA, 62 nt, Homo Sapiens
cagcaggcuugaagcaggguaagcaggcuggcccaggguaagggcuguugagguaccuuaag

SEQ ID NO: 645024 - RNA, 62 nt, Homo Sapiens
cugcuuuugugaagcaacuauuuauuugaagaccaggguaugggcacuuuugccuucucucc

SEQ ID NO: 645025 - RNA, 62 nt, Homo Sapiens
aacaggaauuguuuugauaguuuauccccaucccaggguauauccuuaauuagacuaauuau

SEQ ID NO: 645026 - RNA, 62 nt, Homo Sapiens
uuuguuagguuuucuauguggaaaggacugaaccaggguauuuccuaggaacaauggaagaa

SEQ ID NO: 645027 - RNA, 62 nt, Homo Sapiens
uguaugauuuuguuaccagcuuguuuuugaagccaggguaguuuaaugugcauuacccuauc

SEQ ID NO: 645028 - RNA, 62 nt, Homo Sapiens
uucauaccagacuauuugcagggaccucagacccaggguauuucaggagcaggaacagccag

SEQ ID NO: 645029 - RNA, 62 nt, Homo Sapiens
cuucaguuggcccugauucaguuugacuuuugccaggguaauucaaaacucuuaaaucagua

SEQ ID NO: 645030 - RNA, 62 nt, Homo Sapiens
ccuuauuucacugaagaugaaaaaaagcuaauccaggguaccuuugacuuuuuggcuuuaag

SEQ ID NO: 645031 - RNA, 62 nt, Homo Sapiens
aaggcaacccuauuucuacuguuucucucuugccaggguauuaggaaggacaggaaaaguag

SEQ ID NO: 645032 - RNA, 62 nt, Homo Sapiens
auugauuuaugauggaaaacgauauguuucauccaggguaucucuccgaauuagcauuucug

SEQ ID NO: 645033 - RNA, 62 nt, Homo Sapiens
gaaaggaaccgagaaagaaacaacacacuaaaccaggguagggcugaugcaaaaggauuuuu

SEQ ID NO: 645034 - RNA, 62 nt, Homo Sapiens
gaaguccuccugugccagggaauuuacuaucuccaggguagcacauucccuguguagacggu

SEQ ID NO: 645035 - RNA, 62 nt, Homo Sapiens
gagacaaaucggugugccauugacaacaugagccaggguaaaggcacccuuuggaauuacug

SEQ ID NO: 645036 - RNA, 62 nt, Homo Sapiens
gaucaaaaggauauauugacaguuaucuauagccaggguaguuguuaauaccugcuuguuug

SEQ ID NO: 645037 - RNA, 51 nt, Homo Sapiens
gagggaccuccugccuacucgccaggguagguuuccaucucagaugacuaa

SEQ ID NO: 645038 - RNA, 62 nt, Homo Sapiens
gcuuacagugacuacuauuagaaauaucauugccaggguauguuccugaauucuuuaaauau

SEQ ID NO: 645039 - RNA, 62 nt, Homo Sapiens
auucucuuucagagaugcucaucuuuggaaauccaggguaauuggucauccuguuagaguac

SEQ ID NO: 645040 - RNA, 62 nt, Homo Sapiens
ugcccuugcucucuaacuucugagcccaccucccaggguaggcaccugggggcaugcaggug

SEQ ID NO: 645041 - RNA, 62 nt, Homo Sapiens
uaggcaccugggggcaugcaggugcccaccucccaggguaggcaccugggggcaugcaggua

SEQ ID NO: 645042 - RNA, 62 nt, Homo Sapiens
guucugggcuccaggggagggagcuggggaggccaggguauaagaaaagcaucagaacucuc

SEQ ID NO: 645043 - RNA, 62 nt, Homo Sapiens
uccucgcuggccuugccagagguugagccgccccaggguaugaggagaugaauaacuccaca

SEQ ID NO: 645044 - RNA, 62 nt, Homo Sapiens
ugcccuggggucugggcacuuuuuguucauccccaggguagcgacccagugagaauguagca

SEQ ID NO: 645045 - RNA, 62 nt, Homo Sapiens
gcuccccugaguguauaugauaagcuauguguccaggguauuguuuguucacuaaugugaaa

SEQ ID NO: 645046 - RNA, 62 nt, Homo Sapiens
acagcccuggaaaacaguagaaccagcaauggccaggguacaggagagaaauaaggggaugu

SEQ ID NO: 645047 - RNA, 62 nt, Homo Sapiens
cuccuacaugggucaugacugggcugucaaaaccaggguaacuccugcccuggagcugguuu

SEQ ID NO: 645048 - RNA, 62 nt, Homo Sapiens
cuguggccaccucccgggcuguccgagggaccccaggguaccucacacucggagcucgccug

SEQ ID NO: 645049 - RNA, 62 nt, Homo Sapiens
ugggaaaacggaccgcucuuggcuccugacucccaggguacagcgcccaguaacucauccuu

SEQ ID NO: 645050 - RNA, 62 nt, Homo Sapiens
ggguaaaauaggucugcaagcuuuauauuugcccaggguaucauucauucuucagguguuga

SEQ ID NO: 645051 - RNA, 62 nt, Homo Sapiens
uucuucgagucggagagcuacaaggacagcguccaggguagggugagagggggaccaugagu

SEQ ID NO: 645052 - RNA, 62 nt, Homo Sapiens
uccuacgguaccucuucagacgguccccuugcccaggguaucccaaagcucagcccucuggg

SEQ ID NO: 645053 - RNA, 62 nt, Homo Sapiens
ugaggcacuguugaagaaaucucacuuuucagccaggguacugguucugguacauauggauc

SEQ ID NO: 645054 - RNA, 62 nt, Homo Sapiens
accugccccugccgccugugcccuugcuggguccaggguaggcaaggcugccggcugcaccc

SEQ ID NO: 645055 - RNA, 62 nt, Homo Sapiens
aacaacuguccccucacccaccagcuauuuccccaggguagagugggcaauucucaccuuca

SEQ ID NO: 645056 - RNA, 62 nt, Homo Sapiens
ugucccuguuucaguugcacugggguuggagcccaggguagggguuuccagcuuccccaggc

SEQ ID NO: 645057 - RNA, 62 nt, Homo Sapiens
caguguagccccaagaaggcuggggcuauuuaccaggguagaaaaaggagcuuaccucccac

SEQ ID NO: 645058 - RNA, 62 nt, Homo Sapiens
ugccaggaggaugacaaaaauguuccuguguuccaggguaaugccagguggguuuugagagc

SEQ ID NO: 645059 - RNA, 62 nt, Homo Sapiens
agcccagagggucugggggcacaagacugacgccaggguaugaagaguguuauuuucauuca

SEQ ID NO: 645060 - RNA, 62 nt, Homo Sapiens
gggagccucucuccuuccccuccacccuacccccaggguaaggucauacccccucccucuug

SEQ ID NO: 645061 - RNA, 62 nt, Homo Sapiens
ucagguuggcccaguuugggcucuugcgucuuccaggguagcucccugggauagagugagcc

SEQ ID NO: 645062 - RNA, 62 nt, Homo Sapiens
ccucacagcgccaucaccaagugggaacugcaccaggguacugcaggauuaacuugaccaug

SEQ ID NO: 645063 - RNA, 62 nt, Homo Sapiens
ugcccacgaaagcccagucccauacccccuucccaggguaaggaacacuucuccagccaccu

SEQ ID NO: 645064 - RNA, 62 nt, Homo Sapiens
gugaauggggaggcugggagugcauguggaggccaggguaagggccugagguaugggguaug

SEQ ID NO: 645065 - RNA, 62 nt, Homo Sapiens
gcaaaggagacaaagcaggacgggcaggggagccaggguagauguguaaauauuuuucccuc

SEQ ID NO: 645066 - RNA, 62 nt, Homo Sapiens
aggagcuuccugcuuugcacgggaggcccugcccaggguagggugagaaagagagcaggcuc

SEQ ID NO: 645067 - RNA, 62 nt, Homo Sapiens
aagcagcagcucugcuggacucaaggggaaauccaggguaggcauagguggcccauucagcc

SEQ ID NO: 645068 - RNA, 62 nt, Homo Sapiens
cccacgugcaccauaccuggggaguuccugguccaggguauccuggggccacccucccugcc

SEQ ID NO: 645069 - RNA, 62 nt, Homo Sapiens
ucuucucugccucucaccaggacagccgccccccaggguacuccugcccuugcuugacucag

SEQ ID NO: 645070 - RNA, 62 nt, Homo Sapiens
uuuuuaguagagacgggguuucaccauguuggccaggguagucuugaacuccugacuucaaa

SEQ ID NO: 645071 - RNA, 62 nt, Homo Sapiens
cuagccagcuguggacacauaggaaugcuggaccaggguaccagauuuuuucaacaaagggg

SEQ ID NO: 645072 - RNA, 62 nt, Homo Sapiens
gguggcuuauaacuguaagggagauggcagccccaggguacagccagcaggcauugagcagc

SEQ ID NO: 645073 - RNA, 62 nt, Homo Sapiens
cucacacccugcuaccacccuaacguggacacccaggguaacauaugccuggacauccugaa

SEQ ID NO: 645074 - RNA, 62 nt, Homo Sapiens
ugcccccugcccucgaaucccugaaagagggaccaggguagaccccuuuuucauucccugug

SEQ ID NO: 645075 - RNA, 62 nt, Homo Sapiens
guuuuuaaaaucuccaguggccauaaaacuagccaggguagcucaugcuuuuacugguugga

SEQ ID NO: 645076 - RNA, 62 nt, Homo Sapiens
augccuggcgugagagccagcagacagccaggccaggguaggcagugccugcuucugcucca

SEQ ID NO: 645077 - RNA, 62 nt, Homo Sapiens
gugcaccagcugcacuggcuucccccucagcaccaggguaccaggugagccagaggccugag

SEQ ID NO: 645078 - RNA, 62 nt, Homo Sapiens
ccuggcaugagggguuaggucucagcaccugcccaggguagguuccuggcgcccugaggugg

SEQ ID NO: 645079 - RNA, 62 nt, Homo Sapiens
ggguaggggugggggugggccaucggggguccccaggguaugagguugaggugggggccuug

SEQ ID NO: 645080 - RNA, 62 nt, Homo Sapiens
cuugagagaguucacauucccaugcuugaaggccaggguagaagcggucaaggcaaggaugu

SEQ ID NO: 645081 - RNA, 62 nt, Homo Sapiens
augucucaggcaagcaaaagccuuguaaaaggccaggguaaaagucaaaagauaaauugggg

SEQ ID NO: 645082 - RNA, 62 nt, Homo Sapiens
gugaacaauauggagagagaccugggaaaaguccaggguagcuugcccaggggaagacagca

SEQ ID NO: 645083 - RNA, 62 nt, Homo Sapiens
agugguggcaucuucaccugaauucuucaaugccaggguaauaaaccaaaauaguccuaauc

SEQ ID NO: 645084 - RNA, 62 nt, Homo Sapiens
cugucgccucagucugcgcacaggcaugcaccccaggguagugccugcagggaugcaugugu

SEQ ID NO: 645085 - RNA, 62 nt, Homo Sapiens
guccacacaccuguaggccucugagccagcguccaggguacaggugcgggugguggggauga

SEQ ID NO: 645086 - RNA, 62 nt, Homo Sapiens
guggggcgugguguuuagacacagauaggaguccaggguaugacugauggaggccccggccc

SEQ ID NO: 645087 - RNA, 62 nt, Homo Sapiens
cucucagcucucgggccagugcucugcucuguccaggguagguaauacugggagacuccugu

SEQ ID NO: 645088 - RNA, 62 nt, Homo Sapiens
ccucaucagccucugccuugucccacugagguccaggguagcucggggcagggguggggcag

SEQ ID NO: 645089 - RNA, 62 nt, Homo Sapiens
ggcugacggcgcaagaccagagccuggggaggccaggguagacaaccucugagccaucccag

SEQ ID NO: 645090 - RNA, 62 nt, Homo Sapiens
gaaugaaggguauggaaguaucucuggacacuccaggguagaacguaccuugaaacucucua

SEQ ID NO: 645091 - RNA, 62 nt, Homo Sapiens
gagaccuagaccugucuuuguuccacauucucccaggguaugccagugccccugagcuugcu

SEQ ID NO: 645092 - RNA, 62 nt, Homo Sapiens
ccaaugcguggcucuccugcaggggcugggagccaggguacuggcucaagacggggugggga

SEQ ID NO: 645093 - RNA, 62 nt, Homo Sapiens
uuaaaugcuucuaauauaagaauaauaaaagcccaggguauuaguuuauuuucagaaaauaa

SEQ ID NO: 645094 - RNA, 62 nt, Homo Sapiens
acuggagaugggaguuagugcuucagugcauaccaggguaucguaccccuuugguaaguagg

SEQ ID NO: 645095 - RNA, 62 nt, Homo Sapiens
agcuggugggacacugaucuucccugaagcuuccaggguagcccuacuccaggcuccccauc

SEQ ID NO: 645096 - RNA, 62 nt, Homo Sapiens
agcuuaaggcagggcuggcacuauuuccuuggccaggguaccuuauggggccauauccuaca

SEQ ID NO: 645097 - RNA, 62 nt, Homo Sapiens
gguuugucagaggcuauugggaacagcugggcccaggguauuugcucaguaaauauuuuggg

SEQ ID NO: 645098 - RNA, 62 nt, Homo Sapiens
gacuagauauuuuugcuguuauguauacugauccaggguauauguauggcaggcugggcaga

SEQ ID NO: 645099 - RNA, 62 nt, Homo Sapiens
cuaauaggggcggcucaggcgcauucccagacccaggguacuagcugcccccauaacuggca

SEQ ID NO: 645100 - RNA, 62 nt, Homo Sapiens
ccuggacaguguccccuuuuuucaaaaaauauccaggguacuugaagaagcaacacauaagu

SEQ ID NO: 645101 - RNA, 62 nt, Homo Sapiens
cgccuccuuuucguaacacuugucacgggagcccaggguaccgggguagcccugccgcacuu

SEQ ID NO: 645102 - RNA, 63 nt, Homo Sapiens
ucucugcucagcaccccagccggggcucuggacccaggguaacagccccaguucaucccaacc

SEQ ID NO: 645103 - RNA, 63 nt, Homo Sapiens
ccagaggacugagggaauccuguacaggaugucccaggguagauggggagcaggauugggacc

SEQ ID NO: 645104 - RNA, 63 nt, Homo Sapiens
agucugaaagagcagugggaugggagcuggugaccaggguaccccaggaggcaugaugugccg

SEQ ID NO: 645105 - RNA, 63 nt, Homo Sapiens
cccucucacacugaccuccccccuuacggcccaccaggguauguaaauaucucuuuucuacca

SEQ ID NO: 645106 - RNA, 63 nt, Homo Sapiens
aaaagaggcccacaccuugauauccaggccauaccaggguaucccuugucccuucacccccau

SEQ ID NO: 645107 - RNA, 63 nt, Homo Sapiens
cuauaugcugaauguucugcuguugcaaacuugccaggguauuagccaguguuugugccaagc

SEQ ID NO: 645108 - RNA, 63 nt, Homo Sapiens
cccgaugucuggcuccccugcaggagggaggcuccaggguaagacagggcuggcaggagcaga

SEQ ID NO: 645109 - RNA, 63 nt, Homo Sapiens
ucucccuccccgcaacccugccccaccuugcauccaggguaugguguaaauaaaccuguguug

SEQ ID NO: 645110 - RNA, 63 nt, Homo Sapiens
aucaguauuucuucuacuuagaaggcuuggggcccaggguaaugaggcaccagaugaagauaa

SEQ ID NO: 645111 - RNA, 55 nt, Homo Sapiens; identical to SEQ ID NO: 644922

SEQ ID NO: 645112 - RNA, 63 nt, Homo Sapiens
aguuuccucaucccauuuacaguuuuucuaacuccaggguaguguuuaguguuaauauuuggg

SEQ ID NO: 645113 - RNA, 63 nt, Homo Sapiens
guguaacucagacugaccugccccuccagguguccaggguaaagcuccuggccuugaucccug

SEQ ID NO: 645114 - RNA, 63 nt, Homo Sapiens
aguaacaugacaaacggcugcacuuuuuaaaagccaggguagcucuaaaguccugcucccugu

SEQ ID NO: 645115 - RNA, 63 nt, Homo Sapiens
ggggcuggccuggcauuaguauccauacccaccccaggguaacacggaggggagcccagggcc

SEQ ID NO: 645116 - RNA, 63 nt, Homo Sapiens
uaggaaggcagaacaagacacguucuggcccuuccaggguaaucaguauucucagguguucuu

SEQ ID NO: 645117 - RNA, 63 nt, Homo Sapiens
gaggaagaugccuguucuccacuguuggaaauuccaggguaaguucagcacuuuuugguggga

SEQ ID NO: 645118 - RNA, 63 nt, Homo Sapiens
aagaauuagagguuaaugcaaaugcuuucuuggccaggguaguaggaaagcgcaggaggugaa

SEQ ID NO: 645119 - RNA, 63 nt, Homo Sapiens
auuccaacuuguccaaaagcauuuuggagacuaccaggguaaguuuaaaaaaaaaaaaaaaag

SEQ ID NO: 645120 - RNA, 63 nt, Homo Sapiens
cucuucuccauucccuccacaagcccucagaucccaggguacagcagucuaguccugggggua

SEQ ID NO: 645121 - RNA, 63 nt, Homo Sapiens
aggaagaagccccguuuccagggcauccgcagcccaggguagggagaaauauucucuccacuu

SEQ ID NO: 645122 - RNA, 63 nt, Homo Sapiens
ucccugcugcccaccccucugagccuuuucuccccaggguauggcuccugcugaguuucuugu

SEQ ID NO: 645123 - RNA, 63 nt, Homo Sapiens
gccagcaccaccucagagacacuguucccugcuccaggguagaccugagaugaaccucccugg

SEQ ID NO: 645124 - RNA, 63 nt, Homo Sapiens
uucuaagauaagccuuaaacucugguuguuccuccaggguacugcucauuuagaaauaaauca

SEQ ID NO: 645125 - RNA, 63 nt, Homo Sapiens
gacggcccugcuaggccccaaggcccugccucuccaggguauaaagcucuaaagggagaaguc

SEQ ID NO: 645126 - RNA, 63 nt, Homo Sapiens
ucuguggcccuuagacaguguuuagaaaacaccccaggguagguucugcaauacuuuaaaaca

SEQ ID NO: 645127 - RNA, 63 nt, Homo Sapiens
aauaauaagguugaaucauuuaaacucugucuuccaggguaaacuuuucauuacauacuuguu

SEQ ID NO: 645128 - RNA, 63 nt, Homo Sapiens
acccuauuaagcauuaauuuucccagauccuuuccaggguaccagaccagaaauucuaccacu

SEQ ID NO: 645129 - RNA, 63 nt, Homo Sapiens
augacccuugggcuggcaggggcagugacccuuccaggguaccacugagggaagggccugggu

SEQ ID NO: 645130 - RNA, 63 nt, Homo Sapiens
agguguacgaugucaagauggauucuuugagagccaggguagaucauaugacugccuuucugu

SEQ ID NO: 645131 - RNA, 63 nt, Homo Sapiens
ucuguuuucuucucuuuucacuuuuuguuucuaccaggguagaggccauguugaacuggccuc

SEQ ID NO: 645132 - RNA, 63 nt, Homo Sapiens
cagggcccaggagugggagcccaggcccucccuccaggguagagaugcaccgaauggaaauug

SEQ ID NO: 645133 - RNA, 63 nt, Homo Sapiens
agucaguuggguacagcaggacacgccaccauuccaggguagcugguaccgccagaaacagga

SEQ ID NO: 645134 - RNA, 63 nt, Homo Sapiens
gugcucaaacacaccagagggggcaggcaccagccaggguaugauggcuacuacccuuuucug

SEQ ID NO: 645135 - RNA, 63 nt, Homo Sapiens
agggcucauuuugguuauucuacugccucuaggccaggguaguccuaacacagccugacauag

SEQ ID NO: 645136 - RNA, 63 nt, Homo Sapiens
auggcagccuacucuccuugaguguaugaguagccaggguaagggguaaaaggauaguaagca

SEQ ID NO: 645137 - RNA, 63 nt, Homo Sapiens
uuuccuauuugaaacaguggugguggaagucucccaggguaggcaucagguccuucugcacuu

SEQ ID NO: 645138 - RNA, 63 nt, Homo Sapiens
cugaagaucgaagccuguguuuuucuacugaauccaggguauucaaaacuucauuuaaaaggu

SEQ ID NO: 645139 - RNA, 63 nt, Homo Sapiens
cugcugguaauaucgggaaagauuuuaaugaaaccaggguagaauuguuuggcaaugcacuga

SEQ ID NO: 645140 - RNA, 63 nt, Homo Sapiens
ucugcggggaggacccgggaccacagcugcuggccaggguagacuuggagcuguccuccagag

SEQ ID NO: 645141 - RNA, 63 nt, Homo Sapiens
cugacacgucuacauaacugucccuguuguccuccaggguaagcagcgagcuuaauugcguaa

SEQ ID NO: 645142 - RNA, 63 nt, Homo Sapiens
ugggaaggggaaggguauuaugccaguugaaggccaggguauucaugggaccauguuagcuga

SEQ ID NO: 645143 - RNA, 63 nt, Homo Sapiens
augguagcuucauccaauauaagaguucgggacccaggguaaacuugcaaaacagaaguaaau

SEQ ID NO: 645144 - RNA, 63 nt, Homo Sapiens
auuauagaauauuauucucgcuggcucauagggccaggguauuuuauguccuaauauaaagua

SEQ ID NO: 645145 - RNA, 63 nt, Homo Sapiens
agggguauaccugggaggauccagcaguaauccccaggguacuaggauuacuaguacucugau

SEQ ID NO: 645146 - RNA, 63 nt, Homo Sapiens
agccaacaguaccaaaagugauuuuugagugugccaggguaaaggcuuccaguucagccucag

SEQ ID NO: 645147 - RNA, 63 nt, Homo Sapiens
cccccucagcucucccucacaccucccuucaucccaggguauccaccugcaccccacucccaa

SEQ ID NO: 645148 - RNA, 63 nt, Homo Sapiens
cauugagggaugcugggcacugcugccggguggccaggguauggggcaugugcccagcaaugu

SEQ ID NO: 645149 - RNA, 63 nt, Homo Sapiens
ccaaucaaugucacaugaacaaacaagcugcccccaggguaccauuuggggaggggaaaucuu

SEQ ID NO: 645150 - RNA, 63 nt, Homo Sapiens
cugcauagcauuguauauucaaugagucagucaccaggguauucccuuuuagacuuccaucug

SEQ ID NO: 645151 - RNA, 63 nt, Homo Sapiens
uuuaaagaagacccuuggaguguuaacugaguaccaggguaccgcuagcugccugggaggaau

SEQ ID NO: 645152 - RNA, 63 nt, Homo Sapiens
uguguauguugacuuuuuaaaauucugagugauccaggguaugaccuagggaaugaacuagcu

SEQ ID NO: 645153 - RNA, 63 nt, Homo Sapiens
cuggaggcuggggugcuggggcuugggguggccccaggguagguaacagucuuaggacuuagc

SEQ ID NO: 645154 - RNA, 63 nt, Homo Sapiens
cacuggccaccuagagcccuuggcugugguaauccaggguaauugcgcagaggcaucugaugu

SEQ ID NO: 645155 - RNA, 63 nt, Homo Sapiens
uauuucaguggaaauacaaaaccacuucagagaccaggguaucuccucuggaaggaucuaaga

SEQ ID NO: 645156 - RNA, 63 nt, Homo Sapiens
uagaaauguaaccaaaaaaauguuaaguguucaccaggguauuaaaauacagaggaguauggu

SEQ ID NO: 645157 - RNA, 63 nt, Homo Sapiens
cauggacucuacucuccuucggaccccagaaacccaggguagagugcugacuuucaggucccu

SEQ ID NO: 645158 - RNA, 63 nt, Homo Sapiens
gucuccccagggcuccuccccucuggaaggccaccaggguaggugcgaccucgguucuguggg

SEQ ID NO: 645159 - RNA, 63 nt, Homo Sapiens
uaaucaucuuggaggaaccauaagaaaagguguccaggguaucuauauaaagaggguuaaauu

SEQ ID NO: 645160 - RNA, 63 nt, Homo Sapiens
ccccaaggcagcuacugccccuaacccuucccaccaggguagcuuugggcacugcagcucugg

SEQ ID NO: 645161 - RNA, 63 nt, Homo Sapiens
gggaagggguugcuaggggguggggacggcuaaccaggguaagaauguucagggggcugccca

SEQ ID NO: 645162 - RNA, 63 nt, Homo Sapiens
auggcuagaauuauucagacgauuuggcagcguccaggguaagcugguguuauaauacgcugc

SEQ ID NO: 645163 - RNA, 63 nt, Homo Sapiens
aaauguuggucauuuuauguuaagggaagaauuccaggguauggccauggaguguacaaguau

SEQ ID NO: 645164 - RNA, 63 nt, Homo Sapiens
aguucccuuuucugaguggauuucaagcauuugccaggguaugcuggaggagggacuccuaaa

SEQ ID NO: 645165 - RNA, 63 nt, Homo Sapiens
gugccguagacacaaagaagggaacaauagacaccaggguauacuugaggguggaggguggca

SEQ ID NO: 645166 - RNA, 63 nt, Homo Sapiens
ugcaugcacuggcauuugaauccugcuguaaagccaggguagcauauccuugccauuuauguu

SEQ ID NO: 645167 - RNA, 63 nt, Homo Sapiens
uguggcagccuuugccauaucuguuuuucucauccaggguauaacagaauuuaauuucucgag

SEQ ID NO: 645168 - RNA, 63 nt, Homo Sapiens
uauauaaagaggguuaaauuuaagaaaaaguguccaggguaucuaaucaucuuggaggaacca

SEQ ID NO: 645169 - RNA, 63 nt, Homo Sapiens
aaugggaucgguggagagccggugagaccugguccaggguaagugugacuuccccaagccgca

SEQ ID NO: 645170 - RNA, 63 nt, Homo Sapiens
gugaauauauagaaaucugugccuggccggaguccaggguaaauuaguagcaugguguuagau

SEQ ID NO: 645171 - RNA, 63 nt, Homo Sapiens
uggaccguggacaggcccagcgcggccagcgucccaggguacccgccugagcuccugcugcgg

SEQ ID NO: 645172 - RNA, 63 nt, Homo Sapiens
uaaaaggacuuugcaaccaaaaugaccaaagacccaggguaccguugccaacucccuguuucu

SEQ ID NO: 645173 - RNA, 63 nt, Homo Sapiens
ggggggcaaugcuaugauuauuguagcaggauaccaggguacucccaaauggugugaugcucc

SEQ ID NO: 645174 - RNA, 63 nt, Homo Sapiens
auucaaucagagcuccaguucaucaaguucuccccaggguagaucuugguaccuguggguuag

SEQ ID NO: 645175 - RNA, 63 nt, Homo Sapiens
cauggccggguaaagcaaggcacgcuccaaaccccaggguagccgcucccuucccuccauagc

SEQ ID NO: 645176 - RNA, 63 nt, Homo Sapiens
gaguguugaaauucaauaccagcagcugugcgaccaggguagaguuguuuacagcuuuucuag

SEQ ID NO: 645177 - RNA, 63 nt, Homo Sapiens
cuguacaucucuacuuauuuuggugucucauacccaggguaauuguaaagaagguuuacuuuu

SEQ ID NO: 645178 - RNA, 63 nt, Homo Sapiens
ccgccugccaguccuagcugcccuccugucuucccaggguagcccaagcugggccccagccca

SEQ ID NO: 645179 - RNA, 63 nt, Homo Sapiens
uauuuaaaaacaagaacagccaaggguuguucgccaggguaggaugugucuuaaagauugguc

SEQ ID NO: 645180 - RNA, 63 nt, Homo Sapiens
aucaauguuacaaaauuuaaguauggacuaaauccaggguaaaauaagucuguacauugacgu

SEQ ID NO: 645181 - RNA, 63 nt, Homo Sapiens
cagauucugggguuuuucauuucauuaagaaauccaggguauuuacagauuuuaaaugccaug

SEQ ID NO: 645182 - RNA, 63 nt, Homo Sapiens
aguguuuuucuagcaagaauacucucuaggucuccaggguaggcagcagcuccucucaagcuc

SEQ ID NO: 645183 - RNA, 63 nt, Homo Sapiens
ugcuuuaaaaccgacccgcagcaccuucacucuccaggguacaaaucaguauaccuaucugcu

SEQ ID NO: 645184 - RNA, 63 nt, Homo Sapiens
ccagacuccaguuucauccucccaccugccagcccaggguaccggccagcugggcgccuuccu

SEQ ID NO: 645185 - RNA, 63 nt, Homo Sapiens
agggggcaccugaggagcagccugagcgcgcccccaggguagugcuccgcccaggcaugguag

SEQ ID NO: 645186 - RNA, 63 nt, Homo Sapiens
aaguccugaaauaaagugaugggcuuugcaaauccaggguagaggcccuaacaggcacagaga

SEQ ID NO: 645187 - RNA, 63 nt, Homo Sapiens
aguccuguagguuuauuuuggaagggacuguggccaggguaguucucagguugugcuagagca

SEQ ID NO: 645188 - RNA, 63 nt, Homo Sapiens
cuucggcagcggcggcagcgcacagccguugcaccaggguacugcagccggggccgcgugcgc

SEQ ID NO: 645189 - RNA, 63 nt, Homo Sapiens
uccuccuuccccuuugccaacaaggccugaaggccaggguagauuggggggugggacaaugaa

SEQ ID NO: 645190 - RNA, 63 nt, Homo Sapiens
guccugccagcacccagcaacuuggcaaagcaaccaggguaggggagaaccacgagagaagca

SEQ ID NO: 645191 - RNA, 63 nt, Homo Sapiens
uuacacuuaaugcuagggagaaaauagucaaacccaggguagucccuguuaaaaggaggaggc

SEQ ID NO: 645192 - RNA, 63 nt, Homo Sapiens
caugaaagaaggcucagagaaaccccauuuuucccaggguaauauuggcacaaagcaugaaga

SEQ ID NO: 645193 - RNA, 63 nt, Homo Sapiens
agggguucucccugccccccgucacccacucauccaggguaggccacguucucuagcucucca

SEQ ID NO: 645194 - RNA, 63 nt, Homo Sapiens
ccgccagaggacaaggaagugggggccgcuggcccaggguaggggaggguggggcaaugggga

SEQ ID NO: 645195 - RNA, 63 nt, Homo Sapiens
accauuuccuaugugccaagcugugccagcaguccaggguacccugacugucccucuguagac

SEQ ID NO: 645196 - RNA, 63 nt, Homo Sapiens
cagggagcccuuuccucgguucuggccuccagaccaggguaagggcaggccccuccaacaggu

SEQ ID NO: 645197 - RNA, 63 nt, Homo Sapiens
aaggucugcccgacccaugucuaugcucuacccccaggguagcaucucagcuuccgaacccug

SEQ ID NO: 645198 - RNA, 63 nt, Homo Sapiens
cguggacacugcuggcuugcgggcagucggucuccaggguaccuguugucucuuuuccgaugu

SEQ ID NO: 645199 - RNA, 63 nt, Homo Sapiens
aaauuauuguuaaacauaucauaacuaaucauaccaggguacugcaauaccacuguuuauaag

SEQ ID NO: 645200 - RNA, 63 nt, Homo Sapiens
cuuuuuccaucccuagccauaucccccaaagaaccaggguauuaauaaagcuccuuuggcaga

SEQ ID NO: 645201 - RNA, 63 nt, Homo Sapiens
caauuuaaguugccacuuaucuauuuuccuaaaccaggguacauucauaaguugcaaauauua

SEQ ID NO: 645202 - RNA, 63 nt, Homo Sapiens
acaugucacaggcggccuuaguccaguuggaggccaggguaccuaaacuauaaaugcaguugu

SEQ ID NO: 645203 - RNA, 63 nt, Homo Sapiens
ccucuaauaaccuuuaucuaagaacaaauggauccaggguauaccagcauaugugccauaaac

SEQ ID NO: 645204 - RNA, 63 nt, Homo Sapiens
cuccaccccagcugccaagcgguggcuggaucuccaggguaccuucagaaagggacuguucug

SEQ ID NO: 645205 - RNA, 63 nt, Homo Sapiens
aggugccagggaaguuguggaggccucagccacccaggguaaacaggagcgccucaucuuccc

SEQ ID NO: 645206 - RNA, 63 nt, Homo Sapiens
uguggguugccaggcuggggucugcccccuuucccaggguauccaguauuacggugccucuuc

SEQ ID NO: 645207 - RNA, 63 nt, Homo Sapiens
gaauaagucuaggaaaggggaggagucaggugcccaggguaggcucugccccaccccuacuca

SEQ ID NO: 645208 - RNA, 63 nt, Homo Sapiens
uggauguggucucuacacuaaccuucuugauguccaggguagauaaagggucgaaucucucug

SEQ ID NO: 645209 - RNA, 63 nt, Homo Sapiens
caaacuagucucaugaagaauucuggcgugcagccaggguagcugaaguuugggucugggacu

SEQ ID NO: 645210 - RNA, 63 nt, Homo Sapiens
acagguuuugcccaaggcuuugauaccugucacccaggguaucuuaaaagcaaguuguucucc

SEQ ID NO: 645211 - RNA, 63 nt, Homo Sapiens
cucugcaccucuuccucagcugcuccagaccggccaggguaaccagcuaaccaugccuggcau

SEQ ID NO: 645212 - RNA, 63 nt, Homo Sapiens
ccagcaggcuugaagcaggguaagcaggcuggcccaggguaagggcuguugagguaccuuaag

SEQ ID NO: 645213 - RNA, 63 nt, Homo Sapiens
ucugcuuuugugaagcaacuauuuauuugaagaccaggguaugggcacuuuugccuucucucc

SEQ ID NO: 645214 - RNA, 63 nt, Homo Sapiens
aacaggaauuguuuugauaguuuuauccccaucccaggguauauuccuuaauuagacuaauua

SEQ ID NO: 645215 - RNA, 63 nt, Homo Sapiens
uuuguuagguuuucuaugugagaaaggacugaaccaggguauuuuccuaggaacaauggaaga

SEQ ID NO: 645216 - RNA, 63 nt, Homo Sapiens
uguaugauuuuguuaccagccuuguuuuugaagccaggguaguauuaaugugcauuacccuau

SEQ ID NO: 645217 - RNA, 63 nt, Homo Sapiens
uucauaccagacuauuugcaggggaccucagacccaggguauucucaggagcaggaacagcca

SEQ ID NO: 645218 - RNA, 63 nt, Homo Sapiens
cuucaguuggcccugauucaaguuugacuuuugccaggguaauuucaaaacucuuaaaucagu

SEQ ID NO: 645219 - RNA, 63 nt, Homo Sapiens
uccuuauuucacugaagaugaaaaaaagcuaauccaggguaccuuugacuuuuuggcuuuaag

SEQ ID NO: 645220 - RNA, 63 nt, Homo Sapiens
gaaggcaacccuauuucuacuguuucucucuugccaggguauuaggaaggacaggaaaaguag

SEQ ID NO: 645221 - RNA, 63 nt, Homo Sapiens
auugauuuaugauggaaaacggauauguuucauccaggguaucaucuccgaauuagcauuucu

SEQ ID NO: 645222 - RNA, 63 nt, Homo Sapiens
gaaaggaaccgagaaagaaaucaacacacuaaaccaggguaggugcugaugcaaaaggauuuu

SEQ ID NO: 645223 - RNA, 63 nt, Homo Sapiens
ugaaguccuccugugccagggaauuuacuaucuccaggguagcacauucccuguguagacggu

SEQ ID NO: 645224 - RNA, 63 nt, Homo Sapiens
ggagacaaaucggugugccauugacaacaugagccaggguaaaggcacccuuuggaauuacug

SEQ ID NO: 645225 - RNA, 63 nt, Homo Sapiens
ugaucaaaaggauauauugacaguuaucuauagccaggguaguuguuaauaccugcuuguuug

SEQ ID NO: 645226 - RNA, 51 nt, Homo Sapiens; identical to SEQ ID NO: 645037

SEQ ID NO: 645227 - RNA, 63 nt, Homo Sapiens
gcuuacagugacuacuauuaugaaauaucauugccaggguaugcuuccugaauucuuuaaaua

SEQ ID NO: 645228 - RNA, 63 nt, Homo Sapiens
auucucuuucagagaugcuccaucuuuggaaauccaggguaaucuggucauccuguuagagua

SEQ ID NO: 645229 - RNA, 63 nt, Homo Sapiens
gugcccuugcucucuaacuucugagcccaccucccaggguaggcaccugggggcaugcaggug

SEQ ID NO: 645230 - RNA, 63 nt, Homo Sapiens
guaggcaccugggggcaugcaggugcccaccucccaggguaggcaccugggggcaugcaggua

SEQ ID NO: 645231 - RNA, 63 nt, Homo Sapiens
gguucugggcuccaggggagggagcuggggaggccaggguauaagaaaagcaucagaacucuc

SEQ ID NO: 645232 - RNA, 63 nt, Homo Sapiens
guccucgcuggccuugccagagguugagccgccccaggguaugaggagaugaauaacuccaca

SEQ ID NO: 645233 - RNA, 63 nt, Homo Sapiens
ugcccuggggucugggcacuauuuuguucauccccaggguagcagacccagugagaauguagc

SEQ ID NO: 645234 - RNA, 63 nt, Homo Sapiens
gcuccccugaguguauaugaauaagcuauguguccaggguauuaguuuguucacuaaugugaa

SEQ ID NO: 645235 - RNA, 63 nt, Homo Sapiens
acagcccuggaaaacaguaguaaccagcaauggccaggguacacggagagaaauaaggggaug

SEQ ID NO: 645236 - RNA, 63 nt, Homo Sapiens
cuccuacaugggucaugacuugggcugucaaaaccaggguaaccuccugcccuggagcugguu

SEQ ID NO: 645237 - RNA, 63 nt, Homo Sapiens
ucuguggccaccucccgggcuguccgagggaccccaggguaccucacacucggagcucgccug

SEQ ID NO: 645238 - RNA, 63 nt, Homo Sapiens
gugggaaaacggaccgcucuuggcuccugacucccaggguacagcgcccaguaacucauccuu

SEQ ID NO: 645239 - RNA, 63 nt, Homo Sapiens
uggguaaaauaggucugcaagcuuuauauuugcccaggguaucauucauucuucagguguuga

SEQ ID NO: 645240 - RNA, 63 nt, Homo Sapiens
cuucuucgagucggagagcuacaaggacagcguccaggguagggugagagggggaccaugagu

SEQ ID NO: 645241 - RNA, 63 nt, Homo Sapiens
uccuacgguaccucuucagagcgguccccuugcccaggguauccccaaagcucagcccucugg

SEQ ID NO: 645242 - RNA, 63 nt, Homo Sapiens
uugaggcacuguugaagaaaucucacuuuucagccaggguacugguucugguacauauggauc

SEQ ID NO: 645243 - RNA, 63 nt, Homo Sapiens
gaccugccccugccgccugugcccuugcuggguccaggguaggcaaggcugccggcugcaccc

SEQ ID NO: 645244 - RNA, 63 nt, Homo Sapiens
uaacaacuguccccucacccaccagcuauuuccccaggguagagugggcaauucucaccuuca

SEQ ID NO: 645245 - RNA, 63 nt, Homo Sapiens
gugucccuguuucaguugcacugggguuggagcccaggguagggguuuccagcuuccccaggc

SEQ ID NO: 645246 - RNA, 63 nt, Homo Sapiens
ucaguguagccccaagaaggcuggggcuauuuaccaggguagaaaaaggagcuuaccucccac

SEQ ID NO: 645247 - RNA, 63 nt, Homo Sapiens
gugccaggaggaugacaaaaauguuccuguguuccaggguaaugccagguggguuuugagagc

SEQ ID NO: 645248 - RNA, 63 nt, Homo Sapiens
aagcccagagggucugggggcacaagacugacgccaggguaugaagaguguuauuuucauuca

SEQ ID NO: 645249 - RNA, 63 nt, Homo Sapiens
gggagccucucuccuuccccguccacccuacccccaggguaagggucauacccccucccucuu

SEQ ID NO: 645250 - RNA, 63 nt, Homo Sapiens
ucagguuggcccaguuugggccucuugcgucuuccaggguagcaucccugggauagagugagc

SEQ ID NO: 645251 - RNA, 63 nt, Homo Sapiens
ccucacagcgccaucaccaaggugggaacugcaccaggguacuagcaggauuaacuugaccau

SEQ ID NO: 645252 - RNA, 63 nt, Homo Sapiens
ugcccacgaaagcccaguccucauacccccuucccaggguaagugaacacuucuccagccacc

SEQ ID NO: 645253 - RNA, 63 nt, Homo Sapiens
gugaauggggaggcugggaggugcauguggaggccaggguaaguggccugagguaugggguau

SEQ ID NO: 645254 - RNA, 63 nt, Homo Sapiens
gcaaaggagacaaagcaggaccgggcaggggagccaggguagacuguguaaauauuuuucccu

SEQ ID NO: 645255 - RNA, 63 nt, Homo Sapiens
aggagcuuccugcuuugcaccgggaggcccugcccaggguaggagugagaaagagagcaggcu

SEQ ID NO: 645256 - RNA, 63 nt, Homo Sapiens
aagcagcagcucugcuggaccucaaggggaaauccaggguaggacauagguggcccauucagc

SEQ ID NO: 645257 - RNA, 63 nt, Homo Sapiens
ccccacgugcaccauaccuggggaguuccugguccaggguauccuggggccacccucccugcc

SEQ ID NO: 645258 - RNA, 63 nt, Homo Sapiens
cucuucucugccucucaccaggacagccgccccccaggguacuccugcccuugcuugacucag

SEQ ID NO: 645259 - RNA, 63 nt, Homo Sapiens
auuuuuaguagagacgggguuucaccauguuggccaggguagucuugaacuccugacuucaaa

SEQ ID NO: 645260 - RNA, 63 nt, Homo Sapiens
ucuagccagcuguggacacauaggaaugcuggaccaggguaccagauuuuuucaacaaagggg

SEQ ID NO: 645261 - RNA, 63 nt, Homo Sapiens
ugguggcuuauaacuguaagggagauggcagccccaggguacagccagcaggcauugagcagc

SEQ ID NO: 645262 - RNA, 63 nt, Homo Sapiens
ccucacacccugcuaccacccuaacguggacacccaggguaacauaugccuggacauccugaa

SEQ ID NO: 645263 - RNA, 63 nt, Homo Sapiens
ugcccccugcccucgaauccgcugaaagagggaccaggguagauccccuuuuucauucccugu

SEQ ID NO: 645264 - RNA, 63 nt, Homo Sapiens
gguuuuuaaaaucuccaguggccauaaaacuagccaggguagcucaugcuuuuacugguugga

SEQ ID NO: 645265 - RNA, 63 nt, Homo Sapiens
aaugccuggcgugagagccagcagacagccaggccaggguaggcagugccugcuucugcucca

SEQ ID NO: 645266 - RNA, 63 nt, Homo Sapiens
ugugcaccagcugcacuggcuucccccucagcaccaggguaccaggugagccagaggccugag

SEQ ID NO: 645267 - RNA, 63 nt, Homo Sapiens
ccuggcaugagggguuaggugcucagcaccugcccaggguaggguuccuggcgcccugaggug

SEQ ID NO: 645268 - RNA, 63 nt, Homo Sapiens
ggguaggggugggggugggcgcaucggggguccccaggguaugcagguugaggugggggccuu

SEQ ID NO: 645269 - RNA, 63 nt, Homo Sapiens
cuugagagaguucacauuccucaugcuugaaggccaggguagacagcggucaaggcaaggaug

SEQ ID NO: 645270 - RNA, 63 nt, Homo Sapiens
augucucaggcaagcaaaaggccuuguaaaaggccaggguaaaaagucaaaagauaaauuggg

SEQ ID NO: 645271 - RNA, 63 nt, Homo Sapiens
ggugaacaauauggagagagaccugggaaaaguccaggguagcuugcccaggggaagacagca

SEQ ID NO: 645272 - RNA, 63 nt, Homo Sapiens
gagugguggcaucuucaccugaauucuucaaugccaggguaauaaaccaaaauaguccuaauc

SEQ ID NO: 645273 - RNA, 63 nt, Homo Sapiens
gcugucgccucagucugcgcacaggcaugcaccccaggguagugccugcagggaugcaugugu

SEQ ID NO: 645274 - RNA, 63 nt, Homo Sapiens
uguccacacaccuguaggccucugagccagcguccaggguacaggugcgggugguggggauga

SEQ ID NO: 645275 - RNA, 63 nt, Homo Sapiens
gguggggcgugguguuuagacacagauaggaguccaggguaugacugauggaggccccggccc

SEQ ID NO: 645276 - RNA, 63 nt, Homo Sapiens
gcucucagcucucgggccagugcucugcucuguccaggguagguaauacugggagacuccugu

SEQ ID NO: 645277 - RNA, 63 nt, Homo Sapiens
gccucaucagccucugccuugucccacugagguccaggguagcucggggcagggguggggcag

SEQ ID NO: 645278 - RNA, 63 nt, Homo Sapiens
ggcugacggcgcaagaccaggagccuggggaggccaggguagagcaaccucugagccauccca

SEQ ID NO: 645279 - RNA, 63 nt, Homo Sapiens
gaaugaaggguauggaaguaaucucuggacacuccaggguagaaacguaccuugaaacucucu

SEQ ID NO: 645280 - RNA, 63 nt, Homo Sapiens
gagaccuagaccugucuuuguuuccacauucucccaggguauggccagugccccugagcuugc

SEQ ID NO: 645281 - RNA, 63 nt, Homo Sapiens
ccaaugcguggcucuccugcaaggggcugggagccaggguacuuggcucaagacggggugggg

SEQ ID NO: 645282 - RNA, 63 nt, Homo Sapiens
uuaaaugcuucuaauauaagaaauaauaaaagcccaggguauuaaguuuauuuucagaaaaua

SEQ ID NO: 645283 - RNA, 63 nt, Homo Sapiens
acuggagaugggaguuaguggcuucagugcauaccaggguaucgguaccccuuugguaaguag

SEQ ID NO: 645284 - RNA, 63 nt, Homo Sapiens
agcuggugggacacugaucucucccugaagcuuccaggguagccccuacuccaggcuccccau

SEQ ID NO: 645285 - RNA, 63 nt, Homo Sapiens
gagcuuaaggcagggcuggcacuauuuccuuggccaggguaccuuauggggccauauccuaca

SEQ ID NO: 645286 - RNA, 63 nt, Homo Sapiens
ugguuugucagaggcuauugggaacagcugggcccaggguauuugcucaguaaauauuuuggg

SEQ ID NO: 645287 - RNA, 63 nt, Homo Sapiens
gacuagauauuuuugcuguuaauguauacugauccaggguauaauguauggcaggcugggcag

SEQ ID NO: 645288 - RNA, 63 nt, Homo Sapiens
cuaauaggggcggcucaggcagcauucccagacccaggguacucagcugcccccauaacuggc

SEQ ID NO: 645289 - RNA, 63 nt, Homo Sapiens
ccuggacaguguccccuuuuuuucaaaaaauauccaggguacuaugaagaagcaacacauaag

SEQ ID NO: 645290 - RNA, 63 nt, Homo Sapiens
cgccuccuuuucguaacacuuugucacgggagcccaggguaccggggguagcccugccgcacu

SEQ ID NO: 645291 - RNA, 64 nt, Homo Sapiens
aauaaaacaacucauguuagcuuaaaacuuuuuugcuucauaauauuauuuccacugugagauu

SEQ ID NO: 645292 - RNA, 64 nt, Homo Sapiens
cggacgccacguuaggguugauuacaaccuccaugcuucauaaguuauugcguaccaagaguug

SEQ ID NO: 645293 - RNA, 64 nt, Homo Sapiens
acacuuauagccuuaaaccaucaauucaagagaugcuucauaaaguguauuuccaauuuggucu

SEQ ID NO: 645294 - RNA, 64 nt, Homo Sapiens
uguauggcaaggagggagcuggauguuuuccugggcuucauauccauagcauaccugccacucu

SEQ ID NO: 645295 - RNA, 64 nt, Homo Sapiens
gggaugguguucaaaaaacuauauuugaauguaugcuucauacaaaacucgcucacugcuaaga

SEQ ID NO: 645296 - RNA, 64 nt, Homo Sapiens
caugagauaauaugcagauugaauuggguggggggcuucauacacucuaagacuccagcggcug

SEQ ID NO: 645297 - RNA, 64 nt, Homo Sapiens
guacuguauguaugcauugguaauagcuacuuuugcuucauagcuucauaccaacaaaauauau

SEQ ID NO: 645298 - RNA, 64 nt, Homo Sapiens
uguaugcauugguaauagcuacuuuugcuucauagcuucauaccaacaaaauauauuuauuaga

SEQ ID NO: 645299 - RNA, 64 nt, Homo Sapiens
acauggaguuaggacagggaauauuuucaucauugcuucauacguugguguugcaaaaaguaac

SEQ ID NO: 645300 - RNA, 64 nt, Homo Sapiens
gaguaacgacugacauuagcaccuguccgugucugcuucauaagucuauuauguaaugcuguag

SEQ ID NO: 645301 - RNA, 64 nt, Homo Sapiens
guccccagcggugacgggagguguccuggcugcuccaggacaaaagacaaucgucucugugggu

SEQ ID NO: 645302 - RNA, 64 nt, Homo Sapiens
ggggagggcaaggcucuccucccagccagggacgccaggacauagcugcuccuggucaguggag

SEQ ID NO: 645303 - RNA, 64 nt, Homo Sapiens
cuuuggcauuuuaaaggaguaugaggugggugacccaggacagagaacgcuacuggauccuggg

SEQ ID NO: 645304 - RNA, 64 nt, Homo Sapiens
gacuggucuuggaaacccucagcaaacucagcauccaggacaacaauguggaccugauucuggc

SEQ ID NO: 645305 - RNA, 64 nt, Homo Sapiens
uucccagcagguuuuugccuuagacgugcuggccccaggacagugaugaagacagagccugucu

SEQ ID NO: 645306 - RNA, 64 nt, Homo Sapiens
uaauaaaaguugugccucaccauacuugaagcucccaggacaaggguugagaggcucaaccccu

SEQ ID NO: 645307 - RNA, 64 nt, Homo Sapiens
aaaucaguagagugaggugauccuuagcaacgugccaggacacuuccugugugccugcaguugu

SEQ ID NO: 645308 - RNA, 64 nt, Homo Sapiens
aagaacaaacauuagcuauuuuaugcugcaagaaccaggacacacaauucgccaaucaucccac

SEQ ID NO: 645309 - RNA, 64 nt, Homo Sapiens
cugugaguggcauguccacuugcuggauuaucagccaggacacuauagaacaggaccagcugag

SEQ ID NO: 645310 - RNA, 64 nt, Homo Sapiens
gggagaaggugccauggucuuaggugucugugccccaggacagacccuaggacccuaaauccaa

SEQ ID NO: 645311 - RNA, 64 nt, Homo Sapiens
aaaaggcccccacauacccugcaguuuucucuguccaggacagcagguaaaaaggaauccccag

SEQ ID NO: 645312 - RNA, 64 nt, Homo Sapiens
gagccuguagggaguuuuccaggcagguccuuugccaggacagcaugguccugcccuguugucc

SEQ ID NO: 645313 - RNA, 64 nt, Homo Sapiens
cagggcccaggaggcauuccacacaggcacugccccaggacaacacaacaaggacagucacaac

SEQ ID NO: 645314 - RNA, 64 nt, Homo Sapiens
ucaugguggguggaguggggguggcugggcucccccaggacagaggggacccugagguuggcaa

SEQ ID NO: 645315 - RNA, 64 nt, Homo Sapiens
cauaggggaaaggaucuacccuucuccuggcuccccaggacacucaguucuuucaaagaccagg

SEQ ID NO: 645316 - RNA, 64 nt, Homo Sapiens
uggagucugcaccuccuggaaauccugccaccaaccaggacacagcagccaccguauugaucag

SEQ ID NO: 645317 - RNA, 64 nt, Homo Sapiens
ggaauagguucugucgggaguguugggggugacaccaggacacacaggagagagggacagguuc

SEQ ID NO: 645318 - RNA, 64 nt, Homo Sapiens
gggacagguucugucaugggugucgggggugacaccaggacacacaggacacagggacagguuc

SEQ ID NO: 645319 - RNA, 64 nt, Homo Sapiens
gggacagguucugucgggggugucaggggugacaccaggacacacaggagagagggacagguuc

SEQ ID NO: 645320 - RNA, 64 nt, Homo Sapiens
cccaggcggcccgcccuugcgacacuccacacugccaggacacagcugagcagagcccauccag

SEQ ID NO: 645321 - RNA, 64 nt, Homo Sapiens
ccacacugccaggacacaccugagcagagcccauccaggacacuuuucucugccagcagggggc

SEQ ID NO: 645322 - RNA, 64 nt, Homo Sapiens
cccagccagaaccacugcuacccuccucuccugcccaggacagacaucacugccucuccaggga

SEQ ID NO: 645323 - RNA, 64 nt, Homo Sapiens
cugcacccccucaccccggucgcucggagcccccccaggacacuuugcugaguccccugccaag

SEQ ID NO: 645324 - RNA, 64 nt, Homo Sapiens
agggaaacaguuguuucccucagggugggucccaccaggacaguccuugggaagcccguuagcc

SEQ ID NO: 645325 - RNA, 64 nt, Homo Sapiens
ugugccaggcuucccaugccagcagggcgcaaacccaggacaucugcucacggcccugcagcag

SEQ ID NO: 645326 - RNA, 64 nt, Homo Sapiens
gugguuucugcccugcagaugucuaacacauaagccaggacauucugcugugagugacuuauug

SEQ ID NO: 645327 - RNA, 64 nt, Homo Sapiens
ugaaacagcuaaaagaaaacaucggggaaucucuccaggacauuggagugggcaaagauuucuu

SEQ ID NO: 645328 - RNA, 64 nt, Homo Sapiens
ggucugcuccugcugaggaccagcuguggcugggccaggacagaggacucaacccugcuccucc

SEQ ID NO: 645329 - RNA, 64 nt, Homo Sapiens
cucccccuaacugcaugacauguuaacugugugcccaggacagccgugguggggaccggguaug

SEQ ID NO: 645330 - RNA, 64 nt, Homo Sapiens
ugcccucgugcccaucaagugcagucgggaccucccaggacaagcacgaggccucaggucggcc

SEQ ID NO: 645331 - RNA, 64 nt, Homo Sapiens
aguguguguucuuccccaagguccccccacagcuccaggacaccgcuguccuggcauuuguggc

SEQ ID NO: 645332 - RNA, 64 nt, Homo Sapiens
uuggcaaaauaguggagaacgcaggacacaguuuccaggacauggccguggaggugggugcggg

SEQ ID NO: 645333 - RNA, 64 nt, Homo Sapiens
gcuuugcucagaagccuccugucuccagcucucuccaggacaggcccaguccucugaggcacgg

SEQ ID NO: 645334 - RNA, 64 nt, Homo Sapiens
accagauuuuggagucaugggucuuagaaguggaccaggacagggacaacaagagcgaaacucc

SEQ ID NO: 645335 - RNA, 64 nt, Homo Sapiens
cccggcgcgguggcucacgcuagcuagaagugggccaggacaggcucacccaagcauauauaac

SEQ ID NO: 645336 - RNA, 64 nt, Homo Sapiens
uaaaaaaaaaaaaaaaacaaaaaauguagcuggcccaggacauggccaucauccaccauuuagu

SEQ ID NO: 645337 - RNA, 64 nt, Homo Sapiens
ucuagcuuuugugagaaugucuauguguuaagugccaggacauuuauuugauuauuaaagugag

SEQ ID NO: 645338 - RNA, 64 nt, Homo Sapiens
uguacaucuaggccaccccagccuggccacgcagccaggacaccgggcagggccgcccgggccc

SEQ ID NO: 645339 - RNA, 64 nt, Homo Sapiens
gccacugacugcagggacacgggcagccuggcucccaggacacgacuuguaaugaaaguuuggg

SEQ ID NO: 645340 - RNA, 64 nt, Homo Sapiens
aacuucucccuuaccagugaccccagagacagagccaggacaggagugggggccagccugagga

SEQ ID NO: 645341 - RNA, 64 nt, Homo Sapiens
uagaacuuggacuuuuccccugugaagggggcugccaggacaucucagcacucccgccuggagc

SEQ ID NO: 645342 - RNA, 64 nt, Homo Sapiens
ugguaugaccagugauaaugucaucugccggcccccaggacaagcagccuugguggcaaauauc

SEQ ID NO: 645343 - RNA, 64 nt, Homo Sapiens
aguccagguaguguugagacugaguugaugggggccaggacaccugaggcuccagaggagacuu

SEQ ID NO: 645344 - RNA, 64 nt, Homo Sapiens
gcaucucucgaggacucuggucccaggaugucucccaggacaagccagucugccucuuccuccu

SEQ ID NO: 645345 - RNA, 64 nt, Homo Sapiens
cacacacacacacacgcuuguucacacucagaacccaggacagccacagccaccgcuuagggga

SEQ ID NO: 645346 - RNA, 64 nt, Homo Sapiens
cugguucugcccaugcuagggggugggggagcucccaggacagaccagccuuguuucucaugua

SEQ ID NO: 645347 - RNA, 64 nt, Homo Sapiens
ucguguagaaaugggggaauugguuccccauggcccaggacagcugagaggagguggaggggcc

SEQ ID NO: 645348 - RNA, 64 nt, Homo Sapiens
cagggcugaauggucgcugagacagagauggaagccaggacaagggagcccaccgggcccagau

SEQ ID NO: 645349 - RNA, 64 nt, Homo Sapiens
cggagccaggcgcuuagaggaagaccaaaugcugccaggacacggauuguccagggauuacauu

SEQ ID NO: 645350 - RNA, 64 nt, Homo Sapiens
ggauggggagcccucuggggaugagcaaggccuuccaggacaggcucgguucugguccccugcu

SEQ ID NO: 645351 - RNA, 64 nt, Homo Sapiens; identical to SEQ ID NO: 21758

SEQ ID NO: 645352 - RNA, 64 nt, Homo Sapiens; identical to SEQ ID NO: 21759

SEQ ID NO: 645353 - RNA, 64 nt, Homo Sapiens; identical to SEQ ID NO: 21760

SEQ ID NO: 645354 - RNA, 64 nt, Homo Sapiens; identical to SEQ ID NO: 21761

SEQ ID NO: 645355 - RNA, 64 nt, Homo Sapiens; identical to SEQ ID NO: 21762

SEQ ID NO: 645356 - RNA, 64 nt, Homo Sapiens; identical to SEQ ID NO: 21763

SEQ ID NO: 645357 - RNA, 64 nt, Homo Sapiens; identical to SEQ ID NO: 21764

SEQ ID NO: 645358 - RNA, 64 nt, Homo Sapiens; identical to SEQ ID NO: 21765

SEQ ID NO: 645359 - RNA, 64 nt, Homo Sapiens; identical to SEQ ID NO: 21766

SEQ ID NO: 645360 - RNA, 64 nt, Homo Sapiens; identical to SEQ ID NO: 21767

SEQ ID NO: 645361 - RNA, 64 nt, Homo Sapiens; identical to SEQ ID NO: 21768

SEQ ID NO: 645362 - RNA, 64 nt, Homo Sapiens; identical to SEQ ID NO: 21769

SEQ ID NO: 645363 - RNA, 64 nt, Homo Sapiens; identical to SEQ ID NO: 21770

SEQ ID NO: 645364 - RNA, 64 nt, Homo Sapiens; identical to SEQ ID NO: 21771

SEQ ID NO: 645365 - RNA, 64 nt, Homo Sapiens; identical to SEQ ID NO: 21772

SEQ ID NO: 645366 - RNA, 64 nt, Homo Sapiens; identical to SEQ ID NO: 21773

SEQ ID NO: 645367 - RNA, 64 nt, Homo Sapiens; identical to SEQ ID NO: 21774

SEQ ID NO: 645368 - RNA, 64 nt, Homo Sapiens; identical to SEQ ID NO: 21775

SEQ ID NO: 645369 - RNA, 64 nt, Homo Sapiens; identical to SEQ ID NO: 21776

SEQ ID NO: 645370 - RNA, 64 nt, Homo Sapiens; identical to SEQ ID NO: 21777

SEQ ID NO: 645371 - RNA, 64 nt, Homo Sapiens; identical to SEQ ID NO: 21778

SEQ ID NO: 645372 - RNA, 64 nt, Homo Sapiens; identical to SEQ ID NO: 21779

SEQ ID NO: 645373 - RNA, 64 nt, Homo Sapiens; identical to SEQ ID NO: 21780

SEQ ID NO: 645374 - RNA, 64 nt, Homo Sapiens; identical to SEQ ID NO: 21781

SEQ ID NO: 645375 - RNA, 64 nt, Homo Sapiens; identical to SEQ ID NO: 68768

SEQ ID NO: 645376 - RNA, 64 nt, Homo Sapiens; identical to SEQ ID NO: 68769

SEQ ID NO: 645377 - RNA, 64 nt, Homo Sapiens; identical to SEQ ID NO: 68770

SEQ ID NO: 645378 - RNA, 64 nt, Homo Sapiens; identical to SEQ ID NO: 68771

SEQ ID NO: 645379 - RNA, 64 nt, Homo Sapiens; identical to SEQ ID NO: 68772

SEQ ID NO: 645380 - RNA, 64 nt, Homo Sapiens; identical to SEQ ID NO: 68773

SEQ ID NO: 645381 - RNA, 64 nt, Homo Sapiens; identical to SEQ ID NO: 68774

SEQ ID NO: 645382 - RNA, 64 nt, Homo Sapiens; identical to SEQ ID NO: 68775

SEQ ID NO: 645383 - RNA, 64 nt, Homo Sapiens; identical to SEQ ID NO: 68776

SEQ ID NO: 645384 - RNA, 64 nt, Homo Sapiens; identical to SEQ ID NO: 68777

SEQ ID NO: 645385 - RNA, 64 nt, Homo Sapiens; identical to SEQ ID NO: 68778

SEQ ID NO: 645386 - RNA, 64 nt, Homo Sapiens; identical to SEQ ID NO: 68779

SEQ ID NO: 645387 - RNA, 64 nt, Homo Sapiens; identical to SEQ ID NO: 68780

SEQ ID NO: 645388 - RNA, 64 nt, Homo Sapiens; identical to SEQ ID NO: 68781

SEQ ID NO: 645389 - RNA, 64 nt, Homo Sapiens; identical to SEQ ID NO: 68782

SEQ ID NO: 645390 - RNA, 64 nt, Homo Sapiens; identical to SEQ ID NO: 68783

SEQ ID NO: 645391 - RNA, 64 nt, Homo Sapiens; identical to SEQ ID NO: 68784

SEQ ID NO: 645392 - RNA, 64 nt, Homo Sapiens; identical to SEQ ID NO: 68785

SEQ ID NO: 645393 - RNA, 64 nt, Homo Sapiens; identical to SEQ ID NO: 68786

SEQ ID NO: 645394 - RNA, 64 nt, Homo Sapiens; identical to SEQ ID NO: 68787

SEQ ID NO: 645395 - RNA, 64 nt, Homo Sapiens; identical to SEQ ID NO: 68788

SEQ ID NO: 645396 - RNA, 64 nt, Homo Sapiens; identical to SEQ ID NO: 68789

SEQ ID NO: 645397 - RNA, 64 nt, Homo Sapiens; identical to SEQ ID NO: 68790

SEQ ID NO: 645398 - RNA, 64 nt, Homo Sapiens; identical to SEQ ID NO: 68791

SEQ ID NO: 645399 - RNA, 64 nt, Homo Sapiens; identical to SEQ ID NO: 68792

SEQ ID NO: 645400 - RNA, 64 nt, Homo Sapiens; identical to SEQ ID NO: 68793

SEQ ID NO: 645401 - RNA, 64 nt, Homo Sapiens; identical to SEQ ID NO: 68794

SEQ ID NO: 645402 - RNA, 64 nt, Homo Sapiens; identical to SEQ ID NO: 68795

SEQ ID NO: 645403 - RNA, 64 nt, Homo Sapiens; identical to SEQ ID NO: 68796

SEQ ID NO: 645404 - RNA, 64 nt, Homo Sapiens; identical to SEQ ID NO: 68797

SEQ ID NO: 645405 - RNA, 64 nt, Homo Sapiens; identical to SEQ ID NO: 68798

SEQ ID NO: 645406 - RNA, 64 nt, Homo Sapiens; identical to SEQ ID NO: 68799

SEQ ID NO: 645407 - RNA, 64 nt, Homo Sapiens; identical to SEQ ID NO: 68800

SEQ ID NO: 645408 - RNA, 64 nt, Homo Sapiens; identical to SEQ ID NO: 68801

SEQ ID NO: 645409 - RNA, 59 nt, Homo Sapiens; identical to SEQ ID NO: 68802

SEQ ID NO: 645410 - RNA, 64 nt, Homo Sapiens; identical to SEQ ID NO: 68803

SEQ ID NO: 645411 - RNA, 64 nt, Homo Sapiens; identical to SEQ ID NO: 68804

SEQ ID NO: 645412 - RNA, 64 nt, Homo Sapiens; identical to SEQ ID NO: 68805

SEQ ID NO: 645413 - RNA, 64 nt, Homo Sapiens; identical to SEQ ID NO: 68806

SEQ ID NO: 645414 - RNA, 64 nt, Homo Sapiens; identical to SEQ ID NO: 68807

SEQ ID NO: 645415 - RNA, 64 nt, Homo Sapiens; identical to SEQ ID NO: 68808

SEQ ID NO: 645416 - RNA, 64 nt, Homo Sapiens; identical to SEQ ID NO: 68809

SEQ ID NO: 645417 - RNA, 64 nt, Homo Sapiens; identical to SEQ ID NO: 68810

SEQ ID NO: 645418 - RNA, 64 nt, Homo Sapiens; identical to SEQ ID NO: 68811

SEQ ID NO: 645419 - RNA, 64 nt, Homo Sapiens; identical to SEQ ID NO: 68812

SEQ ID NO: 645420 - RNA, 64 nt, Homo Sapiens
cuccucuccaugcaagugcuggguccucggcccaucuguccaucuuugcaggggacugggccau

SEQ ID NO: 645421 - RNA, 64 nt, Homo Sapiens
cccucccccacgucucucugcucaucugugccugucuguccaacacacuccagaauuacccuuc

SEQ ID NO: 645422 - RNA, 64 nt, Homo Sapiens
aucuuauuaaccauaauacuucuuuggcuacgcaucuguccagcauuuuguuguuauguaauau

SEQ ID NO: 645423 - RNA, 64 nt, Homo Sapiens
ugaggccucaggaccacggcuaguucaucauaaaucuguccaguuuucauucuuauaucuucau

SEQ ID NO: 645424 - RNA, 64 nt, Homo Sapiens
cuuguggcccuaucagccuuaauuuuacuugaugucuguccauuacuugcauguuugggacuca

SEQ ID NO: 645425 - RNA, 64 nt, Homo Sapiens
aaauaauuuugugagcccaguuugaggauggaauucuguccacagaaaccauauaaagaauucu

SEQ ID NO: 645426 - RNA, 64 nt, Homo Sapiens
gaucuugauccacagaaauacaugaaaugucuggucuguccaccccaucaacaagucuugaaac

SEQ ID NO: 645427 - RNA, 64 nt, Homo Sapiens
ucaacaagucuugaaacaagcaacagauggauagucuguccaaauggacauaagacagacagca

SEQ ID NO: 645428 - RNA, 64 nt, Homo Sapiens
uaccugucaguccacauagguguccauccguccgucuguccaccggaaggaaggcaaggcuguc

SEQ ID NO: 645429 - RNA, 64 nt, Homo Sapiens
cguccgucuguccaccuaccggaaggcaaggcugucuguccaucggaguggaccgaggaaggaa

SEQ ID NO: 645430 - RNA, 64 nt, Homo Sapiens
ccuguucuguagucucaagccuggcugaauagacucuguccagcauguguucgcuuguagggug

SEQ ID NO: 645431 - RNA, 64 nt, Homo Sapiens
gugagcacuggaugguggagcugcugcacacgauucuguccagaagacaaggaagguagggcac

SEQ ID NO: 645432 - RNA, 64 nt, Homo Sapiens
gagaacccggagaggcucugugacucuccaucgcucuguccaagcaggucgguccugacucucc

SEQ ID NO: 645433 - RNA, 64 nt, Homo Sapiens
uuccucuuguaaaauaacccugaacaaaucacauucuguccagauaauuuuucccuuuucaacc

SEQ ID NO: 645434 - RNA, 64 nt, Homo Sapiens
caaggcaaggagacuuucucgaucucaucucucaucuguccaaaguccugggagagaagaggag

SEQ ID NO: 645435 - RNA, 64 nt, Homo Sapiens
uauacuuauaaaugccugcauaucuuguauuucuucuguccaguauauugaguuaauagaacgg

SEQ ID NO: 645436 - RNA, 64 nt, Homo Sapiens
gagaggcugguuacagcuucagucccuuugucugucuguccauccauuccuccauccacccauc

SEQ ID NO: 645437 - RNA, 64 nt, Homo Sapiens
ugucugucuguccauccauuccuccauccacccaucuguccauccgcccaucugcccguccauc

SEQ ID NO: 645438 - RNA, 64 nt, Homo Sapiens
uccugguuaguccagcucuuuacucuaaacccuuucuguccaaaaugagucauuuucaguugua

SEQ ID NO: 645439 - RNA, 64 nt, Homo Sapiens
ccccuccccaccaaauaaacaugauauuucauucucuguccagcagucaugaaccccuucaccu

SEQ ID NO: 645440 - RNA, 64 nt, Homo Sapiens
gcucgguaccgaugcgugggcugggcuaggucccucuguccaucugggccuuuguaugagcugc

SEQ ID NO: 645441 - RNA, 64 nt, Homo Sapiens
cuccaggcgcccucggccgcccaucaugguuaauucuguccaacaaacacacacggguagauug

SEQ ID NO: 645442 - RNA, 64 nt, Homo Sapiens
cagugucaugagacgggagcccuuugcugugugcucuguccagugucaugagacgggagcccuu

SEQ ID NO: 645443 - RNA, 64 nt, Homo Sapiens
cagugucaugagacgggagcccuuugcugugugcucuguccagugucaugaggcagguguuugc

SEQ ID NO: 645444 - RNA, 64 nt, Homo Sapiens
ucugggguugggucaugacaggauggagaaccacucuguccagaccugguaggaucuguccaug

SEQ ID NO: 645445 - RNA, 64 nt, Homo Sapiens
ggauggagaaccacucugucaccuccugguaggaucuguccaugaggccuucaccuacgugaag

SEQ ID NO: 645446 - RNA, 64 nt, Homo Sapiens
cucccuauggcccuggccagaaguucucugugcaucuguccauccucagaauccuggugccuug

SEQ ID NO: 645447 - RNA, 64 nt, Homo Sapiens
uccuccucuuccucuccuuuuccugucucuccugucuguccacccaggccaucucuggcugucu

SEQ ID NO: 645448 - RNA, 64 nt, Homo Sapiens
ccccuggugucauggacuuagucuuugccagcauucuguccauguguucucuggucuucucuca

SEQ ID NO: 645449 - RNA, 64 nt, Homo Sapiens
ugagcaucuucacccauuuggucguugagacauaucuguccaugucugucuaaaaggggaggag

SEQ ID NO: 645450 - RNA, 64 nt, Homo Sapiens
caaucucaacucugagguugcuguguugcaauucucuguccagaccucuguccaguccuuaauc

SEQ ID NO: 645451 - RNA, 64 nt, Homo Sapiens
ccuuaauccuguguugcaauuugccuucacaaccucuguccaguugaaccuaggcugugaccuu

SEQ ID NO: 645452 - RNA, 64 nt, Homo Sapiens
caacaugaaccuaggcugugcuacccgaaggcccucuguccacaccuugaccucaccccugccc

SEQ ID NO: 645453 - RNA, 64 nt, Homo Sapiens
uuuccuaagaagacauugcuggaguugacuuucuucuguccaaacaaacaaacaaaaacuaaac

SEQ ID NO: 645454 - RNA, 64 nt, Homo Sapiens
caauauguacacgcuaaggaaaaacuagcacccuucuguccacucagcaauaagagggaucucu

SEQ ID NO: 645455 - RNA, 64 nt, Homo Sapiens; identical to SEQ ID NO: 43747

SEQ ID NO: 645456 - RNA, 64 nt, Homo Sapiens; identical to SEQ ID NO: 43748

SEQ ID NO: 645457 - RNA, 64 nt, Homo Sapiens; identical to SEQ ID NO: 43749

SEQ ID NO: 645458 - RNA, 64 nt, Homo Sapiens; identical to SEQ ID NO: 43750

SEQ ID NO: 645459 - RNA, 64 nt, Homo Sapiens; identical to SEQ ID NO: 43751

SEQ ID NO: 645460 - RNA, 64 nt, Homo Sapiens; identical to SEQ ID NO: 43752

SEQ ID NO: 645461 - RNA, 64 nt, Homo Sapiens; identical to SEQ ID NO: 43753

SEQ ID NO: 645462 - RNA, 64 nt, Homo Sapiens; identical to SEQ ID NO: 43754

SEQ ID NO: 645463 - RNA, 64 nt, Homo Sapiens; identical to SEQ ID NO: 43755

SEQ ID NO: 645464 - RNA, 64 nt, Homo Sapiens; identical to SEQ ID NO: 43756

SEQ ID NO: 645465 - RNA, 64 nt, Homo Sapiens; identical to SEQ ID NO: 43757

SEQ ID NO: 645466 - RNA, 64 nt, Homo Sapiens; identical to SEQ ID NO: 43758

SEQ ID NO: 645467 - RNA, 64 nt, Homo Sapiens; identical to SEQ ID NO: 43759

SEQ ID NO: 645468 - RNA, 64 nt, Homo Sapiens; identical to SEQ ID NO: 43760

SEQ ID NO: 645469 - RNA, 64 nt, Homo Sapiens; identical to SEQ ID NO: 43761

SEQ ID NO: 645470 - RNA, 64 nt, Homo Sapiens; identical to SEQ ID NO: 165842

SEQ ID NO: 645471 - RNA, 64 nt, Homo Sapiens; identical to SEQ ID NO: 165843

SEQ ID NO: 645472 - RNA, 64 nt, Homo Sapiens
cuauuguucauaauggcauuugcuuuccuaacaacuagcaaaagauaauucccaacucauaaau

SEQ ID NO: 645473 - RNA, 64 nt, Homo Sapiens
aguuuuagcggggacaaaaaagugaaagaaugagcuagcaaaugcccaugaacagcuaaugugu

SEQ ID NO: 645474 - RNA, 64 nt, Homo Sapiens
uucagugcuuuugcaaacuuaucacaacaaauaacuagcaaagcaagagaauugguuuggcuga

SEQ ID NO: 645475 - RNA, 64 nt, Homo Sapiens
auagagaauaauguuuaugcauuuuaaugauuuucuagcaaauaauuucacaauuuaaauaguu

SEQ ID NO: 645476 - RNA, 64 nt, Homo Sapiens
cacauugagauuuucuauuguaaaauccugcuaacuagcaaauucagcugauuuaaauaauuug

SEQ ID NO: 645477 - RNA, 64 nt, Homo Sapiens
cuaagccuggauugcagggcugguguaacccggucuagcaaaaguuuuuagccuggcuccguuc

SEQ ID NO: 645478 - RNA, 64 nt, Homo Sapiens
gugccauuuagcaaaacgucuuuagucuaugcaacuagcaaaaaucugcauaaugcaacaacac

SEQ ID NO: 645479 - RNA, 64 nt, Homo Sapiens
ugagggguucuucacgauucuccuggaacccagucuagcaaaaugagaggaaaggcccuaggga

SEQ ID NO: 645480 - RNA, 64 nt, Homo Sapiens
ugcuuuaaugcacacuucucuuccagugcucagccuagcaaauguuucacaccagcccacacca

SEQ ID NO: 645481 - RNA, 64 nt, Homo Sapiens
cccagccuucagagugugcauuugucucaacuggcuagcaaaugccaggcaaccaacaccugau

SEQ ID NO: 645482 - RNA, 64 nt, Homo Sapiens
ggcggaaacagcauuugccuucugagagaagagacuagcaaaaagcugcagagaggauucggcc

SEQ ID NO: 645483 - RNA, 64 nt, Homo Sapiens
cugagccgucugagggccuucaugccggcagcagcuagcaaagccagaaagcaagucuaacagg

SEQ ID NO: 645484 - RNA, 64 nt, Homo Sapiens
agcucagugauaccuccuugugaugccacuuugcagcuaaaauauuucauuaaauggaauaaua

SEQ ID NO: 645485 - RNA, 64 nt, Homo Sapiens
guggucuucuccaccagcccaauucaugugagaaagcuaaaauggggcuucuguaccacacuag

SEQ ID NO: 645486 - RNA, 64 nt, Homo Sapiens
ccuauugcaaguaugaaauuuucuggaccacugaagcuaaaagcuucuucugguaaagcuaaaa

SEQ ID NO: 645487 - RNA, 64 nt, Homo Sapiens
cuggaccacugaagcuaaaauguucuucugguaaagcuaaaauucauagggaggauaagaagag

SEQ ID NO: 645488 - RNA, 64 nt, Homo Sapiens
cuagccagaauaauuuuagaucugaucagguaguagcuaaaauuagaaaaaaacaaaauagaug

SEQ ID NO: 645489 - RNA, 64 nt, Homo Sapiens
agugaaaugucagugucaaaauauuauagauuauagcuaaaauccagauuaauacucauuuggg

SEQ ID NO: 645490 - RNA, 64 nt, Homo Sapiens
ccaaauggcauaugacccuguuuacacagccuaaagcuaaaaauauuacucuaguuuauucuaa

SEQ ID NO: 645491 - RNA, 64 nt, Homo Sapiens
uuauuucuguuauuuuuaagcuuuuauuucuuguagcuaaaaauaaaacaucauaaaucuggua

SEQ ID NO: 645492 - RNA, 64 nt, Homo Sapiens
agauuuuguccccaacaaaaauuuaguuucaaauagcuaaaaggaguuaagaacauuauauucc

SEQ ID NO: 645493 - RNA, 64 nt, Homo Sapiens
auugauaucauagaaguaaauacuuauauguggaagcuaaaaaaaguuaaacauugcauguuau

SEQ ID NO: 645494 - RNA, 64 nt, Homo Sapiens
uccuuuuuaucaaaguguacuuucuuuucuacuaagcuaaaaauuauacuucugaccuuugggc

SEQ ID NO: 645495 - RNA, 64 nt, Homo Sapiens
gaacaaauuugauguuaugcacagccaacucaaaagcuaaaacuagaccuuuaagcaaacuacu

SEQ ID NO: 645496 - RNA, 64 nt, Homo Sapiens
cuagagaguucaaaaguguucaagagauuggacaagcuaaaauuauugauggacucauuucucu

SEQ ID NO: 645497 - RNA, 64 nt, Homo Sapiens
ccucaacccauaguuaagcugaauuuuggcaucuagcuaaaauuaggcucuagcauguggcaug

SEQ ID NO: 645498 - RNA, 64 nt, Homo Sapiens
ccccacgaguggaaaauagacuucuacauaggaaagcuaaaauauguuaauauuuuuaaauuaa

SEQ ID NO: 645499 - RNA, 64 nt, Homo Sapiens
aaaaaaauacagauuaccaauuucaagugcugccagcuaaaauaacuguuuuaacggguaucuu

SEQ ID NO: 645500 - RNA, 64 nt, Homo Sapiens
cuaauuuuuacccauuuagaguauuggggaaaauagcuaaaaguuaaaaauauuaguuuggugu

SEQ ID NO: 645501 - RNA, 64 nt, Homo Sapiens
ccaauguggaauuccuguuuaauaaauauaaggaagcuaaaacauauuuucuaauguucaguac

SEQ ID NO: 645502 - RNA, 64 nt, Homo Sapiens
uaaauucugaacuguauccauauuuuaaggaaggagcuaaaaauggaaauucaugaaacauaaa

SEQ ID NO: 645503 - RNA, 64 nt, Homo Sapiens
ugcuuuaaaaauggccuuccuacacauuagcuccagcuaaaaagacacauuggagagcuuagag

SEQ ID NO: 645504 - RNA, 64 nt, Homo Sapiens
uacaauaaucaaacuuaagguucucauuugugggagcuaaaaauauggaauggcacuucauaua

SEQ ID NO: 645505 - RNA, 64 nt, Homo Sapiens
uuuuugcagguaaaauaaaguuuuuuccaaguguagcuaaaauaaguuauauucucaaguuuau

SEQ ID NO: 645506 - RNA, 64 nt, Homo Sapiens
auuaucagccagaagugcaacauguaugugcaaaagcuaaaauggcuuaacaucaugcuacacu

SEQ ID NO: 645507 - RNA, 64 nt, Homo Sapiens
uuuuuuucuuccagaaugucuuauuuaaaaagaaagcuaaaagcauacuucuaagucagagccu

SEQ ID NO: 645508 - RNA, 64 nt, Homo Sapiens
cacuugaaugaagcugagagagagaucuagcaaaagcuaaaacucauguugucuaucuuugaac

SEQ ID NO: 645509 - RNA, 64 nt, Homo Sapiens
uuuuugguaacucuuuggguuucugauuuguuuuagcuaaaauuuuggggauaugauuuggguc

SEQ ID NO: 645510 - RNA, 64 nt, Homo Sapiens
aaagcaugugugccuguuucaucuaaucaagcagagcuaaaauguucauaccgaauaaauuuau

SEQ ID NO: 645511 - RNA, 64 nt, Homo Sapiens
ugucucaauuauauauguguguguauguuuuuaaagcuaaaaacauuacuuuuagaucccuaga

SEQ ID NO: 645512 - RNA, 64 nt, Homo Sapiens
agcauugggcugugguagccaaaaaccauagguuagcuaaaaagaucaugauacaauuauuuua

SEQ ID NO: 645513 - RNA, 64 nt, Homo Sapiens
ugugaaagcaguucuuacagcuuuguuuucaaccagcuaaaaauguuuuauauauuacucuaac

SEQ ID NO: 645514 - RNA, 64 nt, Homo Sapiens
uggccagugugggguuagcaauauuuuacugaagagcuaaaaaccuggcuuuccuuuuuaaaag

SEQ ID NO: 645515 - RNA, 64 nt, Homo Sapiens
gucuaacccaggaaagcuuuugccuauuccaaagagcuaaaaaaacaaaagucucuauauucuu

SEQ ID NO: 645516 - RNA, 64 nt, Homo Sapiens
gaaagcaugaagaaacaacucugacagugguuacagcuaaaaaaguuauuguccuacaagcaua

SEQ ID NO: 645517 - RNA, 64 nt, Homo Sapiens
agucuaagauuauuaccuucauuaauaccaacaggcugcaaagcaagaguauagauuauuguau

SEQ ID NO: 645518 - RNA, 64 nt, Homo Sapiens
guuugagaaaaggagggaaguuugcuacaaaggggcugcaaagggaauaggcugauggagcugu

SEQ ID NO: 645519 - RNA, 64 nt, Homo Sapiens
cuucuuuggcccagcugggacuccuauugagacagcugcaaaacaggcugauuucaauuaggca

SEQ ID NO: 645520 - RNA, 64 nt, Homo Sapiens
ugguaccucuaguagauaguguguucauuucccugcugcaaauuuugaaguauuugggcaggug

SEQ ID NO: 645521 - RNA, 64 nt, Homo Sapiens
uuucaccugagagcuucaguucuucugcagaauggcugcaaauuuaauugcauuaaggcaagaa

SEQ ID NO: 645522 - RNA, 64 nt, Homo Sapiens
aggucaguacccuuugguauuucgauuagaagaagcugcaaaagaaaggcagcccauuuuacca

SEQ ID NO: 645523 - RNA, 64 nt, Homo Sapiens
guugaaaaaucaucgaaaugugcaaagccaaacagcugcaaaauuaguguaugaauugcugugc

SEQ ID NO: 645524 - RNA, 64 nt, Homo Sapiens
caaacagcugcaaaauguugguaugaauugcugugcugcaaagcguaauuuuguacaguauagu

SEQ ID NO: 645525 - RNA, 64 nt, Homo Sapiens
guuaaauuauauuuauuugaaguaaauuaguauugcugcaaauauagaguaauuaauuuaauaa

SEQ ID NO: 645526 - RNA, 64 nt, Homo Sapiens
uuauggagaauuggggcaccagacauacuucucagcugcaaauaaaauuuaaaaaugaauaaaa

SEQ ID NO: 645527 - RNA, 64 nt, Homo Sapiens
ucaguccuuugugcuacuuguuguaaauaaaauagcugcaaaccucauuguguuaaauguauac

SEQ ID NO: 645528 - RNA, 54 nt, Homo Sapiens
cugaggacacugggaauauauucugcugcaaagccuucaugcucggugauguga

SEQ ID NO: 645529 - RNA, 64 nt, Homo Sapiens
aagggauggaugcaaccuagcuuaacaguauaaugcugcaaauuuuccuccauuaucagccaga

SEQ ID NO: 645530 - RNA, 64 nt, Homo Sapiens
ucuuggagccugccagauauuguuagguccuggggcugcaaagagguccucaacaggauguaaa

SEQ ID NO: 645531 - RNA, 64 nt, Homo Sapiens
ccugcagggcccucccuuuucccauuguuccugcgcugcaaauugcaggccccagcaaucguga

SEQ ID NO: 645532 - RNA, 64 nt, Homo Sapiens
aaccaggggaggccugaggcuucaguuuuacucugcugcaaaaugaaggcgggccugcaagccg

SEQ ID NO: 645533 - RNA, 64 nt, Homo Sapiens
ccaugguuuaaaucuauaugcugucucuacuucggcugcaaaacgauaugaucccagaaaacau

SEQ ID NO: 645534 - RNA, 64 nt, Homo Sapiens
gguuuaaugcccccuacauaacagcuuucuagcagcugcaaaauaaucaggaaaacaggaaaac

SEQ ID NO: 645535 - RNA, 64 nt, Homo Sapiens
acuagccauuauucuauguaaaaguuaaagguaugcugcaaauaugaaaaugcacaaaguuaug

SEQ ID NO: 645536 - RNA, 64 nt, Homo Sapiens
uaauuuggaccuuucauuaauuaccaaaaagauggcugcaaauggucccuuuuucaauaucaca

SEQ ID NO: 645537 - RNA, 64 nt, Homo Sapiens
uguguuaauucuguuuaauagcaacuaaucucaugcugcaaacuuaauaauagggaauaaguuu

SEQ ID NO: 645538 - RNA, 64 nt, Homo Sapiens
uccaauauguucauaucguuagacauaggcaaaugcugcaaacuacaaauuaagagagcugauu

SEQ ID NO: 645539 - RNA, 64 nt, Homo Sapiens; identical to SEQ ID NO: 564100

SEQ ID NO: 645540 - RNA, 64 nt, Homo Sapiens; identical to SEQ ID NO: 564101

SEQ ID NO: 645541 - RNA, 64 nt, Homo Sapiens; identical to SEQ ID NO: 564102

SEQ ID NO: 645542 - RNA, 64 nt, Homo Sapiens; identical to SEQ ID NO: 564103

SEQ ID NO: 645543 - RNA, 64 nt, Homo Sapiens; identical to SEQ ID NO: 564104

SEQ ID NO: 645544 - RNA, 64 nt, Homo Sapiens; identical to SEQ ID NO: 564105

SEQ ID NO: 645545 - RNA, 64 nt, Homo Sapiens; identical to SEQ ID NO: 564106

SEQ ID NO: 645546 - RNA, 64 nt, Homo Sapiens; identical to SEQ ID NO: 564107

SEQ ID NO: 645547 - RNA, 64 nt, Homo Sapiens; identical to SEQ ID NO: 564108

SEQ ID NO: 645548 - RNA, 64 nt, Homo Sapiens; identical to SEQ ID NO: 564109

SEQ ID NO: 645549 - RNA, 64 nt, Homo Sapiens; identical to SEQ ID NO: 564110

SEQ ID NO: 645550 - RNA, 64 nt, Homo Sapiens; identical to SEQ ID NO: 564111

SEQ ID NO: 645551 - RNA, 64 nt, Homo Sapiens; identical to SEQ ID NO: 564112

SEQ ID NO: 645552 - RNA, 64 nt, Homo Sapiens; identical to SEQ ID NO: 564113

SEQ ID NO: 645553 - RNA, 64 nt, Homo Sapiens; identical to SEQ ID NO: 564114

SEQ ID NO: 645554 - RNA, 64 nt, Homo Sapiens; identical to SEQ ID NO: 564115

SEQ ID NO: 645555 - RNA, 64 nt, Homo Sapiens; identical to SEQ ID NO: 564116

SEQ ID NO: 645556 - RNA, 64 nt, Homo Sapiens; identical to SEQ ID NO: 564117

SEQ ID NO: 645557 - RNA, 64 nt, Homo Sapiens; identical to SEQ ID NO: 564118

SEQ ID NO: 645558 - RNA, 64 nt, Homo Sapiens; identical to SEQ ID NO: 564119

SEQ ID NO: 645559 - RNA, 64 nt, Homo Sapiens; identical to SEQ ID NO: 564120

SEQ ID NO: 645560 - RNA, 64 nt, Homo Sapiens; identical to SEQ ID NO: 564121

SEQ ID NO: 645561 - RNA, 64 nt, Homo Sapiens; identical to SEQ ID NO: 564122

SEQ ID NO: 645562 - RNA, 64 nt, Homo Sapiens; identical to SEQ ID NO: 564123

SEQ ID NO: 645563 - RNA, 64 nt, Homo Sapiens; identical to SEQ ID NO: 564124

SEQ ID NO: 645564 - RNA, 64 nt, Homo Sapiens; identical to SEQ ID NO: 564125

SEQ ID NO: 645565 - RNA, 64 nt, Homo Sapiens; identical to SEQ ID NO: 564126

SEQ ID NO: 645566 - RNA, 64 nt, Homo Sapiens; identical to SEQ ID NO: 564127

SEQ ID NO: 645567 - RNA, 64 nt, Homo Sapiens; identical to SEQ ID NO: 564128

SEQ ID NO: 645568 - RNA, 64 nt, Homo Sapiens; identical to SEQ ID NO: 564129

SEQ ID NO: 645569 - RNA, 64 nt, Homo Sapiens; identical to SEQ ID NO: 564130

SEQ ID NO: 645570 - RNA, 64 nt, Homo Sapiens; identical to SEQ ID NO: 564131

SEQ ID NO: 645571 - RNA, 64 nt, Homo Sapiens; identical to SEQ ID NO: 564132

SEQ ID NO: 645572 - RNA, 64 nt, Homo Sapiens; identical to SEQ ID NO: 564133

SEQ ID NO: 645573 - RNA, 64 nt, Homo Sapiens; identical to SEQ ID NO: 564134

SEQ ID NO: 645574 - RNA, 64 nt, Homo Sapiens; identical to SEQ ID NO: 564135

SEQ ID NO: 645575 - RNA, 64 nt, Homo Sapiens; identical to SEQ ID NO: 564136

SEQ ID NO: 645576 - RNA, 64 nt, Homo Sapiens; identical to SEQ ID NO: 564137

SEQ ID NO: 645577 - RNA, 64 nt, Homo Sapiens; identical to SEQ ID NO: 564138

SEQ ID NO: 645578 - RNA, 64 nt, Homo Sapiens; identical to SEQ ID NO: 564139

SEQ ID NO: 645579 - RNA, 64 nt, Homo Sapiens; identical to SEQ ID NO: 564140

SEQ ID NO: 645580 - RNA, 64 nt, Homo Sapiens; identical to SEQ ID NO: 564141

SEQ ID NO: 645581 - RNA, 64 nt, Homo Sapiens; identical to SEQ ID NO: 564142

SEQ ID NO: 645582 - RNA, 64 nt, Homo Sapiens; identical to SEQ ID NO: 564143

SEQ ID NO: 645583 - RNA, 64 nt, Homo Sapiens; identical to SEQ ID NO: 564144

SEQ ID NO: 645584 - RNA, 64 nt, Homo Sapiens; identical to SEQ ID NO: 564145

SEQ ID NO: 645585 - RNA, 64 nt, Homo Sapiens; identical to SEQ ID NO: 564146

SEQ ID NO: 645586 - RNA, 64 nt, Homo Sapiens; identical to SEQ ID NO: 564147

SEQ ID NO: 645587 - RNA, 64 nt, Homo Sapiens; identical to SEQ ID NO: 564148

SEQ ID NO: 645588 - RNA, 64 nt, Homo Sapiens; identical to SEQ ID NO: 564149

SEQ ID NO: 645589 - RNA, 64 nt, Homo Sapiens; identical to SEQ ID NO: 564150

SEQ ID NO: 645590 - RNA, 64 nt, Homo Sapiens; identical to SEQ ID NO: 564151

SEQ ID NO: 645591 - RNA, 64 nt, Homo Sapiens; identical to SEQ ID NO: 564152

SEQ ID NO: 645592 - RNA, 64 nt, Homo Sapiens; identical to SEQ ID NO: 564153

SEQ ID NO: 645593 - RNA, 64 nt, Homo Sapiens; identical to SEQ ID NO: 564154

SEQ ID NO: 645594 - RNA, 64 nt, Homo Sapiens; identical to SEQ ID NO: 564155

SEQ ID NO: 645595 - RNA, 64 nt, Homo Sapiens; identical to SEQ ID NO: 564156

SEQ ID NO: 645596 - RNA, 64 nt, Homo Sapiens; identical to SEQ ID NO: 564157

SEQ ID NO: 645597 - RNA, 64 nt, Homo Sapiens; identical to SEQ ID NO: 564158

SEQ ID NO: 645598 - RNA, 64 nt, Homo Sapiens; identical to SEQ ID NO: 564159

SEQ ID NO: 645599 - RNA, 64 nt, Homo Sapiens; identical to SEQ ID NO: 564160

SEQ ID NO: 645600 - RNA, 64 nt, Homo Sapiens; identical to SEQ ID NO: 564161

SEQ ID NO: 645601 - RNA, 64 nt, Homo Sapiens; identical to SEQ ID NO: 564162

SEQ ID NO: 645602 - RNA, 64 nt, Homo Sapiens; identical to SEQ ID NO: 564163

SEQ ID NO: 645603 - RNA, 64 nt, Homo Sapiens; identical to SEQ ID NO: 564164

SEQ ID NO: 645604 - RNA, 64 nt, Homo Sapiens; identical to SEQ ID NO: 564165

SEQ ID NO: 645605 - RNA, 64 nt, Homo Sapiens; identical to SEQ ID NO: 564166

SEQ ID NO: 645606 - RNA, 64 nt, Homo Sapiens; identical to SEQ ID NO: 564167

SEQ ID NO: 645607 - RNA, 64 nt, Homo Sapiens; identical to SEQ ID NO: 564168

SEQ ID NO: 645608 - RNA, 64 nt, Homo Sapiens; identical to SEQ ID NO: 564169

SEQ ID NO: 645609 - RNA, 64 nt, Homo Sapiens; identical to SEQ ID NO: 564170

SEQ ID NO: 645610 - RNA, 64 nt, Homo Sapiens; identical to SEQ ID NO: 564171

SEQ ID NO: 645611 - RNA, 52 nt, Homo Sapiens; identical to SEQ ID NO: 564172

SEQ ID NO: 645612 - RNA, 64 nt, Homo Sapiens; identical to SEQ ID NO: 564173

SEQ ID NO: 645613 - RNA, 64 nt, Homo Sapiens; identical to SEQ ID NO: 564174

SEQ ID NO: 645614 - RNA, 64 nt, Homo Sapiens; identical to SEQ ID NO: 564175

SEQ ID NO: 645615 - RNA, 64 nt, Homo Sapiens; identical to SEQ ID NO: 564176

SEQ ID NO: 645616 - RNA, 64 nt, Homo Sapiens; identical to SEQ ID NO: 564177

SEQ ID NO: 645617 - RNA, 64 nt, Homo Sapiens; identical to SEQ ID NO: 564178

SEQ ID NO: 645618 - RNA, 64 nt, Homo Sapiens; identical to SEQ ID NO: 564179

SEQ ID NO: 645619 - RNA, 64 nt, Homo Sapiens; identical to SEQ ID NO: 564180

SEQ ID NO: 645620 - RNA, 64 nt, Homo Sapiens; identical to SEQ ID NO: 564181

SEQ ID NO: 645621 - RNA, 64 nt, Homo Sapiens; identical to SEQ ID NO: 564182

SEQ ID NO: 645622 - RNA, 64 nt, Homo Sapiens; identical to SEQ ID NO: 564183

SEQ ID NO: 645623 - RNA, 64 nt, Homo Sapiens; identical to SEQ ID NO: 564184

SEQ ID NO: 645624 - RNA, 64 nt, Homo Sapiens; identical to SEQ ID NO: 564185

SEQ ID NO: 645625 - RNA, 64 nt, Homo Sapiens; identical to SEQ ID NO: 564186

SEQ ID NO: 645626 - RNA, 64 nt, Homo Sapiens; identical to SEQ ID NO: 564187

SEQ ID NO: 645627 - RNA, 64 nt, Homo Sapiens; identical to SEQ ID NO: 564188

SEQ ID NO: 645628 - RNA, 64 nt, Homo Sapiens; identical to SEQ ID NO: 564189

SEQ ID NO: 645629 - RNA, 64 nt, Homo Sapiens; identical to SEQ ID NO: 564190

SEQ ID NO: 645630 - RNA, 64 nt, Homo Sapiens; identical to SEQ ID NO: 564191

SEQ ID NO: 645631 - RNA, 64 nt, Homo Sapiens; identical to SEQ ID NO: 564192

SEQ ID NO: 645632 - RNA, 64 nt, Homo Sapiens; identical to SEQ ID NO: 564193

SEQ ID NO: 645633 - RNA, 64 nt, Homo Sapiens; identical to SEQ ID NO: 564194

SEQ ID NO: 645634 - RNA, 64 nt, Homo Sapiens; identical to SEQ ID NO: 564195

SEQ ID NO: 645635 - RNA, 64 nt, Homo Sapiens; identical to SEQ ID NO: 564196

SEQ ID NO: 645636 - RNA, 64 nt, Homo Sapiens; identical to SEQ ID NO: 564197

SEQ ID NO: 645637 - RNA, 64 nt, Homo Sapiens; identical to SEQ ID NO: 564198

SEQ ID NO: 645638 - RNA, 64 nt, Homo Sapiens; identical to SEQ ID NO: 564199

SEQ ID NO: 645639 - RNA, 64 nt, Homo Sapiens; identical to SEQ ID NO: 564200

SEQ ID NO: 645640 - RNA, 64 nt, Homo Sapiens; identical to SEQ ID NO: 564201

SEQ ID NO: 645641 - RNA, 64 nt, Homo Sapiens; identical to SEQ ID NO: 564202

SEQ ID NO: 645642 - RNA, 64 nt, Homo Sapiens; identical to SEQ ID NO: 564203

SEQ ID NO: 645643 - RNA, 64 nt, Homo Sapiens; identical to SEQ ID NO: 564204

SEQ ID NO: 645644 - RNA, 64 nt, Homo Sapiens; identical to SEQ ID NO: 564205

SEQ ID NO: 645645 - RNA, 64 nt, Homo Sapiens; identical to SEQ ID NO: 564206

SEQ ID NO: 645646 - RNA, 64 nt, Homo Sapiens; identical to SEQ ID NO: 564207

SEQ ID NO: 645647 - RNA, 64 nt, Homo Sapiens; identical to SEQ ID NO: 564208

SEQ ID NO: 645648 - RNA, 64 nt, Homo Sapiens; identical to SEQ ID NO: 564209

SEQ ID NO: 645649 - RNA, 64 nt, Homo Sapiens; identical to SEQ ID NO: 564210

SEQ ID NO: 645650 - RNA, 64 nt, Homo Sapiens; identical to SEQ ID NO: 564211

SEQ ID NO: 645651 - RNA, 64 nt, Homo Sapiens; identical to SEQ ID NO: 564212

SEQ ID NO: 645652 - RNA, 64 nt, Homo Sapiens; identical to SEQ ID NO: 564213

SEQ ID NO: 645653 - RNA, 64 nt, Homo Sapiens; identical to SEQ ID NO: 564214

SEQ ID NO: 645654 - RNA, 64 nt, Homo Sapiens; identical to SEQ ID NO: 564215

SEQ ID NO: 645655 - RNA, 64 nt, Homo Sapiens; identical to SEQ ID NO: 564216

SEQ ID NO: 645656 - RNA, 64 nt, Homo Sapiens; identical to SEQ ID NO: 564217

SEQ ID NO: 645657 - RNA, 64 nt, Homo Sapiens; identical to SEQ ID NO: 564218

SEQ ID NO: 645658 - RNA, 64 nt, Homo Sapiens; identical to SEQ ID NO: 564219

SEQ ID NO: 645659 - RNA, 64 nt, Homo Sapiens; identical to SEQ ID NO: 564220

SEQ ID NO: 645660 - RNA, 64 nt, Homo Sapiens; identical to SEQ ID NO: 564221

SEQ ID NO: 645661 - RNA, 64 nt, Homo Sapiens; identical to SEQ ID NO: 564222

SEQ ID NO: 645662 - RNA, 64 nt, Homo Sapiens; identical to SEQ ID NO: 564223

SEQ ID NO: 645663 - RNA, 64 nt, Homo Sapiens; identical to SEQ ID NO: 564224

SEQ ID NO: 645664 - RNA, 64 nt, Homo Sapiens; identical to SEQ ID NO: 564225

SEQ ID NO: 645665 - RNA, 64 nt, Homo Sapiens; identical to SEQ ID NO: 564226

SEQ ID NO: 645666 - RNA, 64 nt, Homo Sapiens; identical to SEQ ID NO: 564227

SEQ ID NO: 645667 - RNA, 64 nt, Homo Sapiens; identical to SEQ ID NO: 564228

SEQ ID NO: 645668 - RNA, 64 nt, Homo Sapiens; identical to SEQ ID NO: 564229

SEQ ID NO: 645669 - RNA, 64 nt, Homo Sapiens; identical to SEQ ID NO: 564230

SEQ ID NO: 645670 - RNA, 64 nt, Homo Sapiens; identical to SEQ ID NO: 564231

SEQ ID NO: 645671 - RNA, 64 nt, Homo Sapiens; identical to SEQ ID NO: 564232

SEQ ID NO: 645672 - RNA, 64 nt, Homo Sapiens; identical to SEQ ID NO: 564233

SEQ ID NO: 645673 - RNA, 64 nt, Homo Sapiens; identical to SEQ ID NO: 564234

SEQ ID NO: 645674 - RNA, 64 nt, Homo Sapiens; identical to SEQ ID NO: 564235

SEQ ID NO: 645675 - RNA, 64 nt, Homo Sapiens; identical to SEQ ID NO: 564236

SEQ ID NO: 645676 - RNA, 64 nt, Homo Sapiens; identical to SEQ ID NO: 564237

SEQ ID NO: 645677 - RNA, 64 nt, Homo Sapiens; identical to SEQ ID NO: 564238

SEQ ID NO: 645678 - RNA, 64 nt, Homo Sapiens; identical to SEQ ID NO: 564239

SEQ ID NO: 645679 - RNA, 64 nt, Homo Sapiens; identical to SEQ ID NO: 564240

SEQ ID NO: 645680 - RNA, 64 nt, Homo Sapiens; identical to SEQ ID NO: 564241

SEQ ID NO: 645681 - RNA, 64 nt, Homo Sapiens; identical to SEQ ID NO: 564242

SEQ ID NO: 645682 - RNA, 64 nt, Homo Sapiens; identical to SEQ ID NO: 564243

SEQ ID NO: 645683 - RNA, 64 nt, Homo Sapiens; identical to SEQ ID NO: 564244

SEQ ID NO: 645684 - RNA, 64 nt, Homo Sapiens; identical to SEQ ID NO: 564245

SEQ ID NO: 645685 - RNA, 64 nt, Homo Sapiens; identical to SEQ ID NO: 564246

SEQ ID NO: 645686 - RNA, 64 nt, Homo Sapiens; identical to SEQ ID NO: 564247

SEQ ID NO: 645687 - RNA, 64 nt, Homo Sapiens; identical to SEQ ID NO: 564248

SEQ ID NO: 645688 - RNA, 64 nt, Homo Sapiens; identical to SEQ ID NO: 564249

SEQ ID NO: 645689 - RNA, 64 nt, Homo Sapiens; identical to SEQ ID NO: 564250

SEQ ID NO: 645690 - RNA, 64 nt, Homo Sapiens; identical to SEQ ID NO: 564251

SEQ ID NO: 645691 - RNA, 64 nt, Homo Sapiens; identical to SEQ ID NO: 564252

SEQ ID NO: 645692 - RNA, 64 nt, Homo Sapiens; identical to SEQ ID NO: 564253

SEQ ID NO: 645693 - RNA, 64 nt, Homo Sapiens; identical to SEQ ID NO: 564254

SEQ ID NO: 645694 - RNA, 64 nt, Homo Sapiens; identical to SEQ ID NO: 564255

SEQ ID NO: 645695 - RNA, 64 nt, Homo Sapiens; identical to SEQ ID NO: 564256

SEQ ID NO: 645696 - RNA, 64 nt, Homo Sapiens; identical to SEQ ID NO: 564257

SEQ ID NO: 645697 - RNA, 64 nt, Homo Sapiens; identical to SEQ ID NO: 564258

SEQ ID NO: 645698 - RNA, 64 nt, Homo Sapiens; identical to SEQ ID NO: 564259

SEQ ID NO: 645699 - RNA, 64 nt, Homo Sapiens; identical to SEQ ID NO: 564260

SEQ ID NO: 645700 - RNA, 64 nt, Homo Sapiens; identical to SEQ ID NO: 564261

SEQ ID NO: 645701 - RNA, 64 nt, Homo Sapiens; identical to SEQ ID NO: 564262

SEQ ID NO: 645702 - RNA, 64 nt, Homo Sapiens; identical to SEQ ID NO: 564263

SEQ ID NO: 645703 - RNA, 64 nt, Homo Sapiens; identical to SEQ ID NO: 564264

SEQ ID NO: 645704 - RNA, 64 nt, Homo Sapiens; identical to SEQ ID NO: 564265

SEQ ID NO: 645705 - RNA, 64 nt, Homo Sapiens; identical to SEQ ID NO: 564266

SEQ ID NO: 645706 - RNA, 64 nt, Homo Sapiens; identical to SEQ ID NO: 564267

SEQ ID NO: 645707 - RNA, 64 nt, Homo Sapiens; identical to SEQ ID NO: 564268

SEQ ID NO: 645708 - RNA, 64 nt, Homo Sapiens; identical to SEQ ID NO: 564269

SEQ ID NO: 645709 - RNA, 64 nt, Homo Sapiens; identical to SEQ ID NO: 564270

SEQ ID NO: 645710 - RNA, 64 nt, Homo Sapiens; identical to SEQ ID NO: 564271

SEQ ID NO: 645711 - RNA, 64 nt, Homo Sapiens; identical to SEQ ID NO: 564272

SEQ ID NO: 645712 - RNA, 64 nt, Homo Sapiens; identical to SEQ ID NO: 564273

SEQ ID NO: 645713 - RNA, 64 nt, Homo Sapiens; identical to SEQ ID NO: 564274

SEQ ID NO: 645714 - RNA, 64 nt, Homo Sapiens; identical to SEQ ID NO: 564275

SEQ ID NO: 645715 - RNA, 64 nt, Homo Sapiens; identical to SEQ ID NO: 564276

SEQ ID NO: 645716 - RNA, 64 nt, Homo Sapiens; identical to SEQ ID NO: 564277

SEQ ID NO: 645717 - RNA, 64 nt, Homo Sapiens; identical to SEQ ID NO: 564278

SEQ ID NO: 645718 - RNA, 64 nt, Homo Sapiens; identical to SEQ ID NO: 564279

SEQ ID NO: 645719 - RNA, 64 nt, Homo Sapiens; identical to SEQ ID NO: 564280

SEQ ID NO: 645720 - RNA, 64 nt, Homo Sapiens; identical to SEQ ID NO: 564281

SEQ ID NO: 645721 - RNA, 64 nt, Homo Sapiens; identical to SEQ ID NO: 564282

SEQ ID NO: 645722 - RNA, 64 nt, Homo Sapiens; identical to SEQ ID NO: 564283

SEQ ID NO: 645723 - RNA, 64 nt, Homo Sapiens; identical to SEQ ID NO: 564284

SEQ ID NO: 645724 - RNA, 64 nt, Homo Sapiens; identical to SEQ ID NO: 564285

SEQ ID NO: 645725 - RNA, 64 nt, Homo Sapiens; identical to SEQ ID NO: 564286

SEQ ID NO: 645726 - RNA, 64 nt, Homo Sapiens; identical to SEQ ID NO: 564287

SEQ ID NO: 645727 - RNA, 64 nt, Homo Sapiens; identical to SEQ ID NO: 564288

SEQ ID NO: 645728 - RNA, 64 nt, Homo Sapiens; identical to SEQ ID NO: 564289

SEQ ID NO: 645729 - RNA, 64 nt, Homo Sapiens; identical to SEQ ID NO: 564290

SEQ ID NO: 645730 - RNA, 64 nt, Homo Sapiens; identical to SEQ ID NO: 564291

SEQ ID NO: 645731 - RNA, 64 nt, Homo Sapiens; identical to SEQ ID NO: 564292

SEQ ID NO: 645732 - RNA, 64 nt, Homo Sapiens; identical to SEQ ID NO: 564293

SEQ ID NO: 645733 - RNA, 64 nt, Homo Sapiens; identical to SEQ ID NO: 564294

SEQ ID NO: 645734 - RNA, 64 nt, Homo Sapiens; identical to SEQ ID NO: 564295

SEQ ID NO: 645735 - RNA, 64 nt, Homo Sapiens; identical to SEQ ID NO: 564296

SEQ ID NO: 645736 - RNA, 64 nt, Homo Sapiens; identical to SEQ ID NO: 564297

SEQ ID NO: 645737 - RNA, 64 nt, Homo Sapiens; identical to SEQ ID NO: 564298

SEQ ID NO: 645738 - RNA, 64 nt, Homo Sapiens; identical to SEQ ID NO: 564299

SEQ ID NO: 645739 - RNA, 64 nt, Homo Sapiens; identical to SEQ ID NO: 564300

SEQ ID NO: 645740 - RNA, 64 nt, Homo Sapiens; identical to SEQ ID NO: 564301

SEQ ID NO: 645741 - RNA, 64 nt, Homo Sapiens; identical to SEQ ID NO: 564302

SEQ ID NO: 645742 - RNA, 64 nt, Homo Sapiens; identical to SEQ ID NO: 564303

SEQ ID NO: 645743 - RNA, 64 nt, Homo Sapiens; identical to SEQ ID NO: 564304

SEQ ID NO: 645744 - RNA, 64 nt, Homo Sapiens; identical to SEQ ID NO: 564305

SEQ ID NO: 645745 - RNA, 64 nt, Homo Sapiens; identical to SEQ ID NO: 564306

SEQ ID NO: 645746 - RNA, 64 nt, Homo Sapiens; identical to SEQ ID NO: 564307

SEQ ID NO: 645747 - RNA, 64 nt, Homo Sapiens; identical to SEQ ID NO: 564308

SEQ ID NO: 645748 - RNA, 64 nt, Homo Sapiens; identical to SEQ ID NO: 564309

SEQ ID NO: 645749 - RNA, 64 nt, Homo Sapiens; identical to SEQ ID NO: 564310

SEQ ID NO: 645750 - RNA, 64 nt, Homo Sapiens; identical to SEQ ID NO: 564311

SEQ ID NO: 645751 - RNA, 64 nt, Homo Sapiens; identical to SEQ ID NO: 564312

SEQ ID NO: 645752 - RNA, 64 nt, Homo Sapiens; identical to SEQ ID NO: 564313

SEQ ID NO: 645753 - RNA, 64 nt, Homo Sapiens; identical to SEQ ID NO: 564314

SEQ ID NO: 645754 - RNA, 64 nt, Homo Sapiens; identical to SEQ ID NO: 564315

SEQ ID NO: 645755 - RNA, 53 nt, Homo Sapiens; identical to SEQ ID NO: 564316

SEQ ID NO: 645756 - RNA, 64 nt, Homo Sapiens; identical to SEQ ID NO: 564317

SEQ ID NO: 645757 - RNA, 64 nt, Homo Sapiens; identical to SEQ ID NO: 564318

SEQ ID NO: 645758 - RNA, 64 nt, Homo Sapiens; identical to SEQ ID NO: 564319

SEQ ID NO: 645759 - RNA, 64 nt, Homo Sapiens; identical to SEQ ID NO: 564320

SEQ ID NO: 645760 - RNA, 64 nt, Homo Sapiens; identical to SEQ ID NO: 564321

SEQ ID NO: 645761 - RNA, 64 nt, Homo Sapiens; identical to SEQ ID NO: 564322

SEQ ID NO: 645762 - RNA, 64 nt, Homo Sapiens; identical to SEQ ID NO: 564323

SEQ ID NO: 645763 - RNA, 64 nt, Homo Sapiens; identical to SEQ ID NO: 564324

SEQ ID NO: 645764 - RNA, 64 nt, Homo Sapiens; identical to SEQ ID NO: 564325

SEQ ID NO: 645765 - RNA, 64 nt, Homo Sapiens; identical to SEQ ID NO: 564326

SEQ ID NO: 645766 - RNA, 64 nt, Homo Sapiens; identical to SEQ ID NO: 564327

SEQ ID NO: 645767 - RNA, 64 nt, Homo Sapiens; identical to SEQ ID NO: 564328

SEQ ID NO: 645768 - RNA, 64 nt, Homo Sapiens; identical to SEQ ID NO: 564329

SEQ ID NO: 645769 - RNA, 64 nt, Homo Sapiens; identical to SEQ ID NO: 564330

SEQ ID NO: 645770 - RNA, 64 nt, Homo Sapiens; identical to SEQ ID NO: 564331

SEQ ID NO: 645771 - RNA, 64 nt, Homo Sapiens; identical to SEQ ID NO: 564332

SEQ ID NO: 645772 - RNA, 64 nt, Homo Sapiens; identical to SEQ ID NO: 564333

SEQ ID NO: 645773 - RNA, 64 nt, Homo Sapiens; identical to SEQ ID NO: 564334

SEQ ID NO: 645774 - RNA, 64 nt, Homo Sapiens; identical to SEQ ID NO: 564335

SEQ ID NO: 645775 - RNA, 64 nt, Homo Sapiens; identical to SEQ ID NO: 564336

SEQ ID NO: 645776 - RNA, 64 nt, Homo Sapiens; identical to SEQ ID NO: 564337

SEQ ID NO: 645777 - RNA, 64 nt, Homo Sapiens; identical to SEQ ID NO: 564338

SEQ ID NO: 645778 - RNA, 64 nt, Homo Sapiens; identical to SEQ ID NO: 564339

SEQ ID NO: 645779 - RNA, 64 nt, Homo Sapiens; identical to SEQ ID NO: 564340

SEQ ID NO: 645780 - RNA, 64 nt, Homo Sapiens; identical to SEQ ID NO: 564341

SEQ ID NO: 645781 - RNA, 64 nt, Homo Sapiens; identical to SEQ ID NO: 564342

SEQ ID NO: 645782 - RNA, 64 nt, Homo Sapiens; identical to SEQ ID NO: 564343

SEQ ID NO: 645783 - RNA, 64 nt, Homo Sapiens; identical to SEQ ID NO: 564344

SEQ ID NO: 645784 - RNA, 64 nt, Homo Sapiens; identical to SEQ ID NO: 564345

SEQ ID NO: 645785 - RNA, 64 nt, Homo Sapiens; identical to SEQ ID NO: 564346

SEQ ID NO: 645786 - RNA, 64 nt, Homo Sapiens; identical to SEQ ID NO: 564347

SEQ ID NO: 645787 - RNA, 64 nt, Homo Sapiens; identical to SEQ ID NO: 564348

SEQ ID NO: 645788 - RNA, 64 nt, Homo Sapiens; identical to SEQ ID NO: 564349

SEQ ID NO: 645789 - RNA, 64 nt, Homo Sapiens; identical to SEQ ID NO: 564350

SEQ ID NO: 645790 - RNA, 64 nt, Homo Sapiens; identical to SEQ ID NO: 564351

SEQ ID NO: 645791 - RNA, 64 nt, Homo Sapiens; identical to SEQ ID NO: 564352

SEQ ID NO: 645792 - RNA, 64 nt, Homo Sapiens; identical to SEQ ID NO: 564353

SEQ ID NO: 645793 - RNA, 64 nt, Homo Sapiens; identical to SEQ ID NO: 564354

SEQ ID NO: 645794 - RNA, 64 nt, Homo Sapiens; identical to SEQ ID NO: 564355

SEQ ID NO: 645795 - RNA, 64 nt, Homo Sapiens; identical to SEQ ID NO: 564356

SEQ ID NO: 645796 - RNA, 64 nt, Homo Sapiens; identical to SEQ ID NO: 564357

SEQ ID NO: 645797 - RNA, 64 nt, Homo Sapiens; identical to SEQ ID NO: 564358

SEQ ID NO: 645798 - RNA, 64 nt, Homo Sapiens; identical to SEQ ID NO: 564359

SEQ ID NO: 645799 - RNA, 64 nt, Homo Sapiens; identical to SEQ ID NO: 564360

SEQ ID NO: 645800 - RNA, 64 nt, Homo Sapiens; identical to SEQ ID NO: 564361

SEQ ID NO: 645801 - RNA, 64 nt, Homo Sapiens; identical to SEQ ID NO: 564362

SEQ ID NO: 645802 - RNA, 64 nt, Homo Sapiens; identical to SEQ ID NO: 564363

SEQ ID NO: 645803 - RNA, 64 nt, Homo Sapiens; identical to SEQ ID NO: 564364

SEQ ID NO: 645804 - RNA, 64 nt, Homo Sapiens; identical to SEQ ID NO: 564365

SEQ ID NO: 645805 - RNA, 64 nt, Homo Sapiens; identical to SEQ ID NO: 564366

SEQ ID NO: 645806 - RNA, 64 nt, Homo Sapiens; identical to SEQ ID NO: 564367

SEQ ID NO: 645807 - RNA, 64 nt, Homo Sapiens; identical to SEQ ID NO: 564368

SEQ ID NO: 645808 - RNA, 64 nt, Homo Sapiens; identical to SEQ ID NO: 564369

SEQ ID NO: 645809 - RNA, 64 nt, Homo Sapiens; identical to SEQ ID NO: 564370

SEQ ID NO: 645810 - RNA, 64 nt, Homo Sapiens; identical to SEQ ID NO: 564371

SEQ ID NO: 645811 - RNA, 64 nt, Homo Sapiens; identical to SEQ ID NO: 564372

SEQ ID NO: 645812 - RNA, 64 nt, Homo Sapiens; identical to SEQ ID NO: 564373

SEQ ID NO: 645813 - RNA, 64 nt, Homo Sapiens; identical to SEQ ID NO: 564374

SEQ ID NO: 645814 - RNA, 64 nt, Homo Sapiens; identical to SEQ ID NO: 564375

SEQ ID NO: 645815 - RNA, 64 nt, Homo Sapiens; identical to SEQ ID NO: 564376

SEQ ID NO: 645816 - RNA, 64 nt, Homo Sapiens; identical to SEQ ID NO: 564377

SEQ ID NO: 645817 - RNA, 64 nt, Homo Sapiens; identical to SEQ ID NO: 564378

SEQ ID NO: 645818 - RNA, 64 nt, Homo Sapiens; identical to SEQ ID NO: 564379

SEQ ID NO: 645819 - RNA, 64 nt, Homo Sapiens; identical to SEQ ID NO: 564380

SEQ ID NO: 645820 - RNA, 64 nt, Homo Sapiens; identical to SEQ ID NO: 564381

SEQ ID NO: 645821 - RNA, 64 nt, Homo Sapiens; identical to SEQ ID NO: 564382

SEQ ID NO: 645822 - RNA, 64 nt, Homo Sapiens; identical to SEQ ID NO: 564383

SEQ ID NO: 645823 - RNA, 64 nt, Homo Sapiens; identical to SEQ ID NO: 564384

SEQ ID NO: 645824 - RNA, 64 nt, Homo Sapiens; identical to SEQ ID NO: 564385

SEQ ID NO: 645825 - RNA, 64 nt, Homo Sapiens; identical to SEQ ID NO: 564386

SEQ ID NO: 645826 - RNA, 64 nt, Homo Sapiens; identical to SEQ ID NO: 564387

SEQ ID NO: 645827 - RNA, 64 nt, Homo Sapiens; identical to SEQ ID NO: 564388

SEQ ID NO: 645828 - RNA, 64 nt, Homo Sapiens; identical to SEQ ID NO: 564389

SEQ ID NO: 645829 - RNA, 64 nt, Homo Sapiens; identical to SEQ ID NO: 564390

SEQ ID NO: 645830 - RNA, 64 nt, Homo Sapiens; identical to SEQ ID NO: 564391

SEQ ID NO: 645831 - RNA, 64 nt, Homo Sapiens; identical to SEQ ID NO: 564392

SEQ ID NO: 645832 - RNA, 64 nt, Homo Sapiens; identical to SEQ ID NO: 564393

SEQ ID NO: 645833 - RNA, 64 nt, Homo Sapiens; identical to SEQ ID NO: 564394

SEQ ID NO: 645834 - RNA, 64 nt, Homo Sapiens; identical to SEQ ID NO: 564395

SEQ ID NO: 645835 - RNA, 64 nt, Homo Sapiens; identical to SEQ ID NO: 564396

SEQ ID NO: 645836 - RNA, 64 nt, Homo Sapiens; identical to SEQ ID NO: 564397

SEQ ID NO: 645837 - RNA, 64 nt, Homo Sapiens; identical to SEQ ID NO: 564398

SEQ ID NO: 645838 - RNA, 64 nt, Homo Sapiens; identical to SEQ ID NO: 564399

SEQ ID NO: 645839 - RNA, 64 nt, Homo Sapiens; identical to SEQ ID NO: 564400

SEQ ID NO: 645840 - RNA, 64 nt, Homo Sapiens; identical to SEQ ID NO: 564401

SEQ ID NO: 645841 - RNA, 64 nt, Homo Sapiens; identical to SEQ ID NO: 564402

SEQ ID NO: 645842 - RNA, 64 nt, Homo Sapiens; identical to SEQ ID NO: 564403

SEQ ID NO: 645843 - RNA, 64 nt, Homo Sapiens; identical to SEQ ID NO: 564404

SEQ ID NO: 645844 - RNA, 64 nt, Homo Sapiens; identical to SEQ ID NO: 564405

SEQ ID NO: 645845 - RNA, 64 nt, Homo Sapiens; identical to SEQ ID NO: 564406

SEQ ID NO: 645846 - RNA, 64 nt, Homo Sapiens; identical to SEQ ID NO: 564407

SEQ ID NO: 645847 - RNA, 64 nt, Homo Sapiens; identical to SEQ ID NO: 564408

SEQ ID NO: 645848 - RNA, 64 nt, Homo Sapiens; identical to SEQ ID NO: 564409

SEQ ID NO: 645849 - RNA, 64 nt, Homo Sapiens; identical to SEQ ID NO: 564410

SEQ ID NO: 645850 - RNA, 64 nt, Homo Sapiens; identical to SEQ ID NO: 564411

SEQ ID NO: 645851 - RNA, 64 nt, Homo Sapiens; identical to SEQ ID NO: 564412

SEQ ID NO: 645852 - RNA, 64 nt, Homo Sapiens; identical to SEQ ID NO: 564413

SEQ ID NO: 645853 - RNA, 64 nt, Homo Sapiens; identical to SEQ ID NO: 225055

SEQ ID NO: 645854 - RNA, 64 nt, Homo Sapiens; identical to SEQ ID NO: 225056

SEQ ID NO: 645855 - RNA, 64 nt, Homo Sapiens; identical to SEQ ID NO: 225057

SEQ ID NO: 645856 - RNA, 64 nt, Homo Sapiens; identical to SEQ ID NO: 225058

SEQ ID NO: 645857 - RNA, 64 nt, Homo Sapiens; identical to SEQ ID NO: 225059

SEQ ID NO: 645858 - RNA, 64 nt, Homo Sapiens; identical to SEQ ID NO: 225060

SEQ ID NO: 645859 - RNA, 64 nt, Homo Sapiens; identical to SEQ ID NO: 225061

SEQ ID NO: 645860 - RNA, 64 nt, Homo Sapiens; identical to SEQ ID NO: 225062

SEQ ID NO: 645861 - RNA, 64 nt, Homo Sapiens; identical to SEQ ID NO: 225063

SEQ ID NO: 645862 - RNA, 64 nt, Homo Sapiens; identical to SEQ ID NO: 225064

SEQ ID NO: 645863 - RNA, 64 nt, Homo Sapiens; identical to SEQ ID NO: 225065

SEQ ID NO: 645864 - RNA, 64 nt, Homo Sapiens; identical to SEQ ID NO: 225066

SEQ ID NO: 645865 - RNA, 64 nt, Homo Sapiens; identical to SEQ ID NO: 225067

SEQ ID NO: 645866 - RNA, 64 nt, Homo Sapiens; identical to SEQ ID NO: 225068

SEQ ID NO: 645867 - RNA, 64 nt, Homo Sapiens; identical to SEQ ID NO: 225069

SEQ ID NO: 645868 - RNA, 64 nt, Homo Sapiens; identical to SEQ ID NO: 225070

SEQ ID NO: 645869 - RNA, 64 nt, Homo Sapiens; identical to SEQ ID NO: 225071

SEQ ID NO: 645870 - RNA, 64 nt, Homo Sapiens; identical to SEQ ID NO: 225072

SEQ ID NO: 645871 - RNA, 64 nt, Homo Sapiens; identical to SEQ ID NO: 225073

SEQ ID NO: 645872 - RNA, 64 nt, Homo Sapiens; identical to SEQ ID NO: 225074

SEQ ID NO: 645873 - RNA, 64 nt, Homo Sapiens; identical to SEQ ID NO: 225075

SEQ ID NO: 645874 - RNA, 64 nt, Homo Sapiens; identical to SEQ ID NO: 225076

SEQ ID NO: 645875 - RNA, 64 nt, Homo Sapiens; identical to SEQ ID NO: 225077

SEQ ID NO: 645876 - RNA, 64 nt, Homo Sapiens; identical to SEQ ID NO: 225078

SEQ ID NO: 645877 - RNA, 64 nt, Homo Sapiens; identical to SEQ ID NO: 95053

SEQ ID NO: 645878 - RNA, 64 nt, Homo Sapiens; identical to SEQ ID NO: 95054

SEQ ID NO: 645879 - RNA, 64 nt, Homo Sapiens; identical to SEQ ID NO: 95055

SEQ ID NO: 645880 - RNA, 64 nt, Homo Sapiens; identical to SEQ ID NO: 95056

SEQ ID NO: 645881 - RNA, 64 nt, Homo Sapiens; identical to SEQ ID NO: 95057

SEQ ID NO: 645882 - RNA, 64 nt, Homo Sapiens; identical to SEQ ID NO: 95058

SEQ ID NO: 645883 - RNA, 64 nt, Homo Sapiens; identical to SEQ ID NO: 95059

SEQ ID NO: 645884 - RNA, 64 nt, Homo Sapiens; identical to SEQ ID NO: 95060

SEQ ID NO: 645885 - RNA, 64 nt, Homo Sapiens; identical to SEQ ID NO: 95061

SEQ ID NO: 645886 - RNA, 64 nt, Homo Sapiens; identical to SEQ ID NO: 95062

SEQ ID NO: 645887 - RNA, 64 nt, Homo Sapiens; identical to SEQ ID NO: 95063

SEQ ID NO: 645888 - RNA, 64 nt, Homo Sapiens; identical to SEQ ID NO: 95064

SEQ ID NO: 645889 - RNA, 64 nt, Homo Sapiens; identical to SEQ ID NO: 95065

SEQ ID NO: 645890 - RNA, 64 nt, Homo Sapiens; identical to SEQ ID NO: 95066

SEQ ID NO: 645891 - RNA, 64 nt, Homo Sapiens; identical to SEQ ID NO: 95067

SEQ ID NO: 645892 - RNA, 64 nt, Homo Sapiens; identical to SEQ ID NO: 95068

SEQ ID NO: 645893 - RNA, 64 nt, Homo Sapiens; identical to SEQ ID NO: 95069

SEQ ID NO: 645894 - RNA, 64 nt, Homo Sapiens; identical to SEQ ID NO: 95070

SEQ ID NO: 645895 - RNA, 64 nt, Homo Sapiens; identical to SEQ ID NO: 95071

SEQ ID NO: 645896 - RNA, 64 nt, Homo Sapiens; identical to SEQ ID NO: 95072

SEQ ID NO: 645897 - RNA, 64 nt, Homo Sapiens; identical to SEQ ID NO: 95073

SEQ ID NO: 645898 - RNA, 64 nt, Homo Sapiens; identical to SEQ ID NO: 95074

SEQ ID NO: 645899 - RNA, 64 nt, Homo Sapiens; identical to SEQ ID NO: 95075

SEQ ID NO: 645900 - RNA, 64 nt, Homo Sapiens; identical to SEQ ID NO: 95076

SEQ ID NO: 645901 - RNA, 64 nt, Homo Sapiens; identical to SEQ ID NO: 95077

SEQ ID NO: 645902 - RNA, 64 nt, Homo Sapiens; identical to SEQ ID NO: 95078

SEQ ID NO: 645903 - RNA, 64 nt, Homo Sapiens; identical to SEQ ID NO: 95079

SEQ ID NO: 645904 - RNA, 64 nt, Homo Sapiens; identical to SEQ ID NO: 119910

SEQ ID NO: 645905 - RNA, 64 nt, Homo Sapiens; identical to SEQ ID NO: 119911

SEQ ID NO: 645906 - RNA, 64 nt, Homo Sapiens; identical to SEQ ID NO: 119912

SEQ ID NO: 645907 - RNA, 64 nt, Homo Sapiens; identical to SEQ ID NO: 119913

SEQ ID NO: 645908 - RNA, 64 nt, Homo Sapiens; identical to SEQ ID NO: 119914

SEQ ID NO: 645909 - RNA, 64 nt, Homo Sapiens; identical to SEQ ID NO: 119915

SEQ ID NO: 645910 - RNA, 64 nt, Homo Sapiens; identical to SEQ ID NO: 119916

SEQ ID NO: 645911 - RNA, 64 nt, Homo Sapiens; identical to SEQ ID NO: 119917

SEQ ID NO: 645912 - RNA, 64 nt, Homo Sapiens; identical to SEQ ID NO: 119918

SEQ ID NO: 645913 - RNA, 64 nt, Homo Sapiens; identical to SEQ ID NO: 119919

SEQ ID NO: 645914 - RNA, 64 nt, Homo Sapiens; identical to SEQ ID NO: 119920

SEQ ID NO: 645915 - RNA, 64 nt, Homo Sapiens; identical to SEQ ID NO: 119921

SEQ ID NO: 645916 - RNA, 64 nt, Homo Sapiens; identical to SEQ ID NO: 119922

SEQ ID NO: 645917 - RNA, 64 nt, Homo Sapiens; identical to SEQ ID NO: 119923

SEQ ID NO: 645918 - RNA, 64 nt, Homo Sapiens; identical to SEQ ID NO: 119924

SEQ ID NO: 645919 - RNA, 64 nt, Homo Sapiens; identical to SEQ ID NO: 119925

SEQ ID NO: 645920 - RNA, 64 nt, Homo Sapiens; identical to SEQ ID NO: 119926

SEQ ID NO: 645921 - RNA, 64 nt, Homo Sapiens; identical to SEQ ID NO: 119927

SEQ ID NO: 645922 - RNA, 64 nt, Homo Sapiens; identical to SEQ ID NO: 119928

SEQ ID NO: 645923 - RNA, 64 nt, Homo Sapiens; identical to SEQ ID NO: 119929

SEQ ID NO: 645924 - RNA, 64 nt, Homo Sapiens; identical to SEQ ID NO: 119930

SEQ ID NO: 645925 - RNA, 64 nt, Homo Sapiens; identical to SEQ ID NO: 119931

SEQ ID NO: 645926 - RNA, 64 nt, Homo Sapiens; identical to SEQ ID NO: 119932

SEQ ID NO: 645927 - RNA, 64 nt, Homo Sapiens; identical to SEQ ID NO: 119933

SEQ ID NO: 645928 - RNA, 64 nt, Homo Sapiens; identical to SEQ ID NO: 119934

SEQ ID NO: 645929 - RNA, 64 nt, Homo Sapiens; identical to SEQ ID NO: 119935

SEQ ID NO: 645930 - RNA, 64 nt, Homo Sapiens; identical to SEQ ID NO: 119936

SEQ ID NO: 645931 - RNA, 64 nt, Homo Sapiens; identical to SEQ ID NO: 119937

SEQ ID NO: 645932 - RNA, 64 nt, Homo Sapiens; identical to SEQ ID NO: 119938

SEQ ID NO: 645933 - RNA, 64 nt, Homo Sapiens; identical to SEQ ID NO: 119939

SEQ ID NO: 645934 - RNA, 64 nt, Homo Sapiens; identical to SEQ ID NO: 119940

SEQ ID NO: 645935 - RNA, 64 nt, Homo Sapiens; identical to SEQ ID NO: 119941

SEQ ID NO: 645936 - RNA, 64 nt, Homo Sapiens; identical to SEQ ID NO: 119942

SEQ ID NO: 645937 - RNA, 64 nt, Homo Sapiens; identical to SEQ ID NO: 119943

SEQ ID NO: 645938 - RNA, 64 nt, Homo Sapiens; identical to SEQ ID NO: 119944

SEQ ID NO: 645939 - RNA, 64 nt, Homo Sapiens; identical to SEQ ID NO: 119945

SEQ ID NO: 645940 - RNA, 64 nt, Homo Sapiens; identical to SEQ ID NO: 119946

SEQ ID NO: 645941 - RNA, 64 nt, Homo Sapiens; identical to SEQ ID NO: 119947

SEQ ID NO: 645942 - RNA, 64 nt, Homo Sapiens; identical to SEQ ID NO: 119948

SEQ ID NO: 645943 - RNA, 64 nt, Homo Sapiens; identical to SEQ ID NO: 119949

SEQ ID NO: 645944 - RNA, 64 nt, Homo Sapiens; identical to SEQ ID NO: 119950

SEQ ID NO: 645945 - RNA, 64 nt, Homo Sapiens; identical to SEQ ID NO: 119951

SEQ ID NO: 645946 - RNA, 64 nt, Homo Sapiens; identical to SEQ ID NO: 119952

SEQ ID NO: 645947 - RNA, 64 nt, Homo Sapiens; identical to SEQ ID NO: 119953

SEQ ID NO: 645948 - RNA, 64 nt, Homo Sapiens; identical to SEQ ID NO: 119954

SEQ ID NO: 645949 - RNA, 64 nt, Homo Sapiens; identical to SEQ ID NO: 119955

SEQ ID NO: 645950 - RNA, 64 nt, Homo Sapiens; identical to SEQ ID NO: 119956

SEQ ID NO: 645951 - RNA, 64 nt, Homo Sapiens; identical to SEQ ID NO: 119957

SEQ ID NO: 645952 - RNA, 64 nt, Homo Sapiens; identical to SEQ ID NO: 119958

SEQ ID NO: 645953 - RNA, 64 nt, Homo Sapiens; identical to SEQ ID NO: 119959

SEQ ID NO: 645954 - RNA, 64 nt, Homo Sapiens; identical to SEQ ID NO: 119960

SEQ ID NO: 645955 - RNA, 64 nt, Homo Sapiens; identical to SEQ ID NO: 119961

SEQ ID NO: 645956 - RNA, 58 nt, Homo Sapiens; identical to SEQ ID NO: 119962

SEQ ID NO: 645957 - RNA, 64 nt, Homo Sapiens; identical to SEQ ID NO: 119963

SEQ ID NO: 645958 - RNA, 64 nt, Homo Sapiens; identical to SEQ ID NO: 119964

SEQ ID NO: 645959 - RNA, 64 nt, Homo Sapiens; identical to SEQ ID NO: 119965

SEQ ID NO: 645960 - RNA, 64 nt, Homo Sapiens; identical to SEQ ID NO: 119966

SEQ ID NO: 645961 - RNA, 64 nt, Homo Sapiens; identical to SEQ ID NO: 119967

SEQ ID NO: 645962 - RNA, 64 nt, Homo Sapiens; identical to SEQ ID NO: 119968

SEQ ID NO: 645963 - RNA, 64 nt, Homo Sapiens; identical to SEQ ID NO: 119969

SEQ ID NO: 645964 - RNA, 64 nt, Homo Sapiens; identical to SEQ ID NO: 119970

SEQ ID NO: 645965 - RNA, 55 nt, Homo Sapiens; identical to SEQ ID NO: 119971

SEQ ID NO: 645966 - RNA, 64 nt, Homo Sapiens; identical to SEQ ID NO: 119972

SEQ ID NO: 645967 - RNA, 64 nt, Homo Sapiens; identical to SEQ ID NO: 119973

SEQ ID NO: 645968 - RNA, 64 nt, Homo Sapiens; identical to SEQ ID NO: 119974

SEQ ID NO: 645969 - RNA, 64 nt, Homo Sapiens; identical to SEQ ID NO: 119975

SEQ ID NO: 645970 - RNA, 64 nt, Homo Sapiens; identical to SEQ ID NO: 119976

SEQ ID NO: 645971 - RNA, 64 nt, Homo Sapiens; identical to SEQ ID NO: 119977

SEQ ID NO: 645972 - RNA, 64 nt, Homo Sapiens; identical to SEQ ID NO: 119978

SEQ ID NO: 645973 - RNA, 64 nt, Homo Sapiens; identical to SEQ ID NO: 119979

SEQ ID NO: 645974 - RNA, 64 nt, Homo Sapiens; identical to SEQ ID NO: 119980

SEQ ID NO: 645975 - RNA, 64 nt, Homo Sapiens; identical to SEQ ID NO: 119981

SEQ ID NO: 645976 - RNA, 64 nt, Homo Sapiens; identical to SEQ ID NO: 119982

SEQ ID NO: 645977 - RNA, 64 nt, Homo Sapiens; identical to SEQ ID NO: 119983

SEQ ID NO: 645978 - RNA, 64 nt, Homo Sapiens; identical to SEQ ID NO: 119984

SEQ ID NO: 645979 - RNA, 64 nt, Homo Sapiens; identical to SEQ ID NO: 119985

SEQ ID NO: 645980 - RNA, 64 nt, Homo Sapiens; identical to SEQ ID NO: 119986

SEQ ID NO: 645981 - RNA, 64 nt, Homo Sapiens; identical to SEQ ID NO: 119987

SEQ ID NO: 645982 - RNA, 55 nt, Homo Sapiens; identical to SEQ ID NO: 119988

SEQ ID NO: 645983 - RNA, 64 nt, Homo Sapiens; identical to SEQ ID NO: 119989

SEQ ID NO: 645984 - RNA, 64 nt, Homo Sapiens; identical to SEQ ID NO: 119990

SEQ ID NO: 645985 - RNA, 64 nt, Homo Sapiens; identical to SEQ ID NO: 119991

SEQ ID NO: 645986 - RNA, 64 nt, Homo Sapiens; identical to SEQ ID NO: 119992

SEQ ID NO: 645987 - RNA, 64 nt, Homo Sapiens; identical to SEQ ID NO: 119993

SEQ ID NO: 645988 - RNA, 64 nt, Homo Sapiens; identical to SEQ ID NO: 119994

SEQ ID NO: 645989 - RNA, 64 nt, Homo Sapiens; identical to SEQ ID NO: 119995

SEQ ID NO: 645990 - RNA, 64 nt, Homo Sapiens; identical to SEQ ID NO: 119996

SEQ ID NO: 645991 - RNA, 64 nt, Homo Sapiens; identical to SEQ ID NO: 119997

SEQ ID NO: 645992 - RNA, 64 nt, Homo Sapiens; identical to SEQ ID NO: 119998

SEQ ID NO: 645993 - RNA, 62 nt, Homo Sapiens; identical to SEQ ID NO: 119999

SEQ ID NO: 645994 - RNA, 64 nt, Homo Sapiens; identical to SEQ ID NO: 120000

SEQ ID NO: 645995 - RNA, 64 nt, Homo Sapiens; identical to SEQ ID NO: 120001

SEQ ID NO: 645996 - RNA, 64 nt, Homo Sapiens; identical to SEQ ID NO: 120002

SEQ ID NO: 645997 - RNA, 64 nt, Homo Sapiens; identical to SEQ ID NO: 120003

SEQ ID NO: 645998 - RNA, 64 nt, Homo Sapiens; identical to SEQ ID NO: 120004

SEQ ID NO: 645999 - RNA, 64 nt, Homo Sapiens; identical to SEQ ID NO: 120005

SEQ ID NO: 646000 - RNA, 64 nt, Homo Sapiens; identical to SEQ ID NO: 120006

SEQ ID NO: 646001 - RNA, 64 nt, Homo Sapiens; identical to SEQ ID NO: 120007

SEQ ID NO: 646002 - RNA, 64 nt, Homo Sapiens; identical to SEQ ID NO: 120008

SEQ ID NO: 646003 - RNA, 64 nt, Homo Sapiens; identical to SEQ ID NO: 239468

SEQ ID NO: 646004 - RNA, 64 nt, Homo Sapiens; identical to SEQ ID NO: 239469

SEQ ID NO: 646005 - RNA, 64 nt, Homo Sapiens; identical to SEQ ID NO: 239470

SEQ ID NO: 646006 - RNA, 64 nt, Homo Sapiens; identical to SEQ ID NO: 239471

SEQ ID NO: 646007 - RNA, 64 nt, Homo Sapiens; identical to SEQ ID NO: 239472

SEQ ID NO: 646008 - RNA, 64 nt, Homo Sapiens; identical to SEQ ID NO: 239473

SEQ ID NO: 646009 - RNA, 64 nt, Homo Sapiens; identical to SEQ ID NO: 239474

SEQ ID NO: 646010 - RNA, 64 nt, Homo Sapiens; identical to SEQ ID NO: 239475

SEQ ID NO: 646011 - RNA, 64 nt, Homo Sapiens; identical to SEQ ID NO: 239476

SEQ ID NO: 646012 - RNA, 64 nt, Homo Sapiens; identical to SEQ ID NO: 239477

SEQ ID NO: 646013 - RNA, 64 nt, Homo Sapiens; identical to SEQ ID NO: 239478

SEQ ID NO: 646014 - RNA, 64 nt, Homo Sapiens; identical to SEQ ID NO: 239479

SEQ ID NO: 646015 - RNA, 64 nt, Homo Sapiens; identical to SEQ ID NO: 239480

SEQ ID NO: 646016 - RNA, 64 nt, Homo Sapiens; identical to SEQ ID NO: 239481

SEQ ID NO: 646017 - RNA, 64 nt, Homo Sapiens; identical to SEQ ID NO: 239482

SEQ ID NO: 646018 - RNA, 64 nt, Homo Sapiens; identical to SEQ ID NO: 239483

SEQ ID NO: 646019 - RNA, 64 nt, Homo Sapiens; identical to SEQ ID NO: 239484

SEQ ID NO: 646020 - RNA, 64 nt, Homo Sapiens; identical to SEQ ID NO: 239485

SEQ ID NO: 646021 - RNA, 64 nt, Homo Sapiens; identical to SEQ ID NO: 239486

SEQ ID NO: 646022 - RNA, 64 nt, Homo Sapiens; identical to SEQ ID NO: 239487

SEQ ID NO: 646023 - RNA, 64 nt, Homo Sapiens; identical to SEQ ID NO: 239488

SEQ ID NO: 646024 - RNA, 64 nt, Homo Sapiens; identical to SEQ ID NO: 239489

SEQ ID NO: 646025 - RNA, 64 nt, Homo Sapiens; identical to SEQ ID NO: 239490

SEQ ID NO: 646026 - RNA, 64 nt, Homo Sapiens; identical to SEQ ID NO: 239491

SEQ ID NO: 646027 - RNA, 64 nt, Homo Sapiens; identical to SEQ ID NO: 239492

SEQ ID NO: 646028 - RNA, 64 nt, Homo Sapiens; identical to SEQ ID NO: 239493

SEQ ID NO: 646029 - RNA, 64 nt, Homo Sapiens; identical to SEQ ID NO: 239494

SEQ ID NO: 646030 - RNA, 64 nt, Homo Sapiens; identical to SEQ ID NO: 239495

SEQ ID NO: 646031 - RNA, 64 nt, Homo Sapiens; identical to SEQ ID NO: 239496

SEQ ID NO: 646032 - RNA, 64 nt, Homo Sapiens; identical to SEQ ID NO: 239497

SEQ ID NO: 646033 - RNA, 64 nt, Homo Sapiens; identical to SEQ ID NO: 239498

SEQ ID NO: 646034 - RNA, 64 nt, Homo Sapiens; identical to SEQ ID NO: 239499

SEQ ID NO: 646035 - RNA, 64 nt, Homo Sapiens; identical to SEQ ID NO: 239500

SEQ ID NO: 646036 - RNA, 64 nt, Homo Sapiens; identical to SEQ ID NO: 239501

SEQ ID NO: 646037 - RNA, 64 nt, Homo Sapiens; identical to SEQ ID NO: 239502

SEQ ID NO: 646038 - RNA, 64 nt, Homo Sapiens; identical to SEQ ID NO: 239503

SEQ ID NO: 646039 - RNA, 64 nt, Homo Sapiens; identical to SEQ ID NO: 239504

SEQ ID NO: 646040 - RNA, 64 nt, Homo Sapiens; identical to SEQ ID NO: 239505

SEQ ID NO: 646041 - RNA, 64 nt, Homo Sapiens; identical to SEQ ID NO: 239506

SEQ ID NO: 646042 - RNA, 64 nt, Homo Sapiens; identical to SEQ ID NO: 239507

SEQ ID NO: 646043 - RNA, 64 nt, Homo Sapiens; identical to SEQ ID NO: 239508

SEQ ID NO: 646044 - RNA, 64 nt, Homo Sapiens; identical to SEQ ID NO: 239509

SEQ ID NO: 646045 - RNA, 64 nt, Homo Sapiens; identical to SEQ ID NO: 239510

SEQ ID NO: 646046 - RNA, 64 nt, Homo Sapiens; identical to SEQ ID NO: 239511

SEQ ID NO: 646047 - RNA, 64 nt, Homo Sapiens; identical to SEQ ID NO: 239512

SEQ ID NO: 646048 - RNA, 64 nt, Homo Sapiens; identical to SEQ ID NO: 239513

SEQ ID NO: 646049 - RNA, 64 nt, Homo Sapiens; identical to SEQ ID NO: 239514

SEQ ID NO: 646050 - RNA, 64 nt, Homo Sapiens
ccauauaaaugaggcucaguccgagccauggaucaacuaggagcucaucuuacucaucuuaagc

SEQ ID NO: 646051 - RNA, 64 nt, Homo Sapiens
aaguccaucucaagguggacccagaaugcggcagaacuaggaguagaggggucuggaaagaaac

SEQ ID NO: 646052 - RNA, 64 nt, Homo Sapiens; identical to SEQ ID NO: 172966

SEQ ID NO: 646053 - RNA, 64 nt, Homo Sapiens; identical to SEQ ID NO: 172967

SEQ ID NO: 646054 - RNA, 64 nt, Homo Sapiens; identical to SEQ ID NO: 172968

SEQ ID NO: 646055 - RNA, 64 nt, Homo Sapiens; identical to SEQ ID NO: 172969

SEQ ID NO: 646056 - RNA, 64 nt, Homo Sapiens; identical to SEQ ID NO: 172970

SEQ ID NO: 646057 - RNA, 64 nt, Homo Sapiens; identical to SEQ ID NO: 172971

SEQ ID NO: 646058 - RNA, 64 nt, Homo Sapiens; identical to SEQ ID NO: 172972

SEQ ID NO: 646059 - RNA, 64 nt, Homo Sapiens; identical to SEQ ID NO: 172973

SEQ ID NO: 646060 - RNA, 64 nt, Homo Sapiens
ucuuaacaaaaauauggauaugaauucaguagauaucuuaaauucaauaaaaucacuggaaguu

SEQ ID NO: 646061 - RNA, 64 nt, Homo Sapiens
uuuucaugauaacuuauuuuaagaugccuuaaaaaucuuaaagucacaaaaggaaaaagguuuu

SEQ ID NO: 646062 - RNA, 64 nt, Homo Sapiens
uuccagguuagguccuuuucuuucucauugaaucaucuuaaauaguucuuggcccugaauuuag

SEQ ID NO: 646063 - RNA, 64 nt, Homo Sapiens
uuuuuuccuuaaaagccacaggggacaguuaaauaucuuaaaauaucuaaaacauuuuuuaaag

SEQ ID NO: 646064 - RNA, 64 nt, Homo Sapiens
uaaagaaggcugggcgugguuagagcgagaccccaucuuaaaaacucagcugcagccuggacag

SEQ ID NO: 646065 - RNA, 64 nt, Homo Sapiens
cacuuugggacugggaucccugaucuuagauuugaucuuaaaaugcuuggauaacuggguacuu

SEQ ID NO: 646066 - RNA, 64 nt, Homo Sapiens
agcaacguauugugaguacuacuuauaaacagccaucuuaaauauguugcucaaacugcuuuau

SEQ ID NO: 646067 - RNA, 64 nt, Homo Sapiens
uaugauucaguaacuucuuagauuugugccacugaucuuaaaccacauaaucuucuacauguau

SEQ ID NO: 646068 - RNA, 64 nt, Homo Sapiens
uuccuucuuugaagagaaucccaaaaguuaguucaucuuaaagugcaauauuguuuaaucuuaa

SEQ ID NO: 646069 - RNA, 64 nt, Homo Sapiens
aaaguuaguucaucuuaaagugcaauauuguuuaaucuuaaaacugggcaacuuuggaagaacu

SEQ ID NO: 646070 - RNA, 64 nt, Homo Sapiens
uuauaaucaggcuacauucacauuuucuuuucucaucuuaaaacccuuuauguucaaaauacau

SEQ ID NO: 646071 - RNA, 64 nt, Homo Sapiens
augaaaaugaggacacuuucugauggucaguaaaaucuuaaaugauuuuugccacugguauucc

SEQ ID NO: 646072 - RNA, 64 nt, Homo Sapiens
aauugauagauuuuacaucucauuuauguuuauuaucuuaaagcaaauaguuggugcuuacuuu

SEQ ID NO: 646073 - RNA, 64 nt, Homo Sapiens
cuucauaucuagguauccauuaaauuuuuuuuaaaucuuaaaacuaguuuuuaacuuuuauguu

SEQ ID NO: 646074 - RNA, 64 nt, Homo Sapiens
uguuguuaucaugacuggugagacaacaucuuaaaucuuaaaaguuguacuaagcuccucugua

SEQ ID NO: 646075 - RNA, 64 nt, Homo Sapiens
uuaaaaguguuguuaucaugcucuguaagacaacaucuuaaaucaaagcauuuguacuaagcuc

SEQ ID NO: 646076 - RNA, 64 nt, Homo Sapiens
auuccaccuccaucgucuuuaauaacuggacauaaucuuaaaggacuucuucuuuauuaaagca

SEQ ID NO: 646077 - RNA, 64 nt, Homo Sapiens
uucaccuuaaguaaauggcccuuacuuuagcuccaucuuaaaauugguucuaaaaaccagugau

SEQ ID NO: 646078 - RNA, 64 nt, Homo Sapiens
ucauagagcacugugauucauuugagauauaaguaucuuaaauagccuguagaguuucaaccuc

SEQ ID NO: 646079 - RNA, 64 nt, Homo Sapiens
aggaacauaauaaaagaucgaaaaaauaaaaagaaucuuaaaaugagcgagacuccaucucaaa

SEQ ID NO: 646080 - RNA, 64 nt, Homo Sapiens
uaauggacuaaaaaaguagagaggaguuguagagaucuuaaaucauucuggaauuccuaauuau

SEQ ID NO: 646081 - RNA, 64 nt, Homo Sapiens
uuccucauuucuccugauuucuauucuugucucaaucuuaaauuuagagaccaguuguuuuuau

SEQ ID NO: 646082 - RNA, 64 nt, Homo Sapiens
agcagcagcaagguaccuugcucauuuaaaguauaucuuaaaaaagguaaaauccaucugggca

SEQ ID NO: 646083 - RNA, 64 nt, Homo Sapiens
uaaaauccaucugggcacucagucacaagcaaauaucuuaaaggaaauccaacagaaaucuaga

SEQ ID NO: 646084 - RNA, 64 nt, Homo Sapiens
uuaugaauuuuucagaacucauccaguccuuguaaucuuaaacagaugcaaauccuaccccugc

SEQ ID NO: 646085 - RNA, 64 nt, Homo Sapiens
gcguugccucucacuuugaaagaaagacuccguaaucuuaaacagaugcaaauccaauuaggcg

SEQ ID NO: 646086 - RNA, 64 nt, Homo Sapiens
gggguggggauggauuaugaugaaaucauuuucaaucuuaaaauauaauacaacaaucuugcaa

SEQ ID NO: 646087 - RNA, 64 nt, Homo Sapiens
aauucaaguuuagaaacagguaaucagcuauuugaucuuaaaaggcaaugaauuguugggauau

SEQ ID NO: 646088 - RNA, 64 nt, Homo Sapiens
aguaauaaugggugcuauauagugaugcuuauauaucuuaaauuuagacacuauauaaauccgc

SEQ ID NO: 646089 - RNA, 64 nt, Homo Sapiens
agccacuuagccugaaugggccucaagauuaggaaucuuaaaagucucaaugugaagauuguaa

SEQ ID NO: 646090 - RNA, 64 nt, Homo Sapiens
aucuaaaauguuuuaugacauuuuucuggcugugaucuuaaaauaauucauaucuaaauaguau

SEQ ID NO: 646091 - RNA, 64 nt, Homo Sapiens
agucuauaaugugaguaguuacuaaaauuuacacaucuuaaaaguguguaaaugcuuaaauuuc

SEQ ID NO: 646092 - RNA, 64 nt, Homo Sapiens
aagcauguuucuuuucuauacaugagauguuccuaucuuaaauaaaaaugaaagcuuuagaagg

SEQ ID NO: 646093 - RNA, 64 nt, Homo Sapiens
uacaauuucuaagcacuuguauaaaaaggaccuaaucuuaaaaaaaaucccauggcaaagggua

SEQ ID NO: 646094 - RNA, 64 nt, Homo Sapiens
gcaaagcaguauauugguaguguguggcagauagaucuuaaaggugguuuagugguuuaagccu

SEQ ID NO: 646095 - RNA, 64 nt, Homo Sapiens
uaguuuuuuguaacacgaauaguuacaaaaauaaaucuuaaaguuuguuuucccuguugaaaaa

SEQ ID NO: 646096 - RNA, 64 nt, Homo Sapiens
agcaucuuggugacuaaggugacuuuguauauucaucuuaaaaauuauguucuuuagacacugc

SEQ ID NO: 646097 - RNA, 64 nt, Homo Sapiens
ugaguuauauuuauaaauauaucuucagaaauuaaucuuaaaagaggcauuaguucagaauacu

SEQ ID NO: 646098 - RNA, 64 nt, Homo Sapiens
uguaaacuggcccuauuacucugcugccagagcaaucuuaaaaaccuuccaaccacccuccaca

SEQ ID NO: 646099 - RNA, 64 nt, Homo Sapiens
aauuccaagcugagucuucugcaaauaacauaaaaucuuaaaauacuuacuuuuccauaauauu

SEQ ID NO: 646100 - RNA, 64 nt, Homo Sapiens
auuuauucauuccagaauguucuuaacacauuuuaucuuaaauaccuuuaacccugacauucag

SEQ ID NO: 646101 - RNA, 64 nt, Homo Sapiens
aaaauagcaaaccaacauuuagacaaucuuuggcaucuuaaaauaggagacacugcaaagucuu

SEQ ID NO: 646102 - RNA, 64 nt, Homo Sapiens
guccgauucacuacuuguuaauguaguaaacaauaucuuaaaguacagaucuguuuauuucagu

SEQ ID NO: 646103 - RNA, 64 nt, Homo Sapiens
guuuagcuaaaagcaugaauaaaaguaauauugaaucuuaaagucacauuucagaggagagaaa

SEQ ID NO: 646104 - RNA, 64 nt, Homo Sapiens
ucccuuccagcucugaaauggggugcuggauuggaucuuaaagauuuucucauugguaaaaugu

SEQ ID NO: 646105 - RNA, 64 nt, Homo Sapiens
ugcaaggaaaaaagacugccaaauuuaagaauuuaucuuaaaaauacgaguucugcugaucagg

SEQ ID NO: 646106 - RNA, 64 nt, Homo Sapiens
auuaaguuacuauaaauuuggggauccuagagugaucuuaaauauggcaagauacagcucauuu

SEQ ID NO: 646107 - RNA, 64 nt, Homo Sapiens
aaauggcgcaaauauaccuccauuuauauuuuguaucuuaaaauguaguuuaaaaauaggacca

SEQ ID NO: 646108 - RNA, 64 nt, Homo Sapiens
caucccucagguguucuauuaaaucccuuaaaggaucuuaaagaguagaugcuuuguauaucuu

SEQ ID NO: 646109 - RNA, 64 nt, Homo Sapiens
ccuuaaaggaucuuaaagacuagaugcuuuguauaucuuaaaucuuugcccugucaguggaugg

SEQ ID NO: 646110 - RNA, 64 nt, Homo Sapiens
acaugaucaguauucagugcaauuuaauagaauuaucuuaaaauaauuuucuuucuaaaaguau

SEQ ID NO: 646111 - RNA, 64 nt, Homo Sapiens
uugugaugugacaugauauauauuaccaagaaaaaucuuaaaagguuuaugcauauugcaugag

SEQ ID NO: 646112 - RNA, 64 nt, Homo Sapiens
cuguuccuagacugcuagaaucuggccccuggccaucuuaaagugccaacauaugccugcaggg

SEQ ID NO: 646113 - RNA, 64 nt, Homo Sapiens
ggcuagcaguucuaaugugacauucuuuaagcauaucuuaaaauaguauuuaaguaaauggucu

SEQ ID NO: 646114 - RNA, 64 nt, Homo Sapiens
agugcaagcagaugacaaaaaggugcagaaggcaaucuuaaaacagaaaggugcaggagguacc

SEQ ID NO: 646115 - RNA, 64 nt, Homo Sapiens
uuggaaaucaggucgauuugugguaacuguagucaucuuaaauuucaaaccauuuaccaucuga

SEQ ID NO: 646116 - RNA, 64 nt, Homo Sapiens
uauaaagaaccaaagguuuagucaagaaacaaaaaucuuaaagauuauuauaacccagacuaag

SEQ ID NO: 646117 - RNA, 64 nt, Homo Sapiens
uauuuacucaaaguuaagcuuaaaaauaaguuuuaucuuaaaaucauauuugaagacaguaaga

SEQ ID NO: 646118 - RNA, 64 nt, Homo Sapiens; identical to SEQ ID NO: 50174

SEQ ID NO: 646119 - RNA, 64 nt, Homo Sapiens; identical to SEQ ID NO: 50175

SEQ ID NO: 646120 - RNA, 64 nt, Homo Sapiens; identical to SEQ ID NO: 50176

SEQ ID NO: 646121 - RNA, 64 nt, Homo Sapiens; identical to SEQ ID NO: 50177

SEQ ID NO: 646122 - RNA, 64 nt, Homo Sapiens; identical to SEQ ID NO: 50178

SEQ ID NO: 646123 - RNA, 64 nt, Homo Sapiens; identical to SEQ ID NO: 50179

SEQ ID NO: 646124 - RNA, 64 nt, Homo Sapiens; identical to SEQ ID NO: 50180

SEQ ID NO: 646125 - RNA, 64 nt, Homo Sapiens; identical to SEQ ID NO: 50181

SEQ ID NO: 646126 - RNA, 64 nt, Homo Sapiens; identical to SEQ ID NO: 50182

SEQ ID NO: 646127 - RNA, 64 nt, Homo Sapiens; identical to SEQ ID NO: 50183

SEQ ID NO: 646128 - RNA, 64 nt, Homo Sapiens; identical to SEQ ID NO: 50184

SEQ ID NO: 646129 - RNA, 64 nt, Homo Sapiens; identical to SEQ ID NO: 50185

SEQ ID NO: 646130 - RNA, 64 nt, Homo Sapiens; identical to SEQ ID NO: 50186

SEQ ID NO: 646131 - RNA, 64 nt, Homo Sapiens; identical to SEQ ID NO: 50187

SEQ ID NO: 646132 - RNA, 64 nt, Homo Sapiens; identical to SEQ ID NO: 50188

SEQ ID NO: 646133 - RNA, 64 nt, Homo Sapiens; identical to SEQ ID NO: 50189

SEQ ID NO: 646134 - RNA, 64 nt, Homo Sapiens; identical to SEQ ID NO: 50190

SEQ ID NO: 646135 - RNA, 64 nt, Homo Sapiens; identical to SEQ ID NO: 50191

SEQ ID NO: 646136 - RNA, 64 nt, Homo Sapiens; identical to SEQ ID NO: 50192

SEQ ID NO: 646137 - RNA, 64 nt, Homo Sapiens; identical to SEQ ID NO: 50193

SEQ ID NO: 646138 - RNA, 64 nt, Homo Sapiens; identical to SEQ ID NO: 50194

SEQ ID NO: 646139 - RNA, 64 nt, Homo Sapiens; identical to SEQ ID NO: 50195

SEQ ID NO: 646140 - RNA, 64 nt, Homo Sapiens; identical to SEQ ID NO: 50196

SEQ ID NO: 646141 - RNA, 64 nt, Homo Sapiens; identical to SEQ ID NO: 50197

SEQ ID NO: 646142 - RNA, 64 nt, Homo Sapiens; identical to SEQ ID NO: 50198

SEQ ID NO: 646143 - RNA, 64 nt, Homo Sapiens; identical to SEQ ID NO: 50199

SEQ ID NO: 646144 - RNA, 64 nt, Homo Sapiens; identical to SEQ ID NO: 50200

SEQ ID NO: 646145 - RNA, 64 nt, Homo Sapiens; identical to SEQ ID NO: 50201

SEQ ID NO: 646146 - RNA, 64 nt, Homo Sapiens; identical to SEQ ID NO: 50202

SEQ ID NO: 646147 - RNA, 64 nt, Homo Sapiens; identical to SEQ ID NO: 50203

SEQ ID NO: 646148 - RNA, 64 nt, Homo Sapiens; identical to SEQ ID NO: 50204

SEQ ID NO: 646149 - RNA, 64 nt, Homo Sapiens; identical to SEQ ID NO: 50205

SEQ ID NO: 646150 - RNA, 64 nt, Homo Sapiens; identical to SEQ ID NO: 50206

SEQ ID NO: 646151 - RNA, 64 nt, Homo Sapiens; identical to SEQ ID NO: 50207

SEQ ID NO: 646152 - RNA, 64 nt, Homo Sapiens; identical to SEQ ID NO: 50208

SEQ ID NO: 646153 - RNA, 64 nt, Homo Sapiens; identical to SEQ ID NO: 50209

SEQ ID NO: 646154 - RNA, 64 nt, Homo Sapiens; identical to SEQ ID NO: 50210

SEQ ID NO: 646155 - RNA, 64 nt, Homo Sapiens; identical to SEQ ID NO: 50211

SEQ ID NO: 646156 - RNA, 64 nt, Homo Sapiens; identical to SEQ ID NO: 50212

SEQ ID NO: 646157 - RNA, 64 nt, Homo Sapiens; identical to SEQ ID NO: 50213

SEQ ID NO: 646158 - RNA, 64 nt, Homo Sapiens; identical to SEQ ID NO: 50214

SEQ ID NO: 646159 - RNA, 64 nt, Homo Sapiens; identical to SEQ ID NO: 50215

SEQ ID NO: 646160 - RNA, 64 nt, Homo Sapiens; identical to SEQ ID NO: 50216

SEQ ID NO: 646161 - RNA, 64 nt, Homo Sapiens; identical to SEQ ID NO: 50217

SEQ ID NO: 646162 - RNA, 64 nt, Homo Sapiens; identical to SEQ ID NO: 50218

SEQ ID NO: 646163 - RNA, 64 nt, Homo Sapiens; identical to SEQ ID NO: 50219

SEQ ID NO: 646164 - RNA, 64 nt, Homo Sapiens; identical to SEQ ID NO: 50220

SEQ ID NO: 646165 - RNA, 64 nt, Homo Sapiens; identical to SEQ ID NO: 50221

SEQ ID NO: 646166 - RNA, 64 nt, Homo Sapiens; identical to SEQ ID NO: 50222

SEQ ID NO: 646167 - RNA, 64 nt, Homo Sapiens; identical to SEQ ID NO: 50223

SEQ ID NO: 646168 - RNA, 64 nt, Homo Sapiens; identical to SEQ ID NO: 50224

SEQ ID NO: 646169 - RNA, 64 nt, Homo Sapiens; identical to SEQ ID NO: 50225

SEQ ID NO: 646170 - RNA, 64 nt, Homo Sapiens; identical to SEQ ID NO: 50226

SEQ ID NO: 646171 - RNA, 64 nt, Homo Sapiens; identical to SEQ ID NO: 50227

SEQ ID NO: 646172 - RNA, 64 nt, Homo Sapiens; identical to SEQ ID NO: 50228

SEQ ID NO: 646173 - RNA, 64 nt, Homo Sapiens; identical to SEQ ID NO: 50229

SEQ ID NO: 646174 - RNA, 64 nt, Homo Sapiens; identical to SEQ ID NO: 50230

SEQ ID NO: 646175 - RNA, 64 nt, Homo Sapiens; identical to SEQ ID NO: 50231

SEQ ID NO: 646176 - RNA, 64 nt, Homo Sapiens; identical to SEQ ID NO: 50232

SEQ ID NO: 646177 - RNA, 64 nt, Homo Sapiens; identical to SEQ ID NO: 50233

SEQ ID NO: 646178 - RNA, 64 nt, Homo Sapiens; identical to SEQ ID NO: 50234

SEQ ID NO: 646179 - RNA, 64 nt, Homo Sapiens; identical to SEQ ID NO: 50235

SEQ ID NO: 646180 - RNA, 64 nt, Homo Sapiens; identical to SEQ ID NO: 50236

SEQ ID NO: 646181 - RNA, 64 nt, Homo Sapiens; identical to SEQ ID NO: 50237

SEQ ID NO: 646182 - RNA, 64 nt, Homo Sapiens; identical to SEQ ID NO: 50238

SEQ ID NO: 646183 - RNA, 64 nt, Homo Sapiens; identical to SEQ ID NO: 50239

SEQ ID NO: 646184 - RNA, 64 nt, Homo Sapiens; identical to SEQ ID NO: 50240

SEQ ID NO: 646185 - RNA, 64 nt, Homo Sapiens; identical to SEQ ID NO: 50241

SEQ ID NO: 646186 - RNA, 64 nt, Homo Sapiens; identical to SEQ ID NO: 50242

SEQ ID NO: 646187 - RNA, 64 nt, Homo Sapiens; identical to SEQ ID NO: 50243

SEQ ID NO: 646188 - RNA, 64 nt, Homo Sapiens; identical to SEQ ID NO: 392567

SEQ ID NO: 646189 - RNA, 64 nt, Homo Sapiens; identical to SEQ ID NO: 392568

SEQ ID NO: 646190 - RNA, 64 nt, Homo Sapiens; identical to SEQ ID NO: 392569

SEQ ID NO: 646191 - RNA, 64 nt, Homo Sapiens; identical to SEQ ID NO: 392570

SEQ ID NO: 646192 - RNA, 64 nt, Homo Sapiens; identical to SEQ ID NO: 392571

SEQ ID NO: 646193 - RNA, 64 nt, Homo Sapiens; identical to SEQ ID NO: 392572

SEQ ID NO: 646194 - RNA, 64 nt, Homo Sapiens; identical to SEQ ID NO: 392573

SEQ ID NO: 646195 - RNA, 64 nt, Homo Sapiens; identical to SEQ ID NO: 392574

SEQ ID NO: 646196 - RNA, 64 nt, Homo Sapiens; identical to SEQ ID NO: 392575

SEQ ID NO: 646197 - RNA, 64 nt, Homo Sapiens; identical to SEQ ID NO: 392576

SEQ ID NO: 646198 - RNA, 64 nt, Homo Sapiens; identical to SEQ ID NO: 392577

SEQ ID NO: 646199 - RNA, 64 nt, Homo Sapiens; identical to SEQ ID NO: 392578

SEQ ID NO: 646200 - RNA, 64 nt, Homo Sapiens; identical to SEQ ID NO: 392579

SEQ ID NO: 646201 - RNA, 64 nt, Homo Sapiens; identical to SEQ ID NO: 392580

SEQ ID NO: 646202 - RNA, 64 nt, Homo Sapiens; identical to SEQ ID NO: 392581

SEQ ID NO: 646203 - RNA, 64 nt, Homo Sapiens; identical to SEQ ID NO: 392582

SEQ ID NO: 646204 - RNA, 64 nt, Homo Sapiens; identical to SEQ ID NO: 392583

SEQ ID NO: 646205 - RNA, 64 nt, Homo Sapiens; identical to SEQ ID NO: 392584

SEQ ID NO: 646206 - RNA, 64 nt, Homo Sapiens; identical to SEQ ID NO: 392585

SEQ ID NO: 646207 - RNA, 64 nt, Homo Sapiens; identical to SEQ ID NO: 392586

SEQ ID NO: 646208 - RNA, 64 nt, Homo Sapiens; identical to SEQ ID NO: 392587

SEQ ID NO: 646209 - RNA, 64 nt, Homo Sapiens; identical to SEQ ID NO: 392588

SEQ ID NO: 646210 - RNA, 64 nt, Homo Sapiens; identical to SEQ ID NO: 50126

SEQ ID NO: 646211 - RNA, 64 nt, Homo Sapiens; identical to SEQ ID NO: 50127

SEQ ID NO: 646212 - RNA, 64 nt, Homo Sapiens; identical to SEQ ID NO: 50128

SEQ ID NO: 646213 - RNA, 64 nt, Homo Sapiens; identical to SEQ ID NO: 50129

SEQ ID NO: 646214 - RNA, 64 nt, Homo Sapiens; identical to SEQ ID NO: 50130

SEQ ID NO: 646215 - RNA, 64 nt, Homo Sapiens; identical to SEQ ID NO: 50131

SEQ ID NO: 646216 - RNA, 64 nt, Homo Sapiens; identical to SEQ ID NO: 50132

SEQ ID NO: 646217 - RNA, 64 nt, Homo Sapiens; identical to SEQ ID NO: 50133

SEQ ID NO: 646218 - RNA, 64 nt, Homo Sapiens; identical to SEQ ID NO: 263346

SEQ ID NO: 646219 - RNA, 64 nt, Homo Sapiens; identical to SEQ ID NO: 263347

SEQ ID NO: 646220 - RNA, 64 nt, Homo Sapiens; identical to SEQ ID NO: 263348

SEQ ID NO: 646221 - RNA, 64 nt, Homo Sapiens; identical to SEQ ID NO: 263349

SEQ ID NO: 646222 - RNA, 64 nt, Homo Sapiens; identical to SEQ ID NO: 263350

SEQ ID NO: 646223 - RNA, 64 nt, Homo Sapiens; identical to SEQ ID NO: 263351

SEQ ID NO: 646224 - RNA, 64 nt, Homo Sapiens; identical to SEQ ID NO: 263352

SEQ ID NO: 646225 - RNA, 64 nt, Homo Sapiens; identical to SEQ ID NO: 263353

SEQ ID NO: 646226 - RNA, 64 nt, Homo Sapiens; identical to SEQ ID NO: 263354

SEQ ID NO: 646227 - RNA, 64 nt, Homo Sapiens; identical to SEQ ID NO: 263355

SEQ ID NO: 646228 - RNA, 64 nt, Homo Sapiens; identical to SEQ ID NO: 263356

SEQ ID NO: 646229 - RNA, 64 nt, Homo Sapiens; identical to SEQ ID NO: 263357

SEQ ID NO: 646230 - RNA, 64 nt, Homo Sapiens; identical to SEQ ID NO: 263358

SEQ ID NO: 646231 - RNA, 64 nt, Homo Sapiens; identical to SEQ ID NO: 263359

SEQ ID NO: 646232 - RNA, 64 nt, Homo Sapiens; identical to SEQ ID NO: 263360

SEQ ID NO: 646233 - RNA, 64 nt, Homo Sapiens; identical to SEQ ID NO: 263361

SEQ ID NO: 646234 - RNA, 64 nt, Homo Sapiens; identical to SEQ ID NO: 263362

SEQ ID NO: 646235 - RNA, 64 nt, Homo Sapiens; identical to SEQ ID NO: 263363

SEQ ID NO: 646236 - RNA, 64 nt, Homo Sapiens; identical to SEQ ID NO: 263364

SEQ ID NO: 646237 - RNA, 64 nt, Homo Sapiens; identical to SEQ ID NO: 263365

SEQ ID NO: 646238 - RNA, 64 nt, Homo Sapiens; identical to SEQ ID NO: 263366

SEQ ID NO: 646239 - RNA, 64 nt, Homo Sapiens; identical to SEQ ID NO: 263367

SEQ ID NO: 646240 - RNA, 64 nt, Homo Sapiens; identical to SEQ ID NO: 263368

SEQ ID NO: 646241 - RNA, 64 nt, Homo Sapiens; identical to SEQ ID NO: 263369

SEQ ID NO: 646242 - RNA, 64 nt, Homo Sapiens; identical to SEQ ID NO: 263370

SEQ ID NO: 646243 - RNA, 64 nt, Homo Sapiens; identical to SEQ ID NO: 263371

SEQ ID NO: 646244 - RNA, 64 nt, Homo Sapiens; identical to SEQ ID NO: 263372

SEQ ID NO: 646245 - RNA, 64 nt, Homo Sapiens; identical to SEQ ID NO: 263373

SEQ ID NO: 646246 - RNA, 64 nt, Homo Sapiens; identical to SEQ ID NO: 263374

SEQ ID NO: 646247 - RNA, 64 nt, Homo Sapiens; identical to SEQ ID NO: 263375

SEQ ID NO: 646248 - RNA, 64 nt, Homo Sapiens; identical to SEQ ID NO: 263376

SEQ ID NO: 646249 - RNA, 64 nt, Homo Sapiens; identical to SEQ ID NO: 263377

SEQ ID NO: 646250 - RNA, 64 nt, Homo Sapiens; identical to SEQ ID NO: 263378

SEQ ID NO: 646251 - RNA, 64 nt, Homo Sapiens; identical to SEQ ID NO: 263379

SEQ ID NO: 646252 - RNA, 64 nt, Homo Sapiens; identical to SEQ ID NO: 263380

SEQ ID NO: 646253 - RNA, 64 nt, Homo Sapiens; identical to SEQ ID NO: 263381

SEQ ID NO: 646254 - RNA, 64 nt, Homo Sapiens; identical to SEQ ID NO: 263382

SEQ ID NO: 646255 - RNA, 64 nt, Homo Sapiens; identical to SEQ ID NO: 263383

SEQ ID NO: 646256 - RNA, 64 nt, Homo Sapiens; identical to SEQ ID NO: 263384

SEQ ID NO: 646257 - RNA, 64 nt, Homo Sapiens; identical to SEQ ID NO: 263385

SEQ ID NO: 646258 - RNA, 64 nt, Homo Sapiens; identical to SEQ ID NO: 263386

SEQ ID NO: 646259 - RNA, 64 nt, Homo Sapiens; identical to SEQ ID NO: 263387

SEQ ID NO: 646260 - RNA, 64 nt, Homo Sapiens; identical to SEQ ID NO: 263388

SEQ ID NO: 646261 - RNA, 64 nt, Homo Sapiens; identical to SEQ ID NO: 263389

SEQ ID NO: 646262 - RNA, 64 nt, Homo Sapiens; identical to SEQ ID NO: 263390

SEQ ID NO: 646263 - RNA, 64 nt, Homo Sapiens; identical to SEQ ID NO: 263391

SEQ ID NO: 646264 - RNA, 64 nt, Homo Sapiens; identical to SEQ ID NO: 263392

SEQ ID NO: 646265 - RNA, 64 nt, Homo Sapiens; identical to SEQ ID NO: 263393

SEQ ID NO: 646266 - RNA, 64 nt, Homo Sapiens; identical to SEQ ID NO: 263394

SEQ ID NO: 646267 - RNA, 64 nt, Homo Sapiens; identical to SEQ ID NO: 263395

SEQ ID NO: 646268 - RNA, 64 nt, Homo Sapiens; identical to SEQ ID NO: 263396

SEQ ID NO: 646269 - RNA, 64 nt, Homo Sapiens; identical to SEQ ID NO: 263397

SEQ ID NO: 646270 - RNA, 64 nt, Homo Sapiens; identical to SEQ ID NO: 263398

SEQ ID NO: 646271 - RNA, 64 nt, Homo Sapiens; identical to SEQ ID NO: 263399

SEQ ID NO: 646272 - RNA, 64 nt, Homo Sapiens; identical to SEQ ID NO: 263400

SEQ ID NO: 646273 - RNA, 64 nt, Homo Sapiens; identical to SEQ ID NO: 263401

SEQ ID NO: 646274 - RNA, 64 nt, Homo Sapiens; identical to SEQ ID NO: 263402

SEQ ID NO: 646275 - RNA, 64 nt, Homo Sapiens; identical to SEQ ID NO: 263403

SEQ ID NO: 646276 - RNA, 64 nt, Homo Sapiens; identical to SEQ ID NO: 263404

SEQ ID NO: 646277 - RNA, 64 nt, Homo Sapiens; identical to SEQ ID NO: 263405

SEQ ID NO: 646278 - RNA, 64 nt, Homo Sapiens; identical to SEQ ID NO: 263406

SEQ ID NO: 646279 - RNA, 64 nt, Homo Sapiens; identical to SEQ ID NO: 263407

SEQ ID NO: 646280 - RNA, 64 nt, Homo Sapiens; identical to SEQ ID NO: 263408

SEQ ID NO: 646281 - RNA, 64 nt, Homo Sapiens; identical to SEQ ID NO: 263409

SEQ ID NO: 646282 - RNA, 64 nt, Homo Sapiens; identical to SEQ ID NO: 263410

SEQ ID NO: 646283 - RNA, 64 nt, Homo Sapiens; identical to SEQ ID NO: 263411

SEQ ID NO: 646284 - RNA, 64 nt, Homo Sapiens; identical to SEQ ID NO: 263412

SEQ ID NO: 646285 - RNA, 64 nt, Homo Sapiens; identical to SEQ ID NO: 263413

SEQ ID NO: 646286 - RNA, 64 nt, Homo Sapiens; identical to SEQ ID NO: 263414

SEQ ID NO: 646287 - RNA, 64 nt, Homo Sapiens; identical to SEQ ID NO: 263415

SEQ ID NO: 646288 - RNA, 64 nt, Homo Sapiens; identical to SEQ ID NO: 263416

SEQ ID NO: 646289 - RNA, 64 nt, Homo Sapiens; identical to SEQ ID NO: 263417

SEQ ID NO: 646290 - RNA, 64 nt, Homo Sapiens; identical to SEQ ID NO: 263418

SEQ ID NO: 646291 - RNA, 64 nt, Homo Sapiens; identical to SEQ ID NO: 263419

SEQ ID NO: 646292 - RNA, 64 nt, Homo Sapiens; identical to SEQ ID NO: 263420

SEQ ID NO: 646293 - RNA, 64 nt, Homo Sapiens; identical to SEQ ID NO: 263421

SEQ ID NO: 646294 - RNA, 64 nt, Homo Sapiens; identical to SEQ ID NO: 263422

SEQ ID NO: 646295 - RNA, 64 nt, Homo Sapiens; identical to SEQ ID NO: 263423

SEQ ID NO: 646296 - RNA, 64 nt, Homo Sapiens; identical to SEQ ID NO: 263424

SEQ ID NO: 646297 - RNA, 64 nt, Homo Sapiens; identical to SEQ ID NO: 263425

SEQ ID NO: 646298 - RNA, 64 nt, Homo Sapiens; identical to SEQ ID NO: 263426

SEQ ID NO: 646299 - RNA, 64 nt, Homo Sapiens; identical to SEQ ID NO: 263427

SEQ ID NO: 646300 - RNA, 64 nt, Homo Sapiens; identical to SEQ ID NO: 263428

SEQ ID NO: 646301 - RNA, 64 nt, Homo Sapiens; identical to SEQ ID NO: 263429

SEQ ID NO: 646302 - RNA, 64 nt, Homo Sapiens; identical to SEQ ID NO: 263430

SEQ ID NO: 646303 - RNA, 64 nt, Homo Sapiens; identical to SEQ ID NO: 263431

SEQ ID NO: 646304 - RNA, 64 nt, Homo Sapiens; identical to SEQ ID NO: 263432

SEQ ID NO: 646305 - RNA, 64 nt, Homo Sapiens; identical to SEQ ID NO: 263433

SEQ ID NO: 646306 - RNA, 64 nt, Homo Sapiens; identical to SEQ ID NO: 263434

SEQ ID NO: 646307 - RNA, 64 nt, Homo Sapiens; identical to SEQ ID NO: 263435

SEQ ID NO: 646308 - RNA, 64 nt, Homo Sapiens; identical to SEQ ID NO: 263436

SEQ ID NO: 646309 - RNA, 64 nt, Homo Sapiens; identical to SEQ ID NO: 263437

SEQ ID NO: 646310 - RNA, 64 nt, Homo Sapiens; identical to SEQ ID NO: 263438

SEQ ID NO: 646311 - RNA, 64 nt, Homo Sapiens; identical to SEQ ID NO: 263439

SEQ ID NO: 646312 - RNA, 64 nt, Homo Sapiens; identical to SEQ ID NO: 263440

SEQ ID NO: 646313 - RNA, 64 nt, Homo Sapiens; identical to SEQ ID NO: 263441

SEQ ID NO: 646314 - RNA, 64 nt, Homo Sapiens; identical to SEQ ID NO: 263442

SEQ ID NO: 646315 - RNA, 64 nt, Homo Sapiens; identical to SEQ ID NO: 263443

SEQ ID NO: 646316 - RNA, 64 nt, Homo Sapiens; identical to SEQ ID NO: 263444

SEQ ID NO: 646317 - RNA, 64 nt, Homo Sapiens; identical to SEQ ID NO: 263445

SEQ ID NO: 646318 - RNA, 64 nt, Homo Sapiens; identical to SEQ ID NO: 263446

SEQ ID NO: 646319 - RNA, 64 nt, Homo Sapiens; identical to SEQ ID NO: 263447

SEQ ID NO: 646320 - RNA, 64 nt, Homo Sapiens; identical to SEQ ID NO: 263448

SEQ ID NO: 646321 - RNA, 64 nt, Homo Sapiens; identical to SEQ ID NO: 263449

SEQ ID NO: 646322 - RNA, 64 nt, Homo Sapiens; identical to SEQ ID NO: 263450

SEQ ID NO: 646323 - RNA, 64 nt, Homo Sapiens; identical to SEQ ID NO: 263451

SEQ ID NO: 646324 - RNA, 64 nt, Homo Sapiens; identical to SEQ ID NO: 263452

SEQ ID NO: 646325 - RNA, 64 nt, Homo Sapiens; identical to SEQ ID NO: 263453

SEQ ID NO: 646326 - RNA, 64 nt, Homo Sapiens; identical to SEQ ID NO: 263454

SEQ ID NO: 646327 - RNA, 64 nt, Homo Sapiens; identical to SEQ ID NO: 263455

SEQ ID NO: 646328 - RNA, 64 nt, Homo Sapiens; identical to SEQ ID NO: 263456

SEQ ID NO: 646329 - RNA, 64 nt, Homo Sapiens; identical to SEQ ID NO: 263457

SEQ ID NO: 646330 - RNA, 64 nt, Homo Sapiens; identical to SEQ ID NO: 263458

SEQ ID NO: 646331 - RNA, 64 nt, Homo Sapiens; identical to SEQ ID NO: 263459

SEQ ID NO: 646332 - RNA, 64 nt, Homo Sapiens; identical to SEQ ID NO: 263460

SEQ ID NO: 646333 - RNA, 64 nt, Homo Sapiens; identical to SEQ ID NO: 263461

SEQ ID NO: 646334 - RNA, 64 nt, Homo Sapiens; identical to SEQ ID NO: 263462

SEQ ID NO: 646335 - RNA, 64 nt, Homo Sapiens; identical to SEQ ID NO: 263463

SEQ ID NO: 646336 - RNA, 64 nt, Homo Sapiens; identical to SEQ ID NO: 263464

SEQ ID NO: 646337 - RNA, 64 nt, Homo Sapiens; identical to SEQ ID NO: 263465

SEQ ID NO: 646338 - RNA, 64 nt, Homo Sapiens; identical to SEQ ID NO: 263466

SEQ ID NO: 646339 - RNA, 64 nt, Homo Sapiens; identical to SEQ ID NO: 263467

SEQ ID NO: 646340 - RNA, 64 nt, Homo Sapiens; identical to SEQ ID NO: 263468

SEQ ID NO: 646341 - RNA, 64 nt, Homo Sapiens; identical to SEQ ID NO: 263469

SEQ ID NO: 646342 - RNA, 64 nt, Homo Sapiens; identical to SEQ ID NO: 263470

SEQ ID NO: 646343 - RNA, 64 nt, Homo Sapiens; identical to SEQ ID NO: 263471

SEQ ID NO: 646344 - RNA, 64 nt, Homo Sapiens; identical to SEQ ID NO: 263472

SEQ ID NO: 646345 - RNA, 64 nt, Homo Sapiens; identical to SEQ ID NO: 263473

SEQ ID NO: 646346 - RNA, 64 nt, Homo Sapiens; identical to SEQ ID NO: 263474

SEQ ID NO: 646347 - RNA, 64 nt, Homo Sapiens; identical to SEQ ID NO: 263475

SEQ ID NO: 646348 - RNA, 64 nt, Homo Sapiens; identical to SEQ ID NO: 263476

SEQ ID NO: 646349 - RNA, 64 nt, Homo Sapiens; identical to SEQ ID NO: 263477

SEQ ID NO: 646350 - RNA, 64 nt, Homo Sapiens; identical to SEQ ID NO: 263478

SEQ ID NO: 646351 - RNA, 64 nt, Homo Sapiens; identical to SEQ ID NO: 263479

SEQ ID NO: 646352 - RNA, 64 nt, Homo Sapiens; identical to SEQ ID NO: 263480

SEQ ID NO: 646353 - RNA, 64 nt, Homo Sapiens; identical to SEQ ID NO: 263481

SEQ ID NO: 646354 - RNA, 64 nt, Homo Sapiens; identical to SEQ ID NO: 263482

SEQ ID NO: 646355 - RNA, 64 nt, Homo Sapiens; identical to SEQ ID NO: 263483

SEQ ID NO: 646356 - RNA, 64 nt, Homo Sapiens; identical to SEQ ID NO: 263484

SEQ ID NO: 646357 - RNA, 64 nt, Homo Sapiens; identical to SEQ ID NO: 263485

SEQ ID NO: 646358 - RNA, 64 nt, Homo Sapiens; identical to SEQ ID NO: 263486

SEQ ID NO: 646359 - RNA, 64 nt, Homo Sapiens; identical to SEQ ID NO: 263487

SEQ ID NO: 646360 - RNA, 64 nt, Homo Sapiens; identical to SEQ ID NO: 263488

SEQ ID NO: 646361 - RNA, 64 nt, Homo Sapiens; identical to SEQ ID NO: 263489

SEQ ID NO: 646362 - RNA, 64 nt, Homo Sapiens; identical to SEQ ID NO: 263490

SEQ ID NO: 646363 - RNA, 64 nt, Homo Sapiens; identical to SEQ ID NO: 263491

SEQ ID NO: 646364 - RNA, 64 nt, Homo Sapiens; identical to SEQ ID NO: 263492

SEQ ID NO: 646365 - RNA, 64 nt, Homo Sapiens; identical to SEQ ID NO: 263493

SEQ ID NO: 646366 - RNA, 64 nt, Homo Sapiens; identical to SEQ ID NO: 263494

SEQ ID NO: 646367 - RNA, 64 nt, Homo Sapiens; identical to SEQ ID NO: 263495

SEQ ID NO: 646368 - RNA, 64 nt, Homo Sapiens; identical to SEQ ID NO: 263496

SEQ ID NO: 646369 - RNA, 64 nt, Homo Sapiens; identical to SEQ ID NO: 263497

SEQ ID NO: 646370 - RNA, 64 nt, Homo Sapiens; identical to SEQ ID NO: 263498

SEQ ID NO: 646371 - RNA, 64 nt, Homo Sapiens; identical to SEQ ID NO: 263499

SEQ ID NO: 646372 - RNA, 64 nt, Homo Sapiens; identical to SEQ ID NO: 263500

SEQ ID NO: 646373 - RNA, 64 nt, Homo Sapiens; identical to SEQ ID NO: 263501

SEQ ID NO: 646374 - RNA, 64 nt, Homo Sapiens; identical to SEQ ID NO: 263502

SEQ ID NO: 646375 - RNA, 64 nt, Homo Sapiens; identical to SEQ ID NO: 263503

SEQ ID NO: 646376 - RNA, 64 nt, Homo Sapiens; identical to SEQ ID NO: 263504

SEQ ID NO: 646377 - RNA, 64 nt, Homo Sapiens; identical to SEQ ID NO: 263505

SEQ ID NO: 646378 - RNA, 64 nt, Homo Sapiens; identical to SEQ ID NO: 263506

SEQ ID NO: 646379 - RNA, 64 nt, Homo Sapiens; identical to SEQ ID NO: 263507

SEQ ID NO: 646380 - RNA, 64 nt, Homo Sapiens; identical to SEQ ID NO: 263508

SEQ ID NO: 646381 - RNA, 64 nt, Homo Sapiens; identical to SEQ ID NO: 263509

SEQ ID NO: 646382 - RNA, 64 nt, Homo Sapiens; identical to SEQ ID NO: 263510

SEQ ID NO: 646383 - RNA, 64 nt, Homo Sapiens; identical to SEQ ID NO: 263511

SEQ ID NO: 646384 - RNA, 64 nt, Homo Sapiens; identical to SEQ ID NO: 263512

SEQ ID NO: 646385 - RNA, 64 nt, Homo Sapiens; identical to SEQ ID NO: 263513

SEQ ID NO: 646386 - RNA, 64 nt, Homo Sapiens; identical to SEQ ID NO: 263514

SEQ ID NO: 646387 - RNA, 64 nt, Homo Sapiens; identical to SEQ ID NO: 263515

SEQ ID NO: 646388 - RNA, 64 nt, Homo Sapiens; identical to SEQ ID NO: 263516

SEQ ID NO: 646389 - RNA, 64 nt, Homo Sapiens; identical to SEQ ID NO: 263517

SEQ ID NO: 646390 - RNA, 64 nt, Homo Sapiens; identical to SEQ ID NO: 263518

SEQ ID NO: 646391 - RNA, 64 nt, Homo Sapiens; identical to SEQ ID NO: 263519

SEQ ID NO: 646392 - RNA, 64 nt, Homo Sapiens; identical to SEQ ID NO: 263520

SEQ ID NO: 646393 - RNA, 64 nt, Homo Sapiens; identical to SEQ ID NO: 263521

SEQ ID NO: 646394 - RNA, 64 nt, Homo Sapiens; identical to SEQ ID NO: 263522

SEQ ID NO: 646395 - RNA, 64 nt, Homo Sapiens; identical to SEQ ID NO: 263523

SEQ ID NO: 646396 - RNA, 64 nt, Homo Sapiens; identical to SEQ ID NO: 263524

SEQ ID NO: 646397 - RNA, 64 nt, Homo Sapiens; identical to SEQ ID NO: 263525

SEQ ID NO: 646398 - RNA, 64 nt, Homo Sapiens; identical to SEQ ID NO: 263526

SEQ ID NO: 646399 - RNA, 64 nt, Homo Sapiens; identical to SEQ ID NO: 263527

SEQ ID NO: 646400 - RNA, 64 nt, Homo Sapiens; identical to SEQ ID NO: 263528

SEQ ID NO: 646401 - RNA, 64 nt, Homo Sapiens; identical to SEQ ID NO: 263529

SEQ ID NO: 646402 - RNA, 64 nt, Homo Sapiens; identical to SEQ ID NO: 263530

SEQ ID NO: 646403 - RNA, 64 nt, Homo Sapiens; identical to SEQ ID NO: 263531

SEQ ID NO: 646404 - RNA, 64 nt, Homo Sapiens; identical to SEQ ID NO: 263532

SEQ ID NO: 646405 - RNA, 64 nt, Homo Sapiens; identical to SEQ ID NO: 263533

SEQ ID NO: 646406 - RNA, 64 nt, Homo Sapiens; identical to SEQ ID NO: 263534

SEQ ID NO: 646407 - RNA, 64 nt, Homo Sapiens; identical to SEQ ID NO: 263535

SEQ ID NO: 646408 - RNA, 64 nt, Homo Sapiens; identical to SEQ ID NO: 263536

SEQ ID NO: 646409 - RNA, 64 nt, Homo Sapiens; identical to SEQ ID NO: 263537

SEQ ID NO: 646410 - RNA, 64 nt, Homo Sapiens; identical to SEQ ID NO: 263538

SEQ ID NO: 646411 - RNA, 64 nt, Homo Sapiens; identical to SEQ ID NO: 263539

SEQ ID NO: 646412 - RNA, 64 nt, Homo Sapiens; identical to SEQ ID NO: 263540

SEQ ID NO: 646413 - RNA, 64 nt, Homo Sapiens; identical to SEQ ID NO: 263541

SEQ ID NO: 646414 - RNA, 64 nt, Homo Sapiens; identical to SEQ ID NO: 263542

SEQ ID NO: 646415 - RNA, 64 nt, Homo Sapiens; identical to SEQ ID NO: 263543

SEQ ID NO: 646416 - RNA, 64 nt, Homo Sapiens; identical to SEQ ID NO: 263544

SEQ ID NO: 646417 - RNA, 64 nt, Homo Sapiens; identical to SEQ ID NO: 263545

SEQ ID NO: 646418 - RNA, 64 nt, Homo Sapiens; identical to SEQ ID NO: 263546

SEQ ID NO: 646419 - RNA, 64 nt, Homo Sapiens; identical to SEQ ID NO: 263547

SEQ ID NO: 646420 - RNA, 64 nt, Homo Sapiens; identical to SEQ ID NO: 263548

SEQ ID NO: 646421 - RNA, 64 nt, Homo Sapiens; identical to SEQ ID NO: 263549

SEQ ID NO: 646422 - RNA, 64 nt, Homo Sapiens; identical to SEQ ID NO: 263550

SEQ ID NO: 646423 - RNA, 64 nt, Homo Sapiens; identical to SEQ ID NO: 263551

SEQ ID NO: 646424 - RNA, 64 nt, Homo Sapiens; identical to SEQ ID NO: 263552

SEQ ID NO: 646425 - RNA, 64 nt, Homo Sapiens; identical to SEQ ID NO: 263553

SEQ ID NO: 646426 - RNA, 64 nt, Homo Sapiens; identical to SEQ ID NO: 263554

SEQ ID NO: 646427 - RNA, 64 nt, Homo Sapiens; identical to SEQ ID NO: 263555

SEQ ID NO: 646428 - RNA, 64 nt, Homo Sapiens; identical to SEQ ID NO: 263556

SEQ ID NO: 646429 - RNA, 64 nt, Homo Sapiens; identical to SEQ ID NO: 263557

SEQ ID NO: 646430 - RNA, 64 nt, Homo Sapiens; identical to SEQ ID NO: 263558

SEQ ID NO: 646431 - RNA, 64 nt, Homo Sapiens; identical to SEQ ID NO: 263559

SEQ ID NO: 646432 - RNA, 64 nt, Homo Sapiens; identical to SEQ ID NO: 263560

SEQ ID NO: 646433 - RNA, 64 nt, Homo Sapiens; identical to SEQ ID NO: 263561

SEQ ID NO: 646434 - RNA, 64 nt, Homo Sapiens; identical to SEQ ID NO: 263562

SEQ ID NO: 646435 - RNA, 64 nt, Homo Sapiens; identical to SEQ ID NO: 263563

SEQ ID NO: 646436 - RNA, 64 nt, Homo Sapiens; identical to SEQ ID NO: 263564

SEQ ID NO: 646437 - RNA, 64 nt, Homo Sapiens; identical to SEQ ID NO: 263565

SEQ ID NO: 646438 - RNA, 64 nt, Homo Sapiens; identical to SEQ ID NO: 263566

SEQ ID NO: 646439 - RNA, 64 nt, Homo Sapiens; identical to SEQ ID NO: 263567

SEQ ID NO: 646440 - RNA, 64 nt, Homo Sapiens; identical to SEQ ID NO: 263568

SEQ ID NO: 646441 - RNA, 64 nt, Homo Sapiens; identical to SEQ ID NO: 263569

SEQ ID NO: 646442 - RNA, 64 nt, Homo Sapiens; identical to SEQ ID NO: 263570

SEQ ID NO: 646443 - RNA, 64 nt, Homo Sapiens; identical to SEQ ID NO: 263571

SEQ ID NO: 646444 - RNA, 64 nt, Homo Sapiens; identical to SEQ ID NO: 263572

SEQ ID NO: 646445 - RNA, 64 nt, Homo Sapiens; identical to SEQ ID NO: 263573

SEQ ID NO: 646446 - RNA, 64 nt, Homo Sapiens; identical to SEQ ID NO: 263574

SEQ ID NO: 646447 - RNA, 64 nt, Homo Sapiens; identical to SEQ ID NO: 263575

SEQ ID NO: 646448 - RNA, 64 nt, Homo Sapiens; identical to SEQ ID NO: 263576

SEQ ID NO: 646449 - RNA, 64 nt, Homo Sapiens; identical to SEQ ID NO: 263577

SEQ ID NO: 646450 - RNA, 64 nt, Homo Sapiens; identical to SEQ ID NO: 263578

SEQ ID NO: 646451 - RNA, 64 nt, Homo Sapiens; identical to SEQ ID NO: 263579

SEQ ID NO: 646452 - RNA, 64 nt, Homo Sapiens; identical to SEQ ID NO: 263580

SEQ ID NO: 646453 - RNA, 64 nt, Homo Sapiens; identical to SEQ ID NO: 263581

SEQ ID NO: 646454 - RNA, 64 nt, Homo Sapiens; identical to SEQ ID NO: 263582

SEQ ID NO: 646455 - RNA, 64 nt, Homo Sapiens; identical to SEQ ID NO: 263583

SEQ ID NO: 646456 - RNA, 64 nt, Homo Sapiens; identical to SEQ ID NO: 263584

SEQ ID NO: 646457 - RNA, 64 nt, Homo Sapiens; identical to SEQ ID NO: 263585

SEQ ID NO: 646458 - RNA, 64 nt, Homo Sapiens; identical to SEQ ID NO: 263586

SEQ ID NO: 646459 - RNA, 64 nt, Homo Sapiens; identical to SEQ ID NO: 263587

SEQ ID NO: 646460 - RNA, 64 nt, Homo Sapiens; identical to SEQ ID NO: 263588

SEQ ID NO: 646461 - RNA, 64 nt, Homo Sapiens; identical to SEQ ID NO: 263589

SEQ ID NO: 646462 - RNA, 64 nt, Homo Sapiens; identical to SEQ ID NO: 263590

SEQ ID NO: 646463 - RNA, 64 nt, Homo Sapiens; identical to SEQ ID NO: 263591

SEQ ID NO: 646464 - RNA, 64 nt, Homo Sapiens; identical to SEQ ID NO: 263592

SEQ ID NO: 646465 - RNA, 64 nt, Homo Sapiens; identical to SEQ ID NO: 263593

SEQ ID NO: 646466 - RNA, 64 nt, Homo Sapiens; identical to SEQ ID NO: 263594

SEQ ID NO: 646467 - RNA, 64 nt, Homo Sapiens; identical to SEQ ID NO: 263595

SEQ ID NO: 646468 - RNA, 64 nt, Homo Sapiens; identical to SEQ ID NO: 263596

SEQ ID NO: 646469 - RNA, 64 nt, Homo Sapiens; identical to SEQ ID NO: 263597

SEQ ID NO: 646470 - RNA, 64 nt, Homo Sapiens; identical to SEQ ID NO: 263598

SEQ ID NO: 646471 - RNA, 64 nt, Homo Sapiens; identical to SEQ ID NO: 263599

SEQ ID NO: 646472 - RNA, 64 nt, Homo Sapiens; identical to SEQ ID NO: 263600

SEQ ID NO: 646473 - RNA, 64 nt, Homo Sapiens; identical to SEQ ID NO: 263601

SEQ ID NO: 646474 - RNA, 64 nt, Homo Sapiens; identical to SEQ ID NO: 263602

SEQ ID NO: 646475 - RNA, 64 nt, Homo Sapiens; identical to SEQ ID NO: 263603

SEQ ID NO: 646476 - RNA, 64 nt, Homo Sapiens; identical to SEQ ID NO: 263604

SEQ ID NO: 646477 - RNA, 64 nt, Homo Sapiens; identical to SEQ ID NO: 263605

SEQ ID NO: 646478 - RNA, 64 nt, Homo Sapiens; identical to SEQ ID NO: 263606

SEQ ID NO: 646479 - RNA, 64 nt, Homo Sapiens; identical to SEQ ID NO: 263607

SEQ ID NO: 646480 - RNA, 64 nt, Homo Sapiens; identical to SEQ ID NO: 263608

SEQ ID NO: 646481 - RNA, 64 nt, Homo Sapiens; identical to SEQ ID NO: 263609

SEQ ID NO: 646482 - RNA, 64 nt, Homo Sapiens; identical to SEQ ID NO: 263610

SEQ ID NO: 646483 - RNA, 64 nt, Homo Sapiens; identical to SEQ ID NO: 263611

SEQ ID NO: 646484 - RNA, 64 nt, Homo Sapiens; identical to SEQ ID NO: 263612

SEQ ID NO: 646485 - RNA, 64 nt, Homo Sapiens; identical to SEQ ID NO: 263613

SEQ ID NO: 646486 - RNA, 64 nt, Homo Sapiens; identical to SEQ ID NO: 263614

SEQ ID NO: 646487 - RNA, 64 nt, Homo Sapiens; identical to SEQ ID NO: 263615

SEQ ID NO: 646488 - RNA, 64 nt, Homo Sapiens; identical to SEQ ID NO: 263616

SEQ ID NO: 646489 - RNA, 64 nt, Homo Sapiens; identical to SEQ ID NO: 263617

SEQ ID NO: 646490 - RNA, 64 nt, Homo Sapiens; identical to SEQ ID NO: 263618

SEQ ID NO: 646491 - RNA, 64 nt, Homo Sapiens; identical to SEQ ID NO: 263619

SEQ ID NO: 646492 - RNA, 64 nt, Homo Sapiens; identical to SEQ ID NO: 263620

SEQ ID NO: 646493 - RNA, 64 nt, Homo Sapiens; identical to SEQ ID NO: 263621

SEQ ID NO: 646494 - RNA, 64 nt, Homo Sapiens; identical to SEQ ID NO: 263622

SEQ ID NO: 646495 - RNA, 64 nt, Homo Sapiens; identical to SEQ ID NO: 263623

SEQ ID NO: 646496 - RNA, 64 nt, Homo Sapiens; identical to SEQ ID NO: 263624

SEQ ID NO: 646497 - RNA, 64 nt, Homo Sapiens; identical to SEQ ID NO: 263625

SEQ ID NO: 646498 - RNA, 64 nt, Homo Sapiens; identical to SEQ ID NO: 263626

SEQ ID NO: 646499 - RNA, 64 nt, Homo Sapiens; identical to SEQ ID NO: 263627

SEQ ID NO: 646500 - RNA, 64 nt, Homo Sapiens; identical to SEQ ID NO: 263628

SEQ ID NO: 646501 - RNA, 64 nt, Homo Sapiens; identical to SEQ ID NO: 263629

SEQ ID NO: 646502 - RNA, 64 nt, Homo Sapiens; identical to SEQ ID NO: 263630

SEQ ID NO: 646503 - RNA, 64 nt, Homo Sapiens; identical to SEQ ID NO: 263631

SEQ ID NO: 646504 - RNA, 64 nt, Homo Sapiens; identical to SEQ ID NO: 263632

SEQ ID NO: 646505 - RNA, 64 nt, Homo Sapiens; identical to SEQ ID NO: 263633

SEQ ID NO: 646506 - RNA, 64 nt, Homo Sapiens; identical to SEQ ID NO: 263634

SEQ ID NO: 646507 - RNA, 64 nt, Homo Sapiens; identical to SEQ ID NO: 263635

SEQ ID NO: 646508 - RNA, 64 nt, Homo Sapiens; identical to SEQ ID NO: 263636

SEQ ID NO: 646509 - RNA, 64 nt, Homo Sapiens; identical to SEQ ID NO: 263637

SEQ ID NO: 646510 - RNA, 64 nt, Homo Sapiens; identical to SEQ ID NO: 263638

SEQ ID NO: 646511 - RNA, 64 nt, Homo Sapiens; identical to SEQ ID NO: 263639

SEQ ID NO: 646512 - RNA, 64 nt, Homo Sapiens; identical to SEQ ID NO: 263640

SEQ ID NO: 646513 - RNA, 64 nt, Homo Sapiens; identical to SEQ ID NO: 263641

SEQ ID NO: 646514 - RNA, 64 nt, Homo Sapiens; identical to SEQ ID NO: 263642

SEQ ID NO: 646515 - RNA, 64 nt, Homo Sapiens; identical to SEQ ID NO: 263643

SEQ ID NO: 646516 - RNA, 64 nt, Homo Sapiens; identical to SEQ ID NO: 263644

SEQ ID NO: 646517 - RNA, 64 nt, Homo Sapiens; identical to SEQ ID NO: 263645

SEQ ID NO: 646518 - RNA, 64 nt, Homo Sapiens; identical to SEQ ID NO: 263646

SEQ ID NO: 646519 - RNA, 64 nt, Homo Sapiens; identical to SEQ ID NO: 263647

SEQ ID NO: 646520 - RNA, 64 nt, Homo Sapiens; identical to SEQ ID NO: 263648

SEQ ID NO: 646521 - RNA, 64 nt, Homo Sapiens; identical to SEQ ID NO: 263649

SEQ ID NO: 646522 - RNA, 64 nt, Homo Sapiens; identical to SEQ ID NO: 263650

SEQ ID NO: 646523 - RNA, 64 nt, Homo Sapiens; identical to SEQ ID NO: 263651

SEQ ID NO: 646524 - RNA, 64 nt, Homo Sapiens; identical to SEQ ID NO: 263652

SEQ ID NO: 646525 - RNA, 64 nt, Homo Sapiens; identical to SEQ ID NO: 263653

SEQ ID NO: 646526 - RNA, 64 nt, Homo Sapiens; identical to SEQ ID NO: 263654

SEQ ID NO: 646527 - RNA, 64 nt, Homo Sapiens; identical to SEQ ID NO: 263655

SEQ ID NO: 646528 - RNA, 64 nt, Homo Sapiens; identical to SEQ ID NO: 263656

SEQ ID NO: 646529 - RNA, 64 nt, Homo Sapiens; identical to SEQ ID NO: 263657

SEQ ID NO: 646530 - RNA, 64 nt, Homo Sapiens; identical to SEQ ID NO: 263658

SEQ ID NO: 646531 - RNA, 64 nt, Homo Sapiens; identical to SEQ ID NO: 263659

SEQ ID NO: 646532 - RNA, 64 nt, Homo Sapiens; identical to SEQ ID NO: 263660

SEQ ID NO: 646533 - RNA, 64 nt, Homo Sapiens; identical to SEQ ID NO: 263661

SEQ ID NO: 646534 - RNA, 64 nt, Homo Sapiens; identical to SEQ ID NO: 263662

SEQ ID NO: 646535 - RNA, 64 nt, Homo Sapiens; identical to SEQ ID NO: 263663

SEQ ID NO: 646536 - RNA, 64 nt, Homo Sapiens; identical to SEQ ID NO: 263664

SEQ ID NO: 646537 - RNA, 64 nt, Homo Sapiens; identical to SEQ ID NO: 263665

SEQ ID NO: 646538 - RNA, 64 nt, Homo Sapiens; identical to SEQ ID NO: 263666

SEQ ID NO: 646539 - RNA, 64 nt, Homo Sapiens; identical to SEQ ID NO: 263667

SEQ ID NO: 646540 - RNA, 64 nt, Homo Sapiens; identical to SEQ ID NO: 263668

SEQ ID NO: 646541 - RNA, 64 nt, Homo Sapiens; identical to SEQ ID NO: 263669

SEQ ID NO: 646542 - RNA, 64 nt, Homo Sapiens; identical to SEQ ID NO: 263670

SEQ ID NO: 646543 - RNA, 64 nt, Homo Sapiens; identical to SEQ ID NO: 263671

SEQ ID NO: 646544 - RNA, 64 nt, Homo Sapiens; identical to SEQ ID NO: 263672

SEQ ID NO: 646545 - RNA, 64 nt, Homo Sapiens; identical to SEQ ID NO: 263673

SEQ ID NO: 646546 - RNA, 64 nt, Homo Sapiens; identical to SEQ ID NO: 263674

SEQ ID NO: 646547 - RNA, 64 nt, Homo Sapiens; identical to SEQ ID NO: 263675

SEQ ID NO: 646548 - RNA, 64 nt, Homo Sapiens; identical to SEQ ID NO: 263676

SEQ ID NO: 646549 - RNA, 64 nt, Homo Sapiens; identical to SEQ ID NO: 263677

SEQ ID NO: 646550 - RNA, 64 nt, Homo Sapiens; identical to SEQ ID NO: 263678

SEQ ID NO: 646551 - RNA, 64 nt, Homo Sapiens; identical to SEQ ID NO: 263679

SEQ ID NO: 646552 - RNA, 64 nt, Homo Sapiens; identical to SEQ ID NO: 263680

SEQ ID NO: 646553 - RNA, 64 nt, Homo Sapiens; identical to SEQ ID NO: 263681

SEQ ID NO: 646554 - RNA, 64 nt, Homo Sapiens; identical to SEQ ID NO: 263682

SEQ ID NO: 646555 - RNA, 64 nt, Homo Sapiens; identical to SEQ ID NO: 263683

SEQ ID NO: 646556 - RNA, 64 nt, Homo Sapiens; identical to SEQ ID NO: 263684

SEQ ID NO: 646557 - RNA, 64 nt, Homo Sapiens; identical to SEQ ID NO: 263685

SEQ ID NO: 646558 - RNA, 64 nt, Homo Sapiens; identical to SEQ ID NO: 263686

SEQ ID NO: 646559 - RNA, 64 nt, Homo Sapiens; identical to SEQ ID NO: 263687

SEQ ID NO: 646560 - RNA, 64 nt, Homo Sapiens; identical to SEQ ID NO: 263688

SEQ ID NO: 646561 - RNA, 64 nt, Homo Sapiens; identical to SEQ ID NO: 263689

SEQ ID NO: 646562 - RNA, 64 nt, Homo Sapiens; identical to SEQ ID NO: 263690

SEQ ID NO: 646563 - RNA, 64 nt, Homo Sapiens; identical to SEQ ID NO: 263691

SEQ ID NO: 646564 - RNA, 64 nt, Homo Sapiens; identical to SEQ ID NO: 263692

SEQ ID NO: 646565 - RNA, 64 nt, Homo Sapiens; identical to SEQ ID NO: 263693

SEQ ID NO: 646566 - RNA, 64 nt, Homo Sapiens; identical to SEQ ID NO: 263694

SEQ ID NO: 646567 - RNA, 64 nt, Homo Sapiens; identical to SEQ ID NO: 263695

SEQ ID NO: 646568 - RNA, 64 nt, Homo Sapiens; identical to SEQ ID NO: 263696

SEQ ID NO: 646569 - RNA, 64 nt, Homo Sapiens; identical to SEQ ID NO: 263697

SEQ ID NO: 646570 - RNA, 64 nt, Homo Sapiens; identical to SEQ ID NO: 263698

SEQ ID NO: 646571 - RNA, 64 nt, Homo Sapiens; identical to SEQ ID NO: 263699

SEQ ID NO: 646572 - RNA, 64 nt, Homo Sapiens; identical to SEQ ID NO: 263700

SEQ ID NO: 646573 - RNA, 64 nt, Homo Sapiens; identical to SEQ ID NO: 263701

SEQ ID NO: 646574 - RNA, 64 nt, Homo Sapiens; identical to SEQ ID NO: 263702

SEQ ID NO: 646575 - RNA, 64 nt, Homo Sapiens; identical to SEQ ID NO: 263703

SEQ ID NO: 646576 - RNA, 64 nt, Homo Sapiens; identical to SEQ ID NO: 263704

SEQ ID NO: 646577 - RNA, 64 nt, Homo Sapiens; identical to SEQ ID NO: 263705

SEQ ID NO: 646578 - RNA, 64 nt, Homo Sapiens; identical to SEQ ID NO: 263706

SEQ ID NO: 646579 - RNA, 64 nt, Homo Sapiens; identical to SEQ ID NO: 263707

SEQ ID NO: 646580 - RNA, 64 nt, Homo Sapiens; identical to SEQ ID NO: 263708

SEQ ID NO: 646581 - RNA, 64 nt, Homo Sapiens; identical to SEQ ID NO: 263709

SEQ ID NO: 646582 - RNA, 64 nt, Homo Sapiens; identical to SEQ ID NO: 263710

SEQ ID NO: 646583 - RNA, 64 nt, Homo Sapiens; identical to SEQ ID NO: 263711

SEQ ID NO: 646584 - RNA, 64 nt, Homo Sapiens; identical to SEQ ID NO: 263712

SEQ ID NO: 646585 - RNA, 64 nt, Homo Sapiens; identical to SEQ ID NO: 263713

SEQ ID NO: 646586 - RNA, 64 nt, Homo Sapiens; identical to SEQ ID NO: 263714

SEQ ID NO: 646587 - RNA, 64 nt, Homo Sapiens; identical to SEQ ID NO: 263715

SEQ ID NO: 646588 - RNA, 64 nt, Homo Sapiens; identical to SEQ ID NO: 263716

SEQ ID NO: 646589 - RNA, 64 nt, Homo Sapiens; identical to SEQ ID NO: 263717

SEQ ID NO: 646590 - RNA, 64 nt, Homo Sapiens; identical to SEQ ID NO: 263718

SEQ ID NO: 646591 - RNA, 64 nt, Homo Sapiens; identical to SEQ ID NO: 263719

SEQ ID NO: 646592 - RNA, 64 nt, Homo Sapiens; identical to SEQ ID NO: 263720

SEQ ID NO: 646593 - RNA, 64 nt, Homo Sapiens; identical to SEQ ID NO: 263721

SEQ ID NO: 646594 - RNA, 64 nt, Homo Sapiens; identical to SEQ ID NO: 263722

SEQ ID NO: 646595 - RNA, 64 nt, Homo Sapiens; identical to SEQ ID NO: 263723

SEQ ID NO: 646596 - RNA, 64 nt, Homo Sapiens; identical to SEQ ID NO: 263724

SEQ ID NO: 646597 - RNA, 64 nt, Homo Sapiens; identical to SEQ ID NO: 263725

SEQ ID NO: 646598 - RNA, 64 nt, Homo Sapiens; identical to SEQ ID NO: 263726

SEQ ID NO: 646599 - RNA, 64 nt, Homo Sapiens; identical to SEQ ID NO: 263727

SEQ ID NO: 646600 - RNA, 64 nt, Homo Sapiens; identical to SEQ ID NO: 263728

SEQ ID NO: 646601 - RNA, 64 nt, Homo Sapiens; identical to SEQ ID NO: 263729

SEQ ID NO: 646602 - RNA, 64 nt, Homo Sapiens; identical to SEQ ID NO: 263730

SEQ ID NO: 646603 - RNA, 64 nt, Homo Sapiens; identical to SEQ ID NO: 263731

SEQ ID NO: 646604 - RNA, 64 nt, Homo Sapiens; identical to SEQ ID NO: 263732

SEQ ID NO: 646605 - RNA, 64 nt, Homo Sapiens; identical to SEQ ID NO: 263733

SEQ ID NO: 646606 - RNA, 64 nt, Homo Sapiens; identical to SEQ ID NO: 263734

SEQ ID NO: 646607 - RNA, 64 nt, Homo Sapiens; identical to SEQ ID NO: 263735

SEQ ID NO: 646608 - RNA, 64 nt, Homo Sapiens; identical to SEQ ID NO: 263736

SEQ ID NO: 646609 - RNA, 64 nt, Homo Sapiens; identical to SEQ ID NO: 263737

SEQ ID NO: 646610 - RNA, 64 nt, Homo Sapiens; identical to SEQ ID NO: 263738

SEQ ID NO: 646611 - RNA, 64 nt, Homo Sapiens; identical to SEQ ID NO: 263739

SEQ ID NO: 646612 - RNA, 64 nt, Homo Sapiens; identical to SEQ ID NO: 263740

SEQ ID NO: 646613 - RNA, 64 nt, Homo Sapiens; identical to SEQ ID NO: 263741

SEQ ID NO: 646614 - RNA, 64 nt, Homo Sapiens; identical to SEQ ID NO: 263742

SEQ ID NO: 646615 - RNA, 64 nt, Homo Sapiens; identical to SEQ ID NO: 263743

SEQ ID NO: 646616 - RNA, 64 nt, Homo Sapiens; identical to SEQ ID NO: 263744

SEQ ID NO: 646617 - RNA, 64 nt, Homo Sapiens; identical to SEQ ID NO: 263745

SEQ ID NO: 646618 - RNA, 64 nt, Homo Sapiens; identical to SEQ ID NO: 263746

SEQ ID NO: 646619 - RNA, 64 nt, Homo Sapiens; identical to SEQ ID NO: 263747

SEQ ID NO: 646620 - RNA, 64 nt, Homo Sapiens; identical to SEQ ID NO: 263748

SEQ ID NO: 646621 - RNA, 64 nt, Homo Sapiens; identical to SEQ ID NO: 263749

SEQ ID NO: 646622 - RNA, 64 nt, Homo Sapiens; identical to SEQ ID NO: 263750

SEQ ID NO: 646623 - RNA, 64 nt, Homo Sapiens; identical to SEQ ID NO: 263751

SEQ ID NO: 646624 - RNA, 64 nt, Homo Sapiens; identical to SEQ ID NO: 263752

SEQ ID NO: 646625 - RNA, 64 nt, Homo Sapiens; identical to SEQ ID NO: 263753

SEQ ID NO: 646626 - RNA, 64 nt, Homo Sapiens; identical to SEQ ID NO: 263754

SEQ ID NO: 646627 - RNA, 64 nt, Homo Sapiens; identical to SEQ ID NO: 263755

SEQ ID NO: 646628 - RNA, 64 nt, Homo Sapiens; identical to SEQ ID NO: 263756

SEQ ID NO: 646629 - RNA, 64 nt, Homo Sapiens; identical to SEQ ID NO: 263757

SEQ ID NO: 646630 - RNA, 64 nt, Homo Sapiens; identical to SEQ ID NO: 263758

SEQ ID NO: 646631 - RNA, 64 nt, Homo Sapiens; identical to SEQ ID NO: 263759

SEQ ID NO: 646632 - RNA, 64 nt, Homo Sapiens; identical to SEQ ID NO: 263760

SEQ ID NO: 646633 - RNA, 64 nt, Homo Sapiens; identical to SEQ ID NO: 263761

SEQ ID NO: 646634 - RNA, 64 nt, Homo Sapiens; identical to SEQ ID NO: 263762

SEQ ID NO: 646635 - RNA, 64 nt, Homo Sapiens; identical to SEQ ID NO: 263763

SEQ ID NO: 646636 - RNA, 64 nt, Homo Sapiens; identical to SEQ ID NO: 263764

SEQ ID NO: 646637 - RNA, 64 nt, Homo Sapiens; identical to SEQ ID NO: 263765

SEQ ID NO: 646638 - RNA, 64 nt, Homo Sapiens; identical to SEQ ID NO: 263766

SEQ ID NO: 646639 - RNA, 64 nt, Homo Sapiens; identical to SEQ ID NO: 263767

SEQ ID NO: 646640 - RNA, 64 nt, Homo Sapiens; identical to SEQ ID NO: 263768

SEQ ID NO: 646641 - RNA, 64 nt, Homo Sapiens; identical to SEQ ID NO: 263769

SEQ ID NO: 646642 - RNA, 64 nt, Homo Sapiens; identical to SEQ ID NO: 263770

SEQ ID NO: 646643 - RNA, 64 nt, Homo Sapiens; identical to SEQ ID NO: 263771

SEQ ID NO: 646644 - RNA, 64 nt, Homo Sapiens; identical to SEQ ID NO: 263772

SEQ ID NO: 646645 - RNA, 64 nt, Homo Sapiens; identical to SEQ ID NO: 263773

SEQ ID NO: 646646 - RNA, 64 nt, Homo Sapiens; identical to SEQ ID NO: 263774

SEQ ID NO: 646647 - RNA, 64 nt, Homo Sapiens; identical to SEQ ID NO: 263775

SEQ ID NO: 646648 - RNA, 64 nt, Homo Sapiens; identical to SEQ ID NO: 263776

SEQ ID NO: 646649 - RNA, 64 nt, Homo Sapiens; identical to SEQ ID NO: 263777

SEQ ID NO: 646650 - RNA, 64 nt, Homo Sapiens; identical to SEQ ID NO: 263778

SEQ ID NO: 646651 - RNA, 64 nt, Homo Sapiens; identical to SEQ ID NO: 263779

SEQ ID NO: 646652 - RNA, 64 nt, Homo Sapiens; identical to SEQ ID NO: 263780

SEQ ID NO: 646653 - RNA, 64 nt, Homo Sapiens; identical to SEQ ID NO: 263781

SEQ ID NO: 646654 - RNA, 64 nt, Homo Sapiens; identical to SEQ ID NO: 263782

SEQ ID NO: 646655 - RNA, 64 nt, Homo Sapiens; identical to SEQ ID NO: 263783

SEQ ID NO: 646656 - RNA, 64 nt, Homo Sapiens; identical to SEQ ID NO: 263784

SEQ ID NO: 646657 - RNA, 64 nt, Homo Sapiens; identical to SEQ ID NO: 263785

SEQ ID NO: 646658 - RNA, 64 nt, Homo Sapiens; identical to SEQ ID NO: 263786

SEQ ID NO: 646659 - RNA, 64 nt, Homo Sapiens; identical to SEQ ID NO: 263787

SEQ ID NO: 646660 - RNA, 64 nt, Homo Sapiens; identical to SEQ ID NO: 263788

SEQ ID NO: 646661 - RNA, 64 nt, Homo Sapiens; identical to SEQ ID NO: 263789

SEQ ID NO: 646662 - RNA, 64 nt, Homo Sapiens; identical to SEQ ID NO: 263790

SEQ ID NO: 646663 - RNA, 64 nt, Homo Sapiens; identical to SEQ ID NO: 263791

SEQ ID NO: 646664 - RNA, 64 nt, Homo Sapiens; identical to SEQ ID NO: 263792

SEQ ID NO: 646665 - RNA, 64 nt, Homo Sapiens; identical to SEQ ID NO: 263793

SEQ ID NO: 646666 - RNA, 64 nt, Homo Sapiens; identical to SEQ ID NO: 263794

SEQ ID NO: 646667 - RNA, 64 nt, Homo Sapiens; identical to SEQ ID NO: 263795

SEQ ID NO: 646668 - RNA, 64 nt, Homo Sapiens; identical to SEQ ID NO: 263796

SEQ ID NO: 646669 - RNA, 64 nt, Homo Sapiens; identical to SEQ ID NO: 263797

SEQ ID NO: 646670 - RNA, 64 nt, Homo Sapiens; identical to SEQ ID NO: 263798

SEQ ID NO: 646671 - RNA, 64 nt, Homo Sapiens; identical to SEQ ID NO: 263799

SEQ ID NO: 646672 - RNA, 64 nt, Homo Sapiens; identical to SEQ ID NO: 263800

SEQ ID NO: 646673 - RNA, 64 nt, Homo Sapiens; identical to SEQ ID NO: 263801

SEQ ID NO: 646674 - RNA, 64 nt, Homo Sapiens; identical to SEQ ID NO: 263802

SEQ ID NO: 646675 - RNA, 64 nt, Homo Sapiens; identical to SEQ ID NO: 263803

SEQ ID NO: 646676 - RNA, 64 nt, Homo Sapiens; identical to SEQ ID NO: 263804

SEQ ID NO: 646677 - RNA, 64 nt, Homo Sapiens; identical to SEQ ID NO: 263805

SEQ ID NO: 646678 - RNA, 64 nt, Homo Sapiens; identical to SEQ ID NO: 263806

SEQ ID NO: 646679 - RNA, 64 nt, Homo Sapiens; identical to SEQ ID NO: 263807

SEQ ID NO: 646680 - RNA, 64 nt, Homo Sapiens; identical to SEQ ID NO: 263808

SEQ ID NO: 646681 - RNA, 64 nt, Homo Sapiens; identical to SEQ ID NO: 263809

SEQ ID NO: 646682 - RNA, 64 nt, Homo Sapiens; identical to SEQ ID NO: 263810

SEQ ID NO: 646683 - RNA, 64 nt, Homo Sapiens; identical to SEQ ID NO: 263811

SEQ ID NO: 646684 - RNA, 64 nt, Homo Sapiens; identical to SEQ ID NO: 263812

SEQ ID NO: 646685 - RNA, 64 nt, Homo Sapiens; identical to SEQ ID NO: 263813

SEQ ID NO: 646686 - RNA, 64 nt, Homo Sapiens; identical to SEQ ID NO: 263814

SEQ ID NO: 646687 - RNA, 64 nt, Homo Sapiens; identical to SEQ ID NO: 263815

SEQ ID NO: 646688 - RNA, 64 nt, Homo Sapiens; identical to SEQ ID NO: 263816

SEQ ID NO: 646689 - RNA, 64 nt, Homo Sapiens; identical to SEQ ID NO: 263817

SEQ ID NO: 646690 - RNA, 64 nt, Homo Sapiens; identical to SEQ ID NO: 263818

SEQ ID NO: 646691 - RNA, 64 nt, Homo Sapiens; identical to SEQ ID NO: 263819

SEQ ID NO: 646692 - RNA, 64 nt, Homo Sapiens; identical to SEQ ID NO: 263820

SEQ ID NO: 646693 - RNA, 64 nt, Homo Sapiens; identical to SEQ ID NO: 263821

SEQ ID NO: 646694 - RNA, 64 nt, Homo Sapiens; identical to SEQ ID NO: 263822

SEQ ID NO: 646695 - RNA, 64 nt, Homo Sapiens; identical to SEQ ID NO: 263823

SEQ ID NO: 646696 - RNA, 64 nt, Homo Sapiens; identical to SEQ ID NO: 263824

SEQ ID NO: 646697 - RNA, 64 nt, Homo Sapiens; identical to SEQ ID NO: 263825

SEQ ID NO: 646698 - RNA, 64 nt, Homo Sapiens; identical to SEQ ID NO: 263826

SEQ ID NO: 646699 - RNA, 64 nt, Homo Sapiens; identical to SEQ ID NO: 263827

SEQ ID NO: 646700 - RNA, 64 nt, Homo Sapiens; identical to SEQ ID NO: 263828

SEQ ID NO: 646701 - RNA, 64 nt, Homo Sapiens; identical to SEQ ID NO: 263829

SEQ ID NO: 646702 - RNA, 64 nt, Homo Sapiens; identical to SEQ ID NO: 263830

SEQ ID NO: 646703 - RNA, 64 nt, Homo Sapiens; identical to SEQ ID NO: 263831

SEQ ID NO: 646704 - RNA, 64 nt, Homo Sapiens; identical to SEQ ID NO: 263832

SEQ ID NO: 646705 - RNA, 64 nt, Homo Sapiens; identical to SEQ ID NO: 263833

SEQ ID NO: 646706 - RNA, 64 nt, Homo Sapiens; identical to SEQ ID NO: 263834

SEQ ID NO: 646707 - RNA, 64 nt, Homo Sapiens; identical to SEQ ID NO: 263835

SEQ ID NO: 646708 - RNA, 64 nt, Homo Sapiens; identical to SEQ ID NO: 263836

SEQ ID NO: 646709 - RNA, 64 nt, Homo Sapiens; identical to SEQ ID NO: 263837

SEQ ID NO: 646710 - RNA, 64 nt, Homo Sapiens; identical to SEQ ID NO: 263838

SEQ ID NO: 646711 - RNA, 64 nt, Homo Sapiens; identical to SEQ ID NO: 263839

SEQ ID NO: 646712 - RNA, 64 nt, Homo Sapiens; identical to SEQ ID NO: 263840

SEQ ID NO: 646713 - RNA, 64 nt, Homo Sapiens; identical to SEQ ID NO: 263841

SEQ ID NO: 646714 - RNA, 64 nt, Homo Sapiens; identical to SEQ ID NO: 263842

SEQ ID NO: 646715 - RNA, 64 nt, Homo Sapiens; identical to SEQ ID NO: 263843

SEQ ID NO: 646716 - RNA, 64 nt, Homo Sapiens; identical to SEQ ID NO: 263844

SEQ ID NO: 646717 - RNA, 64 nt, Homo Sapiens; identical to SEQ ID NO: 263845

SEQ ID NO: 646718 - RNA, 64 nt, Homo Sapiens; identical to SEQ ID NO: 263846

SEQ ID NO: 646719 - RNA, 64 nt, Homo Sapiens; identical to SEQ ID NO: 263847

SEQ ID NO: 646720 - RNA, 64 nt, Homo Sapiens; identical to SEQ ID NO: 263848

SEQ ID NO: 646721 - RNA, 64 nt, Homo Sapiens; identical to SEQ ID NO: 263849

SEQ ID NO: 646722 - RNA, 64 nt, Homo Sapiens; identical to SEQ ID NO: 263850

SEQ ID NO: 646723 - RNA, 64 nt, Homo Sapiens; identical to SEQ ID NO: 263851

SEQ ID NO: 646724 - RNA, 64 nt, Homo Sapiens; identical to SEQ ID NO: 263852

SEQ ID NO: 646725 - RNA, 64 nt, Homo Sapiens; identical to SEQ ID NO: 263853

SEQ ID NO: 646726 - RNA, 64 nt, Homo Sapiens; identical to SEQ ID NO: 263854

SEQ ID NO: 646727 - RNA, 64 nt, Homo Sapiens; identical to SEQ ID NO: 263855

SEQ ID NO: 646728 - RNA, 64 nt, Homo Sapiens; identical to SEQ ID NO: 263856

SEQ ID NO: 646729 - RNA, 64 nt, Homo Sapiens; identical to SEQ ID NO: 263857

SEQ ID NO: 646730 - RNA, 64 nt, Homo Sapiens; identical to SEQ ID NO: 263858

SEQ ID NO: 646731 - RNA, 64 nt, Homo Sapiens; identical to SEQ ID NO: 263859

SEQ ID NO: 646732 - RNA, 64 nt, Homo Sapiens; identical to SEQ ID NO: 263860

SEQ ID NO: 646733 - RNA, 64 nt, Homo Sapiens; identical to SEQ ID NO: 263861

SEQ ID NO: 646734 - RNA, 64 nt, Homo Sapiens; identical to SEQ ID NO: 263862

SEQ ID NO: 646735 - RNA, 64 nt, Homo Sapiens; identical to SEQ ID NO: 263863

SEQ ID NO: 646736 - RNA, 64 nt, Homo Sapiens; identical to SEQ ID NO: 263864

SEQ ID NO: 646737 - RNA, 64 nt, Homo Sapiens; identical to SEQ ID NO: 263865

SEQ ID NO: 646738 - RNA, 64 nt, Homo Sapiens; identical to SEQ ID NO: 263866

SEQ ID NO: 646739 - RNA, 64 nt, Homo Sapiens; identical to SEQ ID NO: 263867

SEQ ID NO: 646740 - RNA, 64 nt, Homo Sapiens; identical to SEQ ID NO: 263868

SEQ ID NO: 646741 - RNA, 64 nt, Homo Sapiens; identical to SEQ ID NO: 263869

SEQ ID NO: 646742 - RNA, 64 nt, Homo Sapiens; identical to SEQ ID NO: 263870

SEQ ID NO: 646743 - RNA, 64 nt, Homo Sapiens; identical to SEQ ID NO: 511837

SEQ ID NO: 646744 - RNA, 64 nt, Homo Sapiens; identical to SEQ ID NO: 511838

SEQ ID NO: 646745 - RNA, 64 nt, Homo Sapiens; identical to SEQ ID NO: 511839

SEQ ID NO: 646746 - RNA, 64 nt, Homo Sapiens; identical to SEQ ID NO: 511840

SEQ ID NO: 646747 - RNA, 64 nt, Homo Sapiens; identical to SEQ ID NO: 511841

SEQ ID NO: 646748 - RNA, 64 nt, Homo Sapiens; identical to SEQ ID NO: 511842

SEQ ID NO: 646749 - RNA, 64 nt, Homo Sapiens; identical to SEQ ID NO: 511843

SEQ ID NO: 646750 - RNA, 64 nt, Homo Sapiens; identical to SEQ ID NO: 511844

SEQ ID NO: 646751 - RNA, 64 nt, Homo Sapiens; identical to SEQ ID NO: 511845

SEQ ID NO: 646752 - RNA, 64 nt, Homo Sapiens; identical to SEQ ID NO: 511846

SEQ ID NO: 646753 - RNA, 64 nt, Homo Sapiens; identical to SEQ ID NO: 511847

SEQ ID NO: 646754 - RNA, 64 nt, Homo Sapiens; identical to SEQ ID NO: 511848

SEQ ID NO: 646755 - RNA, 64 nt, Homo Sapiens; identical to SEQ ID NO: 511849

SEQ ID NO: 646756 - RNA, 64 nt, Homo Sapiens; identical to SEQ ID NO: 511850

SEQ ID NO: 646757 - RNA, 64 nt, Homo Sapiens; identical to SEQ ID NO: 511851

SEQ ID NO: 646758 - RNA, 64 nt, Homo Sapiens; identical to SEQ ID NO: 511852

SEQ ID NO: 646759 - RNA, 64 nt, Homo Sapiens; identical to SEQ ID NO: 511853

SEQ ID NO: 646760 - RNA, 64 nt, Homo Sapiens; identical to SEQ ID NO: 511854

SEQ ID NO: 646761 - RNA, 64 nt, Homo Sapiens; identical to SEQ ID NO: 505756

SEQ ID NO: 646762 - RNA, 64 nt, Homo Sapiens; identical to SEQ ID NO: 505757

SEQ ID NO: 646763 - RNA, 64 nt, Homo Sapiens; identical to SEQ ID NO: 505758

SEQ ID NO: 646764 - RNA, 64 nt, Homo Sapiens; identical to SEQ ID NO: 505759

SEQ ID NO: 646765 - RNA, 64 nt, Homo Sapiens; identical to SEQ ID NO: 505760

SEQ ID NO: 646766 - RNA, 64 nt, Homo Sapiens; identical to SEQ ID NO: 505761

SEQ ID NO: 646767 - RNA, 64 nt, Homo Sapiens; identical to SEQ ID NO: 505762

SEQ ID NO: 646768 - RNA, 64 nt, Homo Sapiens; identical to SEQ ID NO: 505763

SEQ ID NO: 646769 - RNA, 64 nt, Homo Sapiens
aaucuggaccaucucuccucaacuggaccaucucucuccauaucacuauggaguaaaagaauua

SEQ ID NO: 646770 - RNA, 64 nt, Homo Sapiens
uucuucgagauaagcuuaaaaaggauaucaagguucuccauaggucuauaaaucauauaaugua

SEQ ID NO: 646771 - RNA, 64 nt, Homo Sapiens
aucuuuuaauuccuguuauuaaggaauuauucuuucuccauaucauucuuucuccauaucuuuu

SEQ ID NO: 646772 - RNA, 64 nt, Homo Sapiens
uuuuaaggaauuauucuuucacggaauuauucuuucuccauauccuuaccuguaaaguuaucuu

SEQ ID NO: 646773 - RNA, 64 nt, Homo Sapiens
uacugugugagcuacuuaacaucuccauauggugucuccauaucuccaccaaacuuaacuccgu

SEQ ID NO: 646774 - RNA, 64 nt, Homo Sapiens
gugucuccauaucuacugugaacuuaacuccguaucuccauauguuaauuccuaguauccacca

SEQ ID NO: 646775 - RNA, 64 nt, Homo Sapiens
ugccaagcuccucaaucauagccaagaucccaucucuccauauacuuuggguaucagcaucugu

SEQ ID NO: 646776 - RNA, 64 nt, Homo Sapiens
auauacuuuggguaucagcaucuguccucaucagucuccauaccccuucagcuuuccugagcug

SEQ ID NO: 646777 - RNA, 64 nt, Homo Sapiens
gaaagcuugggaaccaccccuggccuuuggaaccucuccauauacuuucuaagcucugggggag

SEQ ID NO: 646778 - RNA, 64 nt, Homo Sapiens
cuucccuuccuucuuuuuuuccucuacugacuucucuccauacucuuuccccucuauuucuuug

SEQ ID NO: 646779 - RNA, 64 nt, Homo Sapiens
uugauuaauuaauacuauuugaguuauuaaauguuaaucaaaaugaguauaucauuuccugucu

SEQ ID NO: 646780 - RNA, 64 nt, Homo Sapiens
auuacaaaugaauauuucauguuuauauaagcuguaaucaaaaaggacuaguaguaguaguaag

SEQ ID NO: 646781 - RNA, 64 nt, Homo Sapiens
ggagguaggaaagguaacagaaaaccagcauauuuaaucaaagcaagaaguaaucgcugacagu

SEQ ID NO: 646782 - RNA, 64 nt, Homo Sapiens
uauuucaacaauggacuaugccuugguuuuucacuaaucaaaaucaaaauuacucuuuaacaug

SEQ ID NO: 646783 - RNA, 64 nt, Homo Sapiens
aauauugccagccagcuuggguucuaaagugauuuaaucaaauucaugcuccugaucuuuuuuu

SEQ ID NO: 646784 - RNA, 64 nt, Homo Sapiens
guguaugaacuuguguuuuguggugacacauuaauaaucaaauugcuaaaacccugaaucugcu

SEQ ID NO: 646785 - RNA, 64 nt, Homo Sapiens
guagaaauaacuuauuuuuuaguauucuacaguuuaaucaaauuacugaaacaggacuuuugau

SEQ ID NO: 646786 - RNA, 64 nt, Homo Sapiens
cauuguaacuauguagaaaguguagacuaauguauaaucaaaaugcuaaggauuuuuauauggc

SEQ ID NO: 646787 - RNA, 64 nt, Homo Sapiens
uucuaaguuuuggguaauguuaacucagaacacuuaaucaaauugagcuaugugccauaaggua

SEQ ID NO: 646788 - RNA, 64 nt, Homo Sapiens
ggaauucagacacuguucuuaccguguuuguuuuuaaucaaauauuaccuaaaaauguacaaau

SEQ ID NO: 646789 - RNA, 64 nt, Homo Sapiens
ugugugaugauuuccgggaaauaaaaauuuaaacuaaucaaagugagcuuagaacauuuauggu

SEQ ID NO: 646790 - RNA, 64 nt, Homo Sapiens
uauuuuuuuacuuauguaguaauugauguuuuuauaaucaaaugauggacaaucauauuuacaa

SEQ ID NO: 646791 - RNA, 64 nt, Homo Sapiens
uaguuuuauugaugcuugcuccagggcauaauuauaaucaaaauguugaugucaucaaagauca

SEQ ID NO: 646792 - RNA, 64 nt, Homo Sapiens
acuuugggaggcugagucggguggcucacaccuguaaucaaaacagaacucucggccgggcgcg

SEQ ID NO: 646793 - RNA, 64 nt, Homo Sapiens
uaaaagacuugaaauuguaauuaaaauggcaagcuaaucaaacauaagcuucauuaagugggau

SEQ ID NO: 646794 - RNA, 64 nt, Homo Sapiens
gaucucaccucuccauccaggaauggaguccauguaaucaaagugaacuuaaaaauaggacagu

SEQ ID NO: 646795 - RNA, 64 nt, Homo Sapiens
ucauuuuuuuguacagauaacaggaguuucugacuaaucaaagcugguauuuccccgcaugucu

SEQ ID NO: 646796 - RNA, 64 nt, Homo Sapiens
ugucuuauucuugcccuucccccaaccaguuuguuaaucaaacaauaaaaacauguuuuuuuuu

SEQ ID NO: 646797 - RNA, 64 nt, Homo Sapiens
aagucuugcaucauaaauucggaauuaggguuucuaaucaaacuucuuccucagcagaccucuu

SEQ ID NO: 646798 - RNA, 64 nt, Homo Sapiens
cuuauaugaauaauuuugaauguaguagcuaaacuaaucaaaauggaaauagucucaacgugca

SEQ ID NO: 646799 - RNA, 64 nt, Homo Sapiens
aaccagacugugucuuauucgugcauggaacaaauaaucaaaagucuaaaauauccuccaaugu

SEQ ID NO: 646800 - RNA, 64 nt, Homo Sapiens
caccuugucucaugacuuuuaacuauuuuucacauaaucaaacuaguccaucucaaaaaaaaac

SEQ ID NO: 646801 - RNA, 64 nt, Homo Sapiens
gguaaugcuuggaauggcaauaggguagaaugauuaaucaaaggcauaucuucuauaucugaag

SEQ ID NO: 646802 - RNA, 64 nt, Homo Sapiens
ggguuuaauagacugagucagaugggucugauauuaaucaaaauugucucuucugaggaccgcu

SEQ ID NO: 646803 - RNA, 64 nt, Homo Sapiens
guccacuucugcacucucugacacacauaaacucgcuucugagcgccagcagauagaggaaaag

SEQ ID NO: 646804 - RNA, 64 nt, Homo Sapiens
auucaguuuuggagcaagucuucccuaucaugcugcuucugaaaugucagaguugaauaucucu

SEQ ID NO: 646805 - RNA, 64 nt, Homo Sapiens
aauggaaauguagguucacuaaccuuccauguuugcuucugauacaauacuucaucauguaugu

SEQ ID NO: 646806 - RNA, 64 nt, Homo Sapiens
cuggaacucuggaggaagacccggcggaaucgcagcuucugagaggguaacuggagcgucacca

SEQ ID NO: 646807 - RNA, 64 nt, Homo Sapiens
uacaaaacaaaugugcuauguaaaauaaggguuggcuucugaacaucucuuguacacauuuuaa

SEQ ID NO: 646808 - RNA, 64 nt, Homo Sapiens
ucagggacaaaacucagugaugggcugugccagggcuucugacuugugauuuggccugugaacu

SEQ ID NO: 646809 - RNA, 64 nt, Homo Sapiens
agcuugaaaggccaauaccagaacacaggcugaugcuucugagaaagucuuuuccuaguauuua

SEQ ID NO: 646810 - RNA, 64 nt, Homo Sapiens
gucagcucauuuccauuccacuauuucccauaaugcuucugagagccacuaacuugauugauaa

SEQ ID NO: 646811 - RNA, 64 nt, Homo Sapiens
gugugugugucuugugcuuccucagaccuuucucgcuucugagcuugguggccuguucccucca

SEQ ID NO: 646812 - RNA, 64 nt, Homo Sapiens
cccuuauccuucugguccagcgcaaggaggggcugcuucugaggucgguggcugucuuuccauu

SEQ ID NO: 646813 - RNA, 59 nt, Homo Sapiens
aaaauuaacuauacaguuaaugguuuagaacuuagaacuacuuagaauuaaugcuaaag

SEQ ID NO: 646814 - RNA, 59 nt, Homo Sapiens
auacaguuaaugguuuagaacuuagaacuacuuagaauuaaugcuaaagugucaggaag

SEQ ID NO: 646815 - RNA, 59 nt, Homo Sapiens
agguagagaauacaacaaagaguucuaagacuuagaaaagacaauuuuguggugucauu

SEQ ID NO: 646816 - RNA, 59 nt, Homo Sapiens
aauauacaaauuuuccuguaauaaagucaacuuagaaacuccaaggagguuacauguuu

SEQ ID NO: 646817 - RNA, 59 nt, Homo Sapiens
aauacguaaacauacagugacaacauuaaacuuagaaaaguuuuaaaacuuaauggauc

SEQ ID NO: 646818 - RNA, 59 nt, Homo Sapiens
uucgcacuucugagacggcaaagccaaccacuuagaagccuuccacaucuuugucaccu

SEQ ID NO: 646819 - RNA, 59 nt, Homo Sapiens
aaaacccuucauaaaucaagaaggccaucacuuagaacgaaccccaaacaaaaaugcca

SEQ ID NO: 646820 - RNA, 59 nt, Homo Sapiens
cuaagcaaucauuuuuccccccagaaguuacuuagaaggagaacugggaacacuugggg

SEQ ID NO: 646821 - RNA, 59 nt, Homo Sapiens
cauuucucccuucucugccaacuuauuucacuuagaauacagucuugauaacugaaaug

SEQ ID NO: 646822 - RNA, 59 nt, Homo Sapiens
cagucuugauaacugaaaugaaauagauaacuuagaacuuagcauuuuugcaccaguaa

SEQ ID NO: 646823 - RNA, 59 nt, Homo Sapiens
uauguuuauaaaguguaauuuuuagguucacuuagaauauauuuuauuuaauaaguuaa

SEQ ID NO: 646824 - RNA, 59 nt, Homo Sapiens
ucuuauuuuuguacaguuuugaaguuuauacuuagaacugaccaccuccccggccacgc

SEQ ID NO: 646825 - RNA, 59 nt, Homo Sapiens
ccaauccuaggaacuguauacuaguuccuacuuagaacaaaaguaucaaguuugcacac

SEQ ID NO: 646826 - RNA, 59 nt, Homo Sapiens
aguacuuuacuuguauuaucccauuuaauacuuagaacaaccccgugagauaaguaguu

SEQ ID NO: 646827 - RNA, 59 nt, Homo Sapiens
gaucuugguuuuuccaaacucuauuuggaacuuagaaaaucuugggugagcaacggcac

SEQ ID NO: 646828 - RNA, 59 nt, Homo Sapiens
agcugaaauacaaaagcagaaggaagggaacuuagaagaucgaugccucagguuucuag

SEQ ID NO: 646829 - RNA, 59 nt, Homo Sapiens
uucuacagucgucgauuuuuuugugguacacuuagaaaaacucugguuguugugccaaa

SEQ ID NO: 646830 - RNA, 59 nt, Homo Sapiens
uuuuuggauaugccacugcauaaaagcccacuuagaaacaggaggaaggaagggcaacc

SEQ ID NO: 646831 - RNA, 59 nt, Homo Sapiens
uaauagcagucauagugaagauuagcacuacuuagaauuaaauuaggaagucuuuuauc

SEQ ID NO: 646832 - RNA, 59 nt, Homo Sapiens
uuagauguauagaaaaguaagaaaaucuuacuuagaaaaaagccccuugaaacuugcag

SEQ ID NO: 646833 - RNA, 59 nt, Homo Sapiens
uacacagauccuaaguagaagagagaaagacuuagaacauuaucucuuuuuuucuaaag

SEQ ID NO: 646834 - RNA, 59 nt, Homo Sapiens
uacacagauccaaaauagaagagagaaagacuuagaauggagaauguuuuucucuaaau

SEQ ID NO: 646835 - RNA, 59 nt, Homo Sapiens
cugugguaagagauaugcucauuauuaccacuuagaagauguuguuaaaaacaugugaa

SEQ ID NO: 646836 - RNA, 59 nt, Homo Sapiens
ucacugcuuuuuccuuagcuuaaugacuuacuuagaauuuauccuuuauuuuaaaugau

SEQ ID NO: 646837 - RNA, 59 nt, Homo Sapiens
aaauuuauuuuucuggaauucugacacagacuuagaaucgauuaauuuugcguuaaaga

SEQ ID NO: 646838 - RNA, 59 nt, Homo Sapiens
auaaggaauaagucuuugaaaaguuuuuuacuuagaaauugacuuuaaaagccuccuug

SEQ ID NO: 646839 - RNA, 59 nt, Homo Sapiens
ugacaaguauuuuuucugaacagaaguuuacuuagaaauaccaugcacuuggggguacc

SEQ ID NO: 646840 - RNA, 59 nt, Homo Sapiens
uucauuacugcauccccaguaaugaaaguacuuagaaaauaauuauugaaugaaugaaa

SEQ ID NO: 646841 - RNA, 59 nt, Homo Sapiens
guuaauuggaaaucagaguuaagaauaauacuuagaaggauggaugaaacuauaacuua

SEQ ID NO: 646842 - RNA, 59 nt, Homo Sapiens
ucaaguucuagcauuuuagugggauguggacuuagaaaauucauccuguugcuggcagu

SEQ ID NO: 646843 - RNA, 64 nt, Homo Sapiens
uaagaguuuaagcuuugagaaccaacaaguacuccaaaacuaagagaaacagcccacagagcuc

SEQ ID NO: 646844 - RNA, 50 nt, Homo Sapiens
auacccaagacugaagaaaccaaaacuaggucuccccauagguuuauuaa

SEQ ID NO: 646845 - RNA, 64 nt, Homo Sapiens
uaggcuuuacucuugaguguauaaaacaauugggcaaaacuaccucugaaaaucacauuucaga

SEQ ID NO: 646846 - RNA, 64 nt, Homo Sapiens
uauugacuuuauucauccauauuuuuuuuuaaagcaaaacuauuaacucaacuaugaaucuuca

SEQ ID NO: 646847 - RNA, 64 nt, Homo Sapiens
aauugacuuaaacugcuauaauuaaaacugcuuucaaaacuacacuuuuuguggaagauaaaau

SEQ ID NO: 646848 - RNA, 64 nt, Homo Sapiens
uauaauuuauuuuaggaguugucaccucuaccuucaaaacuacaaauauacagccuacuuuuau

SEQ ID NO: 646849 - RNA, 64 nt, Homo Sapiens
cacuauguacuuuuuuauaaaaaagaaauuauugcaaaacuaacgaugauaugacaucuggcua

SEQ ID NO: 646850 - RNA, 64 nt, Homo Sapiens
auagaaaauaauacgaaacuugcaaaaucauagccaaaacuaguauacuuuauaaguaauucua

SEQ ID NO: 646851 - RNA, 56 nt, Homo Sapiens
aguacuucuuaaugaaguaaacccaacaaaacuagagguaugaauuaaugcuacac

SEQ ID NO: 646852 - RNA, 64 nt, Homo Sapiens
aaaugucaguguuuuggugcaccuuuuugaaaugcaaaacuaggaaaagguuaaacuggauuuu

SEQ ID NO: 646853 - RNA, 64 nt, Homo Sapiens
uguauuuagaaaagguuuauauuauuagugaaaacaaaacuaaagggaaguucaaguucucaug

SEQ ID NO: 646854 - RNA, 64 nt, Homo Sapiens
auugcuuagauaauuuagaauuuuuaacuaaugucaaaacuacagugucaaacauucuagguug

SEQ ID NO: 646855 - RNA, 64 nt, Homo Sapiens
acuaguuuuguuuauaaauuggagaugcaaauagcaaaacuaaauacuugcuccauuuacaaac

SEQ ID NO: 646856 - RNA, 64 nt, Homo Sapiens
ucagaacuuucugugccacuguagauagcucaggcaaaacuauuaccuggguauuuauccacua

SEQ ID NO: 646857 - RNA, 64 nt, Homo Sapiens
gagcgagucaaaggaccagucauucugggagaggcaaaacuaucguaugauugcaauuauauga

SEQ ID NO: 646858 - RNA, 64 nt, Homo Sapiens
aauaggauuauguuagcauugugaaaguuuuuggcaaaacuacaucacagauuuuuuugaauuu

SEQ ID NO: 646859 - RNA, 64 nt, Homo Sapiens
ugacaguauuugacagugucggcugccucaguagcaaaacuaccaguccuugugcuggaugagu

SEQ ID NO: 646860 - RNA, 64 nt, Homo Sapiens
aucaaguuauuaaaacuaaauccacgcgccaugacaaaacuauacacacaauugacuggacagg

SEQ ID NO: 646861 - RNA, 64 nt, Homo Sapiens
uguauaaucacaaaucuaauugauuuuauuauggcaaaacuaugcuuuugccaccuuccuguug

SEQ ID NO: 646862 - RNA, 64 nt, Homo Sapiens
cauuauacuauguguauguuugauacagcgucgccaaaacuaguguucuuuauuagugccucuc

SEQ ID NO: 646863 - RNA, 64 nt, Homo Sapiens
cugauuuaaaggcuuaggcauguucaaacgccugcaaaacuacuuaucacucagcuuuaguuuu

SEQ ID NO: 646864 - RNA, 64 nt, Homo Sapiens
aucuaauuccgcaaaaauugaucauuugcaaagucaaaacuauagccauauccaaaucuuuucc

SEQ ID NO: 646865 - RNA, 64 nt, Homo Sapiens
gccaggggccuccgugaacuucucccugacaacacaaaacuagauccaaggugcuugaucaaca

SEQ ID NO: 646866 - RNA, 64 nt, Homo Sapiens
acucuguucagaaaaaaaauauaucauuaaaugucaaaacuauggaaaauauaagaugauaaag

SEQ ID NO: 646867 - RNA, 64 nt, Homo Sapiens
ugagaacaaacagaucgaacuuuuuccaucuuuacaaaacuacaucuugaugaccaaaguccuu

SEQ ID NO: 646868 - RNA, 64 nt, Homo Sapiens
aaucaaguauuugggaagugaaauguaaaggagucaaaacuacaucuugaaauuaagaaggcaa

SEQ ID NO: 646869 - RNA, 65 nt, Homo Sapiens; identical to SEQ ID NO: 44973

SEQ ID NO: 646870 - RNA, 65 nt, Homo Sapiens; identical to SEQ ID NO: 44974

SEQ ID NO: 646871 - RNA, 65 nt, Homo Sapiens; identical to SEQ ID NO: 44975

SEQ ID NO: 646872 - RNA, 65 nt, Homo Sapiens; identical to SEQ ID NO: 44976

SEQ ID NO: 646873 - RNA, 65 nt, Homo Sapiens; identical to SEQ ID NO: 44977

SEQ ID NO: 646874 - RNA, 65 nt, Homo Sapiens; identical to SEQ ID NO: 44978

SEQ ID NO: 646875 - RNA, 65 nt, Homo Sapiens; identical to SEQ ID NO: 44979

SEQ ID NO: 646876 - RNA, 65 nt, Homo Sapiens; identical to SEQ ID NO: 44980

SEQ ID NO: 646877 - RNA, 65 nt, Homo Sapiens; identical to SEQ ID NO: 44981

SEQ ID NO: 646878 - RNA, 65 nt, Homo Sapiens; identical to SEQ ID NO: 44982

SEQ ID NO: 646879 - RNA, 65 nt, Homo Sapiens; identical to SEQ ID NO: 44983

SEQ ID NO: 646880 - RNA, 65 nt, Homo Sapiens; identical to SEQ ID NO: 44984

SEQ ID NO: 646881 - RNA, 65 nt, Homo Sapiens; identical to SEQ ID NO: 44985

SEQ ID NO: 646882 - RNA, 65 nt, Homo Sapiens; identical to SEQ ID NO: 44986

SEQ ID NO: 646883 - RNA, 65 nt, Homo Sapiens; identical to SEQ ID NO: 44987

SEQ ID NO: 646884 - RNA, 65 nt, Homo Sapiens; identical to SEQ ID NO: 44988

SEQ ID NO: 646885 - RNA, 65 nt, Homo Sapiens; identical to SEQ ID NO: 44989

SEQ ID NO: 646886 - RNA, 65 nt, Homo Sapiens; identical to SEQ ID NO: 44990

SEQ ID NO: 646887 - RNA, 65 nt, Homo Sapiens; identical to SEQ ID NO: 44991

SEQ ID NO: 646888 - RNA, 65 nt, Homo Sapiens; identical to SEQ ID NO: 44992

SEQ ID NO: 646889 - RNA, 65 nt, Homo Sapiens; identical to SEQ ID NO: 44993

SEQ ID NO: 646890 - RNA, 65 nt, Homo Sapiens; identical to SEQ ID NO: 44994

SEQ ID NO: 646891 - RNA, 65 nt, Homo Sapiens; identical to SEQ ID NO: 44995

SEQ ID NO: 646892 - RNA, 65 nt, Homo Sapiens; identical to SEQ ID NO: 44996

SEQ ID NO: 646893 - RNA, 65 nt, Homo Sapiens; identical to SEQ ID NO: 44997

SEQ ID NO: 646894 - RNA, 65 nt, Homo Sapiens; identical to SEQ ID NO: 44998

SEQ ID NO: 646895 - RNA, 65 nt, Homo Sapiens; identical to SEQ ID NO: 44999

SEQ ID NO: 646896 - RNA, 65 nt, Homo Sapiens; identical to SEQ ID NO: 45000

SEQ ID NO: 646897 - RNA, 65 nt, Homo Sapiens; identical to SEQ ID NO: 45001

SEQ ID NO: 646898 - RNA, 65 nt, Homo Sapiens; identical to SEQ ID NO: 45002

SEQ ID NO: 646899 - RNA, 65 nt, Homo Sapiens; identical to SEQ ID NO: 45003

SEQ ID NO: 646900 - RNA, 65 nt, Homo Sapiens; identical to SEQ ID NO: 45004

SEQ ID NO: 646901 - RNA, 65 nt, Homo Sapiens; identical to SEQ ID NO: 45005

SEQ ID NO: 646902 - RNA, 65 nt, Homo Sapiens; identical to SEQ ID NO: 45006

SEQ ID NO: 646903 - RNA, 65 nt, Homo Sapiens; identical to SEQ ID NO: 45007

SEQ ID NO: 646904 - RNA, 65 nt, Homo Sapiens; identical to SEQ ID NO: 45008

SEQ ID NO: 646905 - RNA, 65 nt, Homo Sapiens; identical to SEQ ID NO: 45009

SEQ ID NO: 646906 - RNA, 65 nt, Homo Sapiens; identical to SEQ ID NO: 45010

SEQ ID NO: 646907 - RNA, 65 nt, Homo Sapiens; identical to SEQ ID NO: 45011

SEQ ID NO: 646908 - RNA, 65 nt, Homo Sapiens; identical to SEQ ID NO: 45012

SEQ ID NO: 646909 - RNA, 65 nt, Homo Sapiens; identical to SEQ ID NO: 45013

SEQ ID NO: 646910 - RNA, 65 nt, Homo Sapiens; identical to SEQ ID NO: 45014

SEQ ID NO: 646911 - RNA, 65 nt, Homo Sapiens; identical to SEQ ID NO: 45015

SEQ ID NO: 646912 - RNA, 65 nt, Homo Sapiens; identical to SEQ ID NO: 45016

SEQ ID NO: 646913 - RNA, 65 nt, Homo Sapiens; identical to SEQ ID NO: 45017

SEQ ID NO: 646914 - RNA, 65 nt, Homo Sapiens; identical to SEQ ID NO: 45018

SEQ ID NO: 646915 - RNA, 65 nt, Homo Sapiens; identical to SEQ ID NO: 45019

SEQ ID NO: 646916 - RNA, 65 nt, Homo Sapiens; identical to SEQ ID NO: 45020

SEQ ID NO: 646917 - RNA, 65 nt, Homo Sapiens; identical to SEQ ID NO: 45021

SEQ ID NO: 646918 - RNA, 65 nt, Homo Sapiens; identical to SEQ ID NO: 45022

SEQ ID NO: 646919 - RNA, 65 nt, Homo Sapiens; identical to SEQ ID NO: 45023

SEQ ID NO: 646920 - RNA, 65 nt, Homo Sapiens; identical to SEQ ID NO: 45024

SEQ ID NO: 646921 - RNA, 64 nt, Homo Sapiens
gggugcccuauaggcacaagcccagcugaagaacagaauggagggcucugggaggaggcagcuc

SEQ ID NO: 646922 - RNA, 64 nt, Homo Sapiens
gggauggacauaaaggaaaaagagugaugagaagagaauggagagaauuugaauaaaagguggg

SEQ ID NO: 646923 - RNA, 64 nt, Homo Sapiens
acugggaggagaagcauuaaguggccccagggagagaauggaggaauaaggcaucucugagaaa

SEQ ID NO: 646924 - RNA, 64 nt, Homo Sapiens
ugauagucacaaaaguaaaucuuuuuaagaugguagaauggagguuuugacuaaugacaaaccu

SEQ ID NO: 646925 - RNA, 64 nt, Homo Sapiens
ucccccggcugggccuccuucuuccacuucuccaagaauggaagccugaacugaggccuugugu

SEQ ID NO: 646926 - RNA, 64 nt, Homo Sapiens
aggucacugucacugccgacaucccucccccagcagaauggaggcaggggacaagggaggcagu

SEQ ID NO: 646927 - RNA, 64 nt, Homo Sapiens
acagugaacggaaaacacaguugucaaaaugcagagaauggaaaacucuguaggguacuguaau

SEQ ID NO: 646928 - RNA, 64 nt, Homo Sapiens
aggagucugagaucuguacucacaauuaguuuacagaauggaaauacauuugaguaaccaucaa

SEQ ID NO: 646929 - RNA, 64 nt, Homo Sapiens
acacagcccacaucugucacucuccagacccgucagaauggaauaaagacaaagguuagucuga

SEQ ID NO: 646930 - RNA, 64 nt, Homo Sapiens
gggguaaaaguguauuuugaguguaaauaaugacagaauggaguuucauuuuucuuguacauau

SEQ ID NO: 646931 - RNA, 64 nt, Homo Sapiens
aauaccugauguauugugaaagccacugauuuuaagaauggagagaaagggauuuuuuacugca

SEQ ID NO: 646932 - RNA, 64 nt, Homo Sapiens
gaagugacuugcccuaggagcagacagcaugccaagaauggaauuaggcucaggauccagccug

SEQ ID NO: 646933 - RNA, 64 nt, Homo Sapiens
cuaucuuuaucugcaagaggccuggacuagugaaagaauggacuuggacuuuuuuggccacugc

SEQ ID NO: 646934 - RNA, 64 nt, Homo Sapiens
ugacaagaaauaucugcaguugcaguguugaaacagaauggaaagggccuccaguguauuguuc

SEQ ID NO: 646935 - RNA, 64 nt, Homo Sapiens
auaaugcagauauuucuguggucuucaacuuauuagaauggaagauucagacugaaauguuugu

SEQ ID NO: 646936 - RNA, 64 nt, Homo Sapiens
aacucuuaacuuuuaucaaguuauuccauuccagagaauggacagguuaagggaagugacaauu

SEQ ID NO: 646937 - RNA, 64 nt, Homo Sapiens
gcagcacacuccguccccuccagaaguagagaagagaauggaaaguguaucuucuccccaguga

SEQ ID NO: 646938 - RNA, 64 nt, Homo Sapiens
cguugagcauuuaguacaaguuccauagucugagagaauggaaugaaaaaaaugugacagaaug

SEQ ID NO: 646939 - RNA, 64 nt, Homo Sapiens
agagccacaagcaggaagagcagcgcuguguugcagaauggaguuuccauggauuucuaccaga

SEQ ID NO: 646940 - RNA, 64 nt, Homo Sapiens
uuauuaaaacuaaaucugaaauggaauagaaaauagaauggauuacauacagaugguuuccuug

SEQ ID NO: 646941 - RNA, 64 nt, Homo Sapiens
uggaaaaggguggcugcgaccccaauaagaaugaagaauggaaaaaaugucucaaagucaacag

SEQ ID NO: 646942 - RNA, 64 nt, Homo Sapiens
cuccaucaccggaaccagcggagccgcuccuuacagaauggagcaggaaccaacuccagguaga

SEQ ID NO: 646943 - RNA, 64 nt, Homo Sapiens
caggccuucagcccauuggcugcuggaagaauggagaauggaaagccagugaguuguagauuua

SEQ ID NO: 646944 - RNA, 64 nt, Homo Sapiens
auggaaacaggccuucagccagauuuaugcuggaagaauggagauugugcugccagugaguugu

SEQ ID NO: 646945 - RNA, 64 nt, Homo Sapiens
uuuggaucugcuccucgucaccacgucauaaugaagaauggaagaauguuuggacuugauuucc

SEQ ID NO: 646946 - RNA, 64 nt, Homo Sapiens
cggcauucuuggacuucacuauauaggucaggaaagaauggagacucugugccugacucacagc

SEQ ID NO: 646947 - RNA, 64 nt, Homo Sapiens
agagguuccucgaaaggggggagaagaaauuuugagaauggaaaaaucccccagcccagcccag

SEQ ID NO: 646948 - RNA, 64 nt, Homo Sapiens
cagggggugaccccuggagcuaguugcgugucccagaauggaggguguucugacaccccacccu

SEQ ID NO: 646949 - RNA, 64 nt, Homo Sapiens
cugcccugacucaugaaucaucacuauauuuugcagaauggaaaguauugcccaguaggagcua

SEQ ID NO: 646950 - RNA, 64 nt, Homo Sapiens
cagucaugcuaaaugccauaagccuggugacuccagaauggagccaaacucucauuuaggugac

SEQ ID NO: 646951 - RNA, 64 nt, Homo Sapiens
ugcuaaugugcagcugagugcacuuuauuuaaaaagaauggauaaaugcaauauucuugagguc

SEQ ID NO: 646952 - RNA, 64 nt, Homo Sapiens
uuugauccagaggugggugcagcugaaaguaaacagaauggauugccaguuacauguaugccug

SEQ ID NO: 646953 - RNA, 64 nt, Homo Sapiens
aggacuuaggaaaaaguccucugcauguguggggagaauggacagaguauauugaauagaaauu

SEQ ID NO: 646954 - RNA, 64 nt, Homo Sapiens
cucaggcacagaguggcccuggagcaucaguaaaagaauggacaccuugucuggggaguguugg

SEQ ID NO: 646955 - RNA, 64 nt, Homo Sapiens; identical to SEQ ID NO: 159617

SEQ ID NO: 646956 - RNA, 64 nt, Homo Sapiens; identical to SEQ ID NO: 159618

SEQ ID NO: 646957 - RNA, 64 nt, Homo Sapiens; identical to SEQ ID NO: 159619

SEQ ID NO: 646958 - RNA, 64 nt, Homo Sapiens; identical to SEQ ID NO: 159620

SEQ ID NO: 646959 - RNA, 64 nt, Homo Sapiens; identical to SEQ ID NO: 159621

SEQ ID NO: 646960 - RNA, 64 nt, Homo Sapiens; identical to SEQ ID NO: 159622

SEQ ID NO: 646961 - RNA, 64 nt, Homo Sapiens; identical to SEQ ID NO: 159623

SEQ ID NO: 646962 - RNA, 64 nt, Homo Sapiens; identical to SEQ ID NO: 159624

SEQ ID NO: 646963 - RNA, 64 nt, Homo Sapiens; identical to SEQ ID NO: 159625

SEQ ID NO: 646964 - RNA, 64 nt, Homo Sapiens; identical to SEQ ID NO: 159626

SEQ ID NO: 646965 - RNA, 64 nt, Homo Sapiens; identical to SEQ ID NO: 159627

SEQ ID NO: 646966 - RNA, 64 nt, Homo Sapiens; identical to SEQ ID NO: 159628

SEQ ID NO: 646967 - RNA, 64 nt, Homo Sapiens; identical to SEQ ID NO: 159629

SEQ ID NO: 646968 - RNA, 64 nt, Homo Sapiens; identical to SEQ ID NO: 159630

SEQ ID NO: 646969 - RNA, 64 nt, Homo Sapiens; identical to SEQ ID NO: 159631

SEQ ID NO: 646970 - RNA, 64 nt, Homo Sapiens; identical to SEQ ID NO: 159632

SEQ ID NO: 646971 - RNA, 64 nt, Homo Sapiens; identical to SEQ ID NO: 159633

SEQ ID NO: 646972 - RNA, 64 nt, Homo Sapiens; identical to SEQ ID NO: 159634

SEQ ID NO: 646973 - RNA, 64 nt, Homo Sapiens; identical to SEQ ID NO: 159635

SEQ ID NO: 646974 - RNA, 64 nt, Homo Sapiens; identical to SEQ ID NO: 159636

SEQ ID NO: 646975 - RNA, 64 nt, Homo Sapiens; identical to SEQ ID NO: 159637

SEQ ID NO: 646976 - RNA, 64 nt, Homo Sapiens; identical to SEQ ID NO: 159638

SEQ ID NO: 646977 - RNA, 64 nt, Homo Sapiens; identical to SEQ ID NO: 159639

SEQ ID NO: 646978 - RNA, 64 nt, Homo Sapiens; identical to SEQ ID NO: 159640

SEQ ID NO: 646979 - RNA, 64 nt, Homo Sapiens; identical to SEQ ID NO: 159641

SEQ ID NO: 646980 - RNA, 64 nt, Homo Sapiens; identical to SEQ ID NO: 159642

SEQ ID NO: 646981 - RNA, 64 nt, Homo Sapiens; identical to SEQ ID NO: 159643

SEQ ID NO: 646982 - RNA, 64 nt, Homo Sapiens; identical to SEQ ID NO: 159644

SEQ ID NO: 646983 - RNA, 64 nt, Homo Sapiens; identical to SEQ ID NO: 159645

SEQ ID NO: 646984 - RNA, 64 nt, Homo Sapiens; identical to SEQ ID NO: 159646

SEQ ID NO: 646985 - RNA, 64 nt, Homo Sapiens; identical to SEQ ID NO: 159647

SEQ ID NO: 646986 - RNA, 64 nt, Homo Sapiens; identical to SEQ ID NO: 159648

SEQ ID NO: 646987 - RNA, 64 nt, Homo Sapiens; identical to SEQ ID NO: 159649

SEQ ID NO: 646988 - RNA, 64 nt, Homo Sapiens; identical to SEQ ID NO: 159650

SEQ ID NO: 646989 - RNA, 64 nt, Homo Sapiens; identical to SEQ ID NO: 159651

SEQ ID NO: 646990 - RNA, 64 nt, Homo Sapiens; identical to SEQ ID NO: 159652

SEQ ID NO: 646991 - RNA, 64 nt, Homo Sapiens; identical to SEQ ID NO: 159653

SEQ ID NO: 646992 - RNA, 64 nt, Homo Sapiens; identical to SEQ ID NO: 159654

SEQ ID NO: 646993 - RNA, 64 nt, Homo Sapiens; identical to SEQ ID NO: 159655

SEQ ID NO: 646994 - RNA, 64 nt, Homo Sapiens; identical to SEQ ID NO: 159656

SEQ ID NO: 646995 - RNA, 64 nt, Homo Sapiens; identical to SEQ ID NO: 159657

SEQ ID NO: 646996 - RNA, 64 nt, Homo Sapiens; identical to SEQ ID NO: 159658

SEQ ID NO: 646997 - RNA, 64 nt, Homo Sapiens; identical to SEQ ID NO: 637341

SEQ ID NO: 646998 - RNA, 64 nt, Homo Sapiens; identical to SEQ ID NO: 637342

SEQ ID NO: 646999 - RNA, 64 nt, Homo Sapiens; identical to SEQ ID NO: 637343

SEQ ID NO: 647000 - RNA, 64 nt, Homo Sapiens; identical to SEQ ID NO: 637344

SEQ ID NO: 647001 - RNA, 64 nt, Homo Sapiens; identical to SEQ ID NO: 637345

SEQ ID NO: 647002 - RNA, 64 nt, Homo Sapiens; identical to SEQ ID NO: 637346

SEQ ID NO: 647003 - RNA, 64 nt, Homo Sapiens; identical to SEQ ID NO: 637347

SEQ ID NO: 647004 - RNA, 64 nt, Homo Sapiens; identical to SEQ ID NO: 637348

SEQ ID NO: 647005 - RNA, 64 nt, Homo Sapiens; identical to SEQ ID NO: 637349

SEQ ID NO: 647006 - RNA, 64 nt, Homo Sapiens; identical to SEQ ID NO: 637350

SEQ ID NO: 647007 - RNA, 64 nt, Homo Sapiens; identical to SEQ ID NO: 637351

SEQ ID NO: 647008 - RNA, 64 nt, Homo Sapiens; identical to SEQ ID NO: 637352

SEQ ID NO: 647009 - RNA, 64 nt, Homo Sapiens; identical to SEQ ID NO: 637353

SEQ ID NO: 647010 - RNA, 64 nt, Homo Sapiens; identical to SEQ ID NO: 637354

SEQ ID NO: 647011 - RNA, 64 nt, Homo Sapiens; identical to SEQ ID NO: 637355

SEQ ID NO: 647012 - RNA, 64 nt, Homo Sapiens; identical to SEQ ID NO: 637356

SEQ ID NO: 647013 - RNA, 64 nt, Homo Sapiens; identical to SEQ ID NO: 637357

SEQ ID NO: 647014 - RNA, 64 nt, Homo Sapiens; identical to SEQ ID NO: 637358

SEQ ID NO: 647015 - RNA, 64 nt, Homo Sapiens; identical to SEQ ID NO: 637359

SEQ ID NO: 647016 - RNA, 64 nt, Homo Sapiens; identical to SEQ ID NO: 637360

SEQ ID NO: 647017 - RNA, 64 nt, Homo Sapiens; identical to SEQ ID NO: 637361

SEQ ID NO: 647018 - RNA, 64 nt, Homo Sapiens; identical to SEQ ID NO: 637362

SEQ ID NO: 647019 - RNA, 64 nt, Homo Sapiens; identical to SEQ ID NO: 637363

SEQ ID NO: 647020 - RNA, 64 nt, Homo Sapiens; identical to SEQ ID NO: 637364

SEQ ID NO: 647021 - RNA, 64 nt, Homo Sapiens; identical to SEQ ID NO: 144505

SEQ ID NO: 647022 - RNA, 64 nt, Homo Sapiens; identical to SEQ ID NO: 144505

SEQ ID NO: 647023 - RNA, 64 nt, Homo Sapiens; identical to SEQ ID NO: 144507

SEQ ID NO: 647024 - RNA, 64 nt, Homo Sapiens; identical to SEQ ID NO: 144508

SEQ ID NO: 647025 - RNA, 64 nt, Homo Sapiens
aauacacauucauuaaacuuuuguuguaauuaaacugcuauauauuguuugccauauauuaugg

SEQ ID NO: 647026 - RNA, 64 nt, Homo Sapiens
uuauggaaaugaaauaugaaauuuuauuaaaaugcugcuauauuacauaaguugcuucauuaag

SEQ ID NO: 647027 - RNA, 64 nt, Homo Sapiens
augagaauguuuugcguaggggcaacacagucugcugcuauauagugggggaagcgugcacuua

SEQ ID NO: 647028 - RNA, 64 nt, Homo Sapiens
uaaacauuuuuaaucacaagcuguauuagcuuugcugcuauauagguguuauguguaaaugcca

SEQ ID NO: 647029 - RNA, 64 nt, Homo Sapiens
gucugaguucuagcaggguccuggggguaucccacugcuauacuguucuacugcuucccucagu

SEQ ID NO: 647030 - RNA, 64 nt, Homo Sapiens
cgugcugcuguguucugcuccuccccacgcuucccugcuauaguucccagcugcuguaacggag

SEQ ID NO: 647031 - RNA, 64 nt, Homo Sapiens
ggacaauggaauaucccaggguggugacagcagauggagcuacuugggggagagcucaaguugg

SEQ ID NO: 647032 - RNA, 64 nt, Homo Sapiens
uggagcuuugaagaccuaagaggcuagugguuccuggagcuagugguuaccugaacagguaugg

SEQ ID NO: 647033 - RNA, 64 nt, Homo Sapiens
ggagagggagaggaaaggguuacuuaauaagccuuggagcuagugccauguuguugacauuagg

SEQ ID NO: 647034 - RNA, 64 nt, Homo Sapiens
caguccugccuccugcucuccaucugggauccaguggagcuaaucaaagaaugagaaccucaag

SEQ ID NO: 647035 - RNA, 64 nt, Homo Sapiens
gccaggacugcccugagccgcaaaaugucaaagcuggagcuauagagguagcccuaaaggcaac

SEQ ID NO: 647036 - RNA, 64 nt, Homo Sapiens
gcccaggcagggcugcauggagaggaauggaaccuggagcuagaauuaauugcccacucuccca

SEQ ID NO: 647037 - RNA, 59 nt, Homo Sapiens
ucugguugaccggcaugaaguacaucagccugucuuagccugagcugcuuugaagacca

SEQ ID NO: 647038 - RNA, 59 nt, Homo Sapiens
auucuaaccaaaguugacagacugugcgucugucuuaauggaugucuuaggaguugguu

SEQ ID NO: 647039 - RNA, 59 nt, Homo Sapiens
ccuccgccuccuggguucaagggauucuccugucuuagccuccugaguagcugugauua

SEQ ID NO: 647040 - RNA, 59 nt, Homo Sapiens
agaggcucagucuguugagucuguugugacugucuuaugaaucaaucuguugugccaac

SEQ ID NO: 647041 - RNA, 59 nt, Homo Sapiens
aaauuaaagagaaaauugagaguaaaugacugucuuaucacucuuauuugacauuucgu

SEQ ID NO: 647042 - RNA, 59 nt, Homo Sapiens
agucacacugaaagcaauuuugagcuuaucugucuuauuuaugcuuugagugaaucauc

SEQ ID NO: 647043 - RNA, 59 nt, Homo Sapiens
caaaacucuugguaauuuuugaagauagacugucuuaucaccaaggaaauuuauacaaa

SEQ ID NO: 647044 - RNA, 59 nt, Homo Sapiens
uauaggauauauaaaccauuaccauugaucugucuuaugccauaaucuuaaaaaaaauu

SEQ ID NO: 647045 - RNA, 59 nt, Homo Sapiens
cuccucccauccuuucccuuuuuaggucccugucuuauacaaccagagaaguggguguu

SEQ ID NO: 647046 - RNA, 59 nt, Homo Sapiens
uuucagauuguaucugaacucacagacugcugucuuacuaauaggucuggaaggucacg

SEQ ID NO: 647047 - RNA, 59 nt, Homo Sapiens
agcugaaagucccacuggcuggccucaggcugucuuauuccgcuugaaaauagccaaaa

SEQ ID NO: 647048 - RNA, 59 nt, Homo Sapiens
uuguauaguuuugagacauucaauuaucacugucuuaguuguauuuuaauuuacuaaau

SEQ ID NO: 647049 - RNA, 59 nt, Homo Sapiens
uacuuuuggaaauugaacaagaaaugcaucugucuuagaaacuggagauuauuugaugu

SEQ ID NO: 647050 - RNA, 59 nt, Homo Sapiens
ggcuacacaaccuucucaggacaagcccacugucuuaagccacuuugacccugggagac

SEQ ID NO: 647051 - RNA, 59 nt, Homo Sapiens
gcugaaaguacacugggaucacugggacacugucuuaugaagguuugcuugggaugaaa

SEQ ID NO: 647052 - RNA, 59 nt, Homo Sapiens
cucaguugcaucccuggugcaggccaugccugucuuaaaucugaagucccugcaggugg

SEQ ID NO: 647053 - RNA, 59 nt, Homo Sapiens
gaaaucaugaauguggucuggcucuauuucugucuuauaauauacaguauaguuuaucu

SEQ ID NO: 647054 - RNA, 59 nt, Homo Sapiens
cuuuugugucucccaagguguggucagaucugucuuaguaagcugagacacuugucaug

SEQ ID NO: 647055 - RNA, 59 nt, Homo Sapiens
accuccugggucccauccagauggcgauucugucuuauauugagguacaaggggaaaag

SEQ ID NO: 647056 - RNA, 59 nt, Homo Sapiens
aaaagaggauucaacacauaagcaagacccugucuuaaacacuccagccugggugacag

SEQ ID NO: 647057 - RNA, 59 nt, Homo Sapiens
cugugucuuaacuuuuaacaacaaugcuucugucuuaagccaguauuuguuccuguuuu

SEQ ID NO: 647058 - RNA, 59 nt, Homo Sapiens
ccaguggagcuacccuuuaauacagccugcugucuuacaccuaucuuggguccuugaac

SEQ ID NO: 647059 - RNA, 59 nt, Homo Sapiens
aauagaccaauacauggcucgacuacuuccugucuuagucaauauucuagaccaacuuu

SEQ ID NO: 647060 - RNA, 59 nt, Homo Sapiens
uuuuucuggugcuuuauaauauaauaauacugucuuacgugaaccaucuucguacauga

SEQ ID NO: 647061 - RNA, 59 nt, Homo Sapiens
ucagucaauaacauuggauguuucaauaucugucuuauaagaguaaauuuaaauugucu

SEQ ID NO: 647062 - RNA, 59 nt, Homo Sapiens
cugguuauuucacugcuucagucccuuaucugucuuaugcuggcauuugcugcccucuu

SEQ ID NO: 647063 - RNA, 59 nt, Homo Sapiens
uggcagcuuccuguacauacuuuccgggucugucuuaacuagcagcuaggugaguuugu

SEQ ID NO: 647064 - RNA, 59 nt, Homo Sapiens
aacaacugaagggguuaaagaaaggagugcugucuuaaauaccaaaccugacucccugu

SEQ ID NO: 647065 - RNA, 59 nt, Homo Sapiens
gaacuugucaccagaaaccauuucccacacugucuuagagcccgugcauauuuagguca

SEQ ID NO: 647066 - RNA, 59 nt, Homo Sapiens
cauuuauaaggacccugcaaaaaugcugucugucuuacaucccuguaggacucaauagu

SEQ ID NO: 647067 - RNA, 59 nt, Homo Sapiens
auuauagcaacuuuaagaaguugcugcuacugucuuacucagucuaaggucucaugcug

SEQ ID NO: 647068 - RNA, 59 nt, Homo Sapiens
aaauuuuuauauaagaaaauccccagccucugucuuaaacuugugggacaaaaauccuu

SEQ ID NO: 647069 - RNA, 59 nt, Homo Sapiens
cuuccauacaaauuugagauagaucucgccugucuuaaagcugccauuugcucauucua

SEQ ID NO: 647070 - RNA, 59 nt, Homo Sapiens
gaaguugccaagaguucuuuaggugccuccugucuuauggcguugcaggccagguuaug

SEQ ID NO: 647071 - RNA, 59 nt, Homo Sapiens
aaaauagcucauauaucucaucuuuccuccugucuuagaagaacagaccuaacuaguga

SEQ ID NO: 647072 - RNA, 59 nt, Homo Sapiens
uagagaaaauagagaugaauuaggggacacugucuuauggauucauuuauaagaagaga

SEQ ID NO: 647073 - RNA, 59 nt, Homo Sapiens
gacacaagggaacaguauuugcauuuguacugucuuagaauauuauuuauuuuuuugua

SEQ ID NO: 647074 - RNA, 59 nt, Homo Sapiens
uugggguaguuguguuucaacggaaagugcugucuuaaacuaaaugugcaauagaaggu

SEQ ID NO: 647075 - RNA, 59 nt, Homo Sapiens
gguuuaugucaggaaaugaacagccugugcugucuuaaucaccucacaaugaaguacua

SEQ ID NO: 647076 - RNA, 59 nt, Homo Sapiens
aguuaaugauccaaguggcaauauauaugcugucuuaaauuaaaaacuaccaacauaua

SEQ ID NO: 647077 - RNA, 59 nt, Homo Sapiens
agaucugggcagcauuugacaccccuuuccugucuuacugggcuugcuaaauccagcag

SEQ ID NO: 647078 - RNA, 59 nt, Homo Sapiens
guaaauguaacuauuuuuccauccaaacucugucuuaauagauugaaaaauauaaaggu

SEQ ID NO: 647079 - RNA, 59 nt, Homo Sapiens
cagagugcuauaacuauaaauuccuugcacugucuuacaugagguauuuuaaaauuuac

SEQ ID NO: 647080 - RNA, 59 nt, Homo Sapiens
aaacagugggagggaauuccaaccucuuccugucuuaccaugcuacaaaacaccuuguc

SEQ ID NO: 647081 - RNA, 59 nt, Homo Sapiens
uagaauuuuuaaauaguauacguuucucacugucuuaaagaaucuuaaaaaaaaaaaaa

SEQ ID NO: 647082 - RNA, 59 nt, Homo Sapiens
acuggguuuugcuguuuuuuaaaggaauccugucuuaaacuguuguguaaugucucuag

SEQ ID NO: 647083 - RNA, 59 nt, Homo Sapiens
gcacacacaaaaaggcuucuuacacauaccugucuuaaaccauguguagagcuuuaaaa

SEQ ID NO: 647084 - RNA, 59 nt, Homo Sapiens
gagagccacaggaccguuuuggggcugaccugucuuauuacguauguacuucuagguug

SEQ ID NO: 647085 - RNA, 59 nt, Homo Sapiens
ugaccaagagccuaguauauaguuggugccugucuuagucuguuuguguugcuauaaaa

SEQ ID NO: 647086 - RNA, 59 nt, Homo Sapiens
cugagcuacagcccagaagccagacaugccugucuuagcugaccuguuuuugguccacu

SEQ ID NO: 647087 - RNA, 59 nt, Homo Sapiens
uugcuaaaggaaggcuucugugucaaugccugucuuagaugucaagcugaaaacaaaca

SEQ ID NO: 647088 - RNA, 59 nt, Homo Sapiens
uggaagagguccuguccucagggaauuaacugucuuauugggagacaacaacuguccuc

SEQ ID NO: 647089 - RNA, 59 nt, Homo Sapiens
ccaagguacuggaaaaccuucacugcauccugucuuaauugacuggaagaauuuaggac

SEQ ID NO: 647090 - RNA, 59 nt, Homo Sapiens
gacucaauaccuuuaggauugcuucugcucugucuuacuggucaguauggcccaacaua

SEQ ID NO: 647091 - RNA, 59 nt, Homo Sapiens
uauugaaacaccuuaaucuguccaaaguccugucuuaacuacaauuuaaaaacucuugu

SEQ ID NO: 647092 - RNA, 59 nt, Homo Sapiens
uuguggaugauacagaaagccagcagaugcugucuuaauugacaggcucagcaugggcu

SEQ ID NO: 647093 - RNA, 59 nt, Homo Sapiens
ucaaaucuguuguguuucugucaccagagcugucuuagccuccucccucuauuacuguu

SEQ ID NO: 647094 - RNA, 59 nt, Homo Sapiens
uacucauggcagguucuagaccucaaagacugucuuaaucccccaccugacagccccau

SEQ ID NO: 647095 - RNA, 59 nt, Homo Sapiens
ucccacaaauccuuuauacuuuacuaauccugucuuauucuccauugccuggccccaau

SEQ ID NO: 647096 - RNA, 59 nt, Homo Sapiens
uggccuaaauuucuucugguagaacaucccugucuuaacuuuuaaugaccaauugagua

SEQ ID NO: 647097 - RNA, 59 nt, Homo Sapiens
agagaucugcuaauaaauuuauucuucaacugucuuacauggggcuggaaaauguauga

SEQ ID NO: 647098 - RNA, 59 nt, Homo Sapiens
aaggaccuucagugcagaucuuucucaaacugucuuaggaugcugacuuucuaucuucc

SEQ ID NO: 647099 - RNA, 59 nt, Homo Sapiens
aauaugacaauaauccucugggauuuaugcugucuuagcuuuuuuuuuuucuuuugaau

SEQ ID NO: 647100 - RNA, 59 nt, Homo Sapiens
cuccugcuuuucuuuccuacuuuaaauaccugucuuaacguagcuaucucgccauuccc

SEQ ID NO: 647101 - RNA, 59 nt, Homo Sapiens
uaguucagauacucaaaaaugucuucacucugucuuaaauuggacaguugaacuuaaaa

SEQ ID NO: 647102 - RNA, 59 nt, Homo Sapiens
cucagcauuugaucaucacuuuuucuuagcugucuuaagcauuauagaauuucucuuac

SEQ ID NO: 647103 - RNA, 59 nt, Homo Sapiens
aggaucuguagaagacauuuugggaaacacugucuuaaauaaaaacucaauguuuaguu

SEQ ID NO: 647104 - RNA, 59 nt, Homo Sapiens
guauaauauaucucagacugaguuacugccugucuuaucaggauggauaaaacacuaca

SEQ ID NO: 647105 - RNA, 59 nt, Homo Sapiens
aguuuucauugcugcuuuagcaaaccacgcugucuuacagugguacuuucuucuggcca

SEQ ID NO: 647106 - RNA, 59 nt, Homo Sapiens
ucucaauucccaugugcugugacuguagacugucuuaccauagacugucuuacccaucc

SEQ ID NO: 647107 - RNA, 59 nt, Homo Sapiens
gcugugacuguagacugucuuaccauagacugucuuacccauccccuggauaugcucuu

SEQ ID NO: 647108 - RNA, 59 nt, Homo Sapiens
aaauaaggauuuaagaauuaugaggaaagcugucuuauguuucuuguucuuaaauuaua

SEQ ID NO: 647109 - RNA, 59 nt, Homo Sapiens
aacucauacuucaaaaauauuaggaaaaucugucuuauaguuucucuaauaaauaucug

SEQ ID NO: 647110 - RNA, 59 nt, Homo Sapiens
cgauuuguggggugcagugagggcuauuccugucuuagguugcauuucccucccuccag

SEQ ID NO: 647111 - RNA, 59 nt, Homo Sapiens
aauugccucaggcauuuuuuuggaucucucugucuuagguucuucuugugugcucauua

SEQ ID NO: 647112 - RNA, 59 nt, Homo Sapiens
uuccaaagcuuuacauuucacaggugugccugucuuaaaccuguugcaaagucuguaug

SEQ ID NO: 647113 - RNA, 59 nt, Homo Sapiens
ggguaaaaaaagccaccgugaaaaagauucugucuuauaaaaauugaaaauauguugga

SEQ ID NO: 647114 - RNA, 59 nt, Homo Sapiens
uuugugaaaggauuauuuugaacauaaaacugucuuauucaaauaacuaauguuuuuac

SEQ ID NO: 647115 - RNA, 59 nt, Homo Sapiens
aaaauggagaaaggagucauacuugugcucugucuuauaccauagccuugcaaaaugca

SEQ ID NO: 647116 - RNA, 59 nt, Homo Sapiens
uauuuggcuaauuuuaaguguauauguaucugucuuagauuuaauuuguauaucuuuug

SEQ ID NO: 647117 - RNA, 59 nt, Homo Sapiens
uugugaaagagugugucuugcaucaacagcugucuuauuuaugauauauaaguagaaau

SEQ ID NO: 647118 - RNA, 59 nt, Homo Sapiens
gugagaaggguguuguaguuuauaaaagacugucuuaauuugcauacuuaagcauuuag

SEQ ID NO: 647119 - RNA, 59 nt, Homo Sapiens; identical to SEQ ID NO: 647118

SEQ ID NO: 647120 - RNA, 59 nt, Homo Sapiens
aaacauucccaguggcagccugccuaagacugucuuaccuuauguuaaggaagucaggu

SEQ ID NO: 647121 - RNA, 59 nt, Homo Sapiens
agcaguugcucaguagaaagucuagauuucugucuuauaggugauuucugucuuauagg

SEQ ID NO: 647122 - RNA, 59 nt, Homo Sapiens
agucuagauuucugucuuauaggugauuucugucuuauaggugauuauaaucaagugua

SEQ ID NO: 647123 - RNA, 59 nt, Homo Sapiens
ggugguaagccccagucucaggggucacccugucuuagagcuagagaugagguggcagg

SEQ ID NO: 647124 - RNA, 59 nt, Homo Sapiens
uuauuuaaaaucagauuuuuguuuuuagacugucuuagaucuggggcuauuacgaauca

SEQ ID NO: 647125 - RNA, 59 nt, Homo Sapiens
cgcaguaauucccaucugcuuuauugccucugucuuaaagaauuugaaaguuuccuuau

SEQ ID NO: 647126 - RNA, 59 nt, Homo Sapiens
ucuugcuaguggguuaaaugaaggcagugcugucuuacccaagugaccugucuuuuaaa

SEQ ID NO: 647127 - RNA, 59 nt, Homo Sapiens
agauauaaggggaaagauaacuugaguggcugucuuaaauguaucauacucuucuaaaa

SEQ ID NO: 647128 - RNA, 59 nt, Homo Sapiens
gugggaccaacuuccuguugaaaacgaagcugucuuagaucggacaaaaaaaguaggga

SEQ ID NO: 647129 - RNA, 59 nt, Homo Sapiens
ucuagauuuguuuaaaauugucauauauacugucuuauuaaauauuuagcaaauuuguu

SEQ ID NO: 647130 - RNA, 59 nt, Homo Sapiens
uuggggaacccaaagcagauaguauguuucugucuuagaaguccagugaugggaaaaug

SEQ ID NO: 647131 - RNA, 59 nt, Homo Sapiens
gcucauacaaaacaaauagggguuaaauacugucuuaaaucuggcuuggugcuugaccu

SEQ ID NO: 647132 - RNA, 59 nt, Homo Sapiens
cacaaauucauauuuuuacacaaaguguucugucuuaauuuggguuuucgaaauauuuu

SEQ ID NO: 647133 - RNA, 59 nt, Homo Sapiens
ugcuauaaacuuuacauauucuaguaauacugucuuaucacucucaauucccugaaaaa

SEQ ID NO: 647134 - RNA, 59 nt, Homo Sapiens
uaauggugcauuuauuauguuguuucgugcugucuuaaagaacaccuggcauucugugg

SEQ ID NO: 647135 - RNA, 59 nt, Homo Sapiens
cuuugaauguugacccucaccuuuccucccugucuuagaaauaauaauaacucuuguuu

SEQ ID NO: 647136 - RNA, 59 nt, Homo Sapiens
uugauaucuguuguguaaugcuuuuugagcugucuuacuuugcaauauccccuaagaug

SEQ ID NO: 647137 - RNA, 59 nt, Homo Sapiens
ucgaggggcaccugggauccguggggguucugucuuaaccccugguaaaccugggguag

SEQ ID NO: 647138 - RNA, 59 nt, Homo Sapiens
cagaggcgucgcuccugucuucucuguuccugucuuagcgauaucaacaaaauacuccc

SEQ ID NO: 647139 - RNA, 59 nt, Homo Sapiens
gacuaccuauuugaaaggaacccuaucaacugucuuauguacguuacaugauuuuccua

SEQ ID NO: 647140 - RNA, 59 nt, Homo Sapiens
guuauuuuuuguuugugaccacuaagcuucugucuuaauacaaagcuguuaccuucuac

SEQ ID NO: 647141 - RNA, 59 nt, Homo Sapiens
uccaagcuuuuacauuaacgagcaggccucugucuuaaaagggacucaguauauuaauu

SEQ ID NO: 647142 - RNA, 59 nt, Homo Sapiens
ugcacucuauccuggguaacagcgagacucugucuuaaaaauaauaacaauaauaauaa

SEQ ID NO: 647143 - RNA, 59 nt, Homo Sapiens
auaugucagauguauuccuacuuccaaaccugucuuacuuugguuugaugguacacaua

SEQ ID NO: 647144 - RNA, 59 nt, Homo Sapiens
aaauaccuuuuaagcuaguugaucuuugacugucuuauuuauuauaaccuuucagcaca

SEQ ID NO: 647145 - RNA, 59 nt, Homo Sapiens
uaucugggugccccucauagguugggacucugucuuacauaguccuccaacaaccaaag

SEQ ID NO: 647146 - RNA, 59 nt, Homo Sapiens
ucaguuuauuaaaucugaauucaaauuuacugucuuaaaaugagacuuaauuuugucuu

SEQ ID NO: 647147 - RNA, 59 nt, Homo Sapiens
aggccccaaaaaaccuguucuagaagcuccugucuuaucgagucugagaaaaccuuugg

SEQ ID NO: 647148 - RNA, 59 nt, Homo Sapiens
ucuuuuuguuucugccuaguucucucucucugucuuagaugcaccuguguuucaguuac

SEQ ID NO: 647149 - RNA, 59 nt, Homo Sapiens
cagccauucccaguauguuuuguuuccuucugucuuauuuacaagguuaucaggaacuu

SEQ ID NO: 647150 - RNA, 59 nt, Homo Sapiens
ucuuuucacucauucacccuucccauaugcugucuuaauaagcaucuucaaagacguuu

SEQ ID NO: 647151 - RNA, 57 nt, Homo Sapiens
gguuuuauaaugcugacugacagccuucugucuuaaaccucugucuauucugcuuga

SEQ ID NO: 647152 - RNA, 59 nt, Homo Sapiens
uuuugcugcaaauaaaaaugaaguacugucugucuuaaaaaaaaaaaaaagaaaaaaga

SEQ ID NO: 647153 - RNA, 59 nt, Homo Sapiens
uuaaauagcugcugcuguggauccuguggcugucuuauuauuuaaaauauucugcauga

SEQ ID NO: 647154 - RNA, 59 nt, Homo Sapiens
auaugaaggucuuuuuguuucaagugaaacugucuuauaugugccaugugauugacuua

SEQ ID NO: 647155 - RNA, 59 nt, Homo Sapiens
agaacuuaucuuuauucucauuuuuaauccugucuuagauuuguuuuuguuuuguuuag

SEQ ID NO: 647156 - RNA, 59 nt, Homo Sapiens
cuggcagacaccauguaaguuauaagugucugucuuaucuuuacuacacauauuguaac

SEQ ID NO: 647157 - RNA, 59 nt, Homo Sapiens
uacuuuuauuuuaaaauaaaagaugaggucugucuuauguugcccaggcuggucucaaa

SEQ ID NO: 647158 - RNA, 59 nt, Homo Sapiens
ggccuuagaaaaccacaauguuuacagcccugucuuagggccgcggcuucucuuaucuu

SEQ ID NO: 647159 - RNA, 59 nt, Homo Sapiens
aacuaaaauuucagauuucugaggauauacugucuuagacuuauuguacacacuuaguu

SEQ ID NO: 647160 - RNA, 59 nt, Homo Sapiens
caagagcccccagaacgagacccuguacucugucuuaaaggccuaaccaauggacagcc

SEQ ID NO: 647161 - RNA, 59 nt, Homo Sapiens
gccauagucuuaacuggucuccuugcuuccugucuuauccuccaccgucuuucuuuuau

SEQ ID NO: 647162 - RNA, 59 nt, Homo Sapiens
uucucaaguucuuucuuugagaccucaaucugucuuagcauuuuguaacuaauaacuga

SEQ ID NO: 647163 - RNA, 59 nt, Homo Sapiens
aagcaaugguugaaauuuguagguacuaucugucuuauuuuguguguguuuagaggugu

SEQ ID NO: 647164 - RNA, 59 nt, Homo Sapiens
agaaaaagcauuggcaugagccaaagagucugucuuaauguuacuuuugaaaaucugcu

SEQ ID NO: 647165 - RNA, 59 nt, Homo Sapiens
uaucaggaccuucuuugggacccagcaagcugucuuaagugcuuucugcuuugaucaaa

SEQ ID NO: 647166 - RNA, 59 nt, Homo Sapiens
gugaaaaaguaaagaagaaauggaccauccugucuuaugagaucuugguuuuuccaaac

SEQ ID NO: 647167 - RNA, 59 nt, Homo Sapiens
accaagcaagauucaccuguauugcuucacugucuuagauauauuuaaauacuggggaa

SEQ ID NO: 647168 - RNA, 59 nt, Homo Sapiens
ugaagaugcaggguugugggacaauuauccugucuuaucuucaguuuucucaaaacaaa

SEQ ID NO: 647169 - RNA, 59 nt, Homo Sapiens
uuaggaugcagugugaaacugcagaguaucugucuuauuagucuauuuucuacuugcca

SEQ ID NO: 647170 - RNA, 59 nt, Homo Sapiens
aaauugugggaauccccccucccacuuuucugucuuagauuccaguaacuacugauucc

SEQ ID NO: 647171 - RNA, 59 nt, Homo Sapiens
caguuccuguagaacugagauauuugaaucugucuuagcgcaauaggaucuuauuuagu

SEQ ID NO: 647172 - RNA, 59 nt, Homo Sapiens
gcagccuauuaagaguugggcuaauuuugcugucuuaauaaauacuuuguuguauuugg

SEQ ID NO: 647173 - RNA, 59 nt, Homo Sapiens
auuggugcauauguaccauaucugacaaucugucuuaaaggucauguuuuuugaucuuc

SEQ ID NO: 647174 - RNA, 59 nt, Homo Sapiens
acuguucuuauuauaaauugcaaagcaaccugucuuacauucuuacauuaucuuaaaau

SEQ ID NO: 647175 - RNA, 59 nt, Homo Sapiens
uuuggacaucuuuuuccuagaccauguuucugucuuacucuuaaaccugguaacacuug

SEQ ID NO: 647176 - RNA, 59 nt, Homo Sapiens
ggguggccggcuugcugcuccgguuugggcugucuuaccauaacaccgucccagggcuc

SEQ ID NO: 647177 - RNA, 59 nt, Homo Sapiens
aauccaugcaaguguuuuaaagcacuguccugucuuaaucuuacaugcugaaagucuuc

SEQ ID NO: 647178 - RNA, 59 nt, Homo Sapiens
ugguacagaguaccauauugcuaagaaaacugucuuauaaaagauguauaugugugaag

SEQ ID NO: 647179 - RNA, 59 nt, Homo Sapiens
accugaauucuacugagucccuggcaagacugucuuaccuggcagcaaacugcugccug

SEQ ID NO: 647180 - RNA, 59 nt, Homo Sapiens
ucugggcuuuugaauaaauaaaaugcucucugucuuagcaggagaauggcccaaaccug

SEQ ID NO: 647181 - RNA, 59 nt, Homo Sapiens
aaaaacuaaaaagaaaaaaauuuaagacucugucuuaaaaaaagagccugggcaauuuu

SEQ ID NO: 647182 - RNA, 59 nt, Homo Sapiens
aagguuacuucuugguucucacagguccucugucuuaaacuccaagacuaaacaaacag

SEQ ID NO: 647183 - RNA, 59 nt, Homo Sapiens
guuucuucauacugugucugcauauggcucugucuuauucagcuaaauuacaacuuuua

SEQ ID NO: 647184 - RNA, 59 nt, Homo Sapiens
gccaagaauuacagcuuuaucaaggucugcugucuuauauucugggacuauacucacac

SEQ ID NO: 647185 - RNA, 59 nt, Homo Sapiens
agugcccgccccugauauauggauuuauacugucuuaugucaugcaaguuuagacaagu

SEQ ID NO: 647186 - RNA, 59 nt, Homo Sapiens
uuucaaugaacauauucugaaugugguuucugucuuagaccaggaggacagaguuugcu

SEQ ID NO: 647187 - RNA, 59 nt, Homo Sapiens
uccauaaacaagugcaauuuuuuaaagugcugucuuacuaagucuuguuuauuaacucu

SEQ ID NO: 647188 - RNA, 59 nt, Homo Sapiens
cggucugacaguccuugggguuaagucuccugucuuaugguccagaaacuccuguuucu

SEQ ID NO: 647189 - RNA, 59 nt, Homo Sapiens
aaaaagaacaguaccccucuuuuaagaugcugucuuacauuaaugagcaucuaauggaa

SEQ ID NO: 647190 - RNA, 59 nt, Homo Sapiens
cgguaccacgggcugccacagccccugcucugucuuagauuauggugcuuuacaaagag

SEQ ID NO: 647191 - RNA, 59 nt, Homo Sapiens
caauguuugucaccuuucccugcuucaaacugucuuaaacagaccuuggugauaaccug

SEQ ID NO: 647192 - RNA, 59 nt, Homo Sapiens
uaauggggagauuuuaaguaguucagcaacugucuuauuauauuuuguacuuuuuaguu

SEQ ID NO: 647193 - RNA, 59 nt, Homo Sapiens
ggaaggccuuugaggacacaauuuggugccugucuuaaacuuauguguaaccaguggug

SEQ ID NO: 647194 - RNA, 59 nt, Homo Sapiens
auugauauuuuaggauguuuuacacuugucugucuuauauguucuccagaguuuuacau

SEQ ID NO: 647195 - RNA, 59 nt, Homo Sapiens
ccauucuuguuauuaagcugcugucuuugcugucuuagggucccagcccaggaacagug

SEQ ID NO: 647196 - RNA, 59 nt, Homo Sapiens; identical to SEQ ID NO: 647147

SEQ ID NO: 647197 - RNA, 59 nt, Homo Sapiens
gauacuguagguucacccauguacauucucugucuuacucuucuagguuaacucacgaa

SEQ ID NO: 647198 - RNA, 59 nt, Homo Sapiens
cucacacagggaaaauauccgauuugcuucugucuuagcgguggcauuuuucuuaacga

SEQ ID NO: 647199 - RNA, 59 nt, Homo Sapiens
ccugucucucuuaagaguagguucauugucugucuuagagucacuucuauugcaacuca

SEQ ID NO: 647200 - RNA, 59 nt, Homo Sapiens
cuaaaaagcaaagcaaaacagaacuaguucugucuuaaugaaauauaucaacccaaaag

SEQ ID NO: 647201 - RNA, 59 nt, Homo Sapiens
aaaaaaggccuugcaggaaacacccacuucugucuuacugcaucaccagauagggcuuu

SEQ ID NO: 647202 - RNA, 59 nt, Homo Sapiens
acauaguggucagaaauggaacagagaagcugucuuaagccuuguucaagaagcaggaa

SEQ ID NO: 647203 - RNA, 59 nt, Homo Sapiens
guguuuccagugacacaacucauccagaacugucuuagucauaccauccaucccuggug

SEQ ID NO: 647204 - RNA, 59 nt, Homo Sapiens
guauacgcauacauauauauauuuuuacucugucuuacucugucacccaggcuagagug

SEQ ID NO: 647205 - RNA, 59 nt, Homo Sapiens
guuagaguuacuguggauuucucuguuuucugucuuacaagaaacuugucuauguaccu

SEQ ID NO: 647206 - RNA, 59 nt, Homo Sapiens
auguuuuaaaaugugcccauuuaacagaacugucuuaauauacugugggacuauuaugg

SEQ ID NO: 647207 - RNA, 59 nt, Homo Sapiens
cucuuuauuucucauugugcuuucaguugcugucuuauuauuugauaaaucuuauacuu

SEQ ID NO: 647208 - RNA, 59 nt, Homo Sapiens
caauuguaaauaucacuuaaguuugcccucugucuuaaaugaggccuggcucagagccu

SEQ ID NO: 647209 - RNA, 59 nt, Homo Sapiens
uuaguguugcuuguuuuuguguccuuguacugucuuaaguguguuuucugugcugugau

SEQ ID NO: 647210 - RNA, 59 nt, Homo Sapiens
caacuuuacuuuuaaaaucacauagggcccugucuuauuuuuggucucuauugauauuu

SEQ ID NO: 647211 - RNA, 59 nt, Homo Sapiens
cugugagacaggagcaggggugcuggaagcugucuuagggaaagggaugaacugccuuu

SEQ ID NO: 647212 - RNA, 59 nt, Homo Sapiens
ggucacgugucuuuggugagagcagggcccugucuuauggguggaagaugaaucaagga

SEQ ID NO: 647213 - RNA, 59 nt, Homo Sapiens
uaaagcuuucuccaggacagauauuuucccugucuuaaccacugguccagucaucccag

SEQ ID NO: 647214 - RNA, 59 nt, Homo Sapiens
cccugacccacagcgucaccccacucccucugucuuaugacuccccuccccaacccccu

SEQ ID NO: 647215 - RNA, 59 nt, Homo Sapiens
caguguccugaagcccaucuuuucugugacugucuuaggugauguguagcccccuccac

SEQ ID NO: 647216 - RNA, 59 nt, Homo Sapiens
cacuccaaccugagugacagagcaacacucugucuuaaaagaaaaaaaaaaaagagaga

SEQ ID NO: 647217 - RNA, 59 nt, Homo Sapiens
uaauuuaguaagaccuugggcugccucuucugucuuaacugguucugcagcuuguccuu

SEQ ID NO: 647218 - RNA, 59 nt, Homo Sapiens
ccagcagcucaccauggcuuuaaaacaugcugucuuagaucaggagaaacucgggcacu

SEQ ID NO: 647219 - RNA, 59 nt, Homo Sapiens
gugggcacuucauuuguuagaauuauguacugucuuaauugagaaauauugucguuaau

SEQ ID NO: 647220 - RNA, 59 nt, Homo Sapiens
gaauucugacaauuuaucuuagcaaauaccugucuuagguugcacauggauugauuaaa

SEQ ID NO: 647221 - RNA, 59 nt, Homo Sapiens
auucaagguaagaggauacaguuuuugcacugucuuacuggugaguggucggguaucua

SEQ ID NO: 647222 - RNA, 59 nt, Homo Sapiens
aucacugcuguggaaucauguguggcucacugucuuacauucacguuuucccauuuccc

SEQ ID NO: 647223 - RNA, 59 nt, Homo Sapiens
auagagaaguaauagaccuaauuuuuacacugucuuauuaagagcugauaacauaguuu

SEQ ID NO: 647224 - RNA, 59 nt, Homo Sapiens
agaaagccaaggcacguagacuccuccuucugucuuaagagaggcagagcaccuugggg

SEQ ID NO: 647225 - RNA, 59 nt, Homo Sapiens
augaacauucuuuaaaguugcuuuuaaugcugucuuaaaauguucaguguauuuuauua

SEQ ID NO: 647226 - RNA, 59 nt, Homo Sapiens
agguagagcuggugugagugugcuaagcacugucuuaagggcuaucuuggcacacuaaa

SEQ ID NO: 647227 - RNA, 59 nt, Homo Sapiens
ugauuucauuaucacaugauuauagaaggcugucuuagugcaaaaaacauacuuacauu

SEQ ID NO: 647228 - RNA, 59 nt, Homo Sapiens
cuguacuuuuacacuccuuugucuuggaacugucuuauuuuuguucuguaaaugucuau

SEQ ID NO: 647229 - RNA, 59 nt, Homo Sapiens
cuccucucugcgccuaucccuugagaauucugucuuaccagugaaggguggggcugccc

SEQ ID NO: 647230 - RNA, 59 nt, Homo Sapiens
uggguacaggauauccuccuaccccaugacugucuuagggagacuugggguaccuuaug

SEQ ID NO: 647231 - RNA, 59 nt, Homo Sapiens
gccugucucucugcgguaaccccauggagcugucuuauugaugcuagaagccucauaac

SEQ ID NO: 647232 - RNA, 59 nt, Homo Sapiens
auaucaaaagcugcugcuaugucucucuucugucuuauucucaaguaucuacugaugua

SEQ ID NO: 647233 - RNA, 59 nt, Homo Sapiens
uuggauuuguuuuucuguucucuucuguccugucuuauacugcaacugugucuccuagg

SEQ ID NO: 647234 - RNA, 59 nt, Homo Sapiens
ccaacuccuaauuuuaaauaauuucuacucugucuuaaaugagaaguacuugguuuuuu

SEQ ID NO: 647235 - RNA, 59 nt, Homo Sapiens
aauauaaagaucauagcuccccuucacuucugucuuaacuugaacauggcguguuuaaa

SEQ ID NO: 647236 - RNA, 59 nt, Homo Sapiens
uaauuuguuuugaagguuuuuuuuccugacugucuuaaagauuaugcuagcuuuagaac

SEQ ID NO: 647237 - RNA, 59 nt, Homo Sapiens
gaguccagccugggugacauagcaagacccugucuuaaaagaaaaaugggaagaaagac

SEQ ID NO: 647238 - RNA, 59 nt, Homo Sapiens
ucucuaguucuuggcuccuaacucuggaucugucuuaaggugucuccacuagcaaucug

SEQ ID NO: 647239 - RNA, 59 nt, Homo Sapiens
auggggacaucacugaccugggccugacgcugucuuacgacgaggacgucaugggucag

SEQ ID NO: 647240 - RNA, 59 nt, Homo Sapiens
auguugaaguuagcaaugccgaaagguuucugucuuaaaaaaaaaaauccuuguacuua

SEQ ID NO: 647241 - RNA, 59 nt, Homo Sapiens
uuaaucuuauuguacauaagaaugcacaacugucuuauucagauccacaggaaaacuug

SEQ ID NO: 647242 - RNA, 59 nt, Homo Sapiens
ccuauucaagcaacuagaggaauauuucccugucuuaccaucucaguacacaaucauuu

SEQ ID NO: 647243 - RNA, 59 nt, Homo Sapiens
aagacuggcuuuagaaccguaauaagaaccugucuuauucaaacuggcuuaauaauauu

SEQ ID NO: 647244 - RNA, 59 nt, Homo Sapiens
uuauuuuaaaaaaauaaauaaagcuuaugcugucuuaaaacaaugcuuaugcuugguac

SEQ ID NO: 647245 - RNA, 59 nt, Homo Sapiens
uuccucacagacuuuguacaagguaacaucugucuuaccuauuuauuguuuguccauuu

SEQ ID NO: 647246 - RNA, 59 nt, Homo Sapiens
ccacuugagcucagaccucuaagaaagaacugucuuacagaagaguuuaaaggaggaag

SEQ ID NO: 647247 - RNA, 59 nt, Homo Sapiens
gcccagggggagguuaggaggcccaagcccugucuuaagucccaccauuuaucuucucu

SEQ ID NO: 647248 - RNA, 59 nt, Homo Sapiens
cagcccuuccaacugugucaauuuccugucugucuuagauagauuuggcccccaacucc

SEQ ID NO: 647249 - RNA, 59 nt, Homo Sapiens
aaaaaaaauuggugcugauaagugagacucugucuuaaauacuccagccugggugaaga

SEQ ID NO: 647250 - RNA, 59 nt, Homo Sapiens
cuauagucaaacagcucuuuugaagacaacugucuuauuuuauuacaaauuggcuugac

SEQ ID NO: 647251 - RNA, 59 nt, Homo Sapiens
uuaugucaaguucuacaucaauaucaucccugucuuauuagggauuaccguuuccuaag

SEQ ID NO: 647252 - RNA, 59 nt, Homo Sapiens
uuucuuucacuuaaguuaguauucuaugccugucuuaauagccucaaaacaaaggccua

SEQ ID NO: 647253 - RNA, 59 nt, Homo Sapiens
guacugugagcccaccccacguacacacacugucuuagaaaggcuuauuuaagccacac

SEQ ID NO: 647254 - RNA, 59 nt, Homo Sapiens
gcccucaaacagaacagcuccccuuguagcugucuuacauauugggguucaggguaaga

SEQ ID NO: 647255 - RNA, 59 nt, Homo Sapiens
aaaucugccuaguaccccgcuacccuguucugucuuauggagcagcccagauuaucuuu

SEQ ID NO: 647256 - RNA, 59 nt, Homo Sapiens
gucauuuuugcuugaaaauuagcaugccucugucuuaaaagagaccaucaaaccuauua

SEQ ID NO: 647257 - RNA, 59 nt, Homo Sapiens
gugauauuuugaaaaaaguuuguguuuuacugucuuagaucguucuuggaaaucacuaa

SEQ ID NO: 647258 - RNA, 59 nt, Homo Sapiens
uuaggaagccacgugccaauaccuggcugcugucuuaacucguagucugggcacaggau

SEQ ID NO: 647259 - RNA, 59 nt, Homo Sapiens
caaggaaaccuucauggaucuucccuugccugucuuagucacagagagaaauaagagga

SEQ ID NO: 647260 - RNA, 59 nt, Homo Sapiens
ggguuguucucaauugugcugcugauuaccugucuuauguaacuacuugagaccaucug

SEQ ID NO: 647261 - RNA, 59 nt, Homo Sapiens
ucugcgggggaggaaaagcucaagguuagcugucuuaacccaagugacuuaccaggccu

SEQ ID NO: 647262 - RNA, 59 nt, Homo Sapiens
ucauaauaaauauguaagacuaggcuuuacugucuuaugcuuauggacauuguauauuu

SEQ ID NO: 647263 - RNA, 59 nt, Homo Sapiens
agaguaauucuucacuuugcucuauugaacugucuuaaggauuuguuuaaacagcuaag

SEQ ID NO: 647264 - RNA, 59 nt, Homo Sapiens
gacagagggaccaucgucuuugauaggaucugucuuaggaaagagacuuuucccucucu

SEQ ID NO: 647265 - RNA, 59 nt, Homo Sapiens
uuaugagauacuugaaugcuaagacuagacugucuuauaugaugauacaugaucucuga

SEQ ID NO: 647266 - RNA, 59 nt, Homo Sapiens
aaagggagucaaggguuggcuucuuuucucugucuuagaucauugggaagggagugcgc

SEQ ID NO: 647267 - RNA, 59 nt, Homo Sapiens
ugguuucauuaaaugcagcaucucuuuuucugucuuagguucucagugguugucucaug

SEQ ID NO: 647268 - RNA, 59 nt, Homo Sapiens
aauacguuuacaguauuggguagugcacucugucuuaaaauuuuuucuaaaguuaaauu

SEQ ID NO: 647269 - RNA, 59 nt, Homo Sapiens
ugggucgaguggggccuuggagaacuuuucugucuuacaagaggauuguaaaaugcacc

SEQ ID NO: 647270 - RNA, 59 nt, Homo Sapiens
ugagccagggcaaaauuuacacucacucacugucuuaagcaucuuaugcaaagccagga

SEQ ID NO: 647271 - RNA, 59 nt, Homo Sapiens
guggaaauccauuugccuauauucuuuaucugucuuaaagcaugcuauuuuaaucucac

SEQ ID NO: 647272 - RNA, 59 nt, Homo Sapiens
gaagaaauaugcagguauauaauguguaccugucuuauggucauugagcaauauuuuuu

SEQ ID NO: 647273 - RNA, 59 nt, Homo Sapiens
cgguggccuuggcccagaagugccagcgccugucuuaccugaaggagcaaagggugcac

SEQ ID NO: 647274 - RNA, 59 nt, Homo Sapiens
acaccauaaacuggguggauuuaauauaacugucuuaguucaugccuaguuauucauug

SEQ ID NO: 647275 - RNA, 59 nt, Homo Sapiens
uugugcugaauuucugggccauucuuuuccugucuuauuucuaaauuuccuucuuccaa

SEQ ID NO: 647276 - RNA, 59 nt, Homo Sapiens
agggaaucuccagaugaacuauuaaugcacugucuuaugccucucauuggugauguuug

SEQ ID NO: 647277 - RNA, 59 nt, Homo Sapiens
gaagaaaacccaaaauucaaucaacaauucugucuuauugaagaguugcuaggauucag

SEQ ID NO: 647278 - RNA, 59 nt, Homo Sapiens
cugccccaauucaauccugccaauaaauccugucuuauuuguucauccuggagaauuga

SEQ ID NO: 647279 - RNA, 59 nt, Homo Sapiens
uguuuuucaaaggccucaccuucaacugucugucuuagaauuccccucuggagggcuau

SEQ ID NO: 647280 - RNA, 59 nt, Homo Sapiens
ggcccagagcccugucucacucaccccaccugucuuagaccccaguucccagccugaca

SEQ ID NO: 647281 - RNA, 59 nt, Homo Sapiens
gguuaauauuuauaggucacuuuguuuuacugucuuaaguuuauacucuuauagacaac

SEQ ID NO: 647282 - RNA, 59 nt, Homo Sapiens
ucugucauuuagcaccaugcugcuucugucugucuuaaugcuggcauuaagaucaugag

SEQ ID NO: 647283 - RNA, 59 nt, Homo Sapiens
agcaauccugcagcacagggcagagaguacugucuuaggaauuauuaggaguugauucc

SEQ ID NO: 647284 - RNA, 59 nt, Homo Sapiens
ccuaggccacgugugagcugcuccugucucugucuuauugcagcuccaggccugacguu

SEQ ID NO: 647285 - RNA, 59 nt, Homo Sapiens
aaagaaagcuacuucucaagaaagaaauucugucuuaauacuagugcaacaagggacac

SEQ ID NO: 647286 - RNA, 59 nt, Homo Sapiens
gauuuacaaacugaaaucacuagccugcacugucuuacucuucagccugcacugauuug

SEQ ID NO: 647287 - RNA, 59 nt, Homo Sapiens
ugggcacguuccaaaguuuaaucagccuccugucuuaugcugccccaacuacuguuggg

SEQ ID NO: 647288 - RNA, 59 nt, Homo Sapiens
uaagaaaaagagaaggcucuugcaguuuccugucuuauucacuccagcaagggaaauaa

SEQ ID NO: 647289 - RNA, 59 nt, Homo Sapiens
uaaaaggguaguuguggagcuggcaggggcugucuuagguuucuaggcacugugguucu

SEQ ID NO: 647290 - RNA, 59 nt, Homo Sapiens
cagcauuuuuaaaaaauacacuuggaacacugucuuacagaaaaguaacaaagugaugg

SEQ ID NO: 647291 - RNA, 59 nt, Homo Sapiens
caaaaaaccuggugauguuaagcaauugacugucuuagaguccagcagaagaccuuaga

SEQ ID NO: 647292 - RNA, 59 nt, Homo Sapiens
ugcuuguggaaguuucucagcguuucuggcugucuuagggcuggccucagaacccagca

SEQ ID NO: 647293 - RNA, 59 nt, Homo Sapiens
ucuuuaaccuugugugucugugaucuccucugucuuaauccacgcucaggcuaaagaug

SEQ ID NO: 647294 - RNA, 59 nt, Homo Sapiens
aacauucccuaauaggguauucagggaaccugucuuaaauugugcuuaucuaaaucuug

SEQ ID NO: 647295 - RNA, 59 nt, Homo Sapiens
agaccggaaagauuugcauuuuauuaugucugucuuaucaugcaauggaaaugaugcuu

SEQ ID NO: 647296 - RNA, 59 nt, Homo Sapiens
uccugaggauacagcugucccgugacugacugucuuaacugagcauuuucucaacucga

SEQ ID NO: 647297 - RNA, 59 nt, Homo Sapiens
cccacacaugccuauuucugaagaggcuucugucuuauuugaaggccagcccacaccca

SEQ ID NO: 647298 - RNA, 59 nt, Homo Sapiens
accaaggugaagauggccuaggaucuucacugucuuacucaagauacuggacuaagugg

SEQ ID NO: 647299 - RNA, 59 nt, Homo Sapiens
uguuaguuucuuguugcuugaacugucuucugucuuauuucccuuccuuucuguguucc

SEQ ID NO: 647300 - RNA, 59 nt, Homo Sapiens
ggcagaccccgccaaugauuucucuucaccugucuuaagauuaaauaaaaaagaguguc

SEQ ID NO: 647301 - RNA, 59 nt, Homo Sapiens
aaacuuacacuacuucuccaagccuuuugcugucuuaagaauaagaccugagauuaaca

SEQ ID NO: 647302 - RNA, 59 nt, Homo Sapiens
ccccgcuccagucaaugcucacugaaagucugucuuagcugccuguuugaaugacuguu

SEQ ID NO: 647303 - RNA, 59 nt, Homo Sapiens
uucucaaguucuuucuuugagaucucaaucugucuuagcauuuuguaacuaauaacuga

SEQ ID NO: 647304 - RNA, 59 nt, Homo Sapiens
aaaaaugaauuuuauuuuacuugucacaccugucuuaauaaacuggaguuuugcugcua

SEQ ID NO: 647305 - RNA, 59 nt, Homo Sapiens
ggugccagucaguacuccagaaagagauucugucuuaccgggcauggaguaauggauuc

SEQ ID NO: 647306 - RNA, 59 nt, Homo Sapiens
ccaucacccgacucuggccaucucuggcccugucuuaccguuugcgucuguuuccuccc

SEQ ID NO: 647307 - RNA, 59 nt, Homo Sapiens
auuacauugccauccuguuggcauuagcccugucuuaucuuucuuuggggcagagaaga

SEQ ID NO: 647308 - RNA, 59 nt, Homo Sapiens
gucuuguucauguuguagggauauugucacugucuuaguacacaguauuuauguacaua

SEQ ID NO: 647309 - RNA, 59 nt, Homo Sapiens
uaaguaaacuaaugaguuucgcuauuuuacugucuuaauacaaugucuugguacuugcu

SEQ ID NO: 647310 - RNA, 59 nt, Homo Sapiens
cucccaaagugcugggauuagcaguccuccugucuuagcccucgaacuccuggucucaa

SEQ ID NO: 647311 - RNA, 59 nt, Homo Sapiens
cccuggaguucagaaguccuagccccaggcugucuuagcaacccugugaugaucaccca

SEQ ID NO: 647312 - RNA, 59 nt, Homo Sapiens
uucucuguugcucccccccacuugugcaccugucuuacauuaucacugucuguagcaca

SEQ ID NO: 647313 - RNA, 59 nt, Homo Sapiens
ugcgcucagcuuggagucagcaguccuagcugucuuaccuccuggaccuagcaggcccu

SEQ ID NO: 647314 - RNA, 59 nt, Homo Sapiens
uaaugagcauaggaaaauuuugauuuugccugucuuauaguuucuaaauuuucuccuuc

SEQ ID NO: 647315 - RNA, 59 nt, Homo Sapiens
uagaguuaacaaaacagagucagagaccacugucuuaacaguggaagaugcaaauaagu

SEQ ID NO: 647316 - RNA, 59 nt, Homo Sapiens
cauaggaaaacauuuaaaauuugguauuucugucuuauaaacacaaaaguagaaagugc

SEQ ID NO: 647317 - RNA, 59 nt, Homo Sapiens
ggcaucaguagcaucuguaacagcauuaacugucuuaaagagagagagagagaauuccg

SEQ ID NO: 647318 - RNA, 59 nt, Homo Sapiens
acuccagccugggcaacaagagugaaacucugucuuaaaaaacacaaaaaaagacuugg

SEQ ID NO: 647319 - RNA, 59 nt, Homo Sapiens
ccuuccgcagagaccugcgcccacaggugcugucuuaguggacugggacgugaaccuuu

SEQ ID NO: 647320 - RNA, 59 nt, Homo Sapiens
agcgggguguuucauuuuuuugcuuuucccugucuuaggcucccagucuuugacugccu

SEQ ID NO: 647321 - RNA, 59 nt, Homo Sapiens
gugauuuuugcagcuaaaugugaaggcaacugucuuaagucccuuccugcugcuguaac

SEQ ID NO: 647322 - RNA, 59 nt, Homo Sapiens
ucucccacauuacccaagagggaaaugggcugucuuaccaugugcugauguaugugcuc

SEQ ID NO: 647323 - RNA, 59 nt, Homo Sapiens
cuucaacugugaaaaugaugcagagaacucugucuuaagugcccauagcuagcauucaa

SEQ ID NO: 647324 - RNA, 59 nt, Homo Sapiens
acugcccugcuagcucuucccuggguuuccugucuuagcaggaagcccuaaaaugugga

SEQ ID NO: 647325 - RNA, 59 nt, Homo Sapiens
aaagcugcguguuucacuuccuaccgccccugucuuaauuucagcauggagaccuucuu

SEQ ID NO: 647326 - RNA, 59 nt, Homo Sapiens
agaggauuguaaaauggaccagaacuuuucugucuuacauggguugaauggggaccugg

SEQ ID NO: 647327 - RNA, 59 nt, Homo Sapiens
ugucucaagcucuuccuuacucccaggcacugucuuaaggcaucugacaugcaucaucu

SEQ ID NO: 647328 - RNA, 59 nt, Homo Sapiens
ugauuggagcaaaccacuucuuuagucaucugucuuaccccccugggacagcuguuacc

SEQ ID NO: 647329 - RNA, 59 nt, Homo Sapiens
ccaaagaggcaaagcaugugcgacccuuucugucuuauuuuaccaaaagauggugcaaa

SEQ ID NO: 647330 - RNA, 59 nt, Homo Sapiens
gguuuuuucugauugaagcuagagcacuucugucuuaaagcugggcguguaggacggug

SEQ ID NO: 647331 - RNA, 59 nt, Homo Sapiens
cgcagucuccagaacccaugccccacauccugucuuagcugcucucuccccaucuccua

SEQ ID NO: 647332 - RNA, 59 nt, Homo Sapiens
aaaaaaaacaaaacaaaaccagcgagacccugucuuaaacacuccagccugggugacag

SEQ ID NO: 647333 - RNA, 59 nt, Homo Sapiens
ugcuugagauagaaaaugguggcuccuuucugucuuaucuccuaguuucuucaaugcuu

SEQ ID NO: 647334 - RNA, 59 nt, Homo Sapiens
aaaagaaugaaaugaagcugggcuguuuucugucuuauuucucaguugagugagcaagg

SEQ ID NO: 647335 - RNA, 59 nt, Homo Sapiens
auauuguuccuuggugucagcguagcugucugucuuaggagcugggucggcguuccgac

SEQ ID NO: 647336 - RNA, 59 nt, Homo Sapiens
agaaauuaauauauuagugaauguugauacugucuuagaaaaguagugaugaaaaguac

SEQ ID NO: 647337 - RNA, 59 nt, Homo Sapiens
guuuccauggaauuguuuuacagagaggccugucuuaaaucuucauacaugacgguggg

SEQ ID NO: 647338 - RNA, 59 nt, Homo Sapiens
uaaguuuauuuuguaaaaacaugcauaaacugucuuagcaggaaaguacauuccuguua

SEQ ID NO: 647339 - RNA, 59 nt, Homo Sapiens
ccagacccaucacugaccauuugccuuaccugucuuagucugaaauguaauaggaaaga

SEQ ID NO: 647340 - RNA, 59 nt, Homo Sapiens
gcacuccagccuggugacagaacgagacucugucuuaaaaacaaacaaacaaaaaaaaa

SEQ ID NO: 647341 - RNA, 59 nt, Homo Sapiens
ucauagguacaugaaguauuauucccuaccugucuuauuccucuguuugcacuggacau

SEQ ID NO: 647342 - RNA, 59 nt, Homo Sapiens
auugagcuagcuugagucaagcuuugcuucugucuuagagaaagcgaucagcaucaagg

SEQ ID NO: 647343 - RNA, 59 nt, Homo Sapiens
agcauccacucucccuugucucucucacccugucuuaccgaauccuucccuggugaugg

SEQ ID NO: 647344 - RNA, 59 nt, Homo Sapiens
aaaaaaaaaaaggaauuuggaguaagacccugucuuaaacacuccagcuugggugacaa

SEQ ID NO: 647345 - RNA, 59 nt, Homo Sapiens
ugguggugguuauuuggucuuuaagugaacugucuuaaaugagaaacguuuuugucauu

SEQ ID NO: 647346 - RNA, 59 nt, Homo Sapiens
uacauagcaaacaagaccaagauuuagggcugucuuaaacaucacugccgucuugaagc

SEQ ID NO: 647347 - RNA, 59 nt, Homo Sapiens
acucugugcaggggugggggcgggucuaacugucuuaacauucaagucacugcucuuca

SEQ ID NO: 647348 - RNA, 59 nt, Homo Sapiens
guguaugcaucaacacaguauauguaaaacugucuuaaaaauccauuaacuucuaccua

SEQ ID NO: 647349 - RNA, 59 nt, Homo Sapiens
uaaucaacauggaguggagaguuuauucacugucuuaucugcagaaauuugcugucaau

SEQ ID NO: 647350 - RNA, 59 nt, Homo Sapiens
agauugaacuggaauauuguguaaacuaucugucuuacauuaguguagcauuuugcaau

SEQ ID NO: 647351 - RNA, 59 nt, Homo Sapiens
aucuuccaggacaggugguauuagcuccacugucuuaacauaguacguggcacguuaug

SEQ ID NO: 647352 - RNA, 59 nt, Homo Sapiens
auuuagaaaagaucuaauuucugucucagcugucuuaaagagagaacugaagcuuuuga

SEQ ID NO: 647353 - RNA, 59 nt, Homo Sapiens
ccaaaagaaugugaccuauuugaaacuuucugucuuaagaugcuucuugacaugcugca

SEQ ID NO: 647354 - RNA, 59 nt, Homo Sapiens
ucagcugguagggaaagacucugcaccugcugucuuagggaagaaaugguucaaaucca

SEQ ID NO: 647355 - RNA, 59 nt, Homo Sapiens
aaaauuaauaaauuauugguaaauacuuucugucuuauugacgaugagacuagaaggag

SEQ ID NO: 647356 - RNA, 59 nt, Homo Sapiens
uccuaaaucuguuuuuaugauuacugacacugucuuaaaguguaugggcuuguaccaau

SEQ ID NO: 647357 - RNA, 59 nt, Homo Sapiens
ucuacugaauauucuagugauucucaugacugucuuaccggugucagguacggagagga

SEQ ID NO: 647358 - RNA, 59 nt, Homo Sapiens
acaucgccaauuaguuguaaacgugagcacugucuuaucuugugaccaacauucaggcc

SEQ ID NO: 647359 - RNA, 59 nt, Homo Sapiens
aguaaaauauacuucaugcuaaauuucaucugucuuaaaaugccuaaagcugugccuag

SEQ ID NO: 647360 - RNA, 59 nt, Homo Sapiens
guuugcgucugggguguguuguaccacaucugucuuaguugagauauauucauccucau

SEQ ID NO: 647361 - RNA, 59 nt, Homo Sapiens
cugcuagcuuucuccuuaccgggccacaacugucuuagacuaccucagaaagauuugau

SEQ ID NO: 647362 - RNA, 64 nt, Homo Sapiens; identical to SEQ ID NO: 206424

SEQ ID NO: 647363 - RNA, 64 nt, Homo Sapiens; identical to SEQ ID NO: 206425

SEQ ID NO: 647364 - RNA, 64 nt, Homo Sapiens; identical to SEQ ID NO: 206426

SEQ ID NO: 647365 - RNA, 64 nt, Homo Sapiens; identical to SEQ ID NO: 206427

SEQ ID NO: 647366 - RNA, 64 nt, Homo Sapiens; identical to SEQ ID NO: 206428

SEQ ID NO: 647367 - RNA, 64 nt, Homo Sapiens; identical to SEQ ID NO: 206429

SEQ ID NO: 647368 - RNA, 64 nt, Homo Sapiens
uguguguguguguguguguguguguguuggggggaucuccuaaauuauuucugugcaucuccuu

SEQ ID NO: 647369 - RNA, 64 nt, Homo Sapiens
cuuagggaggcaccagauuggagacagaugugcuaucuccuaacagagugaugaggcuucaguu

SEQ ID NO: 647370 - RNA, 64 nt, Homo Sapiens
caacagucuuuaugaugggauuaagguggacaagaucuccuaagaucugugaaugggauuaagg

SEQ ID NO: 647371 - RNA, 64 nt, Homo Sapiens
ccuaagaucugugaaugggauuaagguggacaagaucuccuaagaucugaaaagaaaccuuaau

SEQ ID NO: 647372 - RNA, 64 nt, Homo Sapiens
cucaagccauuuucccaccuucacugcagccuccaucuccuaggugugguggcacgaucacagc

SEQ ID NO: 647373 - RNA, 64 nt, Homo Sapiens
ccacauccugucuuagccgcgcugcucucuccccaucuccuaccacaagacagacgucuguccc

SEQ ID NO: 647374 - RNA, 64 nt, Homo Sapiens; identical to SEQ ID NO: 228300

SEQ ID NO: 647375 - RNA, 64 nt, Homo Sapiens; identical to SEQ ID NO: 228301

SEQ ID NO: 647376 - RNA, 64 nt, Homo Sapiens; identical to SEQ ID NO: 228302

SEQ ID NO: 647377 - RNA, 64 nt, Homo Sapiens; identical to SEQ ID NO: 228303

SEQ ID NO: 647378 - RNA, 64 nt, Homo Sapiens; identical to SEQ ID NO: 228304

SEQ ID NO: 647379 - RNA, 64 nt, Homo Sapiens; identical to SEQ ID NO: 228305

SEQ ID NO: 647380 - RNA, 64 nt, Homo Sapiens; identical to SEQ ID NO: 228306

SEQ ID NO: 647381 - RNA, 64 nt, Homo Sapiens; identical to SEQ ID NO: 228307

SEQ ID NO: 647382 - RNA, 64 nt, Homo Sapiens; identical to SEQ ID NO: 228308

SEQ ID NO: 647383 - RNA, 64 nt, Homo Sapiens; identical to SEQ ID NO: 228309

SEQ ID NO: 647384 - RNA, 64 nt, Homo Sapiens; identical to SEQ ID NO: 228310

SEQ ID NO: 647385 - RNA, 64 nt, Homo Sapiens; identical to SEQ ID NO: 228311

SEQ ID NO: 647386 - RNA, 64 nt, Homo Sapiens; identical to SEQ ID NO: 228312

SEQ ID NO: 647387 - RNA, 64 nt, Homo Sapiens; identical to SEQ ID NO: 228313

SEQ ID NO: 647388 - RNA, 64 nt, Homo Sapiens; identical to SEQ ID NO: 491006

SEQ ID NO: 647389 - RNA, 64 nt, Homo Sapiens; identical to SEQ ID NO: 491007

SEQ ID NO: 647390 - RNA, 64 nt, Homo Sapiens; identical to SEQ ID NO: 491008

SEQ ID NO: 647391 - RNA, 64 nt, Homo Sapiens; identical to SEQ ID NO: 491009

SEQ ID NO: 647392 - RNA, 64 nt, Homo Sapiens; identical to SEQ ID NO: 491010

SEQ ID NO: 647393 - RNA, 64 nt, Homo Sapiens; identical to SEQ ID NO: 491011

SEQ ID NO: 647394 - RNA, 64 nt, Homo Sapiens; identical to SEQ ID NO: 491012

SEQ ID NO: 647395 - RNA, 64 nt, Homo Sapiens; identical to SEQ ID NO: 491013

SEQ ID NO: 647396 - RNA, 64 nt, Homo Sapiens; identical to SEQ ID NO: 491014

SEQ ID NO: 647397 - RNA, 64 nt, Homo Sapiens; identical to SEQ ID NO: 491015

SEQ ID NO: 647398 - RNA, 64 nt, Homo Sapiens; identical to SEQ ID NO: 491016

SEQ ID NO: 647399 - RNA, 64 nt, Homo Sapiens; identical to SEQ ID NO: 491017

SEQ ID NO: 647400 - RNA, 64 nt, Homo Sapiens; identical to SEQ ID NO: 491018

SEQ ID NO: 647401 - RNA, 64 nt, Homo Sapiens; identical to SEQ ID NO: 491019

SEQ ID NO: 647402 - RNA, 64 nt, Homo Sapiens; identical to SEQ ID NO: 491020

SEQ ID NO: 647403 - RNA, 64 nt, Homo Sapiens; identical to SEQ ID NO: 491021

SEQ ID NO: 647404 - RNA, 64 nt, Homo Sapiens; identical to SEQ ID NO: 491022

SEQ ID NO: 647405 - RNA, 64 nt, Homo Sapiens; identical to SEQ ID NO: 491023

SEQ ID NO: 647406 - RNA, 64 nt, Homo Sapiens; identical to SEQ ID NO: 491024

SEQ ID NO: 647407 - RNA, 64 nt, Homo Sapiens; identical to SEQ ID NO: 491025

SEQ ID NO: 647408 - RNA, 64 nt, Homo Sapiens; identical to SEQ ID NO: 491026

SEQ ID NO: 647409 - RNA, 64 nt, Homo Sapiens; identical to SEQ ID NO: 491027

SEQ ID NO: 647410 - RNA, 64 nt, Homo Sapiens; identical to SEQ ID NO: 491028

SEQ ID NO: 647411 - RNA, 64 nt, Homo Sapiens; identical to SEQ ID NO: 491029

SEQ ID NO: 647412 - RNA, 64 nt, Homo Sapiens; identical to SEQ ID NO: 491030

SEQ ID NO: 647413 - RNA, 64 nt, Homo Sapiens; identical to SEQ ID NO: 491031

SEQ ID NO: 647414 - RNA, 64 nt, Homo Sapiens; identical to SEQ ID NO: 491032

SEQ ID NO: 647415 - RNA, 64 nt, Homo Sapiens; identical to SEQ ID NO: 491033

SEQ ID NO: 647416 - RNA, 64 nt, Homo Sapiens; identical to SEQ ID NO: 491034

SEQ ID NO: 647417 - RNA, 64 nt, Homo Sapiens; identical to SEQ ID NO: 491035

SEQ ID NO: 647418 - RNA, 64 nt, Homo Sapiens; identical to SEQ ID NO: 491036

SEQ ID NO: 647419 - RNA, 64 nt, Homo Sapiens; identical to SEQ ID NO: 491037

SEQ ID NO: 647420 - RNA, 64 nt, Homo Sapiens; identical to SEQ ID NO: 491038

SEQ ID NO: 647421 - RNA, 64 nt, Homo Sapiens; identical to SEQ ID NO: 491039

SEQ ID NO: 647422 - RNA, 64 nt, Homo Sapiens; identical to SEQ ID NO: 491040

SEQ ID NO: 647423 - RNA, 64 nt, Homo Sapiens; identical to SEQ ID NO: 491041

SEQ ID NO: 647424 - RNA, 64 nt, Homo Sapiens; identical to SEQ ID NO: 491042

SEQ ID NO: 647425 - RNA, 64 nt, Homo Sapiens; identical to SEQ ID NO: 491043

SEQ ID NO: 647426 - RNA, 64 nt, Homo Sapiens; identical to SEQ ID NO: 491044

SEQ ID NO: 647427 - RNA, 64 nt, Homo Sapiens; identical to SEQ ID NO: 491045

SEQ ID NO: 647428 - RNA, 64 nt, Homo Sapiens; identical to SEQ ID NO: 491046

SEQ ID NO: 647429 - RNA, 64 nt, Homo Sapiens; identical to SEQ ID NO: 491047

SEQ ID NO: 647430 - RNA, 64 nt, Homo Sapiens; identical to SEQ ID NO: 491048

SEQ ID NO: 647431 - RNA, 64 nt, Homo Sapiens; identical to SEQ ID NO: 491049

SEQ ID NO: 647432 - RNA, 64 nt, Homo Sapiens; identical to SEQ ID NO: 491050

SEQ ID NO: 647433 - RNA, 64 nt, Homo Sapiens; identical to SEQ ID NO: 491051

SEQ ID NO: 647434 - RNA, 64 nt, Homo Sapiens; identical to SEQ ID NO: 491052

SEQ ID NO: 647435 - RNA, 64 nt, Homo Sapiens; identical to SEQ ID NO: 491053

SEQ ID NO: 647436 - RNA, 64 nt, Homo Sapiens; identical to SEQ ID NO: 491054

SEQ ID NO: 647437 - RNA, 64 nt, Homo Sapiens; identical to SEQ ID NO: 491055

SEQ ID NO: 647438 - RNA, 64 nt, Homo Sapiens; identical to SEQ ID NO: 491056

SEQ ID NO: 647439 - RNA, 57 nt, Homo Sapiens; identical to SEQ ID NO: 491057

SEQ ID NO: 647440 - RNA, 64 nt, Homo Sapiens; identical to SEQ ID NO: 491058

SEQ ID NO: 647441 - RNA, 64 nt, Homo Sapiens; identical to SEQ ID NO: 491059

SEQ ID NO: 647442 - RNA, 64 nt, Homo Sapiens; identical to SEQ ID NO: 491060

SEQ ID NO: 647443 - RNA, 64 nt, Homo Sapiens; identical to SEQ ID NO: 491061

SEQ ID NO: 647444 - RNA, 64 nt, Homo Sapiens; identical to SEQ ID NO: 491062

SEQ ID NO: 647445 - RNA, 64 nt, Homo Sapiens; identical to SEQ ID NO: 491063

SEQ ID NO: 647446 - RNA, 64 nt, Homo Sapiens; identical to SEQ ID NO: 491064

SEQ ID NO: 647447 - RNA, 64 nt, Homo Sapiens; identical to SEQ ID NO: 491065

SEQ ID NO: 647448 - RNA, 64 nt, Homo Sapiens; identical to SEQ ID NO: 491066

SEQ ID NO: 647449 - RNA, 64 nt, Homo Sapiens; identical to SEQ ID NO: 491067

SEQ ID NO: 647450 - RNA, 64 nt, Homo Sapiens; identical to SEQ ID NO: 491068

SEQ ID NO: 647451 - RNA, 64 nt, Homo Sapiens; identical to SEQ ID NO: 491069

SEQ ID NO: 647452 - RNA, 64 nt, Homo Sapiens; identical to SEQ ID NO: 491070

SEQ ID NO: 647453 - RNA, 64 nt, Homo Sapiens; identical to SEQ ID NO: 491071

SEQ ID NO: 647454 - RNA, 64 nt, Homo Sapiens; identical to SEQ ID NO: 76456

SEQ ID NO: 647455 - RNA, 64 nt, Homo Sapiens; identical to SEQ ID NO: 76457

SEQ ID NO: 647456 - RNA, 64 nt, Homo Sapiens; identical to SEQ ID NO: 76458

SEQ ID NO: 647457 - RNA, 64 nt, Homo Sapiens; identical to SEQ ID NO: 76459

SEQ ID NO: 647458 - RNA, 64 nt, Homo Sapiens; identical to SEQ ID NO: 76460

SEQ ID NO: 647459 - RNA, 64 nt, Homo Sapiens; identical to SEQ ID NO: 76461

SEQ ID NO: 647460 - RNA, 64 nt, Homo Sapiens; identical to SEQ ID NO: 76462

SEQ ID NO: 647461 - RNA, 64 nt, Homo Sapiens; identical to SEQ ID NO: 76463

SEQ ID NO: 647462 - RNA, 64 nt, Homo Sapiens; identical to SEQ ID NO: 76464

SEQ ID NO: 647463 - RNA, 64 nt, Homo Sapiens; identical to SEQ ID NO: 76465

SEQ ID NO: 647464 - RNA, 64 nt, Homo Sapiens; identical to SEQ ID NO: 76466

SEQ ID NO: 647465 - RNA, 64 nt, Homo Sapiens; identical to SEQ ID NO: 76467

SEQ ID NO: 647466 - RNA, 64 nt, Homo Sapiens
uagaaucuuauaucuguaugggggaaaaaauacaucaaaucaaauuuaugguagaccuguuaau

SEQ ID NO: 647467 - RNA, 64 nt, Homo Sapiens
cacuaggccuuugaugcuuugggucacuucggagucaaaucauacuuuaucaaaguagaagaga

SEQ ID NO: 647468 - RNA, 64 nt, Homo Sapiens
auaugaaauuauguaaauuucaaaugcuuaugaaucaaaucauuguugaacaaaagauuuguug

SEQ ID NO: 647469 - RNA, 64 nt, Homo Sapiens
uaucaaaagcaauagugcaccaauuaagaugugcucaaaucaggacuuaaaucauaggcaccac

SEQ ID NO: 647470 - RNA, 64 nt, Homo Sapiens
aaauuucaggcuuuaaaaagcgaaugaaauaaagucaaaucaauugguuaaauuuuaagguauu

SEQ ID NO: 647471 - RNA, 64 nt, Homo Sapiens
ucuuuaaccuaagauguaaguuuuaugucauauaucaaaucaucagaauauauuauauaaagaa

SEQ ID NO: 647472 - RNA, 64 nt, Homo Sapiens
caaaucgauuuaguaaguauguuuuuuauguuccucaaaucagugauaauugguuugacuguac

SEQ ID NO: 647473 - RNA, 64 nt, Homo Sapiens
agucuuugagacuaaauucaaucaccaccagguaucaaaucaacuuuuaugcagcaaauauaug

SEQ ID NO: 647474 - RNA, 64 nt, Homo Sapiens
ccuugcaauucaaccgcaguuugaauuaaucauaucaaaucaguuuuaauuuuuuaaauuguac

SEQ ID NO: 647475 - RNA, 64 nt, Homo Sapiens
gucuucacuguuuauaauacggauggauuuuuuuucaaaucaguguguguuuugaggucuuaug

SEQ ID NO: 647476 - RNA, 64 nt, Homo Sapiens
agggauagagcccaugccucaaccuauccagaguucaaaucaaagaguccccagugugauucaa

SEQ ID NO: 647477 - RNA, 64 nt, Homo Sapiens
auuccuaauucuuaaaugccauucagucuggacuucaaaucacuugucuucagaaaauaaaaga

SEQ ID NO: 647478 - RNA, 64 nt, Homo Sapiens
uucaaaaacacaugaacugcagaugccauaggccucaaaucagcuguaauucuaggagacacgu

SEQ ID NO: 647479 - RNA, 64 nt, Homo Sapiens
uuucuuucaguugucuuugggaggggauguuaagucaaaucacuaaaacaggguucucuuugga

SEQ ID NO: 647480 - RNA, 64 nt, Homo Sapiens
aaaggccuuuacacauguuuuaucaauaugauuaucaaaucacagcauauacagaaaagacuug

SEQ ID NO: 647481 - RNA, 64 nt, Homo Sapiens
ggcacucaagaaacguacaaccacagugcuuucuucaaaucauaugagaaauacuaugcauagc

SEQ ID NO: 647482 - RNA, 64 nt, Homo Sapiens
uugauggagauaaauaaucagugauuaucucaaaucaaaucacucauaccgagccugagauugu

SEQ ID NO: 647483 - RNA, 64 nt, Homo Sapiens
ucacuuugauggagauaaauauugugugauuaucucaaaucaaauuuuacauaccgagccugag

SEQ ID NO: 647484 - RNA, 64 nt, Homo Sapiens
gcucauauacaguaaacuugugccauuugacauuucaaaucaguugagaaauuuguuuuuauua

SEQ ID NO: 647485 - RNA, 64 nt, Homo Sapiens
gaaauucauuuggggucaaacguauuaucacuugucaaaucauucaguuuauuuaugaaaauag

SEQ ID NO: 647486 - RNA, 64 nt, Homo Sapiens
ggggggagaaaaaggaugucgaaaaaugcagcuuucaaaucauuuguuuguuugaaauuggcag

SEQ ID NO: 647487 - RNA, 64 nt, Homo Sapiens
aacuguauuuuuuuuaaugaucccuguaucuaacucaaaucaggaaguaugugcuacuuuuuug

SEQ ID NO: 647488 - RNA, 64 nt, Homo Sapiens
uugaacacugucauccguuucagcugacagcugcucaaaucauuuaagaaggaguucugacauu

SEQ ID NO: 647489 - RNA, 64 nt, Homo Sapiens
guuaucagggauuuuuauuuguagucuaauuuugucaaaucauggccaaaucgcagugauaguu

SEQ ID NO: 647490 - RNA, 64 nt, Homo Sapiens; identical to SEQ ID NO: 546418

SEQ ID NO: 647491 - RNA, 64 nt, Homo Sapiens; identical to SEQ ID NO: 546419

SEQ ID NO: 647492 - RNA, 64 nt, Homo Sapiens; identical to SEQ ID NO: 546420

SEQ ID NO: 647493 - RNA, 64 nt, Homo Sapiens; identical to SEQ ID NO: 546421

SEQ ID NO: 647494 - RNA, 64 nt, Homo Sapiens; identical to SEQ ID NO: 546422

SEQ ID NO: 647495 - RNA, 64 nt, Homo Sapiens; identical to SEQ ID NO: 546423

SEQ ID NO: 647496 - RNA, 64 nt, Homo Sapiens; identical to SEQ ID NO: 546424

SEQ ID NO: 647497 - RNA, 64 nt, Homo Sapiens; identical to SEQ ID NO: 546425

SEQ ID NO: 647498 - RNA, 64 nt, Homo Sapiens; identical to SEQ ID NO: 546426

SEQ ID NO: 647499 - RNA, 64 nt, Homo Sapiens; identical to SEQ ID NO: 546427

SEQ ID NO: 647500 - RNA, 64 nt, Homo Sapiens; identical to SEQ ID NO: 546427

SEQ ID NO: 647501 - RNA, 64 nt, Homo Sapiens; identical to SEQ ID NO: 546429

SEQ ID NO: 647502 - RNA, 64 nt, Homo Sapiens; identical to SEQ ID NO: 546430

SEQ ID NO: 647503 - RNA, 64 nt, Homo Sapiens; identical to SEQ ID NO: 604268

SEQ ID NO: 647504 - RNA, 64 nt, Homo Sapiens; identical to SEQ ID NO: 604269

SEQ ID NO: 647505 - RNA, 64 nt, Homo Sapiens; identical to SEQ ID NO: 604270

SEQ ID NO: 647506 - RNA, 64 nt, Homo Sapiens; identical to SEQ ID NO: 604271

SEQ ID NO: 647507 - RNA, 64 nt, Homo Sapiens; identical to SEQ ID NO: 604272

SEQ ID NO: 647508 - RNA, 64 nt, Homo Sapiens; identical to SEQ ID NO: 604273

SEQ ID NO: 647509 - RNA, 64 nt, Homo Sapiens; identical to SEQ ID NO: 604274

SEQ ID NO: 647510 - RNA, 64 nt, Homo Sapiens; identical to SEQ ID NO: 604275

SEQ ID NO: 647511 - RNA, 64 nt, Homo Sapiens
ggaaugacauaccugggcucaggggaagcaagggggcuuagaauuugugggguauucccaaaag

SEQ ID NO: 647512 - RNA, 64 nt, Homo Sapiens
aaacugcucugcacuguuuaauccauuuccaaggggcuuagaaaagcuaacaaggguguguccc

SEQ ID NO: 647513 - RNA, 64 nt, Homo Sapiens; identical to SEQ ID NO: 182371

SEQ ID NO: 647514 - RNA, 64 nt, Homo Sapiens; identical to SEQ ID NO: 182372

SEQ ID NO: 647515 - RNA, 64 nt, Homo Sapiens; identical to SEQ ID NO: 182373

SEQ ID NO: 647516 - RNA, 64 nt, Homo Sapiens; identical to SEQ ID NO: 182374

SEQ ID NO: 647517 - RNA, 64 nt, Homo Sapiens; identical to SEQ ID NO: 182375

SEQ ID NO: 647518 - RNA, 64 nt, Homo Sapiens; identical to SEQ ID NO: 182376

SEQ ID NO: 647519 - RNA, 64 nt, Homo Sapiens; identical to SEQ ID NO: 182377

SEQ ID NO: 647520 - RNA, 64 nt, Homo Sapiens; identical to SEQ ID NO: 182378

SEQ ID NO: 647521 - RNA, 64 nt, Homo Sapiens; identical to SEQ ID NO: 182379

SEQ ID NO: 647522 - RNA, 64 nt, Homo Sapiens; identical to SEQ ID NO: 182380

SEQ ID NO: 647523 - RNA, 64 nt, Homo Sapiens; identical to SEQ ID NO: 182381

SEQ ID NO: 647524 - RNA, 64 nt, Homo Sapiens; identical to SEQ ID NO: 182382

SEQ ID NO: 647525 - RNA, 64 nt, Homo Sapiens; identical to SEQ ID NO: 182383

SEQ ID NO: 647526 - RNA, 64 nt, Homo Sapiens; identical to SEQ ID NO: 182384

SEQ ID NO: 647527 - RNA, 64 nt, Homo Sapiens; identical to SEQ ID NO: 182385

SEQ ID NO: 647528 - RNA, 64 nt, Homo Sapiens; identical to SEQ ID NO: 182386

SEQ ID NO: 647529 - RNA, 64 nt, Homo Sapiens; identical to SEQ ID NO: 182387

SEQ ID NO: 647530 - RNA, 64 nt, Homo Sapiens; identical to SEQ ID NO: 182388

SEQ ID NO: 647531 - RNA, 64 nt, Homo Sapiens; identical to SEQ ID NO: 182389

SEQ ID NO: 647532 - RNA, 64 nt, Homo Sapiens; identical to SEQ ID NO: 182390

SEQ ID NO: 647533 - RNA, 64 nt, Homo Sapiens; identical to SEQ ID NO: 182391

SEQ ID NO: 647534 - RNA, 64 nt, Homo Sapiens; identical to SEQ ID NO: 182392

SEQ ID NO: 647535 - RNA, 64 nt, Homo Sapiens; identical to SEQ ID NO: 182393

SEQ ID NO: 647536 - RNA, 64 nt, Homo Sapiens; identical to SEQ ID NO: 182394

SEQ ID NO: 647537 - RNA, 64 nt, Homo Sapiens; identical to SEQ ID NO: 182395

SEQ ID NO: 647538 - RNA, 64 nt, Homo Sapiens; identical to SEQ ID NO: 182396

SEQ ID NO: 647539 - RNA, 64 nt, Homo Sapiens; identical to SEQ ID NO: 182397

SEQ ID NO: 647540 - RNA, 64 nt, Homo Sapiens; identical to SEQ ID NO: 182398

SEQ ID NO: 647541 - RNA, 64 nt, Homo Sapiens; identical to SEQ ID NO: 182399

SEQ ID NO: 647542 - RNA, 64 nt, Homo Sapiens; identical to SEQ ID NO: 182400

SEQ ID NO: 647543 - RNA, 64 nt, Homo Sapiens; identical to SEQ ID NO: 182401

SEQ ID NO: 647544 - RNA, 64 nt, Homo Sapiens; identical to SEQ ID NO: 182402

SEQ ID NO: 647545 - RNA, 64 nt, Homo Sapiens; identical to SEQ ID NO: 182403

SEQ ID NO: 647546 - RNA, 64 nt, Homo Sapiens; identical to SEQ ID NO: 182404

SEQ ID NO: 647547 - RNA, 64 nt, Homo Sapiens; identical to SEQ ID NO: 182405

SEQ ID NO: 647548 - RNA, 64 nt, Homo Sapiens; identical to SEQ ID NO: 182406

SEQ ID NO: 647549 - RNA, 64 nt, Homo Sapiens; identical to SEQ ID NO: 182407

SEQ ID NO: 647550 - RNA, 64 nt, Homo Sapiens; identical to SEQ ID NO: 182408

SEQ ID NO: 647551 - RNA, 64 nt, Homo Sapiens; identical to SEQ ID NO: 182409

SEQ ID NO: 647552 - RNA, 64 nt, Homo Sapiens; identical to SEQ ID NO: 182410

SEQ ID NO: 647553 - RNA, 64 nt, Homo Sapiens; identical to SEQ ID NO: 182411

SEQ ID NO: 647554 - RNA, 64 nt, Homo Sapiens; identical to SEQ ID NO: 182412

SEQ ID NO: 647555 - RNA, 64 nt, Homo Sapiens; identical to SEQ ID NO: 182413

SEQ ID NO: 647556 - RNA, 64 nt, Homo Sapiens; identical to SEQ ID NO: 182414

SEQ ID NO: 647557 - RNA, 64 nt, Homo Sapiens; identical to SEQ ID NO: 182415

SEQ ID NO: 647558 - RNA, 64 nt, Homo Sapiens; identical to SEQ ID NO: 182416

SEQ ID NO: 647559 - RNA, 64 nt, Homo Sapiens; identical to SEQ ID NO: 182417

SEQ ID NO: 647560 - RNA, 64 nt, Homo Sapiens; identical to SEQ ID NO: 182418

SEQ ID NO: 647561 - RNA, 64 nt, Homo Sapiens; identical to SEQ ID NO: 182419

SEQ ID NO: 647562 - RNA, 64 nt, Homo Sapiens; identical to SEQ ID NO: 182420

SEQ ID NO: 647563 - RNA, 64 nt, Homo Sapiens; identical to SEQ ID NO: 182421

SEQ ID NO: 647564 - RNA, 64 nt, Homo Sapiens; identical to SEQ ID NO: 182422

SEQ ID NO: 647565 - RNA, 64 nt, Homo Sapiens; identical to SEQ ID NO: 182423

SEQ ID NO: 647566 - RNA, 64 nt, Homo Sapiens; identical to SEQ ID NO: 182424

SEQ ID NO: 647567 - RNA, 64 nt, Homo Sapiens; identical to SEQ ID NO: 182425

SEQ ID NO: 647568 - RNA, 64 nt, Homo Sapiens; identical to SEQ ID NO: 182426

SEQ ID NO: 647569 - RNA, 64 nt, Homo Sapiens; identical to SEQ ID NO: 182427

SEQ ID NO: 647570 - RNA, 64 nt, Homo Sapiens; identical to SEQ ID NO: 182428

SEQ ID NO: 647571 - RNA, 64 nt, Homo Sapiens; identical to SEQ ID NO: 182429

SEQ ID NO: 647572 - RNA, 64 nt, Homo Sapiens; identical to SEQ ID NO: 574358

SEQ ID NO: 647573 - RNA, 64 nt, Homo Sapiens; identical to SEQ ID NO: 574359

SEQ ID NO: 647574 - RNA, 64 nt, Homo Sapiens; identical to SEQ ID NO: 574360

SEQ ID NO: 647575 - RNA, 64 nt, Homo Sapiens; identical to SEQ ID NO: 574361

SEQ ID NO: 647576 - RNA, 64 nt, Homo Sapiens; identical to SEQ ID NO: 350758

SEQ ID NO: 647577 - RNA, 64 nt, Homo Sapiens; identical to SEQ ID NO: 350759

SEQ ID NO: 647578 - RNA, 64 nt, Homo Sapiens; identical to SEQ ID NO: 350760

SEQ ID NO: 647579 - RNA, 64 nt, Homo Sapiens; identical to SEQ ID NO: 350761

SEQ ID NO: 647580 - RNA, 64 nt, Homo Sapiens; identical to SEQ ID NO: 350762

SEQ ID NO: 647581 - RNA, 64 nt, Homo Sapiens; identical to SEQ ID NO: 350763

SEQ ID NO: 647582 - RNA, 64 nt, Homo Sapiens; identical to SEQ ID NO: 350764

SEQ ID NO: 647583 - RNA, 64 nt, Homo Sapiens; identical to SEQ ID NO: 350765

SEQ ID NO: 647584 - RNA, 64 nt, Homo Sapiens; identical to SEQ ID NO: 264286

SEQ ID NO: 647585 - RNA, 64 nt, Homo Sapiens; identical to SEQ ID NO: 264287

SEQ ID NO: 647586 - RNA, 64 nt, Homo Sapiens; identical to SEQ ID NO: 264288

SEQ ID NO: 647587 - RNA, 64 nt, Homo Sapiens; identical to SEQ ID NO: 264289

SEQ ID NO: 647588 - RNA, 64 nt, Homo Sapiens; identical to SEQ ID NO: 264290

SEQ ID NO: 647589 - RNA, 64 nt, Homo Sapiens; identical to SEQ ID NO: 264291

SEQ ID NO: 647590 - RNA, 64 nt, Homo Sapiens; identical to SEQ ID NO: 264292

SEQ ID NO: 647591 - RNA, 64 nt, Homo Sapiens; identical to SEQ ID NO: 264293

SEQ ID NO: 647592 - RNA, 64 nt, Homo Sapiens; identical to SEQ ID NO: 264294

SEQ ID NO: 647593 - RNA, 64 nt, Homo Sapiens; identical to SEQ ID NO: 264295

SEQ ID NO: 647594 - RNA, 64 nt, Homo Sapiens; identical to SEQ ID NO: 264296

SEQ ID NO: 647595 - RNA, 64 nt, Homo Sapiens; identical to SEQ ID NO: 264297

SEQ ID NO: 647596 - RNA, 64 nt, Homo Sapiens; identical to SEQ ID NO: 264298

SEQ ID NO: 647597 - RNA, 64 nt, Homo Sapiens; identical to SEQ ID NO: 264299

SEQ ID NO: 647598 - RNA, 64 nt, Homo Sapiens; identical to SEQ ID NO: 264300

SEQ ID NO: 647599 - RNA, 64 nt, Homo Sapiens; identical to SEQ ID NO: 264301

SEQ ID NO: 647600 - RNA, 64 nt, Homo Sapiens; identical to SEQ ID NO: 89905

SEQ ID NO: 647601 - RNA, 64 nt, Homo Sapiens; identical to SEQ ID NO: 89906

SEQ ID NO: 647602 - RNA, 64 nt, Homo Sapiens; identical to SEQ ID NO: 89907

SEQ ID NO: 647603 - RNA, 64 nt, Homo Sapiens; identical to SEQ ID NO: 89908

SEQ ID NO: 647604 - RNA, 64 nt, Homo Sapiens; identical to SEQ ID NO: 89909

SEQ ID NO: 647605 - RNA, 64 nt, Homo Sapiens; identical to SEQ ID NO: 89910

SEQ ID NO: 647606 - RNA, 64 nt, Homo Sapiens; identical to SEQ ID NO: 89911

SEQ ID NO: 647607 - RNA, 64 nt, Homo Sapiens; identical to SEQ ID NO: 89912

SEQ ID NO: 647608 - RNA, 64 nt, Homo Sapiens; identical to SEQ ID NO: 89913

SEQ ID NO: 647609 - RNA, 64 nt, Homo Sapiens; identical to SEQ ID NO: 89914

SEQ ID NO: 647610 - RNA, 64 nt, Homo Sapiens; identical to SEQ ID NO: 89915

SEQ ID NO: 647611 - RNA, 64 nt, Homo Sapiens; identical to SEQ ID NO: 89916

SEQ ID NO: 647612 - RNA, 64 nt, Homo Sapiens; identical to SEQ ID NO: 89917

SEQ ID NO: 647613 - RNA, 64 nt, Homo Sapiens; identical to SEQ ID NO: 89918

SEQ ID NO: 647614 - RNA, 64 nt, Homo Sapiens; identical to SEQ ID NO: 89919

SEQ ID NO: 647615 - RNA, 64 nt, Homo Sapiens; identical to SEQ ID NO: 89920

SEQ ID NO: 647616 - RNA, 64 nt, Homo Sapiens; identical to SEQ ID NO: 89921

SEQ ID NO: 647617 - RNA, 64 nt, Homo Sapiens; identical to SEQ ID NO: 89922

SEQ ID NO: 647618 - RNA, 64 nt, Homo Sapiens; identical to SEQ ID NO: 89923

SEQ ID NO: 647619 - RNA, 64 nt, Homo Sapiens; identical to SEQ ID NO: 89924

SEQ ID NO: 647620 - RNA, 64 nt, Homo Sapiens; identical to SEQ ID NO: 89925

SEQ ID NO: 647621 - RNA, 64 nt, Homo Sapiens; identical to SEQ ID NO: 89926

SEQ ID NO: 647622 - RNA, 64 nt, Homo Sapiens; identical to SEQ ID NO: 89927

SEQ ID NO: 647623 - RNA, 64 nt, Homo Sapiens; identical to SEQ ID NO: 89928

SEQ ID NO: 647624 - RNA, 50 nt, Homo Sapiens; identical to SEQ ID NO: 89929

SEQ ID NO: 647625 - RNA, 64 nt, Homo Sapiens; identical to SEQ ID NO: 89930

SEQ ID NO: 647626 - RNA, 64 nt, Homo Sapiens; identical to SEQ ID NO: 89931

SEQ ID NO: 647627 - RNA, 64 nt, Homo Sapiens; identical to SEQ ID NO: 89932

SEQ ID NO: 647628 - RNA, 64 nt, Homo Sapiens; identical to SEQ ID NO: 89933

SEQ ID NO: 647629 - RNA, 64 nt, Homo Sapiens; identical to SEQ ID NO: 89934

SEQ ID NO: 647630 - RNA, 64 nt, Homo Sapiens; identical to SEQ ID NO: 89935

SEQ ID NO: 647631 - RNA, 64 nt, Homo Sapiens; identical to SEQ ID NO: 89936

SEQ ID NO: 647632 - RNA, 64 nt, Homo Sapiens; identical to SEQ ID NO: 89937

SEQ ID NO: 647633 - RNA, 64 nt, Homo Sapiens; identical to SEQ ID NO: 89938

SEQ ID NO: 647634 - RNA, 64 nt, Homo Sapiens; identical to SEQ ID NO: 89939

SEQ ID NO: 647635 - RNA, 64 nt, Homo Sapiens; identical to SEQ ID NO: 89940

SEQ ID NO: 647636 - RNA, 64 nt, Homo Sapiens; identical to SEQ ID NO: 89941

SEQ ID NO: 647637 - RNA, 55 nt, Homo Sapiens; identical to SEQ ID NO: 89942

SEQ ID NO: 647638 - RNA, 64 nt, Homo Sapiens; identical to SEQ ID NO: 89943

SEQ ID NO: 647639 - RNA, 64 nt, Homo Sapiens; identical to SEQ ID NO: 89944

SEQ ID NO: 647640 - RNA, 64 nt, Homo Sapiens; identical to SEQ ID NO: 89945

SEQ ID NO: 647641 - RNA, 64 nt, Homo Sapiens; identical to SEQ ID NO: 89946

SEQ ID NO: 647642 - RNA, 64 nt, Homo Sapiens; identical to SEQ ID NO: 89947

SEQ ID NO: 647643 - RNA, 64 nt, Homo Sapiens; identical to SEQ ID NO: 89948

SEQ ID NO: 647644 - RNA, 64 nt, Homo Sapiens; identical to SEQ ID NO: 89949

SEQ ID NO: 647645 - RNA, 64 nt, Homo Sapiens; identical to SEQ ID NO: 89950

SEQ ID NO: 647646 - RNA, 64 nt, Homo Sapiens; identical to SEQ ID NO: 89951

SEQ ID NO: 647647 - RNA, 64 nt, Homo Sapiens; identical to SEQ ID NO: 89952

SEQ ID NO: 647648 - RNA, 64 nt, Homo Sapiens; identical to SEQ ID NO: 89953

SEQ ID NO: 647649 - RNA, 64 nt, Homo Sapiens; identical to SEQ ID NO: 89954

SEQ ID NO: 647650 - RNA, 64 nt, Homo Sapiens; identical to SEQ ID NO: 89955

SEQ ID NO: 647651 - RNA, 64 nt, Homo Sapiens; identical to SEQ ID NO: 89956

SEQ ID NO: 647652 - RNA, 64 nt, Homo Sapiens; identical to SEQ ID NO: 89957

SEQ ID NO: 647653 - RNA, 64 nt, Homo Sapiens; identical to SEQ ID NO: 89958

SEQ ID NO: 647654 - RNA, 64 nt, Homo Sapiens; identical to SEQ ID NO: 89959

SEQ ID NO: 647655 - RNA, 64 nt, Homo Sapiens; identical to SEQ ID NO: 89960

SEQ ID NO: 647656 - RNA, 64 nt, Homo Sapiens; identical to SEQ ID NO: 89961

SEQ ID NO: 647657 - RNA, 64 nt, Homo Sapiens; identical to SEQ ID NO: 89962

SEQ ID NO: 647658 - RNA, 64 nt, Homo Sapiens; identical to SEQ ID NO: 89963

SEQ ID NO: 647659 - RNA, 64 nt, Homo Sapiens; identical to SEQ ID NO: 89964

SEQ ID NO: 647660 - RNA, 64 nt, Homo Sapiens; identical to SEQ ID NO: 89965

SEQ ID NO: 647661 - RNA, 64 nt, Homo Sapiens; identical to SEQ ID NO: 89966

SEQ ID NO: 647662 - RNA, 64 nt, Homo Sapiens; identical to SEQ ID NO: 89967

SEQ ID NO: 647663 - RNA, 64 nt, Homo Sapiens; identical to SEQ ID NO: 89968

SEQ ID NO: 647664 - RNA, 64 nt, Homo Sapiens; identical to SEQ ID NO: 89969

SEQ ID NO: 647665 - RNA, 64 nt, Homo Sapiens; identical to SEQ ID NO: 89970

SEQ ID NO: 647666 - RNA, 64 nt, Homo Sapiens; identical to SEQ ID NO: 89971

SEQ ID NO: 647667 - RNA, 64 nt, Homo Sapiens; identical to SEQ ID NO: 89972

SEQ ID NO: 647668 - RNA, 64 nt, Homo Sapiens; identical to SEQ ID NO: 89973

SEQ ID NO: 647669 - RNA, 64 nt, Homo Sapiens; identical to SEQ ID NO: 89974

SEQ ID NO: 647670 - RNA, 64 nt, Homo Sapiens; identical to SEQ ID NO: 89975

SEQ ID NO: 647671 - RNA, 64 nt, Homo Sapiens; identical to SEQ ID NO: 89976

SEQ ID NO: 647672 - RNA, 64 nt, Homo Sapiens; identical to SEQ ID NO: 89977

SEQ ID NO: 647673 - RNA, 64 nt, Homo Sapiens; identical to SEQ ID NO: 89978

SEQ ID NO: 647674 - RNA, 64 nt, Homo Sapiens; identical to SEQ ID NO: 89979

SEQ ID NO: 647675 - RNA, 64 nt, Homo Sapiens; identical to SEQ ID NO: 89980

SEQ ID NO: 647676 - RNA, 64 nt, Homo Sapiens; identical to SEQ ID NO: 89981

SEQ ID NO: 647677 - RNA, 64 nt, Homo Sapiens; identical to SEQ ID NO: 89982

SEQ ID NO: 647678 - RNA, 64 nt, Homo Sapiens; identical to SEQ ID NO: 89983

SEQ ID NO: 647679 - RNA, 64 nt, Homo Sapiens; identical to SEQ ID NO: 89984

SEQ ID NO: 647680 - RNA, 64 nt, Homo Sapiens; identical to SEQ ID NO: 89985

SEQ ID NO: 647681 - RNA, 64 nt, Homo Sapiens; identical to SEQ ID NO: 89986

SEQ ID NO: 647682 - RNA, 64 nt, Homo Sapiens; identical to SEQ ID NO: 89987

SEQ ID NO: 647683 - RNA, 64 nt, Homo Sapiens; identical to SEQ ID NO: 89988

SEQ ID NO: 647684 - RNA, 59 nt, Homo Sapiens; identical to SEQ ID NO: 89989

SEQ ID NO: 647685 - RNA, 64 nt, Homo Sapiens; identical to SEQ ID NO: 89990

SEQ ID NO: 647686 - RNA, 64 nt, Homo Sapiens; identical to SEQ ID NO: 89991

SEQ ID NO: 647687 - RNA, 64 nt, Homo Sapiens; identical to SEQ ID NO: 89992

SEQ ID NO: 647688 - RNA, 64 nt, Homo Sapiens; identical to SEQ ID NO: 89993

SEQ ID NO: 647689 - RNA, 64 nt, Homo Sapiens; identical to SEQ ID NO: 89994

SEQ ID NO: 647690 - RNA, 64 nt, Homo Sapiens; identical to SEQ ID NO: 89995

SEQ ID NO: 647691 - RNA, 64 nt, Homo Sapiens; identical to SEQ ID NO: 89996

SEQ ID NO: 647692 - RNA, 64 nt, Homo Sapiens; identical to SEQ ID NO: 89997

SEQ ID NO: 647693 - RNA, 64 nt, Homo Sapiens; identical to SEQ ID NO: 89998

SEQ ID NO: 647694 - RNA, 64 nt, Homo Sapiens; identical to SEQ ID NO: 89999

SEQ ID NO: 647695 - RNA, 64 nt, Homo Sapiens; identical to SEQ ID NO: 90000

SEQ ID NO: 647696 - RNA, 64 nt, Homo Sapiens; identical to SEQ ID NO: 90001

SEQ ID NO: 647697 - RNA, 64 nt, Homo Sapiens; identical to SEQ ID NO: 90002

SEQ ID NO: 647698 - RNA, 64 nt, Homo Sapiens; identical to SEQ ID NO: 90003

SEQ ID NO: 647699 - RNA, 64 nt, Homo Sapiens; identical to SEQ ID NO: 90004

SEQ ID NO: 647700 - RNA, 64 nt, Homo Sapiens; identical to SEQ ID NO: 90005

SEQ ID NO: 647701 - RNA, 64 nt, Homo Sapiens; identical to SEQ ID NO: 90006

SEQ ID NO: 647702 - RNA, 64 nt, Homo Sapiens; identical to SEQ ID NO: 90007

SEQ ID NO: 647703 - RNA, 64 nt, Homo Sapiens; identical to SEQ ID NO: 90008

SEQ ID NO: 647704 - RNA, 64 nt, Homo Sapiens; identical to SEQ ID NO: 90009

SEQ ID NO: 647705 - RNA, 64 nt, Homo Sapiens; identical to SEQ ID NO: 90010

SEQ ID NO: 647706 - RNA, 64 nt, Homo Sapiens; identical to SEQ ID NO: 90011

SEQ ID NO: 647707 - RNA, 64 nt, Homo Sapiens; identical to SEQ ID NO: 90012

SEQ ID NO: 647708 - RNA, 64 nt, Homo Sapiens; identical to SEQ ID NO: 90013

SEQ ID NO: 647709 - RNA, 64 nt, Homo Sapiens; identical to SEQ ID NO: 90014

SEQ ID NO: 647710 - RNA, 64 nt, Homo Sapiens; identical to SEQ ID NO: 90015

SEQ ID NO: 647711 - RNA, 64 nt, Homo Sapiens; identical to SEQ ID NO: 90016

SEQ ID NO: 647712 - RNA, 64 nt, Homo Sapiens; identical to SEQ ID NO: 90017

SEQ ID NO: 647713 - RNA, 64 nt, Homo Sapiens; identical to SEQ ID NO: 90018

SEQ ID NO: 647714 - RNA, 64 nt, Homo Sapiens; identical to SEQ ID NO: 90019

SEQ ID NO: 647715 - RNA, 64 nt, Homo Sapiens; identical to SEQ ID NO: 90020

SEQ ID NO: 647716 - RNA, 64 nt, Homo Sapiens; identical to SEQ ID NO: 90021

SEQ ID NO: 647717 - RNA, 64 nt, Homo Sapiens; identical to SEQ ID NO: 90022

SEQ ID NO: 647718 - RNA, 64 nt, Homo Sapiens; identical to SEQ ID NO: 90023

SEQ ID NO: 647719 - RNA, 64 nt, Homo Sapiens; identical to SEQ ID NO: 90024

SEQ ID NO: 647720 - RNA, 64 nt, Homo Sapiens; identical to SEQ ID NO: 90025

SEQ ID NO: 647721 - RNA, 64 nt, Homo Sapiens; identical to SEQ ID NO: 90026

SEQ ID NO: 647722 - RNA, 64 nt, Homo Sapiens; identical to SEQ ID NO: 90027

SEQ ID NO: 647723 - RNA, 64 nt, Homo Sapiens; identical to SEQ ID NO: 90028

SEQ ID NO: 647724 - RNA, 64 nt, Homo Sapiens; identical to SEQ ID NO: 90029

SEQ ID NO: 647725 - RNA, 64 nt, Homo Sapiens; identical to SEQ ID NO: 90030

SEQ ID NO: 647726 - RNA, 64 nt, Homo Sapiens; identical to SEQ ID NO: 90031

SEQ ID NO: 647727 - RNA, 64 nt, Homo Sapiens; identical to SEQ ID NO: 90032

SEQ ID NO: 647728 - RNA, 64 nt, Homo Sapiens; identical to SEQ ID NO: 90033

SEQ ID NO: 647729 - RNA, 64 nt, Homo Sapiens; identical to SEQ ID NO: 90034

SEQ ID NO: 647730 - RNA, 64 nt, Homo Sapiens; identical to SEQ ID NO: 90035

SEQ ID NO: 647731 - RNA, 64 nt, Homo Sapiens; identical to SEQ ID NO: 90036

SEQ ID NO: 647732 - RNA, 64 nt, Homo Sapiens; identical to SEQ ID NO: 90037

SEQ ID NO: 647733 - RNA, 64 nt, Homo Sapiens; identical to SEQ ID NO: 90038

SEQ ID NO: 647734 - RNA, 64 nt, Homo Sapiens; identical to SEQ ID NO: 90039

SEQ ID NO: 647735 - RNA, 64 nt, Homo Sapiens; identical to SEQ ID NO: 90040

SEQ ID NO: 647736 - RNA, 64 nt, Homo Sapiens; identical to SEQ ID NO: 90041

SEQ ID NO: 647737 - RNA, 64 nt, Homo Sapiens; identical to SEQ ID NO: 90042

SEQ ID NO: 647738 - RNA, 64 nt, Homo Sapiens; identical to SEQ ID NO: 90043

SEQ ID NO: 647739 - RNA, 64 nt, Homo Sapiens; identical to SEQ ID NO: 90044

SEQ ID NO: 647740 - RNA, 64 nt, Homo Sapiens; identical to SEQ ID NO: 90045

SEQ ID NO: 647741 - RNA, 64 nt, Homo Sapiens; identical to SEQ ID NO: 90046

SEQ ID NO: 647742 - RNA, 64 nt, Homo Sapiens; identical to SEQ ID NO: 90047

SEQ ID NO: 647743 - RNA, 64 nt, Homo Sapiens; identical to SEQ ID NO: 90048

SEQ ID NO: 647744 - RNA, 64 nt, Homo Sapiens; identical to SEQ ID NO: 90049

SEQ ID NO: 647745 - RNA, 64 nt, Homo Sapiens; identical to SEQ ID NO: 90050

SEQ ID NO: 647746 - RNA, 64 nt, Homo Sapiens; identical to SEQ ID NO: 90051

SEQ ID NO: 647747 - RNA, 64 nt, Homo Sapiens; identical to SEQ ID NO: 90052

SEQ ID NO: 647748 - RNA, 64 nt, Homo Sapiens; identical to SEQ ID NO: 90053

SEQ ID NO: 647749 - RNA, 64 nt, Homo Sapiens; identical to SEQ ID NO: 90054

SEQ ID NO: 647750 - RNA, 64 nt, Homo Sapiens; identical to SEQ ID NO: 90055

SEQ ID NO: 647751 - RNA, 64 nt, Homo Sapiens; identical to SEQ ID NO: 90056

SEQ ID NO: 647752 - RNA, 64 nt, Homo Sapiens; identical to SEQ ID NO: 90057

SEQ ID NO: 647753 - RNA, 64 nt, Homo Sapiens; identical to SEQ ID NO: 90058

SEQ ID NO: 647754 - RNA, 64 nt, Homo Sapiens; identical to SEQ ID NO: 90059

SEQ ID NO: 647755 - RNA, 64 nt, Homo Sapiens; identical to SEQ ID NO: 90060

SEQ ID NO: 647756 - RNA, 64 nt, Homo Sapiens; identical to SEQ ID NO: 90061

SEQ ID NO: 647757 - RNA, 64 nt, Homo Sapiens; identical to SEQ ID NO: 90062

SEQ ID NO: 647758 - RNA, 64 nt, Homo Sapiens; identical to SEQ ID NO: 90063

SEQ ID NO: 647759 - RNA, 64 nt, Homo Sapiens; identical to SEQ ID NO: 90064

SEQ ID NO: 647760 - RNA, 64 nt, Homo Sapiens; identical to SEQ ID NO: 90065

SEQ ID NO: 647761 - RNA, 64 nt, Homo Sapiens; identical to SEQ ID NO: 90066

SEQ ID NO: 647762 - RNA, 64 nt, Homo Sapiens; identical to SEQ ID NO: 90067

SEQ ID NO: 647763 - RNA, 64 nt, Homo Sapiens; identical to SEQ ID NO: 90068

SEQ ID NO: 647764 - RNA, 64 nt, Homo Sapiens; identical to SEQ ID NO: 90069

SEQ ID NO: 647765 - RNA, 64 nt, Homo Sapiens; identical to SEQ ID NO: 90070

SEQ ID NO: 647766 - RNA, 64 nt, Homo Sapiens; identical to SEQ ID NO: 90071

SEQ ID NO: 647767 - RNA, 64 nt, Homo Sapiens; identical to SEQ ID NO: 90072

SEQ ID NO: 647768 - RNA, 64 nt, Homo Sapiens; identical to SEQ ID NO: 90073

SEQ ID NO: 647769 - RNA, 64 nt, Homo Sapiens; identical to SEQ ID NO: 90074

SEQ ID NO: 647770 - RNA, 64 nt, Homo Sapiens; identical to SEQ ID NO: 90075

SEQ ID NO: 647771 - RNA, 64 nt, Homo Sapiens; identical to SEQ ID NO: 90076

SEQ ID NO: 647772 - RNA, 64 nt, Homo Sapiens; identical to SEQ ID NO: 90077

SEQ ID NO: 647773 - RNA, 64 nt, Homo Sapiens; identical to SEQ ID NO: 90078

SEQ ID NO: 647774 - RNA, 64 nt, Homo Sapiens; identical to SEQ ID NO: 90079

SEQ ID NO: 647775 - RNA, 64 nt, Homo Sapiens; identical to SEQ ID NO: 90080

SEQ ID NO: 647776 - RNA, 64 nt, Homo Sapiens; identical to SEQ ID NO: 90081

SEQ ID NO: 647777 - RNA, 64 nt, Homo Sapiens; identical to SEQ ID NO: 90082

SEQ ID NO: 647778 - RNA, 64 nt, Homo Sapiens; identical to SEQ ID NO: 90083

SEQ ID NO: 647779 - RNA, 64 nt, Homo Sapiens; identical to SEQ ID NO: 90084

SEQ ID NO: 647780 - RNA, 64 nt, Homo Sapiens; identical to SEQ ID NO: 528508

SEQ ID NO: 647781 - RNA, 64 nt, Homo Sapiens; identical to SEQ ID NO: 528509

SEQ ID NO: 647782 - RNA, 64 nt, Homo Sapiens; identical to SEQ ID NO: 528510

SEQ ID NO: 647783 - RNA, 64 nt, Homo Sapiens; identical to SEQ ID NO: 528511

SEQ ID NO: 647784 - RNA, 64 nt, Homo Sapiens; identical to SEQ ID NO: 528512

SEQ ID NO: 647785 - RNA, 64 nt, Homo Sapiens; identical to SEQ ID NO: 528513

SEQ ID NO: 647786 - RNA, 64 nt, Homo Sapiens; identical to SEQ ID NO: 528514

SEQ ID NO: 647787 - RNA, 64 nt, Homo Sapiens; identical to SEQ ID NO: 528515

SEQ ID NO: 647788 - RNA, 64 nt, Homo Sapiens; identical to SEQ ID NO: 528516

SEQ ID NO: 647789 - RNA, 64 nt, Homo Sapiens; identical to SEQ ID NO: 528517

SEQ ID NO: 647790 - RNA, 64 nt, Homo Sapiens; identical to SEQ ID NO: 528518

SEQ ID NO: 647791 - RNA, 64 nt, Homo Sapiens; identical to SEQ ID NO: 366291

SEQ ID NO: 647792 - RNA, 64 nt, Homo Sapiens; identical to SEQ ID NO: 366292

SEQ ID NO: 647793 - RNA, 64 nt, Homo Sapiens; identical to SEQ ID NO: 366293

SEQ ID NO: 647794 - RNA, 64 nt, Homo Sapiens; identical to SEQ ID NO: 366294

SEQ ID NO: 647795 - RNA, 64 nt, Homo Sapiens; identical to SEQ ID NO: 366295

SEQ ID NO: 647796 - RNA, 64 nt, Homo Sapiens; identical to SEQ ID NO: 366296

SEQ ID NO: 647797 - RNA, 64 nt, Homo Sapiens; identical to SEQ ID NO: 366297

SEQ ID NO: 647798 - RNA, 64 nt, Homo Sapiens; identical to SEQ ID NO: 366298

SEQ ID NO: 647799 - RNA, 64 nt, Homo Sapiens; identical to SEQ ID NO: 366299

SEQ ID NO: 647800 - RNA, 64 nt, Homo Sapiens; identical to SEQ ID NO: 366300

SEQ ID NO: 647801 - RNA, 64 nt, Homo Sapiens; identical to SEQ ID NO: 366301

SEQ ID NO: 647802 - RNA, 64 nt, Homo Sapiens; identical to SEQ ID NO: 366302

SEQ ID NO: 647803 - RNA, 64 nt, Homo Sapiens; identical to SEQ ID NO: 366303

SEQ ID NO: 647804 - RNA, 64 nt, Homo Sapiens; identical to SEQ ID NO: 366304

SEQ ID NO: 647805 - RNA, 64 nt, Homo Sapiens; identical to SEQ ID NO: 366305

SEQ ID NO: 647806 - RNA, 64 nt, Homo Sapiens; identical to SEQ ID NO: 366306

SEQ ID NO: 647807 - RNA, 64 nt, Homo Sapiens; identical to SEQ ID NO: 366307

SEQ ID NO: 647808 - RNA, 64 nt, Homo Sapiens; identical to SEQ ID NO: 366308

SEQ ID NO: 647809 - RNA, 64 nt, Homo Sapiens; identical to SEQ ID NO: 366309

SEQ ID NO: 647810 - RNA, 64 nt, Homo Sapiens; identical to SEQ ID NO: 366310

SEQ ID NO: 647811 - RNA, 64 nt, Homo Sapiens; identical to SEQ ID NO: 366311

SEQ ID NO: 647812 - RNA, 64 nt, Homo Sapiens; identical to SEQ ID NO: 366312

SEQ ID NO: 647813 - RNA, 64 nt, Homo Sapiens; identical to SEQ ID NO: 366313

SEQ ID NO: 647814 - RNA, 64 nt, Homo Sapiens; identical to SEQ ID NO: 366314

SEQ ID NO: 647815 - RNA, 64 nt, Homo Sapiens; identical to SEQ ID NO: 366315

SEQ ID NO: 647816 - RNA, 64 nt, Homo Sapiens; identical to SEQ ID NO: 366316

SEQ ID NO: 647817 - RNA, 64 nt, Homo Sapiens; identical to SEQ ID NO: 366317

SEQ ID NO: 647818 - RNA, 64 nt, Homo Sapiens; identical to SEQ ID NO: 366318

SEQ ID NO: 647819 - RNA, 64 nt, Homo Sapiens; identical to SEQ ID NO: 366319

SEQ ID NO: 647820 - RNA, 64 nt, Homo Sapiens; identical to SEQ ID NO: 366320

SEQ ID NO: 647821 - RNA, 64 nt, Homo Sapiens; identical to SEQ ID NO: 366321

SEQ ID NO: 647822 - RNA, 64 nt, Homo Sapiens; identical to SEQ ID NO: 366322

SEQ ID NO: 647823 - RNA, 64 nt, Homo Sapiens; identical to SEQ ID NO: 366323

SEQ ID NO: 647824 - RNA, 64 nt, Homo Sapiens; identical to SEQ ID NO: 366324

SEQ ID NO: 647825 - RNA, 64 nt, Homo Sapiens; identical to SEQ ID NO: 366325

SEQ ID NO: 647826 - RNA, 64 nt, Homo Sapiens; identical to SEQ ID NO: 348445

SEQ ID NO: 647827 - RNA, 64 nt, Homo Sapiens; identical to SEQ ID NO: 348446

SEQ ID NO: 647828 - RNA, 64 nt, Homo Sapiens; identical to SEQ ID NO: 348447

SEQ ID NO: 647829 - RNA, 64 nt, Homo Sapiens; identical to SEQ ID NO: 348448

SEQ ID NO: 647830 - RNA, 64 nt, Homo Sapiens; identical to SEQ ID NO: 348449

SEQ ID NO: 647831 - RNA, 64 nt, Homo Sapiens; identical to SEQ ID NO: 348450

SEQ ID NO: 647832 - RNA, 64 nt, Homo Sapiens; identical to SEQ ID NO: 348451

SEQ ID NO: 647833 - RNA, 64 nt, Homo Sapiens; identical to SEQ ID NO: 348452

SEQ ID NO: 647834 - RNA, 64 nt, Homo Sapiens; identical to SEQ ID NO: 348453

SEQ ID NO: 647835 - RNA, 64 nt, Homo Sapiens; identical to SEQ ID NO: 348454

SEQ ID NO: 647836 - RNA, 64 nt, Homo Sapiens; identical to SEQ ID NO: 348455

SEQ ID NO: 647837 - RNA, 64 nt, Homo Sapiens; identical to SEQ ID NO: 348456

SEQ ID NO: 647838 - RNA, 64 nt, Homo Sapiens; identical to SEQ ID NO: 348457

SEQ ID NO: 647839 - RNA, 64 nt, Homo Sapiens; identical to SEQ ID NO: 348458

SEQ ID NO: 647840 - RNA, 64 nt, Homo Sapiens; identical to SEQ ID NO: 348459

SEQ ID NO: 647841 - RNA, 64 nt, Homo Sapiens; identical to SEQ ID NO: 348460

SEQ ID NO: 647842 - RNA, 64 nt, Homo Sapiens; identical to SEQ ID NO: 348461

SEQ ID NO: 647843 - RNA, 64 nt, Homo Sapiens; identical to SEQ ID NO: 348462

SEQ ID NO: 647844 - RNA, 64 nt, Homo Sapiens; identical to SEQ ID NO: 348463

SEQ ID NO: 647845 - RNA, 64 nt, Homo Sapiens; identical to SEQ ID NO: 348464

SEQ ID NO: 647846 - RNA, 64 nt, Homo Sapiens; identical to SEQ ID NO: 348465

SEQ ID NO: 647847 - RNA, 64 nt, Homo Sapiens; identical to SEQ ID NO: 348466

SEQ ID NO: 647848 - RNA, 64 nt, Homo Sapiens; identical to SEQ ID NO: 348467

SEQ ID NO: 647849 - RNA, 64 nt, Homo Sapiens; identical to SEQ ID NO: 348468

SEQ ID NO: 647850 - RNA, 64 nt, Homo Sapiens; identical to SEQ ID NO: 68831

SEQ ID NO: 647851 - RNA, 64 nt, Homo Sapiens; identical to SEQ ID NO: 68832

SEQ ID NO: 647852 - RNA, 64 nt, Homo Sapiens; identical to SEQ ID NO: 68833

SEQ ID NO: 647853 - RNA, 64 nt, Homo Sapiens; identical to SEQ ID NO: 68834

SEQ ID NO: 647854 - RNA, 64 nt, Homo Sapiens; identical to SEQ ID NO: 68835

SEQ ID NO: 647855 - RNA, 64 nt, Homo Sapiens; identical to SEQ ID NO: 68836

SEQ ID NO: 647856 - RNA, 64 nt, Homo Sapiens; identical to SEQ ID NO: 68837

SEQ ID NO: 647857 - RNA, 64 nt, Homo Sapiens; identical to SEQ ID NO: 68838

SEQ ID NO: 647858 - RNA, 64 nt, Homo Sapiens; identical to SEQ ID NO: 68839

SEQ ID NO: 647859 - RNA, 64 nt, Homo Sapiens; identical to SEQ ID NO: 68840

SEQ ID NO: 647860 - RNA, 64 nt, Homo Sapiens; identical to SEQ ID NO: 68841

SEQ ID NO: 647861 - RNA, 64 nt, Homo Sapiens; identical to SEQ ID NO: 68842

SEQ ID NO: 647862 - RNA, 64 nt, Homo Sapiens; identical to SEQ ID NO: 68843

SEQ ID NO: 647863 - RNA, 64 nt, Homo Sapiens; identical to SEQ ID NO: 68844

SEQ ID NO: 647864 - RNA, 64 nt, Homo Sapiens; identical to SEQ ID NO: 68845

SEQ ID NO: 647865 - RNA, 64 nt, Homo Sapiens; identical to SEQ ID NO: 68846

SEQ ID NO: 647866 - RNA, 64 nt, Homo Sapiens; identical to SEQ ID NO: 68847

SEQ ID NO: 647867 - RNA, 64 nt, Homo Sapiens; identical to SEQ ID NO: 68848

SEQ ID NO: 647868 - RNA, 64 nt, Homo Sapiens; identical to SEQ ID NO: 68849

SEQ ID NO: 647869 - RNA, 64 nt, Homo Sapiens; identical to SEQ ID NO: 68850

SEQ ID NO: 647870 - RNA, 64 nt, Homo Sapiens; identical to SEQ ID NO: 68851

SEQ ID NO: 647871 - RNA, 64 nt, Homo Sapiens; identical to SEQ ID NO: 68852

SEQ ID NO: 647872 - RNA, 64 nt, Homo Sapiens; identical to SEQ ID NO: 68853

SEQ ID NO: 647873 - RNA, 64 nt, Homo Sapiens; identical to SEQ ID NO: 68854

SEQ ID NO: 647874 - RNA, 64 nt, Homo Sapiens; identical to SEQ ID NO: 68855

SEQ ID NO: 647875 - RNA, 64 nt, Homo Sapiens; identical to SEQ ID NO: 68856

SEQ ID NO: 647876 - RNA, 64 nt, Homo Sapiens; identical to SEQ ID NO: 68857

SEQ ID NO: 647877 - RNA, 64 nt, Homo Sapiens; identical to SEQ ID NO: 68858

SEQ ID NO: 647878 - RNA, 64 nt, Homo Sapiens; identical to SEQ ID NO: 68859

SEQ ID NO: 647879 - RNA, 64 nt, Homo Sapiens; identical to SEQ ID NO: 68860

SEQ ID NO: 647880 - RNA, 64 nt, Homo Sapiens; identical to SEQ ID NO: 68861

SEQ ID NO: 647881 - RNA, 64 nt, Homo Sapiens; identical to SEQ ID NO: 68862

SEQ ID NO: 647882 - RNA, 64 nt, Homo Sapiens; identical to SEQ ID NO: 68863

SEQ ID NO: 647883 - RNA, 64 nt, Homo Sapiens; identical to SEQ ID NO: 68864

SEQ ID NO: 647884 - RNA, 64 nt, Homo Sapiens; identical to SEQ ID NO: 68865

SEQ ID NO: 647885 - RNA, 64 nt, Homo Sapiens; identical to SEQ ID NO: 68866

SEQ ID NO: 647886 - RNA, 64 nt, Homo Sapiens; identical to SEQ ID NO: 68867

SEQ ID NO: 647887 - RNA, 64 nt, Homo Sapiens; identical to SEQ ID NO: 68868

SEQ ID NO: 647888 - RNA, 64 nt, Homo Sapiens; identical to SEQ ID NO: 68869

SEQ ID NO: 647889 - RNA, 64 nt, Homo Sapiens; identical to SEQ ID NO: 68870

SEQ ID NO: 647890 - RNA, 64 nt, Homo Sapiens; identical to SEQ ID NO: 68871

SEQ ID NO: 647891 - RNA, 64 nt, Homo Sapiens; identical to SEQ ID NO: 68872

SEQ ID NO: 647892 - RNA, 64 nt, Homo Sapiens; identical to SEQ ID NO: 68873

SEQ ID NO: 647893 - RNA, 64 nt, Homo Sapiens; identical to SEQ ID NO: 68874

SEQ ID NO: 647894 - RNA, 64 nt, Homo Sapiens; identical to SEQ ID NO: 68875

SEQ ID NO: 647895 - RNA, 64 nt, Homo Sapiens; identical to SEQ ID NO: 68876

SEQ ID NO: 647896 - RNA, 64 nt, Homo Sapiens; identical to SEQ ID NO: 68877

SEQ ID NO: 647897 - RNA, 64 nt, Homo Sapiens; identical to SEQ ID NO: 68877

SEQ ID NO: 647898 - RNA, 64 nt, Homo Sapiens; identical to SEQ ID NO: 68879

SEQ ID NO: 647899 - RNA, 64 nt, Homo Sapiens; identical to SEQ ID NO: 68880

SEQ ID NO: 647900 - RNA, 64 nt, Homo Sapiens; identical to SEQ ID NO: 68881

SEQ ID NO: 647901 - RNA, 64 nt, Homo Sapiens; identical to SEQ ID NO: 68882

SEQ ID NO: 647902 - RNA, 64 nt, Homo Sapiens; identical to SEQ ID NO: 68883

SEQ ID NO: 647903 - RNA, 64 nt, Homo Sapiens; identical to SEQ ID NO: 68884

SEQ ID NO: 647904 - RNA, 64 nt, Homo Sapiens; identical to SEQ ID NO: 68885

SEQ ID NO: 647905 - RNA, 64 nt, Homo Sapiens; identical to SEQ ID NO: 68886

SEQ ID NO: 647906 - RNA, 64 nt, Homo Sapiens; identical to SEQ ID NO: 68887

SEQ ID NO: 647907 - RNA, 64 nt, Homo Sapiens; identical to SEQ ID NO: 68888

SEQ ID NO: 647908 - RNA, 64 nt, Homo Sapiens; identical to SEQ ID NO: 68889

SEQ ID NO: 647909 - RNA, 64 nt, Homo Sapiens; identical to SEQ ID NO: 68890

SEQ ID NO: 647910 - RNA, 64 nt, Homo Sapiens; identical to SEQ ID NO: 68891

SEQ ID NO: 647911 - RNA, 64 nt, Homo Sapiens; identical to SEQ ID NO: 68892

SEQ ID NO: 647912 - RNA, 64 nt, Homo Sapiens; identical to SEQ ID NO: 68893

SEQ ID NO: 647913 - RNA, 64 nt, Homo Sapiens; identical to SEQ ID NO: 68894

SEQ ID NO: 647914 - RNA, 64 nt, Homo Sapiens; identical to SEQ ID NO: 68895

SEQ ID NO: 647915 - RNA, 64 nt, Homo Sapiens; identical to SEQ ID NO: 68896

SEQ ID NO: 647916 - RNA, 64 nt, Homo Sapiens; identical to SEQ ID NO: 68897

SEQ ID NO: 647917 - RNA, 64 nt, Homo Sapiens; identical to SEQ ID NO: 68898

SEQ ID NO: 647918 - RNA, 64 nt, Homo Sapiens; identical to SEQ ID NO: 68899

SEQ ID NO: 647919 - RNA, 64 nt, Homo Sapiens; identical to SEQ ID NO: 68900

SEQ ID NO: 647920 - RNA, 64 nt, Homo Sapiens; identical to SEQ ID NO: 68901

SEQ ID NO: 647921 - RNA, 64 nt, Homo Sapiens; identical to SEQ ID NO: 68902

SEQ ID NO: 647922 - RNA, 64 nt, Homo Sapiens; identical to SEQ ID NO: 68903

SEQ ID NO: 647923 - RNA, 64 nt, Homo Sapiens; identical to SEQ ID NO: 68904

SEQ ID NO: 647924 - RNA, 64 nt, Homo Sapiens; identical to SEQ ID NO: 68905

SEQ ID NO: 647925 - RNA, 64 nt, Homo Sapiens; identical to SEQ ID NO: 68906

SEQ ID NO: 647926 - RNA, 64 nt, Homo Sapiens; identical to SEQ ID NO: 68907

SEQ ID NO: 647927 - RNA, 64 nt, Homo Sapiens; identical to SEQ ID NO: 68908

SEQ ID NO: 647928 - RNA, 64 nt, Homo Sapiens; identical to SEQ ID NO: 68909

SEQ ID NO: 647929 - RNA, 64 nt, Homo Sapiens; identical to SEQ ID NO: 68910

SEQ ID NO: 647930 - RNA, 64 nt, Homo Sapiens; identical to SEQ ID NO: 68911

SEQ ID NO: 647931 - RNA, 64 nt, Homo Sapiens; identical to SEQ ID NO: 68912

SEQ ID NO: 647932 - RNA, 64 nt, Homo Sapiens; identical to SEQ ID NO: 68913

SEQ ID NO: 647933 - RNA, 64 nt, Homo Sapiens; identical to SEQ ID NO: 68914

SEQ ID NO: 647934 - RNA, 64 nt, Homo Sapiens; identical to SEQ ID NO: 68915

SEQ ID NO: 647935 - RNA, 64 nt, Homo Sapiens; identical to SEQ ID NO: 68916

SEQ ID NO: 647936 - RNA, 64 nt, Homo Sapiens; identical to SEQ ID NO: 68917

SEQ ID NO: 647937 - RNA, 64 nt, Homo Sapiens; identical to SEQ ID NO: 68918

SEQ ID NO: 647938 - RNA, 64 nt, Homo Sapiens; identical to SEQ ID NO: 68919

SEQ ID NO: 647939 - RNA, 64 nt, Homo Sapiens; identical to SEQ ID NO: 68920

SEQ ID NO: 647940 - RNA, 64 nt, Homo Sapiens; identical to SEQ ID NO: 68921

SEQ ID NO: 647941 - RNA, 64 nt, Homo Sapiens; identical to SEQ ID NO: 68922

SEQ ID NO: 647942 - RNA, 64 nt, Homo Sapiens; identical to SEQ ID NO: 68923

SEQ ID NO: 647943 - RNA, 64 nt, Homo Sapiens; identical to SEQ ID NO: 68924

SEQ ID NO: 647944 - RNA, 64 nt, Homo Sapiens; identical to SEQ ID NO: 68925

SEQ ID NO: 647945 - RNA, 64 nt, Homo Sapiens; identical to SEQ ID NO: 68926

SEQ ID NO: 647946 - RNA, 64 nt, Homo Sapiens; identical to SEQ ID NO: 68927

SEQ ID NO: 647947 - RNA, 64 nt, Homo Sapiens; identical to SEQ ID NO: 68928

SEQ ID NO: 647948 - RNA, 64 nt, Homo Sapiens; identical to SEQ ID NO: 68929

SEQ ID NO: 647949 - RNA, 64 nt, Homo Sapiens; identical to SEQ ID NO: 68930

SEQ ID NO: 647950 - RNA, 64 nt, Homo Sapiens; identical to SEQ ID NO: 68931

SEQ ID NO: 647951 - RNA, 64 nt, Homo Sapiens; identical to SEQ ID NO: 68932

SEQ ID NO: 647952 - RNA, 64 nt, Homo Sapiens; identical to SEQ ID NO: 68933

SEQ ID NO: 647953 - RNA, 64 nt, Homo Sapiens; identical to SEQ ID NO: 68934

SEQ ID NO: 647954 - RNA, 64 nt, Homo Sapiens; identical to SEQ ID NO: 68935

SEQ ID NO: 647955 - RNA, 64 nt, Homo Sapiens; identical to SEQ ID NO: 119606

SEQ ID NO: 647956 - RNA, 64 nt, Homo Sapiens; identical to SEQ ID NO: 119607

SEQ ID NO: 647957 - RNA, 64 nt, Homo Sapiens; identical to SEQ ID NO: 119608

SEQ ID NO: 647958 - RNA, 64 nt, Homo Sapiens; identical to SEQ ID NO: 119609

SEQ ID NO: 647959 - RNA, 64 nt, Homo Sapiens; identical to SEQ ID NO: 119610

SEQ ID NO: 647960 - RNA, 64 nt, Homo Sapiens; identical to SEQ ID NO: 119611

SEQ ID NO: 647961 - RNA, 64 nt, Homo Sapiens; identical to SEQ ID NO: 119612

SEQ ID NO: 647962 - RNA, 64 nt, Homo Sapiens; identical to SEQ ID NO: 119613

SEQ ID NO: 647963 - RNA, 64 nt, Homo Sapiens; identical to SEQ ID NO: 119614

SEQ ID NO: 647964 - RNA, 64 nt, Homo Sapiens; identical to SEQ ID NO: 119615

SEQ ID NO: 647965 - RNA, 64 nt, Homo Sapiens; identical to SEQ ID NO: 119616

SEQ ID NO: 647966 - RNA, 64 nt, Homo Sapiens; identical to SEQ ID NO: 119617

SEQ ID NO: 647967 - RNA, 64 nt, Homo Sapiens; identical to SEQ ID NO: 119618

SEQ ID NO: 647968 - RNA, 64 nt, Homo Sapiens; identical to SEQ ID NO: 119619

SEQ ID NO: 647969 - RNA, 64 nt, Homo Sapiens; identical to SEQ ID NO: 119620

SEQ ID NO: 647970 - RNA, 64 nt, Homo Sapiens; identical to SEQ ID NO: 119621

SEQ ID NO: 647971 - RNA, 64 nt, Homo Sapiens; identical to SEQ ID NO: 119622

SEQ ID NO: 647972 - RNA, 64 nt, Homo Sapiens; identical to SEQ ID NO: 119623

SEQ ID NO: 647973 - RNA, 64 nt, Homo Sapiens; identical to SEQ ID NO: 119624

SEQ ID NO: 647974 - RNA, 64 nt, Homo Sapiens; identical to SEQ ID NO: 119625

SEQ ID NO: 647975 - RNA, 64 nt, Homo Sapiens; identical to SEQ ID NO: 119626

SEQ ID NO: 647976 - RNA, 64 nt, Homo Sapiens; identical to SEQ ID NO: 119627

SEQ ID NO: 647977 - RNA, 64 nt, Homo Sapiens; identical to SEQ ID NO: 119628

SEQ ID NO: 647978 - RNA, 64 nt, Homo Sapiens; identical to SEQ ID NO: 119629

SEQ ID NO: 647979 - RNA, 64 nt, Homo Sapiens; identical to SEQ ID NO: 119630

SEQ ID NO: 647980 - RNA, 64 nt, Homo Sapiens; identical to SEQ ID NO: 119631

SEQ ID NO: 647981 - RNA, 64 nt, Homo Sapiens; identical to SEQ ID NO: 453185

SEQ ID NO: 647982 - RNA, 64 nt, Homo Sapiens; identical to SEQ ID NO: 453186

SEQ ID NO: 647983 - RNA, 64 nt, Homo Sapiens; identical to SEQ ID NO: 453187

SEQ ID NO: 647984 - RNA, 64 nt, Homo Sapiens; identical to SEQ ID NO: 453188

SEQ ID NO: 647985 - RNA, 64 nt, Homo Sapiens; identical to SEQ ID NO: 453189

SEQ ID NO: 647986 - RNA, 64 nt, Homo Sapiens; identical to SEQ ID NO: 453190

SEQ ID NO: 647987 - RNA, 64 nt, Homo Sapiens; identical to SEQ ID NO: 453191

SEQ ID NO: 647988 - RNA, 64 nt, Homo Sapiens; identical to SEQ ID NO: 453192

SEQ ID NO: 647989 - RNA, 64 nt, Homo Sapiens; identical to SEQ ID NO: 453193

SEQ ID NO: 647990 - RNA, 64 nt, Homo Sapiens; identical to SEQ ID NO: 453194

SEQ ID NO: 647991 - RNA, 64 nt, Homo Sapiens; identical to SEQ ID NO: 453195

SEQ ID NO: 647992 - RNA, 64 nt, Homo Sapiens; identical to SEQ ID NO: 453196

SEQ ID NO: 647993 - RNA, 64 nt, Homo Sapiens; identical to SEQ ID NO: 453197

SEQ ID NO: 647994 - RNA, 64 nt, Homo Sapiens; identical to SEQ ID NO: 453198

SEQ ID NO: 647995 - RNA, 64 nt, Homo Sapiens; identical to SEQ ID NO: 453199

SEQ ID NO: 647996 - RNA, 64 nt, Homo Sapiens; identical to SEQ ID NO: 453200

SEQ ID NO: 647997 - RNA, 64 nt, Homo Sapiens; identical to SEQ ID NO: 453201

SEQ ID NO: 647998 - RNA, 64 nt, Homo Sapiens; identical to SEQ ID NO: 453202

SEQ ID NO: 647999 - RNA, 64 nt, Homo Sapiens; identical to SEQ ID NO: 453203

SEQ ID NO: 648000 - RNA, 64 nt, Homo Sapiens; identical to SEQ ID NO: 453204

SEQ ID NO: 648001 - RNA, 64 nt, Homo Sapiens; identical to SEQ ID NO: 453205

SEQ ID NO: 648002 - RNA, 64 nt, Homo Sapiens; identical to SEQ ID NO: 453206

SEQ ID NO: 648003 - RNA, 64 nt, Homo Sapiens; identical to SEQ ID NO: 453207

SEQ ID NO: 648004 - RNA, 64 nt, Homo Sapiens; identical to SEQ ID NO: 453208

SEQ ID NO: 648005 - RNA, 64 nt, Homo Sapiens; identical to SEQ ID NO: 453209

SEQ ID NO: 648006 - RNA, 64 nt, Homo Sapiens; identical to SEQ ID NO: 453210

SEQ ID NO: 648007 - RNA, 64 nt, Homo Sapiens; identical to SEQ ID NO: 453211

SEQ ID NO: 648008 - RNA, 64 nt, Homo Sapiens; identical to SEQ ID NO: 453212

SEQ ID NO: 648009 - RNA, 64 nt, Homo Sapiens; identical to SEQ ID NO: 453213

SEQ ID NO: 648010 - RNA, 64 nt, Homo Sapiens; identical to SEQ ID NO: 453214

SEQ ID NO: 648011 - RNA, 64 nt, Homo Sapiens; identical to SEQ ID NO: 453215

SEQ ID NO: 648012 - RNA, 64 nt, Homo Sapiens; identical to SEQ ID NO: 453216

SEQ ID NO: 648013 - RNA, 64 nt, Homo Sapiens; identical to SEQ ID NO: 453217

SEQ ID NO: 648014 - RNA, 64 nt, Homo Sapiens; identical to SEQ ID NO: 453218

SEQ ID NO: 648015 - RNA, 64 nt, Homo Sapiens; identical to SEQ ID NO: 453219

SEQ ID NO: 648016 - RNA, 64 nt, Homo Sapiens; identical to SEQ ID NO: 453220

SEQ ID NO: 648017 - RNA, 64 nt, Homo Sapiens; identical to SEQ ID NO: 453221

SEQ ID NO: 648018 - RNA, 64 nt, Homo Sapiens; identical to SEQ ID NO: 453222

SEQ ID NO: 648019 - RNA, 64 nt, Homo Sapiens; identical to SEQ ID NO: 453223

SEQ ID NO: 648020 - RNA, 64 nt, Homo Sapiens; identical to SEQ ID NO: 453224

SEQ ID NO: 648021 - RNA, 64 nt, Homo Sapiens; identical to SEQ ID NO: 453225

SEQ ID NO: 648022 - RNA, 64 nt, Homo Sapiens; identical to SEQ ID NO: 453226

SEQ ID NO: 648023 - RNA, 64 nt, Homo Sapiens; identical to SEQ ID NO: 309634

SEQ ID NO: 648024 - RNA, 64 nt, Homo Sapiens; identical to SEQ ID NO: 309635

SEQ ID NO: 648025 - RNA, 64 nt, Homo Sapiens; identical to SEQ ID NO: 309636

SEQ ID NO: 648026 - RNA, 64 nt, Homo Sapiens; identical to SEQ ID NO: 309637

SEQ ID NO: 648027 - RNA, 64 nt, Homo Sapiens; identical to SEQ ID NO: 309638

SEQ ID NO: 648028 - RNA, 64 nt, Homo Sapiens; identical to SEQ ID NO: 309639

SEQ ID NO: 648029 - RNA, 64 nt, Homo Sapiens; identical to SEQ ID NO: 309640

SEQ ID NO: 648030 - RNA, 64 nt, Homo Sapiens; identical to SEQ ID NO: 309641

SEQ ID NO: 648031 - RNA, 64 nt, Homo Sapiens; identical to SEQ ID NO: 309642

SEQ ID NO: 648032 - RNA, 64 nt, Homo Sapiens; identical to SEQ ID NO: 309643

SEQ ID NO: 648033 - RNA, 64 nt, Homo Sapiens; identical to SEQ ID NO: 309644

SEQ ID NO: 648034 - RNA, 64 nt, Homo Sapiens; identical to SEQ ID NO: 309645

SEQ ID NO: 648035 - RNA, 64 nt, Homo Sapiens; identical to SEQ ID NO: 309646

SEQ ID NO: 648036 - RNA, 64 nt, Homo Sapiens; identical to SEQ ID NO: 309647

SEQ ID NO: 648037 - RNA, 64 nt, Homo Sapiens; identical to SEQ ID NO: 309648

SEQ ID NO: 648038 - RNA, 64 nt, Homo Sapiens; identical to SEQ ID NO: 309649

SEQ ID NO: 648039 - RNA, 64 nt, Homo Sapiens; identical to SEQ ID NO: 309650

SEQ ID NO: 648040 - RNA, 64 nt, Homo Sapiens; identical to SEQ ID NO: 309651

SEQ ID NO: 648041 - RNA, 64 nt, Homo Sapiens; identical to SEQ ID NO: 309652

SEQ ID NO: 648042 - RNA, 64 nt, Homo Sapiens; identical to SEQ ID NO: 309653

SEQ ID NO: 648043 - RNA, 64 nt, Homo Sapiens; identical to SEQ ID NO: 309654

SEQ ID NO: 648044 - RNA, 64 nt, Homo Sapiens; identical to SEQ ID NO: 309655

SEQ ID NO: 648045 - RNA, 64 nt, Homo Sapiens; identical to SEQ ID NO: 309656

SEQ ID NO: 648046 - RNA, 64 nt, Homo Sapiens; identical to SEQ ID NO: 309657

SEQ ID NO: 648047 - RNA, 64 nt, Homo Sapiens; identical to SEQ ID NO: 309658

SEQ ID NO: 648048 - RNA, 64 nt, Homo Sapiens; identical to SEQ ID NO: 309659

SEQ ID NO: 648049 - RNA, 64 nt, Homo Sapiens; identical to SEQ ID NO: 309660

SEQ ID NO: 648050 - RNA, 64 nt, Homo Sapiens; identical to SEQ ID NO: 309661

SEQ ID NO: 648051 - RNA, 64 nt, Homo Sapiens; identical to SEQ ID NO: 309662

SEQ ID NO: 648052 - RNA, 64 nt, Homo Sapiens; identical to SEQ ID NO: 309663

SEQ ID NO: 648053 - RNA, 64 nt, Homo Sapiens; identical to SEQ ID NO: 309664

SEQ ID NO: 648054 - RNA, 64 nt, Homo Sapiens; identical to SEQ ID NO: 309665

SEQ ID NO: 648055 - RNA, 64 nt, Homo Sapiens; identical to SEQ ID NO: 309666

SEQ ID NO: 648056 - RNA, 64 nt, Homo Sapiens; identical to SEQ ID NO: 309667

SEQ ID NO: 648057 - RNA, 64 nt, Homo Sapiens; identical to SEQ ID NO: 309668

SEQ ID NO: 648058 - RNA, 64 nt, Homo Sapiens; identical to SEQ ID NO: 309669

SEQ ID NO: 648059 - RNA, 64 nt, Homo Sapiens; identical to SEQ ID NO: 178992

SEQ ID NO: 648060 - RNA, 64 nt, Homo Sapiens; identical to SEQ ID NO: 178993

SEQ ID NO: 648061 - RNA, 64 nt, Homo Sapiens; identical to SEQ ID NO: 178994

SEQ ID NO: 648062 - RNA, 64 nt, Homo Sapiens; identical to SEQ ID NO: 178995

SEQ ID NO: 648063 - RNA, 64 nt, Homo Sapiens; identical to SEQ ID NO: 178996

SEQ ID NO: 648064 - RNA, 64 nt, Homo Sapiens; identical to SEQ ID NO: 178997

SEQ ID NO: 648065 - RNA, 64 nt, Homo Sapiens; identical to SEQ ID NO: 178998

SEQ ID NO: 648066 - RNA, 64 nt, Homo Sapiens; identical to SEQ ID NO: 178999

SEQ ID NO: 648067 - RNA, 64 nt, Homo Sapiens; identical to SEQ ID NO: 179000

SEQ ID NO: 648068 - RNA, 64 nt, Homo Sapiens; identical to SEQ ID NO: 179001

SEQ ID NO: 648069 - RNA, 64 nt, Homo Sapiens; identical to SEQ ID NO: 179002

SEQ ID NO: 648070 - RNA, 64 nt, Homo Sapiens; identical to SEQ ID NO: 179003

SEQ ID NO: 648071 - RNA, 64 nt, Homo Sapiens; identical to SEQ ID NO: 179004

SEQ ID NO: 648072 - RNA, 64 nt, Homo Sapiens; identical to SEQ ID NO: 179005

SEQ ID NO: 648073 - RNA, 64 nt, Homo Sapiens; identical to SEQ ID NO: 179006

SEQ ID NO: 648074 - RNA, 64 nt, Homo Sapiens; identical to SEQ ID NO: 179007

SEQ ID NO: 648075 - RNA, 64 nt, Homo Sapiens; identical to SEQ ID NO: 179008

SEQ ID NO: 648076 - RNA, 64 nt, Homo Sapiens; identical to SEQ ID NO: 396681

SEQ ID NO: 648077 - RNA, 64 nt, Homo Sapiens; identical to SEQ ID NO: 396682

SEQ ID NO: 648078 - RNA, 64 nt, Homo Sapiens; identical to SEQ ID NO: 396683

SEQ ID NO: 648079 - RNA, 64 nt, Homo Sapiens; identical to SEQ ID NO: 396684

SEQ ID NO: 648080 - RNA, 64 nt, Homo Sapiens
aaaucauaauguauuauuuaaauguuuaacaucauugcauaacagcguuuauuauacaguggca

SEQ ID NO: 648081 - RNA, 64 nt, Homo Sapiens
gagcuucagaaaggggcauuuuguacucuuguuuuugcauaacugguuuuguuuuuuugcagaa

SEQ ID NO: 648082 - RNA, 64 nt, Homo Sapiens
cuggccugugauugguccauuccaggaccuucauuugcauaagguaucaaaccacaucagccuc

SEQ ID NO: 648083 - RNA, 64 nt, Homo Sapiens
cuggccaaugauugguucauuccaggacauucauuugcauaaggagucaaaccacaccagucuu

SEQ ID NO: 648084 - RNA, 64 nt, Homo Sapiens
uuuaaaagagagagagagaaaaaaaaaauaguauuugcauaacccugagcggugggggaggagg

SEQ ID NO: 648085 - RNA, 64 nt, Homo Sapiens
cagcuguguuauucuuugcguguagcuauggaaguugcauaauuauuauuauuauuauuauaac

SEQ ID NO: 648086 - RNA, 64 nt, Homo Sapiens
agagaugaagacuucucaauaugcuuauuuugcuuugcauaauuggcucuuuuuaagagcccaa

SEQ ID NO: 648087 - RNA, 64 nt, Homo Sapiens
auauuauuuuagguaauauuuguacuuuaacauguugcauaauauaugcuuauguagcuuucca

SEQ ID NO: 648088 - RNA, 64 nt, Homo Sapiens; identical to SEQ ID NO: 536153

SEQ ID NO: 648089 - RNA, 64 nt, Homo Sapiens; identical to SEQ ID NO: 536154

SEQ ID NO: 648090 - RNA, 64 nt, Homo Sapiens; identical to SEQ ID NO: 536155

SEQ ID NO: 648091 - RNA, 64 nt, Homo Sapiens; identical to SEQ ID NO: 536156

SEQ ID NO: 648092 - RNA, 64 nt, Homo Sapiens; identical to SEQ ID NO: 536157

SEQ ID NO: 648093 - RNA, 64 nt, Homo Sapiens; identical to SEQ ID NO: 536158

SEQ ID NO: 648094 - RNA, 64 nt, Homo Sapiens; identical to SEQ ID NO: 536159

SEQ ID NO: 648095 - RNA, 64 nt, Homo Sapiens; identical to SEQ ID NO: 536160

SEQ ID NO: 648096 - RNA, 64 nt, Homo Sapiens; identical to SEQ ID NO: 536161

SEQ ID NO: 648097 - RNA, 64 nt, Homo Sapiens; identical to SEQ ID NO: 536162

SEQ ID NO: 648098 - RNA, 64 nt, Homo Sapiens; identical to SEQ ID NO: 536163

SEQ ID NO: 648099 - RNA, 64 nt, Homo Sapiens; identical to SEQ ID NO: 536164

SEQ ID NO: 648100 - RNA, 64 nt, Homo Sapiens; identical to SEQ ID NO: 153305

SEQ ID NO: 648101 - RNA, 64 nt, Homo Sapiens; identical to SEQ ID NO: 153306

SEQ ID NO: 648102 - RNA, 53 nt, Homo Sapiens; identical to SEQ ID NO: 153307

SEQ ID NO: 648103 - RNA, 64 nt, Homo Sapiens; identical to SEQ ID NO: 153308

SEQ ID NO: 648104 - RNA, 64 nt, Homo Sapiens; identical to SEQ ID NO: 153309

SEQ ID NO: 648105 - RNA, 64 nt, Homo Sapiens; identical to SEQ ID NO: 153310

SEQ ID NO: 648106 - RNA, 64 nt, Homo Sapiens; identical to SEQ ID NO: 153311

SEQ ID NO: 648107 - RNA, 64 nt, Homo Sapiens; identical to SEQ ID NO: 153312

SEQ ID NO: 648108 - RNA, 64 nt, Homo Sapiens; identical to SEQ ID NO: 153313

SEQ ID NO: 648109 - RNA, 64 nt, Homo Sapiens; identical to SEQ ID NO: 153314

SEQ ID NO: 648110 - RNA, 64 nt, Homo Sapiens; identical to SEQ ID NO: 153315

SEQ ID NO: 648111 - RNA, 64 nt, Homo Sapiens; identical to SEQ ID NO: 153312

SEQ ID NO: 648112 - RNA, 64 nt, Homo Sapiens; identical to SEQ ID NO: 153317

SEQ ID NO: 648113 - RNA, 64 nt, Homo Sapiens; identical to SEQ ID NO: 153318

SEQ ID NO: 648114 - RNA, 64 nt, Homo Sapiens; identical to SEQ ID NO: 153315

SEQ ID NO: 648115 - RNA, 64 nt, Homo Sapiens; identical to SEQ ID NO: 153320

SEQ ID NO: 648116 - RNA, 64 nt, Homo Sapiens; identical to SEQ ID NO: 153321

SEQ ID NO: 648117 - RNA, 64 nt, Homo Sapiens; identical to SEQ ID NO: 153322

SEQ ID NO: 648118 - RNA, 64 nt, Homo Sapiens; identical to SEQ ID NO: 153323

SEQ ID NO: 648119 - RNA, 64 nt, Homo Sapiens; identical to SEQ ID NO: 153324

SEQ ID NO: 648120 - RNA, 64 nt, Homo Sapiens; identical to SEQ ID NO: 153325

SEQ ID NO: 648121 - RNA, 64 nt, Homo Sapiens; identical to SEQ ID NO: 153326

SEQ ID NO: 648122 - RNA, 64 nt, Homo Sapiens; identical to SEQ ID NO: 153327

SEQ ID NO: 648123 - RNA, 64 nt, Homo Sapiens; identical to SEQ ID NO: 153328

SEQ ID NO: 648124 - RNA, 64 nt, Homo Sapiens; identical to SEQ ID NO: 153329

SEQ ID NO: 648125 - RNA, 64 nt, Homo Sapiens; identical to SEQ ID NO: 153330

SEQ ID NO: 648126 - RNA, 64 nt, Homo Sapiens; identical to SEQ ID NO: 153331

SEQ ID NO: 648127 - RNA, 64 nt, Homo Sapiens; identical to SEQ ID NO: 153332

SEQ ID NO: 648128 - RNA, 64 nt, Homo Sapiens; identical to SEQ ID NO: 153333

SEQ ID NO: 648129 - RNA, 64 nt, Homo Sapiens; identical to SEQ ID NO: 153334

SEQ ID NO: 648130 - RNA, 64 nt, Homo Sapiens; identical to SEQ ID NO: 153335

SEQ ID NO: 648131 - RNA, 64 nt, Homo Sapiens; identical to SEQ ID NO: 153336

SEQ ID NO: 648132 - RNA, 64 nt, Homo Sapiens; identical to SEQ ID NO: 153337

SEQ ID NO: 648133 - RNA, 64 nt, Homo Sapiens; identical to SEQ ID NO: 153338

SEQ ID NO: 648134 - RNA, 64 nt, Homo Sapiens; identical to SEQ ID NO: 153339

SEQ ID NO: 648135 - RNA, 64 nt, Homo Sapiens; identical to SEQ ID NO: 153340

SEQ ID NO: 648136 - RNA, 64 nt, Homo Sapiens; identical to SEQ ID NO: 153341

SEQ ID NO: 648137 - RNA, 64 nt, Homo Sapiens; identical to SEQ ID NO: 153342

SEQ ID NO: 648138 - RNA, 64 nt, Homo Sapiens; identical to SEQ ID NO: 153343

SEQ ID NO: 648139 - RNA, 64 nt, Homo Sapiens; identical to SEQ ID NO: 153344

SEQ ID NO: 648140 - RNA, 64 nt, Homo Sapiens; identical to SEQ ID NO: 153345

SEQ ID NO: 648141 - RNA, 64 nt, Homo Sapiens; identical to SEQ ID NO: 153346

SEQ ID NO: 648142 - RNA, 51 nt, Homo Sapiens; identical to SEQ ID NO: 153347

SEQ ID NO: 648143 - RNA, 64 nt, Homo Sapiens; identical to SEQ ID NO: 153348

SEQ ID NO: 648144 - RNA, 64 nt, Homo Sapiens; identical to SEQ ID NO: 153349

SEQ ID NO: 648145 - RNA, 64 nt, Homo Sapiens; identical to SEQ ID NO: 153350

SEQ ID NO: 648146 - RNA, 64 nt, Homo Sapiens; identical to SEQ ID NO: 153351

SEQ ID NO: 648147 - RNA, 64 nt, Homo Sapiens; identical to SEQ ID NO: 153352

SEQ ID NO: 648148 - RNA, 64 nt, Homo Sapiens; identical to SEQ ID NO: 153353

SEQ ID NO: 648149 - RNA, 64 nt, Homo Sapiens; identical to SEQ ID NO: 153354

SEQ ID NO: 648150 - RNA, 64 nt, Homo Sapiens; identical to SEQ ID NO: 153355

SEQ ID NO: 648151 - RNA, 64 nt, Homo Sapiens; identical to SEQ ID NO: 153356

SEQ ID NO: 648152 - RNA, 64 nt, Homo Sapiens; identical to SEQ ID NO: 153357

SEQ ID NO: 648153 - RNA, 64 nt, Homo Sapiens; identical to SEQ ID NO: 153358

SEQ ID NO: 648154 - RNA, 64 nt, Homo Sapiens; identical to SEQ ID NO: 153359

SEQ ID NO: 648155 - RNA, 64 nt, Homo Sapiens; identical to SEQ ID NO: 307734

SEQ ID NO: 648156 - RNA, 64 nt, Homo Sapiens; identical to SEQ ID NO: 307735

SEQ ID NO: 648157 - RNA, 64 nt, Homo Sapiens; identical to SEQ ID NO: 307736

SEQ ID NO: 648158 - RNA, 64 nt, Homo Sapiens; identical to SEQ ID NO: 307737

SEQ ID NO: 648159 - RNA, 64 nt, Homo Sapiens; identical to SEQ ID NO: 307738

SEQ ID NO: 648160 - RNA, 64 nt, Homo Sapiens; identical to SEQ ID NO: 307739

SEQ ID NO: 648161 - RNA, 64 nt, Homo Sapiens; identical to SEQ ID NO: 307740

SEQ ID NO: 648162 - RNA, 64 nt, Homo Sapiens; identical to SEQ ID NO: 307741

SEQ ID NO: 648163 - RNA, 59 nt, Homo Sapiens; identical to SEQ ID NO: 307742

SEQ ID NO: 648164 - RNA, 64 nt, Homo Sapiens; identical to SEQ ID NO: 307743

SEQ ID NO: 648165 - RNA, 64 nt, Homo Sapiens; identical to SEQ ID NO: 307744

SEQ ID NO: 648166 - RNA, 64 nt, Homo Sapiens; identical to SEQ ID NO: 307745

SEQ ID NO: 648167 - RNA, 64 nt, Homo Sapiens; identical to SEQ ID NO: 307746

SEQ ID NO: 648168 - RNA, 64 nt, Homo Sapiens; identical to SEQ ID NO: 307747

SEQ ID NO: 648169 - RNA, 64 nt, Homo Sapiens; identical to SEQ ID NO: 307748

SEQ ID NO: 648170 - RNA, 64 nt, Homo Sapiens; identical to SEQ ID NO: 307749

SEQ ID NO: 648171 - RNA, 64 nt, Homo Sapiens; identical to SEQ ID NO: 307750

SEQ ID NO: 648172 - RNA, 64 nt, Homo Sapiens; identical to SEQ ID NO: 307751

SEQ ID NO: 648173 - RNA, 64 nt, Homo Sapiens; identical to SEQ ID NO: 307752

SEQ ID NO: 648174 - RNA, 64 nt, Homo Sapiens; identical to SEQ ID NO: 307753

SEQ ID NO: 648175 - RNA, 64 nt, Homo Sapiens; identical to SEQ ID NO: 307754

SEQ ID NO: 648176 - RNA, 64 nt, Homo Sapiens; identical to SEQ ID NO: 307755

SEQ ID NO: 648177 - RNA, 64 nt, Homo Sapiens; identical to SEQ ID NO: 307756

SEQ ID NO: 648178 - RNA, 64 nt, Homo Sapiens; identical to SEQ ID NO: 307757

SEQ ID NO: 648179 - RNA, 64 nt, Homo Sapiens; identical to SEQ ID NO: 307758

SEQ ID NO: 648180 - RNA, 64 nt, Homo Sapiens; identical to SEQ ID NO: 307759

SEQ ID NO: 648181 - RNA, 64 nt, Homo Sapiens; identical to SEQ ID NO: 307760

SEQ ID NO: 648182 - RNA, 64 nt, Homo Sapiens; identical to SEQ ID NO: 307761

SEQ ID NO: 648183 - RNA, 64 nt, Homo Sapiens; identical to SEQ ID NO: 307762

SEQ ID NO: 648184 - RNA, 64 nt, Homo Sapiens; identical to SEQ ID NO: 307763

SEQ ID NO: 648185 - RNA, 64 nt, Homo Sapiens; identical to SEQ ID NO: 307764

SEQ ID NO: 648186 - RNA, 64 nt, Homo Sapiens; identical to SEQ ID NO: 307765

SEQ ID NO: 648187 - RNA, 64 nt, Homo Sapiens; identical to SEQ ID NO: 307766

SEQ ID NO: 648188 - RNA, 64 nt, Homo Sapiens; identical to SEQ ID NO: 307767

SEQ ID NO: 648189 - RNA, 64 nt, Homo Sapiens; identical to SEQ ID NO: 307768

SEQ ID NO: 648190 - RNA, 64 nt, Homo Sapiens; identical to SEQ ID NO: 307769

SEQ ID NO: 648191 - RNA, 64 nt, Homo Sapiens; identical to SEQ ID NO: 307770

SEQ ID NO: 648192 - RNA, 64 nt, Homo Sapiens; identical to SEQ ID NO: 307771

SEQ ID NO: 648193 - RNA, 64 nt, Homo Sapiens; identical to SEQ ID NO: 307772

SEQ ID NO: 648194 - RNA, 64 nt, Homo Sapiens; identical to SEQ ID NO: 307773

SEQ ID NO: 648195 - RNA, 64 nt, Homo Sapiens; identical to SEQ ID NO: 307774

SEQ ID NO: 648196 - RNA, 64 nt, Homo Sapiens; identical to SEQ ID NO: 307775

SEQ ID NO: 648197 - RNA, 64 nt, Homo Sapiens; identical to SEQ ID NO: 307776

SEQ ID NO: 648198 - RNA, 64 nt, Homo Sapiens; identical to SEQ ID NO: 307777

SEQ ID NO: 648199 - RNA, 64 nt, Homo Sapiens; identical to SEQ ID NO: 307778

SEQ ID NO: 648200 - RNA, 64 nt, Homo Sapiens; identical to SEQ ID NO: 307779

SEQ ID NO: 648201 - RNA, 64 nt, Homo Sapiens; identical to SEQ ID NO: 307780

SEQ ID NO: 648202 - RNA, 64 nt, Homo Sapiens; identical to SEQ ID NO: 307781

SEQ ID NO: 648203 - RNA, 64 nt, Homo Sapiens; identical to SEQ ID NO: 307782

SEQ ID NO: 648204 - RNA, 64 nt, Homo Sapiens; identical to SEQ ID NO: 307783

SEQ ID NO: 648205 - RNA, 64 nt, Homo Sapiens; identical to SEQ ID NO: 307784

SEQ ID NO: 648206 - RNA, 64 nt, Homo Sapiens; identical to SEQ ID NO: 307785

SEQ ID NO: 648207 - RNA, 64 nt, Homo Sapiens; identical to SEQ ID NO: 307786

SEQ ID NO: 648208 - RNA, 64 nt, Homo Sapiens; identical to SEQ ID NO: 307787

SEQ ID NO: 648209 - RNA, 64 nt, Homo Sapiens; identical to SEQ ID NO: 307788

SEQ ID NO: 648210 - RNA, 64 nt, Homo Sapiens; identical to SEQ ID NO: 307789

SEQ ID NO: 648211 - RNA, 64 nt, Homo Sapiens; identical to SEQ ID NO: 307790

SEQ ID NO: 648212 - RNA, 64 nt, Homo Sapiens; identical to SEQ ID NO: 307791

SEQ ID NO: 648213 - RNA, 64 nt, Homo Sapiens; identical to SEQ ID NO: 307792

SEQ ID NO: 648214 - RNA, 64 nt, Homo Sapiens; identical to SEQ ID NO: 307793

SEQ ID NO: 648215 - RNA, 64 nt, Homo Sapiens; identical to SEQ ID NO: 307794

SEQ ID NO: 648216 - RNA, 64 nt, Homo Sapiens; identical to SEQ ID NO: 307795

SEQ ID NO: 648217 - RNA, 64 nt, Homo Sapiens; identical to SEQ ID NO: 307796

SEQ ID NO: 648218 - RNA, 62 nt, Homo Sapiens; identical to SEQ ID NO: 307797

SEQ ID NO: 648219 - RNA, 64 nt, Homo Sapiens; identical to SEQ ID NO: 307798

SEQ ID NO: 648220 - RNA, 64 nt, Homo Sapiens; identical to SEQ ID NO: 307799

SEQ ID NO: 648221 - RNA, 64 nt, Homo Sapiens; identical to SEQ ID NO: 307800

SEQ ID NO: 648222 - RNA, 64 nt, Homo Sapiens; identical to SEQ ID NO: 307801

SEQ ID NO: 648223 - RNA, 64 nt, Homo Sapiens; identical to SEQ ID NO: 307802

SEQ ID NO: 648224 - RNA, 64 nt, Homo Sapiens; identical to SEQ ID NO: 307803

SEQ ID NO: 648225 - RNA, 64 nt, Homo Sapiens; identical to SEQ ID NO: 307804

SEQ ID NO: 648226 - RNA, 64 nt, Homo Sapiens; identical to SEQ ID NO: 307805

SEQ ID NO: 648227 - RNA, 64 nt, Homo Sapiens; identical to SEQ ID NO: 307806

SEQ ID NO: 648228 - RNA, 64 nt, Homo Sapiens; identical to SEQ ID NO: 307807

SEQ ID NO: 648229 - RNA, 64 nt, Homo Sapiens; identical to SEQ ID NO: 307808

SEQ ID NO: 648230 - RNA, 64 nt, Homo Sapiens; identical to SEQ ID NO: 307809

SEQ ID NO: 648231 - RNA, 64 nt, Homo Sapiens; identical to SEQ ID NO: 433812

SEQ ID NO: 648232 - RNA, 64 nt, Homo Sapiens; identical to SEQ ID NO: 433813

SEQ ID NO: 648233 - RNA, 64 nt, Homo Sapiens; identical to SEQ ID NO: 433814

SEQ ID NO: 648234 - RNA, 64 nt, Homo Sapiens; identical to SEQ ID NO: 433815

SEQ ID NO: 648235 - RNA, 64 nt, Homo Sapiens; identical to SEQ ID NO: 433816

SEQ ID NO: 648236 - RNA, 64 nt, Homo Sapiens; identical to SEQ ID NO: 433817

SEQ ID NO: 648237 - RNA, 64 nt, Homo Sapiens; identical to SEQ ID NO: 433818

SEQ ID NO: 648238 - RNA, 64 nt, Homo Sapiens; identical to SEQ ID NO: 433819

SEQ ID NO: 648239 - RNA, 64 nt, Homo Sapiens; identical to SEQ ID NO: 433820

SEQ ID NO: 648240 - RNA, 64 nt, Homo Sapiens; identical to SEQ ID NO: 433821

SEQ ID NO: 648241 - RNA, 64 nt, Homo Sapiens; identical to SEQ ID NO: 433822

SEQ ID NO: 648242 - RNA, 64 nt, Homo Sapiens; identical to SEQ ID NO: 433823

SEQ ID NO: 648243 - RNA, 64 nt, Homo Sapiens; identical to SEQ ID NO: 433824

SEQ ID NO: 648244 - RNA, 64 nt, Homo Sapiens; identical to SEQ ID NO: 433825

SEQ ID NO: 648245 - RNA, 64 nt, Homo Sapiens; identical to SEQ ID NO: 433826

SEQ ID NO: 648246 - RNA, 64 nt, Homo Sapiens; identical to SEQ ID NO: 433827

SEQ ID NO: 648247 - RNA, 64 nt, Homo Sapiens; identical to SEQ ID NO: 433828

SEQ ID NO: 648248 - RNA, 64 nt, Homo Sapiens; identical to SEQ ID NO: 433829

SEQ ID NO: 648249 - RNA, 64 nt, Homo Sapiens; identical to SEQ ID NO: 433830

SEQ ID NO: 648250 - RNA, 64 nt, Homo Sapiens; identical to SEQ ID NO: 433831

SEQ ID NO: 648251 - RNA, 64 nt, Homo Sapiens; identical to SEQ ID NO: 433832

SEQ ID NO: 648252 - RNA, 64 nt, Homo Sapiens; identical to SEQ ID NO: 433833

SEQ ID NO: 648253 - RNA, 64 nt, Homo Sapiens; identical to SEQ ID NO: 433834

SEQ ID NO: 648254 - RNA, 64 nt, Homo Sapiens; identical to SEQ ID NO: 433835

SEQ ID NO: 648255 - RNA, 64 nt, Homo Sapiens; identical to SEQ ID NO: 433836

SEQ ID NO: 648256 - RNA, 64 nt, Homo Sapiens; identical to SEQ ID NO: 433837

SEQ ID NO: 648257 - RNA, 64 nt, Homo Sapiens; identical to SEQ ID NO: 433838

SEQ ID NO: 648258 - RNA, 64 nt, Homo Sapiens; identical to SEQ ID NO: 433839

SEQ ID NO: 648259 - RNA, 64 nt, Homo Sapiens; identical to SEQ ID NO: 433840

SEQ ID NO: 648260 - RNA, 64 nt, Homo Sapiens; identical to SEQ ID NO: 433841

SEQ ID NO: 648261 - RNA, 64 nt, Homo Sapiens; identical to SEQ ID NO: 433842

SEQ ID NO: 648262 - RNA, 64 nt, Homo Sapiens; identical to SEQ ID NO: 433843

SEQ ID NO: 648263 - RNA, 64 nt, Homo Sapiens; identical to SEQ ID NO: 433844

SEQ ID NO: 648264 - RNA, 64 nt, Homo Sapiens; identical to SEQ ID NO: 433845

SEQ ID NO: 648265 - RNA, 64 nt, Homo Sapiens; identical to SEQ ID NO: 433846

SEQ ID NO: 648266 - RNA, 64 nt, Homo Sapiens; identical to SEQ ID NO: 433847

SEQ ID NO: 648267 - RNA, 64 nt, Homo Sapiens; identical to SEQ ID NO: 433848

SEQ ID NO: 648268 - RNA, 64 nt, Homo Sapiens; identical to SEQ ID NO: 433849

SEQ ID NO: 648269 - RNA, 64 nt, Homo Sapiens; identical to SEQ ID NO: 433850

SEQ ID NO: 648270 - RNA, 64 nt, Homo Sapiens; identical to SEQ ID NO: 433851

SEQ ID NO: 648271 - RNA, 64 nt, Homo Sapiens; identical to SEQ ID NO: 433852

SEQ ID NO: 648272 - RNA, 64 nt, Homo Sapiens; identical to SEQ ID NO: 433853

SEQ ID NO: 648273 - RNA, 64 nt, Homo Sapiens; identical to SEQ ID NO: 433854

SEQ ID NO: 648274 - RNA, 64 nt, Homo Sapiens; identical to SEQ ID NO: 433855

SEQ ID NO: 648275 - RNA, 64 nt, Homo Sapiens; identical to SEQ ID NO: 433856

SEQ ID NO: 648276 - RNA, 64 nt, Homo Sapiens; identical to SEQ ID NO: 433857

SEQ ID NO: 648277 - RNA, 64 nt, Homo Sapiens; identical to SEQ ID NO: 433858

SEQ ID NO: 648278 - RNA, 64 nt, Homo Sapiens; identical to SEQ ID NO: 433859

SEQ ID NO: 648279 - RNA, 64 nt, Homo Sapiens; identical to SEQ ID NO: 433860

SEQ ID NO: 648280 - RNA, 64 nt, Homo Sapiens
cuagucaauacuacuuuauguaaacagcaguguaaaauccaaaaacuuccaguccuggaggcag

SEQ ID NO: 648281 - RNA, 64 nt, Homo Sapiens
acucacauuacagcugaugugaaagagauucuggaaauccaaauguuccccagaaauucugaua

SEQ ID NO: 648282 - RNA, 64 nt, Homo Sapiens
cugcuuuuggucuugcuucuagcaugagaaaaaaaaauccaacuaagguaaaaucugauuauuu

SEQ ID NO: 648283 - RNA, 64 nt, Homo Sapiens
agcaaccagaaauguucuagacuggcccacuggcaaauccaacccccucauucccgcugaccuc

SEQ ID NO: 648284 - RNA, 64 nt, Homo Sapiens
uucaaaaugcuccaauaagcguauccaaauccaaaaauccaaaagcauuauauuuagcgguuga

SEQ ID NO: 648285 - RNA, 64 nt, Homo Sapiens
auccaaaauucaaaaugcucgcgguugaguauccaaauccaaaagaauauuugcauuauauuua

SEQ ID NO: 648286 - RNA, 64 nt, Homo Sapiens
ucuuggugcauuauuuuuucgccagaaauguuagaaauccaaaaacccuuuacucucucauaca

SEQ ID NO: 648287 - RNA, 64 nt, Homo Sapiens
auguaaaaugaaacuguugcauuuguaaauuucuaaauccaaucagaauucuuaugaguuuaaa

SEQ ID NO: 648288 - RNA, 64 nt, Homo Sapiens
gcaugaugcuagcaucugguuucuggaaccugggaaauccaaagaaaauuuauuuggcucacag

SEQ ID NO: 648289 - RNA, 64 nt, Homo Sapiens
uauuaaguaccauuagcuacuaguauaaaugagaaaauccaagccuauuucugauuauuaagac

SEQ ID NO: 648290 - RNA, 64 nt, Homo Sapiens
caaaacaaauccugcauuuagauacaccucaacuaaauccaaaguccccauucaguauauucca

SEQ ID NO: 648291 - RNA, 64 nt, Homo Sapiens
caugaguuccuagagaacuguccaaggguugggaaaauccaaauucucuuccugguuccagcac

SEQ ID NO: 648292 - RNA, 64 nt, Homo Sapiens
acaagacauacaacauaacaaaaaguguugcuguaaauccaaaagaaauugcaucuaagggacu

SEQ ID NO: 648293 - RNA, 64 nt, Homo Sapiens
uuucuucagugggccauuguuuuagauauuuaaaaaauccaacaguuucuaucauaauguaacu

SEQ ID NO: 648294 - RNA, 64 nt, Homo Sapiens
gugccuugaauuguacagagaaaaaaccaacaaaaaauccaaguuccguuguuaaaaagcaaac

SEQ ID NO: 648295 - RNA, 64 nt, Homo Sapiens
uaagauuguucugaaauacaugaaauuaaaucaaaaauccaaaguaaugcugacugaauuucag

SEQ ID NO: 648296 - RNA, 64 nt, Homo Sapiens
uuaccauauuauuguuuuuaguuuaaguuccacaaaauccaaauacuguguuugacaugagaua

SEQ ID NO: 648297 - RNA, 64 nt, Homo Sapiens
uugcacuguguuugacaugacugucauaauccugaaauccaaaaguagccuguuucuaacacaa

SEQ ID NO: 648298 - RNA, 64 nt, Homo Sapiens
aaagcccaccuagaaauagauauuugaugaaagaaaauccaaauugagugaggguuauuauuug

SEQ ID NO: 648299 - RNA, 64 nt, Homo Sapiens
gaaaucuagaagucacaagcguagccuuuaguuuaaauccaacagcaaaugauaagcuauucua

SEQ ID NO: 648300 - RNA, 64 nt, Homo Sapiens
uuccuucucuugaguuccucaacaggugcucaauaaauccaaguuaugcgacaugcccugccug

SEQ ID NO: 648301 - RNA, 64 nt, Homo Sapiens
gacgcugccggucggucagaaccucaaaauuauuaaauccaacauuguuuuauuuucuugagag

SEQ ID NO: 648302 - RNA, 64 nt, Homo Sapiens
ccacuuuaggaaacuagaaaaagaagagcaaauuaaauccaaaguaaccugaaaaaacauuaga

SEQ ID NO: 648303 - RNA, 64 nt, Homo Sapiens
aucauaucaauagguacagaaaaagcauuugacaaaauccaauauccauucauguuaaaaccuc

SEQ ID NO: 648304 - RNA, 64 nt, Homo Sapiens
gcaugagauuuuucuauccaggauaaaaucuuccaaauccaaaaugagacccaaaggaagaacu

SEQ ID NO: 648305 - RNA, 64 nt, Homo Sapiens
ugcuggcaccaagcguauucuuggaaacugagcgaaauccaagacuccccuuuguggauucuuu

SEQ ID NO: 648306 - RNA, 64 nt, Homo Sapiens
uccauucaugauaaaaccucaaaagcauuugacaaaauccaauaaucauaucaauagguacaga

SEQ ID NO: 648307 - RNA, 64 nt, Homo Sapiens
uaaccuggaaaaaaauuagaaagaagagcaaauuaaauccaaagccacuuuggaaaacuagaaa

SEQ ID NO: 648308 - RNA, 64 nt, Homo Sapiens
agguauauccgugcucagaguggaaugcagcaguaaauccaaguaccugugcaauauuuuccca

SEQ ID NO: 648309 - RNA, 64 nt, Homo Sapiens
caaucagugagaagaauagcaaauucaaugaaucaaauccaauccaucacuuaauuacuuacuc

SEQ ID NO: 648310 - RNA, 64 nt, Homo Sapiens
ugcauguagaguugacaugucaggacuagccugaaaauccaaaaaauauacaauuucuugaacu

SEQ ID NO: 648311 - RNA, 64 nt, Homo Sapiens
ccaucuaaauugacucuuccaauauaggucucagaaauccaauauuuggaguacaauuucuuuu

SEQ ID NO: 648312 - RNA, 64 nt, Homo Sapiens
cuaaucugaacaguuaaaacccccaaaugccccaaaauccaaaccuuccugaacgcuaugacac

SEQ ID NO: 648313 - RNA, 64 nt, Homo Sapiens
gcacucggcaggacauuucuauccagcaaugcucaaauccaaaaucaacaagacacaagcaaaa

SEQ ID NO: 648314 - RNA, 64 nt, Homo Sapiens
gagagaagaguuuuugcauuaaaaaagaaaaaaaaaauccaaaaaaaaaaaaaaaaaaaaaaag

SEQ ID NO: 648315 - RNA, 64 nt, Homo Sapiens
uuuguuugucacugccaaagaacacaagaaaucaaaauccaaaaaaaggaaauccaaaaaagca

SEQ ID NO: 648316 - RNA, 64 nt, Homo Sapiens
aagcaaacacaagaaaucaacucugcuccaaaggaaauccaaaagccaaggauaccggacacac

SEQ ID NO: 648317 - RNA, 64 nt, Homo Sapiens
aguuuuuuuaaaaaagcaaauuggcuuuaaguaaaaauccaaaauuccuguaauguuaaacucu

SEQ ID NO: 648318 - RNA, 64 nt, Homo Sapiens
agacuagccaaaaaugccguggcaaagagcucagaaauccaauuuggauaccaaagguuucuca

SEQ ID NO: 648319 - RNA, 64 nt, Homo Sapiens
gguggggaaggaggugaugaaacauuaguuugugaaauccaaggcccuggcuugcuuucuuucu

SEQ ID NO: 648320 - RNA, 64 nt, Homo Sapiens
aaagaccagaauauaaaaagcauauacaaaaauaaaauccaacuuuuagcuuucuacuuuauau

SEQ ID NO: 648321 - RNA, 64 nt, Homo Sapiens
agauacaggaauucuguguagagcauucauacaaaaauccaagaucaagcaguaguaagauagu

SEQ ID NO: 648322 - RNA, 64 nt, Homo Sapiens
cuuuucccaccucuuuggauggggacuagaacacaaauccaacgcaauaagccacugguaucug

SEQ ID NO: 648323 - RNA, 64 nt, Homo Sapiens
cugacuguaaaauacauggugggagcaugaagauaaauccaacuaaauaguguggagugaggcg

SEQ ID NO: 648324 - RNA, 64 nt, Homo Sapiens; identical to SEQ ID NO: 154556

SEQ ID NO: 648325 - RNA, 64 nt, Homo Sapiens; identical to SEQ ID NO: 154557

SEQ ID NO: 648326 - RNA, 64 nt, Homo Sapiens; identical to SEQ ID NO: 154558

SEQ ID NO: 648327 - RNA, 64 nt, Homo Sapiens; identical to SEQ ID NO: 154559

SEQ ID NO: 648328 - RNA, 64 nt, Homo Sapiens; identical to SEQ ID NO: 154560

SEQ ID NO: 648329 - RNA, 64 nt, Homo Sapiens; identical to SEQ ID NO: 154561

SEQ ID NO: 648330 - RNA, 64 nt, Homo Sapiens; identical to SEQ ID NO: 154562

SEQ ID NO: 648331 - RNA, 64 nt, Homo Sapiens; identical to SEQ ID NO: 154563

SEQ ID NO: 648332 - RNA, 64 nt, Homo Sapiens; identical to SEQ ID NO: 154564

SEQ ID NO: 648333 - RNA, 64 nt, Homo Sapiens; identical to SEQ ID NO: 154565

SEQ ID NO: 648334 - RNA, 64 nt, Homo Sapiens; identical to SEQ ID NO: 154566

SEQ ID NO: 648335 - RNA, 64 nt, Homo Sapiens; identical to SEQ ID NO: 154567

SEQ ID NO: 648336 - RNA, 64 nt, Homo Sapiens; identical to SEQ ID NO: 154568

SEQ ID NO: 648337 - RNA, 64 nt, Homo Sapiens; identical to SEQ ID NO: 154569

SEQ ID NO: 648338 - RNA, 64 nt, Homo Sapiens; identical to SEQ ID NO: 154570

SEQ ID NO: 648339 - RNA, 64 nt, Homo Sapiens; identical to SEQ ID NO: 154571

SEQ ID NO: 648340 - RNA, 64 nt, Homo Sapiens; identical to SEQ ID NO: 154572

SEQ ID NO: 648341 - RNA, 64 nt, Homo Sapiens; identical to SEQ ID NO: 154573

SEQ ID NO: 648342 - RNA, 64 nt, Homo Sapiens; identical to SEQ ID NO: 154574

SEQ ID NO: 648343 - RNA, 64 nt, Homo Sapiens; identical to SEQ ID NO: 154575

SEQ ID NO: 648344 - RNA, 64 nt, Homo Sapiens; identical to SEQ ID NO: 154576

SEQ ID NO: 648345 - RNA, 64 nt, Homo Sapiens; identical to SEQ ID NO: 154577

SEQ ID NO: 648346 - RNA, 64 nt, Homo Sapiens; identical to SEQ ID NO: 154578

SEQ ID NO: 648347 - RNA, 64 nt, Homo Sapiens; identical to SEQ ID NO: 154579

SEQ ID NO: 648348 - RNA, 64 nt, Homo Sapiens; identical to SEQ ID NO: 154580

SEQ ID NO: 648349 - RNA, 64 nt, Homo Sapiens; identical to SEQ ID NO: 154581

SEQ ID NO: 648350 - RNA, 64 nt, Homo Sapiens; identical to SEQ ID NO: 179620

SEQ ID NO: 648351 - RNA, 64 nt, Homo Sapiens; identical to SEQ ID NO: 179621

SEQ ID NO: 648352 - RNA, 64 nt, Homo Sapiens; identical to SEQ ID NO: 179622

SEQ ID NO: 648353 - RNA, 64 nt, Homo Sapiens; identical to SEQ ID NO: 179623

SEQ ID NO: 648354 - RNA, 64 nt, Homo Sapiens; identical to SEQ ID NO: 179624

SEQ ID NO: 648355 - RNA, 64 nt, Homo Sapiens; identical to SEQ ID NO: 179625

SEQ ID NO: 648356 - RNA, 64 nt, Homo Sapiens; identical to SEQ ID NO: 179626

SEQ ID NO: 648357 - RNA, 64 nt, Homo Sapiens; identical to SEQ ID NO: 179627

SEQ ID NO: 648358 - RNA, 64 nt, Homo Sapiens; identical to SEQ ID NO: 441009

SEQ ID NO: 648359 - RNA, 64 nt, Homo Sapiens; identical to SEQ ID NO: 441010

SEQ ID NO: 648360 - RNA, 64 nt, Homo Sapiens; identical to SEQ ID NO: 441011

SEQ ID NO: 648361 - RNA, 64 nt, Homo Sapiens; identical to SEQ ID NO: 441012

SEQ ID NO: 648362 - RNA, 64 nt, Homo Sapiens; identical to SEQ ID NO: 441013

SEQ ID NO: 648363 - RNA, 64 nt, Homo Sapiens; identical to SEQ ID NO: 441014

SEQ ID NO: 648364 - RNA, 64 nt, Homo Sapiens; identical to SEQ ID NO: 441015

SEQ ID NO: 648365 - RNA, 64 nt, Homo Sapiens; identical to SEQ ID NO: 243972

SEQ ID NO: 648366 - RNA, 64 nt, Homo Sapiens; identical to SEQ ID NO: 243973

SEQ ID NO: 648367 - RNA, 64 nt, Homo Sapiens; identical to SEQ ID NO: 243974

SEQ ID NO: 648368 - RNA, 64 nt, Homo Sapiens; identical to SEQ ID NO: 243975

SEQ ID NO: 648369 - RNA, 64 nt, Homo Sapiens; identical to SEQ ID NO: 243976

SEQ ID NO: 648370 - RNA, 64 nt, Homo Sapiens; identical to SEQ ID NO: 243977

SEQ ID NO: 648371 - RNA, 64 nt, Homo Sapiens; identical to SEQ ID NO: 243978

SEQ ID NO: 648372 - RNA, 64 nt, Homo Sapiens; identical to SEQ ID NO: 243979

SEQ ID NO: 648373 - RNA, 64 nt, Homo Sapiens; identical to SEQ ID NO: 243980

SEQ ID NO: 648374 - RNA, 64 nt, Homo Sapiens; identical to SEQ ID NO: 243981

SEQ ID NO: 648375 - RNA, 64 nt, Homo Sapiens; identical to SEQ ID NO: 243982

SEQ ID NO: 648376 - RNA, 64 nt, Homo Sapiens; identical to SEQ ID NO: 243983

SEQ ID NO: 648377 - RNA, 64 nt, Homo Sapiens; identical to SEQ ID NO: 243984

SEQ ID NO: 648378 - RNA, 64 nt, Homo Sapiens; identical to SEQ ID NO: 243985

SEQ ID NO: 648379 - RNA, 64 nt, Homo Sapiens; identical to SEQ ID NO: 243986

SEQ ID NO: 648380 - RNA, 64 nt, Homo Sapiens; identical to SEQ ID NO: 243987

SEQ ID NO: 648381 - RNA, 64 nt, Homo Sapiens; identical to SEQ ID NO: 243988

SEQ ID NO: 648382 - RNA, 64 nt, Homo Sapiens; identical to SEQ ID NO: 243989

SEQ ID NO: 648383 - RNA, 64 nt, Homo Sapiens; identical to SEQ ID NO: 486961

SEQ ID NO: 648384 - RNA, 64 nt, Homo Sapiens; identical to SEQ ID NO: 486962

SEQ ID NO: 648385 - RNA, 64 nt, Homo Sapiens; identical to SEQ ID NO: 486963

SEQ ID NO: 648386 - RNA, 64 nt, Homo Sapiens; identical to SEQ ID NO: 486964

SEQ ID NO: 648387 - RNA, 64 nt, Homo Sapiens; identical to SEQ ID NO: 486965

SEQ ID NO: 648388 - RNA, 64 nt, Homo Sapiens; identical to SEQ ID NO: 486966

SEQ ID NO: 648389 - RNA, 64 nt, Homo Sapiens; identical to SEQ ID NO: 486967

SEQ ID NO: 648390 - RNA, 64 nt, Homo Sapiens; identical to SEQ ID NO: 486968

SEQ ID NO: 648391 - RNA, 64 nt, Homo Sapiens; identical to SEQ ID NO: 486969

SEQ ID NO: 648392 - RNA, 64 nt, Homo Sapiens; identical to SEQ ID NO: 486970

SEQ ID NO: 648393 - RNA, 64 nt, Homo Sapiens; identical to SEQ ID NO: 486971

SEQ ID NO: 648394 - RNA, 64 nt, Homo Sapiens; identical to SEQ ID NO: 486972

SEQ ID NO: 648395 - RNA, 64 nt, Homo Sapiens; identical to SEQ ID NO: 486973

SEQ ID NO: 648396 - RNA, 64 nt, Homo Sapiens; identical to SEQ ID NO: 486974

SEQ ID NO: 648397 - RNA, 64 nt, Homo Sapiens; identical to SEQ ID NO: 486975

SEQ ID NO: 648398 - RNA, 64 nt, Homo Sapiens; identical to SEQ ID NO: 486976

SEQ ID NO: 648399 - RNA, 64 nt, Homo Sapiens; identical to SEQ ID NO: 486977

SEQ ID NO: 648400 - RNA, 64 nt, Homo Sapiens; identical to SEQ ID NO: 486978

SEQ ID NO: 648401 - RNA, 64 nt, Homo Sapiens; identical to SEQ ID NO: 486979

SEQ ID NO: 648402 - RNA, 64 nt, Homo Sapiens; identical to SEQ ID NO: 486980

SEQ ID NO: 648403 - RNA, 64 nt, Homo Sapiens; identical to SEQ ID NO: 486981

SEQ ID NO: 648404 - RNA, 64 nt, Homo Sapiens; identical to SEQ ID NO: 486982

SEQ ID NO: 648405 - RNA, 64 nt, Homo Sapiens; identical to SEQ ID NO: 486983

SEQ ID NO: 648406 - RNA, 64 nt, Homo Sapiens; identical to SEQ ID NO: 486984

SEQ ID NO: 648407 - RNA, 64 nt, Homo Sapiens; identical to SEQ ID NO: 486985

SEQ ID NO: 648408 - RNA, 64 nt, Homo Sapiens; identical to SEQ ID NO: 486986

SEQ ID NO: 648409 - RNA, 64 nt, Homo Sapiens; identical to SEQ ID NO: 486987

SEQ ID NO: 648410 - RNA, 64 nt, Homo Sapiens; identical to SEQ ID NO: 486988

SEQ ID NO: 648411 - RNA, 64 nt, Homo Sapiens; identical to SEQ ID NO: 486989

SEQ ID NO: 648412 - RNA, 64 nt, Homo Sapiens; identical to SEQ ID NO: 486990

SEQ ID NO: 648413 - RNA, 64 nt, Homo Sapiens; identical to SEQ ID NO: 486991

SEQ ID NO: 648414 - RNA, 64 nt, Homo Sapiens; identical to SEQ ID NO: 486992

SEQ ID NO: 648415 - RNA, 64 nt, Homo Sapiens; identical to SEQ ID NO: 486993

SEQ ID NO: 648416 - RNA, 64 nt, Homo Sapiens; identical to SEQ ID NO: 486994

SEQ ID NO: 648417 - RNA, 64 nt, Homo Sapiens; identical to SEQ ID NO: 486995

SEQ ID NO: 648418 - RNA, 64 nt, Homo Sapiens; identical to SEQ ID NO: 486996

SEQ ID NO: 648419 - RNA, 64 nt, Homo Sapiens; identical to SEQ ID NO: 486997

SEQ ID NO: 648420 - RNA, 64 nt, Homo Sapiens; identical to SEQ ID NO: 486998

SEQ ID NO: 648421 - RNA, 64 nt, Homo Sapiens; identical to SEQ ID NO: 486999

SEQ ID NO: 648422 - RNA, 64 nt, Homo Sapiens; identical to SEQ ID NO: 487000

SEQ ID NO: 648423 - RNA, 64 nt, Homo Sapiens; identical to SEQ ID NO: 487001

SEQ ID NO: 648424 - RNA, 64 nt, Homo Sapiens; identical to SEQ ID NO: 487002

SEQ ID NO: 648425 - RNA, 64 nt, Homo Sapiens; identical to SEQ ID NO: 487003

SEQ ID NO: 648426 - RNA, 64 nt, Homo Sapiens; identical to SEQ ID NO: 487004

SEQ ID NO: 648427 - RNA, 64 nt, Homo Sapiens; identical to SEQ ID NO: 487005

SEQ ID NO: 648428 - RNA, 64 nt, Homo Sapiens; identical to SEQ ID NO: 487006

SEQ ID NO: 648429 - RNA, 64 nt, Homo Sapiens; identical to SEQ ID NO: 487007

SEQ ID NO: 648430 - RNA, 64 nt, Homo Sapiens; identical to SEQ ID NO: 487008

SEQ ID NO: 648431 - RNA, 64 nt, Homo Sapiens; identical to SEQ ID NO: 487009

SEQ ID NO: 648432 - RNA, 64 nt, Homo Sapiens; identical to SEQ ID NO: 487010

SEQ ID NO: 648433 - RNA, 64 nt, Homo Sapiens; identical to SEQ ID NO: 487011

SEQ ID NO: 648434 - RNA, 64 nt, Homo Sapiens; identical to SEQ ID NO: 487012

SEQ ID NO: 648435 - RNA, 64 nt, Homo Sapiens; identical to SEQ ID NO: 487013

SEQ ID NO: 648436 - RNA, 64 nt, Homo Sapiens; identical to SEQ ID NO: 487014

SEQ ID NO: 648437 - RNA, 64 nt, Homo Sapiens; identical to SEQ ID NO: 487015

SEQ ID NO: 648438 - RNA, 64 nt, Homo Sapiens; identical to SEQ ID NO: 487016

SEQ ID NO: 648439 - RNA, 64 nt, Homo Sapiens; identical to SEQ ID NO: 487017

SEQ ID NO: 648440 - RNA, 64 nt, Homo Sapiens; identical to SEQ ID NO: 487018

SEQ ID NO: 648441 - RNA, 64 nt, Homo Sapiens; identical to SEQ ID NO: 487019

SEQ ID NO: 648442 - RNA, 64 nt, Homo Sapiens; identical to SEQ ID NO: 487020

SEQ ID NO: 648443 - RNA, 64 nt, Homo Sapiens; identical to SEQ ID NO: 487021

SEQ ID NO: 648444 - RNA, 64 nt, Homo Sapiens; identical to SEQ ID NO: 487022

SEQ ID NO: 648445 - RNA, 64 nt, Homo Sapiens; identical to SEQ ID NO: 487023

SEQ ID NO: 648446 - RNA, 64 nt, Homo Sapiens; identical to SEQ ID NO: 487024

SEQ ID NO: 648447 - RNA, 64 nt, Homo Sapiens; identical to SEQ ID NO: 487025

SEQ ID NO: 648448 - RNA, 64 nt, Homo Sapiens; identical to SEQ ID NO: 487026

SEQ ID NO: 648449 - RNA, 64 nt, Homo Sapiens; identical to SEQ ID NO: 487027

SEQ ID NO: 648450 - RNA, 64 nt, Homo Sapiens; identical to SEQ ID NO: 487028

SEQ ID NO: 648451 - RNA, 64 nt, Homo Sapiens; identical to SEQ ID NO: 487029

SEQ ID NO: 648452 - RNA, 64 nt, Homo Sapiens; identical to SEQ ID NO: 487030

SEQ ID NO: 648453 - RNA, 64 nt, Homo Sapiens; identical to SEQ ID NO: 487031

SEQ ID NO: 648454 - RNA, 64 nt, Homo Sapiens; identical to SEQ ID NO: 487032

SEQ ID NO: 648455 - RNA, 64 nt, Homo Sapiens; identical to SEQ ID NO: 487033

SEQ ID NO: 648456 - RNA, 64 nt, Homo Sapiens; identical to SEQ ID NO: 487034

SEQ ID NO: 648457 - RNA, 64 nt, Homo Sapiens; identical to SEQ ID NO: 487035

SEQ ID NO: 648458 - RNA, 64 nt, Homo Sapiens; identical to SEQ ID NO: 487036

SEQ ID NO: 648459 - RNA, 64 nt, Homo Sapiens; identical to SEQ ID NO: 487037

SEQ ID NO: 648460 - RNA, 64 nt, Homo Sapiens; identical to SEQ ID NO: 487038

SEQ ID NO: 648461 - RNA, 64 nt, Homo Sapiens; identical to SEQ ID NO: 487039

SEQ ID NO: 648462 - RNA, 64 nt, Homo Sapiens; identical to SEQ ID NO: 487040

SEQ ID NO: 648463 - RNA, 64 nt, Homo Sapiens; identical to SEQ ID NO: 487041

SEQ ID NO: 648464 - RNA, 64 nt, Homo Sapiens; identical to SEQ ID NO: 487042

SEQ ID NO: 648465 - RNA, 64 nt, Homo Sapiens; identical to SEQ ID NO: 487043

SEQ ID NO: 648466 - RNA, 64 nt, Homo Sapiens; identical to SEQ ID NO: 487044

SEQ ID NO: 648467 - RNA, 64 nt, Homo Sapiens; identical to SEQ ID NO: 487045

SEQ ID NO: 648468 - RNA, 64 nt, Homo Sapiens; identical to SEQ ID NO: 487046

SEQ ID NO: 648469 - RNA, 64 nt, Homo Sapiens; identical to SEQ ID NO: 487047

SEQ ID NO: 648470 - RNA, 64 nt, Homo Sapiens; identical to SEQ ID NO: 487048

SEQ ID NO: 648471 - RNA, 64 nt, Homo Sapiens; identical to SEQ ID NO: 487049

SEQ ID NO: 648472 - RNA, 64 nt, Homo Sapiens; identical to SEQ ID NO: 487050

SEQ ID NO: 648473 - RNA, 64 nt, Homo Sapiens; identical to SEQ ID NO: 487051

SEQ ID NO: 648474 - RNA, 64 nt, Homo Sapiens; identical to SEQ ID NO: 487052

SEQ ID NO: 648475 - RNA, 64 nt, Homo Sapiens; identical to SEQ ID NO: 487053

SEQ ID NO: 648476 - RNA, 64 nt, Homo Sapiens; identical to SEQ ID NO: 487054

SEQ ID NO: 648477 - RNA, 64 nt, Homo Sapiens; identical to SEQ ID NO: 487055

SEQ ID NO: 648478 - RNA, 64 nt, Homo Sapiens; identical to SEQ ID NO: 487056

SEQ ID NO: 648479 - RNA, 64 nt, Homo Sapiens; identical to SEQ ID NO: 487057

SEQ ID NO: 648480 - RNA, 64 nt, Homo Sapiens; identical to SEQ ID NO: 487058

SEQ ID NO: 648481 - RNA, 64 nt, Homo Sapiens; identical to SEQ ID NO: 487059

SEQ ID NO: 648482 - RNA, 64 nt, Homo Sapiens; identical to SEQ ID NO: 487060

SEQ ID NO: 648483 - RNA, 62 nt, Homo Sapiens; identical to SEQ ID NO: 487061

SEQ ID NO: 648484 - RNA, 64 nt, Homo Sapiens; identical to SEQ ID NO: 487062

SEQ ID NO: 648485 - RNA, 64 nt, Homo Sapiens; identical to SEQ ID NO: 487063

SEQ ID NO: 648486 - RNA, 64 nt, Homo Sapiens; identical to SEQ ID NO: 487064

SEQ ID NO: 648487 - RNA, 64 nt, Homo Sapiens; identical to SEQ ID NO: 487065

SEQ ID NO: 648488 - RNA, 64 nt, Homo Sapiens; identical to SEQ ID NO: 487066

SEQ ID NO: 648489 - RNA, 64 nt, Homo Sapiens; identical to SEQ ID NO: 487067

SEQ ID NO: 648490 - RNA, 64 nt, Homo Sapiens; identical to SEQ ID NO: 487068

SEQ ID NO: 648491 - RNA, 64 nt, Homo Sapiens; identical to SEQ ID NO: 487069

SEQ ID NO: 648492 - RNA, 64 nt, Homo Sapiens; identical to SEQ ID NO: 487070

SEQ ID NO: 648493 - RNA, 64 nt, Homo Sapiens; identical to SEQ ID NO: 487071

SEQ ID NO: 648494 - RNA, 64 nt, Homo Sapiens; identical to SEQ ID NO: 487072

SEQ ID NO: 648495 - RNA, 64 nt, Homo Sapiens; identical to SEQ ID NO: 487073

SEQ ID NO: 648496 - RNA, 64 nt, Homo Sapiens; identical to SEQ ID NO: 487074

SEQ ID NO: 648497 - RNA, 64 nt, Homo Sapiens; identical to SEQ ID NO: 487075

SEQ ID NO: 648498 - RNA, 64 nt, Homo Sapiens; identical to SEQ ID NO: 487076

SEQ ID NO: 648499 - RNA, 64 nt, Homo Sapiens; identical to SEQ ID NO: 487077

SEQ ID NO: 648500 - RNA, 64 nt, Homo Sapiens; identical to SEQ ID NO: 487078

SEQ ID NO: 648501 - RNA, 64 nt, Homo Sapiens; identical to SEQ ID NO: 487079

SEQ ID NO: 648502 - RNA, 64 nt, Homo Sapiens; identical to SEQ ID NO: 487080

SEQ ID NO: 648503 - RNA, 64 nt, Homo Sapiens; identical to SEQ ID NO: 487081

SEQ ID NO: 648504 - RNA, 64 nt, Homo Sapiens; identical to SEQ ID NO: 487082

SEQ ID NO: 648505 - RNA, 64 nt, Homo Sapiens; identical to SEQ ID NO: 487083

SEQ ID NO: 648506 - RNA, 64 nt, Homo Sapiens; identical to SEQ ID NO: 487084

SEQ ID NO: 648507 - RNA, 64 nt, Homo Sapiens; identical to SEQ ID NO: 487085

SEQ ID NO: 648508 - RNA, 64 nt, Homo Sapiens; identical to SEQ ID NO: 487086

SEQ ID NO: 648509 - RNA, 64 nt, Homo Sapiens; identical to SEQ ID NO: 487087

SEQ ID NO: 648510 - RNA, 64 nt, Homo Sapiens; identical to SEQ ID NO: 487088

SEQ ID NO: 648511 - RNA, 64 nt, Homo Sapiens; identical to SEQ ID NO: 487089

SEQ ID NO: 648512 - RNA, 64 nt, Homo Sapiens; identical to SEQ ID NO: 487090

SEQ ID NO: 648513 - RNA, 64 nt, Homo Sapiens; identical to SEQ ID NO: 487091

SEQ ID NO: 648514 - RNA, 64 nt, Homo Sapiens; identical to SEQ ID NO: 487092

SEQ ID NO: 648515 - RNA, 64 nt, Homo Sapiens; identical to SEQ ID NO: 487093

SEQ ID NO: 648516 - RNA, 64 nt, Homo Sapiens; identical to SEQ ID NO: 487094

SEQ ID NO: 648517 - RNA, 64 nt, Homo Sapiens; identical to SEQ ID NO: 487095

SEQ ID NO: 648518 - RNA, 64 nt, Homo Sapiens; identical to SEQ ID NO: 487096

SEQ ID NO: 648519 - RNA, 64 nt, Homo Sapiens; identical to SEQ ID NO: 487097

SEQ ID NO: 648520 - RNA, 64 nt, Homo Sapiens; identical to SEQ ID NO: 487098

SEQ ID NO: 648521 - RNA, 64 nt, Homo Sapiens; identical to SEQ ID NO: 487099

SEQ ID NO: 648522 - RNA, 64 nt, Homo Sapiens; identical to SEQ ID NO: 487100

SEQ ID NO: 648523 - RNA, 64 nt, Homo Sapiens; identical to SEQ ID NO: 487101

SEQ ID NO: 648524 - RNA, 64 nt, Homo Sapiens; identical to SEQ ID NO: 487102

SEQ ID NO: 648525 - RNA, 64 nt, Homo Sapiens; identical to SEQ ID NO: 487103

SEQ ID NO: 648526 - RNA, 64 nt, Homo Sapiens; identical to SEQ ID NO: 487104

SEQ ID NO: 648527 - RNA, 64 nt, Homo Sapiens; identical to SEQ ID NO: 487105

SEQ ID NO: 648528 - RNA, 64 nt, Homo Sapiens; identical to SEQ ID NO: 487106

SEQ ID NO: 648529 - RNA, 64 nt, Homo Sapiens; identical to SEQ ID NO: 487107

SEQ ID NO: 648530 - RNA, 64 nt, Homo Sapiens; identical to SEQ ID NO: 487108

SEQ ID NO: 648531 - RNA, 64 nt, Homo Sapiens; identical to SEQ ID NO: 487109

SEQ ID NO: 648532 - RNA, 64 nt, Homo Sapiens; identical to SEQ ID NO: 487110

SEQ ID NO: 648533 - RNA, 64 nt, Homo Sapiens; identical to SEQ ID NO: 487111

SEQ ID NO: 648534 - RNA, 64 nt, Homo Sapiens; identical to SEQ ID NO: 487112

SEQ ID NO: 648535 - RNA, 64 nt, Homo Sapiens; identical to SEQ ID NO: 487113

SEQ ID NO: 648536 - RNA, 64 nt, Homo Sapiens; identical to SEQ ID NO: 487114

SEQ ID NO: 648537 - RNA, 64 nt, Homo Sapiens; identical to SEQ ID NO: 487115

SEQ ID NO: 648538 - RNA, 64 nt, Homo Sapiens; identical to SEQ ID NO: 487116

SEQ ID NO: 648539 - RNA, 64 nt, Homo Sapiens; identical to SEQ ID NO: 487117

SEQ ID NO: 648540 - RNA, 64 nt, Homo Sapiens; identical to SEQ ID NO: 487118

SEQ ID NO: 648541 - RNA, 64 nt, Homo Sapiens
augcuauccacacccaccuaucccugcagcuaauuuagcugaucucuaauuuaacugagcucua

SEQ ID NO: 648542 - RNA, 64 nt, Homo Sapiens
auuuagcugaucucuaauuuaacugagcucuaauuuagcugaucagauuuugcuuggguaaagu

SEQ ID NO: 648543 - RNA, 64 nt, Homo Sapiens
gcuauuuacuaucuuauaguaauucaggcucuaauuagcugagggaaugaaacacacaaaaauc

SEQ ID NO: 648544 - RNA, 64 nt, Homo Sapiens
aaccuggggggaguguggaaaagggaaaacuguuuuagcugaauaaaggugaauuauauaauuu

SEQ ID NO: 648545 - RNA, 64 nt, Homo Sapiens
cuugaaaaugaaauccuaaccucugcucuccuaauuagcugacuggugccuacugcugucuaaa

SEQ ID NO: 648546 - RNA, 64 nt, Homo Sapiens
gaaacugaaaucgacauaggauuggcugguugccuuagcugauuaggagacaccagugguggug

SEQ ID NO: 648547 - RNA, 64 nt, Homo Sapiens
uucugauccccuuugguuuuacuacccaaaucuaaauagauacuuuugauaauagauaacugcu

SEQ ID NO: 648548 - RNA, 64 nt, Homo Sapiens
uuuuacuacccaaaucuaaauagauacuuuugauaauagauaacugcucuuuuacuaagacaua

SEQ ID NO: 648549 - RNA, 64 nt, Homo Sapiens
uuuuauuuauguagcuuuuuuagauauuucuauaaauagauaauuaaauuauggaacugcuaaa

SEQ ID NO: 648550 - RNA, 64 nt, Homo Sapiens
ucuauaaauagauaauuuuuuuauggaacugcuaaauagauauuuuugauuugaauauuuuaaa

SEQ ID NO: 648551 - RNA, 64 nt, Homo Sapiens
uuauuauauaugugcuauagaaagcccaccuagaaauagauauuugaugaaagaaaauccaaau

SEQ ID NO: 648552 - RNA, 64 nt, Homo Sapiens
uguuuugaauguaaaguugaagaaauuguaagagaauagauacaaauuaaaccucuuaucuauc

SEQ ID NO: 648553 - RNA, 64 nt, Homo Sapiens
aaagauaccuuuuguaaaguugucaucucucuguaauagauaauggcugacuggaccauaguug

SEQ ID NO: 648554 - RNA, 64 nt, Homo Sapiens
auuuuuuagauacuaucauuagguuggauaugguaauagauauauuucagaauagcaaguggug

SEQ ID NO: 648555 - RNA, 64 nt, Homo Sapiens
gaggcugguguguaugauugucuuaaaauuuuuuaauagauauggccgagcgugauggcucacc

SEQ ID NO: 648556 - RNA, 64 nt, Homo Sapiens
ugacagugagacugucaaaaaaaaaaaaaaaauuaauagauaaaacaggccacuagagggugca

SEQ ID NO: 648557 - RNA, 64 nt, Homo Sapiens
ugaguggaugaguggaucgauggauguauugauaaauagauagaaccagucaucugaagcaacu

SEQ ID NO: 648558 - RNA, 64 nt, Homo Sapiens
aaaaauaaaaaguaccaaaauucauucaagaagaaauagauaccagccugagcaacauggcaaa

SEQ ID NO: 648559 - RNA, 64 nt, Homo Sapiens
uuuucagauuuuuuuacacuucauucugagcagaaauagauauaucacuuuuaaaauguuaaug

SEQ ID NO: 648560 - RNA, 64 nt, Homo Sapiens
cuauauuaaacacuaauuuaauauuucauguuuaaauagauauugguaauugaaguccuauugg

SEQ ID NO: 648561 - RNA, 64 nt, Homo Sapiens; identical to SEQ ID NO: 155629

SEQ ID NO: 648562 - RNA, 64 nt, Homo Sapiens; identical to SEQ ID NO: 155630

SEQ ID NO: 648563 - RNA, 64 nt, Homo Sapiens; identical to SEQ ID NO: 155631

SEQ ID NO: 648564 - RNA, 64 nt, Homo Sapiens; identical to SEQ ID NO: 155632

SEQ ID NO: 648565 - RNA, 64 nt, Homo Sapiens; identical to SEQ ID NO: 155633

SEQ ID NO: 648566 - RNA, 64 nt, Homo Sapiens; identical to SEQ ID NO: 155634

SEQ ID NO: 648567 - RNA, 64 nt, Homo Sapiens; identical to SEQ ID NO: 155635

SEQ ID NO: 648568 - RNA, 64 nt, Homo Sapiens; identical to SEQ ID NO: 155636

SEQ ID NO: 648569 - RNA, 64 nt, Homo Sapiens; identical to SEQ ID NO: 155637

SEQ ID NO: 648570 - RNA, 64 nt, Homo Sapiens; identical to SEQ ID NO: 155638

SEQ ID NO: 648571 - RNA, 64 nt, Homo Sapiens; identical to SEQ ID NO: 155639

SEQ ID NO: 648572 - RNA, 64 nt, Homo Sapiens; identical to SEQ ID NO: 155640

SEQ ID NO: 648573 - RNA, 64 nt, Homo Sapiens; identical to SEQ ID NO: 155641

SEQ ID NO: 648574 - RNA, 64 nt, Homo Sapiens; identical to SEQ ID NO: 155642

SEQ ID NO: 648575 - RNA, 64 nt, Homo Sapiens; identical to SEQ ID NO: 155643

SEQ ID NO: 648576 - RNA, 64 nt, Homo Sapiens; identical to SEQ ID NO: 155644

SEQ ID NO: 648577 - RNA, 64 nt, Homo Sapiens; identical to SEQ ID NO: 155645

SEQ ID NO: 648578 - RNA, 64 nt, Homo Sapiens; identical to SEQ ID NO: 155646

SEQ ID NO: 648579 - RNA, 64 nt, Homo Sapiens; identical to SEQ ID NO: 155647

SEQ ID NO: 648580 - RNA, 64 nt, Homo Sapiens; identical to SEQ ID NO: 155648

SEQ ID NO: 648581 - RNA, 64 nt, Homo Sapiens; identical to SEQ ID NO: 155649

SEQ ID NO: 648582 - RNA, 64 nt, Homo Sapiens; identical to SEQ ID NO: 155650

SEQ ID NO: 648583 - RNA, 64 nt, Homo Sapiens; identical to SEQ ID NO: 155651

SEQ ID NO: 648584 - RNA, 64 nt, Homo Sapiens; identical to SEQ ID NO: 155652

SEQ ID NO: 648585 - RNA, 64 nt, Homo Sapiens; identical to SEQ ID NO: 155653

SEQ ID NO: 648586 - RNA, 64 nt, Homo Sapiens; identical to SEQ ID NO: 155654

SEQ ID NO: 648587 - RNA, 64 nt, Homo Sapiens; identical to SEQ ID NO: 155655

SEQ ID NO: 648588 - RNA, 64 nt, Homo Sapiens; identical to SEQ ID NO: 155656

SEQ ID NO: 648589 - RNA, 64 nt, Homo Sapiens; identical to SEQ ID NO: 155657

SEQ ID NO: 648590 - RNA, 64 nt, Homo Sapiens; identical to SEQ ID NO: 155658

SEQ ID NO: 648591 - RNA, 64 nt, Homo Sapiens; identical to SEQ ID NO: 155659

SEQ ID NO: 648592 - RNA, 64 nt, Homo Sapiens; identical to SEQ ID NO: 155660

SEQ ID NO: 648593 - RNA, 64 nt, Homo Sapiens; identical to SEQ ID NO: 155661

SEQ ID NO: 648594 - RNA, 64 nt, Homo Sapiens; identical to SEQ ID NO: 155662

SEQ ID NO: 648595 - RNA, 64 nt, Homo Sapiens; identical to SEQ ID NO: 155663

SEQ ID NO: 648596 - RNA, 64 nt, Homo Sapiens; identical to SEQ ID NO: 155664

SEQ ID NO: 648597 - RNA, 64 nt, Homo Sapiens; identical to SEQ ID NO: 155665

SEQ ID NO: 648598 - RNA, 64 nt, Homo Sapiens; identical to SEQ ID NO: 155666

SEQ ID NO: 648599 - RNA, 64 nt, Homo Sapiens; identical to SEQ ID NO: 155667

SEQ ID NO: 648600 - RNA, 64 nt, Homo Sapiens; identical to SEQ ID NO: 155668

SEQ ID NO: 648601 - RNA, 64 nt, Homo Sapiens; identical to SEQ ID NO: 155669

SEQ ID NO: 648602 - RNA, 64 nt, Homo Sapiens; identical to SEQ ID NO: 155670

SEQ ID NO: 648603 - RNA, 64 nt, Homo Sapiens; identical to SEQ ID NO: 155671

SEQ ID NO: 648604 - RNA, 64 nt, Homo Sapiens; identical to SEQ ID NO: 155672

SEQ ID NO: 648605 - RNA, 64 nt, Homo Sapiens; identical to SEQ ID NO: 155673

SEQ ID NO: 648606 - RNA, 64 nt, Homo Sapiens; identical to SEQ ID NO: 155674

SEQ ID NO: 648607 - RNA, 64 nt, Homo Sapiens; identical to SEQ ID NO: 155675

SEQ ID NO: 648608 - RNA, 64 nt, Homo Sapiens; identical to SEQ ID NO: 155676

SEQ ID NO: 648609 - RNA, 64 nt, Homo Sapiens; identical to SEQ ID NO: 155677

SEQ ID NO: 648610 - RNA, 64 nt, Homo Sapiens; identical to SEQ ID NO: 155678

SEQ ID NO: 648611 - RNA, 64 nt, Homo Sapiens; identical to SEQ ID NO: 155679

SEQ ID NO: 648612 - RNA, 64 nt, Homo Sapiens; identical to SEQ ID NO: 155680

SEQ ID NO: 648613 - RNA, 64 nt, Homo Sapiens; identical to SEQ ID NO: 155681

SEQ ID NO: 648614 - RNA, 64 nt, Homo Sapiens; identical to SEQ ID NO: 155682

SEQ ID NO: 648615 - RNA, 64 nt, Homo Sapiens; identical to SEQ ID NO: 155683

SEQ ID NO: 648616 - RNA, 64 nt, Homo Sapiens; identical to SEQ ID NO: 155684

SEQ ID NO: 648617 - RNA, 64 nt, Homo Sapiens; identical to SEQ ID NO: 155685

SEQ ID NO: 648618 - RNA, 64 nt, Homo Sapiens; identical to SEQ ID NO: 155686

SEQ ID NO: 648619 - RNA, 64 nt, Homo Sapiens; identical to SEQ ID NO: 155687

SEQ ID NO: 648620 - RNA, 64 nt, Homo Sapiens; identical to SEQ ID NO: 155688

SEQ ID NO: 648621 - RNA, 64 nt, Homo Sapiens; identical to SEQ ID NO: 155689

SEQ ID NO: 648622 - RNA, 64 nt, Homo Sapiens; identical to SEQ ID NO: 155690

SEQ ID NO: 648623 - RNA, 64 nt, Homo Sapiens; identical to SEQ ID NO: 155691

SEQ ID NO: 648624 - RNA, 64 nt, Homo Sapiens; identical to SEQ ID NO: 155692

SEQ ID NO: 648625 - RNA, 64 nt, Homo Sapiens; identical to SEQ ID NO: 155693

SEQ ID NO: 648626 - RNA, 64 nt, Homo Sapiens; identical to SEQ ID NO: 155694

SEQ ID NO: 648627 - RNA, 64 nt, Homo Sapiens; identical to SEQ ID NO: 155695

SEQ ID NO: 648628 - RNA, 64 nt, Homo Sapiens; identical to SEQ ID NO: 155696

SEQ ID NO: 648629 - RNA, 64 nt, Homo Sapiens; identical to SEQ ID NO: 155697

SEQ ID NO: 648630 - RNA, 64 nt, Homo Sapiens; identical to SEQ ID NO: 155698

SEQ ID NO: 648631 - RNA, 64 nt, Homo Sapiens; identical to SEQ ID NO: 155699

SEQ ID NO: 648632 - RNA, 64 nt, Homo Sapiens; identical to SEQ ID NO: 155700

SEQ ID NO: 648633 - RNA, 64 nt, Homo Sapiens; identical to SEQ ID NO: 155701

SEQ ID NO: 648634 - RNA, 64 nt, Homo Sapiens; identical to SEQ ID NO: 155702

SEQ ID NO: 648635 - RNA, 64 nt, Homo Sapiens; identical to SEQ ID NO: 155703

SEQ ID NO: 648636 - RNA, 64 nt, Homo Sapiens; identical to SEQ ID NO: 155704

SEQ ID NO: 648637 - RNA, 64 nt, Homo Sapiens; identical to SEQ ID NO: 155705

SEQ ID NO: 648638 - RNA, 64 nt, Homo Sapiens; identical to SEQ ID NO: 155706

SEQ ID NO: 648639 - RNA, 64 nt, Homo Sapiens; identical to SEQ ID NO: 155707

SEQ ID NO: 648640 - RNA, 64 nt, Homo Sapiens; identical to SEQ ID NO: 155708

SEQ ID NO: 648641 - RNA, 64 nt, Homo Sapiens; identical to SEQ ID NO: 155709

SEQ ID NO: 648642 - RNA, 64 nt, Homo Sapiens; identical to SEQ ID NO: 155710

SEQ ID NO: 648643 - RNA, 64 nt, Homo Sapiens; identical to SEQ ID NO: 155711

SEQ ID NO: 648644 - RNA, 64 nt, Homo Sapiens; identical to SEQ ID NO: 155712

SEQ ID NO: 648645 - RNA, 64 nt, Homo Sapiens; identical to SEQ ID NO: 155713

SEQ ID NO: 648646 - RNA, 64 nt, Homo Sapiens; identical to SEQ ID NO: 155714

SEQ ID NO: 648647 - RNA, 64 nt, Homo Sapiens; identical to SEQ ID NO: 155715

SEQ ID NO: 648648 - RNA, 64 nt, Homo Sapiens; identical to SEQ ID NO: 155716

SEQ ID NO: 648649 - RNA, 64 nt, Homo Sapiens; identical to SEQ ID NO: 155717

SEQ ID NO: 648650 - RNA, 64 nt, Homo Sapiens; identical to SEQ ID NO: 155718

SEQ ID NO: 648651 - RNA, 64 nt, Homo Sapiens; identical to SEQ ID NO: 155719

SEQ ID NO: 648652 - RNA, 64 nt, Homo Sapiens; identical to SEQ ID NO: 155720

SEQ ID NO: 648653 - RNA, 64 nt, Homo Sapiens; identical to SEQ ID NO: 155721

SEQ ID NO: 648654 - RNA, 64 nt, Homo Sapiens; identical to SEQ ID NO: 155722

SEQ ID NO: 648655 - RNA, 64 nt, Homo Sapiens; identical to SEQ ID NO: 155723

SEQ ID NO: 648656 - RNA, 64 nt, Homo Sapiens; identical to SEQ ID NO: 155724

SEQ ID NO: 648657 - RNA, 64 nt, Homo Sapiens; identical to SEQ ID NO: 155725

SEQ ID NO: 648658 - RNA, 64 nt, Homo Sapiens; identical to SEQ ID NO: 155726

SEQ ID NO: 648659 - RNA, 64 nt, Homo Sapiens; identical to SEQ ID NO: 155727

SEQ ID NO: 648660 - RNA, 64 nt, Homo Sapiens; identical to SEQ ID NO: 155728

SEQ ID NO: 648661 - RNA, 64 nt, Homo Sapiens; identical to SEQ ID NO: 155729

SEQ ID NO: 648662 - RNA, 58 nt, Homo Sapiens; identical to SEQ ID NO: 155730

SEQ ID NO: 648663 - RNA, 64 nt, Homo Sapiens; identical to SEQ ID NO: 155731

SEQ ID NO: 648664 - RNA, 64 nt, Homo Sapiens; identical to SEQ ID NO: 155732

SEQ ID NO: 648665 - RNA, 64 nt, Homo Sapiens; identical to SEQ ID NO: 155733

SEQ ID NO: 648666 - RNA, 64 nt, Homo Sapiens; identical to SEQ ID NO: 155734

SEQ ID NO: 648667 - RNA, 64 nt, Homo Sapiens; identical to SEQ ID NO: 155735

SEQ ID NO: 648668 - RNA, 64 nt, Homo Sapiens; identical to SEQ ID NO: 155736

SEQ ID NO: 648669 - RNA, 64 nt, Homo Sapiens; identical to SEQ ID NO: 155737

SEQ ID NO: 648670 - RNA, 64 nt, Homo Sapiens; identical to SEQ ID NO: 155738

SEQ ID NO: 648671 - RNA, 64 nt, Homo Sapiens; identical to SEQ ID NO: 155739

SEQ ID NO: 648672 - RNA, 64 nt, Homo Sapiens; identical to SEQ ID NO: 155740

SEQ ID NO: 648673 - RNA, 64 nt, Homo Sapiens; identical to SEQ ID NO: 155741

SEQ ID NO: 648674 - RNA, 64 nt, Homo Sapiens; identical to SEQ ID NO: 155742

SEQ ID NO: 648675 - RNA, 64 nt, Homo Sapiens; identical to SEQ ID NO: 155743

SEQ ID NO: 648676 - RNA, 64 nt, Homo Sapiens; identical to SEQ ID NO: 155744

SEQ ID NO: 648677 - RNA, 64 nt, Homo Sapiens; identical to SEQ ID NO: 155745

SEQ ID NO: 648678 - RNA, 64 nt, Homo Sapiens; identical to SEQ ID NO: 155746

SEQ ID NO: 648679 - RNA, 64 nt, Homo Sapiens; identical to SEQ ID NO: 155747

SEQ ID NO: 648680 - RNA, 64 nt, Homo Sapiens; identical to SEQ ID NO: 155748

SEQ ID NO: 648681 - RNA, 64 nt, Homo Sapiens; identical to SEQ ID NO: 155749

SEQ ID NO: 648682 - RNA, 64 nt, Homo Sapiens; identical to SEQ ID NO: 155750

SEQ ID NO: 648683 - RNA, 64 nt, Homo Sapiens; identical to SEQ ID NO: 155751

SEQ ID NO: 648684 - RNA, 64 nt, Homo Sapiens; identical to SEQ ID NO: 155752

SEQ ID NO: 648685 - RNA, 64 nt, Homo Sapiens; identical to SEQ ID NO: 155753

SEQ ID NO: 648686 - RNA, 63 nt, Homo Sapiens; identical to SEQ ID NO: 155754

SEQ ID NO: 648687 - RNA, 64 nt, Homo Sapiens; identical to SEQ ID NO: 155755

SEQ ID NO: 648688 - RNA, 64 nt, Homo Sapiens; identical to SEQ ID NO: 155756

SEQ ID NO: 648689 - RNA, 64 nt, Homo Sapiens; identical to SEQ ID NO: 155757

SEQ ID NO: 648690 - RNA, 64 nt, Homo Sapiens; identical to SEQ ID NO: 155758

SEQ ID NO: 648691 - RNA, 64 nt, Homo Sapiens; identical to SEQ ID NO: 155759

SEQ ID NO: 648692 - RNA, 64 nt, Homo Sapiens; identical to SEQ ID NO: 155760

SEQ ID NO: 648693 - RNA, 64 nt, Homo Sapiens; identical to SEQ ID NO: 155761

SEQ ID NO: 648694 - RNA, 64 nt, Homo Sapiens; identical to SEQ ID NO: 155762

SEQ ID NO: 648695 - RNA, 64 nt, Homo Sapiens; identical to SEQ ID NO: 155763

SEQ ID NO: 648696 - RNA, 64 nt, Homo Sapiens; identical to SEQ ID NO: 155764

SEQ ID NO: 648697 - RNA, 64 nt, Homo Sapiens; identical to SEQ ID NO: 155765

SEQ ID NO: 648698 - RNA, 64 nt, Homo Sapiens; identical to SEQ ID NO: 155766

SEQ ID NO: 648699 - RNA, 64 nt, Homo Sapiens; identical to SEQ ID NO: 155767

SEQ ID NO: 648700 - RNA, 64 nt, Homo Sapiens; identical to SEQ ID NO: 155768

SEQ ID NO: 648701 - RNA, 64 nt, Homo Sapiens; identical to SEQ ID NO: 155769

SEQ ID NO: 648702 - RNA, 64 nt, Homo Sapiens; identical to SEQ ID NO: 155770

SEQ ID NO: 648703 - RNA, 64 nt, Homo Sapiens; identical to SEQ ID NO: 155771

SEQ ID NO: 648704 - RNA, 64 nt, Homo Sapiens; identical to SEQ ID NO: 155772

SEQ ID NO: 648705 - RNA, 64 nt, Homo Sapiens; identical to SEQ ID NO: 155773

SEQ ID NO: 648706 - RNA, 64 nt, Homo Sapiens; identical to SEQ ID NO: 155774

SEQ ID NO: 648707 - RNA, 64 nt, Homo Sapiens; identical to SEQ ID NO: 155775

SEQ ID NO: 648708 - RNA, 64 nt, Homo Sapiens; identical to SEQ ID NO: 155776

SEQ ID NO: 648709 - RNA, 64 nt, Homo Sapiens; identical to SEQ ID NO: 155777

SEQ ID NO: 648710 - RNA, 64 nt, Homo Sapiens; identical to SEQ ID NO: 155778

SEQ ID NO: 648711 - RNA, 64 nt, Homo Sapiens; identical to SEQ ID NO: 155779

SEQ ID NO: 648712 - RNA, 64 nt, Homo Sapiens; identical to SEQ ID NO: 155780

SEQ ID NO: 648713 - RNA, 64 nt, Homo Sapiens; identical to SEQ ID NO: 155781

SEQ ID NO: 648714 - RNA, 64 nt, Homo Sapiens; identical to SEQ ID NO: 155782

SEQ ID NO: 648715 - RNA, 64 nt, Homo Sapiens; identical to SEQ ID NO: 155783

SEQ ID NO: 648716 - RNA, 64 nt, Homo Sapiens; identical to SEQ ID NO: 155784

SEQ ID NO: 648717 - RNA, 64 nt, Homo Sapiens; identical to SEQ ID NO: 155785

SEQ ID NO: 648718 - RNA, 64 nt, Homo Sapiens; identical to SEQ ID NO: 155786

SEQ ID NO: 648719 - RNA, 53 nt, Homo Sapiens; identical to SEQ ID NO: 155787

SEQ ID NO: 648720 - RNA, 64 nt, Homo Sapiens; identical to SEQ ID NO: 155788

SEQ ID NO: 648721 - RNA, 64 nt, Homo Sapiens; identical to SEQ ID NO: 155789

SEQ ID NO: 648722 - RNA, 64 nt, Homo Sapiens; identical to SEQ ID NO: 155790

SEQ ID NO: 648723 - RNA, 64 nt, Homo Sapiens; identical to SEQ ID NO: 155791

SEQ ID NO: 648724 - RNA, 64 nt, Homo Sapiens; identical to SEQ ID NO: 155792

SEQ ID NO: 648725 - RNA, 64 nt, Homo Sapiens; identical to SEQ ID NO: 155793

SEQ ID NO: 648726 - RNA, 64 nt, Homo Sapiens; identical to SEQ ID NO: 155794

SEQ ID NO: 648727 - RNA, 64 nt, Homo Sapiens; identical to SEQ ID NO: 155795

SEQ ID NO: 648728 - RNA, 64 nt, Homo Sapiens; identical to SEQ ID NO: 155796

SEQ ID NO: 648729 - RNA, 64 nt, Homo Sapiens; identical to SEQ ID NO: 155797

SEQ ID NO: 648730 - RNA, 64 nt, Homo Sapiens; identical to SEQ ID NO: 155798

SEQ ID NO: 648731 - RNA, 64 nt, Homo Sapiens; identical to SEQ ID NO: 155799

SEQ ID NO: 648732 - RNA, 64 nt, Homo Sapiens; identical to SEQ ID NO: 155800

SEQ ID NO: 648733 - RNA, 64 nt, Homo Sapiens; identical to SEQ ID NO: 155801

SEQ ID NO: 648734 - RNA, 64 nt, Homo Sapiens; identical to SEQ ID NO: 155802

SEQ ID NO: 648735 - RNA, 64 nt, Homo Sapiens; identical to SEQ ID NO: 155803

SEQ ID NO: 648736 - RNA, 64 nt, Homo Sapiens; identical to SEQ ID NO: 155804

SEQ ID NO: 648737 - RNA, 64 nt, Homo Sapiens; identical to SEQ ID NO: 155805

SEQ ID NO: 648738 - RNA, 64 nt, Homo Sapiens; identical to SEQ ID NO: 155806

SEQ ID NO: 648739 - RNA, 64 nt, Homo Sapiens; identical to SEQ ID NO: 155807

SEQ ID NO: 648740 - RNA, 64 nt, Homo Sapiens; identical to SEQ ID NO: 155808

SEQ ID NO: 648741 - RNA, 64 nt, Homo Sapiens; identical to SEQ ID NO: 360747

SEQ ID NO: 648742 - RNA, 64 nt, Homo Sapiens; identical to SEQ ID NO: 360748

SEQ ID NO: 648743 - RNA, 64 nt, Homo Sapiens; identical to SEQ ID NO: 360749

SEQ ID NO: 648744 - RNA, 64 nt, Homo Sapiens; identical to SEQ ID NO: 360750

SEQ ID NO: 648745 - RNA, 64 nt, Homo Sapiens; identical to SEQ ID NO: 360751

SEQ ID NO: 648746 - RNA, 64 nt, Homo Sapiens; identical to SEQ ID NO: 360752

SEQ ID NO: 648747 - RNA, 64 nt, Homo Sapiens; identical to SEQ ID NO: 360753

SEQ ID NO: 648748 - RNA, 64 nt, Homo Sapiens; identical to SEQ ID NO: 360754

SEQ ID NO: 648749 - RNA, 64 nt, Homo Sapiens; identical to SEQ ID NO: 360755

SEQ ID NO: 648750 - RNA, 64 nt, Homo Sapiens; identical to SEQ ID NO: 360756

SEQ ID NO: 648751 - RNA, 64 nt, Homo Sapiens; identical to SEQ ID NO: 360757

SEQ ID NO: 648752 - RNA, 64 nt, Homo Sapiens; identical to SEQ ID NO: 360758

SEQ ID NO: 648753 - RNA, 64 nt, Homo Sapiens; identical to SEQ ID NO: 360759

SEQ ID NO: 648754 - RNA, 64 nt, Homo Sapiens; identical to SEQ ID NO: 360760

SEQ ID NO: 648755 - RNA, 64 nt, Homo Sapiens; identical to SEQ ID NO: 360761

SEQ ID NO: 648756 - RNA, 64 nt, Homo Sapiens; identical to SEQ ID NO: 360762

SEQ ID NO: 648757 - RNA, 64 nt, Homo Sapiens; identical to SEQ ID NO: 360763

SEQ ID NO: 648758 - RNA, 64 nt, Homo Sapiens; identical to SEQ ID NO: 360764

SEQ ID NO: 648759 - RNA, 64 nt, Homo Sapiens; identical to SEQ ID NO: 360765

SEQ ID NO: 648760 - RNA, 59 nt, Homo Sapiens; identical to SEQ ID NO: 76155

SEQ ID NO: 648761 - RNA, 64 nt, Homo Sapiens; identical to SEQ ID NO: 76156

SEQ ID NO: 648762 - RNA, 64 nt, Homo Sapiens; identical to SEQ ID NO: 76157

SEQ ID NO: 648763 - RNA, 64 nt, Homo Sapiens; identical to SEQ ID NO: 76158

SEQ ID NO: 648764 - RNA, 64 nt, Homo Sapiens; identical to SEQ ID NO: 76159

SEQ ID NO: 648765 - RNA, 64 nt, Homo Sapiens; identical to SEQ ID NO: 76160

SEQ ID NO: 648766 - RNA, 64 nt, Homo Sapiens; identical to SEQ ID NO: 76161

SEQ ID NO: 648767 - RNA, 64 nt, Homo Sapiens; identical to SEQ ID NO: 76162

SEQ ID NO: 648768 - RNA, 64 nt, Homo Sapiens; identical to SEQ ID NO: 76163

SEQ ID NO: 648769 - RNA, 64 nt, Homo Sapiens; identical to SEQ ID NO: 76164

SEQ ID NO: 648770 - RNA, 64 nt, Homo Sapiens; identical to SEQ ID NO: 76165

SEQ ID NO: 648771 - RNA, 64 nt, Homo Sapiens; identical to SEQ ID NO: 76166

SEQ ID NO: 648772 - RNA, 64 nt, Homo Sapiens; identical to SEQ ID NO: 76167

SEQ ID NO: 648773 - RNA, 64 nt, Homo Sapiens; identical to SEQ ID NO: 76168

SEQ ID NO: 648774 - RNA, 64 nt, Homo Sapiens; identical to SEQ ID NO: 76169

SEQ ID NO: 648775 - RNA, 58 nt, Homo Sapiens; identical to SEQ ID NO: 76170

SEQ ID NO: 648776 - RNA, 64 nt, Homo Sapiens; identical to SEQ ID NO: 76171

SEQ ID NO: 648777 - RNA, 64 nt, Homo Sapiens; identical to SEQ ID NO: 76172

SEQ ID NO: 648778 - RNA, 64 nt, Homo Sapiens; identical to SEQ ID NO: 76173

SEQ ID NO: 648779 - RNA, 64 nt, Homo Sapiens; identical to SEQ ID NO: 76174

SEQ ID NO: 648780 - RNA, 64 nt, Homo Sapiens; identical to SEQ ID NO: 76175

SEQ ID NO: 648781 - RNA, 52 nt, Homo Sapiens; identical to SEQ ID NO: 76176

SEQ ID NO: 648782 - RNA, 64 nt, Homo Sapiens; identical to SEQ ID NO: 76177

SEQ ID NO: 648783 - RNA, 64 nt, Homo Sapiens; identical to SEQ ID NO: 76178

SEQ ID NO: 648784 - RNA, 64 nt, Homo Sapiens; identical to SEQ ID NO: 76179

SEQ ID NO: 648785 - RNA, 64 nt, Homo Sapiens; identical to SEQ ID NO: 76180

SEQ ID NO: 648786 - RNA, 64 nt, Homo Sapiens; identical to SEQ ID NO: 76181

SEQ ID NO: 648787 - RNA, 64 nt, Homo Sapiens; identical to SEQ ID NO: 76182

SEQ ID NO: 648788 - RNA, 64 nt, Homo Sapiens; identical to SEQ ID NO: 76183

SEQ ID NO: 648789 - RNA, 64 nt, Homo Sapiens; identical to SEQ ID NO: 76184

SEQ ID NO: 648790 - RNA, 64 nt, Homo Sapiens; identical to SEQ ID NO: 76185

SEQ ID NO: 648791 - RNA, 64 nt, Homo Sapiens; identical to SEQ ID NO: 76186

SEQ ID NO: 648792 - RNA, 64 nt, Homo Sapiens; identical to SEQ ID NO: 76187

SEQ ID NO: 648793 - RNA, 64 nt, Homo Sapiens; identical to SEQ ID NO: 76188

SEQ ID NO: 648794 - RNA, 64 nt, Homo Sapiens; identical to SEQ ID NO: 76189

SEQ ID NO: 648795 - RNA, 64 nt, Homo Sapiens; identical to SEQ ID NO: 76190

SEQ ID NO: 648796 - RNA, 64 nt, Homo Sapiens; identical to SEQ ID NO: 76191

SEQ ID NO: 648797 - RNA, 64 nt, Homo Sapiens; identical to SEQ ID NO: 76192

SEQ ID NO: 648798 - RNA, 64 nt, Homo Sapiens; identical to SEQ ID NO: 76193

SEQ ID NO: 648799 - RNA, 64 nt, Homo Sapiens; identical to SEQ ID NO: 76194

SEQ ID NO: 648800 - RNA, 64 nt, Homo Sapiens; identical to SEQ ID NO: 76195

SEQ ID NO: 648801 - RNA, 64 nt, Homo Sapiens; identical to SEQ ID NO: 76196

SEQ ID NO: 648802 - RNA, 64 nt, Homo Sapiens; identical to SEQ ID NO: 76197

SEQ ID NO: 648803 - RNA, 64 nt, Homo Sapiens; identical to SEQ ID NO: 76198

SEQ ID NO: 648804 - RNA, 64 nt, Homo Sapiens; identical to SEQ ID NO: 76199

SEQ ID NO: 648805 - RNA, 64 nt, Homo Sapiens; identical to SEQ ID NO: 76200

SEQ ID NO: 648806 - RNA, 64 nt, Homo Sapiens; identical to SEQ ID NO: 76201

SEQ ID NO: 648807 - RNA, 64 nt, Homo Sapiens; identical to SEQ ID NO: 76202

SEQ ID NO: 648808 - RNA, 64 nt, Homo Sapiens; identical to SEQ ID NO: 76203

SEQ ID NO: 648809 - RNA, 64 nt, Homo Sapiens; identical to SEQ ID NO: 76204

SEQ ID NO: 648810 - RNA, 64 nt, Homo Sapiens; identical to SEQ ID NO: 76205

SEQ ID NO: 648811 - RNA, 64 nt, Homo Sapiens; identical to SEQ ID NO: 76206

SEQ ID NO: 648812 - RNA, 64 nt, Homo Sapiens; identical to SEQ ID NO: 76207

SEQ ID NO: 648813 - RNA, 64 nt, Homo Sapiens; identical to SEQ ID NO: 76208

SEQ ID NO: 648814 - RNA, 64 nt, Homo Sapiens; identical to SEQ ID NO: 76209

SEQ ID NO: 648815 - RNA, 64 nt, Homo Sapiens; identical to SEQ ID NO: 76210

SEQ ID NO: 648816 - RNA, 64 nt, Homo Sapiens; identical to SEQ ID NO: 76211

SEQ ID NO: 648817 - RNA, 64 nt, Homo Sapiens; identical to SEQ ID NO: 76212

SEQ ID NO: 648818 - RNA, 64 nt, Homo Sapiens; identical to SEQ ID NO: 76213

SEQ ID NO: 648819 - RNA, 64 nt, Homo Sapiens; identical to SEQ ID NO: 76214

SEQ ID NO: 648820 - RNA, 64 nt, Homo Sapiens; identical to SEQ ID NO: 76215

SEQ ID NO: 648821 - RNA, 64 nt, Homo Sapiens; identical to SEQ ID NO: 76216

SEQ ID NO: 648822 - RNA, 64 nt, Homo Sapiens; identical to SEQ ID NO: 76217

SEQ ID NO: 648823 - RNA, 64 nt, Homo Sapiens; identical to SEQ ID NO: 76218

SEQ ID NO: 648824 - RNA, 64 nt, Homo Sapiens; identical to SEQ ID NO: 76219

SEQ ID NO: 648825 - RNA, 64 nt, Homo Sapiens; identical to SEQ ID NO: 76456

SEQ ID NO: 648826 - RNA, 64 nt, Homo Sapiens; identical to SEQ ID NO: 76457

SEQ ID NO: 648827 - RNA, 64 nt, Homo Sapiens; identical to SEQ ID NO: 76458

SEQ ID NO: 648828 - RNA, 64 nt, Homo Sapiens; identical to SEQ ID NO: 76459

SEQ ID NO: 648829 - RNA, 64 nt, Homo Sapiens; identical to SEQ ID NO: 76460

SEQ ID NO: 648830 - RNA, 64 nt, Homo Sapiens; identical to SEQ ID NO: 76461

SEQ ID NO: 648831 - RNA, 64 nt, Homo Sapiens; identical to SEQ ID NO: 76462

SEQ ID NO: 648832 - RNA, 64 nt, Homo Sapiens; identical to SEQ ID NO: 76463

SEQ ID NO: 648833 - RNA, 64 nt, Homo Sapiens; identical to SEQ ID NO: 76464

SEQ ID NO: 648834 - RNA, 64 nt, Homo Sapiens; identical to SEQ ID NO: 76465

SEQ ID NO: 648835 - RNA, 64 nt, Homo Sapiens; identical to SEQ ID NO: 76466

SEQ ID NO: 648836 - RNA, 64 nt, Homo Sapiens; identical to SEQ ID NO: 76467

SEQ ID NO: 648837 - RNA, 64 nt, Homo Sapiens; identical to SEQ ID NO: 545907

SEQ ID NO: 648838 - RNA, 64 nt, Homo Sapiens; identical to SEQ ID NO: 545908

SEQ ID NO: 648839 - RNA, 64 nt, Homo Sapiens; identical to SEQ ID NO: 545909

SEQ ID NO: 648840 - RNA, 64 nt, Homo Sapiens; identical to SEQ ID NO: 545910

SEQ ID NO: 648841 - RNA, 64 nt, Homo Sapiens; identical to SEQ ID NO: 545911

SEQ ID NO: 648842 - RNA, 64 nt, Homo Sapiens; identical to SEQ ID NO: 545912

SEQ ID NO: 648843 - RNA, 64 nt, Homo Sapiens; identical to SEQ ID NO: 545913

SEQ ID NO: 648844 - RNA, 64 nt, Homo Sapiens; identical to SEQ ID NO: 545914

SEQ ID NO: 648845 - RNA, 64 nt, Homo Sapiens; identical to SEQ ID NO: 545915

SEQ ID NO: 648846 - RNA, 64 nt, Homo Sapiens; identical to SEQ ID NO: 545916

SEQ ID NO: 648847 - RNA, 64 nt, Homo Sapiens; identical to SEQ ID NO: 545917

SEQ ID NO: 648848 - RNA, 64 nt, Homo Sapiens; identical to SEQ ID NO: 545918

SEQ ID NO: 648849 - RNA, 64 nt, Homo Sapiens; identical to SEQ ID NO: 545919

SEQ ID NO: 648850 - RNA, 64 nt, Homo Sapiens; identical to SEQ ID NO: 545920

SEQ ID NO: 648851 - RNA, 64 nt, Homo Sapiens; identical to SEQ ID NO: 545921

SEQ ID NO: 648852 - RNA, 64 nt, Homo Sapiens; identical to SEQ ID NO: 545922

SEQ ID NO: 648853 - RNA, 64 nt, Homo Sapiens; identical to SEQ ID NO: 545923

SEQ ID NO: 648854 - RNA, 64 nt, Homo Sapiens; identical to SEQ ID NO: 545924

SEQ ID NO: 648855 - RNA, 64 nt, Homo Sapiens; identical to SEQ ID NO: 545925

SEQ ID NO: 648856 - RNA, 64 nt, Homo Sapiens; identical to SEQ ID NO: 545926

SEQ ID NO: 648857 - RNA, 64 nt, Homo Sapiens; identical to SEQ ID NO: 545927

SEQ ID NO: 648858 - RNA, 64 nt, Homo Sapiens; identical to SEQ ID NO: 545928

SEQ ID NO: 648859 - RNA, 64 nt, Homo Sapiens; identical to SEQ ID NO: 545929

SEQ ID NO: 648860 - RNA, 64 nt, Homo Sapiens; identical to SEQ ID NO: 545930

SEQ ID NO: 648861 - RNA, 64 nt, Homo Sapiens; identical to SEQ ID NO: 545931

SEQ ID NO: 648862 - RNA, 64 nt, Homo Sapiens; identical to SEQ ID NO: 545932

SEQ ID NO: 648863 - RNA, 64 nt, Homo Sapiens; identical to SEQ ID NO: 545933

SEQ ID NO: 648864 - RNA, 64 nt, Homo Sapiens; identical to SEQ ID NO: 545934

SEQ ID NO: 648865 - RNA, 64 nt, Homo Sapiens; identical to SEQ ID NO: 545935

SEQ ID NO: 648866 - RNA, 64 nt, Homo Sapiens; identical to SEQ ID NO: 545936

SEQ ID NO: 648867 - RNA, 64 nt, Homo Sapiens; identical to SEQ ID NO: 545937

SEQ ID NO: 648868 - RNA, 64 nt, Homo Sapiens; identical to SEQ ID NO: 545938

SEQ ID NO: 648869 - RNA, 64 nt, Homo Sapiens; identical to SEQ ID NO: 545939

SEQ ID NO: 648870 - RNA, 64 nt, Homo Sapiens; identical to SEQ ID NO: 545940

SEQ ID NO: 648871 - RNA, 64 nt, Homo Sapiens; identical to SEQ ID NO: 545941

SEQ ID NO: 648872 - RNA, 64 nt, Homo Sapiens; identical to SEQ ID NO: 545942

SEQ ID NO: 648873 - RNA, 64 nt, Homo Sapiens; identical to SEQ ID NO: 545943

SEQ ID NO: 648874 - RNA, 62 nt, Homo Sapiens; identical to SEQ ID NO: 545944

SEQ ID NO: 648875 - RNA, 64 nt, Homo Sapiens; identical to SEQ ID NO: 545945

SEQ ID NO: 648876 - RNA, 64 nt, Homo Sapiens; identical to SEQ ID NO: 545946

SEQ ID NO: 648877 - RNA, 64 nt, Homo Sapiens; identical to SEQ ID NO: 545947

SEQ ID NO: 648878 - RNA, 64 nt, Homo Sapiens; identical to SEQ ID NO: 545948

SEQ ID NO: 648879 - RNA, 64 nt, Homo Sapiens; identical to SEQ ID NO: 545949

SEQ ID NO: 648880 - RNA, 64 nt, Homo Sapiens; identical to SEQ ID NO: 545950

SEQ ID NO: 648881 - RNA, 64 nt, Homo Sapiens; identical to SEQ ID NO: 545951

SEQ ID NO: 648882 - RNA, 64 nt, Homo Sapiens; identical to SEQ ID NO: 545952

SEQ ID NO: 648883 - RNA, 64 nt, Homo Sapiens; identical to SEQ ID NO: 545953

SEQ ID NO: 648884 - RNA, 64 nt, Homo Sapiens; identical to SEQ ID NO: 545954

SEQ ID NO: 648885 - RNA, 64 nt, Homo Sapiens; identical to SEQ ID NO: 545955

SEQ ID NO: 648886 - RNA, 64 nt, Homo Sapiens; identical to SEQ ID NO: 545956

SEQ ID NO: 648887 - RNA, 64 nt, Homo Sapiens; identical to SEQ ID NO: 545957

SEQ ID NO: 648888 - RNA, 64 nt, Homo Sapiens; identical to SEQ ID NO: 545958

SEQ ID NO: 648889 - RNA, 64 nt, Homo Sapiens; identical to SEQ ID NO: 545959

SEQ ID NO: 648890 - RNA, 64 nt, Homo Sapiens; identical to SEQ ID NO: 545960

SEQ ID NO: 648891 - RNA, 64 nt, Homo Sapiens; identical to SEQ ID NO: 545961

SEQ ID NO: 648892 - RNA, 64 nt, Homo Sapiens; identical to SEQ ID NO: 545962

SEQ ID NO: 648893 - RNA, 64 nt, Homo Sapiens; identical to SEQ ID NO: 545963

SEQ ID NO: 648894 - RNA, 64 nt, Homo Sapiens; identical to SEQ ID NO: 232514

SEQ ID NO: 648895 - RNA, 64 nt, Homo Sapiens; identical to SEQ ID NO: 232515

SEQ ID NO: 648896 - RNA, 64 nt, Homo Sapiens; identical to SEQ ID NO: 232516

SEQ ID NO: 648897 - RNA, 64 nt, Homo Sapiens; identical to SEQ ID NO: 232517

SEQ ID NO: 648898 - RNA, 64 nt, Homo Sapiens; identical to SEQ ID NO: 232518

SEQ ID NO: 648899 - RNA, 64 nt, Homo Sapiens; identical to SEQ ID NO: 232519

SEQ ID NO: 648900 - RNA, 64 nt, Homo Sapiens; identical to SEQ ID NO: 302252

SEQ ID NO: 648901 - RNA, 64 nt, Homo Sapiens; identical to SEQ ID NO: 302253

SEQ ID NO: 648902 - RNA, 64 nt, Homo Sapiens; identical to SEQ ID NO: 302254

SEQ ID NO: 648903 - RNA, 64 nt, Homo Sapiens; identical to SEQ ID NO: 302255

SEQ ID NO: 648904 - RNA, 64 nt, Homo Sapiens; identical to SEQ ID NO: 302256

SEQ ID NO: 648905 - RNA, 64 nt, Homo Sapiens; identical to SEQ ID NO: 302257

SEQ ID NO: 648906 - RNA, 64 nt, Homo Sapiens; identical to SEQ ID NO: 302258

SEQ ID NO: 648907 - RNA, 64 nt, Homo Sapiens; identical to SEQ ID NO: 302259

SEQ ID NO: 648908 - RNA, 64 nt, Homo Sapiens; identical to SEQ ID NO: 302260

SEQ ID NO: 648909 - RNA, 64 nt, Homo Sapiens; identical to SEQ ID NO: 302261

SEQ ID NO: 648910 - RNA, 64 nt, Homo Sapiens; identical to SEQ ID NO: 302262

SEQ ID NO: 648911 - RNA, 64 nt, Homo Sapiens; identical to SEQ ID NO: 302263

SEQ ID NO: 648912 - RNA, 64 nt, Homo Sapiens; identical to SEQ ID NO: 302264

SEQ ID NO: 648913 - RNA, 64 nt, Homo Sapiens; identical to SEQ ID NO: 302265

SEQ ID NO: 648914 - RNA, 64 nt, Homo Sapiens; identical to SEQ ID NO: 302266

SEQ ID NO: 648915 - RNA, 64 nt, Homo Sapiens; identical to SEQ ID NO: 302267

SEQ ID NO: 648916 - RNA, 64 nt, Homo Sapiens; identical to SEQ ID NO: 302268

SEQ ID NO: 648917 - RNA, 64 nt, Homo Sapiens; identical to SEQ ID NO: 302269

SEQ ID NO: 648918 - RNA, 64 nt, Homo Sapiens; identical to SEQ ID NO: 302270

SEQ ID NO: 648919 - RNA, 64 nt, Homo Sapiens; identical to SEQ ID NO: 302271

SEQ ID NO: 648920 - RNA, 64 nt, Homo Sapiens; identical to SEQ ID NO: 302272

SEQ ID NO: 648921 - RNA, 64 nt, Homo Sapiens; identical to SEQ ID NO: 302273

SEQ ID NO: 648922 - RNA, 64 nt, Homo Sapiens; identical to SEQ ID NO: 38711

SEQ ID NO: 648923 - RNA, 64 nt, Homo Sapiens; identical to SEQ ID NO: 38712

SEQ ID NO: 648924 - RNA, 64 nt, Homo Sapiens; identical to SEQ ID NO: 38713

SEQ ID NO: 648925 - RNA, 64 nt, Homo Sapiens; identical to SEQ ID NO: 38714

SEQ ID NO: 648926 - RNA, 64 nt, Homo Sapiens; identical to SEQ ID NO: 38715

SEQ ID NO: 648927 - RNA, 64 nt, Homo Sapiens; identical to SEQ ID NO: 38716

SEQ ID NO: 648928 - RNA, 64 nt, Homo Sapiens; identical to SEQ ID NO: 38717

SEQ ID NO: 648929 - RNA, 64 nt, Homo Sapiens; identical to SEQ ID NO: 38718

SEQ ID NO: 648930 - RNA, 64 nt, Homo Sapiens; identical to SEQ ID NO: 38719

SEQ ID NO: 648931 - RNA, 64 nt, Homo Sapiens; identical to SEQ ID NO: 38720

SEQ ID NO: 648932 - RNA, 64 nt, Homo Sapiens; identical to SEQ ID NO: 38721

SEQ ID NO: 648933 - RNA, 64 nt, Homo Sapiens; identical to SEQ ID NO: 38722

SEQ ID NO: 648934 - RNA, 64 nt, Homo Sapiens; identical to SEQ ID NO: 38723

SEQ ID NO: 648935 - RNA, 64 nt, Homo Sapiens; identical to SEQ ID NO: 38724

SEQ ID NO: 648936 - RNA, 64 nt, Homo Sapiens; identical to SEQ ID NO: 38725

SEQ ID NO: 648937 - RNA, 64 nt, Homo Sapiens; identical to SEQ ID NO: 38726

SEQ ID NO: 648938 - RNA, 64 nt, Homo Sapiens; identical to SEQ ID NO: 38727

SEQ ID NO: 648939 - RNA, 64 nt, Homo Sapiens; identical to SEQ ID NO: 38728

SEQ ID NO: 648940 - RNA, 64 nt, Homo Sapiens; identical to SEQ ID NO: 38729

SEQ ID NO: 648941 - RNA, 64 nt, Homo Sapiens; identical to SEQ ID NO: 38730

SEQ ID NO: 648942 - RNA, 64 nt, Homo Sapiens; identical to SEQ ID NO: 38731

SEQ ID NO: 648943 - RNA, 64 nt, Homo Sapiens; identical to SEQ ID NO: 38732

SEQ ID NO: 648944 - RNA, 64 nt, Homo Sapiens; identical to SEQ ID NO: 38733

SEQ ID NO: 648945 - RNA, 64 nt, Homo Sapiens; identical to SEQ ID NO: 38734

SEQ ID NO: 648946 - RNA, 64 nt, Homo Sapiens; identical to SEQ ID NO: 38735

SEQ ID NO: 648947 - RNA, 64 nt, Homo Sapiens; identical to SEQ ID NO: 38736

SEQ ID NO: 648948 - RNA, 64 nt, Homo Sapiens; identical to SEQ ID NO: 38737

SEQ ID NO: 648949 - RNA, 64 nt, Homo Sapiens; identical to SEQ ID NO: 38738

SEQ ID NO: 648950 - RNA, 64 nt, Homo Sapiens; identical to SEQ ID NO: 38739

SEQ ID NO: 648951 - RNA, 64 nt, Homo Sapiens; identical to SEQ ID NO: 38740

SEQ ID NO: 648952 - RNA, 64 nt, Homo Sapiens; identical to SEQ ID NO: 38741

SEQ ID NO: 648953 - RNA, 64 nt, Homo Sapiens; identical to SEQ ID NO: 38742

SEQ ID NO: 648954 - RNA, 64 nt, Homo Sapiens; identical to SEQ ID NO: 38743

SEQ ID NO: 648955 - RNA, 64 nt, Homo Sapiens; identical to SEQ ID NO: 38744

SEQ ID NO: 648956 - RNA, 64 nt, Homo Sapiens; identical to SEQ ID NO: 38745

SEQ ID NO: 648957 - RNA, 64 nt, Homo Sapiens; identical to SEQ ID NO: 38746

SEQ ID NO: 648958 - RNA, 64 nt, Homo Sapiens; identical to SEQ ID NO: 38747

SEQ ID NO: 648959 - RNA, 64 nt, Homo Sapiens; identical to SEQ ID NO: 38748

SEQ ID NO: 648960 - RNA, 64 nt, Homo Sapiens; identical to SEQ ID NO: 38749

SEQ ID NO: 648961 - RNA, 64 nt, Homo Sapiens; identical to SEQ ID NO: 38750

SEQ ID NO: 648962 - RNA, 64 nt, Homo Sapiens; identical to SEQ ID NO: 38751

SEQ ID NO: 648963 - RNA, 64 nt, Homo Sapiens; identical to SEQ ID NO: 38752

SEQ ID NO: 648964 - RNA, 64 nt, Homo Sapiens; identical to SEQ ID NO: 38753

SEQ ID NO: 648965 - RNA, 64 nt, Homo Sapiens; identical to SEQ ID NO: 38754

SEQ ID NO: 648966 - RNA, 64 nt, Homo Sapiens; identical to SEQ ID NO: 38755

SEQ ID NO: 648967 - RNA, 64 nt, Homo Sapiens; identical to SEQ ID NO: 38756

SEQ ID NO: 648968 - RNA, 64 nt, Homo Sapiens; identical to SEQ ID NO: 38757

SEQ ID NO: 648969 - RNA, 64 nt, Homo Sapiens; identical to SEQ ID NO: 38758

SEQ ID NO: 648970 - RNA, 64 nt, Homo Sapiens; identical to SEQ ID NO: 38759

SEQ ID NO: 648971 - RNA, 64 nt, Homo Sapiens; identical to SEQ ID NO: 38760

SEQ ID NO: 648972 - RNA, 64 nt, Homo Sapiens; identical to SEQ ID NO: 38761

SEQ ID NO: 648973 - RNA, 64 nt, Homo Sapiens; identical to SEQ ID NO: 38762

SEQ ID NO: 648974 - RNA, 64 nt, Homo Sapiens; identical to SEQ ID NO: 38763

SEQ ID NO: 648975 - RNA, 64 nt, Homo Sapiens; identical to SEQ ID NO: 38764

SEQ ID NO: 648976 - RNA, 64 nt, Homo Sapiens; identical to SEQ ID NO: 38765

SEQ ID NO: 648977 - RNA, 64 nt, Homo Sapiens; identical to SEQ ID NO: 38766

SEQ ID NO: 648978 - RNA, 64 nt, Homo Sapiens; identical to SEQ ID NO: 38767

SEQ ID NO: 648979 - RNA, 64 nt, Homo Sapiens; identical to SEQ ID NO: 38768

SEQ ID NO: 648980 - RNA, 64 nt, Homo Sapiens; identical to SEQ ID NO: 38769

SEQ ID NO: 648981 - RNA, 64 nt, Homo Sapiens; identical to SEQ ID NO: 38770

SEQ ID NO: 648982 - RNA, 64 nt, Homo Sapiens; identical to SEQ ID NO: 38771

SEQ ID NO: 648983 - RNA, 64 nt, Homo Sapiens; identical to SEQ ID NO: 38772

SEQ ID NO: 648984 - RNA, 64 nt, Homo Sapiens; identical to SEQ ID NO: 38773

SEQ ID NO: 648985 - RNA, 64 nt, Homo Sapiens; identical to SEQ ID NO: 38774

SEQ ID NO: 648986 - RNA, 64 nt, Homo Sapiens; identical to SEQ ID NO: 38775

SEQ ID NO: 648987 - RNA, 64 nt, Homo Sapiens; identical to SEQ ID NO: 38776

SEQ ID NO: 648988 - RNA, 64 nt, Homo Sapiens; identical to SEQ ID NO: 38777

SEQ ID NO: 648989 - RNA, 64 nt, Homo Sapiens; identical to SEQ ID NO: 38778

SEQ ID NO: 648990 - RNA, 64 nt, Homo Sapiens; identical to SEQ ID NO: 38779

SEQ ID NO: 648991 - RNA, 64 nt, Homo Sapiens; identical to SEQ ID NO: 38780

SEQ ID NO: 648992 - RNA, 64 nt, Homo Sapiens; identical to SEQ ID NO: 38781

SEQ ID NO: 648993 - RNA, 64 nt, Homo Sapiens; identical to SEQ ID NO: 38782

SEQ ID NO: 648994 - RNA, 64 nt, Homo Sapiens; identical to SEQ ID NO: 38783

SEQ ID NO: 648995 - RNA, 64 nt, Homo Sapiens; identical to SEQ ID NO: 38784

SEQ ID NO: 648996 - RNA, 64 nt, Homo Sapiens; identical to SEQ ID NO: 38785

SEQ ID NO: 648997 - RNA, 64 nt, Homo Sapiens; identical to SEQ ID NO: 38786

SEQ ID NO: 648998 - RNA, 64 nt, Homo Sapiens; identical to SEQ ID NO: 38787

SEQ ID NO: 648999 - RNA, 64 nt, Homo Sapiens; identical to SEQ ID NO: 38788

SEQ ID NO: 649000 - RNA, 64 nt, Homo Sapiens; identical to SEQ ID NO: 38789

SEQ ID NO: 649001 - RNA, 64 nt, Homo Sapiens; identical to SEQ ID NO: 38790

SEQ ID NO: 649002 - RNA, 64 nt, Homo Sapiens; identical to SEQ ID NO: 38791

SEQ ID NO: 649003 - RNA, 64 nt, Homo Sapiens
uuuuuuuguuauuuacaaaaggacaaacucaggcaaggagcaugauguugccacuccuuuuuaa

SEQ ID NO: 649004 - RNA, 64 nt, Homo Sapiens
uggaauugaguccuucagggugacaguuaaguguaaggagcaagagaaaagauaggaccaucag

SEQ ID NO: 649005 - RNA, 64 nt, Homo Sapiens
auuuuaagaggcuuuggcccguuaugccuguacuaaggagcauguucaggcagcacugacaaua

SEQ ID NO: 649006 - RNA, 64 nt, Homo Sapiens
guccugguccuaaagaguuaacccgccauacauuaaggagcagggcugacaauacugcugccuu

SEQ ID NO: 649007 - RNA, 64 nt, Homo Sapiens
ggcccaugugacuguggcauugauuguggcauuuaaggagcagugaaaggagcaguggcccgcg

SEQ ID NO: 649008 - RNA, 64 nt, Homo Sapiens
ggcccgcgugauuguggcauucuguagagaaugaaaggagcaguacagugugagacucagguug

SEQ ID NO: 649009 - RNA, 64 nt, Homo Sapiens
gugccugccauucagccagccacaggaaugggccaaggagcaaccaaggggauggagacaggac

SEQ ID NO: 649010 - RNA, 62 nt, Homo Sapiens
agaccuggcacuggaacaggugcagcucagucaaggagcagcccagacugagccuggaauga

SEQ ID NO: 649011 - RNA, 64 nt, Homo Sapiens
gccaccagguccagagaaccgacaugaguucuggaaggagcaagugaaagcuucuguuugaaga

SEQ ID NO: 649012 - RNA, 64 nt, Homo Sapiens
agacugaaaucgauauuaauaaagagaaacuuugaaggagcaggauauaagucucgccaucguc

SEQ ID NO: 649013 - RNA, 64 nt, Homo Sapiens
uccccaagccuccugaggacacaggaagagacggaaggagcaccuugacagacuugugugaguc

SEQ ID NO: 649014 - RNA, 64 nt, Homo Sapiens
uaaccgucuucacaauguauuuucaucacaguuuaaggagcaucagccgcuucucaagugggua

SEQ ID NO: 649015 - RNA, 64 nt, Homo Sapiens
agaauacuguaacaaacuucgcuugggggauaaaaaggagcaaggacuuuaucagaaacucaaa

SEQ ID NO: 649016 - RNA, 64 nt, Homo Sapiens
auauaguccagagggucagcucgagcagugagccaaggagcagccccaugauugaccagucaaa

SEQ ID NO: 649017 - RNA, 64 nt, Homo Sapiens
cagacucaccgaccgggaccucagacgcgagggaaaggagcacuaaguggggcucgccgccugc

SEQ ID NO: 649018 - RNA, 64 nt, Homo Sapiens
gaugauuuaaaagaugcuuucuaucucugggaaaaaggagcagcauuuggccauguucuuuugu

SEQ ID NO: 649019 - RNA, 64 nt, Homo Sapiens
cccuccgggccaaaugggccccagguuuccaaggaaggagcaaucugugacuccuaaaaugggu

SEQ ID NO: 649020 - RNA, 64 nt, Homo Sapiens
accgccucaguguagggaaggguccaggccagggaaggagcacccucuaguggaggcgggggug

SEQ ID NO: 649021 - RNA, 64 nt, Homo Sapiens
auggggguuggaagcaaaaaaauggggaaaaguuaaggagcaaagugggcugggagacagggac

SEQ ID NO: 649022 - RNA, 64 nt, Homo Sapiens
uaggcugccugccugugggcagucgugguugcagaaggagcaaucucuuggcccagggccaggc

SEQ ID NO: 649023 - RNA, 64 nt, Homo Sapiens
gugcaggaaggccuucaagcgcgccacgcaccucaaggagcacaugcagacacaccaggccggc

SEQ ID NO: 649024 - RNA, 64 nt, Homo Sapiens
uacaucgcagguaggaaaccacagaaccgucugcaaggagcaagcaacgguggcccuguccacc

SEQ ID NO: 649025 - RNA, 64 nt, Homo Sapiens
cuaggcccugccucugucaccucauugguccaugaaggagcagccaggggugguggaaggagca

SEQ ID NO: 649026 - RNA, 64 nt, Homo Sapiens
cauugguccaugaaggagcagccaggggugguggaaggagcacugggcuaggggucagggguca

SEQ ID NO: 649027 - RNA, 64 nt, Homo Sapiens; identical to SEQ ID NO: 74916

SEQ ID NO: 649028 - RNA, 64 nt, Homo Sapiens; identical to SEQ ID NO: 74917

SEQ ID NO: 649029 - RNA, 64 nt, Homo Sapiens; identical to SEQ ID NO: 74918

SEQ ID NO: 649030 - RNA, 64 nt, Homo Sapiens; identical to SEQ ID NO: 74919

SEQ ID NO: 649031 - RNA, 64 nt, Homo Sapiens; identical to SEQ ID NO: 74920

SEQ ID NO: 649032 - RNA, 64 nt, Homo Sapiens; identical to SEQ ID NO: 74921

SEQ ID NO: 649033 - RNA, 64 nt, Homo Sapiens; identical to SEQ ID NO: 74922

SEQ ID NO: 649034 - RNA, 64 nt, Homo Sapiens; identical to SEQ ID NO: 74923

SEQ ID NO: 649035 - RNA, 64 nt, Homo Sapiens; identical to SEQ ID NO: 74924

SEQ ID NO: 649036 - RNA, 64 nt, Homo Sapiens; identical to SEQ ID NO: 74925

SEQ ID NO: 649037 - RNA, 64 nt, Homo Sapiens; identical to SEQ ID NO: 74926

SEQ ID NO: 649038 - RNA, 64 nt, Homo Sapiens; identical to SEQ ID NO: 74927

SEQ ID NO: 649039 - RNA, 64 nt, Homo Sapiens; identical to SEQ ID NO: 74928

SEQ ID NO: 649040 - RNA, 64 nt, Homo Sapiens; identical to SEQ ID NO: 74929

SEQ ID NO: 649041 - RNA, 64 nt, Homo Sapiens; identical to SEQ ID NO: 74930

SEQ ID NO: 649042 - RNA, 64 nt, Homo Sapiens; identical to SEQ ID NO: 74931

SEQ ID NO: 649043 - RNA, 64 nt, Homo Sapiens; identical to SEQ ID NO: 74932

SEQ ID NO: 649044 - RNA, 64 nt, Homo Sapiens; identical to SEQ ID NO: 74933

SEQ ID NO: 649045 - RNA, 64 nt, Homo Sapiens; identical to SEQ ID NO: 74934

SEQ ID NO: 649046 - RNA, 64 nt, Homo Sapiens; identical to SEQ ID NO: 74935

SEQ ID NO: 649047 - RNA, 64 nt, Homo Sapiens; identical to SEQ ID NO: 74936

SEQ ID NO: 649048 - RNA, 64 nt, Homo Sapiens; identical to SEQ ID NO: 74937

SEQ ID NO: 649049 - RNA, 64 nt, Homo Sapiens; identical to SEQ ID NO: 74938

SEQ ID NO: 649050 - RNA, 64 nt, Homo Sapiens; identical to SEQ ID NO: 74939

SEQ ID NO: 649051 - RNA, 64 nt, Homo Sapiens; identical to SEQ ID NO: 74940

SEQ ID NO: 649052 - RNA, 64 nt, Homo Sapiens; identical to SEQ ID NO: 74941

SEQ ID NO: 649053 - RNA, 64 nt, Homo Sapiens; identical to SEQ ID NO: 74942

SEQ ID NO: 649054 - RNA, 64 nt, Homo Sapiens; identical to SEQ ID NO: 74943

SEQ ID NO: 649055 - RNA, 64 nt, Homo Sapiens; identical to SEQ ID NO: 74944

SEQ ID NO: 649056 - RNA, 64 nt, Homo Sapiens; identical to SEQ ID NO: 74945

SEQ ID NO: 649057 - RNA, 64 nt, Homo Sapiens; identical to SEQ ID NO: 74946

SEQ ID NO: 649058 - RNA, 64 nt, Homo Sapiens; identical to SEQ ID NO: 74947

SEQ ID NO: 649059 - RNA, 64 nt, Homo Sapiens; identical to SEQ ID NO: 74948

SEQ ID NO: 649060 - RNA, 64 nt, Homo Sapiens; identical to SEQ ID NO: 74949

SEQ ID NO: 649061 - RNA, 64 nt, Homo Sapiens; identical to SEQ ID NO: 74950

SEQ ID NO: 649062 - RNA, 64 nt, Homo Sapiens; identical to SEQ ID NO: 74951

SEQ ID NO: 649063 - RNA, 64 nt, Homo Sapiens; identical to SEQ ID NO: 74952

SEQ ID NO: 649064 - RNA, 64 nt, Homo Sapiens; identical to SEQ ID NO: 74953

SEQ ID NO: 649065 - RNA, 64 nt, Homo Sapiens; identical to SEQ ID NO: 74954

SEQ ID NO: 649066 - RNA, 64 nt, Homo Sapiens; identical to SEQ ID NO: 74955

SEQ ID NO: 649067 - RNA, 64 nt, Homo Sapiens; identical to SEQ ID NO: 74956

SEQ ID NO: 649068 - RNA, 64 nt, Homo Sapiens; identical to SEQ ID NO: 74957

SEQ ID NO: 649069 - RNA, 64 nt, Homo Sapiens; identical to SEQ ID NO: 74958

SEQ ID NO: 649070 - RNA, 64 nt, Homo Sapiens; identical to SEQ ID NO: 74959

SEQ ID NO: 649071 - RNA, 64 nt, Homo Sapiens; identical to SEQ ID NO: 74960

SEQ ID NO: 649072 - RNA, 64 nt, Homo Sapiens; identical to SEQ ID NO: 74961

SEQ ID NO: 649073 - RNA, 64 nt, Homo Sapiens; identical to SEQ ID NO: 74962

SEQ ID NO: 649074 - RNA, 64 nt, Homo Sapiens; identical to SEQ ID NO: 74963

SEQ ID NO: 649075 - RNA, 64 nt, Homo Sapiens; identical to SEQ ID NO: 74964

SEQ ID NO: 649076 - RNA, 64 nt, Homo Sapiens; identical to SEQ ID NO: 74965

SEQ ID NO: 649077 - RNA, 64 nt, Homo Sapiens; identical to SEQ ID NO: 74966

SEQ ID NO: 649078 - RNA, 64 nt, Homo Sapiens; identical to SEQ ID NO: 74967

SEQ ID NO: 649079 - RNA, 64 nt, Homo Sapiens; identical to SEQ ID NO: 74968

SEQ ID NO: 649080 - RNA, 64 nt, Homo Sapiens; identical to SEQ ID NO: 74969

SEQ ID NO: 649081 - RNA, 64 nt, Homo Sapiens; identical to SEQ ID NO: 74970

SEQ ID NO: 649082 - RNA, 64 nt, Homo Sapiens; identical to SEQ ID NO: 74971

SEQ ID NO: 649083 - RNA, 64 nt, Homo Sapiens; identical to SEQ ID NO: 74972

SEQ ID NO: 649084 - RNA, 64 nt, Homo Sapiens; identical to SEQ ID NO: 74973

SEQ ID NO: 649085 - RNA, 64 nt, Homo Sapiens; identical to SEQ ID NO: 74974

SEQ ID NO: 649086 - RNA, 64 nt, Homo Sapiens; identical to SEQ ID NO: 74975

SEQ ID NO: 649087 - RNA, 64 nt, Homo Sapiens; identical to SEQ ID NO: 74976

SEQ ID NO: 649088 - RNA, 64 nt, Homo Sapiens; identical to SEQ ID NO: 74977

SEQ ID NO: 649089 - RNA, 64 nt, Homo Sapiens; identical to SEQ ID NO: 74978

SEQ ID NO: 649090 - RNA, 64 nt, Homo Sapiens; identical to SEQ ID NO: 74979

SEQ ID NO: 649091 - RNA, 64 nt, Homo Sapiens; identical to SEQ ID NO: 74980

SEQ ID NO: 649092 - RNA, 64 nt, Homo Sapiens; identical to SEQ ID NO: 74981

SEQ ID NO: 649093 - RNA, 64 nt, Homo Sapiens; identical to SEQ ID NO: 74982

SEQ ID NO: 649094 - RNA, 64 nt, Homo Sapiens; identical to SEQ ID NO: 74983

SEQ ID NO: 649095 - RNA, 64 nt, Homo Sapiens; identical to SEQ ID NO: 74984

SEQ ID NO: 649096 - RNA, 64 nt, Homo Sapiens; identical to SEQ ID NO: 74985

SEQ ID NO: 649097 - RNA, 64 nt, Homo Sapiens; identical to SEQ ID NO: 74986

SEQ ID NO: 649098 - RNA, 64 nt, Homo Sapiens; identical to SEQ ID NO: 74987

SEQ ID NO: 649099 - RNA, 64 nt, Homo Sapiens; identical to SEQ ID NO: 74988

SEQ ID NO: 649100 - RNA, 64 nt, Homo Sapiens; identical to SEQ ID NO: 74989

SEQ ID NO: 649101 - RNA, 64 nt, Homo Sapiens; identical to SEQ ID NO: 74990

SEQ ID NO: 649102 - RNA, 64 nt, Homo Sapiens; identical to SEQ ID NO: 74991

SEQ ID NO: 649103 - RNA, 64 nt, Homo Sapiens; identical to SEQ ID NO: 74992

SEQ ID NO: 649104 - RNA, 64 nt, Homo Sapiens; identical to SEQ ID NO: 74993

SEQ ID NO: 649105 - RNA, 64 nt, Homo Sapiens; identical to SEQ ID NO: 74994

SEQ ID NO: 649106 - RNA, 64 nt, Homo Sapiens; identical to SEQ ID NO: 74995

SEQ ID NO: 649107 - RNA, 64 nt, Homo Sapiens
uucacugaaauguugggguugcuuguuauaguagucgguccaucaugaccaguaaaacauaaau

SEQ ID NO: 649108 - RNA, 64 nt, Homo Sapiens
ggccagcuaggagggaaaccaaguggggcugcacucgguccagaugguggagggaaagggagac

SEQ ID NO: 649109 - RNA, 64 nt, Homo Sapiens
aacaggaaaccugacuggggaaauguauccccuuucgguccaacucuugaaggaagcauuucua

SEQ ID NO: 649110 - RNA, 64 nt, Homo Sapiens
ugauucuggccucugugguaggcaggccuccagcucgguccaggugugaagggccagggcccug

SEQ ID NO: 649111 - RNA, 64 nt, Homo Sapiens
gauuuucugcuuucauuucuggcaaagcaauacaucgguccaaggauaaugugaacuucuacua

SEQ ID NO: 649112 - RNA, 64 nt, Homo Sapiens
gcauuuuuuauaauuuucuaagucgugcacuuucucgguccacucuuguugaagugcuguuuua

SEQ ID NO: 649113 - RNA, 64 nt, Homo Sapiens
ugugugcguguguauacuugacggcguguuugguucgguccaugguguguguggcucagcuucc

SEQ ID NO: 649114 - RNA, 64 nt, Homo Sapiens
gaacuggcagauacugguggcccugcucccugcuucgguccagaccccacccucuugcugcucg

SEQ ID NO: 649115 - RNA, 64 nt, Homo Sapiens
uccacaggaggaaucggacgagaggaugugacauucgguccaggagagaaagagcaguuucugu

SEQ ID NO: 649116 - RNA, 64 nt, Homo Sapiens
ccaaaaagguucuuuucagaucauuacucauaccucgguccaaaaguagcggggcuggagcagu

SEQ ID NO: 649117 - RNA, 64 nt, Homo Sapiens
cccaacccaccuuagcauguuacauauggggacaucgguccaagacccacuuuauucaguucug

SEQ ID NO: 649118 - RNA, 64 nt, Homo Sapiens
aaaguuagcccauauguauaauuuagguucuagaucgguccacgcaaacaauguuggaaguggu

SEQ ID NO: 649119 - RNA, 64 nt, Homo Sapiens
augcaguggggccccuggggugcccucggcagcuucgguccagccugcaucugccccucggccu

SEQ ID NO: 649120 - RNA, 64 nt, Homo Sapiens
cccugugcaccuuaccccagccaggccuuaaaugucgguccaggugccccuugccccacacaga

SEQ ID NO: 649121 - RNA, 64 nt, Homo Sapiens
gcugacugagggcauucaggaguaaaugcacaggucgguccaggcccgucuggguuugggaugc

SEQ ID NO: 649122 - RNA, 64 nt, Homo Sapiens
ugcuaaaguucuuaguauuucauuuucugguuccucgguccaguuaaaauucccagugugcaua

SEQ ID NO: 649123 - RNA, 64 nt, Homo Sapiens
cagaaccucaggcagucucugagcgaggccuccuucgguccagguccccucacagaggugcugu

SEQ ID NO: 649124 - RNA, 64 nt, Homo Sapiens
ccugggcauuuggugagaguaaccagcccaaccaucgguccacauuuuaccaaagcaucaauac

SEQ ID NO: 649125 - RNA, 64 nt, Homo Sapiens
guuucgcagcugucuccccuccgcagcagauaccucgguccagaucuccggauugucgggggac

SEQ ID NO: 649126 - RNA, 64 nt, Homo Sapiens
aauguaaauggggacuucuguaaaguucucaguuucgguccaugugguuuaucuuuacauuuua

SEQ ID NO: 649127 - RNA, 64 nt, Homo Sapiens
gcagguuggcagcuaggguuuguguuggaggcuuucgguccagugucuugcaguccuacaacaa

SEQ ID NO: 649128 - RNA, 64 nt, Homo Sapiens
uagcuuucuuugccucucuggucugugcucccauucgguccacauucccucagcaaucuguccu

SEQ ID NO: 649129 - RNA, 64 nt, Homo Sapiens
aacaggaagaggcugaggccuauuccuucuucccucgguccacgggagaaugcccauggcccuu

SEQ ID NO: 649130 - RNA, 64 nt, Homo Sapiens
ggcgugcugcggggcccugaugcccccacccaccucgguccagcgcggcccugcccaggaggcg

SEQ ID NO: 649131 - RNA, 64 nt, Homo Sapiens
ccuggcucccuccacccaacugcacccaugagacucgguccaagaguccauuccccagguggga

SEQ ID NO: 649132 - RNA, 64 nt, Homo Sapiens
aucagccaggccaucuuuucucgugaugggccacucgguccaaacacaacugcuuguucaggua

SEQ ID NO: 649133 - RNA, 64 nt, Homo Sapiens
guucucugccccucccugcccgcguuucagggccucgguccauagagaacaccaccaccauggc

SEQ ID NO: 649134 - RNA, 64 nt, Homo Sapiens
gguacauuuuccucuauugucuagcuaagggcuuucgguccaccaguaaauaagaucaaaugcu

SEQ ID NO: 649135 - RNA, 64 nt, Homo Sapiens
augcugcuggagcugaaucggaugccaccaaggcucgguccagcccaguaccgcuggaagugaa

SEQ ID NO: 649136 - RNA, 64 nt, Homo Sapiens
cagcacucggacguccccggaccagcccucagucucgguccacgcugcuuucuucccaaaggac

SEQ ID NO: 649137 - RNA, 64 nt, Homo Sapiens
uccccaacagagcccaccagcagugguggagaugucgguccaugagcgcacacacaagacugag

SEQ ID NO: 649138 - RNA, 64 nt, Homo Sapiens
gccugaugaccaaacucucccuuuccccauccaaucgguccacacuccccgcccuggccucugg

SEQ ID NO: 649139 - RNA, 64 nt, Homo Sapiens
ugucugucucauuucugcauucgucguccuucguucgguccagaagcaaccgcgacaguccugc

SEQ ID NO: 649140 - RNA, 64 nt, Homo Sapiens
gacccagaucccagggaccuaccgagcgagcagcucgguccaguccggaccuggcaguggagcc

SEQ ID NO: 649141 - RNA, 64 nt, Homo Sapiens
cuccccgcccccggccucugcuuucuccauccaaucgguccacagccugaugaccaaacucucc

SEQ ID NO: 649142 - RNA, 64 nt, Homo Sapiens
caugugggacccugauggaccugaaagaccaggaucgguccagcucagauauugagggcucuga

SEQ ID NO: 649143 - RNA, 64 nt, Homo Sapiens
cagguagggugauuuuaaugucuccugguagaccucgguccaaacuauuacuaagagaaaauuu

SEQ ID NO: 649144 - RNA, 64 nt, Homo Sapiens
ccucccugggggcagguagaccuguggggauggcucgguccaagcccaacacugcccgcuccag

SEQ ID NO: 649145 - RNA, 64 nt, Homo Sapiens
ugcucucugcuugacaacaaaagucagggugcagucgguccacccuugacugcucuuggcuugg

SEQ ID NO: 649146 - RNA, 64 nt, Homo Sapiens
cugccuggcaagguccuucccugggaaucaccacucgguccaaccuagacaaccaagaccgcua

SEQ ID NO: 649147 - RNA, 64 nt, Homo Sapiens
ucugugguggaaggacgggaccucccggggcccugccucggagcccgugccagcguucacgcuc

SEQ ID NO: 649148 - RNA, 58 nt, Homo Sapiens
ugcggucuccugccugugcuuggcugccgccucggaacaccaggaggccuucguguag

SEQ ID NO: 649149 - RNA, 64 nt, Homo Sapiens
cagucggcgggacccucauggaagcaucgcccucgccucggaccuugccuggcgcuauuuuugc

SEQ ID NO: 649150 - RNA, 64 nt, Homo Sapiens
gcgcuauuuuugcagggagcuggggagcaggaacgccucggaccugagugcucuccauauugug

SEQ ID NO: 649151 - RNA, 57 nt, Homo Sapiens; identical to SEQ ID NO: 130560

SEQ ID NO: 649152 - RNA, 64 nt, Homo Sapiens; identical to SEQ ID NO: 130561

SEQ ID NO: 649153 - RNA, 64 nt, Homo Sapiens; identical to SEQ ID NO: 130562

SEQ ID NO: 649154 - RNA, 64 nt, Homo Sapiens; identical to SEQ ID NO: 130563

SEQ ID NO: 649155 - RNA, 64 nt, Homo Sapiens; identical to SEQ ID NO: 130564

SEQ ID NO: 649156 - RNA, 64 nt, Homo Sapiens; identical to SEQ ID NO: 130565

SEQ ID NO: 649157 - RNA, 64 nt, Homo Sapiens; identical to SEQ ID NO: 130566

SEQ ID NO: 649158 - RNA, 64 nt, Homo Sapiens; identical to SEQ ID NO: 130567

SEQ ID NO: 649159 - RNA, 64 nt, Homo Sapiens; identical to SEQ ID NO: 130568

SEQ ID NO: 649160 - RNA, 64 nt, Homo Sapiens; identical to SEQ ID NO: 130569

SEQ ID NO: 649161 - RNA, 64 nt, Homo Sapiens; identical to SEQ ID NO: 130570

SEQ ID NO: 649162 - RNA, 64 nt, Homo Sapiens; identical to SEQ ID NO: 130571

SEQ ID NO: 649163 - RNA, 64 nt, Homo Sapiens; identical to SEQ ID NO: 130572

SEQ ID NO: 649164 - RNA, 64 nt, Homo Sapiens; identical to SEQ ID NO: 130573

SEQ ID NO: 649165 - RNA, 64 nt, Homo Sapiens; identical to SEQ ID NO: 130574

SEQ ID NO: 649166 - RNA, 64 nt, Homo Sapiens; identical to SEQ ID NO: 130575

SEQ ID NO: 649167 - RNA, 64 nt, Homo Sapiens; identical to SEQ ID NO: 130576

SEQ ID NO: 649168 - RNA, 64 nt, Homo Sapiens; identical to SEQ ID NO: 130577

SEQ ID NO: 649169 - RNA, 64 nt, Homo Sapiens; identical to SEQ ID NO: 130578

SEQ ID NO: 649170 - RNA, 64 nt, Homo Sapiens; identical to SEQ ID NO: 130579

SEQ ID NO: 649171 - RNA, 64 nt, Homo Sapiens; identical to SEQ ID NO: 130580

SEQ ID NO: 649172 - RNA, 64 nt, Homo Sapiens; identical to SEQ ID NO: 130581

SEQ ID NO: 649173 - RNA, 64 nt, Homo Sapiens; identical to SEQ ID NO: 130582

SEQ ID NO: 649174 - RNA, 64 nt, Homo Sapiens; identical to SEQ ID NO: 130583

SEQ ID NO: 649175 - RNA, 64 nt, Homo Sapiens; identical to SEQ ID NO: 130584

SEQ ID NO: 649176 - RNA, 64 nt, Homo Sapiens; identical to SEQ ID NO: 130585

SEQ ID NO: 649177 - RNA, 64 nt, Homo Sapiens; identical to SEQ ID NO: 130586

SEQ ID NO: 649178 - RNA, 64 nt, Homo Sapiens; identical to SEQ ID NO: 130587

SEQ ID NO: 649179 - RNA, 64 nt, Homo Sapiens; identical to SEQ ID NO: 130588

SEQ ID NO: 649180 - RNA, 64 nt, Homo Sapiens; identical to SEQ ID NO: 130589

SEQ ID NO: 649181 - RNA, 64 nt, Homo Sapiens; identical to SEQ ID NO: 130590

SEQ ID NO: 649182 - RNA, 64 nt, Homo Sapiens; identical to SEQ ID NO: 130591

SEQ ID NO: 649183 - RNA, 64 nt, Homo Sapiens; identical to SEQ ID NO: 130592

SEQ ID NO: 649184 - RNA, 64 nt, Homo Sapiens; identical to SEQ ID NO: 130593

SEQ ID NO: 649185 - RNA, 64 nt, Homo Sapiens; identical to SEQ ID NO: 130594

SEQ ID NO: 649186 - RNA, 64 nt, Homo Sapiens; identical to SEQ ID NO: 130595

SEQ ID NO: 649187 - RNA, 64 nt, Homo Sapiens; identical to SEQ ID NO: 130596

SEQ ID NO: 649188 - RNA, 64 nt, Homo Sapiens; identical to SEQ ID NO: 130597

SEQ ID NO: 649189 - RNA, 64 nt, Homo Sapiens; identical to SEQ ID NO: 130598

SEQ ID NO: 649190 - RNA, 64 nt, Homo Sapiens; identical to SEQ ID NO: 130599

SEQ ID NO: 649191 - RNA, 64 nt, Homo Sapiens; identical to SEQ ID NO: 130600

SEQ ID NO: 649192 - RNA, 64 nt, Homo Sapiens; identical to SEQ ID NO: 130601

SEQ ID NO: 649193 - RNA, 64 nt, Homo Sapiens; identical to SEQ ID NO: 130602

SEQ ID NO: 649194 - RNA, 64 nt, Homo Sapiens; identical to SEQ ID NO: 130603

SEQ ID NO: 649195 - RNA, 64 nt, Homo Sapiens; identical to SEQ ID NO: 130604

SEQ ID NO: 649196 - RNA, 64 nt, Homo Sapiens; identical to SEQ ID NO: 130605

SEQ ID NO: 649197 - RNA, 64 nt, Homo Sapiens; identical to SEQ ID NO: 130606

SEQ ID NO: 649198 - RNA, 64 nt, Homo Sapiens; identical to SEQ ID NO: 130607

SEQ ID NO: 649199 - RNA, 64 nt, Homo Sapiens; identical to SEQ ID NO: 130608

SEQ ID NO: 649200 - RNA, 64 nt, Homo Sapiens; identical to SEQ ID NO: 130609

SEQ ID NO: 649201 - RNA, 64 nt, Homo Sapiens; identical to SEQ ID NO: 130610

SEQ ID NO: 649202 - RNA, 64 nt, Homo Sapiens; identical to SEQ ID NO: 130611

SEQ ID NO: 649203 - RNA, 64 nt, Homo Sapiens; identical to SEQ ID NO: 72506

SEQ ID NO: 649204 - RNA, 64 nt, Homo Sapiens; identical to SEQ ID NO: 72507

SEQ ID NO: 649205 - RNA, 64 nt, Homo Sapiens; identical to SEQ ID NO: 72508

SEQ ID NO: 649206 - RNA, 64 nt, Homo Sapiens; identical to SEQ ID NO: 72509

SEQ ID NO: 649207 - RNA, 64 nt, Homo Sapiens; identical to SEQ ID NO: 72510

SEQ ID NO: 649208 - RNA, 64 nt, Homo Sapiens; identical to SEQ ID NO: 72511

SEQ ID NO: 649209 - RNA, 64 nt, Homo Sapiens; identical to SEQ ID NO: 72512

SEQ ID NO: 649210 - RNA, 64 nt, Homo Sapiens; identical to SEQ ID NO: 72513

SEQ ID NO: 649211 - RNA, 64 nt, Homo Sapiens; identical to SEQ ID NO: 72514

SEQ ID NO: 649212 - RNA, 64 nt, Homo Sapiens; identical to SEQ ID NO: 72515

SEQ ID NO: 649213 - RNA, 64 nt, Homo Sapiens; identical to SEQ ID NO: 72516

SEQ ID NO: 649214 - RNA, 64 nt, Homo Sapiens; identical to SEQ ID NO: 72517

SEQ ID NO: 649215 - RNA, 64 nt, Homo Sapiens; identical to SEQ ID NO: 72518

SEQ ID NO: 649216 - RNA, 64 nt, Homo Sapiens; identical to SEQ ID NO: 72519

SEQ ID NO: 649217 - RNA, 64 nt, Homo Sapiens; identical to SEQ ID NO: 72520

SEQ ID NO: 649218 - RNA, 64 nt, Homo Sapiens; identical to SEQ ID NO: 72521

SEQ ID NO: 649219 - RNA, 64 nt, Homo Sapiens; identical to SEQ ID NO: 72522

SEQ ID NO: 649220 - RNA, 64 nt, Homo Sapiens; identical to SEQ ID NO: 72523

SEQ ID NO: 649221 - RNA, 64 nt, Homo Sapiens; identical to SEQ ID NO: 72524

SEQ ID NO: 649222 - RNA, 64 nt, Homo Sapiens; identical to SEQ ID NO: 72525

SEQ ID NO: 649223 - RNA, 64 nt, Homo Sapiens; identical to SEQ ID NO: 72526

SEQ ID NO: 649224 - RNA, 64 nt, Homo Sapiens; identical to SEQ ID NO: 72527

SEQ ID NO: 649225 - RNA, 64 nt, Homo Sapiens; identical to SEQ ID NO: 72528

SEQ ID NO: 649226 - RNA, 64 nt, Homo Sapiens; identical to SEQ ID NO: 72529

SEQ ID NO: 649227 - RNA, 64 nt, Homo Sapiens; identical to SEQ ID NO: 72530

SEQ ID NO: 649228 - RNA, 64 nt, Homo Sapiens; identical to SEQ ID NO: 72531

SEQ ID NO: 649229 - RNA, 64 nt, Homo Sapiens; identical to SEQ ID NO: 72532

SEQ ID NO: 649230 - RNA, 64 nt, Homo Sapiens; identical to SEQ ID NO: 72533

SEQ ID NO: 649231 - RNA, 64 nt, Homo Sapiens; identical to SEQ ID NO: 72534

SEQ ID NO: 649232 - RNA, 64 nt, Homo Sapiens; identical to SEQ ID NO: 72535

SEQ ID NO: 649233 - RNA, 64 nt, Homo Sapiens; identical to SEQ ID NO: 72536

SEQ ID NO: 649234 - RNA, 64 nt, Homo Sapiens; identical to SEQ ID NO: 72537

SEQ ID NO: 649235 - RNA, 64 nt, Homo Sapiens; identical to SEQ ID NO: 72538

SEQ ID NO: 649236 - RNA, 64 nt, Homo Sapiens; identical to SEQ ID NO: 72539

SEQ ID NO: 649237 - RNA, 64 nt, Homo Sapiens; identical to SEQ ID NO: 72540

SEQ ID NO: 649238 - RNA, 64 nt, Homo Sapiens; identical to SEQ ID NO: 72541

SEQ ID NO: 649239 - RNA, 64 nt, Homo Sapiens; identical to SEQ ID NO: 72542

SEQ ID NO: 649240 - RNA, 64 nt, Homo Sapiens; identical to SEQ ID NO: 72543

SEQ ID NO: 649241 - RNA, 64 nt, Homo Sapiens; identical to SEQ ID NO: 72544

SEQ ID NO: 649242 - RNA, 64 nt, Homo Sapiens; identical to SEQ ID NO: 72545

SEQ ID NO: 649243 - RNA, 64 nt, Homo Sapiens; identical to SEQ ID NO: 72546

SEQ ID NO: 649244 - RNA, 64 nt, Homo Sapiens; identical to SEQ ID NO: 72547

SEQ ID NO: 649245 - RNA, 64 nt, Homo Sapiens; identical to SEQ ID NO: 72548

SEQ ID NO: 649246 - RNA, 64 nt, Homo Sapiens; identical to SEQ ID NO: 72549

SEQ ID NO: 649247 - RNA, 64 nt, Homo Sapiens; identical to SEQ ID NO: 72550

SEQ ID NO: 649248 - RNA, 64 nt, Homo Sapiens; identical to SEQ ID NO: 72551

SEQ ID NO: 649249 - RNA, 64 nt, Homo Sapiens; identical to SEQ ID NO: 72552

SEQ ID NO: 649250 - RNA, 64 nt, Homo Sapiens; identical to SEQ ID NO: 72553

SEQ ID NO: 649251 - RNA, 64 nt, Homo Sapiens; identical to SEQ ID NO: 72554

SEQ ID NO: 649252 - RNA, 64 nt, Homo Sapiens; identical to SEQ ID NO: 72555

SEQ ID NO: 649253 - RNA, 64 nt, Homo Sapiens; identical to SEQ ID NO: 72556

SEQ ID NO: 649254 - RNA, 64 nt, Homo Sapiens; identical to SEQ ID NO: 72557

SEQ ID NO: 649255 - RNA, 64 nt, Homo Sapiens; identical to SEQ ID NO: 72558

SEQ ID NO: 649256 - RNA, 64 nt, Homo Sapiens; identical to SEQ ID NO: 72559

SEQ ID NO: 649257 - RNA, 64 nt, Homo Sapiens; identical to SEQ ID NO: 72560

SEQ ID NO: 649258 - RNA, 64 nt, Homo Sapiens; identical to SEQ ID NO: 72561

SEQ ID NO: 649259 - RNA, 64 nt, Homo Sapiens; identical to SEQ ID NO: 72562

SEQ ID NO: 649260 - RNA, 64 nt, Homo Sapiens; identical to SEQ ID NO: 72563

SEQ ID NO: 649261 - RNA, 64 nt, Homo Sapiens; identical to SEQ ID NO: 72564

SEQ ID NO: 649262 - RNA, 64 nt, Homo Sapiens; identical to SEQ ID NO: 72565

SEQ ID NO: 649263 - RNA, 64 nt, Homo Sapiens; identical to SEQ ID NO: 72566

SEQ ID NO: 649264 - RNA, 64 nt, Homo Sapiens; identical to SEQ ID NO: 72567

SEQ ID NO: 649265 - RNA, 64 nt, Homo Sapiens; identical to SEQ ID NO: 72568

SEQ ID NO: 649266 - RNA, 64 nt, Homo Sapiens; identical to SEQ ID NO: 72569

SEQ ID NO: 649267 - RNA, 64 nt, Homo Sapiens; identical to SEQ ID NO: 72570

SEQ ID NO: 649268 - RNA, 64 nt, Homo Sapiens; identical to SEQ ID NO: 72571

SEQ ID NO: 649269 - RNA, 64 nt, Homo Sapiens; identical to SEQ ID NO: 72572

SEQ ID NO: 649270 - RNA, 64 nt, Homo Sapiens; identical to SEQ ID NO: 72573

SEQ ID NO: 649271 - RNA, 64 nt, Homo Sapiens; identical to SEQ ID NO: 72574

SEQ ID NO: 649272 - RNA, 64 nt, Homo Sapiens; identical to SEQ ID NO: 72575

SEQ ID NO: 649273 - RNA, 64 nt, Homo Sapiens; identical to SEQ ID NO: 72576

SEQ ID NO: 649274 - RNA, 64 nt, Homo Sapiens; identical to SEQ ID NO: 72577

SEQ ID NO: 649275 - RNA, 64 nt, Homo Sapiens; identical to SEQ ID NO: 72578

SEQ ID NO: 649276 - RNA, 64 nt, Homo Sapiens; identical to SEQ ID NO: 72579

SEQ ID NO: 649277 - RNA, 64 nt, Homo Sapiens; identical to SEQ ID NO: 72580

SEQ ID NO: 649278 - RNA, 64 nt, Homo Sapiens; identical to SEQ ID NO: 72581

SEQ ID NO: 649279 - RNA, 64 nt, Homo Sapiens; identical to SEQ ID NO: 72582

SEQ ID NO: 649280 - RNA, 64 nt, Homo Sapiens; identical to SEQ ID NO: 72583

SEQ ID NO: 649281 - RNA, 64 nt, Homo Sapiens; identical to SEQ ID NO: 72584

SEQ ID NO: 649282 - RNA, 64 nt, Homo Sapiens; identical to SEQ ID NO: 72585

SEQ ID NO: 649283 - RNA, 64 nt, Homo Sapiens; identical to SEQ ID NO: 72586

SEQ ID NO: 649284 - RNA, 64 nt, Homo Sapiens; identical to SEQ ID NO: 72587

SEQ ID NO: 649285 - RNA, 64 nt, Homo Sapiens; identical to SEQ ID NO: 72588

SEQ ID NO: 649286 - RNA, 64 nt, Homo Sapiens; identical to SEQ ID NO: 72589

SEQ ID NO: 649287 - RNA, 64 nt, Homo Sapiens; identical to SEQ ID NO: 72590

SEQ ID NO: 649288 - RNA, 64 nt, Homo Sapiens; identical to SEQ ID NO: 72591

SEQ ID NO: 649289 - RNA, 64 nt, Homo Sapiens; identical to SEQ ID NO: 72592

SEQ ID NO: 649290 - RNA, 64 nt, Homo Sapiens; identical to SEQ ID NO: 72593

SEQ ID NO: 649291 - RNA, 64 nt, Homo Sapiens; identical to SEQ ID NO: 72594

SEQ ID NO: 649292 - RNA, 64 nt, Homo Sapiens; identical to SEQ ID NO: 72595

SEQ ID NO: 649293 - RNA, 64 nt, Homo Sapiens; identical to SEQ ID NO: 72596

SEQ ID NO: 649294 - RNA, 64 nt, Homo Sapiens; identical to SEQ ID NO: 72597

SEQ ID NO: 649295 - RNA, 64 nt, Homo Sapiens; identical to SEQ ID NO: 72598

SEQ ID NO: 649296 - RNA, 64 nt, Homo Sapiens; identical to SEQ ID NO: 72599

SEQ ID NO: 649297 - RNA, 64 nt, Homo Sapiens; identical to SEQ ID NO: 72600

SEQ ID NO: 649298 - RNA, 64 nt, Homo Sapiens; identical to SEQ ID NO: 72601

SEQ ID NO: 649299 - RNA, 64 nt, Homo Sapiens; identical to SEQ ID NO: 198753

SEQ ID NO: 649300 - RNA, 64 nt, Homo Sapiens; identical to SEQ ID NO: 198754

SEQ ID NO: 649301 - RNA, 64 nt, Homo Sapiens; identical to SEQ ID NO: 198755

SEQ ID NO: 649302 - RNA, 64 nt, Homo Sapiens; identical to SEQ ID NO: 198756

SEQ ID NO: 649303 - RNA, 64 nt, Homo Sapiens; identical to SEQ ID NO: 198757

SEQ ID NO: 649304 - RNA, 64 nt, Homo Sapiens; identical to SEQ ID NO: 198758

SEQ ID NO: 649305 - RNA, 64 nt, Homo Sapiens; identical to SEQ ID NO: 198759

SEQ ID NO: 649306 - RNA, 64 nt, Homo Sapiens; identical to SEQ ID NO: 198760

SEQ ID NO: 649307 - RNA, 64 nt, Homo Sapiens; identical to SEQ ID NO: 198761

SEQ ID NO: 649308 - RNA, 64 nt, Homo Sapiens; identical to SEQ ID NO: 198762

SEQ ID NO: 649309 - RNA, 64 nt, Homo Sapiens; identical to SEQ ID NO: 198763

SEQ ID NO: 649310 - RNA, 64 nt, Homo Sapiens; identical to SEQ ID NO: 198764

SEQ ID NO: 649311 - RNA, 64 nt, Homo Sapiens; identical to SEQ ID NO: 198765

SEQ ID NO: 649312 - RNA, 64 nt, Homo Sapiens; identical to SEQ ID NO: 198766

SEQ ID NO: 649313 - RNA, 64 nt, Homo Sapiens; identical to SEQ ID NO: 198767

SEQ ID NO: 649314 - RNA, 64 nt, Homo Sapiens; identical to SEQ ID NO: 198768

SEQ ID NO: 649315 - RNA, 64 nt, Homo Sapiens; identical to SEQ ID NO: 198769

SEQ ID NO: 649316 - RNA, 64 nt, Homo Sapiens; identical to SEQ ID NO: 198770

SEQ ID NO: 649317 - RNA, 64 nt, Homo Sapiens; identical to SEQ ID NO: 198771

SEQ ID NO: 649318 - RNA, 64 nt, Homo Sapiens; identical to SEQ ID NO: 198772

SEQ ID NO: 649319 - RNA, 64 nt, Homo Sapiens; identical to SEQ ID NO: 198773

SEQ ID NO: 649320 - RNA, 64 nt, Homo Sapiens; identical to SEQ ID NO: 198774

SEQ ID NO: 649321 - RNA, 64 nt, Homo Sapiens; identical to SEQ ID NO: 198775

SEQ ID NO: 649322 - RNA, 64 nt, Homo Sapiens; identical to SEQ ID NO: 198776

SEQ ID NO: 649323 - RNA, 64 nt, Homo Sapiens; identical to SEQ ID NO: 198777

SEQ ID NO: 649324 - RNA, 64 nt, Homo Sapiens; identical to SEQ ID NO: 198778

SEQ ID NO: 649325 - RNA, 64 nt, Homo Sapiens; identical to SEQ ID NO: 198779

SEQ ID NO: 649326 - RNA, 64 nt, Homo Sapiens; identical to SEQ ID NO: 198780

SEQ ID NO: 649327 - RNA, 64 nt, Homo Sapiens; identical to SEQ ID NO: 198781

SEQ ID NO: 649328 - RNA, 64 nt, Homo Sapiens; identical to SEQ ID NO: 198782

SEQ ID NO: 649329 - RNA, 64 nt, Homo Sapiens; identical to SEQ ID NO: 198783

SEQ ID NO: 649330 - RNA, 64 nt, Homo Sapiens; identical to SEQ ID NO: 198784

SEQ ID NO: 649331 - RNA, 64 nt, Homo Sapiens; identical to SEQ ID NO: 198785

SEQ ID NO: 649332 - RNA, 64 nt, Homo Sapiens; identical to SEQ ID NO: 198786

SEQ ID NO: 649333 - RNA, 64 nt, Homo Sapiens; identical to SEQ ID NO: 198787

SEQ ID NO: 649334 - RNA, 64 nt, Homo Sapiens; identical to SEQ ID NO: 198788

SEQ ID NO: 649335 - RNA, 64 nt, Homo Sapiens; identical to SEQ ID NO: 198789

SEQ ID NO: 649336 - RNA, 64 nt, Homo Sapiens; identical to SEQ ID NO: 198790

SEQ ID NO: 649337 - RNA, 64 nt, Homo Sapiens; identical to SEQ ID NO: 198791

SEQ ID NO: 649338 - RNA, 64 nt, Homo Sapiens; identical to SEQ ID NO: 198792

SEQ ID NO: 649339 - RNA, 64 nt, Homo Sapiens; identical to SEQ ID NO: 198793

SEQ ID NO: 649340 - RNA, 64 nt, Homo Sapiens; identical to SEQ ID NO: 198794

SEQ ID NO: 649341 - RNA, 64 nt, Homo Sapiens; identical to SEQ ID NO: 198795

SEQ ID NO: 649342 - RNA, 64 nt, Homo Sapiens; identical to SEQ ID NO: 198796

SEQ ID NO: 649343 - RNA, 64 nt, Homo Sapiens; identical to SEQ ID NO: 198797

SEQ ID NO: 649344 - RNA, 64 nt, Homo Sapiens; identical to SEQ ID NO: 198798

SEQ ID NO: 649345 - RNA, 64 nt, Homo Sapiens; identical to SEQ ID NO: 198799

SEQ ID NO: 649346 - RNA, 64 nt, Homo Sapiens
uagagugacucagacacaccacaguaacaacucucgcugcaauuuuauuuuaauuugagaaaua

SEQ ID NO: 649347 - RNA, 64 nt, Homo Sapiens
cccaccucccagguucaagcgcaugaucucagcucgcugcaaccagccaggcuggagugcagug

SEQ ID NO: 649348 - RNA, 64 nt, Homo Sapiens
uuugggucucaauuuuuacuuauucauaucucuacgcugcaaauccugccugugucuauuauua

SEQ ID NO: 649349 - RNA, 64 nt, Homo Sapiens
uugcagccuuuaccacuacauguaguuuucuaaacgcugcaaauaaagcaaagcuuguugauag

SEQ ID NO: 649350 - RNA, 64 nt, Homo Sapiens
acccagugaacugacuuucuaguucuagaaguuccgcugcaaggccaggaaagcuugagaaagg

SEQ ID NO: 649351 - RNA, 64 nt, Homo Sapiens
cgccaggcuggagugcaguggcgcagucucggcucgcugcaaccucugacucccugguucaaac

SEQ ID NO: 649352 - RNA, 64 nt, Homo Sapiens
uguugauagcaagugaauuuaaggccagcaaauucgcugcaaccguuucuagggaaaugaaaga

SEQ ID NO: 649353 - RNA, 64 nt, Homo Sapiens
aauacuguuguucuccucgcacugaaacgcagaacgcugcaaccggagccacaggguguuuugc

SEQ ID NO: 649354 - RNA, 64 nt, Homo Sapiens
cagauugcugggaggacugggcacaccacccucccgcugcaagucgugcaagugagccccgugu

SEQ ID NO: 649355 - RNA, 64 nt, Homo Sapiens
cuuccccucaguuguuucuaagagcagagucucccgcugcaaucugggugguaacugccagccu

SEQ ID NO: 649356 - RNA, 64 nt, Homo Sapiens
ugaacaggggaugucaaaucgauucuugaauucccgcugcaagcuagagccgcaggcacccucu

SEQ ID NO: 649357 - RNA, 64 nt, Homo Sapiens
gcucuucccacccuccacccaccagaguggaacccgcugcaaaauccccagccuuaauucuugc

SEQ ID NO: 649358 - RNA, 64 nt, Homo Sapiens
uuuaucuauuauauauuaaacauucuugcugcugcgcugcaaaaccauagcagauuugaggcac

SEQ ID NO: 649359 - RNA, 64 nt, Homo Sapiens
cacccaagucacagaaauaaaaaacugacuuuaccgcugcaauuuuucuguuuuccuccuuacu

SEQ ID NO: 649360 - RNA, 64 nt, Homo Sapiens
acccucccggaggcauacuugguuuccugacagccgcugcaauacacagucuugacggugccau

SEQ ID NO: 649361 - RNA, 64 nt, Homo Sapiens
gaaagaacaaccuuaaaacugaaacuugauucaucgcugcaaaguuccccaauggacuccagaa

SEQ ID NO: 649362 - RNA, 64 nt, Homo Sapiens
uccuucggcuuugcccccuuagggaccaggccagcgcugcaaccgggcgaguagaugccugggc

SEQ ID NO: 649363 - RNA, 64 nt, Homo Sapiens
aaaccuucugagucagcccuguccgccccgccagcgcugcaaaugcaccccgaggccgccaauu

SEQ ID NO: 649364 - RNA, 64 nt, Homo Sapiens
gccccucauggccaggagcccugugcccuggcgccgcugcaacaucugcugugucucgcccacc

SEQ ID NO: 649365 - RNA, 64 nt, Homo Sapiens
uaaucacaauagauaaaagugcaaaagcagaaaucgcugcaaggugaugcuugagaugguuuuu

SEQ ID NO: 649366 - RNA, 64 nt, Homo Sapiens
gaaucccgcuggagagcaaacacgaacuucuguucgcugcaaaaugguuagaaagaaacagcug

SEQ ID NO: 649367 - RNA, 64 nt, Homo Sapiens
aaagaggcagaaaaguugguuugguuugcaguaacgcugcaacuagaaaauauaugcacuucag

SEQ ID NO: 649368 - RNA, 64 nt, Homo Sapiens
acagccacgaagaacaugcaggagggcccaaugucgcugcaaaccaccuuugaccccaaggccu

SEQ ID NO: 649369 - RNA, 64 nt, Homo Sapiens
guccuacacaaucagaauuugccuuuuuaagucacgcugcaacuauuccggcuuuuuauauggc

SEQ ID NO: 649370 - RNA, 64 nt, Homo Sapiens
ugaagccucgugccacacuggcuuugagguagcacgcugcaaguuagugaguggaguugcccaa

SEQ ID NO: 649371 - RNA, 64 nt, Homo Sapiens
aaaaaaaaaauguuggcuacuauuuugugaauuacgcugcaaaagagguuaucaucauuauuug

SEQ ID NO: 649372 - RNA, 64 nt, Homo Sapiens
uccuccaccgagggaggccucacaaaccacaggacgcugcaacgggucaggcuggcgggcccgg

SEQ ID NO: 649373 - RNA, 64 nt, Homo Sapiens
gccucggcagcuugggauuagcuugggagcgcagcgcugcaaaguggaaaauaugaaaagacca

SEQ ID NO: 649374 - RNA, 64 nt, Homo Sapiens
gacaugcauuuacucucugccgugggucugcagucgcugcaaccuacccucucucugccucagc

SEQ ID NO: 649375 - RNA, 64 nt, Homo Sapiens
caagagcguguggucuugugguuucaauaaaugccgcugcaaugucuggguugucucgaucugu

SEQ ID NO: 649376 - RNA, 64 nt, Homo Sapiens
aacuuguccccagugucaccagaccuucugugugcgcugcaagcgccaggugaggcacauucau

SEQ ID NO: 649377 - RNA, 64 nt, Homo Sapiens
uacuuucugacguaauguaauucaggaagacagacgcugcaaucacagauuuuaaaaaauuguu

SEQ ID NO: 649378 - RNA, 64 nt, Homo Sapiens
uucaccuccuggguucaagcgcacuaucucagcucgcugcaaccgcccaggcuggagugcaaug

SEQ ID NO: 649379 - RNA, 64 nt, Homo Sapiens
caucucagccuuccugaccucugccccaaacacacgcugcaauuuugucuccuccuuuucuguu

SEQ ID NO: 649380 - RNA, 64 nt, Homo Sapiens
auguucuguguuguuuccuuagaccugugguguccgcugcaacagcuacuagccacguguagcu

SEQ ID NO: 649381 - RNA, 64 nt, Homo Sapiens
guuaggacuuuguccacucagcuucugcccaggccgcugcaaagcuuggugaccauugauugcu

SEQ ID NO: 649382 - RNA, 64 nt, Homo Sapiens
cgggaaggaggcaacugccucacuuaacauccuccgcugcaaggugguggcgccgagaggcgug

SEQ ID NO: 649383 - RNA, 64 nt, Homo Sapiens
gccugcagggcccucccuuuucccauuguuccugcgcugcaaauugcaggccccagcaaucgug

SEQ ID NO: 649384 - RNA, 64 nt, Homo Sapiens
cucggagggcugguguucaccaaguuucccuccucgcugcaacccaaugacaccuguauuguuc

SEQ ID NO: 649385 - RNA, 64 nt, Homo Sapiens
acccaggcuggagugcaguggcaugaucucaggucgcugcaaccucugccuccaggguucaagc

SEQ ID NO: 649386 - RNA, 64 nt, Homo Sapiens
gcacuaaacauggaaaggaacaacugauaccagccgcugcaaaaucaugccaaaauguaaagac

SEQ ID NO: 649387 - RNA, 64 nt, Homo Sapiens
ucugccuccuggguucaagcgcacaaucucagcucgcugcaaccguccaggcuggagugcagug

SEQ ID NO: 649388 - RNA, 64 nt, Homo Sapiens
cugguuuuauugcuccuucauaagccaggaccuucgcugcaaacguguaaccagcgggguaagu

SEQ ID NO: 649389 - RNA, 64 nt, Homo Sapiens
uuuucuaagcccggccucgucucgccggaggagacgcugcaauaaagguugggagaaggcgcgg

SEQ ID NO: 649390 - RNA, 64 nt, Homo Sapiens
ccugugugacucaguucuuuccaucuguuugucccgcugcaagccucuuucugcgcugacugug

SEQ ID NO: 649391 - RNA, 64 nt, Homo Sapiens
ccauagcagauuugaggcgccauucuugcugcugcgcugcaaaguuuaucuauuauauauuaaa

SEQ ID NO: 649392 - RNA, 64 nt, Homo Sapiens
ccuagacuucccaacagccucccaugagccugcccgcugcaaugcccuggacaccccugcucua

SEQ ID NO: 649393 - RNA, 64 nt, Homo Sapiens
ucugacucccugguucaaacgcgcagucucggcucgcugcaacccgccaggcuggagugcagug

SEQ ID NO: 649394 - RNA, 64 nt, Homo Sapiens
uaauaaauagucugcugauucuagaguagacaaucuggacuaugagcuauucauaaccuauauu

SEQ ID NO: 649395 - RNA, 64 nt, Homo Sapiens
uucuauaggauaauugcuggcagaauauaauaaucuggacuauuaaguaugaauaaaggugugg

SEQ ID NO: 649396 - RNA, 64 nt, Homo Sapiens
uagcuacgugaggccugcacagcuaaguguggagcuggacuacggcggcaguauggaauuccag

SEQ ID NO: 649397 - RNA, 64 nt, Homo Sapiens
ucuaccugaugaaccugagcgggugccgaagcuacuggacuaugcugauggguauguccuaccc

SEQ ID NO: 649398 - RNA, 64 nt, Homo Sapiens
gcuuacuuuuauuacagucaauuuugaggauauucuggacuaaauauuuaagugcagucauuuc

SEQ ID NO: 649399 - RNA, 64 nt, Homo Sapiens
ucauuucuuuuugguuugcaaaaagagcacagcccuggacuacaaguuuggagauuuaaauucu

SEQ ID NO: 649400 - RNA, 64 nt, Homo Sapiens
aguuuggagaucuaaauucuaaaagagcacagcccuggacuaugucauuucuuuuugguuugca

SEQ ID NO: 649401 - RNA, 64 nt, Homo Sapiens
uauuuaagugcagucauuucauuuugaggauauucuggacuaaagcuaacuuuuauuacaguca

SEQ ID NO: 649402 - RNA, 64 nt, Homo Sapiens; identical to SEQ ID NO: 110824

SEQ ID NO: 649403 - RNA, 64 nt, Homo Sapiens; identical to SEQ ID NO: 110825

SEQ ID NO: 649404 - RNA, 64 nt, Homo Sapiens; identical to SEQ ID NO: 110826

SEQ ID NO: 649405 - RNA, 64 nt, Homo Sapiens; identical to SEQ ID NO: 110827

SEQ ID NO: 649406 - RNA, 64 nt, Homo Sapiens; identical to SEQ ID NO: 110828

SEQ ID NO: 649407 - RNA, 64 nt, Homo Sapiens; identical to SEQ ID NO: 110829

SEQ ID NO: 649408 - RNA, 64 nt, Homo Sapiens; identical to SEQ ID NO: 110830

SEQ ID NO: 649409 - RNA, 64 nt, Homo Sapiens; identical to SEQ ID NO: 110831

SEQ ID NO: 649410 - RNA, 64 nt, Homo Sapiens; identical to SEQ ID NO: 110832

SEQ ID NO: 649411 - RNA, 64 nt, Homo Sapiens; identical to SEQ ID NO: 110833

SEQ ID NO: 649412 - RNA, 64 nt, Homo Sapiens; identical to SEQ ID NO: 608457

SEQ ID NO: 649413 - RNA, 64 nt, Homo Sapiens; identical to SEQ ID NO: 608458

SEQ ID NO: 649414 - RNA, 64 nt, Homo Sapiens; identical to SEQ ID NO: 608459

SEQ ID NO: 649415 - RNA, 64 nt, Homo Sapiens; identical to SEQ ID NO: 608460

SEQ ID NO: 649416 - RNA, 64 nt, Homo Sapiens; identical to SEQ ID NO: 608461

SEQ ID NO: 649417 - RNA, 64 nt, Homo Sapiens; identical to SEQ ID NO: 608462

SEQ ID NO: 649418 - RNA, 64 nt, Homo Sapiens; identical to SEQ ID NO: 608463

SEQ ID NO: 649419 - RNA, 64 nt, Homo Sapiens; identical to SEQ ID NO: 608464

SEQ ID NO: 649420 - RNA, 64 nt, Homo Sapiens; identical to SEQ ID NO: 608465

SEQ ID NO: 649421 - RNA, 64 nt, Homo Sapiens; identical to SEQ ID NO: 608466

SEQ ID NO: 649422 - RNA, 64 nt, Homo Sapiens; identical to SEQ ID NO: 257640

SEQ ID NO: 649423 - RNA, 64 nt, Homo Sapiens; identical to SEQ ID NO: 257641

SEQ ID NO: 649424 - RNA, 64 nt, Homo Sapiens; identical to SEQ ID NO: 257642

SEQ ID NO: 649425 - RNA, 64 nt, Homo Sapiens; identical to SEQ ID NO: 257642

SEQ ID NO: 649426 - RNA, 64 nt, Homo Sapiens; identical to SEQ ID NO: 257644

SEQ ID NO: 649427 - RNA, 64 nt, Homo Sapiens; identical to SEQ ID NO: 257645

SEQ ID NO: 649428 - RNA, 64 nt, Homo Sapiens; identical to SEQ ID NO: 257646

SEQ ID NO: 649429 - RNA, 64 nt, Homo Sapiens; identical to SEQ ID NO: 257647

SEQ ID NO: 649430 - RNA, 64 nt, Homo Sapiens; identical to SEQ ID NO: 300937

SEQ ID NO: 649431 - RNA, 64 nt, Homo Sapiens; identical to SEQ ID NO: 300938

SEQ ID NO: 649432 - RNA, 64 nt, Homo Sapiens; identical to SEQ ID NO: 300939

SEQ ID NO: 649433 - RNA, 64 nt, Homo Sapiens; identical to SEQ ID NO: 300940

SEQ ID NO: 649434 - RNA, 64 nt, Homo Sapiens; identical to SEQ ID NO: 300941

SEQ ID NO: 649435 - RNA, 64 nt, Homo Sapiens; identical to SEQ ID NO: 300942

SEQ ID NO: 649436 - RNA, 64 nt, Homo Sapiens; identical to SEQ ID NO: 300943

SEQ ID NO: 649437 - RNA, 64 nt, Homo Sapiens; identical to SEQ ID NO: 300944

SEQ ID NO: 649438 - RNA, 64 nt, Homo Sapiens; identical to SEQ ID NO: 300945

SEQ ID NO: 649439 - RNA, 64 nt, Homo Sapiens; identical to SEQ ID NO: 300946

SEQ ID NO: 649440 - RNA, 64 nt, Homo Sapiens; identical to SEQ ID NO: 300947

SEQ ID NO: 649441 - RNA, 64 nt, Homo Sapiens; identical to SEQ ID NO: 300948

SEQ ID NO: 649442 - RNA, 64 nt, Homo Sapiens; identical to SEQ ID NO: 300949

SEQ ID NO: 649443 - RNA, 64 nt, Homo Sapiens; identical to SEQ ID NO: 300950

SEQ ID NO: 649444 - RNA, 64 nt, Homo Sapiens; identical to SEQ ID NO: 300951

SEQ ID NO: 649445 - RNA, 64 nt, Homo Sapiens; identical to SEQ ID NO: 300952

SEQ ID NO: 649446 - RNA, 64 nt, Homo Sapiens; identical to SEQ ID NO: 300953

SEQ ID NO: 649447 - RNA, 64 nt, Homo Sapiens; identical to SEQ ID NO: 300954

SEQ ID NO: 649448 - RNA, 64 nt, Homo Sapiens; identical to SEQ ID NO: 300955

SEQ ID NO: 649449 - RNA, 64 nt, Homo Sapiens; identical to SEQ ID NO: 300956

SEQ ID NO: 649450 - RNA, 64 nt, Homo Sapiens; identical to SEQ ID NO: 300957

SEQ ID NO: 649451 - RNA, 64 nt, Homo Sapiens; identical to SEQ ID NO: 300958

SEQ ID NO: 649452 - RNA, 64 nt, Homo Sapiens; identical to SEQ ID NO: 300959

SEQ ID NO: 649453 - RNA, 64 nt, Homo Sapiens; identical to SEQ ID NO: 300960

SEQ ID NO: 649454 - RNA, 64 nt, Homo Sapiens; identical to SEQ ID NO: 300961

SEQ ID NO: 649455 - RNA, 64 nt, Homo Sapiens; identical to SEQ ID NO: 300962

SEQ ID NO: 649456 - RNA, 64 nt, Homo Sapiens; identical to SEQ ID NO: 300963

SEQ ID NO: 649457 - RNA, 64 nt, Homo Sapiens; identical to SEQ ID NO: 300964

SEQ ID NO: 649458 - RNA, 54 nt, Homo Sapiens; identical to SEQ ID NO: 300965

SEQ ID NO: 649459 - RNA, 64 nt, Homo Sapiens; identical to SEQ ID NO: 300966

SEQ ID NO: 649460 - RNA, 64 nt, Homo Sapiens; identical to SEQ ID NO: 300967

SEQ ID NO: 649461 - RNA, 64 nt, Homo Sapiens; identical to SEQ ID NO: 300968

SEQ ID NO: 649462 - RNA, 64 nt, Homo Sapiens; identical to SEQ ID NO: 300969

SEQ ID NO: 649463 - RNA, 64 nt, Homo Sapiens; identical to SEQ ID NO: 300970

SEQ ID NO: 649464 - RNA, 64 nt, Homo Sapiens; identical to SEQ ID NO: 300971

SEQ ID NO: 649465 - RNA, 64 nt, Homo Sapiens; identical to SEQ ID NO: 300972

SEQ ID NO: 649466 - RNA, 59 nt, Homo Sapiens; identical to SEQ ID NO: 300973

SEQ ID NO: 649467 - RNA, 64 nt, Homo Sapiens; identical to SEQ ID NO: 300974

SEQ ID NO: 649468 - RNA, 64 nt, Homo Sapiens; identical to SEQ ID NO: 300975

SEQ ID NO: 649469 - RNA, 64 nt, Homo Sapiens; identical to SEQ ID NO: 300976

SEQ ID NO: 649470 - RNA, 64 nt, Homo Sapiens; identical to SEQ ID NO: 300977

SEQ ID NO: 649471 - RNA, 64 nt, Homo Sapiens; identical to SEQ ID NO: 300978

SEQ ID NO: 649472 - RNA, 64 nt, Homo Sapiens; identical to SEQ ID NO: 300979

SEQ ID NO: 649473 - RNA, 64 nt, Homo Sapiens; identical to SEQ ID NO: 300980

SEQ ID NO: 649474 - RNA, 64 nt, Homo Sapiens; identical to SEQ ID NO: 300981

SEQ ID NO: 649475 - RNA, 64 nt, Homo Sapiens; identical to SEQ ID NO: 300982

SEQ ID NO: 649476 - RNA, 64 nt, Homo Sapiens; identical to SEQ ID NO: 300983

SEQ ID NO: 649477 - RNA, 64 nt, Homo Sapiens; identical to SEQ ID NO: 300984

SEQ ID NO: 649478 - RNA, 64 nt, Homo Sapiens; identical to SEQ ID NO: 300985

SEQ ID NO: 649479 - RNA, 64 nt, Homo Sapiens; identical to SEQ ID NO: 300986

SEQ ID NO: 649480 - RNA, 64 nt, Homo Sapiens; identical to SEQ ID NO: 300987

SEQ ID NO: 649481 - RNA, 64 nt, Homo Sapiens; identical to SEQ ID NO: 300988

SEQ ID NO: 649482 - RNA, 64 nt, Homo Sapiens; identical to SEQ ID NO: 300989

SEQ ID NO: 649483 - RNA, 64 nt, Homo Sapiens; identical to SEQ ID NO: 300990

SEQ ID NO: 649484 - RNA, 64 nt, Homo Sapiens; identical to SEQ ID NO: 300991

SEQ ID NO: 649485 - RNA, 64 nt, Homo Sapiens; identical to SEQ ID NO: 300992

SEQ ID NO: 649486 - RNA, 64 nt, Homo Sapiens; identical to SEQ ID NO: 300993

SEQ ID NO: 649487 - RNA, 64 nt, Homo Sapiens; identical to SEQ ID NO: 300994

SEQ ID NO: 649488 - RNA, 64 nt, Homo Sapiens
ugcuguaauuaggugaacucuaaaacugcaacaucugacaaauagcuuuaaaaauacaaugauu

SEQ ID NO: 649489 - RNA, 64 nt, Homo Sapiens
aauggauauacuuuuaauaaaguuuuauaacucacugacaaaacauauuucaauaguauaugag

SEQ ID NO: 649490 - RNA, 64 nt, Homo Sapiens
agauauucccaaugacugacaauagcagugaagacugacaaaucaauagguucugccagucuac

SEQ ID NO: 649491 - RNA, 64 nt, Homo Sapiens
ggccaccguccgaauaacaggucgaaaucagacccugacaaacucgugauccuucugccaaaau

SEQ ID NO: 649492 - RNA, 64 nt, Homo Sapiens
ggcuuuacauaagccuucauuccuucaaaagguccugacaaaauacuuggguuuuuuucucuuu

SEQ ID NO: 649493 - RNA, 64 nt, Homo Sapiens
ugugggaaugggaaaggaaggagacagccaaacucugacaaaggcuuuuccuuauagaauaacc

SEQ ID NO: 649494 - RNA, 64 nt, Homo Sapiens
agaaacuauucaguuuuuguauugcucugaguaacugacaaagcaaaacaacuguuacaguuuu

SEQ ID NO: 649495 - RNA, 64 nt, Homo Sapiens
auuuuaaaaauauauaaaaccguacaucguaaaacugacaaaauggcuguggugaauggaugaa

SEQ ID NO: 649496 - RNA, 64 nt, Homo Sapiens
auugaaacaguuuauuuuaugauuugaaaaauaacugacaaaccggaugacuguacauuuuagu

SEQ ID NO: 649497 - RNA, 64 nt, Homo Sapiens
agagaaaaauggaccuuuuuaggaaccuuuuauacugacaaaccacuuaaauauauauaaauaa

SEQ ID NO: 649498 - RNA, 64 nt, Homo Sapiens
aaguguaaacauuucaaagcaggccguacuccuucugacaaauuucuuguaaaccaggauugcc

SEQ ID NO: 649499 - RNA, 64 nt, Homo Sapiens
uauauagauuucacuauaaauaagcauuuuaagacugacaaauguugaacuguacauacauuua

SEQ ID NO: 649500 - RNA, 64 nt, Homo Sapiens
augaaugaccaguguuuuuggucgccaaauguugcugacaaacuuaucccaaaacuuuaguggc

SEQ ID NO: 649501 - RNA, 64 nt, Homo Sapiens
uugagacuuugggguaguuuggcugccauucucacugacaaaauguauaucagcccccaccucc

SEQ ID NO: 649502 - RNA, 64 nt, Homo Sapiens
ccacauaucuacaacuaucugaccuuugacaaaccugacaaaaacaagcaauggggaaaggauu

SEQ ID NO: 649503 - RNA, 64 nt, Homo Sapiens
acaaaaugggagaaaauuuucgcaaccuacucaucugacaaagggcuaauauccagaaucuaca

SEQ ID NO: 649504 - RNA, 64 nt, Homo Sapiens; identical to SEQ ID NO: 45285

SEQ ID NO: 649505 - RNA, 64 nt, Homo Sapiens; identical to SEQ ID NO: 45286

SEQ ID NO: 649506 - RNA, 64 nt, Homo Sapiens; identical to SEQ ID NO: 45287

SEQ ID NO: 649507 - RNA, 64 nt, Homo Sapiens; identical to SEQ ID NO: 45288

SEQ ID NO: 649508 - RNA, 64 nt, Homo Sapiens; identical to SEQ ID NO: 45289

SEQ ID NO: 649509 - RNA, 64 nt, Homo Sapiens; identical to SEQ ID NO: 45290

SEQ ID NO: 649510 - RNA, 64 nt, Homo Sapiens; identical to SEQ ID NO: 45291

SEQ ID NO: 649511 - RNA, 64 nt, Homo Sapiens; identical to SEQ ID NO: 45292

SEQ ID NO: 649512 - RNA, 64 nt, Homo Sapiens; identical to SEQ ID NO: 45293

SEQ ID NO: 649513 - RNA, 64 nt, Homo Sapiens; identical to SEQ ID NO: 45294

SEQ ID NO: 649514 - RNA, 64 nt, Homo Sapiens; identical to SEQ ID NO: 45295

SEQ ID NO: 649515 - RNA, 64 nt, Homo Sapiens; identical to SEQ ID NO: 45296

SEQ ID NO: 649516 - RNA, 64 nt, Homo Sapiens; identical to SEQ ID NO: 45297

SEQ ID NO: 649517 - RNA, 64 nt, Homo Sapiens; identical to SEQ ID NO: 45298

SEQ ID NO: 649518 - RNA, 64 nt, Homo Sapiens; identical to SEQ ID NO: 45299

SEQ ID NO: 649519 - RNA, 64 nt, Homo Sapiens; identical to SEQ ID NO: 45300

SEQ ID NO: 649520 - RNA, 64 nt, Homo Sapiens; identical to SEQ ID NO: 45301

SEQ ID NO: 649521 - RNA, 64 nt, Homo Sapiens; identical to SEQ ID NO: 45302

SEQ ID NO: 649522 - RNA, 64 nt, Homo Sapiens; identical to SEQ ID NO: 45303

SEQ ID NO: 649523 - RNA, 64 nt, Homo Sapiens; identical to SEQ ID NO: 45304

SEQ ID NO: 649524 - RNA, 64 nt, Homo Sapiens; identical to SEQ ID NO: 45305

SEQ ID NO: 649525 - RNA, 64 nt, Homo Sapiens; identical to SEQ ID NO: 45306

SEQ ID NO: 649526 - RNA, 64 nt, Homo Sapiens; identical to SEQ ID NO: 45307

SEQ ID NO: 649527 - RNA, 64 nt, Homo Sapiens; identical to SEQ ID NO: 45308

SEQ ID NO: 649528 - RNA, 64 nt, Homo Sapiens; identical to SEQ ID NO: 45309

SEQ ID NO: 649529 - RNA, 64 nt, Homo Sapiens; identical to SEQ ID NO: 45310

SEQ ID NO: 649530 - RNA, 64 nt, Homo Sapiens; identical to SEQ ID NO: 45311

SEQ ID NO: 649531 - RNA, 64 nt, Homo Sapiens; identical to SEQ ID NO: 45312

SEQ ID NO: 649532 - RNA, 64 nt, Homo Sapiens; identical to SEQ ID NO: 45312

SEQ ID NO: 649533 - RNA, 64 nt, Homo Sapiens; identical to SEQ ID NO: 45314

SEQ ID NO: 649534 - RNA, 64 nt, Homo Sapiens; identical to SEQ ID NO: 45315

SEQ ID NO: 649535 - RNA, 64 nt, Homo Sapiens; identical to SEQ ID NO: 45316

SEQ ID NO: 649536 - RNA, 64 nt, Homo Sapiens; identical to SEQ ID NO: 45317

SEQ ID NO: 649537 - RNA, 64 nt, Homo Sapiens; identical to SEQ ID NO: 45318

SEQ ID NO: 649538 - RNA, 64 nt, Homo Sapiens; identical to SEQ ID NO: 45319

SEQ ID NO: 649539 - RNA, 57 nt, Homo Sapiens
uuucuaguugaaauggugaacugauaggaaaacaaaugaguagaaagaguucaugaa

SEQ ID NO: 649540 - RNA, 57 nt, Homo Sapiens
cugaguauaacagcuuuaugauuaugagaaaacaaauucuuuauuuuuuuuuucugu

SEQ ID NO: 649541 - RNA, 57 nt, Homo Sapiens
gaaccaaaggaaauaacauugaagaaggaaaacaauauguagaaaguauuuuagaaa

SEQ ID NO: 649542 - RNA, 57 nt, Homo Sapiens
gauggucagagccagcacuggaauuuugaaaacaaauaaggugauuaucuauuuuag

SEQ ID NO: 649543 - RNA, 57 nt, Homo Sapiens
uaauuauggaaguugggacauguuaaggaaaacaaauauguucaucaccaacaauca

SEQ ID NO: 649544 - RNA, 57 nt, Homo Sapiens
aaagaaaaauauauauucauugcuguagaaaacaaaauccuauuugaauuucuuugg

SEQ ID NO: 649545 - RNA, 57 nt, Homo Sapiens
cugcauauacagguaccauuugguauagaaaacaacgaugcaaguuuugaauaagga

SEQ ID NO: 649546 - RNA, 57 nt, Homo Sapiens
uaggagcagggguuuuuagguaaaugggaaaacaacgccuggcugaagagucugcuu

SEQ ID NO: 649547 - RNA, 57 nt, Homo Sapiens
aucugugaguuuaggagucuauagguugaaaacaauccauugaggauggugagauaa

SEQ ID NO: 649548 - RNA, 57 nt, Homo Sapiens
uauuaccccagggcccaacaucugccugaaaacaauguaagggauagucuuacuuau

SEQ ID NO: 649549 - RNA, 57 nt, Homo Sapiens
uguuucacuaggaacaccucuugaggagaaaacaaagaaacagcuuauuuauacauu

SEQ ID NO: 649550 - RNA, 57 nt, Homo Sapiens
auaauaaccagugcugugaauuauaaggaaaacaaauauuuauaaaguaaaaagauu

SEQ ID NO: 649551 - RNA, 57 nt, Homo Sapiens
gaaauuuaaaucuccaaauaacugcuggaaaacaagguuccaacaccaaauaaccua

SEQ ID NO: 649552 - RNA, 57 nt, Homo Sapiens
aaagcaagcaaggaacauuugggguaagaaaacaaacaugaggcaaaagaaaaaaua

SEQ ID NO: 649553 - RNA, 57 nt, Homo Sapiens
acauucacucuggcugcugggacaucagaaaacaaagucuucaucucucucuccagu

SEQ ID NO: 649554 - RNA, 57 nt, Homo Sapiens
gaagguucuguuuugaguauagccagagaaaacaaggauggagaaaaaucuaggaca

SEQ ID NO: 649555 - RNA, 57 nt, Homo Sapiens
gaagauucuguuuuggguauagccagagaaaacaaggauggagaaaaaucuaggaca

SEQ ID NO: 649556 - RNA, 57 nt, Homo Sapiens
uagugacuugacugagaaguuaggguagaaaacaaaaagggaguggauucugggagc

SEQ ID NO: 649557 - RNA, 57 nt, Homo Sapiens
cauaguuucagauaugguaguuaugaagaaaacaaugucauuugcugcuauuauugu

SEQ ID NO: 649558 - RNA, 57 nt, Homo Sapiens
cuggacagaaacaggaaugucuuuaaagaaaacaaaacgggugggggacagagggac

SEQ ID NO: 649559 - RNA, 57 nt, Homo Sapiens
aucaaagaucuaauaauacaaggcacagaaaacaaauugccgaauucaguugacacg

SEQ ID NO: 649560 - RNA, 57 nt, Homo Sapiens
gacucugagggguccuguuccaauucggaaaacaauaggggaaagccacaaaagcac

SEQ ID NO: 649561 - RNA, 57 nt, Homo Sapiens
caggaaucaaaagagaaaaaaguuucugaaaacaaugaaaccauaaaagauaauauu

SEQ ID NO: 649562 - RNA, 57 nt, Homo Sapiens
caucuuauguccugauuucauauaguagaaaacaaacauuggguccgacuucaaaau

SEQ ID NO: 649563 - RNA, 57 nt, Homo Sapiens
acuggaaucgucauaucucugaauauugaaaacaacaacuaaaaaaguggaccuucu

SEQ ID NO: 649564 - RNA, 57 nt, Homo Sapiens
acagcuccuucuguaaggcuggucuuagaaaacaaguacuuuaguaucaggacagga

SEQ ID NO: 649565 - RNA, 57 nt, Homo Sapiens
guggcaauaucacaagggaggagagaggaaaacaauuaucuucucuacuuggauuau

SEQ ID NO: 649566 - RNA, 57 nt, Homo Sapiens
uuuaaagggauugugucuaugauggaggaaaacaaccguuauguaacaaccugacau

SEQ ID NO: 649567 - RNA, 57 nt, Homo Sapiens
guuacaguuuuauugcucuguauuugggaaaacaacuucagucuuaguguuuuacag

SEQ ID NO: 649568 - RNA, 57 nt, Homo Sapiens
aagagucaacucuuaagauuaucauuagaaaacaaauacgucaacaccuaugaaaag

SEQ ID NO: 649569 - RNA, 57 nt, Homo Sapiens
acgucaacaccuaugaaaagaagcggggaaaacaacaacaaggacaacaacaaaaaa

SEQ ID NO: 649570 - RNA, 57 nt, Homo Sapiens
aaggcaauuggaugauaucuguaggaggaaaacaaugacuaauuucuuccuuuugaa

SEQ ID NO: 649571 - RNA, 57 nt, Homo Sapiens
uuuuagaacuuuuuguuuaauucugaagaaaacaauauauaugguuuacuucucgaa

SEQ ID NO: 649572 - RNA, 57 nt, Homo Sapiens
gaaccaugccuucauaauucggaaucugaaaacaaugaagagaccuugucucgaaaa

SEQ ID NO: 649573 - RNA, 57 nt, Homo Sapiens
uggaaguccagugaugggaaaaaaauugaaaacaaccccaccuuguuuguaacagug

SEQ ID NO: 649574 - RNA, 57 nt, Homo Sapiens
uuucuaauaaauuuauauauuuguaaagaaaacaacagaaaucuuuaugcaauuugu

SEQ ID NO: 649575 - RNA, 57 nt, Homo Sapiens
ggcucuaggaaacauuuacuuguuugugaaaacaauaccccaagguaauaggaaaag

SEQ ID NO: 649576 - RNA, 57 nt, Homo Sapiens
uagagguaaauaucacauuaccauuaggaaaacaaacugaggaccuucucauggaag

SEQ ID NO: 649577 - RNA, 57 nt, Homo Sapiens
ugcuacuuguuaccucuauuguuacaugaaaacaaaaagaaccugcagccauuucuu

SEQ ID NO: 649578 - RNA, 57 nt, Homo Sapiens
ugauaugcuucaauuuuguauuuuagagaaaacaauucuauuccuuucugagcuaug

SEQ ID NO: 649579 - RNA, 57 nt, Homo Sapiens
acaaugaaaauauucauauuugcuacugaaaacaaaauauuuguuucuucugcaucu

SEQ ID NO: 649580 - RNA, 57 nt, Homo Sapiens
uaaaggccuuuuauggaaaccaacuuggaaaacaaccuuaaauguggauguaucaga

SEQ ID NO: 649581 - RNA, 57 nt, Homo Sapiens
agauuugguuuauccagccaugggagagaaaacaaaccuaaguuuacuuuacuugua

SEQ ID NO: 649582 - RNA, 57 nt, Homo Sapiens
ugcacagccugaauggacguaagcaacgaaaacaaaagacuggcucaaaaaagaaag

SEQ ID NO: 649583 - RNA, 57 nt, Homo Sapiens
guaguuuccacagugugaggucaaggggaaaacaaauggcuguagauuuaagggcac

SEQ ID NO: 649584 - RNA, 57 nt, Homo Sapiens
uaaauguaguugucacacuauguguaagaaaacaaacauaauggugaauguucaauc

SEQ ID NO: 649585 - RNA, 57 nt, Homo Sapiens
ugaggagacauucugucuuuaaaguaagaaaacaauaaaggugcuuguuaugucuag

SEQ ID NO: 649586 - RNA, 57 nt, Homo Sapiens
uccaaauccacagcuuuuacuguauaugaaaacaaguauucuaauugucagugauuu

SEQ ID NO: 649587 - RNA, 57 nt, Homo Sapiens
acaacaguccuacuccgaugaaaagcagaaaacaaaauuuucuuucccuuaagaauc

SEQ ID NO: 649588 - RNA, 57 nt, Homo Sapiens
ccuaaacacaaagcaucagucuuuaaggaaaacaaacuugccaucuuuauuaugagc

SEQ ID NO: 649589 - RNA, 57 nt, Homo Sapiens
aagucaaagcaaggaaacuagaaaguggaaaacaagguuaaaaaaaauuuuaaugaa

SEQ ID NO: 649590 - RNA, 57 nt, Homo Sapiens
auucacaacuuguuuuuggugcuugaggaaaacaagccuagggccaagcccagcacu

SEQ ID NO: 649591 - RNA, 57 nt, Homo Sapiens
acuagauggguauguguguuaugugaugaaaacaaagacaugcgaucaguuugggaa

SEQ ID NO: 649592 - RNA, 57 nt, Homo Sapiens
caaacuuguucuuugcagcuuaaaaaggaaaacaaaauguaaacaagauucuaaauu

SEQ ID NO: 649593 - RNA, 57 nt, Homo Sapiens
augcaucuaugugguugaaacugguuugaaaacaaaagaguuaguguuaauggcuuu

SEQ ID NO: 649594 - RNA, 57 nt, Homo Sapiens
uaacuauuuuuaaagugguuuaaucuggaaaacaauguccuaacugaaauauuuacu

SEQ ID NO: 649595 - RNA, 57 nt, Homo Sapiens
uuagagcaaagcugaccuggaacaaaugaaaacaaaaucucccuccacgauugugaa

SEQ ID NO: 649596 - RNA, 57 nt, Homo Sapiens
gaaaacaaaauuagagcaaacgauugugaaaacaaauuccagagaguucucccucca

SEQ ID NO: 649597 - RNA, 57 nt, Homo Sapiens
guauaaaauuccauuuuuucaauuuaagaaaacaaauuucugaagaauaucugucaa

SEQ ID NO: 649598 - RNA, 57 nt, Homo Sapiens
aaaccuaggagauaaauguaauauuccgaaaacaaaaggucuuuauuaaaaaucaca

SEQ ID NO: 649599 - RNA, 57 nt, Homo Sapiens
auggcaaugacuuauauucaauguaaagaaaacaauaauauugaaguggaucaugag

SEQ ID NO: 649600 - RNA, 57 nt, Homo Sapiens
uaauucugauugugucgugcaauuuuagaaaacaaacuuaaaaucccagauacucug

SEQ ID NO: 649601 - RNA, 57 nt, Homo Sapiens
agguguauguuggggagaacugaaagggaaaacaaaauacuugacauagucuuaagu

SEQ ID NO: 649602 - RNA, 57 nt, Homo Sapiens
agucuuaaguagaagaaggcaguuagagaaaacaaaguaucuacuggccuugucaac

SEQ ID NO: 649603 - RNA, 57 nt, Homo Sapiens
uugaaacuuucauaauuguauuaaucagaaaacaagcacauugccauucuuugaaac

SEQ ID NO: 649604 - RNA, 57 nt, Homo Sapiens
uagacaugacagcaguaauaaaaggaugaaaacaagugucuucacuaagcguauggc

SEQ ID NO: 649605 - RNA, 57 nt, Homo Sapiens
uuuuuuaaagccucauucucaaagaaagaaaacaacugaaauuuuuagcuguaacaa

SEQ ID NO: 649606 - RNA, 57 nt, Homo Sapiens
auuuuauaauauuuaacccauugaccagaaaacaauguauuuucucccugcucugua

SEQ ID NO: 649607 - RNA, 57 nt, Homo Sapiens
aaauauucacuaauggugcccguuuaugaaaacaacuaugagucuucaucacagcau

SEQ ID NO: 649608 - RNA, 57 nt, Homo Sapiens
uguaucuccuaggauggcuggcaggaugaaaacaauaucauuucuuuuucuguaaau

SEQ ID NO: 649609 - RNA, 57 nt, Homo Sapiens
aguauaaauugucauagcugguuuacugaaaacaaacacauuuaaaauugguuuacc

SEQ ID NO: 649610 - RNA, 57 nt, Homo Sapiens
ccaaccucugagcccaagaccuugccugaaaacaagcagauaccgauugcuucaucc

SEQ ID NO: 649611 - RNA, 57 nt, Homo Sapiens
uucuggugggugcauuuucuagagauggaaaacaagcuguuuaguggaaacuuucug

SEQ ID NO: 649612 - RNA, 57 nt, Homo Sapiens
ugaaaucauaccucagcucagaucuccgaaaacaaaguuuucauguaggagcugaaa

SEQ ID NO: 649613 - RNA, 57 nt, Homo Sapiens
gugucaguuucaaaucaaauuaucuaagaaaacaagaaaacaaaggcagcagacuau

SEQ ID NO: 649614 - RNA, 57 nt, Homo Sapiens
uucaaaucaaauuaucuaagaaaacaagaaaacaaaggcagcagacuauugguacac

SEQ ID NO: 649615 - RNA, 57 nt, Homo Sapiens
aucugaaagaaacgucuuuauaaaauggaaaacaaaaguagcuccaaaugcaauuuu

SEQ ID NO: 649616 - RNA, 57 nt, Homo Sapiens
cgacucacaaaccuccaaguaaaugaagaaaacaaacuuccaugacucgaauaucug

SEQ ID NO: 649617 - RNA, 57 nt, Homo Sapiens
gacgcugugugugcugcaagugaccccgaaaacaaccacagccgucacaugguccuc

SEQ ID NO: 649618 - RNA, 57 nt, Homo Sapiens
cuguuuacaucgauaaaugcacuuaaggaaaacaaacaaauuaaagcucaucuuaaa

SEQ ID NO: 649619 - RNA, 64 nt, Homo Sapiens; identical to SEQ ID NO: 585264

SEQ ID NO: 649620 - RNA, 64 nt, Homo Sapiens; identical to SEQ ID NO: 585265

SEQ ID NO: 649621 - RNA, 64 nt, Homo Sapiens; identical to SEQ ID NO: 585266

SEQ ID NO: 649622 - RNA, 64 nt, Homo Sapiens; identical to SEQ ID NO: 585267

SEQ ID NO: 649623 - RNA, 64 nt, Homo Sapiens; identical to SEQ ID NO: 585268

SEQ ID NO: 649624 - RNA, 64 nt, Homo Sapiens; identical to SEQ ID NO: 585269

SEQ ID NO: 649625 - RNA, 64 nt, Homo Sapiens; identical to SEQ ID NO: 585270

SEQ ID NO: 649626 - RNA, 64 nt, Homo Sapiens; identical to SEQ ID NO: 585270

SEQ ID NO: 649627 - RNA, 64 nt, Homo Sapiens; identical to SEQ ID NO: 585272

SEQ ID NO: 649628 - RNA, 64 nt, Homo Sapiens; identical to SEQ ID NO: 585273

SEQ ID NO: 649629 - RNA, 64 nt, Homo Sapiens; identical to SEQ ID NO: 585274

SEQ ID NO: 649630 - RNA, 64 nt, Homo Sapiens; identical to SEQ ID NO: 585275

SEQ ID NO: 649631 - RNA, 64 nt, Homo Sapiens; identical to SEQ ID NO: 585276

SEQ ID NO: 649632 - RNA, 64 nt, Homo Sapiens; identical to SEQ ID NO: 585277

SEQ ID NO: 649633 - RNA, 64 nt, Homo Sapiens; identical to SEQ ID NO: 585278

SEQ ID NO: 649634 - RNA, 64 nt, Homo Sapiens; identical to SEQ ID NO: 585279

SEQ ID NO: 649635 - RNA, 64 nt, Homo Sapiens; identical to SEQ ID NO: 585280

SEQ ID NO: 649636 - RNA, 64 nt, Homo Sapiens; identical to SEQ ID NO: 585281

SEQ ID NO: 649637 - RNA, 64 nt, Homo Sapiens; identical to SEQ ID NO: 585282

SEQ ID NO: 649638 - RNA, 64 nt, Homo Sapiens; identical to SEQ ID NO: 585283

SEQ ID NO: 649639 - RNA, 64 nt, Homo Sapiens; identical to SEQ ID NO: 585284

SEQ ID NO: 649640 - RNA, 64 nt, Homo Sapiens; identical to SEQ ID NO: 585285

SEQ ID NO: 649641 - RNA, 64 nt, Homo Sapiens; identical to SEQ ID NO: 585286

SEQ ID NO: 649642 - RNA, 64 nt, Homo Sapiens; identical to SEQ ID NO: 585287

SEQ ID NO: 649643 - RNA, 64 nt, Homo Sapiens; identical to SEQ ID NO: 585288

SEQ ID NO: 649644 - RNA, 64 nt, Homo Sapiens; identical to SEQ ID NO: 585289

SEQ ID NO: 649645 - RNA, 64 nt, Homo Sapiens; identical to SEQ ID NO: 585290

SEQ ID NO: 649646 - RNA, 64 nt, Homo Sapiens; identical to SEQ ID NO: 585291

SEQ ID NO: 649647 - RNA, 64 nt, Homo Sapiens; identical to SEQ ID NO: 585292

SEQ ID NO: 649648 - RNA, 64 nt, Homo Sapiens; identical to SEQ ID NO: 585293

SEQ ID NO: 649649 - RNA, 64 nt, Homo Sapiens; identical to SEQ ID NO: 585294

SEQ ID NO: 649650 - RNA, 64 nt, Homo Sapiens; identical to SEQ ID NO: 585295

SEQ ID NO: 649651 - RNA, 64 nt, Homo Sapiens; identical to SEQ ID NO: 585296

SEQ ID NO: 649652 - RNA, 64 nt, Homo Sapiens; identical to SEQ ID NO: 585297

SEQ ID NO: 649653 - RNA, 64 nt, Homo Sapiens; identical to SEQ ID NO: 585298

SEQ ID NO: 649654 - RNA, 64 nt, Homo Sapiens; identical to SEQ ID NO: 585299

SEQ ID NO: 649655 - RNA, 62 nt, Homo Sapiens
uggccuggcugccuggccguggcuucucuuuggcucccaaagagaaggacaguguugggagu

SEQ ID NO: 649656 - RNA, 62 nt, Homo Sapiens
guguugggaguaucugccguggcuucucuuuggcucccaaagagaaggacaguguugggagu

SEQ ID NO: 649657 - RNA, 62 nt, Homo Sapiens
acggcccuccuucuuuuccuaacaugcaccuugcucccaauggugcuuggagggggaagaga

SEQ ID NO: 649658 - RNA, 62 nt, Homo Sapiens
agggggcaagcuuugcuccuucaguucugcuugcucccaagccccugacccgcucggacuua

SEQ ID NO: 649659 - RNA, 62 nt, Homo Sapiens
ccauucucuuuucucucgugaguucauguguugcucccaacucagcagaauguuauaacgca

SEQ ID NO: 649660 - RNA, 62 nt, Homo Sapiens
uugucauuuuuaaauguuauucacuguuugcagcucccaauguuuaaaauguauguuucccc

SEQ ID NO: 649661 - RNA, 62 nt, Homo Sapiens
ccaggacccacuggggcauacuucccaguugagcucccaagaucucugcuguauccuuucgg

SEQ ID NO: 649662 - RNA, 62 nt, Homo Sapiens
ccaggacccacuggggcauacuucccaguugagcucccaagaucucugcuguguccuuucgg

SEQ ID NO: 649663 - RNA, 64 nt, Homo Sapiens; identical to SEQ ID NO: 603786

SEQ ID NO: 649664 - RNA, 64 nt, Homo Sapiens; identical to SEQ ID NO: 603787

SEQ ID NO: 649665 - RNA, 64 nt, Homo Sapiens; identical to SEQ ID NO: 603788

SEQ ID NO: 649666 - RNA, 64 nt, Homo Sapiens; identical to SEQ ID NO: 603789

SEQ ID NO: 649667 - RNA, 64 nt, Homo Sapiens
uaguuuauuacagauauuaaguaugcaauuacuuguauuauaggaugcaaggucaucauaugua

SEQ ID NO: 649668 - RNA, 64 nt, Homo Sapiens
acaguuuuguaaaauuaguauugaguucuauugaguauuauaagauagcuuacauuuucaaaau

SEQ ID NO: 649669 - RNA, 64 nt, Homo Sapiens
auacucugcacuguguaaaggaaaagggagaaauguauuauacuugagacauugcaccuacccc

SEQ ID NO: 649670 - RNA, 64 nt, Homo Sapiens
aaugaaaaagucuucgauacaauauuguuaagcuguauuauaaguauuguuacacaggguuaug

SEQ ID NO: 649671 - RNA, 64 nt, Homo Sapiens
ccaaauggacugaaagaaacuuuucaaggacaguguauuauaacaaucccuuucccagaauuag

SEQ ID NO: 649672 - RNA, 64 nt, Homo Sapiens
uucaacaacauuuuaaauguauuuuguuauguuuguauuauauaggauaaagcaaaugucaagu

SEQ ID NO: 649673 - RNA, 64 nt, Homo Sapiens
aaccuuaacuucauugucugcacauuacauugaaguauuauaaaugcaacagauguuauaugca

SEQ ID NO: 649674 - RNA, 64 nt, Homo Sapiens
acauaaaguugcguaagaaacuuuaccaagaggaguauuauagccaaguuuucuuugaaaguau

SEQ ID NO: 649675 - RNA, 64 nt, Homo Sapiens
ugaaaaguaaauuaaugugauauuuucauuuucuguauuauauauuuacuauaagguuaauauu

SEQ ID NO: 649676 - RNA, 64 nt, Homo Sapiens
cucaacucguuaucuaaagccugaauucauuucuguauuauauuuaugcaagcacaacuugaag

SEQ ID NO: 649677 - RNA, 64 nt, Homo Sapiens
cccuuuuuuaauguuucaugaccacccauugauuguauuauaaccacuuacaguugcuuauauu

SEQ ID NO: 649678 - RNA, 64 nt, Homo Sapiens
cuuuuguuuuuuaacauuuagaauauuacauuuuguauuauacaguaccuuucucagacauuuu

SEQ ID NO: 649679 - RNA, 64 nt, Homo Sapiens
ugcauacacaugccuccaugauguacguuuauauguauuauaauauaauuucuaaaccauguau

SEQ ID NO: 649680 - RNA, 64 nt, Homo Sapiens
auugagcaaaugagaaaacaaaacuauuucagauguauuauaugauugugcccaaguaauaaua

SEQ ID NO: 649681 - RNA, 64 nt, Homo Sapiens
auuuuucuauucuugguggcagugauauuugcagguauuauacccuaccccuuuuugccuuaca

SEQ ID NO: 649682 - RNA, 64 nt, Homo Sapiens
agugaaaagguguuauaucuccuuuggaaaagauguauuauaccagaaacaagccugccauaau

SEQ ID NO: 649683 - RNA, 64 nt, Homo Sapiens
caugaacuuagauuuuacaugaaguauuuuuucaguauuauauguacccucugaaauacauagg

SEQ ID NO: 649684 - RNA, 64 nt, Homo Sapiens
uuauauguacccucugaaauacauagggauaugcguauuauaccaaaauguugcugaaaaaugg

SEQ ID NO: 649685 - RNA, 64 nt, Homo Sapiens
agcauacuuaacagugaaaagaaucuuuaauuauguauuauaucuguaauauauuuauuuuguu

SEQ ID NO: 649686 - RNA, 64 nt, Homo Sapiens
cuuuguaauauguuuuuaguucccuuuuuuuguuguauuauaggcagaugaacaaauuaaauuu

SEQ ID NO: 649687 - RNA, 64 nt, Homo Sapiens
acgggcugcaugcugaggacgaccagcugaggguguauuauaugcagaauuacauaaacgaagc

SEQ ID NO: 649688 - RNA, 64 nt, Homo Sapiens
acuguaaagagaaguaauuuugcuccuugauaaaguauuauauuaauaauaaaucugccugcaa

SEQ ID NO: 649689 - RNA, 64 nt, Homo Sapiens
aggauaauacagagccaagagaugucacacagugguauuauagagaacacuuagaagacugaua

SEQ ID NO: 649690 - RNA, 64 nt, Homo Sapiens
uaaaguuuuauuugcuguagaauuucaagcaaauguauuauaauugcaugaugaauagcaccuu

SEQ ID NO: 649691 - RNA, 64 nt, Homo Sapiens
cucaaaugagcuuguauauuuauaauacaauauaguauuauaguaacaguuaucauacacugag

SEQ ID NO: 649692 - RNA, 64 nt, Homo Sapiens
gagucacuaguauagacuaucuaucuagugaguuguauuauaagcgaugaaauacuuuaaaagc

SEQ ID NO: 649693 - RNA, 64 nt, Homo Sapiens
acugcuuuacuguguaucucuaugccuuacuauuguauuauaguauaucagacuucaccaaaua

SEQ ID NO: 649694 - RNA, 64 nt, Homo Sapiens
guagauuucaguaguuucuaugugaaggguagugguauuauacuaagaaauaaaucuauauuuu

SEQ ID NO: 649695 - RNA, 64 nt, Homo Sapiens; identical to SEQ ID NO: 346411

SEQ ID NO: 649696 - RNA, 64 nt, Homo Sapiens; identical to SEQ ID NO: 346412

SEQ ID NO: 649697 - RNA, 64 nt, Homo Sapiens; identical to SEQ ID NO: 346413

SEQ ID NO: 649698 - RNA, 64 nt, Homo Sapiens; identical to SEQ ID NO: 346414

SEQ ID NO: 649699 - RNA, 64 nt, Homo Sapiens; identical to SEQ ID NO: 346415

SEQ ID NO: 649700 - RNA, 64 nt, Homo Sapiens; identical to SEQ ID NO: 346416

SEQ ID NO: 649701 - RNA, 64 nt, Homo Sapiens; identical to SEQ ID NO: 346417

SEQ ID NO: 649702 - RNA, 64 nt, Homo Sapiens; identical to SEQ ID NO: 346418

SEQ ID NO: 649703 - RNA, 64 nt, Homo Sapiens; identical to SEQ ID NO: 346419

SEQ ID NO: 649704 - RNA, 64 nt, Homo Sapiens; identical to SEQ ID NO: 346420

SEQ ID NO: 649705 - RNA, 64 nt, Homo Sapiens; identical to SEQ ID NO: 346421

SEQ ID NO: 649706 - RNA, 64 nt, Homo Sapiens; identical to SEQ ID NO: 346422

SEQ ID NO: 649707 - RNA, 64 nt, Homo Sapiens; identical to SEQ ID NO: 346423

SEQ ID NO: 649708 - RNA, 64 nt, Homo Sapiens; identical to SEQ ID NO: 346424

SEQ ID NO: 649709 - RNA, 64 nt, Homo Sapiens; identical to SEQ ID NO: 346425

SEQ ID NO: 649710 - RNA, 64 nt, Homo Sapiens; identical to SEQ ID NO: 346426

SEQ ID NO: 649711 - RNA, 64 nt, Homo Sapiens; identical to SEQ ID NO: 346427

SEQ ID NO: 649712 - RNA, 64 nt, Homo Sapiens; identical to SEQ ID NO: 346428

SEQ ID NO: 649713 - RNA, 64 nt, Homo Sapiens; identical to SEQ ID NO: 553542

SEQ ID NO: 649714 - RNA, 64 nt, Homo Sapiens; identical to SEQ ID NO: 553543

SEQ ID NO: 649715 - RNA, 64 nt, Homo Sapiens; identical to SEQ ID NO: 553544

SEQ ID NO: 649716 - RNA, 64 nt, Homo Sapiens; identical to SEQ ID NO: 553545

SEQ ID NO: 649717 - RNA, 64 nt, Homo Sapiens; identical to SEQ ID NO: 553546

SEQ ID NO: 649718 - RNA, 64 nt, Homo Sapiens; identical to SEQ ID NO: 553547

SEQ ID NO: 649719 - RNA, 64 nt, Homo Sapiens; identical to SEQ ID NO: 553548

SEQ ID NO: 649720 - RNA, 64 nt, Homo Sapiens; identical to SEQ ID NO: 553549

SEQ ID NO: 649721 - RNA, 64 nt, Homo Sapiens; identical to SEQ ID NO: 553550

SEQ ID NO: 649722 - RNA, 64 nt, Homo Sapiens; identical to SEQ ID NO: 553551

SEQ ID NO: 649723 - RNA, 64 nt, Homo Sapiens; identical to SEQ ID NO: 97332

SEQ ID NO: 649724 - RNA, 64 nt, Homo Sapiens; identical to SEQ ID NO: 97333

SEQ ID NO: 649725 - RNA, 64 nt, Homo Sapiens; identical to SEQ ID NO: 97334

SEQ ID NO: 649726 - RNA, 64 nt, Homo Sapiens; identical to SEQ ID NO: 97335

SEQ ID NO: 649727 - RNA, 64 nt, Homo Sapiens; identical to SEQ ID NO: 97336

SEQ ID NO: 649728 - RNA, 64 nt, Homo Sapiens; identical to SEQ ID NO: 97337

SEQ ID NO: 649729 - RNA, 64 nt, Homo Sapiens; identical to SEQ ID NO: 97338

SEQ ID NO: 649730 - RNA, 64 nt, Homo Sapiens; identical to SEQ ID NO: 97339

SEQ ID NO: 649731 - RNA, 64 nt, Homo Sapiens; identical to SEQ ID NO: 97340

SEQ ID NO: 649732 - RNA, 64 nt, Homo Sapiens; identical to SEQ ID NO: 97341

SEQ ID NO: 649733 - RNA, 64 nt, Homo Sapiens; identical to SEQ ID NO: 97342

SEQ ID NO: 649734 - RNA, 64 nt, Homo Sapiens; identical to SEQ ID NO: 97343

SEQ ID NO: 649735 - RNA, 64 nt, Homo Sapiens; identical to SEQ ID NO: 97344

SEQ ID NO: 649736 - RNA, 64 nt, Homo Sapiens; identical to SEQ ID NO: 97345

SEQ ID NO: 649737 - RNA, 64 nt, Homo Sapiens; identical to SEQ ID NO: 97346

SEQ ID NO: 649738 - RNA, 64 nt, Homo Sapiens; identical to SEQ ID NO: 97347

SEQ ID NO: 649739 - RNA, 64 nt, Homo Sapiens; identical to SEQ ID NO: 97348

SEQ ID NO: 649740 - RNA, 64 nt, Homo Sapiens; identical to SEQ ID NO: 97349

SEQ ID NO: 649741 - RNA, 64 nt, Homo Sapiens; identical to SEQ ID NO: 97350

SEQ ID NO: 649742 - RNA, 64 nt, Homo Sapiens; identical to SEQ ID NO: 97351

SEQ ID NO: 649743 - RNA, 64 nt, Homo Sapiens; identical to SEQ ID NO: 97352

SEQ ID NO: 649744 - RNA, 64 nt, Homo Sapiens; identical to SEQ ID NO: 97353

SEQ ID NO: 649745 - RNA, 64 nt, Homo Sapiens; identical to SEQ ID NO: 97354

SEQ ID NO: 649746 - RNA, 64 nt, Homo Sapiens; identical to SEQ ID NO: 97355

SEQ ID NO: 649747 - RNA, 64 nt, Homo Sapiens; identical to SEQ ID NO: 97356

SEQ ID NO: 649748 - RNA, 64 nt, Homo Sapiens; identical to SEQ ID NO: 97357

SEQ ID NO: 649749 - RNA, 64 nt, Homo Sapiens; identical to SEQ ID NO: 97358

SEQ ID NO: 649750 - RNA, 64 nt, Homo Sapiens; identical to SEQ ID NO: 97359

SEQ ID NO: 649751 - RNA, 64 nt, Homo Sapiens; identical to SEQ ID NO: 97360

SEQ ID NO: 649752 - RNA, 64 nt, Homo Sapiens; identical to SEQ ID NO: 97361

SEQ ID NO: 649753 - RNA, 64 nt, Homo Sapiens; identical to SEQ ID NO: 97362

SEQ ID NO: 649754 - RNA, 64 nt, Homo Sapiens; identical to SEQ ID NO: 97363

SEQ ID NO: 649755 - RNA, 64 nt, Homo Sapiens; identical to SEQ ID NO: 97364

SEQ ID NO: 649756 - RNA, 64 nt, Homo Sapiens; identical to SEQ ID NO: 97365

SEQ ID NO: 649757 - RNA, 64 nt, Homo Sapiens; identical to SEQ ID NO: 97366

SEQ ID NO: 649758 - RNA, 64 nt, Homo Sapiens; identical to SEQ ID NO: 97367

SEQ ID NO: 649759 - RNA, 64 nt, Homo Sapiens; identical to SEQ ID NO: 97368

SEQ ID NO: 649760 - RNA, 64 nt, Homo Sapiens; identical to SEQ ID NO: 97369

SEQ ID NO: 649761 - RNA, 64 nt, Homo Sapiens; identical to SEQ ID NO: 97370

SEQ ID NO: 649762 - RNA, 64 nt, Homo Sapiens; identical to SEQ ID NO: 97371

SEQ ID NO: 649763 - RNA, 64 nt, Homo Sapiens; identical to SEQ ID NO: 97372

SEQ ID NO: 649764 - RNA, 64 nt, Homo Sapiens; identical to SEQ ID NO: 97373

SEQ ID NO: 649765 - RNA, 64 nt, Homo Sapiens; identical to SEQ ID NO: 97374

SEQ ID NO: 649766 - RNA, 64 nt, Homo Sapiens; identical to SEQ ID NO: 97375

SEQ ID NO: 649767 - RNA, 64 nt, Homo Sapiens; identical to SEQ ID NO: 97376

SEQ ID NO: 649768 - RNA, 64 nt, Homo Sapiens; identical to SEQ ID NO: 97377

SEQ ID NO: 649769 - RNA, 64 nt, Homo Sapiens; identical to SEQ ID NO: 97378

SEQ ID NO: 649770 - RNA, 64 nt, Homo Sapiens; identical to SEQ ID NO: 97379

SEQ ID NO: 649771 - RNA, 64 nt, Homo Sapiens; identical to SEQ ID NO: 97380

SEQ ID NO: 649772 - RNA, 64 nt, Homo Sapiens; identical to SEQ ID NO: 97381

SEQ ID NO: 649773 - RNA, 64 nt, Homo Sapiens; identical to SEQ ID NO: 97382

SEQ ID NO: 649774 - RNA, 64 nt, Homo Sapiens; identical to SEQ ID NO: 97383

SEQ ID NO: 649775 - RNA, 64 nt, Homo Sapiens; identical to SEQ ID NO: 97384

SEQ ID NO: 649776 - RNA, 64 nt, Homo Sapiens; identical to SEQ ID NO: 97385

SEQ ID NO: 649777 - RNA, 64 nt, Homo Sapiens; identical to SEQ ID NO: 97386

SEQ ID NO: 649778 - RNA, 64 nt, Homo Sapiens; identical to SEQ ID NO: 97387

SEQ ID NO: 649779 - RNA, 64 nt, Homo Sapiens; identical to SEQ ID NO: 97388

SEQ ID NO: 649780 - RNA, 64 nt, Homo Sapiens; identical to SEQ ID NO: 97389

SEQ ID NO: 649781 - RNA, 64 nt, Homo Sapiens; identical to SEQ ID NO: 97390

SEQ ID NO: 649782 - RNA, 64 nt, Homo Sapiens; identical to SEQ ID NO: 97391

SEQ ID NO: 649783 - RNA, 64 nt, Homo Sapiens; identical to SEQ ID NO: 97392

SEQ ID NO: 649784 - RNA, 64 nt, Homo Sapiens; identical to SEQ ID NO: 97393

SEQ ID NO: 649785 - RNA, 64 nt, Homo Sapiens; identical to SEQ ID NO: 97394

SEQ ID NO: 649786 - RNA, 64 nt, Homo Sapiens; identical to SEQ ID NO: 294474

SEQ ID NO: 649787 - RNA, 64 nt, Homo Sapiens; identical to SEQ ID NO: 294475

SEQ ID NO: 649788 - RNA, 64 nt, Homo Sapiens; identical to SEQ ID NO: 294476

SEQ ID NO: 649789 - RNA, 64 nt, Homo Sapiens; identical to SEQ ID NO: 294477

SEQ ID NO: 649790 - RNA, 64 nt, Homo Sapiens; identical to SEQ ID NO: 294478

SEQ ID NO: 649791 - RNA, 64 nt, Homo Sapiens; identical to SEQ ID NO: 294479

SEQ ID NO: 649792 - RNA, 64 nt, Homo Sapiens; identical to SEQ ID NO: 151446

SEQ ID NO: 649793 - RNA, 64 nt, Homo Sapiens; identical to SEQ ID NO: 151447

SEQ ID NO: 649794 - RNA, 64 nt, Homo Sapiens; identical to SEQ ID NO: 151448

SEQ ID NO: 649795 - RNA, 64 nt, Homo Sapiens; identical to SEQ ID NO: 151449

SEQ ID NO: 649796 - RNA, 64 nt, Homo Sapiens; identical to SEQ ID NO: 151450

SEQ ID NO: 649797 - RNA, 64 nt, Homo Sapiens; identical to SEQ ID NO: 151451

SEQ ID NO: 649798 - RNA, 64 nt, Homo Sapiens; identical to SEQ ID NO: 151452

SEQ ID NO: 649799 - RNA, 64 nt, Homo Sapiens; identical to SEQ ID NO: 151453

SEQ ID NO: 649800 - RNA, 64 nt, Homo Sapiens; identical to SEQ ID NO: 151454

SEQ ID NO: 649801 - RNA, 64 nt, Homo Sapiens; identical to SEQ ID NO: 151455

SEQ ID NO: 649802 - RNA, 64 nt, Homo Sapiens; identical to SEQ ID NO: 151456

SEQ ID NO: 649803 - RNA, 64 nt, Homo Sapiens; identical to SEQ ID NO: 151457

SEQ ID NO: 649804 - RNA, 64 nt, Homo Sapiens; identical to SEQ ID NO: 151458

SEQ ID NO: 649805 - RNA, 64 nt, Homo Sapiens; identical to SEQ ID NO: 151459

SEQ ID NO: 649806 - RNA, 64 nt, Homo Sapiens; identical to SEQ ID NO: 151460

SEQ ID NO: 649807 - RNA, 64 nt, Homo Sapiens; identical to SEQ ID NO: 151461

SEQ ID NO: 649808 - RNA, 64 nt, Homo Sapiens; identical to SEQ ID NO: 151462

SEQ ID NO: 649809 - RNA, 64 nt, Homo Sapiens; identical to SEQ ID NO: 151463

SEQ ID NO: 649810 - RNA, 64 nt, Homo Sapiens; identical to SEQ ID NO: 151464

SEQ ID NO: 649811 - RNA, 64 nt, Homo Sapiens; identical to SEQ ID NO: 151465

SEQ ID NO: 649812 - RNA, 64 nt, Homo Sapiens; identical to SEQ ID NO: 151466

SEQ ID NO: 649813 - RNA, 64 nt, Homo Sapiens; identical to SEQ ID NO: 151467

SEQ ID NO: 649814 - RNA, 64 nt, Homo Sapiens; identical to SEQ ID NO: 151468

SEQ ID NO: 649815 - RNA, 64 nt, Homo Sapiens; identical to SEQ ID NO: 151469

SEQ ID NO: 649816 - RNA, 64 nt, Homo Sapiens; identical to SEQ ID NO: 151470

SEQ ID NO: 649817 - RNA, 64 nt, Homo Sapiens; identical to SEQ ID NO: 151471

SEQ ID NO: 649818 - RNA, 64 nt, Homo Sapiens
uacauuguagguggcccgcauuuccagaaauaacguuaugcaucuagauggaagcugcauguaa

SEQ ID NO: 649819 - RNA, 64 nt, Homo Sapiens
aaauuguaaacaaauguaaaacuaaauaaacauuguuaugcaacauuaauaauguggaauuuuu

SEQ ID NO: 649820 - RNA, 64 nt, Homo Sapiens
uuccagaggaagacacagcuuaguagcuuaagcaguuaugcauaucaggauacugugagcaaca

SEQ ID NO: 649821 - RNA, 64 nt, Homo Sapiens
guuaucaccuuuuuuauccguccaccgugacaugguuaugcauccuuuagauuaaccucaccaa

SEQ ID NO: 649822 - RNA, 64 nt, Homo Sapiens
cacuuugauaauauaaacaguuauuguacuuuugguuaugcaaaaggaggcauuuucaucuuua

SEQ ID NO: 649823 - RNA, 64 nt, Homo Sapiens
aaauacuaaaacccaucagggaguuccuguaacaguuaugcagaaauggaagagaaucauuuaa

SEQ ID NO: 649824 - RNA, 64 nt, Homo Sapiens
cuaaauuaaaugugacauaaaccucaguuuugagguuaugcacauuuuuauaaauuggaauaau

SEQ ID NO: 649825 - RNA, 64 nt, Homo Sapiens
ugguuuuuauaaauuggaauaaacuugcauaaaaguuaugcaaggagaaaacuuuguauuuuua

SEQ ID NO: 649826 - RNA, 64 nt, Homo Sapiens
cugggugcagcaggagcugggucccgagagccuggcaggugaaacucugcaggccuuccgccug

SEQ ID NO: 649827 - RNA, 64 nt, Homo Sapiens
gggagaccuuugcaaagggcauccaaauggguaggcaggugacagccgccguauuuauuuugca

SEQ ID NO: 649828 - RNA, 64 nt, Homo Sapiens
ugcaggcuccaugcaccucccuucccucccugaggcaggugagaacccagagagaggggccugc

SEQ ID NO: 649829 - RNA, 64 nt, Homo Sapiens
ccugaggcaggugagaacccagagagaggggccugcaggugagcaggcagggcugggccagguc

SEQ ID NO: 649830 - RNA, 64 nt, Homo Sapiens
gaagcagagagcacagccccugcugugugggucugcaggugagcagacaggacaggugugccgc

SEQ ID NO: 649831 - RNA, 64 nt, Homo Sapiens
cagauccccuaggaaagaggaggcaaauggcacugcaggugagaaccccgcccauccgugcuau

SEQ ID NO: 649832 - RNA, 64 nt, Homo Sapiens
ugaccccagaaaccgccuucaucuccauucggaagcaggugacacaccccuucagaaggugccc

SEQ ID NO: 649833 - RNA, 64 nt, Homo Sapiens
uaaguugccuuuccucuuuguaguuagcguucaggcaggugacguguggaaagucuaggggguu

SEQ ID NO: 649834 - RNA, 64 nt, Homo Sapiens
ugcugaagguaccauauuuuaaauguuauuuaaugcaggugauuuauucaaacauuuguucuag

SEQ ID NO: 649835 - RNA, 64 nt, Homo Sapiens
ucacaacucuuaauugggccuagugaaaaugggggcaggugagaaguccauuuugagaaucagc

SEQ ID NO: 649836 - RNA, 64 nt, Homo Sapiens
caccagaugaauuuccaaguuuaaacucuuuccugcaggugauuacuuugaaaaagguuggucc

SEQ ID NO: 649837 - RNA, 64 nt, Homo Sapiens
augccagaacaugguaaauuugcagccauuucaagcaggugauggucuuuuuuuauaacaucgu

SEQ ID NO: 649838 - RNA, 64 nt, Homo Sapiens
ugagugcccgacagcugagacccugcggcugccggcaggugaacuugaguugugggcccaggag

SEQ ID NO: 649839 - RNA, 64 nt, Homo Sapiens
uccuggcagggggccucgcgaguguggccuccaggcaggugaugaugaggacgacggcuacuga

SEQ ID NO: 649840 - RNA, 64 nt, Homo Sapiens
gccucaggcccagcacccaguuccuccucacauggcaggugagcacagacuucuaguuggcagg

SEQ ID NO: 649841 - RNA, 64 nt, Homo Sapiens
cuaagggcaagcaggauacagggcgagggauguggcaggugagggggcucccgccugugccccu

SEQ ID NO: 649842 - RNA, 64 nt, Homo Sapiens
uaccccggaggcaccuggguccaucagagaaggugcaggugacagaggcgaaggcagauggggc

SEQ ID NO: 649843 - RNA, 64 nt, Homo Sapiens
cggggcuggugggccuuucuguguccuacuccuugcaggugacauuugcucugaacuggaugau

SEQ ID NO: 649844 - RNA, 64 nt, Homo Sapiens
cuggagccagcccggggacuguccuggguggagggcaggugaacacaagcugcugccggggacu

SEQ ID NO: 649845 - RNA, 64 nt, Homo Sapiens
acaagcugcugccggggacuguccuggguggacggcaggugaacacaagcggcugccgcaugua

SEQ ID NO: 649846 - RNA, 64 nt, Homo Sapiens
ggggaggaggauuaggcuggacugaucgcgggucgcaggugaccccgggaccagaugucccucc

SEQ ID NO: 649847 - RNA, 64 nt, Homo Sapiens
ugccugccgcaguggcccagccccuucucucccugcaggugacccgcgccgcccccgcccgccc

SEQ ID NO: 649848 - RNA, 64 nt, Homo Sapiens
ccaagucccgaguggccuucuuugaagagcucuagcaggugacccagccaccccaggaccugcc

SEQ ID NO: 649849 - RNA, 64 nt, Homo Sapiens
ccuugagauccuuccaguuuggcuguuaugcaaagcaggugauuugucuuaaucagauaaaaga

SEQ ID NO: 649850 - RNA, 64 nt, Homo Sapiens; identical to SEQ ID NO: 73323

SEQ ID NO: 649851 - RNA, 64 nt, Homo Sapiens; identical to SEQ ID NO: 73324

SEQ ID NO: 649852 - RNA, 64 nt, Homo Sapiens; identical to SEQ ID NO: 73325

SEQ ID NO: 649853 - RNA, 64 nt, Homo Sapiens; identical to SEQ ID NO: 73326

SEQ ID NO: 649854 - RNA, 64 nt, Homo Sapiens; identical to SEQ ID NO: 73327

SEQ ID NO: 649855 - RNA, 64 nt, Homo Sapiens; identical to SEQ ID NO: 73328

SEQ ID NO: 649856 - RNA, 64 nt, Homo Sapiens; identical to SEQ ID NO: 73329

SEQ ID NO: 649857 - RNA, 64 nt, Homo Sapiens; identical to SEQ ID NO: 73330

SEQ ID NO: 649858 - RNA, 64 nt, Homo Sapiens; identical to SEQ ID NO: 73331

SEQ ID NO: 649859 - RNA, 64 nt, Homo Sapiens; identical to SEQ ID NO: 73332

SEQ ID NO: 649860 - RNA, 64 nt, Homo Sapiens; identical to SEQ ID NO: 73333

SEQ ID NO: 649861 - RNA, 64 nt, Homo Sapiens; identical to SEQ ID NO: 73334

SEQ ID NO: 649862 - RNA, 64 nt, Homo Sapiens; identical to SEQ ID NO: 73335

SEQ ID NO: 649863 - RNA, 64 nt, Homo Sapiens; identical to SEQ ID NO: 73336

SEQ ID NO: 649864 - RNA, 64 nt, Homo Sapiens; identical to SEQ ID NO: 73337

SEQ ID NO: 649865 - RNA, 64 nt, Homo Sapiens; identical to SEQ ID NO: 73338

SEQ ID NO: 649866 - RNA, 64 nt, Homo Sapiens; identical to SEQ ID NO: 73339

SEQ ID NO: 649867 - RNA, 64 nt, Homo Sapiens; identical to SEQ ID NO: 73340

SEQ ID NO: 649868 - RNA, 64 nt, Homo Sapiens; identical to SEQ ID NO: 73341

SEQ ID NO: 649869 - RNA, 64 nt, Homo Sapiens; identical to SEQ ID NO: 73342

SEQ ID NO: 649870 - RNA, 64 nt, Homo Sapiens; identical to SEQ ID NO: 73343

SEQ ID NO: 649871 - RNA, 64 nt, Homo Sapiens; identical to SEQ ID NO: 73344

SEQ ID NO: 649872 - RNA, 64 nt, Homo Sapiens; identical to SEQ ID NO: 117299

SEQ ID NO: 649873 - RNA, 64 nt, Homo Sapiens; identical to SEQ ID NO: 117300

SEQ ID NO: 649874 - RNA, 64 nt, Homo Sapiens; identical to SEQ ID NO: 117301

SEQ ID NO: 649875 - RNA, 64 nt, Homo Sapiens; identical to SEQ ID NO: 117302

SEQ ID NO: 649876 - RNA, 64 nt, Homo Sapiens; identical to SEQ ID NO: 117303

SEQ ID NO: 649877 - RNA, 64 nt, Homo Sapiens; identical to SEQ ID NO: 117304

SEQ ID NO: 649878 - RNA, 64 nt, Homo Sapiens; identical to SEQ ID NO: 117305

SEQ ID NO: 649879 - RNA, 64 nt, Homo Sapiens; identical to SEQ ID NO: 117306

SEQ ID NO: 649880 - RNA, 64 nt, Homo Sapiens; identical to SEQ ID NO: 117307

SEQ ID NO: 649881 - RNA, 64 nt, Homo Sapiens; identical to SEQ ID NO: 117308

SEQ ID NO: 649882 - RNA, 64 nt, Homo Sapiens; identical to SEQ ID NO: 117309

SEQ ID NO: 649883 - RNA, 64 nt, Homo Sapiens; identical to SEQ ID NO: 117310

SEQ ID NO: 649884 - RNA, 64 nt, Homo Sapiens; identical to SEQ ID NO: 117311

SEQ ID NO: 649885 - RNA, 64 nt, Homo Sapiens; identical to SEQ ID NO: 117312

SEQ ID NO: 649886 - RNA, 64 nt, Homo Sapiens; identical to SEQ ID NO: 117313

SEQ ID NO: 649887 - RNA, 64 nt, Homo Sapiens; identical to SEQ ID NO: 117314

SEQ ID NO: 649888 - RNA, 64 nt, Homo Sapiens; identical to SEQ ID NO: 117315

SEQ ID NO: 649889 - RNA, 64 nt, Homo Sapiens; identical to SEQ ID NO: 117316

SEQ ID NO: 649890 - RNA, 64 nt, Homo Sapiens; identical to SEQ ID NO: 117317

SEQ ID NO: 649891 - RNA, 64 nt, Homo Sapiens; identical to SEQ ID NO: 117318

SEQ ID NO: 649892 - RNA, 64 nt, Homo Sapiens; identical to SEQ ID NO: 117319

SEQ ID NO: 649893 - RNA, 64 nt, Homo Sapiens; identical to SEQ ID NO: 117320

SEQ ID NO: 649894 - RNA, 64 nt, Homo Sapiens; identical to SEQ ID NO: 117321

SEQ ID NO: 649895 - RNA, 64 nt, Homo Sapiens; identical to SEQ ID NO: 117322

SEQ ID NO: 649896 - RNA, 64 nt, Homo Sapiens; identical to SEQ ID NO: 117323

SEQ ID NO: 649897 - RNA, 64 nt, Homo Sapiens; identical to SEQ ID NO: 117324

SEQ ID NO: 649898 - RNA, 64 nt, Homo Sapiens; identical to SEQ ID NO: 117325

SEQ ID NO: 649899 - RNA, 64 nt, Homo Sapiens; identical to SEQ ID NO: 117326

SEQ ID NO: 649900 - RNA, 64 nt, Homo Sapiens; identical to SEQ ID NO: 117327

SEQ ID NO: 649901 - RNA, 64 nt, Homo Sapiens; identical to SEQ ID NO: 117328

SEQ ID NO: 649902 - RNA, 64 nt, Homo Sapiens; identical to SEQ ID NO: 174092

SEQ ID NO: 649903 - RNA, 64 nt, Homo Sapiens; identical to SEQ ID NO: 174093

SEQ ID NO: 649904 - RNA, 64 nt, Homo Sapiens; identical to SEQ ID NO: 174095

SEQ ID NO: 649905 - RNA, 64 nt, Homo Sapiens; identical to SEQ ID NO: 174096

SEQ ID NO: 649906 - RNA, 64 nt, Homo Sapiens; identical to SEQ ID NO: 174127

SEQ ID NO: 649907 - RNA, 64 nt, Homo Sapiens; identical to SEQ ID NO: 174128

SEQ ID NO: 649908 - RNA, 64 nt, Homo Sapiens; identical to SEQ ID NO: 174147

SEQ ID NO: 649909 - RNA, 64 nt, Homo Sapiens; identical to SEQ ID NO: 174148

SEQ ID NO: 649910 - RNA, 64 nt, Homo Sapiens; identical to SEQ ID NO: 174171

SEQ ID NO: 649911 - RNA, 64 nt, Homo Sapiens; identical to SEQ ID NO: 174172

SEQ ID NO: 649912 - RNA, 64 nt, Homo Sapiens; identical to SEQ ID NO: 174194

SEQ ID NO: 649913 - RNA, 64 nt, Homo Sapiens; identical to SEQ ID NO: 174195

SEQ ID NO: 649914 - RNA, 64 nt, Homo Sapiens; identical to SEQ ID NO: 174204

SEQ ID NO: 649915 - RNA, 64 nt, Homo Sapiens; identical to SEQ ID NO: 174205

SEQ ID NO: 649916 - RNA, 64 nt, Homo Sapiens; identical to SEQ ID NO: 174212

SEQ ID NO: 649917 - RNA, 64 nt, Homo Sapiens; identical to SEQ ID NO: 174213

SEQ ID NO: 649918 - RNA, 64 nt, Homo Sapiens; identical to SEQ ID NO: 174220

SEQ ID NO: 649919 - RNA, 64 nt, Homo Sapiens; identical to SEQ ID NO: 174221

SEQ ID NO: 649920 - RNA, 64 nt, Homo Sapiens; identical to SEQ ID NO: 174227

SEQ ID NO: 649921 - RNA, 64 nt, Homo Sapiens; identical to SEQ ID NO: 174228

SEQ ID NO: 649922 - RNA, 64 nt, Homo Sapiens; identical to SEQ ID NO: 174230

SEQ ID NO: 649923 - RNA, 64 nt, Homo Sapiens; identical to SEQ ID NO: 174231

SEQ ID NO: 649924 - RNA, 64 nt, Homo Sapiens; identical to SEQ ID NO: 174233

SEQ ID NO: 649925 - RNA, 51 nt, Homo Sapiens; identical to SEQ ID NO: 173793

SEQ ID NO: 649926 - RNA, 64 nt, Homo Sapiens; identical to SEQ ID NO: 174312

SEQ ID NO: 649927 - RNA, 64 nt, Homo Sapiens; identical to SEQ ID NO: 174313

SEQ ID NO: 649928 - RNA, 57 nt, Homo Sapiens; identical to SEQ ID NO: 173883

SEQ ID NO: 649929 - RNA, 64 nt, Homo Sapiens; identical to SEQ ID NO: 174325

SEQ ID NO: 649930 - RNA, 64 nt, Homo Sapiens; identical to SEQ ID NO: 174358

SEQ ID NO: 649931 - RNA, 64 nt, Homo Sapiens; identical to SEQ ID NO: 174359

SEQ ID NO: 649932 - RNA, 64 nt, Homo Sapiens; identical to SEQ ID NO: 174369

SEQ ID NO: 649933 - RNA, 64 nt, Homo Sapiens; identical to SEQ ID NO: 174370

SEQ ID NO: 649934 - RNA, 64 nt, Homo Sapiens; identical to SEQ ID NO: 174388

SEQ ID NO: 649935 - RNA, 64 nt, Homo Sapiens; identical to SEQ ID NO: 174389

SEQ ID NO: 649936 - RNA, 64 nt, Homo Sapiens; identical to SEQ ID NO: 174405

SEQ ID NO: 649937 - RNA, 64 nt, Homo Sapiens; identical to SEQ ID NO: 174406

SEQ ID NO: 649938 - RNA, 64 nt, Homo Sapiens; identical to SEQ ID NO: 174416

SEQ ID NO: 649939 - RNA, 64 nt, Homo Sapiens; identical to SEQ ID NO: 174417

SEQ ID NO: 649940 - RNA, 64 nt, Homo Sapiens; identical to SEQ ID NO: 174427

SEQ ID NO: 649941 - RNA, 64 nt, Homo Sapiens; identical to SEQ ID NO: 174428

SEQ ID NO: 649942 - RNA, 64 nt, Homo Sapiens; identical to SEQ ID NO: 174434

SEQ ID NO: 649943 - RNA, 64 nt, Homo Sapiens; identical to SEQ ID NO: 174435

SEQ ID NO: 649944 - RNA, 64 nt, Homo Sapiens; identical to SEQ ID NO: 174516

SEQ ID NO: 649945 - RNA, 64 nt, Homo Sapiens; identical to SEQ ID NO: 174517

SEQ ID NO: 649946 - RNA, 62 nt, Homo Sapiens; identical to SEQ ID NO: 350237

SEQ ID NO: 649947 - RNA, 62 nt, Homo Sapiens; identical to SEQ ID NO: 350238

SEQ ID NO: 649948 - RNA, 62 nt, Homo Sapiens; identical to SEQ ID NO: 350239

SEQ ID NO: 649949 - RNA, 62 nt, Homo Sapiens; identical to SEQ ID NO: 350240

SEQ ID NO: 649950 - RNA, 62 nt, Homo Sapiens; identical to SEQ ID NO: 350241

SEQ ID NO: 649951 - RNA, 62 nt, Homo Sapiens; identical to SEQ ID NO: 350242

SEQ ID NO: 649952 - RNA, 62 nt, Homo Sapiens; identical to SEQ ID NO: 350243

SEQ ID NO: 649953 - RNA, 62 nt, Homo Sapiens; identical to SEQ ID NO: 350244

SEQ ID NO: 649954 - RNA, 62 nt, Homo Sapiens; identical to SEQ ID NO: 350245

SEQ ID NO: 649955 - RNA, 62 nt, Homo Sapiens; identical to SEQ ID NO: 350246

SEQ ID NO: 649956 - RNA, 62 nt, Homo Sapiens; identical to SEQ ID NO: 350247

SEQ ID NO: 649957 - RNA, 62 nt, Homo Sapiens; identical to SEQ ID NO: 350248

SEQ ID NO: 649958 - RNA, 62 nt, Homo Sapiens; identical to SEQ ID NO: 350249

SEQ ID NO: 649959 - RNA, 62 nt, Homo Sapiens; identical to SEQ ID NO: 350250

SEQ ID NO: 649960 - RNA, 62 nt, Homo Sapiens; identical to SEQ ID NO: 350251

SEQ ID NO: 649961 - RNA, 62 nt, Homo Sapiens; identical to SEQ ID NO: 350252

SEQ ID NO: 649962 - RNA, 55 nt, Homo Sapiens; identical to SEQ ID NO: 174536

SEQ ID NO: 649963 - RNA, 62 nt, Homo Sapiens; identical to SEQ ID NO: 350254

SEQ ID NO: 649964 - RNA, 62 nt, Homo Sapiens; identical to SEQ ID NO: 350255

SEQ ID NO: 649965 - RNA, 62 nt, Homo Sapiens; identical to SEQ ID NO: 350256

SEQ ID NO: 649966 - RNA, 62 nt, Homo Sapiens; identical to SEQ ID NO: 350257

SEQ ID NO: 649967 - RNA, 62 nt, Homo Sapiens; identical to SEQ ID NO: 350258

SEQ ID NO: 649968 - RNA, 62 nt, Homo Sapiens; identical to SEQ ID NO: 350259

SEQ ID NO: 649969 - RNA, 62 nt, Homo Sapiens; identical to SEQ ID NO: 350260

SEQ ID NO: 649970 - RNA, 62 nt, Homo Sapiens; identical to SEQ ID NO: 350261

SEQ ID NO: 649971 - RNA, 62 nt, Homo Sapiens; identical to SEQ ID NO: 350262

SEQ ID NO: 649972 - RNA, 62 nt, Homo Sapiens; identical to SEQ ID NO: 350263

SEQ ID NO: 649973 - RNA, 62 nt, Homo Sapiens; identical to SEQ ID NO: 350264

SEQ ID NO: 649974 - RNA, 62 nt, Homo Sapiens; identical to SEQ ID NO: 350265

SEQ ID NO: 649975 - RNA, 62 nt, Homo Sapiens; identical to SEQ ID NO: 350266

SEQ ID NO: 649976 - RNA, 62 nt, Homo Sapiens; identical to SEQ ID NO: 350267

SEQ ID NO: 649977 - RNA, 62 nt, Homo Sapiens; identical to SEQ ID NO: 350268

SEQ ID NO: 649978 - RNA, 58 nt, Homo Sapiens; identical to SEQ ID NO: 174552

SEQ ID NO: 649979 - RNA, 62 nt, Homo Sapiens; identical to SEQ ID NO: 350270

SEQ ID NO: 649980 - RNA, 62 nt, Homo Sapiens; identical to SEQ ID NO: 350271

SEQ ID NO: 649981 - RNA, 62 nt, Homo Sapiens; identical to SEQ ID NO: 350272

SEQ ID NO: 649982 - RNA, 62 nt, Homo Sapiens; identical to SEQ ID NO: 350273

SEQ ID NO: 649983 - RNA, 62 nt, Homo Sapiens; identical to SEQ ID NO: 350274

SEQ ID NO: 649984 - RNA, 62 nt, Homo Sapiens; identical to SEQ ID NO: 350275

SEQ ID NO: 649985 - RNA, 62 nt, Homo Sapiens; identical to SEQ ID NO: 350276

SEQ ID NO: 649986 - RNA, 62 nt, Homo Sapiens; identical to SEQ ID NO: 350277

SEQ ID NO: 649987 - RNA, 62 nt, Homo Sapiens; identical to SEQ ID NO: 350278

SEQ ID NO: 649988 - RNA, 62 nt, Homo Sapiens; identical to SEQ ID NO: 350279

SEQ ID NO: 649989 - RNA, 62 nt, Homo Sapiens; identical to SEQ ID NO: 350280

SEQ ID NO: 649990 - RNA, 62 nt, Homo Sapiens; identical to SEQ ID NO: 350281

SEQ ID NO: 649991 - RNA, 62 nt, Homo Sapiens; identical to SEQ ID NO: 350282

SEQ ID NO: 649992 - RNA, 62 nt, Homo Sapiens; identical to SEQ ID NO: 350283

SEQ ID NO: 649993 - RNA, 62 nt, Homo Sapiens; identical to SEQ ID NO: 350284

SEQ ID NO: 649994 - RNA, 62 nt, Homo Sapiens; identical to SEQ ID NO: 350285

SEQ ID NO: 649995 - RNA, 62 nt, Homo Sapiens; identical to SEQ ID NO: 350286

SEQ ID NO: 649996 - RNA, 62 nt, Homo Sapiens; identical to SEQ ID NO: 350287

SEQ ID NO: 649997 - RNA, 62 nt, Homo Sapiens; identical to SEQ ID NO: 350288

SEQ ID NO: 649998 - RNA, 62 nt, Homo Sapiens; identical to SEQ ID NO: 350289

SEQ ID NO: 649999 - RNA, 62 nt, Homo Sapiens; identical to SEQ ID NO: 350290

SEQ ID NO: 650000 - RNA, 62 nt, Homo Sapiens; identical to SEQ ID NO: 350291

SEQ ID NO: 650001 - RNA, 62 nt, Homo Sapiens; identical to SEQ ID NO: 350292

SEQ ID NO: 650002 - RNA, 62 nt, Homo Sapiens; identical to SEQ ID NO: 350293

SEQ ID NO: 650003 - RNA, 62 nt, Homo Sapiens; identical to SEQ ID NO: 350294

SEQ ID NO: 650004 - RNA, 62 nt, Homo Sapiens; identical to SEQ ID NO: 350295

SEQ ID NO: 650005 - RNA, 62 nt, Homo Sapiens; identical to SEQ ID NO: 350296

SEQ ID NO: 650006 - RNA, 62 nt, Homo Sapiens; identical to SEQ ID NO: 350297

SEQ ID NO: 650007 - RNA, 62 nt, Homo Sapiens; identical to SEQ ID NO: 350298

SEQ ID NO: 650008 - RNA, 62 nt, Homo Sapiens; identical to SEQ ID NO: 350299

SEQ ID NO: 650009 - RNA, 62 nt, Homo Sapiens; identical to SEQ ID NO: 350300

SEQ ID NO: 650010 - RNA, 62 nt, Homo Sapiens; identical to SEQ ID NO: 350301

SEQ ID NO: 650011 - RNA, 62 nt, Homo Sapiens; identical to SEQ ID NO: 350302

SEQ ID NO: 650012 - RNA, 62 nt, Homo Sapiens; identical to SEQ ID NO: 350303

SEQ ID NO: 650013 - RNA, 62 nt, Homo Sapiens; identical to SEQ ID NO: 350304

SEQ ID NO: 650014 - RNA, 62 nt, Homo Sapiens; identical to SEQ ID NO: 350305

SEQ ID NO: 650015 - RNA, 62 nt, Homo Sapiens; identical to SEQ ID NO: 350306

SEQ ID NO: 650016 - RNA, 62 nt, Homo Sapiens; identical to SEQ ID NO: 350307

SEQ ID NO: 650017 - RNA, 62 nt, Homo Sapiens; identical to SEQ ID NO: 350308

SEQ ID NO: 650018 - RNA, 62 nt, Homo Sapiens; identical to SEQ ID NO: 350309

SEQ ID NO: 650019 - RNA, 62 nt, Homo Sapiens; identical to SEQ ID NO: 350310

SEQ ID NO: 650020 - RNA, 62 nt, Homo Sapiens; identical to SEQ ID NO: 350311

SEQ ID NO: 650021 - RNA, 62 nt, Homo Sapiens; identical to SEQ ID NO: 350312

SEQ ID NO: 650022 - RNA, 62 nt, Homo Sapiens; identical to SEQ ID NO: 350313

SEQ ID NO: 650023 - RNA, 62 nt, Homo Sapiens; identical to SEQ ID NO: 350314

SEQ ID NO: 650024 - RNA, 62 nt, Homo Sapiens; identical to SEQ ID NO: 350315

SEQ ID NO: 650025 - RNA, 62 nt, Homo Sapiens; identical to SEQ ID NO: 350316

SEQ ID NO: 650026 - RNA, 62 nt, Homo Sapiens; identical to SEQ ID NO: 350317

SEQ ID NO: 650027 - RNA, 62 nt, Homo Sapiens; identical to SEQ ID NO: 350318

SEQ ID NO: 650028 - RNA, 62 nt, Homo Sapiens; identical to SEQ ID NO: 350319

SEQ ID NO: 650029 - RNA, 62 nt, Homo Sapiens; identical to SEQ ID NO: 350320

SEQ ID NO: 650030 - RNA, 62 nt, Homo Sapiens; identical to SEQ ID NO: 350321

SEQ ID NO: 650031 - RNA, 62 nt, Homo Sapiens; identical to SEQ ID NO: 350322

SEQ ID NO: 650032 - RNA, 62 nt, Homo Sapiens; identical to SEQ ID NO: 350323

SEQ ID NO: 650033 - RNA, 62 nt, Homo Sapiens; identical to SEQ ID NO: 350324

SEQ ID NO: 650034 - RNA, 62 nt, Homo Sapiens; identical to SEQ ID NO: 350325

SEQ ID NO: 650035 - RNA, 62 nt, Homo Sapiens; identical to SEQ ID NO: 350326

SEQ ID NO: 650036 - RNA, 62 nt, Homo Sapiens; identical to SEQ ID NO: 350327

SEQ ID NO: 650037 - RNA, 62 nt, Homo Sapiens; identical to SEQ ID NO: 350328

SEQ ID NO: 650038 - RNA, 62 nt, Homo Sapiens; identical to SEQ ID NO: 350329

SEQ ID NO: 650039 - RNA, 62 nt, Homo Sapiens; identical to SEQ ID NO: 350330

SEQ ID NO: 650040 - RNA, 62 nt, Homo Sapiens; identical to SEQ ID NO: 350331

SEQ ID NO: 650041 - RNA, 62 nt, Homo Sapiens; identical to SEQ ID NO: 350332

SEQ ID NO: 650042 - RNA, 62 nt, Homo Sapiens; identical to SEQ ID NO: 350333

SEQ ID NO: 650043 - RNA, 62 nt, Homo Sapiens; identical to SEQ ID NO: 350334

SEQ ID NO: 650044 - RNA, 62 nt, Homo Sapiens; identical to SEQ ID NO: 350335

SEQ ID NO: 650045 - RNA, 62 nt, Homo Sapiens; identical to SEQ ID NO: 350336

SEQ ID NO: 650046 - RNA, 62 nt, Homo Sapiens; identical to SEQ ID NO: 350337

SEQ ID NO: 650047 - RNA, 62 nt, Homo Sapiens; identical to SEQ ID NO: 350338

SEQ ID NO: 650048 - RNA, 62 nt, Homo Sapiens; identical to SEQ ID NO: 350339

SEQ ID NO: 650049 - RNA, 62 nt, Homo Sapiens; identical to SEQ ID NO: 350340

SEQ ID NO: 650050 - RNA, 62 nt, Homo Sapiens; identical to SEQ ID NO: 350341

SEQ ID NO: 650051 - RNA, 62 nt, Homo Sapiens; identical to SEQ ID NO: 350342

SEQ ID NO: 650052 - RNA, 62 nt, Homo Sapiens; identical to SEQ ID NO: 350343

SEQ ID NO: 650053 - RNA, 62 nt, Homo Sapiens; identical to SEQ ID NO: 350344

SEQ ID NO: 650054 - RNA, 62 nt, Homo Sapiens; identical to SEQ ID NO: 350345

SEQ ID NO: 650055 - RNA, 62 nt, Homo Sapiens; identical to SEQ ID NO: 350346

SEQ ID NO: 650056 - RNA, 62 nt, Homo Sapiens; identical to SEQ ID NO: 350347

SEQ ID NO: 650057 - RNA, 62 nt, Homo Sapiens; identical to SEQ ID NO: 350348

SEQ ID NO: 650058 - RNA, 62 nt, Homo Sapiens; identical to SEQ ID NO: 350349

SEQ ID NO: 650059 - RNA, 62 nt, Homo Sapiens; identical to SEQ ID NO: 350350

SEQ ID NO: 650060 - RNA, 62 nt, Homo Sapiens; identical to SEQ ID NO: 350351

SEQ ID NO: 650061 - RNA, 62 nt, Homo Sapiens; identical to SEQ ID NO: 350352

SEQ ID NO: 650062 - RNA, 62 nt, Homo Sapiens; identical to SEQ ID NO: 350353

SEQ ID NO: 650063 - RNA, 62 nt, Homo Sapiens; identical to SEQ ID NO: 350354

SEQ ID NO: 650064 - RNA, 62 nt, Homo Sapiens; identical to SEQ ID NO: 350355

SEQ ID NO: 650065 - RNA, 62 nt, Homo Sapiens; identical to SEQ ID NO: 350356

SEQ ID NO: 650066 - RNA, 62 nt, Homo Sapiens; identical to SEQ ID NO: 350357

SEQ ID NO: 650067 - RNA, 62 nt, Homo Sapiens; identical to SEQ ID NO: 350358

SEQ ID NO: 650068 - RNA, 62 nt, Homo Sapiens; identical to SEQ ID NO: 350359

SEQ ID NO: 650069 - RNA, 62 nt, Homo Sapiens; identical to SEQ ID NO: 350360

SEQ ID NO: 650070 - RNA, 62 nt, Homo Sapiens; identical to SEQ ID NO: 350361

SEQ ID NO: 650071 - RNA, 62 nt, Homo Sapiens; identical to SEQ ID NO: 350362

SEQ ID NO: 650072 - RNA, 62 nt, Homo Sapiens; identical to SEQ ID NO: 350363

SEQ ID NO: 650073 - RNA, 62 nt, Homo Sapiens; identical to SEQ ID NO: 350364

SEQ ID NO: 650074 - RNA, 62 nt, Homo Sapiens; identical to SEQ ID NO: 350365

SEQ ID NO: 650075 - RNA, 62 nt, Homo Sapiens; identical to SEQ ID NO: 350366

SEQ ID NO: 650076 - RNA, 62 nt, Homo Sapiens; identical to SEQ ID NO: 350367

SEQ ID NO: 650077 - RNA, 62 nt, Homo Sapiens; identical to SEQ ID NO: 350368

SEQ ID NO: 650078 - RNA, 62 nt, Homo Sapiens; identical to SEQ ID NO: 350369

SEQ ID NO: 650079 - RNA, 62 nt, Homo Sapiens; identical to SEQ ID NO: 350370

SEQ ID NO: 650080 - RNA, 62 nt, Homo Sapiens; identical to SEQ ID NO: 350371

SEQ ID NO: 650081 - RNA, 62 nt, Homo Sapiens; identical to SEQ ID NO: 350372

SEQ ID NO: 650082 - RNA, 62 nt, Homo Sapiens; identical to SEQ ID NO: 350373

SEQ ID NO: 650083 - RNA, 62 nt, Homo Sapiens; identical to SEQ ID NO: 350374

SEQ ID NO: 650084 - RNA, 62 nt, Homo Sapiens; identical to SEQ ID NO: 350375

SEQ ID NO: 650085 - RNA, 62 nt, Homo Sapiens; identical to SEQ ID NO: 350376

SEQ ID NO: 650086 - RNA, 62 nt, Homo Sapiens; identical to SEQ ID NO: 350377

SEQ ID NO: 650087 - RNA, 62 nt, Homo Sapiens; identical to SEQ ID NO: 350378

SEQ ID NO: 650088 - RNA, 62 nt, Homo Sapiens; identical to SEQ ID NO: 350379

SEQ ID NO: 650089 - RNA, 62 nt, Homo Sapiens; identical to SEQ ID NO: 350380

SEQ ID NO: 650090 - RNA, 62 nt, Homo Sapiens; identical to SEQ ID NO: 350381

SEQ ID NO: 650091 - RNA, 62 nt, Homo Sapiens; identical to SEQ ID NO: 350382

SEQ ID NO: 650092 - RNA, 62 nt, Homo Sapiens; identical to SEQ ID NO: 350383

SEQ ID NO: 650093 - RNA, 62 nt, Homo Sapiens; identical to SEQ ID NO: 350384

SEQ ID NO: 650094 - RNA, 62 nt, Homo Sapiens; identical to SEQ ID NO: 350385

SEQ ID NO: 650095 - RNA, 62 nt, Homo Sapiens; identical to SEQ ID NO: 350386

SEQ ID NO: 650096 - RNA, 62 nt, Homo Sapiens; identical to SEQ ID NO: 350387

SEQ ID NO: 650097 - RNA, 62 nt, Homo Sapiens; identical to SEQ ID NO: 350388

SEQ ID NO: 650098 - RNA, 62 nt, Homo Sapiens; identical to SEQ ID NO: 350389

SEQ ID NO: 650099 - RNA, 62 nt, Homo Sapiens; identical to SEQ ID NO: 350390

SEQ ID NO: 650100 - RNA, 62 nt, Homo Sapiens; identical to SEQ ID NO: 350391

SEQ ID NO: 650101 - RNA, 62 nt, Homo Sapiens; identical to SEQ ID NO: 350392

SEQ ID NO: 650102 - RNA, 62 nt, Homo Sapiens; identical to SEQ ID NO: 350393

SEQ ID NO: 650103 - RNA, 62 nt, Homo Sapiens; identical to SEQ ID NO: 350394

SEQ ID NO: 650104 - RNA, 62 nt, Homo Sapiens; identical to SEQ ID NO: 350395

SEQ ID NO: 650105 - RNA, 62 nt, Homo Sapiens; identical to SEQ ID NO: 350396

SEQ ID NO: 650106 - RNA, 62 nt, Homo Sapiens; identical to SEQ ID NO: 350397

SEQ ID NO: 650107 - RNA, 62 nt, Homo Sapiens; identical to SEQ ID NO: 350398

SEQ ID NO: 650108 - RNA, 62 nt, Homo Sapiens; identical to SEQ ID NO: 350399

SEQ ID NO: 650109 - RNA, 62 nt, Homo Sapiens; identical to SEQ ID NO: 350400

SEQ ID NO: 650110 - RNA, 62 nt, Homo Sapiens; identical to SEQ ID NO: 350401

SEQ ID NO: 650111 - RNA, 62 nt, Homo Sapiens; identical to SEQ ID NO: 350402

SEQ ID NO: 650112 - RNA, 62 nt, Homo Sapiens; identical to SEQ ID NO: 350403

SEQ ID NO: 650113 - RNA, 62 nt, Homo Sapiens; identical to SEQ ID NO: 350404

SEQ ID NO: 650114 - RNA, 62 nt, Homo Sapiens; identical to SEQ ID NO: 350405

SEQ ID NO: 650115 - RNA, 62 nt, Homo Sapiens; identical to SEQ ID NO: 350406

SEQ ID NO: 650116 - RNA, 62 nt, Homo Sapiens; identical to SEQ ID NO: 350407

SEQ ID NO: 650117 - RNA, 62 nt, Homo Sapiens; identical to SEQ ID NO: 350408

SEQ ID NO: 650118 - RNA, 62 nt, Homo Sapiens; identical to SEQ ID NO: 350409

SEQ ID NO: 650119 - RNA, 62 nt, Homo Sapiens; identical to SEQ ID NO: 350410

SEQ ID NO: 650120 - RNA, 62 nt, Homo Sapiens; identical to SEQ ID NO: 350411

SEQ ID NO: 650121 - RNA, 62 nt, Homo Sapiens; identical to SEQ ID NO: 350412

SEQ ID NO: 650122 - RNA, 62 nt, Homo Sapiens; identical to SEQ ID NO: 350413

SEQ ID NO: 650123 - RNA, 62 nt, Homo Sapiens; identical to SEQ ID NO: 350414

SEQ ID NO: 650124 - RNA, 62 nt, Homo Sapiens; identical to SEQ ID NO: 350415

SEQ ID NO: 650125 - RNA, 62 nt, Homo Sapiens; identical to SEQ ID NO: 350416

SEQ ID NO: 650126 - RNA, 62 nt, Homo Sapiens; identical to SEQ ID NO: 350417

SEQ ID NO: 650127 - RNA, 62 nt, Homo Sapiens; identical to SEQ ID NO: 350418

SEQ ID NO: 650128 - RNA, 62 nt, Homo Sapiens; identical to SEQ ID NO: 350419

SEQ ID NO: 650129 - RNA, 62 nt, Homo Sapiens; identical to SEQ ID NO: 350420

SEQ ID NO: 650130 - RNA, 62 nt, Homo Sapiens; identical to SEQ ID NO: 350421

SEQ ID NO: 650131 - RNA, 62 nt, Homo Sapiens; identical to SEQ ID NO: 350422

SEQ ID NO: 650132 - RNA, 62 nt, Homo Sapiens; identical to SEQ ID NO: 350423

SEQ ID NO: 650133 - RNA, 62 nt, Homo Sapiens; identical to SEQ ID NO: 350424

SEQ ID NO: 650134 - RNA, 62 nt, Homo Sapiens; identical to SEQ ID NO: 350425

SEQ ID NO: 650135 - RNA, 62 nt, Homo Sapiens; identical to SEQ ID NO: 350426

SEQ ID NO: 650136 - RNA, 62 nt, Homo Sapiens; identical to SEQ ID NO: 350427

SEQ ID NO: 650137 - RNA, 62 nt, Homo Sapiens; identical to SEQ ID NO: 350428

SEQ ID NO: 650138 - RNA, 62 nt, Homo Sapiens; identical to SEQ ID NO: 350429

SEQ ID NO: 650139 - RNA, 62 nt, Homo Sapiens; identical to SEQ ID NO: 350430

SEQ ID NO: 650140 - RNA, 62 nt, Homo Sapiens; identical to SEQ ID NO: 350431

SEQ ID NO: 650141 - RNA, 62 nt, Homo Sapiens; identical to SEQ ID NO: 350432

SEQ ID NO: 650142 - RNA, 62 nt, Homo Sapiens; identical to SEQ ID NO: 350433

SEQ ID NO: 650143 - RNA, 62 nt, Homo Sapiens; identical to SEQ ID NO: 350434

SEQ ID NO: 650144 - RNA, 62 nt, Homo Sapiens; identical to SEQ ID NO: 350435

SEQ ID NO: 650145 - RNA, 62 nt, Homo Sapiens; identical to SEQ ID NO: 350436

SEQ ID NO: 650146 - RNA, 62 nt, Homo Sapiens; identical to SEQ ID NO: 350437

SEQ ID NO: 650147 - RNA, 62 nt, Homo Sapiens; identical to SEQ ID NO: 350438

SEQ ID NO: 650148 - RNA, 62 nt, Homo Sapiens; identical to SEQ ID NO: 350439

SEQ ID NO: 650149 - RNA, 62 nt, Homo Sapiens; identical to SEQ ID NO: 350440

SEQ ID NO: 650150 - RNA, 62 nt, Homo Sapiens; identical to SEQ ID NO: 350441

SEQ ID NO: 650151 - RNA, 62 nt, Homo Sapiens; identical to SEQ ID NO: 350442

SEQ ID NO: 650152 - RNA, 62 nt, Homo Sapiens; identical to SEQ ID NO: 350443

SEQ ID NO: 650153 - RNA, 62 nt, Homo Sapiens; identical to SEQ ID NO: 350444

SEQ ID NO: 650154 - RNA, 62 nt, Homo Sapiens; identical to SEQ ID NO: 350445

SEQ ID NO: 650155 - RNA, 62 nt, Homo Sapiens; identical to SEQ ID NO: 350446

SEQ ID NO: 650156 - RNA, 62 nt, Homo Sapiens; identical to SEQ ID NO: 350447

SEQ ID NO: 650157 - RNA, 62 nt, Homo Sapiens; identical to SEQ ID NO: 350448

SEQ ID NO: 650158 - RNA, 62 nt, Homo Sapiens; identical to SEQ ID NO: 350449

SEQ ID NO: 650159 - RNA, 62 nt, Homo Sapiens; identical to SEQ ID NO: 350450

SEQ ID NO: 650160 - RNA, 62 nt, Homo Sapiens; identical to SEQ ID NO: 350451

SEQ ID NO: 650161 - RNA, 62 nt, Homo Sapiens; identical to SEQ ID NO: 350452

SEQ ID NO: 650162 - RNA, 62 nt, Homo Sapiens; identical to SEQ ID NO: 350453

SEQ ID NO: 650163 - RNA, 62 nt, Homo Sapiens; identical to SEQ ID NO: 350454

SEQ ID NO: 650164 - RNA, 62 nt, Homo Sapiens; identical to SEQ ID NO: 350455

SEQ ID NO: 650165 - RNA, 62 nt, Homo Sapiens; identical to SEQ ID NO: 350456

SEQ ID NO: 650166 - RNA, 62 nt, Homo Sapiens; identical to SEQ ID NO: 350457

SEQ ID NO: 650167 - RNA, 62 nt, Homo Sapiens; identical to SEQ ID NO: 350458

SEQ ID NO: 650168 - RNA, 62 nt, Homo Sapiens; identical to SEQ ID NO: 350459

SEQ ID NO: 650169 - RNA, 62 nt, Homo Sapiens; identical to SEQ ID NO: 350460

SEQ ID NO: 650170 - RNA, 62 nt, Homo Sapiens; identical to SEQ ID NO: 350461

SEQ ID NO: 650171 - RNA, 62 nt, Homo Sapiens; identical to SEQ ID NO: 350462

SEQ ID NO: 650172 - RNA, 62 nt, Homo Sapiens; identical to SEQ ID NO: 350463

SEQ ID NO: 650173 - RNA, 62 nt, Homo Sapiens; identical to SEQ ID NO: 350464

SEQ ID NO: 650174 - RNA, 62 nt, Homo Sapiens; identical to SEQ ID NO: 350465

SEQ ID NO: 650175 - RNA, 62 nt, Homo Sapiens; identical to SEQ ID NO: 350466

SEQ ID NO: 650176 - RNA, 62 nt, Homo Sapiens; identical to SEQ ID NO: 350467

SEQ ID NO: 650177 - RNA, 62 nt, Homo Sapiens; identical to SEQ ID NO: 350468

SEQ ID NO: 650178 - RNA, 62 nt, Homo Sapiens; identical to SEQ ID NO: 350469

SEQ ID NO: 650179 - RNA, 62 nt, Homo Sapiens; identical to SEQ ID NO: 350470

SEQ ID NO: 650180 - RNA, 62 nt, Homo Sapiens; identical to SEQ ID NO: 350471

SEQ ID NO: 650181 - RNA, 62 nt, Homo Sapiens; identical to SEQ ID NO: 350472

SEQ ID NO: 650182 - RNA, 62 nt, Homo Sapiens; identical to SEQ ID NO: 350473

SEQ ID NO: 650183 - RNA, 62 nt, Homo Sapiens; identical to SEQ ID NO: 350474

SEQ ID NO: 650184 - RNA, 62 nt, Homo Sapiens; identical to SEQ ID NO: 350475

SEQ ID NO: 650185 - RNA, 62 nt, Homo Sapiens; identical to SEQ ID NO: 350476

SEQ ID NO: 650186 - RNA, 62 nt, Homo Sapiens; identical to SEQ ID NO: 350477

SEQ ID NO: 650187 - RNA, 62 nt, Homo Sapiens; identical to SEQ ID NO: 350478

SEQ ID NO: 650188 - RNA, 62 nt, Homo Sapiens; identical to SEQ ID NO: 350479

SEQ ID NO: 650189 - RNA, 62 nt, Homo Sapiens; identical to SEQ ID NO: 350480

SEQ ID NO: 650190 - RNA, 62 nt, Homo Sapiens; identical to SEQ ID NO: 350481

SEQ ID NO: 650191 - RNA, 62 nt, Homo Sapiens; identical to SEQ ID NO: 350482

SEQ ID NO: 650192 - RNA, 62 nt, Homo Sapiens; identical to SEQ ID NO: 350483

SEQ ID NO: 650193 - RNA, 62 nt, Homo Sapiens; identical to SEQ ID NO: 350484

SEQ ID NO: 650194 - RNA, 62 nt, Homo Sapiens; identical to SEQ ID NO: 350485

SEQ ID NO: 650195 - RNA, 62 nt, Homo Sapiens; identical to SEQ ID NO: 350486

SEQ ID NO: 650196 - RNA, 62 nt, Homo Sapiens; identical to SEQ ID NO: 350487

SEQ ID NO: 650197 - RNA, 62 nt, Homo Sapiens; identical to SEQ ID NO: 350488

SEQ ID NO: 650198 - RNA, 62 nt, Homo Sapiens; identical to SEQ ID NO: 350489

SEQ ID NO: 650199 - RNA, 62 nt, Homo Sapiens; identical to SEQ ID NO: 350490

SEQ ID NO: 650200 - RNA, 62 nt, Homo Sapiens; identical to SEQ ID NO: 350491

SEQ ID NO: 650201 - RNA, 62 nt, Homo Sapiens; identical to SEQ ID NO: 350492

SEQ ID NO: 650202 - RNA, 62 nt, Homo Sapiens; identical to SEQ ID NO: 350493

SEQ ID NO: 650203 - RNA, 62 nt, Homo Sapiens; identical to SEQ ID NO: 350494

SEQ ID NO: 650204 - RNA, 62 nt, Homo Sapiens; identical to SEQ ID NO: 350495

SEQ ID NO: 650205 - RNA, 62 nt, Homo Sapiens; identical to SEQ ID NO: 350496

SEQ ID NO: 650206 - RNA, 62 nt, Homo Sapiens; identical to SEQ ID NO: 350497

SEQ ID NO: 650207 - RNA, 62 nt, Homo Sapiens; identical to SEQ ID NO: 350498

SEQ ID NO: 650208 - RNA, 62 nt, Homo Sapiens; identical to SEQ ID NO: 350499

SEQ ID NO: 650209 - RNA, 62 nt, Homo Sapiens; identical to SEQ ID NO: 350500

SEQ ID NO: 650210 - RNA, 62 nt, Homo Sapiens; identical to SEQ ID NO: 350501

SEQ ID NO: 650211 - RNA, 62 nt, Homo Sapiens; identical to SEQ ID NO: 350502

SEQ ID NO: 650212 - RNA, 62 nt, Homo Sapiens; identical to SEQ ID NO: 350503

SEQ ID NO: 650213 - RNA, 62 nt, Homo Sapiens; identical to SEQ ID NO: 350504

SEQ ID NO: 650214 - RNA, 62 nt, Homo Sapiens; identical to SEQ ID NO: 350505

SEQ ID NO: 650215 - RNA, 62 nt, Homo Sapiens; identical to SEQ ID NO: 350506

SEQ ID NO: 650216 - RNA, 62 nt, Homo Sapiens; identical to SEQ ID NO: 350507

SEQ ID NO: 650217 - RNA, 62 nt, Homo Sapiens; identical to SEQ ID NO: 350508

SEQ ID NO: 650218 - RNA, 62 nt, Homo Sapiens; identical to SEQ ID NO: 350509

SEQ ID NO: 650219 - RNA, 62 nt, Homo Sapiens; identical to SEQ ID NO: 350510

SEQ ID NO: 650220 - RNA, 62 nt, Homo Sapiens; identical to SEQ ID NO: 350511

SEQ ID NO: 650221 - RNA, 62 nt, Homo Sapiens; identical to SEQ ID NO: 350512

SEQ ID NO: 650222 - RNA, 64 nt, Homo Sapiens
ugguuggaaagucucuuuuuuguaauuuguuuuugcaaaucauugugaggccacuuuuucuuuc

SEQ ID NO: 650223 - RNA, 64 nt, Homo Sapiens
uccuucuuucaucucuuuuuuguaauuuguuguugcaaaucauugugaggccacuuuucuuucc

SEQ ID NO: 650224 - RNA, 64 nt, Homo Sapiens
cauguaccucguggaauucagccagcuucauguugcaaaucagaaagcugaccccaagacugca

SEQ ID NO: 650225 - RNA, 64 nt, Homo Sapiens
ucauguugcaaaucagaaagcugaccccaagacugcaaaucaaugaagguauuggcauuguuaa

SEQ ID NO: 650226 - RNA, 64 nt, Homo Sapiens
uguuuaaaaaggcaguuugcauuuguaauuaaaagcaaaucauuaaggcaucgucaugcacagu

SEQ ID NO: 650227 - RNA, 64 nt, Homo Sapiens
cuuuuguuuccuuuuucagauuuuuauaaauacugcaaaucaggaagguuagagaauaaauuga

SEQ ID NO: 650228 - RNA, 64 nt, Homo Sapiens
uagccuuugcacuuuuaaaauaaaaaccaaguaugcaaaucaaagauauuugguagucaaaaua

SEQ ID NO: 650229 - RNA, 64 nt, Homo Sapiens
uuugccuaaaaaggaaauuggaugggauacuguggcaaaucauaaaaaaccagauaauugaacu

SEQ ID NO: 650230 - RNA, 64 nt, Homo Sapiens
ggagaauccauaaugagagaaugcuacaaccauugcaaaucauuuugucacaaaguuuucagua

SEQ ID NO: 650231 - RNA, 64 nt, Homo Sapiens
ccuugaaacacauaagaaaacaaaguuuucgguugcaaaucaaauacaaauaggaagaauguga

SEQ ID NO: 650232 - RNA, 64 nt, Homo Sapiens
guuuuauguaaaauauuaaaugcuucauaaaacagcaaaucaauauaaauaugaucuaugauuu

SEQ ID NO: 650233 - RNA, 64 nt, Homo Sapiens
aggacucaguacaaacuccgcagcccuucauccagcaaaucagauaagucauuauuauauuuuu

SEQ ID NO: 650234 - RNA, 64 nt, Homo Sapiens; identical to SEQ ID NO: 315044

SEQ ID NO: 650235 - RNA, 64 nt, Homo Sapiens; identical to SEQ ID NO: 315045

SEQ ID NO: 650236 - RNA, 64 nt, Homo Sapiens; identical to SEQ ID NO: 315046

SEQ ID NO: 650237 - RNA, 64 nt, Homo Sapiens; identical to SEQ ID NO: 315047

SEQ ID NO: 650238 - RNA, 64 nt, Homo Sapiens; identical to SEQ ID NO: 315048

SEQ ID NO: 650239 - RNA, 64 nt, Homo Sapiens; identical to SEQ ID NO: 315049

SEQ ID NO: 650240 - RNA, 64 nt, Homo Sapiens; identical to SEQ ID NO: 315050

SEQ ID NO: 650241 - RNA, 64 nt, Homo Sapiens; identical to SEQ ID NO: 315051

SEQ ID NO: 650242 - RNA, 64 nt, Homo Sapiens; identical to SEQ ID NO: 315052

SEQ ID NO: 650243 - RNA, 64 nt, Homo Sapiens; identical to SEQ ID NO: 315053

SEQ ID NO: 650244 - RNA, 64 nt, Homo Sapiens; identical to SEQ ID NO: 315054

SEQ ID NO: 650245 - RNA, 64 nt, Homo Sapiens; identical to SEQ ID NO: 315055

SEQ ID NO: 650246 - RNA, 64 nt, Homo Sapiens; identical to SEQ ID NO: 315056

SEQ ID NO: 650247 - RNA, 64 nt, Homo Sapiens; identical to SEQ ID NO: 315057

SEQ ID NO: 650248 - RNA, 64 nt, Homo Sapiens; identical to SEQ ID NO: 315058

SEQ ID NO: 650249 - RNA, 64 nt, Homo Sapiens; identical to SEQ ID NO: 315059

SEQ ID NO: 650250 - RNA, 64 nt, Homo Sapiens; identical to SEQ ID NO: 315060

SEQ ID NO: 650251 - RNA, 64 nt, Homo Sapiens; identical to SEQ ID NO: 315061

SEQ ID NO: 650252 - RNA, 64 nt, Homo Sapiens; identical to SEQ ID NO: 315062

SEQ ID NO: 650253 - RNA, 64 nt, Homo Sapiens; identical to SEQ ID NO: 315063

SEQ ID NO: 650254 - RNA, 64 nt, Homo Sapiens; identical to SEQ ID NO: 315064

SEQ ID NO: 650255 - RNA, 64 nt, Homo Sapiens; identical to SEQ ID NO: 315065

SEQ ID NO: 650256 - RNA, 64 nt, Homo Sapiens; identical to SEQ ID NO: 315066

SEQ ID NO: 650257 - RNA, 64 nt, Homo Sapiens; identical to SEQ ID NO: 315067

SEQ ID NO: 650258 - RNA, 57 nt, Homo Sapiens; identical to SEQ ID NO: 315068

SEQ ID NO: 650259 - RNA, 64 nt, Homo Sapiens; identical to SEQ ID NO: 315069

SEQ ID NO: 650260 - RNA, 64 nt, Homo Sapiens; identical to SEQ ID NO: 315070

SEQ ID NO: 650261 - RNA, 64 nt, Homo Sapiens; identical to SEQ ID NO: 315071

SEQ ID NO: 650262 - RNA, 64 nt, Homo Sapiens; identical to SEQ ID NO: 315072

SEQ ID NO: 650263 - RNA, 64 nt, Homo Sapiens; identical to SEQ ID NO: 315073

SEQ ID NO: 650264 - RNA, 64 nt, Homo Sapiens; identical to SEQ ID NO: 315074

SEQ ID NO: 650265 - RNA, 64 nt, Homo Sapiens; identical to SEQ ID NO: 315075

SEQ ID NO: 650266 - RNA, 64 nt, Homo Sapiens; identical to SEQ ID NO: 125298

SEQ ID NO: 650267 - RNA, 64 nt, Homo Sapiens; identical to SEQ ID NO: 125299

SEQ ID NO: 650268 - RNA, 64 nt, Homo Sapiens; identical to SEQ ID NO: 125300

SEQ ID NO: 650269 - RNA, 64 nt, Homo Sapiens; identical to SEQ ID NO: 125301

SEQ ID NO: 650270 - RNA, 64 nt, Homo Sapiens; identical to SEQ ID NO: 125302

SEQ ID NO: 650271 - RNA, 64 nt, Homo Sapiens; identical to SEQ ID NO: 125303

SEQ ID NO: 650272 - RNA, 64 nt, Homo Sapiens; identical to SEQ ID NO: 125304

SEQ ID NO: 650273 - RNA, 64 nt, Homo Sapiens; identical to SEQ ID NO: 125305

SEQ ID NO: 650274 - RNA, 64 nt, Homo Sapiens; identical to SEQ ID NO: 125306

SEQ ID NO: 650275 - RNA, 64 nt, Homo Sapiens; identical to SEQ ID NO: 125307

SEQ ID NO: 650276 - RNA, 64 nt, Homo Sapiens; identical to SEQ ID NO: 125308

SEQ ID NO: 650277 - RNA, 64 nt, Homo Sapiens; identical to SEQ ID NO: 125309

SEQ ID NO: 650278 - RNA, 64 nt, Homo Sapiens; identical to SEQ ID NO: 125310

SEQ ID NO: 650279 - RNA, 64 nt, Homo Sapiens; identical to SEQ ID NO: 125311

SEQ ID NO: 650280 - RNA, 64 nt, Homo Sapiens; identical to SEQ ID NO: 125312

SEQ ID NO: 650281 - RNA, 64 nt, Homo Sapiens; identical to SEQ ID NO: 125313

SEQ ID NO: 650282 - RNA, 64 nt, Homo Sapiens; identical to SEQ ID NO: 376189

SEQ ID NO: 650283 - RNA, 64 nt, Homo Sapiens; identical to SEQ ID NO: 376190

SEQ ID NO: 650284 - RNA, 64 nt, Homo Sapiens; identical to SEQ ID NO: 376191

SEQ ID NO: 650285 - RNA, 64 nt, Homo Sapiens; identical to SEQ ID NO: 376192

SEQ ID NO: 650286 - RNA, 64 nt, Homo Sapiens; identical to SEQ ID NO: 376193

SEQ ID NO: 650287 - RNA, 64 nt, Homo Sapiens; identical to SEQ ID NO: 376194

SEQ ID NO: 650288 - RNA, 64 nt, Homo Sapiens; identical to SEQ ID NO: 376195

SEQ ID NO: 650289 - RNA, 64 nt, Homo Sapiens; identical to SEQ ID NO: 376196

SEQ ID NO: 650290 - RNA, 64 nt, Homo Sapiens; identical to SEQ ID NO: 376197

SEQ ID NO: 650291 - RNA, 64 nt, Homo Sapiens; identical to SEQ ID NO: 376198

SEQ ID NO: 650292 - RNA, 64 nt, Homo Sapiens; identical to SEQ ID NO: 376199

SEQ ID NO: 650293 - RNA, 64 nt, Homo Sapiens; identical to SEQ ID NO: 376200

SEQ ID NO: 650294 - RNA, 64 nt, Homo Sapiens; identical to SEQ ID NO: 376201

SEQ ID NO: 650295 - RNA, 64 nt, Homo Sapiens; identical to SEQ ID NO: 376202

SEQ ID NO: 650296 - RNA, 64 nt, Homo Sapiens; identical to SEQ ID NO: 376203

SEQ ID NO: 650297 - RNA, 64 nt, Homo Sapiens; identical to SEQ ID NO: 376204

SEQ ID NO: 650298 - RNA, 64 nt, Homo Sapiens; identical to SEQ ID NO: 376205

SEQ ID NO: 650299 - RNA, 64 nt, Homo Sapiens; identical to SEQ ID NO: 376206

SEQ ID NO: 650300 - RNA, 64 nt, Homo Sapiens; identical to SEQ ID NO: 376207

SEQ ID NO: 650301 - RNA, 64 nt, Homo Sapiens; identical to SEQ ID NO: 376208

SEQ ID NO: 650302 - RNA, 64 nt, Homo Sapiens; identical to SEQ ID NO: 376209

SEQ ID NO: 650303 - RNA, 64 nt, Homo Sapiens; identical to SEQ ID NO: 376210

SEQ ID NO: 650304 - RNA, 64 nt, Homo Sapiens; identical to SEQ ID NO: 376211

SEQ ID NO: 650305 - RNA, 64 nt, Homo Sapiens; identical to SEQ ID NO: 376212

SEQ ID NO: 650306 - RNA, 64 nt, Homo Sapiens; identical to SEQ ID NO: 376213

SEQ ID NO: 650307 - RNA, 64 nt, Homo Sapiens; identical to SEQ ID NO: 376214

SEQ ID NO: 650308 - RNA, 64 nt, Homo Sapiens; identical to SEQ ID NO: 376215

SEQ ID NO: 650309 - RNA, 64 nt, Homo Sapiens; identical to SEQ ID NO: 376216

SEQ ID NO: 650310 - RNA, 64 nt, Homo Sapiens; identical to SEQ ID NO: 376217

SEQ ID NO: 650311 - RNA, 64 nt, Homo Sapiens; identical to SEQ ID NO: 376218

SEQ ID NO: 650312 - RNA, 64 nt, Homo Sapiens; identical to SEQ ID NO: 376219

SEQ ID NO: 650313 - RNA, 64 nt, Homo Sapiens; identical to SEQ ID NO: 282942

SEQ ID NO: 650314 - RNA, 64 nt, Homo Sapiens; identical to SEQ ID NO: 282943

SEQ ID NO: 650315 - RNA, 64 nt, Homo Sapiens; identical to SEQ ID NO: 282944

SEQ ID NO: 650316 - RNA, 64 nt, Homo Sapiens; identical to SEQ ID NO: 282945

SEQ ID NO: 650317 - RNA, 64 nt, Homo Sapiens; identical to SEQ ID NO: 647031

SEQ ID NO: 650318 - RNA, 64 nt, Homo Sapiens; identical to SEQ ID NO: 647032

SEQ ID NO: 650319 - RNA, 64 nt, Homo Sapiens; identical to SEQ ID NO: 647033

SEQ ID NO: 650320 - RNA, 64 nt, Homo Sapiens; identical to SEQ ID NO: 647034

SEQ ID NO: 650321 - RNA, 64 nt, Homo Sapiens; identical to SEQ ID NO: 647035

SEQ ID NO: 650322 - RNA, 64 nt, Homo Sapiens; identical to SEQ ID NO: 647036

SEQ ID NO: 650323 - RNA, 64 nt, Homo Sapiens
cuguggccaccugaugacccuuucccuuuuuauuaaaccggacacaccuguuucccauuucgcu

SEQ ID NO: 650324 - RNA, 64 nt, Homo Sapiens
cucggcuuccgcucagcccgguuuugacugguugaaaccggacauugguuuuuaaauuuuuugu

SEQ ID NO: 650325 - RNA, 64 nt, Homo Sapiens
ucuaggccaaugauaauuauucaaaaaaaaaaaaaaaccggaugcaacagagugagacuccguc

SEQ ID NO: 650326 - RNA, 64 nt, Homo Sapiens
aacugauccagcaauuacaacggagucaaaaauuaaaccggaccaucucuccaacucaacucaa

SEQ ID NO: 650327 - RNA, 64 nt, Homo Sapiens
ugaggucaaauugaagacggaagacggaagacggaaaccggaaaccguuuucuuguaagccccu

SEQ ID NO: 650328 - RNA, 64 nt, Homo Sapiens
uuugaaauugccuauacagucuuagugaccauuuaaaccggacgaacuagguguuuaauuuuca

SEQ ID NO: 650329 - RNA, 64 nt, Homo Sapiens
ggagaauuuauuuuuugaaagccugcaacaguccaaaccggaagcaacuccugaauggccucga

SEQ ID NO: 650330 - RNA, 64 nt, Homo Sapiens
ccucucuauacaaguuuauugcagacuuacauguaaaccggaauuucagcugugguuauuuaaa

SEQ ID NO: 650331 - RNA, 64 nt, Homo Sapiens
cagauggcuucucacagaugcccuccugccagccaaaccggacuuguucuuccugccucugugc

SEQ ID NO: 650332 - RNA, 64 nt, Homo Sapiens
aggagggccagggccggauguguguugcuucagcaaaccggacccacccaguggguaggccaag

SEQ ID NO: 650333 - RNA, 64 nt, Homo Sapiens
aauacgccaagguuagguucugguccauagaaaaaaaccggaaacugugugaugggauaugaaa

SEQ ID NO: 650334 - RNA, 64 nt, Homo Sapiens
ugcaggugaauauuuuaauaucaacaagaugugcaaaccggacaacagaaacucaacucuaaau

SEQ ID NO: 650335 - RNA, 64 nt, Homo Sapiens
cuaacgguguuuuaaaaaauuuuauagaauaauuaaaccggaugcuggauccagucauuauguu

SEQ ID NO: 650336 - RNA, 64 nt, Homo Sapiens
ccucuacagcaccccugcccccuaauuuauacagaaaccggacccacuaauccucugggauugg

SEQ ID NO: 650337 - RNA, 64 nt, Homo Sapiens
uugaucacgcacacacaauaagucuuucucuccgaaaccggaaguaaaucuauaucuguuagaa

SEQ ID NO: 650338 - RNA, 64 nt, Homo Sapiens
aagcaguuccaguuaauugugacguccccgucggaaaccggaaaccccaucaagucccucuggg

SEQ ID NO: 650339 - RNA, 64 nt, Homo Sapiens
gcccccaccagcucaaauuccgagugcagaaaagaaaccggaccccccagugaggccugccagg

SEQ ID NO: 650340 - RNA, 64 nt, Homo Sapiens
gcuagcucggcuuaagggaacucuccccauuggcaaaccggacccggccgccgccaggacugug

SEQ ID NO: 650341 - RNA, 64 nt, Homo Sapiens
uucaguagcugaagaaaauaacuguuuacaaagaaaaccggauugacuucgcuaaaauucugau

SEQ ID NO: 650342 - RNA, 64 nt, Homo Sapiens
uguccuaacaacucuguaauguuaaacguuuauaaaaccggaaaauuccaucucagguccagau

SEQ ID NO: 650343 - RNA, 64 nt, Homo Sapiens
ucacagcugacugggaacuggaaccgccaagcagaaaccggaccuugcacuggugccuccccuc

SEQ ID NO: 650344 - RNA, 64 nt, Homo Sapiens
ccguuuucuuguaagccccucaaauugaagacggaaaccggaaauugcucaggacauuugaggu

SEQ ID NO: 650345 - RNA, 64 nt, Homo Sapiens
caagaaguucgauucacaacaugaaggguuagaaaaaccggaauugcauuucguaguucuuuau

SEQ ID NO: 650346 - RNA, 64 nt, Homo Sapiens
ccauggcaccuuccagagccguggcuccuagugcaaaccggaaagagggaguagggggcuagau

SEQ ID NO: 650347 - RNA, 64 nt, Homo Sapiens
ucaaauaaccagacaccaagacuauucaaaaugaaaaccggauuaugacauacacuuaaccaaa

SEQ ID NO: 650348 - RNA, 64 nt, Homo Sapiens
aagcgucugcaugugugugacuauucagcaagggaaaccggaccuuaccauugggauuguguuu

SEQ ID NO: 650349 - RNA, 54 nt, Homo Sapiens
cagugcccaaaauccacuaguccuaaaccggaagaggaugacaccggccauggg

SEQ ID NO: 650350 - RNA, 64 nt, Homo Sapiens
cagcuguaaaaacacauuucuggaacaacuggagaaaccggaguaugcccuggacuggauauua

SEQ ID NO: 650351 - RNA, 64 nt, Homo Sapiens
uggagugggggguggggguggggccacaaaaggaaaaccggaggagcaauuggggauccaggug

SEQ ID NO: 650352 - RNA, 64 nt, Homo Sapiens
agaaauuccugauuccuguuacuaaucacuaaagaaaccggaugcugccaccguaggauuuaag

SEQ ID NO: 650353 - RNA, 64 nt, Homo Sapiens
cacaaauccaggaggcucucaaccagggacauccaaaccggaaguagaaaggagauggggcuuc

SEQ ID NO: 650354 - RNA, 64 nt, Homo Sapiens
ccucuccccgccgcccccaacaggcugucaaacaaaaccggagagggggugggggagccagccu

SEQ ID NO: 650355 - RNA, 64 nt, Homo Sapiens
gaaaagguccgcuugcacuuggucagguuacaauaaaccggagacuucaacgacaguauugagu

SEQ ID NO: 650356 - RNA, 64 nt, Homo Sapiens
ucuuccaugcccugcaauguuucaauuccugcagaaaccggaaauauggaaggcgugcuaggca

SEQ ID NO: 650357 - RNA, 64 nt, Homo Sapiens
aucacaggguuuauacuggauuacccaggcaucaaaaccggaacuaacgugcaugcuuaagcuu

SEQ ID NO: 650358 - RNA, 64 nt, Homo Sapiens
gaauaaugaccaaaaaauggacaaaacaaaaaaaaaaccggauauguuuccaaacaacaacaaa

SEQ ID NO: 650359 - RNA, 64 nt, Homo Sapiens
ggggaucuuuguggcuucagcaaauucucuuguuaaaccggagugaaaacuucaggggaagggu

SEQ ID NO: 650360 - RNA, 64 nt, Homo Sapiens
cuguugcagccuccuguccuugccaaggcagaauaaaccggauccaccacucucaggaccaccc

SEQ ID NO: 650361 - RNA, 64 nt, Homo Sapiens
aaagguuuguguccaggauguacaaagaacucucaaaccggauaguaagaaaacaaacagccca

SEQ ID NO: 650362 - RNA, 64 nt, Homo Sapiens
cugaacuugaacacugacauuuuguuaguaaagaaaaccggauggugccuuguuaaagggcaag

SEQ ID NO: 650363 - RNA, 64 nt, Homo Sapiens
acugauacaacucagaaacugcucaaugucaggaaaaccggaacuuguugaugaacuuguuuuc

SEQ ID NO: 650364 - RNA, 64 nt, Homo Sapiens
guuuauauguuuaaacauuuaguuuucacgcaucaaaccggauuaauuuaaaagcugugaaauu

SEQ ID NO: 650365 - RNA, 64 nt, Homo Sapiens
cgcccucauuugcauuugugauuauuugcauuacaaaccggaggccccacaccgccgcccggua

SEQ ID NO: 650366 - RNA, 60 nt, Homo Sapiens
cuucuuuuuuuuuuucugaaaaaaggaaaaagcacacagcacacaauuucaagccauuuu

SEQ ID NO: 650367 - RNA, 60 nt, Homo Sapiens
uuuuuuuucugaaaaaaggaaaaagcacacagcacacaauuucaagccauuuucagauca

SEQ ID NO: 650368 - RNA, 60 nt, Homo Sapiens
gcagagaaucagacuggccugaggugaaggagcacacagcccugagggcuuggaacccug

SEQ ID NO: 650369 - RNA, 60 nt, Homo Sapiens
caucugugcuuaaccagaauccagcaagucagcacacaagugauuuuauuguuauuuugu

SEQ ID NO: 650370 - RNA, 60 nt, Homo Sapiens
ggcucaagcagcagagguaacagagagcagagcacacacuggauggcggggcuagggaag

SEQ ID NO: 650371 - RNA, 60 nt, Homo Sapiens
gcugcccgucuugggaucacaggggcgaacagcacacaaggaugcugcuccaagccugug

SEQ ID NO: 650372 - RNA, 60 nt, Homo Sapiens
gcuguccagccacugcccuuuaacaugcccagcacacaugggaggccuguggcccugugu

SEQ ID NO: 650373 - RNA, 60 nt, Homo Sapiens
uaugaacccugcuugauguaaaauggaaauagcacacaggcagauggcccuggguuugga

SEQ ID NO: 650374 - RNA, 60 nt, Homo Sapiens
caaggaacccagggccagcuggaaguguggagcacacaugcuguggagcacacaugcugu

SEQ ID NO: 650375 - RNA, 60 nt, Homo Sapiens
agcuggaaguguggagcacacaugcuguggagcacacaugcuguggagauugcagugugu

SEQ ID NO: 650376 - RNA, 60 nt, Homo Sapiens
cacacacacacacgaacacacacacacacgagcacacacaaagccucaaaacacagcaca

SEQ ID NO: 650377 - RNA, 60 nt, Homo Sapiens
cacacgagcacacacacacacucaaaacacagcacacacacuucaaagcccacguaaagc

SEQ ID NO: 650378 - RNA, 60 nt, Homo Sapiens
agggacuuuuguuuacucuacauuugcucaagcacacaaaguuuuucuccucuugguuuu

SEQ ID NO: 650379 - RNA, 60 nt, Homo Sapiens
ugcagugcacacaaagaaauccaugugcacagcacacacgaccugggaggagucuccaag

SEQ ID NO: 650380 - RNA, 60 nt, Homo Sapiens
auuccaucagcccugaaggacuguguccugagcacacaagacagcuuggucacaacacaa

SEQ ID NO: 650381 - RNA, 60 nt, Homo Sapiens
cacacacacacacacacacaccaauuuaaaagcacacacaacaauccugacaugcucccu

SEQ ID NO: 650382 - RNA, 60 nt, Homo Sapiens
gugaauggcagacuuuucauucucucaggaagcacacacuccccuguauucucaugauuu

SEQ ID NO: 650383 - RNA, 60 nt, Homo Sapiens
uugcuauaaacuguuacuuuuuuuaucaccagcacacagaaugaguaggaucuuguuuug

SEQ ID NO: 650384 - RNA, 60 nt, Homo Sapiens
cugauaauuagcugauauucaugguuguuuagcacacaguucaggaccuuugagaucaug

SEQ ID NO: 650385 - RNA, 60 nt, Homo Sapiens
ccuccuuuguuacacacucaagaauuugucagcacacaauuaauugcagccauaguaccu

SEQ ID NO: 650386 - RNA, 60 nt, Homo Sapiens
gaagggccugcucuuuccauuguggaucacagcacacacauacauacacccuccaccucc

SEQ ID NO: 650387 - RNA, 60 nt, Homo Sapiens
gggccccuuagcagggugagcuguuaaaacagcacacaucucucauccccucuuccuuua

SEQ ID NO: 650388 - RNA, 60 nt, Homo Sapiens
auuucauuuuuuggcacuaggucauuaaguagcacacagucugaaugcccuuuucuggag

SEQ ID NO: 650389 - RNA, 60 nt, Homo Sapiens
ggcaagcuggcuguguacaggaaaauuggaagcacacaguggacugugccucuuaaagau

SEQ ID NO: 650390 - RNA, 60 nt, Homo Sapiens
auuuuauccaaugcaaacaaaugguaaacaagcacacacaauauauauauauauauauau

SEQ ID NO: 650391 - RNA, 60 nt, Homo Sapiens
cgcacacacacuugcauucaucucuauguaagcacacauguguuccucuacgacccgacc

SEQ ID NO: 650392 - RNA, 60 nt, Homo Sapiens
aaggcaaaaacuguacuguguuucgcauuaagcacacacaucuggcccugacuucuggag

SEQ ID NO: 650393 - RNA, 60 nt, Homo Sapiens
caaaggugccucauagcauagccagcauucagcacacacaaaccuacugcccacauuugg

SEQ ID NO: 650394 - RNA, 60 nt, Homo Sapiens
agugcacagagcacacugcacagaccacacagcacacacaagcacaugcacacaggugca

SEQ ID NO: 650395 - RNA, 60 nt, Homo Sapiens
ugcacugaccacaccuguaucagaccacauagcacacaugcacgcuugcacacaugcaca

SEQ ID NO: 650396 - RNA, 60 nt, Homo Sapiens
ggaacuguguguuuccaacaucaugguagcagcacacacuuccaaagcucagccagggac

SEQ ID NO: 650397 - RNA, 60 nt, Homo Sapiens
uaaauaugugaaauauuaugaucugaacuuagcacacaugaagcaacauuucuuugcuac

SEQ ID NO: 650398 - RNA, 64 nt, Homo Sapiens; identical to SEQ ID NO: 379229

SEQ ID NO: 650399 - RNA, 64 nt, Homo Sapiens; identical to SEQ ID NO: 379230

SEQ ID NO: 650400 - RNA, 64 nt, Homo Sapiens; identical to SEQ ID NO: 379231

SEQ ID NO: 650401 - RNA, 64 nt, Homo Sapiens; identical to SEQ ID NO: 379232

SEQ ID NO: 650402 - RNA, 64 nt, Homo Sapiens; identical to SEQ ID NO: 379233

SEQ ID NO: 650403 - RNA, 64 nt, Homo Sapiens; identical to SEQ ID NO: 379234

SEQ ID NO: 650404 - RNA, 64 nt, Homo Sapiens; identical to SEQ ID NO: 379235

SEQ ID NO: 650405 - RNA, 64 nt, Homo Sapiens; identical to SEQ ID NO: 379236

SEQ ID NO: 650406 - RNA, 64 nt, Homo Sapiens; identical to SEQ ID NO: 379237

SEQ ID NO: 650407 - RNA, 64 nt, Homo Sapiens; identical to SEQ ID NO: 379238

SEQ ID NO: 650408 - RNA, 64 nt, Homo Sapiens; identical to SEQ ID NO: 379239

SEQ ID NO: 650409 - RNA, 64 nt, Homo Sapiens; identical to SEQ ID NO: 379240

SEQ ID NO: 650410 - RNA, 64 nt, Homo Sapiens; identical to SEQ ID NO: 379241

SEQ ID NO: 650411 - RNA, 64 nt, Homo Sapiens; identical to SEQ ID NO: 379242

SEQ ID NO: 650412 - RNA, 64 nt, Homo Sapiens; identical to SEQ ID NO: 379243

SEQ ID NO: 650413 - RNA, 64 nt, Homo Sapiens; identical to SEQ ID NO: 379244

SEQ ID NO: 650414 - RNA, 64 nt, Homo Sapiens; identical to SEQ ID NO: 379245

SEQ ID NO: 650415 - RNA, 64 nt, Homo Sapiens; identical to SEQ ID NO: 379246

SEQ ID NO: 650416 - RNA, 64 nt, Homo Sapiens; identical to SEQ ID NO: 379247

SEQ ID NO: 650417 - RNA, 64 nt, Homo Sapiens; identical to SEQ ID NO: 379248

SEQ ID NO: 650418 - RNA, 64 nt, Homo Sapiens; identical to SEQ ID NO: 379249

SEQ ID NO: 650419 - RNA, 64 nt, Homo Sapiens; identical to SEQ ID NO: 379250

SEQ ID NO: 650420 - RNA, 64 nt, Homo Sapiens; identical to SEQ ID NO: 379251

SEQ ID NO: 650421 - RNA, 64 nt, Homo Sapiens; identical to SEQ ID NO: 379252

SEQ ID NO: 650422 - RNA, 64 nt, Homo Sapiens; identical to SEQ ID NO: 379253

SEQ ID NO: 650423 - RNA, 64 nt, Homo Sapiens; identical to SEQ ID NO: 379254

SEQ ID NO: 650424 - RNA, 64 nt, Homo Sapiens; identical to SEQ ID NO: 379255

SEQ ID NO: 650425 - RNA, 64 nt, Homo Sapiens; identical to SEQ ID NO: 379256

SEQ ID NO: 650426 - RNA, 64 nt, Homo Sapiens; identical to SEQ ID NO: 379257

SEQ ID NO: 650427 - RNA, 64 nt, Homo Sapiens; identical to SEQ ID NO: 379258

SEQ ID NO: 650428 - RNA, 64 nt, Homo Sapiens; identical to SEQ ID NO: 379259

SEQ ID NO: 650429 - RNA, 64 nt, Homo Sapiens; identical to SEQ ID NO: 524911

SEQ ID NO: 650430 - RNA, 64 nt, Homo Sapiens; identical to SEQ ID NO: 524912

SEQ ID NO: 650431 - RNA, 64 nt, Homo Sapiens; identical to SEQ ID NO: 524913

SEQ ID NO: 650432 - RNA, 64 nt, Homo Sapiens; identical to SEQ ID NO: 524914

SEQ ID NO: 650433 - RNA, 64 nt, Homo Sapiens; identical to SEQ ID NO: 524915

SEQ ID NO: 650434 - RNA, 64 nt, Homo Sapiens; identical to SEQ ID NO: 524916

SEQ ID NO: 650435 - RNA, 64 nt, Homo Sapiens; identical to SEQ ID NO: 524917

SEQ ID NO: 650436 - RNA, 64 nt, Homo Sapiens; identical to SEQ ID NO: 524918

SEQ ID NO: 650437 - RNA, 64 nt, Homo Sapiens; identical to SEQ ID NO: 524919

SEQ ID NO: 650438 - RNA, 64 nt, Homo Sapiens; identical to SEQ ID NO: 524920

SEQ ID NO: 650439 - RNA, 64 nt, Homo Sapiens; identical to SEQ ID NO: 524921

SEQ ID NO: 650440 - RNA, 64 nt, Homo Sapiens; identical to SEQ ID NO: 524922

SEQ ID NO: 650441 - RNA, 64 nt, Homo Sapiens; identical to SEQ ID NO: 524923

SEQ ID NO: 650442 - RNA, 64 nt, Homo Sapiens; identical to SEQ ID NO: 524924

SEQ ID NO: 650443 - RNA, 64 nt, Homo Sapiens; identical to SEQ ID NO: 524925

SEQ ID NO: 650444 - RNA, 64 nt, Homo Sapiens; identical to SEQ ID NO: 524926

SEQ ID NO: 650445 - RNA, 64 nt, Homo Sapiens; identical to SEQ ID NO: 524927

SEQ ID NO: 650446 - RNA, 64 nt, Homo Sapiens; identical to SEQ ID NO: 524928

SEQ ID NO: 650447 - RNA, 64 nt, Homo Sapiens; identical to SEQ ID NO: 524929

SEQ ID NO: 650448 - RNA, 64 nt, Homo Sapiens; identical to SEQ ID NO: 524930

SEQ ID NO: 650449 - RNA, 64 nt, Homo Sapiens; identical to SEQ ID NO: 524931

SEQ ID NO: 650450 - RNA, 64 nt, Homo Sapiens; identical to SEQ ID NO: 524932

SEQ ID NO: 650451 - RNA, 64 nt, Homo Sapiens; identical to SEQ ID NO: 524933

SEQ ID NO: 650452 - RNA, 64 nt, Homo Sapiens; identical to SEQ ID NO: 524934

SEQ ID NO: 650453 - RNA, 64 nt, Homo Sapiens; identical to SEQ ID NO: 524935

SEQ ID NO: 650454 - RNA, 64 nt, Homo Sapiens; identical to SEQ ID NO: 56439

SEQ ID NO: 650455 - RNA, 64 nt, Homo Sapiens; identical to SEQ ID NO: 56440

SEQ ID NO: 650456 - RNA, 64 nt, Homo Sapiens; identical to SEQ ID NO: 56441

SEQ ID NO: 650457 - RNA, 64 nt, Homo Sapiens; identical to SEQ ID NO: 56442

SEQ ID NO: 650458 - RNA, 64 nt, Homo Sapiens; identical to SEQ ID NO: 56443

SEQ ID NO: 650459 - RNA, 64 nt, Homo Sapiens; identical to SEQ ID NO: 56444

SEQ ID NO: 650460 - RNA, 64 nt, Homo Sapiens; identical to SEQ ID NO: 56445

SEQ ID NO: 650461 - RNA, 64 nt, Homo Sapiens; identical to SEQ ID NO: 56446

SEQ ID NO: 650462 - RNA, 64 nt, Homo Sapiens; identical to SEQ ID NO: 56447

SEQ ID NO: 650463 - RNA, 64 nt, Homo Sapiens; identical to SEQ ID NO: 56448

SEQ ID NO: 650464 - RNA, 64 nt, Homo Sapiens; identical to SEQ ID NO: 56449

SEQ ID NO: 650465 - RNA, 64 nt, Homo Sapiens; identical to SEQ ID NO: 56450

SEQ ID NO: 650466 - RNA, 64 nt, Homo Sapiens; identical to SEQ ID NO: 56451

SEQ ID NO: 650467 - RNA, 64 nt, Homo Sapiens; identical to SEQ ID NO: 56452

SEQ ID NO: 650468 - RNA, 64 nt, Homo Sapiens; identical to SEQ ID NO: 56453

SEQ ID NO: 650469 - RNA, 64 nt, Homo Sapiens; identical to SEQ ID NO: 56454

SEQ ID NO: 650470 - RNA, 64 nt, Homo Sapiens; identical to SEQ ID NO: 56455

SEQ ID NO: 650471 - RNA, 64 nt, Homo Sapiens; identical to SEQ ID NO: 56456

SEQ ID NO: 650472 - RNA, 64 nt, Homo Sapiens; identical to SEQ ID NO: 56457

SEQ ID NO: 650473 - RNA, 64 nt, Homo Sapiens; identical to SEQ ID NO: 56458

SEQ ID NO: 650474 - RNA, 64 nt, Homo Sapiens; identical to SEQ ID NO: 56459

SEQ ID NO: 650475 - RNA, 64 nt, Homo Sapiens; identical to SEQ ID NO: 56460

SEQ ID NO: 650476 - RNA, 64 nt, Homo Sapiens; identical to SEQ ID NO: 56461

SEQ ID NO: 650477 - RNA, 64 nt, Homo Sapiens; identical to SEQ ID NO: 56462

SEQ ID NO: 650478 - RNA, 64 nt, Homo Sapiens; identical to SEQ ID NO: 56463

SEQ ID NO: 650479 - RNA, 64 nt, Homo Sapiens; identical to SEQ ID NO: 56464

SEQ ID NO: 650480 - RNA, 64 nt, Homo Sapiens; identical to SEQ ID NO: 56465

SEQ ID NO: 650481 - RNA, 64 nt, Homo Sapiens; identical to SEQ ID NO: 56466

SEQ ID NO: 650482 - RNA, 64 nt, Homo Sapiens; identical to SEQ ID NO: 56467

SEQ ID NO: 650483 - RNA, 50 nt, Homo Sapiens; identical to SEQ ID NO: 56468

SEQ ID NO: 650484 - RNA, 64 nt, Homo Sapiens; identical to SEQ ID NO: 56469

SEQ ID NO: 650485 - RNA, 64 nt, Homo Sapiens; identical to SEQ ID NO: 56470

SEQ ID NO: 650486 - RNA, 64 nt, Homo Sapiens; identical to SEQ ID NO: 56471

SEQ ID NO: 650487 - RNA, 64 nt, Homo Sapiens; identical to SEQ ID NO: 56472

SEQ ID NO: 650488 - RNA, 64 nt, Homo Sapiens; identical to SEQ ID NO: 56473

SEQ ID NO: 650489 - RNA, 64 nt, Homo Sapiens; identical to SEQ ID NO: 56474

SEQ ID NO: 650490 - RNA, 64 nt, Homo Sapiens; identical to SEQ ID NO: 56475

SEQ ID NO: 650491 - RNA, 64 nt, Homo Sapiens; identical to SEQ ID NO: 56476

SEQ ID NO: 650492 - RNA, 64 nt, Homo Sapiens; identical to SEQ ID NO: 56477

SEQ ID NO: 650493 - RNA, 64 nt, Homo Sapiens; identical to SEQ ID NO: 56478

SEQ ID NO: 650494 - RNA, 64 nt, Homo Sapiens; identical to SEQ ID NO: 56479

SEQ ID NO: 650495 - RNA, 64 nt, Homo Sapiens; identical to SEQ ID NO: 56480

SEQ ID NO: 650496 - RNA, 64 nt, Homo Sapiens; identical to SEQ ID NO: 56481

SEQ ID NO: 650497 - RNA, 64 nt, Homo Sapiens; identical to SEQ ID NO: 56482

SEQ ID NO: 650498 - RNA, 64 nt, Homo Sapiens; identical to SEQ ID NO: 56483

SEQ ID NO: 650499 - RNA, 64 nt, Homo Sapiens; identical to SEQ ID NO: 56484

SEQ ID NO: 650500 - RNA, 64 nt, Homo Sapiens; identical to SEQ ID NO: 56485

SEQ ID NO: 650501 - RNA, 64 nt, Homo Sapiens; identical to SEQ ID NO: 56486

SEQ ID NO: 650502 - RNA, 64 nt, Homo Sapiens; identical to SEQ ID NO: 56487

SEQ ID NO: 650503 - RNA, 64 nt, Homo Sapiens; identical to SEQ ID NO: 56488

SEQ ID NO: 650504 - RNA, 64 nt, Homo Sapiens; identical to SEQ ID NO: 56489

SEQ ID NO: 650505 - RNA, 64 nt, Homo Sapiens; identical to SEQ ID NO: 56490

SEQ ID NO: 650506 - RNA, 64 nt, Homo Sapiens; identical to SEQ ID NO: 56491

SEQ ID NO: 650507 - RNA, 64 nt, Homo Sapiens; identical to SEQ ID NO: 56492

SEQ ID NO: 650508 - RNA, 64 nt, Homo Sapiens; identical to SEQ ID NO: 56493

SEQ ID NO: 650509 - RNA, 64 nt, Homo Sapiens; identical to SEQ ID NO: 56494

SEQ ID NO: 650510 - RNA, 64 nt, Homo Sapiens; identical to SEQ ID NO: 56495

SEQ ID NO: 650511 - RNA, 64 nt, Homo Sapiens; identical to SEQ ID NO: 56496

SEQ ID NO: 650512 - RNA, 64 nt, Homo Sapiens; identical to SEQ ID NO: 56497

SEQ ID NO: 650513 - RNA, 64 nt, Homo Sapiens; identical to SEQ ID NO: 56498

SEQ ID NO: 650514 - RNA, 64 nt, Homo Sapiens; identical to SEQ ID NO: 56499

SEQ ID NO: 650515 - RNA, 64 nt, Homo Sapiens; identical to SEQ ID NO: 56500

SEQ ID NO: 650516 - RNA, 64 nt, Homo Sapiens; identical to SEQ ID NO: 56501

SEQ ID NO: 650517 - RNA, 64 nt, Homo Sapiens; identical to SEQ ID NO: 56502

SEQ ID NO: 650518 - RNA, 64 nt, Homo Sapiens; identical to SEQ ID NO: 56503

SEQ ID NO: 650519 - RNA, 64 nt, Homo Sapiens; identical to SEQ ID NO: 56504

SEQ ID NO: 650520 - RNA, 64 nt, Homo Sapiens; identical to SEQ ID NO: 56505

SEQ ID NO: 650521 - RNA, 64 nt, Homo Sapiens; identical to SEQ ID NO: 56506

SEQ ID NO: 650522 - RNA, 64 nt, Homo Sapiens; identical to SEQ ID NO: 56507

SEQ ID NO: 650523 - RNA, 64 nt, Homo Sapiens; identical to SEQ ID NO: 56508

SEQ ID NO: 650524 - RNA, 64 nt, Homo Sapiens; identical to SEQ ID NO: 56509

SEQ ID NO: 650525 - RNA, 64 nt, Homo Sapiens; identical to SEQ ID NO: 56510

SEQ ID NO: 650526 - RNA, 64 nt, Homo Sapiens; identical to SEQ ID NO: 56511

SEQ ID NO: 650527 - RNA, 64 nt, Homo Sapiens; identical to SEQ ID NO: 56512

SEQ ID NO: 650528 - RNA, 64 nt, Homo Sapiens; identical to SEQ ID NO: 56513

SEQ ID NO: 650529 - RNA, 64 nt, Homo Sapiens; identical to SEQ ID NO: 56514

SEQ ID NO: 650530 - RNA, 64 nt, Homo Sapiens; identical to SEQ ID NO: 56515

SEQ ID NO: 650531 - RNA, 64 nt, Homo Sapiens; identical to SEQ ID NO: 56516

SEQ ID NO: 650532 - RNA, 64 nt, Homo Sapiens; identical to SEQ ID NO: 56517

SEQ ID NO: 650533 - RNA, 64 nt, Homo Sapiens; identical to SEQ ID NO: 56518

SEQ ID NO: 650534 - RNA, 64 nt, Homo Sapiens; identical to SEQ ID NO: 56519

SEQ ID NO: 650535 - RNA, 64 nt, Homo Sapiens; identical to SEQ ID NO: 56520

SEQ ID NO: 650536 - RNA, 64 nt, Homo Sapiens; identical to SEQ ID NO: 56521

SEQ ID NO: 650537 - RNA, 64 nt, Homo Sapiens; identical to SEQ ID NO: 56522

SEQ ID NO: 650538 - RNA, 64 nt, Homo Sapiens; identical to SEQ ID NO: 56523

SEQ ID NO: 650539 - RNA, 64 nt, Homo Sapiens; identical to SEQ ID NO: 56524

SEQ ID NO: 650540 - RNA, 64 nt, Homo Sapiens; identical to SEQ ID NO: 56525

SEQ ID NO: 650541 - RNA, 64 nt, Homo Sapiens; identical to SEQ ID NO: 56526

SEQ ID NO: 650542 - RNA, 64 nt, Homo Sapiens; identical to SEQ ID NO: 56527

SEQ ID NO: 650543 - RNA, 64 nt, Homo Sapiens; identical to SEQ ID NO: 56528

SEQ ID NO: 650544 - RNA, 64 nt, Homo Sapiens; identical to SEQ ID NO: 56529

SEQ ID NO: 650545 - RNA, 64 nt, Homo Sapiens; identical to SEQ ID NO: 56530

SEQ ID NO: 650546 - RNA, 64 nt, Homo Sapiens; identical to SEQ ID NO: 56531

SEQ ID NO: 650547 - RNA, 64 nt, Homo Sapiens; identical to SEQ ID NO: 56532

SEQ ID NO: 650548 - RNA, 64 nt, Homo Sapiens; identical to SEQ ID NO: 56533

SEQ ID NO: 650549 - RNA, 64 nt, Homo Sapiens; identical to SEQ ID NO: 56534

SEQ ID NO: 650550 - RNA, 59 nt, Homo Sapiens; identical to SEQ ID NO: 56535

SEQ ID NO: 650551 - RNA, 64 nt, Homo Sapiens; identical to SEQ ID NO: 56536

SEQ ID NO: 650552 - RNA, 64 nt, Homo Sapiens; identical to SEQ ID NO: 56537

SEQ ID NO: 650553 - RNA, 64 nt, Homo Sapiens; identical to SEQ ID NO: 56538

SEQ ID NO: 650554 - RNA, 64 nt, Homo Sapiens; identical to SEQ ID NO: 56539

SEQ ID NO: 650555 - RNA, 64 nt, Homo Sapiens; identical to SEQ ID NO: 56540

SEQ ID NO: 650556 - RNA, 64 nt, Homo Sapiens; identical to SEQ ID NO: 56541

SEQ ID NO: 650557 - RNA, 64 nt, Homo Sapiens; identical to SEQ ID NO: 56542

SEQ ID NO: 650558 - RNA, 64 nt, Homo Sapiens; identical to SEQ ID NO: 56543

SEQ ID NO: 650559 - RNA, 64 nt, Homo Sapiens; identical to SEQ ID NO: 56544

SEQ ID NO: 650560 - RNA, 64 nt, Homo Sapiens; identical to SEQ ID NO: 56545

SEQ ID NO: 650561 - RNA, 64 nt, Homo Sapiens; identical to SEQ ID NO: 56546

SEQ ID NO: 650562 - RNA, 64 nt, Homo Sapiens; identical to SEQ ID NO: 56547

SEQ ID NO: 650563 - RNA, 64 nt, Homo Sapiens; identical to SEQ ID NO: 56548

SEQ ID NO: 650564 - RNA, 64 nt, Homo Sapiens; identical to SEQ ID NO: 56549

SEQ ID NO: 650565 - RNA, 64 nt, Homo Sapiens; identical to SEQ ID NO: 56550

SEQ ID NO: 650566 - RNA, 64 nt, Homo Sapiens; identical to SEQ ID NO: 56551

SEQ ID NO: 650567 - RNA, 64 nt, Homo Sapiens; identical to SEQ ID NO: 56552

SEQ ID NO: 650568 - RNA, 64 nt, Homo Sapiens; identical to SEQ ID NO: 56553

SEQ ID NO: 650569 - RNA, 64 nt, Homo Sapiens; identical to SEQ ID NO: 56554

SEQ ID NO: 650570 - RNA, 64 nt, Homo Sapiens; identical to SEQ ID NO: 56555

SEQ ID NO: 650571 - RNA, 64 nt, Homo Sapiens; identical to SEQ ID NO: 56556

SEQ ID NO: 650572 - RNA, 62 nt, Homo Sapiens; identical to SEQ ID NO: 56557

SEQ ID NO: 650573 - RNA, 58 nt, Homo Sapiens; identical to SEQ ID NO: 56558

SEQ ID NO: 650574 - RNA, 64 nt, Homo Sapiens; identical to SEQ ID NO: 56559

SEQ ID NO: 650575 - RNA, 64 nt, Homo Sapiens; identical to SEQ ID NO: 56560

SEQ ID NO: 650576 - RNA, 64 nt, Homo Sapiens; identical to SEQ ID NO: 56561

SEQ ID NO: 650577 - RNA, 64 nt, Homo Sapiens; identical to SEQ ID NO: 56562

SEQ ID NO: 650578 - RNA, 64 nt, Homo Sapiens; identical to SEQ ID NO: 56563

SEQ ID NO: 650579 - RNA, 64 nt, Homo Sapiens; identical to SEQ ID NO: 56564

SEQ ID NO: 650580 - RNA, 64 nt, Homo Sapiens; identical to SEQ ID NO: 56565

SEQ ID NO: 650581 - RNA, 64 nt, Homo Sapiens; identical to SEQ ID NO: 56566

SEQ ID NO: 650582 - RNA, 64 nt, Homo Sapiens; identical to SEQ ID NO: 56567

SEQ ID NO: 650583 - RNA, 64 nt, Homo Sapiens; identical to SEQ ID NO: 56568

SEQ ID NO: 650584 - RNA, 64 nt, Homo Sapiens; identical to SEQ ID NO: 56569

SEQ ID NO: 650585 - RNA, 64 nt, Homo Sapiens; identical to SEQ ID NO: 56570

SEQ ID NO: 650586 - RNA, 64 nt, Homo Sapiens; identical to SEQ ID NO: 56571

SEQ ID NO: 650587 - RNA, 64 nt, Homo Sapiens; identical to SEQ ID NO: 56572

SEQ ID NO: 650588 - RNA, 64 nt, Homo Sapiens; identical to SEQ ID NO: 56573

SEQ ID NO: 650589 - RNA, 64 nt, Homo Sapiens; identical to SEQ ID NO: 56574

SEQ ID NO: 650590 - RNA, 64 nt, Homo Sapiens; identical to SEQ ID NO: 56575

SEQ ID NO: 650591 - RNA, 64 nt, Homo Sapiens; identical to SEQ ID NO: 56576

SEQ ID NO: 650592 - RNA, 64 nt, Homo Sapiens; identical to SEQ ID NO: 56577

SEQ ID NO: 650593 - RNA, 64 nt, Homo Sapiens; identical to SEQ ID NO: 56578

SEQ ID NO: 650594 - RNA, 64 nt, Homo Sapiens; identical to SEQ ID NO: 56579

SEQ ID NO: 650595 - RNA, 64 nt, Homo Sapiens; identical to SEQ ID NO: 56580

SEQ ID NO: 650596 - RNA, 64 nt, Homo Sapiens; identical to SEQ ID NO: 56581

SEQ ID NO: 650597 - RNA, 64 nt, Homo Sapiens; identical to SEQ ID NO: 56582

SEQ ID NO: 650598 - RNA, 60 nt, Homo Sapiens
aacuacaauucacuguugugagaauauuccucgucacagcaaaaacacuuuccuuucuac

SEQ ID NO: 650599 - RNA, 60 nt, Homo Sapiens
auuuuagacaccuuagagguccgugcuacaucgucacaguuccuccgaauaaccuuaggu

SEQ ID NO: 650600 - RNA, 60 nt, Homo Sapiens
ccagaaaggaccagagaaagccaggcuggaucgucacaugccggggagcaauguggaugg

SEQ ID NO: 650601 - RNA, 60 nt, Homo Sapiens
gauugugcauguuuuguaugucauaguaugucgucacauaaaagggagggagcgaaaaac

SEQ ID NO: 650602 - RNA, 60 nt, Homo Sapiens
gcacauguccaccugggaaaugagaugccaucgucacauucauuuggucacccucagucc

SEQ ID NO: 650603 - RNA, 60 nt, Homo Sapiens
uagaugcugggcccagggcccuagguuugcucgucacaguguggggaagcccauuccucu

SEQ ID NO: 650604 - RNA, 60 nt, Homo Sapiens
gguaaccuuaaagacagaccuuucuuuuucucgucacacaaguuucuuuucuuuuucuuu

SEQ ID NO: 650605 - RNA, 60 nt, Homo Sapiens
gccuauuguccuguccuucuuuucccagauucgucacaaucugaugugcacuuuguucug

SEQ ID NO: 650606 - RNA, 60 nt, Homo Sapiens
aguagcuauuccgauuggauauuccguucgucgucacauagcuggcuuuucucuccucau

SEQ ID NO: 650607 - RNA, 60 nt, Homo Sapiens
cuuuccugcauuucucccucccuccuucccucgucacaucucuuauaugagcacaguaau

SEQ ID NO: 650608 - RNA, 60 nt, Homo Sapiens
guuuuaugacuuguagucaggcuuugcuguucgucacagugucauuuuccauucagguac

SEQ ID NO: 650609 - RNA, 60 nt, Homo Sapiens
ucacauuggcgccuagaacaguuaggucgcucgucacauaggcaguuaaguggagaacca

SEQ ID NO: 650610 - RNA, 60 nt, Homo Sapiens
ccucaggaaccaccgacagaucugcccugaucgucacaacuugagguggugccuucugcc

SEQ ID NO: 650611 - RNA, 60 nt, Homo Sapiens
auucaacauagaauuacccucuauggagguucgucacaaaucagcugcuguuggaaaacg

SEQ ID NO: 650612 - RNA, 60 nt, Homo Sapiens
uuguagaauuaguucuauaagguuacucugucgucacauugcagugauuugucggacugu

SEQ ID NO: 650613 - RNA, 60 nt, Homo Sapiens
gugacccuugcagcacaggcugcacggcccucgucacaagccugcucagcccggaggcug

SEQ ID NO: 650614 - RNA, 60 nt, Homo Sapiens
cacuguggaaagcuuugaacaauuguguuuucgucacaggagucuuuguaaugcuuguac

SEQ ID NO: 650615 - RNA, 60 nt, Homo Sapiens
cagaaggacaggcuugucugguggaugaggucgucacacucgcccccgccugugucaggu

SEQ ID NO: 650616 - RNA, 60 nt, Homo Sapiens
aaugcaaaagguccugauuucgucauugccucgucacauccccauucuuagccuaacguu

SEQ ID NO: 650617 - RNA, 60 nt, Homo Sapiens
cggggccuccccucccugcuaggaggcaacucgucacacccaagcugcuggccuccaguc

SEQ ID NO: 650618 - RNA, 60 nt, Homo Sapiens
uauaguuccgcaccucugaguuguccacauucgucacagaugcuuccgcugcuugaaggu

SEQ ID NO: 650619 - RNA, 60 nt, Homo Sapiens
gacuuggcaacuggcuuuucuccuguggagucgucacacgccauccagcagcgcuaaggu

SEQ ID NO: 650620 - RNA, 60 nt, Homo Sapiens
auauuugcaaauugccaucuauugaaauucucgucacacuacauagacauaauuguuauc

SEQ ID NO: 650621 - RNA, 60 nt, Homo Sapiens
auguuucacaggccuuccuacauuuagaaaucgucacacagcugugauaagaguagauua

SEQ ID NO: 650622 - RNA, 60 nt, Homo Sapiens
ucuaaaugagaaaucagugauggaguaucuucgucacacaggcauacuugcccuuacagg

SEQ ID NO: 650623 - RNA, 60 nt, Homo Sapiens
aguguuaugccugggagugcucccagagagucgucacaccgaaagagugaugugugagau

SEQ ID NO: 650624 - RNA, 60 nt, Homo Sapiens
agggaccuuugucagugagcaagacugagaucgucacaggagaaggugcccuugcuggcu

SEQ ID NO: 650625 - RNA, 60 nt, Homo Sapiens
caccagcaucuuucuguaccgccaccagccucgucacauaugcacuguggugcuucagug

SEQ ID NO: 650626 - RNA, 60 nt, Homo Sapiens
cuggacuuccucgaguggccacugugagccucgucacagcagaaaccaacuuuucuaacg

SEQ ID NO: 650627 - RNA, 60 nt, Homo Sapiens
ucccuuuccuaagccucugagggcccugacucgucacacuuggaaaagacaccagcccag

SEQ ID NO: 650628 - RNA, 60 nt, Homo Sapiens
gagaguacaucugugaacaagauggggcauucgucacagagccacucuaagaauugaaaa

SEQ ID NO: 650629 - RNA, 60 nt, Homo Sapiens
cccccgaagcggggagggccgcuguggccuucgucacagccgcgcagugcccauggaggc

SEQ ID NO: 650630 - RNA, 60 nt, Homo Sapiens
cuccaauguuuugauucucuaaucauguuuucgucacaugcugaguaaaagugccuuaca

SEQ ID NO: 650631 - RNA, 60 nt, Homo Sapiens
cugagaaaacgagccuguuucagaggaacaucgucacaacgaauacuucuggaagcuuaa

SEQ ID NO: 650632 - RNA, 52 nt, Homo Sapiens
uaaaugcugucugguccccucaucgucacaccucuauguccacucaguuuga

SEQ ID NO: 650633 - RNA, 60 nt, Homo Sapiens
ccaguuuuauaaacagcagauagcaacuugucgucacagcuggcaugggcuggacaguug

SEQ ID NO: 650634 - RNA, 64 nt, Homo Sapiens; identical to SEQ ID NO: 214928

SEQ ID NO: 650635 - RNA, 64 nt, Homo Sapiens; identical to SEQ ID NO: 214929

SEQ ID NO: 650636 - RNA, 64 nt, Homo Sapiens; identical to SEQ ID NO: 214930

SEQ ID NO: 650637 - RNA, 64 nt, Homo Sapiens; identical to SEQ ID NO: 214931

SEQ ID NO: 650638 - RNA, 64 nt, Homo Sapiens; identical to SEQ ID NO: 214932

SEQ ID NO: 650639 - RNA, 64 nt, Homo Sapiens; identical to SEQ ID NO: 214933

SEQ ID NO: 650640 - RNA, 64 nt, Homo Sapiens; identical to SEQ ID NO: 214934

SEQ ID NO: 650641 - RNA, 64 nt, Homo Sapiens; identical to SEQ ID NO: 214935

SEQ ID NO: 650642 - RNA, 64 nt, Homo Sapiens; identical to SEQ ID NO: 214936

SEQ ID NO: 650643 - RNA, 64 nt, Homo Sapiens; identical to SEQ ID NO: 214937

SEQ ID NO: 650644 - RNA, 54 nt, Homo Sapiens; identical to SEQ ID NO: 214938

SEQ ID NO: 650645 - RNA, 64 nt, Homo Sapiens; identical to SEQ ID NO: 214939

SEQ ID NO: 650646 - RNA, 64 nt, Homo Sapiens; identical to SEQ ID NO: 214940

SEQ ID NO: 650647 - RNA, 64 nt, Homo Sapiens; identical to SEQ ID NO: 214941

SEQ ID NO: 650648 - RNA, 64 nt, Homo Sapiens; identical to SEQ ID NO: 214942

SEQ ID NO: 650649 - RNA, 64 nt, Homo Sapiens; identical to SEQ ID NO: 214943

SEQ ID NO: 650650 - RNA, 64 nt, Homo Sapiens; identical to SEQ ID NO: 214944

SEQ ID NO: 650651 - RNA, 64 nt, Homo Sapiens; identical to SEQ ID NO: 214945

SEQ ID NO: 650652 - RNA, 64 nt, Homo Sapiens; identical to SEQ ID NO: 214946

SEQ ID NO: 650653 - RNA, 64 nt, Homo Sapiens; identical to SEQ ID NO: 214947

SEQ ID NO: 650654 - RNA, 64 nt, Homo Sapiens; identical to SEQ ID NO: 214948

SEQ ID NO: 650655 - RNA, 64 nt, Homo Sapiens; identical to SEQ ID NO: 214949

SEQ ID NO: 650656 - RNA, 64 nt, Homo Sapiens; identical to SEQ ID NO: 214950

SEQ ID NO: 650657 - RNA, 64 nt, Homo Sapiens; identical to SEQ ID NO: 214951

SEQ ID NO: 650658 - RNA, 64 nt, Homo Sapiens; identical to SEQ ID NO: 214952

SEQ ID NO: 650659 - RNA, 64 nt, Homo Sapiens; identical to SEQ ID NO: 214953

SEQ ID NO: 650660 - RNA, 64 nt, Homo Sapiens; identical to SEQ ID NO: 214954

SEQ ID NO: 650661 - RNA, 64 nt, Homo Sapiens; identical to SEQ ID NO: 214955

SEQ ID NO: 650662 - RNA, 64 nt, Homo Sapiens; identical to SEQ ID NO: 214956

SEQ ID NO: 650663 - RNA, 64 nt, Homo Sapiens; identical to SEQ ID NO: 214957

SEQ ID NO: 650664 - RNA, 64 nt, Homo Sapiens; identical to SEQ ID NO: 214958

SEQ ID NO: 650665 - RNA, 64 nt, Homo Sapiens; identical to SEQ ID NO: 214959

SEQ ID NO: 650666 - RNA, 64 nt, Homo Sapiens; identical to SEQ ID NO: 214960

SEQ ID NO: 650667 - RNA, 64 nt, Homo Sapiens; identical to SEQ ID NO: 214961

SEQ ID NO: 650668 - RNA, 64 nt, Homo Sapiens; identical to SEQ ID NO: 214962

SEQ ID NO: 650669 - RNA, 64 nt, Homo Sapiens; identical to SEQ ID NO: 214963

SEQ ID NO: 650670 - RNA, 64 nt, Homo Sapiens; identical to SEQ ID NO: 214964

SEQ ID NO: 650671 - RNA, 64 nt, Homo Sapiens; identical to SEQ ID NO: 214965

SEQ ID NO: 650672 - RNA, 64 nt, Homo Sapiens; identical to SEQ ID NO: 214966

SEQ ID NO: 650673 - RNA, 64 nt, Homo Sapiens; identical to SEQ ID NO: 214967

SEQ ID NO: 650674 - RNA, 64 nt, Homo Sapiens; identical to SEQ ID NO: 214968

SEQ ID NO: 650675 - RNA, 64 nt, Homo Sapiens; identical to SEQ ID NO: 214969

SEQ ID NO: 650676 - RNA, 64 nt, Homo Sapiens; identical to SEQ ID NO: 214970

SEQ ID NO: 650677 - RNA, 64 nt, Homo Sapiens; identical to SEQ ID NO: 214971

SEQ ID NO: 650678 - RNA, 64 nt, Homo Sapiens; identical to SEQ ID NO: 214972

SEQ ID NO: 650679 - RNA, 64 nt, Homo Sapiens; identical to SEQ ID NO: 214973

SEQ ID NO: 650680 - RNA, 64 nt, Homo Sapiens; identical to SEQ ID NO: 214974

SEQ ID NO: 650681 - RNA, 64 nt, Homo Sapiens; identical to SEQ ID NO: 214975

SEQ ID NO: 650682 - RNA, 64 nt, Homo Sapiens; identical to SEQ ID NO: 214976

SEQ ID NO: 650683 - RNA, 64 nt, Homo Sapiens; identical to SEQ ID NO: 214977

SEQ ID NO: 650684 - RNA, 64 nt, Homo Sapiens; identical to SEQ ID NO: 214978

SEQ ID NO: 650685 - RNA, 63 nt, Homo Sapiens; identical to SEQ ID NO: 588819

SEQ ID NO: 650686 - RNA, 63 nt, Homo Sapiens; identical to SEQ ID NO: 588820

SEQ ID NO: 650687 - RNA, 63 nt, Homo Sapiens; identical to SEQ ID NO: 588821

SEQ ID NO: 650688 - RNA, 63 nt, Homo Sapiens; identical to SEQ ID NO: 588822

SEQ ID NO: 650689 - RNA, 63 nt, Homo Sapiens; identical to SEQ ID NO: 588823

SEQ ID NO: 650690 - RNA, 63 nt, Homo Sapiens; identical to SEQ ID NO: 588824

SEQ ID NO: 650691 - RNA, 63 nt, Homo Sapiens; identical to SEQ ID NO: 588825

SEQ ID NO: 650692 - RNA, 63 nt, Homo Sapiens; identical to SEQ ID NO: 588826

SEQ ID NO: 650693 - RNA, 63 nt, Homo Sapiens; identical to SEQ ID NO: 588827

SEQ ID NO: 650694 - RNA, 63 nt, Homo Sapiens; identical to SEQ ID NO: 588828

SEQ ID NO: 650695 - RNA, 63 nt, Homo Sapiens; identical to SEQ ID NO: 588829

SEQ ID NO: 650696 - RNA, 63 nt, Homo Sapiens; identical to SEQ ID NO: 588830

SEQ ID NO: 650697 - RNA, 63 nt, Homo Sapiens; identical to SEQ ID NO: 588831

SEQ ID NO: 650698 - RNA, 63 nt, Homo Sapiens; identical to SEQ ID NO: 588832

SEQ ID NO: 650699 - RNA, 63 nt, Homo Sapiens; identical to SEQ ID NO: 588833

SEQ ID NO: 650700 - RNA, 63 nt, Homo Sapiens; identical to SEQ ID NO: 588834

SEQ ID NO: 650701 - RNA, 63 nt, Homo Sapiens; identical to SEQ ID NO: 588835

SEQ ID NO: 650702 - RNA, 63 nt, Homo Sapiens; identical to SEQ ID NO: 588836

SEQ ID NO: 650703 - RNA, 63 nt, Homo Sapiens; identical to SEQ ID NO: 588837

SEQ ID NO: 650704 - RNA, 63 nt, Homo Sapiens; identical to SEQ ID NO: 588838

SEQ ID NO: 650705 - RNA, 63 nt, Homo Sapiens; identical to SEQ ID NO: 588839

SEQ ID NO: 650706 - RNA, 63 nt, Homo Sapiens; identical to SEQ ID NO: 588840

SEQ ID NO: 650707 - RNA, 63 nt, Homo Sapiens; identical to SEQ ID NO: 588841

SEQ ID NO: 650708 - RNA, 63 nt, Homo Sapiens; identical to SEQ ID NO: 588842

SEQ ID NO: 650709 - RNA, 63 nt, Homo Sapiens; identical to SEQ ID NO: 588843

SEQ ID NO: 650710 - RNA, 63 nt, Homo Sapiens; identical to SEQ ID NO: 588844

SEQ ID NO: 650711 - RNA, 63 nt, Homo Sapiens; identical to SEQ ID NO: 588845

SEQ ID NO: 650712 - RNA, 63 nt, Homo Sapiens; identical to SEQ ID NO: 588846

SEQ ID NO: 650713 - RNA, 63 nt, Homo Sapiens; identical to SEQ ID NO: 588847

SEQ ID NO: 650714 - RNA, 63 nt, Homo Sapiens; identical to SEQ ID NO: 588848

SEQ ID NO: 650715 - RNA, 63 nt, Homo Sapiens; identical to SEQ ID NO: 588849

SEQ ID NO: 650716 - RNA, 63 nt, Homo Sapiens; identical to SEQ ID NO: 588850

SEQ ID NO: 650717 - RNA, 63 nt, Homo Sapiens; identical to SEQ ID NO: 588851

SEQ ID NO: 650718 - RNA, 63 nt, Homo Sapiens; identical to SEQ ID NO: 588852

SEQ ID NO: 650719 - RNA, 63 nt, Homo Sapiens; identical to SEQ ID NO: 588853

SEQ ID NO: 650720 - RNA, 63 nt, Homo Sapiens; identical to SEQ ID NO: 588854

SEQ ID NO: 650721 - RNA, 63 nt, Homo Sapiens; identical to SEQ ID NO: 588855

SEQ ID NO: 650722 - RNA, 63 nt, Homo Sapiens; identical to SEQ ID NO: 588856

SEQ ID NO: 650723 - RNA, 63 nt, Homo Sapiens; identical to SEQ ID NO: 588857

SEQ ID NO: 650724 - RNA, 63 nt, Homo Sapiens; identical to SEQ ID NO: 588858

SEQ ID NO: 650725 - RNA, 63 nt, Homo Sapiens; identical to SEQ ID NO: 588859

SEQ ID NO: 650726 - RNA, 63 nt, Homo Sapiens; identical to SEQ ID NO: 588860

SEQ ID NO: 650727 - RNA, 63 nt, Homo Sapiens; identical to SEQ ID NO: 588861

SEQ ID NO: 650728 - RNA, 63 nt, Homo Sapiens; identical to SEQ ID NO: 588862

SEQ ID NO: 650729 - RNA, 63 nt, Homo Sapiens; identical to SEQ ID NO: 588863

SEQ ID NO: 650730 - RNA, 63 nt, Homo Sapiens; identical to SEQ ID NO: 588864

SEQ ID NO: 650731 - RNA, 63 nt, Homo Sapiens; identical to SEQ ID NO: 588865

SEQ ID NO: 650732 - RNA, 63 nt, Homo Sapiens; identical to SEQ ID NO: 588866

SEQ ID NO: 650733 - RNA, 63 nt, Homo Sapiens; identical to SEQ ID NO: 588867

SEQ ID NO: 650734 - RNA, 63 nt, Homo Sapiens; identical to SEQ ID NO: 588868

SEQ ID NO: 650735 - RNA, 63 nt, Homo Sapiens; identical to SEQ ID NO: 588869

SEQ ID NO: 650736 - RNA, 63 nt, Homo Sapiens; identical to SEQ ID NO: 588870

SEQ ID NO: 650737 - RNA, 63 nt, Homo Sapiens; identical to SEQ ID NO: 588871

SEQ ID NO: 650738 - RNA, 63 nt, Homo Sapiens; identical to SEQ ID NO: 588872

SEQ ID NO: 650739 - RNA, 63 nt, Homo Sapiens; identical to SEQ ID NO: 588873

SEQ ID NO: 650740 - RNA, 63 nt, Homo Sapiens; identical to SEQ ID NO: 588874

SEQ ID NO: 650741 - RNA, 63 nt, Homo Sapiens; identical to SEQ ID NO: 588875

SEQ ID NO: 650742 - RNA, 63 nt, Homo Sapiens; identical to SEQ ID NO: 588876

SEQ ID NO: 650743 - RNA, 63 nt, Homo Sapiens; identical to SEQ ID NO: 588877

SEQ ID NO: 650744 - RNA, 63 nt, Homo Sapiens; identical to SEQ ID NO: 588878

SEQ ID NO: 650745 - RNA, 63 nt, Homo Sapiens; identical to SEQ ID NO: 588879

SEQ ID NO: 650746 - RNA, 63 nt, Homo Sapiens; identical to SEQ ID NO: 588880

SEQ ID NO: 650747 - RNA, 63 nt, Homo Sapiens; identical to SEQ ID NO: 588881

SEQ ID NO: 650748 - RNA, 63 nt, Homo Sapiens; identical to SEQ ID NO: 588882

SEQ ID NO: 650749 - RNA, 63 nt, Homo Sapiens; identical to SEQ ID NO: 588883

SEQ ID NO: 650750 - RNA, 63 nt, Homo Sapiens; identical to SEQ ID NO: 588884

SEQ ID NO: 650751 - RNA, 63 nt, Homo Sapiens; identical to SEQ ID NO: 588885

SEQ ID NO: 650752 - RNA, 63 nt, Homo Sapiens; identical to SEQ ID NO: 588886

SEQ ID NO: 650753 - RNA, 63 nt, Homo Sapiens; identical to SEQ ID NO: 588887

SEQ ID NO: 650754 - RNA, 63 nt, Homo Sapiens; identical to SEQ ID NO: 588888

SEQ ID NO: 650755 - RNA, 52 nt, Homo Sapiens; identical to SEQ ID NO: 588889

SEQ ID NO: 650756 - RNA, 63 nt, Homo Sapiens; identical to SEQ ID NO: 588890

SEQ ID NO: 650757 - RNA, 63 nt, Homo Sapiens; identical to SEQ ID NO: 588891

SEQ ID NO: 650758 - RNA, 63 nt, Homo Sapiens; identical to SEQ ID NO: 588892

SEQ ID NO: 650759 - RNA, 63 nt, Homo Sapiens; identical to SEQ ID NO: 588893

SEQ ID NO: 650760 - RNA, 63 nt, Homo Sapiens; identical to SEQ ID NO: 588894

SEQ ID NO: 650761 - RNA, 63 nt, Homo Sapiens; identical to SEQ ID NO: 588895

SEQ ID NO: 650762 - RNA, 63 nt, Homo Sapiens; identical to SEQ ID NO: 588896

SEQ ID NO: 650763 - RNA, 63 nt, Homo Sapiens; identical to SEQ ID NO: 588897

SEQ ID NO: 650764 - RNA, 63 nt, Homo Sapiens; identical to SEQ ID NO: 588898

SEQ ID NO: 650765 - RNA, 63 nt, Homo Sapiens; identical to SEQ ID NO: 588899

SEQ ID NO: 650766 - RNA, 63 nt, Homo Sapiens; identical to SEQ ID NO: 588900

SEQ ID NO: 650767 - RNA, 63 nt, Homo Sapiens; identical to SEQ ID NO: 588901

SEQ ID NO: 650768 - RNA, 63 nt, Homo Sapiens; identical to SEQ ID NO: 588902

SEQ ID NO: 650769 - RNA, 63 nt, Homo Sapiens; identical to SEQ ID NO: 588903

SEQ ID NO: 650770 - RNA, 63 nt, Homo Sapiens; identical to SEQ ID NO: 588904

SEQ ID NO: 650771 - RNA, 63 nt, Homo Sapiens; identical to SEQ ID NO: 588905

SEQ ID NO: 650772 - RNA, 63 nt, Homo Sapiens; identical to SEQ ID NO: 588906

SEQ ID NO: 650773 - RNA, 63 nt, Homo Sapiens; identical to SEQ ID NO: 588907

SEQ ID NO: 650774 - RNA, 63 nt, Homo Sapiens; identical to SEQ ID NO: 588908

SEQ ID NO: 650775 - RNA, 63 nt, Homo Sapiens; identical to SEQ ID NO: 588909

SEQ ID NO: 650776 - RNA, 63 nt, Homo Sapiens; identical to SEQ ID NO: 588910

SEQ ID NO: 650777 - RNA, 63 nt, Homo Sapiens; identical to SEQ ID NO: 588911

SEQ ID NO: 650778 - RNA, 63 nt, Homo Sapiens; identical to SEQ ID NO: 588912

SEQ ID NO: 650779 - RNA, 63 nt, Homo Sapiens; identical to SEQ ID NO: 588913

SEQ ID NO: 650780 - RNA, 63 nt, Homo Sapiens; identical to SEQ ID NO: 588914

SEQ ID NO: 650781 - RNA, 63 nt, Homo Sapiens; identical to SEQ ID NO: 588915

SEQ ID NO: 650782 - RNA, 63 nt, Homo Sapiens; identical to SEQ ID NO: 588916

SEQ ID NO: 650783 - RNA, 63 nt, Homo Sapiens; identical to SEQ ID NO: 588917

SEQ ID NO: 650784 - RNA, 63 nt, Homo Sapiens; identical to SEQ ID NO: 588918

SEQ ID NO: 650785 - RNA, 63 nt, Homo Sapiens; identical to SEQ ID NO: 588919

SEQ ID NO: 650786 - RNA, 63 nt, Homo Sapiens; identical to SEQ ID NO: 588920

SEQ ID NO: 650787 - RNA, 63 nt, Homo Sapiens; identical to SEQ ID NO: 588921

SEQ ID NO: 650788 - RNA, 63 nt, Homo Sapiens; identical to SEQ ID NO: 588922

SEQ ID NO: 650789 - RNA, 63 nt, Homo Sapiens; identical to SEQ ID NO: 588923

SEQ ID NO: 650790 - RNA, 63 nt, Homo Sapiens; identical to SEQ ID NO: 588924

SEQ ID NO: 650791 - RNA, 63 nt, Homo Sapiens; identical to SEQ ID NO: 588925

SEQ ID NO: 650792 - RNA, 63 nt, Homo Sapiens; identical to SEQ ID NO: 588926

SEQ ID NO: 650793 - RNA, 63 nt, Homo Sapiens; identical to SEQ ID NO: 588927

SEQ ID NO: 650794 - RNA, 63 nt, Homo Sapiens; identical to SEQ ID NO: 588928

SEQ ID NO: 650795 - RNA, 63 nt, Homo Sapiens; identical to SEQ ID NO: 588929

SEQ ID NO: 650796 - RNA, 63 nt, Homo Sapiens; identical to SEQ ID NO: 588930

SEQ ID NO: 650797 - RNA, 63 nt, Homo Sapiens; identical to SEQ ID NO: 588931

SEQ ID NO: 650798 - RNA, 63 nt, Homo Sapiens; identical to SEQ ID NO: 588932

SEQ ID NO: 650799 - RNA, 63 nt, Homo Sapiens; identical to SEQ ID NO: 588933

SEQ ID NO: 650800 - RNA, 63 nt, Homo Sapiens; identical to SEQ ID NO: 588934

SEQ ID NO: 650801 - RNA, 63 nt, Homo Sapiens; identical to SEQ ID NO: 588935

SEQ ID NO: 650802 - RNA, 63 nt, Homo Sapiens; identical to SEQ ID NO: 588936

SEQ ID NO: 650803 - RNA, 63 nt, Homo Sapiens; identical to SEQ ID NO: 588937

SEQ ID NO: 650804 - RNA, 63 nt, Homo Sapiens; identical to SEQ ID NO: 588938

SEQ ID NO: 650805 - RNA, 63 nt, Homo Sapiens; identical to SEQ ID NO: 588939

SEQ ID NO: 650806 - RNA, 63 nt, Homo Sapiens; identical to SEQ ID NO: 588940

SEQ ID NO: 650807 - RNA, 63 nt, Homo Sapiens; identical to SEQ ID NO: 588941

SEQ ID NO: 650808 - RNA, 63 nt, Homo Sapiens; identical to SEQ ID NO: 588942

SEQ ID NO: 650809 - RNA, 63 nt, Homo Sapiens; identical to SEQ ID NO: 588943

SEQ ID NO: 650810 - RNA, 63 nt, Homo Sapiens; identical to SEQ ID NO: 588944

SEQ ID NO: 650811 - RNA, 63 nt, Homo Sapiens; identical to SEQ ID NO: 588945

SEQ ID NO: 650812 - RNA, 63 nt, Homo Sapiens; identical to SEQ ID NO: 588946

SEQ ID NO: 650813 - RNA, 63 nt, Homo Sapiens; identical to SEQ ID NO: 588947

SEQ ID NO: 650814 - RNA, 63 nt, Homo Sapiens; identical to SEQ ID NO: 588948

SEQ ID NO: 650815 - RNA, 63 nt, Homo Sapiens; identical to SEQ ID NO: 588949

SEQ ID NO: 650816 - RNA, 63 nt, Homo Sapiens; identical to SEQ ID NO: 588950

SEQ ID NO: 650817 - RNA, 63 nt, Homo Sapiens; identical to SEQ ID NO: 588951

SEQ ID NO: 650818 - RNA, 63 nt, Homo Sapiens; identical to SEQ ID NO: 588952

SEQ ID NO: 650819 - RNA, 63 nt, Homo Sapiens; identical to SEQ ID NO: 588953

SEQ ID NO: 650820 - RNA, 63 nt, Homo Sapiens; identical to SEQ ID NO: 588954

SEQ ID NO: 650821 - RNA, 63 nt, Homo Sapiens; identical to SEQ ID NO: 588955

SEQ ID NO: 650822 - RNA, 63 nt, Homo Sapiens; identical to SEQ ID NO: 588956

SEQ ID NO: 650823 - RNA, 63 nt, Homo Sapiens; identical to SEQ ID NO: 588957

SEQ ID NO: 650824 - RNA, 63 nt, Homo Sapiens; identical to SEQ ID NO: 588958

SEQ ID NO: 650825 - RNA, 63 nt, Homo Sapiens; identical to SEQ ID NO: 588959

SEQ ID NO: 650826 - RNA, 64 nt, Homo Sapiens
ugccaccuaaacgaucaguguggugcugcguucuggccaguaaauuccauguuuuuggcuauau

SEQ ID NO: 650827 - RNA, 64 nt, Homo Sapiens
uucuagaccuuagacacucaagauuacggucccgggccaguaacagcaccugggagcuugguag

SEQ ID NO: 650828 - RNA, 64 nt, Homo Sapiens
ggagaacuaaguaagaaacacaaugccaacagcuggccaguaauuaguguugugcacuucaugu

SEQ ID NO: 650829 - RNA, 64 nt, Homo Sapiens
uauuuauuuauugagaguuuuuuagugcaaucugggccaguauuuuuauagauuaugauuaugu

SEQ ID NO: 650830 - RNA, 64 nt, Homo Sapiens
ggaaaaguuuggcuacuaacaguagcauugugauggccaguauauccaguccauggauaaagaa

SEQ ID NO: 650831 - RNA, 64 nt, Homo Sapiens
aaugucagaacagagugcaacccagucacacuguggccaguaaaauacuauugccucauauugu

SEQ ID NO: 650832 - RNA, 64 nt, Homo Sapiens
agccacaaacaaguacuuuaccccacagcuuaguggccaguaaacacccuggggacuaggaaaa

SEQ ID NO: 650833 - RNA, 64 nt, Homo Sapiens
cagcugucuugguaaaggagagagagagacauggggccaguaauuccggggugcucagaaguuu

SEQ ID NO: 650834 - RNA, 64 nt, Homo Sapiens
ugugcagaccccuccccgccuacaaagucauuucggccaguaggagucccaaggguccacgaug

SEQ ID NO: 650835 - RNA, 64 nt, Homo Sapiens
ccccuguccccagccacacacccagacccaccugggccaguaggccuuccucacuguaucuuug

SEQ ID NO: 650836 - RNA, 64 nt, Homo Sapiens
uggcagcccgaaagacacacaagugucagagcauggccaguaguagcccagcccugaccucagg

SEQ ID NO: 650837 - RNA, 64 nt, Homo Sapiens
uugggcaugggggagccuuuggauuagguguucaggccaguaucuugccacccccugugagcag

SEQ ID NO: 650838 - RNA, 64 nt, Homo Sapiens
caggcaagucauagaauugagagaacaggaaaguggccaguagcaaagacuuaauuuccuuguu

SEQ ID NO: 650839 - RNA, 64 nt, Homo Sapiens
uaaagugcaagacugaauuauuuaaauuggcuuuggccaguagcccagcuuuuuuuuuuuuuuu

SEQ ID NO: 650840 - RNA, 64 nt, Homo Sapiens
aagcagaaguucuaccaccugugucaaaagcacaggccaguauuacaaaguuugccaaccauaa

SEQ ID NO: 650841 - RNA, 64 nt, Homo Sapiens
guauacauccuggguaaugagagguggcuuuugcggccaguauuagacuggaaguucauaccua

SEQ ID NO: 650842 - RNA, 64 nt, Homo Sapiens
ugcaggggcagagaaggaagggaccaggggacugggccaguauguggaggauggggccugcgug

SEQ ID NO: 650843 - RNA, 64 nt, Homo Sapiens
aauaucuguuuuuaauguuuuguuucucccuccaggccaguauaaagggacuugaaguauuuuu

SEQ ID NO: 650844 - RNA, 64 nt, Homo Sapiens
uguauaauuuuuaugcucuuugauuaucuaauaaggccaguauuucaaaagcuguucugaauuu

SEQ ID NO: 650845 - RNA, 64 nt, Homo Sapiens
uauagagcuagcuaaucucuacaaacccucuguaggccaguaguucucaaaguguggucucugg

SEQ ID NO: 650846 - RNA, 64 nt, Homo Sapiens
uugcuagccucucuuacuaauggaauuauauacuggccaguaaaaugggccucccaauugcugu

SEQ ID NO: 650847 - RNA, 64 nt, Homo Sapiens
gucuuugaggaguucaccacaguagcggcaucauggccaguagucaugaagugcucucguucuc

SEQ ID NO: 650848 - RNA, 64 nt, Homo Sapiens
ucagugagaauguuuauguuguuagguuuuggggggccaguagugauuauugauugugagauag

SEQ ID NO: 650849 - RNA, 64 nt, Homo Sapiens
aauguuguguucacagucuacucucucuuucguaggccaguagccuuucucucucccucuuucu

SEQ ID NO: 650850 - RNA, 64 nt, Homo Sapiens
caucuuagcuuggcagguguuggcuucaacauugggccaguagggccuucccuuggagagggcc

SEQ ID NO: 650851 - RNA, 64 nt, Homo Sapiens
ugcggugugcgugguagguugcagugaugagggcggccaguaccucucugcacgcuugaccaaa

SEQ ID NO: 650852 - RNA, 64 nt, Homo Sapiens
aaguugagaaagaaagccaccccaagacguuugaggccaguaggccguacuaacgucugcaaac

SEQ ID NO: 650853 - RNA, 64 nt, Homo Sapiens
uuugacacuucccaguggaauccuucuaccccaaggccaguagucucucuuucucugguggucu

SEQ ID NO: 650854 - RNA, 64 nt, Homo Sapiens
ccaaaccucuuccacgucacuucuguaugucuuaggccaguaucccccuaaacccaacucacgu

SEQ ID NO: 650855 - RNA, 64 nt, Homo Sapiens
auguggcucaguggagggagacccagcauagccaggccaguauggagcaccucacgcacagcuc

SEQ ID NO: 650856 - RNA, 64 nt, Homo Sapiens
uuggugaaauugcuguggggguaucgggggauauggccaguaaaguauugagagacuaacaaau

SEQ ID NO: 650857 - RNA, 64 nt, Homo Sapiens
gguugguugccccucaccucagagcucccccaaaggccaguaauggauccccggccucaguccc

SEQ ID NO: 650858 - RNA, 64 nt, Homo Sapiens
uacaguuccuagaagcagccgcugcucuggcagaggccaguaaacggugcaggcauagcugccu

SEQ ID NO: 650859 - RNA, 64 nt, Homo Sapiens
ggaaauagaaaaacccugccuccaccugcucccaggccaguaaguccauaugaccucaugcauc

SEQ ID NO: 650860 - RNA, 64 nt, Homo Sapiens
uguucucccuugccccaaccuggagugaaaugcuggccaguacuaggucucauacaaggauauu

SEQ ID NO: 650861 - RNA, 64 nt, Homo Sapiens
uauugcuaaagaaagggagauuuagcccucagcuggccaguacuuucuuucaauccucauuauc

SEQ ID NO: 650862 - RNA, 64 nt, Homo Sapiens
uuuagccuccuucgcaggcauguccuggacaccgggccaguaucuauauauguguauguacguu

SEQ ID NO: 650863 - RNA, 64 nt, Homo Sapiens
agugcugggauuacaggugugagccaccacacuuggccaguauauccucaguaugaagauauuu

SEQ ID NO: 650864 - RNA, 64 nt, Homo Sapiens
augucugcaucugugcuguguguguagugugguuggccaguaggugaguaucccugugugugug

SEQ ID NO: 650865 - RNA, 64 nt, Homo Sapiens
gugugaguguuuauauagaaaugaacauagaccuggccaguaaaaggcucugaggaggcuuaaa

SEQ ID NO: 650866 - RNA, 64 nt, Homo Sapiens
ggagugcagggaggggcaggaaaggagacaaggaggccaguauggacacuguguccaguauggc

SEQ ID NO: 650867 - RNA, 64 nt, Homo Sapiens
acaguuccccacccagcgauuagggagcugggcuggccaguacagccaguggggaguggguggg

SEQ ID NO: 650868 - RNA, 64 nt, Homo Sapiens
cuucacacagaaaucuguagcacugcuuuuuugaggccaguagcaacauccagagaucauucuu

SEQ ID NO: 650869 - RNA, 64 nt, Homo Sapiens
uacgggaaaaaauguuuacuaaagugaccaccaaggccaguaaguauuuggggcaucucuauag

SEQ ID NO: 650870 - RNA, 64 nt, Homo Sapiens
gaggaggagccauuguggcacccauucaggcagaggccaguacaacucucucaugacugcacac

SEQ ID NO: 650871 - RNA, 64 nt, Homo Sapiens
gccuuacccucuguaagauacugauucuuccuggggccaguauuaccuuguaugcaaauauuac

SEQ ID NO: 650872 - RNA, 64 nt, Homo Sapiens
agaaagucacauuuaggguuuauuuuuuacacuuggccaguaaaauaggguaaauccuauuaga

SEQ ID NO: 650873 - RNA, 64 nt, Homo Sapiens
caguuggggaaggugggaagcuauccaguagccaggccaguaggcauuauguacagaauaggac

SEQ ID NO: 650874 - RNA, 64 nt, Homo Sapiens
gggagggaaagggagaggggggugagggaggacaggccaguaggugcuuuauaagugaggguag

SEQ ID NO: 650875 - RNA, 64 nt, Homo Sapiens
gaucuuaugaagcuggaggaggggugaagauuggggccaguaucggccccaggggguuagagga

SEQ ID NO: 650876 - RNA, 64 nt, Homo Sapiens
gacuguguggugguaaaugcgcucuuaaaagccaggccaguacuaaguuucugaagucuucaca

SEQ ID NO: 650877 - RNA, 64 nt, Homo Sapiens
uggcagcagcuuuucauugcaguuuuuaguccuaggccaguagaugugcuuuggguugaaaaga

SEQ ID NO: 650878 - RNA, 64 nt, Homo Sapiens
gggucguaaugacuuauuguaguaaaacacagagggccaguaacuaacuguaucuugagguggu

SEQ ID NO: 650879 - RNA, 64 nt, Homo Sapiens
gcuuuauucuuccaaguucauucauacucaaagaggccaguacuuugccauccuugcacuucug

SEQ ID NO: 650880 - RNA, 64 nt, Homo Sapiens
ugaauuuauagagcauuuuuuuucuuaccaagauggccaguaucauuuuacccccaccucccaa

SEQ ID NO: 650881 - RNA, 64 nt, Homo Sapiens
aucucugcuuucagaaguagccccuuuaaaugagggccaguauucugauauuuaauccuuaaaa

SEQ ID NO: 650882 - RNA, 64 nt, Homo Sapiens
guauacuacaguuauguuuaggugagguacuuugggccaguagaacaaauuuaauaacuuuaug

SEQ ID NO: 650883 - RNA, 64 nt, Homo Sapiens
auuauaccauuggcaugaaguuuaauaauuuuguggccaguaaauuuuauuuaauacaaucgga

SEQ ID NO: 650884 - RNA, 64 nt, Homo Sapiens
cuccagcccucccaaugccagaggucaggucugaggccaguaucggggaacgucaggucucucu

SEQ ID NO: 650885 - RNA, 64 nt, Homo Sapiens
aagcagagauaacacuucccaacucauuuugugaggccaguauuacccuaauagcaaaaccagg

SEQ ID NO: 650886 - RNA, 64 nt, Homo Sapiens
aaaaaagauggaacuuuuccaauucaguuuuugaggccaguacaaccuugauaacaaaaccuaa

SEQ ID NO: 650887 - RNA, 64 nt, Homo Sapiens
ccaggccucuuggcagucacaucucuuccuccgaggccaguaccuuuccauuuauucuuugauc

SEQ ID NO: 650888 - RNA, 64 nt, Homo Sapiens
uguccuggcaggaagccaccauuggagaaggugaggccaguaaccaucucaugggauucgcuau

SEQ ID NO: 650889 - RNA, 64 nt, Homo Sapiens
ugggguacaaaggggcccaugcaggagaugcccuggccaguaggaccuccaacagguuguuucc

SEQ ID NO: 650890 - RNA, 64 nt, Homo Sapiens
uguuuuuagugaaauauuauucucuuuguagguuggccaguauauacucuaaauacuaccggag

SEQ ID NO: 650891 - RNA, 64 nt, Homo Sapiens
uaaaaaguauauuuauugcagaggauguucauaaggccaguaugauuuauaaaugcaaucuccc

SEQ ID NO: 650892 - RNA, 64 nt, Homo Sapiens
ggcuaucauuagccacagguacugcugauuauaaggccaguaaaauuuuaguaccuggagguuu

SEQ ID NO: 650893 - RNA, 64 nt, Homo Sapiens
gugcugugggcuggucccacacauccaggaaagaggccaguagagaauucugcccacuuuuuau

SEQ ID NO: 650894 - RNA, 64 nt, Homo Sapiens
ccucuaccugaacaaagagaugaauaauuccaugggccaguaugccaguuugaauucucagucu

SEQ ID NO: 650895 - RNA, 64 nt, Homo Sapiens
uuuccuaagucuuugcucaacuggugccaccacuggccaguaccuggcuaauaggaauucccuc

SEQ ID NO: 650896 - RNA, 52 nt, Homo Sapiens; identical to SEQ ID NO: 588889

SEQ ID NO: 650897 - RNA, 64 nt, Homo Sapiens
uaugacauaauuuaugucuccauuuuguuguauuggccaguacuuuuacaaaucaaaacaucuc

SEQ ID NO: 650898 - RNA, 64 nt, Homo Sapiens
aucugagucuagaacccaggcuucuaaauuucuaggccaguacuacugcucucaaaagagauua

SEQ ID NO: 650899 - RNA, 64 nt, Homo Sapiens
uguaccaagugaauuuaaauaauugguguggauuggccaguagcuaagaagugggcuuuuaaag

SEQ ID NO: 650900 - RNA, 64 nt, Homo Sapiens
uccccccaaccacaggaauggaggcgggacacagggccaguaggagcaauaggauuuuaauaaa

SEQ ID NO: 650901 - RNA, 64 nt, Homo Sapiens
aaucauauuuguauuucagguucuuuuuuaucuuggccaguauauuaugacuaaacgauuauau

SEQ ID NO: 650902 - RNA, 64 nt, Homo Sapiens
gucauugucugaccaaaauuccuucugcacaugaggccaguauaggcaacgucacauuuguuug

SEQ ID NO: 650903 - RNA, 64 nt, Homo Sapiens
ugcccacugccuaccgcgugagccgcagcccuggggccaguaggaagcggacccgcuccaggua

SEQ ID NO: 650904 - RNA, 64 nt, Homo Sapiens
cugagcaagggccuuggaaucaagaaaacagcauggccaguaaauguucuuccuacauaaaaug

SEQ ID NO: 650905 - RNA, 64 nt, Homo Sapiens
guggacuuaacucccaagugggacccgcagugacggccaguaaaaaacacucuguacugugugc

SEQ ID NO: 650906 - RNA, 64 nt, Homo Sapiens
aaugcauuacaacucuguagauuguuaguuacuaggccaguagcuaggaauugguauaaauuua

SEQ ID NO: 650907 - RNA, 64 nt, Homo Sapiens
guucagagggagccagcucuuuauguuggccccaggccaguacuaagcaaauuaaaaagaccga

SEQ ID NO: 650908 - RNA, 64 nt, Homo Sapiens
gauuuuuuugaaguuucaauacagcucaggugaaggccaguaauaauuauggauaacucgaaag

SEQ ID NO: 650909 - RNA, 64 nt, Homo Sapiens
agacacgacagcacacacaggcugagaucgaagaggccaguagguagcacagcacuuugguuuu

SEQ ID NO: 650910 - RNA, 64 nt, Homo Sapiens
cacagguggaaaacgcagccuguagaauaugcacggccaguagucccguucuuauagaugauuu

SEQ ID NO: 650911 - RNA, 64 nt, Homo Sapiens
auccaggccugaggcugcugacguuugacaccagggccaguagagagugcccuuuuguaucuua

SEQ ID NO: 650912 - RNA, 64 nt, Homo Sapiens
ggauguuuaaucuucauuaauaaauaccucaaauggccaguaacucaauauuacuuuucuuccu

SEQ ID NO: 650913 - RNA, 64 nt, Homo Sapiens
uagugcuuugucuauucuuuauuucucucaggguggccaguauuuugacuuauuuauccugcuu

SEQ ID NO: 650914 - RNA, 64 nt, Homo Sapiens
ucuuaaacaaaugaauaggcccuacuguuaaaaaggccaguauauuuggucuaacuucuacauu

SEQ ID NO: 650915 - RNA, 64 nt, Homo Sapiens
acagucauuacuccauuaacugaucccaucgccuggccaguagauuaagcacugaauucacuac

SEQ ID NO: 650916 - RNA, 64 nt, Homo Sapiens
gcacugggcccauuugaaggugucucagacauuuggccaguaugucuuucucagggguuugguc

SEQ ID NO: 650917 - RNA, 64 nt, Homo Sapiens
caguuuuauaagguauuugcauuuuagaagcucuggccaguaguuguuaagauguuggcauuaa

SEQ ID NO: 650918 - RNA, 64 nt, Homo Sapiens
agugaagucugcuccuugaaugucacgugaguggggccaguaagcaagcauucccuuggugaau

SEQ ID NO: 650919 - RNA, 64 nt, Homo Sapiens
aauguguucuuaauuccuaguugccacuagaaagggccaguagcgcuagauaaauguggugaaa

SEQ ID NO: 650920 - RNA, 64 nt, Homo Sapiens
ucgugcccgccuggugccuuugcuggaaccuuuuggccaguaggugcuuggcaccuuagcagac

SEQ ID NO: 650921 - RNA, 64 nt, Homo Sapiens
cuauugggacaguccucuucuauauguuuuaaguggccaguaauuuaaugaauuucugguuugu

SEQ ID NO: 650922 - RNA, 64 nt, Homo Sapiens
uccagguucguauagaaaaagcacagcucucacuggccaguagcugccaaaaagaacacccauc

SEQ ID NO: 650923 - RNA, 64 nt, Homo Sapiens
cugagaggcaguggccucuugagugaacaggggaggccaguagaugccccagauccagagccgu

SEQ ID NO: 650924 - RNA, 64 nt, Homo Sapiens
ucugguuacccaacuacagaaccuccuuugaucaggccaguagguugugaugcaggcuggagcc

SEQ ID NO: 650925 - RNA, 64 nt, Homo Sapiens
ccucccauagggcuuuuccaagcugccacuggucggccaguacagccuccggaagcagcccuac

SEQ ID NO: 650926 - RNA, 64 nt, Homo Sapiens
gugaaacccugucucuccuaucgagaccagcaauggccaguaugcggaucaugaagucaagagu

SEQ ID NO: 650927 - RNA, 64 nt, Homo Sapiens
cagccucuagcuacccuguaucgaggcaaggggaggccaguaaaguuugccaagccugauccug

SEQ ID NO: 650928 - RNA, 64 nt, Homo Sapiens
caauguaacuaagcauuuguguucugauaucugaggccaguaacuauuaauaucuaguucucag

SEQ ID NO: 650929 - RNA, 64 nt, Homo Sapiens
uuaauaauguuuauaagcugggcauggucgcucaggccaguaaucccagugacuuaggaggcug

SEQ ID NO: 650930 - RNA, 64 nt, Homo Sapiens
acggccuggcagaggagcccaagggacugaagauggccaguagcuggguccugaggccccugaa

SEQ ID NO: 650931 - RNA, 64 nt, Homo Sapiens
ucugaccucagggcucccagcucggggccuguggggccaguaugcuggucugggagucccuccu

SEQ ID NO: 650932 - RNA, 64 nt, Homo Sapiens
cugagaaaccuggcagccugcuguuaacaacacaggccaguauuggguuuuauugaauuuggua

SEQ ID NO: 650933 - RNA, 64 nt, Homo Sapiens
guggauuguauugugagauccugugauuccugguggccaguauccuggauuccucuaagaucuu

SEQ ID NO: 650934 - RNA, 64 nt, Homo Sapiens
aauagaagcagaaaaacauuuagggauaacaucaggccaguagaauuaagccucuccaccuguc

SEQ ID NO: 650935 - RNA, 64 nt, Homo Sapiens
ccacccccaaaguaagaagaaacauguuuccaguggccaguaugucuuucauugcuuugcaccc

SEQ ID NO: 650936 - RNA, 64 nt, Homo Sapiens
uauuaacugccaaaacaagagccugauuuuuugaggccaguaauucguuugcuagaauugauuu

SEQ ID NO: 650937 - RNA, 64 nt, Homo Sapiens
cuauuaggagacucuuggaaccauuucuccagagggccaguaucacuaaugggauccagcaggg

SEQ ID NO: 650938 - RNA, 64 nt, Homo Sapiens
uuggggguaggaguccccuauguaggggagccaaggccaguaguccagaagcgaugggguaccg

SEQ ID NO: 650939 - RNA, 64 nt, Homo Sapiens
cagaauuaaagugggggagagcuguuugcccuuaggccaguacaaagacaccaccuuccugcca

SEQ ID NO: 650940 - RNA, 64 nt, Homo Sapiens
uauuaauaucuaguucucagguucugauaucugaggccaguaaccaguguaacuaagcauuugu

SEQ ID NO: 650941 - RNA, 64 nt, Homo Sapiens
cauccuguccuucucuuuccaaagagaagaaaauggccaguauucauccacuuucuucuaaaau

SEQ ID NO: 650942 - RNA, 64 nt, Homo Sapiens
uauuaauaucuaguucucagguucugauaucugaggccaguaaccaauguaacuaaguauuugu

SEQ ID NO: 650943 - RNA, 64 nt, Homo Sapiens
gcagauuuuaacugauuugggauaaaagaauauuggccaguauuaaagcugcggucuccuguuu

SEQ ID NO: 650944 - RNA, 64 nt, Homo Sapiens
gccuuucacguauuccgucugcacaggcaaccaaggccaguagaaagcuauggcugcaaaaccc

SEQ ID NO: 650945 - RNA, 64 nt, Homo Sapiens
aaaaaauuggauaaaguauaggaggguuacuuggggccaguaaaucaguagacugaacauucaa

SEQ ID NO: 650946 - RNA, 64 nt, Homo Sapiens
cccccugcuggucgcuguuucggggacucggggcggccaguaccaccgccugaggcggggcuca

SEQ ID NO: 650947 - RNA, 64 nt, Homo Sapiens
gggcugcaaugcagcauguugcccuggcaccuguggccaguacucgggacagacuaagggcgcu

SEQ ID NO: 650948 - RNA, 64 nt, Homo Sapiens
ucuguguuggccccugugccucagucccgcggauggccaguagggggcgcuggaggacugcggg

SEQ ID NO: 650949 - RNA, 64 nt, Homo Sapiens
cuuaauccuauuuauccccuggaaugugcgugcuggccaguaggagggcuggcuuuggcagcuc

SEQ ID NO: 650950 - RNA, 64 nt, Homo Sapiens
caaagagccccccgggucacccccgccccacugaggccaguagggggccaggccucccacuccu

SEQ ID NO: 650951 - RNA, 64 nt, Homo Sapiens
gcucuuguccaggaagaucuagcaacauacacauggccaguaauaacuacuaguuauuugugau

SEQ ID NO: 650952 - RNA, 64 nt, Homo Sapiens
ugauugaguucaucaugagccguugcuaaugccaggccaguaaaaguauaacagcaaauaacca

SEQ ID NO: 650953 - RNA, 64 nt, Homo Sapiens
cucgccagaggagcacuuggcaaggucagugaggggccaguagacccccggagaagcaguaccg

SEQ ID NO: 650954 - RNA, 64 nt, Homo Sapiens
cauuguugugguuguguuuuuaacggcuuuugaaggccaguaacaccaucagggaagcuuguug

SEQ ID NO: 650955 - RNA, 64 nt, Homo Sapiens
ugccagccauuucucaaaccguagugauuuugguggccaguaaacuuuugcuuguacagaaucu

SEQ ID NO: 650956 - RNA, 64 nt, Homo Sapiens
aaaaaaugaagucugacuagaauucuauugcagaggccaguacauuuaguauggcauugaguug

SEQ ID NO: 650957 - RNA, 64 nt, Homo Sapiens
ucaguuuacuucuaaguaaucacagauaauacauggccaguaaucccaggcuggccauucauuc

SEQ ID NO: 650958 - RNA, 64 nt, Homo Sapiens
cauggaagugaagacuguaaugugacuaagcccuggccaguaggccuugcagcuagcaagguug

SEQ ID NO: 650959 - RNA, 64 nt, Homo Sapiens
aucacuguguccacaugagcgaaccccagcacguggccaguaucaucagcuccuucuuacagug

SEQ ID NO: 650960 - RNA, 64 nt, Homo Sapiens
gggcccccucccucuccucuggugcagacggcagggccaguauguuuaguggggaaagggacgg

SEQ ID NO: 650961 - RNA, 64 nt, Homo Sapiens
gaucagaaccauuuuacuuuguacucuuagaggaggccaguaauacuacuuaaguacuugucau

SEQ ID NO: 650962 - RNA, 64 nt, Homo Sapiens
cuuggggguggggggagggucagcccucuuaaaaggccaguacugacagugaccuccacccccg

SEQ ID NO: 650963 - RNA, 64 nt, Homo Sapiens
cagccaaccccguggggaccgauggagagucgggggccaguagcucacccacauucgcugaagc

SEQ ID NO: 650964 - RNA, 64 nt, Homo Sapiens
uacaguacaggaucuuuggucuacucuaucacaaggccaguaccacacucaugaagaaagaaca

SEQ ID NO: 650965 - RNA, 64 nt, Homo Sapiens
aaaauguaguagacuuaaagagucauguagaaaaggccaguauaaaaauaugcucacaguuugu

SEQ ID NO: 650966 - RNA, 64 nt, Homo Sapiens
aggaauaauaaaucccacuuucccaauaaggugaggccaguagcuccggaagggcuccauacug

SEQ ID NO: 650967 - RNA, 66 nt, Homo Sapiens
uuugccaccuaaacgaucaguguggugcugcguucuggccaguaaauuccauguuuuuggcuauau

SEQ ID NO: 650968 - RNA, 66 nt, Homo Sapiens
cuuucuagaccuuagacacucaagauuacggucccgggccaguaacagcaccugggagcuugguag

SEQ ID NO: 650969 - RNA, 66 nt, Homo Sapiens
ugggagaacuaaguaagaaacacaaugccaacagcuggccaguaauuaguguugugcacuucaugu

SEQ ID NO: 650970 - RNA, 66 nt, Homo Sapiens
aauauuuauuuauugagaguuuuuuagugcaaucugggccaguauuuuuauagauuaugauuaugu

SEQ ID NO: 650971 - RNA, 66 nt, Homo Sapiens
aaggaaaaguuuggcuacuaacaguagcauugugauggccaguauauccaguccauggauaaagaa

SEQ ID NO: 650972 - RNA, 66 nt, Homo Sapiens
cuaaugucagaacagagugcaacccagucacacuguggccaguaaaauacuauugccucauauugu

SEQ ID NO: 650973 - RNA, 66 nt, Homo Sapiens
acagccacaaacaaguacuuuaccccacagcuuaguggccaguaaacacccuggggacuaggaaaa

SEQ ID NO: 650974 - RNA, 66 nt, Homo Sapiens
agcagcugucuugguaaaggagagagagagacauggggccaguaauuccggggugcucagaaguuu

SEQ ID NO: 650975 - RNA, 66 nt, Homo Sapiens
ugugcagaccccuccccgccuguacaaagucauuucggccaguaggccagucccaaggguccacga

SEQ ID NO: 650976 - RNA, 66 nt, Homo Sapiens
ccccuguccccagccacacaugcccagacccaccugggccaguagguaccuuccucacuguaucuu

SEQ ID NO: 650977 - RNA, 66 nt, Homo Sapiens
uggcagcccgaaagacacacggaagugucagagcauggccaguaguccagcccagcccugaccuca

SEQ ID NO: 650978 - RNA, 66 nt, Homo Sapiens
uugggcaugggggagccuuuagggauuagguguucaggccaguaucuuuugccacccccugugagc

SEQ ID NO: 650979 - RNA, 66 nt, Homo Sapiens
caggcaagucauagaauugauugagaacaggaaaguggccaguagcggaaagacuuaauuuccuug

SEQ ID NO: 650980 - RNA, 66 nt, Homo Sapiens
uaaagugcaagacugaauuauuuuuaaauuggcuuuggccaguagcuaccagcuuuuuuuuuuuuu

SEQ ID NO: 650981 - RNA, 66 nt, Homo Sapiens
aagcagaaguucuaccaccuaagugucaaaagcacaggccaguauuagacaaaguuugccaaccau

SEQ ID NO: 650982 - RNA, 66 nt, Homo Sapiens
uuguauacauccuggguaaugagagguggcuuuugcggccaguauuagacuggaaguucauaccua

SEQ ID NO: 650983 - RNA, 66 nt, Homo Sapiens
ugugcaggggcagagaaggaagggaccaggggacugggccaguauguggaggauggggccugcgug

SEQ ID NO: 650984 - RNA, 66 nt, Homo Sapiens
aaaauaucuguuuuuaauguuuuguuucucccuccaggccaguauaaagggacuugaaguauuuuu

SEQ ID NO: 650985 - RNA, 66 nt, Homo Sapiens
uuuguauaauuuuuaugcucuuugauuaucuaauaaggccaguauuucaaaagcuguucugaauuu

SEQ ID NO: 650986 - RNA, 66 nt, Homo Sapiens
cauauagagcuagcuaaucucuacaaacccucuguaggccaguaguucucaaaguguggucucugg

SEQ ID NO: 650987 - RNA, 66 nt, Homo Sapiens
cuuugcuagccucucuuacuaauggaauuauauacuggccaguaaaaugggccucccaauugcugu

SEQ ID NO: 650988 - RNA, 66 nt, Homo Sapiens
gucuuugaggaguucaccacucaguagcggcaucauggccaguaguuccaugaagugcucucguuc

SEQ ID NO: 650989 - RNA, 66 nt, Homo Sapiens
ucagugagaauguuuauguuagguuagguuuuggggggccaguaguaugauuauugauugugagau

SEQ ID NO: 650990 - RNA, 66 nt, Homo Sapiens
aauguuguguucacagucuacucucucucuuucguaggccaguagccucuuucucucucccucuuu

SEQ ID NO: 650991 - RNA, 66 nt, Homo Sapiens
caucuuagcuuggcagguguccuggcuucaacauugggccaguaggcggccuucccuuggagaggg

SEQ ID NO: 650992 - RNA, 66 nt, Homo Sapiens
ugcggugugcgugguagguuaagcagugaugagggcggccaguacccuucucugcacgcuugacca

SEQ ID NO: 650993 - RNA, 66 nt, Homo Sapiens
aaguugagaaagaaagccacaccccaagacguuugaggccaguaggcuccguacuaacgucugcaa

SEQ ID NO: 650994 - RNA, 66 nt, Homo Sapiens
uuugacacuucccaguggaacuuccuucuaccccaaggccaguagucccucucuuucucugguggu

SEQ ID NO: 650995 - RNA, 66 nt, Homo Sapiens
ccaaaccucuuccacgucacguuucuguaugucuuaggccaguaucguccccuaaacccaacucac

SEQ ID NO: 650996 - RNA, 66 nt, Homo Sapiens
aaauguggcucaguggagggagacccagcauagccaggccaguauggagcaccucacgcacagcuc

SEQ ID NO: 650997 - RNA, 66 nt, Homo Sapiens
uguuggugaaauugcuguggggguaucgggggauauggccaguaaaguauugagagacuaacaaau

SEQ ID NO: 650998 - RNA, 66 nt, Homo Sapiens
aggguugguugccccucaccucagagcucccccaaaggccaguaauggauccccggccucaguccc

SEQ ID NO: 650999 - RNA, 66 nt, Homo Sapiens
uacaguuccuagaagcagcccugcugcucuggcagaggccaguaaacacggugcaggcauagcugc

SEQ ID NO: 651000 - RNA, 66 nt, Homo Sapiens
ggaaauagaaaaacccugccucuccaccugcucccaggccaguaagcuuccauaugaccucaugca

SEQ ID NO: 651001 - RNA, 66 nt, Homo Sapiens
uguucucccuugccccaaccuuuggagugaaaugcuggccaguacuugaggucucauacaaggaua

SEQ ID NO: 651002 - RNA, 66 nt, Homo Sapiens
uauugcuaaagaaagggagaucuuuagcccucagcuggccaguacuuuuucuuucaauccucauua

SEQ ID NO: 651003 - RNA, 66 nt, Homo Sapiens
gguuuagccuccuucgcaggcauguccuggacaccgggccaguaucuauauauguguauguacguu

SEQ ID NO: 651004 - RNA, 66 nt, Homo Sapiens
aaagugcugggauuacaggugugagccaccacacuuggccaguauauccucaguaugaagauauuu

SEQ ID NO: 651005 - RNA, 66 nt, Homo Sapiens
caaugucugcaucugugcuguguguguagugugguuggccaguaggugaguaucccugugugugug

SEQ ID NO: 651006 - RNA, 66 nt, Homo Sapiens
uugugugaguguuuauauagaaaugaacauagaccuggccaguaaaaggcucugaggaggcuuaaa

SEQ ID NO: 651007 - RNA, 66 nt, Homo Sapiens
aaggagugcagggaggggcaggaaaggagacaaggaggccaguauggacacuguguccaguauggc

SEQ ID NO: 651008 - RNA, 66 nt, Homo Sapiens
gaacaguuccccacccagcgauuagggagcugggcuggccaguacagccaguggggaguggguggg

SEQ ID NO: 651009 - RNA, 66 nt, Homo Sapiens
cucuucacacagaaaucuguagcacugcuuuuuugaggccaguagcaacauccagagaucauucuu

SEQ ID NO: 651010 - RNA, 66 nt, Homo Sapiens
uacgggaaaaaauguuuacuagaaagugaccaccaaggccaguaaguauauuuggggcaucucuau

SEQ ID NO: 651011 - RNA, 66 nt, Homo Sapiens
gaggaggagccauuguggcaaccccauucaggcagaggccaguacaugacucucucaugacugcac

SEQ ID NO: 651012 - RNA, 66 nt, Homo Sapiens
gugccuuacccucuguaagauacugauucuuccuggggccaguauuaccuuguaugcaaauauuac

SEQ ID NO: 651013 - RNA, 66 nt, Homo Sapiens
agagaaagucacauuuaggguuuauuuuuuacacuuggccaguaaaauaggguaaauccuauuaga

SEQ ID NO: 651014 - RNA, 66 nt, Homo Sapiens
caguuggggaaggugggaagaccuauccaguagccaggccaguaggcccauuauguacagaauagg

SEQ ID NO: 651015 - RNA, 66 nt, Homo Sapiens
gggagggaaagggagaggggagggugagggaggacaggccaguagguuugcuuuauaagugagggu

SEQ ID NO: 651016 - RNA, 66 nt, Homo Sapiens
gaucuuaugaagcuggaggagaggggugaagauuggggccaguaucguggccccaggggguuagag

SEQ ID NO: 651017 - RNA, 66 nt, Homo Sapiens
gacuguguggugguaaaugccagcucuuaaaagccaggccaguacuagaaguuucugaagucuuca

SEQ ID NO: 651018 - RNA, 66 nt, Homo Sapiens
uggcagcagcuuuucauugcgaaguuuuuaguccuaggccaguagauuugugcuuuggguugaaaa

SEQ ID NO: 651019 - RNA, 66 nt, Homo Sapiens
gggucguaaugacuuauuguguaguaaaacacagagggccaguaacccuaacuguaucuugaggug

SEQ ID NO: 651020 - RNA, 66 nt, Homo Sapiens
aggcuuuauucuuccaaguucauucauacucaaagaggccaguacuuugccauccuugcacuucug

SEQ ID NO: 651021 - RNA, 66 nt, Homo Sapiens
guugaauuuauagagcauuuuuuuucuuaccaagauggccaguaucauuuuacccccaccucccaa

SEQ ID NO: 651022 - RNA, 66 nt, Homo Sapiens
aucucugcuuucagaaguagaaccccuuuaaaugagggccaguauucacugauauuuaauccuuaa

SEQ ID NO: 651023 - RNA, 66 nt, Homo Sapiens
guauacuacaguuauguuuaugggugagguacuuugggccaguagaaaacaaauuuaauaacuuua

SEQ ID NO: 651024 - RNA, 66 nt, Homo Sapiens
auuauaccauuggcaugaaggauuuaauaauuuuguggccaguaaagauuuuauuuaauacaaucg

SEQ ID NO: 651025 - RNA, 66 nt, Homo Sapiens
cuccagcccucccaaugccacugaggucaggucugaggccaguaucguggggaacgucaggucucu

SEQ ID NO: 651026 - RNA, 66 nt, Homo Sapiens
aaaagcagagauaacacuucccaacucauuuugugaggccaguauuacccuaauagcaaaaccagg

SEQ ID NO: 651027 - RNA, 66 nt, Homo Sapiens
agaaaaaagauggaacuuuuccaauucaguuuuugaggccaguacaaccuugauaacaaaaccuaa

SEQ ID NO: 651028 - RNA, 66 nt, Homo Sapiens
ggccaggccucuuggcagucacaucucuuccuccgaggccaguaccuuuccauuuauucuuugauc

SEQ ID NO: 651029 - RNA, 66 nt, Homo Sapiens
uguguccuggcaggaagccaccauuggagaaggugaggccaguaaccaucucaugggauucgcuau

SEQ ID NO: 651030 - RNA, 66 nt, Homo Sapiens
ggugggguacaaaggggcccaugcaggagaugcccuggccaguaggaccuccaacagguuguuucc

SEQ ID NO: 651031 - RNA, 66 nt, Homo Sapiens
uguuuuuagugaaauauuauagucucuuuguagguuggccaguauaccuacucuaaauacuaccgg

SEQ ID NO: 651032 - RNA, 66 nt, Homo Sapiens
gcuaaaaaguauauuuauugcagaggauguucauaaggccaguaugauuuauaaaugcaaucuccc

SEQ ID NO: 651033 - RNA, 66 nt, Homo Sapiens
auggcuaucauuagccacagguacugcugauuauaaggccaguaaaauuuuaguaccuggagguuu

SEQ ID NO: 651034 - RNA, 66 nt, Homo Sapiens
aggugcugugggcuggucccacacauccaggaaagaggccaguagagaauucugcccacuuuuuau

SEQ ID NO: 651035 - RNA, 66 nt, Homo Sapiens
uuccucuaccugaacaaagagaugaauaauuccaugggccaguaugccaguuugaauucucagucu

SEQ ID NO: 651036 - RNA, 66 nt, Homo Sapiens
uuuccuaagucuuugcucaauccuggugccaccacuggccaguaccacuggcuaauaggaauuccc

SEQ ID NO: 651037 - RNA, 52 nt, Homo Sapiens; identical to SEQ ID NO: 588889

SEQ ID NO: 651038 - RNA, 66 nt, Homo Sapiens
guuaugacauaauuuaugucuccauuuuguuguauuggccaguacuuuuacaaaucaaaacaucuc

SEQ ID NO: 651039 - RNA, 66 nt, Homo Sapiens
agaucugagucuagaacccaggcuucuaaauuucuaggccaguacuacugcucucaaaagagauua

SEQ ID NO: 651040 - RNA, 66 nt, Homo Sapiens
uguguaccaagugaauuuaaauaauugguguggauuggccaguagcuaagaagugggcuuuuaaag

SEQ ID NO: 651041 - RNA, 66 nt, Homo Sapiens
cuuccccccaaccacaggaauggaggcgggacacagggccaguaggagcaauaggauuuuaauaaa

SEQ ID NO: 651042 - RNA, 66 nt, Homo Sapiens
acugaucuuucugggauagagguucuuuuuuaucuuggccaguauauuaugacuaaacgauuauau

SEQ ID NO: 651043 - RNA, 66 nt, Homo Sapiens
uugucauugucugaccaaaauuccuucugcacaugaggccaguauaggcaacgucacauuuguuug

SEQ ID NO: 651044 - RNA, 66 nt, Homo Sapiens
ugugcccacugccuaccgcgugagccgcagcccuggggccaguaggaagcggacccgcuccaggua

SEQ ID NO: 651045 - RNA, 66 nt, Homo Sapiens
cugagcaagggccuuggaauugcaagaaaacagcauggccaguaaaccuguucuuccuacauaaaa

SEQ ID NO: 651046 - RNA, 66 nt, Homo Sapiens
guggacuuaacucccaaguggcggacccgcagugacggccaguaaaagaaacacucuguacugugu

SEQ ID NO: 651047 - RNA, 66 nt, Homo Sapiens
uuaaugcauuacaacucuguagauuguuaguuacuaggccaguagcuaggaauugguauaaauuua

SEQ ID NO: 651048 - RNA, 66 nt, Homo Sapiens
auguucagagggagccagcucuuuauguuggccccaggccaguacuaagcaaauuaaaaagaccga

SEQ ID NO: 651049 - RNA, 66 nt, Homo Sapiens
gauuuuuuugaaguuucaauagacagcucaggugaaggccaguaauuaaauuauggauaacucgaa

SEQ ID NO: 651050 - RNA, 66 nt, Homo Sapiens
agacacgacagcacacacaguugcugagaucgaagaggccaguagggguagcacagcacuuugguu

SEQ ID NO: 651051 - RNA, 66 nt, Homo Sapiens
cacagguggaaaacgcagccuuuguagaauaugcacggccaguaguggcccguucuuauagaugau

SEQ ID NO: 651052 - RNA, 66 nt, Homo Sapiens
gcauccaggccugaggcugcugacguuugacaccagggccaguagagagugcccuuuuguaucuua

SEQ ID NO: 651053 - RNA, 66 nt, Homo Sapiens
uuggauguuuaaucuucauuaauaaauaccucaaauggccaguaacucaauauuacuuuucuuccu

SEQ ID NO: 651054 - RNA, 66 nt, Homo Sapiens
cuuagugcuuugucuauucuuuauuucucucaggguggccaguauuuugacuuauuuauccugcuu

SEQ ID NO: 651055 - RNA, 66 nt, Homo Sapiens
ucuuaaacaaaugaauaggcuuccuacuguuaaaaaggccaguauagcuuuggucuaacuucuaca

SEQ ID NO: 651056 - RNA, 66 nt, Homo Sapiens
acagucauuacuccauuaacacugaucccaucgccuggccaguagauuuuaagcacugaauucacu

SEQ ID NO: 651057 - RNA, 66 nt, Homo Sapiens
uggcacugggcccauuugaaggugucucagacauuuggccaguaugucuuucucagggguuugguc

SEQ ID NO: 651058 - RNA, 66 nt, Homo Sapiens
aacaguuuuauaagguauuugcauuuuagaagcucuggccaguaguuguuaagauguuggcauuaa

SEQ ID NO: 651059 - RNA, 66 nt, Homo Sapiens
agugaagucugcuccuugaaauugucacgugaguggggccaguaagcccaagcauucccuugguga

SEQ ID NO: 651060 - RNA, 66 nt, Homo Sapiens
aauguguucuuaauuccuagaauugccacuagaaagggccaguagcuggcuagauaaaugugguga

SEQ ID NO: 651061 - RNA, 66 nt, Homo Sapiens
ucgugcccgccuggugccuuacugcuggaaccuuuuggccaguagggcugcuuggcaccuuagcag

SEQ ID NO: 651062 - RNA, 66 nt, Homo Sapiens
uucuauugggacaguccucuucuauauguuuuaaguggccaguaauuuaaugaauuucugguuugu

SEQ ID NO: 651063 - RNA, 66 nt, Homo Sapiens
acuccagguucguauagaaaaagcacagcucucacuggccaguagcugccaaaaagaacacccauc

SEQ ID NO: 651064 - RNA, 66 nt, Homo Sapiens
uccugagaggcaguggccucuugagugaacaggggaggccaguagaugccccagauccagagccgu

SEQ ID NO: 651065 - RNA, 66 nt, Homo Sapiens
acucugguuacccaacuacagaaccuccuuugaucaggccaguagguugugaugcaggcuggagcc

SEQ ID NO: 651066 - RNA, 66 nt, Homo Sapiens
ugccucccauagggcuuuuccaagcugccacuggucggccaguacagccuccggaagcagcccuac

SEQ ID NO: 651067 - RNA, 66 nt, Homo Sapiens
gugaaacccugucucuccuaguucgagaccagcaauggccaguaugggcggaucaugaagucaaga

SEQ ID NO: 651068 - RNA, 66 nt, Homo Sapiens
cccagccucuagcuacccuguaucgaggcaaggggaggccaguaaaguuugccaagccugauccug

SEQ ID NO: 651069 - RNA, 66 nt, Homo Sapiens
accaauguaacuaagcauuuguguucugauaucugaggccaguaacuauuaauaucuaguucucag

SEQ ID NO: 651070 - RNA, 66 nt, Homo Sapiens
aauuaauaauguuuauaagcugggcauggucgcucaggccaguaaucccagugacuuaggaggcug

SEQ ID NO: 651071 - RNA, 66 nt, Homo Sapiens
caacggccuggcagaggagcccaagggacugaagauggccaguagcuggguccugaggccccugaa

SEQ ID NO: 651072 - RNA, 66 nt, Homo Sapiens
gcucugaccucagggcucccagcucggggccuguggggccaguaugcuggucugggagucccuccu

SEQ ID NO: 651073 - RNA, 66 nt, Homo Sapiens
uucugagaaaccuggcagccugcuguuaacaacacaggccaguauuggguuuuauugaauuuggua

SEQ ID NO: 651074 - RNA, 66 nt, Homo Sapiens
aaguggauuguauugugagauccugugauuccugguggccaguauccuggauuccucuaagaucuu

SEQ ID NO: 651075 - RNA, 66 nt, Homo Sapiens
ugaauagaagcagaaaaacauuuagggauaacaucaggccaguagaauuaagccucuccaccuguc

SEQ ID NO: 651076 - RNA, 66 nt, Homo Sapiens
ccccacccccaaaguaagaagaaacauguuuccaguggccaguaugucuuucauugcuuugcaccc

SEQ ID NO: 651077 - RNA, 66 nt, Homo Sapiens
gcuauuaacugccaaaacaagagccugauuuuuugaggccaguaauucguuugcuagaauugauuu

SEQ ID NO: 651078 - RNA, 66 nt, Homo Sapiens
cuauuaggagacucuuggaaggccauuucuccagagggccaguaucuaacuaaugggauccagcag

SEQ ID NO: 651079 - RNA, 66 nt, Homo Sapiens
uuggggguaggaguccccuacguguaggggagccaaggccaguaguugccagaagcgaugggguac

SEQ ID NO: 651080 - RNA, 66 nt, Homo Sapiens
cagaauuaaagugggggagacagcuguuugcccuuaggccaguacauaaagacaccaccuuccugc

SEQ ID NO: 651081 - RNA, 66 nt, Homo Sapiens
uauuaauaucuaguucucagguguucugauaucugaggccaguaacaccaguguaacuaagcauuu

SEQ ID NO: 651082 - RNA, 66 nt, Homo Sapiens
cauccuguccuucucuuuccauaaagagaagaaaauggccaguauuaucauccacuuucuucuaaa

SEQ ID NO: 651083 - RNA, 66 nt, Homo Sapiens
uauuaauaucuaguucucagguguucugauaucugaggccaguaacaccaauguaacuaaguauuu

SEQ ID NO: 651084 - RNA, 66 nt, Homo Sapiens
gcagauuuuaacugauuugguugauaaaagaauauuggccaguauuuuaaagcugcggucuccugu

SEQ ID NO: 651085 - RNA, 66 nt, Homo Sapiens
aggccuuucacguauuccgucugcacaggcaaccaaggccaguagaaagcuauggcugcaaaaccc

SEQ ID NO: 651086 - RNA, 66 nt, Homo Sapiens
ugaaaaaauuggauaaaguauaggaggguuacuuggggccaguaaaucaguagacugaacauucaa

SEQ ID NO: 651087 - RNA, 66 nt, Homo Sapiens
ggcccccugcuggucgcuguuucggggacucggggcggccaguaccaccgccugaggcggggcuca

SEQ ID NO: 651088 - RNA, 66 nt, Homo Sapiens
cagggcugcaaugcagcauguugcccuggcaccuguggccaguacucgggacagacuaagggcgcu

SEQ ID NO: 651089 - RNA, 66 nt, Homo Sapiens
aaucuguguuggccccugugccucagucccgcggauggccaguagggggcgcuggaggacugcggg

SEQ ID NO: 651090 - RNA, 66 nt, Homo Sapiens
cacuuaauccuauuuauccccuggaaugugcgugcuggccaguaggagggcuggcuuuggcagcuc

SEQ ID NO: 651091 - RNA, 66 nt, Homo Sapiens
accaaagagccccccgggucacccccgccccacugaggccaguagggggccaggccucccacuccu

SEQ ID NO: 651092 - RNA, 66 nt, Homo Sapiens
gcucuuguccaggaagaucuauagcaacauacacauggccaguaauuuaacuacuaguuauuugug

SEQ ID NO: 651093 - RNA, 66 nt, Homo Sapiens
uuugauugaguucaucaugagccguugcuaaugccaggccaguaaaaguauaacagcaaauaacca

SEQ ID NO: 651094 - RNA, 66 nt, Homo Sapiens
cccucgccagaggagcacuuggcaaggucagugaggggccaguagacccccggagaagcaguaccg

SEQ ID NO: 651095 - RNA, 66 nt, Homo Sapiens
cauuguugugguuguguuuuuguaacggcuuuugaaggccaguaacacaccaucagggaagcuugu

SEQ ID NO: 651096 - RNA, 66 nt, Homo Sapiens
ugccagccauuucucaaacccuguagugauuuugguggccaguaaagucuuuugcuuguacagaau

SEQ ID NO: 651097 - RNA, 66 nt, Homo Sapiens
guaaaaaaugaagucugacuagaauucuauugcagaggccaguacauuuaguauggcauugaguug

SEQ ID NO: 651098 - RNA, 66 nt, Homo Sapiens
ucucaguuuacuucuaaguaaucacagauaauacauggccaguaaucccaggcuggccauucauuc

SEQ ID NO: 651099 - RNA, 66 nt, Homo Sapiens
cauggaagugaagacuguaaugugugacuaagcccuggccaguaggucccuugcagcuagcaaggu

SEQ ID NO: 651100 - RNA, 66 nt, Homo Sapiens
caaucacuguguccacaugagcgaaccccagcacguggccaguaucaucagcuccuucuuacagug

SEQ ID NO: 651101 - RNA, 66 nt, Homo Sapiens
gggcccccucccucuccucuggggugcagacggcagggccaguauguguuuaguggggaaagggac

SEQ ID NO: 651102 - RNA, 66 nt, Homo Sapiens
gaucagaaccauuuuacuuuauguacucuuagaggaggccaguaauccacuacuuaaguacuuguc

SEQ ID NO: 651103 - RNA, 66 nt, Homo Sapiens
cuuggggguggggggagggucgcagcccucuuaaaaggccaguacucagacagugaccuccacccc

SEQ ID NO: 651104 - RNA, 66 nt, Homo Sapiens
cagccaaccccguggggaccgcgauggagagucgggggccaguagcucucacccacauucgcugaa

SEQ ID NO: 651105 - RNA, 66 nt, Homo Sapiens
uauacaguacaggaucuuuggucuacucuaucacaaggccaguaccacacucaugaagaaagaaca

SEQ ID NO: 651106 - RNA, 66 nt, Homo Sapiens
aaaauguaguagacuuaaagguagucauguagaaaaggccaguauauuaaaauaugcucacaguuu

SEQ ID NO: 651107 - RNA, 66 nt, Homo Sapiens
aggaauaauaaaucccacuuugucccaauaaggugaggccaguagcuuuccggaagggcuccauac

SEQ ID NO: 651108 - RNA, 65 nt, Homo Sapiens
cuguggcagcagcaggcuccccagcggcccagggugggccagaccagcagcccaggaagcagcac

SEQ ID NO: 651109 - RNA, 65 nt, Homo Sapiens
ucccacagcagagccaggugagggggcgccugccagggccagacccagguggggcagccugaacc

SEQ ID NO: 651110 - RNA, 65 nt, Homo Sapiens
uggugaguggcaucaaaugugugacuuacuaucuugggccagaacuaagaaugccaagguuuuau

SEQ ID NO: 651111 - RNA, 65 nt, Homo Sapiens
cggucagcacgugugcucgggacacagcggagucagggccagagcccuucccuccaggaacugau

SEQ ID NO: 651112 - RNA, 65 nt, Homo Sapiens
cuccacuucucagcucuccccugcccugcagcccugggccagacaaggccagaagguuucagggg

SEQ ID NO: 651113 - RNA, 65 nt, Homo Sapiens
agcaugcuucccagagggagcaggccggaaccacagggccagagggagcuggaacccgaggggcc

SEQ ID NO: 651114 - RNA, 65 nt, Homo Sapiens
gaggugggggauugagggagggacagaguguuggagggccagagacuaguccugagauggaaaca

SEQ ID NO: 651115 - RNA, 65 nt, Homo Sapiens
cggggcccuggccuggggcacccacugcacacucagggccagacccaccauccuggacuggcgag

SEQ ID NO: 651116 - RNA, 65 nt, Homo Sapiens
gcucugcuucugcuuuccaaaguagcccagguccugggccagaugcaggggaggugccuauccau

SEQ ID NO: 651117 - RNA, 65 nt, Homo Sapiens
cuuagcuuccacucccuuguguguauucuggcugggggccagauuggggaagcccuucuccccgg

SEQ ID NO: 651118 - RNA, 65 nt, Homo Sapiens
cuauacugaauucccauucauguuagguaacuuaggggccagaaucuccaugcacuuuguagacc

SEQ ID NO: 651119 - RNA, 65 nt, Homo Sapiens
gugggccugguagcacaugucuguccucagagcaggggccagaugauuuuccucccugguuugca

SEQ ID NO: 651120 - RNA, 65 nt, Homo Sapiens
acggcuaagggcacgaagacgauaucugguagagagggccagagaugcccgcgugguagggcugc

SEQ ID NO: 651121 - RNA, 65 nt, Homo Sapiens
agaccaggguuucucaaacucguacuugacauuuggggccagauaauucuuuguuguggggcugu

SEQ ID NO: 651122 - RNA, 65 nt, Homo Sapiens
auugggggaggggacaggaucuaacaaugucacuugggccagaauggaccugcccuuucugcucc

SEQ ID NO: 651123 - RNA, 65 nt, Homo Sapiens
aacuagaucaggaggucaguaaacuuucuguggaagggccagagaguaaauauuuuaggcuuugc

SEQ ID NO: 651124 - RNA, 65 nt, Homo Sapiens
ucaauugaaucagguaacacuaacggaucaaggcagggccagagggugguguggucucuauuuga

SEQ ID NO: 651125 - RNA, 65 nt, Homo Sapiens
agcuugcaaaggaggagaguuuaggauuagggccagggccagaaagucgguaucuugguugugcu

SEQ ID NO: 651126 - RNA, 65 nt, Homo Sapiens
ccagcuacucugaucccucugggggcucuggccaagggccagacagaccuucacagaugccuacu

SEQ ID NO: 651127 - RNA, 60 nt, Homo Sapiens
gugccauggaguccucuuaaagagggacgagggccagacugaagcagcacaaggccgggg

SEQ ID NO: 651128 - RNA, 50 nt, Homo Sapiens
gcaugcagacucacguguaggggccagagccuggcuggggcaucucugcg

SEQ ID NO: 651129 - RNA, 65 nt, Homo Sapiens
ccaggcccucacuccccuuccccauguugucgauggggccagagaugaagggaaguggacuaaag

SEQ ID NO: 651130 - RNA, 65 nt, Homo Sapiens
ugaccagcuuccuccagaccccuguggcagaccgggggccagacacagauacauggggaacugca

SEQ ID NO: 651131 - RNA, 65 nt, Homo Sapiens
ucaugugacacagggguguugugagagcugggauggggccagagauuauaaguuugacacaacau

SEQ ID NO: 651132 - RNA, 65 nt, Homo Sapiens
uugagaaccaagacagggccuggcuccaacucugugggccagaggugggggacugcuaggucgag

SEQ ID NO: 651133 - RNA, 65 nt, Homo Sapiens
uacaccuuuugcuaacaccccuacuaggucccagagggccagaaacaccugacuuaccucugagu

SEQ ID NO: 651134 - RNA, 65 nt, Homo Sapiens
gcccuuggaucaguaugggaaccccaaaucccacagggccagauguggagucugugucugccccc

SEQ ID NO: 651135 - RNA, 65 nt, Homo Sapiens
gauuugagccucuccggcugccagccagggggccugggccagaccagggcucuguccuuccguga

SEQ ID NO: 651136 - RNA, 65 nt, Homo Sapiens
gggaugggagggucccuagccuucgggcaccuccagggccagagagcaggcucagagcagcuagu

SEQ ID NO: 651137 - RNA, 65 nt, Homo Sapiens
gggucucuguuuccauuacaaacuuuguucugucugggccagagaaccuagccuuugaaaucucu

SEQ ID NO: 651138 - RNA, 65 nt, Homo Sapiens
ucggccaacuuggaguccuuucuguuuugaagcaugggccagacccggcacugcgcucggagagc

SEQ ID NO: 651139 - RNA, 65 nt, Homo Sapiens
uucauagcuucucugcuuggcaaagagaugggagggggccagauacugacuaccugggguaggca

SEQ ID NO: 651140 - RNA, 65 nt, Homo Sapiens
uagucacuguuauggggugauaagaggacuucuuggggccagaacuguggaggagagcacauuug

SEQ ID NO: 651141 - RNA, 65 nt, Homo Sapiens
ccucucucugcuccuccauucgcaagugucuuccugggccagacuccccuccaccucauguacuu

SEQ ID NO: 651142 - RNA, 65 nt, Homo Sapiens
uuccccacaaagccguucgcagcuuccgggagaaggggccagagcccgguggggccaguuucuca

SEQ ID NO: 651143 - RNA, 65 nt, Homo Sapiens
cccguccuccuaugcugguguuccuuauguccggugggccagaagugcagagccuuuucucugaa

SEQ ID NO: 651144 - RNA, 65 nt, Homo Sapiens
ccagaagugccaccucaucaaggcccagcucagcugggccagagcaugccaucacauggaggacg

SEQ ID NO: 651145 - RNA, 65 nt, Homo Sapiens
accacucugcugccccaccaggcggcgucggcgcggggccagagcugaagaagugugaaugugaa

SEQ ID NO: 651146 - RNA, 65 nt, Homo Sapiens
gagggcagagccaugggccucaucgugacccuucagggccagaaguuccuccugauggccaagag

SEQ ID NO: 651147 - RNA, 65 nt, Homo Sapiens
gauagguccuagcagaaggcguggagagaacaggagggccagauaguggucucauaauuccauuu

SEQ ID NO: 651148 - RNA, 65 nt, Homo Sapiens
gccucacccucugcccuaauggccgaaggguccaagggccagacucgcacugaaagggcagagua

SEQ ID NO: 651149 - RNA, 65 nt, Homo Sapiens
guuguccagcaguguuucugauggcacaucauucagggccagaagcccuccaccuggcuggagag

SEQ ID NO: 651150 - RNA, 65 nt, Homo Sapiens
gccauccccuauggaccagacagagauaggccugugggccagauuagcagagucugaauagucuu

SEQ ID NO: 651151 - RNA, 65 nt, Homo Sapiens
aagggagggagggugggggguacugcaucucacuggggccagagggcguggacauagcccuguga

SEQ ID NO: 651152 - RNA, 64 nt, Homo Sapiens; identical to SEQ ID NO: 533523

SEQ ID NO: 651153 - RNA, 65 nt, Homo Sapiens
aauuuggcaccaggcaaacguuugcaaauuaaaaagggccagaaauuguuuuuuuuuuuuuaagg

SEQ ID NO: 651154 - RNA, 65 nt, Homo Sapiens
uacaacaguauucuucucuguagcagagaagcagggggccagagcagaauuaaagacaccagaag

SEQ ID NO: 651155 - RNA, 65 nt, Homo Sapiens
ccaaagcugagcuuuuaacuuaagcucccuaacuugggccagaaauggaccaaggcuaaccuuuc

SEQ ID NO: 651156 - RNA, 65 nt, Homo Sapiens
ggaggguaggagugccacuccuauucaguaccaaggggccagagugggguggggggaacaacugg

SEQ ID NO: 651157 - RNA, 65 nt, Homo Sapiens
augaacagacugaccuugauuaccaugugcuacaggggccagaagugugccgcaccauugaacug

SEQ ID NO: 651158 - RNA, 65 nt, Homo Sapiens
ucucuuacucuguggguaauuaaaagguuagcucugggccagacuuauuaagaaacguaaugaca

SEQ ID NO: 651159 - RNA, 65 nt, Homo Sapiens
cccugccaggaaagggacauaaagagaagcagucugggccagaugacuaggacuacuuuuuacca

SEQ ID NO: 651160 - RNA, 65 nt, Homo Sapiens
ucuuuacacacacauucccguucccugcccaaguggggccagaccgacagcuccuucccuacuca

SEQ ID NO: 651161 - RNA, 65 nt, Homo Sapiens
aaggguggugaugggugagcgcucuggcccaggcugggccagacucccgcccaagcaugaacagg

SEQ ID NO: 651162 - RNA, 65 nt, Homo Sapiens
guacauagcagggagugaucggggugaaauaacuugggccagaauauuauuaaacaaucaucagg

SEQ ID NO: 651163 - RNA, 65 nt, Homo Sapiens
uaggcuucuucuuucauguaguuccucauaagcaggggccagaauaucucagccaccugcaguga

SEQ ID NO: 651164 - RNA, 65 nt, Homo Sapiens
uuaguaucuguucucucugagccuggaugggcuuggggccagaccuuugccugauuccugauucc

SEQ ID NO: 651165 - RNA, 65 nt, Homo Sapiens
gacaggccuccuuguugggagcacagaagugcuaugggccagaagccccucccuucaaggaucuc

SEQ ID NO: 651166 - RNA, 65 nt, Homo Sapiens
ugcugcuagucuccaauugccaagggaauuuaacugggccagacuaccuuuuuauacuaggucug

SEQ ID NO: 651167 - RNA, 65 nt, Homo Sapiens
gcaucaccaccacaccccugccggccuuggccuuggggccagacuggcugcacagcccaaccagg

SEQ ID NO: 651168 - RNA, 65 nt, Homo Sapiens
agacucuggucauagaaacaauaaaugaguuagaagggccagauuucauucucagucccagagca

SEQ ID NO: 651169 - RNA, 50 nt, Homo Sapiens
uugaguauauugaugauuaagggccagaggaucucacuugcuuaucugaa

SEQ ID NO: 651170 - RNA, 65 nt, Homo Sapiens
ccaguguccaagccccuccaggaggguccuggggugggccagaugccugcccaccucugucuccu

SEQ ID NO: 651171 - RNA, 65 nt, Homo Sapiens
cccugggagauccgggcuggacuguggaccccgaugggccagaguccuuguggcccacagcauag

SEQ ID NO: 651172 - RNA, 65 nt, Homo Sapiens
cugcccacaagucccagcgcuuugauccgcagcaggggccagacccccugcagauagcaccgguc

SEQ ID NO: 651173 - RNA, 65 nt, Homo Sapiens
uguggguugaggcuugacugaaguuuacaucccuugggccagauauaaauuacuaaaauaaguuc

SEQ ID NO: 651174 - RNA, 53 nt, Homo Sapiens
uugggugcagauguagaagcagggggccagaugcuguccacucagaguucuga

SEQ ID NO: 651175 - RNA, 65 nt, Homo Sapiens
gaccugcuagauuuggaaggaggugucgggggaaugggccagaugaguaggcaucuuagcuuggc

SEQ ID NO: 651176 - RNA, 65 nt, Homo Sapiens
uuuuguuuuuguuuuuguuuuuucuggagucuugagggccagaguaaauccuccuccuucccuuu

SEQ ID NO: 651177 - RNA, 65 nt, Homo Sapiens
gccuggaugccuggguagccccucccugagcuccagggccagaauugcuccgacucucagggcug

SEQ ID NO: 651178 - RNA, 63 nt, Homo Sapiens
gggcucuggucuccacagauggaccucacccuggggccagaguacagcgcccaccugucauag

SEQ ID NO: 651179 - RNA, 65 nt, Homo Sapiens
guaguacaacguuaaauuguaaguaggaaacuguagggccagagaaguuuccaggaaacaucagg

SEQ ID NO: 651180 - RNA, 65 nt, Homo Sapiens
gucaccuggagcuggggagauggcuucaccuggaggggccagagguccugaguggagccuuaaag

SEQ ID NO: 651181 - RNA, 65 nt, Homo Sapiens
cucugccaggcuggauuguagauucugcucuaagggggccagaccgaaauauacuggggucccca

SEQ ID NO: 651182 - RNA, 65 nt, Homo Sapiens
uucaggcugccccgccuccacuucccacuccugcagggccagaagcggaaagacaaaagcgauuu

SEQ ID NO: 651183 - RNA, 65 nt, Homo Sapiens
ucaagaaaauugcauauuuccauucuggucuuucugggccagauuuuuauauugguuuucaguaa

SEQ ID NO: 651184 - RNA, 65 nt, Homo Sapiens
gguggggcaacagcgguggcagggcaggggguggugggccagacugguccccgggggacuucuuc

SEQ ID NO: 651185 - RNA, 65 nt, Homo Sapiens
auaguuguaaccuacagcugauugguaagaacuaugggccagacauuuaaucucuccaucuauga

SEQ ID NO: 651186 - RNA, 65 nt, Homo Sapiens
ucaauuuuggacucugcacucccucuccucuucaggggccagacuuggcagcaugugcaccaggu

SEQ ID NO: 651187 - RNA, 65 nt, Homo Sapiens
cugagauuucuacagcaauaaaggagacacacacugggccagagaggccugccuucugccugcuc

SEQ ID NO: 651188 - RNA, 65 nt, Homo Sapiens
aaagugcugggauuacaggcgugagccacugcacagggccagauucaucauuucaaaguuacuuu

SEQ ID NO: 651189 - RNA, 65 nt, Homo Sapiens
auuugcuugaaauucuugagcagggaucuuauaaagggccagaaauaagaugugugguucacaua

SEQ ID NO: 651190 - RNA, 65 nt, Homo Sapiens
gcuaagccuucuccucacugcccuuuaggcucccagggccagaggagccagggacuauuuucugc

SEQ ID NO: 651191 - RNA, 65 nt, Homo Sapiens
accuuuaaggaccagcugggcuguagugauuccuggggccagaguggcauuauguuuuuacaaaa

SEQ ID NO: 651192 - RNA, 65 nt, Homo Sapiens
ugagggguuucauuauaggccuugguucucuccaggggccagaugaguuuauuguggaaucuuug

SEQ ID NO: 651193 - RNA, 65 nt, Homo Sapiens
ugcuauacagcugggaacagcagacuuucucugaagggccagaugguaacuacauuaggguuugc

SEQ ID NO: 651194 - RNA, 65 nt, Homo Sapiens
cugagggggugggcuuacucccugggcagucuugggggccagagcugaggccaguccauauuaca

SEQ ID NO: 651195 - RNA, 65 nt, Homo Sapiens
cuugaugagguauaggucauuuguuuugaguaugugggccagaaauuuaaaauuagaaauuuguu

SEQ ID NO: 651196 - RNA, 65 nt, Homo Sapiens
aucuaaaauaaagguuggcaaacuuuuucuguaaagggccagauuguaaauauuucagacugugu

SEQ ID NO: 651197 - RNA, 65 nt, Homo Sapiens
gucaggaauucaagcgugaacccauauugauaagugggccagaauuauuuaggggccuggcuugc

SEQ ID NO: 651198 - RNA, 65 nt, Homo Sapiens
ugggaaccacagcuccacaagggggagaggcagcugggccagaccgaggucacagccacuccaag

SEQ ID NO: 651199 - RNA, 65 nt, Homo Sapiens
uggaggagccccaguggcugggggggccuagccaugggccagagaguugauuacccuugccugcu

SEQ ID NO: 651200 - RNA, 65 nt, Homo Sapiens
cauaggaagggucuuggaguaguggcugggcaggggggccagagugucccaaaacuggcacuaga

SEQ ID NO: 651201 - RNA, 65 nt, Homo Sapiens
aaacgcuuauaaaaccagagccugagggguagaaggggccagaaaaccccgcuucccuuggaauc

SEQ ID NO: 651202 - RNA, 65 nt, Homo Sapiens
ugccugcuguuuccauggguguaggcaucaugugggggccagaucacagccuccucuuggucuga

SEQ ID NO: 651203 - RNA, 65 nt, Homo Sapiens
gcucugugcucuaggagcuagggccggcagugguggggccagagguguacagaacuggacagguu

SEQ ID NO: 651204 - RNA, 65 nt, Homo Sapiens
gcaggggagggggcaaugguaacagguggggucaggggccagaguauaaauugccaaagaguggg

SEQ ID NO: 651205 - RNA, 65 nt, Homo Sapiens
uggggggcugagucuucccuguacccgggcugugugggccagaaccaguuccuaagggccacugu

SEQ ID NO: 651206 - RNA, 65 nt, Homo Sapiens
cgugugcccaccagcggccuugaagaggcaggucugggccagaugcugggcaggaaaccccagcg

SEQ ID NO: 651207 - RNA, 65 nt, Homo Sapiens
cugguuguugccagguugcagcugcucuugcaucugggccagaaguccucccuccugcaggcugg

SEQ ID NO: 651208 - RNA, 65 nt, Homo Sapiens
uaaaagcacacagggucugcuauuccugaggcugggggccagagaagcuuuuacgcauggaaaaa

SEQ ID NO: 651209 - RNA, 65 nt, Homo Sapiens
aaauccccuaccccucaaaaacagguugaguuuaugggccagaauauuuuguauaccagacauug

SEQ ID NO: 651210 - RNA, 65 nt, Homo Sapiens
ucugauuuggaaaaagagagggagguauggacugggggccagaguccuuuccaaggcuucuccaa

SEQ ID NO: 651211 - RNA, 65 nt, Homo Sapiens
uucugaaguauuuuauuuaccuaacuauaauuauugggccagauacuuguuaauaaaugggcuua

SEQ ID NO: 651212 - RNA, 65 nt, Homo Sapiens
caaucccucacauccaggaaaugaauuuugcaauugggccagaugcuaauuugcacguugauuca

SEQ ID NO: 651213 - RNA, 65 nt, Homo Sapiens
aagguaucaaaccacaucagccucugauuggccaugggccagaccugcacucuggccaaugauug

SEQ ID NO: 651214 - RNA, 65 nt, Homo Sapiens
uagaaaaccagaacggauuucauuucuaauggagggggccagagaugggaaaauuucuuguucag

SEQ ID NO: 651215 - RNA, 65 nt, Homo Sapiens
caugacccucacaggucuugcuacccagacuuaaugggccagagcgagaacuacaguuaugucag

SEQ ID NO: 651216 - RNA, 65 nt, Homo Sapiens
acagaaacuccaacuggcaaggaaagaagccuguugggccagaaggaauauagcugcauuaacuu

SEQ ID NO: 651217 - RNA, 65 nt, Homo Sapiens
uacagaaaacaauucugguacccaucuuccaggcagggccagaauugccacugaauugaagacca

SEQ ID NO: 651218 - RNA, 65 nt, Homo Sapiens
aaucuuguacagaauaaugaguuaaguaauauuuagggccagaaauuauugaauccaaacaaugu

SEQ ID NO: 651219 - RNA, 65 nt, Homo Sapiens
cuaucauuuuauuaaguaugauugacacagcccaugggccagaacacacucuacaaaaugacuag

SEQ ID NO: 651220 - RNA, 65 nt, Homo Sapiens
aaaucaacuuguguacugauaaaauacucuagccugggccagagaagauaauguucuuuaauguu

SEQ ID NO: 651221 - RNA, 65 nt, Homo Sapiens
cacuguauuuaccacuucuaagagugacugacgacgggccagaugacccuugaaguagucauuau

SEQ ID NO: 651222 - RNA, 65 nt, Homo Sapiens
uguguuucauucuccaaaggacagcugagacuuaugggccagaagauacuggaagaugguguggc

SEQ ID NO: 651223 - RNA, 65 nt, Homo Sapiens
gagaggaagaagagggcaggguggggaggagcucugggccagaggaugcugagcugccugggcag

SEQ ID NO: 651224 - RNA, 65 nt, Homo Sapiens
gaguggucucagugagaagguagaugccaacuggagggccagaccuguguccugcccauguccuc

SEQ ID NO: 651225 - RNA, 65 nt, Homo Sapiens
gccaguucugcagggugucagcuccaggacccacagggccagaaccagcugggagaauugguuau

SEQ ID NO: 651226 - RNA, 65 nt, Homo Sapiens
ggcaggauggucauucucaaaaacccugggguccugggccagagacaggcagggcccaguccagg

SEQ ID NO: 651227 - RNA, 65 nt, Homo Sapiens
gucacugaagcauccaaauaaagaauuucccucaugggccagacuacaacuuaacagaccuaggg

SEQ ID NO: 651228 - RNA, 65 nt, Homo Sapiens
cgugggcagguggggcauggccccugguggccugggggccagaccgugagacaggacgcagcggg

SEQ ID NO: 651229 - RNA, 65 nt, Homo Sapiens
gagggucaggggaccaggcucugggaggccagaccgggccagacuggggcaguugcgugacccug

SEQ ID NO: 651230 - RNA, 65 nt, Homo Sapiens
cguguccaccaagggacaguugaggcaucauuccugggccagaguggccaggcagccuccccagc

SEQ ID NO: 651231 - RNA, 65 nt, Homo Sapiens
cugaauccaguacuuucaguaacauugucugcaaagggccagauaucuggaguagggggucagca

SEQ ID NO: 651232 - RNA, 65 nt, Homo Sapiens
cccagaacagggagagacuguuguggucuccgguggggccagaucgagaugucuagacuggugcg

SEQ ID NO: 651233 - RNA, 65 nt, Homo Sapiens
ccaaaccccuacuucuacagcaagggcguggaucugggccagaagccucucuuuuugacagagga

SEQ ID NO: 651234 - RNA, 65 nt, Homo Sapiens
cggccccgcccaaaggguucacugccguccccggagggccagauaacauuucugggggugucguc

SEQ ID NO: 651235 - RNA, 65 nt, Homo Sapiens
uguccacguccugagcuuucgcacugggcuuguuggggccagaaaaaaccacugugugguggggg

SEQ ID NO: 651236 - RNA, 65 nt, Homo Sapiens
uggaaggagacaucuguccccucagaggacagucugggccagaacgaggagcccugugcucccag

SEQ ID NO: 651237 - RNA, 65 nt, Homo Sapiens
gcacgacagcagaaggauguugcuuuuuuaagggagggccagaaagaaaguuaguggauugcaaa

SEQ ID NO: 651238 - RNA, 65 nt, Homo Sapiens
uaaggacaggguggaagagggugguauauagggaagggccagauaggcaacuucauuuggcuugu

SEQ ID NO: 651239 - RNA, 65 nt, Homo Sapiens
acuggcguuggggaguugguuccugagaggucugagggccagagcugcccucuacauuaacaugc

SEQ ID NO: 651240 - RNA, 65 nt, Homo Sapiens
uggguggcuuucaaggcuggggcauggcaaaucaggggccagagagcaggggagcuugggacuca

SEQ ID NO: 651241 - RNA, 65 nt, Homo Sapiens
uugcucuucugucugucaucuugcaggaugcccgagggccagaugggcuuagcuaggccaaagua

SEQ ID NO: 651242 - RNA, 65 nt, Homo Sapiens
cagagaagcccuccuguggcucaggggcagcugcagggccagauggaguuggccugcagggaguc

SEQ ID NO: 651243 - RNA, 65 nt, Homo Sapiens
agugugugacuuacagaaacugcaugaaaaaucaugggccagagccucggcccuagcauugcacu

SEQ ID NO: 651244 - RNA, 65 nt, Homo Sapiens
uauaguauucaguauauauuguuuccauggugauggggccagaugcccaggcaggcuuuggaguu

SEQ ID NO: 651245 - RNA, 65 nt, Homo Sapiens
aagugcaagucauggagugcugagcuccuugcagagggccagagugcacauccuuggaggcgaga

SEQ ID NO: 651246 - RNA, 65 nt, Homo Sapiens
auggcuuaugggggcccaggucugucuugugcagagggccagagauaccucgcagauuugcugag

SEQ ID NO: 651247 - RNA, 65 nt, Homo Sapiens
ccaccuccccaacaugugaauacuguggggcaguggggccagagccucucugccuucugccccac

SEQ ID NO: 651248 - RNA, 65 nt, Homo Sapiens
aguauguuuaaguggagaguauuugaaaugagggugggccagauggggaggccauuuuugccuaa

SEQ ID NO: 651249 - RNA, 65 nt, Homo Sapiens
ggaaagucacuugagacacaguuauugggcacuaagggccagacuucacuacuucugacacucug

SEQ ID NO: 651250 - RNA, 65 nt, Homo Sapiens
auucugcaaaucccaaaucucuuuuguuuuuaauugggccagaagguucuggauauuuacagcuu

SEQ ID NO: 651251 - RNA, 65 nt, Homo Sapiens
ugguguaccgcugguggaucucccugucuugcccugggccagagccuacucagugauugggaaau

SEQ ID NO: 651252 - RNA, 65 nt, Homo Sapiens
cagcaacuguuuuucauauugguucauccaucagggggccagaagacuuaaaaguaagaaguagu

SEQ ID NO: 651253 - RNA, 65 nt, Homo Sapiens
ccagccccagcccugggccugggcugccgacaccugggccagagccccugcugugauuggugcuc

SEQ ID NO: 651254 - RNA, 65 nt, Homo Sapiens
ggauucuaucuacauaaguccuuucaauuccaccagggccagagcagcuccaccacugugcacuu

SEQ ID NO: 651255 - RNA, 65 nt, Homo Sapiens
gugcuguaaacagguuugggcaguggugggggagggggccagagaggcggcucagguugcccagc

SEQ ID NO: 651256 - RNA, 65 nt, Homo Sapiens
gugcuggugggaaaugggcuugagucacucaccuggggccagaagaggcccccagggaguuguga

SEQ ID NO: 651257 - RNA, 65 nt, Homo Sapiens
gugccuguccauaacugugaaguauuaagcacuuagggccagaugcacuguaaacauugcagguu

SEQ ID NO: 651258 - RNA, 65 nt, Homo Sapiens
cagcagggugguggggacuccugagcccagccugggggccagagcaccccaggaccccgggggga

SEQ ID NO: 651259 - RNA, 65 nt, Homo Sapiens
ccauggacacuccagugccagcaaugacaucucaggggccagaggaacuguccagagagcaacuc

SEQ ID NO: 651260 - RNA, 65 nt, Homo Sapiens
ccuagccuccuauaaggcccaggaagagggcagaggggccagaaggacuccauggcccaaagacc

SEQ ID NO: 651261 - RNA, 65 nt, Homo Sapiens
uauuuaagggguauucagauuagaaucaaaaacaagggccagauggcuguaaguggcuagguugg

SEQ ID NO: 651262 - RNA, 65 nt, Homo Sapiens
gaccacagcagggcaggcauucccaggagacaccagggccagagugagaggccaggagggccuga

SEQ ID NO: 651263 - RNA, 65 nt, Homo Sapiens
guguauacccaggcuugucucauuuuguggguggagggccagaguugaagagccucaccuggggg

SEQ ID NO: 651264 - RNA, 50 nt, Homo Sapiens
gggcucugcucggccugugagggccagaggagcaggaaggaauugaguag

SEQ ID NO: 651265 - RNA, 65 nt, Homo Sapiens
cgggcggggaccuacuguccucccucgggugcugugggccagaucacuucuguagugcugcaggg

SEQ ID NO: 651266 - RNA, 65 nt, Homo Sapiens
ggacccuuuaaauuaaaaagugaagauagucaccagggccagaaagcucauggaguggccguaau

SEQ ID NO: 651267 - RNA, 65 nt, Homo Sapiens
guguaaaccaggaauuggcacacuuuuuuuagaaugggccagaugguaaauauuuaugcuucacg

SEQ ID NO: 651268 - RNA, 65 nt, Homo Sapiens
agauccuggcucggaccacugcaagggccgaggcagggccagaccagagcauccuggguacaggc

SEQ ID NO: 651269 - RNA, 65 nt, Homo Sapiens
gcuuggaaagugaacuugcagccuuggauggggaagggccagaugcugggugggugccugucacc

SEQ ID NO: 651270 - RNA, 65 nt, Homo Sapiens
acucaccugcccuucccgugcccacagcuggagcagggccagagccuugggccgguggagccccu

SEQ ID NO: 651271 - RNA, 65 nt, Homo Sapiens
ugggaaggccuuacagaagaggugacauuucagcugggccagagaucaguagagagcagcugaag

SEQ ID NO: 651272 - RNA, 65 nt, Homo Sapiens
cugggagucccuaccugcuuccaucuguccagcuggggccagaggggcacccucagggagccucc

SEQ ID NO: 651273 - RNA, 57 nt, Homo Sapiens
gaaugaccauuacuaacaugauccauugggccagaagcugggcagaagaagauuuaa

SEQ ID NO: 651274 - RNA, 65 nt, Homo Sapiens
uucagaaacguaauucuuacgaagaccaugccauggggccagaaaguggcaucauacucagaaag

SEQ ID NO: 651275 - RNA, 65 nt, Homo Sapiens
agauauggggaaggagcauccucaaaugcugacaggggccagaggguauugaucaggguagcaaa

SEQ ID NO: 651276 - RNA, 65 nt, Homo Sapiens
guuaaucacaaagagcaauuacuuuacuauuuuaagggccagagguuacuuauuuuaauuuucug

SEQ ID NO: 651277 - RNA, 65 nt, Homo Sapiens
aaugagagagaggaagacugcccugguucugcagagggccagaagggguggaagucaguuggccu

SEQ ID NO: 651278 - RNA, 65 nt, Homo Sapiens
ugcugggggaccgaguuugugacuguccguucucggggccagagccgggaaggcgccgggcccgg

SEQ ID NO: 651279 - RNA, 65 nt, Homo Sapiens
cgcccggcccagcccuggaggcucucccggcagaggggccagaauccaggccgaacuccgcacuc

SEQ ID NO: 651280 - RNA, 65 nt, Homo Sapiens
gucgagaugacuuugaucauugguaacuugggccugggccagacaaaguauaaaacuuacaaaag

SEQ ID NO: 651281 - RNA, 65 nt, Homo Sapiens
uaguugcugagaggggcuggggagauggggcgggagggccagacucagugcugcuguggagcuag

SEQ ID NO: 651282 - RNA, 65 nt, Homo Sapiens
aggccagguggagaugaggauggguaacaguauuggggccagaucccuaagccccccagcuguaa

SEQ ID NO: 651283 - RNA, 65 nt, Homo Sapiens
uuuuuuuucuguaccacaggcauuaucuauaccuggggccagauuuucugcacuuugaaauguug

SEQ ID NO: 651284 - RNA, 65 nt, Homo Sapiens
cgucaugacuacgcagcagcagcaguuuccaagacgggccagaaacgcauccacagcaguggcac

SEQ ID NO: 651285 - RNA, 65 nt, Homo Sapiens
agaccuuugaucugcaguguaaaucuaccagucaugggccagaagggcaaaagcccagcuuucuc

SEQ ID NO: 651286 - RNA, 65 nt, Homo Sapiens
ucugaaaggucccucugacccaggucaccaaauuugggccagaacuggcacuuccgagugcccac

SEQ ID NO: 651287 - RNA, 65 nt, Homo Sapiens
agcgccggacggcgcagcuggccaagaggcgggcggggccagaaauaccucaugccccugcacca

SEQ ID NO: 651288 - RNA, 65 nt, Homo Sapiens
uccugggcuccacucaggggaggugcuuggccaaugggccagaaaccgcuucugagcggggcacu

SEQ ID NO: 651289 - RNA, 65 nt, Homo Sapiens
uucucagaagaggcccagcguccaccucucucccagggccagacagcccuuccuggcucccccau

SEQ ID NO: 651290 - RNA, 65 nt, Homo Sapiens
ccgaugcuaccccugucagacagaggcugcggccugggccagagucagggaguagcugcugcuuc

SEQ ID NO: 651291 - RNA, 65 nt, Homo Sapiens
gauuuuagaacccuaaugcacccuggaggguagcugggccagacuucucauuucacaggugagga

SEQ ID NO: 651292 - RNA, 65 nt, Homo Sapiens
uccccauggaacagcccugcacgcccaggaugaaggggccagaccacgccccugccugagaccac

SEQ ID NO: 651293 - RNA, 65 nt, Homo Sapiens
ugugccccguucacccaccccggggugauauaggggggccagacgagagcugcguaaaguuaccc

SEQ ID NO: 651294 - RNA, 65 nt, Homo Sapiens
caguggcucaugccuguaaugaauaggggaagacugggccagacguuuucaaacugugguccaga

SEQ ID NO: 651295 - RNA, 65 nt, Homo Sapiens
ggcaauuuggcuaaaaaaugcagaacaaaagcucugggccagaaaaaaaaugcauaccaugcuuu

SEQ ID NO: 651296 - RNA, 65 nt, Homo Sapiens
agaaaggccuacgguuucuguggguccucuuuagggggccagacacuggggaguuuuccugaucu

SEQ ID NO: 651297 - RNA, 65 nt, Homo Sapiens
accuccggaauccugccaccgcccugguggugggggggccagaccccuugcuccguuguucccuu

SEQ ID NO: 651298 - RNA, 65 nt, Homo Sapiens
ccgaaucucgcugauuugguccggcccuucauggggggccagaagguggcugcugugggcaagga

SEQ ID NO: 651299 - RNA, 65 nt, Homo Sapiens
aagacucggcaaaggggcgaggccccgcggggcuggggccagacaccgagggcacagggacccgg

SEQ ID NO: 651300 - RNA, 65 nt, Homo Sapiens
ccccccaacccccagcugccugcuggccaggcaaggggccagaccaggaauggagaagcugaccc

SEQ ID NO: 651301 - RNA, 65 nt, Homo Sapiens
auauuacugguuaacauuguggagcuauuacugaugggccagacucugugcuaggcacagacuuu

SEQ ID NO: 651302 - RNA, 65 nt, Homo Sapiens
gaugcucuuggacuccccacugcaucugggcugcagggccagagcuagucugaccauuaggucag

SEQ ID NO: 651303 - RNA, 65 nt, Homo Sapiens
auggucacccagagccauagagcacccuuccuccugggccagagcuggguuaucaugguuggcuu

SEQ ID NO: 651304 - RNA, 65 nt, Homo Sapiens
acaguacuggagagagacacacagaucuaagucgggggccagagggagcucccucaacuaggcag

SEQ ID NO: 651305 - RNA, 65 nt, Homo Sapiens
caagggacagugaaacacccugauuacaguggugugggccagaaaaaaauauuuuaauggcagac

SEQ ID NO: 651306 - RNA, 65 nt, Homo Sapiens
cucguugacuggcuguguguaggacccagaggaaggggccagaggcucgcugccagcucuguauc

SEQ ID NO: 651307 - RNA, 65 nt, Homo Sapiens
cucccacaggugggugagugagaagugcacagccugggccagauacagcacgaacugcccgucag

SEQ ID NO: 651308 - RNA, 51 nt, Homo Sapiens; identical to SEQ ID NO: 533529

SEQ ID NO: 651309 - RNA, 65 nt, Homo Sapiens
gucauuccuuccaucuuccuaaaaacaaaaaaaaagggccagaaacaaacucacuccuuuuuaga

SEQ ID NO: 651310 - RNA, 65 nt, Homo Sapiens
agaagagagaggccccuguggucuguucuuugugggggccagauccuaccagcagcaaccaggac

SEQ ID NO: 651311 - RNA, 65 nt, Homo Sapiens
uucuggcuuuuggauuuggugguaauuuggagauggggccagagcuugucagaagggacacaggu

SEQ ID NO: 651312 - RNA, 65 nt, Homo Sapiens
ggacggcguggcgaaagucacaggaggccggugcugggccagagaagugucugcuccucugaggc

SEQ ID NO: 651313 - RNA, 65 nt, Homo Sapiens
ucuggcucaucucuggcauuuccauggagagccuggggccagauauuuccacacccuccucggua

SEQ ID NO: 651314 - RNA, 65 nt, Homo Sapiens
gugggcagagugcaucucggucucuggagcugaaggggccagagauggggauucaguaguccaga

SEQ ID NO: 651315 - RNA, 65 nt, Homo Sapiens
agagugccaggagcuaaugggguuaaggagggagugggccagaccucuugaccuuggaccugcuu

SEQ ID NO: 651316 - RNA, 65 nt, Homo Sapiens
ccucuuucuuucaguuuuuuuguaagcucccccuagggccagaggagcugcucagaacccaagau

SEQ ID NO: 651317 - RNA, 65 nt, Homo Sapiens
cucaaugaauaagugguuccguuuaaauugaaaaugggccagauugcaagcuaaaucauuuaaau

SEQ ID NO: 651318 - RNA, 65 nt, Homo Sapiens
auuuagccuggaucuccucugccagccuuccugaagggccagaaaagguagggagagccagaggu

SEQ ID NO: 651319 - RNA, 65 nt, Homo Sapiens
agacccauugcgauggccgcuccguguuccucggugggccagagcugaaccuugaggggcuaggu

SEQ ID NO: 651320 - RNA, 65 nt, Homo Sapiens
ugaucugccuuacuucacuuuauccucugguuuuagggccagacgccagaagccaugugucaauu

SEQ ID NO: 651321 - RNA, 65 nt, Homo Sapiens
uaagugucaagugggaggauacugcccccuugugggggccagacgggucggacacggcugugccc

SEQ ID NO: 651322 - RNA, 65 nt, Homo Sapiens
ggagaacagccaguagccuugguaauaugaagggugggccagaagaugauuucacuugcaaaaac

SEQ ID NO: 651323 - RNA, 65 nt, Homo Sapiens
caggacacggaagugagagacacuaaagaaggugugggccagacaaggccuuggagcccacacau

SEQ ID NO: 651324 - RNA, 65 nt, Homo Sapiens
ucugagcagggcccaaggcagccaggggccuggaggggccagaggaggguggggucagggccgcc

SEQ ID NO: 651325 - RNA, 65 nt, Homo Sapiens
cugucacugacuuugugcaggccaaggaccuggcagggccagacgcuguaccaucacccaggcca

SEQ ID NO: 651326 - RNA, 56 nt, Homo Sapiens
auaucaucucacagcucugaggcccugggccagauuacuuccuccaccccucccua

SEQ ID NO: 651327 - RNA, 65 nt, Homo Sapiens
ccaugaccccaugucccagcuccccacacagcgcugggccagagaggcauuggugcgagggauug

SEQ ID NO: 651328 - RNA, 65 nt, Homo Sapiens
aggagggagcgugagccucccagagccccaggacugggccagagcacuuagguuucuuuuuccau

SEQ ID NO: 651329 - RNA, 65 nt, Homo Sapiens
cccagggcucagcccugcuguccugagcgucuccugggccagagagaggagaugggggugggagg

SEQ ID NO: 651330 - RNA, 65 nt, Homo Sapiens
ucuccacccccccgggacuguuggggggauucugagggccagagggggauauauaugauucccca

SEQ ID NO: 651331 - RNA, 65 nt, Homo Sapiens
uguccuccagggcgagcacuuuccacuuccagagggggccagagggacuuugccugcccagucuu

SEQ ID NO: 651332 - RNA, 65 nt, Homo Sapiens
cucgugcugggcucugcccugggcagacaggcagagggccagagcagaggacacauggccuugcg

SEQ ID NO: 651333 - RNA, 65 nt, Homo Sapiens
cuccuuucccuuauacuuuuuauuaccuugcucaagggccagagaucucaagugucaaccuugag

SEQ ID NO: 651334 - RNA, 65 nt, Homo Sapiens
agccuaccccaggacaggagccaucccccagccuggggccagaaccaccccugucagucugcucc

SEQ ID NO: 651335 - RNA, 65 nt, Homo Sapiens
uggcagcacugaaugugggcgucuggcugggaggugggccagaccuggggugauuggacaagagg

SEQ ID NO: 651336 - RNA, 65 nt, Homo Sapiens
uucaaaggcaucacuauggauagggccuaaauugggggccagaguaugaaguccaguggaguucu

SEQ ID NO: 651337 - RNA, 65 nt, Homo Sapiens
aggaacagcucgggccacucuuuggcccugaaccagggccagauacccaggaaucucaaacuccc

SEQ ID NO: 651338 - RNA, 65 nt, Homo Sapiens
uguuaagugguuucauaggacuuaaaggauugcaagggccagaucaaacaaccccccaucacaaa

SEQ ID NO: 651339 - RNA, 65 nt, Homo Sapiens
aaaguguuuauaaugcaaugaguuacaugaauuaagggccagaaaaaaugccuauguuuucuuuu

SEQ ID NO: 651340 - RNA, 65 nt, Homo Sapiens
ggcgcuggggccucggcuucgcccugcccaugccugggccagaguaguugcccgcugggccuggg

SEQ ID NO: 651341 - RNA, 55 nt, Homo Sapiens
agagcccgggagggccaggggccccgggccagagagggccucggagcuacuguga

SEQ ID NO: 651342 - RNA, 65 nt, Homo Sapiens
caugcagucccagaaaccccugcuucgugauuccagggccagagccagagaagggcucuccccac

SEQ ID NO: 651343 - RNA, 65 nt, Homo Sapiens
gacucucguucuuucuagauagagcuggugccuucgggccagaaacuccucauugugccuucauc

SEQ ID NO: 651344 - RNA, 65 nt, Homo Sapiens
gugcugggaaggcaguuguuuagaaaugcggugaagggccagacgagaugugugugugacguguu

SEQ ID NO: 651345 - RNA, 65 nt, Homo Sapiens
uuauucccuuucuuaaagaugcagccaguuggugagggccagaugcuucgguuuguugaacuuug

SEQ ID NO: 651346 - RNA, 65 nt, Homo Sapiens
ugggcagaaagacuccagcagcuugaccugaagaagggccagaccucagaagaacauccuucucu

SEQ ID NO: 651347 - RNA, 65 nt, Homo Sapiens
caguuucauagaugggucaggagguggacaaguuggggccagagaugauggcaguccagcagcaa

SEQ ID NO: 651348 - RNA, 65 nt, Homo Sapiens
acauccaagacuggagcagcaggcuggccacgcucgggccagagagagcucacagcugaagcucu

SEQ ID NO: 651349 - RNA, 63 nt, Homo Sapiens
ucaguggcaauggcuucugagaucaggcacccggggccagagacauaugggccauaccccuua

SEQ ID NO: 651350 - RNA, 65 nt, Homo Sapiens
ggaggauaugugggugggugggagggcuggggcaggggccagauagaaauuauugguuuuguuuu

SEQ ID NO: 651351 - RNA, 65 nt, Homo Sapiens
guccccguuacucuuagagaaaggaguuggggugagggccagagcuggcaguggaaacuuguucu

SEQ ID NO: 651352 - RNA, 65 nt, Homo Sapiens
ccguaggaaaaaggaauagcaaucauuaaaaucuugggccagagaacacuauuuuuacauaacag

SEQ ID NO: 651353 - RNA, 65 nt, Homo Sapiens
caaagaggugguuucugaggaagucagagcgcccagggccagagcagucaguaaugggugaauga

SEQ ID NO: 651354 - RNA, 65 nt, Homo Sapiens
uuuccaucucacuggacugcagacccggccugguggggccagagaguccccagcuagggaccugc

SEQ ID NO: 651355 - RNA, 65 nt, Homo Sapiens
uaugacuaaaaccuuaucucggacccccuucuugggggccagagaacuuuuucaaguucacaugg

SEQ ID NO: 651356 - RNA, 65 nt, Homo Sapiens
uucccaaguuggucacaggugaugugguccccaaggggccagaaauugaagggggcaagggcuga

SEQ ID NO: 651357 - RNA, 65 nt, Homo Sapiens
uuccacgucuccaucucaguucugauccuccaucagggccagauccuuucacccaaccugcuccc

SEQ ID NO: 651358 - RNA, 65 nt, Homo Sapiens
uguggagacaugguuuuuguuguuguuuggggcaagggccagaaaguuugcccuugaacuaaaaa

SEQ ID NO: 651359 - RNA, 65 nt, Homo Sapiens
cagccuggggucuggaguugaucagaacucaaauggggccagaucagagcccagcuccaagggga

SEQ ID NO: 651360 - RNA, 65 nt, Homo Sapiens
ugccacaaggacuuccuguccauucacaguucuuugggccagacaggaaagauaacuaggaaauc

SEQ ID NO: 651361 - RNA, 65 nt, Homo Sapiens
caggggggugaggagcugggagagacauacuugaagggccagagcgaagcuccucuccccagccc

SEQ ID NO: 651362 - RNA, 65 nt, Homo Sapiens
cugagcucuggucaccuguuccccggacucggagggggccagagaugcgucaaagcacagaggcu

SEQ ID NO: 651363 - RNA, 65 nt, Homo Sapiens
aaugcugcugcacugccaacugcucuggagagguagggccagaggaacacucacauggcaagagu

SEQ ID NO: 651364 - RNA, 65 nt, Homo Sapiens
uagauauugacagcuauucaccuuucacggugcuggggccagauuagggaucacucccgugagga

SEQ ID NO: 651365 - RNA, 65 nt, Homo Sapiens
gggacuccauggagacagccccuguggggagugcagggccagaugcagcuccugaugaaaucauc

SEQ ID NO: 651366 - RNA, 65 nt, Homo Sapiens
gggacaguggcccugagcccaccccuuccugggaugggccagacaagcaggugcugggaggaggc

SEQ ID NO: 651367 - RNA, 65 nt, Homo Sapiens
aucauggcagugggaccaagcguggucccgaggaagggccagagccugguagagacuagggaagg

SEQ ID NO: 651368 - RNA, 65 nt, Homo Sapiens
uuggcccagggccuccuuccacauuaguagccccagggccagauggagccaaaggucagcucucu

SEQ ID NO: 651369 - RNA, 65 nt, Homo Sapiens
uaacauuguagugucuuucauucauuuuauuuuaggggccagaucaagaaaacauuuguucccug

SEQ ID NO: 651370 - RNA, 65 nt, Homo Sapiens
cagaacccuuggagucaugucuuuugccauaccaagggccagacuuugcacagaauugcaaaugu

SEQ ID NO: 651371 - RNA, 65 nt, Homo Sapiens
ggaagacacuucagaucugaagaauggcugggucagggccagacuaaagggagaaggaagggcag

SEQ ID NO: 651372 - RNA, 65 nt, Homo Sapiens
aggcuucugagcuucuccuguacugugcaucgugagggccagagacaggaauguaaggauuggca

SEQ ID NO: 651373 - RNA, 65 nt, Homo Sapiens
aaagcucaaagguuuggaaggagcagaaaacccuugggccagaaguaccagacuagauggaccug

SEQ ID NO: 651374 - RNA, 65 nt, Homo Sapiens
ccacgcucuucuaauugggagauaauauggaagaagggccagagcaguuacagcccuccuucuuu

SEQ ID NO: 651375 - RNA, 65 nt, Homo Sapiens
aagagaggcuccauuuguggcuauuauguagaacugggccagagccaguccauugccuguuuuuu

SEQ ID NO: 651376 - RNA, 65 nt, Homo Sapiens
guguccccaaccaucccaauagggugggggccugugggccagaggacuccaugacaguagccaug

SEQ ID NO: 651377 - RNA, 58 nt, Homo Sapiens
acaggagaagugcacccuagggccuucugggccagaggcaccaucccuucuggccauc

SEQ ID NO: 651378 - RNA, 65 nt, Homo Sapiens
cuggagcaagucucccagaugauucuaauacaggagggccagaggccaaacuugaagaacugcug

SEQ ID NO: 651379 - RNA, 65 nt, Homo Sapiens
gcaucagcaacaaccagcaucccuugaccaggccugggccagaguauuggucuccucucagcccc

SEQ ID NO: 651380 - RNA, 65 nt, Homo Sapiens
aacaaaguuuuccaggaggccuugcggaacaucgggggccagauucaggagaagguaugugagug

SEQ ID NO: 651381 - RNA, 65 nt, Homo Sapiens
ccagcaccccaccaucccuuugcaggggagucaaagggccagaacuccuugggggaccagaacau

SEQ ID NO: 651382 - RNA, 65 nt, Homo Sapiens
cuuuugaaugauagggaaauugauuccuccaauaugggccagaugccuugcaacucagugugagu

SEQ ID NO: 651383 - RNA, 65 nt, Homo Sapiens
ccgccuuacacacaccccagcagcuuuugaucuuggggccagagggggaagggcccagccacuuc

SEQ ID NO: 651384 - RNA, 65 nt, Homo Sapiens
ggaaggcccuggauucucaccccaggcuggggccagggccagagguggaaauagcaaaaacaagg

SEQ ID NO: 651385 - RNA, 65 nt, Homo Sapiens
agcagaagcucucgauggacggaagcccagcuccagggccagaugugcccuggggcugaucucag

SEQ ID NO: 651386 - RNA, 65 nt, Homo Sapiens
augaacccuucaagaaaacgugaaguagaacgggugggccagaaaugaaaacaggcaaguaaagu

SEQ ID NO: 651387 - RNA, 65 nt, Homo Sapiens
aggaacagcaaggacguugauugguuggggcaggggggccagaguagcugauguaggaguacugg

SEQ ID NO: 651388 - RNA, 55 nt, Homo Sapiens
cuuugguuauggacacauaacuccugggccagaggcuaaaaccccaggaccccug

SEQ ID NO: 651389 - RNA, 65 nt, Homo Sapiens
aaaagaacaaagucuccccaccuuucucggaugcagggccagagugacacagccgaaaaauugca

SEQ ID NO: 651390 - RNA, 65 nt, Homo Sapiens
cagcauagcuacaggaaaagucagcccuugacugagggccagaucaucccuggagugcaccucua

SEQ ID NO: 651391 - RNA, 65 nt, Homo Sapiens
agcaucucagcgccagcucuaccaguucucguuuugggccagaggcagccucugcacucccacgc

SEQ ID NO: 651392 - RNA, 65 nt, Homo Sapiens
cugacuuagccgagguaaggucagugcagcagacagggccagacugggguguggggggcugagcu

SEQ ID NO: 651393 - RNA, 65 nt, Homo Sapiens
gacagcugcauuccagagcaggaggcagggcucuggggccagaauggcuguccuugucguagagc

SEQ ID NO: 651394 - RNA, 65 nt, Homo Sapiens
aaaaagcuccaaaugcagcuuuaaaaaauuaaucugggccagaauuucaaacggccucacuaggc

SEQ ID NO: 651395 - RNA, 65 nt, Homo Sapiens
ccaaucgggagggagagacagagacagagccgauggggccagagcaggcagaacaggcggagcgc

SEQ ID NO: 651396 - RNA, 65 nt, Homo Sapiens
gcaccugcuuggcccugccaccuuccuccaggggagggccagauggcauccuggcuuggggcggg

SEQ ID NO: 651397 - RNA, 65 nt, Homo Sapiens
cacccagggcgaauggggcccagggcagaccuucagggccagagcccuggcggaggagaggcccu

SEQ ID NO: 651398 - RNA, 65 nt, Homo Sapiens
ggcgggcaggaaccggggcugcgcgcagcgcuugcgggccagagugaguuccgggugggcguggg

SEQ ID NO: 651399 - RNA, 65 nt, Homo Sapiens
cugggugauggguagagcccucgaaacuugacauggggccagaagggccuggguugaaguaguaa

SEQ ID NO: 651400 - RNA, 65 nt, Homo Sapiens
ugauuaugagugguucacagcagcccuuauaagcugggccagaaaauuucacuaggucaguaauu

SEQ ID NO: 651401 - RNA, 65 nt, Homo Sapiens
cgggacugucugauugaggacagugacgacgaggcgggccagagcugagcgugaggacgugcuug

SEQ ID NO: 651402 - RNA, 65 nt, Homo Sapiens
auacacuuuggccuuccuuuccccagcgccccugagggccagaggcagaugugggcugcaggcug

SEQ ID NO: 651403 - RNA, 65 nt, Homo Sapiens
gcuacgccccaugucaucacagggccuucaugacagggccagagccagccagcuuugaagacgcg

SEQ ID NO: 651404 - RNA, 65 nt, Homo Sapiens
caccgcaacaagcgggccgccccagccaccuccgagggccagagcaagcgcuguaaacccugacg

SEQ ID NO: 651405 - RNA, 65 nt, Homo Sapiens
ccuggggugcggcccuggcccccuccaccccugcugggccagagcgggugggcagugucaaggcc

SEQ ID NO: 651406 - RNA, 65 nt, Homo Sapiens
ccugccggccucagaggacagcgcaggugcagcgggggccagacuccgccccugccagccaccaa

SEQ ID NO: 651407 - RNA, 58 nt, Homo Sapiens
gacugacaccacagaugacacagccagggggccagaagaggcccuggagcgacacuga

SEQ ID NO: 651408 - RNA, 65 nt, Homo Sapiens
gguguugguuggagguggggaaauucacagcuggugggccagacuucuggggguagaacagaacc

SEQ ID NO: 651409 - RNA, 65 nt, Homo Sapiens
uaucuucacuugucauuguuaauacuacuguguaagggccagaaaggaaucagagaccuuccaga

SEQ ID NO: 651410 - RNA, 65 nt, Homo Sapiens
gagccuucacggacggcgcuccuggcugaccgugagggccagagacccuucggugugaccggcag

SEQ ID NO: 651411 - RNA, 65 nt, Homo Sapiens
cagcccugcccccgggcacugcacagccugucugggggccagaccaccccauuguccauccuugu

SEQ ID NO: 651412 - RNA, 65 nt, Homo Sapiens
cuccagccaguucaagcucagagccagagcuggacgggccagaacugcgcugcacacuuccugga

SEQ ID NO: 651413 - RNA, 65 nt, Homo Sapiens
ucagugugcggacagaggagaccacucugcuccuggggccagaggccauucaauagccugccuuc

SEQ ID NO: 651414 - RNA, 65 nt, Homo Sapiens
ucacugaaccucucaggaucaaugaccccuguaaggggccagagccuuggaggacacuaagagga

SEQ ID NO: 651415 - RNA, 65 nt, Homo Sapiens
uccucacauacgguaaagccaaagagcugucacaugggccagaaacaugagccacggcaggaaga

SEQ ID NO: 651416 - RNA, 65 nt, Homo Sapiens
auccuccuuuccucaugcagcacaagugcucaccggggccagagccagggcauggauaugacaag

SEQ ID NO: 651417 - RNA, 65 nt, Homo Sapiens
aguggccuggcuccgcuguguggauggggagaucggggccagaggcagaacccuggugaggaagc

SEQ ID NO: 651418 - RNA, 63 nt, Homo Sapiens
cucaucaggcccucgacugaaaaguucucaguggggccagacuggcuccuggagcugacaagc

SEQ ID NO: 651419 - RNA, 65 nt, Homo Sapiens
cccugggcagaguaccaggcugcugacccucagcagggccagacaaggcucaguggaucuggucu

SEQ ID NO: 651420 - RNA, 65 nt, Homo Sapiens
ggcuggggcugacccugggcagggacuuuccugcagggccagaccugccugcauucugagacaaa

SEQ ID NO: 651421 - RNA, 65 nt, Homo Sapiens
ucuacaugcaaaucuggcuuaguaaaucgaggugugggccagagauccucugacagcuguccuga

SEQ ID NO: 651422 - RNA, 65 nt, Homo Sapiens
gugagccaguuccagcuggcuccagccauccugcagggccagaccaaagagaagaugguuaccau

SEQ ID NO: 651423 - RNA, 65 nt, Homo Sapiens
gcccuugaguguauuuguucucaguccuaacccuggggccagagauugguccgagguugagaauu

SEQ ID NO: 651424 - RNA, 65 nt, Homo Sapiens
agggcuuccuaggagccagucagcagggugggguggggccagaggagcucuccagcccugccuag

SEQ ID NO: 651425 - RNA, 65 nt, Homo Sapiens
cucauguggccaagcacaucuuugaccacgucaucgggccagaaggcgugcuggcaggcaaggug

SEQ ID NO: 651426 - RNA, 65 nt, Homo Sapiens
uuccagugcucagagggcggggagaaucucagcgugggccagaggcagcucgugugccuggcccg

SEQ ID NO: 651427 - RNA, 65 nt, Homo Sapiens
cauugugaccgaccccacuuccucagaauguaacggggccagagggaaacuucucacaaacuucg

SEQ ID NO: 651428 - RNA, 65 nt, Homo Sapiens
ugcugacaccagaacagcccaaaucagaguucccagggccagacaggcucuuccugggccacaga

SEQ ID NO: 651429 - RNA, 65 nt, Homo Sapiens
ggauucagagguugccugcggaguaccuugucccagggccagacacacccacaccacccacuguc

SEQ ID NO: 651430 - RNA, 65 nt, Homo Sapiens
ggugaagucaggccagggccuuccagcugcucuuggggccagagccaagagccucucaguagagg

SEQ ID NO: 651431 - RNA, 65 nt, Homo Sapiens
gagccaugccagcccuacuggcaauaggaaagccagggccagagcgugggccaggccgggccaca

SEQ ID NO: 651432 - RNA, 65 nt, Homo Sapiens
uaagagugccucucugagucuguaccgagccucuggggccagauacgccucccucucuacgucuc

SEQ ID NO: 651433 - RNA, 65 nt, Homo Sapiens
caaggacaacuuaggggaagaguuccugaaacccagggccagagaaggcuuccuuaccaagaaug

SEQ ID NO: 651434 - RNA, 65 nt, Homo Sapiens
uagggcugcugcuucugcucccuauacagaacagagggccagagcuccccagaccaacccuggga

SEQ ID NO: 651435 - RNA, 65 nt, Homo Sapiens
ccauagccucuuagauuccucuaucagagagagaagggccagaccggguucugggaaagcaacag

SEQ ID NO: 651436 - RNA, 65 nt, Homo Sapiens
uagguuuuagagauccuacagcagacagaaaguuggggccagagcgaggcugagaaaccuccagg

SEQ ID NO: 651437 - RNA, 65 nt, Homo Sapiens
ggcaacaagagagcaagacccacugaucaggcucagggccagagauaaugcugaguucugucuca

SEQ ID NO: 651438 - RNA, 65 nt, Homo Sapiens
ccccucucuaguccccuuuuccacuugucgccuuagggccagauuuguucaauugccuuguguaa

SEQ ID NO: 651439 - RNA, 65 nt, Homo Sapiens
caaaccgcaggcaaacggguggcugccuuaugggugggccagauccggucauucuacacugagga

SEQ ID NO: 651440 - RNA, 65 nt, Homo Sapiens
gagccgagugugccaacaagcccagcaucccagcugggccagagagcccagcaacccugccccuc

SEQ ID NO: 651441 - RNA, 65 nt, Homo Sapiens
aaaaaaaacuauugauaaguuuccuaaaagaaacagggccagagguugggaauuaggaaccuuau

SEQ ID NO: 651442 - RNA, 65 nt, Homo Sapiens
gacugcucacccacuuccacgugcccauucacugagggccagaaucacacucucccucaucuuuc

SEQ ID NO: 651443 - RNA, 65 nt, Homo Sapiens
ugucuuuauuguccaccaugacaugccaugccuaugggccagagugugugugugugugcacaucu

SEQ ID NO: 651444 - RNA, 65 nt, Homo Sapiens
cauccugcugucccggguggcaguguggcucugcugggccagagguguuggacuuagaccuccuu

SEQ ID NO: 651445 - RNA, 65 nt, Homo Sapiens
gcauccaucccugcuguuugcuggcccuuaccccagggccagacaagaggggauggcugaggaca

SEQ ID NO: 651446 - RNA, 65 nt, Homo Sapiens
guccaggcaucccaaguccacuucccgugugagaagggccagaggcauucagggagaaaccucuc

SEQ ID NO: 651447 - RNA, 65 nt, Homo Sapiens
ggugagagauuuuggccuuuuuuauuggauaaauugggccagaaaggcaggguagauuucgaagc

SEQ ID NO: 651448 - RNA, 65 nt, Homo Sapiens
gagagacaccagcucucagggcagagauuggcuuggggccagaaggacccuccccaacccuggag

SEQ ID NO: 651449 - RNA, 65 nt, Homo Sapiens
gcucuccaguaauugucuuuucauuuugaugguaggggccagacugaaugaauaaugcauucuuu

SEQ ID NO: 651450 - RNA, 65 nt, Homo Sapiens
cuagcagaauagcaagcagaguaucauucaugcuggggccagaaugauggccgguugccagauau

SEQ ID NO: 651451 - RNA, 65 nt, Homo Sapiens
uauuccuuguuagaauugcuaucaguuuugccaaggggccagaauuuuacuuuguuuuaaaacug

SEQ ID NO: 651452 - RNA, 65 nt, Homo Sapiens
cuguggcagcgggaguucccggcccuccacacccggggccagacccucggggccaugccuuggug

SEQ ID NO: 651453 - RNA, 65 nt, Homo Sapiens
gaccgcagcgcgcagccacaugcccuggcugccaugggccagaccgccuccaccucccccgcccg

SEQ ID NO: 651454 - RNA, 65 nt, Homo Sapiens
gugcgaggcccucggggcccacccacagcggcccagggccagacccuggcuggaagccagaacgc

SEQ ID NO: 651455 - RNA, 65 nt, Homo Sapiens
ugagagcugggccuccucuccagaaucauguggaggggccagaggccugccagacccccagcugg

SEQ ID NO: 651456 - RNA, 65 nt, Homo Sapiens
cccucaugcuuccugucccccgcuuacacgacaacgggccagaccacaggaaggacgguguuugu

SEQ ID NO: 651457 - RNA, 65 nt, Homo Sapiens
cuguccuccuaaaguggccccuguucccaucucccgggccagacagcuguccccccguccuccuc

SEQ ID NO: 651458 - RNA, 65 nt, Homo Sapiens
uuaccugagaucugggaugcugaguggcuguuugggggccagagaaacacacacucaacugccca

SEQ ID NO: 651459 - RNA, 65 nt, Homo Sapiens
uucccccucuucaggugucagugcggagaggcucugggccagaccucacccccagugacuuccga

SEQ ID NO: 651460 - RNA, 65 nt, Homo Sapiens
ugagcgcuguggggagcgcgugucaggcccugucugggccagaacccgggacugcaggcggcgga

SEQ ID NO: 651461 - RNA, 65 nt, Homo Sapiens
ccuguguccuugcuuggcuguggagagacagauuugggccagacuaucugccccagccuccaacu

SEQ ID NO: 651462 - RNA, 65 nt, Homo Sapiens
acccaaaacuccucaggacuccugugaaauaggcagggccagaucaggaagggugaaagagaaag

SEQ ID NO: 651463 - RNA, 65 nt, Homo Sapiens
uucccacaguaaaucuccccggggaggaaggggccgggccagacgggcggccagcggcgcccgga

SEQ ID NO: 651464 - RNA, 65 nt, Homo Sapiens
uguaauguuuuggcugagugugacauggauuuugggggccagaggugaauauauuuuacauguga

SEQ ID NO: 651465 - RNA, 65 nt, Homo Sapiens
acacccuaaagcaggcugaugucaguugugaagaggggccagaugauucacccccauccacaguu

SEQ ID NO: 651466 - RNA, 65 nt, Homo Sapiens
uccugggugccuccuacuagggaacuucucauugugggccagaagaaccagacuuccaguucuca

SEQ ID NO: 651467 - RNA, 65 nt, Homo Sapiens
aacagcucgagggagaaccugaccccacagcaccugggccagaccucuagucacuggccucaaag

SEQ ID NO: 651468 - RNA, 65 nt, Homo Sapiens
uaggguggggggcgagggugaguugcccacacugggggccagagccgagggugggcugaggcuga

SEQ ID NO: 651469 - RNA, 65 nt, Homo Sapiens
ugagggcccagaggucugggccuggaucucuguaagggccagaagagggauggggguguuggaug

SEQ ID NO: 651470 - RNA, 65 nt, Homo Sapiens
cgggaccaggaaggaacugaugccagaggggaccagggccagagacgagccaagcagggggacgu

SEQ ID NO: 651471 - RNA, 65 nt, Homo Sapiens
aagagauucuccuuccaggccuaagccugggauuugggccagagauaagaauccaaacuaugagg

SEQ ID NO: 651472 - RNA, 65 nt, Homo Sapiens
cggccagacguggcuucuccugaguucuagggcucgggccagaguggcacuacugcccggccagu

SEQ ID NO: 651473 - RNA, 65 nt, Homo Sapiens
gagauuuugcguuugacauugugucugggaaggaagggccagaccuuggaaccuuuggaaccugc

SEQ ID NO: 651474 - RNA, 65 nt, Homo Sapiens
ccgcucucugcagcguggauuuccuuugcccauuugggccagaaggucaccaggaguucaucacu

SEQ ID NO: 651475 - RNA, 65 nt, Homo Sapiens
aagaauagccagcggagcauggacuguuccagcacgggccagauggccagcugucgagagcagcc

SEQ ID NO: 651476 - RNA, 65 nt, Homo Sapiens
ugcuucuuugaaggaguaaauguguuuuguuccuagggccagaggagcuugucuuccuuguccuc

SEQ ID NO: 651477 - RNA, 65 nt, Homo Sapiens
ccuugcuagccaaaaucucuuaaauacacguaggugggccagagaacauuggaagaaucaagaga

SEQ ID NO: 651478 - RNA, 65 nt, Homo Sapiens
ucacccaugcuaggguccccaaagcacuggggcaggggccagagcagcagcacccagugcucccu

SEQ ID NO: 651479 - RNA, 65 nt, Homo Sapiens
uaaguggggaggagggucagcuaagagaagugggagggccagagcuuuuugguucugauuuacaa

SEQ ID NO: 651480 - RNA, 65 nt, Homo Sapiens
uccacaaaucuauauuaaagguauucuggcugcaagggccagaguuauuuauggcuuauaaaugu

SEQ ID NO: 651481 - RNA, 65 nt, Homo Sapiens
aacaugaaugcaggcagauugcuagggguugagaggggccagaaagaaagaacagagaagugaca

SEQ ID NO: 651482 - RNA, 65 nt, Homo Sapiens
cugggccaagcccuccagccccucagggggcuguggggccagaagcuggcacagggcugcaugga

SEQ ID NO: 651483 - RNA, 65 nt, Homo Sapiens
ggaugcuuagcaaacccaaugaugccccagaucaggggccagaggggucucagggggaccccagg

SEQ ID NO: 651484 - RNA, 65 nt, Homo Sapiens
cccccucaucggcccgcagccuccaggugcagggcgggccagaagacuccaggugcagggcgggc

SEQ ID NO: 651485 - RNA, 65 nt, Homo Sapiens
uccccagagccuccgccuguggcugugaugaccuugggccagaaggucaaacuccgaagacugaa

SEQ ID NO: 651486 - RNA, 65 nt, Homo Sapiens
gcauggguggucccugcuucgauggccccaaagcugggccagaguuaagggaaagaggaggaagu

SEQ ID NO: 651487 - RNA, 65 nt, Homo Sapiens
ccgugggugaaguccuggggucagggggugggguggggccagaaggccugauagaagggucaggg

SEQ ID NO: 651488 - RNA, 65 nt, Homo Sapiens
uuucaggcaucugagucggcguuuacccaggggccgggccagagacgggggucggccgcucgcuc

SEQ ID NO: 651489 - RNA, 65 nt, Homo Sapiens
aacugucuuucuguagguugguuccuguauaccuugggccagagagcaaacauagguggccugag

SEQ ID NO: 651490 - RNA, 65 nt, Homo Sapiens
ggcacaaggcacucgugcccaaaggggcugugcuggggccagacucauaccaggagucacuggag

SEQ ID NO: 651491 - RNA, 65 nt, Homo Sapiens
cuguugaccauaccaggaguucggggcccaggccugggccagaagagcagaggacuccagccuuc

SEQ ID NO: 651492 - RNA, 65 nt, Homo Sapiens
aaacaacugcucaacaaagguagccaaggcugugagggccagaauuccccagggccuuuguggac

SEQ ID NO: 651493 - RNA, 65 nt, Homo Sapiens
ccaggaaggugggguagacugcggggggccuggcugggccagacccccggacacccauagacggu

SEQ ID NO: 651494 - RNA, 65 nt, Homo Sapiens
ggcuaggaucccaaaggacugguugggacuuaggugggccagaggugugccuuugcugccccuua

SEQ ID NO: 651495 - RNA, 65 nt, Homo Sapiens
ucauguugacccuggggaugccaguggcggggacagggccagauuaacgcaggccuggggagccc

SEQ ID NO: 651496 - RNA, 65 nt, Homo Sapiens
uuucuaugaaucuauuuuuccaggcccccggggaggggccagaguagauguugaggcgagcaggg

SEQ ID NO: 651497 - RNA, 65 nt, Homo Sapiens
ggagccccaggacccauuaacuccugccuuccugagggccagaggugcaucccaagccccucaug

SEQ ID NO: 651498 - RNA, 65 nt, Homo Sapiens
uucagcccuucuuuagcucaugucccucccaccaugggccagagccucagcugcuucagggaaug

SEQ ID NO: 651499 - RNA, 65 nt, Homo Sapiens
cuguguggacaaccguccccaagcccacccagauggggccagaguuggcccaggacgccugcugc

SEQ ID NO: 651500 - RNA, 65 nt, Homo Sapiens
ugagccuggacuugaccaauggacuugggaguugggggccagagugggaaaugaguugagaccau

SEQ ID NO: 651501 - RNA, 65 nt, Homo Sapiens
cacgaggcagccaggcagggccuaccuacccagcugggccagaggggggagcagcuaugcaaauc

SEQ ID NO: 651502 - RNA, 65 nt, Homo Sapiens
caggguccccaaaguccugggaguaacaaguggcagggccagaacacauguggaauaaaguaaua

SEQ ID NO: 651503 - RNA, 65 nt, Homo Sapiens
ggcgggucuauguucacguccugaugcccagagcggggccagagcagagagagcggaaggagcag

SEQ ID NO: 651504 - RNA, 65 nt, Homo Sapiens
uuggacugauucuccauuuuaucaccugaaggcuugggccagagcucaacagcuacucaacugga

SEQ ID NO: 651505 - RNA, 65 nt, Homo Sapiens
agcauacuccaguuuacuaauacagcaggguaacugggccagauguucuuucuacagaagaauau

SEQ ID NO: 651506 - RNA, 58 nt, Homo Sapiens
gccugacaggguaugugugaagaaccaggggccagagcugggggguggcugggucugu

SEQ ID NO: 651507 - RNA, 65 nt, Homo Sapiens
acuuaaaucaggggucagcaaacuuuuucuguaaagggccagacgggaaauauuuugggcuuugc

SEQ ID NO: 651508 - RNA, 65 nt, Homo Sapiens
gccuaaggacacacaaauuugguugggaguugauggggccagaugagccagcauuccagcucuuu

SEQ ID NO: 651509 - RNA, 65 nt, Homo Sapiens
aagucagaacaaagaaaaugcuuauuccccacucagggccagagauucaaugaaauaaaaaugaa

SEQ ID NO: 651510 - RNA, 65 nt, Homo Sapiens
gcuuuuaauugaaauuguuaauuucucuuucuucagggccagacagaccagcuauauccaggauc

SEQ ID NO: 651511 - RNA, 65 nt, Homo Sapiens
uagaggggugggugcguaagacagccuuuuuuccugggccagaaguaucaaaggaaaugagaaug

SEQ ID NO: 651512 - RNA, 65 nt, Homo Sapiens
uaggaggagguuuugaagaaaaaauggagggggaggggccagaaaucucuagccuggagaagagc

SEQ ID NO: 651513 - RNA, 65 nt, Homo Sapiens
ccuaacagguuuuucuccguagauuucaggcaagagggccagauagagugguugguaaaaucaau

SEQ ID NO: 651514 - RNA, 65 nt, Homo Sapiens
accacacauuucacugucugcucgaugcagacagggggccagaacauggcaauguuuugcuuuug

SEQ ID NO: 651515 - RNA, 65 nt, Homo Sapiens
uagcuuugcacuuuucuaaauugaagaccuaaccagggccagaaguaccgacaagcacagucagg

SEQ ID NO: 651516 - RNA, 67 nt, Homo Sapiens
auucaccaagcauuuuaggauuugacuuuuucacuaaccaguugacgagcagugcauuuacaaggca

SEQ ID NO: 651517 - RNA, 67 nt, Homo Sapiens
aauauuuguauagaauagaauuuauguaaacuaguaaccaguugaucucugugccaaauacauuaua

SEQ ID NO: 651518 - RNA, 67 nt, Homo Sapiens
uguccuaauuccuuucucacucaccgaugcugaauacccaguugaaucaaacugucaaccuaccaaa

SEQ ID NO: 651519 - RNA, 67 nt, Homo Sapiens
cgaaggucaacacacaauuccugcccuuaaggaauguccaguugaauuggagaguugaugacagaca

SEQ ID NO: 651520 - RNA, 67 nt, Homo Sapiens
caaaccaggagcuacuacuguguaaauagguuacaccccaguugaaaucuuugcaaaggucgguucu

SEQ ID NO: 651521 - RNA, 67 nt, Homo Sapiens
ucaggagcgagacuucaaggacucaguuugguuccacccaguugaaagacacccagugcacacccaa

SEQ ID NO: 651522 - RNA, 67 nt, Homo Sapiens
uauugaguguuauggaggacacagagguagcagaaucccaguugaaaauguuuugauauuuuauugu

SEQ ID NO: 651523 - RNA, 67 nt, Homo Sapiens
uuugcaaauucaaaauauaguuugguaauuuuuuuuuccaguugauuuuuaaaaagaacugcuguac

SEQ ID NO: 651524 - RNA, 67 nt, Homo Sapiens
acccaugccagcucagaguuuagguguacacauuuacccaguugagcguucuuagaauaacuacugc

SEQ ID NO: 651525 - RNA, 67 nt, Homo Sapiens
agcggcguguccccucugcagaccgaccgcggcugccccaguugaugccugccgcccgccaccggcc

SEQ ID NO: 651526 - RNA, 67 nt, Homo Sapiens
caguagcuguguccucugagaagcuuuccgaauccucccaguugaggcaaugccuucugaccuucug

SEQ ID NO: 651527 - RNA, 67 nt, Homo Sapiens
auggucccuuacagcuucccugguucuccucuuaaggccaguugaagggauucucccaucagccauc

SEQ ID NO: 651528 - RNA, 67 nt, Homo Sapiens
aaaugcagaaacccuucuguggaccaguguugccacaccaguugauagccuggacugacacccagug

SEQ ID NO: 651529 - RNA, 67 nt, Homo Sapiens
aaacaaacuugcuaaucacugaaagguuuaagagaauccaguugagaaccuuucugugcagugaagg

SEQ ID NO: 651530 - RNA, 67 nt, Homo Sapiens
ccucaggaccacggcaugauguucaucauaaaucuguccaguugaggucauucuuauaucuucauua

SEQ ID NO: 651531 - RNA, 67 nt, Homo Sapiens
uguauuaacacaccuuccacgaucugaccuuuuuuuuccaguugaaauccuaacaacauuuucgggg

SEQ ID NO: 651532 - RNA, 67 nt, Homo Sapiens
acuguaugccaaaauuaguuguuguuucuaauauuguccaguugaaaauuugcauucggaaauccau

SEQ ID NO: 651533 - RNA, 67 nt, Homo Sapiens
aauauuacaagcucuuguagaagagacaguuggaauaccaguugacugaaaagugcccuuuccccuu

SEQ ID NO: 651534 - RNA, 59 nt, Homo Sapiens
gaaagaugaggcuaggcucuuaagccuucccaguugacuuugggcuggauucccucuga

SEQ ID NO: 651535 - RNA, 67 nt, Homo Sapiens
gucauauccaggaaaaaaugccucccucugaucauuuccaguugauuccuggucaacaucaacaacc

SEQ ID NO: 651536 - RNA, 67 nt, Homo Sapiens
ugaagcacgucguuagaacgaccuugcuucauaguaaccaguugagagauuggggccaaacauuuac

SEQ ID NO: 651537 - RNA, 67 nt, Homo Sapiens
uaaccaccucauuuuuuacacccagucccccuucaacccaguugaugacaaggaauuucugggauua

SEQ ID NO: 651538 - RNA, 67 nt, Homo Sapiens
cuuuagaaagggagauuccaaacucccauuugguaaaccaguugauuauuuggaaauguucacugcc

SEQ ID NO: 651539 - RNA, 67 nt, Homo Sapiens
gggaaaggaaagaauucacuagaaauuuguuuaggguccaguugauuuguguauuuuuguuaucauu

SEQ ID NO: 651540 - RNA, 67 nt, Homo Sapiens
ucaggaagaaggcuuccuaggggacuggcgauuuaaaccaguugagaaacacugccaucagcaggca

SEQ ID NO: 651541 - RNA, 67 nt, Homo Sapiens
accaguguuacccugagccccgcaggccaacccauccccaguugagccuuauagggucaguagcucu

SEQ ID NO: 651542 - RNA, 67 nt, Homo Sapiens
aagaguuaucuuacguucugcuauauuuguauuugggccaguugauuguagguuguccaacauuuuu

SEQ ID NO: 651543 - RNA, 67 nt, Homo Sapiens
uaguacauacucaguacucuccuucaauugcugaaccccaguugaccauuuuaccaagacuuuagau

SEQ ID NO: 651544 - RNA, 67 nt, Homo Sapiens
guuuaauaguaagggagauaacacagcauguguagcaccaguugauaauuggucucuaguagcuuac

SEQ ID NO: 651545 - RNA, 67 nt, Homo Sapiens
aauauauuugaauuucuguuuuagauuguaucgggucccaguugauucauguguacaaaguuaugcu

SEQ ID NO: 651546 - RNA, 67 nt, Homo Sapiens
uagcgauuaccauaauuuugcucauugaaggcuaucuccaguugaucauugggaugagcaucuuugu

SEQ ID NO: 651547 - RNA, 67 nt, Homo Sapiens
aacuaccuuguucgguugauacuuaguaacuccguggccaguugaagcgcuggauguuuccuagaac

SEQ ID NO: 651548 - RNA, 67 nt, Homo Sapiens
auagagcauuugcagagccucuacacuuggguggagaccaguugacccuuaccacgacguuucuguu

SEQ ID NO: 651549 - RNA, 67 nt, Homo Sapiens
gguuugagucuccugcuuguaagcauccauuuaccguccaguugacagaagucuggaaguauucuga

SEQ ID NO: 651550 - RNA, 67 nt, Homo Sapiens
uuauggaaucuaccaacuguagggcuauacaugguagccaguugaauuaaccaccuaccuuacagug

SEQ ID NO: 651551 - RNA, 67 nt, Homo Sapiens
uuaguggaaaucugaacauuauucugauuauugaguuccaguugaaguuuaacuaaauuuuaaagcc

SEQ ID NO: 651552 - RNA, 67 nt, Homo Sapiens
uuucuaagucugugauccccaaauuguaggccaaaguccaguugaacuucacuaagaguaaacuggg

SEQ ID NO: 651553 - RNA, 67 nt, Homo Sapiens
aacacuaagguuauggugaaguucccacgaacaaguuccaguugagauuccucaaacacaaaucagu

SEQ ID NO: 651554 - RNA, 67 nt, Homo Sapiens
cucucaaaugaggggcuacucuggaaaguauaguuggccaguugagucuucaguucuccagguccac

SEQ ID NO: 651555 - RNA, 67 nt, Homo Sapiens
auuucaacuaauguguauuaaaaaaagccuacauucuccaguugauuagacucuuucaaaaaaaaaa

SEQ ID NO: 651556 - RNA, 67 nt, Homo Sapiens
gggcaaccucuggcuacaggggccauugggugcccucccaguugagaggggccgcuguuucgccuug

SEQ ID NO: 651557 - RNA, 67 nt, Homo Sapiens
uaccaauuuauuuuggccguggguuuuugcuuuuuuuccaguugaugacuuugugaacauucccagg

SEQ ID NO: 651558 - RNA, 67 nt, Homo Sapiens
guuugcauguuuguuugcuuguugaauuuuugaacagccaguugaccaaucauagaaaguauuacuu

SEQ ID NO: 651559 - RNA, 67 nt, Homo Sapiens
uuuguuuuuuauaguuuaaaauugauccuuugggaauccaguugaaguucccaaauacuuuauaaga

SEQ ID NO: 651560 - RNA, 67 nt, Homo Sapiens
ucuuggauagauucuuuaaggcauuccacuuagcuugccaguugagacaaucaccacaguuauuacc

SEQ ID NO: 651561 - RNA, 67 nt, Homo Sapiens
cauggcaucccagagcaaggacacaggagcccacaggccaguugagguugggcaaggagacuuccag

SEQ ID NO: 651562 - RNA, 67 nt, Homo Sapiens
cuggguaugagggguacagaacuagccuuagucaucuccaguugaggauguggccucaagugcacag

SEQ ID NO: 651563 - RNA, 67 nt, Homo Sapiens
uuaguacuguacaaugguauauugcuuaaaucuagaaccaguugagauuccuaauuuuuucaaacua

SEQ ID NO: 651564 - RNA, 67 nt, Homo Sapiens
aguugagagagugcaggcugcccccaaccccgaacccccaguugaggcuacugcaacuaacuguugc

SEQ ID NO: 651565 - RNA, 67 nt, Homo Sapiens
gccuuguuagcaugggcagcuuccaccuuugcagggcccaguugaugggguggcuauccgccaggcc

SEQ ID NO: 651566 - RNA, 67 nt, Homo Sapiens
gagggugguagaaaucuauuuaugggauggguagguuccaguugaaauuuucucaaauaugccauca

SEQ ID NO: 651567 - RNA, 67 nt, Homo Sapiens
agaacugaucuuauuggucuacuccaaccagccaggaccaguugaucgccucacagaucuuugcaac

SEQ ID NO: 651568 - RNA, 67 nt, Homo Sapiens
uuuguauuuuugauagagacggcgugcaccaccacgcccaguugauucccaaguagcugggauuaca

SEQ ID NO: 651569 - RNA, 67 nt, Homo Sapiens
uuuuaauucauccuuaguacggugggaagagagcaaaccaguugauuaaugcagucaucccuuuuca

SEQ ID NO: 651570 - RNA, 67 nt, Homo Sapiens
guacguagccacaggagcccuuaaacucuuuuuggguccaguugauuaugaguuaauuguuuuauuu

SEQ ID NO: 651571 - RNA, 67 nt, Homo Sapiens
auuuccaaaugagggaaaaguccuuggcucguuugauccaguugaguugaaaggguugccuuggcag

SEQ ID NO: 651572 - RNA, 67 nt, Homo Sapiens
caaaagaaaccauuagaaauuaauaacuguggcucuuccaguugaaauaggaauuggagagaaagga

SEQ ID NO: 651573 - RNA, 67 nt, Homo Sapiens
gggagaggacauuaagugaaacaguugacagacaucaccaguugacuucugcauuaaccugcaugau

SEQ ID NO: 651574 - RNA, 67 nt, Homo Sapiens
auuuuuuauauauauguuuuuauuuuuaaaaaacauaccaguugaaugggguuaaagcuuucaauau

SEQ ID NO: 651575 - RNA, 67 nt, Homo Sapiens
uggacaguauuauauguacaauauaucacuauaaaauccaguugaccugaaugaagaauguuuguuu

SEQ ID NO: 651576 - RNA, 67 nt, Homo Sapiens
gccaggguauuugggaaggggaccauguuagcugaugccaguugaagauucaggggugcacacaugg

SEQ ID NO: 651577 - RNA, 67 nt, Homo Sapiens
uuuaauauauuugauuggaauauuuauaacccucaagccaguugauuuauuacuaucccauuguaau

SEQ ID NO: 651578 - RNA, 67 nt, Homo Sapiens
uucaucaugcuuaaggccauuguucuucuaccacccaccaguugaauuuaaaggcuaugauugucuu

SEQ ID NO: 651579 - RNA, 67 nt, Homo Sapiens
gcaugaaguuguugccaguucauaauuuaucuguucuccaguugaagaauucaauuacgggaacuac

SEQ ID NO: 651580 - RNA, 67 nt, Homo Sapiens
uggugaucagugcaauugaccuucucccucacuccugccaguugaaaauggauuuuuaaauuauacu

SEQ ID NO: 651581 - RNA, 67 nt, Homo Sapiens
ucauccugcaacagaagcauucucuaggucccaguuuccaguugauugcauauccuugaucagcccu

SEQ ID NO: 651582 - RNA, 67 nt, Homo Sapiens
ccuguuaaauuuuuaauggcuaauagcccagugccauccaguugaaaaaacaacagcaaucacaaag

SEQ ID NO: 651583 - RNA, 67 nt, Homo Sapiens
cuauuaucugaccagcggaggcagaaaagagaggaacccaguugaauaggauccaaucccugguuag

SEQ ID NO: 651584 - RNA, 67 nt, Homo Sapiens
cauucagaaaacuucaagacaucaccaucagcaggcuccaguugaacacuagucuguguaacuuuaa

SEQ ID NO: 651585 - RNA, 67 nt, Homo Sapiens
uggaguuauaggauuuucacugacucaggauauuaggccaguugaagcuauucuucugaccaucuag

SEQ ID NO: 651586 - RNA, 67 nt, Homo Sapiens
uuacccuaagccccuguguuaguucccaggaauuuguccaguugauacuguggcaagcuauguccgc

SEQ ID NO: 651587 - RNA, 67 nt, Homo Sapiens
agggaagcauuauguuuacagucuuuucaaagugcugccaguugaaauuguauugucuuauuguauu

SEQ ID NO: 651588 - RNA, 67 nt, Homo Sapiens
uuuaggucugucaucuuaauuauucuaacucauuaacccaguugaaacuaaauuugggaaacagauc

SEQ ID NO: 651589 - RNA, 67 nt, Homo Sapiens
aaaaucaaaauuuuuugccucuagcgaggcauacuuuccaguugaaagaggaacagcauagccaagg

SEQ ID NO: 651590 - RNA, 67 nt, Homo Sapiens
ccuguccgcagaucaaccagaacauaaaugaaucaucccaguugagcgaggaucagagaccaugugg

SEQ ID NO: 651591 - RNA, 67 nt, Homo Sapiens
ucucagccuccuucaacauucuaugccuccuauaaguccaguugaaaggagccccuccugcauccac

SEQ ID NO: 651592 - RNA, 67 nt, Homo Sapiens
auuuagauagaacuuuuuuuuggauacagcacaaacuccaguugacaguaaaaugaagcuucuaggu

SEQ ID NO: 651593 - RNA, 67 nt, Homo Sapiens
acucccauucccccguccccaauguguuugugaguuuccaguugauuuguagcaaaugccuacuuag

SEQ ID NO: 651594 - RNA, 67 nt, Homo Sapiens
aaccaaccauagaauguuucaguucuaggaaauaaaaccaguugauuaaagcaaauuuucuccggcc

SEQ ID NO: 651595 - RNA, 67 nt, Homo Sapiens
acaaaacaugugcugacugcacucuggcgacccuuuuccaguugauguuuuuugucaugugacuguu

SEQ ID NO: 651596 - RNA, 67 nt, Homo Sapiens
aaauggcagaaaagcaguuauagauaaaugaauucaaccaguugaucaaaaauaaguaacccaaugg

SEQ ID NO: 651597 - RNA, 67 nt, Homo Sapiens
aaagaacaaaacacaugcaucuaaacugcugggcaauccaguugacuuuuaaauguaagaauggaau

SEQ ID NO: 651598 - RNA, 67 nt, Homo Sapiens
ccguuaagugaacuauuauaauauuuuugcugacuacccaguugaagaaaaguuuguuaauuggaug

SEQ ID NO: 651599 - RNA, 67 nt, Homo Sapiens
aauaaaauaaauaacauaaaucguugaacauaauguuccaguugaaugcaaaacaaaaaaaauaugg

SEQ ID NO: 651600 - RNA, 67 nt, Homo Sapiens
aauauuuauauuguauauaaaugguuggcagcuuauuccaguugaucucuucacaucugccuuaaaa

SEQ ID NO: 651601 - RNA, 67 nt, Homo Sapiens
aaaagugcacaccuuaaaaauguacacugacuugagaccaguugaauggaggcagccagggcuuacc

SEQ ID NO: 651602 - RNA, 67 nt, Homo Sapiens
uaggaugcucuauuacuaaucuaaacuuauuuuuaagccaguugauuacuguuucuuuugugagaga

SEQ ID NO: 651603 - RNA, 67 nt, Homo Sapiens
auaccagcuuugguuggacaauggacagaaauuauggccaguugaaacuucaguccauccauguuag

SEQ ID NO: 651604 - RNA, 67 nt, Homo Sapiens
aauggcccauucaugccaacauggagacaucccacccccaguugaauaauuugagcacaguccagaa

SEQ ID NO: 651605 - RNA, 67 nt, Homo Sapiens
uucccagaguuuacucauucuuguuauuaaacucuagccaguugacaucuucgcaauuucaaggacu

SEQ ID NO: 651606 - RNA, 67 nt, Homo Sapiens
uccagucuacccugguguuaaacaagcuaauaugcuuccaguugacuuguucugacaguuguguggu

SEQ ID NO: 651607 - RNA, 67 nt, Homo Sapiens
ugcuggguugugacuggcagaaacagagcaugaggaaccaguugacacacaugugaauuuccacacc

SEQ ID NO: 651608 - RNA, 67 nt, Homo Sapiens
aagagauucuguuuaggaagaaacucacucucuuuugccaguugaauuuauagagcauuuuuuuucu

SEQ ID NO: 651609 - RNA, 67 nt, Homo Sapiens
agauuaguuuuucucaguaaaucuuuuuguuuuccagccaguugaaucuuacugaugcacugggccu

SEQ ID NO: 651610 - RNA, 67 nt, Homo Sapiens
cucccacccacagggcugucucacaggugcucccaccccaguugagguccuguuccaccucagguuu

SEQ ID NO: 651611 - RNA, 67 nt, Homo Sapiens
cagcgacaacagcaccagagccauccccaguucuuagccaguugagcacuucaaaucucaaccugag

SEQ ID NO: 651612 - RNA, 67 nt, Homo Sapiens
gcuccgaguuugggccaguuagcucccagauuuuggaccaguugaaacaaaaauggcaaacaucacc

SEQ ID NO: 651613 - RNA, 67 nt, Homo Sapiens
auuaugugagcaaaauuuaaccucuucugugucuuucccaguugaacaauacacgcagcaaaauucu

SEQ ID NO: 651614 - RNA, 67 nt, Homo Sapiens
cauugaggauccaaguugaguuauuguguaagauaaaccaguugaauucuugaaacugaccaaacgc

SEQ ID NO: 651615 - RNA, 67 nt, Homo Sapiens
cuguacuuuguuuuucagguaaagaaggaaaauucagccaguugauuuuguuuuuagcuuacugcug

SEQ ID NO: 651616 - RNA, 67 nt, Homo Sapiens
agaauccacaaauuaaacugaguccuucacuggcaugccaguugacuauuauuagcugucauaagua

SEQ ID NO: 651617 - RNA, 67 nt, Homo Sapiens
uuacccuauacauccacaggguuuugacacuuguuguccaguugaaaaaagguuguguagcuguguc

SEQ ID NO: 651618 - RNA, 67 nt, Homo Sapiens
caaugcuugaagaguuuuuggcaaguaaauuuuuuuuccaguugaacucugucacuuguuagagauu

SEQ ID NO: 651619 - RNA, 67 nt, Homo Sapiens
agaucggggcgaccccugcagauguggagccauuagcccaguugaggauauucuccaaguuguccuc

SEQ ID NO: 651620 - RNA, 67 nt, Homo Sapiens
ccaaaaugacguucuaaccugaagcugcuggcuguuuccaguugaacaacucaugaaaucugcucug

SEQ ID NO: 651621 - RNA, 67 nt, Homo Sapiens
ucccaagaccaggacccacuuguauccuuucggcuucccaguugagcggggcauauaaaaucucugc

SEQ ID NO: 651622 - RNA, 67 nt, Homo Sapiens
ucccaagaccaggacccacuuguguccuuucggcuucccaguugagcgggggccugcccuucucugc

SEQ ID NO: 651623 - RNA, 67 nt, Homo Sapiens
cuggacuuucacuaacccucugacauacuccccacacccaguugauggcuuuccguaauaaaaagau

SEQ ID NO: 651624 - RNA, 67 nt, Homo Sapiens
aguuuuuuuggucuguucucccacuugauugaccucaccaguugagacaccuaguguauggcucaug

SEQ ID NO: 651625 - RNA, 67 nt, Homo Sapiens
ucuaccuguuuuaguugugaagguaguuuuguguaauccaguugauugcuccucuggcagagagaag

SEQ ID NO: 651626 - RNA, 67 nt, Homo Sapiens
aagacauaggaagacuuaauuuuuaaacggucaguguccaguugaaggcagaacacuaaucagauuu

SEQ ID NO: 651627 - RNA, 67 nt, Homo Sapiens
uggcaaugacuuuuuguguggaacaagcaagcauuauccaguugaucaaauuuuuuucucaguuauu

SEQ ID NO: 651628 - RNA, 67 nt, Homo Sapiens
aauugguuuaaacuuuuaaagacucacacacaucaguccaguugaaggaggugccuucucuguauua

SEQ ID NO: 651629 - RNA, 67 nt, Homo Sapiens
cagugcauacgcaguagcuagcaguggucuccuuuccccaguugaaguacuugugccagugacagau

SEQ ID NO: 651630 - RNA, 67 nt, Homo Sapiens
ggauaaggaggagggguggcccucacucuauaguugcccaguugaaaccuaauacaauuagaaucuc

SEQ ID NO: 651631 - RNA, 67 nt, Homo Sapiens
gacuuguuuguaaauuauccguuguuuuugcauaugcccaguugaugugauaaaauuuucauugucu

SEQ ID NO: 651632 - RNA, 67 nt, Homo Sapiens
caggaaucagaggcagcuguuaccagguuucggccuuccaguugaucccuccacuguccaggcuguc

SEQ ID NO: 651633 - RNA, 67 nt, Homo Sapiens
gcccugggccaucccugucuuccugucccuugucugcccaguugacaccuacuggugacuucuaggg

SEQ ID NO: 651634 - RNA, 67 nt, Homo Sapiens
cuguccaugccagcauaguaguuguauggacuucuaaccaguugaguuuuuuaaagcauugaggauu

SEQ ID NO: 651635 - RNA, 67 nt, Homo Sapiens
gucaucaucauuaucuuuuaacauuuugggggacuuuccaguugaaaagaaaacaugcuaugucauu

SEQ ID NO: 651636 - RNA, 67 nt, Homo Sapiens
ggagcauuagagaaaagccuagacuuuuaguugauagccaguugaaauaucauugauagaauuuuag

SEQ ID NO: 651637 - RNA, 67 nt, Homo Sapiens
cugcuggagcugagacacagaggaguccugggucuucccaguugagacagggauuagagaaaagagc

SEQ ID NO: 651638 - RNA, 67 nt, Homo Sapiens
uucuuuggcuaauuuuacuucuucaacaagcucuccaccaguugacuuuuuuuuuuuuuuaaauuug

SEQ ID NO: 651639 - RNA, 67 nt, Homo Sapiens
ggcaaaaacuuccaucacaaaugcuugacuagaguuuccaguugaaauuuuaaaaguuuguuaaaau

SEQ ID NO: 651640 - RNA, 67 nt, Homo Sapiens
gggggguugacuuucgcaauuuuuguucucuguaccaccaguugaagaauaacuuguaaauggauaa

SEQ ID NO: 651641 - RNA, 67 nt, Homo Sapiens
uuuuugguuauaaauguaaugaauauucaaucugguaccaguugaaaucaacuguguguucgacagu

SEQ ID NO: 651642 - RNA, 67 nt, Homo Sapiens
gaagugaguuggcugcauuuuaccuuuuggggagguuccaguugauuaaaugaaauucacacaacua

SEQ ID NO: 651643 - RNA, 67 nt, Homo Sapiens
ucuuuuuugaaaauaauuuaauauaccauguaauuuaccaguugaagauguucgcuuucagaauaua

SEQ ID NO: 651644 - RNA, 67 nt, Homo Sapiens
aacucagaguuuuaauaaaggugugaggaggcuggggccaguugacaccagcaugcugccuuuuucu

SEQ ID NO: 651645 - RNA, 67 nt, Homo Sapiens
uuuaagcauauuuucauuuaugugaaaugccaugguuccaguugaauuauugcugagcucaaauuga

SEQ ID NO: 651646 - RNA, 67 nt, Homo Sapiens
aacuucuaggccccugcccggggguucugcccacugcccaguugagcagagguuugagcccacaccu

SEQ ID NO: 651647 - RNA, 67 nt, Homo Sapiens
ggaugugaucugguccccuuggaugccaggagagaauccaguugaacuugcuccuaaaugcucuuaa

SEQ ID NO: 651648 - RNA, 67 nt, Homo Sapiens
cagcucacacagagucauccacacaaacccacggcucccaguugacagucaguggaaugcucgucuc

SEQ ID NO: 651649 - RNA, 67 nt, Homo Sapiens
ucuacccagcaccaguagugccgaugugccacacugcccaguugaggccccucacgcucugugcccc

SEQ ID NO: 651650 - RNA, 67 nt, Homo Sapiens
cagggcagccacauccaggcgggccuugguccaggagccaguugagcagaaagaaacugguggguua

SEQ ID NO: 651651 - RNA, 67 nt, Homo Sapiens
cugguucucuucugucuuguuugguaauaaacacauuccaguugaugccuugcagggcauucuucaa

SEQ ID NO: 651652 - RNA, 66 nt, Homo Sapiens
uggaggugaugcugaagugagcagccccuccccacaccaguugaacugcaggaagagaggacccau

SEQ ID NO: 651653 - RNA, 67 nt, Homo Sapiens
guuagugucacagccauuacagcacaagucaaagucgccaguugaauuuucauuaugcacgugugug

SEQ ID NO: 651654 - RNA, 67 nt, Homo Sapiens
cauucuugaucuucagccuucguuugcaaggagaguuccaguugacgugguguuugguuccauggcg

SEQ ID NO: 651655 - RNA, 67 nt, Homo Sapiens
uaaauaucuggucucucucuuauuuuuuuguuaaaaaccaguugauuaagaaacaauacaaagaaua

SEQ ID NO: 651656 - RNA, 67 nt, Homo Sapiens
ugguguuugguuccauggcgcguuugcaagaagaguuccaguugaugcauucuugaucuucagccuu

SEQ ID NO: 651657 - RNA, 67 nt, Homo Sapiens
uccuugaagacuggaggguugagacccaggcccccugccaguugaagugagaguuuggugauacugu

SEQ ID NO: 651658 - RNA, 67 nt, Homo Sapiens
auuuugcugaacacuuggguagugagugggauccuauccaguugaggaaugcuugcaaugcucauug

SEQ ID NO: 651659 - RNA, 67 nt, Homo Sapiens
gcgguuucacgccccacacuuuguacagaccgagaggccaguugaucugcucuguuuuauacuagug

SEQ ID NO: 651660 - RNA, 67 nt, Homo Sapiens
ccauggacaccuagccacccuguuguguguccuuaugccaguugagcugaaucuuuuccccaguaua

SEQ ID NO: 651661 - RNA, 67 nt, Homo Sapiens
caccauuacucagacuucuaaagagacuauuugaaguccaguugagucacaagagaagccugucuug

SEQ ID NO: 651662 - RNA, 67 nt, Homo Sapiens
guggagccggcaccucuggucuggauuccacuuaaaaccaguugaguggucucaagcccuuaaccuc

SEQ ID NO: 651663 - RNA, 67 nt, Homo Sapiens
agcauccauuaugagcugagcaccuccaccuguugccccaguugaaagcccuaacaagggcuccucc

SEQ ID NO: 651664 - RNA, 67 nt, Homo Sapiens
augccaaauguaguaucaaauuggucagaaagauaagccaguugauacacugcaggcuuuccugugg

SEQ ID NO: 651665 - RNA, 67 nt, Homo Sapiens
ucugggagcugggcacuacucuuggcagggugaggggccaguugaguaaaggccaagccaagccaug

SEQ ID NO: 651666 - RNA, 67 nt, Homo Sapiens
gaaggccuuuaucagauucaaacaucccaaauugucuccaguugaagcuucccaaaccuuguuuugc

SEQ ID NO: 651667 - RNA, 67 nt, Homo Sapiens
ccaaaguuguaucacuguuaaacuucugaagacauaaccaguugagucuuauuucaagauauguucu

SEQ ID NO: 651668 - RNA, 67 nt, Homo Sapiens
cauugcauggaaaagaccuauuuuauuucuagguucaccaguugagggacauuuggauuguucccac

SEQ ID NO: 651669 - RNA, 67 nt, Homo Sapiens
aaaauaaugcauguuaacaguuaugaaauaaacuuuaccaguugacuaggcuuaaaauuacuuauac

SEQ ID NO: 651670 - RNA, 67 nt, Homo Sapiens
aauuuugcguuaaagacugauguggggcauuuuccccccaguugauuaaucgcugaacucucaauau

SEQ ID NO: 651671 - RNA, 67 nt, Homo Sapiens
acuuugcaguugcagacgucugugccuagcaauauuuccaguugaccaaauauucuaaucuuuuuuc

SEQ ID NO: 651672 - RNA, 67 nt, Homo Sapiens
uaugcaauaacugagcuugaugggggugggcagggggccaguugagccaagcccccagccccgaucu

SEQ ID NO: 651673 - RNA, 67 nt, Homo Sapiens
ccacagguuuaagggcucauuccccaagucugcuccuccaguugagacacaagucacaaauccaggc

SEQ ID NO: 651674 - RNA, 58 nt, Homo Sapiens
agaaacagccuaccucauagcucucaagccaguugaagaaaccuugccuuuucagcuu

SEQ ID NO: 651675 - RNA, 67 nt, Homo Sapiens
cccuuuuucuguguggccccccagaugcugcaaacuuccaguugaacucugccagaauuggccuuuc

SEQ ID NO: 651676 - RNA, 67 nt, Homo Sapiens
caucucucagccucucugagcucaaaacgggcaucacccaguugaccccacuugggaagcuaaggcu

SEQ ID NO: 651677 - RNA, 67 nt, Homo Sapiens
uccccugacaaucuggaaggcgggaaucaaagcgaguccaguugaucaccagcuuuggggaggaggc

SEQ ID NO: 651678 - RNA, 67 nt, Homo Sapiens
uaacagcucugaaggagaucuugauauguagggauguccaguugauauucacaagggaaagacacuu

SEQ ID NO: 651679 - RNA, 67 nt, Homo Sapiens
uuuuuaaaaaguuuuacaaauccauggaaaaguuaacccaguugagaauggguaaggaccugaaaga

SEQ ID NO: 651680 - RNA, 67 nt, Homo Sapiens
gugccugugucccuggcaguguccaguguguucacuuccaguugaaguauccauguguuucugggca

SEQ ID NO: 651681 - RNA, 67 nt, Homo Sapiens
uuguaugaugcugaauuauuaugcagacuaauuccacccaguugagacacaccaugcuuguucacuu

SEQ ID NO: 651682 - RNA, 67 nt, Homo Sapiens
gcaccugcugaccucagggucacaguugagucauuugccaguugacggagcaaguuugaccuugguu

SEQ ID NO: 651683 - RNA, 67 nt, Homo Sapiens
agaaaagaggaacccaguggauguaacagaaccgacuccaguugaauguuuagauuuuugcuaaacu

SEQ ID NO: 651684 - RNA, 67 nt, Homo Sapiens
ggaccgucauugagggguaacuccucccacaggaaccccaguugacaguuuaaaagcacuuucacac

SEQ ID NO: 651685 - RNA, 67 nt, Homo Sapiens
aggcaaaaaugccccuucaucuuucucuauauauuuuccaguugaaaacaaacuaagaaguccuuua

SEQ ID NO: 651686 - RNA, 67 nt, Homo Sapiens
uguggaauuuuacaccuggccugcguggcagccucuuccaguugagguguuuuaugucacgcacacu

SEQ ID NO: 651687 - RNA, 67 nt, Homo Sapiens
uucuguuccaccugccugccaucuugccaggucuuggccaguugagacucaaccccugggguaucua

SEQ ID NO: 651688 - RNA, 67 nt, Homo Sapiens
ggagggcauuaccugggcuauuuagggaacagagaugccaguugaggucagagaaaagaggucaaug

SEQ ID NO: 651689 - RNA, 67 nt, Homo Sapiens
ucagcaucaguccaccucuacucuagauugguauagaccaguugacucuuguuacaccuaguggaug

SEQ ID NO: 651690 - RNA, 67 nt, Homo Sapiens
aaugaauaaauaaacgagcccaggcuuucaagaagugccaguugaucgggaaaggcuuggcacacag

SEQ ID NO: 651691 - RNA, 67 nt, Homo Sapiens
agauuuuuccacccucgagcugaguauuucccuuuugccaguugacaucauaaugcccagugauuag

SEQ ID NO: 651692 - RNA, 67 nt, Homo Sapiens
ucauuuaugcaugacauagguaaugugacuaauuucuccaguugauucaagaaacucauuacuuugc

SEQ ID NO: 651693 - RNA, 67 nt, Homo Sapiens
auauucuauuccauguccauacauaaaauuccacuggccaguugaaugaaggcauaggcuuauucug

SEQ ID NO: 651694 - RNA, 67 nt, Homo Sapiens
uccaggauggcugcaagcgcuagcaaagggucuguggccaguugacaauguagccagggacucccca

SEQ ID NO: 651695 - RNA, 67 nt, Homo Sapiens
gcucgugugccagcggugugggccugccucagcagcaccaguugacugaauuauaaaugugguguuu

SEQ ID NO: 651696 - RNA, 67 nt, Homo Sapiens
uagucugaaauguaauaggaaagauaacgggaagaugccaguugacugaaaauucaaagccuuucaa

SEQ ID NO: 651697 - RNA, 67 nt, Homo Sapiens
augggugacucagccuuaguuucuauucuuggaugucccaguugaaucagaaggggaccucuggagu

SEQ ID NO: 651698 - RNA, 67 nt, Homo Sapiens
cauuuccugccccuuucgccacucacggaccuugaggccaguugacggcccuucuccccacgccugu

SEQ ID NO: 651699 - RNA, 67 nt, Homo Sapiens
ggguaacgacugagucuccaaagccaugcucagccuuccaguugaguuggguaaccaucagaggaaa

SEQ ID NO: 651700 - RNA, 67 nt, Homo Sapiens
cccugggugucugggaacugggguccacgucugggcuccaguugaucgucugggguggucacucccg

SEQ ID NO: 651701 - RNA, 67 nt, Homo Sapiens
ucuugaggcuguugagaaacagagaaaguuccuuuccccaguugaugugguuaaguauagggucacc

SEQ ID NO: 651702 - RNA, 67 nt, Homo Sapiens
uguugaaacugacuugcugugacuuaugugcagcuuuccaguugagcagaggaaaauaguggcagga

SEQ ID NO: 651703 - RNA, 67 nt, Homo Sapiens
aucacauggagcaguaauggagcaaagaccagccaucccaguugagauacccuacaccaaccagauu

SEQ ID NO: 651704 - RNA, 67 nt, Homo Sapiens
agucacuccauuguguggauuuacuacuguuuguuccccaguugaaggauguuuaggaucuuugcag

SEQ ID NO: 651705 - RNA, 67 nt, Homo Sapiens
aagccauuuuggaaauucacgaaaguacugcuccaccccaguugaguuauuuagaauuuuaucucaa

SEQ ID NO: 651706 - RNA, 67 nt, Homo Sapiens
cuuugguucauaaauauggcucuugaacccauagaccccaguugaagauggaauuuucaggaaaggg

SEQ ID NO: 651707 - RNA, 67 nt, Homo Sapiens
agauagcuuaugucuaaaacaguggugaugaguaaggccaguugagcauugcuuacuuaugguuaaa

SEQ ID NO: 651708 - RNA, 67 nt, Homo Sapiens
aaguagaaggaauuuccagaggacggguaggaauuagccaguugagguaccugaacugagucuugag

SEQ ID NO: 651709 - RNA, 67 nt, Homo Sapiens
uucauccugcacagggaaauggcuaccuauuaaagucccaguugaaauuuuuugaaaaaauacaccu

SEQ ID NO: 651710 - RNA, 64 nt, Homo Sapiens
ucaaauaggcuauuaaaaaauguuuggcguagcagaguuaaaucauggacauuuagaagaaaga

SEQ ID NO: 651711 - RNA, 64 nt, Homo Sapiens
gcacauauagacacauacacgguagcauucuuuggaguuaaaaugcaucuugguuauuucugaa

SEQ ID NO: 651712 - RNA, 64 nt, Homo Sapiens
uacaugcucggucacucauuuaguaauuucauuugaguuaaauuuguuuuuaaagcaauuauug

SEQ ID NO: 651713 - RNA, 64 nt, Homo Sapiens
gcugggcaggugccacaggagugggaggacaggggaguuaaaugugggaaacacuuuauguagg

SEQ ID NO: 651714 - RNA, 64 nt, Homo Sapiens
uaaauguacagagaggaaagaauacaugugagaggaguuaaauauuaaauauuuucuuugccua

SEQ ID NO: 651715 - RNA, 64 nt, Homo Sapiens
ugguggaaaaggcuuauugcuugguacagaaggugaguuaaagccauagugguagguuugcccu

SEQ ID NO: 651716 - RNA, 64 nt, Homo Sapiens
uauggcuucgucaagggaggugaacauuguugcugaguuaaauuccagggucucagaugguuag

SEQ ID NO: 651717 - RNA, 64 nt, Homo Sapiens
cagaaaacucagcucaggcacaauugucaccaaggaguuaaaagcuucuucuucaauagaggaa

SEQ ID NO: 651718 - RNA, 64 nt, Homo Sapiens
gcaaugauuacuguguugcuaacucauuuucuuugaguuaaagcuguguauacauuuuaaaagg

SEQ ID NO: 651719 - RNA, 64 nt, Homo Sapiens
guuuguuuuccuaccuuaugcugaguaguccagagaguuaaaaaaauucucugcauguuggucu

SEQ ID NO: 651720 - RNA, 64 nt, Homo Sapiens
gaaaaaaaaaagguuugugcaaaagcccuuucuugaguuaaaaaggaagugaguuaaaaacaau

SEQ ID NO: 651721 - RNA, 64 nt, Homo Sapiens
caauaaaagcccuuucuugaacuucccaggaagugaguuaaaaauaagaguguuuuaaaaauua

SEQ ID NO: 651722 - RNA, 64 nt, Homo Sapiens; identical to SEQ ID NO: 196427

SEQ ID NO: 651723 - RNA, 64 nt, Homo Sapiens; identical to SEQ ID NO: 196428

SEQ ID NO: 651724 - RNA, 64 nt, Homo Sapiens; identical to SEQ ID NO: 196429

SEQ ID NO: 651725 - RNA, 64 nt, Homo Sapiens; identical to SEQ ID NO: 196430

SEQ ID NO: 651726 - RNA, 64 nt, Homo Sapiens; identical to SEQ ID NO: 196431

SEQ ID NO: 651727 - RNA, 64 nt, Homo Sapiens; identical to SEQ ID NO: 196432

SEQ ID NO: 651728 - RNA, 64 nt, Homo Sapiens; identical to SEQ ID NO: 196433

SEQ ID NO: 651729 - RNA, 64 nt, Homo Sapiens; identical to SEQ ID NO: 196434

SEQ ID NO: 651730 - RNA, 64 nt, Homo Sapiens; identical to SEQ ID NO: 196435

SEQ ID NO: 651731 - RNA, 64 nt, Homo Sapiens; identical to SEQ ID NO: 196436

SEQ ID NO: 651732 - RNA, 64 nt, Homo Sapiens; identical to SEQ ID NO: 196437

SEQ ID NO: 651733 - RNA, 64 nt, Homo Sapiens; identical to SEQ ID NO: 196438

SEQ ID NO: 651734 - RNA, 64 nt, Homo Sapiens; identical to SEQ ID NO: 196439

SEQ ID NO: 651735 - RNA, 64 nt, Homo Sapiens; identical to SEQ ID NO: 196440

SEQ ID NO: 651736 - RNA, 64 nt, Homo Sapiens; identical to SEQ ID NO: 196441

SEQ ID NO: 651737 - RNA, 57 nt, Homo Sapiens; identical to SEQ ID NO: 196442

SEQ ID NO: 651738 - RNA, 64 nt, Homo Sapiens; identical to SEQ ID NO: 196443

SEQ ID NO: 651739 - RNA, 64 nt, Homo Sapiens; identical to SEQ ID NO: 196444

SEQ ID NO: 651740 - RNA, 64 nt, Homo Sapiens; identical to SEQ ID NO: 196445

SEQ ID NO: 651741 - RNA, 64 nt, Homo Sapiens; identical to SEQ ID NO: 196446

SEQ ID NO: 651742 - RNA, 64 nt, Homo Sapiens; identical to SEQ ID NO: 196447

SEQ ID NO: 651743 - RNA, 64 nt, Homo Sapiens; identical to SEQ ID NO: 651710

SEQ ID NO: 651744 - RNA, 64 nt, Homo Sapiens; identical to SEQ ID NO: 651711

SEQ ID NO: 651745 - RNA, 64 nt, Homo Sapiens; identical to SEQ ID NO: 651712

SEQ ID NO: 651746 - RNA, 64 nt, Homo Sapiens; identical to SEQ ID NO: 651713

SEQ ID NO: 651747 - RNA, 64 nt, Homo Sapiens; identical to SEQ ID NO: 651714

SEQ ID NO: 651748 - RNA, 64 nt, Homo Sapiens; identical to SEQ ID NO: 651715

SEQ ID NO: 651749 - RNA, 64 nt, Homo Sapiens; identical to SEQ ID NO: 651716

SEQ ID NO: 651750 - RNA, 64 nt, Homo Sapiens; identical to SEQ ID NO: 651717

SEQ ID NO: 651751 - RNA, 64 nt, Homo Sapiens; identical to SEQ ID NO: 651718

SEQ ID NO: 651752 - RNA, 64 nt, Homo Sapiens; identical to SEQ ID NO: 651719

SEQ ID NO: 651753 - RNA, 64 nt, Homo Sapiens; identical to SEQ ID NO: 651720

SEQ ID NO: 651754 - RNA, 64 nt, Homo Sapiens; identical to SEQ ID NO: 651721

SEQ ID NO: 651755 - RNA, 64 nt, Homo Sapiens; identical to SEQ ID NO: 196427

SEQ ID NO: 651756 - RNA, 64 nt, Homo Sapiens; identical to SEQ ID NO: 196428

SEQ ID NO: 651757 - RNA, 64 nt, Homo Sapiens; identical to SEQ ID NO: 196429

SEQ ID NO: 651758 - RNA, 64 nt, Homo Sapiens; identical to SEQ ID NO: 196430

SEQ ID NO: 651759 - RNA, 64 nt, Homo Sapiens; identical to SEQ ID NO: 196431

SEQ ID NO: 651760 - RNA, 64 nt, Homo Sapiens; identical to SEQ ID NO: 196432

SEQ ID NO: 651761 - RNA, 64 nt, Homo Sapiens; identical to SEQ ID NO: 196433

SEQ ID NO: 651762 - RNA, 64 nt, Homo Sapiens; identical to SEQ ID NO: 196434

SEQ ID NO: 651763 - RNA, 64 nt, Homo Sapiens; identical to SEQ ID NO: 196435

SEQ ID NO: 651764 - RNA, 64 nt, Homo Sapiens; identical to SEQ ID NO: 196436

SEQ ID NO: 651765 - RNA, 64 nt, Homo Sapiens; identical to SEQ ID NO: 196437

SEQ ID NO: 651766 - RNA, 64 nt, Homo Sapiens; identical to SEQ ID NO: 196438

SEQ ID NO: 651767 - RNA, 64 nt, Homo Sapiens; identical to SEQ ID NO: 196439

SEQ ID NO: 651768 - RNA, 64 nt, Homo Sapiens; identical to SEQ ID NO: 196440

SEQ ID NO: 651769 - RNA, 64 nt, Homo Sapiens; identical to SEQ ID NO: 196441

SEQ ID NO: 651770 - RNA, 57 nt, Homo Sapiens; identical to SEQ ID NO: 196442

SEQ ID NO: 651771 - RNA, 64 nt, Homo Sapiens; identical to SEQ ID NO: 196443

SEQ ID NO: 651772 - RNA, 64 nt, Homo Sapiens; identical to SEQ ID NO: 196444

SEQ ID NO: 651773 - RNA, 64 nt, Homo Sapiens; identical to SEQ ID NO: 196445

SEQ ID NO: 651774 - RNA, 64 nt, Homo Sapiens; identical to SEQ ID NO: 196446

SEQ ID NO: 651775 - RNA, 64 nt, Homo Sapiens; identical to SEQ ID NO: 196447

SEQ ID NO: 651776 - RNA, 64 nt, Homo Sapiens; identical to SEQ ID NO: 57592

SEQ ID NO: 651777 - RNA, 64 nt, Homo Sapiens; identical to SEQ ID NO: 57593

SEQ ID NO: 651778 - RNA, 64 nt, Homo Sapiens; identical to SEQ ID NO: 57594

SEQ ID NO: 651779 - RNA, 64 nt, Homo Sapiens; identical to SEQ ID NO: 57595

SEQ ID NO: 651780 - RNA, 64 nt, Homo Sapiens; identical to SEQ ID NO: 57596

SEQ ID NO: 651781 - RNA, 64 nt, Homo Sapiens; identical to SEQ ID NO: 57597

SEQ ID NO: 651782 - RNA, 64 nt, Homo Sapiens; identical to SEQ ID NO: 57598

SEQ ID NO: 651783 - RNA, 64 nt, Homo Sapiens; identical to SEQ ID NO: 57599

SEQ ID NO: 651784 - RNA, 64 nt, Homo Sapiens; identical to SEQ ID NO: 57600

SEQ ID NO: 651785 - RNA, 64 nt, Homo Sapiens; identical to SEQ ID NO: 57601

SEQ ID NO: 651786 - RNA, 64 nt, Homo Sapiens; identical to SEQ ID NO: 57602

SEQ ID NO: 651787 - RNA, 64 nt, Homo Sapiens; identical to SEQ ID NO: 108382

SEQ ID NO: 651788 - RNA, 64 nt, Homo Sapiens; identical to SEQ ID NO: 108383

SEQ ID NO: 651789 - RNA, 64 nt, Homo Sapiens; identical to SEQ ID NO: 108384

SEQ ID NO: 651790 - RNA, 64 nt, Homo Sapiens; identical to SEQ ID NO: 108385

SEQ ID NO: 651791 - RNA, 64 nt, Homo Sapiens; identical to SEQ ID NO: 108386

SEQ ID NO: 651792 - RNA, 64 nt, Homo Sapiens; identical to SEQ ID NO: 108387

SEQ ID NO: 651793 - RNA, 64 nt, Homo Sapiens; identical to SEQ ID NO: 108388

SEQ ID NO: 651794 - RNA, 64 nt, Homo Sapiens; identical to SEQ ID NO: 108389

SEQ ID NO: 651795 - RNA, 64 nt, Homo Sapiens; identical to SEQ ID NO: 108390

SEQ ID NO: 651796 - RNA, 64 nt, Homo Sapiens; identical to SEQ ID NO: 108391

SEQ ID NO: 651797 - RNA, 64 nt, Homo Sapiens; identical to SEQ ID NO: 108392

SEQ ID NO: 651798 - RNA, 64 nt, Homo Sapiens; identical to SEQ ID NO: 108393

SEQ ID NO: 651799 - RNA, 64 nt, Homo Sapiens; identical to SEQ ID NO: 108394

SEQ ID NO: 651800 - RNA, 64 nt, Homo Sapiens; identical to SEQ ID NO: 108395

SEQ ID NO: 651801 - RNA, 64 nt, Homo Sapiens; identical to SEQ ID NO: 370058

SEQ ID NO: 651802 - RNA, 64 nt, Homo Sapiens; identical to SEQ ID NO: 370059

SEQ ID NO: 651803 - RNA, 64 nt, Homo Sapiens; identical to SEQ ID NO: 370060

SEQ ID NO: 651804 - RNA, 64 nt, Homo Sapiens; identical to SEQ ID NO: 370061

SEQ ID NO: 651805 - RNA, 64 nt, Homo Sapiens; identical to SEQ ID NO: 370062

SEQ ID NO: 651806 - RNA, 64 nt, Homo Sapiens; identical to SEQ ID NO: 370063

SEQ ID NO: 651807 - RNA, 64 nt, Homo Sapiens; identical to SEQ ID NO: 78101

SEQ ID NO: 651808 - RNA, 62 nt, Homo Sapiens; identical to SEQ ID NO: 78102

SEQ ID NO: 651809 - RNA, 64 nt, Homo Sapiens; identical to SEQ ID NO: 78103

SEQ ID NO: 651810 - RNA, 55 nt, Homo Sapiens; identical to SEQ ID NO: 78104

SEQ ID NO: 651811 - RNA, 64 nt, Homo Sapiens; identical to SEQ ID NO: 78105

SEQ ID NO: 651812 - RNA, 64 nt, Homo Sapiens; identical to SEQ ID NO: 78106

SEQ ID NO: 651813 - RNA, 64 nt, Homo Sapiens; identical to SEQ ID NO: 78107

SEQ ID NO: 651814 - RNA, 64 nt, Homo Sapiens; identical to SEQ ID NO: 78108

SEQ ID NO: 651815 - RNA, 64 nt, Homo Sapiens; identical to SEQ ID NO: 78109

SEQ ID NO: 651816 - RNA, 64 nt, Homo Sapiens; identical to SEQ ID NO: 78110

SEQ ID NO: 651817 - RNA, 64 nt, Homo Sapiens; identical to SEQ ID NO: 78111

SEQ ID NO: 651818 - RNA, 64 nt, Homo Sapiens; identical to SEQ ID NO: 78112

SEQ ID NO: 651819 - RNA, 64 nt, Homo Sapiens; identical to SEQ ID NO: 78113

SEQ ID NO: 651820 - RNA, 64 nt, Homo Sapiens; identical to SEQ ID NO: 78114

SEQ ID NO: 651821 - RNA, 64 nt, Homo Sapiens; identical to SEQ ID NO: 78115

SEQ ID NO: 651822 - RNA, 64 nt, Homo Sapiens; identical to SEQ ID NO: 78116

SEQ ID NO: 651823 - RNA, 64 nt, Homo Sapiens; identical to SEQ ID NO: 78117

SEQ ID NO: 651824 - RNA, 64 nt, Homo Sapiens; identical to SEQ ID NO: 78118

SEQ ID NO: 651825 - RNA, 64 nt, Homo Sapiens; identical to SEQ ID NO: 78119

SEQ ID NO: 651826 - RNA, 64 nt, Homo Sapiens; identical to SEQ ID NO: 78120

SEQ ID NO: 651827 - RNA, 64 nt, Homo Sapiens; identical to SEQ ID NO: 78121

SEQ ID NO: 651828 - RNA, 64 nt, Homo Sapiens; identical to SEQ ID NO: 78122

SEQ ID NO: 651829 - RNA, 64 nt, Homo Sapiens; identical to SEQ ID NO: 78123

SEQ ID NO: 651830 - RNA, 64 nt, Homo Sapiens; identical to SEQ ID NO: 78124

SEQ ID NO: 651831 - RNA, 64 nt, Homo Sapiens; identical to SEQ ID NO: 78125

SEQ ID NO: 651832 - RNA, 64 nt, Homo Sapiens; identical to SEQ ID NO: 78126

SEQ ID NO: 651833 - RNA, 64 nt, Homo Sapiens; identical to SEQ ID NO: 78127

SEQ ID NO: 651834 - RNA, 64 nt, Homo Sapiens; identical to SEQ ID NO: 78128

SEQ ID NO: 651835 - RNA, 64 nt, Homo Sapiens; identical to SEQ ID NO: 78129

SEQ ID NO: 651836 - RNA, 64 nt, Homo Sapiens; identical to SEQ ID NO: 78130

SEQ ID NO: 651837 - RNA, 64 nt, Homo Sapiens; identical to SEQ ID NO: 78131

SEQ ID NO: 651838 - RNA, 64 nt, Homo Sapiens; identical to SEQ ID NO: 78132

SEQ ID NO: 651839 - RNA, 64 nt, Homo Sapiens; identical to SEQ ID NO: 78133

SEQ ID NO: 651840 - RNA, 64 nt, Homo Sapiens; identical to SEQ ID NO: 78134

SEQ ID NO: 651841 - RNA, 64 nt, Homo Sapiens; identical to SEQ ID NO: 78135

SEQ ID NO: 651842 - RNA, 64 nt, Homo Sapiens; identical to SEQ ID NO: 78136

SEQ ID NO: 651843 - RNA, 64 nt, Homo Sapiens; identical to SEQ ID NO: 78137

SEQ ID NO: 651844 - RNA, 64 nt, Homo Sapiens; identical to SEQ ID NO: 78138

SEQ ID NO: 651845 - RNA, 64 nt, Homo Sapiens; identical to SEQ ID NO: 78139

SEQ ID NO: 651846 - RNA, 64 nt, Homo Sapiens; identical to SEQ ID NO: 78140

SEQ ID NO: 651847 - RNA, 64 nt, Homo Sapiens; identical to SEQ ID NO: 78141

SEQ ID NO: 651848 - RNA, 64 nt, Homo Sapiens; identical to SEQ ID NO: 78142

SEQ ID NO: 651849 - RNA, 64 nt, Homo Sapiens; identical to SEQ ID NO: 78143

SEQ ID NO: 651850 - RNA, 64 nt, Homo Sapiens; identical to SEQ ID NO: 78144

SEQ ID NO: 651851 - RNA, 64 nt, Homo Sapiens; identical to SEQ ID NO: 78145

SEQ ID NO: 651852 - RNA, 64 nt, Homo Sapiens; identical to SEQ ID NO: 78146

SEQ ID NO: 651853 - RNA, 64 nt, Homo Sapiens; identical to SEQ ID NO: 78147

SEQ ID NO: 651854 - RNA, 64 nt, Homo Sapiens; identical to SEQ ID NO: 78148

SEQ ID NO: 651855 - RNA, 64 nt, Homo Sapiens; identical to SEQ ID NO: 78149

SEQ ID NO: 651856 - RNA, 64 nt, Homo Sapiens; identical to SEQ ID NO: 78150

SEQ ID NO: 651857 - RNA, 64 nt, Homo Sapiens; identical to SEQ ID NO: 78151

SEQ ID NO: 651858 - RNA, 64 nt, Homo Sapiens; identical to SEQ ID NO: 78152

SEQ ID NO: 651859 - RNA, 64 nt, Homo Sapiens; identical to SEQ ID NO: 78153

SEQ ID NO: 651860 - RNA, 64 nt, Homo Sapiens; identical to SEQ ID NO: 78154

SEQ ID NO: 651861 - RNA, 64 nt, Homo Sapiens; identical to SEQ ID NO: 78155

SEQ ID NO: 651862 - RNA, 64 nt, Homo Sapiens; identical to SEQ ID NO: 78156

SEQ ID NO: 651863 - RNA, 64 nt, Homo Sapiens; identical to SEQ ID NO: 78157

SEQ ID NO: 651864 - RNA, 64 nt, Homo Sapiens; identical to SEQ ID NO: 78158

SEQ ID NO: 651865 - RNA, 64 nt, Homo Sapiens; identical to SEQ ID NO: 78159

SEQ ID NO: 651866 - RNA, 64 nt, Homo Sapiens; identical to SEQ ID NO: 78160

SEQ ID NO: 651867 - RNA, 64 nt, Homo Sapiens; identical to SEQ ID NO: 78161

SEQ ID NO: 651868 - RNA, 64 nt, Homo Sapiens; identical to SEQ ID NO: 78162

SEQ ID NO: 651869 - RNA, 64 nt, Homo Sapiens; identical to SEQ ID NO: 78163

SEQ ID NO: 651870 - RNA, 64 nt, Homo Sapiens; identical to SEQ ID NO: 78164

SEQ ID NO: 651871 - RNA, 64 nt, Homo Sapiens; identical to SEQ ID NO: 78165

SEQ ID NO: 651872 - RNA, 64 nt, Homo Sapiens; identical to SEQ ID NO: 78166

SEQ ID NO: 651873 - RNA, 64 nt, Homo Sapiens; identical to SEQ ID NO: 78167

SEQ ID NO: 651874 - RNA, 64 nt, Homo Sapiens; identical to SEQ ID NO: 78168

SEQ ID NO: 651875 - RNA, 64 nt, Homo Sapiens; identical to SEQ ID NO: 78169

SEQ ID NO: 651876 - RNA, 64 nt, Homo Sapiens; identical to SEQ ID NO: 78170

SEQ ID NO: 651877 - RNA, 64 nt, Homo Sapiens; identical to SEQ ID NO: 78171

SEQ ID NO: 651878 - RNA, 64 nt, Homo Sapiens; identical to SEQ ID NO: 78172

SEQ ID NO: 651879 - RNA, 64 nt, Homo Sapiens; identical to SEQ ID NO: 78173

SEQ ID NO: 651880 - RNA, 64 nt, Homo Sapiens; identical to SEQ ID NO: 78174

SEQ ID NO: 651881 - RNA, 64 nt, Homo Sapiens; identical to SEQ ID NO: 78175

SEQ ID NO: 651882 - RNA, 64 nt, Homo Sapiens; identical to SEQ ID NO: 78176

SEQ ID NO: 651883 - RNA, 64 nt, Homo Sapiens; identical to SEQ ID NO: 78177

SEQ ID NO: 651884 - RNA, 64 nt, Homo Sapiens; identical to SEQ ID NO: 78178

SEQ ID NO: 651885 - RNA, 64 nt, Homo Sapiens; identical to SEQ ID NO: 78179

SEQ ID NO: 651886 - RNA, 64 nt, Homo Sapiens; identical to SEQ ID NO: 78180

SEQ ID NO: 651887 - RNA, 64 nt, Homo Sapiens; identical to SEQ ID NO: 78181

SEQ ID NO: 651888 - RNA, 64 nt, Homo Sapiens; identical to SEQ ID NO: 78182

SEQ ID NO: 651889 - RNA, 64 nt, Homo Sapiens; identical to SEQ ID NO: 78183

SEQ ID NO: 651890 - RNA, 64 nt, Homo Sapiens; identical to SEQ ID NO: 78184

SEQ ID NO: 651891 - RNA, 64 nt, Homo Sapiens; identical to SEQ ID NO: 78185

SEQ ID NO: 651892 - RNA, 64 nt, Homo Sapiens; identical to SEQ ID NO: 78186

SEQ ID NO: 651893 - RNA, 64 nt, Homo Sapiens; identical to SEQ ID NO: 78187

SEQ ID NO: 651894 - RNA, 64 nt, Homo Sapiens; identical to SEQ ID NO: 78188

SEQ ID NO: 651895 - RNA, 64 nt, Homo Sapiens; identical to SEQ ID NO: 78189

SEQ ID NO: 651896 - RNA, 64 nt, Homo Sapiens; identical to SEQ ID NO: 78190

SEQ ID NO: 651897 - RNA, 64 nt, Homo Sapiens; identical to SEQ ID NO: 78191

SEQ ID NO: 651898 - RNA, 64 nt, Homo Sapiens; identical to SEQ ID NO: 78192

SEQ ID NO: 651899 - RNA, 64 nt, Homo Sapiens; identical to SEQ ID NO: 78193

SEQ ID NO: 651900 - RNA, 64 nt, Homo Sapiens; identical to SEQ ID NO: 78194

SEQ ID NO: 651901 - RNA, 64 nt, Homo Sapiens; identical to SEQ ID NO: 78195

SEQ ID NO: 651902 - RNA, 64 nt, Homo Sapiens; identical to SEQ ID NO: 78196

SEQ ID NO: 651903 - RNA, 64 nt, Homo Sapiens; identical to SEQ ID NO: 78197

SEQ ID NO: 651904 - RNA, 64 nt, Homo Sapiens; identical to SEQ ID NO: 78198

SEQ ID NO: 651905 - RNA, 64 nt, Homo Sapiens; identical to SEQ ID NO: 78199

SEQ ID NO: 651906 - RNA, 64 nt, Homo Sapiens; identical to SEQ ID NO: 78200

SEQ ID NO: 651907 - RNA, 64 nt, Homo Sapiens; identical to SEQ ID NO: 78201

SEQ ID NO: 651908 - RNA, 64 nt, Homo Sapiens; identical to SEQ ID NO: 78202

SEQ ID NO: 651909 - RNA, 64 nt, Homo Sapiens; identical to SEQ ID NO: 78203

SEQ ID NO: 651910 - RNA, 64 nt, Homo Sapiens; identical to SEQ ID NO: 78204

SEQ ID NO: 651911 - RNA, 64 nt, Homo Sapiens; identical to SEQ ID NO: 78205

SEQ ID NO: 651912 - RNA, 64 nt, Homo Sapiens; identical to SEQ ID NO: 78206

SEQ ID NO: 651913 - RNA, 64 nt, Homo Sapiens; identical to SEQ ID NO: 78207

SEQ ID NO: 651914 - RNA, 64 nt, Homo Sapiens; identical to SEQ ID NO: 78208

SEQ ID NO: 651915 - RNA, 64 nt, Homo Sapiens; identical to SEQ ID NO: 78209

SEQ ID NO: 651916 - RNA, 64 nt, Homo Sapiens; identical to SEQ ID NO: 78210

SEQ ID NO: 651917 - RNA, 64 nt, Homo Sapiens; identical to SEQ ID NO: 78211

SEQ ID NO: 651918 - RNA, 64 nt, Homo Sapiens; identical to SEQ ID NO: 78212

SEQ ID NO: 651919 - RNA, 64 nt, Homo Sapiens; identical to SEQ ID NO: 78213

SEQ ID NO: 651920 - RNA, 64 nt, Homo Sapiens; identical to SEQ ID NO: 78214

SEQ ID NO: 651921 - RNA, 64 nt, Homo Sapiens; identical to SEQ ID NO: 78215

SEQ ID NO: 651922 - RNA, 64 nt, Homo Sapiens; identical to SEQ ID NO: 78216

SEQ ID NO: 651923 - RNA, 64 nt, Homo Sapiens; identical to SEQ ID NO: 78217

SEQ ID NO: 651924 - RNA, 64 nt, Homo Sapiens; identical to SEQ ID NO: 78218

SEQ ID NO: 651925 - RNA, 64 nt, Homo Sapiens; identical to SEQ ID NO: 465655

SEQ ID NO: 651926 - RNA, 64 nt, Homo Sapiens; identical to SEQ ID NO: 465656

SEQ ID NO: 651927 - RNA, 64 nt, Homo Sapiens; identical to SEQ ID NO: 465657

SEQ ID NO: 651928 - RNA, 64 nt, Homo Sapiens; identical to SEQ ID NO: 465658

SEQ ID NO: 651929 - RNA, 64 nt, Homo Sapiens; identical to SEQ ID NO: 61300

SEQ ID NO: 651930 - RNA, 64 nt, Homo Sapiens; identical to SEQ ID NO: 61301

SEQ ID NO: 651931 - RNA, 64 nt, Homo Sapiens; identical to SEQ ID NO: 61302

SEQ ID NO: 651932 - RNA, 64 nt, Homo Sapiens; identical to SEQ ID NO: 61303

SEQ ID NO: 651933 - RNA, 64 nt, Homo Sapiens; identical to SEQ ID NO: 61304

SEQ ID NO: 651934 - RNA, 64 nt, Homo Sapiens; identical to SEQ ID NO: 61305

SEQ ID NO: 651935 - RNA, 64 nt, Homo Sapiens; identical to SEQ ID NO: 61306

SEQ ID NO: 651936 - RNA, 64 nt, Homo Sapiens; identical to SEQ ID NO: 61307

SEQ ID NO: 651937 - RNA, 64 nt, Homo Sapiens; identical to SEQ ID NO: 61308

SEQ ID NO: 651938 - RNA, 64 nt, Homo Sapiens; identical to SEQ ID NO: 61309

SEQ ID NO: 651939 - RNA, 64 nt, Homo Sapiens; identical to SEQ ID NO: 61310

SEQ ID NO: 651940 - RNA, 56 nt, Homo Sapiens; identical to SEQ ID NO: 61311

SEQ ID NO: 651941 - RNA, 64 nt, Homo Sapiens; identical to SEQ ID NO: 61312

SEQ ID NO: 651942 - RNA, 64 nt, Homo Sapiens; identical to SEQ ID NO: 61313

SEQ ID NO: 651943 - RNA, 64 nt, Homo Sapiens; identical to SEQ ID NO: 61314

SEQ ID NO: 651944 - RNA, 64 nt, Homo Sapiens; identical to SEQ ID NO: 61315

SEQ ID NO: 651945 - RNA, 64 nt, Homo Sapiens; identical to SEQ ID NO: 61316

SEQ ID NO: 651946 - RNA, 64 nt, Homo Sapiens; identical to SEQ ID NO: 61317

SEQ ID NO: 651947 - RNA, 64 nt, Homo Sapiens; identical to SEQ ID NO: 380102

SEQ ID NO: 651948 - RNA, 64 nt, Homo Sapiens; identical to SEQ ID NO: 380103

SEQ ID NO: 651949 - RNA, 64 nt, Homo Sapiens; identical to SEQ ID NO: 380104

SEQ ID NO: 651950 - RNA, 64 nt, Homo Sapiens; identical to SEQ ID NO: 380105

SEQ ID NO: 651951 - RNA, 64 nt, Homo Sapiens; identical to SEQ ID NO: 380106

SEQ ID NO: 651952 - RNA, 64 nt, Homo Sapiens; identical to SEQ ID NO: 380107

SEQ ID NO: 651953 - RNA, 64 nt, Homo Sapiens; identical to SEQ ID NO: 380108

SEQ ID NO: 651954 - RNA, 64 nt, Homo Sapiens; identical to SEQ ID NO: 380109

SEQ ID NO: 651955 - RNA, 64 nt, Homo Sapiens; identical to SEQ ID NO: 380110

SEQ ID NO: 651956 - RNA, 64 nt, Homo Sapiens; identical to SEQ ID NO: 380111

SEQ ID NO: 651957 - RNA, 64 nt, Homo Sapiens; identical to SEQ ID NO: 380112

SEQ ID NO: 651958 - RNA, 64 nt, Homo Sapiens; identical to SEQ ID NO: 380113

SEQ ID NO: 651959 - RNA, 64 nt, Homo Sapiens; identical to SEQ ID NO: 380114

SEQ ID NO: 651960 - RNA, 64 nt, Homo Sapiens; identical to SEQ ID NO: 380115

SEQ ID NO: 651961 - RNA, 58 nt, Homo Sapiens; identical to SEQ ID NO: 380116

SEQ ID NO: 651962 - RNA, 64 nt, Homo Sapiens; identical to SEQ ID NO: 380117

SEQ ID NO: 651963 - RNA, 64 nt, Homo Sapiens; identical to SEQ ID NO: 380118

SEQ ID NO: 651964 - RNA, 64 nt, Homo Sapiens; identical to SEQ ID NO: 380119

SEQ ID NO: 651965 - RNA, 64 nt, Homo Sapiens; identical to SEQ ID NO: 380120

SEQ ID NO: 651966 - RNA, 64 nt, Homo Sapiens; identical to SEQ ID NO: 380121

SEQ ID NO: 651967 - RNA, 64 nt, Homo Sapiens; identical to SEQ ID NO: 380122

SEQ ID NO: 651968 - RNA, 64 nt, Homo Sapiens; identical to SEQ ID NO: 380123

SEQ ID NO: 651969 - RNA, 64 nt, Homo Sapiens; identical to SEQ ID NO: 380124

SEQ ID NO: 651970 - RNA, 64 nt, Homo Sapiens; identical to SEQ ID NO: 380125

SEQ ID NO: 651971 - RNA, 64 nt, Homo Sapiens; identical to SEQ ID NO: 380126

SEQ ID NO: 651972 - RNA, 64 nt, Homo Sapiens; identical to SEQ ID NO: 380127

SEQ ID NO: 651973 - RNA, 64 nt, Homo Sapiens; identical to SEQ ID NO: 380128

SEQ ID NO: 651974 - RNA, 64 nt, Homo Sapiens; identical to SEQ ID NO: 380129

SEQ ID NO: 651975 - RNA, 64 nt, Homo Sapiens; identical to SEQ ID NO: 380130

SEQ ID NO: 651976 - RNA, 64 nt, Homo Sapiens; identical to SEQ ID NO: 380131

SEQ ID NO: 651977 - RNA, 64 nt, Homo Sapiens; identical to SEQ ID NO: 380132

SEQ ID NO: 651978 - RNA, 64 nt, Homo Sapiens; identical to SEQ ID NO: 380133

SEQ ID NO: 651979 - RNA, 64 nt, Homo Sapiens; identical to SEQ ID NO: 380134

SEQ ID NO: 651980 - RNA, 64 nt, Homo Sapiens; identical to SEQ ID NO: 380135

SEQ ID NO: 651981 - RNA, 64 nt, Homo Sapiens; identical to SEQ ID NO: 380136

SEQ ID NO: 651982 - RNA, 64 nt, Homo Sapiens; identical to SEQ ID NO: 380137

SEQ ID NO: 651983 - RNA, 64 nt, Homo Sapiens; identical to SEQ ID NO: 380138

SEQ ID NO: 651984 - RNA, 64 nt, Homo Sapiens; identical to SEQ ID NO: 380139

SEQ ID NO: 651985 - RNA, 64 nt, Homo Sapiens; identical to SEQ ID NO: 380140

SEQ ID NO: 651986 - RNA, 64 nt, Homo Sapiens; identical to SEQ ID NO: 380141

SEQ ID NO: 651987 - RNA, 64 nt, Homo Sapiens; identical to SEQ ID NO: 380142

SEQ ID NO: 651988 - RNA, 64 nt, Homo Sapiens; identical to SEQ ID NO: 380143

SEQ ID NO: 651989 - RNA, 64 nt, Homo Sapiens; identical to SEQ ID NO: 380144

SEQ ID NO: 651990 - RNA, 64 nt, Homo Sapiens; identical to SEQ ID NO: 380145

SEQ ID NO: 651991 - RNA, 64 nt, Homo Sapiens; identical to SEQ ID NO: 380146

SEQ ID NO: 651992 - RNA, 64 nt, Homo Sapiens; identical to SEQ ID NO: 380147

SEQ ID NO: 651993 - RNA, 59 nt, Homo Sapiens; identical to SEQ ID NO: 380148

SEQ ID NO: 651994 - RNA, 64 nt, Homo Sapiens; identical to SEQ ID NO: 380149

SEQ ID NO: 651995 - RNA, 64 nt, Homo Sapiens; identical to SEQ ID NO: 380150

SEQ ID NO: 651996 - RNA, 64 nt, Homo Sapiens; identical to SEQ ID NO: 380151

SEQ ID NO: 651997 - RNA, 64 nt, Homo Sapiens; identical to SEQ ID NO: 380152

SEQ ID NO: 651998 - RNA, 64 nt, Homo Sapiens; identical to SEQ ID NO: 380153

SEQ ID NO: 651999 - RNA, 64 nt, Homo Sapiens; identical to SEQ ID NO: 380154

SEQ ID NO: 652000 - RNA, 64 nt, Homo Sapiens; identical to SEQ ID NO: 380155

SEQ ID NO: 652001 - RNA, 64 nt, Homo Sapiens; identical to SEQ ID NO: 380156

SEQ ID NO: 652002 - RNA, 64 nt, Homo Sapiens; identical to SEQ ID NO: 380157

SEQ ID NO: 652003 - RNA, 64 nt, Homo Sapiens; identical to SEQ ID NO: 380158

SEQ ID NO: 652004 - RNA, 64 nt, Homo Sapiens; identical to SEQ ID NO: 380159

SEQ ID NO: 652005 - RNA, 64 nt, Homo Sapiens; identical to SEQ ID NO: 380160

SEQ ID NO: 652006 - RNA, 64 nt, Homo Sapiens; identical to SEQ ID NO: 380161

SEQ ID NO: 652007 - RNA, 54 nt, Homo Sapiens; identical to SEQ ID NO: 380162

SEQ ID NO: 652008 - RNA, 64 nt, Homo Sapiens; identical to SEQ ID NO: 380163

SEQ ID NO: 652009 - RNA, 64 nt, Homo Sapiens; identical to SEQ ID NO: 380164

SEQ ID NO: 652010 - RNA, 64 nt, Homo Sapiens; identical to SEQ ID NO: 380165

SEQ ID NO: 652011 - RNA, 64 nt, Homo Sapiens; identical to SEQ ID NO: 380166

SEQ ID NO: 652012 - RNA, 64 nt, Homo Sapiens; identical to SEQ ID NO: 380167

SEQ ID NO: 652013 - RNA, 64 nt, Homo Sapiens; identical to SEQ ID NO: 380168

SEQ ID NO: 652014 - RNA, 64 nt, Homo Sapiens; identical to SEQ ID NO: 380169

SEQ ID NO: 652015 - RNA, 64 nt, Homo Sapiens; identical to SEQ ID NO: 380170

SEQ ID NO: 652016 - RNA, 64 nt, Homo Sapiens; identical to SEQ ID NO: 380171

SEQ ID NO: 652017 - RNA, 64 nt, Homo Sapiens; identical to SEQ ID NO: 380172

SEQ ID NO: 652018 - RNA, 64 nt, Homo Sapiens; identical to SEQ ID NO: 380173

SEQ ID NO: 652019 - RNA, 64 nt, Homo Sapiens; identical to SEQ ID NO: 380174

SEQ ID NO: 652020 - RNA, 64 nt, Homo Sapiens; identical to SEQ ID NO: 380175

SEQ ID NO: 652021 - RNA, 64 nt, Homo Sapiens; identical to SEQ ID NO: 380176

SEQ ID NO: 652022 - RNA, 64 nt, Homo Sapiens; identical to SEQ ID NO: 380177

SEQ ID NO: 652023 - RNA, 64 nt, Homo Sapiens; identical to SEQ ID NO: 380178

SEQ ID NO: 652024 - RNA, 64 nt, Homo Sapiens; identical to SEQ ID NO: 380179

SEQ ID NO: 652025 - RNA, 64 nt, Homo Sapiens; identical to SEQ ID NO: 380180

SEQ ID NO: 652026 - RNA, 64 nt, Homo Sapiens; identical to SEQ ID NO: 380181

SEQ ID NO: 652027 - RNA, 64 nt, Homo Sapiens; identical to SEQ ID NO: 380182

SEQ ID NO: 652028 - RNA, 64 nt, Homo Sapiens; identical to SEQ ID NO: 380183

SEQ ID NO: 652029 - RNA, 64 nt, Homo Sapiens; identical to SEQ ID NO: 380184

SEQ ID NO: 652030 - RNA, 64 nt, Homo Sapiens; identical to SEQ ID NO: 380185

SEQ ID NO: 652031 - RNA, 64 nt, Homo Sapiens; identical to SEQ ID NO: 380186

SEQ ID NO: 652032 - RNA, 64 nt, Homo Sapiens; identical to SEQ ID NO: 380187

SEQ ID NO: 652033 - RNA, 64 nt, Homo Sapiens; identical to SEQ ID NO: 380188

SEQ ID NO: 652034 - RNA, 64 nt, Homo Sapiens; identical to SEQ ID NO: 380189

SEQ ID NO: 652035 - RNA, 64 nt, Homo Sapiens; identical to SEQ ID NO: 380190

SEQ ID NO: 652036 - RNA, 64 nt, Homo Sapiens; identical to SEQ ID NO: 380191

SEQ ID NO: 652037 - RNA, 64 nt, Homo Sapiens; identical to SEQ ID NO: 380192

SEQ ID NO: 652038 - RNA, 64 nt, Homo Sapiens; identical to SEQ ID NO: 380193

SEQ ID NO: 652039 - RNA, 64 nt, Homo Sapiens; identical to SEQ ID NO: 380194

SEQ ID NO: 652040 - RNA, 64 nt, Homo Sapiens; identical to SEQ ID NO: 380195

SEQ ID NO: 652041 - RNA, 58 nt, Homo Sapiens; identical to SEQ ID NO: 380196

SEQ ID NO: 652042 - RNA, 64 nt, Homo Sapiens; identical to SEQ ID NO: 380197

SEQ ID NO: 652043 - RNA, 64 nt, Homo Sapiens; identical to SEQ ID NO: 380198

SEQ ID NO: 652044 - RNA, 64 nt, Homo Sapiens; identical to SEQ ID NO: 380199

SEQ ID NO: 652045 - RNA, 64 nt, Homo Sapiens; identical to SEQ ID NO: 380200

SEQ ID NO: 652046 - RNA, 64 nt, Homo Sapiens; identical to SEQ ID NO: 380201

SEQ ID NO: 652047 - RNA, 64 nt, Homo Sapiens; identical to SEQ ID NO: 380202

SEQ ID NO: 652048 - RNA, 64 nt, Homo Sapiens; identical to SEQ ID NO: 380203

SEQ ID NO: 652049 - RNA, 64 nt, Homo Sapiens; identical to SEQ ID NO: 380204

SEQ ID NO: 652050 - RNA, 64 nt, Homo Sapiens; identical to SEQ ID NO: 380205

SEQ ID NO: 652051 - RNA, 64 nt, Homo Sapiens; identical to SEQ ID NO: 380206

SEQ ID NO: 652052 - RNA, 64 nt, Homo Sapiens; identical to SEQ ID NO: 380207

SEQ ID NO: 652053 - RNA, 64 nt, Homo Sapiens; identical to SEQ ID NO: 380208

SEQ ID NO: 652054 - RNA, 64 nt, Homo Sapiens; identical to SEQ ID NO: 380209

SEQ ID NO: 652055 - RNA, 63 nt, Homo Sapiens; identical to SEQ ID NO: 380210

SEQ ID NO: 652056 - RNA, 64 nt, Homo Sapiens; identical to SEQ ID NO: 380211

SEQ ID NO: 652057 - RNA, 64 nt, Homo Sapiens; identical to SEQ ID NO: 380212

SEQ ID NO: 652058 - RNA, 64 nt, Homo Sapiens; identical to SEQ ID NO: 380213

SEQ ID NO: 652059 - RNA, 64 nt, Homo Sapiens; identical to SEQ ID NO: 380214

SEQ ID NO: 652060 - RNA, 64 nt, Homo Sapiens; identical to SEQ ID NO: 380215

SEQ ID NO: 652061 - RNA, 64 nt, Homo Sapiens; identical to SEQ ID NO: 380216

SEQ ID NO: 652062 - RNA, 64 nt, Homo Sapiens; identical to SEQ ID NO: 380217

SEQ ID NO: 652063 - RNA, 64 nt, Homo Sapiens; identical to SEQ ID NO: 380218

SEQ ID NO: 652064 - RNA, 64 nt, Homo Sapiens; identical to SEQ ID NO: 380219

SEQ ID NO: 652065 - RNA, 64 nt, Homo Sapiens; identical to SEQ ID NO: 380220

SEQ ID NO: 652066 - RNA, 64 nt, Homo Sapiens; identical to SEQ ID NO: 380221

SEQ ID NO: 652067 - RNA, 64 nt, Homo Sapiens; identical to SEQ ID NO: 380222

SEQ ID NO: 652068 - RNA, 64 nt, Homo Sapiens; identical to SEQ ID NO: 380223

SEQ ID NO: 652069 - RNA, 64 nt, Homo Sapiens; identical to SEQ ID NO: 380224

SEQ ID NO: 652070 - RNA, 64 nt, Homo Sapiens; identical to SEQ ID NO: 380225

SEQ ID NO: 652071 - RNA, 64 nt, Homo Sapiens; identical to SEQ ID NO: 380226

SEQ ID NO: 652072 - RNA, 64 nt, Homo Sapiens; identical to SEQ ID NO: 380227

SEQ ID NO: 652073 - RNA, 64 nt, Homo Sapiens; identical to SEQ ID NO: 380228

SEQ ID NO: 652074 - RNA, 64 nt, Homo Sapiens; identical to SEQ ID NO: 380229

SEQ ID NO: 652075 - RNA, 64 nt, Homo Sapiens; identical to SEQ ID NO: 380230

SEQ ID NO: 652076 - RNA, 64 nt, Homo Sapiens; identical to SEQ ID NO: 380231

SEQ ID NO: 652077 - RNA, 64 nt, Homo Sapiens; identical to SEQ ID NO: 380232

SEQ ID NO: 652078 - RNA, 64 nt, Homo Sapiens; identical to SEQ ID NO: 380233

SEQ ID NO: 652079 - RNA, 64 nt, Homo Sapiens; identical to SEQ ID NO: 380234

SEQ ID NO: 652080 - RNA, 64 nt, Homo Sapiens; identical to SEQ ID NO: 380235

SEQ ID NO: 652081 - RNA, 51 nt, Homo Sapiens; identical to SEQ ID NO: 380236

SEQ ID NO: 652082 - RNA, 64 nt, Homo Sapiens; identical to SEQ ID NO: 380237

SEQ ID NO: 652083 - RNA, 64 nt, Homo Sapiens; identical to SEQ ID NO: 380238

SEQ ID NO: 652084 - RNA, 64 nt, Homo Sapiens; identical to SEQ ID NO: 380239

SEQ ID NO: 652085 - RNA, 64 nt, Homo Sapiens; identical to SEQ ID NO: 380240

SEQ ID NO: 652086 - RNA, 64 nt, Homo Sapiens; identical to SEQ ID NO: 380241

SEQ ID NO: 652087 - RNA, 64 nt, Homo Sapiens; identical to SEQ ID NO: 380242

SEQ ID NO: 652088 - RNA, 64 nt, Homo Sapiens; identical to SEQ ID NO: 380243

SEQ ID NO: 652089 - RNA, 64 nt, Homo Sapiens; identical to SEQ ID NO: 380244

SEQ ID NO: 652090 - RNA, 64 nt, Homo Sapiens; identical to SEQ ID NO: 380245

SEQ ID NO: 652091 - RNA, 64 nt, Homo Sapiens; identical to SEQ ID NO: 380246

SEQ ID NO: 652092 - RNA, 64 nt, Homo Sapiens; identical to SEQ ID NO: 380247

SEQ ID NO: 652093 - RNA, 64 nt, Homo Sapiens; identical to SEQ ID NO: 380248

SEQ ID NO: 652094 - RNA, 64 nt, Homo Sapiens; identical to SEQ ID NO: 380249

SEQ ID NO: 652095 - RNA, 64 nt, Homo Sapiens; identical to SEQ ID NO: 380250

SEQ ID NO: 652096 - RNA, 64 nt, Homo Sapiens; identical to SEQ ID NO: 380251

SEQ ID NO: 652097 - RNA, 64 nt, Homo Sapiens; identical to SEQ ID NO: 380252

SEQ ID NO: 652098 - RNA, 64 nt, Homo Sapiens; identical to SEQ ID NO: 380253

SEQ ID NO: 652099 - RNA, 64 nt, Homo Sapiens; identical to SEQ ID NO: 380254

SEQ ID NO: 652100 - RNA, 64 nt, Homo Sapiens; identical to SEQ ID NO: 380255

SEQ ID NO: 652101 - RNA, 64 nt, Homo Sapiens; identical to SEQ ID NO: 380256

SEQ ID NO: 652102 - RNA, 64 nt, Homo Sapiens; identical to SEQ ID NO: 380257

SEQ ID NO: 652103 - RNA, 64 nt, Homo Sapiens; identical to SEQ ID NO: 380258

SEQ ID NO: 652104 - RNA, 64 nt, Homo Sapiens; identical to SEQ ID NO: 380259

SEQ ID NO: 652105 - RNA, 64 nt, Homo Sapiens; identical to SEQ ID NO: 380260

SEQ ID NO: 652106 - RNA, 64 nt, Homo Sapiens; identical to SEQ ID NO: 380261

SEQ ID NO: 652107 - RNA, 64 nt, Homo Sapiens; identical to SEQ ID NO: 380262

SEQ ID NO: 652108 - RNA, 64 nt, Homo Sapiens; identical to SEQ ID NO: 380263

SEQ ID NO: 652109 - RNA, 64 nt, Homo Sapiens; identical to SEQ ID NO: 380264

SEQ ID NO: 652110 - RNA, 64 nt, Homo Sapiens; identical to SEQ ID NO: 380265

SEQ ID NO: 652111 - RNA, 64 nt, Homo Sapiens; identical to SEQ ID NO: 380266

SEQ ID NO: 652112 - RNA, 64 nt, Homo Sapiens; identical to SEQ ID NO: 380267

SEQ ID NO: 652113 - RNA, 64 nt, Homo Sapiens; identical to SEQ ID NO: 380268

SEQ ID NO: 652114 - RNA, 64 nt, Homo Sapiens; identical to SEQ ID NO: 380269

SEQ ID NO: 652115 - RNA, 64 nt, Homo Sapiens; identical to SEQ ID NO: 380270

SEQ ID NO: 652116 - RNA, 64 nt, Homo Sapiens; identical to SEQ ID NO: 380271

SEQ ID NO: 652117 - RNA, 64 nt, Homo Sapiens; identical to SEQ ID NO: 380272

SEQ ID NO: 652118 - RNA, 64 nt, Homo Sapiens; identical to SEQ ID NO: 380273

SEQ ID NO: 652119 - RNA, 64 nt, Homo Sapiens; identical to SEQ ID NO: 380274

SEQ ID NO: 652120 - RNA, 64 nt, Homo Sapiens; identical to SEQ ID NO: 380275

SEQ ID NO: 652121 - RNA, 64 nt, Homo Sapiens; identical to SEQ ID NO: 380276

SEQ ID NO: 652122 - RNA, 64 nt, Homo Sapiens; identical to SEQ ID NO: 380277

SEQ ID NO: 652123 - RNA, 64 nt, Homo Sapiens; identical to SEQ ID NO: 380278

SEQ ID NO: 652124 - RNA, 64 nt, Homo Sapiens; identical to SEQ ID NO: 380279

SEQ ID NO: 652125 - RNA, 50 nt, Homo Sapiens; identical to SEQ ID NO: 380280

SEQ ID NO: 652126 - RNA, 64 nt, Homo Sapiens; identical to SEQ ID NO: 380281

SEQ ID NO: 652127 - RNA, 63 nt, Homo Sapiens; identical to SEQ ID NO: 380282

SEQ ID NO: 652128 - RNA, 64 nt, Homo Sapiens; identical to SEQ ID NO: 380283

SEQ ID NO: 652129 - RNA, 64 nt, Homo Sapiens; identical to SEQ ID NO: 380284

SEQ ID NO: 652130 - RNA, 64 nt, Homo Sapiens; identical to SEQ ID NO: 380285

SEQ ID NO: 652131 - RNA, 64 nt, Homo Sapiens; identical to SEQ ID NO: 380286

SEQ ID NO: 652132 - RNA, 64 nt, Homo Sapiens; identical to SEQ ID NO: 380287

SEQ ID NO: 652133 - RNA, 64 nt, Homo Sapiens; identical to SEQ ID NO: 380288

SEQ ID NO: 652134 - RNA, 64 nt, Homo Sapiens; identical to SEQ ID NO: 380289

SEQ ID NO: 652135 - RNA, 64 nt, Homo Sapiens; identical to SEQ ID NO: 380290

SEQ ID NO: 652136 - RNA, 64 nt, Homo Sapiens; identical to SEQ ID NO: 380291

SEQ ID NO: 652137 - RNA, 64 nt, Homo Sapiens; identical to SEQ ID NO: 380292

SEQ ID NO: 652138 - RNA, 64 nt, Homo Sapiens; identical to SEQ ID NO: 380293

SEQ ID NO: 652139 - RNA, 64 nt, Homo Sapiens; identical to SEQ ID NO: 380294

SEQ ID NO: 652140 - RNA, 64 nt, Homo Sapiens; identical to SEQ ID NO: 380295

SEQ ID NO: 652141 - RNA, 64 nt, Homo Sapiens; identical to SEQ ID NO: 380296

SEQ ID NO: 652142 - RNA, 64 nt, Homo Sapiens; identical to SEQ ID NO: 380297

SEQ ID NO: 652143 - RNA, 64 nt, Homo Sapiens; identical to SEQ ID NO: 380298

SEQ ID NO: 652144 - RNA, 64 nt, Homo Sapiens; identical to SEQ ID NO: 380299

SEQ ID NO: 652145 - RNA, 64 nt, Homo Sapiens; identical to SEQ ID NO: 380300

SEQ ID NO: 652146 - RNA, 64 nt, Homo Sapiens; identical to SEQ ID NO: 380301

SEQ ID NO: 652147 - RNA, 64 nt, Homo Sapiens; identical to SEQ ID NO: 380302

SEQ ID NO: 652148 - RNA, 64 nt, Homo Sapiens; identical to SEQ ID NO: 380303

SEQ ID NO: 652149 - RNA, 64 nt, Homo Sapiens; identical to SEQ ID NO: 380304

SEQ ID NO: 652150 - RNA, 64 nt, Homo Sapiens; identical to SEQ ID NO: 380304

SEQ ID NO: 652151 - RNA, 64 nt, Homo Sapiens; identical to SEQ ID NO: 380306

SEQ ID NO: 652152 - RNA, 64 nt, Homo Sapiens; identical to SEQ ID NO: 380307

SEQ ID NO: 652153 - RNA, 64 nt, Homo Sapiens; identical to SEQ ID NO: 380308

SEQ ID NO: 652154 - RNA, 64 nt, Homo Sapiens; identical to SEQ ID NO: 380309

SEQ ID NO: 652155 - RNA, 64 nt, Homo Sapiens; identical to SEQ ID NO: 380310

SEQ ID NO: 652156 - RNA, 64 nt, Homo Sapiens; identical to SEQ ID NO: 380311

SEQ ID NO: 652157 - RNA, 64 nt, Homo Sapiens
uguauauguugucaugcaggguuugggccaagaaagcaugcagaaaaaaaugccaugugauugu

SEQ ID NO: 652158 - RNA, 64 nt, Homo Sapiens
aaaugauucucucacaggcuugggaaauccuguuagcaugcagaauaaugugguaacuuuguca

SEQ ID NO: 652159 - RNA, 64 nt, Homo Sapiens
agauuauuuuagucugucauccagaaaaugugucagcaugcauagugcuaagaaagcaagccaa

SEQ ID NO: 652160 - RNA, 64 nt, Homo Sapiens
auuuuuuguauauuaaagcaccaaauucauguacagcaugcaucacggaucaauagacuguacu

SEQ ID NO: 652161 - RNA, 64 nt, Homo Sapiens
gcugccaggugagucaccgccuguccugcaguggagcaugcacagcucgcagccucuuugcacg

SEQ ID NO: 652162 - RNA, 64 nt, Homo Sapiens
aacagacacaucuccaaaugggcaaggagucucuagcaugcagcccaggccuucuccauacccc

SEQ ID NO: 652163 - RNA, 64 nt, Homo Sapiens
ggcaggccacaguccugagcuuguaagauggugcagcaugcagaccagacuuguccccaagguc

SEQ ID NO: 652164 - RNA, 64 nt, Homo Sapiens
gcuggcuacuaacuaacugggagaccuuaggcaaagcaugcaaucgcucugaauggcaguuucc

SEQ ID NO: 652165 - RNA, 64 nt, Homo Sapiens
gugguguagaggcaggcauuaaaacuaaguggugagcaugcauugaucuguuugcaucuucuuu

SEQ ID NO: 652166 - RNA, 64 nt, Homo Sapiens
auggugccccucuucugaccuguauacucuaaaaagcaugcagcuuggcugggccaugagaguc

SEQ ID NO: 652167 - RNA, 64 nt, Homo Sapiens
gaccguguucacgauucccuacucugcaacucucagcaugcaucaugaugauucucuaacacug

SEQ ID NO: 652168 - RNA, 64 nt, Homo Sapiens
uaacacugucugucaccuuccuguauuuccacagagcaugcaagaacuucuacaaaacuucuau

SEQ ID NO: 652169 - RNA, 64 nt, Homo Sapiens; identical to SEQ ID NO: 102259

SEQ ID NO: 652170 - RNA, 64 nt, Homo Sapiens; identical to SEQ ID NO: 102260

SEQ ID NO: 652171 - RNA, 64 nt, Homo Sapiens; identical to SEQ ID NO: 102261

SEQ ID NO: 652172 - RNA, 64 nt, Homo Sapiens; identical to SEQ ID NO: 102262

SEQ ID NO: 652173 - RNA, 64 nt, Homo Sapiens; identical to SEQ ID NO: 102263

SEQ ID NO: 652174 - RNA, 64 nt, Homo Sapiens; identical to SEQ ID NO: 102264

SEQ ID NO: 652175 - RNA, 64 nt, Homo Sapiens; identical to SEQ ID NO: 102265

SEQ ID NO: 652176 - RNA, 64 nt, Homo Sapiens; identical to SEQ ID NO: 102266

SEQ ID NO: 652177 - RNA, 64 nt, Homo Sapiens; identical to SEQ ID NO: 102267

SEQ ID NO: 652178 - RNA, 64 nt, Homo Sapiens; identical to SEQ ID NO: 102268

SEQ ID NO: 652179 - RNA, 64 nt, Homo Sapiens
aggauuguugcugccagaacuaaagaaauauuccaagugucauuuuuguaacuguuuagugcug

SEQ ID NO: 652180 - RNA, 64 nt, Homo Sapiens
ucuaauggggaaauauauucuuagaccccccaaaaagugucaguauagauuuugaauugauucu

SEQ ID NO: 652181 - RNA, 64 nt, Homo Sapiens
uuaauauuuauugcuaccuuuauuuauuauucaaaagugucauuugcuuccacauucaccuaug

SEQ ID NO: 652182 - RNA, 64 nt, Homo Sapiens
gaaagugcuuuccagaauaauaugaaguaucuaaaagugucaccuuuucuugccugaucaacaa

SEQ ID NO: 652183 - RNA, 64 nt, Homo Sapiens
cacucuggucuuggaauuccauuugaggauuuagaagugucauguuuauaacuauucaguugug

SEQ ID NO: 652184 - RNA, 64 nt, Homo Sapiens
ccauucacccaugaauggaugguagaagcagcccaagugucaucauuauuuacaguagccaaaa

SEQ ID NO: 652185 - RNA, 64 nt, Homo Sapiens
acaggcauaacauauuuuuaaugaguaucuugugaagugucauaacuagagcuuuagugucuac

SEQ ID NO: 652186 - RNA, 64 nt, Homo Sapiens
gccuuuauuuauuacuuuuuggaggaaaucagagaagugucaauggaccgucacucagacugag

SEQ ID NO: 652187 - RNA, 64 nt, Homo Sapiens
auuaauaauagguuacaggaaagccagccagaggaagugucagcacuuuaaaauucuagacccc

SEQ ID NO: 652188 - RNA, 64 nt, Homo Sapiens
gauucggcugccggaaaugcggugcagcugccgaaagugucagacccgaugugcaccuccccga

SEQ ID NO: 652189 - RNA, 64 nt, Homo Sapiens
gaugaaacucccagaggugugguacagcugccgaaagugucagaccggaggugcggcuuccaga

SEQ ID NO: 652190 - RNA, 64 nt, Homo Sapiens
gaugaaacucccaaaggugcgguagagcugcccaaagugucagaccggaggugcggcuuccaga

SEQ ID NO: 652191 - RNA, 64 nt, Homo Sapiens
uuguggcuugaguuuacaaacuuaaccaugauuauuaacuaaguguugcucuuuggcaaugucc

SEQ ID NO: 652192 - RNA, 64 nt, Homo Sapiens
guguacagaaaugaacguguucccagguucuaaauuaacuaaauuggggaaucgauuguaaaag

SEQ ID NO: 652193 - RNA, 64 nt, Homo Sapiens
cccaaccgauuuccauaaugaaauacuacaauauuuaacuaagguuucaauauacaaauuuuaa

SEQ ID NO: 652194 - RNA, 64 nt, Homo Sapiens
uguaggauuuuaaaauuaaaauuuucucuaacccuuaacuaaaguuccuccuccauagggacac

SEQ ID NO: 652195 - RNA, 64 nt, Homo Sapiens
acuaagauaauguuuccuaguuuucaagucaauuuuaacuaaaaaaagacaugcacuuuccaua

SEQ ID NO: 652196 - RNA, 64 nt, Homo Sapiens
uaagauuagcuauuauuugucaaagccagaaagcuuaacuaaugcuuuggacuuuugauauacu

SEQ ID NO: 652197 - RNA, 64 nt, Homo Sapiens
cuguuuuaugguugugcuaaaacaagugucuugguuaacuaauuguacuuguuucccuuuuuga

SEQ ID NO: 652198 - RNA, 64 nt, Homo Sapiens
uguuacuugccuuucucaccgggccagcagguuuuuaacuaaauggaaugaaucaacugaccuu

SEQ ID NO: 652199 - RNA, 64 nt, Homo Sapiens
acaauaaauuaaacaaagccguacaggagugacauuaacuaaugucuuuuagcaauucaguuua

SEQ ID NO: 652200 - RNA, 64 nt, Homo Sapiens
ggcuauucgaaaucuugacuuuuuuuuuuacacauuaacuaaagaggaauugccucaggcauuu

SEQ ID NO: 652201 - RNA, 64 nt, Homo Sapiens
uuuuuccuuuucucucaaacuuauuguaaagauuuuaacuaaaggauuuauagucauaauuauu

SEQ ID NO: 652202 - RNA, 64 nt, Homo Sapiens
agauuuauagucauaauuauuaauguguacauauuuaacuaaaguucuuuauacaaauaccaug

SEQ ID NO: 652203 - RNA, 64 nt, Homo Sapiens
cagugaccugguccuaaguuaauauaaauauacuuuaacuaagcccuuaccuuggaaacuauca

SEQ ID NO: 652204 - RNA, 64 nt, Homo Sapiens
uugucugcaguuugguauuguuucugcauaguucuuaacuaaucuaaagguaggaugcucaggu

SEQ ID NO: 652205 - RNA, 64 nt, Homo Sapiens
ucuuuuauuuauuauauuauaccagcacuacuaauuaacuaaugguuuaguauuuuagaaauau

SEQ ID NO: 652206 - RNA, 64 nt, Homo Sapiens
acaaauauaugcauuguguaauaaauuuagcaguuuaacuaaauucuuucuuggaauaugugaa

SEQ ID NO: 652207 - RNA, 64 nt, Homo Sapiens
acagacaugguguacugaucagaaauguucaguuuuaacuaaaacuaaauuuauguuauuuggc

SEQ ID NO: 652208 - RNA, 64 nt, Homo Sapiens
agcugcaaaauaauuguagacaaaauaauggcauuuaacuaaagauggagcaugaucuaaguac

SEQ ID NO: 652209 - RNA, 64 nt, Homo Sapiens
gcuaugagccuaaaaccucuuuaaaaacggucaguuaacuaaaaaauaaaaaucaagucuuuag

SEQ ID NO: 652210 - RNA, 64 nt, Homo Sapiens
aaaaaucaagucuuuaggagaguagaaaacacaauuaacuaaaaagcagggacaucugaaagag

SEQ ID NO: 652211 - RNA, 64 nt, Homo Sapiens
auaaaccauuuuguauguuuggauuuugaauggguuaacuaauuacaggcuaaaauaaugccuu

SEQ ID NO: 652212 - RNA, 64 nt, Homo Sapiens
gauuuauauagucagguuuuugucauguaauuuauuaacuaacuauuacagaaacacagcuaag

SEQ ID NO: 652213 - RNA, 64 nt, Homo Sapiens
aaagguguuuuauugauaaaucuauuguacuauuuggauacauuuguguauuccuugcagccaa

SEQ ID NO: 652214 - RNA, 64 nt, Homo Sapiens
uuuaaaauuacauaacuaaaaauaaaccacacuguggauacaucuuauaaaacuaauggaaaca

SEQ ID NO: 652215 - RNA, 64 nt, Homo Sapiens
uauaauuuuuguuaauaagacaaagguaauauauuggauacaaagacacaaauguauugugugu

SEQ ID NO: 652216 - RNA, 64 nt, Homo Sapiens
uuaaugaagcagagagcuaguacuucauuuucacuggauacauuuucagcaucaugaguuguca

SEQ ID NO: 652217 - RNA, 64 nt, Homo Sapiens; identical to SEQ ID NO: 354645

SEQ ID NO: 652218 - RNA, 64 nt, Homo Sapiens; identical to SEQ ID NO: 354646

SEQ ID NO: 652219 - RNA, 64 nt, Homo Sapiens; identical to SEQ ID NO: 354647

SEQ ID NO: 652220 - RNA, 64 nt, Homo Sapiens; identical to SEQ ID NO: 354648

SEQ ID NO: 652221 - RNA, 64 nt, Homo Sapiens; identical to SEQ ID NO: 354649

SEQ ID NO: 652222 - RNA, 64 nt, Homo Sapiens; identical to SEQ ID NO: 354650

SEQ ID NO: 652223 - RNA, 64 nt, Homo Sapiens; identical to SEQ ID NO: 354651

SEQ ID NO: 652224 - RNA, 64 nt, Homo Sapiens; identical to SEQ ID NO: 354652

SEQ ID NO: 652225 - RNA, 64 nt, Homo Sapiens; identical to SEQ ID NO: 354653

SEQ ID NO: 652226 - RNA, 64 nt, Homo Sapiens; identical to SEQ ID NO: 354654

SEQ ID NO: 652227 - RNA, 64 nt, Homo Sapiens; identical to SEQ ID NO: 354655

SEQ ID NO: 652228 - RNA, 64 nt, Homo Sapiens; identical to SEQ ID NO: 354656

SEQ ID NO: 652229 - RNA, 64 nt, Homo Sapiens; identical to SEQ ID NO: 354657

SEQ ID NO: 652230 - RNA, 64 nt, Homo Sapiens; identical to SEQ ID NO: 354658

SEQ ID NO: 652231 - RNA, 64 nt, Homo Sapiens; identical to SEQ ID NO: 354659

SEQ ID NO: 652232 - RNA, 64 nt, Homo Sapiens; identical to SEQ ID NO: 354660

SEQ ID NO: 652233 - RNA, 64 nt, Homo Sapiens; identical to SEQ ID NO: 354661

SEQ ID NO: 652234 - RNA, 64 nt, Homo Sapiens; identical to SEQ ID NO: 354662

SEQ ID NO: 652235 - RNA, 64 nt, Homo Sapiens; identical to SEQ ID NO: 354663

SEQ ID NO: 652236 - RNA, 64 nt, Homo Sapiens; identical to SEQ ID NO: 354664

SEQ ID NO: 652237 - RNA, 64 nt, Homo Sapiens; identical to SEQ ID NO: 354665

SEQ ID NO: 652238 - RNA, 64 nt, Homo Sapiens; identical to SEQ ID NO: 354666

SEQ ID NO: 652239 - RNA, 64 nt, Homo Sapiens; identical to SEQ ID NO: 151446

SEQ ID NO: 652240 - RNA, 64 nt, Homo Sapiens; identical to SEQ ID NO: 151447

SEQ ID NO: 652241 - RNA, 64 nt, Homo Sapiens; identical to SEQ ID NO: 151448

SEQ ID NO: 652242 - RNA, 64 nt, Homo Sapiens; identical to SEQ ID NO: 151449

SEQ ID NO: 652243 - RNA, 64 nt, Homo Sapiens; identical to SEQ ID NO: 151450

SEQ ID NO: 652244 - RNA, 64 nt, Homo Sapiens; identical to SEQ ID NO: 151451

SEQ ID NO: 652245 - RNA, 64 nt, Homo Sapiens; identical to SEQ ID NO: 151452

SEQ ID NO: 652246 - RNA, 64 nt, Homo Sapiens; identical to SEQ ID NO: 151453

SEQ ID NO: 652247 - RNA, 64 nt, Homo Sapiens; identical to SEQ ID NO: 151454

SEQ ID NO: 652248 - RNA, 64 nt, Homo Sapiens; identical to SEQ ID NO: 151455

SEQ ID NO: 652249 - RNA, 64 nt, Homo Sapiens; identical to SEQ ID NO: 151456

SEQ ID NO: 652250 - RNA, 64 nt, Homo Sapiens; identical to SEQ ID NO: 151457

SEQ ID NO: 652251 - RNA, 64 nt, Homo Sapiens; identical to SEQ ID NO: 151458

SEQ ID NO: 652252 - RNA, 64 nt, Homo Sapiens; identical to SEQ ID NO: 151459

SEQ ID NO: 652253 - RNA, 64 nt, Homo Sapiens; identical to SEQ ID NO: 151460

SEQ ID NO: 652254 - RNA, 64 nt, Homo Sapiens; identical to SEQ ID NO: 151461

SEQ ID NO: 652255 - RNA, 64 nt, Homo Sapiens; identical to SEQ ID NO: 151462

SEQ ID NO: 652256 - RNA, 64 nt, Homo Sapiens; identical to SEQ ID NO: 151463

SEQ ID NO: 652257 - RNA, 64 nt, Homo Sapiens; identical to SEQ ID NO: 151464

SEQ ID NO: 652258 - RNA, 64 nt, Homo Sapiens; identical to SEQ ID NO: 151465

SEQ ID NO: 652259 - RNA, 64 nt, Homo Sapiens; identical to SEQ ID NO: 151466

SEQ ID NO: 652260 - RNA, 64 nt, Homo Sapiens; identical to SEQ ID NO: 151467

SEQ ID NO: 652261 - RNA, 64 nt, Homo Sapiens; identical to SEQ ID NO: 151468

SEQ ID NO: 652262 - RNA, 64 nt, Homo Sapiens; identical to SEQ ID NO: 151469

SEQ ID NO: 652263 - RNA, 64 nt, Homo Sapiens; identical to SEQ ID NO: 151470

SEQ ID NO: 652264 - RNA, 64 nt, Homo Sapiens; identical to SEQ ID NO: 151471

SEQ ID NO: 652265 - RNA, 64 nt, Homo Sapiens
aggaaacuuugaaggguuaaauagagauuuaaaaaaauaaaauaaaaaggcugggcuagggugc

SEQ ID NO: 652266 - RNA, 64 nt, Homo Sapiens
acuuugaaggguuaaauagagauuuaaaaaaauaaaauaaaaaggcugggcuagggugcuuuuu

SEQ ID NO: 652267 - RNA, 64 nt, Homo Sapiens
cuuuuuauaagaguugucauuguuggaaauucuuaaauaaaacugauuuaaauaauaugugucu

SEQ ID NO: 652268 - RNA, 64 nt, Homo Sapiens
augcauucauucuaaaaaauuuuuugaaccagauaaauaaaauuuuuuuuugacaccacaguuu

SEQ ID NO: 652269 - RNA, 64 nt, Homo Sapiens
cagaaagaaauccugugugagccucugguaugagaaauaaaaucugccaguuuuauaacauuca

SEQ ID NO: 652270 - RNA, 64 nt, Homo Sapiens
guguuggugcucaaugcaguguagacauguuuucaaauaaaacaaaugauuguguacaacaaug

SEQ ID NO: 652271 - RNA, 64 nt, Homo Sapiens
aguuacuguuguuuacagugaguuuggggaaaaaaaauaaaauaaaaauggcuuucccaguccu

SEQ ID NO: 652272 - RNA, 64 nt, Homo Sapiens
cuguuguuuacagugaguuuggggaaaaaaaauaaaauaaaaauggcuuucccaguccuugcau

SEQ ID NO: 652273 - RNA, 64 nt, Homo Sapiens
augcuaucagaaacaguauuuucuucccaaaucaaaauaaaagaaauaugaucagagcuugaac

SEQ ID NO: 652274 - RNA, 64 nt, Homo Sapiens
auaugaucagagcuugaacacaggcuuauuuuuaaaauaaaaauauuuuuaacauggguuuccu

SEQ ID NO: 652275 - RNA, 64 nt, Homo Sapiens
cuagugaacaaaaggugccuauucuuuuuuaaaaaaauaaaauaaaacauaaauauuacucuuc

SEQ ID NO: 652276 - RNA, 64 nt, Homo Sapiens
gaacaaaaggugccuauucuuuuuuaaaaaaauaaaauaaaacauaaauauuacucuuccauau

SEQ ID NO: 652277 - RNA, 64 nt, Homo Sapiens
cugucaauagccuagggcugaauuuuugucagauaaauaaaauaaaucauucauccuuuuuuuu

SEQ ID NO: 652278 - RNA, 64 nt, Homo Sapiens
uaaauguauuuuagacuuccuguagggggcgauaaaauaaaaugcuaaacaacuggguauacau

SEQ ID NO: 652279 - RNA, 64 nt, Homo Sapiens
aaaaucaugucaucuucuauuuguacagaaaugaaaauaaaauaugaaaauaaugaaagaaaug

SEQ ID NO: 652280 - RNA, 64 nt, Homo Sapiens
gggcaaaugucauuguuaccucuguguguuaagaaaauaaaaauauuuucuaaaggucuguauu

SEQ ID NO: 652281 - RNA, 64 nt, Homo Sapiens
gaacauuuuucuuuuauuguuuuaucuucacagaaaauaaaagguguuaauuugcuuuuuaaaa

SEQ ID NO: 652282 - RNA, 64 nt, Homo Sapiens
cugaguugauuuucuagguucuuacguauuugaaaaauaaaauugcaauucgagauaagugcuu

SEQ ID NO: 652283 - RNA, 64 nt, Homo Sapiens
aaaugaccuuuucuugaaauguaacuugaaaacaaaauaaaauguggaacauaauguuuaauua

SEQ ID NO: 652284 - RNA, 64 nt, Homo Sapiens
auuauuuguggagaacucuaagguuaagaucaggaaauaaaagacugugugugugugugugugu

SEQ ID NO: 652285 - RNA, 64 nt, Homo Sapiens
cuaucacuuuaaaaaaauaauugaaguguaagcuaaauaaaaugcuuggaguuuugccugggcu

SEQ ID NO: 652286 - RNA, 64 nt, Homo Sapiens
gcuucccucaguucaccaaaguuaccaaaauguaaaauaaaauaagacuggcucagguaaguag

SEQ ID NO: 652287 - RNA, 64 nt, Homo Sapiens
ugugggccaaaucuagcucacuaucuguuuuuguaaauaaaauuuuauaauaguacacagccac

SEQ ID NO: 652288 - RNA, 64 nt, Homo Sapiens
uaaaucuagaaaccauuaguuugagaucucucaaaaauaaaaauaaaaauugcuuucagagagu

SEQ ID NO: 652289 - RNA, 64 nt, Homo Sapiens
uagaaaccauuaguuugagaucucucaaaaauaaaaauaaaaauugcuuucagagaguagccca

SEQ ID NO: 652290 - RNA, 64 nt, Homo Sapiens
augaauucuccauuuccuacuggaggauuuauuuaaauaaaauaugcuuauuaaacacuccugc

SEQ ID NO: 652291 - RNA, 64 nt, Homo Sapiens
cgacauuauaugugacuuaaaaccuagaagaaauaaauaaaacuauugaucaauuuuaacuaca

SEQ ID NO: 652292 - RNA, 64 nt, Homo Sapiens
ucuggccaacauggugaaacccugucucuacugaaaauaaaaaaaacuagcugggcaugguggc

SEQ ID NO: 652293 - RNA, 64 nt, Homo Sapiens
uugauucauuuuagaucucuggggaagaaaaaggaaauaaaaaccaucucaauaauuaagguaa

SEQ ID NO: 652294 - RNA, 64 nt, Homo Sapiens
gacuuaugguccaaaaaagugacccaauggcaacaaauaaaaauugaaaugcaguuguucuccu

SEQ ID NO: 652295 - RNA, 64 nt, Homo Sapiens
agccuaggagacaaaacgagacuucauuuaaaaaaaauaaaaauaaaaauaaaaauaaagucau

SEQ ID NO: 652296 - RNA, 64 nt, Homo Sapiens
ggagacaaaacgagacuucauuuaaaaaaaauaaaaauaaaaauaaaaauaaagucaucuugcc

SEQ ID NO: 652297 - RNA, 64 nt, Homo Sapiens
aaaacgagacuucauuuaaaaaaaauaaaaauaaaaauaaaaauaaagucaucuugccacccac

SEQ ID NO: 652298 - RNA, 64 nt, Homo Sapiens
acaagaucuguaauguuauuuccacuuauaaaggaaauaaaaaaugaaaaacauuauuuggaua

SEQ ID NO: 652299 - RNA, 64 nt, Homo Sapiens
aaaaaaugaaaaacauuauuuggauaucaaaagcaaauaaaaacccaauucagucucuucuaag

SEQ ID NO: 652300 - RNA, 64 nt, Homo Sapiens
accuuaguuacauccuaggaaaaaauacuuccuaaaauaaaacuaagguaucauccuuacccuu

SEQ ID NO: 652301 - RNA, 64 nt, Homo Sapiens
cuuaaaucuccaggcuuuuuaaagcacaaaauauaaauaaaagcugggaaaguaaaccaaaauu

SEQ ID NO: 652302 - RNA, 64 nt, Homo Sapiens
caaguuggagcaauugucuguguuugaaaagaugaaauaaaaauaauaaucaagggcaaagcuu

SEQ ID NO: 652303 - RNA, 64 nt, Homo Sapiens
uccccauuccaagaaauauaagugagugaaguugaaauaaaaucuuuaaaauuuacuauauugc

SEQ ID NO: 652304 - RNA, 64 nt, Homo Sapiens
aacaguucucuuguauuuauuuaucaauuaaaucaaauaaaaaugauuaugucaaugcguuuuc

SEQ ID NO: 652305 - RNA, 64 nt, Homo Sapiens
auacauuuuuuaggacaucuuaaaucuaaacaaaaaauaaaaugaacaucucuugaaaccuguu

SEQ ID NO: 652306 - RNA, 64 nt, Homo Sapiens
cuuuagguuagggguucuauuuauuccuguuaguaaauaaaauuaacaaauuucuuuguuuaac

SEQ ID NO: 652307 - RNA, 64 nt, Homo Sapiens
aguuauuaggaaacagaaggcaaaaagauugucaaaauaaaaacaauaauucaaguaacaaugc

SEQ ID NO: 652308 - RNA, 64 nt, Homo Sapiens
acuguuuuugacaauuuuuuuaucaagaaagagcaaauaaaaagcagugguaaugauccaaagu

SEQ ID NO: 652309 - RNA, 64 nt, Homo Sapiens
uaauuaugaagaugaaacacuagagucauauaagaaauaaaaauugggcaauaaaauaaaauga

SEQ ID NO: 652310 - RNA, 64 nt, Homo Sapiens
cuagagucauauaagaaauaaaaauugggcaauaaaauaaaaugauucaguguuucuuuucuau

SEQ ID NO: 652311 - RNA, 64 nt, Homo Sapiens
auaauagaacuagugacuaaucacacaucuugaaaaauaaaacgcauauugucaccuguaccug

SEQ ID NO: 652312 - RNA, 64 nt, Homo Sapiens
guugaacucucugucuucauucccuuagauugcaaaauaaaauagauugaagugcagagaaaaa

SEQ ID NO: 652313 - RNA, 63 nt, Homo Sapiens; identical to SEQ ID NO: 628887

SEQ ID NO: 652314 - RNA, 64 nt, Homo Sapiens
aaauaaaauaaaauaaaauaaauaaaauaaaauaaaauaaaauaugucucaaaaaauaaaauaa

SEQ ID NO: 652315 - RNA, 64 nt, Homo Sapiens
aaauaaaauaaaauaaaauaaauaaaauaaaauaaaauaaaauacacucugucucaaaaaauaa

SEQ ID NO: 652316 - RNA, 64 nt, Homo Sapiens
aaauaaaauaaaauaaaauaaauaaaauaaaauaaaauaaaauaagugacacucugucucaaaa

SEQ ID NO: 652317 - RNA, 64 nt, Homo Sapiens
aaauaaaauaaaauaaaauacaaaaaauaaaauaaaauaaaauaaacagagugacacucugucu

SEQ ID NO: 652318 - RNA, 64 nt, Homo Sapiens
aaauaaaauaaaauaaaauaugucucaaaaaauaaaauaaaauaugggcaacagagugacacuc

SEQ ID NO: 652319 - RNA, 64 nt, Homo Sapiens
aaauaaaauaaaauaaaauacacucugucucaaaaaauaaaauacagccugggcaacagaguga

SEQ ID NO: 652320 - RNA, 64 nt, Homo Sapiens
caucagcaugggguuauguaggauguuuuauacuaaauaaaaccgccagagacugguguuugau

SEQ ID NO: 652321 - RNA, 64 nt, Homo Sapiens
ucugagaaaagguucaagcaaaaacauacuggggaaauaaaacccuaaguaaaggccccaguga

SEQ ID NO: 652322 - RNA, 64 nt, Homo Sapiens
acaaaugaaaaggcacauccacuuuuuaaauguaaaauaaaaagauccacuuagagcaauaacc

SEQ ID NO: 652323 - RNA, 64 nt, Homo Sapiens
aagccacaaaacuaaaaggccaaauucugcaaaaaaauaaaaauaggaggcugcacuacaaacc

SEQ ID NO: 652324 - RNA, 64 nt, Homo Sapiens
uuuacaaaggggccuuaggaucgggaagauuucuaaauaaaaguuauauauaugugaggaugua

SEQ ID NO: 652325 - RNA, 64 nt, Homo Sapiens
aagggcacagcaucuguaguuuuauucuuuuccaaaauaaaacagaugacaagaugguacaacc

SEQ ID NO: 652326 - RNA, 64 nt, Homo Sapiens
acaacaugaagauucagauuaagguaaaaaaauaaaauaaaauuuagugccaaaaacuuuuuaa

SEQ ID NO: 652327 - RNA, 64 nt, Homo Sapiens
aaauuacaacaugaagauucuuuaaaagguaaaaaaauaaaauaccuuguagugccaaaaacuu

SEQ ID NO: 652328 - RNA, 64 nt, Homo Sapiens
ucguaacacaacuaauuaaguaaaugugcuuuuuaaauaaaagccugcgaaacuauacuuguau

SEQ ID NO: 652329 - RNA, 64 nt, Homo Sapiens
aaagagcaaguuugcucaguuuguuuuguguuuuaaauaaaaggugacuuuaguucaggaaguu

SEQ ID NO: 652330 - RNA, 64 nt, Homo Sapiens
uacgacauuuuaagauauuugucugcugcaauuuaaauaaaaauuguuuuuuuuccguaacauu

SEQ ID NO: 652331 - RNA, 64 nt, Homo Sapiens
guuucucuuaacaguauuucuuuucugguuuaaaaaauaaaaaggucacaugagcuuuaguuug

SEQ ID NO: 652332 - RNA, 64 nt, Homo Sapiens
uaauaaaauauaguacuuucaaguuccauuuccuaaauaaaaacaaaauauugggauaaaguga

SEQ ID NO: 652333 - RNA, 64 nt, Homo Sapiens
aaagucuaccucugaagaaaggaagaacucauugaaauaaaaacgaaaguguucuagcucgagu

SEQ ID NO: 652334 - RNA, 64 nt, Homo Sapiens
aauuuugcucaaguuuucucuaaaccacaggccuaaauaaaacucucuuguaucucaauauuuu

SEQ ID NO: 652335 - RNA, 64 nt, Homo Sapiens
cacucuucaauacaugaauguuuacuaguaguguaaauaaaauuaguaacuggaguagcuggga

SEQ ID NO: 652336 - RNA, 64 nt, Homo Sapiens
ucauaaagcauuuuaaauauuacugaauaauaucaaauaaaauaauuugccacaaaaccuguau

SEQ ID NO: 652337 - RNA, 64 nt, Homo Sapiens
uuucauuaugcacuuuuagauucaagagcuagaaaaauaaaauguggcuuauuucuaugacaaa

SEQ ID NO: 652338 - RNA, 64 nt, Homo Sapiens
auguaauuucaaaauacauuaauauacauuuucuaaauaaaaaugcucuuuccaaauuaaaaca

SEQ ID NO: 652339 - RNA, 64 nt, Homo Sapiens
uuaaaaauucaauugaaaacguauuguauuuuucaaauaaaaauaggaaauaauucucugcugu

SEQ ID NO: 652340 - RNA, 64 nt, Homo Sapiens
uucacuuuaguuucucacagugaacaaaauucuuaaauaaaacaacaaaaaugugaugaccaaa

SEQ ID NO: 652341 - RNA, 64 nt, Homo Sapiens
uugucacuugagcuuauguagaguugaaaacugcaaauaaaaguauuuucauaucauuugcauu

SEQ ID NO: 652342 - RNA, 64 nt, Homo Sapiens
acuagaauacugcuaguuaagcaaguacaccugcaaauaaaacugauuuauaauaauaugggcu

SEQ ID NO: 652343 - RNA, 64 nt, Homo Sapiens
uucaauguuuuuuuggucuucaaauccccugugaaaauaaaauuaaaauaauguucuuuuuaug

SEQ ID NO: 652344 - RNA, 64 nt, Homo Sapiens
gucuuccucuggaaagagaauuccuagaauuuaaaaauaaaaaacaauuugaauaagucaugcu

SEQ ID NO: 652345 - RNA, 64 nt, Homo Sapiens
uuugcaauuguuuucugcaucacagaaagccgcuaaauaaaauccucuguuucuaagugccaag

SEQ ID NO: 652346 - RNA, 64 nt, Homo Sapiens
gugugaagaaggaauaguuuugguaggggaaggaaaauaaaaggugauuccacagcaugcagcc

SEQ ID NO: 652347 - RNA, 64 nt, Homo Sapiens
ggaauuuuuuacccauacaacccuacauuaguaaaaauaaaaauagaaggaaacauauguucuc

SEQ ID NO: 652348 - RNA, 64 nt, Homo Sapiens
gaaacuauccaggaguggugccuugucuccacaaaaauaaaaaagccuggacaacauagugaga

SEQ ID NO: 652349 - RNA, 64 nt, Homo Sapiens
uggcaauaagugucagacuaaaauaaaaaauauuaaauaaaacauuuuuaaaaauuaaaagauu

SEQ ID NO: 652350 - RNA, 64 nt, Homo Sapiens
uauuaaauaaaacauggcaaaaaauuaaaagauuaaauaaaaaacuguuaauggguuuuuuuua

SEQ ID NO: 652351 - RNA, 64 nt, Homo Sapiens
uuggaaagcacuuucuagaaagguacaaauaaaaaaauaaaacuaacguuuucuggaacaaggc

SEQ ID NO: 652352 - RNA, 64 nt, Homo Sapiens
auaaaacuuuggaaagcacuaacaaggcagguacaaauaaaaaaccaccuucaacguuuucugg

SEQ ID NO: 652353 - RNA, 64 nt, Homo Sapiens
accuacgaaauacuaagaaacucaaauuaagaaaaaauaaaacugggucuuguuuggauccuga

SEQ ID NO: 652354 - RNA, 64 nt, Homo Sapiens
aagagagggaggaagaaaggaugggaaaaaaaugaaauaaaaagcuggcuucuauaacaaauaa

SEQ ID NO: 652355 - RNA, 64 nt, Homo Sapiens
aagcaccauuuuguuucccuuuuuaaaauaaauaaaauaaaauaguccugccacuguagcgccu

SEQ ID NO: 652356 - RNA, 64 nt, Homo Sapiens
aaauaaagcaccauuuuguucgccuuuuuaaaauaaauaaaauagcagcguccugccacuguag

SEQ ID NO: 652357 - RNA, 64 nt, Homo Sapiens
aaauagaucuuauuauucugaaaauaaauaaauaaaauaaaaugagagugagacucugucucaa

SEQ ID NO: 652358 - RNA, 64 nt, Homo Sapiens
aaaugaaauagaucuuauuacucaaaaaauaaauaaauaaaauagugacagagugagacucugu

SEQ ID NO: 652359 - RNA, 64 nt, Homo Sapiens
ucucagaauucacuacugguauuuacauggaaacaaauaaaagauaguuaauaguaauauugcu

SEQ ID NO: 652360 - RNA, 64 nt, Homo Sapiens
gcuaaauagaagaaauuguauuaugaaggaagguaaauaaaaaucaucccucuauuuuaaucug

SEQ ID NO: 652361 - RNA, 64 nt, Homo Sapiens
ucuggugaaacaaauuaaacucugccacaucucaaaauaaaacuaacaugaccaauguuuuuca

SEQ ID NO: 652362 - RNA, 64 nt, Homo Sapiens
aaacccaaaaauaaugcaugcauaucauuuuuaaaaauaaaaaaaugacccauaguauuaaaua

SEQ ID NO: 652363 - RNA, 64 nt, Homo Sapiens
uaaagucaauaauaguccuuauacuugcacaugaaaauaaaauaguugccuuuuuaaaauaauu

SEQ ID NO: 652364 - RNA, 64 nt, Homo Sapiens
guaaagugcaaugugaaauccaauaauucuacagaaauaaaacuaagauauucuaauguacucu

SEQ ID NO: 652365 - RNA, 53 nt, Homo Sapiens
agaaacuuuuuuccuacaaauaaaaauaaaauggggaggaaacucaacuuuga

SEQ ID NO: 652366 - RNA, 64 nt, Homo Sapiens
aaauuugguucuaauagaacgucucaaaaaauaaaaauaaaaaugggugacagagcaagacucu

SEQ ID NO: 652367 - RNA, 64 nt, Homo Sapiens
aaaaauaaauuugguucuaagacucugucucaaaaaauaaaaaucagccugggugacagagcaa

SEQ ID NO: 652368 - RNA, 64 nt, Homo Sapiens
uggcauguagccaauguuucaacauuacucuuugaaauaaaaauaugauaacuauuauuugugc

SEQ ID NO: 652369 - RNA, 64 nt, Homo Sapiens
cauuuuaaaaaguauugacaguuuuaucuauuguaaauaaaaaguaauauuguauuuccuuacu

SEQ ID NO: 652370 - RNA, 64 nt, Homo Sapiens
aaaacguggauuuaaaaagaaucucacaaauaggaaauaaaacuagcauuacaaaagaguaagu

SEQ ID NO: 652371 - RNA, 64 nt, Homo Sapiens
uauacaauauauacauuguuacuacacuauauauaaauaaaauaguuuaaguugcuacuauuca

SEQ ID NO: 652372 - RNA, 64 nt, Homo Sapiens
uugaauauuucaagaauauaaauguauagcuuagaaauaaaacuaugguuuauuauagaauacc

SEQ ID NO: 652373 - RNA, 64 nt, Homo Sapiens
uuuacuuugaacuauuuugacuguuacauuuuucaaauaaaacuaaacugcugaaauaaaauga

SEQ ID NO: 652374 - RNA, 64 nt, Homo Sapiens
acuguuacauuuuucaaauauuuuuaaacugcugaaauaaaaugcucuuuaagaaaaaggacaa

SEQ ID NO: 652375 - RNA, 64 nt, Homo Sapiens
uagcaacauuuugaucacuuaaguuuuaaguugaaaauaaaaugauuuggcaaauuuuauaaug

SEQ ID NO: 652376 - RNA, 64 nt, Homo Sapiens
uuguaaaguaaugugaauuaauuuucaguauuuuaaauaaaauuaacugucuuuuuaacaaaac

SEQ ID NO: 652377 - RNA, 64 nt, Homo Sapiens
gcaguauauauauguugcuucguuugugcgauugaaauaaaauuaguuuccuacacgcuaacuu

SEQ ID NO: 652378 - RNA, 64 nt, Homo Sapiens
cuaaaucuuaaaagaaacugaagauaagagacuaaaauaaaaugggguacaagugguccaaacu

SEQ ID NO: 652379 - RNA, 64 nt, Homo Sapiens
cuauuuagauguugauucucaacaaguaaaauaaaaauaaaaguugaauuuucuuuucugucca

SEQ ID NO: 652380 - RNA, 64 nt, Homo Sapiens
aaaagucuauuuagauguuguguccaaacaaguaaaauaaaaauagcugaugaauuuucuuuuc

SEQ ID NO: 652381 - RNA, 64 nt, Homo Sapiens
gaaaacagacuuaaauuuucaaaauacauuuauaaaauaaaaagggauuaaacaaguauaaaau

SEQ ID NO: 652382 - RNA, 64 nt, Homo Sapiens
cauuuauaaaauaaaaaggaauuaaacaaguauaaaauaaaauaaugugcuaggucuaagaugg

SEQ ID NO: 652383 - RNA, 64 nt, Homo Sapiens
uuggcaaacaauacagcaacagaugcaaaaugcaaaauaaaauaagaaggauuuuauucucaac

SEQ ID NO: 652384 - RNA, 64 nt, Homo Sapiens
aaggugaagguauuccagauauacauaagaugauaaauaaaaugaauaguaauuaaaaugagaa

SEQ ID NO: 652385 - RNA, 64 nt, Homo Sapiens
gcuuggcgacagagcaagacccccucucaaaaauaaauaaaauaaaguaaaauaaauauaaaua

SEQ ID NO: 652386 - RNA, 64 nt, Homo Sapiens
ugagaccccugucuauauauuuuuuuaauuuaaaaaauaaaagaauaaaauuguguagcucagu

SEQ ID NO: 652387 - RNA, 64 nt, Homo Sapiens
uauuguagauacaauuuucugauuaaaucuggaaaaauaaaaggcagccuguuuuuucugcuuu

SEQ ID NO: 652388 - RNA, 64 nt, Homo Sapiens
uuguauuaacagcugagguagcuaaaguuauuuaaaauaaaauuaaauuuaugauccaaguagc

SEQ ID NO: 652389 - RNA, 64 nt, Homo Sapiens
auguacagauuaaaauuauugcuacauuugaggaaaauaaaauugcuugcuucuauguaauucc

SEQ ID NO: 652390 - RNA, 64 nt, Homo Sapiens
auacacuggugguguccuucuuacaaaacuuuugaaauaaaaaaaaaacucaaaucuucacugu

SEQ ID NO: 652391 - RNA, 64 nt, Homo Sapiens
uuucaguguguaaauuuccuuuuagcuuauacaaaaauaaaauaauuuaaaagaaauuuagccu

SEQ ID NO: 652392 - RNA, 64 nt, Homo Sapiens
auaguaccauacaugaguuauuucuaaguuugaaaaauaaaaagaaauugcaucacacuaauua

SEQ ID NO: 652393 - RNA, 64 nt, Homo Sapiens
uaaauuaacaugaaauacuucauuuugauugagaaaauaaaaucagauuuuuucaaagucaauu

SEQ ID NO: 652394 - RNA, 64 nt, Homo Sapiens
gggagcaucuguauuuuuauguuaaaagcccacaaaauaaaaauaaaaaguaacugagaugaau

SEQ ID NO: 652395 - RNA, 64 nt, Homo Sapiens
aucuguauuuuuauguuaaaagcccacaaaauaaaaauaaaaaguaacugagaugaauuuaccu

SEQ ID NO: 652396 - RNA, 64 nt, Homo Sapiens
aagcauucauuguuuuauuaauacuuuuuuucuaaaauaaaacuuguacaccaguuuauuacuc

SEQ ID NO: 652397 - RNA, 64 nt, Homo Sapiens
aauagaacauuuauuaauauguaggaauguuaagaaauaaaacauuuaauaagaucucagaaga

SEQ ID NO: 652398 - RNA, 64 nt, Homo Sapiens
cacauguuugacucaaauuguggagcaaaauaguaaauaaaauauaaaaaugaaaaugaagaua

SEQ ID NO: 652399 - RNA, 64 nt, Homo Sapiens
ggggguuacccaaauagguucacagaagaaccagaaauaaaaccugccuuucuagacuguaagu

SEQ ID NO: 652400 - RNA, 64 nt, Homo Sapiens
gcugguaaagcuucugaauauugaguuugcugagaaauaaaaaucaaaacuucuuuaagcuggu

SEQ ID NO: 652401 - RNA, 64 nt, Homo Sapiens
gaaguccuuaccucuuuauauuguuugcagguuuaaauaaaacaguguggugccauuuugacuc

SEQ ID NO: 652402 - RNA, 64 nt, Homo Sapiens
cccaggccaugcugguggugauuuuuuagccccuaaauaaaacacuggacuauuuccuguuuac

SEQ ID NO: 652403 - RNA, 64 nt, Homo Sapiens
uacagcuguuguaauaaugaccuauuucuauauaaaauaaaauuguauggcuuauguguaaauu

SEQ ID NO: 652404 - RNA, 58 nt, Homo Sapiens
cugaagauaauuuacagugaccccaucuaaauaaaauacugcuuuugcaaacagaaca

SEQ ID NO: 652405 - RNA, 64 nt, Homo Sapiens
acauagugaauuuuaaaauguagaagaaagcaaaaaauaaaauaaguccuaaagugaagaagcc

SEQ ID NO: 652406 - RNA, 64 nt, Homo Sapiens
aacaaaaugaaguuaacuuaguguuuagcauuaaaaauaaaaguuguaccuugacccuagaauu

SEQ ID NO: 652407 - RNA, 64 nt, Homo Sapiens
guagaccugauuuucaaaaucugcccucagaugaaaauaaaauaaacgaaacauuuagacaaug

SEQ ID NO: 652408 - RNA, 59 nt, Homo Sapiens
acuucugcauggaacucugagcaagauguaaauaaaauuaaaagguggauggcaagagu

SEQ ID NO: 652409 - RNA, 64 nt, Homo Sapiens
gagcuucaaauaagcaccuuuuuauuauguaaauaaauaaaaguuaucuguauccccacugcau

SEQ ID NO: 652410 - RNA, 64 nt, Homo Sapiens
gagcgagaccuugucucuaaaaauaauaguaauaaaauaaaaauaacguuuuaugacuauuuau

SEQ ID NO: 652411 - RNA, 64 nt, Homo Sapiens
augaaucuguuuugagaauccucuccauuuucccaaauaaaaaccuaucacaacagugacuaua

SEQ ID NO: 652412 - RNA, 64 nt, Homo Sapiens
uuuuaauguguuauaauugaccuugcauggugugaaauaaaaguuuaaacacugguguauuuca

SEQ ID NO: 652413 - RNA, 64 nt, Homo Sapiens
uugcaguaccuuuuucugguaaauuuuguagcagaaauaaaaugacaauuccuaagagccacug

SEQ ID NO: 652414 - RNA, 64 nt, Homo Sapiens
uacaugugggugaaaaaccaaucuaauuuuguauaaauaaaaacaggcuccuggaaggugaaaa

SEQ ID NO: 652415 - RNA, 64 nt, Homo Sapiens
ggagauuguaaaaucuguaaaguuuguuuugugaaaauaaaauguucacaguagaauuuuucuc

SEQ ID NO: 652416 - RNA, 64 nt, Homo Sapiens
cagaauacagauuuaaaaguuugccuguagagcaaaauaaaacagucaguuguagucauuaauc

SEQ ID NO: 652417 - RNA, 64 nt, Homo Sapiens
ucaaauaaauuuaaauaaauuuuaaauaaauuuuaaauaaaauuuuacagagacguggucucac

SEQ ID NO: 652418 - RNA, 64 nt, Homo Sapiens
uggaugucucgcuucacaauaaaacacagcuuaaaaauaaaauaacugaaagaaauagaauuca

SEQ ID NO: 652419 - RNA, 64 nt, Homo Sapiens
ccugcuguuuuggaaaugcacaguugacauguugaaauaaaaaugaauaccauuuuuaaauguu

SEQ ID NO: 652420 - RNA, 64 nt, Homo Sapiens
uauagauuagaaaaauuccuaagaaucagaguagaaauaaaagugaaugaaagauuaaacagau

SEQ ID NO: 652421 - RNA, 64 nt, Homo Sapiens
uucuucagucagaaaacuuuaaaaaauauuuauuaaauaaaaucaauuuuuaggaaguuuucug

SEQ ID NO: 652422 - RNA, 64 nt, Homo Sapiens
uuacgucuccccuguaaaaggggcaaaaagaaaaaaauaaaaagcauuuuaaaaucauggaauu

SEQ ID NO: 652423 - RNA, 64 nt, Homo Sapiens
aaaaaauaaaaagcauuuuaaaaucauggaauugaaauaaaauaauguauuuuguuuuaaaacu

SEQ ID NO: 652424 - RNA, 54 nt, Homo Sapiens
cugaaagagauugcuaauaaaaucaaauaaaacuguaugaacucuaauggagaa

SEQ ID NO: 652425 - RNA, 64 nt, Homo Sapiens
cauaagauaugagauacaugaaccugaacuauuaaaauaaaauauuauauuuaacccuuaguuu

SEQ ID NO: 652426 - RNA, 64 nt, Homo Sapiens
ccuggccaacauggcaaaaccacaucucuacuaaaaauaaaaaaauuagcugggugugguggug

SEQ ID NO: 652427 - RNA, 64 nt, Homo Sapiens
cacaacauucacuauguuugcaaggaauuaacacaaauaaaagaugccuuuuuacuuaaacacc

SEQ ID NO: 652428 - RNA, 64 nt, Homo Sapiens
uaaauaguuuccuaugcaacgugucuuguagcacaaauaaaauucuacaaaaguugcaguaaau

SEQ ID NO: 652429 - RNA, 64 nt, Homo Sapiens
guguguguguguuuucuguacccaaccagacuuuaaauaaaacaaacaugaaaccuaauguacg

SEQ ID NO: 652430 - RNA, 64 nt, Homo Sapiens
aaaauauuuuuagcagaacagauggguuuuguaaaaauaaaaaauuguuaugaaauaaaaaaaa

SEQ ID NO: 652431 - RNA, 64 nt, Homo Sapiens
aagauggguuuuguaaaaauaaauuuuuguuaugaaauaaaaaaaggaaguacagacguacuuu

SEQ ID NO: 652432 - RNA, 64 nt, Homo Sapiens
uaaaauuuauauguauuaaguguguaacuucuaaaaauaaaacugaaauuguucuuuuaaaaua

SEQ ID NO: 652433 - RNA, 64 nt, Homo Sapiens
uugagcaccugauuauauuuaacauuuuguaagaaaauaaaaguuaguuuggguucauuucuau

SEQ ID NO: 652434 - RNA, 64 nt, Homo Sapiens
ucucaaaauacauugguuuaaagccuuauaaaccaaauaaaaauuccagaggucauggaacaga

SEQ ID NO: 652435 - RNA, 64 nt, Homo Sapiens
agaagaccagaagucuuugagggcucauuggccuaaauaaaaagaugagcuuaggauagagagu

SEQ ID NO: 652436 - RNA, 64 nt, Homo Sapiens
ccguaggaaugggcucaacauuuacugaggauuaaaauaaaaaagcuacagagcacccagugau

SEQ ID NO: 652437 - RNA, 64 nt, Homo Sapiens
uuucaaggauuccugaccauaaaggauuaggcaaaaauaaaaugaaaauauguuuacauuggau

SEQ ID NO: 652438 - RNA, 64 nt, Homo Sapiens
aaaaaaguuugauugagacauuuuaaauuuaaaaaaauaaaaaccucucugagagaaaagggug

SEQ ID NO: 652439 - RNA, 64 nt, Homo Sapiens
cgcugcaguagcuguggccuguaaauaaauaaauaaauaaaaagcagagcaagacuccaucuca

SEQ ID NO: 652440 - RNA, 64 nt, Homo Sapiens
uugcauagcacaauuuaucugucaucuaaguuguaaauaaaaccagauucugagcaaucauaga

SEQ ID NO: 652441 - RNA, 64 nt, Homo Sapiens
uauauuuacuaaaauguguucauuuacucuugacaaauaaaacaaauauucuaaauaaaacuga

SEQ ID NO: 652442 - RNA, 64 nt, Homo Sapiens
gacauuuacucuugacaaauuacuugaauauucuaaauaaaacuauauacauuuucauuuuuug

SEQ ID NO: 652443 - RNA, 64 nt, Homo Sapiens
uauuauguauugguuuucagcauuucugaccuucaaauaaaacuuaaaaugggaacauggacac

SEQ ID NO: 652444 - RNA, 64 nt, Homo Sapiens
ggaacauggacaccauuucugucugauccaggaaaaauaaaauguaagauuuguucauaaaaug

SEQ ID NO: 652445 - RNA, 64 nt, Homo Sapiens
guaaccaugucuuugucuaacuuuuuuuuucuucaaauaaaaaagcaguauuuauuaaaacaua

SEQ ID NO: 652446 - RNA, 64 nt, Homo Sapiens
ugucuugguuugaugucauaaaaaaugcaaagucaaauaaaagggauuuuuugccaucguugau

SEQ ID NO: 652447 - RNA, 64 nt, Homo Sapiens
acaauuccuuauugucugaauuguuuugcccugcaaauaaaaaguaucaccacagauaaagauu

SEQ ID NO: 652448 - RNA, 64 nt, Homo Sapiens
gacagcuuuagcacaauuuuguuaaagucauuaaaaauaaaaauauaaaaucuugucuagcaca

SEQ ID NO: 652449 - RNA, 64 nt, Homo Sapiens
uugucuagcacaguuaaaguauuucuguggcugaaaauaaaaucgaguuauguuggauaguuuu

SEQ ID NO: 652450 - RNA, 64 nt, Homo Sapiens
gcuggguuugacuuuugaguacacuguggugauaaaauaaaagauuauuuuaagcuuguaaaau

SEQ ID NO: 652451 - RNA, 64 nt, Homo Sapiens
aggcuacagguauagcugacgaacuaaauaaaacaaauaaaacuuaaugaaggguuuuuuaaaa

SEQ ID NO: 652452 - RNA, 64 nt, Homo Sapiens
aauaaaacuaggcuacagguuuuuuaaaagaacuaaauaaaacagaauaaaacuaaugaagggu

SEQ ID NO: 652453 - RNA, 64 nt, Homo Sapiens
auuaauaaaaugguguaguaaauaaaauaaaauaaaauaaaauagagcaagacucuaucucaaa

SEQ ID NO: 652454 - RNA, 64 nt, Homo Sapiens
aaauaauuaauaaaauggugucaaaaauaaaauaaaauaaaauacaacagagcaagacucuauc

SEQ ID NO: 652455 - RNA, 64 nt, Homo Sapiens
aaauaaaauaauuaauaaaacuaucucaaaaauaaaauaaaauacugagcaacagagcaagacu

SEQ ID NO: 652456 - RNA, 64 nt, Homo Sapiens
aaauaaaauaaaauaauuaaagacucuaucucaaaaauaaaauaccagccugagcaacagagca

SEQ ID NO: 652457 - RNA, 64 nt, Homo Sapiens
ugauggccuaaguaaaauuuaaauucaaaggugaaaauaaaaaacauaucucuaauuuacuuug

SEQ ID NO: 652458 - RNA, 64 nt, Homo Sapiens
gcuagcgacagucuuucuuauguuguugaugaugaaauaaaaauagagaaagaaacugcauguu

SEQ ID NO: 652459 - RNA, 64 nt, Homo Sapiens
cagaaucauaauuuucaagauuuccgucucccuaaaauaaaaacauucauuucacuuuaaaguc

SEQ ID NO: 652460 - RNA, 64 nt, Homo Sapiens
auacaguaaaguuuaaaaaacucuucuauuuaaaaaauaaaaaauuauguauuauuuucuauag

SEQ ID NO: 652461 - RNA, 64 nt, Homo Sapiens
uuucauuauucuuguauauuuucaagacaacaaaaaauaaaacaauuacauuuuaguaauuguu

SEQ ID NO: 652462 - RNA, 64 nt, Homo Sapiens
cugaauuacauuuuaguaauaagccaggcuagagaaauaaaaucaccuucaugauaccagugag

SEQ ID NO: 652463 - RNA, 64 nt, Homo Sapiens
caucugccuucuugauauuuccuaauguaaaauaaaauaaaacaugagauugugguuuuuucuu

SEQ ID NO: 652464 - RNA, 64 nt, Homo Sapiens
aaacacaucugccuucuugauucuuccuaauguaaaauaaaauaugcuuugagauugugguuuu

SEQ ID NO: 652465 - RNA, 64 nt, Homo Sapiens
gggaugagcccuaauggagggaauggaggaauggaaauaaaauugguugugaaugugaaagggg

SEQ ID NO: 652466 - RNA, 64 nt, Homo Sapiens
cacaguuacuuugcauuugguuuauuguucauagaaauaaaaaaaugugaaauuaugaaaguau

SEQ ID NO: 652467 - RNA, 64 nt, Homo Sapiens
uuguaaaauauacgguuuuucauauuucagauguaaauaaaagaauguuuuuguaacauuuaag

SEQ ID NO: 652468 - RNA, 64 nt, Homo Sapiens
ccaccuuguugcaaaagcuggucaugcaccaaaaaaauaaaaccgucucguuagaguauuugau

SEQ ID NO: 652469 - RNA, 64 nt, Homo Sapiens
aaaaaaagacgaacuauuggaauaaaaauaaaaaaaauaaaaaacauuaucacacaaagagacc

SEQ ID NO: 652470 - RNA, 64 nt, Homo Sapiens
aauaaaaaaaaaaaaagacgaaagagaccaauaaaaauaaaaaauguguaggucauuaucacac

SEQ ID NO: 652471 - RNA, 64 nt, Homo Sapiens
ugaaaugucaaagacaugucggauaugguacuaaaaauaaaauguucugaugagcacugacaaa

SEQ ID NO: 652472 - RNA, 64 nt, Homo Sapiens
acgagaaggcaaugugagguccuucuugugauaaaaauaaaauuucaggaaucacuauguauuu

SEQ ID NO: 652473 - RNA, 64 nt, Homo Sapiens
uuuguucuuguauugcuuucuuucaacaguuucaaaauaaaauaucauauaaauauugagggaa

SEQ ID NO: 652474 - RNA, 64 nt, Homo Sapiens
ugauucauauauuuuaugaaucagaauaaccuucaaauaaaauaaaucuaagucgguuaaaaug

SEQ ID NO: 652475 - RNA, 64 nt, Homo Sapiens
aaauauuuucauuauacaugaaauucaacuuuccaaauaaaaguucuacuucauguaauccaaa

SEQ ID NO: 652476 - RNA, 64 nt, Homo Sapiens
gcacagagucagaagcugccaccuuagagaacugaaauaaaaauagaaguucuuacgcuuuuuu

SEQ ID NO: 652477 - RNA, 64 nt, Homo Sapiens
ugguacagaugcuuucgacaauuuaaagaaagcuaaauaaaaauguagacauggcuggcgcagu

SEQ ID NO: 652478 - RNA, 64 nt, Homo Sapiens
ccucaacugugucugauguuucuucucauguaagaaauaaaaaauaaaaauaaaauaaaauaua

SEQ ID NO: 652479 - RNA, 64 nt, Homo Sapiens
ugugucugauguuucuucucauguaagaaauaaaaaauaaaaauaaaauaaaauauauugguau

SEQ ID NO: 652480 - RNA, 64 nt, Homo Sapiens
ugauguuucuucucauguaagaaauaaaaaauaaaaauaaaauaaaauauauugguauguaacu

SEQ ID NO: 652481 - RNA, 64 nt, Homo Sapiens
uuucuucucauguaagaaauaaaaaauaaaaauaaaauaaaauauauugguauguaacuacagg

SEQ ID NO: 652482 - RNA, 64 nt, Homo Sapiens
aaauaaaauauauugguauguaacuacaggaaaaaaauaaaaaauauauaguggacaguaaccu

SEQ ID NO: 652483 - RNA, 64 nt, Homo Sapiens
aaaaaaagauguuauacaaccaucaaaguggcaaaaauaaaaaaaaucaaguauuggcaaagau

SEQ ID NO: 652484 - RNA, 64 nt, Homo Sapiens
aauagaaugagugaaucaccugugguauauuuauaaauaaaaauauuaaauagaagguaaaaca

SEQ ID NO: 652485 - RNA, 64 nt, Homo Sapiens
auaaaaaugacaacaaaguaaaaggguaucccaaaaauaaaacuauccuuuuggaaaaaaaaag

SEQ ID NO: 652486 - RNA, 64 nt, Homo Sapiens
agaaacuacugaauucucuguuugucuguuguggaaauaaaaccuucuggggaugaaucaaaac

SEQ ID NO: 652487 - RNA, 64 nt, Homo Sapiens
aauucagauauacuuuaucuuuuuaaaaaaguguaaauaaaaucaaagaauguaaagucuaucu

SEQ ID NO: 652488 - RNA, 64 nt, Homo Sapiens
uuucuaaauucauguacuguauguccauaagugaaaauaaaaugucauauucuuuucuauuauu

SEQ ID NO: 652489 - RNA, 64 nt, Homo Sapiens
auggaucacacgauuucuuuaagggaauuaaaaaaaauaaaagaauuacggcuuuuacagcaac

SEQ ID NO: 652490 - RNA, 64 nt, Homo Sapiens
ucuggacggacuuauuaaaauacaaacagacaaaaaauaaaacaaaacuugaguucuauuuacc

SEQ ID NO: 652491 - RNA, 64 nt, Homo Sapiens
guagucauuaggugcccuucucugaaguuauguaaaauaaaagcaucugauccuucaaggauaa

SEQ ID NO: 652492 - RNA, 64 nt, Homo Sapiens
aucccuugaaaaggaaauauuuucuguuucuuauaaauaaaagaguaaucuuacuuucagaagg

SEQ ID NO: 652493 - RNA, 64 nt, Homo Sapiens
cuuagugaaacauguguaacauugaaugcauguuaaauaaaaauggaauuucuaacuuuuuuuc

SEQ ID NO: 652494 - RNA, 64 nt, Homo Sapiens
augaauauauccacccaccuagauuuuaagcaguaaauaaaacauuucgcaaaagauuaaaguu

SEQ ID NO: 652495 - RNA, 64 nt, Homo Sapiens
ucuaaauaaacaaagaugauuucuuugacacuugaaauaaaauacaaauucaacaaaaaguaga

SEQ ID NO: 652496 - RNA, 64 nt, Homo Sapiens
acauaauaagagguguaaaaacuaucacaggaagaaauaaaaacagauuuuugaaggugagaug

SEQ ID NO: 652497 - RNA, 64 nt, Homo Sapiens
cuggacaacagagcaagacucugucucaaaaaaaaaauaaaaaauaaaaaauaaaaaauaaaag

SEQ ID NO: 652498 - RNA, 64 nt, Homo Sapiens
acagagcaagacucugucucaaaaaaaaaauaaaaaauaaaaaauaaaaaauaaaagaaacaua

SEQ ID NO: 652499 - RNA, 64 nt, Homo Sapiens
aagacucugucucaaaaaaaaaauaaaaaauaaaaaauaaaaaauaaaagaaacauaagauaag

SEQ ID NO: 652500 - RNA, 64 nt, Homo Sapiens
ugucucaaaaaaaaaauaaaaaauaaaaaauaaaaaauaaaagaaacauaagauaaguaccucu

SEQ ID NO: 652501 - RNA, 64 nt, Homo Sapiens
ucugagcaacauggcaaaacccugugucuacaaaaaauaaaaaauuagcugggcaugacggcca

SEQ ID NO: 652502 - RNA, 64 nt, Homo Sapiens
aacaaaagucaagauuuuauuaccaaacuuauagaaauaaaaauuauuagaaagaaauacuaug

SEQ ID NO: 652503 - RNA, 64 nt, Homo Sapiens
uuuuuaguucuuaaaaauuuauuuuuaaguucuaaaauaaaauaaaaauaaguucuuaaaauuu

SEQ ID NO: 652504 - RNA, 64 nt, Homo Sapiens
aguucuuaaaaauuuauuuuuaaguucuaaaauaaaauaaaaauaaguucuuaaaauuuauuuu

SEQ ID NO: 652505 - RNA, 64 nt, Homo Sapiens
uugcuuggauacauaugaaugaugcuuuccccucaaauaaaacaucugcauuauucugaaacuc

SEQ ID NO: 652506 - RNA, 64 nt, Homo Sapiens
cuuauaauaaagaauggguugggggaagggggagaaauaaaagccaagaagaggaaacaagaua

SEQ ID NO: 652507 - RNA, 64 nt, Homo Sapiens
cuuuguaacuuccugugaauuuauaauaauuucaaaauaaaacaaguuaaaaaaaaacccacua

SEQ ID NO: 652508 - RNA, 64 nt, Homo Sapiens
uauugauugguuuuauaguucauugaaaauccucaaauaaaauauaauuauuacugaaauaugu

SEQ ID NO: 652509 - RNA, 64 nt, Homo Sapiens
auggauccuaguccuuuucauuaccugaugguagaaauaaaauaauugauuuuaaauuccuuug

SEQ ID NO: 652510 - RNA, 64 nt, Homo Sapiens
gcguaacguaaaguguauucuguacauaauuuacaaauaaaacauuuuauuuuaauuguuacuu

SEQ ID NO: 652511 - RNA, 64 nt, Homo Sapiens
accuauuuugggguauaaacaugguguuuuucagaaauaaaaauuauuucauuaaccuuuacua

SEQ ID NO: 652512 - RNA, 64 nt, Homo Sapiens
auucuguguuaaaucauuucaggguuuaauuuugaaauaaaagauuaauauaaaaugcaacaac

SEQ ID NO: 652513 - RNA, 64 nt, Homo Sapiens
uaccuuuuuuuuuuuuuuuuacuuugaagucuuuaaauaaaauguauaauacccauugagagug

SEQ ID NO: 652514 - RNA, 64 nt, Homo Sapiens
uaccucucugugccucaguuuucccaugcaugaaaaauaaaauaaaauaaaacggggauucuaa

SEQ ID NO: 652515 - RNA, 64 nt, Homo Sapiens
cucugugccucaguuuucccaugcaugaaaaauaaaauaaaauaaaacggggauucuaauguuu

SEQ ID NO: 652516 - RNA, 64 nt, Homo Sapiens
ugccucaguuuucccaugcaugaaaaauaaaauaaaauaaaacggggauucuaauguuuguaag

SEQ ID NO: 652517 - RNA, 64 nt, Homo Sapiens
accaaacaggaaagaacuaugucugaaauauaaaaaauaaaaauaaaaaaacaacuaugaauau

SEQ ID NO: 652518 - RNA, 64 nt, Homo Sapiens
caggaaagaacuaugucugaaauauaaaaaauaaaaauaaaaaaacaacuaugaauaugcacaa

SEQ ID NO: 652519 - RNA, 64 nt, Homo Sapiens
cauuuugccugacaauugcaaaucagagcauacaaaauaaaacugugcaguuuuguuugguuua

SEQ ID NO: 652520 - RNA, 64 nt, Homo Sapiens
uuuuuucuaguuuuuaauuuuaacaucagaacugaaauaaaaaauuauggauacguguuuugaa

SEQ ID NO: 652521 - RNA, 64 nt, Homo Sapiens
ccugggcaacauagugagaccuugucucuacaaaaaauaaaauaaaauaaaaaccaaauuagcc

SEQ ID NO: 652522 - RNA, 64 nt, Homo Sapiens
gcaacauagugagaccuugucucuacaaaaaauaaaauaaaauaaaaaccaaauuagccagaca

SEQ ID NO: 652523 - RNA, 64 nt, Homo Sapiens
auagugagaccuugucucuacaaaaaauaaaauaaaauaaaaaccaaauuagccagacauggug

SEQ ID NO: 652524 - RNA, 64 nt, Homo Sapiens
uuucuuuuccagaaauacaaugcuagguguuuugaaauaaaacuuauauagcaauuguuuaaag

SEQ ID NO: 652525 - RNA, 64 nt, Homo Sapiens
uagguauuuaucaacugcagauguuauugaaagaaaauaaaauucagucucaagaguaaacccu

SEQ ID NO: 652526 - RNA, 64 nt, Homo Sapiens
aaacaaaaaaaauucaacagcaaugaacuuuaaaaaauaaaaauuuugagaauguacuaaaaac

SEQ ID NO: 652527 - RNA, 64 nt, Homo Sapiens
uggucuguccacgcaauggaaacugaugaaugggaaauaaaaugaaacaacccaaaugucuacc

SEQ ID NO: 652528 - RNA, 64 nt, Homo Sapiens
aauagaucaccuuagaaaauaaauaagcuuagguaaauaaaacuugcaauuuuuacuaucaugc

SEQ ID NO: 652529 - RNA, 64 nt, Homo Sapiens
ucacuguacuuuuuuuucauuguuuuuauuuuggaaauaaaagugcacugccguaauucaaauu

SEQ ID NO: 652530 - RNA, 64 nt, Homo Sapiens
cauuauucuuaauauggccuuccuauuucucuuaaaauaaaauccucuuaaaauaaaauccauu

SEQ ID NO: 652531 - RNA, 64 nt, Homo Sapiens
cauuuccuauuucucuuaaauccuguuucucuuaaaauaaaaucgauuaugcuuaacagcuguu

SEQ ID NO: 652532 - RNA, 64 nt, Homo Sapiens
aucuuagguuauaccaucuuuugaaaauauaaugaaauaaaagcuguuauaaugcguaaagaua

SEQ ID NO: 652533 - RNA, 64 nt, Homo Sapiens
aaaacauguuucuucaaauuauaucuguucauaaaaauaaaaggacaaaaugugaaaugucuaa

SEQ ID NO: 652534 - RNA, 64 nt, Homo Sapiens
cauauuuuuaaaacaaaccacaaacuucauguauaaauaaaauaacuaaucgagcacuucucac

SEQ ID NO: 652535 - RNA, 64 nt, Homo Sapiens
cuuccagaggagaguggccuugucaguccuacaaaaauaaaagguguuuucacgcaggucauau

SEQ ID NO: 652536 - RNA, 64 nt, Homo Sapiens
accuugagguuuguagcuuuagauuauuugguuuaaauaaaacaaauguauauaugucuugcuc

SEQ ID NO: 652537 - RNA, 64 nt, Homo Sapiens
gguuugagcgucagugauaugaaauacauauuggaaauaaaaauaguggaaacaaacauguauu

SEQ ID NO: 652538 - RNA, 64 nt, Homo Sapiens
cauuuauuguuuuugcaauauguuuauguuugaaaaauaaaaaguuacuuuuauacuuaaguau

SEQ ID NO: 652539 - RNA, 64 nt, Homo Sapiens
acaucuagaaguauaagcaugagaaaguuucaggaaauaaaacuagauacaguauuuaguaaaa

SEQ ID NO: 652540 - RNA, 64 nt, Homo Sapiens
ugaccccaaagacaaauaaguauuuaaaaaauaaaaauaaaagcacccugucucaaaaaauaua

SEQ ID NO: 652541 - RNA, 64 nt, Homo Sapiens
aaaagcugaccccaaagacaaauauauauuuaaaaaauaaaaauagagagacccugucucaaaa

SEQ ID NO: 652542 - RNA, 64 nt, Homo Sapiens
cacaauguaauacuacuacuuugaucaaauuugaaaauaaaauuuuuuauuauuuucaucuuua

SEQ ID NO: 652543 - RNA, 64 nt, Homo Sapiens
guaaucagaagcuaaaguaauaaaguaaaaauaaaaauaaaaaaaaaaauaauaauaauaauaa

SEQ ID NO: 652544 - RNA, 64 nt, Homo Sapiens
aaaaaaguaaucagaagcuauaauaauaaaguaaaaauaaaaaucaucucaaaaauaauaauaa

SEQ ID NO: 652545 - RNA, 64 nt, Homo Sapiens
cuguuucccuuuggaacuaugaaaguacuccuuaaaauaaaacaagcccucauauaauagguuu

SEQ ID NO: 652546 - RNA, 64 nt, Homo Sapiens
aauauaaaauauaggcuuuacuaacaaaauuaaaaaauaaaauaaauaaagugagacccuguca

SEQ ID NO: 652547 - RNA, 64 nt, Homo Sapiens
ucuguguucuaaacaauucuacaauaaaugcaaaaaauaaaaaguauguuauguauauuuuacc

SEQ ID NO: 652548 - RNA, 64 nt, Homo Sapiens
cuuuucuuuuuaacauguuuugucuagguuuuuuaaauaaaaauaacccccauuuuaauuacua

SEQ ID NO: 652549 - RNA, 64 nt, Homo Sapiens
caggcuuacuaauuuuugugauauuuucauguucaaauaaaauguuuuuuuguauuuucuccaa

SEQ ID NO: 652550 - RNA, 64 nt, Homo Sapiens
aaugggguguuaaagccguuuuuuauuuuuuucuaaauaaaaagagaacccaugcuuuuaugga

SEQ ID NO: 652551 - RNA, 64 nt, Homo Sapiens
uguuuguuaguaugaaaaguuaacuuuuuuuccaaaauaaaagagugaauuuuucauguuaagu

SEQ ID NO: 652552 - RNA, 64 nt, Homo Sapiens
uuaaguuaaaaaucuuugucuuguacuauuucaaaaauaaaaagacagcaaugacuuuauaucc

SEQ ID NO: 652553 - RNA, 64 nt, Homo Sapiens
acaauagaacagaaauuugggacauuuuucuaggaaauaaaauuccucgguguauuaaucuaag

SEQ ID NO: 652554 - RNA, 64 nt, Homo Sapiens
aauaccauauggaaaucuuuuaauaaauauauguaaauaaaauaaaaaauauuugucuccaccu

SEQ ID NO: 652555 - RNA, 64 nt, Homo Sapiens
cauauggaaaucuuuuaauaaauauauguaaauaaaauaaaaaauauuugucuccaccuuuucc

SEQ ID NO: 652556 - RNA, 64 nt, Homo Sapiens
agaauuugcaguggcaucuaaagagaucuuuuuuaaauaaaaauuauguauuguggcauaaucc

SEQ ID NO: 652557 - RNA, 64 nt, Homo Sapiens
guauggauacauccauucacugugguacauuuuaaaauaaaauauuuuagcagugaauauggau

SEQ ID NO: 652558 - RNA, 64 nt, Homo Sapiens
gaauucaccacagcuggaauagcuguggaaaacaaaauaaaacaacaaaauuaauaaugaaaug

SEQ ID NO: 652559 - RNA, 64 nt, Homo Sapiens
ugcaaacaaauuauuuuuuacaaaaaaacaaaauaaauaaaauuagacuuccuucccucacuau

SEQ ID NO: 652560 - RNA, 64 nt, Homo Sapiens
aagaaaaaaaaaucuuuucaaaauuuacuuugucaaauaaaaauuuguuuuucagagauuuacc

SEQ ID NO: 652561 - RNA, 64 nt, Homo Sapiens
aaauauuuuguggcaaugaagaaaacacuacggaaaauaaaaaauaagauaaagccuuaugagc

SEQ ID NO: 652562 - RNA, 64 nt, Homo Sapiens
ugacaaaacccuuuagauaauuaucuuccauuuuaaauaaaauuuuauuucacaaauaugagcc

SEQ ID NO: 652563 - RNA, 64 nt, Homo Sapiens
ugcuuuaaugucaaguuugcagaauugucucugaaaauaaaaacccugacuuuaguuguaaaac

SEQ ID NO: 652564 - RNA, 64 nt, Homo Sapiens
gaucuguagaagacauuuugggaaacacugucuuaaauaaaaacucaauguuuaguuguuuuuu

SEQ ID NO: 652565 - RNA, 64 nt, Homo Sapiens
uguauaaaacugucuuuuaagaauuauccuuucaaaauaaaaauguuauuguuucacuaguuua

SEQ ID NO: 652566 - RNA, 64 nt, Homo Sapiens
gaaauauugaaaauauugaaaauauuauuauugaaaauaaaaucuugaucucaacuauccccca

SEQ ID NO: 652567 - RNA, 64 nt, Homo Sapiens
auuugguuaguaccuucacugagcaauaguggaaaaauaaaaaaauaaguaaacagaaaaaacu

SEQ ID NO: 652568 - RNA, 64 nt, Homo Sapiens
uuauuauuuuaaguaacuagaaccaccaaauaucaaauaaaauuauuugguuaugguuauguuc

SEQ ID NO: 652569 - RNA, 64 nt, Homo Sapiens
cuguuauuuuuaagcuuuuauuucuuguagcuaaaaauaaaacaucauaaaucugguagguaaa

SEQ ID NO: 652570 - RNA, 64 nt, Homo Sapiens
guucuccucuaucuuagagggguauucuucuugaaaauaaaaaauauugaaaugcuguauuuuu

SEQ ID NO: 652571 - RNA, 64 nt, Homo Sapiens
gcaucaucuguuuguaaucauuaucucacuuuguaaauaaaaacacaccuuaaaacaugaacaa

SEQ ID NO: 652572 - RNA, 64 nt, Homo Sapiens
uuaaagaaaaguauauucaaugaagaugaaauuuaaauaaaaaaggacagagucuauccuccag

SEQ ID NO: 652573 - RNA, 64 nt, Homo Sapiens
cauagcugcaauguguacaauggcugauuuaauuaaauaaaauguacaaguguuaaauguggca

SEQ ID NO: 652574 - RNA, 64 nt, Homo Sapiens
augacuuuagugacauuauaaaacugaaacuggaaaauaaaauggcuuaucugcugauguuuau

SEQ ID NO: 652575 - RNA, 64 nt, Homo Sapiens
aaauggcuuaucugcugauguuuaucuuuaaaauaaauaaaaucuugcuagugugaauauaucu

SEQ ID NO: 652576 - RNA, 64 nt, Homo Sapiens
uauauauuuaugauaaaucuuuuccauuuguacaaaauaaaauuccauuucauugugaccuacu

SEQ ID NO: 652577 - RNA, 64 nt, Homo Sapiens
cuauauuuauguaacuguauacugaauucugacaaaauaaaaaaagauaccuuauugacgaaau

SEQ ID NO: 652578 - RNA, 64 nt, Homo Sapiens
uaggguuuuaaaaguaucuuuggaaaauaaauaaaaauaaaaacacauucuaguaacuggccac

SEQ ID NO: 652579 - RNA, 64 nt, Homo Sapiens
aaaaacuaggguuuuaaaagggccacuggaaaauaaauaaaaauauaaaaacauucuaguaacu

SEQ ID NO: 652580 - RNA, 64 nt, Homo Sapiens
auucuaguaacuggccacuguuauaacaugcaaaaaauaaaaacucaaaccacagagaaaauau

SEQ ID NO: 652581 - RNA, 64 nt, Homo Sapiens
uucuccaucaacaacuauaugaugaaaauuacauaaauaaaacaaggacagaagcaucucuaca

SEQ ID NO: 652582 - RNA, 64 nt, Homo Sapiens
uaaacuucaaacucuuuacuugucaauuuuuguaaaauaaaaauaaucauguugguuuuaauag

SEQ ID NO: 652583 - RNA, 64 nt, Homo Sapiens
aagaaaugcagcauuauauaauaugcacuguuucaaauaaaaccccuaccauaaaaugcuaaaa

SEQ ID NO: 652584 - RNA, 64 nt, Homo Sapiens
uagcagaaccaucugcaucauguuacaucauauuaaauaaaaugcaguuuacuagauuaccaag

SEQ ID NO: 652585 - RNA, 64 nt, Homo Sapiens
uguaaauauaugaaagaugcauauuuacaaguggaaauaaaauucuugguuuuaaauguugaca

SEQ ID NO: 652586 - RNA, 64 nt, Homo Sapiens
uaaaguaguaauaaagaauaauucauuuaaggauaaauaaaaaauggauguuuugaaagugagc

SEQ ID NO: 652587 - RNA, 64 nt, Homo Sapiens
auugaggaacauugcuuguauguugcagucccuaaaauaaaaauuucuuuauguuuuaugaaag

SEQ ID NO: 652588 - RNA, 64 nt, Homo Sapiens
uaauuuaaaaaguaucugauuuaugucgcucaaaaaauaaaauucucccaaauauguucaauuc

SEQ ID NO: 652589 - RNA, 64 nt, Homo Sapiens
gaggauacuacaggcugggaaucauagaaguaaaaaauaaaacauggaagcuaaaaaaauugau

SEQ ID NO: 652590 - RNA, 64 nt, Homo Sapiens
aacauauuggugaagaugcgacugucucaaaauaaaauaaaaauagccugggugacagagugag

SEQ ID NO: 652591 - RNA, 64 nt, Homo Sapiens
aaaauaacauauuggugaaggugagacugucucaaaauaaaauaacuccagccugggugacaga

SEQ ID NO: 652592 - RNA, 64 nt, Homo Sapiens
aaagaaaagauuucccacaaauauaaaauguuuuaaauaaaaauuaauacccacaaaacuuaaa

SEQ ID NO: 652593 - RNA, 64 nt, Homo Sapiens
agauuggccauauguuuauaaaugaagagauaauaaauaaaacucugggaaguugaaagugggg

SEQ ID NO: 652594 - RNA, 64 nt, Homo Sapiens
ucuucacuauguagcauaccugccaacaaaauaaaaauaaaaagaauguugaaaccaacugaac

SEQ ID NO: 652595 - RNA, 64 nt, Homo Sapiens
aaaaagucuucacuauguagcugaacugccaacaaaauaaaaauucaauaaauguugaaaccaa

SEQ ID NO: 652596 - RNA, 64 nt, Homo Sapiens
acuucuguauucuucagauacauuaaauaaaaagaaauaaaaauccagcauuuguauuuugcau

SEQ ID NO: 652597 - RNA, 64 nt, Homo Sapiens
aaauaaaaauacuucuguauuauuuugcaucauuaaauaaaaagauauaucaagccagcauuug

SEQ ID NO: 652598 - RNA, 64 nt, Homo Sapiens
cagcaaauacucagauacagggcuaaaugugaacaaauaaaauaaguaguguuaaccucaaaua

SEQ ID NO: 652599 - RNA, 64 nt, Homo Sapiens
agagcuguaaggaaaaugaauauucaggcuuuuuaaauaaaauuuaaggcagcagucauuugug

SEQ ID NO: 652600 - RNA, 64 nt, Homo Sapiens
auguggcuauuuuggggagauguauugaaucaucaaauaaaagagugacuauuugaaucaaaaa

SEQ ID NO: 652601 - RNA, 64 nt, Homo Sapiens
caacuuaugaaaguagacauguuauuggagaugaaaauaaaaaguuaucauaucuuccauuccu

SEQ ID NO: 652602 - RNA, 64 nt, Homo Sapiens
uguuguggaaacuuaaaauuuaugauuaaacaagaaauaaaagguuuuuucucuguccuuuugg

SEQ ID NO: 652603 - RNA, 64 nt, Homo Sapiens
aauuguuuuugacuaagugauacuugguugguccaaauaaaauauauccuagucaaacaaaauu

SEQ ID NO: 652604 - RNA, 64 nt, Homo Sapiens
augcaguaagaaaacuguaaaauucgagccauauaaauaaaaccuguacuguucuaguuguuuu

SEQ ID NO: 652605 - RNA, 64 nt, Homo Sapiens
uaaggauuacuuugucugcccaccaccuaguguaaaauaaaaucaaguaauacaaucuuaacug

SEQ ID NO: 652606 - RNA, 64 nt, Homo Sapiens
ccuaacuuuaguagcaaaucuugauuaauugaagaaauaaaauauuucggauaagguuucauaa

SEQ ID NO: 652607 - RNA, 64 nt, Homo Sapiens
uaaaaccacuaauuguuccguuaagcuucacagaaaauaaaaccucuauuacuagacauuuaug

SEQ ID NO: 652608 - RNA, 64 nt, Homo Sapiens
gagauugcaccacugcacuccagcuugggugauaaaauaaaauaaaauagucgugaaucuuguu

SEQ ID NO: 652609 - RNA, 64 nt, Homo Sapiens
ugcaccacugcacuccagcuugggugauaaaauaaaauaaaauagucgugaaucuuguucaaaa

SEQ ID NO: 652610 - RNA, 64 nt, Homo Sapiens
ugucuucgagauguagaaauaaggaauauucugaaaauaaaaauuauacaguaguaaagauaau

SEQ ID NO: 652611 - RNA, 64 nt, Homo Sapiens
gcaggagugcccugcauuguuuucuuuuaauuagaaauaaaaaguauuagucuaaaugugguuc

SEQ ID NO: 652612 - RNA, 64 nt, Homo Sapiens
aucacagaaaugauauucugcaagaauuucuuuuaaauaaaaaguuugggggugcaauauaaga

SEQ ID NO: 652613 - RNA, 64 nt, Homo Sapiens
uuguauauuuauuguauuaacacagagugucauaaaauaaaaugcuguuuacuggauguuuguu

SEQ ID NO: 652614 - RNA, 64 nt, Homo Sapiens
ucagauaaaauauauuuugggaaauuaacugaacaaauaaaaaguuuuugauauaacuucaauu

SEQ ID NO: 652615 - RNA, 64 nt, Homo Sapiens
aaauguuuuagauaagacacaauaaaauuauuauaaauaaaagcuuaauguuuguaaaaaaucu

SEQ ID NO: 652616 - RNA, 64 nt, Homo Sapiens
caucaguauaaaagugccaaaccugcccucuuuuaaauaaaaauguaaaaaggccacucccagg

SEQ ID NO: 652617 - RNA, 64 nt, Homo Sapiens
uaauuuuuuuuacaacccucugacucaacaaaguaaauaaaaguauauuuuaucacuauuaagc

SEQ ID NO: 652618 - RNA, 64 nt, Homo Sapiens
uuaaauauuauugacuuacaguuuaaaaauaaauaaauaaaagcauacuauaguuguaaaaaca

SEQ ID NO: 652619 - RNA, 64 nt, Homo Sapiens
ugaauauuugcucauguuuucuaaauuccuuauaaaauaaaauuaauucgaauucaaucugcac

SEQ ID NO: 652620 - RNA, 64 nt, Homo Sapiens
acacgauccucuuucugggcauuccuaggggagaaaauaaaauuuguaauguucuagagaucau

SEQ ID NO: 652621 - RNA, 64 nt, Homo Sapiens
uaauaugagacauacuguuacuaaacauaaguucaaauaaaaaguuguucuguuaaaaaaaaaa

SEQ ID NO: 652622 - RNA, 64 nt, Homo Sapiens
ggagccuacuucuagcuguauuuuuuguaugcuuaaauaaaaauaaaaauucauaaccaaagag

SEQ ID NO: 652623 - RNA, 64 nt, Homo Sapiens
uacuucuagcuguauuuuuuguaugcuuaaauaaaaauaaaaauucauaaccaaagagaauccc

SEQ ID NO: 652624 - RNA, 64 nt, Homo Sapiens
aaaaguucuauuuucccuguauugguaucuccuuaaauaaaauaaaauauuccuauuguaagug

SEQ ID NO: 652625 - RNA, 64 nt, Homo Sapiens
uucuauuuucccuguauugguaucuccuuaaauaaaauaaaauauuccuauuguaagugauaug

SEQ ID NO: 652626 - RNA, 64 nt, Homo Sapiens
gugauaugagaaaucuuuaaccagccuuaucuaaaaauaaaaagagaagccauuguaagacauu

SEQ ID NO: 652627 - RNA, 64 nt, Homo Sapiens
cuccagccugggcaauaagagcaaaacuccaucaaaauaaaauaaaauaaaauauaaaauaacu

SEQ ID NO: 652628 - RNA, 64 nt, Homo Sapiens
gccugggcaauaagagcaaaacuccaucaaaauaaaauaaaauaaaauauaaaauaacuuaaaa

SEQ ID NO: 652629 - RNA, 64 nt, Homo Sapiens
ggcaauaagagcaaaacuccaucaaaauaaaauaaaauaaaauauaaaauaacuuaaaaagaac

SEQ ID NO: 652630 - RNA, 64 nt, Homo Sapiens
gcugauguauaaaacagacuaugccuuauaauugaaauaaaauuauaaucugccugaaaaugaa

SEQ ID NO: 652631 - RNA, 64 nt, Homo Sapiens
gaaauaaaauuauaaucugccugaaaaugaauaaaaauaaaacauuuugaaaugugugguugag

SEQ ID NO: 652632 - RNA, 64 nt, Homo Sapiens
uauguaacuuaaaucuagacaccaucaaagcauaaaauaaaaauaaaaagcguugcugaaucug

SEQ ID NO: 652633 - RNA, 64 nt, Homo Sapiens
acuuaaaucuagacaccaucaaagcauaaaauaaaaauaaaaagcguugcugaaucugggucga

SEQ ID NO: 652634 - RNA, 64 nt, Homo Sapiens
ugucuagauuauauagguuuagguugaaguuauaaaauaaaauaaaauucauuuuccacuggaa

SEQ ID NO: 652635 - RNA, 64 nt, Homo Sapiens
agauuauauagguuuagguugaaguuauaaaauaaaauaaaauucauuuuccacuggaacucua

SEQ ID NO: 652636 - RNA, 64 nt, Homo Sapiens
auuuggugcucucauucauggcaaaggauuugauaaauaaaaguucuuuaaacacuaaagcaaa

SEQ ID NO: 652637 - RNA, 64 nt, Homo Sapiens
caauauauuuguagguauacuauguaagggcuuuaaauaaaagagguccauuaauacuuccuua

SEQ ID NO: 652638 - RNA, 64 nt, Homo Sapiens
uccaccaauaucauguguagauauuauguauagaaaauaaaauaaauuauggcucuaacuucug

SEQ ID NO: 652639 - RNA, 64 nt, Homo Sapiens
auuaucccucaaaaaguuaccaccacaucagaaaaaauaaaaaaaaaauaguaaaguaggcaga

SEQ ID NO: 652640 - RNA, 64 nt, Homo Sapiens
ugccaacuucaucaaguaaugcaugcuuuauuauaaauaaaauucuagcuuugaaaggcguuau

SEQ ID NO: 652641 - RNA, 64 nt, Homo Sapiens
auacuucuccauacacagaccucugcagaaugcaaaauaaaacuugcagugaaugaauuuagca

SEQ ID NO: 652642 - RNA, 64 nt, Homo Sapiens
cuauuuucuauuuucccagucuaugacuuagguaaaauaaaagauauuuuugaagacuauuuuu

SEQ ID NO: 652643 - RNA, 64 nt, Homo Sapiens
guucuuacacaaggggcaaaaaaauauaguuuggaaauaaaaauuucuacucuaaagcuucuau

SEQ ID NO: 652644 - RNA, 64 nt, Homo Sapiens
acacugcuuaguauucuugacuauguguucaaugaaauaaaagcuuuugcuguuaguuauaaaa

SEQ ID NO: 652645 - RNA, 64 nt, Homo Sapiens
aaaaggaaaaucauucaggaccuucaaaaaauaaaaauaaaagagaccaccaguaaauaauccu

SEQ ID NO: 652646 - RNA, 64 nt, Homo Sapiens
aaaagaaaaaggaaaaucauaauccuccuucaaaaaauaaaaaucuuuuagaccaccaguaaau

SEQ ID NO: 652647 - RNA, 64 nt, Homo Sapiens
augcccucagcuuuuaaugaguagggucauagagaaauaaaagcgauaauacaguccaugcaaa

SEQ ID NO: 652648 - RNA, 64 nt, Homo Sapiens
aaaaaacuuagagcacaauauugacaacucuaaaaaauaaaaaaccuucgugucauugugauau

SEQ ID NO: 652649 - RNA, 64 nt, Homo Sapiens
accagaaaaccccugaaggauuugggaaaagucaaaauaaaacacuuuuuuuuuuuuuuuuggc

SEQ ID NO: 652650 - RNA, 64 nt, Homo Sapiens
uuuagcccuuccuugguaggggggugggagugggaaauaaaauagagcaggagaagauggggag

SEQ ID NO: 652651 - RNA, 64 nt, Homo Sapiens
cagcaauaugucauuaacaacuuaauaaugaauaaaauaaaaagccccacagagugccuagaau

SEQ ID NO: 652652 - RNA, 64 nt, Homo Sapiens
uaugucuuuauaacucugaugcuuagauccuuugaaauaaaaauuccccugagaucuagcugau

SEQ ID NO: 652653 - RNA, 64 nt, Homo Sapiens
uuagagaucacucuuggcuguaaaaauucugguuaaauaaaaaauaaaauauuuauuauauugg

SEQ ID NO: 652654 - RNA, 64 nt, Homo Sapiens
ucagcuuauaauaaugauacuagauaauuuaguaaaauaaaaauggcacagaauuuuuuugaca

SEQ ID NO: 652655 - RNA, 64 nt, Homo Sapiens
ugggcaguuucuguggcauuugcccuggugaaauaaauaaaagacaguuaacuuggugcuaaug

SEQ ID NO: 652656 - RNA, 64 nt, Homo Sapiens
gguguuguauugcuugugagucaauaacugugaaaaauaaaaaauauuuaauauuugacugauu

SEQ ID NO: 652657 - RNA, 64 nt, Homo Sapiens
gugugcucuuuacuguuuuuucaguguugugaguaaauaaaaauaaaaaguuuacauuaauuau

SEQ ID NO: 652658 - RNA, 64 nt, Homo Sapiens
gaguucucauuuaacuguuaaaauaaauagauguaaauaaaauuagaugugauacacugaaugg

SEQ ID NO: 652659 - RNA, 64 nt, Homo Sapiens
acaguuuucuugguggcagaaauccuuuucccauaaauaaaaguuaaguaucuaggaguauuua

SEQ ID NO: 652660 - RNA, 64 nt, Homo Sapiens
auauaccccacaggcugugugaaauauaaacuuaaaauaaaauuuguauguugcuauccugcag

SEQ ID NO: 652661 - RNA, 64 nt, Homo Sapiens
auguugaauuuucguauuguuucauauauuuaacaaauaaaaauaaggaauauauuuaauuaua

SEQ ID NO: 652662 - RNA, 64 nt, Homo Sapiens
uaaaaaaaaauuauuaggcuccaacucuacaaaaaaauaaaaauugguuagcaaggcaagaucc

SEQ ID NO: 652663 - RNA, 64 nt, Homo Sapiens
cugccucuccccucccccaguuucuccuccccuaaaauaaaaauaguggucaacuuuaguaaua

SEQ ID NO: 652664 - RNA, 64 nt, Homo Sapiens
cauuuguaagcagaacucuagcuauaugggguagaaauaaaaucucugagaugaaacaaaggaa

SEQ ID NO: 652665 - RNA, 64 nt, Homo Sapiens
uucuguuugcagauaugauugauguauuucaccaaaauaaaauauuuuuauguuuauaaagugu

SEQ ID NO: 652666 - RNA, 64 nt, Homo Sapiens
uuauagaauaaauauucagcugugaaaacugguuaaauaaaacuaauauuucuuaacacauuug

SEQ ID NO: 652667 - RNA, 64 nt, Homo Sapiens
aggcacugauaaaaccgcaacaaaaacauguaagaaauaaaauagaaaugcuuuauauaauuua

SEQ ID NO: 652668 - RNA, 64 nt, Homo Sapiens
uuuuuguguuuggaguguaguccauuugcaauagaaauaaaaaaauccgucaccaaauuguaac

SEQ ID NO: 652669 - RNA, 64 nt, Homo Sapiens
caagugugcaaauuaugacugcgugagccuuagaaaauaaaauguauaaagggcaacacaugag

SEQ ID NO: 652670 - RNA, 64 nt, Homo Sapiens
cuuguuuucauuuuuguuguacguguagaucuguaaauaaaauugcaguauuuaaagcuuaagc

SEQ ID NO: 652671 - RNA, 64 nt, Homo Sapiens
uacccucuugagguaggaaaugcucugugaugguaaauaaaauuggagcagacagaaaagauau

SEQ ID NO: 652672 - RNA, 64 nt, Homo Sapiens
ggucauaaguuaacuguauuaagaacaguaaaauaaauaaaaaccaauaguacuaauuuugcuu

SEQ ID NO: 652673 - RNA, 64 nt, Homo Sapiens
uguguauuuauuguuaauucuuaaaauaguguguaaauaaaauaacaucagugugcuuuaaaga

SEQ ID NO: 652674 - RNA, 64 nt, Homo Sapiens
gagccuuaagucaaucucagaagguagcauaaacaaauaaaaauuaacuguauggcaugaucag

SEQ ID NO: 652675 - RNA, 64 nt, Homo Sapiens
aggaauuguauuauuguguguauauauaauuuguaaauaaaaaguauggagaugauacgguguu

SEQ ID NO: 652676 - RNA, 64 nt, Homo Sapiens
acuuguguacgaaaaauaaaucuccuuaaaaacuaaauaaaaugcacuguauucuuacaguuaa

SEQ ID NO: 652677 - RNA, 64 nt, Homo Sapiens
auuaauacaguaguaguaaucauuuucuaggggaaaauaaaagaauaaaucacuauacugauau

SEQ ID NO: 652678 - RNA, 64 nt, Homo Sapiens
gggugacaaagcaagacugugucucaaaauaaauaaauaaaauaaaauaaaaugacguacagag

SEQ ID NO: 652679 - RNA, 64 nt, Homo Sapiens
acaaagcaagacugugucucaaaauaaauaaauaaaauaaaauaaaaugacguacagagauucu

SEQ ID NO: 652680 - RNA, 64 nt, Homo Sapiens
gcaagacugugucucaaaauaaauaaauaaaauaaaauaaaaugacguacagagauucuauauu

SEQ ID NO: 652681 - RNA, 64 nt, Homo Sapiens
aaauaucauuauucacucagacuuccauaagaguaaauaaaaaugaauaugcaguggcugacau

SEQ ID NO: 652682 - RNA, 64 nt, Homo Sapiens
ugagcucauuauuaaucauaguuucaaaauuaucaaauaaaaccagugaagaucugaagaugca

SEQ ID NO: 652683 - RNA, 64 nt, Homo Sapiens
accaaaaacauguauauaaaagaaugaaauugaaaaauaaaauauauaaacauaaauaaauuag

SEQ ID NO: 652684 - RNA, 64 nt, Homo Sapiens
auucaaguuguacuuguuauaucugacaugaaugaaauaaaaucuuaauuacagaugcuuuuua

SEQ ID NO: 652685 - RNA, 64 nt, Homo Sapiens
ugaaaauauuacauucaugauuauuuuauuuaguaaauaaaauaauagagagcccagaaaucaa

SEQ ID NO: 652686 - RNA, 64 nt, Homo Sapiens
ccuuguauuauauagguugaaauuaaagaugaauaaauaaaauaaaaugacacaaggccaaaaa

SEQ ID NO: 652687 - RNA, 64 nt, Homo Sapiens
uauuauauagguugaaauuaaagaugaauaaauaaaauaaaaugacacaaggccaaaaacaaau

SEQ ID NO: 652688 - RNA, 64 nt, Homo Sapiens
uguuagcuucgaugaagucaauuuauacccuauaaaauaaaacugaagauuuuuuugaagauua

SEQ ID NO: 652689 - RNA, 64 nt, Homo Sapiens
gguuuuguucagauuaaaaucacagagagucuccaaauaaaaagaaacguggagcauuguuucu

SEQ ID NO: 652690 - RNA, 64 nt, Homo Sapiens
aaacuucaaauaagacuaugauacuuauagacugaaauaaaaugagugcuuuaaacaaauagca

SEQ ID NO: 652691 - RNA, 64 nt, Homo Sapiens
auccaguuuguggaugacuaucuaauggcucagaaaauaaaaacucaaagugauuuugaaaauc

SEQ ID NO: 652692 - RNA, 64 nt, Homo Sapiens
cauauauuaauaaaaaccuaucuugagcaccagaaaauaaaaucgucaguuuagcauuacauug

SEQ ID NO: 652693 - RNA, 64 nt, Homo Sapiens
aaaaucccuaaaaacucucucaguuucacuucaaaaauaaaaaaaugcuauaaguauguacaua

SEQ ID NO: 652694 - RNA, 64 nt, Homo Sapiens
aaaaccagugaagugccacaaccaauaggugcaaaaauaaaaggccaauucacccagaaaaaag

SEQ ID NO: 652695 - RNA, 64 nt, Homo Sapiens
uucaaaccaauucacccagauuguaaaaccaacuaaauaaaaaaacaacauauuugggguuugc

SEQ ID NO: 652696 - RNA, 64 nt, Homo Sapiens
cuaucucaaaguuuaacacaccagaggcagagugaaauaaaaugguucuaugaauauggaaagg

SEQ ID NO: 652697 - RNA, 64 nt, Homo Sapiens
ggaauuauguggucagugcauguauaacuguguaaaauaaaaaaaaauguguauuuagaauauu

SEQ ID NO: 652698 - RNA, 64 nt, Homo Sapiens
uuuuauuccauuugcuuguuuugcaauacuuuaaaaauaaaaaaguuacaaaccugugggccug

SEQ ID NO: 652699 - RNA, 64 nt, Homo Sapiens
ugauguaaaugaaugcugcaguuuagaauauaguaaauaaaaggaaauguuaaauauuuuauga

SEQ ID NO: 652700 - RNA, 64 nt, Homo Sapiens
uacccaugugaaauaauaauuauauacuaagaauaaauaaaauauuacugaaccauuaaauacu

SEQ ID NO: 652701 - RNA, 64 nt, Homo Sapiens
aauggcaggacucauauuauugagucaagaguguaaauaaaagaacuucugucauaauucuugc

SEQ ID NO: 652702 - RNA, 64 nt, Homo Sapiens
aucaggaauacaacuuaaguuuaaagugaaucucaaauaaaagagauuauuaucuagguuagac

SEQ ID NO: 652703 - RNA, 64 nt, Homo Sapiens
cccaaaacaauauaaaguugcuauuuucuuaaagaaauaaaacauaaaguugggagaggagcau

SEQ ID NO: 652704 - RNA, 64 nt, Homo Sapiens
uuuggauuaaauuaguuugugaaggauuauggaaaaauaaaacugucacuguuggacgucagca

SEQ ID NO: 652705 - RNA, 64 nt, Homo Sapiens
auauucucuauuugaauuauuucugucacaguaaaaauaaaauacuuugaguuuugagcuacug

SEQ ID NO: 652706 - RNA, 64 nt, Homo Sapiens
ugaauugcaauuuauuaaauauucuuauccucuuaaauaaaacugcucaacaguuaaucagcag

SEQ ID NO: 652707 - RNA, 64 nt, Homo Sapiens
auguuuagcaggcuguaaacuuaagaaaaggguaaaauaaaauuuucuggagaggaacuuggaa

SEQ ID NO: 652708 - RNA, 64 nt, Homo Sapiens
acucucugguaagacuugaaugugauuauuuuauaaauaaaagaaccacuaugaaacuuucaug

SEQ ID NO: 652709 - RNA, 64 nt, Homo Sapiens
aaguucgaauuacaguugugagauugauuuauuuaaauaaaaauaugccuuugccaguuuugga

SEQ ID NO: 652710 - RNA, 64 nt, Homo Sapiens
aaacaucaacaaaaacaaaacccacugugucuuaaaauaaaauguucugcauuguagucaauaa

SEQ ID NO: 652711 - RNA, 64 nt, Homo Sapiens
cuucaacuaagcucuugcagagugagaugacuugaaauaaaaauguucuaugaauauugaauuu

SEQ ID NO: 652712 - RNA, 64 nt, Homo Sapiens
aaaaaaaaaacaaaaaaaaaaaaacaaaagaaaaaaauaaaaauacgguggcaauauuauguaa

SEQ ID NO: 652713 - RNA, 64 nt, Homo Sapiens
acauuauguguaacagauugauuuucucagcacaaaauaaaaagcaucuguauuaauguaaaga

SEQ ID NO: 652714 - RNA, 64 nt, Homo Sapiens
guuauggaaaaugucaaccuuuguaagaaaaccaaaauaaaaauugaaaaauaaaaaccauaaa

SEQ ID NO: 652715 - RNA, 64 nt, Homo Sapiens
caaccuuuguaagaaaaccaaaauaaaaauugaaaaauaaaaaccauaaacauuugcaccacuu

SEQ ID NO: 652716 - RNA, 64 nt, Homo Sapiens
agccuggauaacagagcgagacccugucucaaaaaaauaaaauaaaaaauaaaaacacccuugc

SEQ ID NO: 652717 - RNA, 64 nt, Homo Sapiens
ggauaacagagcgagacccugucucaaaaaaauaaaauaaaaaauaaaaacacccuugccugcg

SEQ ID NO: 652718 - RNA, 64 nt, Homo Sapiens
agagcgagacccugucucaaaaaaauaaaauaaaaaauaaaaacacccuugccugcgcuccauu

SEQ ID NO: 652719 - RNA, 64 nt, Homo Sapiens
ggaauuuuuuccuaaucauguuuuuaacauuuuaaaauaaaauuuaauacuaagaaauuauggc

SEQ ID NO: 652720 - RNA, 64 nt, Homo Sapiens
ggcaugcacugcaagaauuaaguaucucagacugaaauaaaaccguucauaauuaaaguauuau

SEQ ID NO: 652721 - RNA, 64 nt, Homo Sapiens
gaggaaacuguguuaggcauguauuaaaacauuuaaauaaaauaaaaauacauuucagcuacaa

SEQ ID NO: 652722 - RNA, 64 nt, Homo Sapiens
aacuguguuaggcauguauuaaaacauuuaaauaaaauaaaaauacauuucagcuacaaaguga

SEQ ID NO: 652723 - RNA, 64 nt, Homo Sapiens
cauucugccuugcuguagugaagagacccacuccaaauaaaaaaggggccacacggggcuucua

SEQ ID NO: 652724 - RNA, 64 nt, Homo Sapiens
gaucagcaauaaugacuauguaaucucaaaaaacaaauaaaauauucuuaacauggacucuuaa

SEQ ID NO: 652725 - RNA, 64 nt, Homo Sapiens
uccuuccccuuagcuuuauuaagguaucauugauaaauaaaaauaaaauauguuuaauguauau

SEQ ID NO: 652726 - RNA, 64 nt, Homo Sapiens
cccuuagcuuuauuaagguaucauugauaaauaaaaauaaaauauguuuaauguauauaaugug

SEQ ID NO: 652727 - RNA, 64 nt, Homo Sapiens
ggcgcaaacccuuuuccucccagccuauuuuuguaaauaaaauguuuaaacuugaaauacaaau

SEQ ID NO: 652728 - RNA, 64 nt, Homo Sapiens
ugugaggcauguucugauauguuuauaggcaaacaaauaaaacagcaaacuuuuuugccacaug

SEQ ID NO: 652729 - RNA, 64 nt, Homo Sapiens
cuuucucuaguuuuggagcuauuuuauaucaauaaaauaaaauaaccuuuaaacccauaaauua

SEQ ID NO: 652730 - RNA, 64 nt, Homo Sapiens
aaucaaacacagaauuugauuaaagcugaguauaaaauaaaaccuacaguuuugugauauaaaa

SEQ ID NO: 652731 - RNA, 64 nt, Homo Sapiens
acugggaucaaacuggccugaagaacaccuuuagaaauaaaaauguaacaaucagaggaacuau

SEQ ID NO: 652732 - RNA, 64 nt, Homo Sapiens
auaugccaaagauuuucuugagcuggauaacuaaaaauaaaaauggacagucuagagacucugg

SEQ ID NO: 652733 - RNA, 64 nt, Homo Sapiens
cacaguuucaaaugguaucaaauuuuaaauugauaaauaaaaaguaaugaaagcaucaacagau

SEQ ID NO: 652734 - RNA, 64 nt, Homo Sapiens
auuuuagccuuucucaguuuugguauaguggcuuaaauaaaacauuggugaaaucaauaugucu

SEQ ID NO: 652735 - RNA, 64 nt, Homo Sapiens
cugcucucacugucagcucuuaccauuuuauacaaaauaaaaaggaaagccaguauuguuaaaa

SEQ ID NO: 652736 - RNA, 64 nt, Homo Sapiens
uauugauucuuuucuauuuuuuuaacuuuuugccaaauaaaauaauuguuguguugagaugaua

SEQ ID NO: 652737 - RNA, 64 nt, Homo Sapiens
aaauuuuaaguguucucgggagaauuucccagugaaauaaaaaaaugauuguaaaguagcugua

SEQ ID NO: 652738 - RNA, 64 nt, Homo Sapiens
aggaaccugcuauacaugugaaaaugauuugaacaaauaaaacugguguuucuuaugcacuuau

SEQ ID NO: 652739 - RNA, 64 nt, Homo Sapiens
cuaucuaauccuacucuccaacaacgcccaaaggaaauaaaaucauaaggcauucaauaaaugc

SEQ ID NO: 652740 - RNA, 64 nt, Homo Sapiens
gagaggcagacaaugucugguaauaaagaaaaauaaauaaaaagaacucuaaaaacaaaaauaa

SEQ ID NO: 652741 - RNA, 64 nt, Homo Sapiens
aaaucaaaucuuagcuguugucuuuuagugccacaaauaaaagacucuucaucacagcuaucug

SEQ ID NO: 652742 - RNA, 64 nt, Homo Sapiens
uguaucugagugagaaaacaaagauguguugaugaaauaaaaugugaaaaaaguaauagaaauc

SEQ ID NO: 652743 - RNA, 64 nt, Homo Sapiens
uguugaauuccccaguuaugucauuggccuggcaaaauaaaacauuaauuggauauugaugaaa

SEQ ID NO: 652744 - RNA, 64 nt, Homo Sapiens
uagauggaaaaaugugaaaaaaauuauuuucuccaaauaaaaauauuagaauaauuucauacug

SEQ ID NO: 652745 - RNA, 64 nt, Homo Sapiens
ugaaagcaaguggauuacacagauguuuucaccuaaauaaaaaucuaaaauaugaaauuuugua

SEQ ID NO: 652746 - RNA, 64 nt, Homo Sapiens
cauguuaauccuuguaucaugaaacaaauaacugaaauaaaaaaauacaucaaguucauuugca

SEQ ID NO: 652747 - RNA, 64 nt, Homo Sapiens
uaagguaacuucucagaaaguucacucacuguggaaauaaaaacuuauaacacagucuuuaauu

SEQ ID NO: 652748 - RNA, 64 nt, Homo Sapiens
gauucccagauuccauacauuuacaagucagguaaaauaaaaucacaauuuuaaauaauucauc

SEQ ID NO: 652749 - RNA, 64 nt, Homo Sapiens
ucacacaauaaaaaacaacaaaauauuauuaguaaaauaaaauuaauuaguuaaaauauauuaa

SEQ ID NO: 652750 - RNA, 64 nt, Homo Sapiens
uuuucucuaagcaucuuuaguugucaacuaaugaaaauaaaacaccauucaacugaacaacuag

SEQ ID NO: 652751 - RNA, 64 nt, Homo Sapiens
acaaaaaagguaauccaguagacgcacuugggugaaauaaaacaaaacuuagguaaaugacaua

SEQ ID NO: 652752 - RNA, 64 nt, Homo Sapiens
uauuagucgacuguguuacuaaaaguaaauuuuuaaauaaaauauuuauccauuuauaggcuuc

SEQ ID NO: 652753 - RNA, 64 nt, Homo Sapiens
uguuauuuuggcauauuucuagaccucauucuuuaaauaaaacuccucauuucuuucugcccaa

SEQ ID NO: 652754 - RNA, 64 nt, Homo Sapiens
cagccaagauuaaucaaucauucugagaacucauaaauaaaauucucaucuccugaaccuguua

SEQ ID NO: 652755 - RNA, 64 nt, Homo Sapiens
uuuuauuguauagcaauucuaaaugccacgugaaaaauaaaaaugcuguuuaaccguguaacaa

SEQ ID NO: 652756 - RNA, 64 nt, Homo Sapiens
uaccuaacuugggcacagcuugaacauaaagaggaaauaaaaggaaaauuaaauaaaacuaaua

SEQ ID NO: 652757 - RNA, 64 nt, Homo Sapiens
aauaugaacauaaagaggaaauaaauuaaaaauuaaauaaaacuaccuacacacaauuuuagaa

SEQ ID NO: 652758 - RNA, 64 nt, Homo Sapiens
uagccugggcaacggugagacccugccucaaaaaaaauaaaaauaaaaauaaaacacuuuaauu

SEQ ID NO: 652759 - RNA, 64 nt, Homo Sapiens
gggcaacggugagacccugccucaaaaaaaauaaaaauaaaaauaaaacacuuuaauuagaauc

SEQ ID NO: 652760 - RNA, 64 nt, Homo Sapiens
cggugagacccugccucaaaaaaaauaaaaauaaaaauaaaacacuuuaauuagaaucuauuuu

SEQ ID NO: 652761 - RNA, 64 nt, Homo Sapiens
aaaccaaaguuuauuaauaauuuuuauauaacuaaaauaaaauagauguggagggaucugugau

SEQ ID NO: 652762 - RNA, 64 nt, Homo Sapiens
gugaaauuuagcaauaguuaauauuaggugacauaaauaaaacaucccagacuagugaguuaag

SEQ ID NO: 652763 - RNA, 64 nt, Homo Sapiens
agaaaaacuugaaauguugacuuaagugagggggaaauaaaacccagagagagagagagagcga

SEQ ID NO: 652764 - RNA, 64 nt, Homo Sapiens
cuauggugugaaauccuuuguuauuuuucuaaaaaaauaaaauuuaaaaagaaagaaaacuaag

SEQ ID NO: 652765 - RNA, 64 nt, Homo Sapiens
guauuucaaagcucuuuuccuaacugguuaaguaaaauaaaaaauugagcuuucuagaauauuu

SEQ ID NO: 652766 - RNA, 64 nt, Homo Sapiens
aaaaaagagagaguaacuacagaagaacuuuaaaaaauaaaaaauaagcuuaccuuggauucuu

SEQ ID NO: 652767 - RNA, 64 nt, Homo Sapiens
guuuuguuuuucacaaagcucuuauuaugaagcaaaauaaaaauucuaguuucuuguaugauuu

SEQ ID NO: 652768 - RNA, 64 nt, Homo Sapiens
gaguauuugcacugcugaagagucacuaugagcaaaauaaaacaaauaagacucaaacugcuca

SEQ ID NO: 652769 - RNA, 64 nt, Homo Sapiens
uggcuucaggaaagucuagaagcaauauuucuucaaauaaaagguguuuaaacuuuuuucuguu

SEQ ID NO: 652770 - RNA, 64 nt, Homo Sapiens
uuuuaaccagacuuucucuuaaaaacauuagauaaaauaaaagauucaccggauggauucugau

SEQ ID NO: 652771 - RNA, 64 nt, Homo Sapiens
acugugaugcuauguuuguuucacuaaacuuucuaaauaaaaacugagaaaaaaaaaaucacug

SEQ ID NO: 652772 - RNA, 64 nt, Homo Sapiens
guguaggagugaagacaggaucccgugcuuaaaaaaauaaaaaauaaaaaaauaaaaaaaaaau

SEQ ID NO: 652773 - RNA, 64 nt, Homo Sapiens
agugaagacaggaucccgugcuuaaaaaaauaaaaaauaaaaaaauaaaaaaaaaauaagacuu

SEQ ID NO: 652774 - RNA, 64 nt, Homo Sapiens
caggaucccgugcuuaaaaaaauaaaaaauaaaaaaauaaaaaaaaaauaagacuuuaacugca

SEQ ID NO: 652775 - RNA, 64 nt, Homo Sapiens
uugcuucucgggaaagcaaagaagcugcuuuaaaaaauaaaaaggggacuaaaaauuuguuuug

SEQ ID NO: 652776 - RNA, 64 nt, Homo Sapiens
aaaauuauaaauguuaaaaggaaguuauugaagaaaauaaaagaaauuauguuauauuaucuag

SEQ ID NO: 652777 - RNA, 64 nt, Homo Sapiens
uuuguuaauaaauuugcuuuucacaccuuucuuuaaauaaaagguauaucucucuuucuugugg

SEQ ID NO: 652778 - RNA, 64 nt, Homo Sapiens
uuugcauguaaacaaugauuucaaaauacuugaaaaauaaaauuuuaacccaaaugaauaacua

SEQ ID NO: 652779 - RNA, 64 nt, Homo Sapiens
auaccuuuguauacucucaguucucauucaguauaaauaaaauuuuaaaauccuuucauaguuc

SEQ ID NO: 652780 - RNA, 64 nt, Homo Sapiens
uuaaaaccccauuuuccuaaagaacaaaguaguaaaauaaaaaaaaauuuaaaaaauuaaaaaa

SEQ ID NO: 652781 - RNA, 64 nt, Homo Sapiens
aguaguaaaauaaaaaaaaauuuaaaaaauuaaaaaauaaaaaaaagaggucacuaaaagacca

SEQ ID NO: 652782 - RNA, 64 nt, Homo Sapiens
ugucaauuauuuucaaaugucuaaauuccuuuggaaauaaaaauaucaguuuuacuuugaaauu

SEQ ID NO: 652783 - RNA, 64 nt, Homo Sapiens
ggaauguuuucauaaucgaaagaaacggguauccaaauaaaaccaaguucuugacauuggucug

SEQ ID NO: 652784 - RNA, 64 nt, Homo Sapiens
augacaaacuacuucuauaaugcuuauuaugguaaaauaaaauuggaaaaaauuaaaacugacc

SEQ ID NO: 652785 - RNA, 64 nt, Homo Sapiens
aaacacaucaucaauaaaacguaaaaacaaauguaaauaaaagagaaauucaauaccaaauaca

SEQ ID NO: 652786 - RNA, 64 nt, Homo Sapiens
uauucccaagugauuuuaauuucaaaauauuugaaaauaaaaagcugacugauaguucuauauu

SEQ ID NO: 652787 - RNA, 64 nt, Homo Sapiens
ggauagguggugacccacugaaauaaaauaaauaaaauaaaaaugguaaacaaagaaaugacaa

SEQ ID NO: 652788 - RNA, 64 nt, Homo Sapiens
aaaauggauagguggugaccgacaaaaauaaaauaaauaaaauaggauagguaaacaaagaaau

SEQ ID NO: 652789 - RNA, 64 nt, Homo Sapiens
aauaaaauaaaaauggauagcaaagaaaugacaaaaauaaaauauuuaaaaaaggauagguaaa

SEQ ID NO: 652790 - RNA, 64 nt, Homo Sapiens
aaauucaccuagucuaaggaaaaaaaauaaaauaaaauaaaaaucaugaaaaaaggacaauuuc

SEQ ID NO: 652791 - RNA, 64 nt, Homo Sapiens
aaaauaaauucaccuagucuauuucaaaaaaauaaaauaaaauauuugacaugaaaaaaggaca

SEQ ID NO: 652792 - RNA, 64 nt, Homo Sapiens
aaauaaaaauaaauucaccuggacaauuucaaaaaaauaaaauaaauguuuugacaugaaaaaa

SEQ ID NO: 652793 - RNA, 64 nt, Homo Sapiens
ccauauauacugcaaaguucuuauacaaaaaagaaaauaaaaaggauucuaaauaaauaggggc

SEQ ID NO: 652794 - RNA, 64 nt, Homo Sapiens
ugcuuauuugaaauguuaauauguuuacaucucuaaauaaaauuguugaguuuuuaauguuuac

SEQ ID NO: 652795 - RNA, 64 nt, Homo Sapiens
agugcaaauaaagcaaugauuuacccucacuugcaaauaaaauauacguaacuugcgaaucugu

SEQ ID NO: 652796 - RNA, 64 nt, Homo Sapiens
augaaaacaguacacuguugauauaauaccucaaaaauaaaaaugucuauacacuucacacuuu

SEQ ID NO: 652797 - RNA, 64 nt, Homo Sapiens
agccugugauguucaagggaaccuguucugucccaaauaaaacccagggaccuuuggaaauaaa

SEQ ID NO: 652798 - RNA, 64 nt, Homo Sapiens
uguucugucccaaauaaaacucagggaccuuuggaaauaaaaccguucauugucauugcugugu

SEQ ID NO: 652799 - RNA, 64 nt, Homo Sapiens
acggcuguauauaacauauuugccuauugugauaaaauaaaaagcaaaaccagacccaucuugu

SEQ ID NO: 652800 - RNA, 64 nt, Homo Sapiens
caaauuaauccuacaaucaggcugcagaugggcuaaauaaaagcagcugauuuuuaaugauaaa

SEQ ID NO: 652801 - RNA, 64 nt, Homo Sapiens
uggcauuaugugguuaagaguugucuugucacugaaauaaaagaagagugugaccuaaaugcuu

SEQ ID NO: 652802 - RNA, 64 nt, Homo Sapiens
guuguuuucaaagccaucuucaucuauuuguuguaaauaaaagucacgagugcuguugcacuac

SEQ ID NO: 652803 - RNA, 64 nt, Homo Sapiens
cuagauccaguucuuguuuuacuuccauaauuuaaaauaaaaucgcuauuuuuuuuccccagag

SEQ ID NO: 652804 - RNA, 64 nt, Homo Sapiens
gaaaguaauauuugugcaacacauuauuugauuuaaauaaaauuaaguucuucauaucaucaca

SEQ ID NO: 652805 - RNA, 64 nt, Homo Sapiens
auaaaaaaagaaagcaugauauauuacaaaaacaaaauaaaauaagaauacuauuuccaaacuc

SEQ ID NO: 652806 - RNA, 64 nt, Homo Sapiens
auuauaaauaucauuguacauugaagucuauaaaaaauaaaauagugucuauaaaagaaacacu

SEQ ID NO: 652807 - RNA, 64 nt, Homo Sapiens
ggauaauugcuuuuguaaaagugcaauguaaacaaaauaaaaauaaguaugauguaaauuuuca

SEQ ID NO: 652808 - RNA, 64 nt, Homo Sapiens
uccuaauaaucuacucuauuauuuuugaucgaccaaauaaaaugaccauccuuuauuuuacaau

SEQ ID NO: 652809 - RNA, 64 nt, Homo Sapiens
ugucaaguucuuuucaaaagacuaugucuuauuaaaauaaaaccuuuuaagccauuuccucuuc

SEQ ID NO: 652810 - RNA, 64 nt, Homo Sapiens
uugaugauaucuuuuaagccggcagugcuuaguuaaauaaaagaucauuuccuucaaaaugaag

SEQ ID NO: 652811 - RNA, 64 nt, Homo Sapiens
uuuuuaaugacacugguuucauguaguuuucaagaaauaaaagaauucauucaagugaagccau

SEQ ID NO: 652812 - RNA, 64 nt, Homo Sapiens
aauucauuguucuacuuaguugcagcuguaccugaaauaaaaauguuauugaugacugaauuuu

SEQ ID NO: 652813 - RNA, 64 nt, Homo Sapiens
gccugggugacagagugagacucugucucaaaaaaaauaaaauaaaaagucaauuuagaaugug

SEQ ID NO: 652814 - RNA, 64 nt, Homo Sapiens
ggugacagagugagacucugucucaaaaaaaauaaaauaaaaagucaauuuagaaugugaaauu

SEQ ID NO: 652815 - RNA, 64 nt, Homo Sapiens
gaauugaugguuguauaagaacuagcucauguaaaaauaaaauaacauuauuacauugccucaa

SEQ ID NO: 652816 - RNA, 64 nt, Homo Sapiens
gucuuguuuauuaacucuccuuuauucuauauggaaauaaaaaggaggcagucauguuagcaaa

SEQ ID NO: 652817 - RNA, 64 nt, Homo Sapiens
guuuuugucgugucuauaaaggaagaacaaaacaaaauaaaaacagagcccuagagaaaugcug

SEQ ID NO: 652818 - RNA, 64 nt, Homo Sapiens
uuuguguuuuuuucuggaacuacuucaagugagaaaauaaaaaaaaauggugacaaagcuguac

SEQ ID NO: 652819 - RNA, 64 nt, Homo Sapiens
gauagagauaauagaagacaaagagauuaaaaggaaauaaaaaugcaugauuaaaaacuaagaa

SEQ ID NO: 652820 - RNA, 64 nt, Homo Sapiens
aucuaccuucaggauugcugacagacagaauuugaaauaaaauaugcaaguuagcuaauacaaa

SEQ ID NO: 652821 - RNA, 64 nt, Homo Sapiens
ugcagccuuuccucuguacuuuucuccaugguugaaauaaaacagggugacugggaguuacuua

SEQ ID NO: 652822 - RNA, 64 nt, Homo Sapiens
auuuucauucauucacucaucaaagcucaaauaaaaauaaaauacugcuagcaaauggcagaac

SEQ ID NO: 652823 - RNA, 64 nt, Homo Sapiens
aaaauaauuuucauucauuccagaaccaaagcucaaauaaaaaugucacacugcuagcaaaugg

SEQ ID NO: 652824 - RNA, 64 nt, Homo Sapiens
gaucuaugucauaaucuauagaaaaaagaggcuaaaauaaaauaauguacuugacaauuccuua

SEQ ID NO: 652825 - RNA, 64 nt, Homo Sapiens
uuaggauuuauuaauauauguucaaucaguaaagaaauaaaaguguauuaaguuauacuaaugu

SEQ ID NO: 652826 - RNA, 64 nt, Homo Sapiens
guaacacuuuaaaacaagaacaacaaaagaaaaaaaauaaaacacaguaaaacaaauguguauu

SEQ ID NO: 652827 - RNA, 64 nt, Homo Sapiens
uuacuauuuccuuuauauacuuuaucuucugccaaaauaaaaauaggcauuuuaaucugcacag

SEQ ID NO: 652828 - RNA, 64 nt, Homo Sapiens
guguacaugugauuaaaagacugaauucaguaauaaauaaaaauaacauauucugcaucccuca

SEQ ID NO: 652829 - RNA, 64 nt, Homo Sapiens
uagaggugagagaugauuuagccucauuucuaggaaauaaaagacuauaucggcuuagaaacau

SEQ ID NO: 652830 - RNA, 64 nt, Homo Sapiens
gccagcguacacaaugagauuaaauugcaaaauaaaauaaaauaagaguuguaggaugcagggc

SEQ ID NO: 652831 - RNA, 64 nt, Homo Sapiens
aaauagccagcguacacaauagggcuaaauugcaaaauaaaauauaucaagaguuguaggaugc

SEQ ID NO: 652832 - RNA, 64 nt, Homo Sapiens
uucuguucaacuuauaaaacauagaauugcugagaaauaaaaugcucauguuuaauuuguacgc

SEQ ID NO: 652833 - RNA, 64 nt, Homo Sapiens
uacaucugaagaugauuauucugugaaauguacuaaauaaaauggagggacugaauacugaaaa

SEQ ID NO: 652834 - RNA, 64 nt, Homo Sapiens
agaauuucaaccuguaauuuuauuuaucauuuugaaauaaaaucgucagaacuaugccucgguu

SEQ ID NO: 652835 - RNA, 64 nt, Homo Sapiens
aaaguacuuuuuacuuuuuacauuuucaaaggaaaaauaaaaugguccuguuugccacuaaaaa

SEQ ID NO: 652836 - RNA, 64 nt, Homo Sapiens
agugaaaagaaaacaugggaaaacuaccuaauauaaauaaaauuugaauugauauucugaguga

SEQ ID NO: 652837 - RNA, 64 nt, Homo Sapiens
ucuauauaccaaaaaugugagugcugcauuaagaaaauaaaauuauauugauuguaugucuacu

SEQ ID NO: 652838 - RNA, 64 nt, Homo Sapiens
caucuaaauagaaggguucuuaauaaauauugcaaaauaaaaucguacauuugaauugaauaua

SEQ ID NO: 652839 - RNA, 64 nt, Homo Sapiens
aauguuauucucugauaaaguaggaaaacuuuccaaauaaaauaauagcagauagucucauauu

SEQ ID NO: 652840 - RNA, 64 nt, Homo Sapiens
acaugaaacugcaaaaaugaauauggcuggaccaaaauaaaauguuuuuuucuccuacaaggag

SEQ ID NO: 652841 - RNA, 64 nt, Homo Sapiens
aauauuuauaauggauauuuuuccaauucuuuuaaaauaaaauuuauguaauauauguaacauc

SEQ ID NO: 652842 - RNA, 64 nt, Homo Sapiens
cagaggccuaucuccacuuucugcuaggauuuaaaaauaaaaaugccucuuaaaaaaaaaaaac

SEQ ID NO: 652843 - RNA, 64 nt, Homo Sapiens
uacuuuaguuugcuaaccaaacuguacaucccauaaauaaaaaauuccguaagacccaauaguu

SEQ ID NO: 652844 - RNA, 64 nt, Homo Sapiens
agaaacacaacucuacuaguuuaauaaaaguaaaaaauaaaaauaaucuguauuaaaaauaaaa

SEQ ID NO: 652845 - RNA, 64 nt, Homo Sapiens
aauaaaaguaaaaaauaaaaaaaaucuguauuaaaaauaaaauuguugaaaaugccccuuacug

SEQ ID NO: 652846 - RNA, 64 nt, Homo Sapiens
ucuuuaaaagguauccagcccugauauuuuguguaaauaaaauguuuuuaaaaccuguuaguua

SEQ ID NO: 652847 - RNA, 64 nt, Homo Sapiens
ccaguuccucuuugauaaauauauaguuaauucgaaauaaaauccauugcaauucauuuaugag

SEQ ID NO: 652848 - RNA, 64 nt, Homo Sapiens
accaugcauaacucuugggaaguugagcuuugcuaaauaaaagauauuucugcugaucaaagau

SEQ ID NO: 652849 - RNA, 64 nt, Homo Sapiens
aaugagccaggagaacaaacuaauuccuuuaaauaaauaaaaaaaaaaaaugcaaauguccuuc

SEQ ID NO: 652850 - RNA, 64 nt, Homo Sapiens
auauaaauguuuuauauguauauguuuuauacauaaauaaaacauuucaucuaauauauauaug

SEQ ID NO: 652851 - RNA, 64 nt, Homo Sapiens
aauuuaagaaaucuaaagugaaaauuuugcuuagaaauaaaauacgacaaguuauguuuugagu

SEQ ID NO: 652852 - RNA, 64 nt, Homo Sapiens
gaaaugauaccaagucucuaccaucucuuucagaaaauaaaagcagagauaacacuucccaacu

SEQ ID NO: 652853 - RNA, 64 nt, Homo Sapiens
gcuuuuugacagcuuuuugagaccucuuaagaaaaaauaaaaaguaaaaaaugaaaggaaucuu

SEQ ID NO: 652854 - RNA, 64 nt, Homo Sapiens
cgguuucugcuguauuaaugacaauuauucaugaaaauaaaaaaugaaauauuuuguauacuac

SEQ ID NO: 652855 - RNA, 64 nt, Homo Sapiens
ggaguggggagggauuaaaacccauccaaaaaauaaauaaaaacuauauaggugcuauguauau

SEQ ID NO: 652856 - RNA, 64 nt, Homo Sapiens
caacaaacaaacaaaaaacaagaaugaaaaacagaaauaaaagaaguagaaaagacaaagaaag

SEQ ID NO: 652857 - RNA, 64 nt, Homo Sapiens
aaaacaggaaccugauuuuuuuaaaauaaauuuuaaauaaaauagaauuacuacaauucugcaa

SEQ ID NO: 652858 - RNA, 64 nt, Homo Sapiens
ccuuuuacagaucuuacuguagcuuuuuccauauaaauaaaaugcuuuuucuacuauuugucuu

SEQ ID NO: 652859 - RNA, 64 nt, Homo Sapiens
ugcuuuuucuacuauuugucuugauuacuuaaaaaaauaaaaauauaaguaaggaucaaaacuc

SEQ ID NO: 652860 - RNA, 64 nt, Homo Sapiens
guauaaaaaagcaaauacuuggugagugauuuaaaaauaaaaccaaaacaaaacacaaaaagau

SEQ ID NO: 652861 - RNA, 64 nt, Homo Sapiens
aguuugaagcaguucuucaugccacuuaguuugaaaauaaaauucuagauaugcaaaugauuuu

SEQ ID NO: 652862 - RNA, 64 nt, Homo Sapiens
agauaugcaaaugauuuucuuagaaaacuucacaaaauaaaagaucuuguuuuuuuuuccauag

SEQ ID NO: 652863 - RNA, 64 nt, Homo Sapiens
guauuuuuugacuuaaacagaguaugacccugaaaaauaaaagaaucuuuuuuuuucaaaacuc

SEQ ID NO: 652864 - RNA, 64 nt, Homo Sapiens
ugugauacaguuaaaaggugcagcugccagugacaaauaaaaacuuuuguuacaucucauuauu

SEQ ID NO: 652865 - RNA, 64 nt, Homo Sapiens
acaggugcauucuaguuacaugaacaugcuaguuaaauaaaagucacaauuaagucauuaugac

SEQ ID NO: 652866 - RNA, 64 nt, Homo Sapiens
gaaaagacuauugcuuugccaugccuguuuuccuaaauaaaacaguugcuggcauuugcacauc

SEQ ID NO: 652867 - RNA, 64 nt, Homo Sapiens
augaugccauaagggagaagaguuuauuuggggaaaauaaaagaaauuuccacaccuuuguucu

SEQ ID NO: 652868 - RNA, 64 nt, Homo Sapiens
cuucuucccuuuuauaguucaucagccacaacaaaaauaaaaccuuugugugauuuacuguuuu

SEQ ID NO: 652869 - RNA, 64 nt, Homo Sapiens
agcuuuauaaccucaccaaugaauacaaauguuuaaauaaaauauugauuaaaaaaacauuaaa

SEQ ID NO: 652870 - RNA, 64 nt, Homo Sapiens
aacacuugugucaaaaugauauagcuuaguauaaaaauaaaauucaacguuuuggccaaaaugu

SEQ ID NO: 652871 - RNA, 64 nt, Homo Sapiens
uuguuucauuuugcucuguuuuaaauccauaugcaaauaaaacugcuucucucuuacacugcuu

SEQ ID NO: 652872 - RNA, 64 nt, Homo Sapiens
gaaacauguauaagaaaccagauuuaaguguuuuaaauaaaauguaaacaguuuuuauuuggua

SEQ ID NO: 652873 - RNA, 64 nt, Homo Sapiens
uuuugguuuacaguguaauaauaccucauuuaaaaaauaaaaaccacuacuguuacauuuuauu

SEQ ID NO: 652874 - RNA, 64 nt, Homo Sapiens
cuauaaauuccccuugaauuuauagugugaugccaaauaaaauuuucucaggaucuuauuaggu

SEQ ID NO: 652875 - RNA, 64 nt, Homo Sapiens
cauguuugauugacuuucauaguuuccugcauugaaauaaaaucacuaugaauucuaguuuauc

SEQ ID NO: 652876 - RNA, 64 nt, Homo Sapiens
agcaaauaauaauaauauuaauaauaauaaagagaaauaaaauaauaaaauaaaaaacaauagc

SEQ ID NO: 652877 - RNA, 64 nt, Homo Sapiens
aauauuaauaauaauaaagagaaauaaaauaauaaaauaaaaaacaauagcacagcccuuguug

SEQ ID NO: 652878 - RNA, 64 nt, Homo Sapiens
ugaacccuuccugagcuuuaugguccuaaaagcaaaauaaaaacuauucgaaugaaaagacaag

SEQ ID NO: 652879 - RNA, 64 nt, Homo Sapiens
aaucaacuuugaagacacaaaaguuaauuggaagaaauaaaaacugugaacgaagaauaccuuu

SEQ ID NO: 652880 - RNA, 64 nt, Homo Sapiens
gugacucaaaauucugaauuauggcagaaaggaaaaauaaaacauacuucacauuagaacacag

SEQ ID NO: 652881 - RNA, 64 nt, Homo Sapiens
uauguuauaauaugcuguuaaucaggacuuuauuaaauaaaaacauuggcucuuccaaccccca

SEQ ID NO: 652882 - RNA, 64 nt, Homo Sapiens
cacuuuuucguaugcacuacuguauuuccuuucuaaauaaaauugauuugauuguaugcaguac

SEQ ID NO: 652883 - RNA, 64 nt, Homo Sapiens
auuuguuuuuaaaaaaacaagaaaugcauguuucaaauaaaauucucuauuguaaauaaaauuu

SEQ ID NO: 652884 - RNA, 64 nt, Homo Sapiens
agaaaugcauguuucaaauaaaauucucuauuguaaauaaaauuuuuucuuuggaucuuggcaa

SEQ ID NO: 652885 - RNA, 64 nt, Homo Sapiens
uuauuucuugcaaaguuaaaaugauaaugaagaaaaauaaaaauuuauuauucuuaaaugcugu

SEQ ID NO: 652886 - RNA, 64 nt, Homo Sapiens
uaauuuaaucuuugcagauaaaaugagagcgagcaaauaaaacuauuugugagagauuauugua

SEQ ID NO: 652887 - RNA, 64 nt, Homo Sapiens
ucuauuuucaauauuuuuaaaccuuguauaaacaaaauaaaacauauuuguauuuugacauugu

SEQ ID NO: 652888 - RNA, 64 nt, Homo Sapiens
ccugccccgaaucuuccgucuacaugugguaaugaaauaaaaacacagugugagcugccuggaa

SEQ ID NO: 652889 - RNA, 64 nt, Homo Sapiens
guuuagaguuuuacuguaacugcugaaauauucuaaauaaaauguucauguagguucuguucac

SEQ ID NO: 652890 - RNA, 64 nt, Homo Sapiens
caagaaaagaacguugaaccgcaauggauguagaaaauaaaauucuguacauccacaaaaauau

SEQ ID NO: 652891 - RNA, 64 nt, Homo Sapiens
auugggaaagaaggugggucacauuagaauuuuaaaauaaaauauccauuaccuggcacuagca

SEQ ID NO: 652892 - RNA, 64 nt, Homo Sapiens
uaaugauuuauugcagaauuauuugcuuuaaaaaaaauaaaagauuuuguccuuuccuucacug

SEQ ID NO: 652893 - RNA, 64 nt, Homo Sapiens
aucagaauaaacacaacaaugauauaggacucccaaauaaaagucaguacacaugucauuuugu

SEQ ID NO: 652894 - RNA, 64 nt, Homo Sapiens
aucucaauuucuaauaccggcucucaaauagucaaaauaaaaacgaacauuaucuacaauuuua

SEQ ID NO: 652895 - RNA, 64 nt, Homo Sapiens
cacauaaauuuggaaggaggaccaaaaaaaaaggaaauaaaauggugcuaucuaaugcagugau

SEQ ID NO: 652896 - RNA, 64 nt, Homo Sapiens
agggauaacacuucccaaaucugucucuuucagaaaauaaaagcgaaaugauaccaagucugua

SEQ ID NO: 652897 - RNA, 64 nt, Homo Sapiens
ugacaaguucuguuuugaguaaaauuuugcuuagaaauaaaauaaauuuaagaaaucuaaagug

SEQ ID NO: 652898 - RNA, 64 nt, Homo Sapiens
uagauuuaagucgagcucagcauaaaauaaaauaaaauaaaauuuuuauuagagggagcauggc

SEQ ID NO: 652899 - RNA, 64 nt, Homo Sapiens
aaauuuagauuuaagucgagauggccauaaaauaaaauaaaauauuagauuuauuagagggagc

SEQ ID NO: 652900 - RNA, 64 nt, Homo Sapiens
aaauaaaauuuagauuuaagggagcauggccauaaaauaaaauaaaaauuuagauuuauuagag

SEQ ID NO: 652901 - RNA, 64 nt, Homo Sapiens
gauccagaucauaaagaaaguggacaagauaaagaaauaaaaguaacugcaguggcugagcaau

SEQ ID NO: 652902 - RNA, 64 nt, Homo Sapiens
gcuuuuaaaauuuuguuuguaauaauggugaaggaaauaaaaagugauauuuguauuguaaaac

SEQ ID NO: 652903 - RNA, 64 nt, Homo Sapiens
gauagacacagaaagguuuguugcaccgauauucaaauaaaaauuucugaaaucuuucuaccug

SEQ ID NO: 652904 - RNA, 64 nt, Homo Sapiens
uuuuucuauuauauuuauuauuauacaacaauacaaauaaaauaucuauaugauuguaaauauu

SEQ ID NO: 652905 - RNA, 64 nt, Homo Sapiens
uuguauuaaaaauuuaaaauagauguuuauauuaaaauaaaauauaucuuugucuauaacugac

SEQ ID NO: 652906 - RNA, 64 nt, Homo Sapiens
uugaauuggccaauaacaugucaauagcauaaugaaauaaaauuuaauuuuuauuugagcuguu

SEQ ID NO: 652907 - RNA, 64 nt, Homo Sapiens
ccuguccaaagucuagcuuucucgugggcuugagaaauaaaaagaguauuuuguaauuagacuc

SEQ ID NO: 652908 - RNA, 64 nt, Homo Sapiens
uuaagaauuaaauugcugccaaugucauugcaagaaauaaaaauucaaaucacacugaacccua

SEQ ID NO: 652909 - RNA, 64 nt, Homo Sapiens
guuuccauaaggugucagcauaauuagaauuuccaaauaaaacagcagaacaguuuuaaaaauc

SEQ ID NO: 652910 - RNA, 64 nt, Homo Sapiens
acugaauaucuuugcucuuauuucccagaggcagaaauaaaaauuguuuuaaaaugucagugug

SEQ ID NO: 652911 - RNA, 64 nt, Homo Sapiens
aauguuguauuuaaaagguauuccuucauuuuuuaaauaaaauuauaauaggaaaaacacuucu

SEQ ID NO: 652912 - RNA, 64 nt, Homo Sapiens
guugaucaagacauggaguucaccuaaaaaaauaaaauaaaaaucauucuauuguguucuacuu

SEQ ID NO: 652913 - RNA, 64 nt, Homo Sapiens
aaaauguugaucaagacauguacuucaccuaaaaaaauaaaauaugagccauucuauuguguuc

SEQ ID NO: 652914 - RNA, 64 nt, Homo Sapiens
auuuuacuaucagugauuuguaaaauaagaaacuaaauaaaauuuguugaaaugcuaccuuuuu

SEQ ID NO: 652915 - RNA, 64 nt, Homo Sapiens
uuuaccugucgaauuguugccuuuugaauuauaaaaauaaaaucuuuaguucuccuuaaaagaa

SEQ ID NO: 652916 - RNA, 64 nt, Homo Sapiens
uucauuguauuugaaguuuuaguuagguuuuuuaaaauaaaaugcuuuuaccaaguggugaguu

SEQ ID NO: 652917 - RNA, 64 nt, Homo Sapiens
uuaagugaugcuguauuauaaaucaacugucuuuaaauaaaauuuccaguccaaggcaggccug

SEQ ID NO: 652918 - RNA, 64 nt, Homo Sapiens
auaggaauacaguuuucuuuuccacauuaugaucaaauaaaaaucuugugagauuguuuauguu

SEQ ID NO: 652919 - RNA, 64 nt, Homo Sapiens
aauuuugaccuugaaagaugaauuccuucaagaaaaauaaaauaaugcuuaagauaauguguac

SEQ ID NO: 652920 - RNA, 64 nt, Homo Sapiens
uuguuuuaaauguaaauugagaaucuuuuauaagaaauaaaagcauuauugggugccuuuguuu

SEQ ID NO: 652921 - RNA, 64 nt, Homo Sapiens
cugggcuacagagagcaagacucugucucaaaaaaaauaaaauaaaauaaauaaaaaaagauau

SEQ ID NO: 652922 - RNA, 64 nt, Homo Sapiens
cuacagagagcaagacucugucucaaaaaaaauaaaauaaaauaaauaaaaaaagauauaguau

SEQ ID NO: 652923 - RNA, 64 nt, Homo Sapiens
gcaagacucugucucaaaaaaaauaaaauaaaauaaauaaaaaaagauauaguauuaaugccug

SEQ ID NO: 652924 - RNA, 64 nt, Homo Sapiens
ccagccugggcgacagagcaagacuccaucucaaaaauaaaauaaaaaaagaaagaaagaaaag

SEQ ID NO: 652925 - RNA, 64 nt, Homo Sapiens
cugggcgacagagcaagacuccaucucaaaaauaaaauaaaaaaagaaagaaagaaaagaagaa

SEQ ID NO: 652926 - RNA, 64 nt, Homo Sapiens
acaguaguuucaguucugaugguauaagcaaaacaaauaaaacguuuauaaaaguuguaucuug

SEQ ID NO: 652927 - RNA, 64 nt, Homo Sapiens
ggugggaaaugggggaucuucaauguuuauuuuaaaauaaaauaaaauaaguucuugacuuuuc

SEQ ID NO: 652928 - RNA, 64 nt, Homo Sapiens
gaaaugggggaucuucaauguuuauuuuaaaauaaaauaaaauaaguucuugacuuuucucaug

SEQ ID NO: 652929 - RNA, 64 nt, Homo Sapiens
aacacuggccauggccgugggaguacugggaguaaaauaaaaauaucgagguauagacuagcau

SEQ ID NO: 652930 - RNA, 64 nt, Homo Sapiens
uaaggcauauuaaaaauaaauauguaaagaagaaaaauaaaaguugucuucauggaagcaacuu

SEQ ID NO: 652931 - RNA, 64 nt, Homo Sapiens
uguacacauaagugugugugucucaggaaguaggaaauaaaaauggaagcuauuaugaccucaa

SEQ ID NO: 652932 - RNA, 64 nt, Homo Sapiens
agauguaaacuugauuauuuuauugcuaauuuaaaaauaaaaaugacuuuguauugauugugaa

SEQ ID NO: 652933 - RNA, 64 nt, Homo Sapiens
ucuugacuuuaacaucagcauuauaaaaagugucaaauaaaaaauuaccaucauuaucauuaaa

SEQ ID NO: 652934 - RNA, 64 nt, Homo Sapiens
aacuacuuugucgguugcucugaggguuaaaugaaaauaaaaagaaaaugugaaacagcaccac

SEQ ID NO: 652935 - RNA, 64 nt, Homo Sapiens
cccggccuacaagaacaaaacuccaucucaaaauaaauaaaaaaauaaauaaaaauaaaaauag

SEQ ID NO: 652936 - RNA, 64 nt, Homo Sapiens
gaacaaaacuccaucucaaaauaaauaaaaaaauaaauaaaaauaaaaauagacuauauauagu

SEQ ID NO: 652937 - RNA, 64 nt, Homo Sapiens
aacuccaucucaaaauaaauaaaaaaauaaauaaaaauaaaaauagacuauauauagucuuuga

SEQ ID NO: 652938 - RNA, 64 nt, Homo Sapiens
gucuuugaauucauuuauuuuaaauaaaugaauaaaauaaaauaaaaaagaauauucagucguu

SEQ ID NO: 652939 - RNA, 64 nt, Homo Sapiens
ugaauucauuuauuuuaaauaaaugaauaaaauaaaauaaaaaagaauauucagucguuggcac

SEQ ID NO: 652940 - RNA, 64 nt, Homo Sapiens
ggaaucuauuuuaugucaccaguugguccucaucaaauaaaauuuccuuaggagugcagagggc

SEQ ID NO: 652941 - RNA, 64 nt, Homo Sapiens
aaauuuccuuaggagugcagagggcucauugggaaaauaaaaauaauaaaaauaaauaaaacuu

SEQ ID NO: 652942 - RNA, 64 nt, Homo Sapiens
gagggcucauugggaaaauaaaaauaauaaaaauaaauaaaacuuccuaaaagaaaagauugaa

SEQ ID NO: 652943 - RNA, 64 nt, Homo Sapiens
ugcaauuuauagauuucauguugaaauauauguuaaauaaaauuucuguuuauugaaccucuuu

SEQ ID NO: 652944 - RNA, 64 nt, Homo Sapiens
caacagagcaagacuccgucucacaaaaaugaauaaauaaaauaaaaauaaaaauguuacuuuu

SEQ ID NO: 652945 - RNA, 64 nt, Homo Sapiens
gagcaagacuccgucucacaaaaaugaauaaauaaaauaaaaauaaaaauguuacuuuuuaaaa

SEQ ID NO: 652946 - RNA, 64 nt, Homo Sapiens
gacuccgucucacaaaaaugaauaaauaaaauaaaaauaaaaauguuacuuuuuaaaaaguaac

SEQ ID NO: 652947 - RNA, 64 nt, Homo Sapiens
auguaacaagccugcacauguaccccagaaucuaaaauaaaaauaaaaagaaaaacaaagaaug

SEQ ID NO: 652948 - RNA, 64 nt, Homo Sapiens
caagccugcacauguaccccagaaucuaaaauaaaaauaaaaagaaaaacaaagaauguacucu

SEQ ID NO: 652949 - RNA, 64 nt, Homo Sapiens
agcaugaugggugaagagaaccgagcaaagaucaaaauaaaaagugacacagcagcuucaccag

SEQ ID NO: 652950 - RNA, 64 nt, Homo Sapiens
uauuaccccacacauccccuuuguguagaaagccaaauaaaaucuauacauaccauuuccuuuu

SEQ ID NO: 652951 - RNA, 64 nt, Homo Sapiens
gccugggugacagagcaagacccugucucaaaaaaaauaaaauaaaaggcuuucugccuucauu

SEQ ID NO: 652952 - RNA, 64 nt, Homo Sapiens
ggugacagagcaagacccugucucaaaaaaaauaaaauaaaaggcuuucugccuucauugccuc

SEQ ID NO: 652953 - RNA, 64 nt, Homo Sapiens
agaaaggccaucagagcaaauuuggggguuucucaaauaaaauaaaaauaaaaacaaauacugu

SEQ ID NO: 652954 - RNA, 64 nt, Homo Sapiens
ggccaucagagcaaauuuggggguuucucaaauaaaauaaaaauaaaaacaaauacuguguuuc

SEQ ID NO: 652955 - RNA, 64 nt, Homo Sapiens
cagagcaaauuuggggguuucucaaauaaaauaaaaauaaaaacaaauacuguguuucagaagc

SEQ ID NO: 652956 - RNA, 64 nt, Homo Sapiens
uaaacaacaacaaaaacaaaaaaagaagaaaacuaaauaaaaauaaaaauaaaaauaagaucca

SEQ ID NO: 652957 - RNA, 64 nt, Homo Sapiens
acaacaaaaacaaaaaaagaagaaaacuaaauaaaaauaaaaauaaaaauaagauccacuucuc

SEQ ID NO: 652958 - RNA, 64 nt, Homo Sapiens
aaaacaaaaaaagaagaaaacuaaauaaaaauaaaaauaaaaauaagauccacuucucucugcc

SEQ ID NO: 652959 - RNA, 64 nt, Homo Sapiens
aaguaaccuuauauuuaaaagaugauuuugcaaaaaauaaaaaauaaaaaauaugccuucugga

SEQ ID NO: 652960 - RNA, 64 nt, Homo Sapiens
cuuauauuuaaaagaugauuuugcaaaaaauaaaaaauaaaaaauaugccuucuggagugaugu

SEQ ID NO: 652961 - RNA, 64 nt, Homo Sapiens
uaaaaaacugugccuccgucuuccuaaaaauaaaaaauaaaauuuguaugguuugcaaaagggc

SEQ ID NO: 652962 - RNA, 64 nt, Homo Sapiens
uaaaauuuaaaaaacugugcaaagggcuuccuaaaaauaaaaaauauaucuuguaugguuugca

SEQ ID NO: 652963 - RNA, 64 nt, Homo Sapiens
ucuucauauauaaauuaagccucaaaaacaaauuaaauaaaauagugacagagaaagacccugu

SEQ ID NO: 652964 - RNA, 64 nt, Homo Sapiens
aauuagcuaggcauaguaccugcaucucuacaaaaaauaaaaaaccugggcaacauagugagaa

SEQ ID NO: 652965 - RNA, 64 nt, Homo Sapiens
uugucccuugcuacuugauauauuuagucaucacaaauaaaauacauaaaaucauuguaaauau

SEQ ID NO: 652966 - RNA, 64 nt, Homo Sapiens
ucaaaagaaaagguugucuuuuuguguucuaaaaaaauaaaauugaaacucuuuguuuucuucu

SEQ ID NO: 652967 - RNA, 64 nt, Homo Sapiens
uuuccaacagggucagcugcaaccuugcagugguaaauaaaaaagugugacacuuuggagcaaa

SEQ ID NO: 652968 - RNA, 64 nt, Homo Sapiens
auuucaguagucuuugcaucgaugucaaacugccaaauaaaaauugaauuuuaaauuauccaga

SEQ ID NO: 652969 - RNA, 64 nt, Homo Sapiens
ccaaccucaagcugucaccccuauacaaauaaaaaaauaaaaaccugcuaccacagagauugua

SEQ ID NO: 652970 - RNA, 64 nt, Homo Sapiens
auaaaaacccaaccucaagcagauuguacuauacaaauaaaaaaauauauuucugcuaccacag

SEQ ID NO: 652971 - RNA, 64 nt, Homo Sapiens
augagucacagcuuuuguucuauaauaguuuaugaaauaaaaacaaaaucuauucacuuuaacu

SEQ ID NO: 652972 - RNA, 64 nt, Homo Sapiens
uuccagucaauuauuccucauaacuacuuuaaagaaauaaaaaaggucuuaacuugaccuggga

SEQ ID NO: 652973 - RNA, 64 nt, Homo Sapiens
cgaaagaaaacaauuauugaugccaaaaauauauaaauaaaacauuuaauaaacacaauuuugc

SEQ ID NO: 652974 - RNA, 64 nt, Homo Sapiens
caauauuaugcagauuuaugaaaggagagaauggaaauaaaacuaaagcauacauaguagaggg

SEQ ID NO: 652975 - RNA, 64 nt, Homo Sapiens
uggaacgcaauuggguguaacagcccaaacuuccaaauaaaauaauaggacuuuagacaccacc

SEQ ID NO: 652976 - RNA, 64 nt, Homo Sapiens
cuuuggguucuugaauggaguuuugaaaaaauaaaaauaaaagcaaggaaaaaagguacuucua

SEQ ID NO: 652977 - RNA, 64 nt, Homo Sapiens
aaaagccuuuggguucuugacuucuauuuugaaaaaauaaaaauuaauaaaaggaaaaaaggua

SEQ ID NO: 652978 - RNA, 64 nt, Homo Sapiens
gaaaaaaaaaucauuugguuauauauuuuggcucaaauaaaauugcauaacuaaaauuaaguau

SEQ ID NO: 652979 - RNA, 64 nt, Homo Sapiens
uguaaaccauagguaaugaugauauguaucauaaaaauaaaaucucaguguaccacuacuuaga

SEQ ID NO: 652980 - RNA, 64 nt, Homo Sapiens
aauuuucuaaauaaaaaguuuauauauaccuuuuaaauaaaauauauaucuugggacuuaugua

SEQ ID NO: 652981 - RNA, 64 nt, Homo Sapiens
auguauucuccuaacugaaaaaaacugaaaauaaaaauaaaaaucagagugagacuccaucuca

SEQ ID NO: 652982 - RNA, 64 nt, Homo Sapiens
aaaaauauguauucuccuaaaucucaaaaacugaaaauaaaaaugggugacagagugagacucc

SEQ ID NO: 652983 - RNA, 64 nt, Homo Sapiens
uucauaaugugaacugucugauaaauaaauaaacaaauaaaaaaacuccaucucaaaaaauaaa

SEQ ID NO: 652984 - RNA, 64 nt, Homo Sapiens
aauaaauaaacaaauaaaaaaacuccaucucaaaaaauaaaauaagccugggcaacaacagcaa

SEQ ID NO: 652985 - RNA, 64 nt, Homo Sapiens
uggaaaaaaauucuugugaauauccccaaaucugaaauaaaagcccucauuuugcauccuucug

SEQ ID NO: 652986 - RNA, 64 nt, Homo Sapiens
uaacgguacacuuaagagugaauuucucaaauuaaaauaaaagggcuguggauguauuuuauuu

SEQ ID NO: 652987 - RNA, 64 nt, Homo Sapiens
ucagcagaaauuuaaauaagauuuaauucacaucaaauaaaauuuagaaaauaaaauuuaacuc

SEQ ID NO: 652988 - RNA, 64 nt, Homo Sapiens
aauaagauuuaauucacaucaaauaaaauuuagaaaauaaaauuuaacucacacugcccaggcu

SEQ ID NO: 652989 - RNA, 64 nt, Homo Sapiens
gcauucccaggaaaauacgaaaaucccaugagauaaauaaaaauauaggugaugggcagaucuu

SEQ ID NO: 652990 - RNA, 64 nt, Homo Sapiens
uaaaaauauaggugaugggcagaucuuuucuuuaaaauaaaaaagcaaaaacucuugugguacc

SEQ ID NO: 652991 - RNA, 64 nt, Homo Sapiens
aucuuuuaugcaccaaaguuggucuugaaaaggaaaauaaaaucacuuucuugcuugguaagca

SEQ ID NO: 652992 - RNA, 64 nt, Homo Sapiens
augaaaaugagucuuauaaaauuaagugaagugcaaauaaaagcacugcuacuauaagacauuc

SEQ ID NO: 652993 - RNA, 64 nt, Homo Sapiens
guuuuuacauacuuuugcaaaauaaguaaauaauaaauaaaauaaaagccaaccuucaaagaaa

SEQ ID NO: 652994 - RNA, 64 nt, Homo Sapiens
uacauacuuuugcaaaauaaguaaauaauaaauaaaauaaaagccaaccuucaaagaaacuuga

SEQ ID NO: 652995 - RNA, 64 nt, Homo Sapiens
ugcguuaaauaagcaaauaaacaguggcucauaaaaauaaaagucgcauuccauaucuuuggau

SEQ ID NO: 652996 - RNA, 64 nt, Homo Sapiens
ucuaagcugagaaguagauuguuacccaguaaugaaauaaaaaauaaaaauaaaaggauuuuuu

SEQ ID NO: 652997 - RNA, 64 nt, Homo Sapiens
ugagaaguagauuguuacccaguaaugaaauaaaaaauaaaaauaaaaggauuuuuuucucuau

SEQ ID NO: 652998 - RNA, 64 nt, Homo Sapiens
guagauuguuacccaguaaugaaauaaaaaauaaaaauaaaaggauuuuuuucucuauuguuua

SEQ ID NO: 652999 - RNA, 64 nt, Homo Sapiens
ucuuuucucuuuaauccuuuaguuauauuguauuaaauaaaaauauaauacugccuaauguaua

SEQ ID NO: 653000 - RNA, 64 nt, Homo Sapiens
uucaagauauaagaaauuuuggaaauuccaccauaaauaaaauuuuuuacuacaagaaauauuu

SEQ ID NO: 653001 - RNA, 64 nt, Homo Sapiens
gggcagcuaaauuuuucaguuccaugugccucccaaauaaaaaacagaaaauaaguaguuuuug

SEQ ID NO: 653002 - RNA, 64 nt, Homo Sapiens
uaagaauccugacuuuuuuauauuuggaaacaucaaauaaaaauggaaaaaaugaucauggcuu

SEQ ID NO: 653003 - RNA, 64 nt, Homo Sapiens
ggcugaccaagaccuguugauccuuuuagauuaaaaauaaaaugucgcauguaaaggcugaagu

SEQ ID NO: 653004 - RNA, 64 nt, Homo Sapiens
auuuacugcuguuacuauuugauuagaauguauuaaauaaaaaaaaccugauuucuacaaguug

SEQ ID NO: 653005 - RNA, 64 nt, Homo Sapiens
agcaacccacugccuacuaacaucaagaggggcuaaauaaaacugcauuuuccuugcaaggaca

SEQ ID NO: 653006 - RNA, 64 nt, Homo Sapiens
uugguggugaggaggaagaacaaauaauagaagaaaauaaaaaugagauagaagaaaaguaaga

SEQ ID NO: 653007 - RNA, 64 nt, Homo Sapiens
aaauuuuaacauuggcaucuaaaguguuauuugaaaauaaaauuauuuuccuguucauugauuu

SEQ ID NO: 653008 - RNA, 64 nt, Homo Sapiens
aacuuauugugaaaguugugcuguuuucuaaguaaaauaaaaaauaaaaaauuagcaauuuaug

SEQ ID NO: 653009 - RNA, 64 nt, Homo Sapiens
ugugaaaguugugcuguuuucuaaguaaaauaaaaaauaaaaaauuagcaauuuaugauagcca

SEQ ID NO: 653010 - RNA, 64 nt, Homo Sapiens
gccuuugagccuauacuauacuguguauguguggaaauaaaaauguauuguacuuuuggagaau

SEQ ID NO: 653011 - RNA, 64 nt, Homo Sapiens
aauaugacaucggauguuucagcaacuguucuguaaauaaaaucuuugaucacaccacucagug

SEQ ID NO: 653012 - RNA, 64 nt, Homo Sapiens
uacaguugugcaagauaugaaugguuucacacucaaauaaaaaauauugaaacgaccugcuuuc

SEQ ID NO: 653013 - RNA, 64 nt, Homo Sapiens
uuuucgacacuggacuggaagaacaagucuauaaaaauaaaaauggacaauuaacaguggugag

SEQ ID NO: 653014 - RNA, 64 nt, Homo Sapiens
gguuggagaacgaaugaauacaaauuuuauuguaaaauaaaaauguauauaaagcauaugagca

SEQ ID NO: 653015 - RNA, 64 nt, Homo Sapiens
acgaugugcaauacauuuuuuucucuuuccuugaaaauaaaaagagaaacaaguauuuugcuau

SEQ ID NO: 653016 - RNA, 64 nt, Homo Sapiens
auaugauauuuuucaugcuccacuauuuuauuaaaaauaaaauauguucuuuaguuugcugcua

SEQ ID NO: 653017 - RNA, 64 nt, Homo Sapiens
uaucucagcuucuguuagcuucuguuuaaaauaaaaauaaaauuguaaccccuuuuuccuuucu

SEQ ID NO: 653018 - RNA, 64 nt, Homo Sapiens
aaaauuuaucucagcuucugcuuucuucuguuuaaaauaaaaauaaaaauguaaccccuuuuuc

SEQ ID NO: 653019 - RNA, 64 nt, Homo Sapiens
ucaguaugauggaauaaacuuuuauaugaaguuaaaauaaaaaaauaaaauaauauaaaaguga

SEQ ID NO: 653020 - RNA, 64 nt, Homo Sapiens
auauaaaagugauuuauauggaagauaaaauaccaaauaaaauauaaauaauuuuggaagcugu

SEQ ID NO: 653021 - RNA, 64 nt, Homo Sapiens
aauccuuuugauaaauuuaaaugcuuuaaaauaaaaauaaaaacagucugauccauauuuaaua

SEQ ID NO: 653022 - RNA, 64 nt, Homo Sapiens
aaaaacaauccuuuugauaauuaauaaugcuuuaaaauaaaaauuuuucaagucugauccauau

SEQ ID NO: 653023 - RNA, 62 nt, Homo Sapiens; identical to SEQ ID NO: 629600

SEQ ID NO: 653024 - RNA, 64 nt, Homo Sapiens
ugcaagucuucaggauggcauuaagcuaucugaaaaauaaaaugaacacacucgauuaaaaaug

SEQ ID NO: 653025 - RNA, 64 nt, Homo Sapiens
uuuuccacagagaaaggcaaaaaaauaaauaaauaaauaaaaucccagaacuuaaaguaaaaua

SEQ ID NO: 653026 - RNA, 64 nt, Homo Sapiens
uaaauaaauaaauaaaaucucagaacuuaaaguaaaauaaaaaauuaaagaagucuuuuccucc

SEQ ID NO: 653027 - RNA, 64 nt, Homo Sapiens
aaaaaaaauaaaaaccaugaaaaaauaaauaaauaaauaaaauuguguaaaaaaaaauaaaaau

SEQ ID NO: 653028 - RNA, 64 nt, Homo Sapiens
aaauaaauaaauaaaauuaaguaaaaaaaaauaaaaauaaaaauagggaauaaagugcuaaagu

SEQ ID NO: 653029 - RNA, 64 nt, Homo Sapiens
aaaaauaaauaaauaaauaauaaaguguaaaaaaaaauaaaaauaacuucagggaauaaagugc

SEQ ID NO: 653030 - RNA, 64 nt, Homo Sapiens
ugaucuaguguaauggaagagaucuaguguaaugaaauaaaaugaaaugcaguaaucaaaaugu

SEQ ID NO: 653031 - RNA, 64 nt, Homo Sapiens
acuaauuuugagguaccaaagauauuucugugggaaauaaaauauuagaauggaagauaaugca

SEQ ID NO: 653032 - RNA, 64 nt, Homo Sapiens
uggaaaaagguaucuucugauaaaaaguauacaaaaauaaaaaguauuuacauuuucacucauc

SEQ ID NO: 653033 - RNA, 64 nt, Homo Sapiens
uguggugcacauuucuacccuguguauguguuuaaaauaaaacccuguuuuugucaaggauggu

SEQ ID NO: 653034 - RNA, 64 nt, Homo Sapiens
ucguuuguuauuuaucucauguuuuauaaaauaaaaauaaaauaaaauuuguuguaaacugcau

SEQ ID NO: 653035 - RNA, 64 nt, Homo Sapiens
aaaauaucguuuguuauuuacugcauguuuuauaaaauaaaaauuuuuaaaaauuuguuguaaa

SEQ ID NO: 653036 - RNA, 64 nt, Homo Sapiens
aaauuguuuucauuaccucagucucaaaaaauaaaaauaaaaaagggugacagagcgagaccau

SEQ ID NO: 653037 - RNA, 64 nt, Homo Sapiens
aaaaaaaaauuguuuucauugaccaugucucaaaaaauaaaaaucagccugggugacagagcga

SEQ ID NO: 653038 - RNA, 64 nt, Homo Sapiens
uuuuauccucuaaccuuuacagaaggaaucuguuaaauaaaagcugcuugccauaauuugucug

SEQ ID NO: 653039 - RNA, 64 nt, Homo Sapiens
uaaauauuagaaugugagaauaauaaaauuuaaaaaauaaaaauuacacaucauaccuagcagg

SEQ ID NO: 653040 - RNA, 64 nt, Homo Sapiens
augguacuuucauuuuauaagccuuuguuuguaaaaauaaaauaccauuaacuagucuugaaau

SEQ ID NO: 653041 - RNA, 64 nt, Homo Sapiens
auucagauugaaauucuaauugaaauuggcuuuaaaauaaaaccucuuugaaacaauauuauuu

SEQ ID NO: 653042 - RNA, 64 nt, Homo Sapiens
ugugccugauuauuuuugcauugauuaagauguaaaauaaaaaguuccuuuuguauuuguaaug

SEQ ID NO: 653043 - RNA, 64 nt, Homo Sapiens
gcuaugcaaucuugaauauuauaaccauuucaaaaaauaaaauuauuuaaggaaauucuuuagg

SEQ ID NO: 653044 - RNA, 64 nt, Homo Sapiens
auugaaugcuuucuaacaaauuuuuggauuuucuaaauaaaaauuucuuuauauuugauugugu

SEQ ID NO: 653045 - RNA, 64 nt, Homo Sapiens
uuucuuaauuguaaucauaaugaagaaaaugagaaaauaaaauacaaacaggaggauaacgacc

SEQ ID NO: 653046 - RNA, 64 nt, Homo Sapiens
aguaugagucuucuguaauuuaauuuccaggaaaaaauaaaaaguuaguaaagcuuuucuuuuu

SEQ ID NO: 653047 - RNA, 64 nt, Homo Sapiens
uagauacuggaaaccuaacucauugcuaaaaaauaaauaaaagcuggcaaaaucuuguuaaugu

SEQ ID NO: 653048 - RNA, 64 nt, Homo Sapiens
aagccuguggccuguuuugaauaaauaaauaaauaaauaaaaaucaaagugagacucugucuca

SEQ ID NO: 653049 - RNA, 64 nt, Homo Sapiens
uaacaugccugagggagagcgggaauuuuguguaaaauaaaagaauccacacaaccaaguucau

SEQ ID NO: 653050 - RNA, 64 nt, Homo Sapiens
aacuuagcuaggcauguugcaaaauaaaaaauaaaaauaaaaaaaguuagaccucaucucuaca

SEQ ID NO: 653051 - RNA, 64 nt, Homo Sapiens
aaaaaaaacuuagcuaggcaucuacaaaaauaaaaaauaaaaauaaacauaguuagaccucauc

SEQ ID NO: 653052 - RNA, 64 nt, Homo Sapiens
uaaaaauaaaaaaaacuuagccucaucucuacaaaaauaaaaaaagccuggaaacauaguuaga

SEQ ID NO: 653053 - RNA, 64 nt, Homo Sapiens
aguuuuaaaaacugaucaagaaaaaaaauuuaaaaaauaaaaaaauaauauaaaauaaaaacuu

SEQ ID NO: 653054 - RNA, 64 nt, Homo Sapiens
uuaaaaaaaauuuaaaaaauuuguagauaauauaaaauaaaaacuuaagggaaaaacuuuuacu

SEQ ID NO: 653055 - RNA, 64 nt, Homo Sapiens
cgcagugaacuuaaagcaaagaccucuuaguaaaaaauaaaaaaaaauaaaaaauaaaaauaaa

SEQ ID NO: 653056 - RNA, 64 nt, Homo Sapiens
uuaaagcaaagaccucuuaguaaaaaauaaaaaaaaauaaaaaauaaaaauaaaaaaaguuaaa

SEQ ID NO: 653057 - RNA, 64 nt, Homo Sapiens
aaagaccucuuaguaaaaaauaaaaaaaaauaaaaaauaaaaauaaaaaaaguuaaauuuauuu

SEQ ID NO: 653058 - RNA, 64 nt, Homo Sapiens
cucuuaguaaaaaauaaaaaaaaauaaaaaauaaaaauaaaaaaaguuaaauuuauuuauagaa

SEQ ID NO: 653059 - RNA, 64 nt, Homo Sapiens
cgagaaacuaugggaaaaaaaauugcaaaaucuaaaauaaaaaaugcaaaaucuaaaauaaaaa

SEQ ID NO: 653060 - RNA, 64 nt, Homo Sapiens
auugcaaaaucuaaaauaaaaaaugcaaaaucuaaaauaaaaaauggaaaggaaacuuugaacc

SEQ ID NO: 653061 - RNA, 64 nt, Homo Sapiens
caacaagagcaaaacuccgucucaaaaaagaugaaaauaaaauaaaauauauauuuacaggccu

SEQ ID NO: 653062 - RNA, 64 nt, Homo Sapiens
agagcaaaacuccgucucaaaaaagaugaaaauaaaauaaaauauauauuuacaggccuacaac

SEQ ID NO: 653063 - RNA, 64 nt, Homo Sapiens
uuguuagugggaagaauaugguaaauuuuuuguuaaauaaaauagacccuuauguuuagcauuu

SEQ ID NO: 653064 - RNA, 64 nt, Homo Sapiens
cuccaaucaaggucuuguugauauuauauaguaaaaauaaaaccaaaaauaaauauuauucaag

SEQ ID NO: 653065 - RNA, 64 nt, Homo Sapiens
augguaucuaauuaauaacuagucugacaucagaaaauaaaauugaggcugauuuuuaaaaauu

SEQ ID NO: 653066 - RNA, 64 nt, Homo Sapiens
gaaacccacuguuaaaauuuaaaaaggugcuuuaaaauaaaacgccuauaaagauugugcagua

SEQ ID NO: 653067 - RNA, 64 nt, Homo Sapiens
auaauuuuuuagaguuuaauuuguaaagcuuagcaaauaaaaucuuguacuaugaauagcuucu

SEQ ID NO: 653068 - RNA, 64 nt, Homo Sapiens
ucuaacuauucagggacauuuuuccauuuccaaaaaauaaaauuuauuaugcuuuauaaccucu

SEQ ID NO: 653069 - RNA, 64 nt, Homo Sapiens
uucuguauuuucuaauuuuuucauugucuuugauaaauaaaacaguuuuguuuugcuaauauag

SEQ ID NO: 653070 - RNA, 64 nt, Homo Sapiens
ccuuccggagucuuugaagcugaaaauauaaaacaaauaaaaaauaaaaaaauaaaaacccaca

SEQ ID NO: 653071 - RNA, 64 nt, Homo Sapiens
gagucuuugaagcugaaaauauaaaacaaauaaaaaauaaaaaaauaaaaacccacaaaaaugu

SEQ ID NO: 653072 - RNA, 64 nt, Homo Sapiens
gaagcugaaaauauaaaacaaauaaaaaauaaaaaaauaaaaacccacaaaaauguugaaccaa

SEQ ID NO: 653073 - RNA, 64 nt, Homo Sapiens
aggacugagaacugacuguuauugcugagaauucaaauaaaaagagagugaugauucugugaau

SEQ ID NO: 653074 - RNA, 64 nt, Homo Sapiens
uuaagauacuuaguuuuguuuuaaauauaauguaaaauaaaaugaguuguaaguauuauuuuua

SEQ ID NO: 653075 - RNA, 64 nt, Homo Sapiens
guguaauugggacguuuguacuuuauacauuuaaaaauaaaagagugacuacagucaacaauaa

SEQ ID NO: 653076 - RNA, 64 nt, Homo Sapiens
gaagugguaaauagcuuacaaguuguuaaaauggaaauaaaaguaaggccaaggauaauguacu

SEQ ID NO: 653077 - RNA, 64 nt, Homo Sapiens
agauuauuacgucuuuuguacuuugauuuaaaauaaauaaaaauguuaggaaauggaauggucu

SEQ ID NO: 653078 - RNA, 64 nt, Homo Sapiens
gguaccagaacuuaugcuucaugugguuaauuauaaauaaaacuuuuguagaaaagugauuugu

SEQ ID NO: 653079 - RNA, 64 nt, Homo Sapiens
ugccauacuaguaugugcuucaucacuuuuagugaaauaaaauguacaagacauucacguuuaa

SEQ ID NO: 653080 - RNA, 64 nt, Homo Sapiens
uaugucugggcaugguggccccccaucucuacaaaaauaaaaaagccugggcaacauagcaaaa

SEQ ID NO: 653081 - RNA, 64 nt, Homo Sapiens
aaauuuuagcaaggauuaaauaguguuugauuugaaauaaaagggaagaccuuugagaaugcuu

SEQ ID NO: 653082 - RNA, 64 nt, Homo Sapiens
aaauauauaaguguaacauguuuuuuuuucuuaaaaauaaaaaaccaaaagcuuucacugaagg

SEQ ID NO: 653083 - RNA, 64 nt, Homo Sapiens
ccaaucuggcaacagagcgagaccuugucuuuaaaaauaaaaauaaaaacaucuuuacaacauu

SEQ ID NO: 653084 - RNA, 64 nt, Homo Sapiens
uggcaacagagcgagaccuugucuuuaaaaauaaaaauaaaaacaucuuuacaacauuccuguu

SEQ ID NO: 653085 - RNA, 64 nt, Homo Sapiens
aauucauacaacaucagugguuacagcuauacuaaaauaaaacuuuauaugcuaauuaucuuca

SEQ ID NO: 653086 - RNA, 64 nt, Homo Sapiens
cuuuauaugcuaauuaucuucaagggucuuucuaaaauaaaagggguuguuaggcuacugcaaa

SEQ ID NO: 653087 - RNA, 64 nt, Homo Sapiens
guucaaauacaugugaauucuacugcuuuaagagaaauaaaacaaauaagccuagggaaauauu

SEQ ID NO: 653088 - RNA, 64 nt, Homo Sapiens
acugcagaccucuaaacauaaguaggaaaaagaaaaauaaaagaauauuaccaauaauuaaagg

SEQ ID NO: 653089 - RNA, 64 nt, Homo Sapiens
uaauuuuugauugacugguggaauuagauuuacuaaauaaaaauggcuuaaauuuugacuguac

SEQ ID NO: 653090 - RNA, 64 nt, Homo Sapiens
auuuagucaucagagauacuuuccuaaaaaggaaaaauaaaaaacaaaauggugccacuuuggg

SEQ ID NO: 653091 - RNA, 64 nt, Homo Sapiens
auuuugagaugucauacuguacacuguauuguaaaaauaaaaaguaaaauuauauuucaaauuu

SEQ ID NO: 653092 - RNA, 64 nt, Homo Sapiens
aauaacuggugucuuguaaauguucuguuuuuuuaaauaaaacuucucuacuuuagucuuuacu

SEQ ID NO: 653093 - RNA, 64 nt, Homo Sapiens
gaaaaacuuucuggaaaggaaauaaaugggagaaaaauaaaauuaauugaaggcagcaaaaggc

SEQ ID NO: 653094 - RNA, 64 nt, Homo Sapiens
ccugccuuuuguagaaaagaaaaacaaaaaaaguaaauaaaaauuuuaaacaguaaaauaaaag

SEQ ID NO: 653095 - RNA, 64 nt, Homo Sapiens
aaacaaaaaaaguaaauaaaaauuuuaaacaguaaaauaaaaguuuaacugcuaaaaugugaau

SEQ ID NO: 653096 - RNA, 64 nt, Homo Sapiens
uauaaucagggaaacuaauuguauuuagugacaaaaauaaaaaguuuuuuuuuauaauucaguc

SEQ ID NO: 653097 - RNA, 64 nt, Homo Sapiens
ggcuugauugguguaaaucuuuuuauaaauacauaaauaaaagaaaaauaugcauuuuucuuuu

SEQ ID NO: 653098 - RNA, 64 nt, Homo Sapiens
guuucucucucaaccacuuuaauaaaaaggccaaaaauaaaauucccuaaaaugcuagaauaau

SEQ ID NO: 653099 - RNA, 64 nt, Homo Sapiens
guggaagcccuaaaaugcuaaguuaaccaucuaaaaauaaaagagcaaauagguaucaucaaug

SEQ ID NO: 653100 - RNA, 64 nt, Homo Sapiens
uacuuuccuccacauaguucaaguaggaaacaugaaauaaaauuuuccaaaucucuucuaacac

SEQ ID NO: 653101 - RNA, 64 nt, Homo Sapiens
gugagaagaaaaaaauaauaaguuuuggcuguauaaauaaaacuuauaggcaacuugagauuau

SEQ ID NO: 653102 - RNA, 64 nt, Homo Sapiens
uuaaaggauuguugauaaccagggaaaaaaauaaaaauaaaaaaguauauugguucgaaauccc

SEQ ID NO: 653103 - RNA, 64 nt, Homo Sapiens
aaaaaauuaaaggauuguugaaucccagggaaaaaaauaaaaaucuaggaguauauugguucga

SEQ ID NO: 653104 - RNA, 64 nt, Homo Sapiens
ggugugagaauuguguguguaauagagaacuucaaaauaaaacaaguagaucaaaauagaacac

SEQ ID NO: 653105 - RNA, 64 nt, Homo Sapiens
uauaaaaauguacuuuaggaauauuaaaaacacaaaauaaaaacgauugacuauaccaaacauu

SEQ ID NO: 653106 - RNA, 64 nt, Homo Sapiens
aaaauaaggaauccuuuuaaaauaaaaaauaaaaaaauaaaaacagccagaccuugucucaaaa

SEQ ID NO: 653107 - RNA, 64 nt, Homo Sapiens
auaaaaacaaaauaaggaauucucaaaaaauaaaaaauaaaaaaagagagagagccagaccuug

SEQ ID NO: 653108 - RNA, 64 nt, Homo Sapiens
uaaaaaaauaaaaacaaaaugaccuugucucaaaaaauaaaaaagccugagagagagagagcca

SEQ ID NO: 653109 - RNA, 64 nt, Homo Sapiens
uggggaacacuuuuuauuuucuuucacuaauacuaaauaaaauuauauauuuauucucauaaua

SEQ ID NO: 653110 - RNA, 64 nt, Homo Sapiens
aaagauugcccaguuagauuuugcuggauuuagcaaauaaaaauauuuuucaguacauuuaggg

SEQ ID NO: 653111 - RNA, 64 nt, Homo Sapiens
augguaaaugugacaagcauauaauauguaauauaaauaaaacuucaaacuagcguuuuaugua

SEQ ID NO: 653112 - RNA, 64 nt, Homo Sapiens
uuaacauuaaaagacuuccagcuuguacugguuuaaauaaaaugagucuuuuguuaagcauggu

SEQ ID NO: 653113 - RNA, 64 nt, Homo Sapiens
auuuucuaauguguauaucuuuuuuaaaggguccaaauaaaauacauuuggugaaauuaauacu

SEQ ID NO: 653114 - RNA, 64 nt, Homo Sapiens
uuauuuuauccuucuugguguacuauaagacuauaaauaaaaaccaaguuaaggcuucccccuu

SEQ ID NO: 653115 - RNA, 64 nt, Homo Sapiens
uauguuguacauacugccgaauuccauuccauggaaauaaaaagguagucucaguucguguuug

SEQ ID NO: 653116 - RNA, 64 nt, Homo Sapiens
uaugaaauauggugaggucacuauuugggcucugaaauaaaaauuuuugccugaguguauuuua

SEQ ID NO: 653117 - RNA, 64 nt, Homo Sapiens
ccugguugcagcacauucacacccuaaagcaguaaaauaaaaaagguguugagauuuacgugga

SEQ ID NO: 653118 - RNA, 64 nt, Homo Sapiens
gauagaaaaaaacuaaaguuacugaauaaaaaauaaauaaaauguuuuguccauuccauuaaua

SEQ ID NO: 653119 - RNA, 64 nt, Homo Sapiens
ccaaucuccugcuaauagguuuauguggaccuauaaauaaaaaucugguuauuuccuugaagcu

SEQ ID NO: 653120 - RNA, 64 nt, Homo Sapiens
auaaaaagaaaacccuuacauuagaauccuagguaaauaaaacaagcuaugacuucucaguuuc

SEQ ID NO: 653121 - RNA, 64 nt, Homo Sapiens
ccaauaucaggaagccauuuaauaaugcauuuuuaaauaaaauagguggucuuuuggaugaggg

SEQ ID NO: 653122 - RNA, 64 nt, Homo Sapiens
aaaaaaaaaacaaaaacaaaguuagugaauuuggaaauaaaaaggggauuuaauguaccuuuuu

SEQ ID NO: 653123 - RNA, 64 nt, Homo Sapiens
auaauuuauaggacaguuuucacuauaaagaacaaaauaaaauacguggcauucacaauacugg

SEQ ID NO: 653124 - RNA, 64 nt, Homo Sapiens
uggcaugcaguuuuuuuuuuuuuuuuuuguccugaaauaaaaaguuuacuuuuucauuccuucc

SEQ ID NO: 653125 - RNA, 64 nt, Homo Sapiens
aauaaugcaauuuaaccuucuaaaaaaaucauaaaaauaaaagauugucucuuuuuuuugguau

SEQ ID NO: 653126 - RNA, 64 nt, Homo Sapiens
acaaggcagggcagugcucagaaaauguguuuagaaauaaaagcucaucagaaaaauacauuag

SEQ ID NO: 653127 - RNA, 64 nt, Homo Sapiens
uguaauugccaucugucacucacuauauucacaaaaauaaaacucuacaacucauucuaacauu

SEQ ID NO: 653128 - RNA, 64 nt, Homo Sapiens
agcuucugaguuuuauacugcucaagaucgucauaaauaaaauuuuuucucauugucauagauu

SEQ ID NO: 653129 - RNA, 64 nt, Homo Sapiens
uuagaauuuguguuuauauuuccuguaagugaauaaauaaaacaaaacaaaacaaaaaaaacuu

SEQ ID NO: 653130 - RNA, 64 nt, Homo Sapiens
aagcuaaggcucauuuauuuuuaaaaggcauauuaaauaaaauacuguaauuuaggaagaaagu

SEQ ID NO: 653131 - RNA, 64 nt, Homo Sapiens
cucaggaccagccuagagagaucccaucucuaaaaaauaaaauauaagaaaauaaaacuuaggg

SEQ ID NO: 653132 - RNA, 64 nt, Homo Sapiens
gagagaucccaucucuaaaaaauaaaauauaagaaaauaaaacuuaggggauauacagauuuaa

SEQ ID NO: 653133 - RNA, 64 nt, Homo Sapiens
gaugaaugucuuuuugguuguaauuuaacaagucaaauaaaauaaucauugcugagcacaauca

SEQ ID NO: 653134 - RNA, 64 nt, Homo Sapiens
ccauauuuuacuuuuuuaggauuuuucccccuuuaaauaaaaauauuagaucaaauacuauaug

SEQ ID NO: 653135 - RNA, 64 nt, Homo Sapiens
aaugggcagugucugcuauagggcuucaggcauuaaauaaaaccgaggguuguugauuuugcug

SEQ ID NO: 653136 - RNA, 64 nt, Homo Sapiens
aaaagagagcuuaaugauaauauuguggugccacaaauaaaauggauuuauuagaauuucauau

SEQ ID NO: 653137 - RNA, 64 nt, Homo Sapiens
cgacagaaggaaccagcguguauaugaggguaucaaauaaaauugcuacuacuuaccuaccaca

SEQ ID NO: 653138 - RNA, 64 nt, Homo Sapiens
cgaagugucuuccaccugcccugcggaccguggaaaauaaaaggcucugcccccagugugagug

SEQ ID NO: 653139 - RNA, 64 nt, Homo Sapiens
cuuggcuacacucauguugcucagacuauauuucaaauaaaaaaucuucucaccaugcagguag

SEQ ID NO: 653140 - RNA, 64 nt, Homo Sapiens
guggcacuuuucaccauaauuguaccauaaugcuaaauaaaacuugagacagaacuguuuguua

SEQ ID NO: 653141 - RNA, 64 nt, Homo Sapiens
auuauguauuuuuaacuaaguuuauugcauuauaaaauaaaaggaugugauguuguuaauuucu

SEQ ID NO: 653142 - RNA, 64 nt, Homo Sapiens
aaaaaaaggaaggaaaaaaaaacaaaacaaaacaaaauaaaacaaaggauuuggcaugcuguaa

SEQ ID NO: 653143 - RNA, 64 nt, Homo Sapiens
uuuuauaaaauuaaaaaaaacaguuuguaaggaaaaauaaaaguaucaggucuccuaacuaccc

SEQ ID NO: 653144 - RNA, 64 nt, Homo Sapiens
gcuauuaucaggucuccuaacuuuggugccaagaaaauaaaaaaaggaacacauaaguaaguug

SEQ ID NO: 653145 - RNA, 64 nt, Homo Sapiens
acaguauaacaguuauuuaaaauaaaaauaauacaaauaaaaauagaucaaaaauauuagaaaa

SEQ ID NO: 653146 - RNA, 64 nt, Homo Sapiens
aauacaaauaaaaauacaguaaaaauauuagaaaaaauaaaaaugauuaaaccaauugcagauc

SEQ ID NO: 653147 - RNA, 64 nt, Homo Sapiens
uccaagcugacaaguauuaauagcaugauacuggaaauaaaaugucacacaacaaggagauuuu

SEQ ID NO: 653148 - RNA, 64 nt, Homo Sapiens
aucacacaacaaggagauuugugugcaugucaagaaauaaaagaauacuuuuugauccauauau

SEQ ID NO: 653149 - RNA, 64 nt, Homo Sapiens
uugcugauugucuuuuuauuaugcuaagugcccaaaauaaaauaauguauugaggaucugugaa

SEQ ID NO: 653150 - RNA, 64 nt, Homo Sapiens
aacuuuauaaugaaacgguuuucuacaauuguuuaaauaaaaggauccuuuauuauuacuaaua

SEQ ID NO: 653151 - RNA, 64 nt, Homo Sapiens
auuuaaaaaguaaugcugauauuauuuguacauaaaauaaaaccuauggguacaacguauguuc

SEQ ID NO: 653152 - RNA, 64 nt, Homo Sapiens
uucuuugcaguaaaauauucgcuagugauguauaaaauaaaauaacuaauggcaaaaauucaug

SEQ ID NO: 653153 - RNA, 64 nt, Homo Sapiens
aguuccugagucacacaaucaaugaaauaaaauaaaauaaaauccgcuauuuaaguuaaauuua

SEQ ID NO: 653154 - RNA, 64 nt, Homo Sapiens
aaaucaguuccugagucacaauuuaaaugaaauaaaauaaaauaagugucgcuauuuaaguuaa

SEQ ID NO: 653155 - RNA, 64 nt, Homo Sapiens
aaauaaaaucaguuccugagguuaaauuuaaaugaaauaaaauaauccaagugucgcuauuuaa

SEQ ID NO: 653156 - RNA, 64 nt, Homo Sapiens
cauuuuuauuuuuuaguuugauuuccaaaaaacuaaauaaaaauuuugccaauuauuuuguuau

SEQ ID NO: 653157 - RNA, 64 nt, Homo Sapiens
aguaaaauuuggccgggcaccuaggggaaaaagcaaauaaaaauaacuauccauguagucaaau

SEQ ID NO: 653158 - RNA, 64 nt, Homo Sapiens
aaauauucaugcauugaacaauaauugucuuuugaaauaaaaucauagagggucaguguuauaa

SEQ ID NO: 653159 - RNA, 64 nt, Homo Sapiens
uagagcaaaguuuaaaacugcucaaaauaaaauaaaauaaaacugggcaauagcaagacuccau

SEQ ID NO: 653160 - RNA, 64 nt, Homo Sapiens
aaacuuagagcaaaguuuaauccaucucaaaauaaaauaaaauaagcuugggcaauagcaagac

SEQ ID NO: 653161 - RNA, 64 nt, Homo Sapiens
aaauaaaacuuagagcaaagaagacuccaucucaaaauaaaauaacuccagcuugggcaauagc

SEQ ID NO: 653162 - RNA, 64 nt, Homo Sapiens
uaaauuaaaaaaguugccggccuauuucaauaaaaaauaaaauaguuucacaaguuuugggcca

SEQ ID NO: 653163 - RNA, 64 nt, Homo Sapiens
uauuuuguucuauugguaggugcugguauaauuaaaauaaaauaggucuuucugggccuuacug

SEQ ID NO: 653164 - RNA, 64 nt, Homo Sapiens
uuaauaggaguugugagccucuuuaaggaaaauaaaauaaaauacaaauguaauuuuaugucug

SEQ ID NO: 653165 - RNA, 64 nt, Homo Sapiens
aaauauuaauaggaguuguggucugcuuuaaggaaaauaaaauaucuuccaaauguaauuuuau

SEQ ID NO: 653166 - RNA, 64 nt, Homo Sapiens
acuacauuucuaacguauucauuaacaucaugaaaaauaaaagugauuaauuuagauuagaauc

SEQ ID NO: 653167 - RNA, 64 nt, Homo Sapiens
cagccuggaccacagagcaagacccuguguaaaaaaauaaaauaaaaaacagauuggaugucuu

SEQ ID NO: 653168 - RNA, 64 nt, Homo Sapiens
uggaccacagagcaagacccuguguaaaaaaauaaaauaaaaaacagauuggaugucuuucuuc

SEQ ID NO: 653169 - RNA, 64 nt, Homo Sapiens
aucauuuuagcaacucuaaaaaaaaaaaaaauacaaauaaaaaggaaaaaaaauuacauuuuuu

SEQ ID NO: 653170 - RNA, 64 nt, Homo Sapiens
ggguauccgucacgggucuuccuguuuuguauuuaaauaaaaacaacagcagcaggcugucccu

SEQ ID NO: 653171 - RNA, 64 nt, Homo Sapiens
gugagccacugugcccagccuaagccauuucuuaaaauaaaaaugcuaaaggacuaguaaguaa

SEQ ID NO: 653172 - RNA, 64 nt, Homo Sapiens
cuuaaaauaaaaaugcuaaaggacuaguaaguaaaaauaaaacuuccuaugggauuucccagug

SEQ ID NO: 653173 - RNA, 64 nt, Homo Sapiens
uuuuacuuuuuauuacauaaaaauauuaaaaaauaaauaaaaaaaauaaaauuuuaaacuaacu

SEQ ID NO: 653174 - RNA, 64 nt, Homo Sapiens
uuauuacauaaaaauauuaaaaaauaaauaaaaaaaauaaaauuuuaaacuaacuuaaccugcc

SEQ ID NO: 653175 - RNA, 64 nt, Homo Sapiens
cugggcaacacagcgagacuccgucucaaggaaaaaauaaaaauaaaaagcgggcacgggcccg

SEQ ID NO: 653176 - RNA, 64 nt, Homo Sapiens
aacacagcgagacuccgucucaaggaaaaaauaaaaauaaaaagcgggcacgggcccgugacau

SEQ ID NO: 653177 - RNA, 64 nt, Homo Sapiens
gaguuuuauuucugaaaauaaauuaauuuuuuguaaauaaaauguuuaaaaauaaaaaagaaac

SEQ ID NO: 653178 - RNA, 64 nt, Homo Sapiens
aaauaaauuaauuuuuuguaaauaaaauguuuaaaaauaaaaaagaaacuaaaguuacuuguau

SEQ ID NO: 653179 - RNA, 64 nt, Homo Sapiens
aaagaaaacaaaauauaagggaaaaauaugagaaaaauaaaaauaaaaagagaauaauaggcca

SEQ ID NO: 653180 - RNA, 64 nt, Homo Sapiens
aacaaaauauaagggaaaaauaugagaaaaauaaaaauaaaaagagaauaauaggccaggcacu

SEQ ID NO: 653181 - RNA, 64 nt, Homo Sapiens
agcacucuggugcgggaagaagcagaagcaaaaaaaauaaaaauaaaaaaauaaauaaaaauaa

SEQ ID NO: 653182 - RNA, 64 nt, Homo Sapiens
cuggugcgggaagaagcagaagcaaaaaaaauaaaaauaaaaaaauaaauaaaaauaaaaaaaa

SEQ ID NO: 653183 - RNA, 64 nt, Homo Sapiens
gaagcagaagcaaaaaaaauaaaaauaaaaaaauaaauaaaaauaaaaaaaauaaaaaaggaaa

SEQ ID NO: 653184 - RNA, 64 nt, Homo Sapiens
gaagcaaaaaaaauaaaaauaaaaaaauaaauaaaaauaaaaaaaauaaaaaaggaaaaaaaaa

SEQ ID NO: 653185 - RNA, 64 nt, Homo Sapiens
aaaauaaaaauaaaaaaauaaauaaaaauaaaaaaaauaaaaaaggaaaaaaaaaaaagaagaa

SEQ ID NO: 653186 - RNA, 64 nt, Homo Sapiens
ugugugaauugacuaccguuguuugcaaacccgaaaauaaaagacguucauuauguaugaaaag

SEQ ID NO: 653187 - RNA, 64 nt, Homo Sapiens
ugaaucaucaaagcucacaccaaauuuuucuaucaaauaaaacuagugacagcuuguggcuuuu

SEQ ID NO: 653188 - RNA, 64 nt, Homo Sapiens
aguuucaggaaugaaguagaagguaguuauuuaaaaauaaaaaacacaguccgucccuaccaau

SEQ ID NO: 653189 - RNA, 64 nt, Homo Sapiens
cauaucuuuuaugaacaaaucugaacaauuugugaaauaaaacauugaaaaccaucuuucaggc

SEQ ID NO: 653190 - RNA, 64 nt, Homo Sapiens
uaguggugggucugaucugacugcagccaucgguaaauaaaaguuuuugauccuguugaacccg

SEQ ID NO: 653191 - RNA, 64 nt, Homo Sapiens
gccuuuuguguauuuuuuccuaaaaaaagaacaaaaauaaaaauguauaacauuuguacauggc

SEQ ID NO: 653192 - RNA, 64 nt, Homo Sapiens
gguaggaauguuuucuugccagacaugccuggauaaauaaaauuguaacaaacagccauauuua

SEQ ID NO: 653193 - RNA, 64 nt, Homo Sapiens
ugaggcuuuuaagaaucaugugaguccuguucugaaauaaaacacugcacagucugcagcuucc

SEQ ID NO: 653194 - RNA, 64 nt, Homo Sapiens
aauuuuuaaaaagagaauaaaaaaaaauaaaauaaaauaaaacccaacauagugagauucuguu

SEQ ID NO: 653195 - RNA, 64 nt, Homo Sapiens
aaaccaauuuuuaaaaagagcuguuaaaaaaauaaaauaaaauacugggcaacauagugagauu

SEQ ID NO: 653196 - RNA, 64 nt, Homo Sapiens
aaauaaaaccaauuuuuaaaagauucuguuaaaaaaauaaaauaccaaccugggcaacauagug

SEQ ID NO: 653197 - RNA, 64 nt, Homo Sapiens; identical to SEQ ID NO: 653192

SEQ ID NO: 653198 - RNA, 64 nt, Homo Sapiens
ugaggcuuuuaagaaucaugugaggccuguucugaaauaaaacacugcacagucugcaacuucc

SEQ ID NO: 653199 - RNA, 64 nt, Homo Sapiens
cugaaaagaaaccaacaaaauuguauauuuugaaaaauaaaacauugugaaauaaaaacuuaaa

SEQ ID NO: 653200 - RNA, 64 nt, Homo Sapiens
uuaaauuguauauuuugaaaaaacuacgguugugaaauaaaaacgauuuuggaauaaauauaca

SEQ ID NO: 653201 - RNA, 64 nt, Homo Sapiens
ugguccugugagaggauaauuaaaugaauaaauaaaauaaaaguuacuuuuaaaaauuuguccu

SEQ ID NO: 653202 - RNA, 64 nt, Homo Sapiens
aaaguugguccugugagaggguccuuaaaugaauaaauaaaauacacuuuacuuuuaaaaauuu

SEQ ID NO: 653203 - RNA, 64 nt, Homo Sapiens
aaaaugcacacuuuauaguuucaagauuuucaguaaauaaaaucuguccauuccuaccuggaca

SEQ ID NO: 653204 - RNA, 64 nt, Homo Sapiens
uuuagaaagauguuaauguacauaaauagaguguaaauaaaauaguguugauguacugaaauau

SEQ ID NO: 653205 - RNA, 64 nt, Homo Sapiens
guaaaagggaaauuugaacaacaaaaaccaaaaaaaauaaaaauaaaaaacuucaaaaguugac

SEQ ID NO: 653206 - RNA, 64 nt, Homo Sapiens
gggaaauuugaacaacaaaaaccaaaaaaaauaaaaauaaaaaacuucaaaaguugacaagaag

SEQ ID NO: 653207 - RNA, 64 nt, Homo Sapiens
aaguugcuugagccaagugcuuaaaaaguuaauaaaauaaaaugaucuguaugauaccugcaau

SEQ ID NO: 653208 - RNA, 64 nt, Homo Sapiens
aaaacuuuguguuuuggcaaucguuuuauaacuaaaauaaaaugaaagcuaaaucuacacgcug

SEQ ID NO: 653209 - RNA, 64 nt, Homo Sapiens
cuggacaacacagugagaccucaucucuaucaaaaaauaaaaauuagcuagaugugguggcaug

SEQ ID NO: 653210 - RNA, 64 nt, Homo Sapiens
cuugggcaacagagcaagacccugucuccgaaacaaauaaaaaauacuguaauaaaaguacuua

SEQ ID NO: 653211 - RNA, 64 nt, Homo Sapiens
uugaaaaaggaaaaucagcaauucagcaaaaaauaaauaaaaaauaaaaauguaaauaugauag

SEQ ID NO: 653212 - RNA, 64 nt, Homo Sapiens
aggaaaaucagcaauucagcaaaaaauaaauaaaaaauaaaaauguaaauaugauaguaauaaa

SEQ ID NO: 653213 - RNA, 64 nt, Homo Sapiens
aagaacccugaaauuuauauaggugagacaauagaaauaaaaagaucuucagccaggccuuucu

SEQ ID NO: 653214 - RNA, 64 nt, Homo Sapiens
ggagagagagagagaugcuguugagcacaugacaaaauaaaauaaaauggaugauucauucuua

SEQ ID NO: 653215 - RNA, 64 nt, Homo Sapiens
gagagagagaugcuguugagcacaugacaaaauaaaauaaaauggaugauucauucuuaagugc

SEQ ID NO: 653216 - RNA, 64 nt, Homo Sapiens
aaaaucaaaaacuuuugcaaucuuaagcagagauaaauaaaagauagcaauaugagacacaggu

SEQ ID NO: 653217 - RNA, 64 nt, Homo Sapiens
ucaaaugagcaucucaaauguuuucugcagaaaaaaauaaaaagauucuaauaaaauguauucu

SEQ ID NO: 653218 - RNA, 64 nt, Homo Sapiens
cuccugaagaaauggcucagauauugagucagagaaauaaaaaguaggaucaguuagcaauucu

SEQ ID NO: 653219 - RNA, 64 nt, Homo Sapiens
uuuucuugcaucaguauuggcuagaaaagaaaauaaauaaaaccaaguuaauuuaguaguaaca

SEQ ID NO: 653220 - RNA, 64 nt, Homo Sapiens
uagugagagacccuguaucugaaaguaauaauaaaaauaaaaaauauaaaugaggucucguuga

SEQ ID NO: 653221 - RNA, 64 nt, Homo Sapiens
agccugggcaacaaagcaagacucugucucaaaaaaauaaaaauaaaaaaaaaaucuuaguucc

SEQ ID NO: 653222 - RNA, 64 nt, Homo Sapiens
ggcaacaaagcaagacucugucucaaaaaaauaaaaauaaaaaaaaaaucuuaguuccauggaa

SEQ ID NO: 653223 - RNA, 64 nt, Homo Sapiens
aaacggggaaugaaggcaggaaggaggcuggaauaaauaaaaauaaaaauagacaaguaagaca

SEQ ID NO: 653224 - RNA, 64 nt, Homo Sapiens
ggaaugaaggcaggaaggaggcuggaauaaauaaaaauaaaaauagacaaguaagacagcauaa

SEQ ID NO: 653225 - RNA, 64 nt, Homo Sapiens
uaaccaaaagccaucugcuccccaaaaacuauugaaauaaaauaaaauauaaaaagaaagagaa

SEQ ID NO: 653226 - RNA, 64 nt, Homo Sapiens
aaaagccaucugcuccccaaaaacuauugaaauaaaauaaaauauaaaaagaaagagaaagaaa

SEQ ID NO: 653227 - RNA, 64 nt, Homo Sapiens
aggcaaucuggucacuaggucuuugugaugccaaaaauaaaagaggguggggugggugcuuucu

SEQ ID NO: 653228 - RNA, 64 nt, Homo Sapiens
gaugcucagacuugguugucuuauguuuaccaauaaauaaaaguagacuuuuucuauuuuuauu

SEQ ID NO: 653229 - RNA, 64 nt, Homo Sapiens
ucuaugcucauaacugugucgucaaacaucuggaaaauaaaaggauuuuauguauguuuacacu

SEQ ID NO: 653230 - RNA, 64 nt, Homo Sapiens
aaugcacaaugucuugguacaaguaacuugucuuaaauaaaagauucuaacucugauguaaaug

SEQ ID NO: 653231 - RNA, 64 nt, Homo Sapiens
aaaccuuacuuacaagcauagauuuuaaaaguaaaaauaaaaauucuuuaacuuccagaauagu

SEQ ID NO: 653232 - RNA, 64 nt, Homo Sapiens
uuuguuuucugcuagaugcaaaaaugaaaacaaaaaauaaaauauaagaaacucuaaagguuau

SEQ ID NO: 653233 - RNA, 64 nt, Homo Sapiens
aauaguacuuaguguaaaauacuacauaguaaaaaaauaaaauaaaacaguucuaggggguuga

SEQ ID NO: 653234 - RNA, 64 nt, Homo Sapiens
acagcauuacuauuucuaauuagaacccacuucaaaauaaaaaagaauuaaaaccaaucauaag

SEQ ID NO: 653235 - RNA, 64 nt, Homo Sapiens
ucuauauuagugcugcuuugauucaauacaguuuaaauaaaaucacaugcaaugugcuguaaaa

SEQ ID NO: 653236 - RNA, 64 nt, Homo Sapiens
aagguuuucguuguuguugucucuccuggcaugaaaauaaaacaacaggagcuacaccuugauc

SEQ ID NO: 653237 - RNA, 64 nt, Homo Sapiens
guguugauguaccgaaauaucauaaauagaguguaaauaaaauauuuagaaagauguuaaugua

SEQ ID NO: 653238 - RNA, 64 nt, Homo Sapiens
ucuaauuaaaauaguuaacuggcccugaagcacaaaauaaaaauauguaguuauuuuauccugu

SEQ ID NO: 653239 - RNA, 64 nt, Homo Sapiens
uugauggacuuuucuuauguaguuuauuucuuagaaauaaaacuuuacguucggguuauaugca

SEQ ID NO: 653240 - RNA, 64 nt, Homo Sapiens
augagguuuuuagccugaacugagaacauuuuacaaauaaaaauauuaucaauaaagcuaacac

SEQ ID NO: 653241 - RNA, 64 nt, Homo Sapiens
cuaauucauaacuaaugcauuaauguuccaaucuaaauaaaaaacaucuucuuaaauaaguacg

SEQ ID NO: 653242 - RNA, 64 nt, Homo Sapiens
uauguauaauuaagugaagcuuuugcuuuucuuuaaauaaaacgugaaaugcugugguugugug

SEQ ID NO: 653243 - RNA, 64 nt, Homo Sapiens
uaauguuuuaagcuuaauagccuuugcacuuuuaaaauaaaaaccaaguaugcaaaucaaagau

SEQ ID NO: 653244 - RNA, 64 nt, Homo Sapiens
gaugcaaaacauaauuugcaaaauuuuauaauugaaauaaaacuugguaugcuguuuuauaaua

SEQ ID NO: 653245 - RNA, 64 nt, Homo Sapiens
gaacugguagccaguauauuaaauauugauauaaaaauaaaagaacuggaaccagauucagaau

SEQ ID NO: 653246 - RNA, 64 nt, Homo Sapiens
uauugaauuguaauguuuaucugcugcuuuuuuuaaauaaaauuugacugaaaauguuuaauug

SEQ ID NO: 653247 - RNA, 64 nt, Homo Sapiens
cucuugcuuaaaugauagucuauuuaguaguuuaaaauaaaaauaaucacucccuaugaucuag

SEQ ID NO: 653248 - RNA, 64 nt, Homo Sapiens
gugugcugaauguuccuguguacauauguguguuaaauaaaacaauuguauugaagacuguuuu

SEQ ID NO: 653249 - RNA, 64 nt, Homo Sapiens
uucugguauuuugacauguuauaauacgcaaguaaaauaaaacaauaguuuacucagcucaugu

SEQ ID NO: 653250 - RNA, 64 nt, Homo Sapiens
gcaaaacauaaauuaaaacucaaaugccaggacaaaauaaaacaauauaccagauggagaggau

SEQ ID NO: 653251 - RNA, 64 nt, Homo Sapiens
uuuauguacuaauucaacugaaggggaaaacuuuaaauaaaaacuguaaaugaagcuugcuugg

SEQ ID NO: 653252 - RNA, 64 nt, Homo Sapiens
auuuaugagaauuauaaguauuuauuucucaccaaaauaaaagcacuuguucugcauuuuauuu

SEQ ID NO: 653253 - RNA, 64 nt, Homo Sapiens
cuaaaauauauuuuaaccauacaacuuuaggaguaaauaaaagcagcccuccagagcuugaaca

SEQ ID NO: 653254 - RNA, 64 nt, Homo Sapiens
uaaucugaaaaccucauguuaacgcccaggauuaaaauaaaauacuauguaaaaauaaaauuca

SEQ ID NO: 653255 - RNA, 64 nt, Homo Sapiens
caaacgcccaggauuaaaauaugcagcuauguaaaaauaaaauuguuuugagggaauauacuaa

SEQ ID NO: 653256 - RNA, 64 nt, Homo Sapiens
gccugggcgacagagcaagacucugucucaaaaaaaauaaaaaauaaucagggcacaguggcuc

SEQ ID NO: 653257 - RNA, 64 nt, Homo Sapiens
ccagccugggcaacaagagcaaaacuccgucucaaaauaaaaagaaaagaaaagaauggacagu

SEQ ID NO: 653258 - RNA, 64 nt, Homo Sapiens
cagccugggggacagagcacgacccugucuccaaaaauaaaauaaaaauaaaaauaaauauugg

SEQ ID NO: 653259 - RNA, 64 nt, Homo Sapiens
ugggggacagagcacgacccugucuccaaaaauaaaauaaaaauaaaaauaaauauuggcgggg

SEQ ID NO: 653260 - RNA, 64 nt, Homo Sapiens
acagagcacgacccugucuccaaaaauaaaauaaaaauaaaaauaaauauuggcgggggaaccc

SEQ ID NO: 653261 - RNA, 64 nt, Homo Sapiens
uauccagccaaacuaagcuucauaagugaaggagaaauaaaauacuuuacagacaagcaaaugc

SEQ ID NO: 653262 - RNA, 64 nt, Homo Sapiens
acccaucucacgugcagagacacacauaggcucaaaauaaaaggauggaggaagaucuacgaag

SEQ ID NO: 653263 - RNA, 64 nt, Homo Sapiens
cucuucaaggagaacuacaaaccacugcuuaacgaaauaaaagaggaugcaaagaaauggaaga

SEQ ID NO: 653264 - RNA, 64 nt, Homo Sapiens
uuuauacgaaaauauauuuucaaagguguaguaaaaauaaaaaaaauuuuaauccaaauuuguc

SEQ ID NO: 653265 - RNA, 64 nt, Homo Sapiens
gaauauucuacuaaaugagaguucugaguauagaaaauaaaacuaaaguugguagaaaaauuau

SEQ ID NO: 653266 - RNA, 64 nt, Homo Sapiens
aauaacauuuaggaagcaaauagauuaaacacaaaaauaaaacuaaagcauaggaauuauguuu

SEQ ID NO: 653267 - RNA, 64 nt, Homo Sapiens
uuuaaauauaauuuuauuucuuucaacaaauauaaaauaaaaaacaacuuuggaacaaugacuu

SEQ ID NO: 653268 - RNA, 64 nt, Homo Sapiens
uggugacagagugagauccugucucuaaauaaauaaauaaaaugcgggccaggcacaguggcuc

SEQ ID NO: 653269 - RNA, 64 nt, Homo Sapiens
accagaaaaaugaaaagaaaaaaacagacauacaaaauaaaagccccaguuuuuuauuauggua

SEQ ID NO: 653270 - RNA, 64 nt, Homo Sapiens
ccugggcgacagagugagacucccucucaaaagaaaauaaaaauaaaaauaaacuggccaggug

SEQ ID NO: 653271 - RNA, 64 nt, Homo Sapiens
cgacagagugagacucccucucaaaagaaaauaaaaauaaaaauaaacuggccaggugcggugg

SEQ ID NO: 653272 - RNA, 64 nt, Homo Sapiens
ccugggcaagagagagagacuuugucucuauuaaaaauaaaaaugauuggccgagcaugguggu

SEQ ID NO: 653273 - RNA, 64 nt, Homo Sapiens
acaggcugcaccauaagacccacucacaauaaaaaaauaaaaggccgagccgggcaugguugcu

SEQ ID NO: 653274 - RNA, 64 nt, Homo Sapiens
gagccgggcaugguugcucacucccguaauaaaaaaauaaaagaacaggcugagccgggcaugg

SEQ ID NO: 653275 - RNA, 64 nt, Homo Sapiens
cagaaagcaaggggugccuaucaaaauaaauaaaaaauaaaagaaacaagagcgaaacucuguc

SEQ ID NO: 653276 - RNA, 64 nt, Homo Sapiens
uaaaagacagaaagcaagggcucugucucaaaauaaauaaaaaaccugggcaacaagagcgaaa

SEQ ID NO: 653277 - RNA, 64 nt, Homo Sapiens
ucuaagggcucaggaaccaggucaaaaaaauaaaaaauaaaaaagugacagaaugagacucugu

SEQ ID NO: 653278 - RNA, 64 nt, Homo Sapiens
uaaaaaaucuaagggcucagacucugugucaaaaaaauaaaaaaagccugggugacagaaugag

SEQ ID NO: 653279 - RNA, 64 nt, Homo Sapiens
acacacugcacauccacuguauggaaauaaaaacaaauaaaacuuucgcuuccucucuuguguu

SEQ ID NO: 653280 - RNA, 64 nt, Homo Sapiens
aaauaaaacuacacacugcacucuuguguuauggaaauaaaaacgcccuggcccuucgcuuccu

SEQ ID NO: 653281 - RNA, 64 nt, Homo Sapiens
auaauaauguaugaagcucuuugguuaaaaaauaaaauaaaauaugaagcacuuuugcauuaau

SEQ ID NO: 653282 - RNA, 64 nt, Homo Sapiens
aaauaauaauaauguaugaauuaauuugguuaaaaaauaaaauauacuuugaagcacuuuugca

SEQ ID NO: 653283 - RNA, 64 nt, Homo Sapiens
aacccaaguaaagaacagccaaaaggaaacaacaaaauaaaaccaauaaguauuuccgucaaga

SEQ ID NO: 653284 - RNA, 64 nt, Homo Sapiens
ucguaugauaugagauacauagugugauuauaaaaaauaaaagaauuugguuagggauuauguc

SEQ ID NO: 653285 - RNA, 64 nt, Homo Sapiens
ccaaagaacacacauugucguugcugcaauuuugaaauaaaaugugauuuuuuuuucucugucu

SEQ ID NO: 653286 - RNA, 64 nt, Homo Sapiens
ccagcgggcggcgucuggguugaagugcaauacgaaauaaaaggcucccuaccaaugacucacc

SEQ ID NO: 653287 - RNA, 64 nt, Homo Sapiens
ccuaugaacauuuguacacauuucuuacuguuacaaauaaaaaucauuaguuuuguucccgguu

SEQ ID NO: 653288 - RNA, 64 nt, Homo Sapiens
ucaacagauugagagaguucacgucuuugcccaaaaauaaaacugaaauguaauaauuauagga

SEQ ID NO: 653289 - RNA, 64 nt, Homo Sapiens
gcuuguagaaacaauuuugaaagccccuugaggaaaauaaaaaucaagaagaacacuuuucucc

SEQ ID NO: 653290 - RNA, 64 nt, Homo Sapiens
uuaucagaaccugcagugaaauuaaacuuauguuaaauaaaaccaguuugcaggugcacaaacu

SEQ ID NO: 653291 - RNA, 64 nt, Homo Sapiens
gucuuuuuuuugggcagcguggugggggauaaauaaauaaaaggaaaaaaaacuuagccuagaa

SEQ ID NO: 653292 - RNA, 64 nt, Homo Sapiens
uuuuuuuuuuuuuuuuuuacugcauguuacauugaaauaaaaacaaaguaaaaugagcaauugc

SEQ ID NO: 653293 - RNA, 64 nt, Homo Sapiens
uggcuuuuuauaaagcuugaguuauguaagauuuaaauaaaaguuugcuaccaagaugauugcc

SEQ ID NO: 653294 - RNA, 64 nt, Homo Sapiens
aagucuuuaucugccccuuuaacaaguugaguaaaaauaaaagguauuuuuuagucaauguguu

SEQ ID NO: 653295 - RNA, 64 nt, Homo Sapiens
gaaagcccauuuucucccuuccuaagcuagauccaaauaaaagaaaguucaguuuucccccaua

SEQ ID NO: 653296 - RNA, 64 nt, Homo Sapiens
uaacaacuucaacaucauaaacaaauuccuugaaaaauaaaaaguaccaaaauucauucaagaa

SEQ ID NO: 653297 - RNA, 64 nt, Homo Sapiens
gauagauuuuaaugggaaaauuauaauucagauuaaauaaaaaacaauucccuuuucccuguug

SEQ ID NO: 653298 - RNA, 64 nt, Homo Sapiens
uucccacugcugggccucuaucuccaugacaacaaaauaaaaacagagguugcuugacucauua

SEQ ID NO: 653299 - RNA, 64 nt, Homo Sapiens
gccacaaaaguucccucucacuuucaguaaaaauaaauaaaacagcagcagcaaacaaauaaaa

SEQ ID NO: 653300 - RNA, 64 nt, Homo Sapiens
uucaguaaaaauaaauaaaacagcagcagcaaacaaauaaaaugaaauaaaagaaacaaaugaa

SEQ ID NO: 653301 - RNA, 64 nt, Homo Sapiens
auaaauaaaacagcagcagcaaacaaauaaaaugaaauaaaagaaacaaaugaaauaaauauug

SEQ ID NO: 653302 - RNA, 64 nt, Homo Sapiens
uaaauauuguguugugcagcauuaaaaaaaaucaaaauaaaaauuaaaugugagcaaagaauga

SEQ ID NO: 653303 - RNA, 64 nt, Homo Sapiens
cgucguucugagcugaggaguaaaagcuauuuuuaaauaaaagagagaauuggugaguuuaaaa

SEQ ID NO: 653304 - RNA, 64 nt, Homo Sapiens
uauuuuuaaauaaaagacguaauuggugaguuuaaaauaaaagcugugagugugugugagagag

SEQ ID NO: 653305 - RNA, 64 nt, Homo Sapiens
aagaugcugaugacuugguguccuccaguacaauaaauaaaagaaggcuuguguaauuuccugc

SEQ ID NO: 653306 - RNA, 64 nt, Homo Sapiens
agaaagaggaauaaaaugaucucuuaaugucucaaaauaaaaccauccccauaaugcuucuuuc

SEQ ID NO: 653307 - RNA, 64 nt, Homo Sapiens
aaauguuugccuuuuccccagaaacugcauuugcaaauaaaaaugugagcacuaacuauuggca

SEQ ID NO: 653308 - RNA, 64 nt, Homo Sapiens
ugagccacaguauaccacucaaccaaaaauaaugaaauaaaauuugugcacguuucauuaaucc

SEQ ID NO: 653309 - RNA, 64 nt, Homo Sapiens
agcucuacuggucuuguggaucacugguagaccaaaauaaaaccuugacugucacuguuccuug

SEQ ID NO: 653310 - RNA, 64 nt, Homo Sapiens
ggccauuugcuuuuucaccaaacaaaaacacuaaaaauaaaaaugaaccccuacaugaaacaga

SEQ ID NO: 653311 - RNA, 64 nt, Homo Sapiens
acauuuuuuucaagcagggaaauaaaaaaaauaaaaauaaaaaaaauccccucaaaaaaauaaa

SEQ ID NO: 653312 - RNA, 64 nt, Homo Sapiens
aaaaaaacauuuuuuucaagaauaaaaauaaaaaaaauaaaaaucugugcaauccccucaaaaa

SEQ ID NO: 653313 - RNA, 64 nt, Homo Sapiens
aauaaaaauaaaaaaacauuccucaaaaaaauaaaaauaaaaaaggaaauaaacugugcaaucc

SEQ ID NO: 653314 - RNA, 64 nt, Homo Sapiens
aaaaaaaauaaaaauaaaaacaauccccucaaaaaaauaaaaauguguuuggaaauaaacugug

SEQ ID NO: 653315 - RNA, 64 nt, Homo Sapiens
cucuuaaaaaggccacaggauguaagaaccacucaaauaaaaguuuucauauugcaacaaucuu

SEQ ID NO: 653316 - RNA, 64 nt, Homo Sapiens
guuaacaggaaugcagugugcuguuaccuugaaaaaauaaaaauugucauuuguaugcaauuuc

SEQ ID NO: 653317 - RNA, 64 nt, Homo Sapiens
uuuuaaauauuugagagacuuucucugaaaguaaaaauaaaaguuucaucuguauaccuucaaa

SEQ ID NO: 653318 - RNA, 64 nt, Homo Sapiens
auuauugggaaacuagagaauucuuccugcauugaaauaaaaacaggccucccaugaaauugcg

SEQ ID NO: 653319 - RNA, 64 nt, Homo Sapiens
uagaaauccaauuaagacucacuuggguaaaaaaaaauaaaaaaauaaacaaaauaaacugcuc

SEQ ID NO: 653320 - RNA, 64 nt, Homo Sapiens
cagcccagccaacauugugagacauaaucucuacaaauaaaauaaauuaguuggacaugauggu

SEQ ID NO: 653321 - RNA, 64 nt, Homo Sapiens
agccugagugacagagugagacuuugcaaccaaaaaauaaaauaauaauaauaaugaaauaaau

SEQ ID NO: 653322 - RNA, 64 nt, Homo Sapiens
uccuguauaguucacguuucauguaauccucaagaaauaaaaggaagccaaagaguguauuuuu

SEQ ID NO: 653323 - RNA, 64 nt, Homo Sapiens
aauugugugugaugugaagccaauucagacaggcaaauaaaagugaccuuuuacacugacucuu

SEQ ID NO: 653324 - RNA, 64 nt, Homo Sapiens
uuacucuuuuguacuucuccucugauuuuuaaauaaauaaaaugacuauuuugccauauuugcu

SEQ ID NO: 653325 - RNA, 64 nt, Homo Sapiens
acugcuuuccaucuacugggaagcaauucaugauaaauaaaauugcacauguuuaauuggcaaa

SEQ ID NO: 653326 - RNA, 64 nt, Homo Sapiens
cugcaagaguuaucaauagauauggcauuuucucaaauaaaacuuaggcaauuuucuucagugg

SEQ ID NO: 653327 - RNA, 64 nt, Homo Sapiens
ucugggccuuacuuguuuuuaaaaaugucuuagaaaauaaaaauuauuuaugcccuuauauccc

SEQ ID NO: 653328 - RNA, 64 nt, Homo Sapiens
acacagguaauuuaguaucuguagugaaugcagaaaauaaaaauuaaucaauggauauccuuca

SEQ ID NO: 653329 - RNA, 64 nt, Homo Sapiens
gugaaagaagcaagcugugucugucucaaaaauaaaauaaaaaacuggaccacagagcaggccc

SEQ ID NO: 653330 - RNA, 64 nt, Homo Sapiens
aaaaagugaaagaagcaagcggccccugucucaaaaauaaaauaauagccuggaccacagagca

SEQ ID NO: 653331 - RNA, 64 nt, Homo Sapiens
ucuuaugaaauagagaguguccuaaauaucacugaaauaaaaaguaggaaaaagaagcuugaau

SEQ ID NO: 653332 - RNA, 64 nt, Homo Sapiens
uuaaaugugcuuucuuuuugaaauuuauguuuucaaauaaaaucucccuaaagcaauauuuaaa

SEQ ID NO: 653333 - RNA, 64 nt, Homo Sapiens
uaggguuucuguuguguuuuuuuuuuuuuuuuugaaauaaaacuauaauauaaauucuccuauu

SEQ ID NO: 653334 - RNA, 64 nt, Homo Sapiens
uuugaaauaaaacuauaauauaaauucuccuauuaaauaaaauuauuuuaaguuuuagugucaa

SEQ ID NO: 653335 - RNA, 64 nt, Homo Sapiens
agccugggugacagagugagacccuauuucaaaaaaauaaaaauuggaagaagagcuuaaaaaa

SEQ ID NO: 653336 - RNA, 64 nt, Homo Sapiens
agagaccugcuguccuuuuucuccuugagggaggaaauaaaacugcggaauacaauguccuucc

SEQ ID NO: 653337 - RNA, 64 nt, Homo Sapiens
cuugagacuugugacaagcuagacucuguucugaaaauaaaaaacucuuuuuaaaaauaaaacc

SEQ ID NO: 653338 - RNA, 64 nt, Homo Sapiens
agacucuguucugaaaauaaccuucucuuuuuaaaaauaaaacccuagcauuuaucacuuuuuu

SEQ ID NO: 653339 - RNA, 64 nt, Homo Sapiens
aaucaaacuuaaaacuguguugcaaagcauuuugaaauaaaaaaugaacaguaauucauuuaau

SEQ ID NO: 653340 - RNA, 64 nt, Homo Sapiens
ugcaggcuggaaugaucucauuccuucugccuacaaauaaaaagaugccccucaaccuaucccg

SEQ ID NO: 653341 - RNA, 64 nt, Homo Sapiens
auacuagaguaucuagaagggugaaaacaaaaaaaaauaaaaagaaacacagacgcccaggugu

SEQ ID NO: 653342 - RNA, 64 nt, Homo Sapiens
aaugauauaacaguuccuucaaaauuggccuaggaaauaaaaccuuaaaaggacacuggugugc

SEQ ID NO: 653343 - RNA, 64 nt, Homo Sapiens
ucuacugcacaccaacuguuuauagaauacacaaaaauaaaauguaauaacuguauucugugaa

SEQ ID NO: 653344 - RNA, 64 nt, Homo Sapiens
uuuagaaauuagcuccagguucuuaaacuaacaaaaauaaaaccuaagcaugccacagagcuau

SEQ ID NO: 653345 - RNA, 64 nt, Homo Sapiens
ccacagaauuuucaagcccuuaagaguuuaguuaaaauaaaauuuuugaaauuauugucuuaau

SEQ ID NO: 653346 - RNA, 64 nt, Homo Sapiens
gcuguaaauggguugccaacauaagcuggcugagaaauaaaagaaaacaagacaguuguucaua

SEQ ID NO: 653347 - RNA, 64 nt, Homo Sapiens
ggaguaacugaauugaaucaaccaguuugcauuuaaauaaaagaacaggcucaguggucuuccu

SEQ ID NO: 653348 - RNA, 64 nt, Homo Sapiens
uuuugagaccaugaugguuacacuuuugguuccuaaauaaaauuuaaaaaauuaacagccaagu

SEQ ID NO: 653349 - RNA, 64 nt, Homo Sapiens
uucaaacacuacuccuauuacauuuucuauguguaaauaaaacugcuuagcauuguacagaaac

SEQ ID NO: 653350 - RNA, 64 nt, Homo Sapiens
aauacuacaaaaucaacaugauuucauaaggugcaaauaaaaguuggugacagauuuaauauaa

SEQ ID NO: 653351 - RNA, 64 nt, Homo Sapiens
auuucaaauaauaacaauacuuuuuguuuuucaaaaauaaaaugcaauguuauauaaagcuaua

SEQ ID NO: 653352 - RNA, 64 nt, Homo Sapiens
acacagaacaaaaaccaucaaaaucucauauaugaaauaaaauauauucuucuaagcaaagaaa

SEQ ID NO: 653353 - RNA, 64 nt, Homo Sapiens
acaaaaaaaucugcucagaaaaauguaugugcacaaauaaaaaaaauuaauggcaauuguuuag

SEQ ID NO: 653354 - RNA, 64 nt, Homo Sapiens
uguaauuuagguuuuucaacaaagcccuugucuaaaauaaaaggcauuauuggaaauauuugaa

SEQ ID NO: 653355 - RNA, 64 nt, Homo Sapiens
gaaagccuacaaugaaucauuguucaaccuugaaaaauaaaauuuuguaaaacaucgguugaug

SEQ ID NO: 653356 - RNA, 64 nt, Homo Sapiens
gaauuuuguucaaauuauagcagaauuuaggcaaaaauaaaacagacauguauuuuuguuugcu

SEQ ID NO: 653357 - RNA, 64 nt, Homo Sapiens
caauuuguauugauucucuuuaaauauaaaauguaaauaaaauauuccaauaaaaguuuguguc

SEQ ID NO: 653358 - RNA, 64 nt, Homo Sapiens
uccacaguguccagacuaauuugugcaugaacugaaauaaaaccauccuacgguauccagggaa

SEQ ID NO: 653359 - RNA, 64 nt, Homo Sapiens
gggaggacaggaaggcagccugggacauuuaaaaaaauaaaaaugaaaaaaaaacccagaaccc

SEQ ID NO: 653360 - RNA, 64 nt, Homo Sapiens
cuaacauacucacugugaacccagccuauugcaaaaauaaaaucuuuuuauaauauuaucuaug

SEQ ID NO: 653361 - RNA, 64 nt, Homo Sapiens
auuuuugacaugcuccuauuuuuguaacuugaaaaaauaaaauuuugccuugugacagauuuuc

SEQ ID NO: 653362 - RNA, 64 nt, Homo Sapiens
auuccuuccaguaaugccacuguauuuugucuccaaauaaaagaagcuuauuguaguauguuug

SEQ ID NO: 653363 - RNA, 64 nt, Homo Sapiens
cuuauuagagugugggaauagggaucuaaauuuuaaauaaaauuauauauauauauaaauuggu

SEQ ID NO: 653364 - RNA, 54 nt, Homo Sapiens
ucugccugaaagccccaugaagaaaaauaaaacaccuuguacuuuauuuucuau

SEQ ID NO: 653365 - RNA, 64 nt, Homo Sapiens
uuauaaaggauuaaugucaauucuugccaaauauaaauaaaaauaauccucaguuuuugugaaa

SEQ ID NO: 653366 - RNA, 64 nt, Homo Sapiens
gccuaauuauguaaaaagaauauaauaccuguggaaauaaaaaugaauuccaaguguauacuug

SEQ ID NO: 653367 - RNA, 64 nt, Homo Sapiens
uccaccaaaaccuauggaaauuuaaaaaaaacaaaaauaaaaagcaaaacaaaaaucccaaaau

SEQ ID NO: 653368 - RNA, 64 nt, Homo Sapiens
auagcuucauucacuugccuuacuaagaguaaugaaauaaaauugguggaaauaguuguggaug

SEQ ID NO: 653369 - RNA, 64 nt, Homo Sapiens
gaauugauguaaaguuccauguuaucuacauaggaaauaaaauguaugccaucuguccucaagu

SEQ ID NO: 653370 - RNA, 64 nt, Homo Sapiens
ugaacaacuuucaacaaugucuacugcaauuagaaaauaaaauaguaaagaaaucagauacaaa

SEQ ID NO: 653371 - RNA, 64 nt, Homo Sapiens
uuugaaauccaagaauaaugaagcuaugcacagaaaauaaaauguuccuauaauacagugcuau

SEQ ID NO: 653372 - RNA, 64 nt, Homo Sapiens
ucaugcugcagaauauguuaacagcugagaaauaaaauaaaaugaguuucugaaugaaaaagcu

SEQ ID NO: 653373 - RNA, 64 nt, Homo Sapiens
aaaugucaugcugcagaauaaagcuacagcugagaaauaaaauaucuccaguuucugaaugaaa

SEQ ID NO: 653374 - RNA, 64 nt, Homo Sapiens
cuuguugaaaagccuuuuucuagcaacuuguaaaaaauaaaauaauauauaaauuuuaauuuca

SEQ ID NO: 653375 - RNA, 64 nt, Homo Sapiens
gauuucacggaugugguuugguggaaaaaaauaaaaauaaaaguguugacaugaagucaucuau

SEQ ID NO: 653376 - RNA, 64 nt, Homo Sapiens
aaaagugauuucacggauguaucuauguggaaaaaaauaaaaauuuuguaguugacaugaaguc

SEQ ID NO: 653377 - RNA, 64 nt, Homo Sapiens
aaauaauaauaaaugugucacaaacugggaaauaaaauaaaaaagugaauguaagaggugucaa

SEQ ID NO: 653378 - RNA, 64 nt, Homo Sapiens
aaaaaaaauaauaauaaauggucaacaaacugggaaauaaaauaugccugugaauguaagaggu

SEQ ID NO: 653379 - RNA, 64 nt, Homo Sapiens
uguuucuaaauuucaaagcaguauuucagaucuuaaauaaaauuaaguugauauuuuaggaauu

SEQ ID NO: 653380 - RNA, 64 nt, Homo Sapiens
aguguaagcuccuuuucucacuguuuuaaacagaaaauaaaaggguuucaguuuguuuuccguu

SEQ ID NO: 653381 - RNA, 64 nt, Homo Sapiens
uugaaagaaucuuccaauuuuuucagaaacuaaaaaauaaaaugaaaauguauuuugauuugua

SEQ ID NO: 653382 - RNA, 64 nt, Homo Sapiens
uaugguuuucuuaaaaggaagguuguuuacucugaaauaaaaugcuauguauuuguuuuugaug

SEQ ID NO: 653383 - RNA, 64 nt, Homo Sapiens
auguaaccuauuaucauggacaguagggcucugcaaauaaaauaaggaguuguucaaaucacug

SEQ ID NO: 653384 - RNA, 64 nt, Homo Sapiens
aaaccaaaacuauacuuuugcaugcuucuaaauaaaauaaaacacccagcuuuagucauuugaa

SEQ ID NO: 653385 - RNA, 64 nt, Homo Sapiens
aaacaaaaccaaaacuauacuugaacaugcuucuaaauaaaauaaggagcccagcuuuagucau

SEQ ID NO: 653386 - RNA, 64 nt, Homo Sapiens
auacacacuuucuaguucuuguaaaauugaauucaaauaaaaucucuaguagacuucugcacau

SEQ ID NO: 653387 - RNA, 64 nt, Homo Sapiens
cugaucgcauaaaaauauguguaaacaaaaaauaaaauaaaauucuauauuuuuauauucaugu

SEQ ID NO: 653388 - RNA, 64 nt, Homo Sapiens
aaauucugaucgcauaaaaacauguguaaacaaaaaauaaaauauuuuucuauauuuuuauauu

SEQ ID NO: 653389 - RNA, 64 nt, Homo Sapiens
aagguaauuaaaaaccuaagagguauguuuggcaaaauaaaauaaaaaaauaaaagguauuccc

SEQ ID NO: 653390 - RNA, 64 nt, Homo Sapiens
uauucccagguauguuuggcccaagguaaaaaaaaaauaaaagguaugguuuggaaccaucacc

SEQ ID NO: 653391 - RNA, 64 nt, Homo Sapiens
uugacacauacaaacaaauguucaguaaugaguuaaauaaaacauuuauuuuccugcugguuuc

SEQ ID NO: 653392 - RNA, 64 nt, Homo Sapiens
acaaugucuucuugaaauuuuguugaaagcuuugaaauaaaauaauaagucaggaggaugcaau

SEQ ID NO: 653393 - RNA, 64 nt, Homo Sapiens
cucaguuguuuauuauccuggccucauacguuuaaaauaaaacuauguuaacauuucagguuaa

SEQ ID NO: 653394 - RNA, 64 nt, Homo Sapiens
uguggcugaccaaaaggucuagaaaugaaaaggaaaauaaaaaccaacugaaucuuuuauucau

SEQ ID NO: 653395 - RNA, 64 nt, Homo Sapiens
uaauuuuaaaaaacaauauaaagaagcacucauuaaauaaaacagauuauauuauuuuuaaaug

SEQ ID NO: 653396 - RNA, 64 nt, Homo Sapiens
uuuuacuuuaauaguuuaguguaaaguacaucagaaauaaaacuguaucugacauuuuaagccu

SEQ ID NO: 653397 - RNA, 64 nt, Homo Sapiens; identical to SEQ ID NO: 653352

SEQ ID NO: 653398 - RNA, 64 nt, Homo Sapiens; identical to SEQ ID NO: 653353

SEQ ID NO: 653399 - RNA, 64 nt, Homo Sapiens
uuaaaaaaaaacaugagcuuucuguaaaaaauaaaaauaaaacacaacacagugagaacucauc

SEQ ID NO: 653400 - RNA, 64 nt, Homo Sapiens
aaaacauuaaaaaaaaacaucucaucucuguaaaaaauaaaaauccuaggcaacacagugagaa

SEQ ID NO: 653401 - RNA, 62 nt, Homo Sapiens
aaggcagcucaccauuugcugguaacuuaaugugagagaauccauaucugcgugaaaacacc

SEQ ID NO: 653402 - RNA, 62 nt, Homo Sapiens
aacuuggcauuuccaacuucuuccuuuccgggugagagaagaagcggagaaggguucagugu

SEQ ID NO: 653403 - RNA, 62 nt, Homo Sapiens
cuggauuuuuagagcuuuagaaauuuguaagcugagagaacaauguuucacuuaauaggagg

SEQ ID NO: 653404 - RNA, 62 nt, Homo Sapiens
gaucacguggcaaaagagcauguacaugggagugagagaaaaagagagagagagacagagug

SEQ ID NO: 653405 - RNA, 62 nt, Homo Sapiens
agcaccccucauccaucucaucacugucuaccugagagaaugcucggcugaaccaggacucc

SEQ ID NO: 653406 - RNA, 62 nt, Homo Sapiens
uucuagaagccacuccagccagggaaaaguaaugagagaaguauaagugcuuagcugccaug

SEQ ID NO: 653407 - RNA, 62 nt, Homo Sapiens
aaguacucucaucaacuuauuuccuugguacaugagagaaauuaugcuuuuuucugugaauu

SEQ ID NO: 653408 - RNA, 62 nt, Homo Sapiens
gaacuggccccuguacagguagggaagggugaugagagaacauuugagcauugcucuauaga

SEQ ID NO: 653409 - RNA, 62 nt, Homo Sapiens
ucuuguaaaaaccugucaguuauuuucaucuaugagagaagaggagcccaaacucucgccca

SEQ ID NO: 653410 - RNA, 62 nt, Homo Sapiens
cucugaagggggaagguagugggaauagguggugagagaacucacauuuuucucuuguccug

SEQ ID NO: 653411 - RNA, 62 nt, Homo Sapiens
aguuguuucauagcucccagucaaaaagaaagugagagaagcuguugggcagcgaaccuacu

SEQ ID NO: 653412 - RNA, 62 nt, Homo Sapiens
uguuagcucaaaaaaacuuuacugcacacuacugagagaaugagaugaaaaacgauuaaugu

SEQ ID NO: 653413 - RNA, 62 nt, Homo Sapiens
gaaagucugugucagccaaagccaugucacucugagagaacugauucugaggacaaguuagc

SEQ ID NO: 653414 - RNA, 62 nt, Homo Sapiens
ggaacauaaccaaaguucacaaacauaacgagugagagaaacacauucaagcccaggucuag

SEQ ID NO: 653415 - RNA, 62 nt, Homo Sapiens
auuguuuggggaaguucaagaaaagaaaaauaugagagaacuacuguuaacugucuugagag

SEQ ID NO: 653416 - RNA, 62 nt, Homo Sapiens
gaaaaauaugagagaacuauuguuaacugucuugagagaaaaacuguuucacuaauacuuac

SEQ ID NO: 653417 - RNA, 62 nt, Homo Sapiens
uuaugaagaccagugaauuacgauauuuaaagugagagaacuuaauuauuugcaaagguaag

SEQ ID NO: 653418 - RNA, 62 nt, Homo Sapiens
uuauuugcaaagguaaguuacagcuuguuuuuugagagaaucaaaugaguuuacuuuuguuc

SEQ ID NO: 653419 - RNA, 62 nt, Homo Sapiens
agccuggaaagauguggccucaggaaaagggaugagagaaaggaggugguauggaagacuca

SEQ ID NO: 653420 - RNA, 62 nt, Homo Sapiens
ucuagggguuuggcuacuguuggccugggagcugagagaaggcacugagagggacaguaggc

SEQ ID NO: 653421 - RNA, 62 nt, Homo Sapiens
aaauauguuucucaagcaaccugcaucuuuuaugagagaagaaagagugagagaagaauugc

SEQ ID NO: 653422 - RNA, 62 nt, Homo Sapiens
gcaaccugcaucuuuuaugagagaagaaagagugagagaagaauugccucuggacuaucauc

SEQ ID NO: 653423 - RNA, 62 nt, Homo Sapiens
aggaagaaucagcccagcagaaggauagaggcugagagaagauguggguaaagacagggaug

SEQ ID NO: 653424 - RNA, 62 nt, Homo Sapiens
ugcccaucaggggcugggacugacugcuucucugagagaacucugccccaucacagccagca

SEQ ID NO: 653425 - RNA, 62 nt, Homo Sapiens
cccauugguucccacuggcagcaugguagagcugagagaaacaggcucucaggguaccugac

SEQ ID NO: 653426 - RNA, 62 nt, Homo Sapiens
gugaaaauuccuuauaaauccaggauuggcucugagagaacuggcuaagauucaggaagaaa

SEQ ID NO: 653427 - RNA, 62 nt, Homo Sapiens
auuuuuguccaaaaaccuacagacaaguacuuugagagaauuuccaauauaauauuagacau

SEQ ID NO: 653428 - RNA, 62 nt, Homo Sapiens
uuuuuguacaaauuuagcuaauagcuacaggcugagagaauuguaacauagcaugacaaauu

SEQ ID NO: 653429 - RNA, 62 nt, Homo Sapiens
uauauggagaaaccccuaggcuuucuuguauaugagagaacuaauuuuucagugauucuucu

SEQ ID NO: 653430 - RNA, 62 nt, Homo Sapiens
cugaagaauggaacagcuguaagauuauguacugagagaaucucucaccuucaugggcccag

SEQ ID NO: 653431 - RNA, 62 nt, Homo Sapiens
aguaauuugauuauuucauuagggugagaauuugagagaaaucacucugagcgagucucuag

SEQ ID NO: 653432 - RNA, 62 nt, Homo Sapiens
uauuucuauuaaugguuuaaauauuacauauuugagagaaaaaaacuuucuuuuacaaaaga

SEQ ID NO: 653433 - RNA, 64 nt, Homo Sapiens; identical to SEQ ID NO: 155522

SEQ ID NO: 653434 - RNA, 64 nt, Homo Sapiens; identical to SEQ ID NO: 155523

SEQ ID NO: 653435 - RNA, 64 nt, Homo Sapiens; identical to SEQ ID NO: 155524

SEQ ID NO: 653436 - RNA, 64 nt, Homo Sapiens; identical to SEQ ID NO: 155525

SEQ ID NO: 653437 - RNA, 64 nt, Homo Sapiens; identical to SEQ ID NO: 155526

SEQ ID NO: 653438 - RNA, 64 nt, Homo Sapiens; identical to SEQ ID NO: 155527

SEQ ID NO: 653439 - RNA, 64 nt, Homo Sapiens; identical to SEQ ID NO: 155528

SEQ ID NO: 653440 - RNA, 64 nt, Homo Sapiens; identical to SEQ ID NO: 155529

SEQ ID NO: 653441 - RNA, 64 nt, Homo Sapiens; identical to SEQ ID NO: 155530

SEQ ID NO: 653442 - RNA, 64 nt, Homo Sapiens; identical to SEQ ID NO: 155531

SEQ ID NO: 653443 - RNA, 64 nt, Homo Sapiens; identical to SEQ ID NO: 155532

SEQ ID NO: 653444 - RNA, 64 nt, Homo Sapiens; identical to SEQ ID NO: 155533

SEQ ID NO: 653445 - RNA, 64 nt, Homo Sapiens; identical to SEQ ID NO: 155534

SEQ ID NO: 653446 - RNA, 64 nt, Homo Sapiens; identical to SEQ ID NO: 155535

SEQ ID NO: 653447 - RNA, 64 nt, Homo Sapiens; identical to SEQ ID NO: 155536

SEQ ID NO: 653448 - RNA, 64 nt, Homo Sapiens; identical to SEQ ID NO: 155537

SEQ ID NO: 653449 - RNA, 64 nt, Homo Sapiens; identical to SEQ ID NO: 155538

SEQ ID NO: 653450 - RNA, 64 nt, Homo Sapiens; identical to SEQ ID NO: 155539

SEQ ID NO: 653451 - RNA, 64 nt, Homo Sapiens; identical to SEQ ID NO: 155540

SEQ ID NO: 653452 - RNA, 64 nt, Homo Sapiens; identical to SEQ ID NO: 155541

SEQ ID NO: 653453 - RNA, 64 nt, Homo Sapiens; identical to SEQ ID NO: 155542

SEQ ID NO: 653454 - RNA, 64 nt, Homo Sapiens; identical to SEQ ID NO: 155543

SEQ ID NO: 653455 - RNA, 64 nt, Homo Sapiens; identical to SEQ ID NO: 155544

SEQ ID NO: 653456 - RNA, 64 nt, Homo Sapiens; identical to SEQ ID NO: 155545

SEQ ID NO: 653457 - RNA, 64 nt, Homo Sapiens; identical to SEQ ID NO: 155546

SEQ ID NO: 653458 - RNA, 59 nt, Homo Sapiens
agcagugugugcacagcuuucuuuugguuggcagagauucaggaucauggaguacugcu

SEQ ID NO: 653459 - RNA, 59 nt, Homo Sapiens
cucucauaauugaagacguguuuguuauuggcagagaaccuuaaaaaaggccuuuaccu

SEQ ID NO: 653460 - RNA, 59 nt, Homo Sapiens
uugcugcccaggcccaggggucuguccuuggcagagaccaagcugguccaucacuggcc

SEQ ID NO: 653461 - RNA, 59 nt, Homo Sapiens
aggagggaggcugucaggaugcaagucagggcagagaggccagcacugacucaggaaca

SEQ ID NO: 653462 - RNA, 59 nt, Homo Sapiens
ggcuggcucaggcaucgucucccgcaaugggcagagagagcagagacagguggaccaac

SEQ ID NO: 653463 - RNA, 59 nt, Homo Sapiens
uacccccagcuucacucagcacuggagcuggcagagacgcaaaacccagucugcccuug

SEQ ID NO: 653464 - RNA, 59 nt, Homo Sapiens
ugcagugggugcggggggauggcacccugggcagagagagcggggcauccuaugaggca

SEQ ID NO: 653465 - RNA, 59 nt, Homo Sapiens
cucuguggcgcggggcauccggcgcccugggcagagagacgaggaccagcugugaggcg

SEQ ID NO: 653466 - RNA, 59 nt, Homo Sapiens
cacuagaagaccuucauccucacggagagggcagagaugauucaugccaaccuugccaa

SEQ ID NO: 653467 - RNA, 59 nt, Homo Sapiens
ucagauggcccuuuuaaggggggacguuaggcagagagcacggaaucuauguagacaau

SEQ ID NO: 653468 - RNA, 59 nt, Homo Sapiens
gacuggacuugggaucagcagagagccagggcagagagauguaugucaccaggauggca

SEQ ID NO: 653469 - RNA, 59 nt, Homo Sapiens
cagggcagagagagacuggacaccaggauggcagagagcugucccccauaucuguaugu

SEQ ID NO: 653470 - RNA, 59 nt, Homo Sapiens
cuuccagaugauaaaccccaugaggcugaggcagagaauaagcuguuguucccugaggc

SEQ ID NO: 653471 - RNA, 59 nt, Homo Sapiens
agacuuaaggaaaccuguaaggcagcacuggcagagagccuccucuuacugagauacag

SEQ ID NO: 653472 - RNA, 59 nt, Homo Sapiens
ugccaaaucuaaauaguuuauauagggauggcagagaguucccaucucaucugucagcc

SEQ ID NO: 653473 - RNA, 59 nt, Homo Sapiens
gauacaaggagagguugucaucuggguagggcagagaggagggcuugcucaucugaaca

SEQ ID NO: 653474 - RNA, 59 nt, Homo Sapiens
aaagaggguugcauuucuugcagccagaaggcagagaaagugaagaccaaguccagaac

SEQ ID NO: 653475 - RNA, 59 nt, Homo Sapiens
ggaagggaacuggagcuggccagggcuggggcagagaaaacaccgccaugagcacaggg

SEQ ID NO: 653476 - RNA, 59 nt, Homo Sapiens
agcucauugggucacuggugcagacccgaggcagagaacccaggagccauggccucaca

SEQ ID NO: 653477 - RNA, 59 nt, Homo Sapiens
gaguuaagucauagguggccccacucagaggcagagacuacuguggcagagaaaguccu

SEQ ID NO: 653478 - RNA, 59 nt, Homo Sapiens
guccuccacucagaggcagaguggacuguggcagagaaauuugucaggaaacucagcca

SEQ ID NO: 653479 - RNA, 59 nt, Homo Sapiens
aggucccucccaaaguuguuuucgugugaggcagagaaagccacacucugaauacauuu

SEQ ID NO: 653480 - RNA, 59 nt, Homo Sapiens
uugggacuucaguucucgugguccauaggggcagagaugucaaagugaagguugccuga

SEQ ID NO: 653481 - RNA, 59 nt, Homo Sapiens
ccuguccugcaggaugcugcauaggaaugggcagagauguccuggaugggaacaugguc

SEQ ID NO: 653482 - RNA, 59 nt, Homo Sapiens
cagugaggggugauucagagguggggaugggcagagagggcuggccacucugccucagg

SEQ ID NO: 653483 - RNA, 59 nt, Homo Sapiens
auuguaaccgaggucagagcucugggguuggcagagaugaguggccauaucugggggua

SEQ ID NO: 653484 - RNA, 59 nt, Homo Sapiens
cucgggcuucauuuucucuauuuagagauggcagagagugagguaguggcgagaaagcu

SEQ ID NO: 653485 - RNA, 59 nt, Homo Sapiens
ccuucugacugucagcaccaccggcacagggcagagaugcggguggcccaaggaccacg

SEQ ID NO: 653486 - RNA, 59 nt, Homo Sapiens
gggacagcaaggucccuuguuauaagaggggcagagaggacaacuccgcuuuggccaac

SEQ ID NO: 653487 - RNA, 59 nt, Homo Sapiens
aacccacagugagaggggagggcuccuggggcagagaaguuccuuagguuuucuuugga

SEQ ID NO: 653488 - RNA, 59 nt, Homo Sapiens
uuauauugggcgauuugggggcucggggaggcagagaaucucuugggagucuugggugg

SEQ ID NO: 653489 - RNA, 59 nt, Homo Sapiens; identical to SEQ ID NO: 52361

SEQ ID NO: 653490 - RNA, 59 nt, Homo Sapiens
gauauggagaugggagggggaggacaaggggcagagaguagggucuagcuggcuaucuc

SEQ ID NO: 653491 - RNA, 59 nt, Homo Sapiens
cagagagggagagagggacaagggagagaggcagagagaagagagggagagaggcagag

SEQ ID NO: 653492 - RNA, 59 nt, Homo Sapiens
gagagaggcagagagacagaagggagagaggcagagaggagagaaggagagaggcagag

SEQ ID NO: 653493 - RNA, 59 nt, Homo Sapiens
gagagaggcagagagggagaaaggagagaggcagagaggaaggaaagagacaggcagag

SEQ ID NO: 653494 - RNA, 59 nt, Homo Sapiens
gagagaggcagagagggagaaaagagacaggcagagaagagggaaagaggcagagaagg

SEQ ID NO: 653495 - RNA, 59 nt, Homo Sapiens
gaaagagacaggcagagaagagggaaagaggcagagaagagaggggaagagaggcagag

SEQ ID NO: 653496 - RNA, 59 nt, Homo Sapiens
gaaagaggcagagaaggaaagggaagagaggcagagaggagagggagagagagacagag

SEQ ID NO: 653497 - RNA, 59 nt, Homo Sapiens
gagagaaacagaggagacaggacagaggaggcagagagggagagauaugaggagagaga

SEQ ID NO: 653498 - RNA, 59 nt, Homo Sapiens
uguugcuaggugaauauauaaggagagacggcagagauauaugucuucauuaugagagc

SEQ ID NO: 653499 - RNA, 59 nt, Homo Sapiens
cggcuaugucuucauuaugaaggggcccgggcagagaaugacccggaggagcaucagca

SEQ ID NO: 653500 - RNA, 59 nt, Homo Sapiens
uuugcugggagcugggagcaggcuugccuggcagagaaccuguucagauacaggccagu

SEQ ID NO: 653501 - RNA, 59 nt, Homo Sapiens
uauuucccuggcaggcagccuugccagaaggcagagaggcaguucugaaucauucucuc

SEQ ID NO: 653502 - RNA, 59 nt, Homo Sapiens
gucgcuugugcgggcgggagggcaaugguggcagagacaugcugguggccccggcggag

SEQ ID NO: 653503 - RNA, 59 nt, Homo Sapiens
uuuugaaagcaaguguagacaccuucgagggcagagaucgggagauuuaagauguuaca

SEQ ID NO: 653504 - RNA, 64 nt, Homo Sapiens; identical to SEQ ID NO: 97332

SEQ ID NO: 653505 - RNA, 64 nt, Homo Sapiens; identical to SEQ ID NO: 97333

SEQ ID NO: 653506 - RNA, 64 nt, Homo Sapiens; identical to SEQ ID NO: 97334

SEQ ID NO: 653507 - RNA, 64 nt, Homo Sapiens; identical to SEQ ID NO: 97335

SEQ ID NO: 653508 - RNA, 64 nt, Homo Sapiens; identical to SEQ ID NO: 97336

SEQ ID NO: 653509 - RNA, 64 nt, Homo Sapiens; identical to SEQ ID NO: 97337

SEQ ID NO: 653510 - RNA, 64 nt, Homo Sapiens; identical to SEQ ID NO: 97338

SEQ ID NO: 653511 - RNA, 64 nt, Homo Sapiens; identical to SEQ ID NO: 97339

SEQ ID NO: 653512 - RNA, 64 nt, Homo Sapiens; identical to SEQ ID NO: 97340

SEQ ID NO: 653513 - RNA, 64 nt, Homo Sapiens; identical to SEQ ID NO: 97341

SEQ ID NO: 653514 - RNA, 64 nt, Homo Sapiens; identical to SEQ ID NO: 97342

SEQ ID NO: 653515 - RNA, 64 nt, Homo Sapiens; identical to SEQ ID NO: 97343

SEQ ID NO: 653516 - RNA, 64 nt, Homo Sapiens; identical to SEQ ID NO: 97344

SEQ ID NO: 653517 - RNA, 64 nt, Homo Sapiens; identical to SEQ ID NO: 97345

SEQ ID NO: 653518 - RNA, 64 nt, Homo Sapiens; identical to SEQ ID NO: 97346

SEQ ID NO: 653519 - RNA, 64 nt, Homo Sapiens; identical to SEQ ID NO: 97347

SEQ ID NO: 653520 - RNA, 64 nt, Homo Sapiens; identical to SEQ ID NO: 97348

SEQ ID NO: 653521 - RNA, 64 nt, Homo Sapiens; identical to SEQ ID NO: 97349

SEQ ID NO: 653522 - RNA, 64 nt, Homo Sapiens; identical to SEQ ID NO: 97350

SEQ ID NO: 653523 - RNA, 64 nt, Homo Sapiens; identical to SEQ ID NO: 97351

SEQ ID NO: 653524 - RNA, 64 nt, Homo Sapiens; identical to SEQ ID NO: 97352

SEQ ID NO: 653525 - RNA, 64 nt, Homo Sapiens; identical to SEQ ID NO: 97353

SEQ ID NO: 653526 - RNA, 64 nt, Homo Sapiens; identical to SEQ ID NO: 97354

SEQ ID NO: 653527 - RNA, 64 nt, Homo Sapiens; identical to SEQ ID NO: 97355

SEQ ID NO: 653528 - RNA, 64 nt, Homo Sapiens; identical to SEQ ID NO: 97356

SEQ ID NO: 653529 - RNA, 64 nt, Homo Sapiens; identical to SEQ ID NO: 97357

SEQ ID NO: 653530 - RNA, 64 nt, Homo Sapiens; identical to SEQ ID NO: 97358

SEQ ID NO: 653531 - RNA, 64 nt, Homo Sapiens; identical to SEQ ID NO: 97359

SEQ ID NO: 653532 - RNA, 64 nt, Homo Sapiens; identical to SEQ ID NO: 97360

SEQ ID NO: 653533 - RNA, 64 nt, Homo Sapiens; identical to SEQ ID NO: 97361

SEQ ID NO: 653534 - RNA, 64 nt, Homo Sapiens; identical to SEQ ID NO: 97362

SEQ ID NO: 653535 - RNA, 64 nt, Homo Sapiens; identical to SEQ ID NO: 97363

SEQ ID NO: 653536 - RNA, 64 nt, Homo Sapiens; identical to SEQ ID NO: 97364

SEQ ID NO: 653537 - RNA, 64 nt, Homo Sapiens; identical to SEQ ID NO: 97365

SEQ ID NO: 653538 - RNA, 64 nt, Homo Sapiens; identical to SEQ ID NO: 97366

SEQ ID NO: 653539 - RNA, 64 nt, Homo Sapiens; identical to SEQ ID NO: 97367

SEQ ID NO: 653540 - RNA, 64 nt, Homo Sapiens; identical to SEQ ID NO: 97368

SEQ ID NO: 653541 - RNA, 64 nt, Homo Sapiens; identical to SEQ ID NO: 97369

SEQ ID NO: 653542 - RNA, 64 nt, Homo Sapiens; identical to SEQ ID NO: 97370

SEQ ID NO: 653543 - RNA, 64 nt, Homo Sapiens; identical to SEQ ID NO: 97371

SEQ ID NO: 653544 - RNA, 64 nt, Homo Sapiens; identical to SEQ ID NO: 97372

SEQ ID NO: 653545 - RNA, 64 nt, Homo Sapiens; identical to SEQ ID NO: 97373

SEQ ID NO: 653546 - RNA, 64 nt, Homo Sapiens; identical to SEQ ID NO: 97374

SEQ ID NO: 653547 - RNA, 64 nt, Homo Sapiens; identical to SEQ ID NO: 97375

SEQ ID NO: 653548 - RNA, 64 nt, Homo Sapiens; identical to SEQ ID NO: 97376

SEQ ID NO: 653549 - RNA, 64 nt, Homo Sapiens; identical to SEQ ID NO: 97377

SEQ ID NO: 653550 - RNA, 64 nt, Homo Sapiens; identical to SEQ ID NO: 97378

SEQ ID NO: 653551 - RNA, 64 nt, Homo Sapiens; identical to SEQ ID NO: 97379

SEQ ID NO: 653552 - RNA, 64 nt, Homo Sapiens; identical to SEQ ID NO: 97380

SEQ ID NO: 653553 - RNA, 64 nt, Homo Sapiens; identical to SEQ ID NO: 97381

SEQ ID NO: 653554 - RNA, 64 nt, Homo Sapiens; identical to SEQ ID NO: 97382

SEQ ID NO: 653555 - RNA, 64 nt, Homo Sapiens; identical to SEQ ID NO: 97383

SEQ ID NO: 653556 - RNA, 64 nt, Homo Sapiens; identical to SEQ ID NO: 97384

SEQ ID NO: 653557 - RNA, 64 nt, Homo Sapiens; identical to SEQ ID NO: 97385

SEQ ID NO: 653558 - RNA, 64 nt, Homo Sapiens; identical to SEQ ID NO: 97386

SEQ ID NO: 653559 - RNA, 64 nt, Homo Sapiens; identical to SEQ ID NO: 97387

SEQ ID NO: 653560 - RNA, 64 nt, Homo Sapiens; identical to SEQ ID NO: 97388

SEQ ID NO: 653561 - RNA, 64 nt, Homo Sapiens; identical to SEQ ID NO: 97389

SEQ ID NO: 653562 - RNA, 64 nt, Homo Sapiens; identical to SEQ ID NO: 97390

SEQ ID NO: 653563 - RNA, 64 nt, Homo Sapiens; identical to SEQ ID NO: 97391

SEQ ID NO: 653564 - RNA, 64 nt, Homo Sapiens; identical to SEQ ID NO: 97392

SEQ ID NO: 653565 - RNA, 64 nt, Homo Sapiens; identical to SEQ ID NO: 97393

SEQ ID NO: 653566 - RNA, 64 nt, Homo Sapiens; identical to SEQ ID NO: 97394

SEQ ID NO: 653567 - RNA, 64 nt, Homo Sapiens
aggaaauauauguguguggugacacagcaccauuccugagaaauccgauuuugugcauaguaau

SEQ ID NO: 653568 - RNA, 64 nt, Homo Sapiens
cuucuuaaacucugaguuuaguugccugacacguccugagaaauggguucugugcguguaccau

SEQ ID NO: 653569 - RNA, 64 nt, Homo Sapiens
uaucuuaauauuucaaguuuacaucaagauaaacccugagaagaacuacggagaaaucaaauaa

SEQ ID NO: 653570 - RNA, 64 nt, Homo Sapiens
agagcugcuguaacagcucuuccuguucugcuccccugagaacagugugguggggagaggcagg

SEQ ID NO: 653571 - RNA, 64 nt, Homo Sapiens
acgugaagguuucaguuaccugcucuagacuuugccugagaacuuguaaauuaaucagugagac

SEQ ID NO: 653572 - RNA, 64 nt, Homo Sapiens
ugcaaagucucugaagagaagagaauggcuuaguccugagaaucuccauuuuugauucauuccu

SEQ ID NO: 653573 - RNA, 64 nt, Homo Sapiens
gcuuaguccugagaaucugcauuuuugauucauuccugagaaugcccagagagccaucucuucc

SEQ ID NO: 653574 - RNA, 64 nt, Homo Sapiens
acuugucauuuuuuuuccugcaucuaugagggguccugagaaagcuggggagcagaauucuugu

SEQ ID NO: 653575 - RNA, 64 nt, Homo Sapiens
uuugaccuugaagggcuucucgacagccacaaguccugagaagcuccaucagcucagcagagcu

SEQ ID NO: 653576 - RNA, 64 nt, Homo Sapiens
gucccuccgucccagggggcugugcuagcacagaccugagaauggggacacaggucauucagag

SEQ ID NO: 653577 - RNA, 64 nt, Homo Sapiens
uguaggaagccauaggagagugaccacgggauucccugagaaacagggccggccccccaacuuc

SEQ ID NO: 653578 - RNA, 64 nt, Homo Sapiens
gcucucucucuguuuuguucuagccaugaauuugccugagaaacuuguaaccuaugugccucaa

SEQ ID NO: 653579 - RNA, 64 nt, Homo Sapiens
aaaucaaccaacauaucugaaaaggaucaugaaaccugagaaaugcuaauggagauuugcuggu

SEQ ID NO: 653580 - RNA, 64 nt, Homo Sapiens
ugggggagaagucccaccaggaugcccccccuccccugagaagcccgccuucucccucguggac

SEQ ID NO: 653581 - RNA, 64 nt, Homo Sapiens
ccagagcagcagagauuugcagcccucgccccucccugagaagaagcuggauuugaaaaucccu

SEQ ID NO: 653582 - RNA, 64 nt, Homo Sapiens
gaccuggaugcggcccucugucuauuuauugcuuccugagaacuagaagagaagacaaccucca

SEQ ID NO: 653583 - RNA, 64 nt, Homo Sapiens
gaagacaaccuccaucuauugagccaguugcugcccugagaagaggccuuguuuuuagugcuga

SEQ ID NO: 653584 - RNA, 64 nt, Homo Sapiens
aguguguucuaaugggauuccagcuuuuucucuuccugagaaacugagaacuuuucuuguaaug

SEQ ID NO: 653585 - RNA, 64 nt, Homo Sapiens
uuucuuguaaugcagcuuuuagaacuccuaaaguccugagaacugcucugaaauaacaguccua

SEQ ID NO: 653586 - RNA, 64 nt, Homo Sapiens
ggggaguggauccaggacaggggagguuguaaccccugagaaaugaacauugguaggagcauuu

SEQ ID NO: 653587 - RNA, 64 nt, Homo Sapiens
aggcagccuacucuuggaaacuggaggaaacugcccugagaauuauuagaaugcuaauaauagu

SEQ ID NO: 653588 - RNA, 64 nt, Homo Sapiens
cugcagacaccagcucuccuuccugccuuuagauccugagaaggagggaaaugaggggugcuga

SEQ ID NO: 653589 - RNA, 64 nt, Homo Sapiens
ccugucuucucugauucuuuucccucaaaauaguccugagaacuaauugucacacuggcucauc

SEQ ID NO: 653590 - RNA, 64 nt, Homo Sapiens
auagcgauuuugcuuugccaccaaaaggcuuuucccugagaacagugaaggauguaugucauuu

SEQ ID NO: 653591 - RNA, 64 nt, Homo Sapiens
aggccaaugcugaagacacagcuccgcuugggagccugagaacccaggcuucccaggccagagu

SEQ ID NO: 653592 - RNA, 64 nt, Homo Sapiens
auggcguccugcccuugcuccagccugacaacagccugagaaauccccccguaacuuauuauca

SEQ ID NO: 653593 - RNA, 64 nt, Homo Sapiens
gugucccccgaacgcucugcaccuucugacgcagccugagaaugaccugcccuggccccagccc

SEQ ID NO: 653594 - RNA, 64 nt, Homo Sapiens
aacugggccuccgcuucccagcaacgcagccaggccugagaauucugugcgcccggcgggcuuu

SEQ ID NO: 653595 - RNA, 64 nt, Homo Sapiens
auucuguuccggugccuuuccuauccaggcaccaccugagaaaguugucauuugaggucgcacu

SEQ ID NO: 653596 - RNA, 64 nt, Homo Sapiens
ugcuucccugcaguuuagaucccgggauggcauuccugagaaagcaacccgaaccagcuguccu

SEQ ID NO: 653597 - RNA, 64 nt, Homo Sapiens
cagguggggacagaaggaagaagccaggagccucccugagaaggugucaccuuaucuguccucc

SEQ ID NO: 653598 - RNA, 64 nt, Homo Sapiens
accagucaccuuucacuucuuggccaaauuuuauccugagaaugcugaagaggagcugguucag

SEQ ID NO: 653599 - RNA, 64 nt, Homo Sapiens
uggaguggaugcccuggggcuucacauuuaugacccugagaacagacugacccccaagaucucc

SEQ ID NO: 653600 - RNA, 64 nt, Homo Sapiens
ugggaagucauuguagggagugagacacugaagcccugagaagccagugccaucauccccaccc

SEQ ID NO: 653601 - RNA, 64 nt, Homo Sapiens
agaagagccaaggaauaaacaugcaaugaacccaaaaggucacucugagaggagugauaccaau

SEQ ID NO: 653602 - RNA, 64 nt, Homo Sapiens
cuaagucacucugagaggagugauaccaaugaaaaaaggucaguugauuccagugcuaaaaggg

SEQ ID NO: 653603 - RNA, 64 nt, Homo Sapiens
cccgggaccucacagucccuucuuagaagccugcaaaggucagcugugcccucugggauucuga

SEQ ID NO: 653604 - RNA, 64 nt, Homo Sapiens
cagaggcucuugaggcuccgaggcccuggggaucaaaggucaaugaguuagguggggagaaaga

SEQ ID NO: 653605 - RNA, 64 nt, Homo Sapiens
aaauucaguccucaguuaacggaucauguuugcaaaaggucacugugaggcugcauauuucaga

SEQ ID NO: 653606 - RNA, 64 nt, Homo Sapiens
uauuuuaagcaucaaaugcaaucaucuaaaauauaaaggucaaucauuuauaauagaaacaccu

SEQ ID NO: 653607 - RNA, 64 nt, Homo Sapiens
acauaguaaaguuugcuuucauaacugcagcaaaaaaggucaacuugccaagucacugcugcca

SEQ ID NO: 653608 - RNA, 64 nt, Homo Sapiens
gaaaugcaugggaauauuuuagaaugauacaaagaaaggucagagauugcugggagcaaaaacu

SEQ ID NO: 653609 - RNA, 64 nt, Homo Sapiens
cuugggguuggccguuccucgcuccuauguggcaaaaggucagcuaccauucuccuugucccuu

SEQ ID NO: 653610 - RNA, 64 nt, Homo Sapiens
aaagggagaaaugacauguuguaauugaaugaagaaaggucacuuaacauucuugguaaaccag

SEQ ID NO: 653611 - RNA, 64 nt, Homo Sapiens
aggcuuauauuuaauuaaaguaaaauugugaagcaaaggucaauaaugaaauuuucauuaauau

SEQ ID NO: 653612 - RNA, 64 nt, Homo Sapiens; identical to SEQ ID NO: 147964

SEQ ID NO: 653613 - RNA, 64 nt, Homo Sapiens; identical to SEQ ID NO: 147965

SEQ ID NO: 653614 - RNA, 64 nt, Homo Sapiens; identical to SEQ ID NO: 147966

SEQ ID NO: 653615 - RNA, 64 nt, Homo Sapiens; identical to SEQ ID NO: 147967

SEQ ID NO: 653616 - RNA, 64 nt, Homo Sapiens; identical to SEQ ID NO: 147968

SEQ ID NO: 653617 - RNA, 64 nt, Homo Sapiens; identical to SEQ ID NO: 147969

SEQ ID NO: 653618 - RNA, 64 nt, Homo Sapiens; identical to SEQ ID NO: 147970

SEQ ID NO: 653619 - RNA, 64 nt, Homo Sapiens; identical to SEQ ID NO: 147971

SEQ ID NO: 653620 - RNA, 64 nt, Homo Sapiens; identical to SEQ ID NO: 147972

SEQ ID NO: 653621 - RNA, 64 nt, Homo Sapiens
uuaguaacagucaccaaaauguucuaagcaacuacuuuccuagaguaucauuugccaaccaaaa

SEQ ID NO: 653622 - RNA, 64 nt, Homo Sapiens
auuuuaaaaaccuguuaaucuuuuuauuuguauacuuuccuaaaaauauucauauggggaaucc

SEQ ID NO: 653623 - RNA, 64 nt, Homo Sapiens
ccuucccuuuaauccugccacugucauaugcuaccuuuccuaucucuucccucaucaucuuguu

SEQ ID NO: 653624 - RNA, 64 nt, Homo Sapiens
aaggaacuuaaagaacaaaaaucaucugguaauucuuuccuagaaggaucacagccccugggau

SEQ ID NO: 653625 - RNA, 64 nt, Homo Sapiens
aaaaaguuuuugaaaaacauugccucugguauagcuuuccuaauuaaucauuguauagugauua

SEQ ID NO: 653626 - RNA, 64 nt, Homo Sapiens
cugaacaaaacuaaaaccgcuccauccucacgaucuuuccuaccuuuacacuugucccaguaac

SEQ ID NO: 653627 - RNA, 64 nt, Homo Sapiens
aaagaaaacauaugaugcuuacaaaagggggggucuuuccuaaaauuagggguaugucuauaca

SEQ ID NO: 653628 - RNA, 64 nt, Homo Sapiens
uaaguauaauaaugugggaauggacacagcaaggcuuuccuacauucuaucuuuguguuaacag

SEQ ID NO: 653629 - RNA, 64 nt, Homo Sapiens
cugacauccagaaacaauggugucaccguuuacucuuuccuacccacugcaaggagaccucuac

SEQ ID NO: 653630 - RNA, 52 nt, Homo Sapiens
aggagagauggcuugucccccccuuuccuaucagacucuacucaaccccuga

SEQ ID NO: 653631 - RNA, 64 nt, Homo Sapiens
aaaagacuccaggccgacucaugauacucugcaucuuuccuacaugagaagcuucucugccaca

SEQ ID NO: 653632 - RNA, 64 nt, Homo Sapiens
uuaacuuuuaaacugaauauuaaaauguaucugucuuuccuaguauguuuuuaucuucucaugu

SEQ ID NO: 653633 - RNA, 64 nt, Homo Sapiens
ccuauuaaagaaccucguccuuauuuauuuuucucuuuccuacucucuccugaauuuaugaggu

SEQ ID NO: 653634 - RNA, 64 nt, Homo Sapiens
gagcaaccagcucugggcucuggccccacucugccuuuccuauugaaggcagaaagugggaucc

SEQ ID NO: 653635 - RNA, 64 nt, Homo Sapiens
cacacaguggagagguuaaucugaggguuuaggaggucugaacaaaggccuugcccuaagcuac

SEQ ID NO: 653636 - RNA, 64 nt, Homo Sapiens
uuucaaagggagaccuauagacuucuuuuagcaaggucugaaagugcccuuauuccuccacccc

SEQ ID NO: 653637 - RNA, 64 nt, Homo Sapiens
ucuccugcugauggaaaugggaaugaaguuaaguggucugaaaaacuugaaucguucacauuuc

SEQ ID NO: 653638 - RNA, 64 nt, Homo Sapiens
augcacucuucccuugccggcuccugguaccauuggucugaacagcuguaguuggucuacuccu

SEQ ID NO: 653639 - RNA, 64 nt, Homo Sapiens
aaagcaucuuuaaucaacacugaaaagucccaagggucugaauguucugaagaggcgaauuugu

SEQ ID NO: 653640 - RNA, 64 nt, Homo Sapiens
gagaaccgagcuuggaguucgggcagcuacacguggucugaaucaggcucacacgucaauucca

SEQ ID NO: 653641 - RNA, 64 nt, Homo Sapiens
gaaguuccagagcaaggagccauguuccucuaagggaauucaggaauucagacgugcuaguccc

SEQ ID NO: 653642 - RNA, 64 nt, Homo Sapiens
agagcaaggagccauguuccucuaagggaauucaggaauucagacgugcuagucccacaccagu

SEQ ID NO: 653643 - RNA, 64 nt, Homo Sapiens
accucaugggacuuuuaaaagaagggcuauuuaaggaauucacuugguaguacuuugcuuuagc

SEQ ID NO: 653644 - RNA, 64 nt, Homo Sapiens
uauguuuuaugucuuugagagagauacaggucuuggaauucacuuuuuaaauguuacguuccaa

SEQ ID NO: 653645 - RNA, 64 nt, Homo Sapiens
ggcuuuaguaauuuguauguaaugucaaauaaaaggaauucaaaucugaguaaauaacagccuc

SEQ ID NO: 653646 - RNA, 64 nt, Homo Sapiens
ugauugaagaauguaucacucuuauucaagcaaaggaauucagacuuaaaugccuaccucugug

SEQ ID NO: 653647 - RNA, 64 nt, Homo Sapiens
aagaaguuaccugcaauuauucuuaacacuacauggaauucacuggguaauugugggucauuua

SEQ ID NO: 653648 - RNA, 64 nt, Homo Sapiens
cuuucuaaaaagucuugagaucccaccauucugaggaauucaauaugaucacuuuuuccuucuu

SEQ ID NO: 653649 - RNA, 64 nt, Homo Sapiens
uuugacaaacaagcauccuuuacuaacaagagcaggaauucagaggcacaagaaaaagcauugg

SEQ ID NO: 653650 - RNA, 64 nt, Homo Sapiens
guguuuucauuugaugucgugacuuucuaacauaggaauucacuuguggcagacauugccgagu

SEQ ID NO: 653651 - RNA, 64 nt, Homo Sapiens
guguuuucauuugaugucguugcuguguaacauaggaauucacucauaacagugcagagcacaa

SEQ ID NO: 653652 - RNA, 64 nt, Homo Sapiens
ucuuaagguguguuuucuagaaaaguucccuaauggaauucaugaguuugggggucucagucac

SEQ ID NO: 653653 - RNA, 64 nt, Homo Sapiens
gguggccauuuccugacaucugcauguaccucguggaauucagccagcuucauguugcaaauca

SEQ ID NO: 653654 - RNA, 64 nt, Homo Sapiens
accagccuggccaacauggcacugccugaggucaggaauucaaggagaggccugaggucggcgg

SEQ ID NO: 653655 - RNA, 64 nt, Homo Sapiens
acagaggcaaaugacuccugaacuuuguagucuuggaauucauggcuaucccagcaucucuuaa

SEQ ID NO: 653656 - RNA, 64 nt, Homo Sapiens
gauucuauaucaugaccaaguggaauuuaucccaggaauucaagguugguucaacaucuaaaaa

SEQ ID NO: 653657 - RNA, 64 nt, Homo Sapiens
uguacuugaaguucuagccacagcaguuagguuaggaauucaagguuuguucaacaucuaaaaa

SEQ ID NO: 653658 - RNA, 64 nt, Homo Sapiens
agcagaaggucaggauagcacuugaggagcaugaggaauucaggagcgagcaauugcuaguugu

SEQ ID NO: 653659 - RNA, 64 nt, Homo Sapiens
gaugaaaagaaagaauaauuggagauuguuuucaggaauucaggauccauaauaaaaaaaaaug

SEQ ID NO: 653660 - RNA, 64 nt, Homo Sapiens
ggaauguagcuuaaugauuuucuguuucccauaccauuucuaaucuuuuguguaauuuucucuu

SEQ ID NO: 653661 - RNA, 64 nt, Homo Sapiens
auugaaauaguauugauuuagaaaaaguauauugcauuucuaaaaaacaucuaccaagguuacu

SEQ ID NO: 653662 - RNA, 64 nt, Homo Sapiens
gcauuagacuaacagauuccucgggcuugcuaagcauuucuaaagacuaauuaguuuaauucuu

SEQ ID NO: 653663 - RNA, 64 nt, Homo Sapiens
acacgcccuauuuaaaaaagcuuacguuaaacuucauuucuaguuuaacauuguaaacaacaga

SEQ ID NO: 653664 - RNA, 64 nt, Homo Sapiens
uccuuuuuugagaacugccaauauacguaucggucauuucuauuuuauuucuagugaaacuuuu

SEQ ID NO: 653665 - RNA, 64 nt, Homo Sapiens
cugaaaugacucacugucguuccaauuauuccaucauuucuauuuuuaagccuucaacuugauu

SEQ ID NO: 653666 - RNA, 64 nt, Homo Sapiens
cucccauggcuuaaugcuucaguuucucagcucccauuucuacuagcucccauuucuacucuua

SEQ ID NO: 653667 - RNA, 64 nt, Homo Sapiens
cuuaaguuucucagcucccaaucuucucagcucccauuucuacuugaggauaggaguucacuuc

SEQ ID NO: 653668 - RNA, 64 nt, Homo Sapiens
uauagaauaaauguuucauuaauucugaaaaauacauuucuauucaagaaaccaacccaaagaa

SEQ ID NO: 653669 - RNA, 64 nt, Homo Sapiens
auauuuuaaacaagugaaguauauacaauuuuuacauuucuaauagaaauauaaugugagcccc

SEQ ID NO: 653670 - RNA, 64 nt, Homo Sapiens
cuuagaaaugguauagucaaagacauuuuauccacauuucuaauaguggacuugauuaaguaga

SEQ ID NO: 653671 - RNA, 64 nt, Homo Sapiens
gaaacaaaauuaauaguucauaugucacucauagcauuucuauauuugaaaguagcccaauaua

SEQ ID NO: 653672 - RNA, 64 nt, Homo Sapiens
ucaucuuuugagucauauguaggugacaccacugcauuucuauuauuauuuuaaaagguauuuu

SEQ ID NO: 653673 - RNA, 64 nt, Homo Sapiens
uagauuuuuugacauuaaugagccccuuuccaaccauuucuaagaggcaugagccaccacaccc

SEQ ID NO: 653674 - RNA, 54 nt, Homo Sapiens
cuggcaaggaacauaguugaaugacauuucuaguaaucucuaauuccagugucu

SEQ ID NO: 653675 - RNA, 64 nt, Homo Sapiens
uauaauaaguauaugaguauaauuauaauucacacauuucuaagucaugaaugcuuuuaaaaaa

SEQ ID NO: 653676 - RNA, 64 nt, Homo Sapiens
gaaaccuccugcccucccugcacgucugugucuucauuucuaaaaugggggugaugcuuucaua

SEQ ID NO: 653677 - RNA, 64 nt, Homo Sapiens
gguugaccaugccuggugccacagccaugguuuccauuucuagaugaaaggauggccuaggaca

SEQ ID NO: 653678 - RNA, 64 nt, Homo Sapiens
uagugugcaacucuaaugucuccauguauucuaacauuucuauguccaccuguucauuuguuca

SEQ ID NO: 653679 - RNA, 64 nt, Homo Sapiens
aguucaaauauacuuguuaagauuaaaacacuuccauuucuaaauaugauuacauaucaaaauu

SEQ ID NO: 653680 - RNA, 64 nt, Homo Sapiens
aaagaaauggucauuuuacuuccacuguuuugaucauuucuauagccuccugaauuuuagaugu

SEQ ID NO: 653681 - RNA, 64 nt, Homo Sapiens
aaaaugcccuuuuggggccuguguaaguuauuaacauuucuauguguuauugacuggaguuaau

SEQ ID NO: 653682 - RNA, 64 nt, Homo Sapiens
acaguuuuuuccuuauggacuuguuuguccuaaccauuucuacuuccccccuguuucuacuuua

SEQ ID NO: 653683 - RNA, 64 nt, Homo Sapiens
ccaucccucacguuauuggaagucggguagauagcauuucuaucugcuuuguuuucuccucaga

SEQ ID NO: 653684 - RNA, 64 nt, Homo Sapiens
uguaauuucugagccauuguggagggaggagugucauuucuaugucagagcucuuggcgagggu

SEQ ID NO: 653685 - RNA, 64 nt, Homo Sapiens
uuggaauugugagccucuauguuguuguugaucccauuucuaacuuugggaugauuugauuucu

SEQ ID NO: 653686 - RNA, 64 nt, Homo Sapiens
acgcacucuggagccauguagaaggaggcagauucauuucuaagugaauguggaguguggagag

SEQ ID NO: 653687 - RNA, 64 nt, Homo Sapiens
caaucuuaaggaugugaauaaaaccaccaaauggcauuucuagacaguuugaccuguuauacag

SEQ ID NO: 653688 - RNA, 64 nt, Homo Sapiens
ccauuuucuaguaaagccagaaauucuugcuucccauuucuagaauaguuucuagaacagugcu

SEQ ID NO: 653689 - RNA, 64 nt, Homo Sapiens
gcuucgcuguaaguggcuagaaaccacauguuuucauuucuaguggggaaaaaaagagcacuau

SEQ ID NO: 653690 - RNA, 64 nt, Homo Sapiens
agggauauauaccuucagaauuuuuuaaaaaggacauuucuaucacgccuggccaauuauguaa

SEQ ID NO: 653691 - RNA, 64 nt, Homo Sapiens
ccuccuauauuaaggucugucggccaauuuuucucauuucuaugcaggugugagccaccacguc

SEQ ID NO: 653692 - RNA, 64 nt, Homo Sapiens
auuuucaucacugaaagucagaggccaaggaaaucauuucuacuucuuuaaaaacuccuucuaa

SEQ ID NO: 653693 - RNA, 64 nt, Homo Sapiens
cauuuuugaauagggucaaggagcccaagcaaaucauuucuacuuuuuccuuuaagcauaauaa

SEQ ID NO: 653694 - RNA, 64 nt, Homo Sapiens
aaaauaaauccaguauuuguaaagugaauaacuucauuucuaauuguuuaauuuuuaaaauucu

SEQ ID NO: 653695 - RNA, 64 nt, Homo Sapiens
gaaauaugaccuuuucugaaaauacauacuuuuacauuucuacuuuauugagaccuauuagaug

SEQ ID NO: 653696 - RNA, 64 nt, Homo Sapiens
uuuuccuugcuuuuuauaugcagaauaucaaagucauuucuaauuuaguugucaaaaacauaua

SEQ ID NO: 653697 - RNA, 64 nt, Homo Sapiens
aagcauggucaugcugguuuauagauuuuuuacccauuucuacucuuuuucucuauugguggca

SEQ ID NO: 653698 - RNA, 64 nt, Homo Sapiens
ugcugugcauuuuaaccaauauuuugaaauggaucauuucuacugagaacgcuagauauuaaga

SEQ ID NO: 653699 - RNA, 64 nt, Homo Sapiens
ucagagggccaaagugaaucaaauacuaagauggcauuucuaucaagagguauguagucacagu

SEQ ID NO: 653700 - RNA, 64 nt, Homo Sapiens
cuauuauuccuaaccuauuauuuguaauguaguacauuucuaauagauaguuauaggccacugu

SEQ ID NO: 653701 - RNA, 64 nt, Homo Sapiens
aagcagugagguuguuugacuuuccaguguuuagcauuucuaguaaauguauaaaauuccauuu

SEQ ID NO: 653702 - RNA, 64 nt, Homo Sapiens
uuuugugagaaugugucuacguuaagugccaggacauuucuagcauuauuaaagugagcuaugu

SEQ ID NO: 653703 - RNA, 64 nt, Homo Sapiens
gggucaccaagaagguuuacuuaauuaaauaccgcauuucuaagagaagauacuuuguguaaga

SEQ ID NO: 653704 - RNA, 64 nt, Homo Sapiens
ucauacugaacaaaugucauucuaguuuagauagcauuucuaagauaacugauacuaauacuug

SEQ ID NO: 653705 - RNA, 64 nt, Homo Sapiens
uaggaaguaaaauuugcuucuucugccaccuacacauuucuauucuccugcugaaaaauacgcu

SEQ ID NO: 653706 - RNA, 64 nt, Homo Sapiens
aacugcucugacauuguaaagaauaaaauacuaacauuucuaacauccuucacagcaagaaacc

SEQ ID NO: 653707 - RNA, 64 nt, Homo Sapiens
aaaaauaccacuaucagaguagaaacaagguagacauuucuaaaacauaugugcuucauuauga

SEQ ID NO: 653708 - RNA, 64 nt, Homo Sapiens
gagucaaaauaccauuuacaaagaaaaucaaaagcauuucuauauuuugucuuuuuuuaguuca

SEQ ID NO: 653709 - RNA, 64 nt, Homo Sapiens
aaaauaauggggucuugggcauuucacaucacuccauuucuacugagacuuucagaaucacaca

SEQ ID NO: 653710 - RNA, 64 nt, Homo Sapiens
uccuaaguauuguguauguuuaaaacgacagaaccauuucuacuucauuuggaaaaagauucag

SEQ ID NO: 653711 - RNA, 64 nt, Homo Sapiens
cugcucuuagcauucuaccaccaugugucucacccauuucuaauuucauugucuuucuucccac

SEQ ID NO: 653712 - RNA, 64 nt, Homo Sapiens
ccauuucuaauuucauugucuuucuucccacgcucauuucuaucauucucccccaugacccguc

SEQ ID NO: 653713 - RNA, 64 nt, Homo Sapiens
aagguuuuauauagagaaacuugaguaauuuuuacauuucuaagacauuaaaucccauuuaaau

SEQ ID NO: 653714 - RNA, 64 nt, Homo Sapiens
uuuuccauuuccauuuaaacauuuuuagccacuucauuucuauuuauugaacaggucaaauuug

SEQ ID NO: 653715 - RNA, 64 nt, Homo Sapiens
cgaagaugauuggaaaaaagucugaaagauacaucauuucuauauuccuugcuuaauuuuuaua

SEQ ID NO: 653716 - RNA, 64 nt, Homo Sapiens
aggaaauucuaaaggcuuaacaugaaacugucugcauuucuaccuguuagacaaugguugcucu

SEQ ID NO: 653717 - RNA, 64 nt, Homo Sapiens
cacugucugcgugcaguuauuacaugcauuugugcauuucuacuacaauggcaucuuuaugucu

SEQ ID NO: 653718 - RNA, 64 nt, Homo Sapiens
gcuguauguacaauccugggcauugacucugugacauuucuagcauauccaaggcaccaccagu

SEQ ID NO: 653719 - RNA, 64 nt, Homo Sapiens
guugcaaauaacucuaaaacuuuucaaguuuacucauuucuauggcccuuucuuaugccguggg

SEQ ID NO: 653720 - RNA, 64 nt, Homo Sapiens
gaauuacaacagaacucaguuguauggugucgcucauuucuauuaaugcuaaauuuuguuuuca

SEQ ID NO: 653721 - RNA, 64 nt, Homo Sapiens; identical to SEQ ID NO: 427206

SEQ ID NO: 653722 - RNA, 64 nt, Homo Sapiens; identical to SEQ ID NO: 427207

SEQ ID NO: 653723 - RNA, 64 nt, Homo Sapiens; identical to SEQ ID NO: 76468

SEQ ID NO: 653724 - RNA, 64 nt, Homo Sapiens; identical to SEQ ID NO: 76469

SEQ ID NO: 653725 - RNA, 64 nt, Homo Sapiens; identical to SEQ ID NO: 76470

SEQ ID NO: 653726 - RNA, 64 nt, Homo Sapiens; identical to SEQ ID NO: 76471

SEQ ID NO: 653727 - RNA, 64 nt, Homo Sapiens; identical to SEQ ID NO: 76472

SEQ ID NO: 653728 - RNA, 64 nt, Homo Sapiens; identical to SEQ ID NO: 76473

SEQ ID NO: 653729 - RNA, 64 nt, Homo Sapiens; identical to SEQ ID NO: 653621

SEQ ID NO: 653730 - RNA, 64 nt, Homo Sapiens; identical to SEQ ID NO: 653622

SEQ ID NO: 653731 - RNA, 64 nt, Homo Sapiens; identical to SEQ ID NO: 653623

SEQ ID NO: 653732 - RNA, 64 nt, Homo Sapiens; identical to SEQ ID NO: 653624

SEQ ID NO: 653733 - RNA, 64 nt, Homo Sapiens; identical to SEQ ID NO: 653625

SEQ ID NO: 653734 - RNA, 64 nt, Homo Sapiens; identical to SEQ ID NO: 653626

SEQ ID NO: 653735 - RNA, 64 nt, Homo Sapiens; identical to SEQ ID NO: 653627

SEQ ID NO: 653736 - RNA, 64 nt, Homo Sapiens; identical to SEQ ID NO: 653628

SEQ ID NO: 653737 - RNA, 64 nt, Homo Sapiens; identical to SEQ ID NO: 653629

SEQ ID NO: 653738 - RNA, 52 nt, Homo Sapiens; identical to SEQ ID NO: 653630

SEQ ID NO: 653739 - RNA, 64 nt, Homo Sapiens; identical to SEQ ID NO: 653631

SEQ ID NO: 653740 - RNA, 64 nt, Homo Sapiens; identical to SEQ ID NO: 653632

SEQ ID NO: 653741 - RNA, 64 nt, Homo Sapiens; identical to SEQ ID NO: 653633

SEQ ID NO: 653742 - RNA, 64 nt, Homo Sapiens; identical to SEQ ID NO: 653634

SEQ ID NO: 653743 - RNA, 64 nt, Homo Sapiens; identical to SEQ ID NO: 189185

SEQ ID NO: 653744 - RNA, 64 nt, Homo Sapiens; identical to SEQ ID NO: 189186

SEQ ID NO: 653745 - RNA, 64 nt, Homo Sapiens; identical to SEQ ID NO: 189187

SEQ ID NO: 653746 - RNA, 64 nt, Homo Sapiens; identical to SEQ ID NO: 189188

SEQ ID NO: 653747 - RNA, 64 nt, Homo Sapiens; identical to SEQ ID NO: 189189

SEQ ID NO: 653748 - RNA, 64 nt, Homo Sapiens; identical to SEQ ID NO: 189190

SEQ ID NO: 653749 - RNA, 64 nt, Homo Sapiens; identical to SEQ ID NO: 189191

SEQ ID NO: 653750 - RNA, 64 nt, Homo Sapiens; identical to SEQ ID NO: 189192

SEQ ID NO: 653751 - RNA, 64 nt, Homo Sapiens; identical to SEQ ID NO: 189193

SEQ ID NO: 653752 - RNA, 64 nt, Homo Sapiens; identical to SEQ ID NO: 189194

SEQ ID NO: 653753 - RNA, 64 nt, Homo Sapiens; identical to SEQ ID NO: 189195

SEQ ID NO: 653754 - RNA, 64 nt, Homo Sapiens; identical to SEQ ID NO: 189196

SEQ ID NO: 653755 - RNA, 64 nt, Homo Sapiens; identical to SEQ ID NO: 189197

SEQ ID NO: 653756 - RNA, 64 nt, Homo Sapiens; identical to SEQ ID NO: 189198

SEQ ID NO: 653757 - RNA, 64 nt, Homo Sapiens; identical to SEQ ID NO: 189199

SEQ ID NO: 653758 - RNA, 64 nt, Homo Sapiens; identical to SEQ ID NO: 189200

SEQ ID NO: 653759 - RNA, 64 nt, Homo Sapiens; identical to SEQ ID NO: 189201

SEQ ID NO: 653760 - RNA, 64 nt, Homo Sapiens; identical to SEQ ID NO: 189202

SEQ ID NO: 653761 - RNA, 64 nt, Homo Sapiens; identical to SEQ ID NO: 189203

SEQ ID NO: 653762 - RNA, 64 nt, Homo Sapiens; identical to SEQ ID NO: 189204

SEQ ID NO: 653763 - RNA, 64 nt, Homo Sapiens; identical to SEQ ID NO: 189205

SEQ ID NO: 653764 - RNA, 64 nt, Homo Sapiens; identical to SEQ ID NO: 189206

SEQ ID NO: 653765 - RNA, 64 nt, Homo Sapiens; identical to SEQ ID NO: 189207

SEQ ID NO: 653766 - RNA, 64 nt, Homo Sapiens; identical to SEQ ID NO: 189208

SEQ ID NO: 653767 - RNA, 64 nt, Homo Sapiens; identical to SEQ ID NO: 189209

SEQ ID NO: 653768 - RNA, 64 nt, Homo Sapiens; identical to SEQ ID NO: 189210

SEQ ID NO: 653769 - RNA, 64 nt, Homo Sapiens; identical to SEQ ID NO: 189211

SEQ ID NO: 653770 - RNA, 64 nt, Homo Sapiens; identical to SEQ ID NO: 189212

SEQ ID NO: 653771 - RNA, 64 nt, Homo Sapiens; identical to SEQ ID NO: 189213

SEQ ID NO: 653772 - RNA, 50 nt, Homo Sapiens; identical to SEQ ID NO: 189214

SEQ ID NO: 653773 - RNA, 64 nt, Homo Sapiens; identical to SEQ ID NO: 189215

SEQ ID NO: 653774 - RNA, 64 nt, Homo Sapiens; identical to SEQ ID NO: 189216

SEQ ID NO: 653775 - RNA, 64 nt, Homo Sapiens; identical to SEQ ID NO: 189217

SEQ ID NO: 653776 - RNA, 64 nt, Homo Sapiens; identical to SEQ ID NO: 189218

SEQ ID NO: 653777 - RNA, 64 nt, Homo Sapiens; identical to SEQ ID NO: 189219

SEQ ID NO: 653778 - RNA, 64 nt, Homo Sapiens; identical to SEQ ID NO: 189220

SEQ ID NO: 653779 - RNA, 64 nt, Homo Sapiens; identical to SEQ ID NO: 189221

SEQ ID NO: 653780 - RNA, 64 nt, Homo Sapiens; identical to SEQ ID NO: 189222

SEQ ID NO: 653781 - RNA, 64 nt, Homo Sapiens; identical to SEQ ID NO: 189223

SEQ ID NO: 653782 - RNA, 64 nt, Homo Sapiens; identical to SEQ ID NO: 189224

SEQ ID NO: 653783 - RNA, 64 nt, Homo Sapiens; identical to SEQ ID NO: 189225

SEQ ID NO: 653784 - RNA, 64 nt, Homo Sapiens; identical to SEQ ID NO: 189226

SEQ ID NO: 653785 - RNA, 64 nt, Homo Sapiens; identical to SEQ ID NO: 189227

SEQ ID NO: 653786 - RNA, 64 nt, Homo Sapiens; identical to SEQ ID NO: 189228

SEQ ID NO: 653787 - RNA, 64 nt, Homo Sapiens; identical to SEQ ID NO: 189229

SEQ ID NO: 653788 - RNA, 64 nt, Homo Sapiens; identical to SEQ ID NO: 189230

SEQ ID NO: 653789 - RNA, 64 nt, Homo Sapiens; identical to SEQ ID NO: 189231

SEQ ID NO: 653790 - RNA, 64 nt, Homo Sapiens; identical to SEQ ID NO: 189232

SEQ ID NO: 653791 - RNA, 64 nt, Homo Sapiens; identical to SEQ ID NO: 189233

SEQ ID NO: 653792 - RNA, 64 nt, Homo Sapiens; identical to SEQ ID NO: 189234

SEQ ID NO: 653793 - RNA, 64 nt, Homo Sapiens; identical to SEQ ID NO: 189235

SEQ ID NO: 653794 - RNA, 64 nt, Homo Sapiens; identical to SEQ ID NO: 189236

SEQ ID NO: 653795 - RNA, 64 nt, Homo Sapiens; identical to SEQ ID NO: 189237

SEQ ID NO: 653796 - RNA, 64 nt, Homo Sapiens; identical to SEQ ID NO: 189238

SEQ ID NO: 653797 - RNA, 64 nt, Homo Sapiens; identical to SEQ ID NO: 189239

SEQ ID NO: 653798 - RNA, 64 nt, Homo Sapiens; identical to SEQ ID NO: 189240

SEQ ID NO: 653799 - RNA, 64 nt, Homo Sapiens; identical to SEQ ID NO: 189241

SEQ ID NO: 653800 - RNA, 64 nt, Homo Sapiens; identical to SEQ ID NO: 189242

SEQ ID NO: 653801 - RNA, 64 nt, Homo Sapiens; identical to SEQ ID NO: 189243

SEQ ID NO: 653802 - RNA, 64 nt, Homo Sapiens; identical to SEQ ID NO: 189244

SEQ ID NO: 653803 - RNA, 64 nt, Homo Sapiens; identical to SEQ ID NO: 189245

SEQ ID NO: 653804 - RNA, 64 nt, Homo Sapiens; identical to SEQ ID NO: 189246

SEQ ID NO: 653805 - RNA, 64 nt, Homo Sapiens; identical to SEQ ID NO: 189247

SEQ ID NO: 653806 - RNA, 64 nt, Homo Sapiens; identical to SEQ ID NO: 189248

SEQ ID NO: 653807 - RNA, 64 nt, Homo Sapiens; identical to SEQ ID NO: 189249

SEQ ID NO: 653808 - RNA, 64 nt, Homo Sapiens; identical to SEQ ID NO: 189250

SEQ ID NO: 653809 - RNA, 64 nt, Homo Sapiens; identical to SEQ ID NO: 189251

SEQ ID NO: 653810 - RNA, 64 nt, Homo Sapiens; identical to SEQ ID NO: 189252

SEQ ID NO: 653811 - RNA, 64 nt, Homo Sapiens; identical to SEQ ID NO: 189253

SEQ ID NO: 653812 - RNA, 64 nt, Homo Sapiens; identical to SEQ ID NO: 189254

SEQ ID NO: 653813 - RNA, 64 nt, Homo Sapiens; identical to SEQ ID NO: 189255

SEQ ID NO: 653814 - RNA, 64 nt, Homo Sapiens; identical to SEQ ID NO: 189256

SEQ ID NO: 653815 - RNA, 64 nt, Homo Sapiens; identical to SEQ ID NO: 189257

SEQ ID NO: 653816 - RNA, 64 nt, Homo Sapiens; identical to SEQ ID NO: 189258

SEQ ID NO: 653817 - RNA, 60 nt, Homo Sapiens
acacucucccuuuucaguaagcgcaaagccucagaagaccuggaacaagauucugccauc

SEQ ID NO: 653818 - RNA, 64 nt, Homo Sapiens
aaguguugacaagaugccuauucguagaguucccucagaagagccaugguguuuaugaagagaa

SEQ ID NO: 653819 - RNA, 64 nt, Homo Sapiens
acauaagauuccucuuaaagccauauacaugauuucagaagauggaagacacuaauauuauuac

SEQ ID NO: 653820 - RNA, 64 nt, Homo Sapiens
agacacuaauauuauuacccaaagaaucacaucuucagaagagagggaagagaacauggcauua

SEQ ID NO: 653821 - RNA, 64 nt, Homo Sapiens
aucaucuuguugugggcaugaggaggugcugaugucagaagaaauggcucgagcucagaagaua

SEQ ID NO: 653822 - RNA, 64 nt, Homo Sapiens
aggaggugcugaugucagaagaaauggcucgagcucagaagauaaaagauaaguaggguaugcu

SEQ ID NO: 653823 - RNA, 64 nt, Homo Sapiens
uucugauguagagcgacuggaaagauucuucgacucagaagaugaagacuuugaaauccugucc

SEQ ID NO: 653824 - RNA, 64 nt, Homo Sapiens
acaugaauuucugggcgcucccugagucagagucucagaagaccugugcaggcuggcgugagag

SEQ ID NO: 653825 - RNA, 64 nt, Homo Sapiens
uuuugcauuuucuucugucaaaaugggcaaauauucagaagaucggugaugguguggcuuuccg

SEQ ID NO: 653826 - RNA, 64 nt, Homo Sapiens
cuugucugguauuugccacagaauuacuguggguucagaagaccggcuccuccaugacuagugg

SEQ ID NO: 653827 - RNA, 64 nt, Homo Sapiens
guuccauggaagaaaaaggcacuaaccagcuuagucagaagaugcagguuuucuaguucagaag

SEQ ID NO: 653828 - RNA, 64 nt, Homo Sapiens
aaccagcuuagucagaagauccagguuuucuaguucagaagacuuuuuggauucuaucccagac

SEQ ID NO: 653829 - RNA, 64 nt, Homo Sapiens
aaaauaugacuguuuuaggguuguaaguagcuguucagaagaauuuucacugauugagauuacu

SEQ ID NO: 653830 - RNA, 64 nt, Homo Sapiens
uuuuuuaaagcagacuaaaagcaugaaauugcuuucagaagaauguauaucaucgggaaaaguu

SEQ ID NO: 653831 - RNA, 64 nt, Homo Sapiens
aucucuaaagcaaaagccucaccucaagggcugcucagaagagagcaccuucagcaugaguugu

SEQ ID NO: 653832 - RNA, 64 nt, Homo Sapiens
uaccccaggugaaacuggaagggcauggccugagucagaagagcuguuuuccccucuaaugaga

SEQ ID NO: 653833 - RNA, 64 nt, Homo Sapiens
gaacacagauguggacacaugaaauuuuucuuuuucagaagacaggcagggugugguuuggggg

SEQ ID NO: 653834 - RNA, 64 nt, Homo Sapiens
uaggaagcuuugccaguaguacuucacagagcugucagaagacucauuggaaaaagccacuugg

SEQ ID NO: 653835 - RNA, 64 nt, Homo Sapiens
ugggaagguuugccagcauuacuuuacagagcugucagaagacucucuggagauagcuaccugg

SEQ ID NO: 653836 - RNA, 64 nt, Homo Sapiens
gugaugccacuucuucaguauuagggauucucagucagaagagacccccuguguggccugaguc

SEQ ID NO: 653837 - RNA, 64 nt, Homo Sapiens
cauuguuaauuugaggacugggcugucuuggggcucagaagauaaagaacuauuugagcagaug

SEQ ID NO: 653838 - RNA, 64 nt, Homo Sapiens
gggagacuguugcucaaccaucaggaaacaguugucagaagacaucauugguucuguguuuccu

SEQ ID NO: 653839 - RNA, 64 nt, Homo Sapiens
aaagucgcauaggguuuuuuaaugcagaauuuugucagaagacaauggcgcugcauguuuuucu

SEQ ID NO: 653840 - RNA, 64 nt, Homo Sapiens
uagguagggggcuuucacuaggaaaaucaugugcucagaagaggaaaugacucguagucagguu

SEQ ID NO: 653841 - RNA, 64 nt, Homo Sapiens
ggagaaaucauccuguuuucucugugaccugauuucagaagagacugauccaaaaauuauaacg

SEQ ID NO: 653842 - RNA, 64 nt, Homo Sapiens
aacaagaaaaccauggcccuccuuuguucaaguaucagaagaaauaaacccacagcuccagaga

SEQ ID NO: 653843 - RNA, 64 nt, Homo Sapiens
aaaacauuugaaaccaaguacuguuuaauuucaaucagaagaugcaaauacauacuuugaucua

SEQ ID NO: 653844 - RNA, 64 nt, Homo Sapiens
cucuaugcccuguuaaauggugcaugaguggacgucagaagaauccuuagaacaccugagcugc

SEQ ID NO: 653845 - RNA, 64 nt, Homo Sapiens
cagagggccccucucuccacccaugcaucacuauucagaagacagagucacccccaggacuuau

SEQ ID NO: 653846 - RNA, 64 nt, Homo Sapiens
guaaauagaauuuauauuacuaauaacauaaaguucagaagaguauuauauagcccagaaacua

SEQ ID NO: 653847 - RNA, 63 nt, Homo Sapiens
agcaggagcuccacuacgcuggcuggccccaucucagaagaugguuucagaccacccugcuga

SEQ ID NO: 653848 - RNA, 64 nt, Homo Sapiens
ucuuuccuuuuuuuaaauuuaaaccauugagacuucagaagagcaggacacaaugcuguggaca

SEQ ID NO: 653849 - RNA, 64 nt, Homo Sapiens
cucggcuguuagggaucugaacuugguuuucccgucagaagaaucagcaggacagaucguagug

SEQ ID NO: 653850 - RNA, 64 nt, Homo Sapiens; identical to SEQ ID NO: 379260

SEQ ID NO: 653851 - RNA, 64 nt, Homo Sapiens; identical to SEQ ID NO: 379261

SEQ ID NO: 653852 - RNA, 64 nt, Homo Sapiens; identical to SEQ ID NO: 379262

SEQ ID NO: 653853 - RNA, 64 nt, Homo Sapiens; identical to SEQ ID NO: 379263

SEQ ID NO: 653854 - RNA, 64 nt, Homo Sapiens; identical to SEQ ID NO: 379264

SEQ ID NO: 653855 - RNA, 64 nt, Homo Sapiens; identical to SEQ ID NO: 379265

SEQ ID NO: 653856 - RNA, 64 nt, Homo Sapiens; identical to SEQ ID NO: 379266

SEQ ID NO: 653857 - RNA, 64 nt, Homo Sapiens; identical to SEQ ID NO: 379267

SEQ ID NO: 653858 - RNA, 64 nt, Homo Sapiens; identical to SEQ ID NO: 379268

SEQ ID NO: 653859 - RNA, 64 nt, Homo Sapiens; identical to SEQ ID NO: 379269

SEQ ID NO: 653860 - RNA, 64 nt, Homo Sapiens; identical to SEQ ID NO: 379270

SEQ ID NO: 653861 - RNA, 64 nt, Homo Sapiens; identical to SEQ ID NO: 379271

SEQ ID NO: 653862 - RNA, 64 nt, Homo Sapiens; identical to SEQ ID NO: 379272

SEQ ID NO: 653863 - RNA, 64 nt, Homo Sapiens; identical to SEQ ID NO: 379273

SEQ ID NO: 653864 - RNA, 64 nt, Homo Sapiens; identical to SEQ ID NO: 530346

SEQ ID NO: 653865 - RNA, 64 nt, Homo Sapiens; identical to SEQ ID NO: 530347

SEQ ID NO: 653866 - RNA, 64 nt, Homo Sapiens; identical to SEQ ID NO: 530348

SEQ ID NO: 653867 - RNA, 64 nt, Homo Sapiens; identical to SEQ ID NO: 530349

SEQ ID NO: 653868 - RNA, 64 nt, Homo Sapiens; identical to SEQ ID NO: 530350

SEQ ID NO: 653869 - RNA, 64 nt, Homo Sapiens; identical to SEQ ID NO: 530351

SEQ ID NO: 653870 - RNA, 64 nt, Homo Sapiens; identical to SEQ ID NO: 530352

SEQ ID NO: 653871 - RNA, 64 nt, Homo Sapiens; identical to SEQ ID NO: 530353

SEQ ID NO: 653872 - RNA, 64 nt, Homo Sapiens; identical to SEQ ID NO: 530354

SEQ ID NO: 653873 - RNA, 64 nt, Homo Sapiens; identical to SEQ ID NO: 530355

SEQ ID NO: 653874 - RNA, 64 nt, Homo Sapiens; identical to SEQ ID NO: 530356

SEQ ID NO: 653875 - RNA, 64 nt, Homo Sapiens; identical to SEQ ID NO: 530357

SEQ ID NO: 653876 - RNA, 64 nt, Homo Sapiens; identical to SEQ ID NO: 530358

SEQ ID NO: 653877 - RNA, 64 nt, Homo Sapiens; identical to SEQ ID NO: 530359

SEQ ID NO: 653878 - RNA, 64 nt, Homo Sapiens; identical to SEQ ID NO: 530360

SEQ ID NO: 653879 - RNA, 64 nt, Homo Sapiens; identical to SEQ ID NO: 530361

SEQ ID NO: 653880 - RNA, 64 nt, Homo Sapiens; identical to SEQ ID NO: 530362

SEQ ID NO: 653881 - RNA, 64 nt, Homo Sapiens; identical to SEQ ID NO: 530363

SEQ ID NO: 653882 - RNA, 64 nt, Homo Sapiens; identical to SEQ ID NO: 530364

SEQ ID NO: 653883 - RNA, 64 nt, Homo Sapiens; identical to SEQ ID NO: 530365

SEQ ID NO: 653884 - RNA, 64 nt, Homo Sapiens; identical to SEQ ID NO: 530366

SEQ ID NO: 653885 - RNA, 64 nt, Homo Sapiens; identical to SEQ ID NO: 530367

SEQ ID NO: 653886 - RNA, 64 nt, Homo Sapiens; identical to SEQ ID NO: 530368

SEQ ID NO: 653887 - RNA, 64 nt, Homo Sapiens; identical to SEQ ID NO: 530369

SEQ ID NO: 653888 - RNA, 64 nt, Homo Sapiens; identical to SEQ ID NO: 530370

SEQ ID NO: 653889 - RNA, 64 nt, Homo Sapiens; identical to SEQ ID NO: 530371

SEQ ID NO: 653890 - RNA, 64 nt, Homo Sapiens; identical to SEQ ID NO: 530372

SEQ ID NO: 653891 - RNA, 64 nt, Homo Sapiens; identical to SEQ ID NO: 530373

SEQ ID NO: 653892 - RNA, 64 nt, Homo Sapiens; identical to SEQ ID NO: 530374

SEQ ID NO: 653893 - RNA, 64 nt, Homo Sapiens; identical to SEQ ID NO: 530375

SEQ ID NO: 653894 - RNA, 64 nt, Homo Sapiens; identical to SEQ ID NO: 530376

SEQ ID NO: 653895 - RNA, 60 nt, Homo Sapiens; identical to SEQ ID NO: 530377

SEQ ID NO: 653896 - RNA, 64 nt, Homo Sapiens; identical to SEQ ID NO: 530378

SEQ ID NO: 653897 - RNA, 64 nt, Homo Sapiens; identical to SEQ ID NO: 530379

SEQ ID NO: 653898 - RNA, 64 nt, Homo Sapiens; identical to SEQ ID NO: 530380

SEQ ID NO: 653899 - RNA, 64 nt, Homo Sapiens; identical to SEQ ID NO: 530381

SEQ ID NO: 653900 - RNA, 64 nt, Homo Sapiens; identical to SEQ ID NO: 530382

SEQ ID NO: 653901 - RNA, 64 nt, Homo Sapiens; identical to SEQ ID NO: 530383

SEQ ID NO: 653902 - RNA, 64 nt, Homo Sapiens; identical to SEQ ID NO: 530384

SEQ ID NO: 653903 - RNA, 64 nt, Homo Sapiens; identical to SEQ ID NO: 530385

SEQ ID NO: 653904 - RNA, 64 nt, Homo Sapiens; identical to SEQ ID NO: 530386

SEQ ID NO: 653905 - RNA, 64 nt, Homo Sapiens; identical to SEQ ID NO: 530387

SEQ ID NO: 653906 - RNA, 64 nt, Homo Sapiens; identical to SEQ ID NO: 530388

SEQ ID NO: 653907 - RNA, 64 nt, Homo Sapiens; identical to SEQ ID NO: 530389

SEQ ID NO: 653908 - RNA, 64 nt, Homo Sapiens; identical to SEQ ID NO: 530390

SEQ ID NO: 653909 - RNA, 64 nt, Homo Sapiens; identical to SEQ ID NO: 530391

SEQ ID NO: 653910 - RNA, 64 nt, Homo Sapiens; identical to SEQ ID NO: 530392

SEQ ID NO: 653911 - RNA, 64 nt, Homo Sapiens; identical to SEQ ID NO: 530393

SEQ ID NO: 653912 - RNA, 64 nt, Homo Sapiens; identical to SEQ ID NO: 530394

SEQ ID NO: 653913 - RNA, 64 nt, Homo Sapiens; identical to SEQ ID NO: 530395

SEQ ID NO: 653914 - RNA, 64 nt, Homo Sapiens; identical to SEQ ID NO: 530396

SEQ ID NO: 653915 - RNA, 64 nt, Homo Sapiens; identical to SEQ ID NO: 530397

SEQ ID NO: 653916 - RNA, 64 nt, Homo Sapiens; identical to SEQ ID NO: 530398

SEQ ID NO: 653917 - RNA, 64 nt, Homo Sapiens; identical to SEQ ID NO: 530399

SEQ ID NO: 653918 - RNA, 64 nt, Homo Sapiens; identical to SEQ ID NO: 530400

SEQ ID NO: 653919 - RNA, 64 nt, Homo Sapiens; identical to SEQ ID NO: 530401

SEQ ID NO: 653920 - RNA, 64 nt, Homo Sapiens; identical to SEQ ID NO: 530402

SEQ ID NO: 653921 - RNA, 64 nt, Homo Sapiens; identical to SEQ ID NO: 530403

SEQ ID NO: 653922 - RNA, 64 nt, Homo Sapiens; identical to SEQ ID NO: 530404

SEQ ID NO: 653923 - RNA, 64 nt, Homo Sapiens; identical to SEQ ID NO: 530405

SEQ ID NO: 653924 - RNA, 64 nt, Homo Sapiens; identical to SEQ ID NO: 530406

SEQ ID NO: 653925 - RNA, 64 nt, Homo Sapiens; identical to SEQ ID NO: 530407

SEQ ID NO: 653926 - RNA, 64 nt, Homo Sapiens; identical to SEQ ID NO: 530408

SEQ ID NO: 653927 - RNA, 64 nt, Homo Sapiens; identical to SEQ ID NO: 530409

SEQ ID NO: 653928 - RNA, 64 nt, Homo Sapiens; identical to SEQ ID NO: 530410

SEQ ID NO: 653929 - RNA, 64 nt, Homo Sapiens; identical to SEQ ID NO: 530411

SEQ ID NO: 653930 - RNA, 64 nt, Homo Sapiens; identical to SEQ ID NO: 530412

SEQ ID NO: 653931 - RNA, 64 nt, Homo Sapiens; identical to SEQ ID NO: 530413

SEQ ID NO: 653932 - RNA, 64 nt, Homo Sapiens; identical to SEQ ID NO: 530414

SEQ ID NO: 653933 - RNA, 64 nt, Homo Sapiens; identical to SEQ ID NO: 530415

SEQ ID NO: 653934 - RNA, 64 nt, Homo Sapiens; identical to SEQ ID NO: 530416

SEQ ID NO: 653935 - RNA, 64 nt, Homo Sapiens; identical to SEQ ID NO: 530417

SEQ ID NO: 653936 - RNA, 64 nt, Homo Sapiens; identical to SEQ ID NO: 530418

SEQ ID NO: 653937 - RNA, 64 nt, Homo Sapiens; identical to SEQ ID NO: 530419

SEQ ID NO: 653938 - RNA, 64 nt, Homo Sapiens; identical to SEQ ID NO: 530420

SEQ ID NO: 653939 - RNA, 64 nt, Homo Sapiens; identical to SEQ ID NO: 530421

SEQ ID NO: 653940 - RNA, 64 nt, Homo Sapiens; identical to SEQ ID NO: 530422

SEQ ID NO: 653941 - RNA, 64 nt, Homo Sapiens; identical to SEQ ID NO: 530423

SEQ ID NO: 653942 - RNA, 64 nt, Homo Sapiens; identical to SEQ ID NO: 530424

SEQ ID NO: 653943 - RNA, 64 nt, Homo Sapiens; identical to SEQ ID NO: 530425

SEQ ID NO: 653944 - RNA, 64 nt, Homo Sapiens; identical to SEQ ID NO: 530426

SEQ ID NO: 653945 - RNA, 64 nt, Homo Sapiens; identical to SEQ ID NO: 530427

SEQ ID NO: 653946 - RNA, 64 nt, Homo Sapiens; identical to SEQ ID NO: 530428

SEQ ID NO: 653947 - RNA, 64 nt, Homo Sapiens; identical to SEQ ID NO: 530429

SEQ ID NO: 653948 - RNA, 64 nt, Homo Sapiens; identical to SEQ ID NO: 530430

SEQ ID NO: 653949 - RNA, 64 nt, Homo Sapiens; identical to SEQ ID NO: 530431

SEQ ID NO: 653950 - RNA, 64 nt, Homo Sapiens; identical to SEQ ID NO: 530432

SEQ ID NO: 653951 - RNA, 64 nt, Homo Sapiens; identical to SEQ ID NO: 530433

SEQ ID NO: 653952 - RNA, 64 nt, Homo Sapiens; identical to SEQ ID NO: 530434

SEQ ID NO: 653953 - RNA, 64 nt, Homo Sapiens; identical to SEQ ID NO: 530435

SEQ ID NO: 653954 - RNA, 64 nt, Homo Sapiens; identical to SEQ ID NO: 530436

SEQ ID NO: 653955 - RNA, 64 nt, Homo Sapiens; identical to SEQ ID NO: 530437

SEQ ID NO: 653956 - RNA, 51 nt, Homo Sapiens; identical to SEQ ID NO: 530438

SEQ ID NO: 653957 - RNA, 59 nt, Homo Sapiens; identical to SEQ ID NO: 530439

SEQ ID NO: 653958 - RNA, 64 nt, Homo Sapiens; identical to SEQ ID NO: 530440

SEQ ID NO: 653959 - RNA, 64 nt, Homo Sapiens; identical to SEQ ID NO: 530441

SEQ ID NO: 653960 - RNA, 64 nt, Homo Sapiens; identical to SEQ ID NO: 530442

SEQ ID NO: 653961 - RNA, 64 nt, Homo Sapiens; identical to SEQ ID NO: 530443

SEQ ID NO: 653962 - RNA, 64 nt, Homo Sapiens; identical to SEQ ID NO: 530444

SEQ ID NO: 653963 - RNA, 64 nt, Homo Sapiens; identical to SEQ ID NO: 530445

SEQ ID NO: 653964 - RNA, 64 nt, Homo Sapiens; identical to SEQ ID NO: 530446

SEQ ID NO: 653965 - RNA, 64 nt, Homo Sapiens; identical to SEQ ID NO: 530447

SEQ ID NO: 653966 - RNA, 64 nt, Homo Sapiens; identical to SEQ ID NO: 530448

SEQ ID NO: 653967 - RNA, 64 nt, Homo Sapiens; identical to SEQ ID NO: 530449

SEQ ID NO: 653968 - RNA, 64 nt, Homo Sapiens; identical to SEQ ID NO: 530450

SEQ ID NO: 653969 - RNA, 64 nt, Homo Sapiens; identical to SEQ ID NO: 530451

SEQ ID NO: 653970 - RNA, 64 nt, Homo Sapiens; identical to SEQ ID NO: 530452

SEQ ID NO: 653971 - RNA, 64 nt, Homo Sapiens; identical to SEQ ID NO: 530453

SEQ ID NO: 653972 - RNA, 64 nt, Homo Sapiens; identical to SEQ ID NO: 530454

SEQ ID NO: 653973 - RNA, 64 nt, Homo Sapiens; identical to SEQ ID NO: 530455

SEQ ID NO: 653974 - RNA, 64 nt, Homo Sapiens; identical to SEQ ID NO: 530456

SEQ ID NO: 653975 - RNA, 64 nt, Homo Sapiens; identical to SEQ ID NO: 530457

SEQ ID NO: 653976 - RNA, 64 nt, Homo Sapiens; identical to SEQ ID NO: 530458

SEQ ID NO: 653977 - RNA, 64 nt, Homo Sapiens; identical to SEQ ID NO: 530459

SEQ ID NO: 653978 - RNA, 64 nt, Homo Sapiens; identical to SEQ ID NO: 530460

SEQ ID NO: 653979 - RNA, 64 nt, Homo Sapiens; identical to SEQ ID NO: 530461

SEQ ID NO: 653980 - RNA, 64 nt, Homo Sapiens; identical to SEQ ID NO: 530462

SEQ ID NO: 653981 - RNA, 64 nt, Homo Sapiens; identical to SEQ ID NO: 530463

SEQ ID NO: 653982 - RNA, 64 nt, Homo Sapiens; identical to SEQ ID NO: 530464

SEQ ID NO: 653983 - RNA, 64 nt, Homo Sapiens; identical to SEQ ID NO: 530465

SEQ ID NO: 653984 - RNA, 64 nt, Homo Sapiens; identical to SEQ ID NO: 530466

SEQ ID NO: 653985 - RNA, 64 nt, Homo Sapiens; identical to SEQ ID NO: 530467

SEQ ID NO: 653986 - RNA, 64 nt, Homo Sapiens; identical to SEQ ID NO: 530468

SEQ ID NO: 653987 - RNA, 64 nt, Homo Sapiens; identical to SEQ ID NO: 530469

SEQ ID NO: 653988 - RNA, 64 nt, Homo Sapiens; identical to SEQ ID NO: 530470

SEQ ID NO: 653989 - RNA, 64 nt, Homo Sapiens; identical to SEQ ID NO: 530471

SEQ ID NO: 653990 - RNA, 64 nt, Homo Sapiens; identical to SEQ ID NO: 530472

SEQ ID NO: 653991 - RNA, 64 nt, Homo Sapiens; identical to SEQ ID NO: 530473

SEQ ID NO: 653992 - RNA, 64 nt, Homo Sapiens; identical to SEQ ID NO: 530474

SEQ ID NO: 653993 - RNA, 64 nt, Homo Sapiens; identical to SEQ ID NO: 530475

SEQ ID NO: 653994 - RNA, 64 nt, Homo Sapiens; identical to SEQ ID NO: 530476

SEQ ID NO: 653995 - RNA, 64 nt, Homo Sapiens; identical to SEQ ID NO: 530477

SEQ ID NO: 653996 - RNA, 64 nt, Homo Sapiens; identical to SEQ ID NO: 530478

SEQ ID NO: 653997 - RNA, 64 nt, Homo Sapiens; identical to SEQ ID NO: 530479

SEQ ID NO: 653998 - RNA, 64 nt, Homo Sapiens; identical to SEQ ID NO: 530480

SEQ ID NO: 653999 - RNA, 64 nt, Homo Sapiens; identical to SEQ ID NO: 530481

SEQ ID NO: 654000 - RNA, 64 nt, Homo Sapiens; identical to SEQ ID NO: 530482

SEQ ID NO: 654001 - RNA, 64 nt, Homo Sapiens; identical to SEQ ID NO: 530483

SEQ ID NO: 654002 - RNA, 64 nt, Homo Sapiens; identical to SEQ ID NO: 530484

SEQ ID NO: 654003 - RNA, 64 nt, Homo Sapiens; identical to SEQ ID NO: 530485

SEQ ID NO: 654004 - RNA, 64 nt, Homo Sapiens; identical to SEQ ID NO: 530486

SEQ ID NO: 654005 - RNA, 64 nt, Homo Sapiens; identical to SEQ ID NO: 530487

SEQ ID NO: 654006 - RNA, 64 nt, Homo Sapiens; identical to SEQ ID NO: 530488

SEQ ID NO: 654007 - RNA, 64 nt, Homo Sapiens; identical to SEQ ID NO: 530489

SEQ ID NO: 654008 - RNA, 64 nt, Homo Sapiens; identical to SEQ ID NO: 530490

SEQ ID NO: 654009 - RNA, 64 nt, Homo Sapiens; identical to SEQ ID NO: 530491

SEQ ID NO: 654010 - RNA, 64 nt, Homo Sapiens; identical to SEQ ID NO: 530492

SEQ ID NO: 654011 - RNA, 64 nt, Homo Sapiens; identical to SEQ ID NO: 530493

SEQ ID NO: 654012 - RNA, 64 nt, Homo Sapiens; identical to SEQ ID NO: 530494

SEQ ID NO: 654013 - RNA, 64 nt, Homo Sapiens; identical to SEQ ID NO: 530495

SEQ ID NO: 654014 - RNA, 64 nt, Homo Sapiens; identical to SEQ ID NO: 530496

SEQ ID NO: 654015 - RNA, 64 nt, Homo Sapiens; identical to SEQ ID NO: 530497

SEQ ID NO: 654016 - RNA, 64 nt, Homo Sapiens; identical to SEQ ID NO: 530498

SEQ ID NO: 654017 - RNA, 64 nt, Homo Sapiens; identical to SEQ ID NO: 530499

SEQ ID NO: 654018 - RNA, 64 nt, Homo Sapiens; identical to SEQ ID NO: 530500

SEQ ID NO: 654019 - RNA, 64 nt, Homo Sapiens; identical to SEQ ID NO: 530501

SEQ ID NO: 654020 - RNA, 64 nt, Homo Sapiens; identical to SEQ ID NO: 530502

SEQ ID NO: 654021 - RNA, 64 nt, Homo Sapiens; identical to SEQ ID NO: 530503

SEQ ID NO: 654022 - RNA, 64 nt, Homo Sapiens; identical to SEQ ID NO: 530504

SEQ ID NO: 654023 - RNA, 64 nt, Homo Sapiens; identical to SEQ ID NO: 530505

SEQ ID NO: 654024 - RNA, 64 nt, Homo Sapiens; identical to SEQ ID NO: 530506

SEQ ID NO: 654025 - RNA, 64 nt, Homo Sapiens; identical to SEQ ID NO: 530507

SEQ ID NO: 654026 - RNA, 64 nt, Homo Sapiens; identical to SEQ ID NO: 530508

SEQ ID NO: 654027 - RNA, 64 nt, Homo Sapiens; identical to SEQ ID NO: 530509

SEQ ID NO: 654028 - RNA, 64 nt, Homo Sapiens; identical to SEQ ID NO: 530510

SEQ ID NO: 654029 - RNA, 64 nt, Homo Sapiens; identical to SEQ ID NO: 530511

SEQ ID NO: 654030 - RNA, 64 nt, Homo Sapiens; identical to SEQ ID NO: 530512

SEQ ID NO: 654031 - RNA, 64 nt, Homo Sapiens; identical to SEQ ID NO: 530513

SEQ ID NO: 654032 - RNA, 64 nt, Homo Sapiens; identical to SEQ ID NO: 530514

SEQ ID NO: 654033 - RNA, 64 nt, Homo Sapiens; identical to SEQ ID NO: 530515

SEQ ID NO: 654034 - RNA, 64 nt, Homo Sapiens; identical to SEQ ID NO: 530516

SEQ ID NO: 654035 - RNA, 64 nt, Homo Sapiens; identical to SEQ ID NO: 530517

SEQ ID NO: 654036 - RNA, 64 nt, Homo Sapiens; identical to SEQ ID NO: 530518

SEQ ID NO: 654037 - RNA, 64 nt, Homo Sapiens; identical to SEQ ID NO: 530519

SEQ ID NO: 654038 - RNA, 64 nt, Homo Sapiens; identical to SEQ ID NO: 530520

SEQ ID NO: 654039 - RNA, 64 nt, Homo Sapiens; identical to SEQ ID NO: 530521

SEQ ID NO: 654040 - RNA, 64 nt, Homo Sapiens; identical to SEQ ID NO: 530522

SEQ ID NO: 654041 - RNA, 64 nt, Homo Sapiens; identical to SEQ ID NO: 530523

SEQ ID NO: 654042 - RNA, 64 nt, Homo Sapiens; identical to SEQ ID NO: 530524

SEQ ID NO: 654043 - RNA, 64 nt, Homo Sapiens; identical to SEQ ID NO: 530525

SEQ ID NO: 654044 - RNA, 64 nt, Homo Sapiens; identical to SEQ ID NO: 530526

SEQ ID NO: 654045 - RNA, 64 nt, Homo Sapiens; identical to SEQ ID NO: 530527

SEQ ID NO: 654046 - RNA, 64 nt, Homo Sapiens; identical to SEQ ID NO: 530528

SEQ ID NO: 654047 - RNA, 64 nt, Homo Sapiens; identical to SEQ ID NO: 530529

SEQ ID NO: 654048 - RNA, 64 nt, Homo Sapiens; identical to SEQ ID NO: 530530

SEQ ID NO: 654049 - RNA, 64 nt, Homo Sapiens; identical to SEQ ID NO: 530531

SEQ ID NO: 654050 - RNA, 64 nt, Homo Sapiens; identical to SEQ ID NO: 530532

SEQ ID NO: 654051 - RNA, 64 nt, Homo Sapiens; identical to SEQ ID NO: 530533

SEQ ID NO: 654052 - RNA, 64 nt, Homo Sapiens; identical to SEQ ID NO: 530534

SEQ ID NO: 654053 - RNA, 64 nt, Homo Sapiens; identical to SEQ ID NO: 530535

SEQ ID NO: 654054 - RNA, 64 nt, Homo Sapiens; identical to SEQ ID NO: 530536

SEQ ID NO: 654055 - RNA, 64 nt, Homo Sapiens; identical to SEQ ID NO: 530537

SEQ ID NO: 654056 - RNA, 64 nt, Homo Sapiens; identical to SEQ ID NO: 530538

SEQ ID NO: 654057 - RNA, 64 nt, Homo Sapiens; identical to SEQ ID NO: 530539

SEQ ID NO: 654058 - RNA, 64 nt, Homo Sapiens; identical to SEQ ID NO: 530540

SEQ ID NO: 654059 - RNA, 64 nt, Homo Sapiens; identical to SEQ ID NO: 530541

SEQ ID NO: 654060 - RNA, 64 nt, Homo Sapiens; identical to SEQ ID NO: 530542

SEQ ID NO: 654061 - RNA, 64 nt, Homo Sapiens; identical to SEQ ID NO: 530543

SEQ ID NO: 654062 - RNA, 64 nt, Homo Sapiens; identical to SEQ ID NO: 530544

SEQ ID NO: 654063 - RNA, 64 nt, Homo Sapiens; identical to SEQ ID NO: 530545

SEQ ID NO: 654064 - RNA, 64 nt, Homo Sapiens; identical to SEQ ID NO: 530546

SEQ ID NO: 654065 - RNA, 64 nt, Homo Sapiens; identical to SEQ ID NO: 530547

SEQ ID NO: 654066 - RNA, 64 nt, Homo Sapiens; identical to SEQ ID NO: 530548

SEQ ID NO: 654067 - RNA, 64 nt, Homo Sapiens; identical to SEQ ID NO: 530549

SEQ ID NO: 654068 - RNA, 64 nt, Homo Sapiens; identical to SEQ ID NO: 530550

SEQ ID NO: 654069 - RNA, 64 nt, Homo Sapiens; identical to SEQ ID NO: 530551

SEQ ID NO: 654070 - RNA, 64 nt, Homo Sapiens; identical to SEQ ID NO: 530552

SEQ ID NO: 654071 - RNA, 64 nt, Homo Sapiens; identical to SEQ ID NO: 530553

SEQ ID NO: 654072 - RNA, 64 nt, Homo Sapiens; identical to SEQ ID NO: 530554

SEQ ID NO: 654073 - RNA, 64 nt, Homo Sapiens; identical to SEQ ID NO: 530555

SEQ ID NO: 654074 - RNA, 64 nt, Homo Sapiens; identical to SEQ ID NO: 530556

SEQ ID NO: 654075 - RNA, 64 nt, Homo Sapiens; identical to SEQ ID NO: 530557

SEQ ID NO: 654076 - RNA, 64 nt, Homo Sapiens; identical to SEQ ID NO: 530558

SEQ ID NO: 654077 - RNA, 64 nt, Homo Sapiens; identical to SEQ ID NO: 530559

SEQ ID NO: 654078 - RNA, 64 nt, Homo Sapiens; identical to SEQ ID NO: 530560

SEQ ID NO: 654079 - RNA, 64 nt, Homo Sapiens; identical to SEQ ID NO: 530561

SEQ ID NO: 654080 - RNA, 62 nt, Homo Sapiens; identical to SEQ ID NO: 530562

SEQ ID NO: 654081 - RNA, 64 nt, Homo Sapiens; identical to SEQ ID NO: 530563

SEQ ID NO: 654082 - RNA, 64 nt, Homo Sapiens; identical to SEQ ID NO: 530564

SEQ ID NO: 654083 - RNA, 64 nt, Homo Sapiens; identical to SEQ ID NO: 530565

SEQ ID NO: 654084 - RNA, 64 nt, Homo Sapiens; identical to SEQ ID NO: 530566

SEQ ID NO: 654085 - RNA, 64 nt, Homo Sapiens; identical to SEQ ID NO: 530567

SEQ ID NO: 654086 - RNA, 64 nt, Homo Sapiens; identical to SEQ ID NO: 530568

SEQ ID NO: 654087 - RNA, 64 nt, Homo Sapiens; identical to SEQ ID NO: 530569

SEQ ID NO: 654088 - RNA, 64 nt, Homo Sapiens; identical to SEQ ID NO: 530570

SEQ ID NO: 654089 - RNA, 64 nt, Homo Sapiens; identical to SEQ ID NO: 530571

SEQ ID NO: 654090 - RNA, 64 nt, Homo Sapiens; identical to SEQ ID NO: 530572

SEQ ID NO: 654091 - RNA, 64 nt, Homo Sapiens; identical to SEQ ID NO: 530573

SEQ ID NO: 654092 - RNA, 64 nt, Homo Sapiens; identical to SEQ ID NO: 530574

SEQ ID NO: 654093 - RNA, 64 nt, Homo Sapiens; identical to SEQ ID NO: 530575

SEQ ID NO: 654094 - RNA, 64 nt, Homo Sapiens; identical to SEQ ID NO: 530576

SEQ ID NO: 654095 - RNA, 64 nt, Homo Sapiens; identical to SEQ ID NO: 530577

SEQ ID NO: 654096 - RNA, 64 nt, Homo Sapiens; identical to SEQ ID NO: 530578

SEQ ID NO: 654097 - RNA, 64 nt, Homo Sapiens; identical to SEQ ID NO: 530579

SEQ ID NO: 654098 - RNA, 64 nt, Homo Sapiens; identical to SEQ ID NO: 530580

SEQ ID NO: 654099 - RNA, 64 nt, Homo Sapiens; identical to SEQ ID NO: 530581

SEQ ID NO: 654100 - RNA, 64 nt, Homo Sapiens; identical to SEQ ID NO: 530582

SEQ ID NO: 654101 - RNA, 64 nt, Homo Sapiens; identical to SEQ ID NO: 530583

SEQ ID NO: 654102 - RNA, 64 nt, Homo Sapiens; identical to SEQ ID NO: 530584

SEQ ID NO: 654103 - RNA, 64 nt, Homo Sapiens; identical to SEQ ID NO: 530585

SEQ ID NO: 654104 - RNA, 64 nt, Homo Sapiens; identical to SEQ ID NO: 530586

SEQ ID NO: 654105 - RNA, 64 nt, Homo Sapiens; identical to SEQ ID NO: 530587

SEQ ID NO: 654106 - RNA, 64 nt, Homo Sapiens; identical to SEQ ID NO: 530588

SEQ ID NO: 654107 - RNA, 64 nt, Homo Sapiens; identical to SEQ ID NO: 530589

SEQ ID NO: 654108 - RNA, 64 nt, Homo Sapiens; identical to SEQ ID NO: 530590

SEQ ID NO: 654109 - RNA, 64 nt, Homo Sapiens; identical to SEQ ID NO: 530591

SEQ ID NO: 654110 - RNA, 64 nt, Homo Sapiens; identical to SEQ ID NO: 530592

SEQ ID NO: 654111 - RNA, 64 nt, Homo Sapiens; identical to SEQ ID NO: 530593

SEQ ID NO: 654112 - RNA, 64 nt, Homo Sapiens; identical to SEQ ID NO: 530594

SEQ ID NO: 654113 - RNA, 64 nt, Homo Sapiens; identical to SEQ ID NO: 530595

SEQ ID NO: 654114 - RNA, 64 nt, Homo Sapiens; identical to SEQ ID NO: 530596

SEQ ID NO: 654115 - RNA, 64 nt, Homo Sapiens; identical to SEQ ID NO: 530597

SEQ ID NO: 654116 - RNA, 64 nt, Homo Sapiens; identical to SEQ ID NO: 530598

SEQ ID NO: 654117 - RNA, 64 nt, Homo Sapiens; identical to SEQ ID NO: 530599

SEQ ID NO: 654118 - RNA, 64 nt, Homo Sapiens; identical to SEQ ID NO: 530600

SEQ ID NO: 654119 - RNA, 64 nt, Homo Sapiens; identical to SEQ ID NO: 530601

SEQ ID NO: 654120 - RNA, 64 nt, Homo Sapiens; identical to SEQ ID NO: 530602

SEQ ID NO: 654121 - RNA, 64 nt, Homo Sapiens; identical to SEQ ID NO: 530603

SEQ ID NO: 654122 - RNA, 64 nt, Homo Sapiens; identical to SEQ ID NO: 530604

SEQ ID NO: 654123 - RNA, 64 nt, Homo Sapiens; identical to SEQ ID NO: 530605

SEQ ID NO: 654124 - RNA, 64 nt, Homo Sapiens; identical to SEQ ID NO: 530606

SEQ ID NO: 654125 - RNA, 64 nt, Homo Sapiens; identical to SEQ ID NO: 530607

SEQ ID NO: 654126 - RNA, 64 nt, Homo Sapiens; identical to SEQ ID NO: 530608

SEQ ID NO: 654127 - RNA, 64 nt, Homo Sapiens; identical to SEQ ID NO: 530609

SEQ ID NO: 654128 - RNA, 64 nt, Homo Sapiens; identical to SEQ ID NO: 530610

SEQ ID NO: 654129 - RNA, 64 nt, Homo Sapiens; identical to SEQ ID NO: 530611

SEQ ID NO: 654130 - RNA, 64 nt, Homo Sapiens; identical to SEQ ID NO: 530612

SEQ ID NO: 654131 - RNA, 64 nt, Homo Sapiens; identical to SEQ ID NO: 530613

SEQ ID NO: 654132 - RNA, 64 nt, Homo Sapiens; identical to SEQ ID NO: 530614

SEQ ID NO: 654133 - RNA, 64 nt, Homo Sapiens; identical to SEQ ID NO: 530615

SEQ ID NO: 654134 - RNA, 64 nt, Homo Sapiens; identical to SEQ ID NO: 530616

SEQ ID NO: 654135 - RNA, 64 nt, Homo Sapiens; identical to SEQ ID NO: 530617

SEQ ID NO: 654136 - RNA, 64 nt, Homo Sapiens; identical to SEQ ID NO: 530618

SEQ ID NO: 654137 - RNA, 64 nt, Homo Sapiens; identical to SEQ ID NO: 530619

SEQ ID NO: 654138 - RNA, 64 nt, Homo Sapiens; identical to SEQ ID NO: 530620

SEQ ID NO: 654139 - RNA, 64 nt, Homo Sapiens; identical to SEQ ID NO: 530621

SEQ ID NO: 654140 - RNA, 64 nt, Homo Sapiens; identical to SEQ ID NO: 530622

SEQ ID NO: 654141 - RNA, 64 nt, Homo Sapiens; identical to SEQ ID NO: 530623

SEQ ID NO: 654142 - RNA, 64 nt, Homo Sapiens; identical to SEQ ID NO: 530624

SEQ ID NO: 654143 - RNA, 64 nt, Homo Sapiens; identical to SEQ ID NO: 530625

SEQ ID NO: 654144 - RNA, 64 nt, Homo Sapiens; identical to SEQ ID NO: 530626

SEQ ID NO: 654145 - RNA, 64 nt, Homo Sapiens; identical to SEQ ID NO: 530627

SEQ ID NO: 654146 - RNA, 64 nt, Homo Sapiens; identical to SEQ ID NO: 530628

SEQ ID NO: 654147 - RNA, 64 nt, Homo Sapiens; identical to SEQ ID NO: 530629

SEQ ID NO: 654148 - RNA, 64 nt, Homo Sapiens; identical to SEQ ID NO: 530630

SEQ ID NO: 654149 - RNA, 64 nt, Homo Sapiens; identical to SEQ ID NO: 530631

SEQ ID NO: 654150 - RNA, 64 nt, Homo Sapiens; identical to SEQ ID NO: 530632

SEQ ID NO: 654151 - RNA, 64 nt, Homo Sapiens; identical to SEQ ID NO: 530633

SEQ ID NO: 654152 - RNA, 64 nt, Homo Sapiens; identical to SEQ ID NO: 530634

SEQ ID NO: 654153 - RNA, 64 nt, Homo Sapiens; identical to SEQ ID NO: 530635

SEQ ID NO: 654154 - RNA, 64 nt, Homo Sapiens; identical to SEQ ID NO: 530636

SEQ ID NO: 654155 - RNA, 64 nt, Homo Sapiens; identical to SEQ ID NO: 530637

SEQ ID NO: 654156 - RNA, 64 nt, Homo Sapiens; identical to SEQ ID NO: 530638

SEQ ID NO: 654157 - RNA, 64 nt, Homo Sapiens; identical to SEQ ID NO: 530639

SEQ ID NO: 654158 - RNA, 64 nt, Homo Sapiens; identical to SEQ ID NO: 530640

SEQ ID NO: 654159 - RNA, 64 nt, Homo Sapiens; identical to SEQ ID NO: 530641

SEQ ID NO: 654160 - RNA, 64 nt, Homo Sapiens; identical to SEQ ID NO: 530642

SEQ ID NO: 654161 - RNA, 64 nt, Homo Sapiens; identical to SEQ ID NO: 530643

SEQ ID NO: 654162 - RNA, 64 nt, Homo Sapiens; identical to SEQ ID NO: 530644

SEQ ID NO: 654163 - RNA, 64 nt, Homo Sapiens; identical to SEQ ID NO: 530645

SEQ ID NO: 654164 - RNA, 64 nt, Homo Sapiens; identical to SEQ ID NO: 530646

SEQ ID NO: 654165 - RNA, 64 nt, Homo Sapiens; identical to SEQ ID NO: 530647

SEQ ID NO: 654166 - RNA, 64 nt, Homo Sapiens; identical to SEQ ID NO: 530648

SEQ ID NO: 654167 - RNA, 64 nt, Homo Sapiens; identical to SEQ ID NO: 530649

SEQ ID NO: 654168 - RNA, 64 nt, Homo Sapiens; identical to SEQ ID NO: 530650

SEQ ID NO: 654169 - RNA, 64 nt, Homo Sapiens; identical to SEQ ID NO: 530651

SEQ ID NO: 654170 - RNA, 64 nt, Homo Sapiens; identical to SEQ ID NO: 530652

SEQ ID NO: 654171 - RNA, 64 nt, Homo Sapiens; identical to SEQ ID NO: 530653

SEQ ID NO: 654172 - RNA, 64 nt, Homo Sapiens; identical to SEQ ID NO: 530654

SEQ ID NO: 654173 - RNA, 64 nt, Homo Sapiens; identical to SEQ ID NO: 530655

SEQ ID NO: 654174 - RNA, 64 nt, Homo Sapiens; identical to SEQ ID NO: 530656

SEQ ID NO: 654175 - RNA, 64 nt, Homo Sapiens; identical to SEQ ID NO: 530657

SEQ ID NO: 654176 - RNA, 64 nt, Homo Sapiens; identical to SEQ ID NO: 530658

SEQ ID NO: 654177 - RNA, 64 nt, Homo Sapiens; identical to SEQ ID NO: 530659

SEQ ID NO: 654178 - RNA, 64 nt, Homo Sapiens; identical to SEQ ID NO: 530660

SEQ ID NO: 654179 - RNA, 64 nt, Homo Sapiens; identical to SEQ ID NO: 530661

SEQ ID NO: 654180 - RNA, 64 nt, Homo Sapiens; identical to SEQ ID NO: 530662

SEQ ID NO: 654181 - RNA, 64 nt, Homo Sapiens; identical to SEQ ID NO: 530663

SEQ ID NO: 654182 - RNA, 64 nt, Homo Sapiens; identical to SEQ ID NO: 530664

SEQ ID NO: 654183 - RNA, 64 nt, Homo Sapiens; identical to SEQ ID NO: 530665

SEQ ID NO: 654184 - RNA, 64 nt, Homo Sapiens; identical to SEQ ID NO: 530666

SEQ ID NO: 654185 - RNA, 64 nt, Homo Sapiens; identical to SEQ ID NO: 530667

SEQ ID NO: 654186 - RNA, 64 nt, Homo Sapiens; identical to SEQ ID NO: 530668

SEQ ID NO: 654187 - RNA, 64 nt, Homo Sapiens; identical to SEQ ID NO: 530669

SEQ ID NO: 654188 - RNA, 64 nt, Homo Sapiens; identical to SEQ ID NO: 530670

SEQ ID NO: 654189 - RNA, 64 nt, Homo Sapiens; identical to SEQ ID NO: 530671

SEQ ID NO: 654190 - RNA, 64 nt, Homo Sapiens; identical to SEQ ID NO: 530672

SEQ ID NO: 654191 - RNA, 64 nt, Homo Sapiens; identical to SEQ ID NO: 530673

SEQ ID NO: 654192 - RNA, 64 nt, Homo Sapiens; identical to SEQ ID NO: 530674

SEQ ID NO: 654193 - RNA, 64 nt, Homo Sapiens; identical to SEQ ID NO: 530675

SEQ ID NO: 654194 - RNA, 64 nt, Homo Sapiens; identical to SEQ ID NO: 530676

SEQ ID NO: 654195 - RNA, 64 nt, Homo Sapiens; identical to SEQ ID NO: 530677

SEQ ID NO: 654196 - RNA, 64 nt, Homo Sapiens; identical to SEQ ID NO: 530678

SEQ ID NO: 654197 - RNA, 64 nt, Homo Sapiens; identical to SEQ ID NO: 530679

SEQ ID NO: 654198 - RNA, 64 nt, Homo Sapiens; identical to SEQ ID NO: 530680

SEQ ID NO: 654199 - RNA, 64 nt, Homo Sapiens; identical to SEQ ID NO: 530681

SEQ ID NO: 654200 - RNA, 64 nt, Homo Sapiens; identical to SEQ ID NO: 530682

SEQ ID NO: 654201 - RNA, 64 nt, Homo Sapiens; identical to SEQ ID NO: 530683

SEQ ID NO: 654202 - RNA, 64 nt, Homo Sapiens; identical to SEQ ID NO: 530684

SEQ ID NO: 654203 - RNA, 64 nt, Homo Sapiens; identical to SEQ ID NO: 530685

SEQ ID NO: 654204 - RNA, 64 nt, Homo Sapiens; identical to SEQ ID NO: 530686

SEQ ID NO: 654205 - RNA, 64 nt, Homo Sapiens; identical to SEQ ID NO: 530687

SEQ ID NO: 654206 - RNA, 64 nt, Homo Sapiens; identical to SEQ ID NO: 530688

SEQ ID NO: 654207 - RNA, 64 nt, Homo Sapiens; identical to SEQ ID NO: 530689

SEQ ID NO: 654208 - RNA, 64 nt, Homo Sapiens; identical to SEQ ID NO: 530690

SEQ ID NO: 654209 - RNA, 64 nt, Homo Sapiens; identical to SEQ ID NO: 530691

SEQ ID NO: 654210 - RNA, 64 nt, Homo Sapiens; identical to SEQ ID NO: 530692

SEQ ID NO: 654211 - RNA, 64 nt, Homo Sapiens; identical to SEQ ID NO: 530693

SEQ ID NO: 654212 - RNA, 64 nt, Homo Sapiens; identical to SEQ ID NO: 530694

SEQ ID NO: 654213 - RNA, 64 nt, Homo Sapiens; identical to SEQ ID NO: 530695

SEQ ID NO: 654214 - RNA, 64 nt, Homo Sapiens; identical to SEQ ID NO: 530696

SEQ ID NO: 654215 - RNA, 64 nt, Homo Sapiens; identical to SEQ ID NO: 530697

SEQ ID NO: 654216 - RNA, 64 nt, Homo Sapiens; identical to SEQ ID NO: 530698

SEQ ID NO: 654217 - RNA, 64 nt, Homo Sapiens; identical to SEQ ID NO: 530699

SEQ ID NO: 654218 - RNA, 64 nt, Homo Sapiens; identical to SEQ ID NO: 530700

SEQ ID NO: 654219 - RNA, 64 nt, Homo Sapiens; identical to SEQ ID NO: 530701

SEQ ID NO: 654220 - RNA, 64 nt, Homo Sapiens; identical to SEQ ID NO: 530702

SEQ ID NO: 654221 - RNA, 64 nt, Homo Sapiens; identical to SEQ ID NO: 530703

SEQ ID NO: 654222 - RNA, 64 nt, Homo Sapiens; identical to SEQ ID NO: 530704

SEQ ID NO: 654223 - RNA, 64 nt, Homo Sapiens; identical to SEQ ID NO: 530705

SEQ ID NO: 654224 - RNA, 64 nt, Homo Sapiens; identical to SEQ ID NO: 530706

SEQ ID NO: 654225 - RNA, 64 nt, Homo Sapiens; identical to SEQ ID NO: 530707

SEQ ID NO: 654226 - RNA, 64 nt, Homo Sapiens; identical to SEQ ID NO: 530708

SEQ ID NO: 654227 - RNA, 64 nt, Homo Sapiens; identical to SEQ ID NO: 530709

SEQ ID NO: 654228 - RNA, 64 nt, Homo Sapiens; identical to SEQ ID NO: 530710

SEQ ID NO: 654229 - RNA, 64 nt, Homo Sapiens; identical to SEQ ID NO: 530711

SEQ ID NO: 654230 - RNA, 64 nt, Homo Sapiens; identical to SEQ ID NO: 530712

SEQ ID NO: 654231 - RNA, 64 nt, Homo Sapiens; identical to SEQ ID NO: 530713

SEQ ID NO: 654232 - RNA, 64 nt, Homo Sapiens; identical to SEQ ID NO: 530714

SEQ ID NO: 654233 - RNA, 64 nt, Homo Sapiens; identical to SEQ ID NO: 530715

SEQ ID NO: 654234 - RNA, 64 nt, Homo Sapiens; identical to SEQ ID NO: 530716

SEQ ID NO: 654235 - RNA, 64 nt, Homo Sapiens; identical to SEQ ID NO: 530717

SEQ ID NO: 654236 - RNA, 64 nt, Homo Sapiens; identical to SEQ ID NO: 530718

SEQ ID NO: 654237 - RNA, 64 nt, Homo Sapiens; identical to SEQ ID NO: 530719

SEQ ID NO: 654238 - RNA, 64 nt, Homo Sapiens; identical to SEQ ID NO: 530720

SEQ ID NO: 654239 - RNA, 64 nt, Homo Sapiens; identical to SEQ ID NO: 530721

SEQ ID NO: 654240 - RNA, 64 nt, Homo Sapiens; identical to SEQ ID NO: 530722

SEQ ID NO: 654241 - RNA, 64 nt, Homo Sapiens; identical to SEQ ID NO: 530723

SEQ ID NO: 654242 - RNA, 64 nt, Homo Sapiens; identical to SEQ ID NO: 530724

SEQ ID NO: 654243 - RNA, 64 nt, Homo Sapiens; identical to SEQ ID NO: 530725

SEQ ID NO: 654244 - RNA, 64 nt, Homo Sapiens; identical to SEQ ID NO: 530726

SEQ ID NO: 654245 - RNA, 64 nt, Homo Sapiens; identical to SEQ ID NO: 530727

SEQ ID NO: 654246 - RNA, 64 nt, Homo Sapiens; identical to SEQ ID NO: 530728

SEQ ID NO: 654247 - RNA, 64 nt, Homo Sapiens; identical to SEQ ID NO: 530729

SEQ ID NO: 654248 - RNA, 64 nt, Homo Sapiens; identical to SEQ ID NO: 530730

SEQ ID NO: 654249 - RNA, 64 nt, Homo Sapiens; identical to SEQ ID NO: 530731

SEQ ID NO: 654250 - RNA, 64 nt, Homo Sapiens; identical to SEQ ID NO: 530732

SEQ ID NO: 654251 - RNA, 64 nt, Homo Sapiens; identical to SEQ ID NO: 530733

SEQ ID NO: 654252 - RNA, 64 nt, Homo Sapiens; identical to SEQ ID NO: 530734

SEQ ID NO: 654253 - RNA, 64 nt, Homo Sapiens; identical to SEQ ID NO: 530735

SEQ ID NO: 654254 - RNA, 64 nt, Homo Sapiens; identical to SEQ ID NO: 530736

SEQ ID NO: 654255 - RNA, 64 nt, Homo Sapiens; identical to SEQ ID NO: 530737

SEQ ID NO: 654256 - RNA, 64 nt, Homo Sapiens; identical to SEQ ID NO: 530738

SEQ ID NO: 654257 - RNA, 64 nt, Homo Sapiens; identical to SEQ ID NO: 530739

SEQ ID NO: 654258 - RNA, 64 nt, Homo Sapiens; identical to SEQ ID NO: 530740

SEQ ID NO: 654259 - RNA, 64 nt, Homo Sapiens; identical to SEQ ID NO: 530741

SEQ ID NO: 654260 - RNA, 64 nt, Homo Sapiens; identical to SEQ ID NO: 530742

SEQ ID NO: 654261 - RNA, 64 nt, Homo Sapiens; identical to SEQ ID NO: 530743

SEQ ID NO: 654262 - RNA, 62 nt, Homo Sapiens; identical to SEQ ID NO: 530744

SEQ ID NO: 654263 - RNA, 64 nt, Homo Sapiens; identical to SEQ ID NO: 530745

SEQ ID NO: 654264 - RNA, 64 nt, Homo Sapiens; identical to SEQ ID NO: 530746

SEQ ID NO: 654265 - RNA, 64 nt, Homo Sapiens; identical to SEQ ID NO: 530747

SEQ ID NO: 654266 - RNA, 64 nt, Homo Sapiens; identical to SEQ ID NO: 530748

SEQ ID NO: 654267 - RNA, 64 nt, Homo Sapiens; identical to SEQ ID NO: 530749

SEQ ID NO: 654268 - RNA, 64 nt, Homo Sapiens; identical to SEQ ID NO: 530750

SEQ ID NO: 654269 - RNA, 64 nt, Homo Sapiens; identical to SEQ ID NO: 530751

SEQ ID NO: 654270 - RNA, 64 nt, Homo Sapiens; identical to SEQ ID NO: 530752

SEQ ID NO: 654271 - RNA, 64 nt, Homo Sapiens; identical to SEQ ID NO: 530753

SEQ ID NO: 654272 - RNA, 64 nt, Homo Sapiens; identical to SEQ ID NO: 530754

SEQ ID NO: 654273 - RNA, 64 nt, Homo Sapiens; identical to SEQ ID NO: 530755

SEQ ID NO: 654274 - RNA, 64 nt, Homo Sapiens; identical to SEQ ID NO: 530756

SEQ ID NO: 654275 - RNA, 64 nt, Homo Sapiens; identical to SEQ ID NO: 530757

SEQ ID NO: 654276 - RNA, 64 nt, Homo Sapiens; identical to SEQ ID NO: 530758

SEQ ID NO: 654277 - RNA, 64 nt, Homo Sapiens; identical to SEQ ID NO: 530759

SEQ ID NO: 654278 - RNA, 64 nt, Homo Sapiens; identical to SEQ ID NO: 530760

SEQ ID NO: 654279 - RNA, 64 nt, Homo Sapiens; identical to SEQ ID NO: 530761

SEQ ID NO: 654280 - RNA, 64 nt, Homo Sapiens; identical to SEQ ID NO: 530762

SEQ ID NO: 654281 - RNA, 64 nt, Homo Sapiens; identical to SEQ ID NO: 530763

SEQ ID NO: 654282 - RNA, 64 nt, Homo Sapiens; identical to SEQ ID NO: 530764

SEQ ID NO: 654283 - RNA, 64 nt, Homo Sapiens; identical to SEQ ID NO: 530765

SEQ ID NO: 654284 - RNA, 64 nt, Homo Sapiens; identical to SEQ ID NO: 530766

SEQ ID NO: 654285 - RNA, 64 nt, Homo Sapiens; identical to SEQ ID NO: 530767

SEQ ID NO: 654286 - RNA, 64 nt, Homo Sapiens; identical to SEQ ID NO: 530768

SEQ ID NO: 654287 - RNA, 64 nt, Homo Sapiens; identical to SEQ ID NO: 530769

SEQ ID NO: 654288 - RNA, 64 nt, Homo Sapiens; identical to SEQ ID NO: 530770

SEQ ID NO: 654289 - RNA, 64 nt, Homo Sapiens; identical to SEQ ID NO: 530771

SEQ ID NO: 654290 - RNA, 64 nt, Homo Sapiens; identical to SEQ ID NO: 530772

SEQ ID NO: 654291 - RNA, 64 nt, Homo Sapiens; identical to SEQ ID NO: 530773

SEQ ID NO: 654292 - RNA, 64 nt, Homo Sapiens; identical to SEQ ID NO: 530774

SEQ ID NO: 654293 - RNA, 64 nt, Homo Sapiens; identical to SEQ ID NO: 530775

SEQ ID NO: 654294 - RNA, 64 nt, Homo Sapiens; identical to SEQ ID NO: 530776

SEQ ID NO: 654295 - RNA, 64 nt, Homo Sapiens; identical to SEQ ID NO: 530777

SEQ ID NO: 654296 - RNA, 64 nt, Homo Sapiens; identical to SEQ ID NO: 530778

SEQ ID NO: 654297 - RNA, 64 nt, Homo Sapiens; identical to SEQ ID NO: 530779

SEQ ID NO: 654298 - RNA, 64 nt, Homo Sapiens; identical to SEQ ID NO: 530780

SEQ ID NO: 654299 - RNA, 64 nt, Homo Sapiens; identical to SEQ ID NO: 530781

SEQ ID NO: 654300 - RNA, 64 nt, Homo Sapiens; identical to SEQ ID NO: 530782

SEQ ID NO: 654301 - RNA, 64 nt, Homo Sapiens; identical to SEQ ID NO: 530783

SEQ ID NO: 654302 - RNA, 64 nt, Homo Sapiens; identical to SEQ ID NO: 530784

SEQ ID NO: 654303 - RNA, 64 nt, Homo Sapiens; identical to SEQ ID NO: 530785

SEQ ID NO: 654304 - RNA, 64 nt, Homo Sapiens; identical to SEQ ID NO: 530786

SEQ ID NO: 654305 - RNA, 64 nt, Homo Sapiens; identical to SEQ ID NO: 530787

SEQ ID NO: 654306 - RNA, 64 nt, Homo Sapiens; identical to SEQ ID NO: 530788

SEQ ID NO: 654307 - RNA, 64 nt, Homo Sapiens; identical to SEQ ID NO: 530789

SEQ ID NO: 654308 - RNA, 64 nt, Homo Sapiens; identical to SEQ ID NO: 530790

SEQ ID NO: 654309 - RNA, 64 nt, Homo Sapiens; identical to SEQ ID NO: 530791

SEQ ID NO: 654310 - RNA, 64 nt, Homo Sapiens; identical to SEQ ID NO: 530792

SEQ ID NO: 654311 - RNA, 64 nt, Homo Sapiens; identical to SEQ ID NO: 530793

SEQ ID NO: 654312 - RNA, 64 nt, Homo Sapiens; identical to SEQ ID NO: 530794

SEQ ID NO: 654313 - RNA, 64 nt, Homo Sapiens; identical to SEQ ID NO: 530795

SEQ ID NO: 654314 - RNA, 64 nt, Homo Sapiens; identical to SEQ ID NO: 530796

SEQ ID NO: 654315 - RNA, 64 nt, Homo Sapiens; identical to SEQ ID NO: 530797

SEQ ID NO: 654316 - RNA, 64 nt, Homo Sapiens; identical to SEQ ID NO: 530798

SEQ ID NO: 654317 - RNA, 64 nt, Homo Sapiens; identical to SEQ ID NO: 530799

SEQ ID NO: 654318 - RNA, 64 nt, Homo Sapiens; identical to SEQ ID NO: 530800

SEQ ID NO: 654319 - RNA, 64 nt, Homo Sapiens; identical to SEQ ID NO: 530801

SEQ ID NO: 654320 - RNA, 64 nt, Homo Sapiens; identical to SEQ ID NO: 530802

SEQ ID NO: 654321 - RNA, 64 nt, Homo Sapiens; identical to SEQ ID NO: 530803

SEQ ID NO: 654322 - RNA, 64 nt, Homo Sapiens; identical to SEQ ID NO: 530804

SEQ ID NO: 654323 - RNA, 64 nt, Homo Sapiens; identical to SEQ ID NO: 530805

SEQ ID NO: 654324 - RNA, 64 nt, Homo Sapiens; identical to SEQ ID NO: 530806

SEQ ID NO: 654325 - RNA, 64 nt, Homo Sapiens; identical to SEQ ID NO: 530807

SEQ ID NO: 654326 - RNA, 64 nt, Homo Sapiens; identical to SEQ ID NO: 530808

SEQ ID NO: 654327 - RNA, 64 nt, Homo Sapiens; identical to SEQ ID NO: 530809

SEQ ID NO: 654328 - RNA, 64 nt, Homo Sapiens; identical to SEQ ID NO: 530810

SEQ ID NO: 654329 - RNA, 64 nt, Homo Sapiens; identical to SEQ ID NO: 530811

SEQ ID NO: 654330 - RNA, 64 nt, Homo Sapiens; identical to SEQ ID NO: 530812

SEQ ID NO: 654331 - RNA, 64 nt, Homo Sapiens; identical to SEQ ID NO: 530813

SEQ ID NO: 654332 - RNA, 64 nt, Homo Sapiens; identical to SEQ ID NO: 530814

SEQ ID NO: 654333 - RNA, 64 nt, Homo Sapiens; identical to SEQ ID NO: 530815

SEQ ID NO: 654334 - RNA, 64 nt, Homo Sapiens; identical to SEQ ID NO: 530816

SEQ ID NO: 654335 - RNA, 64 nt, Homo Sapiens; identical to SEQ ID NO: 530817

SEQ ID NO: 654336 - RNA, 64 nt, Homo Sapiens; identical to SEQ ID NO: 530818

SEQ ID NO: 654337 - RNA, 64 nt, Homo Sapiens; identical to SEQ ID NO: 530819

SEQ ID NO: 654338 - RNA, 64 nt, Homo Sapiens; identical to SEQ ID NO: 530820

SEQ ID NO: 654339 - RNA, 64 nt, Homo Sapiens; identical to SEQ ID NO: 530821

SEQ ID NO: 654340 - RNA, 64 nt, Homo Sapiens; identical to SEQ ID NO: 530822

SEQ ID NO: 654341 - RNA, 64 nt, Homo Sapiens; identical to SEQ ID NO: 530823

SEQ ID NO: 654342 - RNA, 64 nt, Homo Sapiens; identical to SEQ ID NO: 530824

SEQ ID NO: 654343 - RNA, 64 nt, Homo Sapiens; identical to SEQ ID NO: 530825

SEQ ID NO: 654344 - RNA, 64 nt, Homo Sapiens; identical to SEQ ID NO: 530826

SEQ ID NO: 654345 - RNA, 64 nt, Homo Sapiens; identical to SEQ ID NO: 530827

SEQ ID NO: 654346 - RNA, 64 nt, Homo Sapiens; identical to SEQ ID NO: 530828

SEQ ID NO: 654347 - RNA, 64 nt, Homo Sapiens; identical to SEQ ID NO: 530829

SEQ ID NO: 654348 - RNA, 64 nt, Homo Sapiens; identical to SEQ ID NO: 530830

SEQ ID NO: 654349 - RNA, 64 nt, Homo Sapiens; identical to SEQ ID NO: 530831

SEQ ID NO: 654350 - RNA, 64 nt, Homo Sapiens; identical to SEQ ID NO: 530832

SEQ ID NO: 654351 - RNA, 64 nt, Homo Sapiens; identical to SEQ ID NO: 530833

SEQ ID NO: 654352 - RNA, 64 nt, Homo Sapiens; identical to SEQ ID NO: 530834

SEQ ID NO: 654353 - RNA, 64 nt, Homo Sapiens; identical to SEQ ID NO: 530835

SEQ ID NO: 654354 - RNA, 64 nt, Homo Sapiens; identical to SEQ ID NO: 530836

SEQ ID NO: 654355 - RNA, 64 nt, Homo Sapiens; identical to SEQ ID NO: 530837

SEQ ID NO: 654356 - RNA, 64 nt, Homo Sapiens; identical to SEQ ID NO: 530838

SEQ ID NO: 654357 - RNA, 64 nt, Homo Sapiens; identical to SEQ ID NO: 530839

SEQ ID NO: 654358 - RNA, 64 nt, Homo Sapiens; identical to SEQ ID NO: 530840

SEQ ID NO: 654359 - RNA, 64 nt, Homo Sapiens; identical to SEQ ID NO: 530841

SEQ ID NO: 654360 - RNA, 64 nt, Homo Sapiens; identical to SEQ ID NO: 530842

SEQ ID NO: 654361 - RNA, 64 nt, Homo Sapiens; identical to SEQ ID NO: 530819

SEQ ID NO: 654362 - RNA, 64 nt, Homo Sapiens; identical to SEQ ID NO: 530844

SEQ ID NO: 654363 - RNA, 64 nt, Homo Sapiens; identical to SEQ ID NO: 530845

SEQ ID NO: 654364 - RNA, 64 nt, Homo Sapiens
aaaaaagccauaugugaauguacaccuaauuguuauugguuaaagaaauguuuuaaaauagaag

SEQ ID NO: 654365 - RNA, 64 nt, Homo Sapiens
aaugaugucccagcauuugacagugucugaugcuauugguuaguuugugauuauccauuaaauc

SEQ ID NO: 654366 - RNA, 64 nt, Homo Sapiens
cugauuugcaaagugaucaacauaguuuuagaucauugguuauccaaucugcuuaagauccugu

SEQ ID NO: 654367 - RNA, 64 nt, Homo Sapiens
agaguuagaugggaugaugcaguuuuagccaggcauugguuaaauauacugggcuggacauucc

SEQ ID NO: 654368 - RNA, 64 nt, Homo Sapiens
uuuuguucuguuuuuuuuuuacugugcuuaguuaauugguuauagauuuuuuuaaaagauguaa

SEQ ID NO: 654369 - RNA, 64 nt, Homo Sapiens
aauuuugaaauaucuauuauagaugagaagacaaauugguuaugugauaguggcugagaaauuc

SEQ ID NO: 654370 - RNA, 64 nt, Homo Sapiens; identical to SEQ ID NO: 530346

SEQ ID NO: 654371 - RNA, 64 nt, Homo Sapiens; identical to SEQ ID NO: 530347

SEQ ID NO: 654372 - RNA, 64 nt, Homo Sapiens; identical to SEQ ID NO: 530348

SEQ ID NO: 654373 - RNA, 64 nt, Homo Sapiens; identical to SEQ ID NO: 530349

SEQ ID NO: 654374 - RNA, 64 nt, Homo Sapiens; identical to SEQ ID NO: 530350

SEQ ID NO: 654375 - RNA, 64 nt, Homo Sapiens; identical to SEQ ID NO: 530351

SEQ ID NO: 654376 - RNA, 64 nt, Homo Sapiens; identical to SEQ ID NO: 530352

SEQ ID NO: 654377 - RNA, 64 nt, Homo Sapiens; identical to SEQ ID NO: 530353

SEQ ID NO: 654378 - RNA, 64 nt, Homo Sapiens; identical to SEQ ID NO: 530354

SEQ ID NO: 654379 - RNA, 64 nt, Homo Sapiens; identical to SEQ ID NO: 530355

SEQ ID NO: 654380 - RNA, 64 nt, Homo Sapiens; identical to SEQ ID NO: 530356

SEQ ID NO: 654381 - RNA, 64 nt, Homo Sapiens; identical to SEQ ID NO: 530357

SEQ ID NO: 654382 - RNA, 64 nt, Homo Sapiens; identical to SEQ ID NO: 530358

SEQ ID NO: 654383 - RNA, 64 nt, Homo Sapiens; identical to SEQ ID NO: 530359

SEQ ID NO: 654384 - RNA, 64 nt, Homo Sapiens; identical to SEQ ID NO: 530360

SEQ ID NO: 654385 - RNA, 64 nt, Homo Sapiens; identical to SEQ ID NO: 530361

SEQ ID NO: 654386 - RNA, 64 nt, Homo Sapiens; identical to SEQ ID NO: 530362

SEQ ID NO: 654387 - RNA, 64 nt, Homo Sapiens; identical to SEQ ID NO: 530363

SEQ ID NO: 654388 - RNA, 64 nt, Homo Sapiens; identical to SEQ ID NO: 530364

SEQ ID NO: 654389 - RNA, 64 nt, Homo Sapiens; identical to SEQ ID NO: 530365

SEQ ID NO: 654390 - RNA, 64 nt, Homo Sapiens; identical to SEQ ID NO: 530366

SEQ ID NO: 654391 - RNA, 64 nt, Homo Sapiens; identical to SEQ ID NO: 530367

SEQ ID NO: 654392 - RNA, 64 nt, Homo Sapiens; identical to SEQ ID NO: 530368

SEQ ID NO: 654393 - RNA, 64 nt, Homo Sapiens; identical to SEQ ID NO: 530369

SEQ ID NO: 654394 - RNA, 64 nt, Homo Sapiens; identical to SEQ ID NO: 530370

SEQ ID NO: 654395 - RNA, 64 nt, Homo Sapiens; identical to SEQ ID NO: 530371

SEQ ID NO: 654396 - RNA, 64 nt, Homo Sapiens; identical to SEQ ID NO: 530372

SEQ ID NO: 654397 - RNA, 64 nt, Homo Sapiens; identical to SEQ ID NO: 530373

SEQ ID NO: 654398 - RNA, 64 nt, Homo Sapiens; identical to SEQ ID NO: 530374

SEQ ID NO: 654399 - RNA, 64 nt, Homo Sapiens; identical to SEQ ID NO: 530375

SEQ ID NO: 654400 - RNA, 64 nt, Homo Sapiens; identical to SEQ ID NO: 530376

SEQ ID NO: 654401 - RNA, 60 nt, Homo Sapiens; identical to SEQ ID NO: 530377

SEQ ID NO: 654402 - RNA, 64 nt, Homo Sapiens; identical to SEQ ID NO: 530378

SEQ ID NO: 654403 - RNA, 64 nt, Homo Sapiens; identical to SEQ ID NO: 530379

SEQ ID NO: 654404 - RNA, 64 nt, Homo Sapiens; identical to SEQ ID NO: 530380

SEQ ID NO: 654405 - RNA, 64 nt, Homo Sapiens; identical to SEQ ID NO: 530381

SEQ ID NO: 654406 - RNA, 64 nt, Homo Sapiens; identical to SEQ ID NO: 530382

SEQ ID NO: 654407 - RNA, 64 nt, Homo Sapiens; identical to SEQ ID NO: 530383

SEQ ID NO: 654408 - RNA, 64 nt, Homo Sapiens; identical to SEQ ID NO: 530384

SEQ ID NO: 654409 - RNA, 64 nt, Homo Sapiens; identical to SEQ ID NO: 530385

SEQ ID NO: 654410 - RNA, 64 nt, Homo Sapiens; identical to SEQ ID NO: 530386

SEQ ID NO: 654411 - RNA, 64 nt, Homo Sapiens; identical to SEQ ID NO: 530387

SEQ ID NO: 654412 - RNA, 64 nt, Homo Sapiens; identical to SEQ ID NO: 530388

SEQ ID NO: 654413 - RNA, 64 nt, Homo Sapiens; identical to SEQ ID NO: 530389

SEQ ID NO: 654414 - RNA, 64 nt, Homo Sapiens; identical to SEQ ID NO: 530390

SEQ ID NO: 654415 - RNA, 64 nt, Homo Sapiens; identical to SEQ ID NO: 530391

SEQ ID NO: 654416 - RNA, 64 nt, Homo Sapiens; identical to SEQ ID NO: 530392

SEQ ID NO: 654417 - RNA, 64 nt, Homo Sapiens; identical to SEQ ID NO: 530393

SEQ ID NO: 654418 - RNA, 64 nt, Homo Sapiens; identical to SEQ ID NO: 530394

SEQ ID NO: 654419 - RNA, 64 nt, Homo Sapiens; identical to SEQ ID NO: 530395

SEQ ID NO: 654420 - RNA, 64 nt, Homo Sapiens; identical to SEQ ID NO: 530396

SEQ ID NO: 654421 - RNA, 64 nt, Homo Sapiens; identical to SEQ ID NO: 530397

SEQ ID NO: 654422 - RNA, 64 nt, Homo Sapiens; identical to SEQ ID NO: 530398

SEQ ID NO: 654423 - RNA, 64 nt, Homo Sapiens; identical to SEQ ID NO: 530399

SEQ ID NO: 654424 - RNA, 64 nt, Homo Sapiens; identical to SEQ ID NO: 530400

SEQ ID NO: 654425 - RNA, 64 nt, Homo Sapiens; identical to SEQ ID NO: 530401

SEQ ID NO: 654426 - RNA, 64 nt, Homo Sapiens; identical to SEQ ID NO: 530402

SEQ ID NO: 654427 - RNA, 64 nt, Homo Sapiens; identical to SEQ ID NO: 530403

SEQ ID NO: 654428 - RNA, 64 nt, Homo Sapiens; identical to SEQ ID NO: 530404

SEQ ID NO: 654429 - RNA, 64 nt, Homo Sapiens; identical to SEQ ID NO: 530405

SEQ ID NO: 654430 - RNA, 64 nt, Homo Sapiens; identical to SEQ ID NO: 530406

SEQ ID NO: 654431 - RNA, 64 nt, Homo Sapiens; identical to SEQ ID NO: 530407

SEQ ID NO: 654432 - RNA, 64 nt, Homo Sapiens; identical to SEQ ID NO: 530408

SEQ ID NO: 654433 - RNA, 64 nt, Homo Sapiens; identical to SEQ ID NO: 530409

SEQ ID NO: 654434 - RNA, 64 nt, Homo Sapiens; identical to SEQ ID NO: 530410

SEQ ID NO: 654435 - RNA, 64 nt, Homo Sapiens; identical to SEQ ID NO: 530411

SEQ ID NO: 654436 - RNA, 64 nt, Homo Sapiens; identical to SEQ ID NO: 530412

SEQ ID NO: 654437 - RNA, 64 nt, Homo Sapiens; identical to SEQ ID NO: 530413

SEQ ID NO: 654438 - RNA, 64 nt, Homo Sapiens; identical to SEQ ID NO: 530414

SEQ ID NO: 654439 - RNA, 64 nt, Homo Sapiens; identical to SEQ ID NO: 530415

SEQ ID NO: 654440 - RNA, 64 nt, Homo Sapiens; identical to SEQ ID NO: 530416

SEQ ID NO: 654441 - RNA, 64 nt, Homo Sapiens; identical to SEQ ID NO: 530417

SEQ ID NO: 654442 - RNA, 64 nt, Homo Sapiens; identical to SEQ ID NO: 530418

SEQ ID NO: 654443 - RNA, 64 nt, Homo Sapiens; identical to SEQ ID NO: 530419

SEQ ID NO: 654444 - RNA, 64 nt, Homo Sapiens; identical to SEQ ID NO: 530420

SEQ ID NO: 654445 - RNA, 64 nt, Homo Sapiens; identical to SEQ ID NO: 530421

SEQ ID NO: 654446 - RNA, 64 nt, Homo Sapiens; identical to SEQ ID NO: 530422

SEQ ID NO: 654447 - RNA, 64 nt, Homo Sapiens; identical to SEQ ID NO: 530423

SEQ ID NO: 654448 - RNA, 64 nt, Homo Sapiens; identical to SEQ ID NO: 530424

SEQ ID NO: 654449 - RNA, 64 nt, Homo Sapiens; identical to SEQ ID NO: 530425

SEQ ID NO: 654450 - RNA, 64 nt, Homo Sapiens; identical to SEQ ID NO: 530426

SEQ ID NO: 654451 - RNA, 64 nt, Homo Sapiens; identical to SEQ ID NO: 530427

SEQ ID NO: 654452 - RNA, 64 nt, Homo Sapiens; identical to SEQ ID NO: 530428

SEQ ID NO: 654453 - RNA, 64 nt, Homo Sapiens; identical to SEQ ID NO: 530429

SEQ ID NO: 654454 - RNA, 64 nt, Homo Sapiens; identical to SEQ ID NO: 530430

SEQ ID NO: 654455 - RNA, 64 nt, Homo Sapiens; identical to SEQ ID NO: 530431

SEQ ID NO: 654456 - RNA, 64 nt, Homo Sapiens; identical to SEQ ID NO: 530432

SEQ ID NO: 654457 - RNA, 64 nt, Homo Sapiens; identical to SEQ ID NO: 530433

SEQ ID NO: 654458 - RNA, 64 nt, Homo Sapiens; identical to SEQ ID NO: 530434

SEQ ID NO: 654459 - RNA, 64 nt, Homo Sapiens; identical to SEQ ID NO: 530435

SEQ ID NO: 654460 - RNA, 64 nt, Homo Sapiens; identical to SEQ ID NO: 530436

SEQ ID NO: 654461 - RNA, 64 nt, Homo Sapiens; identical to SEQ ID NO: 530437

SEQ ID NO: 654462 - RNA, 51 nt, Homo Sapiens; identical to SEQ ID NO: 530438

SEQ ID NO: 654463 - RNA, 59 nt, Homo Sapiens; identical to SEQ ID NO: 530439

SEQ ID NO: 654464 - RNA, 64 nt, Homo Sapiens; identical to SEQ ID NO: 530440

SEQ ID NO: 654465 - RNA, 64 nt, Homo Sapiens; identical to SEQ ID NO: 530441

SEQ ID NO: 654466 - RNA, 64 nt, Homo Sapiens; identical to SEQ ID NO: 530442

SEQ ID NO: 654467 - RNA, 64 nt, Homo Sapiens; identical to SEQ ID NO: 530443

SEQ ID NO: 654468 - RNA, 64 nt, Homo Sapiens; identical to SEQ ID NO: 530444

SEQ ID NO: 654469 - RNA, 64 nt, Homo Sapiens; identical to SEQ ID NO: 530445

SEQ ID NO: 654470 - RNA, 64 nt, Homo Sapiens; identical to SEQ ID NO: 530446

SEQ ID NO: 654471 - RNA, 64 nt, Homo Sapiens; identical to SEQ ID NO: 530447

SEQ ID NO: 654472 - RNA, 64 nt, Homo Sapiens; identical to SEQ ID NO: 530448

SEQ ID NO: 654473 - RNA, 64 nt, Homo Sapiens; identical to SEQ ID NO: 530449

SEQ ID NO: 654474 - RNA, 64 nt, Homo Sapiens; identical to SEQ ID NO: 530450

SEQ ID NO: 654475 - RNA, 64 nt, Homo Sapiens; identical to SEQ ID NO: 530451

SEQ ID NO: 654476 - RNA, 64 nt, Homo Sapiens; identical to SEQ ID NO: 530452

SEQ ID NO: 654477 - RNA, 64 nt, Homo Sapiens; identical to SEQ ID NO: 530453

SEQ ID NO: 654478 - RNA, 64 nt, Homo Sapiens; identical to SEQ ID NO: 530454

SEQ ID NO: 654479 - RNA, 64 nt, Homo Sapiens; identical to SEQ ID NO: 530455

SEQ ID NO: 654480 - RNA, 64 nt, Homo Sapiens; identical to SEQ ID NO: 530456

SEQ ID NO: 654481 - RNA, 64 nt, Homo Sapiens; identical to SEQ ID NO: 530457

SEQ ID NO: 654482 - RNA, 64 nt, Homo Sapiens; identical to SEQ ID NO: 530458

SEQ ID NO: 654483 - RNA, 64 nt, Homo Sapiens; identical to SEQ ID NO: 530459

SEQ ID NO: 654484 - RNA, 64 nt, Homo Sapiens; identical to SEQ ID NO: 530460

SEQ ID NO: 654485 - RNA, 64 nt, Homo Sapiens; identical to SEQ ID NO: 530461

SEQ ID NO: 654486 - RNA, 64 nt, Homo Sapiens; identical to SEQ ID NO: 530462

SEQ ID NO: 654487 - RNA, 64 nt, Homo Sapiens; identical to SEQ ID NO: 530463

SEQ ID NO: 654488 - RNA, 64 nt, Homo Sapiens; identical to SEQ ID NO: 530464

SEQ ID NO: 654489 - RNA, 64 nt, Homo Sapiens; identical to SEQ ID NO: 530465

SEQ ID NO: 654490 - RNA, 64 nt, Homo Sapiens; identical to SEQ ID NO: 530466

SEQ ID NO: 654491 - RNA, 64 nt, Homo Sapiens; identical to SEQ ID NO: 530467

SEQ ID NO: 654492 - RNA, 64 nt, Homo Sapiens; identical to SEQ ID NO: 530468

SEQ ID NO: 654493 - RNA, 64 nt, Homo Sapiens; identical to SEQ ID NO: 530469

SEQ ID NO: 654494 - RNA, 64 nt, Homo Sapiens; identical to SEQ ID NO: 530470

SEQ ID NO: 654495 - RNA, 64 nt, Homo Sapiens; identical to SEQ ID NO: 530471

SEQ ID NO: 654496 - RNA, 64 nt, Homo Sapiens; identical to SEQ ID NO: 530472

SEQ ID NO: 654497 - RNA, 64 nt, Homo Sapiens; identical to SEQ ID NO: 530473

SEQ ID NO: 654498 - RNA, 64 nt, Homo Sapiens; identical to SEQ ID NO: 530474

SEQ ID NO: 654499 - RNA, 64 nt, Homo Sapiens; identical to SEQ ID NO: 530475

SEQ ID NO: 654500 - RNA, 64 nt, Homo Sapiens; identical to SEQ ID NO: 530476

SEQ ID NO: 654501 - RNA, 64 nt, Homo Sapiens; identical to SEQ ID NO: 530477

SEQ ID NO: 654502 - RNA, 64 nt, Homo Sapiens; identical to SEQ ID NO: 530478

SEQ ID NO: 654503 - RNA, 64 nt, Homo Sapiens; identical to SEQ ID NO: 530479

SEQ ID NO: 654504 - RNA, 64 nt, Homo Sapiens; identical to SEQ ID NO: 530480

SEQ ID NO: 654505 - RNA, 64 nt, Homo Sapiens; identical to SEQ ID NO: 530481

SEQ ID NO: 654506 - RNA, 64 nt, Homo Sapiens; identical to SEQ ID NO: 530482

SEQ ID NO: 654507 - RNA, 64 nt, Homo Sapiens; identical to SEQ ID NO: 530483

SEQ ID NO: 654508 - RNA, 64 nt, Homo Sapiens; identical to SEQ ID NO: 530484

SEQ ID NO: 654509 - RNA, 64 nt, Homo Sapiens; identical to SEQ ID NO: 530485

SEQ ID NO: 654510 - RNA, 64 nt, Homo Sapiens; identical to SEQ ID NO: 530486

SEQ ID NO: 654511 - RNA, 64 nt, Homo Sapiens; identical to SEQ ID NO: 530487

SEQ ID NO: 654512 - RNA, 64 nt, Homo Sapiens; identical to SEQ ID NO: 530488

SEQ ID NO: 654513 - RNA, 64 nt, Homo Sapiens; identical to SEQ ID NO: 530489

SEQ ID NO: 654514 - RNA, 64 nt, Homo Sapiens; identical to SEQ ID NO: 530490

SEQ ID NO: 654515 - RNA, 64 nt, Homo Sapiens; identical to SEQ ID NO: 530491

SEQ ID NO: 654516 - RNA, 64 nt, Homo Sapiens; identical to SEQ ID NO: 530492

SEQ ID NO: 654517 - RNA, 64 nt, Homo Sapiens; identical to SEQ ID NO: 530493

SEQ ID NO: 654518 - RNA, 64 nt, Homo Sapiens; identical to SEQ ID NO: 530494

SEQ ID NO: 654519 - RNA, 64 nt, Homo Sapiens; identical to SEQ ID NO: 530495

SEQ ID NO: 654520 - RNA, 64 nt, Homo Sapiens; identical to SEQ ID NO: 530496

SEQ ID NO: 654521 - RNA, 64 nt, Homo Sapiens; identical to SEQ ID NO: 530497

SEQ ID NO: 654522 - RNA, 64 nt, Homo Sapiens; identical to SEQ ID NO: 530498

SEQ ID NO: 654523 - RNA, 64 nt, Homo Sapiens; identical to SEQ ID NO: 530499

SEQ ID NO: 654524 - RNA, 64 nt, Homo Sapiens; identical to SEQ ID NO: 530500

SEQ ID NO: 654525 - RNA, 64 nt, Homo Sapiens; identical to SEQ ID NO: 530501

SEQ ID NO: 654526 - RNA, 64 nt, Homo Sapiens; identical to SEQ ID NO: 530502

SEQ ID NO: 654527 - RNA, 64 nt, Homo Sapiens; identical to SEQ ID NO: 530503

SEQ ID NO: 654528 - RNA, 64 nt, Homo Sapiens; identical to SEQ ID NO: 530504

SEQ ID NO: 654529 - RNA, 64 nt, Homo Sapiens; identical to SEQ ID NO: 530505

SEQ ID NO: 654530 - RNA, 64 nt, Homo Sapiens; identical to SEQ ID NO: 530506

SEQ ID NO: 654531 - RNA, 64 nt, Homo Sapiens; identical to SEQ ID NO: 530507

SEQ ID NO: 654532 - RNA, 64 nt, Homo Sapiens; identical to SEQ ID NO: 530508

SEQ ID NO: 654533 - RNA, 64 nt, Homo Sapiens; identical to SEQ ID NO: 530509

SEQ ID NO: 654534 - RNA, 64 nt, Homo Sapiens; identical to SEQ ID NO: 530510

SEQ ID NO: 654535 - RNA, 64 nt, Homo Sapiens; identical to SEQ ID NO: 530511

SEQ ID NO: 654536 - RNA, 64 nt, Homo Sapiens; identical to SEQ ID NO: 530512

SEQ ID NO: 654537 - RNA, 64 nt, Homo Sapiens; identical to SEQ ID NO: 530513

SEQ ID NO: 654538 - RNA, 64 nt, Homo Sapiens; identical to SEQ ID NO: 530514

SEQ ID NO: 654539 - RNA, 64 nt, Homo Sapiens; identical to SEQ ID NO: 530515

SEQ ID NO: 654540 - RNA, 64 nt, Homo Sapiens; identical to SEQ ID NO: 530516

SEQ ID NO: 654541 - RNA, 64 nt, Homo Sapiens; identical to SEQ ID NO: 530517

SEQ ID NO: 654542 - RNA, 64 nt, Homo Sapiens; identical to SEQ ID NO: 530518

SEQ ID NO: 654543 - RNA, 64 nt, Homo Sapiens; identical to SEQ ID NO: 530519

SEQ ID NO: 654544 - RNA, 64 nt, Homo Sapiens; identical to SEQ ID NO: 530520

SEQ ID NO: 654545 - RNA, 64 nt, Homo Sapiens; identical to SEQ ID NO: 530521

SEQ ID NO: 654546 - RNA, 64 nt, Homo Sapiens; identical to SEQ ID NO: 530522

SEQ ID NO: 654547 - RNA, 64 nt, Homo Sapiens; identical to SEQ ID NO: 530523

SEQ ID NO: 654548 - RNA, 64 nt, Homo Sapiens; identical to SEQ ID NO: 530524

SEQ ID NO: 654549 - RNA, 64 nt, Homo Sapiens; identical to SEQ ID NO: 530525

SEQ ID NO: 654550 - RNA, 64 nt, Homo Sapiens; identical to SEQ ID NO: 530526

SEQ ID NO: 654551 - RNA, 64 nt, Homo Sapiens; identical to SEQ ID NO: 530527

SEQ ID NO: 654552 - RNA, 64 nt, Homo Sapiens; identical to SEQ ID NO: 530528

SEQ ID NO: 654553 - RNA, 64 nt, Homo Sapiens; identical to SEQ ID NO: 530529

SEQ ID NO: 654554 - RNA, 64 nt, Homo Sapiens; identical to SEQ ID NO: 530530

SEQ ID NO: 654555 - RNA, 64 nt, Homo Sapiens; identical to SEQ ID NO: 530531

SEQ ID NO: 654556 - RNA, 64 nt, Homo Sapiens; identical to SEQ ID NO: 530532

SEQ ID NO: 654557 - RNA, 64 nt, Homo Sapiens; identical to SEQ ID NO: 530533

SEQ ID NO: 654558 - RNA, 64 nt, Homo Sapiens; identical to SEQ ID NO: 530534

SEQ ID NO: 654559 - RNA, 64 nt, Homo Sapiens; identical to SEQ ID NO: 530535

SEQ ID NO: 654560 - RNA, 64 nt, Homo Sapiens; identical to SEQ ID NO: 530536

SEQ ID NO: 654561 - RNA, 64 nt, Homo Sapiens; identical to SEQ ID NO: 530537

SEQ ID NO: 654562 - RNA, 64 nt, Homo Sapiens; identical to SEQ ID NO: 530538

SEQ ID NO: 654563 - RNA, 64 nt, Homo Sapiens; identical to SEQ ID NO: 530539

SEQ ID NO: 654564 - RNA, 64 nt, Homo Sapiens; identical to SEQ ID NO: 530540

SEQ ID NO: 654565 - RNA, 64 nt, Homo Sapiens; identical to SEQ ID NO: 530541

SEQ ID NO: 654566 - RNA, 64 nt, Homo Sapiens; identical to SEQ ID NO: 530542

SEQ ID NO: 654567 - RNA, 64 nt, Homo Sapiens; identical to SEQ ID NO: 530543

SEQ ID NO: 654568 - RNA, 64 nt, Homo Sapiens; identical to SEQ ID NO: 530544

SEQ ID NO: 654569 - RNA, 64 nt, Homo Sapiens; identical to SEQ ID NO: 530545

SEQ ID NO: 654570 - RNA, 64 nt, Homo Sapiens; identical to SEQ ID NO: 530546

SEQ ID NO: 654571 - RNA, 64 nt, Homo Sapiens; identical to SEQ ID NO: 530547

SEQ ID NO: 654572 - RNA, 64 nt, Homo Sapiens; identical to SEQ ID NO: 530548

SEQ ID NO: 654573 - RNA, 64 nt, Homo Sapiens; identical to SEQ ID NO: 530549

SEQ ID NO: 654574 - RNA, 64 nt, Homo Sapiens; identical to SEQ ID NO: 530550

SEQ ID NO: 654575 - RNA, 64 nt, Homo Sapiens; identical to SEQ ID NO: 530551

SEQ ID NO: 654576 - RNA, 64 nt, Homo Sapiens; identical to SEQ ID NO: 530552

SEQ ID NO: 654577 - RNA, 64 nt, Homo Sapiens; identical to SEQ ID NO: 530553

SEQ ID NO: 654578 - RNA, 64 nt, Homo Sapiens; identical to SEQ ID NO: 530554

SEQ ID NO: 654579 - RNA, 64 nt, Homo Sapiens; identical to SEQ ID NO: 530555

SEQ ID NO: 654580 - RNA, 64 nt, Homo Sapiens; identical to SEQ ID NO: 530556

SEQ ID NO: 654581 - RNA, 64 nt, Homo Sapiens; identical to SEQ ID NO: 530557

SEQ ID NO: 654582 - RNA, 64 nt, Homo Sapiens; identical to SEQ ID NO: 530558

SEQ ID NO: 654583 - RNA, 64 nt, Homo Sapiens; identical to SEQ ID NO: 530559

SEQ ID NO: 654584 - RNA, 64 nt, Homo Sapiens; identical to SEQ ID NO: 530560

SEQ ID NO: 654585 - RNA, 64 nt, Homo Sapiens; identical to SEQ ID NO: 530561

SEQ ID NO: 654586 - RNA, 62 nt, Homo Sapiens; identical to SEQ ID NO: 530562

SEQ ID NO: 654587 - RNA, 64 nt, Homo Sapiens; identical to SEQ ID NO: 530563

SEQ ID NO: 654588 - RNA, 64 nt, Homo Sapiens; identical to SEQ ID NO: 530564

SEQ ID NO: 654589 - RNA, 64 nt, Homo Sapiens; identical to SEQ ID NO: 530565

SEQ ID NO: 654590 - RNA, 64 nt, Homo Sapiens; identical to SEQ ID NO: 530566

SEQ ID NO: 654591 - RNA, 64 nt, Homo Sapiens; identical to SEQ ID NO: 530567

SEQ ID NO: 654592 - RNA, 64 nt, Homo Sapiens; identical to SEQ ID NO: 530568

SEQ ID NO: 654593 - RNA, 64 nt, Homo Sapiens; identical to SEQ ID NO: 530569

SEQ ID NO: 654594 - RNA, 64 nt, Homo Sapiens; identical to SEQ ID NO: 530570

SEQ ID NO: 654595 - RNA, 64 nt, Homo Sapiens; identical to SEQ ID NO: 530571

SEQ ID NO: 654596 - RNA, 64 nt, Homo Sapiens; identical to SEQ ID NO: 530572

SEQ ID NO: 654597 - RNA, 64 nt, Homo Sapiens; identical to SEQ ID NO: 530573

SEQ ID NO: 654598 - RNA, 64 nt, Homo Sapiens; identical to SEQ ID NO: 530574

SEQ ID NO: 654599 - RNA, 64 nt, Homo Sapiens; identical to SEQ ID NO: 530575

SEQ ID NO: 654600 - RNA, 64 nt, Homo Sapiens; identical to SEQ ID NO: 530576

SEQ ID NO: 654601 - RNA, 64 nt, Homo Sapiens; identical to SEQ ID NO: 530577

SEQ ID NO: 654602 - RNA, 64 nt, Homo Sapiens; identical to SEQ ID NO: 530578

SEQ ID NO: 654603 - RNA, 64 nt, Homo Sapiens; identical to SEQ ID NO: 530579

SEQ ID NO: 654604 - RNA, 64 nt, Homo Sapiens; identical to SEQ ID NO: 530580

SEQ ID NO: 654605 - RNA, 64 nt, Homo Sapiens; identical to SEQ ID NO: 530581

SEQ ID NO: 654606 - RNA, 64 nt, Homo Sapiens; identical to SEQ ID NO: 530582

SEQ ID NO: 654607 - RNA, 64 nt, Homo Sapiens; identical to SEQ ID NO: 530583

SEQ ID NO: 654608 - RNA, 64 nt, Homo Sapiens; identical to SEQ ID NO: 530584

SEQ ID NO: 654609 - RNA, 64 nt, Homo Sapiens; identical to SEQ ID NO: 530585

SEQ ID NO: 654610 - RNA, 64 nt, Homo Sapiens; identical to SEQ ID NO: 530586

SEQ ID NO: 654611 - RNA, 64 nt, Homo Sapiens; identical to SEQ ID NO: 530587

SEQ ID NO: 654612 - RNA, 64 nt, Homo Sapiens; identical to SEQ ID NO: 530588

SEQ ID NO: 654613 - RNA, 64 nt, Homo Sapiens; identical to SEQ ID NO: 530589

SEQ ID NO: 654614 - RNA, 64 nt, Homo Sapiens; identical to SEQ ID NO: 530590

SEQ ID NO: 654615 - RNA, 64 nt, Homo Sapiens; identical to SEQ ID NO: 530591

SEQ ID NO: 654616 - RNA, 64 nt, Homo Sapiens; identical to SEQ ID NO: 530592

SEQ ID NO: 654617 - RNA, 64 nt, Homo Sapiens; identical to SEQ ID NO: 530593

SEQ ID NO: 654618 - RNA, 64 nt, Homo Sapiens; identical to SEQ ID NO: 530594

SEQ ID NO: 654619 - RNA, 64 nt, Homo Sapiens; identical to SEQ ID NO: 530595

SEQ ID NO: 654620 - RNA, 64 nt, Homo Sapiens; identical to SEQ ID NO: 530596

SEQ ID NO: 654621 - RNA, 64 nt, Homo Sapiens; identical to SEQ ID NO: 530597

SEQ ID NO: 654622 - RNA, 64 nt, Homo Sapiens; identical to SEQ ID NO: 530598

SEQ ID NO: 654623 - RNA, 64 nt, Homo Sapiens; identical to SEQ ID NO: 530599

SEQ ID NO: 654624 - RNA, 64 nt, Homo Sapiens; identical to SEQ ID NO: 530600

SEQ ID NO: 654625 - RNA, 64 nt, Homo Sapiens; identical to SEQ ID NO: 530601

SEQ ID NO: 654626 - RNA, 64 nt, Homo Sapiens; identical to SEQ ID NO: 530602

SEQ ID NO: 654627 - RNA, 64 nt, Homo Sapiens; identical to SEQ ID NO: 530603

SEQ ID NO: 654628 - RNA, 64 nt, Homo Sapiens; identical to SEQ ID NO: 530604

SEQ ID NO: 654629 - RNA, 64 nt, Homo Sapiens; identical to SEQ ID NO: 530605

SEQ ID NO: 654630 - RNA, 64 nt, Homo Sapiens; identical to SEQ ID NO: 530606

SEQ ID NO: 654631 - RNA, 64 nt, Homo Sapiens; identical to SEQ ID NO: 530607

SEQ ID NO: 654632 - RNA, 64 nt, Homo Sapiens; identical to SEQ ID NO: 530608

SEQ ID NO: 654633 - RNA, 64 nt, Homo Sapiens; identical to SEQ ID NO: 530609

SEQ ID NO: 654634 - RNA, 64 nt, Homo Sapiens; identical to SEQ ID NO: 530610

SEQ ID NO: 654635 - RNA, 64 nt, Homo Sapiens; identical to SEQ ID NO: 530611

SEQ ID NO: 654636 - RNA, 64 nt, Homo Sapiens; identical to SEQ ID NO: 530612

SEQ ID NO: 654637 - RNA, 64 nt, Homo Sapiens; identical to SEQ ID NO: 530613

SEQ ID NO: 654638 - RNA, 64 nt, Homo Sapiens; identical to SEQ ID NO: 530614

SEQ ID NO: 654639 - RNA, 64 nt, Homo Sapiens; identical to SEQ ID NO: 530615

SEQ ID NO: 654640 - RNA, 64 nt, Homo Sapiens; identical to SEQ ID NO: 530616

SEQ ID NO: 654641 - RNA, 64 nt, Homo Sapiens; identical to SEQ ID NO: 530617

SEQ ID NO: 654642 - RNA, 64 nt, Homo Sapiens; identical to SEQ ID NO: 530618

SEQ ID NO: 654643 - RNA, 64 nt, Homo Sapiens; identical to SEQ ID NO: 530619

SEQ ID NO: 654644 - RNA, 64 nt, Homo Sapiens; identical to SEQ ID NO: 530620

SEQ ID NO: 654645 - RNA, 64 nt, Homo Sapiens; identical to SEQ ID NO: 530621

SEQ ID NO: 654646 - RNA, 64 nt, Homo Sapiens; identical to SEQ ID NO: 530622

SEQ ID NO: 654647 - RNA, 64 nt, Homo Sapiens; identical to SEQ ID NO: 530623

SEQ ID NO: 654648 - RNA, 64 nt, Homo Sapiens; identical to SEQ ID NO: 530624

SEQ ID NO: 654649 - RNA, 64 nt, Homo Sapiens; identical to SEQ ID NO: 530625

SEQ ID NO: 654650 - RNA, 64 nt, Homo Sapiens; identical to SEQ ID NO: 530626

SEQ ID NO: 654651 - RNA, 64 nt, Homo Sapiens; identical to SEQ ID NO: 530627

SEQ ID NO: 654652 - RNA, 64 nt, Homo Sapiens; identical to SEQ ID NO: 530628

SEQ ID NO: 654653 - RNA, 64 nt, Homo Sapiens; identical to SEQ ID NO: 530629

SEQ ID NO: 654654 - RNA, 64 nt, Homo Sapiens; identical to SEQ ID NO: 530630

SEQ ID NO: 654655 - RNA, 64 nt, Homo Sapiens; identical to SEQ ID NO: 530631

SEQ ID NO: 654656 - RNA, 64 nt, Homo Sapiens; identical to SEQ ID NO: 530632

SEQ ID NO: 654657 - RNA, 64 nt, Homo Sapiens; identical to SEQ ID NO: 530633

SEQ ID NO: 654658 - RNA, 64 nt, Homo Sapiens; identical to SEQ ID NO: 530634

SEQ ID NO: 654659 - RNA, 64 nt, Homo Sapiens; identical to SEQ ID NO: 530635

SEQ ID NO: 654660 - RNA, 64 nt, Homo Sapiens; identical to SEQ ID NO: 530636

SEQ ID NO: 654661 - RNA, 64 nt, Homo Sapiens; identical to SEQ ID NO: 530637

SEQ ID NO: 654662 - RNA, 64 nt, Homo Sapiens; identical to SEQ ID NO: 530638

SEQ ID NO: 654663 - RNA, 64 nt, Homo Sapiens; identical to SEQ ID NO: 530639

SEQ ID NO: 654664 - RNA, 64 nt, Homo Sapiens; identical to SEQ ID NO: 530640

SEQ ID NO: 654665 - RNA, 64 nt, Homo Sapiens; identical to SEQ ID NO: 530641

SEQ ID NO: 654666 - RNA, 64 nt, Homo Sapiens; identical to SEQ ID NO: 530642

SEQ ID NO: 654667 - RNA, 64 nt, Homo Sapiens; identical to SEQ ID NO: 530643

SEQ ID NO: 654668 - RNA, 64 nt, Homo Sapiens; identical to SEQ ID NO: 530644

SEQ ID NO: 654669 - RNA, 64 nt, Homo Sapiens; identical to SEQ ID NO: 530645

SEQ ID NO: 654670 - RNA, 64 nt, Homo Sapiens; identical to SEQ ID NO: 530646

SEQ ID NO: 654671 - RNA, 64 nt, Homo Sapiens; identical to SEQ ID NO: 530647

SEQ ID NO: 654672 - RNA, 64 nt, Homo Sapiens; identical to SEQ ID NO: 530648

SEQ ID NO: 654673 - RNA, 64 nt, Homo Sapiens; identical to SEQ ID NO: 530649

SEQ ID NO: 654674 - RNA, 64 nt, Homo Sapiens; identical to SEQ ID NO: 530650

SEQ ID NO: 654675 - RNA, 64 nt, Homo Sapiens; identical to SEQ ID NO: 530651

SEQ ID NO: 654676 - RNA, 64 nt, Homo Sapiens; identical to SEQ ID NO: 530652

SEQ ID NO: 654677 - RNA, 64 nt, Homo Sapiens; identical to SEQ ID NO: 530653

SEQ ID NO: 654678 - RNA, 64 nt, Homo Sapiens; identical to SEQ ID NO: 530654

SEQ ID NO: 654679 - RNA, 64 nt, Homo Sapiens; identical to SEQ ID NO: 530655

SEQ ID NO: 654680 - RNA, 64 nt, Homo Sapiens; identical to SEQ ID NO: 530656

SEQ ID NO: 654681 - RNA, 64 nt, Homo Sapiens; identical to SEQ ID NO: 530657

SEQ ID NO: 654682 - RNA, 64 nt, Homo Sapiens; identical to SEQ ID NO: 530658

SEQ ID NO: 654683 - RNA, 64 nt, Homo Sapiens; identical to SEQ ID NO: 530659

SEQ ID NO: 654684 - RNA, 64 nt, Homo Sapiens; identical to SEQ ID NO: 530660

SEQ ID NO: 654685 - RNA, 64 nt, Homo Sapiens; identical to SEQ ID NO: 530661

SEQ ID NO: 654686 - RNA, 64 nt, Homo Sapiens; identical to SEQ ID NO: 530662

SEQ ID NO: 654687 - RNA, 64 nt, Homo Sapiens; identical to SEQ ID NO: 530663

SEQ ID NO: 654688 - RNA, 64 nt, Homo Sapiens; identical to SEQ ID NO: 530664

SEQ ID NO: 654689 - RNA, 64 nt, Homo Sapiens; identical to SEQ ID NO: 530665

SEQ ID NO: 654690 - RNA, 64 nt, Homo Sapiens; identical to SEQ ID NO: 530666

SEQ ID NO: 654691 - RNA, 64 nt, Homo Sapiens; identical to SEQ ID NO: 530667

SEQ ID NO: 654692 - RNA, 64 nt, Homo Sapiens; identical to SEQ ID NO: 530668

SEQ ID NO: 654693 - RNA, 64 nt, Homo Sapiens; identical to SEQ ID NO: 530669

SEQ ID NO: 654694 - RNA, 64 nt, Homo Sapiens; identical to SEQ ID NO: 530670

SEQ ID NO: 654695 - RNA, 64 nt, Homo Sapiens; identical to SEQ ID NO: 530671

SEQ ID NO: 654696 - RNA, 64 nt, Homo Sapiens; identical to SEQ ID NO: 530672

SEQ ID NO: 654697 - RNA, 64 nt, Homo Sapiens; identical to SEQ ID NO: 530673

SEQ ID NO: 654698 - RNA, 64 nt, Homo Sapiens; identical to SEQ ID NO: 530674

SEQ ID NO: 654699 - RNA, 64 nt, Homo Sapiens; identical to SEQ ID NO: 530675

SEQ ID NO: 654700 - RNA, 64 nt, Homo Sapiens; identical to SEQ ID NO: 530676

SEQ ID NO: 654701 - RNA, 64 nt, Homo Sapiens; identical to SEQ ID NO: 530677

SEQ ID NO: 654702 - RNA, 64 nt, Homo Sapiens; identical to SEQ ID NO: 530678

SEQ ID NO: 654703 - RNA, 64 nt, Homo Sapiens; identical to SEQ ID NO: 530679

SEQ ID NO: 654704 - RNA, 64 nt, Homo Sapiens; identical to SEQ ID NO: 530680

SEQ ID NO: 654705 - RNA, 64 nt, Homo Sapiens; identical to SEQ ID NO: 530681

SEQ ID NO: 654706 - RNA, 64 nt, Homo Sapiens; identical to SEQ ID NO: 530682

SEQ ID NO: 654707 - RNA, 64 nt, Homo Sapiens; identical to SEQ ID NO: 530683

SEQ ID NO: 654708 - RNA, 64 nt, Homo Sapiens; identical to SEQ ID NO: 530684

SEQ ID NO: 654709 - RNA, 64 nt, Homo Sapiens; identical to SEQ ID NO: 530685

SEQ ID NO: 654710 - RNA, 64 nt, Homo Sapiens; identical to SEQ ID NO: 530686

SEQ ID NO: 654711 - RNA, 64 nt, Homo Sapiens; identical to SEQ ID NO: 530687

SEQ ID NO: 654712 - RNA, 64 nt, Homo Sapiens; identical to SEQ ID NO: 530688

SEQ ID NO: 654713 - RNA, 64 nt, Homo Sapiens; identical to SEQ ID NO: 530689

SEQ ID NO: 654714 - RNA, 64 nt, Homo Sapiens; identical to SEQ ID NO: 530690

SEQ ID NO: 654715 - RNA, 64 nt, Homo Sapiens; identical to SEQ ID NO: 530691

SEQ ID NO: 654716 - RNA, 64 nt, Homo Sapiens; identical to SEQ ID NO: 530692

SEQ ID NO: 654717 - RNA, 64 nt, Homo Sapiens; identical to SEQ ID NO: 530693

SEQ ID NO: 654718 - RNA, 64 nt, Homo Sapiens; identical to SEQ ID NO: 530694

SEQ ID NO: 654719 - RNA, 64 nt, Homo Sapiens; identical to SEQ ID NO: 530695

SEQ ID NO: 654720 - RNA, 64 nt, Homo Sapiens; identical to SEQ ID NO: 530696

SEQ ID NO: 654721 - RNA, 64 nt, Homo Sapiens; identical to SEQ ID NO: 530697

SEQ ID NO: 654722 - RNA, 64 nt, Homo Sapiens; identical to SEQ ID NO: 530698

SEQ ID NO: 654723 - RNA, 64 nt, Homo Sapiens; identical to SEQ ID NO: 530699

SEQ ID NO: 654724 - RNA, 64 nt, Homo Sapiens; identical to SEQ ID NO: 530700

SEQ ID NO: 654725 - RNA, 64 nt, Homo Sapiens; identical to SEQ ID NO: 530701

SEQ ID NO: 654726 - RNA, 64 nt, Homo Sapiens; identical to SEQ ID NO: 530702

SEQ ID NO: 654727 - RNA, 64 nt, Homo Sapiens; identical to SEQ ID NO: 530703

SEQ ID NO: 654728 - RNA, 64 nt, Homo Sapiens; identical to SEQ ID NO: 530704

SEQ ID NO: 654729 - RNA, 64 nt, Homo Sapiens; identical to SEQ ID NO: 530705

SEQ ID NO: 654730 - RNA, 64 nt, Homo Sapiens; identical to SEQ ID NO: 530706

SEQ ID NO: 654731 - RNA, 64 nt, Homo Sapiens; identical to SEQ ID NO: 530707

SEQ ID NO: 654732 - RNA, 64 nt, Homo Sapiens; identical to SEQ ID NO: 530708

SEQ ID NO: 654733 - RNA, 64 nt, Homo Sapiens; identical to SEQ ID NO: 530709

SEQ ID NO: 654734 - RNA, 64 nt, Homo Sapiens; identical to SEQ ID NO: 530710

SEQ ID NO: 654735 - RNA, 64 nt, Homo Sapiens; identical to SEQ ID NO: 530711

SEQ ID NO: 654736 - RNA, 64 nt, Homo Sapiens; identical to SEQ ID NO: 530712

SEQ ID NO: 654737 - RNA, 64 nt, Homo Sapiens; identical to SEQ ID NO: 530713

SEQ ID NO: 654738 - RNA, 64 nt, Homo Sapiens; identical to SEQ ID NO: 530714

SEQ ID NO: 654739 - RNA, 64 nt, Homo Sapiens; identical to SEQ ID NO: 530715

SEQ ID NO: 654740 - RNA, 64 nt, Homo Sapiens; identical to SEQ ID NO: 530716

SEQ ID NO: 654741 - RNA, 64 nt, Homo Sapiens; identical to SEQ ID NO: 530717

SEQ ID NO: 654742 - RNA, 64 nt, Homo Sapiens; identical to SEQ ID NO: 530718

SEQ ID NO: 654743 - RNA, 64 nt, Homo Sapiens; identical to SEQ ID NO: 530719

SEQ ID NO: 654744 - RNA, 64 nt, Homo Sapiens; identical to SEQ ID NO: 530720

SEQ ID NO: 654745 - RNA, 64 nt, Homo Sapiens; identical to SEQ ID NO: 530721

SEQ ID NO: 654746 - RNA, 64 nt, Homo Sapiens; identical to SEQ ID NO: 530722

SEQ ID NO: 654747 - RNA, 64 nt, Homo Sapiens; identical to SEQ ID NO: 530723

SEQ ID NO: 654748 - RNA, 64 nt, Homo Sapiens; identical to SEQ ID NO: 530724

SEQ ID NO: 654749 - RNA, 64 nt, Homo Sapiens; identical to SEQ ID NO: 530725

SEQ ID NO: 654750 - RNA, 64 nt, Homo Sapiens; identical to SEQ ID NO: 530726

SEQ ID NO: 654751 - RNA, 64 nt, Homo Sapiens; identical to SEQ ID NO: 530727

SEQ ID NO: 654752 - RNA, 64 nt, Homo Sapiens; identical to SEQ ID NO: 530728

SEQ ID NO: 654753 - RNA, 64 nt, Homo Sapiens; identical to SEQ ID NO: 530729

SEQ ID NO: 654754 - RNA, 64 nt, Homo Sapiens; identical to SEQ ID NO: 530730

SEQ ID NO: 654755 - RNA, 64 nt, Homo Sapiens; identical to SEQ ID NO: 530731

SEQ ID NO: 654756 - RNA, 64 nt, Homo Sapiens; identical to SEQ ID NO: 530732

SEQ ID NO: 654757 - RNA, 64 nt, Homo Sapiens; identical to SEQ ID NO: 530733

SEQ ID NO: 654758 - RNA, 64 nt, Homo Sapiens; identical to SEQ ID NO: 530734

SEQ ID NO: 654759 - RNA, 64 nt, Homo Sapiens; identical to SEQ ID NO: 530735

SEQ ID NO: 654760 - RNA, 64 nt, Homo Sapiens; identical to SEQ ID NO: 530736

SEQ ID NO: 654761 - RNA, 64 nt, Homo Sapiens; identical to SEQ ID NO: 530737

SEQ ID NO: 654762 - RNA, 64 nt, Homo Sapiens; identical to SEQ ID NO: 530738

SEQ ID NO: 654763 - RNA, 64 nt, Homo Sapiens; identical to SEQ ID NO: 530739

SEQ ID NO: 654764 - RNA, 64 nt, Homo Sapiens; identical to SEQ ID NO: 530740

SEQ ID NO: 654765 - RNA, 64 nt, Homo Sapiens; identical to SEQ ID NO: 530741

SEQ ID NO: 654766 - RNA, 64 nt, Homo Sapiens; identical to SEQ ID NO: 530742

SEQ ID NO: 654767 - RNA, 64 nt, Homo Sapiens; identical to SEQ ID NO: 530743

SEQ ID NO: 654768 - RNA, 62 nt, Homo Sapiens; identical to SEQ ID NO: 530744

SEQ ID NO: 654769 - RNA, 64 nt, Homo Sapiens; identical to SEQ ID NO: 530745

SEQ ID NO: 654770 - RNA, 64 nt, Homo Sapiens; identical to SEQ ID NO: 530746

SEQ ID NO: 654771 - RNA, 64 nt, Homo Sapiens; identical to SEQ ID NO: 530747

SEQ ID NO: 654772 - RNA, 64 nt, Homo Sapiens; identical to SEQ ID NO: 530748

SEQ ID NO: 654773 - RNA, 64 nt, Homo Sapiens; identical to SEQ ID NO: 530749

SEQ ID NO: 654774 - RNA, 64 nt, Homo Sapiens; identical to SEQ ID NO: 530750

SEQ ID NO: 654775 - RNA, 64 nt, Homo Sapiens; identical to SEQ ID NO: 530751

SEQ ID NO: 654776 - RNA, 64 nt, Homo Sapiens; identical to SEQ ID NO: 530752

SEQ ID NO: 654777 - RNA, 64 nt, Homo Sapiens; identical to SEQ ID NO: 530753

SEQ ID NO: 654778 - RNA, 64 nt, Homo Sapiens; identical to SEQ ID NO: 530754

SEQ ID NO: 654779 - RNA, 64 nt, Homo Sapiens; identical to SEQ ID NO: 530755

SEQ ID NO: 654780 - RNA, 64 nt, Homo Sapiens; identical to SEQ ID NO: 530756

SEQ ID NO: 654781 - RNA, 64 nt, Homo Sapiens; identical to SEQ ID NO: 530757

SEQ ID NO: 654782 - RNA, 64 nt, Homo Sapiens; identical to SEQ ID NO: 530758

SEQ ID NO: 654783 - RNA, 64 nt, Homo Sapiens; identical to SEQ ID NO: 530759

SEQ ID NO: 654784 - RNA, 64 nt, Homo Sapiens; identical to SEQ ID NO: 530760

SEQ ID NO: 654785 - RNA, 64 nt, Homo Sapiens; identical to SEQ ID NO: 530761

SEQ ID NO: 654786 - RNA, 64 nt, Homo Sapiens; identical to SEQ ID NO: 530762

SEQ ID NO: 654787 - RNA, 64 nt, Homo Sapiens; identical to SEQ ID NO: 530763

SEQ ID NO: 654788 - RNA, 64 nt, Homo Sapiens; identical to SEQ ID NO: 530764

SEQ ID NO: 654789 - RNA, 64 nt, Homo Sapiens; identical to SEQ ID NO: 530765

SEQ ID NO: 654790 - RNA, 64 nt, Homo Sapiens; identical to SEQ ID NO: 530766

SEQ ID NO: 654791 - RNA, 64 nt, Homo Sapiens; identical to SEQ ID NO: 530767

SEQ ID NO: 654792 - RNA, 64 nt, Homo Sapiens; identical to SEQ ID NO: 530768

SEQ ID NO: 654793 - RNA, 64 nt, Homo Sapiens; identical to SEQ ID NO: 530769

SEQ ID NO: 654794 - RNA, 64 nt, Homo Sapiens; identical to SEQ ID NO: 530770

SEQ ID NO: 654795 - RNA, 64 nt, Homo Sapiens; identical to SEQ ID NO: 530771

SEQ ID NO: 654796 - RNA, 64 nt, Homo Sapiens; identical to SEQ ID NO: 530772

SEQ ID NO: 654797 - RNA, 64 nt, Homo Sapiens; identical to SEQ ID NO: 530773

SEQ ID NO: 654798 - RNA, 64 nt, Homo Sapiens; identical to SEQ ID NO: 530774

SEQ ID NO: 654799 - RNA, 64 nt, Homo Sapiens; identical to SEQ ID NO: 530775

SEQ ID NO: 654800 - RNA, 64 nt, Homo Sapiens; identical to SEQ ID NO: 530776

SEQ ID NO: 654801 - RNA, 64 nt, Homo Sapiens; identical to SEQ ID NO: 530777

SEQ ID NO: 654802 - RNA, 64 nt, Homo Sapiens; identical to SEQ ID NO: 530778

SEQ ID NO: 654803 - RNA, 64 nt, Homo Sapiens; identical to SEQ ID NO: 530779

SEQ ID NO: 654804 - RNA, 64 nt, Homo Sapiens; identical to SEQ ID NO: 530780

SEQ ID NO: 654805 - RNA, 64 nt, Homo Sapiens; identical to SEQ ID NO: 530781

SEQ ID NO: 654806 - RNA, 64 nt, Homo Sapiens; identical to SEQ ID NO: 530782

SEQ ID NO: 654807 - RNA, 64 nt, Homo Sapiens; identical to SEQ ID NO: 530783

SEQ ID NO: 654808 - RNA, 64 nt, Homo Sapiens; identical to SEQ ID NO: 530784

SEQ ID NO: 654809 - RNA, 64 nt, Homo Sapiens; identical to SEQ ID NO: 530785

SEQ ID NO: 654810 - RNA, 64 nt, Homo Sapiens; identical to SEQ ID NO: 530786

SEQ ID NO: 654811 - RNA, 64 nt, Homo Sapiens; identical to SEQ ID NO: 530787

SEQ ID NO: 654812 - RNA, 64 nt, Homo Sapiens; identical to SEQ ID NO: 530788

SEQ ID NO: 654813 - RNA, 64 nt, Homo Sapiens; identical to SEQ ID NO: 530789

SEQ ID NO: 654814 - RNA, 64 nt, Homo Sapiens; identical to SEQ ID NO: 530790

SEQ ID NO: 654815 - RNA, 64 nt, Homo Sapiens; identical to SEQ ID NO: 530791

SEQ ID NO: 654816 - RNA, 64 nt, Homo Sapiens; identical to SEQ ID NO: 530792

SEQ ID NO: 654817 - RNA, 64 nt, Homo Sapiens; identical to SEQ ID NO: 530793

SEQ ID NO: 654818 - RNA, 64 nt, Homo Sapiens; identical to SEQ ID NO: 530794

SEQ ID NO: 654819 - RNA, 64 nt, Homo Sapiens; identical to SEQ ID NO: 530795

SEQ ID NO: 654820 - RNA, 64 nt, Homo Sapiens; identical to SEQ ID NO: 530796

SEQ ID NO: 654821 - RNA, 64 nt, Homo Sapiens; identical to SEQ ID NO: 530797

SEQ ID NO: 654822 - RNA, 64 nt, Homo Sapiens; identical to SEQ ID NO: 530798

SEQ ID NO: 654823 - RNA, 64 nt, Homo Sapiens; identical to SEQ ID NO: 530799

SEQ ID NO: 654824 - RNA, 64 nt, Homo Sapiens; identical to SEQ ID NO: 530800

SEQ ID NO: 654825 - RNA, 64 nt, Homo Sapiens; identical to SEQ ID NO: 530801

SEQ ID NO: 654826 - RNA, 64 nt, Homo Sapiens; identical to SEQ ID NO: 530802

SEQ ID NO: 654827 - RNA, 64 nt, Homo Sapiens; identical to SEQ ID NO: 530803

SEQ ID NO: 654828 - RNA, 64 nt, Homo Sapiens; identical to SEQ ID NO: 530804

SEQ ID NO: 654829 - RNA, 64 nt, Homo Sapiens; identical to SEQ ID NO: 530805

SEQ ID NO: 654830 - RNA, 64 nt, Homo Sapiens; identical to SEQ ID NO: 530806

SEQ ID NO: 654831 - RNA, 64 nt, Homo Sapiens; identical to SEQ ID NO: 530807

SEQ ID NO: 654832 - RNA, 64 nt, Homo Sapiens; identical to SEQ ID NO: 530808

SEQ ID NO: 654833 - RNA, 64 nt, Homo Sapiens; identical to SEQ ID NO: 530809

SEQ ID NO: 654834 - RNA, 64 nt, Homo Sapiens; identical to SEQ ID NO: 530810

SEQ ID NO: 654835 - RNA, 64 nt, Homo Sapiens; identical to SEQ ID NO: 530811

SEQ ID NO: 654836 - RNA, 64 nt, Homo Sapiens; identical to SEQ ID NO: 530812

SEQ ID NO: 654837 - RNA, 64 nt, Homo Sapiens; identical to SEQ ID NO: 530813

SEQ ID NO: 654838 - RNA, 64 nt, Homo Sapiens; identical to SEQ ID NO: 530814

SEQ ID NO: 654839 - RNA, 64 nt, Homo Sapiens; identical to SEQ ID NO: 530815

SEQ ID NO: 654840 - RNA, 64 nt, Homo Sapiens; identical to SEQ ID NO: 530816

SEQ ID NO: 654841 - RNA, 64 nt, Homo Sapiens; identical to SEQ ID NO: 530817

SEQ ID NO: 654842 - RNA, 64 nt, Homo Sapiens; identical to SEQ ID NO: 530818

SEQ ID NO: 654843 - RNA, 64 nt, Homo Sapiens; identical to SEQ ID NO: 530819

SEQ ID NO: 654844 - RNA, 64 nt, Homo Sapiens; identical to SEQ ID NO: 530820

SEQ ID NO: 654845 - RNA, 64 nt, Homo Sapiens; identical to SEQ ID NO: 530821

SEQ ID NO: 654846 - RNA, 64 nt, Homo Sapiens; identical to SEQ ID NO: 530822

SEQ ID NO: 654847 - RNA, 64 nt, Homo Sapiens; identical to SEQ ID NO: 530823

SEQ ID NO: 654848 - RNA, 64 nt, Homo Sapiens; identical to SEQ ID NO: 530824

SEQ ID NO: 654849 - RNA, 64 nt, Homo Sapiens; identical to SEQ ID NO: 530825

SEQ ID NO: 654850 - RNA, 64 nt, Homo Sapiens; identical to SEQ ID NO: 530826

SEQ ID NO: 654851 - RNA, 64 nt, Homo Sapiens; identical to SEQ ID NO: 530827

SEQ ID NO: 654852 - RNA, 64 nt, Homo Sapiens; identical to SEQ ID NO: 530828

SEQ ID NO: 654853 - RNA, 64 nt, Homo Sapiens; identical to SEQ ID NO: 530829

SEQ ID NO: 654854 - RNA, 64 nt, Homo Sapiens; identical to SEQ ID NO: 530830

SEQ ID NO: 654855 - RNA, 64 nt, Homo Sapiens; identical to SEQ ID NO: 530831

SEQ ID NO: 654856 - RNA, 64 nt, Homo Sapiens; identical to SEQ ID NO: 530832

SEQ ID NO: 654857 - RNA, 64 nt, Homo Sapiens; identical to SEQ ID NO: 530833

SEQ ID NO: 654858 - RNA, 64 nt, Homo Sapiens; identical to SEQ ID NO: 530834

SEQ ID NO: 654859 - RNA, 64 nt, Homo Sapiens; identical to SEQ ID NO: 530835

SEQ ID NO: 654860 - RNA, 64 nt, Homo Sapiens; identical to SEQ ID NO: 530836

SEQ ID NO: 654861 - RNA, 64 nt, Homo Sapiens; identical to SEQ ID NO: 530837

SEQ ID NO: 654862 - RNA, 64 nt, Homo Sapiens; identical to SEQ ID NO: 530838

SEQ ID NO: 654863 - RNA, 64 nt, Homo Sapiens; identical to SEQ ID NO: 530839

SEQ ID NO: 654864 - RNA, 64 nt, Homo Sapiens; identical to SEQ ID NO: 530840

SEQ ID NO: 654865 - RNA, 64 nt, Homo Sapiens; identical to SEQ ID NO: 530841

SEQ ID NO: 654866 - RNA, 64 nt, Homo Sapiens; identical to SEQ ID NO: 530842

SEQ ID NO: 654867 - RNA, 64 nt, Homo Sapiens; identical to SEQ ID NO: 530819

SEQ ID NO: 654868 - RNA, 64 nt, Homo Sapiens; identical to SEQ ID NO: 530844

SEQ ID NO: 654869 - RNA, 64 nt, Homo Sapiens; identical to SEQ ID NO: 530845

SEQ ID NO: 654870 - RNA, 64 nt, Homo Sapiens; identical to SEQ ID NO: 654364

SEQ ID NO: 654871 - RNA, 64 nt, Homo Sapiens; identical to SEQ ID NO: 654365

SEQ ID NO: 654872 - RNA, 64 nt, Homo Sapiens; identical to SEQ ID NO: 654366

SEQ ID NO: 654873 - RNA, 64 nt, Homo Sapiens; identical to SEQ ID NO: 654367

SEQ ID NO: 654874 - RNA, 64 nt, Homo Sapiens; identical to SEQ ID NO: 654368

SEQ ID NO: 654875 - RNA, 64 nt, Homo Sapiens; identical to SEQ ID NO: 654369

SEQ ID NO: 654876 - RNA, 64 nt, Homo Sapiens; identical to SEQ ID NO: 193370

SEQ ID NO: 654877 - RNA, 64 nt, Homo Sapiens; identical to SEQ ID NO: 193371

SEQ ID NO: 654878 - RNA, 64 nt, Homo Sapiens; identical to SEQ ID NO: 193372

SEQ ID NO: 654879 - RNA, 64 nt, Homo Sapiens; identical to SEQ ID NO: 193373

SEQ ID NO: 654880 - RNA, 64 nt, Homo Sapiens; identical to SEQ ID NO: 193374

SEQ ID NO: 654881 - RNA, 64 nt, Homo Sapiens; identical to SEQ ID NO: 193375

SEQ ID NO: 654882 - RNA, 64 nt, Homo Sapiens; identical to SEQ ID NO: 193376

SEQ ID NO: 654883 - RNA, 64 nt, Homo Sapiens; identical to SEQ ID NO: 193377

SEQ ID NO: 654884 - RNA, 64 nt, Homo Sapiens; identical to SEQ ID NO: 193378

SEQ ID NO: 654885 - RNA, 64 nt, Homo Sapiens; identical to SEQ ID NO: 193379

SEQ ID NO: 654886 - RNA, 64 nt, Homo Sapiens; identical to SEQ ID NO: 193380

SEQ ID NO: 654887 - RNA, 64 nt, Homo Sapiens; identical to SEQ ID NO: 193381

SEQ ID NO: 654888 - RNA, 64 nt, Homo Sapiens; identical to SEQ ID NO: 193382

SEQ ID NO: 654889 - RNA, 64 nt, Homo Sapiens; identical to SEQ ID NO: 193383

SEQ ID NO: 654890 - RNA, 64 nt, Homo Sapiens; identical to SEQ ID NO: 193384

SEQ ID NO: 654891 - RNA, 64 nt, Homo Sapiens; identical to SEQ ID NO: 193385

SEQ ID NO: 654892 - RNA, 64 nt, Homo Sapiens; identical to SEQ ID NO: 193386

SEQ ID NO: 654893 - RNA, 64 nt, Homo Sapiens; identical to SEQ ID NO: 193387

SEQ ID NO: 654894 - RNA, 64 nt, Homo Sapiens; identical to SEQ ID NO: 193388

SEQ ID NO: 654895 - RNA, 64 nt, Homo Sapiens; identical to SEQ ID NO: 193389

SEQ ID NO: 654896 - RNA, 64 nt, Homo Sapiens; identical to SEQ ID NO: 193390

SEQ ID NO: 654897 - RNA, 64 nt, Homo Sapiens; identical to SEQ ID NO: 193391

SEQ ID NO: 654898 - RNA, 64 nt, Homo Sapiens; identical to SEQ ID NO: 193392

SEQ ID NO: 654899 - RNA, 64 nt, Homo Sapiens; identical to SEQ ID NO: 193393

SEQ ID NO: 654900 - RNA, 64 nt, Homo Sapiens; identical to SEQ ID NO: 263253

SEQ ID NO: 654901 - RNA, 64 nt, Homo Sapiens; identical to SEQ ID NO: 263254

SEQ ID NO: 654902 - RNA, 64 nt, Homo Sapiens; identical to SEQ ID NO: 263255

SEQ ID NO: 654903 - RNA, 64 nt, Homo Sapiens; identical to SEQ ID NO: 263256

SEQ ID NO: 654904 - RNA, 64 nt, Homo Sapiens; identical to SEQ ID NO: 263257

SEQ ID NO: 654905 - RNA, 64 nt, Homo Sapiens; identical to SEQ ID NO: 263258

SEQ ID NO: 654906 - RNA, 64 nt, Homo Sapiens; identical to SEQ ID NO: 263259

SEQ ID NO: 654907 - RNA, 64 nt, Homo Sapiens; identical to SEQ ID NO: 263260

SEQ ID NO: 654908 - RNA, 64 nt, Homo Sapiens; identical to SEQ ID NO: 263261

SEQ ID NO: 654909 - RNA, 64 nt, Homo Sapiens; identical to SEQ ID NO: 263262

SEQ ID NO: 654910 - RNA, 64 nt, Homo Sapiens; identical to SEQ ID NO: 263263

SEQ ID NO: 654911 - RNA, 64 nt, Homo Sapiens; identical to SEQ ID NO: 263264

SEQ ID NO: 654912 - RNA, 64 nt, Homo Sapiens; identical to SEQ ID NO: 263265

SEQ ID NO: 654913 - RNA, 64 nt, Homo Sapiens; identical to SEQ ID NO: 263266

SEQ ID NO: 654914 - RNA, 64 nt, Homo Sapiens; identical to SEQ ID NO: 263267

SEQ ID NO: 654915 - RNA, 64 nt, Homo Sapiens; identical to SEQ ID NO: 263268

SEQ ID NO: 654916 - RNA, 64 nt, Homo Sapiens; identical to SEQ ID NO: 263269

SEQ ID NO: 654917 - RNA, 64 nt, Homo Sapiens; identical to SEQ ID NO: 263270

SEQ ID NO: 654918 - RNA, 64 nt, Homo Sapiens; identical to SEQ ID NO: 263271

SEQ ID NO: 654919 - RNA, 64 nt, Homo Sapiens; identical to SEQ ID NO: 263272

SEQ ID NO: 654920 - RNA, 59 nt, Homo Sapiens; identical to SEQ ID NO: 263273

SEQ ID NO: 654921 - RNA, 64 nt, Homo Sapiens; identical to SEQ ID NO: 164108

SEQ ID NO: 654922 - RNA, 64 nt, Homo Sapiens; identical to SEQ ID NO: 164109

SEQ ID NO: 654923 - RNA, 64 nt, Homo Sapiens; identical to SEQ ID NO: 164110

SEQ ID NO: 654924 - RNA, 64 nt, Homo Sapiens; identical to SEQ ID NO: 164111

SEQ ID NO: 654925 - RNA, 64 nt, Homo Sapiens; identical to SEQ ID NO: 164112

SEQ ID NO: 654926 - RNA, 64 nt, Homo Sapiens; identical to SEQ ID NO: 164113

SEQ ID NO: 654927 - RNA, 64 nt, Homo Sapiens; identical to SEQ ID NO: 164114

SEQ ID NO: 654928 - RNA, 64 nt, Homo Sapiens; identical to SEQ ID NO: 164115

SEQ ID NO: 654929 - RNA, 64 nt, Homo Sapiens; identical to SEQ ID NO: 164116

SEQ ID NO: 654930 - RNA, 64 nt, Homo Sapiens; identical to SEQ ID NO: 164117

SEQ ID NO: 654931 - RNA, 64 nt, Homo Sapiens; identical to SEQ ID NO: 164118

SEQ ID NO: 654932 - RNA, 64 nt, Homo Sapiens; identical to SEQ ID NO: 164119

SEQ ID NO: 654933 - RNA, 64 nt, Homo Sapiens; identical to SEQ ID NO: 164120

SEQ ID NO: 654934 - RNA, 64 nt, Homo Sapiens; identical to SEQ ID NO: 164121

SEQ ID NO: 654935 - RNA, 64 nt, Homo Sapiens; identical to SEQ ID NO: 164122

SEQ ID NO: 654936 - RNA, 64 nt, Homo Sapiens; identical to SEQ ID NO: 164123

SEQ ID NO: 654937 - RNA, 64 nt, Homo Sapiens; identical to SEQ ID NO: 164124

SEQ ID NO: 654938 - RNA, 64 nt, Homo Sapiens; identical to SEQ ID NO: 164125

SEQ ID NO: 654939 - RNA, 64 nt, Homo Sapiens; identical to SEQ ID NO: 164126

SEQ ID NO: 654940 - RNA, 64 nt, Homo Sapiens; identical to SEQ ID NO: 164127

SEQ ID NO: 654941 - RNA, 64 nt, Homo Sapiens; identical to SEQ ID NO: 164128

SEQ ID NO: 654942 - RNA, 64 nt, Homo Sapiens; identical to SEQ ID NO: 164129

SEQ ID NO: 654943 - RNA, 64 nt, Homo Sapiens; identical to SEQ ID NO: 164130

SEQ ID NO: 654944 - RNA, 64 nt, Homo Sapiens
gagagggaaaagcacaaugcaagaaccuaacuaacgugaugauaugaagaguuuucuuaagacc

SEQ ID NO: 654945 - RNA, 64 nt, Homo Sapiens
gcagcccaagggcuccagacacaccugaacacaucgugaugaugacguccucucaacucucuuu

SEQ ID NO: 654946 - RNA, 64 nt, Homo Sapiens
cuccgucucuaccaaaaaauacuagccugggcaacgugaugagacuugaacucaggaguucgag

SEQ ID NO: 654947 - RNA, 64 nt, Homo Sapiens
uaaagcaucuacgucagcaguagaggacauuuagcgugaugaaaaggauugaagaauucaccau

SEQ ID NO: 654948 - RNA, 64 nt, Homo Sapiens
ccuguuucuaaggaaaugcaugugugcccugagccgugaugauccucccauccguguugugagc

SEQ ID NO: 654949 - RNA, 64 nt, Homo Sapiens
ucuugcuaagugucacacacacucuucccaaagacgugaugaguuaaaguuguauucugaaauc

SEQ ID NO: 654950 - RNA, 64 nt, Homo Sapiens
uauagauucuguagucuggugaaggugugggugacgugaugagagguuugagaaaugggugaaa

SEQ ID NO: 654951 - RNA, 64 nt, Homo Sapiens
gacuggcuucccugugggacgcuuuugucugacacgugaugaugugguccugccugccacugug

SEQ ID NO: 654952 - RNA, 64 nt, Homo Sapiens
gugggaagggcuuugguggaggaaacucuggugacgugaugaauuagaacucucccuacuagcu

SEQ ID NO: 654953 - RNA, 64 nt, Homo Sapiens
aaaaauuuauuuggcucacacacagacuggguaacgugaugaacgggcugcuauaacagaauac

SEQ ID NO: 654954 - RNA, 64 nt, Homo Sapiens
ugugcugcugcugaccgacggggacgugcacauccgugaugacgggcgccgggccaccaucuca

SEQ ID NO: 654955 - RNA, 64 nt, Homo Sapiens
cuuucacauguaaacacauuuugacguaaaucaacgugaugauuauaaacaaauaugauguucu

SEQ ID NO: 654956 - RNA, 64 nt, Homo Sapiens
uguuaauauggcaguaauuaccuccuguggcuuacgugaugaauaauuccuuaugagacucuug

SEQ ID NO: 654957 - RNA, 64 nt, Homo Sapiens
agcuguuugucauagggcagaccaucauuauaaacgugaugaucguucgaagcuccgugaguga

SEQ ID NO: 654958 - RNA, 64 nt, Homo Sapiens
ccugucucuacuaaaaauacaaaaaguagccagccgugaugacaggcaccuguaaucccagcua

SEQ ID NO: 654959 - RNA, 64 nt, Homo Sapiens
uaucacaugucagccacuguuguuaauauuucuucgugaugacagcagauauucucuagucauu

SEQ ID NO: 654960 - RNA, 64 nt, Homo Sapiens
ugugagacagacuugacuuggaucaggaugucagcgugaugaggguaaaaguggaagagaggca

SEQ ID NO: 654961 - RNA, 56 nt, Homo Sapiens
auagcuuuggauuaaauuagagaucucgugaugacgcguuguuuucugccauuuau

SEQ ID NO: 654962 - RNA, 64 nt, Homo Sapiens
uugacuuucccacuguugcuggagacaaagacaucgugaugagagaaaguucgcacaaucuagu

SEQ ID NO: 654963 - RNA, 64 nt, Homo Sapiens
acccagcgcaccccucccccccuuuuuuuaaacgcgugaugaagacagaaggcuccggggugac

SEQ ID NO: 654964 - RNA, 64 nt, Homo Sapiens
cuggcccuuucuuauucuuuggcuccucauccaccgugaugagaagcgcugcuguggccacggc

SEQ ID NO: 654965 - RNA, 64 nt, Homo Sapiens
gcagcguuacuucugaccguugugagagguuagccgugaugaaagcugugaauacuucucucag

SEQ ID NO: 654966 - RNA, 64 nt, Homo Sapiens
auaccagugaaaagauuuuuaaauagaaggcuuccgugaugaaaauuaggcaccguauugcaua

SEQ ID NO: 654967 - RNA, 64 nt, Homo Sapiens
cuuaaauauauauucuuuguggcucuacagcagucgugaugaaauauuaauguaaaaagggggg

SEQ ID NO: 654968 - RNA, 64 nt, Homo Sapiens
agacagaaaaugaauuccgucgguauguuccaaucgugaugaauuugagaaacauugcaagagg

SEQ ID NO: 654969 - RNA, 64 nt, Homo Sapiens
guugaauugcaccaucgugaaagaugggaaaaaucgugaugauggguaaggggaaaacuucccg

SEQ ID NO: 654970 - RNA, 64 nt, Homo Sapiens
gacggaagcagcagcgggccagcagcuggauuuucgugaugaagggugacagagaugauggaug

SEQ ID NO: 654971 - RNA, 64 nt, Homo Sapiens
ugugcggcggcuaccugagcugaccccugcugagcgugaugaucuagccuccaucaugaagaag

SEQ ID NO: 654972 - RNA, 55 nt, Homo Sapiens
auacuaagaagaaugaauaaauuuacgugaugagcucuacaaggccaaaaauuuu

SEQ ID NO: 654973 - RNA, 64 nt, Homo Sapiens
acaagcaacauuuaucuaauuuugcugugaacaacgugaugacaggugcuuauuuuuucaaaaa

SEQ ID NO: 654974 - RNA, 64 nt, Homo Sapiens
acuuucuaaauuucaguaguacguuucuuugugucgugaugaaagaugaccacuaauugauaga

SEQ ID NO: 654975 - RNA, 64 nt, Homo Sapiens
acuuucuaaauuucaguaguacguuacuuugugucgugaugaaagaugaccucuaacugauaga

SEQ ID NO: 654976 - RNA, 64 nt, Homo Sapiens
ugugucauugaucagcaccauuugugguauguuccgugaugagcguuuagugagccugcuggcu

SEQ ID NO: 654977 - RNA, 58 nt, Homo Sapiens
agacacuuucugccucauuugagggaaccgugaugaagucuaucagucucgggacuga

SEQ ID NO: 654978 - RNA, 64 nt, Homo Sapiens
ucacuaguacuaccuuucuauagauaacaauacacgugaugaugggcaccacacauuugcccca

SEQ ID NO: 654979 - RNA, 64 nt, Homo Sapiens
caaacugaaaauuauugcaaauaggcucugcuaacgugaugagaauccuuucuaaauugcauga

SEQ ID NO: 654980 - RNA, 64 nt, Homo Sapiens
ccacacuuccucagccgcaugucuaauccccagucgugaugauucuccugagcgcccguucuug

SEQ ID NO: 654981 - RNA, 62 nt, Homo Sapiens
aagacuucgcgcauaucacuaauaaaccugaagucgugaugaaaagccgugugugugacugg

SEQ ID NO: 654982 - RNA, 64 nt, Homo Sapiens
uuauugcuaauuggaaauuuucccaauaccccaccgugaugacuugaaauauaaucagcgcugg

SEQ ID NO: 654983 - RNA, 64 nt, Homo Sapiens
gugcuaccuucauuauaguucaaaucaguguguucgugaugacucaggcuccccuaaagaauag

SEQ ID NO: 654984 - RNA, 64 nt, Homo Sapiens
aaccuaauacuguaauuugagcuuuuguucaaaucgugaugagaggacucauuucaagcaguuu

SEQ ID NO: 654985 - RNA, 64 nt, Homo Sapiens
auaggugaacacaccuugucauccaucaguguuacgugaugagaauugauaaauuagguaugga

SEQ ID NO: 654986 - RNA, 64 nt, Homo Sapiens
uacucgugguucuggagcucgugagcgcucaggacgugaugaggcaggcggcuugcugggggau

SEQ ID NO: 654987 - RNA, 64 nt, Homo Sapiens
cugagaaaacgaaacugcucuaagcacacggagacgugaugaagggaggaggugaacuguuucc

SEQ ID NO: 654988 - RNA, 64 nt, Homo Sapiens
ugugcagccccccugcccugguguccuggguuuucgugaugaucuuugcucuguuuccaguggg

SEQ ID NO: 654989 - RNA, 64 nt, Homo Sapiens
uauuuggugcacugaugccaauugucuuaaaauacgugaugaguuaaaagcauaauuuaauagc

SEQ ID NO: 654990 - RNA, 64 nt, Homo Sapiens
gcagggcgcgggggggaggcuggggucccgccgccgugaugaauguacugacgagccgaggcag

SEQ ID NO: 654991 - RNA, 64 nt, Homo Sapiens
agaggcugauucuuguagaauuaacagcccucaacgugaugagcuaugauaacacuaugaauua

SEQ ID NO: 654992 - RNA, 64 nt, Homo Sapiens
uuuuaagucucaaauggugugcccuucugaguagcgugaugaaaucucucgcuguccggcucca

SEQ ID NO: 654993 - RNA, 64 nt, Homo Sapiens
auuugauuuuguucuagauuacuuuucaacccaacgugaugaauauaagaugcaaaaucuucca

SEQ ID NO: 654994 - RNA, 64 nt, Homo Sapiens
cauuucaaaauccugagugauaaaacaaauuucucgugaugauuuguucucagugauucaacuu

SEQ ID NO: 654995 - RNA, 64 nt, Homo Sapiens
gaggacuuggguccucggucaucacuggggaggacgugaugaguuaccccagcuccauccuugc

SEQ ID NO: 654996 - RNA, 62 nt, Homo Sapiens
cugggcacagagggucagguggagaugcuugccgugaugacgacuccaaggcuggugaguga

SEQ ID NO: 654997 - RNA, 64 nt, Homo Sapiens
ucucuacgcgcuuucuugucccacagggagccgccgugaugagcacagccaacccaguucccgg

SEQ ID NO: 654998 - RNA, 64 nt, Homo Sapiens
aacaggauggcuuucuguagccacaccugugaggcgugaugauuguuguauuauuagauuacug

SEQ ID NO: 654999 - RNA, 64 nt, Homo Sapiens
ggcaggguucaacagaccagaauuggugggacagcgugaugacccugugcauucuagaccagcc

SEQ ID NO: 655000 - RNA, 64 nt, Homo Sapiens
cagcuagguuaauaggaggacccuuccccacucccgugaugaaagaagcaccccaccacacaca

SEQ ID NO: 655001 - RNA, 64 nt, Homo Sapiens
uaauuucuggguagauccugggaauagaagaaaucgugaugaaacaauugcuucaggcacaggu

SEQ ID NO: 655002 - RNA, 64 nt, Homo Sapiens; identical to SEQ ID NO: 382042

SEQ ID NO: 655003 - RNA, 64 nt, Homo Sapiens; identical to SEQ ID NO: 382043

SEQ ID NO: 655004 - RNA, 64 nt, Homo Sapiens; identical to SEQ ID NO: 382044

SEQ ID NO: 655005 - RNA, 64 nt, Homo Sapiens; identical to SEQ ID NO: 382045

SEQ ID NO: 655006 - RNA, 64 nt, Homo Sapiens; identical to SEQ ID NO: 382046

SEQ ID NO: 655007 - RNA, 64 nt, Homo Sapiens; identical to SEQ ID NO: 382047

SEQ ID NO: 655008 - RNA, 64 nt, Homo Sapiens; identical to SEQ ID NO: 382048

SEQ ID NO: 655009 - RNA, 64 nt, Homo Sapiens; identical to SEQ ID NO: 382049

SEQ ID NO: 655010 - RNA, 64 nt, Homo Sapiens; identical to SEQ ID NO: 382050

SEQ ID NO: 655011 - RNA, 64 nt, Homo Sapiens; identical to SEQ ID NO: 382051

SEQ ID NO: 655012 - RNA, 64 nt, Homo Sapiens; identical to SEQ ID NO: 382052

SEQ ID NO: 655013 - RNA, 64 nt, Homo Sapiens; identical to SEQ ID NO: 382053

SEQ ID NO: 655014 - RNA, 64 nt, Homo Sapiens; identical to SEQ ID NO: 382054

SEQ ID NO: 655015 - RNA, 64 nt, Homo Sapiens; identical to SEQ ID NO: 382055

SEQ ID NO: 655016 - RNA, 64 nt, Homo Sapiens; identical to SEQ ID NO: 382056

SEQ ID NO: 655017 - RNA, 64 nt, Homo Sapiens; identical to SEQ ID NO: 382057

SEQ ID NO: 655018 - RNA, 64 nt, Homo Sapiens; identical to SEQ ID NO: 382058

SEQ ID NO: 655019 - RNA, 64 nt, Homo Sapiens; identical to SEQ ID NO: 382059

SEQ ID NO: 655020 - RNA, 64 nt, Homo Sapiens; identical to SEQ ID NO: 382060

SEQ ID NO: 655021 - RNA, 64 nt, Homo Sapiens; identical to SEQ ID NO: 382061

SEQ ID NO: 655022 - RNA, 64 nt, Homo Sapiens
aaagaaagggaaaaagcagaaacacugcagaagacacaaacaaacaaagaagagaaggauucuu

SEQ ID NO: 655023 - RNA, 64 nt, Homo Sapiens
caauucggaaaacaauaggggaaagccacaaaagcacaaacaugggucaaaggaaaaucuuaaa

SEQ ID NO: 655024 - RNA, 64 nt, Homo Sapiens
uuuuuuuuuuuuuuuuuuuuuaaugucaaaauugcacaaacauggugcucuaccaggaaggauu

SEQ ID NO: 655025 - RNA, 64 nt, Homo Sapiens
uagauaggcucaggccacacuuuaaaaacaaacacacaaacaacaaaaaacggguauucuaguc

SEQ ID NO: 655026 - RNA, 64 nt, Homo Sapiens
cauaaagagagcaauugauaugugcaacaguacacacaaacauauauauuugugugcauuugca

SEQ ID NO: 655027 - RNA, 64 nt, Homo Sapiens
ugaugaugucauucaauuaaauauauuggccagacacaaacaguucauuauuacaucaaagcau

SEQ ID NO: 655028 - RNA, 64 nt, Homo Sapiens
caugcuucagcugugacucagcaguuccuuaaaucacaaacaaugguaggucuauuauuuucuc

SEQ ID NO: 655029 - RNA, 64 nt, Homo Sapiens
aauaauaaugacaaaaagcacaugcagaguaauacacaaacaaaaaaagugacaguuacuuuuu

SEQ ID NO: 655030 - RNA, 64 nt, Homo Sapiens
gagcucccacacguacacaugcacauguacgcaccacaaacacaugcgcaggcuccugcaggcg

SEQ ID NO: 655031 - RNA, 64 nt, Homo Sapiens
auacacacaugcacacacauauacacacaugugccacaaacaagugcacacuguccuggugucc

SEQ ID NO: 655032 - RNA, 64 nt, Homo Sapiens
agaucugccucacaccuucaaauucaugaaaggacacaaacacacauaagaauacacucuggag

SEQ ID NO: 655033 - RNA, 64 nt, Homo Sapiens
agaucugccaagaaccuucgaauucaugaaaggacacaaacacacguaagaaugcacucuguag

SEQ ID NO: 655034 - RNA, 64 nt, Homo Sapiens
agaggaaaaaaaagcaacaaaagcgacaaaaaaacacaaacagaaaaaaagaaaaaaaucaaaa

SEQ ID NO: 655035 - RNA, 64 nt, Homo Sapiens
acccaggaacacgcagacauaggucacggagaaacacaaacaccggacaucaaauuuggacacc

SEQ ID NO: 655036 - RNA, 64 nt, Homo Sapiens
aaaagacaaaaaauuagcugggcaugguggcauauaccuguaaccccaacuacuuggguggcug

SEQ ID NO: 655037 - RNA, 64 nt, Homo Sapiens
agugauccuguguaaaacugccaaggaaaguaauuaccuguaggaguuugcugagcuugaagag

SEQ ID NO: 655038 - RNA, 64 nt, Homo Sapiens
aguauugcuguguaaaaauuuggauugccguuuguaccuguaucaacugaaaggucgauuguaa

SEQ ID NO: 655039 - RNA, 64 nt, Homo Sapiens
gucuuacuugugauugugccgaauagccacaucuuaccuguaaacuggaguagaaaccaaaugu

SEQ ID NO: 655040 - RNA, 64 nt, Homo Sapiens
aaaggaauuuuaacaaagagucauuuauaaaaaguaccuguaucaaccgaauguucauucauau

SEQ ID NO: 655041 - RNA, 64 nt, Homo Sapiens
guuuuauaaaguguggucagaaucuauguugguuuaccuguaguagcuuugcuugcagccuucc

SEQ ID NO: 655042 - RNA, 64 nt, Homo Sapiens
uuauucuugaaguuggccaaauuauuucaguauuuaccuguauuagugaagaacuuauuuaaga

SEQ ID NO: 655043 - RNA, 64 nt, Homo Sapiens
ugaaggacgguucuggggcauguaguucccggguuaccuguauccaauuucaaaaggcugcuga

SEQ ID NO: 655044 - RNA, 64 nt, Homo Sapiens
gaaaauuuccucaugcugaauuguaauuuucucuuaccuguaaaguaaaauuuagaucaauucc

SEQ ID NO: 655045 - RNA, 64 nt, Homo Sapiens
uugaauuauuuucuaaaauuaagagccguauaccuaccuguaagucuuuucacauaucauuuaa

SEQ ID NO: 655046 - RNA, 64 nt, Homo Sapiens
cauuuuaggucccagaauggacauguacugcuaguaccuguaagggaaaagucuuugcuauccg

SEQ ID NO: 655047 - RNA, 64 nt, Homo Sapiens
aaacagaaaagagaagaaaggguuccagggacuguaccuguaggaggaaaaggcuggcaaggug

SEQ ID NO: 655048 - RNA, 64 nt, Homo Sapiens
gacucauuggaaugauauaauguuuugaauggauuaccuguaguugauaguauuaagcaaguca

SEQ ID NO: 655049 - RNA, 64 nt, Homo Sapiens
guauuuaugugauaugugucaaaaauaaacuaaguaccuguagugauuggccuaggcuaaggac

SEQ ID NO: 655050 - RNA, 64 nt, Homo Sapiens
uggucaauaacuguuacuuuuaaguauccuuuaauaccuguaccuuuuguuuuagaagauuguu

SEQ ID NO: 655051 - RNA, 64 nt, Homo Sapiens
cauaauguagauaaaaagaaaaaaaggauaugguuaccuguaaucuuaccaaucauagauaauc

SEQ ID NO: 655052 - RNA, 64 nt, Homo Sapiens
ucugcaaauacagaccauuuuuuaucuuucaucuuaccuguaauccuagcacuuugagaccacu

SEQ ID NO: 655053 - RNA, 64 nt, Homo Sapiens
caugguuaauauuucuucauuuuauuuuaaagcuuaccuguaucauuacuuaugaagucaguuu

SEQ ID NO: 655054 - RNA, 64 nt, Homo Sapiens
gacaguucacuaauuguugaauuuuacuguauauucauauaaaaaugcaaacguacuagaccag

SEQ ID NO: 655055 - RNA, 64 nt, Homo Sapiens
uugugaaagaaaauggucauuuuuuuuacugaagucauauaaugacuugggucagcucguaaug

SEQ ID NO: 655056 - RNA, 64 nt, Homo Sapiens
uaaaaauauaaacaauguucaggagaguaaaaauucauauaaagugcaauugcacaaauacaag

SEQ ID NO: 655057 - RNA, 64 nt, Homo Sapiens
accaugugcaucaggaaacaccucacucauacugucauauaaugcaacagggaggcauagucuc

SEQ ID NO: 655058 - RNA, 64 nt, Homo Sapiens
uaaagaaacacuaaauuaguaauucaccaaaaguucauauaauucuugguuugguacaguucau

SEQ ID NO: 655059 - RNA, 64 nt, Homo Sapiens
aagacaguggcacuaaaaugagaaaaauuacagaucauauaagcuuauacauaaacaguuuugg

SEQ ID NO: 655060 - RNA, 64 nt, Homo Sapiens
uuuguaugauuaaaaauaaauuacugcaguuaaaucauauaauguaagaaaagauauaauuucu

SEQ ID NO: 655061 - RNA, 64 nt, Homo Sapiens
aaaagcuguggaaaagagucaauuaugaguuuguucauauaaagaguugagaugcauuuuacau

SEQ ID NO: 655062 - RNA, 64 nt, Homo Sapiens
gaaaaaaaaaagugaagccacauaauaggaugaaucauauaacaucucugcuuucagaaguaga

SEQ ID NO: 655063 - RNA, 64 nt, Homo Sapiens
ugcuuuuauuacuuaauguaacaagggcuguuacucauauaacuuuaccuuagccacuaagaag

SEQ ID NO: 655064 - RNA, 64 nt, Homo Sapiens
aacaugcuucgucagaggugcaugauccuugccuucauauaacauauaacaugcuucgugccau

SEQ ID NO: 655065 - RNA, 64 nt, Homo Sapiens
ugcuucgugccaucaugauccauggucauugccuucauauaacacauauaacaugcuucgugcu

SEQ ID NO: 655066 - RNA, 64 nt, Homo Sapiens
ugcuucgugcucauggucaucauggucauugccuucauauaacaauuuugguggcagcugccau

SEQ ID NO: 655067 - RNA, 64 nt, Homo Sapiens
agaaucuuauaguacguuccccuuuucuggacugucauauaaacucuccgucacuauuauuuug

SEQ ID NO: 655068 - RNA, 64 nt, Homo Sapiens
acuuuaaugaauuaggauaaaguauaaaauccaaucauauaaaagucucuagguaauugauuua

SEQ ID NO: 655069 - RNA, 64 nt, Homo Sapiens
caaaccuaauuguccaacuaacauuugguugagcucauauaaucuuuguugcagcugucagcua

SEQ ID NO: 655070 - RNA, 64 nt, Homo Sapiens
uaauaauauaaaguuugaacuuagagaauuuauuucauauaaaauaugggagauagcacuguaa

SEQ ID NO: 655071 - RNA, 64 nt, Homo Sapiens
uauagaauaaaguaccaccuaaaacugaauuuuaucauauaagcaaguaauaccuauuagucau

SEQ ID NO: 655072 - RNA, 64 nt, Homo Sapiens
ccuaaguguauaauuaugugcaauguucaauaccucauauaauacuugcucaacaguauagugg

SEQ ID NO: 655073 - RNA, 64 nt, Homo Sapiens
gaauauauacucucgugagacucguguauauacuucauauaaguuauaagugaaaucauacacu

SEQ ID NO: 655074 - RNA, 64 nt, Homo Sapiens
gaaaucauacacucucgugugagcuucuagaacuucauauaaguuauuggccuugccucuucua

SEQ ID NO: 655075 - RNA, 64 nt, Homo Sapiens; identical to SEQ ID NO: 312121

SEQ ID NO: 655076 - RNA, 64 nt, Homo Sapiens; identical to SEQ ID NO: 312122

SEQ ID NO: 655077 - RNA, 64 nt, Homo Sapiens; identical to SEQ ID NO: 312123

SEQ ID NO: 655078 - RNA, 64 nt, Homo Sapiens; identical to SEQ ID NO: 312124

SEQ ID NO: 655079 - RNA, 64 nt, Homo Sapiens; identical to SEQ ID NO: 312125

SEQ ID NO: 655080 - RNA, 64 nt, Homo Sapiens; identical to SEQ ID NO: 312126

SEQ ID NO: 655081 - RNA, 64 nt, Homo Sapiens; identical to SEQ ID NO: 312127

SEQ ID NO: 655082 - RNA, 64 nt, Homo Sapiens; identical to SEQ ID NO: 312128

SEQ ID NO: 655083 - RNA, 64 nt, Homo Sapiens; identical to SEQ ID NO: 312129

SEQ ID NO: 655084 - RNA, 64 nt, Homo Sapiens; identical to SEQ ID NO: 312130

SEQ ID NO: 655085 - RNA, 64 nt, Homo Sapiens; identical to SEQ ID NO: 312131

SEQ ID NO: 655086 - RNA, 64 nt, Homo Sapiens; identical to SEQ ID NO: 312132

SEQ ID NO: 655087 - RNA, 64 nt, Homo Sapiens
cgggguuucaccauguuggucaggcuggucucaaacuccugaccucaggugauccgcccaccuc

SEQ ID NO: 655088 - RNA, 64 nt, Homo Sapiens
cgggguuucaccauguuggccaggcuguucucgaacuccugaccucaggugaucugcccgccuc

SEQ ID NO: 655089 - RNA, 64 nt, Homo Sapiens
ucagguaaucgaccugccuccaggcugcucuugaacuccugacccaggguuucaccauguuggc

SEQ ID NO: 655090 - RNA, 64 nt, Homo Sapiens
uuaggugauccacucgccuucaggcuggucucgaacuccugacccgggguuucaccauguuggc

SEQ ID NO: 655091 - RNA, 64 nt, Homo Sapiens
auggagucucaccacauaggccaggcagucucgaacuccugaccucaggugauccacccaccuu

SEQ ID NO: 655092 - RNA, 64 nt, Homo Sapiens
caggguucaaccauguuggucaggcuggucucgaacuccugaccgcaagugauccacacgccuu

SEQ ID NO: 655093 - RNA, 64 nt, Homo Sapiens
cgggguuucaccacguugcccaggcuggucuugaacuccugaccuccagugauccgccugccuu

SEQ ID NO: 655094 - RNA, 64 nt, Homo Sapiens
acagguuuugccauguugcccaggcuggccucaaacuccugagcucaagugauccucccgucuc

SEQ ID NO: 655095 - RNA, 64 nt, Homo Sapiens
caggguuucaccauauuggccaggcuggucucgaacuccugaccuugugaucugcccgccucca

SEQ ID NO: 655096 - RNA, 64 nt, Homo Sapiens
cgggguuucaccacauucgucagguugguuucaaacuccugacuuugugauccacccgccucgg

SEQ ID NO: 655097 - RNA, 64 nt, Homo Sapiens
uugcuccauacuuuuaaauacugcaggucucugcacuccugauuguauucucucucuggcucug

SEQ ID NO: 655098 - RNA, 64 nt, Homo Sapiens
ugucccuuagcuauaaucaguuaaggaaaagucaacuccugaaaccuccucucuauuuguuuuu

SEQ ID NO: 655099 - RNA, 64 nt, Homo Sapiens
cgggauuuuaucauguuggccaggcuggucucgaacuccugaccucaggugaucugcccaccuu

SEQ ID NO: 655100 - RNA, 64 nt, Homo Sapiens
cgggguuucaccauguuggccaggcuggucuugaacuccugaccucaacugauccgcccaccuu

SEQ ID NO: 655101 - RNA, 64 nt, Homo Sapiens
acacgguucucuccuagccucuacaagcagugggacuccugagagauaacuuccccacuccacc

SEQ ID NO: 655102 - RNA, 64 nt, Homo Sapiens
ugggagaggcagggaucagaggucagacucugggacuccugagaagacauggagccccucccuu

SEQ ID NO: 655103 - RNA, 64 nt, Homo Sapiens
ucgugauccacccaccuuggcagacuggucuuggacuccugaccugguguuucaccauguuggc

SEQ ID NO: 655104 - RNA, 64 nt, Homo Sapiens
ucaagcaauccguccacuugcaggcuggucucaaacuccugagcggaguuuugccauguggucc

SEQ ID NO: 655105 - RNA, 64 nt, Homo Sapiens
agggguuucaccacguuggccaggcuggucucgaacuccugaccuuaggugauccgcccgccuc

SEQ ID NO: 655106 - RNA, 64 nt, Homo Sapiens
caggauuucaccauguuggccaggccagucucaaacuccugaccucaggugauccaccugccuc

SEQ ID NO: 655107 - RNA, 64 nt, Homo Sapiens
cagacaugauccaguccagcaggccuagcagucaacuccugauugcacaacucagacaccccug

SEQ ID NO: 655108 - RNA, 64 nt, Homo Sapiens
ucaagugaucugccugccuucaggcuggucucgaacuccugacccaggguuucaccauguuggc

SEQ ID NO: 655109 - RNA, 64 nt, Homo Sapiens
gacggguucaccguguuggccaggcuggucuugaacuccugaccucaggugauacccgcccccc

SEQ ID NO: 655110 - RNA, 64 nt, Homo Sapiens
gacacuuuccucuguuccauuccccaucucagggacuccugaauauucagccucuccaggcugg

SEQ ID NO: 655111 - RNA, 64 nt, Homo Sapiens
ugggguuucaccauguuagccaggcuggucucaaacuccugacccugugauccgcccgccucgg

SEQ ID NO: 655112 - RNA, 64 nt, Homo Sapiens
ggacucccgcguugauggaccguucuuggugcagacuccugacugcgugcaugaaaccugagac

SEQ ID NO: 655113 - RNA, 64 nt, Homo Sapiens
aagggagugugaccugcaguagagucugcauggcacuccugaaguuggccuguuagauuguucc

SEQ ID NO: 655114 - RNA, 64 nt, Homo Sapiens
ugcgggagagguggcccagagucccucuagcaucacuccugagcugggaaguccugagugcucc

SEQ ID NO: 655115 - RNA, 64 nt, Homo Sapiens
cauuaucaaacccgaguggauccgaauguucucaacuccugaacugcagcgucucaucucuggc

SEQ ID NO: 655116 - RNA, 64 nt, Homo Sapiens
ccuaagguacacaucccaucugggcgguggcuucacuccugagucugcaaaaucccaggaaacu

SEQ ID NO: 655117 - RNA, 64 nt, Homo Sapiens
ucaggugauccaccuuucucggccaggcugauuaacuccugaccagacgggguuucaccauguu

SEQ ID NO: 655118 - RNA, 64 nt, Homo Sapiens
uugugauccacccaccucggcaggcuggucuugaacuccugacccagaguuucaccauguuggc

SEQ ID NO: 655119 - RNA, 64 nt, Homo Sapiens
ucuuuguucucacuguauucuagcugacaaggacacuccugaggcugucucuggucucuuccuu

SEQ ID NO: 655120 - RNA, 64 nt, Homo Sapiens
gccacccuaucgcccccuacgcgccuugucuccuacuccugacuccuaccugcccuggaacauc

SEQ ID NO: 655121 - RNA, 64 nt, Homo Sapiens
gcaauaacuucugaccuuuuggugaaagcugagaacuccugacuguaacauauucuguaugaac

SEQ ID NO: 655122 - RNA, 64 nt, Homo Sapiens
caggguuucaccauguuggccaggcuggucucgaacuccugaccucgugauccgccugccucag

SEQ ID NO: 655123 - RNA, 64 nt, Homo Sapiens
gggaguuucaccauguuggccagguuggucuugaacuccugaccucaggugauccuccugccuc

SEQ ID NO: 655124 - RNA, 64 nt, Homo Sapiens
ugggguuucaccauguuggccaggcuugucucgaacuccugaccccaaguuauccaccugccuu

SEQ ID NO: 655125 - RNA, 64 nt, Homo Sapiens
acggguuucaccauguuggcuagacuagucucaaacuccugaccucaagugaucugcccgccuc

SEQ ID NO: 655126 - RNA, 64 nt, Homo Sapiens
ugagguuucuccauguuggucaggcuggucucgaacuccugaccucaggugauccacccaccuu

SEQ ID NO: 655127 - RNA, 64 nt, Homo Sapiens
aauuugaacaucaaaagagauacuuacugacuccacuccugacuucugcuucugaaaaaaugaa

SEQ ID NO: 655128 - RNA, 64 nt, Homo Sapiens
ucaggugaugcacccaccuccaggccggucucaaacuccugaccugagguuucaucauguuggc

SEQ ID NO: 655129 - RNA, 64 nt, Homo Sapiens
ucaggugauccacccgccuccaggcuggucucgaacuccugaccggggguuucaccauguuagc

SEQ ID NO: 655130 - RNA, 64 nt, Homo Sapiens
uggugaucugcccacccaggcaggcuggucucgaacuccugacccgggguuucaccauguugac

SEQ ID NO: 655131 - RNA, 64 nt, Homo Sapiens
caagugauccucccaccuugcaggcuguuauggaacuccugagugagacggacucuauguugcc

SEQ ID NO: 655132 - RNA, 64 nt, Homo Sapiens
ucaagcaguccuccugcuuccaggcuggucuugaacuccugaguuggcaucuugcuaugucguc

SEQ ID NO: 655133 - RNA, 64 nt, Homo Sapiens
ucaggugauccacccaccuccgggcuggucucaaacuccugacccgggguuucaccguguuggc

SEQ ID NO: 655134 - RNA, 64 nt, Homo Sapiens
gaaagcuccucccacccaaaccccgcacccagcaacuccugacacacuggagggcacacacgua

SEQ ID NO: 655135 - RNA, 64 nt, Homo Sapiens
gagggggaagaagagaggguccugccuaaaucccacuccugaggggccuaaggucucuaggguc

SEQ ID NO: 655136 - RNA, 64 nt, Homo Sapiens
ucaggugauccaccugccuccaggcuggucucgaacuccugaccuggaguuucaccauguuggc

SEQ ID NO: 655137 - RNA, 64 nt, Homo Sapiens
ucaggugauccgcccaccuucaggcucgucucgaacuccugacccagcguuuugccaugcuggc

SEQ ID NO: 655138 - RNA, 64 nt, Homo Sapiens
ugggguuucacuguguaggccaggcuggucucgaacuccugaacucaagugauucacccaccuu

SEQ ID NO: 655139 - RNA, 64 nt, Homo Sapiens
ccuggcuaaauuuuguauuuuuagguggucuugaacuccugaugucaggugauucuccuagcuc

SEQ ID NO: 655140 - RNA, 64 nt, Homo Sapiens
acaguguuuaccauguuggccaggcaggucuccaacuccugaccucaagugauauguucaccuc

SEQ ID NO: 655141 - RNA, 64 nt, Homo Sapiens
ugggguuucaccacguuggccacacuggucucaaacuccugaccucaggcgauccaucugccuc

SEQ ID NO: 655142 - RNA, 64 nt, Homo Sapiens
ucagguaauccaccugccuucaggcuggucuugaacuccugacccgggguuucaccauguuggc

SEQ ID NO: 655143 - RNA, 64 nt, Homo Sapiens
ucaggugaucugccugccuccaggcuggucucaaacuccugaccugggguuucuccauguuggu

SEQ ID NO: 655144 - RNA, 64 nt, Homo Sapiens
ucauaugauccaccugccuccaggcugguuucaaacuccugacccgaaguuucaccauguuggc

SEQ ID NO: 655145 - RNA, 64 nt, Homo Sapiens
uuaaaugauuugccugccuccaagcuggucucgaacuccugacccaggguuucauaauguaagu

SEQ ID NO: 655146 - RNA, 64 nt, Homo Sapiens
caggguuucaccauguuggccaggcuggucuugaacuccugaccucaggugauccacccaccug

SEQ ID NO: 655147 - RNA, 64 nt, Homo Sapiens
caguguuuugccauguuggccaggcuggucucgaacuccugacaucaggugauccaccugccuc

SEQ ID NO: 655148 - RNA, 64 nt, Homo Sapiens
cgggguuucaccaugucagucaggcuggucuugaacuccugaccucaggugauccacccgccuc

SEQ ID NO: 655149 - RNA, 64 nt, Homo Sapiens
caggguuucaccauauuagccaggugggucuugaacuccugaccuugugauccacccgccucgg

SEQ ID NO: 655150 - RNA, 64 nt, Homo Sapiens
cuggguuucaccauguuggccaggcuggucuugaacuccugaccucaggugauccgccuaucuc

SEQ ID NO: 655151 - RNA, 64 nt, Homo Sapiens
cauugcucccaaaauggacuucucugcaagccugacuccugaaacugugcauuguacccugaaa

SEQ ID NO: 655152 - RNA, 64 nt, Homo Sapiens
ucaguugauccacccgccuccgggcugguuucaaacuccugacccgggguuucgcuauuuuggc

SEQ ID NO: 655153 - RNA, 64 nt, Homo Sapiens
ucgugauccacccaccucagcaggcuggucuugaacuccugacccaggguuucaccauauuggu

SEQ ID NO: 655154 - RNA, 64 nt, Homo Sapiens
ucgugaucugcccgccuuggcaggcuggucuugaacuccugacccaggguuucaccauauuggu

SEQ ID NO: 655155 - RNA, 64 nt, Homo Sapiens; identical to SEQ ID NO: 229362

SEQ ID NO: 655156 - RNA, 64 nt, Homo Sapiens; identical to SEQ ID NO: 229363

SEQ ID NO: 655157 - RNA, 64 nt, Homo Sapiens; identical to SEQ ID NO: 229364

SEQ ID NO: 655158 - RNA, 64 nt, Homo Sapiens; identical to SEQ ID NO: 229365

SEQ ID NO: 655159 - RNA, 64 nt, Homo Sapiens; identical to SEQ ID NO: 229366

SEQ ID NO: 655160 - RNA, 64 nt, Homo Sapiens; identical to SEQ ID NO: 229367

SEQ ID NO: 655161 - RNA, 64 nt, Homo Sapiens; identical to SEQ ID NO: 229368

SEQ ID NO: 655162 - RNA, 64 nt, Homo Sapiens; identical to SEQ ID NO: 229369

SEQ ID NO: 655163 - RNA, 64 nt, Homo Sapiens
cacacagccuggaugacgccuuggcuguucuaaggggcuguaaggugggcucugggccuuccag

SEQ ID NO: 655164 - RNA, 64 nt, Homo Sapiens
aucaccacccugagcagauacaggaguggggagggggcuguaacucagugaguggcuuccaggg

SEQ ID NO: 655165 - RNA, 64 nt, Homo Sapiens; identical to SEQ ID NO: 385392

SEQ ID NO: 655166 - RNA, 64 nt, Homo Sapiens; identical to SEQ ID NO: 385393

SEQ ID NO: 655167 - RNA, 64 nt, Homo Sapiens; identical to SEQ ID NO: 385394

SEQ ID NO: 655168 - RNA, 64 nt, Homo Sapiens; identical to SEQ ID NO: 385395

SEQ ID NO: 655169 - RNA, 64 nt, Homo Sapiens; identical to SEQ ID NO: 385396

SEQ ID NO: 655170 - RNA, 64 nt, Homo Sapiens; identical to SEQ ID NO: 385397

SEQ ID NO: 655171 - RNA, 64 nt, Homo Sapiens; identical to SEQ ID NO: 385398

SEQ ID NO: 655172 - RNA, 64 nt, Homo Sapiens; identical to SEQ ID NO: 385399

SEQ ID NO: 655173 - RNA, 64 nt, Homo Sapiens; identical to SEQ ID NO: 385400

SEQ ID NO: 655174 - RNA, 64 nt, Homo Sapiens; identical to SEQ ID NO: 385401

SEQ ID NO: 655175 - RNA, 64 nt, Homo Sapiens; identical to SEQ ID NO: 385402

SEQ ID NO: 655176 - RNA, 64 nt, Homo Sapiens; identical to SEQ ID NO: 385403

SEQ ID NO: 655177 - RNA, 64 nt, Homo Sapiens; identical to SEQ ID NO: 385404

SEQ ID NO: 655178 - RNA, 64 nt, Homo Sapiens; identical to SEQ ID NO: 385405

SEQ ID NO: 655179 - RNA, 64 nt, Homo Sapiens; identical to SEQ ID NO: 385406

SEQ ID NO: 655180 - RNA, 64 nt, Homo Sapiens; identical to SEQ ID NO: 385407

SEQ ID NO: 655181 - RNA, 64 nt, Homo Sapiens; identical to SEQ ID NO: 385408

SEQ ID NO: 655182 - RNA, 64 nt, Homo Sapiens; identical to SEQ ID NO: 385409

SEQ ID NO: 655183 - RNA, 64 nt, Homo Sapiens; identical to SEQ ID NO: 385410

SEQ ID NO: 655184 - RNA, 64 nt, Homo Sapiens; identical to SEQ ID NO: 385411

SEQ ID NO: 655185 - RNA, 64 nt, Homo Sapiens; identical to SEQ ID NO: 385412

SEQ ID NO: 655186 - RNA, 64 nt, Homo Sapiens; identical to SEQ ID NO: 385413

SEQ ID NO: 655187 - RNA, 62 nt, Homo Sapiens; identical to SEQ ID NO: 385414

SEQ ID NO: 655188 - RNA, 64 nt, Homo Sapiens; identical to SEQ ID NO: 385415

SEQ ID NO: 655189 - RNA, 64 nt, Homo Sapiens; identical to SEQ ID NO: 385416

SEQ ID NO: 655190 - RNA, 64 nt, Homo Sapiens; identical to SEQ ID NO: 385417

SEQ ID NO: 655191 - RNA, 64 nt, Homo Sapiens; identical to SEQ ID NO: 385418

SEQ ID NO: 655192 - RNA, 64 nt, Homo Sapiens; identical to SEQ ID NO: 385419

SEQ ID NO: 655193 - RNA, 64 nt, Homo Sapiens; identical to SEQ ID NO: 385420

SEQ ID NO: 655194 - RNA, 64 nt, Homo Sapiens; identical to SEQ ID NO: 385421

SEQ ID NO: 655195 - RNA, 64 nt, Homo Sapiens; identical to SEQ ID NO: 385422

SEQ ID NO: 655196 - RNA, 64 nt, Homo Sapiens; identical to SEQ ID NO: 385423

SEQ ID NO: 655197 - RNA, 64 nt, Homo Sapiens; identical to SEQ ID NO: 385424

SEQ ID NO: 655198 - RNA, 64 nt, Homo Sapiens; identical to SEQ ID NO: 385425

SEQ ID NO: 655199 - RNA, 59 nt, Homo Sapiens
aaacucagucauauauagugaacaguucaaaugggaaaguguucuaaaacauauuauuu

SEQ ID NO: 655200 - RNA, 59 nt, Homo Sapiens
aauugugugaaaucaccuuaucaaauuaaaaugggaagaaaguaauuuuaauaauuuuu

SEQ ID NO: 655201 - RNA, 59 nt, Homo Sapiens
aaaaagcaaaugggauuaaggacucauggaaugggaaggggaaggggagucuuacuaua

SEQ ID NO: 655202 - RNA, 59 nt, Homo Sapiens
caagcucccugccaaccucuggauacaucaaugggaaggaaaccagggaagcauagacc

SEQ ID NO: 655203 - RNA, 59 nt, Homo Sapiens
ggauggaugcaggaaggaauggaggaaugaaugggaagggagaacauaucuauccucuc

SEQ ID NO: 655204 - RNA, 59 nt, Homo Sapiens
gggcuagagguggaggaggcaguccugggaaugggaaaaaccccaacuuuggggucaua

SEQ ID NO: 655205 - RNA, 59 nt, Homo Sapiens
gcauugcuguauacaccucaugcuuaugcaaugggaagaauaugggggccagggggugu

SEQ ID NO: 655206 - RNA, 59 nt, Homo Sapiens
guauguauagaggagcugaggugcugucuaaugggaaaugugauuugauugauuuauuu

SEQ ID NO: 655207 - RNA, 59 nt, Homo Sapiens
agcaccuuccuuagguuucauggacaaauaaugggaacuucuaauuuugaucaauccca

SEQ ID NO: 655208 - RNA, 59 nt, Homo Sapiens
uaaucucccguuagccaaaauaugccagaaaugggaaagagaggagaaaaagucauuaa

SEQ ID NO: 655209 - RNA, 59 nt, Homo Sapiens
uaguguugaaauaggauucaacaacgaugaaugggaaacucauaagaaacaucugaaua

SEQ ID NO: 655210 - RNA, 59 nt, Homo Sapiens
aaaguauacuuaaggaucugcuuuauaaaaaugggaaaaccuuuuuaauaugaguaaug

SEQ ID NO: 655211 - RNA, 59 nt, Homo Sapiens
caugaaauuaaauauuacuuccacuuguaaaugggaauuuaaaaucauuccuguccauu

SEQ ID NO: 655212 - RNA, 59 nt, Homo Sapiens
aaagauuuugguugagacuaauuauuaugaaugggaaaaagacauuugaggggaggagg

SEQ ID NO: 655213 - RNA, 59 nt, Homo Sapiens
cugacuuacuuaaccagguuuuuuuauaaaaugggaauuagcuuuuaguucagacuuag

SEQ ID NO: 655214 - RNA, 59 nt, Homo Sapiens
uauuuuugaaagaauucuauaauaggaugaaugggaaagaaaaaaaaucuuuaaugguu

SEQ ID NO: 655215 - RNA, 59 nt, Homo Sapiens
auauuucggauaagguuucauaauuuacaaaugggaauuucauuuauaauaauaaauau

SEQ ID NO: 655216 - RNA, 59 nt, Homo Sapiens
aaugguguaaaagagaccaguagauuuucaaugggaaauguaccuagcaagcugguucu

SEQ ID NO: 655217 - RNA, 59 nt, Homo Sapiens
uccacagugcuacagacaauaagugauaaaaugggaaaaaauagugaagaucuucuuuu

SEQ ID NO: 655218 - RNA, 59 nt, Homo Sapiens
uagggacuucuaaugaaaaggguauaugaaaugggaacaauaaauucuguacauguaua

SEQ ID NO: 655219 - RNA, 59 nt, Homo Sapiens
accuguuacccauuaggggugauaacauuaaugggaagaaaugauggcaacuuugaaug

SEQ ID NO: 655220 - RNA, 59 nt, Homo Sapiens
agaacucugccuuccaucaacugcaguguaaugggaaagaggguggugagguuuugaaa

SEQ ID NO: 655221 - RNA, 59 nt, Homo Sapiens
aacuaauuuuaaaucagucauugcacagaaaugggaaauuaaaacagaaaugggaauua

SEQ ID NO: 655222 - RNA, 59 nt, Homo Sapiens
auugcacagaaaugggaaauuaaaacagaaaugggaauucauagaaguaugaaucuaau

SEQ ID NO: 655223 - RNA, 59 nt, Homo Sapiens
acauuagcuuaugcuucuuuagauggaauaaugggaaaggagggaaaugggaaauggau

SEQ ID NO: 655224 - RNA, 59 nt, Homo Sapiens
cuuuagauggaauaaugggaaaggagggaaaugggaaauggauggaaaugggaaaggag

SEQ ID NO: 655225 - RNA, 59 nt, Homo Sapiens
ggaaaggagggaaaugggaaauggauggaaaugggaaaggagggaaaauaauagcccag

SEQ ID NO: 655226 - RNA, 59 nt, Homo Sapiens
cuugagacaauaagguggagcaacagaacaaugggaaagaggacugggagaggaaucua

SEQ ID NO: 655227 - RNA, 59 nt, Homo Sapiens
cucucuguauagaauuuucacaucuuuaaaaugggaauaauaguaccuaccucauaggg

SEQ ID NO: 655228 - RNA, 59 nt, Homo Sapiens
uuagacucuaaaaagucuuuucaaaaagaaaugggaaauaggcagacuguuuauguuaa

SEQ ID NO: 655229 - RNA, 59 nt, Homo Sapiens
gcugauuuugcuaaacuccuguucccuacaaugggaaaugucacaagaaugugcaaaaa

SEQ ID NO: 655230 - RNA, 59 nt, Homo Sapiens
uuauuuaaacaacaaaaaaccaacauaaaaaugggaaggcacaggcucaacgggacaug

SEQ ID NO: 655231 - RNA, 59 nt, Homo Sapiens
uugacagccaugaccaugaaauccuugaaaaugggaacucaagaccaugaccuucuuug

SEQ ID NO: 655232 - RNA, 59 nt, Homo Sapiens
aggugccugcccucaguauagacguauccaaugggaaaacagcggaccugcccagagca

SEQ ID NO: 655233 - RNA, 59 nt, Homo Sapiens
gucucgucccagaggcauuggaucaggagaaugggaauuuuuuuccucccaccuggaca

SEQ ID NO: 655234 - RNA, 59 nt, Homo Sapiens
uggcauuuuccugaugaucuuaaagucuuaaugggaacuccugggaucucaaggagcuu

SEQ ID NO: 655235 - RNA, 59 nt, Homo Sapiens
uucagauauuuucuuaguagggaaaugacaaugggaaaagucaaggggaguuuuuacau

SEQ ID NO: 655236 - RNA, 59 nt, Homo Sapiens
aggaacauuggagccugcaauaagggaaaaaugggaacuggagaguguggggaauggga

SEQ ID NO: 655237 - RNA, 59 nt, Homo Sapiens
gggaaaaaugggaacuggagaguguggggaaugggaagaagcaguuuacuuuagacuaa

SEQ ID NO: 655238 - RNA, 64 nt, Homo Sapiens; identical to SEQ ID NO: 306996

SEQ ID NO: 655239 - RNA, 64 nt, Homo Sapiens; identical to SEQ ID NO: 306997

SEQ ID NO: 655240 - RNA, 64 nt, Homo Sapiens; identical to SEQ ID NO: 306998

SEQ ID NO: 655241 - RNA, 64 nt, Homo Sapiens; identical to SEQ ID NO: 306999

SEQ ID NO: 655242 - RNA, 64 nt, Homo Sapiens; identical to SEQ ID NO: 307000

SEQ ID NO: 655243 - RNA, 64 nt, Homo Sapiens; identical to SEQ ID NO: 307001

SEQ ID NO: 655244 - RNA, 64 nt, Homo Sapiens; identical to SEQ ID NO: 307002

SEQ ID NO: 655245 - RNA, 64 nt, Homo Sapiens; identical to SEQ ID NO: 307003

SEQ ID NO: 655246 - RNA, 64 nt, Homo Sapiens; identical to SEQ ID NO: 307004

SEQ ID NO: 655247 - RNA, 64 nt, Homo Sapiens; identical to SEQ ID NO: 307005

SEQ ID NO: 655248 - RNA, 64 nt, Homo Sapiens; identical to SEQ ID NO: 307006

SEQ ID NO: 655249 - RNA, 64 nt, Homo Sapiens; identical to SEQ ID NO: 307007

SEQ ID NO: 655250 - RNA, 64 nt, Homo Sapiens; identical to SEQ ID NO: 113569

SEQ ID NO: 655251 - RNA, 64 nt, Homo Sapiens; identical to SEQ ID NO: 113570

SEQ ID NO: 655252 - RNA, 64 nt, Homo Sapiens; identical to SEQ ID NO: 113571

SEQ ID NO: 655253 - RNA, 64 nt, Homo Sapiens; identical to SEQ ID NO: 113572

SEQ ID NO: 655254 - RNA, 64 nt, Homo Sapiens; identical to SEQ ID NO: 113573

SEQ ID NO: 655255 - RNA, 64 nt, Homo Sapiens; identical to SEQ ID NO: 113574

SEQ ID NO: 655256 - RNA, 64 nt, Homo Sapiens; identical to SEQ ID NO: 113575

SEQ ID NO: 655257 - RNA, 64 nt, Homo Sapiens; identical to SEQ ID NO: 113576

SEQ ID NO: 655258 - RNA, 64 nt, Homo Sapiens; identical to SEQ ID NO: 113577

SEQ ID NO: 655259 - RNA, 64 nt, Homo Sapiens; identical to SEQ ID NO: 113578

SEQ ID NO: 655260 - RNA, 64 nt, Homo Sapiens; identical to SEQ ID NO: 113579

SEQ ID NO: 655261 - RNA, 64 nt, Homo Sapiens; identical to SEQ ID NO: 113580

SEQ ID NO: 655262 - RNA, 64 nt, Homo Sapiens; identical to SEQ ID NO: 113581

SEQ ID NO: 655263 - RNA, 64 nt, Homo Sapiens; identical to SEQ ID NO: 113582

SEQ ID NO: 655264 - RNA, 64 nt, Homo Sapiens
auuauauuuuucaaugccaguguccagacacagacuuuaugauucuucuaguucccaaaggcga

SEQ ID NO: 655265 - RNA, 64 nt, Homo Sapiens
gcucuuaaauuuugucuaaaaucaauacuucuggcuuuaugagauuuggaugcacuaaggaguu

SEQ ID NO: 655266 - RNA, 64 nt, Homo Sapiens
aaguuagccccaagacuucccuaggguugauguacuuuaugauccagaugcuaaacuucuuaga

SEQ ID NO: 655267 - RNA, 64 nt, Homo Sapiens
aaucuuacagauauuauaggaauuucuuuucuaucuuuaugaaaacaacguauauaaaauauau

SEQ ID NO: 655268 - RNA, 64 nt, Homo Sapiens
uacaguugacaggaaccuggaccccuuaccccaacuuuaugaguaaugcuuggaauaaaaacuc

SEQ ID NO: 655269 - RNA, 64 nt, Homo Sapiens
guaauuuagaaauuaacaugauaucuuaaauuaccuuuaugaaauauaguuuuguauaauagca

SEQ ID NO: 655270 - RNA, 64 nt, Homo Sapiens
cacuugaccauccagaaauacaugacuacaaguccuuuaugacuguuugccauuuuuuuuaaug

SEQ ID NO: 655271 - RNA, 64 nt, Homo Sapiens
ugaaagcaacacagccuuaaacucaaugcuuuugcuuuaugacaugggaauguucugucaucaa

SEQ ID NO: 655272 - RNA, 64 nt, Homo Sapiens
ccuuuuuaugguucugaagucauaucuguuccuucuuuaugauguucuuuuggacuauggagcg

SEQ ID NO: 655273 - RNA, 64 nt, Homo Sapiens
uauugccuauauaucugugaagucacaucaacaucuuuaugaucuuucaguuuuuuaauuuuau

SEQ ID NO: 655274 - RNA, 64 nt, Homo Sapiens
caaguccuaguuguucagcauggcauccaagacucuuuaugaucuggcccuugcuuaccucuca

SEQ ID NO: 655275 - RNA, 64 nt, Homo Sapiens
uuaaaguucuucuaagcugaguuaggugucuguccuuuaugaucccgcaguauuccaugaauac

SEQ ID NO: 655276 - RNA, 64 nt, Homo Sapiens
agaacaauuugcucaaagccuguaagcagaucaucuuuaugauuaagcaccugaugaaaauauu

SEQ ID NO: 655277 - RNA, 64 nt, Homo Sapiens
ggaagauugucuagguugcagaaggcuccccugacuuuaugaaggcccugaugucuuaaauucu

SEQ ID NO: 655278 - RNA, 64 nt, Homo Sapiens
guacccugggucuuucauccauacaacuuugcuucuuuaugaaaauaaccuagugaaccuggaa

SEQ ID NO: 655279 - RNA, 64 nt, Homo Sapiens
aaauguuuguuuauuucagcggucuuugagucagcuuuaugaaauuucuacaaaagucuccuag

SEQ ID NO: 655280 - RNA, 64 nt, Homo Sapiens
auuaaacucuuuugugccaaagccaagugaugcacuuuaugauaauuuucuuuuuaauauauuu

SEQ ID NO: 655281 - RNA, 64 nt, Homo Sapiens
aagacaauuuucugaaaaguaaguagaguagcuucuuuaugauaaaaaacugguucuauaaauu

SEQ ID NO: 655282 - RNA, 64 nt, Homo Sapiens
auacuauuaguugggcauuaggaagaaauccagucuuuaugaaucagguaguuauaagggaucu

SEQ ID NO: 655283 - RNA, 64 nt, Homo Sapiens
acaggcaugagccaccgugcucagccgcaaaauucuuuaugaauuuuacacuuggcaaauguua

SEQ ID NO: 655284 - RNA, 64 nt, Homo Sapiens
gcuggauggcucaaauauaaaugaaugaggaauucuuuaugaaguaucagucagauuuuaugau

SEQ ID NO: 655285 - RNA, 64 nt, Homo Sapiens
aggauaagguauaauguccccaggucacacgucucuuuaugauggagucccacauucccugagg

SEQ ID NO: 655286 - RNA, 64 nt, Homo Sapiens
acucagagcauuguucagcugaacgggaagucuucuuuaugaaucuacauugaaccggaaaucu

SEQ ID NO: 655287 - RNA, 64 nt, Homo Sapiens
ucaucacuagcagaugucaguugcacauugaguccuuuaugaaauucauaaauaaagaauuguu

SEQ ID NO: 655288 - RNA, 64 nt, Homo Sapiens
aguuugguaauacugagcaagccuguggaauuuucuuuaugaaaaaugauuuuagccuuugcaa

SEQ ID NO: 655289 - RNA, 64 nt, Homo Sapiens
ucugaauacugucaacacucuuaucuaaguuugccuuuaugaugcaguggcagcauuuugaauu

SEQ ID NO: 655290 - RNA, 64 nt, Homo Sapiens
gauauuuuguaaaacuuuuuuuuccaaguaaaaacuuuaugaaacuuggucucaaaaauguugu

SEQ ID NO: 655291 - RNA, 64 nt, Homo Sapiens; identical to SEQ ID NO: 100684

SEQ ID NO: 655292 - RNA, 64 nt, Homo Sapiens; identical to SEQ ID NO: 100685

SEQ ID NO: 655293 - RNA, 64 nt, Homo Sapiens; identical to SEQ ID NO: 100686

SEQ ID NO: 655294 - RNA, 64 nt, Homo Sapiens; identical to SEQ ID NO: 100687

SEQ ID NO: 655295 - RNA, 64 nt, Homo Sapiens; identical to SEQ ID NO: 100688

SEQ ID NO: 655296 - RNA, 64 nt, Homo Sapiens; identical to SEQ ID NO: 100689

SEQ ID NO: 655297 - RNA, 64 nt, Homo Sapiens; identical to SEQ ID NO: 100690

SEQ ID NO: 655298 - RNA, 64 nt, Homo Sapiens; identical to SEQ ID NO: 100691

SEQ ID NO: 655299 - RNA, 64 nt, Homo Sapiens; identical to SEQ ID NO: 100692

SEQ ID NO: 655300 - RNA, 64 nt, Homo Sapiens; identical to SEQ ID NO: 100693

SEQ ID NO: 655301 - RNA, 64 nt, Homo Sapiens; identical to SEQ ID NO: 100694

SEQ ID NO: 655302 - RNA, 64 nt, Homo Sapiens; identical to SEQ ID NO: 100695

SEQ ID NO: 655303 - RNA, 64 nt, Homo Sapiens; identical to SEQ ID NO: 100696

SEQ ID NO: 655304 - RNA, 64 nt, Homo Sapiens; identical to SEQ ID NO: 100697

SEQ ID NO: 655305 - RNA, 64 nt, Homo Sapiens; identical to SEQ ID NO: 100698

SEQ ID NO: 655306 - RNA, 64 nt, Homo Sapiens; identical to SEQ ID NO: 100699

SEQ ID NO: 655307 - RNA, 64 nt, Homo Sapiens; identical to SEQ ID NO: 100700

SEQ ID NO: 655308 - RNA, 64 nt, Homo Sapiens; identical to SEQ ID NO: 130118

SEQ ID NO: 655309 - RNA, 64 nt, Homo Sapiens; identical to SEQ ID NO: 130119

SEQ ID NO: 655310 - RNA, 64 nt, Homo Sapiens; identical to SEQ ID NO: 130120

SEQ ID NO: 655311 - RNA, 64 nt, Homo Sapiens; identical to SEQ ID NO: 130121

SEQ ID NO: 655312 - RNA, 64 nt, Homo Sapiens; identical to SEQ ID NO: 130122

SEQ ID NO: 655313 - RNA, 64 nt, Homo Sapiens; identical to SEQ ID NO: 130123

SEQ ID NO: 655314 - RNA, 64 nt, Homo Sapiens; identical to SEQ ID NO: 130124

SEQ ID NO: 655315 - RNA, 64 nt, Homo Sapiens; identical to SEQ ID NO: 130125

SEQ ID NO: 655316 - RNA, 64 nt, Homo Sapiens; identical to SEQ ID NO: 130126

SEQ ID NO: 655317 - RNA, 64 nt, Homo Sapiens; identical to SEQ ID NO: 130127

SEQ ID NO: 655318 - RNA, 64 nt, Homo Sapiens; identical to SEQ ID NO: 130128

SEQ ID NO: 655319 - RNA, 64 nt, Homo Sapiens; identical to SEQ ID NO: 130129

SEQ ID NO: 655320 - RNA, 64 nt, Homo Sapiens; identical to SEQ ID NO: 130130

SEQ ID NO: 655321 - RNA, 64 nt, Homo Sapiens; identical to SEQ ID NO: 130131

SEQ ID NO: 655322 - RNA, 64 nt, Homo Sapiens; identical to SEQ ID NO: 130132

SEQ ID NO: 655323 - RNA, 64 nt, Homo Sapiens; identical to SEQ ID NO: 130133

SEQ ID NO: 655324 - RNA, 64 nt, Homo Sapiens; identical to SEQ ID NO: 130134

SEQ ID NO: 655325 - RNA, 64 nt, Homo Sapiens; identical to SEQ ID NO: 130135

SEQ ID NO: 655326 - RNA, 64 nt, Homo Sapiens; identical to SEQ ID NO: 130136

SEQ ID NO: 655327 - RNA, 64 nt, Homo Sapiens; identical to SEQ ID NO: 130137

SEQ ID NO: 655328 - RNA, 64 nt, Homo Sapiens; identical to SEQ ID NO: 130138

SEQ ID NO: 655329 - RNA, 64 nt, Homo Sapiens; identical to SEQ ID NO: 130139

SEQ ID NO: 655330 - RNA, 64 nt, Homo Sapiens; identical to SEQ ID NO: 130140

SEQ ID NO: 655331 - RNA, 64 nt, Homo Sapiens; identical to SEQ ID NO: 130141

SEQ ID NO: 655332 - RNA, 64 nt, Homo Sapiens; identical to SEQ ID NO: 130142

SEQ ID NO: 655333 - RNA, 64 nt, Homo Sapiens; identical to SEQ ID NO: 130143

SEQ ID NO: 655334 - RNA, 64 nt, Homo Sapiens; identical to SEQ ID NO: 130144

SEQ ID NO: 655335 - RNA, 64 nt, Homo Sapiens; identical to SEQ ID NO: 130145

SEQ ID NO: 655336 - RNA, 64 nt, Homo Sapiens; identical to SEQ ID NO: 130146

SEQ ID NO: 655337 - RNA, 64 nt, Homo Sapiens; identical to SEQ ID NO: 130147

SEQ ID NO: 655338 - RNA, 64 nt, Homo Sapiens; identical to SEQ ID NO: 130148

SEQ ID NO: 655339 - RNA, 64 nt, Homo Sapiens; identical to SEQ ID NO: 130149

SEQ ID NO: 655340 - RNA, 64 nt, Homo Sapiens; identical to SEQ ID NO: 130150

SEQ ID NO: 655341 - RNA, 64 nt, Homo Sapiens; identical to SEQ ID NO: 130151

SEQ ID NO: 655342 - RNA, 64 nt, Homo Sapiens; identical to SEQ ID NO: 130152

SEQ ID NO: 655343 - RNA, 64 nt, Homo Sapiens; identical to SEQ ID NO: 130153

SEQ ID NO: 655344 - RNA, 64 nt, Homo Sapiens; identical to SEQ ID NO: 130154

SEQ ID NO: 655345 - RNA, 64 nt, Homo Sapiens; identical to SEQ ID NO: 130155

SEQ ID NO: 655346 - RNA, 64 nt, Homo Sapiens; identical to SEQ ID NO: 130156

SEQ ID NO: 655347 - RNA, 64 nt, Homo Sapiens; identical to SEQ ID NO: 130157

SEQ ID NO: 655348 - RNA, 64 nt, Homo Sapiens; identical to SEQ ID NO: 130158

SEQ ID NO: 655349 - RNA, 64 nt, Homo Sapiens; identical to SEQ ID NO: 130159

SEQ ID NO: 655350 - RNA, 64 nt, Homo Sapiens; identical to SEQ ID NO: 130160

SEQ ID NO: 655351 - RNA, 64 nt, Homo Sapiens; identical to SEQ ID NO: 130161

SEQ ID NO: 655352 - RNA, 64 nt, Homo Sapiens; identical to SEQ ID NO: 130162

SEQ ID NO: 655353 - RNA, 64 nt, Homo Sapiens; identical to SEQ ID NO: 130163

SEQ ID NO: 655354 - RNA, 64 nt, Homo Sapiens; identical to SEQ ID NO: 130164

SEQ ID NO: 655355 - RNA, 64 nt, Homo Sapiens; identical to SEQ ID NO: 130165

SEQ ID NO: 655356 - RNA, 64 nt, Homo Sapiens; identical to SEQ ID NO: 130166

SEQ ID NO: 655357 - RNA, 64 nt, Homo Sapiens; identical to SEQ ID NO: 130167

SEQ ID NO: 655358 - RNA, 64 nt, Homo Sapiens; identical to SEQ ID NO: 130168

SEQ ID NO: 655359 - RNA, 64 nt, Homo Sapiens; identical to SEQ ID NO: 130169

SEQ ID NO: 655360 - RNA, 64 nt, Homo Sapiens; identical to SEQ ID NO: 130170

SEQ ID NO: 655361 - RNA, 64 nt, Homo Sapiens; identical to SEQ ID NO: 130171

SEQ ID NO: 655362 - RNA, 64 nt, Homo Sapiens; identical to SEQ ID NO: 130172

SEQ ID NO: 655363 - RNA, 64 nt, Homo Sapiens; identical to SEQ ID NO: 130173

SEQ ID NO: 655364 - RNA, 64 nt, Homo Sapiens; identical to SEQ ID NO: 130174

SEQ ID NO: 655365 - RNA, 64 nt, Homo Sapiens; identical to SEQ ID NO: 130175

SEQ ID NO: 655366 - RNA, 64 nt, Homo Sapiens; identical to SEQ ID NO: 130176

SEQ ID NO: 655367 - RNA, 64 nt, Homo Sapiens; identical to SEQ ID NO: 130177

SEQ ID NO: 655368 - RNA, 64 nt, Homo Sapiens; identical to SEQ ID NO: 130178

SEQ ID NO: 655369 - RNA, 64 nt, Homo Sapiens; identical to SEQ ID NO: 130179

SEQ ID NO: 655370 - RNA, 64 nt, Homo Sapiens; identical to SEQ ID NO: 130180

SEQ ID NO: 655371 - RNA, 64 nt, Homo Sapiens; identical to SEQ ID NO: 130181

SEQ ID NO: 655372 - RNA, 64 nt, Homo Sapiens; identical to SEQ ID NO: 130182

SEQ ID NO: 655373 - RNA, 64 nt, Homo Sapiens; identical to SEQ ID NO: 130183

SEQ ID NO: 655374 - RNA, 64 nt, Homo Sapiens; identical to SEQ ID NO: 130184

SEQ ID NO: 655375 - RNA, 64 nt, Homo Sapiens; identical to SEQ ID NO: 130185

SEQ ID NO: 655376 - RNA, 64 nt, Homo Sapiens; identical to SEQ ID NO: 130186

SEQ ID NO: 655377 - RNA, 64 nt, Homo Sapiens; identical to SEQ ID NO: 130187

SEQ ID NO: 655378 - RNA, 64 nt, Homo Sapiens; identical to SEQ ID NO: 130188

SEQ ID NO: 655379 - RNA, 64 nt, Homo Sapiens; identical to SEQ ID NO: 130189

SEQ ID NO: 655380 - RNA, 64 nt, Homo Sapiens; identical to SEQ ID NO: 130190

SEQ ID NO: 655381 - RNA, 64 nt, Homo Sapiens; identical to SEQ ID NO: 130191

SEQ ID NO: 655382 - RNA, 64 nt, Homo Sapiens; identical to SEQ ID NO: 130192

SEQ ID NO: 655383 - RNA, 64 nt, Homo Sapiens; identical to SEQ ID NO: 130193

SEQ ID NO: 655384 - RNA, 64 nt, Homo Sapiens; identical to SEQ ID NO: 130194

SEQ ID NO: 655385 - RNA, 64 nt, Homo Sapiens; identical to SEQ ID NO: 130195

SEQ ID NO: 655386 - RNA, 64 nt, Homo Sapiens; identical to SEQ ID NO: 130196

SEQ ID NO: 655387 - RNA, 64 nt, Homo Sapiens; identical to SEQ ID NO: 437317

SEQ ID NO: 655388 - RNA, 64 nt, Homo Sapiens; identical to SEQ ID NO: 437318

SEQ ID NO: 655389 - RNA, 64 nt, Homo Sapiens; identical to SEQ ID NO: 437319

SEQ ID NO: 655390 - RNA, 64 nt, Homo Sapiens; identical to SEQ ID NO: 437320

SEQ ID NO: 655391 - RNA, 64 nt, Homo Sapiens; identical to SEQ ID NO: 437321

SEQ ID NO: 655392 - RNA, 64 nt, Homo Sapiens; identical to SEQ ID NO: 437322

SEQ ID NO: 655393 - RNA, 64 nt, Homo Sapiens; identical to SEQ ID NO: 437323

SEQ ID NO: 655394 - RNA, 64 nt, Homo Sapiens; identical to SEQ ID NO: 437324

SEQ ID NO: 655395 - RNA, 64 nt, Homo Sapiens; identical to SEQ ID NO: 437325

SEQ ID NO: 655396 - RNA, 64 nt, Homo Sapiens; identical to SEQ ID NO: 437326

SEQ ID NO: 655397 - RNA, 64 nt, Homo Sapiens; identical to SEQ ID NO: 437327

SEQ ID NO: 655398 - RNA, 64 nt, Homo Sapiens; identical to SEQ ID NO: 437328

SEQ ID NO: 655399 - RNA, 64 nt, Homo Sapiens; identical to SEQ ID NO: 437329

SEQ ID NO: 655400 - RNA, 64 nt, Homo Sapiens; identical to SEQ ID NO: 437330

SEQ ID NO: 655401 - RNA, 64 nt, Homo Sapiens; identical to SEQ ID NO: 437331

SEQ ID NO: 655402 - RNA, 64 nt, Homo Sapiens; identical to SEQ ID NO: 437332

SEQ ID NO: 655403 - RNA, 64 nt, Homo Sapiens; identical to SEQ ID NO: 437333

SEQ ID NO: 655404 - RNA, 64 nt, Homo Sapiens; identical to SEQ ID NO: 437334

SEQ ID NO: 655405 - RNA, 64 nt, Homo Sapiens; identical to SEQ ID NO: 437335

SEQ ID NO: 655406 - RNA, 64 nt, Homo Sapiens; identical to SEQ ID NO: 437336

SEQ ID NO: 655407 - RNA, 64 nt, Homo Sapiens; identical to SEQ ID NO: 437337

SEQ ID NO: 655408 - RNA, 64 nt, Homo Sapiens; identical to SEQ ID NO: 437338

SEQ ID NO: 655409 - RNA, 64 nt, Homo Sapiens; identical to SEQ ID NO: 437339

SEQ ID NO: 655410 - RNA, 64 nt, Homo Sapiens; identical to SEQ ID NO: 437340

SEQ ID NO: 655411 - RNA, 64 nt, Homo Sapiens; identical to SEQ ID NO: 437341

SEQ ID NO: 655412 - RNA, 64 nt, Homo Sapiens; identical to SEQ ID NO: 437342

SEQ ID NO: 655413 - RNA, 64 nt, Homo Sapiens; identical to SEQ ID NO: 437343

SEQ ID NO: 655414 - RNA, 64 nt, Homo Sapiens; identical to SEQ ID NO: 437344

SEQ ID NO: 655415 - RNA, 64 nt, Homo Sapiens; identical to SEQ ID NO: 437345

SEQ ID NO: 655416 - RNA, 64 nt, Homo Sapiens; identical to SEQ ID NO: 437346

SEQ ID NO: 655417 - RNA, 64 nt, Homo Sapiens; identical to SEQ ID NO: 437347

SEQ ID NO: 655418 - RNA, 64 nt, Homo Sapiens; identical to SEQ ID NO: 437348

SEQ ID NO: 655419 - RNA, 64 nt, Homo Sapiens; identical to SEQ ID NO: 437349

SEQ ID NO: 655420 - RNA, 64 nt, Homo Sapiens; identical to SEQ ID NO: 437350

SEQ ID NO: 655421 - RNA, 64 nt, Homo Sapiens; identical to SEQ ID NO: 437351

SEQ ID NO: 655422 - RNA, 64 nt, Homo Sapiens; identical to SEQ ID NO: 437352

SEQ ID NO: 655423 - RNA, 64 nt, Homo Sapiens; identical to SEQ ID NO: 437353

SEQ ID NO: 655424 - RNA, 64 nt, Homo Sapiens; identical to SEQ ID NO: 437354

SEQ ID NO: 655425 - RNA, 64 nt, Homo Sapiens; identical to SEQ ID NO: 437355

SEQ ID NO: 655426 - RNA, 64 nt, Homo Sapiens; identical to SEQ ID NO: 284541

SEQ ID NO: 655427 - RNA, 64 nt, Homo Sapiens; identical to SEQ ID NO: 284542

SEQ ID NO: 655428 - RNA, 64 nt, Homo Sapiens; identical to SEQ ID NO: 284543

SEQ ID NO: 655429 - RNA, 64 nt, Homo Sapiens; identical to SEQ ID NO: 284544

SEQ ID NO: 655430 - RNA, 64 nt, Homo Sapiens; identical to SEQ ID NO: 284545

SEQ ID NO: 655431 - RNA, 64 nt, Homo Sapiens; identical to SEQ ID NO: 284546

SEQ ID NO: 655432 - RNA, 64 nt, Homo Sapiens; identical to SEQ ID NO: 284547

SEQ ID NO: 655433 - RNA, 64 nt, Homo Sapiens; identical to SEQ ID NO: 284548

SEQ ID NO: 655434 - RNA, 64 nt, Homo Sapiens; identical to SEQ ID NO: 284549

SEQ ID NO: 655435 - RNA, 64 nt, Homo Sapiens; identical to SEQ ID NO: 284550

SEQ ID NO: 655436 - RNA, 64 nt, Homo Sapiens; identical to SEQ ID NO: 284551

SEQ ID NO: 655437 - RNA, 64 nt, Homo Sapiens; identical to SEQ ID NO: 284552

SEQ ID NO: 655438 - RNA, 64 nt, Homo Sapiens; identical to SEQ ID NO: 284553

SEQ ID NO: 655439 - RNA, 64 nt, Homo Sapiens; identical to SEQ ID NO: 284554

SEQ ID NO: 655440 - RNA, 64 nt, Homo Sapiens; identical to SEQ ID NO: 284555

SEQ ID NO: 655441 - RNA, 64 nt, Homo Sapiens; identical to SEQ ID NO: 284556

SEQ ID NO: 655442 - RNA, 64 nt, Homo Sapiens; identical to SEQ ID NO: 284557

SEQ ID NO: 655443 - RNA, 64 nt, Homo Sapiens; identical to SEQ ID NO: 284558

SEQ ID NO: 655444 - RNA, 64 nt, Homo Sapiens; identical to SEQ ID NO: 284559

SEQ ID NO: 655445 - RNA, 64 nt, Homo Sapiens; identical to SEQ ID NO: 284560

SEQ ID NO: 655446 - RNA, 64 nt, Homo Sapiens; identical to SEQ ID NO: 284561

SEQ ID NO: 655447 - RNA, 64 nt, Homo Sapiens; identical to SEQ ID NO: 284562

SEQ ID NO: 655448 - RNA, 64 nt, Homo Sapiens; identical to SEQ ID NO: 284563

SEQ ID NO: 655449 - RNA, 64 nt, Homo Sapiens; identical to SEQ ID NO: 284564

SEQ ID NO: 655450 - RNA, 64 nt, Homo Sapiens; identical to SEQ ID NO: 284565

SEQ ID NO: 655451 - RNA, 64 nt, Homo Sapiens; identical to SEQ ID NO: 284566

SEQ ID NO: 655452 - RNA, 64 nt, Homo Sapiens; identical to SEQ ID NO: 284567

SEQ ID NO: 655453 - RNA, 64 nt, Homo Sapiens; identical to SEQ ID NO: 284568

SEQ ID NO: 655454 - RNA, 64 nt, Homo Sapiens; identical to SEQ ID NO: 284569

SEQ ID NO: 655455 - RNA, 64 nt, Homo Sapiens; identical to SEQ ID NO: 284570

SEQ ID NO: 655456 - RNA, 59 nt, Homo Sapiens; identical to SEQ ID NO: 284571

SEQ ID NO: 655457 - RNA, 64 nt, Homo Sapiens; identical to SEQ ID NO: 284572

SEQ ID NO: 655458 - RNA, 64 nt, Homo Sapiens; identical to SEQ ID NO: 284573

SEQ ID NO: 655459 - RNA, 64 nt, Homo Sapiens; identical to SEQ ID NO: 284574

SEQ ID NO: 655460 - RNA, 64 nt, Homo Sapiens; identical to SEQ ID NO: 284575

SEQ ID NO: 655461 - RNA, 64 nt, Homo Sapiens; identical to SEQ ID NO: 284576

SEQ ID NO: 655462 - RNA, 64 nt, Homo Sapiens; identical to SEQ ID NO: 284577

SEQ ID NO: 655463 - RNA, 64 nt, Homo Sapiens; identical to SEQ ID NO: 284578

SEQ ID NO: 655464 - RNA, 64 nt, Homo Sapiens; identical to SEQ ID NO: 284579

SEQ ID NO: 655465 - RNA, 64 nt, Homo Sapiens; identical to SEQ ID NO: 284580

SEQ ID NO: 655466 - RNA, 64 nt, Homo Sapiens; identical to SEQ ID NO: 284581

SEQ ID NO: 655467 - RNA, 64 nt, Homo Sapiens; identical to SEQ ID NO: 284582

SEQ ID NO: 655468 - RNA, 64 nt, Homo Sapiens; identical to SEQ ID NO: 284583

SEQ ID NO: 655469 - RNA, 56 nt, Homo Sapiens; identical to SEQ ID NO: 284584

SEQ ID NO: 655470 - RNA, 64 nt, Homo Sapiens; identical to SEQ ID NO: 284585

SEQ ID NO: 655471 - RNA, 64 nt, Homo Sapiens; identical to SEQ ID NO: 284586

SEQ ID NO: 655472 - RNA, 64 nt, Homo Sapiens; identical to SEQ ID NO: 284587

SEQ ID NO: 655473 - RNA, 64 nt, Homo Sapiens; identical to SEQ ID NO: 284588

SEQ ID NO: 655474 - RNA, 64 nt, Homo Sapiens; identical to SEQ ID NO: 284589

SEQ ID NO: 655475 - RNA, 64 nt, Homo Sapiens; identical to SEQ ID NO: 284590

SEQ ID NO: 655476 - RNA, 64 nt, Homo Sapiens; identical to SEQ ID NO: 284591

SEQ ID NO: 655477 - RNA, 64 nt, Homo Sapiens; identical to SEQ ID NO: 284592

SEQ ID NO: 655478 - RNA, 64 nt, Homo Sapiens; identical to SEQ ID NO: 284593

SEQ ID NO: 655479 - RNA, 64 nt, Homo Sapiens; identical to SEQ ID NO: 284594

SEQ ID NO: 655480 - RNA, 64 nt, Homo Sapiens; identical to SEQ ID NO: 284595

SEQ ID NO: 655481 - RNA, 64 nt, Homo Sapiens; identical to SEQ ID NO: 284596

SEQ ID NO: 655482 - RNA, 64 nt, Homo Sapiens; identical to SEQ ID NO: 284597

SEQ ID NO: 655483 - RNA, 64 nt, Homo Sapiens; identical to SEQ ID NO: 284598

SEQ ID NO: 655484 - RNA, 64 nt, Homo Sapiens; identical to SEQ ID NO: 284599

SEQ ID NO: 655485 - RNA, 64 nt, Homo Sapiens; identical to SEQ ID NO: 284600

SEQ ID NO: 655486 - RNA, 64 nt, Homo Sapiens; identical to SEQ ID NO: 284601

SEQ ID NO: 655487 - RNA, 64 nt, Homo Sapiens; identical to SEQ ID NO: 284602

SEQ ID NO: 655488 - RNA, 64 nt, Homo Sapiens; identical to SEQ ID NO: 284603

SEQ ID NO: 655489 - RNA, 64 nt, Homo Sapiens; identical to SEQ ID NO: 284604

SEQ ID NO: 655490 - RNA, 64 nt, Homo Sapiens; identical to SEQ ID NO: 284605

SEQ ID NO: 655491 - RNA, 64 nt, Homo Sapiens; identical to SEQ ID NO: 130376

SEQ ID NO: 655492 - RNA, 64 nt, Homo Sapiens; identical to SEQ ID NO: 130377

SEQ ID NO: 655493 - RNA, 64 nt, Homo Sapiens; identical to SEQ ID NO: 130378

SEQ ID NO: 655494 - RNA, 64 nt, Homo Sapiens; identical to SEQ ID NO: 130379

SEQ ID NO: 655495 - RNA, 64 nt, Homo Sapiens; identical to SEQ ID NO: 359890

SEQ ID NO: 655496 - RNA, 64 nt, Homo Sapiens; identical to SEQ ID NO: 359891

SEQ ID NO: 655497 - RNA, 64 nt, Homo Sapiens; identical to SEQ ID NO: 359892

SEQ ID NO: 655498 - RNA, 64 nt, Homo Sapiens; identical to SEQ ID NO: 359893

SEQ ID NO: 655499 - RNA, 64 nt, Homo Sapiens; identical to SEQ ID NO: 359894

SEQ ID NO: 655500 - RNA, 64 nt, Homo Sapiens; identical to SEQ ID NO: 359895

SEQ ID NO: 655501 - RNA, 64 nt, Homo Sapiens; identical to SEQ ID NO: 359896

SEQ ID NO: 655502 - RNA, 64 nt, Homo Sapiens; identical to SEQ ID NO: 359897

SEQ ID NO: 655503 - RNA, 64 nt, Homo Sapiens; identical to SEQ ID NO: 359898

SEQ ID NO: 655504 - RNA, 64 nt, Homo Sapiens; identical to SEQ ID NO: 359899

SEQ ID NO: 655505 - RNA, 64 nt, Homo Sapiens; identical to SEQ ID NO: 359900

SEQ ID NO: 655506 - RNA, 64 nt, Homo Sapiens; identical to SEQ ID NO: 359901

SEQ ID NO: 655507 - RNA, 64 nt, Homo Sapiens; identical to SEQ ID NO: 359902

SEQ ID NO: 655508 - RNA, 64 nt, Homo Sapiens; identical to SEQ ID NO: 359903

SEQ ID NO: 655509 - RNA, 64 nt, Homo Sapiens; identical to SEQ ID NO: 359904

SEQ ID NO: 655510 - RNA, 64 nt, Homo Sapiens; identical to SEQ ID NO: 359905

SEQ ID NO: 655511 - RNA, 64 nt, Homo Sapiens; identical to SEQ ID NO: 359906

SEQ ID NO: 655512 - RNA, 64 nt, Homo Sapiens; identical to SEQ ID NO: 359907

SEQ ID NO: 655513 - RNA, 64 nt, Homo Sapiens; identical to SEQ ID NO: 359908

SEQ ID NO: 655514 - RNA, 64 nt, Homo Sapiens; identical to SEQ ID NO: 359909

SEQ ID NO: 655515 - RNA, 64 nt, Homo Sapiens; identical to SEQ ID NO: 359910

SEQ ID NO: 655516 - RNA, 64 nt, Homo Sapiens; identical to SEQ ID NO: 359911

SEQ ID NO: 655517 - RNA, 64 nt, Homo Sapiens; identical to SEQ ID NO: 359912

SEQ ID NO: 655518 - RNA, 64 nt, Homo Sapiens; identical to SEQ ID NO: 359913

SEQ ID NO: 655519 - RNA, 64 nt, Homo Sapiens; identical to SEQ ID NO: 359914

SEQ ID NO: 655520 - RNA, 64 nt, Homo Sapiens; identical to SEQ ID NO: 359915

SEQ ID NO: 655521 - RNA, 64 nt, Homo Sapiens; identical to SEQ ID NO: 359916

SEQ ID NO: 655522 - RNA, 64 nt, Homo Sapiens; identical to SEQ ID NO: 359917

SEQ ID NO: 655523 - RNA, 64 nt, Homo Sapiens; identical to SEQ ID NO: 359918

SEQ ID NO: 655524 - RNA, 64 nt, Homo Sapiens; identical to SEQ ID NO: 359919

SEQ ID NO: 655525 - RNA, 64 nt, Homo Sapiens; identical to SEQ ID NO: 359920

SEQ ID NO: 655526 - RNA, 64 nt, Homo Sapiens; identical to SEQ ID NO: 359921

SEQ ID NO: 655527 - RNA, 64 nt, Homo Sapiens; identical to SEQ ID NO: 359922

SEQ ID NO: 655528 - RNA, 64 nt, Homo Sapiens; identical to SEQ ID NO: 359923

SEQ ID NO: 655529 - RNA, 64 nt, Homo Sapiens; identical to SEQ ID NO: 359924

SEQ ID NO: 655530 - RNA, 64 nt, Homo Sapiens; identical to SEQ ID NO: 359925

SEQ ID NO: 655531 - RNA, 64 nt, Homo Sapiens; identical to SEQ ID NO: 359926

SEQ ID NO: 655532 - RNA, 64 nt, Homo Sapiens; identical to SEQ ID NO: 359927

SEQ ID NO: 655533 - RNA, 64 nt, Homo Sapiens
uuggaugggaagaugguagcagauaaagacagcugacagauacauagauggaccaguagacaac

SEQ ID NO: 655534 - RNA, 64 nt, Homo Sapiens
ugugcaaauuuuaaaaaggaacccuuuuccuccagacagauacagccccaaaccagggugcaug

SEQ ID NO: 655535 - RNA, 64 nt, Homo Sapiens
cucccugcuccaggagggaaaaacagauguuguugacagauagagugauaggcaaauucugugu

SEQ ID NO: 655536 - RNA, 64 nt, Homo Sapiens
caccauuaauuuugaguauaauuuguuacauagcgacagauaacuauacagcucaacaacuaga

SEQ ID NO: 655537 - RNA, 64 nt, Homo Sapiens
uccauugagacauuccauuucaaagcaccgugcugacagauaucaaaguacucuagcagggaaa

SEQ ID NO: 655538 - RNA, 64 nt, Homo Sapiens
aauuuguuugcuguguaaggaagaauguagacaagacagauaaaucugaaggucauguggcauc

SEQ ID NO: 655539 - RNA, 64 nt, Homo Sapiens; identical to SEQ ID NO: 537060

SEQ ID NO: 655540 - RNA, 64 nt, Homo Sapiens; identical to SEQ ID NO: 537061

SEQ ID NO: 655541 - RNA, 64 nt, Homo Sapiens; identical to SEQ ID NO: 537062

SEQ ID NO: 655542 - RNA, 64 nt, Homo Sapiens; identical to SEQ ID NO: 537063

SEQ ID NO: 655543 - RNA, 64 nt, Homo Sapiens; identical to SEQ ID NO: 537064

SEQ ID NO: 655544 - RNA, 64 nt, Homo Sapiens; identical to SEQ ID NO: 537065

SEQ ID NO: 655545 - RNA, 64 nt, Homo Sapiens; identical to SEQ ID NO: 537066

SEQ ID NO: 655546 - RNA, 64 nt, Homo Sapiens; identical to SEQ ID NO: 537067

SEQ ID NO: 655547 - RNA, 64 nt, Homo Sapiens; identical to SEQ ID NO: 300702

SEQ ID NO: 655548 - RNA, 64 nt, Homo Sapiens; identical to SEQ ID NO: 300703

SEQ ID NO: 655549 - RNA, 64 nt, Homo Sapiens; identical to SEQ ID NO: 300704

SEQ ID NO: 655550 - RNA, 64 nt, Homo Sapiens; identical to SEQ ID NO: 300705

SEQ ID NO: 655551 - RNA, 64 nt, Homo Sapiens; identical to SEQ ID NO: 300706

SEQ ID NO: 655552 - RNA, 64 nt, Homo Sapiens; identical to SEQ ID NO: 300707

SEQ ID NO: 655553 - RNA, 64 nt, Homo Sapiens; identical to SEQ ID NO: 300708

SEQ ID NO: 655554 - RNA, 64 nt, Homo Sapiens; identical to SEQ ID NO: 300709

SEQ ID NO: 655555 - RNA, 64 nt, Homo Sapiens; identical to SEQ ID NO: 300710

SEQ ID NO: 655556 - RNA, 65 nt, Homo Sapiens
cugggggaagagccucccauaaaaucacaccuacucugugguaagaauaaaaucccacccaccug

SEQ ID NO: 655557 - RNA, 65 nt, Homo Sapiens
cagugaccgaaagaacccggugugccgggagauggcugugguacugcuggccaaccuggcucagg

SEQ ID NO: 655558 - RNA, 65 nt, Homo Sapiens
ugugggcccuuauugcagcugucucacagccugagcugugguacagagaaauggggguucuccuu

SEQ ID NO: 655559 - RNA, 65 nt, Homo Sapiens
gcuugaaggcacauggcuuucucauguagggcucucugugguauuuguuauuauuuugcaacaag

SEQ ID NO: 655560 - RNA, 65 nt, Homo Sapiens
uaacuucagcuccagcugguuuuugacagcuguugcugugguaauauuuuugacaugugauggug

SEQ ID NO: 655561 - RNA, 65 nt, Homo Sapiens
uaucggugacuccguauuaugacuccauuagugagcugugguauggguaggauuuuccuacuucu

SEQ ID NO: 655562 - RNA, 65 nt, Homo Sapiens
uagcaagauagucuucaguuucauuuuccugugcccugugguaguuggaaacaaaucauaaugua

SEQ ID NO: 655563 - RNA, 65 nt, Homo Sapiens
uuuaacaugauaaaugaauuuaccaguuuaguaugcugugguauuuuaauaaguuuucaaagaua

SEQ ID NO: 655564 - RNA, 65 nt, Homo Sapiens
acuuucugaagcuaaagaccacaccugaaucagggcugugguaaucaucuuaccauagcuguaaa

SEQ ID NO: 655565 - RNA, 65 nt, Homo Sapiens
gggaacauacuucuaaguucccugcagucucuguccugugguagaccaucuuuuuguaaacugcg

SEQ ID NO: 655566 - RNA, 65 nt, Homo Sapiens
gacaaaaacagagagaccgcagaaggaggaagauacugugguacugucauaaaaaacaguggagc

SEQ ID NO: 655567 - RNA, 65 nt, Homo Sapiens
uacugauuguguuuggauaauuugggaauuuucgacugugguaaaauauacauaaaauaauacuu

SEQ ID NO: 655568 - RNA, 65 nt, Homo Sapiens
ugucuuauuccgcuugaaaauagccaaaaagucuacugugguauuuguaauaaacucuaucugcu

SEQ ID NO: 655569 - RNA, 65 nt, Homo Sapiens
gccgggcuguggcucagguagccuuggcuggaaaacugugguagaguuaaccaggcaagacacaa

SEQ ID NO: 655570 - RNA, 65 nt, Homo Sapiens
acugucagguaaaaacauacaacuugacagucuaccugugguauaguuauugauucacucuucuc

SEQ ID NO: 655571 - RNA, 65 nt, Homo Sapiens
guaauuugaggaauacagugauauuuugccuauuucugugguaguguacauuugaaggauuuggc

SEQ ID NO: 655572 - RNA, 65 nt, Homo Sapiens
aggaagacagaacucacacagaggcagaggggagacugugguagaggcagggagugcuccggagg

SEQ ID NO: 655573 - RNA, 65 nt, Homo Sapiens
gcacuggcccugccuugagagugugcucaggagcacugugguagauccugggugucccagggacu

SEQ ID NO: 655574 - RNA, 65 nt, Homo Sapiens
cauuguuuuauaaugaaauauaaaauaucauaguucugugguagauaauuuuuuuaaauaucaac

SEQ ID NO: 655575 - RNA, 65 nt, Homo Sapiens
ggguaaagccauguaagaagcucuuuagcaaaagccugugguauguaauuugaaaccugaaaugc

SEQ ID NO: 655576 - RNA, 65 nt, Homo Sapiens
gauggacuuaaccggaguucauaacacaaguaaaacugugguacuccugugaagacugggugagg

SEQ ID NO: 655577 - RNA, 65 nt, Homo Sapiens
ucuauuuguauaucucaacaagaagguguaggcugcugugguaauuuuaaguguuuagaaaucau

SEQ ID NO: 655578 - RNA, 65 nt, Homo Sapiens
ggucagggaagggcauauagguucccugguggggucugugguaagucaaacucagccuauuccuu

SEQ ID NO: 655579 - RNA, 65 nt, Homo Sapiens
acuuccccucugauaggacaagucuugaugugcuccugugguauuccaugguucuuuauguuugu

SEQ ID NO: 655580 - RNA, 65 nt, Homo Sapiens
aggcagggagaguaagacauaggugauucuggccucugugguagggcaggccuccagcucggucc

SEQ ID NO: 655581 - RNA, 65 nt, Homo Sapiens
ugugggagggccauuaaggauauuuuaagugucuucugugguauaguguaaugagcuagagauaa

SEQ ID NO: 655582 - RNA, 65 nt, Homo Sapiens
aggugcugugagaagugcaccaggcagcuuucucucugugguagacuaggcaugucuggggaugg

SEQ ID NO: 655583 - RNA, 65 nt, Homo Sapiens
gugacuauuugaggauuuugaaaacaucagauuugcugugguaugggagaaaaggcuauguacuu

SEQ ID NO: 655584 - RNA, 65 nt, Homo Sapiens
caccccauucuacuccauggccucucugcucccagcugugguaggcucacauagccagugugauc

SEQ ID NO: 655585 - RNA, 65 nt, Homo Sapiens
uuugccuauuucgcuaacaguuugguuuuuaauggcugugguauuugagugaggcaacucugggg

SEQ ID NO: 655586 - RNA, 65 nt, Homo Sapiens
gaggggaacuuaacuauuaacuacaaguuguaugucugugguaucuugauuuucccauuucuaaa

SEQ ID NO: 655587 - RNA, 65 nt, Homo Sapiens
cagcagugugugagaagagcagccuuccuuugucccugugguauucauaaaguacccgcuccacc

SEQ ID NO: 655588 - RNA, 65 nt, Homo Sapiens
ugagcccugcuugguugucuccacacacagcugggcugugguagggggugucucaggccacaccg

SEQ ID NO: 655589 - RNA, 65 nt, Homo Sapiens
guaucagaaccacaugaaguuauagccucuaaagccugugguauuuuauauaauauuuuuauaac

SEQ ID NO: 655590 - RNA, 65 nt, Homo Sapiens
gcuuuuugguugcuguugaguuuuuguuuugucuucugugguaagaacacuuaacucaagaccua

SEQ ID NO: 655591 - RNA, 65 nt, Homo Sapiens
auggcucuuguuuaucagcuaaucuugaauuuauucugugguaaaucuuuugaguuguugaguau

SEQ ID NO: 655592 - RNA, 65 nt, Homo Sapiens
aucccugaaaaucauuuacagauaaccacaauuugcugugguauauaaacuaauucuuggucuau

SEQ ID NO: 655593 - RNA, 65 nt, Homo Sapiens
gguagaaagcagcaccuuucauuucauaaaugcaucugugguagaaaauagcuucauugaucaac

SEQ ID NO: 655594 - RNA, 65 nt, Homo Sapiens
aaaacauuaaccaaaagauuauuuuauuuuuguaucugugguaacauuugagagaaauuauucag

SEQ ID NO: 655595 - RNA, 65 nt, Homo Sapiens
ggccagcagaagacauggcccccgccacgaucuuucugugguagcugcggacgccggcuguucuu

SEQ ID NO: 655596 - RNA, 65 nt, Homo Sapiens
cucagaaauucgucuuugucuuugagugucaguaacugugguagaauggccuaacuaucgggaaa

SEQ ID NO: 655597 - RNA, 65 nt, Homo Sapiens
auggaugagguuucuaugagagugaagagguagaacugugguauuucccuuuuugcuuaaccugg

SEQ ID NO: 655598 - RNA, 65 nt, Homo Sapiens
gacuauaauuauuucuauaaacagauuuggugacucugugguaaaugacucuguuuugauugggu

SEQ ID NO: 655599 - RNA, 65 nt, Homo Sapiens
aucuuaaacuauggaaaauuaacuaugaauaaguucugugguaaaugcaaccuaauugcaucuaa

SEQ ID NO: 655600 - RNA, 65 nt, Homo Sapiens
aauaugaauaauguuaagucuuaccucauaugcagcugugguagauuaacuuaauuuuuuuuccu

SEQ ID NO: 655601 - RNA, 65 nt, Homo Sapiens
gaagacuucuggguucuuucagauaccgaagccuacugugguacuggucccucaccuggcuaggg

SEQ ID NO: 655602 - RNA, 65 nt, Homo Sapiens
uugaacggaauaucacagcugugaccguuugacaucugugguagauccuuugacuucuguaaaau

SEQ ID NO: 655603 - RNA, 65 nt, Homo Sapiens
ggggcgggagcagcagggaccacuucccagcagcucugugguaguggggcugggcagucgccccc

SEQ ID NO: 655604 - RNA, 65 nt, Homo Sapiens
uguuaaauuaauuauaaugggauuggguuuguuaucugugguaguauauauccuaguguuccuau

SEQ ID NO: 655605 - RNA, 65 nt, Homo Sapiens
ugcugcccuugugcaguuuggucagucugugggcucugugguauaugacugcuucgaggcugccc

SEQ ID NO: 655606 - RNA, 65 nt, Homo Sapiens
ugaccuuguucaaucacuaugaagcagagugaaagcugugguagagugguuaacagauacaagug

SEQ ID NO: 655607 - RNA, 65 nt, Homo Sapiens
uaccaaaauguccaccaauagaaugagugaaucaccugugguauauuuauaaauaaaaauauuaa

SEQ ID NO: 655608 - RNA, 65 nt, Homo Sapiens
aaauauuuauauugaauucugaauacaaaaugucccugugguagaaaacuuacucuuuaugccug

SEQ ID NO: 655609 - RNA, 65 nt, Homo Sapiens
accuggaugugugacacacaguuuuggaaaaaggucugugguagucuggaguugaugaggaaggg

SEQ ID NO: 655610 - RNA, 65 nt, Homo Sapiens
caucuuaagaaguaaagaucaggacuuuuuaauuacugugguaauuaaauguguucaguauguac

SEQ ID NO: 655611 - RNA, 65 nt, Homo Sapiens
uauagagguuuaacuuauaugcuguaggaauaaaucugugguaacauacuccaaaaccuagaaau

SEQ ID NO: 655612 - RNA, 65 nt, Homo Sapiens
ggggcugcugcuauuuaagccacccccaggaggcgcugugguacucagaaagcuaggugcucugu

SEQ ID NO: 655613 - RNA, 65 nt, Homo Sapiens
aacuccaguggugaacggcuuuucucaauccccugcugugguaggcuuuucaguguuuggagaca

SEQ ID NO: 655614 - RNA, 65 nt, Homo Sapiens
ggcuauacuagggaaccauuaauuucuaccuuuuucugugguaucaaggugcauaugcaugucuc

SEQ ID NO: 655615 - RNA, 65 nt, Homo Sapiens
cacugaauuuucuuugucacauaauuuaucaaagccugugguacgaauauauacauugauuuuuc

SEQ ID NO: 655616 - RNA, 65 nt, Homo Sapiens
uggaaaaguagcaggguggugugucuauggguggccugugguauacagcuucacccccuggcuuu

SEQ ID NO: 655617 - RNA, 65 nt, Homo Sapiens
auagagaagaauuaaagcaauuguuaaauauuuuacugugguaauuaucaguaaucucuuggacu

SEQ ID NO: 655618 - RNA, 65 nt, Homo Sapiens
auaaugugucucuuacuagauauuaaacaguuuuucugugguauauuaaaggaguuagagagcua

SEQ ID NO: 655619 - RNA, 65 nt, Homo Sapiens
uccccuagcaaauguaacuaacaagguucugaguccugugguaugucccuaaaaaaguaaaacag

SEQ ID NO: 655620 - RNA, 65 nt, Homo Sapiens
acuccugcaaaauuuuauagaaugucacuuaaaggcugugguaguuugugaccaaguuauaaauc

SEQ ID NO: 655621 - RNA, 65 nt, Homo Sapiens
cagaagaugaugaauugugaucaggaccaagaucccugugguaaacacucugauugaaucugggg

SEQ ID NO: 655622 - RNA, 65 nt, Homo Sapiens
ucuaucuugcugaaauauugcuucauauuuauagccugugguagugcacaugguuaacauaaaag

SEQ ID NO: 655623 - RNA, 65 nt, Homo Sapiens
acauuuauaagaaccaguauggauacauccauucacugugguacauuuuaaaauaaaauauuuua

SEQ ID NO: 655624 - RNA, 63 nt, Homo Sapiens
uuagggcugagaauucauaaaaaaauucauucucugugguauccaagaaucagugaagaugcc

SEQ ID NO: 655625 - RNA, 65 nt, Homo Sapiens
aucaguaguaccaaaggaucuuuuuacaaggcuuccugugguauugacucugagaauaacacaua

SEQ ID NO: 655626 - RNA, 65 nt, Homo Sapiens
ugaaauuaguagaaucagggaggacgggacuuaugcugugguaggcaacagaaaaaaacuucuau

SEQ ID NO: 655627 - RNA, 65 nt, Homo Sapiens
aaaauagccacuagaaagaauaaugaagcucaacacugugguaggauauaaguuauuuaauauaa

SEQ ID NO: 655628 - RNA, 65 nt, Homo Sapiens
agagacuugagcuggaucugguauucauacauacucugugguaauaauuagauugguaaauacau

SEQ ID NO: 655629 - RNA, 65 nt, Homo Sapiens
agccucaaugaaaucauuuacauauuuuuaaaacccugugguaaauugugcuucagcucauuuuc

SEQ ID NO: 655630 - RNA, 65 nt, Homo Sapiens
uuaaaggaaacaaguagaaaucagcaguggagugucugugguaagaaaacaugaacuuuaugcuu

SEQ ID NO: 655631 - RNA, 65 nt, Homo Sapiens
gacagcuugacugcuuuuaaaugaccaaagaugaccugugguaagcaaccugggcaucuuaggaa

SEQ ID NO: 655632 - RNA, 65 nt, Homo Sapiens
acuugccaagcccuuaacucuacuuccucuucagucugugguacuccuccuaacccuaaacccuc

SEQ ID NO: 655633 - RNA, 65 nt, Homo Sapiens
cuuucuucccccugggauaugaugugugguguuuccugugguaaaagacugaggcaggccagggg

SEQ ID NO: 655634 - RNA, 65 nt, Homo Sapiens
agcagggggacaugugucccucagcucagcagaggcugugguacaacaugguccuuggugaagac

SEQ ID NO: 655635 - RNA, 65 nt, Homo Sapiens
uuugacuucuguggcauggugcuagugcauguacccugugguauugccccucuguccguagugug

SEQ ID NO: 655636 - RNA, 65 nt, Homo Sapiens
cuaacgaggcugccuccagcauuuccugauuuccucugugguaauaaaagcuuucugugcuuagg

SEQ ID NO: 655637 - RNA, 65 nt, Homo Sapiens
augucagcagagucuccaaggagguaaugaauugucugugguaucaugcgggaagcagccgcggg

SEQ ID NO: 655638 - RNA, 65 nt, Homo Sapiens
ccaaauagcauacauguacaggaguguguauguaccugugguauaacugaagagaauguuuauga

SEQ ID NO: 655639 - RNA, 65 nt, Homo Sapiens
cauguccuuccaugacuaauugugaggaaagauaucugugguagaaagaaauggaauaauuuaaa

SEQ ID NO: 655640 - RNA, 65 nt, Homo Sapiens
gguugggcccccagccuguagugagccagagggagcugugguaaguccucuauuaauuacugugu

SEQ ID NO: 655641 - RNA, 65 nt, Homo Sapiens
auuauuuuaauaauguugccauguuauauuagggacugugguauauaccuuccuacuggagcuug

SEQ ID NO: 655642 - RNA, 65 nt, Homo Sapiens
gacaccugagagaaaggggacauacucccugcucccugugguagagcucaggcagacucaccuca

SEQ ID NO: 655643 - RNA, 65 nt, Homo Sapiens
gcccuguaagaaccugcccccagagagacucucagcugugguacugccuucagucaccugaucag

SEQ ID NO: 655644 - RNA, 65 nt, Homo Sapiens
ggcacuugcagggccugggaugagcagucuucaagcugugguaguuagcgggcaggagagcgaca

SEQ ID NO: 655645 - RNA, 65 nt, Homo Sapiens
gacuucugacucuccuuccaccuccccacuguacacugugguacagauaguuggcacuauccuag

SEQ ID NO: 655646 - RNA, 65 nt, Homo Sapiens
cgggugccagcaugcuaugggcuccugcgugaggccugugguacacagagauuagguugugauac

SEQ ID NO: 655647 - RNA, 65 nt, Homo Sapiens
ucucuaugccaccacuggccaccuagagcccuuggcugugguaauccaggguaauugcgcagagg

SEQ ID NO: 655648 - RNA, 65 nt, Homo Sapiens
ggaaacaauaaauuccugagauacauucuuccaaucugugguaauaauaagaauuccucucugcc

SEQ ID NO: 655649 - RNA, 65 nt, Homo Sapiens
ccaagcugugauaaguggaaugguuacuguuuauacugugguauguuuuugauuacagcagauaa

SEQ ID NO: 655650 - RNA, 65 nt, Homo Sapiens
cagauuuuaaauuguauguguacuugcaucuaagacugugguagagaaguaaagagaagucaauu

SEQ ID NO: 655651 - RNA, 65 nt, Homo Sapiens
guucuguuuucuugagacauuuaaucuggugguaacugugguaacauugcagcccuaagcagcau

SEQ ID NO: 655652 - RNA, 65 nt, Homo Sapiens
cauagugccauuggauagggaagaacuucagaaaucugugguacucuuggccuugucuuugucuu

SEQ ID NO: 655653 - RNA, 65 nt, Homo Sapiens
acaugguuaacauucauaaauggugggggcccuuacugugguagaaaccauugucacugcaaggc

SEQ ID NO: 655654 - RNA, 65 nt, Homo Sapiens
cuaggcaccugcuguucuuucaggaaacagcuuggcugugguaaugcucuacugggcccuucaga

SEQ ID NO: 655655 - RNA, 65 nt, Homo Sapiens
gagaaggugagagacaaaaauggaaagauccuggccugugguagugguagcaguuuucucaaaua

SEQ ID NO: 655656 - RNA, 65 nt, Homo Sapiens
uauaagugcuucgucccuuuaugaaacacaugugucugugguaucuuuuuuuaacaaaacuaaaa

SEQ ID NO: 655657 - RNA, 65 nt, Homo Sapiens
caugaacuccugauggaacaauaacaggcccaagccugugguaugaugugcacacuugcuagacu

SEQ ID NO: 655658 - RNA, 65 nt, Homo Sapiens
cccaagaccaggagggggcaaugggcccagccuuucugugguaucugaugcaggaaggacugcag

SEQ ID NO: 655659 - RNA, 65 nt, Homo Sapiens
ccagaaaccacaaauugacugcugagaaguuaggucugugguagauaucuacauagauaugcuuu

SEQ ID NO: 655660 - RNA, 65 nt, Homo Sapiens
cauuuggcauauuuuguggaaaauaaaaggugucacugugguaggcuugaaaagcuuucuuguua

SEQ ID NO: 655661 - RNA, 65 nt, Homo Sapiens
cccccauguggcacccagggggaguuaucuucccacugugguaacgaauucuuucugacagccua

SEQ ID NO: 655662 - RNA, 65 nt, Homo Sapiens
uccagcgauggugcugcccauccagggccccccaacugugguagccacaccccuggggcugaguc

SEQ ID NO: 655663 - RNA, 65 nt, Homo Sapiens
ccuuuccugcuuuggggcuuaugagggccauaucccugugguauuuuguugcaucccucaauuga

SEQ ID NO: 655664 - RNA, 65 nt, Homo Sapiens
aaugugauaauauauugcuagaguauuucuggcagcugugguacaguuuacaaacauggaaaaca

SEQ ID NO: 655665 - RNA, 65 nt, Homo Sapiens
cccagcaguucucagggugcugacccacccagccccugugguagcggccccccagaccauaccuc

SEQ ID NO: 655666 - RNA, 65 nt, Homo Sapiens
caggccacacguugugcccgcccucucuucuggcccugugguaccgacaggagcagggccccugu

SEQ ID NO: 655667 - RNA, 65 nt, Homo Sapiens
aaguaucauguaaucacaguguacagucuaauaagcugugguaggccacaggaauaucuucuguu

SEQ ID NO: 655668 - RNA, 65 nt, Homo Sapiens
agugaagggauacugcaggccuguguuugcagcgccugugguaacuguggaaugagcucuguuag

SEQ ID NO: 655669 - RNA, 65 nt, Homo Sapiens
agaaaugguuuucuuaaauaccuacaaaaaaguuacugugguaucuaugaguuaucaucuuagcu

SEQ ID NO: 655670 - RNA, 65 nt, Homo Sapiens
uguaucuuuuucaagaagaaucucuuauggacagucugugguaaagaagcaacucuuugcuuuag

SEQ ID NO: 655671 - RNA, 65 nt, Homo Sapiens
ccugcccaagcuucucccccagccacccucugccccugugguagagcccacuauaggcccaggcg

SEQ ID NO: 655672 - RNA, 65 nt, Homo Sapiens
accaaguuugaggcauugaccaagcagcuucuugccugugguaauaguggauuuauccugcagcu

SEQ ID NO: 655673 - RNA, 65 nt, Homo Sapiens
aucauaccccauggauaccaggagcacuuacaaggcugugguagauuguggguacuuuaagguuu

SEQ ID NO: 655674 - RNA, 65 nt, Homo Sapiens
acauuauguuuauaauugcagcucuuuguugaagccugugguagcggaaaaaaguaucuuuaaca

SEQ ID NO: 655675 - RNA, 65 nt, Homo Sapiens
cgagguuuuuauuuguucgguauuguuuuuuuacacugugguacauauaagcaacuuuaauaggu

SEQ ID NO: 655676 - RNA, 65 nt, Homo Sapiens
cacagaaagggucaugaagcccuggcccaacaggacugugguacuaggggcugggaugugggguu

SEQ ID NO: 655677 - RNA, 65 nt, Homo Sapiens
ccccccuaauaaauuaauuuaaaaagccccccaaucugugguauuuuauuauggcagcccuagca

SEQ ID NO: 655678 - RNA, 65 nt, Homo Sapiens
gggagggaugguuugggcaggugcagauccaagggcugugguaaacgggagagcuuguguuuuug

SEQ ID NO: 655679 - RNA, 65 nt, Homo Sapiens
aguaagcagagacaguguuaaggacgaguuggugucugugguagcuuuuaggcugcuccuaaccc

SEQ ID NO: 655680 - RNA, 65 nt, Homo Sapiens
ucaggugugaccguuggugaaaacuugugccccuucugugguaugcccuugcccuguucuauaaa

SEQ ID NO: 655681 - RNA, 65 nt, Homo Sapiens
uguguaauuauguccauuauuaaaauuguagaugacugugguaaaugucuuuuugugauguuaua

SEQ ID NO: 655682 - RNA, 65 nt, Homo Sapiens
augacagccauuguuucauaaagauacaauguauacugugguacaguaauuuaagaaccuucacc

SEQ ID NO: 655683 - RNA, 65 nt, Homo Sapiens
augaaauguuacuguuaacuuugcauaucacaacccugugguagucuguuuaaaauauuuuaaau

SEQ ID NO: 655684 - RNA, 65 nt, Homo Sapiens
gaggaguauggccacugcccccucuuuguagaacccugugguauacuucugaauccuuagaaugg

SEQ ID NO: 655685 - RNA, 65 nt, Homo Sapiens
cugugaaauauguugauuacucugcaugcuguuaacugugguacagaaaccauuauauuuuacua

SEQ ID NO: 655686 - RNA, 65 nt, Homo Sapiens
ugaaauauuugccauuguuguuuaaauaccuaucacugugguagagcuugcauugaucuuuucca

SEQ ID NO: 655687 - RNA, 65 nt, Homo Sapiens
uggacagacuucaauuugccauuuugagauuugaccugugguagcaucugggccuaauguuggcu

SEQ ID NO: 655688 - RNA, 65 nt, Homo Sapiens
ggauagagaucccaacuugaaacaacagccagugccugugguaacuuaaugucuugucaaauacu

SEQ ID NO: 655689 - RNA, 65 nt, Homo Sapiens
uugcccuuaaaaauuaguuugacguuuuucuucugcugugguauccaugaagucuuuucuugcaa

SEQ ID NO: 655690 - RNA, 65 nt, Homo Sapiens
gggugagcggcucauguguguggaaggugugcuugcugugguacuuagaggauacuuucuggguu

SEQ ID NO: 655691 - RNA, 65 nt, Homo Sapiens
cuagguucauuccucaucaauguggcagguuuccacugugguaagcagaaccccggccuugcagu

SEQ ID NO: 655692 - RNA, 65 nt, Homo Sapiens
uaguuaugguagugcaaaucucuuugggccaugaccugugguaccaugauaucuaguccauuaac

SEQ ID NO: 655693 - RNA, 65 nt, Homo Sapiens
uuagcuuuaaaagaguauuuauuaugagcuaaaagcugugguaugucauuaaggcaucuaugggc

SEQ ID NO: 655694 - RNA, 65 nt, Homo Sapiens
aaggauauuuaaucaugacagguucuuuagggugacugugguaagugucccuaguccuaagcuuu

SEQ ID NO: 655695 - RNA, 65 nt, Homo Sapiens
caccugcacgcauaggauuggagaaaacuguuugccugugguagaucacauuacuacaaaauggg

SEQ ID NO: 655696 - RNA, 65 nt, Homo Sapiens
auaacuaaaauuguucacaacuugaaaugcuuuaacugugguauugagacaugaugagaagccgu

SEQ ID NO: 655697 - RNA, 65 nt, Homo Sapiens
auggaccugguggcuucuccaucccacuguggccucugugguauggaccugguggcuucuccauc

SEQ ID NO: 655698 - RNA, 65 nt, Homo Sapiens
aaccccaaauguccauccacagacgaauguauaaacugugguauccauuacacaauagacuacuu

SEQ ID NO: 655699 - RNA, 65 nt, Homo Sapiens
uuaggaaggaaucuuuuuuuaaagacuuccaucuacugugguauuauacccaagccuagugugua

SEQ ID NO: 655700 - RNA, 65 nt, Homo Sapiens
cagcuacaccccaggugcucgggaauguggcugagcugugguaacagggcugaccuccguuucug

SEQ ID NO: 655701 - RNA, 65 nt, Homo Sapiens
acccagggguaaacuauuauguagaauuucucauucugugguacaaaaaagaguuguauaaucuu

SEQ ID NO: 655702 - RNA, 65 nt, Homo Sapiens
ggggucuuuuggcucugaaggggcaaaggucaagacugugguauuuccaguuucagaagcaggca

SEQ ID NO: 655703 - RNA, 65 nt, Homo Sapiens
ccagacaaaaggugagugaccuggaaagccagcagcugugguacugcggguggugauaauagggg

SEQ ID NO: 655704 - RNA, 65 nt, Homo Sapiens
cuauaaaaaaaguuugucuugucacagcuuuuguucugugguaacuuuaugaaauaaaaacauga

SEQ ID NO: 655705 - RNA, 65 nt, Homo Sapiens
ugcagcgugggggacgugcucacugcugccaggggcugugguaccagaccaugcccgggccucuu

SEQ ID NO: 655706 - RNA, 65 nt, Homo Sapiens
cuggcagagaagagaccaagccuuggcgugugucccugugguacccuggcaucacacgcagguua

SEQ ID NO: 655707 - RNA, 65 nt, Homo Sapiens
caaagcuuuuuaaugcauaaaaguauaauugaaaucugugguauuuauuuacaaacaugucuaca

SEQ ID NO: 655708 - RNA, 65 nt, Homo Sapiens
acuccccacacuccggggcagaucuuuccucuugucugugguaaggaaggagucuugaccauaga

SEQ ID NO: 655709 - RNA, 65 nt, Homo Sapiens
agucuuuugugcaauuguuucucacccugcugauucugugguaucuguguugaauaaagaaaaag

SEQ ID NO: 655710 - RNA, 65 nt, Homo Sapiens
cucuuacuuuaaaaacuggucuuuuuauuuacccucugugguagaagagucaccagcagguucca

SEQ ID NO: 655711 - RNA, 65 nt, Homo Sapiens
cucuggagaaauaccuccccucucuggggugcuuccugugguagugucuuucagguauccguucc

SEQ ID NO: 655712 - RNA, 65 nt, Homo Sapiens
ccauuuggaaaauccuaccaaagaggauaaauccucugugguaaguaugggaugaaauauuucaa

SEQ ID NO: 655713 - RNA, 65 nt, Homo Sapiens
ggcauuuaaacaauauaauaaaaaaaaaaauuacacugugguaguuccagagauucaguauuaaa

SEQ ID NO: 655714 - RNA, 65 nt, Homo Sapiens
guggucucauuaaagucaaguggaaaagagaaccucugugguaauugacaauguuggaagucauc

SEQ ID NO: 655715 - RNA, 65 nt, Homo Sapiens
cagcgugaaucaugaaaauauggaguuaggagggccugugguagacccccaaacuccuucuccac

SEQ ID NO: 655716 - RNA, 65 nt, Homo Sapiens
uugcaggaacugugugcuaaaugauuucucaccugcugugguaucuaaaagaugaacucuuugag

SEQ ID NO: 655717 - RNA, 65 nt, Homo Sapiens
acaggacuggcccacuuaguggacuguuccccccacugugguagggucaugagcaaguuuucugu

SEQ ID NO: 655718 - RNA, 65 nt, Homo Sapiens
gugauauucugcugugcaaauccaugcaaaacugacugugguagugaaaagucuguagaaaagua

SEQ ID NO: 655719 - RNA, 65 nt, Homo Sapiens
uuuugacucaaauugcuacaguugccaucaccuuucugugguaauacuacugauauuugcuuuuc

SEQ ID NO: 655720 - RNA, 65 nt, Homo Sapiens
cagcaucggaaagaacgcugcucccuuuuccaugacugugguagcgacaggccuguccaacacau

SEQ ID NO: 655721 - RNA, 65 nt, Homo Sapiens
ugaaucauuuugccaggucagaauauucucacgcucugugguauuauaucuugagcuuuacugag

SEQ ID NO: 655722 - RNA, 65 nt, Homo Sapiens
ggaauugaagaaaauauaacuguggaguuagccuccugugguaaaaugagaaacaugagggaaau

SEQ ID NO: 655723 - RNA, 65 nt, Homo Sapiens
auaacaugagugaaugucauacucuauuuaaggaucugugguaguuuaguaauuaugcaguaugu

SEQ ID NO: 655724 - RNA, 65 nt, Homo Sapiens
gcuaauaccugucaacauuucauuagaucuaguuacugugguaugcuccaggcauuuagcccuca

SEQ ID NO: 655725 - RNA, 65 nt, Homo Sapiens
uuucaaguucaauguuauuuuuguauaucuugacucugugguagauuugccuugccaaguauaac

SEQ ID NO: 655726 - RNA, 65 nt, Homo Sapiens
cugcugucaugucugggucuuuaggguaggacaggcugugguaugagaggcaggagucuccacaa

SEQ ID NO: 655727 - RNA, 64 nt, Homo Sapiens
acauggaauccagucugugacaguguuuuucacucugugguaagcugaggaauaugucacauuu

SEQ ID NO: 655728 - RNA, 65 nt, Homo Sapiens
gcaggaaugaagccaauaauuuauugcuuuccauucugugguaugaugugcgugugcgugagugu

SEQ ID NO: 655729 - RNA, 65 nt, Homo Sapiens
uucucuuguguguaccuaaagccauauuuccaagucugugguacuccaggauuccaggaguaagc

SEQ ID NO: 655730 - RNA, 65 nt, Homo Sapiens
guguauuggaaauuuuauaauguuuagacacauaacugugguacauacuccauuaacauccucac

SEQ ID NO: 655731 - RNA, 65 nt, Homo Sapiens
cagcugugcuguggcucaguaggucgaauuucgaccugugguacacugcuagauuguaauauuua

SEQ ID NO: 655732 - RNA, 65 nt, Homo Sapiens
aacaguaaaaugauuuaaaaccaauuuaaaugcgacugugguauacugucaugggagccauucug

SEQ ID NO: 655733 - RNA, 65 nt, Homo Sapiens
accaaaccacccaaggccaggggaugaagaaaacccugugguagacuuccacuuccuccccaaaa

SEQ ID NO: 655734 - RNA, 65 nt, Homo Sapiens
cugaccccagcccagacagcaagguguggaggcuccugugguaguccucccaagcugugcuggga

SEQ ID NO: 655735 - RNA, 65 nt, Homo Sapiens
gaagguaaacuuccuugaggagaagugaaguuucacugugguauggccauugaaaaacaaaaacu

SEQ ID NO: 655736 - RNA, 65 nt, Homo Sapiens
gucgcguagcccaggguggaggcagaacgaugcugcugugguagcccuuugccuuucaugcccau

SEQ ID NO: 655737 - RNA, 65 nt, Homo Sapiens
caacucuagguuucaaguacuccuuuucuccgauccugugguacuugaauauccaaaaacccugc

SEQ ID NO: 655738 - RNA, 65 nt, Homo Sapiens
gggaggaaagagcugcguggauagauucaaacuuccugugguagugcucccagucugaccucugu

SEQ ID NO: 655739 - RNA, 65 nt, Homo Sapiens
uauuuuaaaccuguugggccaccauccaggagagacugugguauauuugguucaucagugaauuc

SEQ ID NO: 655740 - RNA, 65 nt, Homo Sapiens
auaacaguauaucugauuaaacuugaacacaaacacugugguagguuaauccuuaucuuagggau

SEQ ID NO: 655741 - RNA, 65 nt, Homo Sapiens
caauugccgccuugugucuucuuacuuccaugaagcugugguaccuaauaugcaaauucccacca

SEQ ID NO: 655742 - RNA, 65 nt, Homo Sapiens
gaugaguucuuggcaagggccagcguuagaaaucacugugguacuagagccguucuucaccacgc

SEQ ID NO: 655743 - RNA, 65 nt, Homo Sapiens
agcaauaaauguuugauguuuauaagccacccagacugugguauuuuguuauagcagccugaaca

SEQ ID NO: 655744 - RNA, 65 nt, Homo Sapiens
cuagaaaccacaagaugauggagaggucauaaaaacugugguaguaugcuuagaaacuguugauu

SEQ ID NO: 655745 - RNA, 65 nt, Homo Sapiens
aaugaaaaaaaaaauccaaaacagaacaagcccuucugugguauuugcuuuuuaucagaaagaac

SEQ ID NO: 655746 - RNA, 65 nt, Homo Sapiens
aagguggagcuuuccuggcccugggaggaagcuggcugugguagcguagcgcucucucucucugu

SEQ ID NO: 655747 - RNA, 65 nt, Homo Sapiens
uacccaaaacugagucccuuugggcucagaaaugucugugguauugggucagacucugaccacag

SEQ ID NO: 655748 - RNA, 65 nt, Homo Sapiens
uugcccuuggccuggcucccugcccggggcuggugcugugguaccuacaucuucaggaagcugug

SEQ ID NO: 655749 - RNA, 65 nt, Homo Sapiens
gauagacaugaagagagcuugucuaagaugggaaacugugguacaccuugccagcugacgucaca

SEQ ID NO: 655750 - RNA, 65 nt, Homo Sapiens
cauugaauguacuauguauguagaggugacucucucugugguacaauugaguugcuggaaugaag

SEQ ID NO: 655751 - RNA, 65 nt, Homo Sapiens
ggguugccuagcgacucuucuggcacagggugugucugugguauaccugugaggugguugacaau

SEQ ID NO: 655752 - RNA, 65 nt, Homo Sapiens
acaucuacacugcugcucuucaccauuggaauucacugugguauuuauaguauuggcuucagucc

SEQ ID NO: 655753 - RNA, 65 nt, Homo Sapiens
aaagaccaaccggcaaacuuucagaugaaugcuuacugugguauuuggaauguauguaucuucug

SEQ ID NO: 655754 - RNA, 65 nt, Homo Sapiens
gguugugacuuccccuuaaguauaacuaauuugcucugugguaagagauaugcucauuauuacca

SEQ ID NO: 655755 - RNA, 65 nt, Homo Sapiens
acugauccuucagaagaagcaaugcaaggaaauggcugugguaaccguccugagaaggacggugu

SEQ ID NO: 655756 - RNA, 65 nt, Homo Sapiens
gaacucucuuccuucuuuccuacacccacagcggucugugguagagcagagccggacccaguggc

SEQ ID NO: 655757 - RNA, 65 nt, Homo Sapiens
aaaaaaugaacucuuucaauucuaacuaaugagcucugugguaagagauaugcuucgagcacuuu

SEQ ID NO: 655758 - RNA, 65 nt, Homo Sapiens
uuugucagaucacacauauauuguguuauugggcgcugugguaucuuuuauaaaaccucuugcuu

SEQ ID NO: 655759 - RNA, 65 nt, Homo Sapiens
accaggcccuaauaauagaaguuguaccaaaaugccugugguacuugauggccuguuggucaaau

SEQ ID NO: 655760 - RNA, 65 nt, Homo Sapiens
ccuaccuaagucagucacuuugcuaaauucuucaccugugguaacucauuuugauuguuauaaca

SEQ ID NO: 655761 - RNA, 65 nt, Homo Sapiens
ucccauaucaaaaagccuuuggaguguggagcuuucugugguauggcagaaauggguggauggca

SEQ ID NO: 655762 - RNA, 65 nt, Homo Sapiens
aagaauagaaaaggcucucagauuugugaguggaccugugguaaguaccaguccauaccagcugc

SEQ ID NO: 655763 - RNA, 65 nt, Homo Sapiens
cacuguacuuaauacuaggauauugagaaccuggccugugguagguuuugugucauuuauucaag

SEQ ID NO: 655764 - RNA, 65 nt, Homo Sapiens
aagccagaccuccccggcggaagaaagcaggaaaccugugguaugaguggugcuuacgcuccacc

SEQ ID NO: 655765 - RNA, 65 nt, Homo Sapiens
gcugguuuugcugugagcugcaguguucugugggucugugguaucugacacuguggacauuaaug

SEQ ID NO: 655766 - RNA, 65 nt, Homo Sapiens
gaugacauggucaucuacaacuaauauuaagacuccugugguauugauugagcagagcagaagag

SEQ ID NO: 655767 - RNA, 65 nt, Homo Sapiens
agcaggggcuggaugccuuucaucccaacuauucucugugguaucaaaaagaaaaaaaaaaaaaa

SEQ ID NO: 655768 - RNA, 65 nt, Homo Sapiens
aaacugucuggggugauuccuagaagaucauuaaacugugguacauuuuuuugucuaugaauguu

SEQ ID NO: 655769 - RNA, 65 nt, Homo Sapiens
uauuucuuuauucaguauaauagcacuggaggagacugugguagccaucuucguaaauuuaaacu

SEQ ID NO: 655770 - RNA, 65 nt, Homo Sapiens
aaaacagcuauagacaaucaaacucaauucuaccacugugguauggugagccagguauuuacagc

SEQ ID NO: 655771 - RNA, 65 nt, Homo Sapiens
ccacgcggcugguagugcagccuucugugaccccgcugugguaaguccagccugcccagggcugc

SEQ ID NO: 655772 - RNA, 65 nt, Homo Sapiens
aaaugauaaaacagaauauugacaagcuaggacaccugugguaucuuuaauuguaucuccuucag

SEQ ID NO: 655773 - RNA, 65 nt, Homo Sapiens
gcuuuugacaucagauuuucauuugagagggagagcugugguacuggcuaaaaagaaaggaagau

SEQ ID NO: 655774 - RNA, 65 nt, Homo Sapiens
accugcccuucagaauucgguucacuugggggcuucugugguagagacuaacuggccuucugaug

SEQ ID NO: 655775 - RNA, 65 nt, Homo Sapiens
uuuugugauuucuguauaggacucuuuaucuugagcugugguauuuuuguuuuguuuuugucuuu

SEQ ID NO: 655776 - RNA, 65 nt, Homo Sapiens
ugggucauuuaaaguccuguaugaaccauaaccugcugugguaccuuuguacauguuugauucug

SEQ ID NO: 655777 - RNA, 65 nt, Homo Sapiens
uuaaacuguuguucucaucccaguuuaaguggauccugugguaacaaguguuuuuauuuguuaac

SEQ ID NO: 655778 - RNA, 65 nt, Homo Sapiens
agcuaugaccaagagcaggccccgugaccugccugcugugguaugacuuggcagcacagcaugcc

SEQ ID NO: 655779 - RNA, 65 nt, Homo Sapiens
uccacauccagguaccaccgccugucucuggcccacugugguaaugccagaggguuauauaccau

SEQ ID NO: 655780 - RNA, 65 nt, Homo Sapiens
uaccuggggccauucuaggcacacuacgggaaucucugugguauaguaaauggguacuugugauc

SEQ ID NO: 655781 - RNA, 65 nt, Homo Sapiens
ggccaggaggccugagaaagugauuuccagcagaccugugguauugcaaugaaaaaccauguggg

SEQ ID NO: 655782 - RNA, 65 nt, Homo Sapiens
ugcgaguguuaugaccaggauaauucucaccauuccugugguaccucaccaucucuuguaaaagu

SEQ ID NO: 655783 - RNA, 63 nt, Homo Sapiens
uuugcaggcggcccucagugcucucgggcgccccugugguaacuucagaaugugaaccaguga

SEQ ID NO: 655784 - RNA, 65 nt, Homo Sapiens
ucgaggggacccuggcaccccgggcacacaaaccucugugguauaggugaggggugugaggcccc

SEQ ID NO: 655785 - RNA, 65 nt, Homo Sapiens
aauaugaaguguuuuaguugucccguauucuguuucugugguaaaacagacuuuucauacuuacc

SEQ ID NO: 655786 - RNA, 65 nt, Homo Sapiens
aaaaaaaaaaauaaugcauucuuuuuuuuuuuaaacugugguaaacaaagauugugcauuuuuuu

SEQ ID NO: 655787 - RNA, 65 nt, Homo Sapiens
ggcagggaggcaacacugcucaaauaggagggagacugugguaggagccuguggcuuggaguggc

SEQ ID NO: 655788 - RNA, 65 nt, Homo Sapiens
ugcauguagugugggaggcuccuguuagcuccucacugugguaaaugccacacaccuuuaaguag

SEQ ID NO: 655789 - RNA, 65 nt, Homo Sapiens
uucuagagugaauuauaguauugacgugaaucccacugugguauagauuccauaauaugcuugaa

SEQ ID NO: 655790 - RNA, 59 nt, Homo Sapiens
augccuggaccuggggcuagaggagggugcugugguacauggcagccaggggcuucauu

SEQ ID NO: 655791 - RNA, 65 nt, Homo Sapiens
uguuccaaaaacccaaguagucagucccuuauguacugugguaaaccuguuuauguucaccccaa

SEQ ID NO: 655792 - RNA, 65 nt, Homo Sapiens
uaugauuaaacuguguguaaauuuuguaacauaaacugugguaauugcauaauuucauuggugag

SEQ ID NO: 655793 - RNA, 65 nt, Homo Sapiens
ggcuuucaguuuuuagucagaaaucaagcauugggcugugguagccaaaaaccauagguuagcua

SEQ ID NO: 655794 - RNA, 65 nt, Homo Sapiens
aagaugacccucugagcuuuucauuuauucaagcucugugguacagccuuuuuuuaaaauaaauu

SEQ ID NO: 655795 - RNA, 65 nt, Homo Sapiens
gguugauuugcuguuuuguuucuugucuuuguguucugugguacuugcugagagaaaagaaaagu

SEQ ID NO: 655796 - RNA, 65 nt, Homo Sapiens
uacuuucuccuacucuagcagaguaaugauggucccugugguauauuaugcauagacccacucua

SEQ ID NO: 655797 - RNA, 65 nt, Homo Sapiens
agcugugacuuuucuauuucgaaguugggcgugcucugugguaccuccuaagaggagacagcugu

SEQ ID NO: 655798 - RNA, 65 nt, Homo Sapiens
uguuugaacagaggccacauuuucccuuugccacacugugguaggccacucuuagcccaugcugu

SEQ ID NO: 655799 - RNA, 65 nt, Homo Sapiens
ugauuuaaaacacuaguauauucaagaaauguacacugugguaaaaguuuuaguaguagaauguu

SEQ ID NO: 655800 - RNA, 65 nt, Homo Sapiens
gcuugguaaaagacugaagaccaaggcaaccacagcugugguagagguuuggaugugcagcacau

SEQ ID NO: 655801 - RNA, 65 nt, Homo Sapiens
uguuccaaaaacccaaguagucagucccuuguguacugugguaaaccuguuuauguucaccccaa

SEQ ID NO: 655802 - RNA, 65 nt, Homo Sapiens
uaauuuaugauuaaacuguaauuuuguaacauaaacugugguaauugcauaauuucauuggugag

SEQ ID NO: 655803 - RNA, 65 nt, Homo Sapiens
cauugugcauaccuguagucccagcuauucaggagcugugguaggaggauggcuugagcucaaga

SEQ ID NO: 655804 - RNA, 64 nt, Homo Sapiens; identical to SEQ ID NO: 332833

SEQ ID NO: 655805 - RNA, 64 nt, Homo Sapiens; identical to SEQ ID NO: 332834

SEQ ID NO: 655806 - RNA, 64 nt, Homo Sapiens; identical to SEQ ID NO: 332835

SEQ ID NO: 655807 - RNA, 64 nt, Homo Sapiens; identical to SEQ ID NO: 332836

SEQ ID NO: 655808 - RNA, 64 nt, Homo Sapiens; identical to SEQ ID NO: 332837

SEQ ID NO: 655809 - RNA, 64 nt, Homo Sapiens; identical to SEQ ID NO: 332838

SEQ ID NO: 655810 - RNA, 64 nt, Homo Sapiens; identical to SEQ ID NO: 332839

SEQ ID NO: 655811 - RNA, 64 nt, Homo Sapiens; identical to SEQ ID NO: 332840

SEQ ID NO: 655812 - RNA, 64 nt, Homo Sapiens; identical to SEQ ID NO: 332841

SEQ ID NO: 655813 - RNA, 64 nt, Homo Sapiens; identical to SEQ ID NO: 332842

SEQ ID NO: 655814 - RNA, 64 nt, Homo Sapiens; identical to SEQ ID NO: 332843

SEQ ID NO: 655815 - RNA, 64 nt, Homo Sapiens; identical to SEQ ID NO: 332844

SEQ ID NO: 655816 - RNA, 64 nt, Homo Sapiens; identical to SEQ ID NO: 332845

SEQ ID NO: 655817 - RNA, 64 nt, Homo Sapiens; identical to SEQ ID NO: 332846

SEQ ID NO: 655818 - RNA, 64 nt, Homo Sapiens; identical to SEQ ID NO: 332847

SEQ ID NO: 655819 - RNA, 64 nt, Homo Sapiens; identical to SEQ ID NO: 332848

SEQ ID NO: 655820 - RNA, 64 nt, Homo Sapiens; identical to SEQ ID NO: 332849

SEQ ID NO: 655821 - RNA, 64 nt, Homo Sapiens; identical to SEQ ID NO: 332850

SEQ ID NO: 655822 - RNA, 64 nt, Homo Sapiens; identical to SEQ ID NO: 332851

SEQ ID NO: 655823 - RNA, 64 nt, Homo Sapiens; identical to SEQ ID NO: 332852

SEQ ID NO: 655824 - RNA, 64 nt, Homo Sapiens; identical to SEQ ID NO: 332853

SEQ ID NO: 655825 - RNA, 64 nt, Homo Sapiens; identical to SEQ ID NO: 332854

SEQ ID NO: 655826 - RNA, 64 nt, Homo Sapiens; identical to SEQ ID NO: 332855

SEQ ID NO: 655827 - RNA, 64 nt, Homo Sapiens; identical to SEQ ID NO: 332856

SEQ ID NO: 655828 - RNA, 64 nt, Homo Sapiens; identical to SEQ ID NO: 332857

SEQ ID NO: 655829 - RNA, 64 nt, Homo Sapiens; identical to SEQ ID NO: 332858

SEQ ID NO: 655830 - RNA, 64 nt, Homo Sapiens; identical to SEQ ID NO: 332859

SEQ ID NO: 655831 - RNA, 64 nt, Homo Sapiens; identical to SEQ ID NO: 332860

SEQ ID NO: 655832 - RNA, 64 nt, Homo Sapiens; identical to SEQ ID NO: 332861

SEQ ID NO: 655833 - RNA, 64 nt, Homo Sapiens; identical to SEQ ID NO: 332862

SEQ ID NO: 655834 - RNA, 64 nt, Homo Sapiens; identical to SEQ ID NO: 332863

SEQ ID NO: 655835 - RNA, 64 nt, Homo Sapiens; identical to SEQ ID NO: 332864

SEQ ID NO: 655836 - RNA, 64 nt, Homo Sapiens; identical to SEQ ID NO: 332865

SEQ ID NO: 655837 - RNA, 64 nt, Homo Sapiens; identical to SEQ ID NO: 332866

SEQ ID NO: 655838 - RNA, 64 nt, Homo Sapiens; identical to SEQ ID NO: 332867

SEQ ID NO: 655839 - RNA, 64 nt, Homo Sapiens; identical to SEQ ID NO: 332868

SEQ ID NO: 655840 - RNA, 61 nt, Homo Sapiens
uaauaaauagucugcugauugaguagacaaucuggacuauguauucauaaccuauauucua

SEQ ID NO: 655841 - RNA, 61 nt, Homo Sapiens
uucuauaggauaauugcuggaauauaauaaucuggacuauuuaugaauaaagguguggcag

SEQ ID NO: 655842 - RNA, 61 nt, Homo Sapiens
augccuauugcugggcaggcuaaguguggagcuggacuacggcggcaguauggaauuccag

SEQ ID NO: 655843 - RNA, 61 nt, Homo Sapiens
accugaugaaccugagcgggugccgaagcuacuggacuaugcugauggguauguccuaccc

SEQ ID NO: 655844 - RNA, 61 nt, Homo Sapiens
uacuuuuauuacagucaauuuugaggauauucuggacuaaauauuuaagugcagucauuuc

SEQ ID NO: 655845 - RNA, 61 nt, Homo Sapiens
uuucuuuuugguuugcaaaaagagcacagcccuggacuacaaguuuggagauuuaaauucu

SEQ ID NO: 655846 - RNA, 61 nt, Homo Sapiens
aguuuggagaucuaaauucuagagcacagcccuggacuauguuucuuuuugguuugcaaaa

SEQ ID NO: 655847 - RNA, 61 nt, Homo Sapiens
uauuuaagugcagucauuucuugaggauauucuggacuaaaaacuuuuauuacagucaauu

SEQ ID NO: 655848 - RNA, 64 nt, Homo Sapiens; identical to SEQ ID NO: 88616

SEQ ID NO: 655849 - RNA, 64 nt, Homo Sapiens; identical to SEQ ID NO: 88617

SEQ ID NO: 655850 - RNA, 64 nt, Homo Sapiens; identical to SEQ ID NO: 88618

SEQ ID NO: 655851 - RNA, 64 nt, Homo Sapiens; identical to SEQ ID NO: 88619

SEQ ID NO: 655852 - RNA, 64 nt, Homo Sapiens; identical to SEQ ID NO: 88620

SEQ ID NO: 655853 - RNA, 64 nt, Homo Sapiens; identical to SEQ ID NO: 88621

SEQ ID NO: 655854 - RNA, 64 nt, Homo Sapiens; identical to SEQ ID NO: 88622

SEQ ID NO: 655855 - RNA, 64 nt, Homo Sapiens; identical to SEQ ID NO: 88623

SEQ ID NO: 655856 - RNA, 64 nt, Homo Sapiens; identical to SEQ ID NO: 162369

SEQ ID NO: 655857 - RNA, 64 nt, Homo Sapiens; identical to SEQ ID NO: 162370

SEQ ID NO: 655858 - RNA, 64 nt, Homo Sapiens; identical to SEQ ID NO: 162371

SEQ ID NO: 655859 - RNA, 64 nt, Homo Sapiens; identical to SEQ ID NO: 162372

SEQ ID NO: 655860 - RNA, 64 nt, Homo Sapiens; identical to SEQ ID NO: 162373

SEQ ID NO: 655861 - RNA, 64 nt, Homo Sapiens; identical to SEQ ID NO: 162374

SEQ ID NO: 655862 - RNA, 64 nt, Homo Sapiens; identical to SEQ ID NO: 162375

SEQ ID NO: 655863 - RNA, 64 nt, Homo Sapiens; identical to SEQ ID NO: 162376

SEQ ID NO: 655864 - RNA, 64 nt, Homo Sapiens; identical to SEQ ID NO: 162377

SEQ ID NO: 655865 - RNA, 64 nt, Homo Sapiens; identical to SEQ ID NO: 162378

SEQ ID NO: 655866 - RNA, 64 nt, Homo Sapiens; identical to SEQ ID NO: 162379

SEQ ID NO: 655867 - RNA, 64 nt, Homo Sapiens; identical to SEQ ID NO: 162380

SEQ ID NO: 655868 - RNA, 64 nt, Homo Sapiens; identical to SEQ ID NO: 162381

SEQ ID NO: 655869 - RNA, 64 nt, Homo Sapiens; identical to SEQ ID NO: 162382

SEQ ID NO: 655870 - RNA, 64 nt, Homo Sapiens; identical to SEQ ID NO: 162383

SEQ ID NO: 655871 - RNA, 64 nt, Homo Sapiens; identical to SEQ ID NO: 162384

SEQ ID NO: 655872 - RNA, 64 nt, Homo Sapiens; identical to SEQ ID NO: 162385

SEQ ID NO: 655873 - RNA, 64 nt, Homo Sapiens; identical to SEQ ID NO: 162386

SEQ ID NO: 655874 - RNA, 64 nt, Homo Sapiens; identical to SEQ ID NO: 162387

SEQ ID NO: 655875 - RNA, 64 nt, Homo Sapiens; identical to SEQ ID NO: 162388

SEQ ID NO: 655876 - RNA, 64 nt, Homo Sapiens; identical to SEQ ID NO: 162389

SEQ ID NO: 655877 - RNA, 64 nt, Homo Sapiens; identical to SEQ ID NO: 162390

SEQ ID NO: 655878 - RNA, 64 nt, Homo Sapiens; identical to SEQ ID NO: 362237

SEQ ID NO: 655879 - RNA, 64 nt, Homo Sapiens; identical to SEQ ID NO: 362238

SEQ ID NO: 655880 - RNA, 64 nt, Homo Sapiens
gaagugaggagcgucuccgcccggcagccacccaguccgggagggaggugggggggucaguccc

SEQ ID NO: 655881 - RNA, 64 nt, Homo Sapiens
gggggggucagucccccguccggccagccgccccguccgggaggugaggggcgccucugcccag

SEQ ID NO: 655882 - RNA, 64 nt, Homo Sapiens
aagugaggagccccucugccccgccagccaccccguccgggagggaggugggggggucagcccc

SEQ ID NO: 655883 - RNA, 64 nt, Homo Sapiens
gggggggucagccccccgcccggccagccgccccguccgggagggaggugggggaucagccccc

SEQ ID NO: 655884 - RNA, 64 nt, Homo Sapiens
ugggggaucagccccccgcccggcuagccgccccguccgggaggcgaggggcgccucugcccgg

SEQ ID NO: 655885 - RNA, 64 nt, Homo Sapiens
gggggggucagccccccgcccggccagccgcccgguccgggagggaggugggggggucagcccc

SEQ ID NO: 655886 - RNA, 64 nt, Homo Sapiens
gggggggucagccccccgcccggccagccgccccguccgggagguuaggggcgccucugcccgg

SEQ ID NO: 655887 - RNA, 64 nt, Homo Sapiens
aagugaggagcgucuacgcccgggcagcugccccguccgggagggaggugggggggucagcccc

SEQ ID NO: 655888 - RNA, 64 nt, Homo Sapiens
gggggggucagccccccgcccggccagccgccccguccgggagggaggugggggggaucagccc

SEQ ID NO: 655889 - RNA, 64 nt, Homo Sapiens
ggggggaucagccccccgcccggccagccgccccguccgggagggagguggggggcgccucugc

SEQ ID NO: 655890 - RNA, 64 nt, Homo Sapiens
gggucaguaucgugggcaugucucaugcagagagguccgggacaggggugcugggcucuggccu

SEQ ID NO: 655891 - RNA, 64 nt, Homo Sapiens
caagaagugggugggagaaugagaccaaaucuuuguccgggaagcugggugcaucugcuaaugg

SEQ ID NO: 655892 - RNA, 64 nt, Homo Sapiens; identical to SEQ ID NO: 85822

SEQ ID NO: 655893 - RNA, 64 nt, Homo Sapiens; identical to SEQ ID NO: 85823

SEQ ID NO: 655894 - RNA, 64 nt, Homo Sapiens; identical to SEQ ID NO: 85824

SEQ ID NO: 655895 - RNA, 64 nt, Homo Sapiens; identical to SEQ ID NO: 85825

SEQ ID NO: 655896 - RNA, 64 nt, Homo Sapiens; identical to SEQ ID NO: 85826

SEQ ID NO: 655897 - RNA, 64 nt, Homo Sapiens; identical to SEQ ID NO: 85827

SEQ ID NO: 655898 - RNA, 64 nt, Homo Sapiens; identical to SEQ ID NO: 85828

SEQ ID NO: 655899 - RNA, 64 nt, Homo Sapiens; identical to SEQ ID NO: 85829

SEQ ID NO: 655900 - RNA, 64 nt, Homo Sapiens; identical to SEQ ID NO: 85830

SEQ ID NO: 655901 - RNA, 64 nt, Homo Sapiens; identical to SEQ ID NO: 85831

SEQ ID NO: 655902 - RNA, 64 nt, Homo Sapiens; identical to SEQ ID NO: 85832

SEQ ID NO: 655903 - RNA, 64 nt, Homo Sapiens; identical to SEQ ID NO: 85833

SEQ ID NO: 655904 - RNA, 64 nt, Homo Sapiens; identical to SEQ ID NO: 85834

SEQ ID NO: 655905 - RNA, 64 nt, Homo Sapiens; identical to SEQ ID NO: 85835

SEQ ID NO: 655906 - RNA, 64 nt, Homo Sapiens; identical to SEQ ID NO: 85836

SEQ ID NO: 655907 - RNA, 64 nt, Homo Sapiens; identical to SEQ ID NO: 85837

SEQ ID NO: 655908 - RNA, 64 nt, Homo Sapiens; identical to SEQ ID NO: 85838

SEQ ID NO: 655909 - RNA, 64 nt, Homo Sapiens; identical to SEQ ID NO: 85839

SEQ ID NO: 655910 - RNA, 64 nt, Homo Sapiens; identical to SEQ ID NO: 85840

SEQ ID NO: 655911 - RNA, 64 nt, Homo Sapiens; identical to SEQ ID NO: 85841

SEQ ID NO: 655912 - RNA, 64 nt, Homo Sapiens; identical to SEQ ID NO: 85842

SEQ ID NO: 655913 - RNA, 64 nt, Homo Sapiens; identical to SEQ ID NO: 85843

SEQ ID NO: 655914 - RNA, 64 nt, Homo Sapiens; identical to SEQ ID NO: 85844

SEQ ID NO: 655915 - RNA, 64 nt, Homo Sapiens; identical to SEQ ID NO: 85845

SEQ ID NO: 655916 - RNA, 64 nt, Homo Sapiens; identical to SEQ ID NO: 85846

SEQ ID NO: 655917 - RNA, 64 nt, Homo Sapiens; identical to SEQ ID NO: 85847

SEQ ID NO: 655918 - RNA, 64 nt, Homo Sapiens; identical to SEQ ID NO: 85848

SEQ ID NO: 655919 - RNA, 64 nt, Homo Sapiens; identical to SEQ ID NO: 85849

SEQ ID NO: 655920 - RNA, 64 nt, Homo Sapiens; identical to SEQ ID NO: 85850

SEQ ID NO: 655921 - RNA, 64 nt, Homo Sapiens; identical to SEQ ID NO: 85851

SEQ ID NO: 655922 - RNA, 64 nt, Homo Sapiens; identical to SEQ ID NO: 85852

SEQ ID NO: 655923 - RNA, 64 nt, Homo Sapiens; identical to SEQ ID NO: 85853

SEQ ID NO: 655924 - RNA, 64 nt, Homo Sapiens; identical to SEQ ID NO: 85854

SEQ ID NO: 655925 - RNA, 64 nt, Homo Sapiens; identical to SEQ ID NO: 85855

SEQ ID NO: 655926 - RNA, 64 nt, Homo Sapiens; identical to SEQ ID NO: 85856

SEQ ID NO: 655927 - RNA, 64 nt, Homo Sapiens; identical to SEQ ID NO: 85857

SEQ ID NO: 655928 - RNA, 64 nt, Homo Sapiens; identical to SEQ ID NO: 85858

SEQ ID NO: 655929 - RNA, 64 nt, Homo Sapiens
acccagcacucaaucuguucaagacaaccaguggggaugagaggcuguaccccucacccacauc

SEQ ID NO: 655930 - RNA, 64 nt, Homo Sapiens
ggcucugggauauucuggccuccgacuucacaccggaugagagagcuauguuucugaagguauu

SEQ ID NO: 655931 - RNA, 64 nt, Homo Sapiens
aaaaaaauuauaugcugcaucaaaugugccuguuggaugagaguuucaagugaaauaguaaauc

SEQ ID NO: 655932 - RNA, 64 nt, Homo Sapiens
ggauguuaaaccacuucuuacugaaugccagaugggaugagaugucaauaaccagugccaaauu

SEQ ID NO: 655933 - RNA, 64 nt, Homo Sapiens; identical to SEQ ID NO: 80199

SEQ ID NO: 655934 - RNA, 64 nt, Homo Sapiens; identical to SEQ ID NO: 80200

SEQ ID NO: 655935 - RNA, 64 nt, Homo Sapiens; identical to SEQ ID NO: 80201

SEQ ID NO: 655936 - RNA, 64 nt, Homo Sapiens; identical to SEQ ID NO: 80202

SEQ ID NO: 655937 - RNA, 64 nt, Homo Sapiens; identical to SEQ ID NO: 80203

SEQ ID NO: 655938 - RNA, 64 nt, Homo Sapiens; identical to SEQ ID NO: 80204

SEQ ID NO: 655939 - RNA, 64 nt, Homo Sapiens; identical to SEQ ID NO: 80205

SEQ ID NO: 655940 - RNA, 64 nt, Homo Sapiens; identical to SEQ ID NO: 80206

SEQ ID NO: 655941 - RNA, 64 nt, Homo Sapiens; identical to SEQ ID NO: 80207

SEQ ID NO: 655942 - RNA, 64 nt, Homo Sapiens; identical to SEQ ID NO: 80208

SEQ ID NO: 655943 - RNA, 64 nt, Homo Sapiens; identical to SEQ ID NO: 80209

SEQ ID NO: 655944 - RNA, 64 nt, Homo Sapiens; identical to SEQ ID NO: 80210

SEQ ID NO: 655945 - RNA, 64 nt, Homo Sapiens; identical to SEQ ID NO: 80211

SEQ ID NO: 655946 - RNA, 64 nt, Homo Sapiens; identical to SEQ ID NO: 80212

SEQ ID NO: 655947 - RNA, 64 nt, Homo Sapiens; identical to SEQ ID NO: 80213

SEQ ID NO: 655948 - RNA, 64 nt, Homo Sapiens; identical to SEQ ID NO: 80214

SEQ ID NO: 655949 - RNA, 64 nt, Homo Sapiens; identical to SEQ ID NO: 80215

SEQ ID NO: 655950 - RNA, 64 nt, Homo Sapiens; identical to SEQ ID NO: 80216

SEQ ID NO: 655951 - RNA, 64 nt, Homo Sapiens; identical to SEQ ID NO: 80217

SEQ ID NO: 655952 - RNA, 64 nt, Homo Sapiens; identical to SEQ ID NO: 80218

SEQ ID NO: 655953 - RNA, 64 nt, Homo Sapiens; identical to SEQ ID NO: 80219

SEQ ID NO: 655954 - RNA, 64 nt, Homo Sapiens; identical to SEQ ID NO: 80220

SEQ ID NO: 655955 - RNA, 64 nt, Homo Sapiens; identical to SEQ ID NO: 80221

SEQ ID NO: 655956 - RNA, 64 nt, Homo Sapiens; identical to SEQ ID NO: 80222

SEQ ID NO: 655957 - RNA, 64 nt, Homo Sapiens; identical to SEQ ID NO: 80223

SEQ ID NO: 655958 - RNA, 64 nt, Homo Sapiens; identical to SEQ ID NO: 80224

SEQ ID NO: 655959 - RNA, 64 nt, Homo Sapiens; identical to SEQ ID NO: 80225

SEQ ID NO: 655960 - RNA, 64 nt, Homo Sapiens; identical to SEQ ID NO: 80226

SEQ ID NO: 655961 - RNA, 64 nt, Homo Sapiens; identical to SEQ ID NO: 80227

SEQ ID NO: 655962 - RNA, 64 nt, Homo Sapiens; identical to SEQ ID NO: 80228

SEQ ID NO: 655963 - RNA, 64 nt, Homo Sapiens; identical to SEQ ID NO: 80229

SEQ ID NO: 655964 - RNA, 64 nt, Homo Sapiens; identical to SEQ ID NO: 80230

SEQ ID NO: 655965 - RNA, 64 nt, Homo Sapiens; identical to SEQ ID NO: 80231

SEQ ID NO: 655966 - RNA, 52 nt, Homo Sapiens; identical to SEQ ID NO: 80232

SEQ ID NO: 655967 - RNA, 64 nt, Homo Sapiens; identical to SEQ ID NO: 80233

SEQ ID NO: 655968 - RNA, 64 nt, Homo Sapiens; identical to SEQ ID NO: 80234

SEQ ID NO: 655969 - RNA, 64 nt, Homo Sapiens; identical to SEQ ID NO: 80235

SEQ ID NO: 655970 - RNA, 64 nt, Homo Sapiens; identical to SEQ ID NO: 80236

SEQ ID NO: 655971 - RNA, 64 nt, Homo Sapiens; identical to SEQ ID NO: 80237

SEQ ID NO: 655972 - RNA, 64 nt, Homo Sapiens; identical to SEQ ID NO: 80238

SEQ ID NO: 655973 - RNA, 64 nt, Homo Sapiens; identical to SEQ ID NO: 80239

SEQ ID NO: 655974 - RNA, 64 nt, Homo Sapiens; identical to SEQ ID NO: 80240

SEQ ID NO: 655975 - RNA, 64 nt, Homo Sapiens; identical to SEQ ID NO: 80241

SEQ ID NO: 655976 - RNA, 64 nt, Homo Sapiens; identical to SEQ ID NO: 80242

SEQ ID NO: 655977 - RNA, 64 nt, Homo Sapiens; identical to SEQ ID NO: 80243

SEQ ID NO: 655978 - RNA, 64 nt, Homo Sapiens; identical to SEQ ID NO: 80244

SEQ ID NO: 655979 - RNA, 64 nt, Homo Sapiens; identical to SEQ ID NO: 80245

SEQ ID NO: 655980 - RNA, 64 nt, Homo Sapiens; identical to SEQ ID NO: 80246

SEQ ID NO: 655981 - RNA, 64 nt, Homo Sapiens; identical to SEQ ID NO: 80247

SEQ ID NO: 655982 - RNA, 64 nt, Homo Sapiens; identical to SEQ ID NO: 80248

SEQ ID NO: 655983 - RNA, 64 nt, Homo Sapiens; identical to SEQ ID NO: 80249

SEQ ID NO: 655984 - RNA, 64 nt, Homo Sapiens; identical to SEQ ID NO: 80250

SEQ ID NO: 655985 - RNA, 64 nt, Homo Sapiens; identical to SEQ ID NO: 80251

SEQ ID NO: 655986 - RNA, 64 nt, Homo Sapiens; identical to SEQ ID NO: 80252

SEQ ID NO: 655987 - RNA, 64 nt, Homo Sapiens; identical to SEQ ID NO: 80253

SEQ ID NO: 655988 - RNA, 64 nt, Homo Sapiens; identical to SEQ ID NO: 80254

SEQ ID NO: 655989 - RNA, 64 nt, Homo Sapiens; identical to SEQ ID NO: 80255

SEQ ID NO: 655990 - RNA, 64 nt, Homo Sapiens; identical to SEQ ID NO: 80256

SEQ ID NO: 655991 - RNA, 64 nt, Homo Sapiens; identical to SEQ ID NO: 80257

SEQ ID NO: 655992 - RNA, 64 nt, Homo Sapiens; identical to SEQ ID NO: 80258

SEQ ID NO: 655993 - RNA, 64 nt, Homo Sapiens; identical to SEQ ID NO: 80259

SEQ ID NO: 655994 - RNA, 64 nt, Homo Sapiens; identical to SEQ ID NO: 80260

SEQ ID NO: 655995 - RNA, 64 nt, Homo Sapiens; identical to SEQ ID NO: 80261

SEQ ID NO: 655996 - RNA, 64 nt, Homo Sapiens; identical to SEQ ID NO: 80262

SEQ ID NO: 655997 - RNA, 64 nt, Homo Sapiens; identical to SEQ ID NO: 80263

SEQ ID NO: 655998 - RNA, 64 nt, Homo Sapiens; identical to SEQ ID NO: 80264

SEQ ID NO: 655999 - RNA, 64 nt, Homo Sapiens; identical to SEQ ID NO: 80265

SEQ ID NO: 656000 - RNA, 64 nt, Homo Sapiens; identical to SEQ ID NO: 80266

SEQ ID NO: 656001 - RNA, 64 nt, Homo Sapiens; identical to SEQ ID NO: 80267

SEQ ID NO: 656002 - RNA, 64 nt, Homo Sapiens; identical to SEQ ID NO: 80268

SEQ ID NO: 656003 - RNA, 64 nt, Homo Sapiens; identical to SEQ ID NO: 80269

SEQ ID NO: 656004 - RNA, 64 nt, Homo Sapiens; identical to SEQ ID NO: 80270

SEQ ID NO: 656005 - RNA, 64 nt, Homo Sapiens; identical to SEQ ID NO: 80271

SEQ ID NO: 656006 - RNA, 64 nt, Homo Sapiens; identical to SEQ ID NO: 80272

SEQ ID NO: 656007 - RNA, 64 nt, Homo Sapiens; identical to SEQ ID NO: 80273

SEQ ID NO: 656008 - RNA, 64 nt, Homo Sapiens; identical to SEQ ID NO: 80274

SEQ ID NO: 656009 - RNA, 64 nt, Homo Sapiens; identical to SEQ ID NO: 80275

SEQ ID NO: 656010 - RNA, 64 nt, Homo Sapiens; identical to SEQ ID NO: 80276

SEQ ID NO: 656011 - RNA, 64 nt, Homo Sapiens; identical to SEQ ID NO: 80277

SEQ ID NO: 656012 - RNA, 64 nt, Homo Sapiens; identical to SEQ ID NO: 80278

SEQ ID NO: 656013 - RNA, 64 nt, Homo Sapiens; identical to SEQ ID NO: 80279

SEQ ID NO: 656014 - RNA, 64 nt, Homo Sapiens; identical to SEQ ID NO: 80280

SEQ ID NO: 656015 - RNA, 64 nt, Homo Sapiens; identical to SEQ ID NO: 80281

SEQ ID NO: 656016 - RNA, 64 nt, Homo Sapiens; identical to SEQ ID NO: 80282

SEQ ID NO: 656017 - RNA, 64 nt, Homo Sapiens; identical to SEQ ID NO: 80283

SEQ ID NO: 656018 - RNA, 64 nt, Homo Sapiens; identical to SEQ ID NO: 80284

SEQ ID NO: 656019 - RNA, 64 nt, Homo Sapiens; identical to SEQ ID NO: 80285

SEQ ID NO: 656020 - RNA, 64 nt, Homo Sapiens; identical to SEQ ID NO: 80286

SEQ ID NO: 656021 - RNA, 64 nt, Homo Sapiens; identical to SEQ ID NO: 80287

SEQ ID NO: 656022 - RNA, 64 nt, Homo Sapiens; identical to SEQ ID NO: 80288

SEQ ID NO: 656023 - RNA, 64 nt, Homo Sapiens; identical to SEQ ID NO: 80289

SEQ ID NO: 656024 - RNA, 64 nt, Homo Sapiens; identical to SEQ ID NO: 80290

SEQ ID NO: 656025 - RNA, 64 nt, Homo Sapiens; identical to SEQ ID NO: 80291

SEQ ID NO: 656026 - RNA, 64 nt, Homo Sapiens; identical to SEQ ID NO: 80292

SEQ ID NO: 656027 - RNA, 64 nt, Homo Sapiens; identical to SEQ ID NO: 80293

SEQ ID NO: 656028 - RNA, 64 nt, Homo Sapiens; identical to SEQ ID NO: 80294

SEQ ID NO: 656029 - RNA, 64 nt, Homo Sapiens; identical to SEQ ID NO: 80295

SEQ ID NO: 656030 - RNA, 64 nt, Homo Sapiens; identical to SEQ ID NO: 80296

SEQ ID NO: 656031 - RNA, 64 nt, Homo Sapiens; identical to SEQ ID NO: 80297

SEQ ID NO: 656032 - RNA, 64 nt, Homo Sapiens; identical to SEQ ID NO: 80298

SEQ ID NO: 656033 - RNA, 64 nt, Homo Sapiens; identical to SEQ ID NO: 80299

SEQ ID NO: 656034 - RNA, 64 nt, Homo Sapiens; identical to SEQ ID NO: 80300

SEQ ID NO: 656035 - RNA, 64 nt, Homo Sapiens; identical to SEQ ID NO: 80301

SEQ ID NO: 656036 - RNA, 64 nt, Homo Sapiens; identical to SEQ ID NO: 80302

SEQ ID NO: 656037 - RNA, 64 nt, Homo Sapiens; identical to SEQ ID NO: 80303

SEQ ID NO: 656038 - RNA, 64 nt, Homo Sapiens; identical to SEQ ID NO: 80304

SEQ ID NO: 656039 - RNA, 64 nt, Homo Sapiens; identical to SEQ ID NO: 80305

SEQ ID NO: 656040 - RNA, 64 nt, Homo Sapiens; identical to SEQ ID NO: 80306

SEQ ID NO: 656041 - RNA, 64 nt, Homo Sapiens; identical to SEQ ID NO: 80307

SEQ ID NO: 656042 - RNA, 64 nt, Homo Sapiens; identical to SEQ ID NO: 80308

SEQ ID NO: 656043 - RNA, 64 nt, Homo Sapiens; identical to SEQ ID NO: 80309

SEQ ID NO: 656044 - RNA, 64 nt, Homo Sapiens; identical to SEQ ID NO: 80310

SEQ ID NO: 656045 - RNA, 64 nt, Homo Sapiens; identical to SEQ ID NO: 80311

SEQ ID NO: 656046 - RNA, 64 nt, Homo Sapiens; identical to SEQ ID NO: 80312

SEQ ID NO: 656047 - RNA, 64 nt, Homo Sapiens; identical to SEQ ID NO: 80313

SEQ ID NO: 656048 - RNA, 64 nt, Homo Sapiens; identical to SEQ ID NO: 80314

SEQ ID NO: 656049 - RNA, 64 nt, Homo Sapiens; identical to SEQ ID NO: 80315

SEQ ID NO: 656050 - RNA, 64 nt, Homo Sapiens; identical to SEQ ID NO: 80316

SEQ ID NO: 656051 - RNA, 64 nt, Homo Sapiens; identical to SEQ ID NO: 80317

SEQ ID NO: 656052 - RNA, 64 nt, Homo Sapiens; identical to SEQ ID NO: 80318

SEQ ID NO: 656053 - RNA, 64 nt, Homo Sapiens; identical to SEQ ID NO: 80319

SEQ ID NO: 656054 - RNA, 64 nt, Homo Sapiens; identical to SEQ ID NO: 80320

SEQ ID NO: 656055 - RNA, 64 nt, Homo Sapiens; identical to SEQ ID NO: 80321

SEQ ID NO: 656056 - RNA, 64 nt, Homo Sapiens; identical to SEQ ID NO: 80322

SEQ ID NO: 656057 - RNA, 64 nt, Homo Sapiens; identical to SEQ ID NO: 80323

SEQ ID NO: 656058 - RNA, 64 nt, Homo Sapiens; identical to SEQ ID NO: 80324

SEQ ID NO: 656059 - RNA, 51 nt, Homo Sapiens; identical to SEQ ID NO: 80325

SEQ ID NO: 656060 - RNA, 64 nt, Homo Sapiens; identical to SEQ ID NO: 80326

SEQ ID NO: 656061 - RNA, 64 nt, Homo Sapiens; identical to SEQ ID NO: 80327

SEQ ID NO: 656062 - RNA, 64 nt, Homo Sapiens; identical to SEQ ID NO: 80328

SEQ ID NO: 656063 - RNA, 64 nt, Homo Sapiens; identical to SEQ ID NO: 80329

SEQ ID NO: 656064 - RNA, 64 nt, Homo Sapiens; identical to SEQ ID NO: 80330

SEQ ID NO: 656065 - RNA, 62 nt, Homo Sapiens; identical to SEQ ID NO: 80331

SEQ ID NO: 656066 - RNA, 64 nt, Homo Sapiens; identical to SEQ ID NO: 80332

SEQ ID NO: 656067 - RNA, 64 nt, Homo Sapiens; identical to SEQ ID NO: 80333

SEQ ID NO: 656068 - RNA, 64 nt, Homo Sapiens; identical to SEQ ID NO: 80334

SEQ ID NO: 656069 - RNA, 54 nt, Homo Sapiens; identical to SEQ ID NO: 80335

SEQ ID NO: 656070 - RNA, 64 nt, Homo Sapiens; identical to SEQ ID NO: 80336

SEQ ID NO: 656071 - RNA, 64 nt, Homo Sapiens; identical to SEQ ID NO: 80337

SEQ ID NO: 656072 - RNA, 64 nt, Homo Sapiens; identical to SEQ ID NO: 80338

SEQ ID NO: 656073 - RNA, 64 nt, Homo Sapiens; identical to SEQ ID NO: 80339

SEQ ID NO: 656074 - RNA, 64 nt, Homo Sapiens; identical to SEQ ID NO: 80340

SEQ ID NO: 656075 - RNA, 64 nt, Homo Sapiens; identical to SEQ ID NO: 80341

SEQ ID NO: 656076 - RNA, 64 nt, Homo Sapiens; identical to SEQ ID NO: 80342

SEQ ID NO: 656077 - RNA, 64 nt, Homo Sapiens; identical to SEQ ID NO: 80343

SEQ ID NO: 656078 - RNA, 64 nt, Homo Sapiens; identical to SEQ ID NO: 80344

SEQ ID NO: 656079 - RNA, 64 nt, Homo Sapiens; identical to SEQ ID NO: 80345

SEQ ID NO: 656080 - RNA, 64 nt, Homo Sapiens; identical to SEQ ID NO: 80346

SEQ ID NO: 656081 - RNA, 64 nt, Homo Sapiens; identical to SEQ ID NO: 80347

SEQ ID NO: 656082 - RNA, 64 nt, Homo Sapiens; identical to SEQ ID NO: 80348

SEQ ID NO: 656083 - RNA, 64 nt, Homo Sapiens; identical to SEQ ID NO: 80349

SEQ ID NO: 656084 - RNA, 64 nt, Homo Sapiens; identical to SEQ ID NO: 80350

SEQ ID NO: 656085 - RNA, 64 nt, Homo Sapiens; identical to SEQ ID NO: 80351

SEQ ID NO: 656086 - RNA, 59 nt, Homo Sapiens; identical to SEQ ID NO: 80352

SEQ ID NO: 656087 - RNA, 64 nt, Homo Sapiens; identical to SEQ ID NO: 80353

SEQ ID NO: 656088 - RNA, 64 nt, Homo Sapiens; identical to SEQ ID NO: 80354

SEQ ID NO: 656089 - RNA, 64 nt, Homo Sapiens; identical to SEQ ID NO: 80355

SEQ ID NO: 656090 - RNA, 64 nt, Homo Sapiens; identical to SEQ ID NO: 80356

SEQ ID NO: 656091 - RNA, 64 nt, Homo Sapiens; identical to SEQ ID NO: 80357

SEQ ID NO: 656092 - RNA, 64 nt, Homo Sapiens; identical to SEQ ID NO: 80358

SEQ ID NO: 656093 - RNA, 64 nt, Homo Sapiens; identical to SEQ ID NO: 80359

SEQ ID NO: 656094 - RNA, 64 nt, Homo Sapiens; identical to SEQ ID NO: 80360

SEQ ID NO: 656095 - RNA, 64 nt, Homo Sapiens; identical to SEQ ID NO: 80361

SEQ ID NO: 656096 - RNA, 64 nt, Homo Sapiens; identical to SEQ ID NO: 80362

SEQ ID NO: 656097 - RNA, 64 nt, Homo Sapiens; identical to SEQ ID NO: 80363

SEQ ID NO: 656098 - RNA, 64 nt, Homo Sapiens; identical to SEQ ID NO: 80364

SEQ ID NO: 656099 - RNA, 64 nt, Homo Sapiens; identical to SEQ ID NO: 80365

SEQ ID NO: 656100 - RNA, 64 nt, Homo Sapiens; identical to SEQ ID NO: 80366

SEQ ID NO: 656101 - RNA, 64 nt, Homo Sapiens; identical to SEQ ID NO: 80367

SEQ ID NO: 656102 - RNA, 64 nt, Homo Sapiens; identical to SEQ ID NO: 80368

SEQ ID NO: 656103 - RNA, 64 nt, Homo Sapiens; identical to SEQ ID NO: 80369

SEQ ID NO: 656104 - RNA, 64 nt, Homo Sapiens; identical to SEQ ID NO: 80370

SEQ ID NO: 656105 - RNA, 64 nt, Homo Sapiens; identical to SEQ ID NO: 80371

SEQ ID NO: 656106 - RNA, 64 nt, Homo Sapiens; identical to SEQ ID NO: 80372

SEQ ID NO: 656107 - RNA, 64 nt, Homo Sapiens; identical to SEQ ID NO: 80373

SEQ ID NO: 656108 - RNA, 64 nt, Homo Sapiens; identical to SEQ ID NO: 80374

SEQ ID NO: 656109 - RNA, 64 nt, Homo Sapiens; identical to SEQ ID NO: 80375

SEQ ID NO: 656110 - RNA, 64 nt, Homo Sapiens; identical to SEQ ID NO: 80376

SEQ ID NO: 656111 - RNA, 64 nt, Homo Sapiens; identical to SEQ ID NO: 80377

SEQ ID NO: 656112 - RNA, 64 nt, Homo Sapiens; identical to SEQ ID NO: 80378

SEQ ID NO: 656113 - RNA, 64 nt, Homo Sapiens; identical to SEQ ID NO: 80379

SEQ ID NO: 656114 - RNA, 64 nt, Homo Sapiens; identical to SEQ ID NO: 80380

SEQ ID NO: 656115 - RNA, 64 nt, Homo Sapiens; identical to SEQ ID NO: 80381

SEQ ID NO: 656116 - RNA, 64 nt, Homo Sapiens; identical to SEQ ID NO: 80382

SEQ ID NO: 656117 - RNA, 64 nt, Homo Sapiens; identical to SEQ ID NO: 80383

SEQ ID NO: 656118 - RNA, 64 nt, Homo Sapiens; identical to SEQ ID NO: 80384

SEQ ID NO: 656119 - RNA, 64 nt, Homo Sapiens; identical to SEQ ID NO: 80385

SEQ ID NO: 656120 - RNA, 64 nt, Homo Sapiens; identical to SEQ ID NO: 80386

SEQ ID NO: 656121 - RNA, 64 nt, Homo Sapiens; identical to SEQ ID NO: 80387

SEQ ID NO: 656122 - RNA, 64 nt, Homo Sapiens; identical to SEQ ID NO: 80388

SEQ ID NO: 656123 - RNA, 64 nt, Homo Sapiens; identical to SEQ ID NO: 80389

SEQ ID NO: 656124 - RNA, 64 nt, Homo Sapiens; identical to SEQ ID NO: 80390

SEQ ID NO: 656125 - RNA, 64 nt, Homo Sapiens; identical to SEQ ID NO: 80391

SEQ ID NO: 656126 - RNA, 53 nt, Homo Sapiens; identical to SEQ ID NO: 80392

SEQ ID NO: 656127 - RNA, 64 nt, Homo Sapiens; identical to SEQ ID NO: 80393

SEQ ID NO: 656128 - RNA, 64 nt, Homo Sapiens; identical to SEQ ID NO: 80394

SEQ ID NO: 656129 - RNA, 64 nt, Homo Sapiens; identical to SEQ ID NO: 80395

SEQ ID NO: 656130 - RNA, 64 nt, Homo Sapiens; identical to SEQ ID NO: 80396

SEQ ID NO: 656131 - RNA, 64 nt, Homo Sapiens; identical to SEQ ID NO: 80397

SEQ ID NO: 656132 - RNA, 64 nt, Homo Sapiens; identical to SEQ ID NO: 80398

SEQ ID NO: 656133 - RNA, 64 nt, Homo Sapiens; identical to SEQ ID NO: 80399

SEQ ID NO: 656134 - RNA, 64 nt, Homo Sapiens; identical to SEQ ID NO: 80400

SEQ ID NO: 656135 - RNA, 64 nt, Homo Sapiens; identical to SEQ ID NO: 80401

SEQ ID NO: 656136 - RNA, 64 nt, Homo Sapiens; identical to SEQ ID NO: 80402

SEQ ID NO: 656137 - RNA, 64 nt, Homo Sapiens; identical to SEQ ID NO: 80403

SEQ ID NO: 656138 - RNA, 64 nt, Homo Sapiens; identical to SEQ ID NO: 80404

SEQ ID NO: 656139 - RNA, 64 nt, Homo Sapiens; identical to SEQ ID NO: 80405

SEQ ID NO: 656140 - RNA, 64 nt, Homo Sapiens; identical to SEQ ID NO: 80406

SEQ ID NO: 656141 - RNA, 64 nt, Homo Sapiens; identical to SEQ ID NO: 80407

SEQ ID NO: 656142 - RNA, 64 nt, Homo Sapiens; identical to SEQ ID NO: 80408

SEQ ID NO: 656143 - RNA, 64 nt, Homo Sapiens; identical to SEQ ID NO: 80409

SEQ ID NO: 656144 - RNA, 64 nt, Homo Sapiens; identical to SEQ ID NO: 80410

SEQ ID NO: 656145 - RNA, 64 nt, Homo Sapiens; identical to SEQ ID NO: 80411

SEQ ID NO: 656146 - RNA, 64 nt, Homo Sapiens; identical to SEQ ID NO: 80412

SEQ ID NO: 656147 - RNA, 64 nt, Homo Sapiens; identical to SEQ ID NO: 80413

SEQ ID NO: 656148 - RNA, 64 nt, Homo Sapiens; identical to SEQ ID NO: 80414

SEQ ID NO: 656149 - RNA, 64 nt, Homo Sapiens; identical to SEQ ID NO: 80415

SEQ ID NO: 656150 - RNA, 64 nt, Homo Sapiens; identical to SEQ ID NO: 80416

SEQ ID NO: 656151 - RNA, 64 nt, Homo Sapiens; identical to SEQ ID NO: 80417

SEQ ID NO: 656152 - RNA, 64 nt, Homo Sapiens; identical to SEQ ID NO: 80418

SEQ ID NO: 656153 - RNA, 64 nt, Homo Sapiens; identical to SEQ ID NO: 247680

SEQ ID NO: 656154 - RNA, 64 nt, Homo Sapiens; identical to SEQ ID NO: 247681

SEQ ID NO: 656155 - RNA, 64 nt, Homo Sapiens; identical to SEQ ID NO: 247682

SEQ ID NO: 656156 - RNA, 64 nt, Homo Sapiens; identical to SEQ ID NO: 247683

SEQ ID NO: 656157 - RNA, 64 nt, Homo Sapiens; identical to SEQ ID NO: 247684

SEQ ID NO: 656158 - RNA, 64 nt, Homo Sapiens; identical to SEQ ID NO: 247685

SEQ ID NO: 656159 - RNA, 64 nt, Homo Sapiens; identical to SEQ ID NO: 247686

SEQ ID NO: 656160 - RNA, 64 nt, Homo Sapiens; identical to SEQ ID NO: 247687

SEQ ID NO: 656161 - RNA, 64 nt, Homo Sapiens; identical to SEQ ID NO: 247688

SEQ ID NO: 656162 - RNA, 64 nt, Homo Sapiens; identical to SEQ ID NO: 247689

SEQ ID NO: 656163 - RNA, 64 nt, Homo Sapiens; identical to SEQ ID NO: 247690

SEQ ID NO: 656164 - RNA, 64 nt, Homo Sapiens; identical to SEQ ID NO: 247691

SEQ ID NO: 656165 - RNA, 64 nt, Homo Sapiens; identical to SEQ ID NO: 247692

SEQ ID NO: 656166 - RNA, 64 nt, Homo Sapiens; identical to SEQ ID NO: 247693

SEQ ID NO: 656167 - RNA, 64 nt, Homo Sapiens; identical to SEQ ID NO: 247694

SEQ ID NO: 656168 - RNA, 64 nt, Homo Sapiens; identical to SEQ ID NO: 247695

SEQ ID NO: 656169 - RNA, 64 nt, Homo Sapiens; identical to SEQ ID NO: 247696

SEQ ID NO: 656170 - RNA, 64 nt, Homo Sapiens; identical to SEQ ID NO: 247697

SEQ ID NO: 656171 - RNA, 64 nt, Homo Sapiens; identical to SEQ ID NO: 217395

SEQ ID NO: 656172 - RNA, 64 nt, Homo Sapiens; identical to SEQ ID NO: 217396

SEQ ID NO: 656173 - RNA, 64 nt, Homo Sapiens; identical to SEQ ID NO: 217397

SEQ ID NO: 656174 - RNA, 64 nt, Homo Sapiens; identical to SEQ ID NO: 217398

SEQ ID NO: 656175 - RNA, 64 nt, Homo Sapiens; identical to SEQ ID NO: 217399

SEQ ID NO: 656176 - RNA, 64 nt, Homo Sapiens; identical to SEQ ID NO: 217400

SEQ ID NO: 656177 - RNA, 64 nt, Homo Sapiens; identical to SEQ ID NO: 217401

SEQ ID NO: 656178 - RNA, 64 nt, Homo Sapiens; identical to SEQ ID NO: 217402

SEQ ID NO: 656179 - RNA, 64 nt, Homo Sapiens; identical to SEQ ID NO: 217403

SEQ ID NO: 656180 - RNA, 64 nt, Homo Sapiens; identical to SEQ ID NO: 217404

SEQ ID NO: 656181 - RNA, 64 nt, Homo Sapiens; identical to SEQ ID NO: 217405

SEQ ID NO: 656182 - RNA, 64 nt, Homo Sapiens; identical to SEQ ID NO: 217406

SEQ ID NO: 656183 - RNA, 64 nt, Homo Sapiens; identical to SEQ ID NO: 217407

SEQ ID NO: 656184 - RNA, 64 nt, Homo Sapiens; identical to SEQ ID NO: 217408

SEQ ID NO: 656185 - RNA, 64 nt, Homo Sapiens; identical to SEQ ID NO: 217409

SEQ ID NO: 656186 - RNA, 64 nt, Homo Sapiens; identical to SEQ ID NO: 217410

SEQ ID NO: 656187 - RNA, 64 nt, Homo Sapiens; identical to SEQ ID NO: 217411

SEQ ID NO: 656188 - RNA, 64 nt, Homo Sapiens; identical to SEQ ID NO: 217412

SEQ ID NO: 656189 - RNA, 64 nt, Homo Sapiens; identical to SEQ ID NO: 217413

SEQ ID NO: 656190 - RNA, 64 nt, Homo Sapiens; identical to SEQ ID NO: 217414

SEQ ID NO: 656191 - RNA, 64 nt, Homo Sapiens; identical to SEQ ID NO: 217415

SEQ ID NO: 656192 - RNA, 64 nt, Homo Sapiens; identical to SEQ ID NO: 217416

SEQ ID NO: 656193 - RNA, 64 nt, Homo Sapiens; identical to SEQ ID NO: 209724

SEQ ID NO: 656194 - RNA, 64 nt, Homo Sapiens; identical to SEQ ID NO: 209725

SEQ ID NO: 656195 - RNA, 64 nt, Homo Sapiens; identical to SEQ ID NO: 209726

SEQ ID NO: 656196 - RNA, 64 nt, Homo Sapiens; identical to SEQ ID NO: 209727

SEQ ID NO: 656197 - RNA, 64 nt, Homo Sapiens; identical to SEQ ID NO: 209728

SEQ ID NO: 656198 - RNA, 64 nt, Homo Sapiens; identical to SEQ ID NO: 209729

SEQ ID NO: 656199 - RNA, 64 nt, Homo Sapiens; identical to SEQ ID NO: 209730

SEQ ID NO: 656200 - RNA, 64 nt, Homo Sapiens; identical to SEQ ID NO: 209731

SEQ ID NO: 656201 - RNA, 64 nt, Homo Sapiens; identical to SEQ ID NO: 209732

SEQ ID NO: 656202 - RNA, 64 nt, Homo Sapiens; identical to SEQ ID NO: 209733

SEQ ID NO: 656203 - RNA, 63 nt, Homo Sapiens; identical to SEQ ID NO: 209734

SEQ ID NO: 656204 - RNA, 64 nt, Homo Sapiens; identical to SEQ ID NO: 209735

SEQ ID NO: 656205 - RNA, 64 nt, Homo Sapiens; identical to SEQ ID NO: 209736

SEQ ID NO: 656206 - RNA, 64 nt, Homo Sapiens; identical to SEQ ID NO: 209737

SEQ ID NO: 656207 - RNA, 64 nt, Homo Sapiens; identical to SEQ ID NO: 209738

SEQ ID NO: 656208 - RNA, 64 nt, Homo Sapiens; identical to SEQ ID NO: 209739

SEQ ID NO: 656209 - RNA, 64 nt, Homo Sapiens; identical to SEQ ID NO: 209740

SEQ ID NO: 656210 - RNA, 64 nt, Homo Sapiens; identical to SEQ ID NO: 209741

SEQ ID NO: 656211 - RNA, 64 nt, Homo Sapiens; identical to SEQ ID NO: 209742

SEQ ID NO: 656212 - RNA, 64 nt, Homo Sapiens; identical to SEQ ID NO: 209743

SEQ ID NO: 656213 - RNA, 64 nt, Homo Sapiens; identical to SEQ ID NO: 209744

SEQ ID NO: 656214 - RNA, 64 nt, Homo Sapiens; identical to SEQ ID NO: 209745

SEQ ID NO: 656215 - RNA, 64 nt, Homo Sapiens; identical to SEQ ID NO: 209746

SEQ ID NO: 656216 - RNA, 64 nt, Homo Sapiens; identical to SEQ ID NO: 209747

SEQ ID NO: 656217 - RNA, 64 nt, Homo Sapiens; identical to SEQ ID NO: 209748

SEQ ID NO: 656218 - RNA, 64 nt, Homo Sapiens; identical to SEQ ID NO: 209749

SEQ ID NO: 656219 - RNA, 64 nt, Homo Sapiens; identical to SEQ ID NO: 209750

SEQ ID NO: 656220 - RNA, 64 nt, Homo Sapiens; identical to SEQ ID NO: 209751

SEQ ID NO: 656221 - RNA, 64 nt, Homo Sapiens; identical to SEQ ID NO: 209752

SEQ ID NO: 656222 - RNA, 64 nt, Homo Sapiens; identical to SEQ ID NO: 209753

SEQ ID NO: 656223 - RNA, 64 nt, Homo Sapiens; identical to SEQ ID NO: 209754

SEQ ID NO: 656224 - RNA, 64 nt, Homo Sapiens; identical to SEQ ID NO: 209755

SEQ ID NO: 656225 - RNA, 64 nt, Homo Sapiens; identical to SEQ ID NO: 209756

SEQ ID NO: 656226 - RNA, 64 nt, Homo Sapiens; identical to SEQ ID NO: 209757

SEQ ID NO: 656227 - RNA, 64 nt, Homo Sapiens; identical to SEQ ID NO: 209758

SEQ ID NO: 656228 - RNA, 64 nt, Homo Sapiens; identical to SEQ ID NO: 209759

SEQ ID NO: 656229 - RNA, 64 nt, Homo Sapiens; identical to SEQ ID NO: 209760

SEQ ID NO: 656230 - RNA, 64 nt, Homo Sapiens; identical to SEQ ID NO: 209761

SEQ ID NO: 656231 - RNA, 64 nt, Homo Sapiens; identical to SEQ ID NO: 209762

SEQ ID NO: 656232 - RNA, 64 nt, Homo Sapiens; identical to SEQ ID NO: 209763

SEQ ID NO: 656233 - RNA, 64 nt, Homo Sapiens; identical to SEQ ID NO: 209764

SEQ ID NO: 656234 - RNA, 64 nt, Homo Sapiens; identical to SEQ ID NO: 209765

SEQ ID NO: 656235 - RNA, 64 nt, Homo Sapiens; identical to SEQ ID NO: 209766

SEQ ID NO: 656236 - RNA, 64 nt, Homo Sapiens; identical to SEQ ID NO: 209767

SEQ ID NO: 656237 - RNA, 64 nt, Homo Sapiens; identical to SEQ ID NO: 209768

SEQ ID NO: 656238 - RNA, 64 nt, Homo Sapiens; identical to SEQ ID NO: 209769

SEQ ID NO: 656239 - RNA, 64 nt, Homo Sapiens; identical to SEQ ID NO: 209770

SEQ ID NO: 656240 - RNA, 64 nt, Homo Sapiens; identical to SEQ ID NO: 209771

SEQ ID NO: 656241 - RNA, 64 nt, Homo Sapiens; identical to SEQ ID NO: 209772

SEQ ID NO: 656242 - RNA, 64 nt, Homo Sapiens; identical to SEQ ID NO: 209773

SEQ ID NO: 656243 - RNA, 64 nt, Homo Sapiens; identical to SEQ ID NO: 209774

SEQ ID NO: 656244 - RNA, 64 nt, Homo Sapiens; identical to SEQ ID NO: 209775

SEQ ID NO: 656245 - RNA, 64 nt, Homo Sapiens; identical to SEQ ID NO: 209776

SEQ ID NO: 656246 - RNA, 64 nt, Homo Sapiens; identical to SEQ ID NO: 209777

SEQ ID NO: 656247 - RNA, 64 nt, Homo Sapiens; identical to SEQ ID NO: 209778

SEQ ID NO: 656248 - RNA, 64 nt, Homo Sapiens; identical to SEQ ID NO: 209779

SEQ ID NO: 656249 - RNA, 64 nt, Homo Sapiens; identical to SEQ ID NO: 209780

SEQ ID NO: 656250 - RNA, 64 nt, Homo Sapiens; identical to SEQ ID NO: 209781

SEQ ID NO: 656251 - RNA, 64 nt, Homo Sapiens; identical to SEQ ID NO: 209782

SEQ ID NO: 656252 - RNA, 64 nt, Homo Sapiens; identical to SEQ ID NO: 209783

SEQ ID NO: 656253 - RNA, 64 nt, Homo Sapiens; identical to SEQ ID NO: 209784

SEQ ID NO: 656254 - RNA, 64 nt, Homo Sapiens; identical to SEQ ID NO: 209785

SEQ ID NO: 656255 - RNA, 64 nt, Homo Sapiens; identical to SEQ ID NO: 209786

SEQ ID NO: 656256 - RNA, 64 nt, Homo Sapiens; identical to SEQ ID NO: 209787

SEQ ID NO: 656257 - RNA, 64 nt, Homo Sapiens; identical to SEQ ID NO: 209788

SEQ ID NO: 656258 - RNA, 64 nt, Homo Sapiens; identical to SEQ ID NO: 209789

SEQ ID NO: 656259 - RNA, 64 nt, Homo Sapiens; identical to SEQ ID NO: 209790

SEQ ID NO: 656260 - RNA, 64 nt, Homo Sapiens; identical to SEQ ID NO: 209791

SEQ ID NO: 656261 - RNA, 64 nt, Homo Sapiens; identical to SEQ ID NO: 209792

SEQ ID NO: 656262 - RNA, 64 nt, Homo Sapiens; identical to SEQ ID NO: 209793

SEQ ID NO: 656263 - RNA, 64 nt, Homo Sapiens; identical to SEQ ID NO: 209794

SEQ ID NO: 656264 - RNA, 64 nt, Homo Sapiens; identical to SEQ ID NO: 209795

SEQ ID NO: 656265 - RNA, 64 nt, Homo Sapiens; identical to SEQ ID NO: 209796

SEQ ID NO: 656266 - RNA, 64 nt, Homo Sapiens; identical to SEQ ID NO: 209797

SEQ ID NO: 656267 - RNA, 64 nt, Homo Sapiens; identical to SEQ ID NO: 209798

SEQ ID NO: 656268 - RNA, 64 nt, Homo Sapiens; identical to SEQ ID NO: 209799

SEQ ID NO: 656269 - RNA, 64 nt, Homo Sapiens; identical to SEQ ID NO: 209800

SEQ ID NO: 656270 - RNA, 64 nt, Homo Sapiens; identical to SEQ ID NO: 209801

SEQ ID NO: 656271 - RNA, 64 nt, Homo Sapiens; identical to SEQ ID NO: 209802

SEQ ID NO: 656272 - RNA, 64 nt, Homo Sapiens; identical to SEQ ID NO: 209803

SEQ ID NO: 656273 - RNA, 64 nt, Homo Sapiens; identical to SEQ ID NO: 209804

SEQ ID NO: 656274 - RNA, 64 nt, Homo Sapiens; identical to SEQ ID NO: 209805

SEQ ID NO: 656275 - RNA, 64 nt, Homo Sapiens; identical to SEQ ID NO: 209806

SEQ ID NO: 656276 - RNA, 64 nt, Homo Sapiens; identical to SEQ ID NO: 209807

SEQ ID NO: 656277 - RNA, 64 nt, Homo Sapiens; identical to SEQ ID NO: 209808

SEQ ID NO: 656278 - RNA, 64 nt, Homo Sapiens; identical to SEQ ID NO: 209809

SEQ ID NO: 656279 - RNA, 64 nt, Homo Sapiens; identical to SEQ ID NO: 209810

SEQ ID NO: 656280 - RNA, 64 nt, Homo Sapiens; identical to SEQ ID NO: 209811

SEQ ID NO: 656281 - RNA, 64 nt, Homo Sapiens; identical to SEQ ID NO: 209812

SEQ ID NO: 656282 - RNA, 64 nt, Homo Sapiens; identical to SEQ ID NO: 209813

SEQ ID NO: 656283 - RNA, 64 nt, Homo Sapiens; identical to SEQ ID NO: 209814

SEQ ID NO: 656284 - RNA, 64 nt, Homo Sapiens; identical to SEQ ID NO: 217965

SEQ ID NO: 656285 - RNA, 64 nt, Homo Sapiens; identical to SEQ ID NO: 217966

SEQ ID NO: 656286 - RNA, 64 nt, Homo Sapiens; identical to SEQ ID NO: 217967

SEQ ID NO: 656287 - RNA, 64 nt, Homo Sapiens; identical to SEQ ID NO: 217968

SEQ ID NO: 656288 - RNA, 64 nt, Homo Sapiens; identical to SEQ ID NO: 217969

SEQ ID NO: 656289 - RNA, 64 nt, Homo Sapiens; identical to SEQ ID NO: 217970

SEQ ID NO: 656290 - RNA, 64 nt, Homo Sapiens; identical to SEQ ID NO: 217971

SEQ ID NO: 656291 - RNA, 64 nt, Homo Sapiens; identical to SEQ ID NO: 217972

SEQ ID NO: 656292 - RNA, 64 nt, Homo Sapiens; identical to SEQ ID NO: 217973

SEQ ID NO: 656293 - RNA, 64 nt, Homo Sapiens; identical to SEQ ID NO: 217974

SEQ ID NO: 656294 - RNA, 64 nt, Homo Sapiens; identical to SEQ ID NO: 217975

SEQ ID NO: 656295 - RNA, 64 nt, Homo Sapiens; identical to SEQ ID NO: 217976

SEQ ID NO: 656296 - RNA, 64 nt, Homo Sapiens; identical to SEQ ID NO: 217977

SEQ ID NO: 656297 - RNA, 64 nt, Homo Sapiens; identical to SEQ ID NO: 217978

SEQ ID NO: 656298 - RNA, 64 nt, Homo Sapiens; identical to SEQ ID NO: 217979

SEQ ID NO: 656299 - RNA, 64 nt, Homo Sapiens; identical to SEQ ID NO: 217980

SEQ ID NO: 656300 - RNA, 64 nt, Homo Sapiens; identical to SEQ ID NO: 217981

SEQ ID NO: 656301 - RNA, 64 nt, Homo Sapiens; identical to SEQ ID NO: 217982

SEQ ID NO: 656302 - RNA, 64 nt, Homo Sapiens; identical to SEQ ID NO: 217983

SEQ ID NO: 656303 - RNA, 64 nt, Homo Sapiens; identical to SEQ ID NO: 217984

SEQ ID NO: 656304 - RNA, 64 nt, Homo Sapiens; identical to SEQ ID NO: 217985

SEQ ID NO: 656305 - RNA, 64 nt, Homo Sapiens; identical to SEQ ID NO: 217986

SEQ ID NO: 656306 - RNA, 64 nt, Homo Sapiens; identical to SEQ ID NO: 217987

SEQ ID NO: 656307 - RNA, 56 nt, Homo Sapiens; identical to SEQ ID NO: 217988

SEQ ID NO: 656308 - RNA, 64 nt, Homo Sapiens; identical to SEQ ID NO: 217989

SEQ ID NO: 656309 - RNA, 64 nt, Homo Sapiens; identical to SEQ ID NO: 217990

SEQ ID NO: 656310 - RNA, 64 nt, Homo Sapiens; identical to SEQ ID NO: 217991

SEQ ID NO: 656311 - RNA, 64 nt, Homo Sapiens; identical to SEQ ID NO: 217992

SEQ ID NO: 656312 - RNA, 64 nt, Homo Sapiens; identical to SEQ ID NO: 217993

SEQ ID NO: 656313 - RNA, 64 nt, Homo Sapiens; identical to SEQ ID NO: 217994

SEQ ID NO: 656314 - RNA, 64 nt, Homo Sapiens; identical to SEQ ID NO: 217995

SEQ ID NO: 656315 - RNA, 64 nt, Homo Sapiens; identical to SEQ ID NO: 217996

SEQ ID NO: 656316 - RNA, 64 nt, Homo Sapiens; identical to SEQ ID NO: 217997

SEQ ID NO: 656317 - RNA, 64 nt, Homo Sapiens; identical to SEQ ID NO: 217998

SEQ ID NO: 656318 - RNA, 64 nt, Homo Sapiens; identical to SEQ ID NO: 217999

SEQ ID NO: 656319 - RNA, 64 nt, Homo Sapiens; identical to SEQ ID NO: 218000

SEQ ID NO: 656320 - RNA, 64 nt, Homo Sapiens; identical to SEQ ID NO: 218001

SEQ ID NO: 656321 - RNA, 64 nt, Homo Sapiens; identical to SEQ ID NO: 218002

SEQ ID NO: 656322 - RNA, 64 nt, Homo Sapiens; identical to SEQ ID NO: 218003

SEQ ID NO: 656323 - RNA, 64 nt, Homo Sapiens; identical to SEQ ID NO: 218004

SEQ ID NO: 656324 - RNA, 64 nt, Homo Sapiens; identical to SEQ ID NO: 218005

SEQ ID NO: 656325 - RNA, 64 nt, Homo Sapiens; identical to SEQ ID NO: 218006

SEQ ID NO: 656326 - RNA, 64 nt, Homo Sapiens; identical to SEQ ID NO: 218007

SEQ ID NO: 656327 - RNA, 64 nt, Homo Sapiens; identical to SEQ ID NO: 218008

SEQ ID NO: 656328 - RNA, 64 nt, Homo Sapiens; identical to SEQ ID NO: 218009

SEQ ID NO: 656329 - RNA, 64 nt, Homo Sapiens; identical to SEQ ID NO: 218010

SEQ ID NO: 656330 - RNA, 64 nt, Homo Sapiens; identical to SEQ ID NO: 218011

SEQ ID NO: 656331 - RNA, 64 nt, Homo Sapiens; identical to SEQ ID NO: 218012

SEQ ID NO: 656332 - RNA, 64 nt, Homo Sapiens; identical to SEQ ID NO: 218013

SEQ ID NO: 656333 - RNA, 64 nt, Homo Sapiens; identical to SEQ ID NO: 218014

SEQ ID NO: 656334 - RNA, 64 nt, Homo Sapiens; identical to SEQ ID NO: 218015

SEQ ID NO: 656335 - RNA, 64 nt, Homo Sapiens; identical to SEQ ID NO: 218016

SEQ ID NO: 656336 - RNA, 64 nt, Homo Sapiens; identical to SEQ ID NO: 218017

SEQ ID NO: 656337 - RNA, 64 nt, Homo Sapiens; identical to SEQ ID NO: 218018

SEQ ID NO: 656338 - RNA, 64 nt, Homo Sapiens; identical to SEQ ID NO: 218019

SEQ ID NO: 656339 - RNA, 64 nt, Homo Sapiens; identical to SEQ ID NO: 218020

SEQ ID NO: 656340 - RNA, 64 nt, Homo Sapiens
gguaaauaaugcaaaauaccugguaguaaaauaaaugcugaaaauuuuccuuuaaaauagaauc

SEQ ID NO: 656341 - RNA, 64 nt, Homo Sapiens
cugaggucaggaguucgaguccagccuggccaauaugcugaaacccugucucuacuaaaauuac

SEQ ID NO: 656342 - RNA, 64 nt, Homo Sapiens
uuggugucuguccuaauuccuuucucacucaccgaugcugaauacccaguugaaucaaacuguc

SEQ ID NO: 656343 - RNA, 64 nt, Homo Sapiens
aauggaauuuccuaugcacuacuguagcuaggaaaugcugaaaacaacuguguuuuuuaauuaa

SEQ ID NO: 656344 - RNA, 64 nt, Homo Sapiens
gcaugaacauguacuguucucuucuugaacacucaugcugaaagcccaaguagggggucuaaaa

SEQ ID NO: 656345 - RNA, 64 nt, Homo Sapiens
auuuuuaaggacuuuccuuccuccaucuccaagaaugcugaaaccaagggggaugacaugugac

SEQ ID NO: 656346 - RNA, 64 nt, Homo Sapiens
guccaccugccugcugaccacuggacgcugcuccaugcugaagaaaagugacagucuccagggg

SEQ ID NO: 656347 - RNA, 64 nt, Homo Sapiens
agaaaagugacagucuccaggggacauuucagccaugcugaaagggaggcuggcaguggucauu

SEQ ID NO: 656348 - RNA, 64 nt, Homo Sapiens
uuauuuuggaugcuagcugcugaacaauagaaaaaugcugaacacuaaaguugaauaaaaugca

SEQ ID NO: 656349 - RNA, 64 nt, Homo Sapiens
uaagauggucccauuucaauggacuuaggagaaaaugcugaauguauuacagagcuauguaaag

SEQ ID NO: 656350 - RNA, 64 nt, Homo Sapiens
aacaccuagcuuuauucuucccagaaaugucuaaaugcugaaaacauguaccauuugcauggcu

SEQ ID NO: 656351 - RNA, 64 nt, Homo Sapiens
aacaguggaaugugaccaguaauuugagugaucuaugcugaauaaucccagcacaucacuguag

SEQ ID NO: 656352 - RNA, 64 nt, Homo Sapiens
guccagaaaagaaggacauuagggguguuguuagaugcugaaaucuugauuuuacugcagauca

SEQ ID NO: 656353 - RNA, 64 nt, Homo Sapiens
cuuauuuagcuuaucauaaucuacuuuguaaaacaugcugaaaccucacuguggagaaccagaa

SEQ ID NO: 656354 - RNA, 64 nt, Homo Sapiens
augguccgaauaucugggccugcccccccaaauuaugcugaaaccuaaucaccagugugauggu

SEQ ID NO: 656355 - RNA, 64 nt, Homo Sapiens
ccccaaagaucucauguuaauaaagugucuaauaaugcugaagagaagagaaacuagaaacagu

SEQ ID NO: 656356 - RNA, 64 nt, Homo Sapiens
uucucaaccagaagaaagggugggacuauuuugcaugcugaaacaccucagucucccaaguagc

SEQ ID NO: 656357 - RNA, 64 nt, Homo Sapiens
acagagcaugauguuuaaucguggaucccuguguaugcugaacuaaugucagauuuauuuuuau

SEQ ID NO: 656358 - RNA, 64 nt, Homo Sapiens
uuaagaugccaaauauuuuuaaguugugaugcucaugcugaaauuauucuucuaacccuuccug

SEQ ID NO: 656359 - RNA, 64 nt, Homo Sapiens; identical to SEQ ID NO: 125003

SEQ ID NO: 656360 - RNA, 64 nt, Homo Sapiens; identical to SEQ ID NO: 125004

SEQ ID NO: 656361 - RNA, 64 nt, Homo Sapiens; identical to SEQ ID NO: 125005

SEQ ID NO: 656362 - RNA, 64 nt, Homo Sapiens; identical to SEQ ID NO: 125006

SEQ ID NO: 656363 - RNA, 64 nt, Homo Sapiens; identical to SEQ ID NO: 125007

SEQ ID NO: 656364 - RNA, 64 nt, Homo Sapiens; identical to SEQ ID NO: 125008

SEQ ID NO: 656365 - RNA, 64 nt, Homo Sapiens; identical to SEQ ID NO: 125009

SEQ ID NO: 656366 - RNA, 64 nt, Homo Sapiens; identical to SEQ ID NO: 125010

SEQ ID NO: 656367 - RNA, 64 nt, Homo Sapiens; identical to SEQ ID NO: 125011

SEQ ID NO: 656368 - RNA, 64 nt, Homo Sapiens; identical to SEQ ID NO: 125012

SEQ ID NO: 656369 - RNA, 64 nt, Homo Sapiens; identical to SEQ ID NO: 125013

SEQ ID NO: 656370 - RNA, 64 nt, Homo Sapiens; identical to SEQ ID NO: 125014

SEQ ID NO: 656371 - RNA, 64 nt, Homo Sapiens; identical to SEQ ID NO: 125015

SEQ ID NO: 656372 - RNA, 64 nt, Homo Sapiens; identical to SEQ ID NO: 125016

SEQ ID NO: 656373 - RNA, 64 nt, Homo Sapiens; identical to SEQ ID NO: 125017

SEQ ID NO: 656374 - RNA, 64 nt, Homo Sapiens
cuuuuauaauaaaaaaaagaaguugaguaaaaaaaaaaaacacacaaaccuguuaguuucaaaa

SEQ ID NO: 656375 - RNA, 64 nt, Homo Sapiens
uugaugcaauuuuuaacguuaauugauauaaaaaaaaaaacaacaaaauuaggcuuguaaaacu

SEQ ID NO: 656376 - RNA, 64 nt, Homo Sapiens
aaacacuaacauuuuccccuucuguaguuguaugaaaaaacaaauauuguuagcauaguagaua

SEQ ID NO: 656377 - RNA, 64 nt, Homo Sapiens
auuguguaaaauuacauuuuuuuuccaggggagaaaaaaacaucaaacaaaaacaucuaaauca

SEQ ID NO: 656378 - RNA, 64 nt, Homo Sapiens
aaagguuaaaacaaaaacaaaaaaccacaaaaauaaaaaacaaaaaaaacaaaaaacccaagaa

SEQ ID NO: 656379 - RNA, 64 nt, Homo Sapiens
aacaaaaacaaaaaaccacaaaaauaaaaaacaaaaaaaacaaaaaacccaagaaaaaaaaaaa

SEQ ID NO: 656380 - RNA, 64 nt, Homo Sapiens
uuuuaaaaguuuugaaaugcugcacuuacauuuaaaaaaacaacaacaacauuuuuucaacaau

SEQ ID NO: 656381 - RNA, 64 nt, Homo Sapiens
guccuuucaccccaggacucuaaauuauugggguaaaaaacagccuugcaagaaaaaggggagc

SEQ ID NO: 656382 - RNA, 64 nt, Homo Sapiens
gcuggagaggcaggagcccuggggugagaaaagcaaaaaacaaacaaaaaacaaaacccuggag

SEQ ID NO: 656383 - RNA, 64 nt, Homo Sapiens
aggagcccuggggugagaaaagcaaaaaacaaacaaaaaacaaaacccuggaguguuaggagga

SEQ ID NO: 656384 - RNA, 64 nt, Homo Sapiens
acuaaccaccagaagacuugaaaaucuuaaaaaaaaaaaacaaaaaaacaagaaaaggcaacau

SEQ ID NO: 656385 - RNA, 64 nt, Homo Sapiens
ccagaagacuugaaaaucuuaaaaaaaaaaaacaaaaaaacaagaaaaggcaacaucucauuuu

SEQ ID NO: 656386 - RNA, 64 nt, Homo Sapiens
acaguuuuuaaaacugauuuacaaaaaaacaaaaaaaaaacaaaugagcaaaaaaaaaaaaaaa

SEQ ID NO: 656387 - RNA, 64 nt, Homo Sapiens
aaaaaaacaaaacaguuuuuaaaaaaaaaaaacaaaaaaacaaagcaaauaguccugagcaaaa

SEQ ID NO: 656388 - RNA, 64 nt, Homo Sapiens
aaaacaaaaaaaaaacaaaagagcaaaaaaaaaaaaaaaacaaacucugaaagcaaauaguccu

SEQ ID NO: 656389 - RNA, 64 nt, Homo Sapiens
agugauauauauauauauauaaaaaacaacaccaaaaaaacagcgauaaaaaaaaaaaaaaaac

SEQ ID NO: 656390 - RNA, 64 nt, Homo Sapiens
accaaaaaaacagcagugauaaaaaaaaaaaaacaaaaaacaacccugggcacuuuuagauaaa

SEQ ID NO: 656391 - RNA, 64 nt, Homo Sapiens
aaacaacaccaaaaaaacagagauaaaaaaaaaaaaaaaacaaaaagcccaccugggcacuuuu

SEQ ID NO: 656392 - RNA, 64 nt, Homo Sapiens
aauuuuaucugguuauugcaacuaagcgauugggaaaaaacaggaaaaacaacaacaacaaaaa

SEQ ID NO: 656393 - RNA, 64 nt, Homo Sapiens
aacaacaaaaaacuaagcgaugaucuacucaguuaaaaaacaacaaaguaguucugggucagaa

SEQ ID NO: 656394 - RNA, 64 nt, Homo Sapiens
aagagcuugcuuuuaaauuguagucacuacaggcaaaaaacaguggaauacaguguguuguuaa

SEQ ID NO: 656395 - RNA, 64 nt, Homo Sapiens
aacaaagucacauaaaucuugaugcagagagaggaaaaaacagcuugcuuuacaauaaugcuua

SEQ ID NO: 656396 - RNA, 64 nt, Homo Sapiens
aaaaaaagcuaaguuauaagaaaacaaaaaacaaaaaaaacaacaaggaacuauucuuuggaaa

SEQ ID NO: 656397 - RNA, 64 nt, Homo Sapiens
aaaaacaacaaaaaaagcuacuuuggaaaaaaacaaaaaacaaaauccauuuuaaggaacuauu

SEQ ID NO: 656398 - RNA, 64 nt, Homo Sapiens
aaacaaaaaaaacaacaaaaaacuauucuuuggaaaaaaacaaacaggagcauccauuuuaagg

SEQ ID NO: 656399 - RNA, 64 nt, Homo Sapiens
aaggaaguaaaaccaaagacguaccuguuuuaagaaaaaacaacuuuauauuguuugauacuca

SEQ ID NO: 656400 - RNA, 64 nt, Homo Sapiens
cuuaauuuugauugaacuaaggccugacauccacaaaaaacaaaugauuaucaaagaauaucag

SEQ ID NO: 656401 - RNA, 64 nt, Homo Sapiens
auuuuuaaaauuagccugguugagaucccaucucaaaaaacauugaccagccugggcaacauag

SEQ ID NO: 656402 - RNA, 64 nt, Homo Sapiens
auucauguuacuaaaagacaccaucucaaaaacaaaaaaacaaacugggcgacagagcaagacg

SEQ ID NO: 656403 - RNA, 64 nt, Homo Sapiens
caaguucaacuguuucuuugaucaaaccuacuauaaaaaacauuuacaucacuggcugcucuuc

SEQ ID NO: 656404 - RNA, 64 nt, Homo Sapiens
aaagaaaauauaguuugauugagacucuguuucaaaaaaacagaccagccuggaugacagagug

SEQ ID NO: 656405 - RNA, 64 nt, Homo Sapiens
aaaaaaccuuguuccuuuauugaagaaaaaaaacaaaaaacaaacugcuucacuugccuagucu

SEQ ID NO: 656406 - RNA, 64 nt, Homo Sapiens
aaacaaaaaaaaaccuuguucuagucuugaagaaaaaaaacaaaauucccacugcuucacuugc

SEQ ID NO: 656407 - RNA, 64 nt, Homo Sapiens
aggaguccacucaacccuggaacaaaacaaaacaaaaaaacacugugcagucgugucauaaaaa

SEQ ID NO: 656408 - RNA, 64 nt, Homo Sapiens
acaaaacaaaaaaacacuaggcagucgugucauaaaaaaacaaacaggaccagauccacaucgu

SEQ ID NO: 656409 - RNA, 64 nt, Homo Sapiens
gaugagucgcacaucugcugacaaaaaaaaaaacaaaaaacaaaagacucuaucucaaaaaaaa

SEQ ID NO: 656410 - RNA, 64 nt, Homo Sapiens
aaacaaagaugagucgcacaaaaaaaaacaaaaaaaaaaacaaacagagcgagacucuaucuca

SEQ ID NO: 656411 - RNA, 64 nt, Homo Sapiens
aaaaaaaacaaaaaacaaaggacucuaucucaaaaaaaaacaaacagccugggcaacagagcga

SEQ ID NO: 656412 - RNA, 64 nt, Homo Sapiens
uuuauuucuuauuuccuaacauugaauucguuagaaaaaacagcgucaccucacucuucaccug

SEQ ID NO: 656413 - RNA, 64 nt, Homo Sapiens
guauugcaaaaguuagaagucauuuuacaaauuaaaaaaacauuuuuuucuugguagucuuuaa

SEQ ID NO: 656414 - RNA, 64 nt, Homo Sapiens
cucucucucaaagaaaaaaaaaaugggagugcaaaaaaaacaaagccaaaaaauauaugaagga

SEQ ID NO: 656415 - RNA, 64 nt, Homo Sapiens
aaguagaaacauaauuuuuuuuccuccaaaggugaaaaaacaaugcauucuugcuuuaaaaaaa

SEQ ID NO: 656416 - RNA, 64 nt, Homo Sapiens
aguggauuuuguauuuuguauuuaacuugcauucaaaaaacaggaucucaguucuccuuucuug

SEQ ID NO: 656417 - RNA, 64 nt, Homo Sapiens
auguuuucuuccugaaugcucauuaggacuucuuaaaaaacaugaaaguaauuuggaaguaagu

SEQ ID NO: 656418 - RNA, 64 nt, Homo Sapiens
uauccauuuguugacauguagacuguuuacaaaaaaaaaacacaugguuaaauguuaaauuuua

SEQ ID NO: 656419 - RNA, 64 nt, Homo Sapiens
aaugaaaggagucaccuuuuacaugacucaggugaaaaaacaguauaaacauuaauuuacuuug

SEQ ID NO: 656420 - RNA, 64 nt, Homo Sapiens
aagguagugaaaaaaugaaaauuugcuauuuauuaaaaaacauuaaauuucauuccaaaugaga

SEQ ID NO: 656421 - RNA, 64 nt, Homo Sapiens
uaacaucuaagcaucaucugauuugauauucccuaaaaaacauuuggaauauaugcuaucuaua

SEQ ID NO: 656422 - RNA, 64 nt, Homo Sapiens
uacugacuucccguugaguaguuguucuccuugcaaaaaacaugcagcaucauuaaacaguuau

SEQ ID NO: 656423 - RNA, 64 nt, Homo Sapiens
uaccuggugagaaguugcaugcaaaacugaccauaaaaaacaaugacuagggggacaaagaaaa

SEQ ID NO: 656424 - RNA, 64 nt, Homo Sapiens
caaaacguacuggugcuuucaccuggagcaaauaaaaaaacauaaaagugacagucaaaacccc

SEQ ID NO: 656425 - RNA, 64 nt, Homo Sapiens
aaacauaauaaaacaccaaguuaaacaaacaaacaaaaaacacaacugagguagcgacacaaag

SEQ ID NO: 656426 - RNA, 64 nt, Homo Sapiens
ggccaauaaauucccuaacagaaaaacaaaaaacaaaaaacaggugcucuuguuucucaaaaaa

SEQ ID NO: 656427 - RNA, 64 nt, Homo Sapiens
aaacaggggccaauaaauuccaaaaaagaaaaacaaaaaacaaauaucucaugcucuuguuucu

SEQ ID NO: 656428 - RNA, 64 nt, Homo Sapiens
cauuggggaaagguuuaagacagguuguaaaaaaaaaaaacauacuuggauacacaccgcucuu

SEQ ID NO: 656429 - RNA, 64 nt, Homo Sapiens
ucauuauguuuaggggggaagaaaaauuuuuuuuaaaaaacacuuuuuuaaauauaaauguuaa

SEQ ID NO: 656430 - RNA, 64 nt, Homo Sapiens
aacaaaagauuuuuaucaaaaaaaaaaaaaaaacaaaaaacaaaccgaacagguuuauuuuagu

SEQ ID NO: 656431 - RNA, 64 nt, Homo Sapiens
aaacaaaaacaaaagauuuuuuuuaguaaaaaaaaaaaaacaaauguucccccgaacagguuua

SEQ ID NO: 656432 - RNA, 64 nt, Homo Sapiens
aaccaucaucacagaagauggaaaacaaaaacaaaaaaaacacauccaucucauuaaaaaaaac

SEQ ID NO: 656433 - RNA, 64 nt, Homo Sapiens
uaaaaacccaccaucacaugagguuuucagaaggaaaaaacauugguagggacaaaaccacauc

SEQ ID NO: 656434 - RNA, 64 nt, Homo Sapiens
agaaaaaauuuccagaagaggaaaaaaaaacuacaaaaaacaaaacauugaagguugauauuuu

SEQ ID NO: 656435 - RNA, 64 nt, Homo Sapiens
guagauaggagcuuauggucaaaaagugcaaaaaaaaaaacaaaaaaaaagcaauagauagaga

SEQ ID NO: 656436 - RNA, 64 nt, Homo Sapiens
auuucuauuucaaaggaaaccaaaccuuaaaaaaaaaaaacaaaaacugggcugggucuuccaa

SEQ ID NO: 656437 - RNA, 64 nt, Homo Sapiens
ccauugguucagccucaagucuggcccgucuucgaaaaaacaaacacauuuguaagcuuugugg

SEQ ID NO: 656438 - RNA, 64 nt, Homo Sapiens
ccgcucugggugucucccacaugucuacuauggcaaaaaacauuaccauccccacccauaccac

SEQ ID NO: 656439 - RNA, 64 nt, Homo Sapiens
cgccccagcccucagccccaggccccagcuggagaaaaaacauugcccagggauuaggagcagc

SEQ ID NO: 656440 - RNA, 64 nt, Homo Sapiens
ccaacaugaagucucuuuaugguuagagaagaccaaaaaacaaacaaacaaacuuagaaacaua

SEQ ID NO: 656441 - RNA, 64 nt, Homo Sapiens
cccaauauggugaaaccccgucucuccugaaaaaaaaaaacacaaaaauuagccaggcauggug

SEQ ID NO: 656442 - RNA, 55 nt, Homo Sapiens; identical to SEQ ID NO: 422370

SEQ ID NO: 656443 - RNA, 62 nt, Homo Sapiens
auuuauuguaucccauguaaaaacaaaaaaacaaaaaacaaagaaaagaaagagauuuuaua

SEQ ID NO: 656444 - RNA, 64 nt, Homo Sapiens
gauacaauuaaccauuuuauauuugccaccuacaaaaaaacacccaauaucuucucuuguagac

SEQ ID NO: 656445 - RNA, 64 nt, Homo Sapiens
gaguaaugaaguuaucuuuuuuguuuaaaaaaaaaaaaaacacugcauuaaaaaaguaucuguu

SEQ ID NO: 656446 - RNA, 64 nt, Homo Sapiens
auaugcuagaaaaggcauuuugggguuauguuuaaaaaaacauuauugucccacaauauuaccu

SEQ ID NO: 656447 - RNA, 64 nt, Homo Sapiens
aaauuagccagacaugguggcaugcgcuuguuuaaaaaaacaaauaaauaaauaaucgacucaa

SEQ ID NO: 656448 - RNA, 64 nt, Homo Sapiens
acaaacaaaagagaacuaugauuuuucaaaaaacaaaaaacaaaggaguaauuguacugcaaua

SEQ ID NO: 656449 - RNA, 64 nt, Homo Sapiens
aaacaaaacaaacaaaagagugcaauaauuuuucaaaaaacaaaccaaauaggaguaauuguac

SEQ ID NO: 656450 - RNA, 64 nt, Homo Sapiens
agaccaacauauagaguguuugcauuauuccacaaaaaaacagcccuuuuaaggaugccaagaa

SEQ ID NO: 656451 - RNA, 64 nt, Homo Sapiens
caucgaaaggcuuaugccaauauuucacugguuuaaaaaacaaaucugucuugcgugauuugua

SEQ ID NO: 656452 - RNA, 64 nt, Homo Sapiens
cuuuguugggaggguauuucgugcaaugucuuuaaaaaaacagggagcugcugagauuucagug

SEQ ID NO: 656453 - RNA, 64 nt, Homo Sapiens
acuguuagacccaaagcauugcuuuuuguggcugaaaaaacauaaaaggaacauauucaauuug

SEQ ID NO: 656454 - RNA, 64 nt, Homo Sapiens
ucacucaguugcacuuagucauuaaaauuuaaaaaaaaaacauuguucaaaccuuuagggaaug

SEQ ID NO: 656455 - RNA, 64 nt, Homo Sapiens
ucaaaaguuagcagugaaauaaaaaggaaaaaaaaaaaaacacgaccccgagaaugaagauugg

SEQ ID NO: 656456 - RNA, 64 nt, Homo Sapiens
uuauggugcaaaaaguaaucuccuuuugugguguaaaaaacaaauuacagauacugaaagugcc

SEQ ID NO: 656457 - RNA, 64 nt, Homo Sapiens
cucaaacaaaagacuugcuuugcuaccuuaguuuaaaaaacaauccauuacauggcaaaauguu

SEQ ID NO: 656458 - RNA, 64 nt, Homo Sapiens
ugugugggauugugcugauuuuuguugauaacacaaaaaacacuauguuuucuggagagcugug

SEQ ID NO: 656459 - RNA, 64 nt, Homo Sapiens
uugguggguuguauaaggguagcuuuuguuguuaaaaaaacaguagagaguuaaguuccauaua

SEQ ID NO: 656460 - RNA, 64 nt, Homo Sapiens
acuguacugaauagguuccccaauccaucguauuaaaaaacaauuaacugcccucugaaauaau

SEQ ID NO: 656461 - RNA, 64 nt, Homo Sapiens
aagucucuguguaaccagcucaguguuuugguggaaaaaacauuuuaaguuuuacugauaauuu

SEQ ID NO: 656462 - RNA, 64 nt, Homo Sapiens
ucuagccugggugacagagucagacuccgucccaaaaaaacaaacaaacaaaacaaaacaaaaa

SEQ ID NO: 656463 - RNA, 64 nt, Homo Sapiens
gucccaaaaaaacaaacaaacaaaacaaaacaaaaaaaaacagaaguuacaaaugaauacucac

SEQ ID NO: 656464 - RNA, 64 nt, Homo Sapiens
uucaagaccaaccuggugaaaccccgucucuacaaaaaaacacaaaaaauagccaggcauggug

SEQ ID NO: 656465 - RNA, 64 nt, Homo Sapiens
gcauucuauuuucuauaugacccucuugauauuuaaaaaacacuauggauaacaauucuucauu

SEQ ID NO: 656466 - RNA, 64 nt, Homo Sapiens
gcagaaacauaccuuugacuauaagaaauuaaaaaaaaaacaccaaaauaauauuuuucuuacu

SEQ ID NO: 656467 - RNA, 64 nt, Homo Sapiens
aggcuuuucuuugguuuucuucaaacauaggugaaaaaaacacugccauucacaagucaaggaa

SEQ ID NO: 656468 - RNA, 64 nt, Homo Sapiens
guucauaguuugagcugguauaaggcauaaaggaaaaaaacagaucuuggagaauuuggaugcc

SEQ ID NO: 656469 - RNA, 64 nt, Homo Sapiens
aaaagugauggaaagguguuuucccaacuuuguuaaaaaacaaaaaaaagauguaagacuuugg

SEQ ID NO: 656470 - RNA, 64 nt, Homo Sapiens
aggaaaaaaaagacaaauuaacccagaaagguuuaaaaaacauauaaaaaacaaaaagccaaca

SEQ ID NO: 656471 - RNA, 64 nt, Homo Sapiens
aagccaacaacccagaaaggaggcagaaaccauuaaaaaacaaaauaaaaacaaaaaaguugga

SEQ ID NO: 656472 - RNA, 64 nt, Homo Sapiens
auaaauuuugugugauaauuuuuuugcauugugaaaaaaacaaaaaauauacuuauuugucuuc

SEQ ID NO: 656473 - RNA, 64 nt, Homo Sapiens
uuguauucaauauugucacaaagaaaaccaauacaaaaaacaauucacuuugaauugugcacau

SEQ ID NO: 656474 - RNA, 64 nt, Homo Sapiens
acacaaauaauuauucuauaguucaauauguaauaaaaaacauaaaccaacaaacucucuuaag

SEQ ID NO: 656475 - RNA, 64 nt, Homo Sapiens
aucuuaaggggauagacuaguauuuugugcauuuaaaaaacacauauuucagcccuauuuguau

SEQ ID NO: 656476 - RNA, 64 nt, Homo Sapiens
ggugagaaaccacaacacaggcacaaggaugccaaaaaaacaaauaaaauaccuucagccuaag

SEQ ID NO: 656477 - RNA, 64 nt, Homo Sapiens
gacaccaacacaccacucauuggaaaauggaaaaaaaaaacaaaaaaaaaacaaaaaaauguac

SEQ ID NO: 656478 - RNA, 64 nt, Homo Sapiens
accacucauuggaaaauggaaaaaaaaaacaaaaaaaaaacaaaaaaauguacaauggaugcau

SEQ ID NO: 656479 - RNA, 64 nt, Homo Sapiens
aaaccccuacccuccuugguuuaccuccaucauuaaaaaacaacaaugacaacgacaacaaaaa

SEQ ID NO: 656480 - RNA, 64 nt, Homo Sapiens
uccaucauuaaaaaacaacaaugacaacgacaacaaaaaacaaaacuaaaacgacuuauuauuu

SEQ ID NO: 656481 - RNA, 64 nt, Homo Sapiens
ucagaugucagccuuugcucuccauuuugacguuaaaaaacaacaacagaucuagagauaccuc

SEQ ID NO: 656482 - RNA, 64 nt, Homo Sapiens
gguauccuguaauuuaguuguaacauagaaaaugaaaaaacaguuaaaaaaagugaaguaguug

SEQ ID NO: 656483 - RNA, 64 nt, Homo Sapiens
aaauuauuugguguggccauaaauuaucuaaggaaaaaaacagagauaaaguauuacugauaaa

SEQ ID NO: 656484 - RNA, 64 nt, Homo Sapiens
ugcccauuuguuggcuguuuaaucuucaguguuaaaaaaacagaacuuuuaaaaagugucugua

SEQ ID NO: 656485 - RNA, 64 nt, Homo Sapiens
acaaaacaaaacaaccaaacaguccugugaggcaaaaaaacaaauuucuuaagacuauuucaca

SEQ ID NO: 656486 - RNA, 64 nt, Homo Sapiens
caugaugaagcuuuugaauaaacuggguucuggaaaaaaacaaauuaacuuuguccuauuuguc

SEQ ID NO: 656487 - RNA, 64 nt, Homo Sapiens
accacuuauauugcuagcuagucugucucaaaacaaaaaacaaagggcaacagagcaagacccu

SEQ ID NO: 656488 - RNA, 64 nt, Homo Sapiens
acaaaacaaaacacaguccuguguaaggcuugcuaaaaaacaaauauugcauacaaaagaaaau

SEQ ID NO: 656489 - RNA, 64 nt, Homo Sapiens
aauuuggaaaaacccaugaacuugaaaaacuaaaaaaaaacaauuguauuaauauaugcauuca

SEQ ID NO: 656490 - RNA, 64 nt, Homo Sapiens
agacauugcuaaaagaguuaaaguuaugugaggaaaaaaacagauauauaauaaugaaaugacu

SEQ ID NO: 656491 - RNA, 64 nt, Homo Sapiens
gggaaaggguugguuaggcaaaaaaaaaaaaaaaaaaaaacaagauugaagauaaagcaaaagu

SEQ ID NO: 656492 - RNA, 64 nt, Homo Sapiens
aaaauuagcugggcauugugagccccaucucuacaaaaaacacacagcuugggcaacauggcaa

SEQ ID NO: 656493 - RNA, 64 nt, Homo Sapiens
uuaaaaacugaauguacugaucuguuugugaagaaaaaaacaagucuacuauuguaagaguucu

SEQ ID NO: 656494 - RNA, 64 nt, Homo Sapiens
cauucagccaaccacuuauagaaggagugguagaaaaaaacacaggauguucuugaacauuuca

SEQ ID NO: 656495 - RNA, 64 nt, Homo Sapiens
aaaaaaacccccaaaccugaaaaaaaacaaaacaaaaaaacaccacagagcgagacucugucuc

SEQ ID NO: 656496 - RNA, 64 nt, Homo Sapiens
acaaaaaaacaccaaaaaaagagacucugucucaaaaaaacaaauccagccugggugacagagc

SEQ ID NO: 656497 - RNA, 64 nt, Homo Sapiens
uuuaauugaauugaaaauaucccuuaggaaaaaaaaaaaacacacaaaaaaccacaagagcccc

SEQ ID NO: 656498 - RNA, 64 nt, Homo Sapiens
aguuuaaaaaagaaaauauguaauauaauguaaaaaaaaacaaaaaaaagcuuuuaugauggau

SEQ ID NO: 656499 - RNA, 64 nt, Homo Sapiens
auucaaacgcaacucaaaucugugcuggacuuuaaaaaaacaauucaggaccaaauuuuuucuc

SEQ ID NO: 656500 - RNA, 64 nt, Homo Sapiens
uuuuuauauuuaaauguagacuuuugacacuuuuaaaaaacaaaaaaagacaagagagaugaaa

SEQ ID NO: 656501 - RNA, 64 nt, Homo Sapiens
agaguuuuuacagcucaucauucaaauaacgcacaaaaaacaaaagccgcuaugaccggcguug

SEQ ID NO: 656502 - RNA, 64 nt, Homo Sapiens
aaauuagccacguaacaagagucuauuugccuugaaaaaacaauuauccuugaacuuccuccag

SEQ ID NO: 656503 - RNA, 64 nt, Homo Sapiens
acaaauggaauccugugcugaacccgaaucuuccaaaaaacagccuacaaucugugaccaccac

SEQ ID NO: 656504 - RNA, 64 nt, Homo Sapiens
uugcucuuguccugagaaauaacagugcuguuuuaaaaaacauuugaaauaaauaccgcacaca

SEQ ID NO: 656505 - RNA, 64 nt, Homo Sapiens
agauuauuaaaccuuuguucugggauuuacuguuaaaaaacaaacaaaaaacaacaaaaaagcg

SEQ ID NO: 656506 - RNA, 64 nt, Homo Sapiens
ccuuuguucugggauuuacuguuaaaaaacaaacaaaaaacaacaaaaaagcggugacaggaaa

SEQ ID NO: 656507 - RNA, 64 nt, Homo Sapiens
aauugucuugguuucuugauucauuuauuugagaaaaaaacaauacaaagaaaugcauucauau

SEQ ID NO: 656508 - RNA, 64 nt, Homo Sapiens
accaucugcaaccauaugcuauuaauaaaauggaaaaaaacaaaauggucauuuugcauauacu

SEQ ID NO: 656509 - RNA, 64 nt, Homo Sapiens
aaaaaacccugagaccaugauguaaaaaaaaaaaaaaaaacaaaugugcuaaggguuuauuuua

SEQ ID NO: 656510 - RNA, 64 nt, Homo Sapiens
agucccaauuaagaaccucccgaaauucugucuaaaaaaacaaauccagccuggacaacaagag

SEQ ID NO: 656511 - RNA, 64 nt, Homo Sapiens
aauagagcucuaaguuauguaaaaaaauuaaaaaaaaaaacagaaacaaaaaacaaacaacaaa

SEQ ID NO: 656512 - RNA, 64 nt, Homo Sapiens
caacaaaaaaaaaauuaaaauaaaaacaaacaacaaaaaacaaaccaaagaaguccugcuaugu

SEQ ID NO: 656513 - RNA, 64 nt, Homo Sapiens
aagcaaguuguacugcuagauaagaaauaaaaacaaaaaacaagacaaaaaacaaccuuagcau

SEQ ID NO: 656514 - RNA, 64 nt, Homo Sapiens
cuuagcauuaagaaauaaaaacaaacaaacaaacaaaaaacaacgaagccuuaauacucuguaa

SEQ ID NO: 656515 - RNA, 64 nt, Homo Sapiens
aacccauggaagcaacaaaauacucaaaaaaacaaaaaaacaaacugaauuguuuuaauaucuu

SEQ ID NO: 656516 - RNA, 64 nt, Homo Sapiens
aaaacaaaaacccauggaagaauaucuuuacucaaaaaaacaaauuuggcaucugaauuguuuu

SEQ ID NO: 656517 - RNA, 64 nt, Homo Sapiens
cugucccuuggaaccuuuguacgcuuugcucaaaaaaaaacaaaaaaaaaaaacaaaaaaaaaa

SEQ ID NO: 656518 - RNA, 64 nt, Homo Sapiens
ccuuuguacgcuuugcucaaaaaaaaacaaaaaaaaaaaacaaaaaaaaaaaacaacgguggag

SEQ ID NO: 656519 - RNA, 64 nt, Homo Sapiens
ugcucaaaaaaaaacaaaaaaaaaaaacaaaaaaaaaaaacaacgguggagccuucgcacucaa

SEQ ID NO: 656520 - RNA, 64 nt, Homo Sapiens
cauuggugacagggucugacauggucagucuacuaaaaaacaaaaaaaaaaaacaaaaaaaaaa

SEQ ID NO: 656521 - RNA, 64 nt, Homo Sapiens
gucugacauggucagucuacuaaaaaacaaaaaaaaaaaacaaaaaaaaaaaaacaaaagaaaa

SEQ ID NO: 656522 - RNA, 64 nt, Homo Sapiens
gucuacuaaaaaacaaaaaaaaaaaacaaaaaaaaaaaaacaaaagaaaaaaauaaaaauacgg

SEQ ID NO: 656523 - RNA, 64 nt, Homo Sapiens
ccaggauuaaguugucaucauucugggaagaaaaaaaaaacauuaaugaagaggccaauaauau

SEQ ID NO: 656524 - RNA, 64 nt, Homo Sapiens
auagcaugacuguuuuuugaauagguuggaauugaaaaaacaauuaucaaacguuaagaacaaa

SEQ ID NO: 656525 - RNA, 64 nt, Homo Sapiens
uacaacaaagcaccuuuaaaaaaaauacauuuuaaaaaaacauuccaagccaauuggaagacau

SEQ ID NO: 656526 - RNA, 64 nt, Homo Sapiens
uccagccugggcgacagagcaggacucucucucaaaaaaacacaaaaaaacaaaaacaaaaaac

SEQ ID NO: 656527 - RNA, 64 nt, Homo Sapiens
gcgacagagcaggacucucucucaaaaaaacacaaaaaaacaaaaacaaaaaaccauacacaca

SEQ ID NO: 656528 - RNA, 64 nt, Homo Sapiens
agaguuauccacuguauuuauaaggaagagucggaaaaaacaaugaccuuaguuuuuuuuaagc

SEQ ID NO: 656529 - RNA, 64 nt, Homo Sapiens
auuuuauuucagauaaaagucaggaguuacugcuaaaaaacagacauguaggagacauucaaca

SEQ ID NO: 656530 - RNA, 64 nt, Homo Sapiens
cagacuuugugaaugguucagauauuuuuucauuaaaaaacaagguauggcagauggacuuuuc

SEQ ID NO: 656531 - RNA, 64 nt, Homo Sapiens
guauauucuaaauaaagucaucuaacuauuaaaaaaaaaacacccuuccuaacccuucuuuucu

SEQ ID NO: 656532 - RNA, 64 nt, Homo Sapiens
aguaaauuaaaaacaaaaccaaaaaaaaaacaaaaaaaaacaaauagaaauuaaaaacaaaaca

SEQ ID NO: 656533 - RNA, 64 nt, Homo Sapiens
aaaaaacaaaaguaaauuaaaaacaaaacaaaaaaaaaaacaaaaccagaaaaauagaaauuaa

SEQ ID NO: 656534 - RNA, 64 nt, Homo Sapiens
augacgacgacaaccacaaaaaaaaaaaaaaaaaaaaaaacaaggugauuuguuaaaaaaaaac

SEQ ID NO: 656535 - RNA, 64 nt, Homo Sapiens
aaaaaaaaaaaaaaaaacaaugugauuuguuaaaaaaaaacaaaugcagaaaaacaagaccaga

SEQ ID NO: 656536 - RNA, 64 nt, Homo Sapiens
acuaaggcacuucacuuagaaaccacaaaaaacaaaaaaacaaaacccccccaaaaaauaaaaa

SEQ ID NO: 656537 - RNA, 64 nt, Homo Sapiens
aaaacaaaacuaaggcacuuaauaaaaaaaccacaaaaaacaaacuccucccacccccccaaaa

SEQ ID NO: 656538 - RNA, 64 nt, Homo Sapiens
gaagcugccugcguaaaaagguuacaaaaaacaaaaaaaacagaugagauuucuaagcuugcag

SEQ ID NO: 656539 - RNA, 64 nt, Homo Sapiens
aaaaacagagaagcugccugagcuugcagguuacaaaaaacaaaagcacaaccugagauuucua

SEQ ID NO: 656540 - RNA, 64 nt, Homo Sapiens
uguauuuuuaagaauguuuacucuuaaauguuauaaaaaacaauuucagagcauuuuuaccucu

SEQ ID NO: 656541 - RNA, 64 nt, Homo Sapiens
uuaauccuuguaucauacuucaaauaacugaaauaaaaaacaugaucaaguucauuugcagaaa

SEQ ID NO: 656542 - RNA, 64 nt, Homo Sapiens
uguagcuguuauuuucaguaucauuauguuuaucaaaaaacaacaugcauugcuuaaugguuuc

SEQ ID NO: 656543 - RNA, 64 nt, Homo Sapiens
aauuucuaauggauuuaucaguggaaagcugauuaaaaaacaaaauggcugccaaaaccauuaa

SEQ ID NO: 656544 - RNA, 64 nt, Homo Sapiens
cagacacucaaauuccacaaacaaacaauuaaaaaaaaaacauagcuuaucaacuccccuccaa

SEQ ID NO: 656545 - RNA, 64 nt, Homo Sapiens
uuuuucuaagcauuucucauaaaagcauacauauaaaaaacaguaaaaauuaggaaaucaaaag

SEQ ID NO: 656546 - RNA, 64 nt, Homo Sapiens
acuugauugggauccaaaaugucuccaaaaaaaaaaaaaacaaagggcgacaaaucaagacccc

SEQ ID NO: 656547 - RNA, 64 nt, Homo Sapiens
uagcauuggacaucuuaauauaugaaaaaacaucaaaaaacaauaugcucuguaugucacuaca

SEQ ID NO: 656548 - RNA, 64 nt, Homo Sapiens
aaaaaacaauuagcauuggaugucacuacauaugaaaaaacaucucagugcuaaaugcucugua

SEQ ID NO: 656549 - RNA, 64 nt, Homo Sapiens
ccaucagugauuggggaaucaaacauuuugguuuaaaaaacaugauuauuuaaaacuggaaacu

SEQ ID NO: 656550 - RNA, 64 nt, Homo Sapiens
cuuguaauggcaccucaaauuuuauacucuuaaaaaaaaacaauaauuugugaauuaccaccaa

SEQ ID NO: 656551 - RNA, 64 nt, Homo Sapiens
gccugaguagcauagcaagacccugucucuacaaaaaaaacaaaaauuagcugggcaugguggc

SEQ ID NO: 656552 - RNA, 64 nt, Homo Sapiens
caccugcacuuagaggaaauuugaacaaguuggaaaaaaacaauuuuuguuucaauucuaagaa

SEQ ID NO: 656553 - RNA, 64 nt, Homo Sapiens
caugguaauuuuugguuguuuugguuguuuucuuaaaaaacaaguuaaaaccugacgauuucug

SEQ ID NO: 656554 - RNA, 64 nt, Homo Sapiens
guaaccacugucuugauggcaaaauaauuaugguaaaaaacaagucucguguuuauuauuccuu

SEQ ID NO: 656555 - RNA, 64 nt, Homo Sapiens
cuaacuaacuaacuguguaacuaauuuuucuauaaaaaaacaaacuauguguaaauguagaacc

SEQ ID NO: 656556 - RNA, 64 nt, Homo Sapiens
acgagagaaucggcuuaaaggcagcaccaggcugaaaaaacagaguguaugaagcauucgucca

SEQ ID NO: 656557 - RNA, 64 nt, Homo Sapiens
aaaacguguaauaaaguuagaagacaaaaaaaacaaaaaacaaacuaccaacaauaagcuagaa

SEQ ID NO: 656558 - RNA, 64 nt, Homo Sapiens
aaacaaaaaaacguguaauagcuagaaaagacaaaaaaaacaaauguuuuucuaccaacaauaa

SEQ ID NO: 656559 - RNA, 64 nt, Homo Sapiens
uuucuaaggacugaagauuguuuuuuuuuuaacaaaaaaacacuauaguuaucccccccuuuuu

SEQ ID NO: 656560 - RNA, 64 nt, Homo Sapiens
aaaaaauaguaaaauauaaauugauuuaaaaacaaaaaaacacaugcuaguccuagauuacuua

SEQ ID NO: 656561 - RNA, 64 nt, Homo Sapiens
gcaaaauauaaaauaaauaauaaauauuauggaaaaaaaacauuuaucuaaacaucgaaaaacu

SEQ ID NO: 656562 - RNA, 64 nt, Homo Sapiens
acuuucuaggagcuauaaauguagagugacuauuaaaaaacauacaaagcuaggccugauuaga

SEQ ID NO: 656563 - RNA, 64 nt, Homo Sapiens
caaacacuucuuuccaucagucuuugacaagaaaaaaaaacaaaauuuaaaacuaugguguaag

SEQ ID NO: 656564 - RNA, 64 nt, Homo Sapiens
aaagcugcaugucuaaaauuaaacaaaaacaaaaaaaaaacacauuuuuucaaaaaaaaaaaaa

SEQ ID NO: 656565 - RNA, 64 nt, Homo Sapiens
aacaaaaaaaaaacacaaaauuucaaaaaaaaaaaaaaaacaaaucucaaaauaaacugguuuu

SEQ ID NO: 656566 - RNA, 64 nt, Homo Sapiens
gaaaugauuucaaguacccuguauucuggaugcuaaaaaacaaaaacaaacaaaaaaacaaaaa

SEQ ID NO: 656567 - RNA, 64 nt, Homo Sapiens
cuguauucuggaugcuaaaaaacaaaaacaaacaaaaaaacaaaaacaaaaaaacaaaaccaga

SEQ ID NO: 656568 - RNA, 64 nt, Homo Sapiens
cuaaaaaacaaaaacaaacaaaaaaacaaaaacaaaaaaacaaaaccagaaucagguaaaacag

SEQ ID NO: 656569 - RNA, 64 nt, Homo Sapiens
uuuuucaagaccuaacugcagccgcuuugggaaaaaaaaacaaaaaacaaaaaacagaaaacaa

SEQ ID NO: 656570 - RNA, 64 nt, Homo Sapiens
agaccuaacugcagccgcuuugggaaaaaaaaacaaaaaacaaaaaacagaaaacaaaaaaaaa

SEQ ID NO: 656571 - RNA, 63 nt, Homo Sapiens
acugcagccgcuuugggaaaaaaaaacaaaaaacaaaaaacagaaaacaaaaaaaaaaaaacu

SEQ ID NO: 656572 - RNA, 64 nt, Homo Sapiens
uuucucuguauauuuaugaccagagcaaaaauguaaaaaacaaaaaaaacaacaaaaaaaguuu

SEQ ID NO: 656573 - RNA, 64 nt, Homo Sapiens
auauuuaugaccagagcaaaaauguaaaaaacaaaaaaaacaacaaaaaaaguuuguuacuuug

SEQ ID NO: 656574 - RNA, 64 nt, Homo Sapiens
aaagggaccacauuuuucaaguauuucuaaguauaaaaaacaaaacaaaaaucucuuaggaaau

SEQ ID NO: 656575 - RNA, 64 nt, Homo Sapiens
uuuccuugacaaaauuuaagcugagcuuaaaagcaaaaaacaaaaaguacacagaaauauuuau

SEQ ID NO: 656576 - RNA, 64 nt, Homo Sapiens
uggugauucuuucaagugccaaaaccgcuuuuuaaaaaaacacugccaauuuguuggccaccag

SEQ ID NO: 656577 - RNA, 64 nt, Homo Sapiens
gucuuguuuuuacuaccuguuuuuuaaaaaaagaaaaaaacauguauguuagcauuaaugcaca

SEQ ID NO: 656578 - RNA, 64 nt, Homo Sapiens
agucaagugauuuauuauauaagaguugauguuaaaaaaacaaauauugcaaucgaaaugaaag

SEQ ID NO: 656579 - RNA, 64 nt, Homo Sapiens
guaacagucauaguucaccuugaucauuauaaagaaaaaacaagcaugccaacacuucuguaau

SEQ ID NO: 656580 - RNA, 64 nt, Homo Sapiens
uauacugcuguaucaugccacucaaaaaaaacaaaaaaaacauaggacagagcaagacucuugu

SEQ ID NO: 656581 - RNA, 64 nt, Homo Sapiens
aaaaacauauauacugcugugacucuugucucaaaaaaaacaaaccagccuggggacagagcaa

SEQ ID NO: 656582 - RNA, 64 nt, Homo Sapiens
cccaaagguaggaaggucaaggucaugaauagaaaaaaaacaaaugggauuggaagaaacacgu

SEQ ID NO: 656583 - RNA, 64 nt, Homo Sapiens
uuagaaacggacagcuuauacccaagugcaaaagaaaaaacauugaauuggaaaggaaaagagg

SEQ ID NO: 656584 - RNA, 64 nt, Homo Sapiens
uauguguuuuguauaaaucccuaauauuuaaaaaaaaaaacaaaacaaaaaaagguuacaaagu

SEQ ID NO: 656585 - RNA, 64 nt, Homo Sapiens
ccugggauggaaaggacuagccucuacugaugcaaaaaaacaaaaagcaacacaaacguuuccu

SEQ ID NO: 656586 - RNA, 64 nt, Homo Sapiens
aguucucacaguauagaagagaacuuaaagagggaaaaaacaauaugaagauagggaaugcagg

SEQ ID NO: 656587 - RNA, 64 nt, Homo Sapiens
acugcacuccagccugagugacagagagagauucaaaaaacaaaaaaaaagcaaaaauauacuu

SEQ ID NO: 656588 - RNA, 64 nt, Homo Sapiens
gaggccaguacaaccuugauaacaaaaccuaaaaaaaaaacaacaaaaaaacccauaaagcuau

SEQ ID NO: 656589 - RNA, 64 nt, Homo Sapiens
ucucauagauuuagaugcaaaauccuaaaauugaaaaaaacaucuagccauauccauaaacuau

SEQ ID NO: 656590 - RNA, 64 nt, Homo Sapiens
uauuugaacuagcuucuugucuuaggccugaaccaaaaaacaacaaacaaacaaaaaacaagaa

SEQ ID NO: 656591 - RNA, 64 nt, Homo Sapiens
gucuuaggccugaaccaaaaaacaacaaacaaacaaaaaacaagaaugaaaaacagaaauaaaa

SEQ ID NO: 656592 - RNA, 64 nt, Homo Sapiens
cuguuuccucuuagcuuucuagacuucuuaacagaaaaaacaguuuggguucaauagcauuuua

SEQ ID NO: 656593 - RNA, 64 nt, Homo Sapiens
cuucuauuauuuguuuugguuagaaagugaauuuaaaaaacaaaccaaacucuaaacuuucuca

SEQ ID NO: 656594 - RNA, 64 nt, Homo Sapiens
gauggaacuucaggucuuaagugcaaaucaaagcaaaaaacaaacaaaacuuacauggaaaaac

SEQ ID NO: 656595 - RNA, 64 nt, Homo Sapiens
accuacaaagaguuaaaacaaacagacaaacaaaaaaaaacacuacuauuuuaaauaguggaac

SEQ ID NO: 656596 - RNA, 64 nt, Homo Sapiens
aaccaaucgguaaucugaucaagagaaaaaaaacaaaaaacagaccagcaguggccugaagagg

SEQ ID NO: 656597 - RNA, 62 nt, Homo Sapiens
aaacagaaaccaaucgguaaagaggaagagaaaaaaaacaaacaucuccagcaguggccuga

SEQ ID NO: 656598 - RNA, 64 nt, Homo Sapiens
auuaaacaacaugaaacugcgucaaguuaaaaaaaaaaaacaauuucuucaggggaagacugug

SEQ ID NO: 656599 - RNA, 64 nt, Homo Sapiens
aaaacgaaagcaucuucacaucaugacugaaaacaaaaaacaaaacaacucauucuucagugcc

SEQ ID NO: 656600 - RNA, 64 nt, Homo Sapiens
aaacuguugucuaauauaucagagaaucuaaaaaaaaaaacaaagggugcuuauucuuuaacaa

SEQ ID NO: 656601 - RNA, 64 nt, Homo Sapiens
uuauauuuuauauacacauauauaaacacuacuaaaaaaacagugcuucaggaauacugcucgu

SEQ ID NO: 656602 - RNA, 64 nt, Homo Sapiens
agaggcccccaucagggaccagacuguuccaaaaaaaaaacaaaaaacaaaaacaaacaaaaaa

SEQ ID NO: 656603 - RNA, 64 nt, Homo Sapiens
cccaucagggaccagacuguuccaaaaaaaaaacaaaaaacaaaaacaaacaaaaaaacacuua

SEQ ID NO: 656604 - RNA, 64 nt, Homo Sapiens
guuccaaaaaaaaaacaaaaaacaaaaacaaacaaaaaaacacuuaaaagcccaaggaguaagc

SEQ ID NO: 656605 - RNA, 64 nt, Homo Sapiens
cauauuagugacuugaaucuucauaaguuaaaguaaaaaacagcaaaaaaccuagaucuuuguc

SEQ ID NO: 656606 - RNA, 64 nt, Homo Sapiens
aggcuaaaaccacaaaguggcucaggcuuuaaaaaaaaaacacuguggauaaugacaaaaagca

SEQ ID NO: 656607 - RNA, 64 nt, Homo Sapiens
auuuauuguauuuuaguauaucaccauguaaaacaaaaaacaaucucuaugguaaagauauuau

SEQ ID NO: 656608 - RNA, 64 nt, Homo Sapiens
cacacacacaacaaaaauuuuucagaaaacagaaaaaaaacacauugauaauaaacuguccucu

SEQ ID NO: 656609 - RNA, 64 nt, Homo Sapiens
aaagaaaagaaauuuauuuaaaagugucuuuacaaaaaaacaaagcuaaaucuacuguuucaaa

SEQ ID NO: 656610 - RNA, 64 nt, Homo Sapiens
caaucaaaaaaaaagacaguauuuacagaguuacaaaaaacaaaaagagacucaaaucuaaaac

SEQ ID NO: 656611 - RNA, 64 nt, Homo Sapiens
guugugaaaacaugccuccugcuaauuuuauuuuaaaaaacaaaaaauauuuuuuggaagagcu

SEQ ID NO: 656612 - RNA, 64 nt, Homo Sapiens
gaggauuaugugugacugggcucuugaacagagcaaaaaacaaggcaccuuugcaugaugauga

SEQ ID NO: 656613 - RNA, 64 nt, Homo Sapiens
auuaaaaaaaauugauuuccggggggaaaaaagcaaaaaacaaaaucaggaggcaucuggaaag

SEQ ID NO: 656614 - RNA, 64 nt, Homo Sapiens
aucgcucccaaaggaaagagugggcugaguagauaaaaaacaucucccaaguaaaaauuucuuc

SEQ ID NO: 656615 - RNA, 64 nt, Homo Sapiens
cccaaguaaaaauuucuucuaauacauguauuuaaaaaaacaauugcaguucauccgcacugua

SEQ ID NO: 656616 - RNA, 64 nt, Homo Sapiens
agcuaaauuuuucaguuccaugugccucccaaauaaaaaacagaaaauaaguaguuuuugugaa

SEQ ID NO: 656617 - RNA, 64 nt, Homo Sapiens
aauaaaaauggaaaaaaugaucauggcuuuaaaaaaaaaacaaaaacacacacacaugaacuca

SEQ ID NO: 656618 - RNA, 64 nt, Homo Sapiens
gccuggguggcaaagugagacucuggcucaaaaaaaaaaacaaaaaacaaaaccaucugcccuc

SEQ ID NO: 656619 - RNA, 64 nt, Homo Sapiens
uggcaaagugagacucuggcucaaaaaaaaaaacaaaaaacaaaaccaucugcccuccuccccu

SEQ ID NO: 656620 - RNA, 64 nt, Homo Sapiens
ugaccaguuguugauaaccaggaaaaaaaaaaacaaaaaacaacucgaauccagagagcagugu

SEQ ID NO: 656621 - RNA, 64 nt, Homo Sapiens
aaacaacugaccaguuguuggcaguguggaaaaaaaaaaacaaaacuagguucgaauccagaga

SEQ ID NO: 656622 - RNA, 64 nt, Homo Sapiens
uccaaacugauauauccuauaaaacaacaacaacaaaaaacaagugaacuucaaaacaaaacaa

SEQ ID NO: 656623 - RNA, 64 nt, Homo Sapiens
aacaacaaaaaacaaguccacuucaaaacaaaacaaaaaacaacguaaaaaaaagugcacugaa

SEQ ID NO: 656624 - RNA, 64 nt, Homo Sapiens
acacacguacauuagguccuguuauuuaaaaaacaaaaaacaaacuggccauguuauaaauauu

SEQ ID NO: 656625 - RNA, 64 nt, Homo Sapiens
aaacaaaacacacguacauuaaauauuguuauuuaaaaaacaaaagagucacuggccauguuau

SEQ ID NO: 656626 - RNA, 64 nt, Homo Sapiens
uucuaaauacuagagauaacaaacaaaaaaacacaaaaaacacaccuucuuaaaaucaaaaaca

SEQ ID NO: 656627 - RNA, 64 nt, Homo Sapiens
aaaaacacauucuaaauacuucaaaaacaaaacaaaaaaacacaaaaagaauuccuucuuaaaa

SEQ ID NO: 656628 - RNA, 64 nt, Homo Sapiens
gacuucuuuauaucuuuugaaaacaaacaaacaaaaaaaacauauaaaacagacuccuuuaaaa

SEQ ID NO: 656629 - RNA, 64 nt, Homo Sapiens
caaacaaaaaaaacauagacaacagacuccuuuaaaaaaacaaaaggauaauaggcaauuuuaa

SEQ ID NO: 656630 - RNA, 64 nt, Homo Sapiens
ucaccaugagugcuacauguaaacaaacaaacaaaaaaaacaccucucaaaaaaaaaaaaacaa

SEQ ID NO: 656631 - RNA, 64 nt, Homo Sapiens
aacaaacaaacaaaaaaaaccugucucaaaaaaaaaaaaacaaauugggcaacagaguaagacu

SEQ ID NO: 656632 - RNA, 64 nt, Homo Sapiens
acaacaaugaccaccauuguauagucucacagguaaaaaacauauugaauuuaguuugucuaaa

SEQ ID NO: 656633 - RNA, 64 nt, Homo Sapiens
agcagugguguucuaaugaaaacaaaacaaaacaaaaaaacauguuguuuaaaaaaacgaaaaa

SEQ ID NO: 656634 - RNA, 64 nt, Homo Sapiens
acaaaacaaaaaaacaugagguuuaaaaaaacgaaaaaaacaaaauagauaacacuaaugcuuu

SEQ ID NO: 656635 - RNA, 64 nt, Homo Sapiens
gccagccccaaccuuccaaaaaaauuuuuuuugaaaaaaacaagaaauauucuuccugauuaaa

SEQ ID NO: 656636 - RNA, 64 nt, Homo Sapiens
cacaaaaagaugagucccacugucucaaaacuuaaaaaaacaaaaaaaugugacuuucuuguuu

SEQ ID NO: 656637 - RNA, 64 nt, Homo Sapiens
aguagcugugguggauauuauuauuugaagaaagaaaaaacagauuuuaggguggaaaaaacag

SEQ ID NO: 656638 - RNA, 64 nt, Homo Sapiens
uauuugaagaaagaaaaaacagauuuuaggguggaaaaaacagucaacucacacaaagaaugga

SEQ ID NO: 656639 - RNA, 64 nt, Homo Sapiens
auacaguaccuacauaguuuuuaaauuauuguuuaaaaaacaaaacagcuguuauaaaugaaua

SEQ ID NO: 656640 - RNA, 64 nt, Homo Sapiens
uaugaugaauaaaucuuaaaugcuuuguuuaauuaaaaaacaaaaaucaccaauauccaagaca

SEQ ID NO: 656641 - RNA, 64 nt, Homo Sapiens
aaauuuaaaaaaaagguuuguaaaaaaaacaaaaaaaaaacaaaguucaccaucaauuuaaaag

SEQ ID NO: 656642 - RNA, 64 nt, Homo Sapiens
aaaaaaacaaaaaauuuaaacaauuuaaaaguaaaaaaaacaaauuaaugccacgguucaccau

SEQ ID NO: 656643 - RNA, 64 nt, Homo Sapiens
uaccagguucuguguguuuggguuaaaaaaaaaaaaaaaacaggaaaaagguguagacaauggu

SEQ ID NO: 656644 - RNA, 64 nt, Homo Sapiens
uaaaauaacuugacaugagcauuggguagacaguaaaaaacaaggugaagaaaauucauuuuac

SEQ ID NO: 656645 - RNA, 64 nt, Homo Sapiens
agucaucagagauacuuuccuaaaaaggaaaaauaaaaaacaaaauggugccacuuuggguuga

SEQ ID NO: 656646 - RNA, 64 nt, Homo Sapiens
ggcuugaauucauuuauaugucuuuugauucuuaaaaaaacaaaaaacauuccauuagaagcac

SEQ ID NO: 656647 - RNA, 64 nt, Homo Sapiens
auucauuuauaugucuuuugauucuuaaaaaaacaaaaaacauuccauuagaagcaccaguuuu

SEQ ID NO: 656648 - RNA, 64 nt, Homo Sapiens
ugacuguaaccauguuuuuucuguuuaauuauguaaaaaacaaaacuacaacaacaaaaaaaga

SEQ ID NO: 656649 - RNA, 64 nt, Homo Sapiens
uacaacaacaaaaaaagaaaaaaguuaaaaaagaaaaaaacaccaaaaaacaaaaacaaacaaa

SEQ ID NO: 656650 - RNA, 64 nt, Homo Sapiens
aaaaaagaaaaaaguuaaaaaagaaaaaaacaccaaaaaacaaaaacaaacaaaaaaaaaaacc

SEQ ID NO: 656651 - RNA, 64 nt, Homo Sapiens
uugcauuaacuauuucaaaaauuacugccuuuaaaaaaaacaaccucaagcuauauuuguauuc

SEQ ID NO: 656652 - RNA, 64 nt, Homo Sapiens
gaugauguauuucuccauugaaaacacaauaaaaaaaaaacagcacaaucucacaguugccuga

SEQ ID NO: 656653 - RNA, 64 nt, Homo Sapiens
caccuguuucacugugaauaaaaaaaaaagaaaaaaaaaacauggaaaaaacaaaacaaaaaaa

SEQ ID NO: 656654 - RNA, 64 nt, Homo Sapiens
acaaaaaaaaaaaaaaaagaaccucagaacucugaaaaaacaaagugcuguggcucagucagca

SEQ ID NO: 656655 - RNA, 64 nt, Homo Sapiens
aucuagggcuguauuuuauaagaaaaaaaaacaaaaaaaacaaacaucgugaccaaauuguuua

SEQ ID NO: 656656 - RNA, 64 nt, Homo Sapiens
aaaaacaaaaucuagggcugaauuguuuaagaaaaaaaaacaaaucaaaggugcaucgugacca

SEQ ID NO: 656657 - RNA, 64 nt, Homo Sapiens
cauguuacaguguuuuuuguauguagccucugggaaaaaacaaaaaguauuccagcaaaagagg

SEQ ID NO: 656658 - RNA, 64 nt, Homo Sapiens
auaaggacuucaauccaaagucucuaaguaaaggaaaaaacaaaagcagcacuguauauaccug

SEQ ID NO: 656659 - RNA, 64 nt, Homo Sapiens
aucaugaaaggcaaaaaguacguggcuccuaaggaaaaaacagcaauugaaguucagagucacc

SEQ ID NO: 656660 - RNA, 64 nt, Homo Sapiens
agggcuucagucucauggauugcucucuaugggaaaaaaacaaacuugcugccuuuaauugucu

SEQ ID NO: 656661 - RNA, 64 nt, Homo Sapiens
uuuguauguuaaguccuauuauaaaauauugcaaaaaaaacacauauuuuuuuaauuuggcagg

SEQ ID NO: 656662 - RNA, 64 nt, Homo Sapiens
aacaaacaggcugccauaauaaauaaaaagaaaaaaaaaacaaacuuuuuguuagugaauuugg

SEQ ID NO: 656663 - RNA, 64 nt, Homo Sapiens
gaaagaagagagagaacuugaugcaaaguccacgaaaaaacaauuuuuuucaccucagguguca

SEQ ID NO: 656664 - RNA, 64 nt, Homo Sapiens
uuuuuucaccucaggugucaaaguaaauuuguuaaaaaaacaaaaaaaacacaaaaauuucaaa

SEQ ID NO: 656665 - RNA, 64 nt, Homo Sapiens
cucaggugucaaaguaaauuuguuaaaaaaacaaaaaaaacacaaaaauuucaaaaaacaccac

SEQ ID NO: 656666 - RNA, 64 nt, Homo Sapiens
uuuguuaaaaaaacaaaaaaaacacaaaaauuucaaaaaacaccacccaccaaauugcacaaua

SEQ ID NO: 656667 - RNA, 64 nt, Homo Sapiens
uaucugaagacacaaaccugacaggagggagaagaaaaaacaaaacacuugaaccaagaaacuc

SEQ ID NO: 656668 - RNA, 64 nt, Homo Sapiens
augcccagaagcuuuccuucauaaaauagaaagaaaaaaacauuuggcuuauuuuucacuguag

SEQ ID NO: 656669 - RNA, 64 nt, Homo Sapiens
gugaagcauuuuauuaaaagaauaauuauaauuaaaaaaacacgauacagaucagugcauauag

SEQ ID NO: 656670 - RNA, 64 nt, Homo Sapiens
accuaaaacuguucuaaaauagaaagucugugaaaaaaaacaaaaguaaaguuauaaaaggaaa

SEQ ID NO: 656671 - RNA, 64 nt, Homo Sapiens
guuaucccaauacauuauccgcuuuuuuauuuuaaaaaaacagaucaaucccugaccauguaag

SEQ ID NO: 656672 - RNA, 64 nt, Homo Sapiens
guccucaaauaauguucuuuucagaaugugucugaaaaaacauuugaagugaauuugaauauca

SEQ ID NO: 656673 - RNA, 64 nt, Homo Sapiens
uugaaugaagcacuuggaaaaaugcagaaggaaaaaaaaacauaguauagauaugaucagacaa

SEQ ID NO: 656674 - RNA, 64 nt, Homo Sapiens
aaaaaccucaugagugcaugaaaacaaaaaacaaaaaaaacaaaucuuccugcuaaaaagacaa

SEQ ID NO: 656675 - RNA, 64 nt, Homo Sapiens
aaaaacaaaaaaaaccucauaaaagacaaaaaacaaaaaacaaauucucccccucuuccugcua

SEQ ID NO: 656676 - RNA, 64 nt, Homo Sapiens
aaacaaaaaaaacaaaaaaaccugcuaaaaagacaaaaaacaaacauuauauucucccccucuu

SEQ ID NO: 656677 - RNA, 64 nt, Homo Sapiens
uccaaaaagauacacagaagacaguccagccaguaaaaaacacuguaccacucuauucacuggu

SEQ ID NO: 656678 - RNA, 64 nt, Homo Sapiens
acuuuacuuucuucugccccacaacuucuauuuuaaaaaacaagaucuauauagucuaaugcug

SEQ ID NO: 656679 - RNA, 64 nt, Homo Sapiens
cagauuuaauuugcuaaauagacuaacaggaggaaaaaaacaaacagccuagcuuuaaaaaaca

SEQ ID NO: 656680 - RNA, 64 nt, Homo Sapiens
cuaacaggaggaaaaaaacaaacagccuagcuuuaaaaaacagugaaauagcagugauuucaug

SEQ ID NO: 656681 - RNA, 64 nt, Homo Sapiens
uuuacuucaaaagcaugugcacucaagcaaaaacaaaaaacagcucagagguaccuggcaccuu

SEQ ID NO: 656682 - RNA, 64 nt, Homo Sapiens
ccccacucagaaacagagaauguacaauccaggaaaaaaacaaaccauuccaccugacccugug

SEQ ID NO: 656683 - RNA, 64 nt, Homo Sapiens
aaaaacuuuuuuuaaucguucuuuaaaaaaaacaaaaaaacaaagcucucuccucauccuaguu

SEQ ID NO: 656684 - RNA, 58 nt, Homo Sapiens; identical to SEQ ID NO: 422612

SEQ ID NO: 656685 - RNA, 64 nt, Homo Sapiens
aaccgcaggaguuugcgaaggauguuugccaaauaaaaaacagauucaugaugguaauaaacga

SEQ ID NO: 656686 - RNA, 64 nt, Homo Sapiens
aaaacuacaaacaaaagcagccaaacuuuugcagaaaaaacaaacgcagcuacuccccuuucuu

SEQ ID NO: 656687 - RNA, 64 nt, Homo Sapiens
agccugggcgauagagcuagacucugucucaaaaaaaaaacaaaaaacaaguaacucuuuauuc

SEQ ID NO: 656688 - RNA, 64 nt, Homo Sapiens
gcgauagagcuagacucugucucaaaaaaaaaacaaaaaacaaguaacucuuuauuccuugugu

SEQ ID NO: 656689 - RNA, 64 nt, Homo Sapiens
ccuucccuucugugugaccgaccccuuggccaaaaaaaaacaaaaagcaaaaaacaaaaaccua

SEQ ID NO: 656690 - RNA, 64 nt, Homo Sapiens
ugaccgaccccuuggccaaaaaaaaacaaaaagcaaaaaacaaaaaccuacccuguucugguuu

SEQ ID NO: 656691 - RNA, 64 nt, Homo Sapiens
cugcagggcuuaauacauuagugguaacugguuuaaaaaacaaagacuguaagccugugugugc

SEQ ID NO: 656692 - RNA, 64 nt, Homo Sapiens
aacauuuuugugcuauuguuuuaaaaaaauaauuaaaaaacaguuggcguuaauaaaaauguca

SEQ ID NO: 656693 - RNA, 64 nt, Homo Sapiens
augaaucauuaucagcaugaugaaaggugugucuaaaaaacaauucagaauaccagcagcauug

SEQ ID NO: 656694 - RNA, 64 nt, Homo Sapiens
auagucuugaauauuuuauuuuuuuaaugaaaagaaaaaacaagaaaguuauguuucauaauuu

SEQ ID NO: 656695 - RNA, 64 nt, Homo Sapiens
acaaaacaaaaacaacaacauaaaacuucaucucaaaaaacaaauccagccuggucaacaagag

SEQ ID NO: 656696 - RNA, 64 nt, Homo Sapiens
cccaaggguacagaagagcugguaaaaaaaaaaaaaaaaacaauucaaagucagacacacccau

SEQ ID NO: 656697 - RNA, 64 nt, Homo Sapiens
cccagaccccaccugaauuggaaaaggaaaaaacaaaaaacaaaguugaauugaguauauauuu

SEQ ID NO: 656698 - RNA, 64 nt, Homo Sapiens
aaacaaacccagaccccaccuauauuugaaaaggaaaaaacaaauacagagguugaauugagua

SEQ ID NO: 656699 - RNA, 64 nt, Homo Sapiens
aaaaaaacccuauuuaaaugaaaacaaaaaacaaaaaaaacaaagaauagggaaguaaaaaaac

SEQ ID NO: 656700 - RNA, 64 nt, Homo Sapiens
aaaaacaaaaaaaaaacccuuaaaaaaacaaaacaaaaaacaaaacucaaaucgaauagggaag

SEQ ID NO: 656701 - RNA, 64 nt, Homo Sapiens
acaaaaaacaaaaaaaacaacgaauagggaaguaaaaaaacaaacugaaucaggaaacucaaau

SEQ ID NO: 656702 - RNA, 64 nt, Homo Sapiens
caaaacaaaaacagaacaaaaaaacaaacaaaaaaaaaaacacaucccccaccccuuuuucuaa

SEQ ID NO: 656703 - RNA, 64 nt, Homo Sapiens
caaaaaaaaaaacacacaaaccaccccuuuuucuaaaaaacaaacugauuuuauuucuucuccc

SEQ ID NO: 656704 - RNA, 64 nt, Homo Sapiens
gcgauuucagcugauagaaaaacaaaaaugaaaaaaaaaacacaaaaaacaaaaaacauggcac

SEQ ID NO: 656705 - RNA, 64 nt, Homo Sapiens
gcugauagaaaaacaaaaaugaaaaaaaaaacacaaaaaacaaaaaacauggcacguugcuagu

SEQ ID NO: 656706 - RNA, 64 nt, Homo Sapiens
gaaaaacaaaaaugaaaaaaaaaacacaaaaaacaaaaaacauggcacguugcuaguuuacagg

SEQ ID NO: 656707 - RNA, 64 nt, Homo Sapiens
auuacaagggggaauaauauaacacuucucagugaaaaaacaaguauuuuuuuaugaaaaaaaa

SEQ ID NO: 656708 - RNA, 64 nt, Homo Sapiens
ucucagugaaaaaacaagauuuuuuuuaugaaaaaaaaaacacuuaaaauuaucauuugaaaua

SEQ ID NO: 656709 - RNA, 64 nt, Homo Sapiens
ugcaaaucaaguggacaagaaaaaauaacaaaacaaaaaacaagaaaaaaaaaacacaaaaccc

SEQ ID NO: 656710 - RNA, 64 nt, Homo Sapiens
acaagaaaaaauaacaaaacaaaaaacaagaaaaaaaaaacacaaaaccccguaaaaucacaaa

SEQ ID NO: 656711 - RNA, 64 nt, Homo Sapiens
aggagauguggggacguguuaggagagaaaaaaaaaaaaacaaaaauauauaugggggaaauua

SEQ ID NO: 656712 - RNA, 64 nt, Homo Sapiens
gggcugaaggaaacguucacauuuuagaguuuaaaaaaaacaccucgacauuuaaaaaaucaac

SEQ ID NO: 656713 - RNA, 64 nt, Homo Sapiens
gggugacggugagacuuugucucaaaaaaaaaaaaaaaaacaauggaaggcagacagcaagucc

SEQ ID NO: 656714 - RNA, 64 nt, Homo Sapiens
acaucacacaguguccuguagcuaagugucuaggaaaaaacaaaaacuccaaacccuucagugg

SEQ ID NO: 656715 - RNA, 64 nt, Homo Sapiens
cuauaacuuuucagcuggugcuuuuacuuagggaaaaaaacaauuuguaaauacagaacauugu

SEQ ID NO: 656716 - RNA, 64 nt, Homo Sapiens
auaaguuauggaagaaccgggacauuuuacagaaaaaaaacaaaaaacaacaaaaaauauacgu

SEQ ID NO: 656717 - RNA, 64 nt, Homo Sapiens
auggaagaaccgggacauuuuacagaaaaaaaacaaaaaacaacaaaaaauauacgugggaaaa

SEQ ID NO: 656718 - RNA, 64 nt, Homo Sapiens
auuuagcacugagaacuaguauuauaugguuuuuaaaaaacaauggugaaguacaugccacaua

SEQ ID NO: 656719 - RNA, 64 nt, Homo Sapiens
uaucuuguaaaaugaaacucuauaaccaccauuaaaaaaacaacucauucccacauucuucagu

SEQ ID NO: 656720 - RNA, 64 nt, Homo Sapiens
aacagaagaggaaaaaaaagucaaaaaagcgacaaaaaaacacaaggaacaaaaaagaaaaaaa

SEQ ID NO: 656721 - RNA, 64 nt, Homo Sapiens
aaaaaagacaaaaaaaaaaauugaacuugaaaaaaaaaaacacaagaauuuuuacuggggauuc

SEQ ID NO: 656722 - RNA, 64 nt, Homo Sapiens
aaaccacacacacauuuuguaaaaaacaaaaaacaaaaaacaaauuugcccccuuuuucuuguu

SEQ ID NO: 656723 - RNA, 64 nt, Homo Sapiens
aaacaaaaaaccacacacacucuuguuaaaaaacaaaaaacaaaccuggcuuuugcccccuuuu

SEQ ID NO: 656724 - RNA, 64 nt, Homo Sapiens
aaacaaaaaacaaaaaaccacccuuuuucuuguuaaaaaacaaaccccauuccuggcuuuugcc

SEQ ID NO: 656725 - RNA, 64 nt, Homo Sapiens
caaauguaagguuuguaacaaauucauacuggagaaaaaacauacacagcuugaaagacaggag

SEQ ID NO: 656726 - RNA, 64 nt, Homo Sapiens
ccuugcacgucaucauagaacaagguuuuuaaucaaaaaacaacuacaaguguaaugaaugugg

SEQ ID NO: 656727 - RNA, 64 nt, Homo Sapiens
uuugugaugccuuaggacauguuugaacugcagcaaaaaacaaaaacaaaaaacagugcauuag

SEQ ID NO: 656728 - RNA, 64 nt, Homo Sapiens
aggacauguuugaacugcagcaaaaaacaaaaacaaaaaacagugcauuagcaauuucauagca

SEQ ID NO: 656729 - RNA, 64 nt, Homo Sapiens
acuaaaagagagagaggaagcgagagagagagagaaaaaacaaaaaacagaaaacacgaaugcc

SEQ ID NO: 656730 - RNA, 64 nt, Homo Sapiens
gagagagaggaagcgagagagagagagaaaaaacaaaaaacagaaaacacgaaugccuuuucua

SEQ ID NO: 656731 - RNA, 64 nt, Homo Sapiens
aacauagcgagaccucaucuccaaaaaagaaaacaaaaaacaaaaaaaggaaugauguucugua

SEQ ID NO: 656732 - RNA, 64 nt, Homo Sapiens
uaugcacugauuuaaaacaaaccaaaaaaaaagaaaaaaacaaaaaaaaaaaucccuccuuucu

SEQ ID NO: 656733 - RNA, 64 nt, Homo Sapiens
cuggcuggucugucuuuucuccauuuguuuaaaaaaaaaacaaaaacaaaaaacaacacuuugg

SEQ ID NO: 656734 - RNA, 64 nt, Homo Sapiens
cuuuucuccauuuguuuaaaaaaaaaacaaaaacaaaaaacaacacuuugguguggugguaugg

SEQ ID NO: 656735 - RNA, 64 nt, Homo Sapiens
uuucacaaaaauaguccuuuucuaaagauguuuuaaaaaacacugguacauuuuugcacugaaa

SEQ ID NO: 656736 - RNA, 64 nt, Homo Sapiens
aaccaaaugugaccuugugcugucauguuaaaaaaaaaaacaggugcuguuaauagugugaaau

SEQ ID NO: 656737 - RNA, 64 nt, Homo Sapiens
acuacagagaggacguuucccuguuuagggaaagaaaaaacaucuucagaucauagguccuaaa

SEQ ID NO: 656738 - RNA, 64 nt, Homo Sapiens
aaggccagucugguuuaaguagucauuucugcugaaaaaacagaugauccugguggaagaaaag

SEQ ID NO: 656739 - RNA, 64 nt, Homo Sapiens
aagcgcugagcaccagcagcagaaaacaacaacaaaaaaacaccucguuuuuaccuugucuucu

SEQ ID NO: 656740 - RNA, 64 nt, Homo Sapiens
uccauguauuuauucaagugaauucauuuugaggaaaaaacaacaucucagucuuuauuugugu

SEQ ID NO: 656741 - RNA, 64 nt, Homo Sapiens
gcaauugucaaaaaaaguuauauuacaaguuuagaaaaaacaaaauuauuucuuuuguuacauc

SEQ ID NO: 656742 - RNA, 64 nt, Homo Sapiens
aaaaaaaccacucuucuccaaaaaacaaacaaacaaaaaacacaaauuagaauuauuuuucuca

SEQ ID NO: 656743 - RNA, 64 nt, Homo Sapiens
caaacaaaaaacacaaaaaagaauuauuuuucucaaaaaacaaauggaaaugaggcuucaauua

SEQ ID NO: 656744 - RNA, 64 nt, Homo Sapiens
ccaaaauaugcucuugcgccaccccuagucuaugaaaaaacaaaucuuaguagugcagaccuuu

SEQ ID NO: 656745 - RNA, 64 nt, Homo Sapiens
caaagauggguuucugaauaaaaaacaacaaaaaaaaaaacauacauaaggggaauuuuuuuua

SEQ ID NO: 656746 - RNA, 64 nt, Homo Sapiens
aaaaaaaaaaacauacaaagggggaauuuuuuuuaaaaaacaacuugaccaaaccaguucauaa

SEQ ID NO: 656747 - RNA, 62 nt, Homo Sapiens
auccuggggaggccaaauaagcccccacugcaaaaaaacaaaaaacagguuaagaaaauuac

SEQ ID NO: 656748 - RNA, 64 nt, Homo Sapiens
ggggaggccaaauaagcccccacugcaaaaaaacaaaaaacagguuaagaaaauuacuugggug

SEQ ID NO: 656749 - RNA, 64 nt, Homo Sapiens
uguucuuugccuaauaaagaaaaacaaaaaaacaaaaaaacaacaaggaaauguuaaaaaaaaa

SEQ ID NO: 656750 - RNA, 64 nt, Homo Sapiens
aaaacaacuguucuuugccuaaaaaaaaaaaacaaaaaaacaaacuuccuuaaaggaaauguua

SEQ ID NO: 656751 - RNA, 64 nt, Homo Sapiens
aaaacaaaaaaacaacuguuaaauguuaaaaaaaaaaaaacaaaugagccaccuuccuuaaagg

SEQ ID NO: 656752 - RNA, 64 nt, Homo Sapiens
guaagaaaauuacuugggugcacuccaaaaaaacaaaaaacaggggggaggccaaauaagcccu

SEQ ID NO: 656753 - RNA, 62 nt, Homo Sapiens
aaacaggguaagaaaauuacgcccucacuccaaaaaaacaaaguccuggggaggccaaauaa

SEQ ID NO: 656754 - RNA, 64 nt, Homo Sapiens
acaaguaaauuuuaaaaaaaacacaaaaaaagagaaaaaacauaaaaaacaaaaaaacacacac

SEQ ID NO: 656755 - RNA, 64 nt, Homo Sapiens
cacacacaaaaaaagagaaaaaaaacaaaaaacaaaaaaacacaacaaaaaacaaaaaaaacaa

SEQ ID NO: 656756 - RNA, 64 nt, Homo Sapiens
aaaacacacacacacaaaaaaaaaacaaaaaaacaaaaaacaaaaagcaaaaacaaaaaacaaa

SEQ ID NO: 656757 - RNA, 64 nt, Homo Sapiens
aaacaaaaaaacacacacacaaacaaaaaaaacaaaaaaacaaacuuccaaaagcaaaaacaaa

SEQ ID NO: 656758 - RNA, 64 nt, Homo Sapiens
aaaacaaaaaacaaaaaaacaaaacaaaaaacaaaaaaaacaaaugggagaccuuccaaaagca

SEQ ID NO: 656759 - RNA, 64 nt, Homo Sapiens
aaaaacaaaaaaacaaaaaaccaaaagcaaaaacaaaaaacaaaacccuccgcugggagaccuu

SEQ ID NO: 656760 - RNA, 64 nt, Homo Sapiens
aaaaaucaaaaaaucaaaaauuauuuaaaaaaacaaaaaacaaauagcuguuucacaaacaguu

SEQ ID NO: 656761 - RNA, 64 nt, Homo Sapiens
aaacaaaaaaaaucaaaaaaaacaguuuuauuuaaaaaaacaaagauaaaauagcuguuucaca

SEQ ID NO: 656762 - RNA, 64 nt, Homo Sapiens
caagaaaagaagaauaguuguuuaaauauuuuuuaaaaaacacuugaauaagaaucaguagggu

SEQ ID NO: 656763 - RNA, 64 nt, Homo Sapiens
auccuggcuaacacggugaaaccccgucucuacuaaaaaacagaaaauuagccgggcguggugg

SEQ ID NO: 656764 - RNA, 64 nt, Homo Sapiens
uuucaccuacuccuuucauguauccaaauaauuuaaaaaacacuacuucaggagagcuacuuuc

SEQ ID NO: 656765 - RNA, 64 nt, Homo Sapiens
caaauaguagaagcagcaaguagucauaaggagaaaaaaacacugacucuuucauacuacccuu

SEQ ID NO: 656766 - RNA, 64 nt, Homo Sapiens
gauacuucucccugagguggggauaaaagaaaaaaaaaaacaacuucuuuuuuucuuccgcaua

SEQ ID NO: 656767 - RNA, 64 nt, Homo Sapiens
cucuguuauugucggcaggcggugagggguagaaaaaaaacaaacaaacaaacagaaaaaaaaa

SEQ ID NO: 656768 - RNA, 64 nt, Homo Sapiens
gggagcucaaagucacaagaagaaaaaugaaaggaaaaaacagcagcccuauucagaaauuggu

SEQ ID NO: 656769 - RNA, 64 nt, Homo Sapiens
gaaaguuuaaagaaacuugaccaaaagacaguacaaaaaacacuggcacuugaauguugaaugu

SEQ ID NO: 656770 - RNA, 64 nt, Homo Sapiens
cggauacucccauuaaugagaaauaacacuaggaagccacuauuacaggaagaaaagauuuggu

SEQ ID NO: 656771 - RNA, 64 nt, Homo Sapiens
cauggcagucuguuuuuuuaaaaaaaaauuuuugagccacuaucuauuguugaauauuuuaaga

SEQ ID NO: 656772 - RNA, 64 nt, Homo Sapiens
caagucauuagugaaaguggcuaaggcaugcauuagccacuacaugcacucgcucccucucugg

SEQ ID NO: 656773 - RNA, 64 nt, Homo Sapiens
gaccaaggucucuucagugccuucucuaccccaaagccacuacuguaaaaauaaacaguguucu

SEQ ID NO: 656774 - RNA, 64 nt, Homo Sapiens
auggcuaauugaucauugauucuccuugucuauuagccacuagcuggagagauuauggagauaa

SEQ ID NO: 656775 - RNA, 64 nt, Homo Sapiens
gccaaugccuggcugcaggcuuugcuaaugguggagccacuaugaucaccguuaaacacugauc

SEQ ID NO: 656776 - RNA, 62 nt, Homo Sapiens
uucgaaguaguagauucucagaucuuuauucuaacaauuacaugauuugaaaacaguacuca

SEQ ID NO: 656777 - RNA, 62 nt, Homo Sapiens
uaaaaaauguuuuguaaauccagguguauuuuaacaauuaaaugccuauuuuguuauauguu

SEQ ID NO: 656778 - RNA, 62 nt, Homo Sapiens
uucauaagacuauuuuaaauagaaauuauuucaacaauuaaaguaauguugaccaucccccu

SEQ ID NO: 656779 - RNA, 62 nt, Homo Sapiens
uguuaaugaauauuuuugcaguuguaaagcauaacaauuacaacuacacaucuauuucuaaa

SEQ ID NO: 656780 - RNA, 62 nt, Homo Sapiens
gaucaguauuguaacguaugugaauagaugauaacaauuaauauuacuaaaagucccacaug

SEQ ID NO: 656781 - RNA, 62 nt, Homo Sapiens
ucucagagggcaacuuuauuuaauaacaauuaaacaauuauuacugucuuggaaaaaaaaua

SEQ ID NO: 656782 - RNA, 62 nt, Homo Sapiens
caauuauuucucagagggcaaaaaaauauaauaacaauuaaaagaugaagacugucuuggaa

SEQ ID NO: 656783 - RNA, 62 nt, Homo Sapiens
aaacaaguacuuuaguaucaggacaggaguugaacaauuagguuagcagauggagaugagag

SEQ ID NO: 656784 - RNA, 62 nt, Homo Sapiens
ugguggcaauaucacaagggaggagagaggaaaacaauuaucuucucuacuuggauuaugag

SEQ ID NO: 656785 - RNA, 62 nt, Homo Sapiens
cuaaaaagucaauucaucuaguuaagucgcugaacaauuaccugccaaaugcuauacugugu

SEQ ID NO: 656786 - RNA, 62 nt, Homo Sapiens
agcagggugggguaaggaggagaaaauaaaccaacaauuaggucugcauuuucucaggcagu

SEQ ID NO: 656787 - RNA, 64 nt, Homo Sapiens; identical to SEQ ID NO: 95053

SEQ ID NO: 656788 - RNA, 64 nt, Homo Sapiens; identical to SEQ ID NO: 95054

SEQ ID NO: 656789 - RNA, 64 nt, Homo Sapiens; identical to SEQ ID NO: 95055

SEQ ID NO: 656790 - RNA, 64 nt, Homo Sapiens; identical to SEQ ID NO: 95056

SEQ ID NO: 656791 - RNA, 64 nt, Homo Sapiens; identical to SEQ ID NO: 95057

SEQ ID NO: 656792 - RNA, 64 nt, Homo Sapiens; identical to SEQ ID NO: 95058

SEQ ID NO: 656793 - RNA, 64 nt, Homo Sapiens; identical to SEQ ID NO: 95059

SEQ ID NO: 656794 - RNA, 64 nt, Homo Sapiens; identical to SEQ ID NO: 95060

SEQ ID NO: 656795 - RNA, 64 nt, Homo Sapiens; identical to SEQ ID NO: 95061

SEQ ID NO: 656796 - RNA, 64 nt, Homo Sapiens; identical to SEQ ID NO: 95062

SEQ ID NO: 656797 - RNA, 64 nt, Homo Sapiens; identical to SEQ ID NO: 95063

SEQ ID NO: 656798 - RNA, 64 nt, Homo Sapiens; identical to SEQ ID NO: 95064

SEQ ID NO: 656799 - RNA, 64 nt, Homo Sapiens; identical to SEQ ID NO: 95065

SEQ ID NO: 656800 - RNA, 64 nt, Homo Sapiens; identical to SEQ ID NO: 95066

SEQ ID NO: 656801 - RNA, 64 nt, Homo Sapiens; identical to SEQ ID NO: 95067

SEQ ID NO: 656802 - RNA, 64 nt, Homo Sapiens; identical to SEQ ID NO: 95068

SEQ ID NO: 656803 - RNA, 64 nt, Homo Sapiens; identical to SEQ ID NO: 95069

SEQ ID NO: 656804 - RNA, 64 nt, Homo Sapiens; identical to SEQ ID NO: 95070

SEQ ID NO: 656805 - RNA, 64 nt, Homo Sapiens; identical to SEQ ID NO: 95071

SEQ ID NO: 656806 - RNA, 64 nt, Homo Sapiens; identical to SEQ ID NO: 95072

SEQ ID NO: 656807 - RNA, 64 nt, Homo Sapiens; identical to SEQ ID NO: 95073

SEQ ID NO: 656808 - RNA, 64 nt, Homo Sapiens; identical to SEQ ID NO: 95074

SEQ ID NO: 656809 - RNA, 64 nt, Homo Sapiens; identical to SEQ ID NO: 95075

SEQ ID NO: 656810 - RNA, 64 nt, Homo Sapiens; identical to SEQ ID NO: 95076

SEQ ID NO: 656811 - RNA, 64 nt, Homo Sapiens; identical to SEQ ID NO: 95077

SEQ ID NO: 656812 - RNA, 64 nt, Homo Sapiens; identical to SEQ ID NO: 95078

SEQ ID NO: 656813 - RNA, 64 nt, Homo Sapiens; identical to SEQ ID NO: 95079

SEQ ID NO: 656814 - RNA, 64 nt, Homo Sapiens; identical to SEQ ID NO: 71812

SEQ ID NO: 656815 - RNA, 64 nt, Homo Sapiens; identical to SEQ ID NO: 71813

SEQ ID NO: 656816 - RNA, 64 nt, Homo Sapiens; identical to SEQ ID NO: 71814

SEQ ID NO: 656817 - RNA, 64 nt, Homo Sapiens; identical to SEQ ID NO: 71815

SEQ ID NO: 656818 - RNA, 64 nt, Homo Sapiens; identical to SEQ ID NO: 71816

SEQ ID NO: 656819 - RNA, 64 nt, Homo Sapiens; identical to SEQ ID NO: 71817

SEQ ID NO: 656820 - RNA, 64 nt, Homo Sapiens; identical to SEQ ID NO: 71818

SEQ ID NO: 656821 - RNA, 64 nt, Homo Sapiens; identical to SEQ ID NO: 71819

SEQ ID NO: 656822 - RNA, 64 nt, Homo Sapiens; identical to SEQ ID NO: 71820

SEQ ID NO: 656823 - RNA, 64 nt, Homo Sapiens; identical to SEQ ID NO: 71821

SEQ ID NO: 656824 - RNA, 64 nt, Homo Sapiens; identical to SEQ ID NO: 71822

SEQ ID NO: 656825 - RNA, 64 nt, Homo Sapiens; identical to SEQ ID NO: 71823

SEQ ID NO: 656826 - RNA, 64 nt, Homo Sapiens; identical to SEQ ID NO: 71824

SEQ ID NO: 656827 - RNA, 64 nt, Homo Sapiens; identical to SEQ ID NO: 71825

SEQ ID NO: 656828 - RNA, 64 nt, Homo Sapiens; identical to SEQ ID NO: 71826

SEQ ID NO: 656829 - RNA, 64 nt, Homo Sapiens; identical to SEQ ID NO: 71827

SEQ ID NO: 656830 - RNA, 64 nt, Homo Sapiens; identical to SEQ ID NO: 71828

SEQ ID NO: 656831 - RNA, 64 nt, Homo Sapiens; identical to SEQ ID NO: 71829

SEQ ID NO: 656832 - RNA, 64 nt, Homo Sapiens; identical to SEQ ID NO: 71830

SEQ ID NO: 656833 - RNA, 64 nt, Homo Sapiens; identical to SEQ ID NO: 71831

SEQ ID NO: 656834 - RNA, 64 nt, Homo Sapiens; identical to SEQ ID NO: 71832

SEQ ID NO: 656835 - RNA, 64 nt, Homo Sapiens; identical to SEQ ID NO: 71833

SEQ ID NO: 656836 - RNA, 64 nt, Homo Sapiens; identical to SEQ ID NO: 71834

SEQ ID NO: 656837 - RNA, 64 nt, Homo Sapiens; identical to SEQ ID NO: 71835

SEQ ID NO: 656838 - RNA, 64 nt, Homo Sapiens; identical to SEQ ID NO: 71836

SEQ ID NO: 656839 - RNA, 64 nt, Homo Sapiens; identical to SEQ ID NO: 71837

SEQ ID NO: 656840 - RNA, 64 nt, Homo Sapiens; identical to SEQ ID NO: 71838

SEQ ID NO: 656841 - RNA, 64 nt, Homo Sapiens; identical to SEQ ID NO: 71839

SEQ ID NO: 656842 - RNA, 64 nt, Homo Sapiens; identical to SEQ ID NO: 71840

SEQ ID NO: 656843 - RNA, 64 nt, Homo Sapiens; identical to SEQ ID NO: 71841

SEQ ID NO: 656844 - RNA, 64 nt, Homo Sapiens; identical to SEQ ID NO: 71842

SEQ ID NO: 656845 - RNA, 64 nt, Homo Sapiens; identical to SEQ ID NO: 71843

SEQ ID NO: 656846 - RNA, 64 nt, Homo Sapiens; identical to SEQ ID NO: 71844

SEQ ID NO: 656847 - RNA, 64 nt, Homo Sapiens; identical to SEQ ID NO: 71845

SEQ ID NO: 656848 - RNA, 64 nt, Homo Sapiens; identical to SEQ ID NO: 71846

SEQ ID NO: 656849 - RNA, 64 nt, Homo Sapiens; identical to SEQ ID NO: 71847

SEQ ID NO: 656850 - RNA, 64 nt, Homo Sapiens; identical to SEQ ID NO: 71847

SEQ ID NO: 656851 - RNA, 64 nt, Homo Sapiens; identical to SEQ ID NO: 71849

SEQ ID NO: 656852 - RNA, 64 nt, Homo Sapiens; identical to SEQ ID NO: 71850

SEQ ID NO: 656853 - RNA, 64 nt, Homo Sapiens; identical to SEQ ID NO: 71851

SEQ ID NO: 656854 - RNA, 64 nt, Homo Sapiens; identical to SEQ ID NO: 71852

SEQ ID NO: 656855 - RNA, 64 nt, Homo Sapiens; identical to SEQ ID NO: 71853

SEQ ID NO: 656856 - RNA, 64 nt, Homo Sapiens; identical to SEQ ID NO: 71854

SEQ ID NO: 656857 - RNA, 64 nt, Homo Sapiens; identical to SEQ ID NO: 71855

SEQ ID NO: 656858 - RNA, 64 nt, Homo Sapiens; identical to SEQ ID NO: 71856

SEQ ID NO: 656859 - RNA, 57 nt, Homo Sapiens; identical to SEQ ID NO: 71857

SEQ ID NO: 656860 - RNA, 64 nt, Homo Sapiens; identical to SEQ ID NO: 71858

SEQ ID NO: 656861 - RNA, 64 nt, Homo Sapiens
uuaaaacauaggucacuaacugugauguuauuuguuuucuaagugguaugugagauuuucuaau

SEQ ID NO: 656862 - RNA, 64 nt, Homo Sapiens
gugauguuauuuguuuucuaagugguaugugagauuuucuaauguaguuagaaguuucauuguc

SEQ ID NO: 656863 - RNA, 64 nt, Homo Sapiens
ugguugguugguauagaauggugggaauucaaauuuuucuaaacucaugguaaguauauuguaa

SEQ ID NO: 656864 - RNA, 64 nt, Homo Sapiens
uucuuauuugggggagugggcaaaauguugauuauuuucuaaugcuuuguagcaaagcauauca

SEQ ID NO: 656865 - RNA, 64 nt, Homo Sapiens
gagucugucagcuuucauuuuauuuugcuaagguuuuucuaaugaauuuuuaaguguuugugua

SEQ ID NO: 656866 - RNA, 64 nt, Homo Sapiens
gcaguagcuuuagcaagcagauggucacaaucuguuuucuaaaucauuuuuuauuaaaugaauc

SEQ ID NO: 656867 - RNA, 64 nt, Homo Sapiens
gcgaaaauaugcaggaagauuaauuuuguggcaguuuucuaaaacugacaaccaggugggacca

SEQ ID NO: 656868 - RNA, 63 nt, Homo Sapiens
aguauaguuugaaagcggcacaauuaaaaauuaauuuucuaacaaaguugggagguuugaugg

SEQ ID NO: 656869 - RNA, 64 nt, Homo Sapiens
cuagaacuuuaaagaaaaaagaauguuauauuaguuuucuaaaacucaacuaucuuuagucaug

SEQ ID NO: 656870 - RNA, 64 nt, Homo Sapiens
auuguuaccucuguguguuaagaaaauaaaaauauuuucuaaaggucuguauuuugcuuucauu

SEQ ID NO: 656871 - RNA, 64 nt, Homo Sapiens
cucuauuaggagaacuagaccacuuucuucauucuuuucuaaacugcugcagauugccgugaac

SEQ ID NO: 656872 - RNA, 64 nt, Homo Sapiens
uaucaauagucucuuuuccgcaggcaaaguggcauuuucuaaacauguuugcuuacugccaggu

SEQ ID NO: 656873 - RNA, 64 nt, Homo Sapiens
auauaaauaugucagauguacauagagaucuauuuuuucuaaaacauuccccuccccacuccuc

SEQ ID NO: 656874 - RNA, 62 nt, Homo Sapiens
aggcagagaccuccaauaaagugccuucugggcuuuuucuaaccuuugucuuagcuaccugu

SEQ ID NO: 656875 - RNA, 64 nt, Homo Sapiens
cugcauuauaauagcucuaaguauuuaugucugcuuuucuaaaugaugcuugggggaucauaga

SEQ ID NO: 656876 - RNA, 64 nt, Homo Sapiens
ggauuauuaugucuugaaaggaaaggcuucaguuuuuucuaauuauauauguacaaaaauuacu

SEQ ID NO: 656877 - RNA, 64 nt, Homo Sapiens
cauuaaauuauuugguuuggcaaaugauugcaauuuuucuaaauuguauccuaguuuagugaua

SEQ ID NO: 656878 - RNA, 64 nt, Homo Sapiens
aagaauacagcacuagacuuacucuguguugcuauuuucuaagaaccuggguuuauuuacuauu

SEQ ID NO: 656879 - RNA, 64 nt, Homo Sapiens
uacugaucuuacuacuacaauuuauuauuacuuuuuuucuaauugaucugaauuauaguucuaa

SEQ ID NO: 656880 - RNA, 64 nt, Homo Sapiens
uguaaauauuugccacaaugaaauacaaaguuuguuuucuaaaauuuuaaaaauuauguugacu

SEQ ID NO: 656881 - RNA, 64 nt, Homo Sapiens
gaaauaggaggcauuuucaucuuauuaaguauuauuuucuaaaaaacaucaaagaugcagcaag

SEQ ID NO: 656882 - RNA, 64 nt, Homo Sapiens
gcugcaaauuugcagccuuuuguugauaguguaguuuucuaaacucaguccauaaagcaaagcu

SEQ ID NO: 656883 - RNA, 64 nt, Homo Sapiens
uaacuuaaggagacggguaaaggaucuuaaauuuuuuucuaauagaaagaugugcuacacugua

SEQ ID NO: 656884 - RNA, 64 nt, Homo Sapiens
cagugcaaaaguucuuuaaaaugcauaugucuuuuuuucuaauuccguuuuguuuuaaagcaca

SEQ ID NO: 656885 - RNA, 64 nt, Homo Sapiens
uauuucaacagugugacuaauguuugaaauuauuuuuucuaagaguuuuucuauaaccuuccaa

SEQ ID NO: 656886 - RNA, 64 nt, Homo Sapiens
cucuucugcaaaagguacuguuaaguaaaccagauuuucuaaauaggcauucuuaaaauuucag

SEQ ID NO: 656887 - RNA, 64 nt, Homo Sapiens
uaagaaauacuuucauuuauguuugcuagaaacauuuucuaaaugauagugauuagcugguuag

SEQ ID NO: 656888 - RNA, 64 nt, Homo Sapiens
ucucuguggaucuaugccaaaaucaugggccaucuuuucuaaguguacuucugauuaaugcaag

SEQ ID NO: 656889 - RNA, 64 nt, Homo Sapiens
ggccuauugcacaagucuugacaaacaacauauauuuucuaaaacuauccagauuucauuauca

SEQ ID NO: 656890 - RNA, 64 nt, Homo Sapiens
cguugcaaggauuagccaaacuggaaaagaguauuuuucuaauacggaggaggcuucuaauuag

SEQ ID NO: 656891 - RNA, 64 nt, Homo Sapiens
ccaaauuucccauguaagcuaauaucgcuuuaacuuuucuaaagacaaacuuguaccacaaaac

SEQ ID NO: 656892 - RNA, 64 nt, Homo Sapiens
guuaccaguuauccaaucacucugucaacuaaacuuuucuaaagcuaacucacuucggucucug

SEQ ID NO: 656893 - RNA, 64 nt, Homo Sapiens
augcucuaccgcauuguagauuugaagguuuaucuuuucuaaucugucuuggacaacacuauug

SEQ ID NO: 656894 - RNA, 64 nt, Homo Sapiens
caguuuuuauauagucuacaaaaguuguaaauaauuuucuaagauagaguauuuacacuaugau

SEQ ID NO: 656895 - RNA, 63 nt, Homo Sapiens
ugcacuaauguguuaugagaauucuucuaaaaguuuucuaauuuuccuucuuuccaugacuaa

SEQ ID NO: 656896 - RNA, 64 nt, Homo Sapiens
gccucguaggguagaaaccauuaaaaugugaacguuuucuaacuuugugguuuguacagauuug

SEQ ID NO: 656897 - RNA, 64 nt, Homo Sapiens
ggauauuguauuuuuuuuaaguuuaaaauauggcuuuucuaauucagcuuauucuuguacaaau

SEQ ID NO: 656898 - RNA, 64 nt, Homo Sapiens
auuguaauucuucccuucuuaucuuuaguugcucuuuucuaaccucagaaguauaauagaaaua

SEQ ID NO: 656899 - RNA, 64 nt, Homo Sapiens
caguugcuacaaaaacugauauuucaguacaagauuuucuaaauaugugcaagucuaauuguug

SEQ ID NO: 656900 - RNA, 64 nt, Homo Sapiens
uguauaauaauucaaaauuauucuaaauguuuaguuuucuaaauuaugaugucauuaauacuuu

SEQ ID NO: 656901 - RNA, 64 nt, Homo Sapiens
guuuaguuuucuaaauuguaaugucauuaauacuuuuucuaaauuugaauguaaaguauauaug

SEQ ID NO: 656902 - RNA, 64 nt, Homo Sapiens
agggaaucauuuuuguaggaagcauuuuuuauaauuuucuaagucgugcacuuucucgguccac

SEQ ID NO: 656903 - RNA, 64 nt, Homo Sapiens
auggauucauggaguagccuggacuguuucauaguuuucuaaauguacaaauucuuauaggcua

SEQ ID NO: 656904 - RNA, 64 nt, Homo Sapiens
auuauuuuacggagcugcaaccuccaauuuuguguuuucuaagugauuuacuuaagucaauaac

SEQ ID NO: 656905 - RNA, 64 nt, Homo Sapiens
acagauggaauccuguggacuaaugugccaccaguuuucuaacaaggguguacauaaaauggau

SEQ ID NO: 656906 - RNA, 64 nt, Homo Sapiens
aacauuuucagaccaugaaugaauguuuccauuuuuuucuaauggaaugugagaguuuacuuuu

SEQ ID NO: 656907 - RNA, 64 nt, Homo Sapiens
agauugucucuucuauauugaaagcauuuuuauguuuucuaauuuaaaaauuaauauuuucuua

SEQ ID NO: 656908 - RNA, 64 nt, Homo Sapiens
ugugcuaugacccacuaugaccacagcaucugcauuuucuaaaaaauuccaugcagguguuuug

SEQ ID NO: 656909 - RNA, 64 nt, Homo Sapiens
ucugccuuguucuuaucaacuugaaauguuggcauuuucuaaccuuguuuuguuggcuacaaua

SEQ ID NO: 656910 - RNA, 64 nt, Homo Sapiens
auuuuucaucaauaacugucagaggugaucuuuauuuucuaaauauuucaaacuugaaaacaga

SEQ ID NO: 656911 - RNA, 64 nt, Homo Sapiens
uuaaauuucaaggaaauaugaaggcacuuccuuuuuuucuaagaaggaaguugcuagaugauuc

SEQ ID NO: 656912 - RNA, 64 nt, Homo Sapiens
uuuaaaaaauggucauauuaauugauagcuuuuauuuucuaauucuuccuuauguugcugugau

SEQ ID NO: 656913 - RNA, 64 nt, Homo Sapiens
ccuggagacuuauuuuacuguuuauuuuauuuuuuuuucuaacuuauucaacuucaucaaucac

SEQ ID NO: 656914 - RNA, 64 nt, Homo Sapiens
ggaggggcucuagugcuaaauuuaaaagaauuguuuuucuaacuaaccucaaaucauaaagaca

SEQ ID NO: 656915 - RNA, 64 nt, Homo Sapiens
cuaaauaaauagcaaacuuuuuuucuuucaguguuuuucuaagagcguacuacauuuccugccu

SEQ ID NO: 656916 - RNA, 64 nt, Homo Sapiens
uuuauuaccaauauauaagauaaaaaaaguuguauuuucuaauuauauuuucuaaagaaaaaaa

SEQ ID NO: 656917 - RNA, 64 nt, Homo Sapiens
aaaaaaauaaaaaaaguuguuuuaaaaaguuauauuuucuaaaggcuauuguagauggcaucuu

SEQ ID NO: 656918 - RNA, 64 nt, Homo Sapiens
uuaaccaugauccuccagauuuuuuggaguauucuuuucuaaccuuaacccugccaaaccuuga

SEQ ID NO: 656919 - RNA, 64 nt, Homo Sapiens
guuuuguuuuugcccuuuauguacuacauucuuauuuucuaacuuuuaaacacuguauuggagg

SEQ ID NO: 656920 - RNA, 64 nt, Homo Sapiens
auuccuaaugggguguuaaagccguuuuuuauuuuuuucuaaauaaaaagagaacccaugcuuu

SEQ ID NO: 656921 - RNA, 64 nt, Homo Sapiens
gcuuaacuggguaauuuguggucuaggccuuuuguuuucuaagcuuacuaucuuguguuuguuu

SEQ ID NO: 656922 - RNA, 64 nt, Homo Sapiens
aacacuaguaauuaaaaugugccuuuugaagauguuuucuaagagaaaggaaauacguugcagu

SEQ ID NO: 656923 - RNA, 64 nt, Homo Sapiens
aagaaugacuuuuccaagaguucuagauguuugauuuucuaauuaauacuuaucagaucuacaa

SEQ ID NO: 656924 - RNA, 64 nt, Homo Sapiens
aaagaagggaaucuguuuaucgcuuuucaaaauauuuucuaaagugggggaagaaaguuuauag

SEQ ID NO: 656925 - RNA, 64 nt, Homo Sapiens
guaccugaguugaccauccuugaaccuuuguguguuuucuaauuugugggcaguuuaauaaacc

SEQ ID NO: 656926 - RNA, 64 nt, Homo Sapiens
gagaggauuauucccaguaauuucuucuuucuuuuuuucuaauuaccacaaugaucugauuuuc

SEQ ID NO: 656927 - RNA, 64 nt, Homo Sapiens
uuuaauuaauuaauuuauuuauuuuacuuauggcuuuucuaauucagaacagggcaaacucucc

SEQ ID NO: 656928 - RNA, 64 nt, Homo Sapiens
guuaaaggucugaagcagcuaauuccacuaucccuuuucuaaagguuuaaagacguguuuuuaa

SEQ ID NO: 656929 - RNA, 64 nt, Homo Sapiens
acaauuguuauagccagagguuagcuugguaaauuuuucuaaacacaacuuagaucaacuauuu

SEQ ID NO: 656930 - RNA, 64 nt, Homo Sapiens
uuguuaaauauaucuauuuuuuauaacuguuggcuuuucuaaucuuuauauucuccuuuugaca

SEQ ID NO: 656931 - RNA, 64 nt, Homo Sapiens
uuuucaaaaggaauauguguauuggugaaacauuuuuucuaagauucaagaguuguaccuuaac

SEQ ID NO: 656932 - RNA, 64 nt, Homo Sapiens
guuaaccuugugggcuguuguguaucaagcugaauuuucuaaaaauuaugaugaauuauuuucu

SEQ ID NO: 656933 - RNA, 64 nt, Homo Sapiens
gauguguaucacuuaccuuuccagacaaauuguguuuucuaaagauacaugugcaaucaucccc

SEQ ID NO: 656934 - RNA, 64 nt, Homo Sapiens
aauaagagcaguauccuuagcucuagccaagcauuuuucuaauuccugccuuuggucacaaaga

SEQ ID NO: 656935 - RNA, 64 nt, Homo Sapiens
agacuuauaaaggauuucaucagaaguuuucauuuuuucuaaauccuccccuacaaaauuuuca

SEQ ID NO: 656936 - RNA, 64 nt, Homo Sapiens
uuuguuuccagaaauucuucaauuugaaaucaccuuuucuaaaaagucaauucaucuaguuaag

SEQ ID NO: 656937 - RNA, 64 nt, Homo Sapiens
uuuugucagucugagucaucaaaaagagucuuaauuuucuaaaacaaguuggcuagaagaaagu

SEQ ID NO: 656938 - RNA, 64 nt, Homo Sapiens
ugaauucagaauauuaagaaaaugaaguaacugauuuucuaaaaaaaaaaaaaaaaaaaauuuc

SEQ ID NO: 656939 - RNA, 64 nt, Homo Sapiens
ugauaauacuguaauauaccugucacacaaaugcuuuucuaauguuuuaaccuugaguauugca

SEQ ID NO: 656940 - RNA, 64 nt, Homo Sapiens
caggaaaaaaaucuaugcauuagcaccuuugaucuuuucuaaauuguacaguuuuacuaagguu

SEQ ID NO: 656941 - RNA, 64 nt, Homo Sapiens
acuucaaguguuugauuaaauaacauagguaucuuuuucuaaaacauaaagugaagcugcaaug

SEQ ID NO: 656942 - RNA, 64 nt, Homo Sapiens
aguaacuugcaaguuuucaggccacugguuauuuuuuucuaaggcuauguucagaacuucaucu

SEQ ID NO: 656943 - RNA, 64 nt, Homo Sapiens
ucaagucuuccugauacaugcagaaauugcauaauuuucuaauuaguaggaggaggaugagcca

SEQ ID NO: 656944 - RNA, 64 nt, Homo Sapiens
auaguauucaacuuaguugaauuuaaaacuuuaauuuucuaaacuuaucuauauauaaaccaug

SEQ ID NO: 656945 - RNA, 64 nt, Homo Sapiens
ugcaacaugugaguuuaguggcuuccagaucaccuuuucuaagauucucacuauaguccauaau

SEQ ID NO: 656946 - RNA, 64 nt, Homo Sapiens
uaauaauuuaauagugaucuaccaguguuaagaauuuucuaauugucgccacucgucuaauuug

SEQ ID NO: 656947 - RNA, 64 nt, Homo Sapiens
agagacaucauguuggaaagucucacaaaaccauuuuucuaauauuucuuccuucacaguuuua

SEQ ID NO: 656948 - RNA, 64 nt, Homo Sapiens
uacuuagauguuggauaugugagauuguucugcuuuuucuaaguacuucugguagaugucuuau

SEQ ID NO: 656949 - RNA, 64 nt, Homo Sapiens
gucccucccuuccaaaagugaaauuauucucuuuuuuucuaagauacacuauucauaacucuua

SEQ ID NO: 656950 - RNA, 64 nt, Homo Sapiens
ugaaacuugauaaaguagacuaauuucuaugauguuuucuaaaauggaguuggguugcuaaccu

SEQ ID NO: 656951 - RNA, 64 nt, Homo Sapiens
gaauacaggacacguauuagcucauuugcccucuuuuucuaaguugugaaguuguuaaggcacu

SEQ ID NO: 656952 - RNA, 64 nt, Homo Sapiens
caccucuaauaugaacauuaguuugagguaguuuuuuucuaaagcaaaaauuuuaacuguuuuc

SEQ ID NO: 656953 - RNA, 64 nt, Homo Sapiens
agguaguuuuuuucuaaagcaaaaauuuuaacuguuuucuaauugucaagcacuauuuucauua

SEQ ID NO: 656954 - RNA, 64 nt, Homo Sapiens
agaguuuauuuuauucucagaguuuggacuacaauuuucuaagauguuucugguucaagacugu

SEQ ID NO: 656955 - RNA, 64 nt, Homo Sapiens
uuuucuuuacacuaaucgauacauuuagaaaaaauuuucuaaguuagagacaaguuuaaaagua

SEQ ID NO: 656956 - RNA, 64 nt, Homo Sapiens
gaaccucucugggauguuuccagcaaaagugagcuuuucuaaucgucucauuguaacauggcuu

SEQ ID NO: 656957 - RNA, 64 nt, Homo Sapiens
gauguccuuaauaagggaagucauguauaagauguuuucuaaaagacuuuucaguauuacaacu

SEQ ID NO: 656958 - RNA, 64 nt, Homo Sapiens
ccugcuguuaauguuuuuuccccccuugugaauguuuucuaacuuugucuugguaauugcaauu

SEQ ID NO: 656959 - RNA, 64 nt, Homo Sapiens
auguaauugcuuaccugcacacaguuuuuuuuccuuuucuaaauuuguuugugaucauugacag

SEQ ID NO: 656960 - RNA, 64 nt, Homo Sapiens
ggaaugguauuuucgguuuauugacauugaauuguuuucuaaguuuuuccaucacaagauagga

SEQ ID NO: 656961 - RNA, 64 nt, Homo Sapiens
cccacauuugguuauugaagauaagaacagaaacuuuucuaagauauuuugccuguuugugcag

SEQ ID NO: 656962 - RNA, 64 nt, Homo Sapiens
aacaaugaauccugauuucucuuuaccuuacauuuuuucuaaguuuauauucugauuaagcuua

SEQ ID NO: 656963 - RNA, 64 nt, Homo Sapiens
gucacugcugacauaacucccuaauacugaaagauuuucuaaauuggauuaaaucugauauuuu

SEQ ID NO: 656964 - RNA, 64 nt, Homo Sapiens
cugaaagauuuucuaaaugugauuaaaucugauauuuucuaauaggguuggggugguuccuuug

SEQ ID NO: 656965 - RNA, 64 nt, Homo Sapiens
caacugccuugucaguuugguaauucacuuaugauuuucuaauguucucuuggugaauuuuauu

SEQ ID NO: 656966 - RNA, 64 nt, Homo Sapiens
aauauauuuacuauaauucuaaauguuuaaaugcuuuucuaaaaaugcaaaacuaugauguuua

SEQ ID NO: 656967 - RNA, 64 nt, Homo Sapiens
gaaauguuuauugacaggucuuuucaaauaaugcuuuucuaauuaauagccaaagauuucauau

SEQ ID NO: 656968 - RNA, 64 nt, Homo Sapiens
aauaaaagauaaaagagcgauacacaaagcuuucuuuucuaacuuuuccaagcaaaaucuaaaa

SEQ ID NO: 656969 - RNA, 64 nt, Homo Sapiens
uaugaugagcagacuucucggaauucauaauaaauuuucuaaaagccuacaaauguguguauug

SEQ ID NO: 656970 - RNA, 64 nt, Homo Sapiens
gaagagagauuagaacuguuagaaggaguugaaauuuucuaaaagacauaguauuuaguuuaua

SEQ ID NO: 656971 - RNA, 64 nt, Homo Sapiens
aaugaaguucacaauaggucauaaggucucuuccuuuucuaaaauugaaagacaagaaauuuag

SEQ ID NO: 656972 - RNA, 64 nt, Homo Sapiens
aauuuguugauuaagugaucuguuacaaauuuuguuuucuaaacgucgacaguuucuacaaaaa

SEQ ID NO: 656973 - RNA, 64 nt, Homo Sapiens
auucaacuauaacugcuguuaaaaagaaaaacauuuuucuaaauucaaaugguacuaugaggaa

SEQ ID NO: 656974 - RNA, 64 nt, Homo Sapiens
gaccaaugcuugaauaaguagaccccaagcauccuuuucuaaaaagugacuuaaaauaagccaa

SEQ ID NO: 656975 - RNA, 64 nt, Homo Sapiens
auaaaacacuuuaauuagaaucuauuuuuaccuauuuucuaaauuuauuuaaaugcuuagcagg

SEQ ID NO: 656976 - RNA, 64 nt, Homo Sapiens
ucaugauuuuguuaaaguagccuucuucagaugcuuuucuaagggcuaguuaccaacuuuauuu

SEQ ID NO: 656977 - RNA, 64 nt, Homo Sapiens
aaguaauuacauuauuuaggucuuaauccaacuuuuuucuaauauaucuaaacaauugaaaggg

SEQ ID NO: 656978 - RNA, 64 nt, Homo Sapiens
auaauguaaaugucuucuaugcaacaucgguggauuuucuaaaauuacaaauaugugccauugu

SEQ ID NO: 656979 - RNA, 64 nt, Homo Sapiens
cugugcugucggugauacagaagaaaagcaauaauuuucuaaagaccugaaauaauaagauaau

SEQ ID NO: 656980 - RNA, 64 nt, Homo Sapiens
gaguuguugauuuuaggagucucucccuccuuucuuuucuaagucuggauuaauucccagaacc

SEQ ID NO: 656981 - RNA, 64 nt, Homo Sapiens
aacuguugaucagcaaaaauauaccugcagcugcuuuucuaacaugucucagaccuuagguaac

SEQ ID NO: 656982 - RNA, 64 nt, Homo Sapiens
uaauauuaaugagaagggaaaagcauggggauucuuuucuaaggaagguagauuuuuauaaaac

SEQ ID NO: 656983 - RNA, 64 nt, Homo Sapiens
cuccuguugguuacuaaucucaguauggauuugcuuuucuaagccuuucuugugugugaugaac

SEQ ID NO: 656984 - RNA, 64 nt, Homo Sapiens
uuacacacaugagggcugguguucauuaauacuguuuucuaauuuuuccauaguuaaucuauaa

SEQ ID NO: 656985 - RNA, 64 nt, Homo Sapiens
ugaauguguuuuuuaaauggaacuaucuccaaauuuuucuaagacuacuaugaacaguuuucuu

SEQ ID NO: 656986 - RNA, 64 nt, Homo Sapiens
aaccuaaaagaguagucuuaacacauuacuaacuuuuucuaagagaaauugauuccuguuuugu

SEQ ID NO: 656987 - RNA, 64 nt, Homo Sapiens
cagaguaacucaccuccaugggcugaccaaaggcuuuucuaauuuuuguuacugaugagaugaa

SEQ ID NO: 656988 - RNA, 64 nt, Homo Sapiens
cacagaagcuuuaaaaauacauagucauccaagguuuucuaaaaauugaaaucauauguuggga

SEQ ID NO: 656989 - RNA, 64 nt, Homo Sapiens
guucauguugucauuugaaacucuucacauaaaauuuucuaauauucauuuggaaaaccucucc

SEQ ID NO: 656990 - RNA, 64 nt, Homo Sapiens
guuguuacugauaugcuuuuuaucauucauuucuuuuucuaaaaaggucauaucuguuuuucuu

SEQ ID NO: 656991 - RNA, 64 nt, Homo Sapiens
gacuguuuuuaaugauuuuguuugguguauugcuuuuucuaauucuggaaacacuaccauuauu

SEQ ID NO: 656992 - RNA, 64 nt, Homo Sapiens
ugacauuuaaguggaaaaccaaguuaucauugucuuuucuaagcucaguguggaugauugcauu

SEQ ID NO: 656993 - RNA, 64 nt, Homo Sapiens
ucuacuuuauagaagguugcuuuucuuuuuaauuuuuucuaacaaagaaaagaauaaaguauuu

SEQ ID NO: 656994 - RNA, 64 nt, Homo Sapiens
agcauagcaugguuuuguuuguuuuugcuuucaauuuucuaauuuggcauggauccauauguau

SEQ ID NO: 656995 - RNA, 64 nt, Homo Sapiens
aauuuggcauggauccauauguauuuacuauccuuuuucuaauauauuaauauaugcuacauuu

SEQ ID NO: 656996 - RNA, 64 nt, Homo Sapiens
uucugacuugauaaagcuuuaauaauguacaguguuuucuaaauauuuccuguuuuuucagcac

SEQ ID NO: 656997 - RNA, 64 nt, Homo Sapiens
gaaggaaaugcugucccauaaaaugccauuccuauuuucuaauauaaaacucuuuuccaggaag

SEQ ID NO: 656998 - RNA, 64 nt, Homo Sapiens
agauaguggaaguucaagggugaggaacaagacuuuuucuaaaagcuugacaacacucugggaa

SEQ ID NO: 656999 - RNA, 64 nt, Homo Sapiens
cauuuuuaagggaaugaaacuuuuuuugcuuuuauuuucuaaauaaaagacguccuuuuccauu

SEQ ID NO: 657000 - RNA, 64 nt, Homo Sapiens
uuauguuaccugagaaauuaguauuagaauuguuuuuucuaaagaaccagacaggaguuaacuu

SEQ ID NO: 657001 - RNA, 64 nt, Homo Sapiens
uuauguuaccugaaaaaucauauuagaauuguuuuuuucuaaagacaggauaagguuacacuug

SEQ ID NO: 657002 - RNA, 64 nt, Homo Sapiens
uuuucucuuuaagugcuccugauucaugaagacguuuucuaacuuucuguacauuaaaagaacu

SEQ ID NO: 657003 - RNA, 64 nt, Homo Sapiens
agaaggcucucauaaguuucaaaguaaacuuauuuuuucuaacucacauguauggaaaccuuaa

SEQ ID NO: 657004 - RNA, 64 nt, Homo Sapiens
uacaggcagagugggacugaggggguaggggcuguuuucuaaguuauuaacucgcagacccucu

SEQ ID NO: 657005 - RNA, 64 nt, Homo Sapiens
auuuggugguuuauguuuaccucguuuacaagccuuuucuaaguaaagagaaccuuucggauca

SEQ ID NO: 657006 - RNA, 64 nt, Homo Sapiens
ucuaaaauuucauaauucugaugcacaaaacuacuuuucuaaaaugguuaauguaguaugguau

SEQ ID NO: 657007 - RNA, 64 nt, Homo Sapiens
aggcugcucacaaguucuaugucuaccuguguuuuuuucuaaaaaauaggcauuuuaaguaaaa

SEQ ID NO: 657008 - RNA, 64 nt, Homo Sapiens
uguuuuuguuuuuuguauguuaggaugagcucccuuuucuaagguaguuuuauguaagaaaccu

SEQ ID NO: 657009 - RNA, 64 nt, Homo Sapiens
guaaauuauuuguuagaugauuuuauccuuauauuuuucuaaaggcagggcuuuacauuuaccu

SEQ ID NO: 657010 - RNA, 64 nt, Homo Sapiens
cuugcuauauaagauucaaaagagcuuuuuaaauuuuucuaauaauaucuuacauuuguacagc

SEQ ID NO: 657011 - RNA, 64 nt, Homo Sapiens
ugccagacuuucuccaaaugaaaccugaaucaauuuuucuaaaucuagguuucauagaguccuc

SEQ ID NO: 657012 - RNA, 64 nt, Homo Sapiens
ggcacuguaaauacuuuccaguauuaaauuauccuuuucuaacacuguaggaacuauuuugaau

SEQ ID NO: 657013 - RNA, 64 nt, Homo Sapiens
uauggaguuguuauuucauaggcauugaaaaugguuuucuaaacuccaaaauggucaucuuauc

SEQ ID NO: 657014 - RNA, 64 nt, Homo Sapiens
uaauaauauugaccauuuccuaucugccaggcauuuuucuaagcacaugaagaaauuaguccua

SEQ ID NO: 657015 - RNA, 64 nt, Homo Sapiens
uauaguuagcauuuucauuuguucaaauuaaaacuuuucuaaaauguauuuuuaaucauaaguu

SEQ ID NO: 657016 - RNA, 64 nt, Homo Sapiens
aguuguuuaauagagaaaauuuggcuuaguuuaauuuucuaaaguguccauuaaucaacagaug

SEQ ID NO: 657017 - RNA, 64 nt, Homo Sapiens
ccuaaaaauugucaaaaacagcauuuagguaaaauuuucuaauacauccauuaauaguuauuag

SEQ ID NO: 657018 - RNA, 64 nt, Homo Sapiens
cucuugccacuuuuaaaauuaacaaugcuuaggcuuuucuaagccugaaaugccuuguaccuac

SEQ ID NO: 657019 - RNA, 64 nt, Homo Sapiens
aacacauuuauuuauacuaaauaacugucaaccauuuucuaacaaaaaguaagacugaauugac

SEQ ID NO: 657020 - RNA, 64 nt, Homo Sapiens
gggcacaaagaaaauuuagaucugacaaguauaauuuucuaaagacauuauuucaggauuaaca

SEQ ID NO: 657021 - RNA, 64 nt, Homo Sapiens
aaacuggggauuucucaaugugacuaacucuaauuuuucuaauuauaacugccuuuaauuaaca

SEQ ID NO: 657022 - RNA, 64 nt, Homo Sapiens
aaaagaguuuuauuauaaaccguguguuuuugguuuuucuaaguauauagaaagcuuguauaau

SEQ ID NO: 657023 - RNA, 64 nt, Homo Sapiens
cuuguagcuuauuauuguaaaguguuuuuuuuuuuuuucuaauuucucccacauguauuucugg

SEQ ID NO: 657024 - RNA, 64 nt, Homo Sapiens
auuaucccuggaacuuauugugaaaguugugcuguuuucuaaguaaaauaaaaaauaaaaaauu

SEQ ID NO: 657025 - RNA, 64 nt, Homo Sapiens
gaacuguggggauccaggauauaacuuugaggcauuuucuaaauuuaaaccugcugcaagagcc

SEQ ID NO: 657026 - RNA, 64 nt, Homo Sapiens
cuuugcauuaucaguuacaaaacacauuuaacuguuuucuaaugcaguuaauacuguauuucaa

SEQ ID NO: 657027 - RNA, 64 nt, Homo Sapiens
uggaaacuuagugugccuugaccaggcuagaguauuuucuaagcacuuaaugaauauguuaagg

SEQ ID NO: 657028 - RNA, 64 nt, Homo Sapiens
uuuuuaggaaaauauuaagcuuuguucugauuuuuuuucuaauauacuacauguaaacugauuu

SEQ ID NO: 657029 - RNA, 64 nt, Homo Sapiens
gggggcgcugucuagcacuuuaccggagccuuguuuuucuaaagggaaguagaucugaauaggc

SEQ ID NO: 657030 - RNA, 64 nt, Homo Sapiens
acguguuuuggauccuguacugggcacuuuauauuuuucuaaaacaccuguguaaguugguauu

SEQ ID NO: 657031 - RNA, 64 nt, Homo Sapiens
ugugaaacacagauuucaagauuugaauuuauuuuuuucuaauaagcuaaugguaauuagaauc

SEQ ID NO: 657032 - RNA, 64 nt, Homo Sapiens
auccauagcagcaccguucauucuaugagucuauuuuucuaaugaugcaguaauuaaauugcau

SEQ ID NO: 657033 - RNA, 64 nt, Homo Sapiens
acaggccuacaacuuuugccucagacuguuccccuuuucuaaggguauucaaguuuucaccuuu

SEQ ID NO: 657034 - RNA, 64 nt, Homo Sapiens
acuauuuucaaaaucauuuucaucaagacaccuuuuuucuaaaauaggcauugcauacacauau

SEQ ID NO: 657035 - RNA, 64 nt, Homo Sapiens
uauuuauuucauuuaagauaauuuucaaaguuaauuuucuaaauaagauaauucucauuugugu

SEQ ID NO: 657036 - RNA, 64 nt, Homo Sapiens
auaaaauuuauuaugcuuuauaaccucuucuguauuuucuaauuuuuucauugucuuugauaaa

SEQ ID NO: 657037 - RNA, 64 nt, Homo Sapiens
uuaaaauguccaaauuaggcuuuuuaaaaauugguuuucuaaaagaaaacacugcauuuaagaa

SEQ ID NO: 657038 - RNA, 64 nt, Homo Sapiens
ccagagaauaaggaacugauaagguuuguuuguguuuucuaaaaaaggaaccucgguacuucuu

SEQ ID NO: 657039 - RNA, 64 nt, Homo Sapiens
augcagaauaagcucuuuaugcuuggugucuuucuuuucuaauuacauaaauuauguuuaaaug

SEQ ID NO: 657040 - RNA, 64 nt, Homo Sapiens
auccaauugguccaaggaaauguguguuuuugguuuuucuaaauguagauacagauuguauuug

SEQ ID NO: 657041 - RNA, 64 nt, Homo Sapiens
augauaaaagguuauuacgacuauauauuuaaaguuuucuaaaaugaaaauugucuauuuuuau

SEQ ID NO: 657042 - RNA, 64 nt, Homo Sapiens
auaguucuuccauaaccaccuuguagaaacuugguuuucuaagcaaguauugcuaguaaaugau

SEQ ID NO: 657043 - RNA, 64 nt, Homo Sapiens
gaaugaaccauuuuccucuuaccuagcuuuguuuuuuucuaauguaaaggcaggucugaauaag

SEQ ID NO: 657044 - RNA, 64 nt, Homo Sapiens
guauuuccccauggaaaggauucuccuuggugaguuuucuaaaauugucuugagacguggcaaa

SEQ ID NO: 657045 - RNA, 64 nt, Homo Sapiens
acauaggauggauuuggggauagaugaguugcacuuuucuaauaguuuaaauuuagcacagaac

SEQ ID NO: 657046 - RNA, 64 nt, Homo Sapiens
uguaucaggacccagguguccuauaccgauuucauuuucuaaacugacucuccaauagguucuu

SEQ ID NO: 657047 - RNA, 64 nt, Homo Sapiens
cucuuacuaaauccagauuuaguguuuuauuuauuuuucuaaaaaaggggagaaguagaaccac

SEQ ID NO: 657048 - RNA, 64 nt, Homo Sapiens
agacccuuaugggaguuugauuaucauaauuaguuuuucuaaauaacacaacuggaguuuccau

SEQ ID NO: 657049 - RNA, 64 nt, Homo Sapiens
aauuuauguaauuuuauuugauugauuuuggcauuuuucuaagcuccuuaauauguuugaaauu

SEQ ID NO: 657050 - RNA, 64 nt, Homo Sapiens
gccauagucuuuuucauaauacuuaccaggaauauuuucuaaguuaccuauauuuaccauguuu

SEQ ID NO: 657051 - RNA, 64 nt, Homo Sapiens
aggaauuuggguaauuuuuaagguaauugucucuuuuucuaauacacagauccuaaguagaacc

SEQ ID NO: 657052 - RNA, 64 nt, Homo Sapiens
gagagaaagacuuagaacaucagauuaucucuuuuuuucuaaagacacagauccaaaauagaau

SEQ ID NO: 657053 - RNA, 64 nt, Homo Sapiens
cagugccauucugccuucucaaugagcaaaaccauuuucuaaguaugaggauauuagugaguag

SEQ ID NO: 657054 - RNA, 64 nt, Homo Sapiens
aucaauuuaauauacaguacuucauuuuuaauuguuuucuaaaaaaaagguuuuuuuuuuccuu

SEQ ID NO: 657055 - RNA, 64 nt, Homo Sapiens
auuugggaguuugggguuuuauguuuuguuuuucuuuucuaaaaugaagugagauuguucacac

SEQ ID NO: 657056 - RNA, 64 nt, Homo Sapiens
uuuugauauuugagccauuccuaaagauuugggguuuucuaaaacuaaagaaucuaggaaccuu

SEQ ID NO: 657057 - RNA, 64 nt, Homo Sapiens
gguugagcugaagccacaguuucucugugcuguguuuucuaacacauuuuucuguuuuuaauua

SEQ ID NO: 657058 - RNA, 64 nt, Homo Sapiens
cauuugauauauuuuucuuaacuaugggguuuauuuuucuaaauguggguugauugacuguuaa

SEQ ID NO: 657059 - RNA, 64 nt, Homo Sapiens
auuguuucagcagacuucuuucagcagcucguguuuuucuaaagugaaaggcaugguuuguccu

SEQ ID NO: 657060 - RNA, 64 nt, Homo Sapiens
augguaugaaauuucucucccccugcuugaagaguuuucuaauucguuucuagugagcaaaaca

SEQ ID NO: 657061 - RNA, 64 nt, Homo Sapiens
auauucaaaagggugacaaauaugauauuguaauuuuucuaagcuuuaagggcuuuaugugaac

SEQ ID NO: 657062 - RNA, 64 nt, Homo Sapiens
uaaacagucaguaugcaaucuauucucaaaaguuuuuucuaaguuuaaaguuucuugcauuuau

SEQ ID NO: 657063 - RNA, 64 nt, Homo Sapiens
gaguuuauguuccauuaaacaccuagcugaauguuuuucuaaaguuuuuucuauggguguuauc

SEQ ID NO: 657064 - RNA, 64 nt, Homo Sapiens
acaaagguuuaaaugaacaauuaacauaagcuauuuuucuaacuucaaugagcauguuuagacu

SEQ ID NO: 657065 - RNA, 64 nt, Homo Sapiens
uuuuuuaaaauuuuuuuuucucuuaaugaacacauuuucuaaaugaauuuuuuuuguaguuacu

SEQ ID NO: 657066 - RNA, 64 nt, Homo Sapiens
uuguauuuuuuuucuuuugaaaggguuuguuaauuuuucuaauuuuaccaaaguuugcagccua

SEQ ID NO: 657067 - RNA, 64 nt, Homo Sapiens
uauuagggaagaaugagacaauuuuguguaggcuuuuucuaaaguccaguacuuuguccagauu

SEQ ID NO: 657068 - RNA, 64 nt, Homo Sapiens
uuuauuuuucaaaccaccccugacuucuguuuccuuuucuaaguuuuuuuuuaacuuugacaac

SEQ ID NO: 657069 - RNA, 62 nt, Homo Sapiens
ggcuggcaccagagauaacuagcggaagaggauuuucuaagucuacgcggacuccuaccuga

SEQ ID NO: 657070 - RNA, 64 nt, Homo Sapiens
ugggggguggaggggugccuauacagaugucuauuuuucuaaacgggagaacagaaaugcaaaa

SEQ ID NO: 657071 - RNA, 64 nt, Homo Sapiens
cugugccucccucuccucggagaagcaaaaucuuuuuucuaaacagucuauuuuuguacaaaag

SEQ ID NO: 657072 - RNA, 64 nt, Homo Sapiens
agaaguggccugcagaaguuuaauaauuugacuuuuuucuaauauuuuaguuugaaagaaaauu

SEQ ID NO: 657073 - RNA, 64 nt, Homo Sapiens
uaugccuauuuuaacauuaacuucuaaagaaguuuuuucuaagaaaauguuucaaggcaauauu

SEQ ID NO: 657074 - RNA, 64 nt, Homo Sapiens
aaacauugauuuuuuuauaucuuucauaauauaauuuucuaacaaugcaauaaaaccacuaaac

SEQ ID NO: 657075 - RNA, 64 nt, Homo Sapiens
auuugacauucuuucacaagaauaaauuguacauuuuucuaauuuugcuuuauacauuuauauu

SEQ ID NO: 657076 - RNA, 64 nt, Homo Sapiens
ugguucaagcaucuacucuuaguauaguaauuuguuuucuaaggaugcuuugauuguucuagaa

SEQ ID NO: 657077 - RNA, 64 nt, Homo Sapiens
gaggucaaaaauauaauuuauuccucagucaugguuuucuaaauaucuguacuccacauuccau

SEQ ID NO: 657078 - RNA, 64 nt, Homo Sapiens
ggaagcacuuucagaacuauucacuugccagguauuuucuaaaauuccaccugaaagccaaaag

SEQ ID NO: 657079 - RNA, 64 nt, Homo Sapiens
agggaaagugauuuaaacuuuauuuaaagagguauuuucuaauuaugcacagauaucuacuuua

SEQ ID NO: 657080 - RNA, 64 nt, Homo Sapiens
aagacacacccuugggcuuaucuacagagcacacuuuucuaacagugaaucuccuaauuuuagc

SEQ ID NO: 657081 - RNA, 64 nt, Homo Sapiens
auccuaauugcaguuuagugaaauuacuagauuuuuuucuaaucuucaguauguagugagcauu

SEQ ID NO: 657082 - RNA, 64 nt, Homo Sapiens
aaagaacagaguggaguggauauauucacuuuuuuuuucuaaaacauacaaagugauaaaauaa

SEQ ID NO: 657083 - RNA, 64 nt, Homo Sapiens
cacuuguggagcaucaagcauuucuaacuuacuauuuucuaaaaaaaggauuacgucugcaucu

SEQ ID NO: 657084 - RNA, 64 nt, Homo Sapiens
uacuauuuucuaaaacacuuauuacgucugcaucuuuucuaacucaccaccauccaacaaaagg

SEQ ID NO: 657085 - RNA, 64 nt, Homo Sapiens; identical to SEQ ID NO: 618913

SEQ ID NO: 657086 - RNA, 64 nt, Homo Sapiens; identical to SEQ ID NO: 618914

SEQ ID NO: 657087 - RNA, 64 nt, Homo Sapiens; identical to SEQ ID NO: 618915

SEQ ID NO: 657088 - RNA, 64 nt, Homo Sapiens; identical to SEQ ID NO: 618916

SEQ ID NO: 657089 - RNA, 55 nt, Homo Sapiens; identical to SEQ ID NO: 618917

SEQ ID NO: 657090 - RNA, 64 nt, Homo Sapiens; identical to SEQ ID NO: 618918

SEQ ID NO: 657091 - RNA, 64 nt, Homo Sapiens; identical to SEQ ID NO: 618919

SEQ ID NO: 657092 - RNA, 64 nt, Homo Sapiens; identical to SEQ ID NO: 618920

SEQ ID NO: 657093 - RNA, 64 nt, Homo Sapiens; identical to SEQ ID NO: 618921

SEQ ID NO: 657094 - RNA, 64 nt, Homo Sapiens; identical to SEQ ID NO: 618922

SEQ ID NO: 657095 - RNA, 64 nt, Homo Sapiens; identical to SEQ ID NO: 618923

SEQ ID NO: 657096 - RNA, 64 nt, Homo Sapiens; identical to SEQ ID NO: 618924

SEQ ID NO: 657097 - RNA, 64 nt, Homo Sapiens; identical to SEQ ID NO: 605888

SEQ ID NO: 657098 - RNA, 64 nt, Homo Sapiens; identical to SEQ ID NO: 605889

SEQ ID NO: 657099 - RNA, 64 nt, Homo Sapiens; identical to SEQ ID NO: 605890

SEQ ID NO: 657100 - RNA, 64 nt, Homo Sapiens; identical to SEQ ID NO: 605891

SEQ ID NO: 657101 - RNA, 64 nt, Homo Sapiens; identical to SEQ ID NO: 605892

SEQ ID NO: 657102 - RNA, 64 nt, Homo Sapiens; identical to SEQ ID NO: 605893

SEQ ID NO: 657103 - RNA, 64 nt, Homo Sapiens; identical to SEQ ID NO: 605894

SEQ ID NO: 657104 - RNA, 64 nt, Homo Sapiens; identical to SEQ ID NO: 605895

SEQ ID NO: 657105 - RNA, 64 nt, Homo Sapiens; identical to SEQ ID NO: 605896

SEQ ID NO: 657106 - RNA, 64 nt, Homo Sapiens; identical to SEQ ID NO: 605897

SEQ ID NO: 657107 - RNA, 64 nt, Homo Sapiens; identical to SEQ ID NO: 605898

SEQ ID NO: 657108 - RNA, 64 nt, Homo Sapiens; identical to SEQ ID NO: 605899

SEQ ID NO: 657109 - RNA, 64 nt, Homo Sapiens; identical to SEQ ID NO: 605900

SEQ ID NO: 657110 - RNA, 64 nt, Homo Sapiens; identical to SEQ ID NO: 605901

SEQ ID NO: 657111 - RNA, 64 nt, Homo Sapiens; identical to SEQ ID NO: 605902

SEQ ID NO: 657112 - RNA, 64 nt, Homo Sapiens; identical to SEQ ID NO: 605903

SEQ ID NO: 657113 - RNA, 64 nt, Homo Sapiens; identical to SEQ ID NO: 605904

SEQ ID NO: 657114 - RNA, 52 nt, Homo Sapiens; identical to SEQ ID NO: 605905

SEQ ID NO: 657115 - RNA, 64 nt, Homo Sapiens; identical to SEQ ID NO: 605906

SEQ ID NO: 657116 - RNA, 64 nt, Homo Sapiens; identical to SEQ ID NO: 605907

SEQ ID NO: 657117 - RNA, 64 nt, Homo Sapiens; identical to SEQ ID NO: 605908

SEQ ID NO: 657118 - RNA, 64 nt, Homo Sapiens; identical to SEQ ID NO: 605909

SEQ ID NO: 657119 - RNA, 64 nt, Homo Sapiens; identical to SEQ ID NO: 605910

SEQ ID NO: 657120 - RNA, 64 nt, Homo Sapiens; identical to SEQ ID NO: 605911

SEQ ID NO: 657121 - RNA, 64 nt, Homo Sapiens; identical to SEQ ID NO: 605912

SEQ ID NO: 657122 - RNA, 64 nt, Homo Sapiens; identical to SEQ ID NO: 605913

SEQ ID NO: 657123 - RNA, 64 nt, Homo Sapiens; identical to SEQ ID NO: 605914

SEQ ID NO: 657124 - RNA, 64 nt, Homo Sapiens; identical to SEQ ID NO: 605915

SEQ ID NO: 657125 - RNA, 64 nt, Homo Sapiens; identical to SEQ ID NO: 605916

SEQ ID NO: 657126 - RNA, 64 nt, Homo Sapiens; identical to SEQ ID NO: 605917

SEQ ID NO: 657127 - RNA, 64 nt, Homo Sapiens; identical to SEQ ID NO: 605918

SEQ ID NO: 657128 - RNA, 64 nt, Homo Sapiens; identical to SEQ ID NO: 605919

SEQ ID NO: 657129 - RNA, 64 nt, Homo Sapiens; identical to SEQ ID NO: 605920

SEQ ID NO: 657130 - RNA, 64 nt, Homo Sapiens; identical to SEQ ID NO: 605921

SEQ ID NO: 657131 - RNA, 64 nt, Homo Sapiens; identical to SEQ ID NO: 605922

SEQ ID NO: 657132 - RNA, 64 nt, Homo Sapiens; identical to SEQ ID NO: 605923

SEQ ID NO: 657133 - RNA, 64 nt, Homo Sapiens; identical to SEQ ID NO: 605924

SEQ ID NO: 657134 - RNA, 64 nt, Homo Sapiens; identical to SEQ ID NO: 605925

SEQ ID NO: 657135 - RNA, 64 nt, Homo Sapiens; identical to SEQ ID NO: 605926

SEQ ID NO: 657136 - RNA, 64 nt, Homo Sapiens; identical to SEQ ID NO: 605927

SEQ ID NO: 657137 - RNA, 64 nt, Homo Sapiens; identical to SEQ ID NO: 605928

SEQ ID NO: 657138 - RNA, 64 nt, Homo Sapiens; identical to SEQ ID NO: 605929

SEQ ID NO: 657139 - RNA, 64 nt, Homo Sapiens; identical to SEQ ID NO: 605930

SEQ ID NO: 657140 - RNA, 64 nt, Homo Sapiens; identical to SEQ ID NO: 605931

SEQ ID NO: 657141 - RNA, 64 nt, Homo Sapiens; identical to SEQ ID NO: 605932

SEQ ID NO: 657142 - RNA, 64 nt, Homo Sapiens; identical to SEQ ID NO: 605933

SEQ ID NO: 657143 - RNA, 64 nt, Homo Sapiens; identical to SEQ ID NO: 605934

SEQ ID NO: 657144 - RNA, 64 nt, Homo Sapiens; identical to SEQ ID NO: 605935

SEQ ID NO: 657145 - RNA, 64 nt, Homo Sapiens; identical to SEQ ID NO: 605936

SEQ ID NO: 657146 - RNA, 64 nt, Homo Sapiens; identical to SEQ ID NO: 605937

SEQ ID NO: 657147 - RNA, 64 nt, Homo Sapiens; identical to SEQ ID NO: 605938

SEQ ID NO: 657148 - RNA, 64 nt, Homo Sapiens; identical to SEQ ID NO: 605939

SEQ ID NO: 657149 - RNA, 64 nt, Homo Sapiens; identical to SEQ ID NO: 605940

SEQ ID NO: 657150 - RNA, 64 nt, Homo Sapiens; identical to SEQ ID NO: 605941

SEQ ID NO: 657151 - RNA, 64 nt, Homo Sapiens; identical to SEQ ID NO: 605942

SEQ ID NO: 657152 - RNA, 64 nt, Homo Sapiens; identical to SEQ ID NO: 605943

SEQ ID NO: 657153 - RNA, 64 nt, Homo Sapiens; identical to SEQ ID NO: 605944

SEQ ID NO: 657154 - RNA, 64 nt, Homo Sapiens; identical to SEQ ID NO: 605945

SEQ ID NO: 657155 - RNA, 64 nt, Homo Sapiens; identical to SEQ ID NO: 605946

SEQ ID NO: 657156 - RNA, 64 nt, Homo Sapiens; identical to SEQ ID NO: 605947

SEQ ID NO: 657157 - RNA, 64 nt, Homo Sapiens; identical to SEQ ID NO: 605948

SEQ ID NO: 657158 - RNA, 64 nt, Homo Sapiens; identical to SEQ ID NO: 605949

SEQ ID NO: 657159 - RNA, 64 nt, Homo Sapiens; identical to SEQ ID NO: 605950

SEQ ID NO: 657160 - RNA, 64 nt, Homo Sapiens; identical to SEQ ID NO: 605951

SEQ ID NO: 657161 - RNA, 64 nt, Homo Sapiens; identical to SEQ ID NO: 605952

SEQ ID NO: 657162 - RNA, 64 nt, Homo Sapiens; identical to SEQ ID NO: 605953

SEQ ID NO: 657163 - RNA, 64 nt, Homo Sapiens; identical to SEQ ID NO: 605954

SEQ ID NO: 657164 - RNA, 64 nt, Homo Sapiens; identical to SEQ ID NO: 605955

SEQ ID NO: 657165 - RNA, 64 nt, Homo Sapiens; identical to SEQ ID NO: 605956

SEQ ID NO: 657166 - RNA, 64 nt, Homo Sapiens; identical to SEQ ID NO: 605957

SEQ ID NO: 657167 - RNA, 64 nt, Homo Sapiens; identical to SEQ ID NO: 605958

SEQ ID NO: 657168 - RNA, 64 nt, Homo Sapiens; identical to SEQ ID NO: 605959

SEQ ID NO: 657169 - RNA, 64 nt, Homo Sapiens; identical to SEQ ID NO: 605960

SEQ ID NO: 657170 - RNA, 64 nt, Homo Sapiens; identical to SEQ ID NO: 605961

SEQ ID NO: 657171 - RNA, 64 nt, Homo Sapiens; identical to SEQ ID NO: 605962

SEQ ID NO: 657172 - RNA, 64 nt, Homo Sapiens; identical to SEQ ID NO: 605963

SEQ ID NO: 657173 - RNA, 64 nt, Homo Sapiens; identical to SEQ ID NO: 605964

SEQ ID NO: 657174 - RNA, 64 nt, Homo Sapiens; identical to SEQ ID NO: 605965

SEQ ID NO: 657175 - RNA, 64 nt, Homo Sapiens; identical to SEQ ID NO: 605966

SEQ ID NO: 657176 - RNA, 64 nt, Homo Sapiens; identical to SEQ ID NO: 605967

SEQ ID NO: 657177 - RNA, 64 nt, Homo Sapiens; identical to SEQ ID NO: 605968

SEQ ID NO: 657178 - RNA, 64 nt, Homo Sapiens; identical to SEQ ID NO: 605969

SEQ ID NO: 657179 - RNA, 64 nt, Homo Sapiens; identical to SEQ ID NO: 605970

SEQ ID NO: 657180 - RNA, 64 nt, Homo Sapiens; identical to SEQ ID NO: 605971

SEQ ID NO: 657181 - RNA, 64 nt, Homo Sapiens; identical to SEQ ID NO: 605972

SEQ ID NO: 657182 - RNA, 64 nt, Homo Sapiens; identical to SEQ ID NO: 605973

SEQ ID NO: 657183 - RNA, 64 nt, Homo Sapiens; identical to SEQ ID NO: 605974

SEQ ID NO: 657184 - RNA, 64 nt, Homo Sapiens; identical to SEQ ID NO: 605975

SEQ ID NO: 657185 - RNA, 64 nt, Homo Sapiens; identical to SEQ ID NO: 605976

SEQ ID NO: 657186 - RNA, 64 nt, Homo Sapiens; identical to SEQ ID NO: 605977

SEQ ID NO: 657187 - RNA, 64 nt, Homo Sapiens; identical to SEQ ID NO: 605978

SEQ ID NO: 657188 - RNA, 64 nt, Homo Sapiens; identical to SEQ ID NO: 605979

SEQ ID NO: 657189 - RNA, 64 nt, Homo Sapiens; identical to SEQ ID NO: 605980

SEQ ID NO: 657190 - RNA, 64 nt, Homo Sapiens; identical to SEQ ID NO: 605981

SEQ ID NO: 657191 - RNA, 64 nt, Homo Sapiens; identical to SEQ ID NO: 605982

SEQ ID NO: 657192 - RNA, 64 nt, Homo Sapiens; identical to SEQ ID NO: 605983

SEQ ID NO: 657193 - RNA, 64 nt, Homo Sapiens; identical to SEQ ID NO: 605984

SEQ ID NO: 657194 - RNA, 64 nt, Homo Sapiens; identical to SEQ ID NO: 605985

SEQ ID NO: 657195 - RNA, 64 nt, Homo Sapiens; identical to SEQ ID NO: 605986

SEQ ID NO: 657196 - RNA, 64 nt, Homo Sapiens; identical to SEQ ID NO: 605987

SEQ ID NO: 657197 - RNA, 64 nt, Homo Sapiens; identical to SEQ ID NO: 605988

SEQ ID NO: 657198 - RNA, 64 nt, Homo Sapiens; identical to SEQ ID NO: 605989

SEQ ID NO: 657199 - RNA, 64 nt, Homo Sapiens; identical to SEQ ID NO: 605990

SEQ ID NO: 657200 - RNA, 64 nt, Homo Sapiens; identical to SEQ ID NO: 605991

SEQ ID NO: 657201 - RNA, 64 nt, Homo Sapiens; identical to SEQ ID NO: 605992

SEQ ID NO: 657202 - RNA, 64 nt, Homo Sapiens; identical to SEQ ID NO: 605993

SEQ ID NO: 657203 - RNA, 64 nt, Homo Sapiens; identical to SEQ ID NO: 605994

SEQ ID NO: 657204 - RNA, 64 nt, Homo Sapiens; identical to SEQ ID NO: 605995

SEQ ID NO: 657205 - RNA, 64 nt, Homo Sapiens; identical to SEQ ID NO: 605996

SEQ ID NO: 657206 - RNA, 64 nt, Homo Sapiens; identical to SEQ ID NO: 605997

SEQ ID NO: 657207 - RNA, 64 nt, Homo Sapiens; identical to SEQ ID NO: 605998

SEQ ID NO: 657208 - RNA, 64 nt, Homo Sapiens; identical to SEQ ID NO: 605999

SEQ ID NO: 657209 - RNA, 64 nt, Homo Sapiens; identical to SEQ ID NO: 606000

SEQ ID NO: 657210 - RNA, 64 nt, Homo Sapiens; identical to SEQ ID NO: 606001

SEQ ID NO: 657211 - RNA, 64 nt, Homo Sapiens; identical to SEQ ID NO: 606002

SEQ ID NO: 657212 - RNA, 64 nt, Homo Sapiens; identical to SEQ ID NO: 606003

SEQ ID NO: 657213 - RNA, 64 nt, Homo Sapiens; identical to SEQ ID NO: 606004

SEQ ID NO: 657214 - RNA, 64 nt, Homo Sapiens; identical to SEQ ID NO: 606005

SEQ ID NO: 657215 - RNA, 64 nt, Homo Sapiens; identical to SEQ ID NO: 606006

SEQ ID NO: 657216 - RNA, 64 nt, Homo Sapiens; identical to SEQ ID NO: 606007

SEQ ID NO: 657217 - RNA, 64 nt, Homo Sapiens; identical to SEQ ID NO: 606008

SEQ ID NO: 657218 - RNA, 64 nt, Homo Sapiens; identical to SEQ ID NO: 606009

SEQ ID NO: 657219 - RNA, 64 nt, Homo Sapiens; identical to SEQ ID NO: 606010

SEQ ID NO: 657220 - RNA, 64 nt, Homo Sapiens; identical to SEQ ID NO: 606011

SEQ ID NO: 657221 - RNA, 64 nt, Homo Sapiens; identical to SEQ ID NO: 606012

SEQ ID NO: 657222 - RNA, 64 nt, Homo Sapiens; identical to SEQ ID NO: 606013

SEQ ID NO: 657223 - RNA, 64 nt, Homo Sapiens; identical to SEQ ID NO: 606014

SEQ ID NO: 657224 - RNA, 56 nt, Homo Sapiens; identical to SEQ ID NO: 606015

SEQ ID NO: 657225 - RNA, 64 nt, Homo Sapiens; identical to SEQ ID NO: 606016

SEQ ID NO: 657226 - RNA, 64 nt, Homo Sapiens; identical to SEQ ID NO: 606017

SEQ ID NO: 657227 - RNA, 64 nt, Homo Sapiens; identical to SEQ ID NO: 606018

SEQ ID NO: 657228 - RNA, 64 nt, Homo Sapiens; identical to SEQ ID NO: 606019

SEQ ID NO: 657229 - RNA, 64 nt, Homo Sapiens; identical to SEQ ID NO: 606020

SEQ ID NO: 657230 - RNA, 64 nt, Homo Sapiens; identical to SEQ ID NO: 606021

SEQ ID NO: 657231 - RNA, 64 nt, Homo Sapiens; identical to SEQ ID NO: 606022

SEQ ID NO: 657232 - RNA, 64 nt, Homo Sapiens; identical to SEQ ID NO: 606023

SEQ ID NO: 657233 - RNA, 64 nt, Homo Sapiens; identical to SEQ ID NO: 606024

SEQ ID NO: 657234 - RNA, 64 nt, Homo Sapiens; identical to SEQ ID NO: 606025

SEQ ID NO: 657235 - RNA, 64 nt, Homo Sapiens; identical to SEQ ID NO: 52236

SEQ ID NO: 657236 - RNA, 64 nt, Homo Sapiens; identical to SEQ ID NO: 52237

SEQ ID NO: 657237 - RNA, 64 nt, Homo Sapiens; identical to SEQ ID NO: 52238

SEQ ID NO: 657238 - RNA, 64 nt, Homo Sapiens; identical to SEQ ID NO: 52239

SEQ ID NO: 657239 - RNA, 64 nt, Homo Sapiens; identical to SEQ ID NO: 52240

SEQ ID NO: 657240 - RNA, 64 nt, Homo Sapiens; identical to SEQ ID NO: 52241

SEQ ID NO: 657241 - RNA, 64 nt, Homo Sapiens; identical to SEQ ID NO: 52242

SEQ ID NO: 657242 - RNA, 64 nt, Homo Sapiens; identical to SEQ ID NO: 52243

SEQ ID NO: 657243 - RNA, 64 nt, Homo Sapiens; identical to SEQ ID NO: 52244

SEQ ID NO: 657244 - RNA, 64 nt, Homo Sapiens; identical to SEQ ID NO: 52245

SEQ ID NO: 657245 - RNA, 64 nt, Homo Sapiens; identical to SEQ ID NO: 52246

SEQ ID NO: 657246 - RNA, 64 nt, Homo Sapiens; identical to SEQ ID NO: 52247

SEQ ID NO: 657247 - RNA, 64 nt, Homo Sapiens; identical to SEQ ID NO: 52248

SEQ ID NO: 657248 - RNA, 64 nt, Homo Sapiens; identical to SEQ ID NO: 52249

SEQ ID NO: 657249 - RNA, 64 nt, Homo Sapiens; identical to SEQ ID NO: 52250

SEQ ID NO: 657250 - RNA, 64 nt, Homo Sapiens; identical to SEQ ID NO: 52251

SEQ ID NO: 657251 - RNA, 64 nt, Homo Sapiens; identical to SEQ ID NO: 52252

SEQ ID NO: 657252 - RNA, 64 nt, Homo Sapiens; identical to SEQ ID NO: 52253

SEQ ID NO: 657253 - RNA, 64 nt, Homo Sapiens; identical to SEQ ID NO: 52254

SEQ ID NO: 657254 - RNA, 64 nt, Homo Sapiens; identical to SEQ ID NO: 52255

SEQ ID NO: 657255 - RNA, 64 nt, Homo Sapiens; identical to SEQ ID NO: 60066

SEQ ID NO: 657256 - RNA, 64 nt, Homo Sapiens; identical to SEQ ID NO: 60067

SEQ ID NO: 657257 - RNA, 64 nt, Homo Sapiens; identical to SEQ ID NO: 60068

SEQ ID NO: 657258 - RNA, 64 nt, Homo Sapiens; identical to SEQ ID NO: 60069

SEQ ID NO: 657259 - RNA, 64 nt, Homo Sapiens; identical to SEQ ID NO: 60070

SEQ ID NO: 657260 - RNA, 64 nt, Homo Sapiens; identical to SEQ ID NO: 60071

SEQ ID NO: 657261 - RNA, 64 nt, Homo Sapiens; identical to SEQ ID NO: 60072

SEQ ID NO: 657262 - RNA, 64 nt, Homo Sapiens; identical to SEQ ID NO: 60073

SEQ ID NO: 657263 - RNA, 64 nt, Homo Sapiens; identical to SEQ ID NO: 60074

SEQ ID NO: 657264 - RNA, 64 nt, Homo Sapiens; identical to SEQ ID NO: 60075

SEQ ID NO: 657265 - RNA, 64 nt, Homo Sapiens; identical to SEQ ID NO: 60076

SEQ ID NO: 657266 - RNA, 64 nt, Homo Sapiens; identical to SEQ ID NO: 115740

SEQ ID NO: 657267 - RNA, 64 nt, Homo Sapiens; identical to SEQ ID NO: 115741

SEQ ID NO: 657268 - RNA, 64 nt, Homo Sapiens; identical to SEQ ID NO: 115742

SEQ ID NO: 657269 - RNA, 64 nt, Homo Sapiens; identical to SEQ ID NO: 115743

SEQ ID NO: 657270 - RNA, 64 nt, Homo Sapiens; identical to SEQ ID NO: 115744

SEQ ID NO: 657271 - RNA, 64 nt, Homo Sapiens; identical to SEQ ID NO: 115745

SEQ ID NO: 657272 - RNA, 64 nt, Homo Sapiens; identical to SEQ ID NO: 115746

SEQ ID NO: 657273 - RNA, 64 nt, Homo Sapiens; identical to SEQ ID NO: 115747

SEQ ID NO: 657274 - RNA, 64 nt, Homo Sapiens; identical to SEQ ID NO: 115748

SEQ ID NO: 657275 - RNA, 64 nt, Homo Sapiens; identical to SEQ ID NO: 115749

SEQ ID NO: 657276 - RNA, 64 nt, Homo Sapiens; identical to SEQ ID NO: 115750

SEQ ID NO: 657277 - RNA, 64 nt, Homo Sapiens; identical to SEQ ID NO: 115751

SEQ ID NO: 657278 - RNA, 64 nt, Homo Sapiens; identical to SEQ ID NO: 115752

SEQ ID NO: 657279 - RNA, 64 nt, Homo Sapiens; identical to SEQ ID NO: 115753

SEQ ID NO: 657280 - RNA, 64 nt, Homo Sapiens; identical to SEQ ID NO: 115754

SEQ ID NO: 657281 - RNA, 64 nt, Homo Sapiens; identical to SEQ ID NO: 115755

SEQ ID NO: 657282 - RNA, 64 nt, Homo Sapiens; identical to SEQ ID NO: 115756

SEQ ID NO: 657283 - RNA, 64 nt, Homo Sapiens; identical to SEQ ID NO: 115757

SEQ ID NO: 657284 - RNA, 64 nt, Homo Sapiens; identical to SEQ ID NO: 115758

SEQ ID NO: 657285 - RNA, 64 nt, Homo Sapiens; identical to SEQ ID NO: 115759

SEQ ID NO: 657286 - RNA, 64 nt, Homo Sapiens; identical to SEQ ID NO: 115760

SEQ ID NO: 657287 - RNA, 64 nt, Homo Sapiens; identical to SEQ ID NO: 115761

SEQ ID NO: 657288 - RNA, 64 nt, Homo Sapiens; identical to SEQ ID NO: 115762

SEQ ID NO: 657289 - RNA, 64 nt, Homo Sapiens; identical to SEQ ID NO: 115763

SEQ ID NO: 657290 - RNA, 64 nt, Homo Sapiens; identical to SEQ ID NO: 115764

SEQ ID NO: 657291 - RNA, 64 nt, Homo Sapiens; identical to SEQ ID NO: 115765

SEQ ID NO: 657292 - RNA, 64 nt, Homo Sapiens; identical to SEQ ID NO: 115766

SEQ ID NO: 657293 - RNA, 64 nt, Homo Sapiens; identical to SEQ ID NO: 115767

SEQ ID NO: 657294 - RNA, 64 nt, Homo Sapiens; identical to SEQ ID NO: 115768

SEQ ID NO: 657295 - RNA, 64 nt, Homo Sapiens; identical to SEQ ID NO: 115769

SEQ ID NO: 657296 - RNA, 64 nt, Homo Sapiens; identical to SEQ ID NO: 115770

SEQ ID NO: 657297 - RNA, 64 nt, Homo Sapiens; identical to SEQ ID NO: 115771

SEQ ID NO: 657298 - RNA, 64 nt, Homo Sapiens; identical to SEQ ID NO: 115772

SEQ ID NO: 657299 - RNA, 64 nt, Homo Sapiens; identical to SEQ ID NO: 115773

SEQ ID NO: 657300 - RNA, 64 nt, Homo Sapiens; identical to SEQ ID NO: 115774

SEQ ID NO: 657301 - RNA, 64 nt, Homo Sapiens; identical to SEQ ID NO: 115775

SEQ ID NO: 657302 - RNA, 64 nt, Homo Sapiens; identical to SEQ ID NO: 115776

SEQ ID NO: 657303 - RNA, 64 nt, Homo Sapiens; identical to SEQ ID NO: 115777

SEQ ID NO: 657304 - RNA, 64 nt, Homo Sapiens; identical to SEQ ID NO: 336816

SEQ ID NO: 657305 - RNA, 64 nt, Homo Sapiens; identical to SEQ ID NO: 336817

SEQ ID NO: 657306 - RNA, 64 nt, Homo Sapiens; identical to SEQ ID NO: 336818

SEQ ID NO: 657307 - RNA, 64 nt, Homo Sapiens; identical to SEQ ID NO: 336819

SEQ ID NO: 657308 - RNA, 64 nt, Homo Sapiens; identical to SEQ ID NO: 336820

SEQ ID NO: 657309 - RNA, 64 nt, Homo Sapiens; identical to SEQ ID NO: 336821

SEQ ID NO: 657310 - RNA, 64 nt, Homo Sapiens; identical to SEQ ID NO: 336822

SEQ ID NO: 657311 - RNA, 64 nt, Homo Sapiens; identical to SEQ ID NO: 336823

SEQ ID NO: 657312 - RNA, 64 nt, Homo Sapiens; identical to SEQ ID NO: 336824

SEQ ID NO: 657313 - RNA, 64 nt, Homo Sapiens; identical to SEQ ID NO: 336825

SEQ ID NO: 657314 - RNA, 64 nt, Homo Sapiens; identical to SEQ ID NO: 336826

SEQ ID NO: 657315 - RNA, 64 nt, Homo Sapiens; identical to SEQ ID NO: 336827

SEQ ID NO: 657316 - RNA, 64 nt, Homo Sapiens; identical to SEQ ID NO: 336828

SEQ ID NO: 657317 - RNA, 64 nt, Homo Sapiens; identical to SEQ ID NO: 336829

SEQ ID NO: 657318 - RNA, 61 nt, Homo Sapiens; identical to SEQ ID NO: 336830

SEQ ID NO: 657319 - RNA, 64 nt, Homo Sapiens; identical to SEQ ID NO: 336831

SEQ ID NO: 657320 - RNA, 64 nt, Homo Sapiens; identical to SEQ ID NO: 336832

SEQ ID NO: 657321 - RNA, 64 nt, Homo Sapiens; identical to SEQ ID NO: 336833

SEQ ID NO: 657322 - RNA, 64 nt, Homo Sapiens; identical to SEQ ID NO: 336834

SEQ ID NO: 657323 - RNA, 62 nt, Homo Sapiens
ucaaaccccagcugggcccgccaagccaaggccuccccuaccgggcccuggagcugcugggg

SEQ ID NO: 657324 - RNA, 55 nt, Homo Sapiens; identical to SEQ ID NO: 21545

SEQ ID NO: 657325 - RNA, 62 nt, Homo Sapiens
aaacuucauuacuuuccuuaggcccucugccccuccccuagcauauggcucuuucuccuauu

SEQ ID NO: 657326 - RNA, 62 nt, Homo Sapiens
uuuaucauuucagcuacacauaaaagguuucucuccccuauggauuuugcuaaugguugagu

SEQ ID NO: 657327 - RNA, 62 nt, Homo Sapiens
gaggcccuacccgugucuaaacccuccucucacuccccuaagccuggugaaagagucagaag

SEQ ID NO: 657328 - RNA, 62 nt, Homo Sapiens
acuucaucuucuuggugucucauguccucauucuccccuauaugacaugcaaaaacgaucuu

SEQ ID NO: 657329 - RNA, 62 nt, Homo Sapiens
gguuggguguccauggugcccugggcuguguccuccccuagggaugagggucgggccuccac

SEQ ID NO: 657330 - RNA, 62 nt, Homo Sapiens
gguuggauguccaagaugcccugggcuguguacuccccuaggaaugagggcuggguguccaa

SEQ ID NO: 657331 - RNA, 62 nt, Homo Sapiens
cagggcuguggacccagacucuucucaaccuucuccccuaccuuugcacaaugaaguuucag

SEQ ID NO: 657332 - RNA, 62 nt, Homo Sapiens
gaggguggggguguaguuacagguggaaggggcuccccuagaauagucugggaacaugguca

SEQ ID NO: 657333 - RNA, 62 nt, Homo Sapiens
aguccauccuguacaucucaagcaagggguuccuccccuagcaccugggcuuggcagaaggg

SEQ ID NO: 657334 - RNA, 62 nt, Homo Sapiens
gcuuggcagaagggccauaguucauccagcuccuccccuagagcaaugcugaggagcggggg

SEQ ID NO: 657335 - RNA, 62 nt, Homo Sapiens
caagugggucaggccuggcccagguccuuauacuccccuaucuuguccuagcccaggccucc

SEQ ID NO: 657336 - RNA, 62 nt, Homo Sapiens
uggcauugccccagagcucuccagagaugagccuccccuauccccacccuguccccgucccc

SEQ ID NO: 657337 - RNA, 62 nt, Homo Sapiens
gccuccagggggaacuggaggcaggaaggauccuccccuagagcccccaggagcugggagag

SEQ ID NO: 657338 - RNA, 62 nt, Homo Sapiens
gucucuggagggaacuggaugcaggaaggacccuccccuagaguccccaggagcugggagag

SEQ ID NO: 657339 - RNA, 64 nt, Homo Sapiens
uaaacuaaacuaaugugaacaguagggaagcaagggcccaaaugcauaaguuucuuugcacugu

SEQ ID NO: 657340 - RNA, 64 nt, Homo Sapiens
gaacaacaggauagagcuguugggguggcacaguggcccaaagagcagcuucagagauaauucc

SEQ ID NO: 657341 - RNA, 64 nt, Homo Sapiens
gaugcguuaaaaugacaugagcaggcgacucaguggcccaaaacaggacccagaacauucaucc

SEQ ID NO: 657342 - RNA, 64 nt, Homo Sapiens
aacauucauccguaaauggaaucugauaaucuggggcccaaauucuguuuacuuaacaugugag

SEQ ID NO: 657343 - RNA, 64 nt, Homo Sapiens
gucccaaaguaggccucgccauguggcccaaaguggcccaaagcgccccaagcugccuuccucg

SEQ ID NO: 657344 - RNA, 64 nt, Homo Sapiens
ggcccaaagcgucccaaagugccuuccucgauguggcccaaagugcgccucccggccccaagcu

SEQ ID NO: 657345 - RNA, 64 nt, Homo Sapiens
gauaagauguaguucauguuuuucuguagcacugggcccaaauauucuuuguaaagaaaaucgc

SEQ ID NO: 657346 - RNA, 64 nt, Homo Sapiens
agugcugggauuacaggcgugagccaccaugcccggcccaaauauuuuuuauucaggaugguau

SEQ ID NO: 657347 - RNA, 64 nt, Homo Sapiens; identical to SEQ ID NO: 553500

SEQ ID NO: 657348 - RNA, 64 nt, Homo Sapiens; identical to SEQ ID NO: 553501

SEQ ID NO: 657349 - RNA, 64 nt, Homo Sapiens; identical to SEQ ID NO: 553502

SEQ ID NO: 657350 - RNA, 64 nt, Homo Sapiens; identical to SEQ ID NO: 553503

SEQ ID NO: 657351 - RNA, 64 nt, Homo Sapiens; identical to SEQ ID NO: 553504

SEQ ID NO: 657352 - RNA, 64 nt, Homo Sapiens; identical to SEQ ID NO: 553505

SEQ ID NO: 657353 - RNA, 64 nt, Homo Sapiens; identical to SEQ ID NO: 553506

SEQ ID NO: 657354 - RNA, 64 nt, Homo Sapiens; identical to SEQ ID NO: 553507

SEQ ID NO: 657355 - RNA, 64 nt, Homo Sapiens; identical to SEQ ID NO: 553508

SEQ ID NO: 657356 - RNA, 64 nt, Homo Sapiens; identical to SEQ ID NO: 553509

SEQ ID NO: 657357 - RNA, 64 nt, Homo Sapiens; identical to SEQ ID NO: 553510

SEQ ID NO: 657358 - RNA, 64 nt, Homo Sapiens; identical to SEQ ID NO: 553511

SEQ ID NO: 657359 - RNA, 64 nt, Homo Sapiens; identical to SEQ ID NO: 553512

SEQ ID NO: 657360 - RNA, 64 nt, Homo Sapiens; identical to SEQ ID NO: 553513

SEQ ID NO: 657361 - RNA, 64 nt, Homo Sapiens; identical to SEQ ID NO: 553514

SEQ ID NO: 657362 - RNA, 64 nt, Homo Sapiens; identical to SEQ ID NO: 553515

SEQ ID NO: 657363 - RNA, 64 nt, Homo Sapiens; identical to SEQ ID NO: 553516

SEQ ID NO: 657364 - RNA, 64 nt, Homo Sapiens; identical to SEQ ID NO: 553517

SEQ ID NO: 657365 - RNA, 64 nt, Homo Sapiens; identical to SEQ ID NO: 553518

SEQ ID NO: 657366 - RNA, 64 nt, Homo Sapiens; identical to SEQ ID NO: 553519

SEQ ID NO: 657367 - RNA, 64 nt, Homo Sapiens; identical to SEQ ID NO: 553520

SEQ ID NO: 657368 - RNA, 64 nt, Homo Sapiens; identical to SEQ ID NO: 553521

SEQ ID NO: 657369 - RNA, 64 nt, Homo Sapiens; identical to SEQ ID NO: 553522

SEQ ID NO: 657370 - RNA, 64 nt, Homo Sapiens; identical to SEQ ID NO: 553523

SEQ ID NO: 657371 - RNA, 64 nt, Homo Sapiens; identical to SEQ ID NO: 553524

SEQ ID NO: 657372 - RNA, 64 nt, Homo Sapiens; identical to SEQ ID NO: 553525

SEQ ID NO: 657373 - RNA, 64 nt, Homo Sapiens; identical to SEQ ID NO: 553526

SEQ ID NO: 657374 - RNA, 64 nt, Homo Sapiens; identical to SEQ ID NO: 553527

SEQ ID NO: 657375 - RNA, 64 nt, Homo Sapiens; identical to SEQ ID NO: 553528

SEQ ID NO: 657376 - RNA, 64 nt, Homo Sapiens; identical to SEQ ID NO: 553529

SEQ ID NO: 657377 - RNA, 64 nt, Homo Sapiens; identical to SEQ ID NO: 553530

SEQ ID NO: 657378 - RNA, 64 nt, Homo Sapiens; identical to SEQ ID NO: 553531

SEQ ID NO: 657379 - RNA, 64 nt, Homo Sapiens; identical to SEQ ID NO: 553532

SEQ ID NO: 657380 - RNA, 64 nt, Homo Sapiens; identical to SEQ ID NO: 553533

SEQ ID NO: 657381 - RNA, 64 nt, Homo Sapiens; identical to SEQ ID NO: 553534

SEQ ID NO: 657382 - RNA, 64 nt, Homo Sapiens; identical to SEQ ID NO: 553535

SEQ ID NO: 657383 - RNA, 64 nt, Homo Sapiens; identical to SEQ ID NO: 553536

SEQ ID NO: 657384 - RNA, 64 nt, Homo Sapiens; identical to SEQ ID NO: 553537

SEQ ID NO: 657385 - RNA, 64 nt, Homo Sapiens; identical to SEQ ID NO: 553538

SEQ ID NO: 657386 - RNA, 64 nt, Homo Sapiens; identical to SEQ ID NO: 553539

SEQ ID NO: 657387 - RNA, 64 nt, Homo Sapiens; identical to SEQ ID NO: 553540

SEQ ID NO: 657388 - RNA, 64 nt, Homo Sapiens; identical to SEQ ID NO: 553541

SEQ ID NO: 657389 - RNA, 64 nt, Homo Sapiens; identical to SEQ ID NO: 236284

SEQ ID NO: 657390 - RNA, 64 nt, Homo Sapiens; identical to SEQ ID NO: 236285

SEQ ID NO: 657391 - RNA, 64 nt, Homo Sapiens; identical to SEQ ID NO: 236286

SEQ ID NO: 657392 - RNA, 64 nt, Homo Sapiens; identical to SEQ ID NO: 236287

SEQ ID NO: 657393 - RNA, 64 nt, Homo Sapiens; identical to SEQ ID NO: 236288

SEQ ID NO: 657394 - RNA, 64 nt, Homo Sapiens; identical to SEQ ID NO: 236289

SEQ ID NO: 657395 - RNA, 64 nt, Homo Sapiens; identical to SEQ ID NO: 184094

SEQ ID NO: 657396 - RNA, 64 nt, Homo Sapiens; identical to SEQ ID NO: 184095

SEQ ID NO: 657397 - RNA, 64 nt, Homo Sapiens; identical to SEQ ID NO: 184096

SEQ ID NO: 657398 - RNA, 64 nt, Homo Sapiens; identical to SEQ ID NO: 184097

SEQ ID NO: 657399 - RNA, 64 nt, Homo Sapiens; identical to SEQ ID NO: 184098

SEQ ID NO: 657400 - RNA, 64 nt, Homo Sapiens; identical to SEQ ID NO: 184099

SEQ ID NO: 657401 - RNA, 64 nt, Homo Sapiens; identical to SEQ ID NO: 184100

SEQ ID NO: 657402 - RNA, 64 nt, Homo Sapiens; identical to SEQ ID NO: 184101

SEQ ID NO: 657403 - RNA, 64 nt, Homo Sapiens; identical to SEQ ID NO: 184102

SEQ ID NO: 657404 - RNA, 64 nt, Homo Sapiens; identical to SEQ ID NO: 184103

SEQ ID NO: 657405 - RNA, 64 nt, Homo Sapiens; identical to SEQ ID NO: 184104

SEQ ID NO: 657406 - RNA, 64 nt, Homo Sapiens; identical to SEQ ID NO: 184105

SEQ ID NO: 657407 - RNA, 64 nt, Homo Sapiens; identical to SEQ ID NO: 184106

SEQ ID NO: 657408 - RNA, 64 nt, Homo Sapiens; identical to SEQ ID NO: 184107

SEQ ID NO: 657409 - RNA, 64 nt, Homo Sapiens; identical to SEQ ID NO: 184108

SEQ ID NO: 657410 - RNA, 64 nt, Homo Sapiens; identical to SEQ ID NO: 184109

SEQ ID NO: 657411 - RNA, 64 nt, Homo Sapiens; identical to SEQ ID NO: 184110

SEQ ID NO: 657412 - RNA, 64 nt, Homo Sapiens; identical to SEQ ID NO: 184111

SEQ ID NO: 657413 - RNA, 64 nt, Homo Sapiens; identical to SEQ ID NO: 184112

SEQ ID NO: 657414 - RNA, 64 nt, Homo Sapiens; identical to SEQ ID NO: 184113

SEQ ID NO: 657415 - RNA, 64 nt, Homo Sapiens; identical to SEQ ID NO: 184114

SEQ ID NO: 657416 - RNA, 64 nt, Homo Sapiens; identical to SEQ ID NO: 184115

SEQ ID NO: 657417 - RNA, 64 nt, Homo Sapiens; identical to SEQ ID NO: 184116

SEQ ID NO: 657418 - RNA, 64 nt, Homo Sapiens; identical to SEQ ID NO: 184117

SEQ ID NO: 657419 - RNA, 64 nt, Homo Sapiens; identical to SEQ ID NO: 184118

SEQ ID NO: 657420 - RNA, 64 nt, Homo Sapiens; identical to SEQ ID NO: 184119

SEQ ID NO: 657421 - RNA, 64 nt, Homo Sapiens; identical to SEQ ID NO: 184120

SEQ ID NO: 657422 - RNA, 64 nt, Homo Sapiens; identical to SEQ ID NO: 184121

SEQ ID NO: 657423 - RNA, 64 nt, Homo Sapiens; identical to SEQ ID NO: 140386

SEQ ID NO: 657424 - RNA, 64 nt, Homo Sapiens; identical to SEQ ID NO: 140387

SEQ ID NO: 657425 - RNA, 64 nt, Homo Sapiens; identical to SEQ ID NO: 140388

SEQ ID NO: 657426 - RNA, 64 nt, Homo Sapiens; identical to SEQ ID NO: 140389

SEQ ID NO: 657427 - RNA, 64 nt, Homo Sapiens; identical to SEQ ID NO: 140390

SEQ ID NO: 657428 - RNA, 64 nt, Homo Sapiens; identical to SEQ ID NO: 140391

SEQ ID NO: 657429 - RNA, 64 nt, Homo Sapiens; identical to SEQ ID NO: 140392

SEQ ID NO: 657430 - RNA, 64 nt, Homo Sapiens; identical to SEQ ID NO: 140393

SEQ ID NO: 657431 - RNA, 64 nt, Homo Sapiens; identical to SEQ ID NO: 140394

SEQ ID NO: 657432 - RNA, 64 nt, Homo Sapiens; identical to SEQ ID NO: 140395

SEQ ID NO: 657433 - RNA, 64 nt, Homo Sapiens; identical to SEQ ID NO: 140396

SEQ ID NO: 657434 - RNA, 64 nt, Homo Sapiens; identical to SEQ ID NO: 140397

SEQ ID NO: 657435 - RNA, 64 nt, Homo Sapiens; identical to SEQ ID NO: 140398

SEQ ID NO: 657436 - RNA, 64 nt, Homo Sapiens; identical to SEQ ID NO: 140399

SEQ ID NO: 657437 - RNA, 64 nt, Homo Sapiens; identical to SEQ ID NO: 140400

SEQ ID NO: 657438 - RNA, 64 nt, Homo Sapiens; identical to SEQ ID NO: 140401

SEQ ID NO: 657439 - RNA, 64 nt, Homo Sapiens; identical to SEQ ID NO: 140402

SEQ ID NO: 657440 - RNA, 64 nt, Homo Sapiens; identical to SEQ ID NO: 140403

SEQ ID NO: 657441 - RNA, 64 nt, Homo Sapiens; identical to SEQ ID NO: 140404

SEQ ID NO: 657442 - RNA, 64 nt, Homo Sapiens; identical to SEQ ID NO: 140405

SEQ ID NO: 657443 - RNA, 64 nt, Homo Sapiens; identical to SEQ ID NO: 140406

SEQ ID NO: 657444 - RNA, 64 nt, Homo Sapiens; identical to SEQ ID NO: 140407

SEQ ID NO: 657445 - RNA, 64 nt, Homo Sapiens; identical to SEQ ID NO: 140408

SEQ ID NO: 657446 - RNA, 64 nt, Homo Sapiens; identical to SEQ ID NO: 140409

SEQ ID NO: 657447 - RNA, 64 nt, Homo Sapiens; identical to SEQ ID NO: 140410

SEQ ID NO: 657448 - RNA, 64 nt, Homo Sapiens; identical to SEQ ID NO: 140411

SEQ ID NO: 657449 - RNA, 64 nt, Homo Sapiens; identical to SEQ ID NO: 140412

SEQ ID NO: 657450 - RNA, 64 nt, Homo Sapiens; identical to SEQ ID NO: 140413

SEQ ID NO: 657451 - RNA, 64 nt, Homo Sapiens; identical to SEQ ID NO: 140414

SEQ ID NO: 657452 - RNA, 64 nt, Homo Sapiens; identical to SEQ ID NO: 140415

SEQ ID NO: 657453 - RNA, 64 nt, Homo Sapiens; identical to SEQ ID NO: 140416

SEQ ID NO: 657454 - RNA, 64 nt, Homo Sapiens; identical to SEQ ID NO: 140417

SEQ ID NO: 657455 - RNA, 64 nt, Homo Sapiens; identical to SEQ ID NO: 140418

SEQ ID NO: 657456 - RNA, 64 nt, Homo Sapiens; identical to SEQ ID NO: 140419

SEQ ID NO: 657457 - RNA, 64 nt, Homo Sapiens; identical to SEQ ID NO: 140420

SEQ ID NO: 657458 - RNA, 64 nt, Homo Sapiens; identical to SEQ ID NO: 140421

SEQ ID NO: 657459 - RNA, 64 nt, Homo Sapiens; identical to SEQ ID NO: 140422

SEQ ID NO: 657460 - RNA, 64 nt, Homo Sapiens; identical to SEQ ID NO: 140423

SEQ ID NO: 657461 - RNA, 64 nt, Homo Sapiens; identical to SEQ ID NO: 140424

SEQ ID NO: 657462 - RNA, 64 nt, Homo Sapiens; identical to SEQ ID NO: 140425

SEQ ID NO: 657463 - RNA, 64 nt, Homo Sapiens; identical to SEQ ID NO: 140426

SEQ ID NO: 657464 - RNA, 64 nt, Homo Sapiens; identical to SEQ ID NO: 140427

SEQ ID NO: 657465 - RNA, 64 nt, Homo Sapiens; identical to SEQ ID NO: 140428

SEQ ID NO: 657466 - RNA, 64 nt, Homo Sapiens; identical to SEQ ID NO: 140429

SEQ ID NO: 657467 - RNA, 63 nt, Homo Sapiens; identical to SEQ ID NO: 140430

SEQ ID NO: 657468 - RNA, 64 nt, Homo Sapiens; identical to SEQ ID NO: 140431

SEQ ID NO: 657469 - RNA, 64 nt, Homo Sapiens; identical to SEQ ID NO: 140432

SEQ ID NO: 657470 - RNA, 64 nt, Homo Sapiens; identical to SEQ ID NO: 140433

SEQ ID NO: 657471 - RNA, 64 nt, Homo Sapiens; identical to SEQ ID NO: 140434

SEQ ID NO: 657472 - RNA, 52 nt, Homo Sapiens; identical to SEQ ID NO: 140435

SEQ ID NO: 657473 - RNA, 64 nt, Homo Sapiens; identical to SEQ ID NO: 140436

SEQ ID NO: 657474 - RNA, 64 nt, Homo Sapiens; identical to SEQ ID NO: 140437

SEQ ID NO: 657475 - RNA, 64 nt, Homo Sapiens; identical to SEQ ID NO: 140438

SEQ ID NO: 657476 - RNA, 64 nt, Homo Sapiens; identical to SEQ ID NO: 140439

SEQ ID NO: 657477 - RNA, 64 nt, Homo Sapiens; identical to SEQ ID NO: 140440

SEQ ID NO: 657478 - RNA, 64 nt, Homo Sapiens; identical to SEQ ID NO: 140441

SEQ ID NO: 657479 - RNA, 64 nt, Homo Sapiens; identical to SEQ ID NO: 140442

SEQ ID NO: 657480 - RNA, 64 nt, Homo Sapiens; identical to SEQ ID NO: 140443

SEQ ID NO: 657481 - RNA, 64 nt, Homo Sapiens; identical to SEQ ID NO: 140444

SEQ ID NO: 657482 - RNA, 64 nt, Homo Sapiens; identical to SEQ ID NO: 140445

SEQ ID NO: 657483 - RNA, 64 nt, Homo Sapiens; identical to SEQ ID NO: 140446

SEQ ID NO: 657484 - RNA, 64 nt, Homo Sapiens; identical to SEQ ID NO: 140447

SEQ ID NO: 657485 - RNA, 64 nt, Homo Sapiens; identical to SEQ ID NO: 140448

SEQ ID NO: 657486 - RNA, 64 nt, Homo Sapiens; identical to SEQ ID NO: 140449

SEQ ID NO: 657487 - RNA, 64 nt, Homo Sapiens; identical to SEQ ID NO: 140450

SEQ ID NO: 657488 - RNA, 64 nt, Homo Sapiens; identical to SEQ ID NO: 140451

SEQ ID NO: 657489 - RNA, 64 nt, Homo Sapiens; identical to SEQ ID NO: 140452

SEQ ID NO: 657490 - RNA, 64 nt, Homo Sapiens; identical to SEQ ID NO: 140453

SEQ ID NO: 657491 - RNA, 64 nt, Homo Sapiens; identical to SEQ ID NO: 140454

SEQ ID NO: 657492 - RNA, 64 nt, Homo Sapiens; identical to SEQ ID NO: 140455

SEQ ID NO: 657493 - RNA, 64 nt, Homo Sapiens; identical to SEQ ID NO: 140456

SEQ ID NO: 657494 - RNA, 64 nt, Homo Sapiens; identical to SEQ ID NO: 140457

SEQ ID NO: 657495 - RNA, 64 nt, Homo Sapiens; identical to SEQ ID NO: 140458

SEQ ID NO: 657496 - RNA, 64 nt, Homo Sapiens; identical to SEQ ID NO: 140459

SEQ ID NO: 657497 - RNA, 64 nt, Homo Sapiens; identical to SEQ ID NO: 140460

SEQ ID NO: 657498 - RNA, 64 nt, Homo Sapiens; identical to SEQ ID NO: 140461

SEQ ID NO: 657499 - RNA, 64 nt, Homo Sapiens; identical to SEQ ID NO: 140462

SEQ ID NO: 657500 - RNA, 64 nt, Homo Sapiens; identical to SEQ ID NO: 140463

SEQ ID NO: 657501 - RNA, 64 nt, Homo Sapiens; identical to SEQ ID NO: 140464

SEQ ID NO: 657502 - RNA, 64 nt, Homo Sapiens; identical to SEQ ID NO: 140465

SEQ ID NO: 657503 - RNA, 64 nt, Homo Sapiens; identical to SEQ ID NO: 140466

SEQ ID NO: 657504 - RNA, 64 nt, Homo Sapiens; identical to SEQ ID NO: 140467

SEQ ID NO: 657505 - RNA, 64 nt, Homo Sapiens; identical to SEQ ID NO: 140468

SEQ ID NO: 657506 - RNA, 64 nt, Homo Sapiens; identical to SEQ ID NO: 140469

SEQ ID NO: 657507 - RNA, 64 nt, Homo Sapiens; identical to SEQ ID NO: 140470

SEQ ID NO: 657508 - RNA, 64 nt, Homo Sapiens; identical to SEQ ID NO: 140471

SEQ ID NO: 657509 - RNA, 64 nt, Homo Sapiens; identical to SEQ ID NO: 140472

SEQ ID NO: 657510 - RNA, 64 nt, Homo Sapiens; identical to SEQ ID NO: 140473

SEQ ID NO: 657511 - RNA, 64 nt, Homo Sapiens; identical to SEQ ID NO: 140474

SEQ ID NO: 657512 - RNA, 64 nt, Homo Sapiens; identical to SEQ ID NO: 140475

SEQ ID NO: 657513 - RNA, 64 nt, Homo Sapiens; identical to SEQ ID NO: 140476

SEQ ID NO: 657514 - RNA, 64 nt, Homo Sapiens; identical to SEQ ID NO: 140477

SEQ ID NO: 657515 - RNA, 64 nt, Homo Sapiens; identical to SEQ ID NO: 140478

SEQ ID NO: 657516 - RNA, 64 nt, Homo Sapiens; identical to SEQ ID NO: 140479

SEQ ID NO: 657517 - RNA, 64 nt, Homo Sapiens; identical to SEQ ID NO: 140480

SEQ ID NO: 657518 - RNA, 64 nt, Homo Sapiens; identical to SEQ ID NO: 140481

SEQ ID NO: 657519 - RNA, 64 nt, Homo Sapiens; identical to SEQ ID NO: 140482

SEQ ID NO: 657520 - RNA, 64 nt, Homo Sapiens; identical to SEQ ID NO: 140483

SEQ ID NO: 657521 - RNA, 64 nt, Homo Sapiens; identical to SEQ ID NO: 140484

SEQ ID NO: 657522 - RNA, 64 nt, Homo Sapiens; identical to SEQ ID NO: 140485

SEQ ID NO: 657523 - RNA, 64 nt, Homo Sapiens; identical to SEQ ID NO: 140486

SEQ ID NO: 657524 - RNA, 64 nt, Homo Sapiens; identical to SEQ ID NO: 140487

SEQ ID NO: 657525 - RNA, 64 nt, Homo Sapiens; identical to SEQ ID NO: 140488

SEQ ID NO: 657526 - RNA, 64 nt, Homo Sapiens; identical to SEQ ID NO: 140489

SEQ ID NO: 657527 - RNA, 64 nt, Homo Sapiens; identical to SEQ ID NO: 140490

SEQ ID NO: 657528 - RNA, 64 nt, Homo Sapiens; identical to SEQ ID NO: 140491

SEQ ID NO: 657529 - RNA, 64 nt, Homo Sapiens; identical to SEQ ID NO: 140492

SEQ ID NO: 657530 - RNA, 64 nt, Homo Sapiens; identical to SEQ ID NO: 140493

SEQ ID NO: 657531 - RNA, 64 nt, Homo Sapiens; identical to SEQ ID NO: 140494

SEQ ID NO: 657532 - RNA, 64 nt, Homo Sapiens; identical to SEQ ID NO: 140495

SEQ ID NO: 657533 - RNA, 64 nt, Homo Sapiens; identical to SEQ ID NO: 140496

SEQ ID NO: 657534 - RNA, 64 nt, Homo Sapiens; identical to SEQ ID NO: 140497

SEQ ID NO: 657535 - RNA, 64 nt, Homo Sapiens; identical to SEQ ID NO: 140498

SEQ ID NO: 657536 - RNA, 64 nt, Homo Sapiens; identical to SEQ ID NO: 140499

SEQ ID NO: 657537 - RNA, 64 nt, Homo Sapiens; identical to SEQ ID NO: 140500

SEQ ID NO: 657538 - RNA, 64 nt, Homo Sapiens; identical to SEQ ID NO: 140501

SEQ ID NO: 657539 - RNA, 64 nt, Homo Sapiens; identical to SEQ ID NO: 140502

SEQ ID NO: 657540 - RNA, 64 nt, Homo Sapiens; identical to SEQ ID NO: 140503

SEQ ID NO: 657541 - RNA, 64 nt, Homo Sapiens; identical to SEQ ID NO: 140504

SEQ ID NO: 657542 - RNA, 64 nt, Homo Sapiens; identical to SEQ ID NO: 140505

SEQ ID NO: 657543 - RNA, 64 nt, Homo Sapiens; identical to SEQ ID NO: 140506

SEQ ID NO: 657544 - RNA, 64 nt, Homo Sapiens; identical to SEQ ID NO: 140507

SEQ ID NO: 657545 - RNA, 64 nt, Homo Sapiens; identical to SEQ ID NO: 140508

SEQ ID NO: 657546 - RNA, 64 nt, Homo Sapiens; identical to SEQ ID NO: 140509

SEQ ID NO: 657547 - RNA, 64 nt, Homo Sapiens; identical to SEQ ID NO: 140510

SEQ ID NO: 657548 - RNA, 64 nt, Homo Sapiens; identical to SEQ ID NO: 140511

SEQ ID NO: 657549 - RNA, 64 nt, Homo Sapiens; identical to SEQ ID NO: 140512

SEQ ID NO: 657550 - RNA, 64 nt, Homo Sapiens; identical to SEQ ID NO: 140513

SEQ ID NO: 657551 - RNA, 64 nt, Homo Sapiens; identical to SEQ ID NO: 140514

SEQ ID NO: 657552 - RNA, 64 nt, Homo Sapiens; identical to SEQ ID NO: 140515

SEQ ID NO: 657553 - RNA, 64 nt, Homo Sapiens; identical to SEQ ID NO: 140516

SEQ ID NO: 657554 - RNA, 64 nt, Homo Sapiens; identical to SEQ ID NO: 140517

SEQ ID NO: 657555 - RNA, 64 nt, Homo Sapiens; identical to SEQ ID NO: 140518

SEQ ID NO: 657556 - RNA, 64 nt, Homo Sapiens; identical to SEQ ID NO: 140519

SEQ ID NO: 657557 - RNA, 64 nt, Homo Sapiens; identical to SEQ ID NO: 140520

SEQ ID NO: 657558 - RNA, 64 nt, Homo Sapiens; identical to SEQ ID NO: 140521

SEQ ID NO: 657559 - RNA, 64 nt, Homo Sapiens; identical to SEQ ID NO: 140522

SEQ ID NO: 657560 - RNA, 64 nt, Homo Sapiens; identical to SEQ ID NO: 140523

SEQ ID NO: 657561 - RNA, 64 nt, Homo Sapiens; identical to SEQ ID NO: 140524

SEQ ID NO: 657562 - RNA, 64 nt, Homo Sapiens; identical to SEQ ID NO: 140525

SEQ ID NO: 657563 - RNA, 64 nt, Homo Sapiens; identical to SEQ ID NO: 140526

SEQ ID NO: 657564 - RNA, 64 nt, Homo Sapiens; identical to SEQ ID NO: 140527

SEQ ID NO: 657565 - RNA, 64 nt, Homo Sapiens; identical to SEQ ID NO: 140528

SEQ ID NO: 657566 - RNA, 64 nt, Homo Sapiens; identical to SEQ ID NO: 140529

SEQ ID NO: 657567 - RNA, 64 nt, Homo Sapiens; identical to SEQ ID NO: 140530

SEQ ID NO: 657568 - RNA, 64 nt, Homo Sapiens; identical to SEQ ID NO: 140531

SEQ ID NO: 657569 - RNA, 64 nt, Homo Sapiens; identical to SEQ ID NO: 140532

SEQ ID NO: 657570 - RNA, 64 nt, Homo Sapiens; identical to SEQ ID NO: 140533

SEQ ID NO: 657571 - RNA, 64 nt, Homo Sapiens; identical to SEQ ID NO: 140534

SEQ ID NO: 657572 - RNA, 64 nt, Homo Sapiens; identical to SEQ ID NO: 140535

SEQ ID NO: 657573 - RNA, 64 nt, Homo Sapiens; identical to SEQ ID NO: 140536

SEQ ID NO: 657574 - RNA, 64 nt, Homo Sapiens; identical to SEQ ID NO: 140537

SEQ ID NO: 657575 - RNA, 64 nt, Homo Sapiens; identical to SEQ ID NO: 140538

SEQ ID NO: 657576 - RNA, 62 nt, Homo Sapiens; identical to SEQ ID NO: 140539

SEQ ID NO: 657577 - RNA, 64 nt, Homo Sapiens; identical to SEQ ID NO: 140540

SEQ ID NO: 657578 - RNA, 64 nt, Homo Sapiens; identical to SEQ ID NO: 140541

SEQ ID NO: 657579 - RNA, 64 nt, Homo Sapiens; identical to SEQ ID NO: 140542

SEQ ID NO: 657580 - RNA, 64 nt, Homo Sapiens; identical to SEQ ID NO: 140543

SEQ ID NO: 657581 - RNA, 64 nt, Homo Sapiens; identical to SEQ ID NO: 140544

SEQ ID NO: 657582 - RNA, 64 nt, Homo Sapiens; identical to SEQ ID NO: 140545

SEQ ID NO: 657583 - RNA, 64 nt, Homo Sapiens; identical to SEQ ID NO: 140546

SEQ ID NO: 657584 - RNA, 64 nt, Homo Sapiens; identical to SEQ ID NO: 140547

SEQ ID NO: 657585 - RNA, 64 nt, Homo Sapiens; identical to SEQ ID NO: 140548

SEQ ID NO: 657586 - RNA, 64 nt, Homo Sapiens; identical to SEQ ID NO: 140549

SEQ ID NO: 657587 - RNA, 64 nt, Homo Sapiens; identical to SEQ ID NO: 140550

SEQ ID NO: 657588 - RNA, 64 nt, Homo Sapiens; identical to SEQ ID NO: 140551

SEQ ID NO: 657589 - RNA, 64 nt, Homo Sapiens; identical to SEQ ID NO: 140552

SEQ ID NO: 657590 - RNA, 64 nt, Homo Sapiens; identical to SEQ ID NO: 140553

SEQ ID NO: 657591 - RNA, 64 nt, Homo Sapiens; identical to SEQ ID NO: 140554

SEQ ID NO: 657592 - RNA, 64 nt, Homo Sapiens; identical to SEQ ID NO: 140555

SEQ ID NO: 657593 - RNA, 64 nt, Homo Sapiens; identical to SEQ ID NO: 140556

SEQ ID NO: 657594 - RNA, 64 nt, Homo Sapiens; identical to SEQ ID NO: 140557

SEQ ID NO: 657595 - RNA, 64 nt, Homo Sapiens; identical to SEQ ID NO: 140558

SEQ ID NO: 657596 - RNA, 64 nt, Homo Sapiens; identical to SEQ ID NO: 140559

SEQ ID NO: 657597 - RNA, 64 nt, Homo Sapiens; identical to SEQ ID NO: 140560

SEQ ID NO: 657598 - RNA, 64 nt, Homo Sapiens; identical to SEQ ID NO: 140561

SEQ ID NO: 657599 - RNA, 64 nt, Homo Sapiens; identical to SEQ ID NO: 140562

SEQ ID NO: 657600 - RNA, 64 nt, Homo Sapiens; identical to SEQ ID NO: 140563

SEQ ID NO: 657601 - RNA, 64 nt, Homo Sapiens; identical to SEQ ID NO: 140564

SEQ ID NO: 657602 - RNA, 64 nt, Homo Sapiens; identical to SEQ ID NO: 140565

SEQ ID NO: 657603 - RNA, 64 nt, Homo Sapiens; identical to SEQ ID NO: 140566

SEQ ID NO: 657604 - RNA, 64 nt, Homo Sapiens; identical to SEQ ID NO: 140567

SEQ ID NO: 657605 - RNA, 64 nt, Homo Sapiens; identical to SEQ ID NO: 140568

SEQ ID NO: 657606 - RNA, 64 nt, Homo Sapiens; identical to SEQ ID NO: 140569

SEQ ID NO: 657607 - RNA, 64 nt, Homo Sapiens; identical to SEQ ID NO: 140570

SEQ ID NO: 657608 - RNA, 64 nt, Homo Sapiens; identical to SEQ ID NO: 140571

SEQ ID NO: 657609 - RNA, 64 nt, Homo Sapiens; identical to SEQ ID NO: 140572

SEQ ID NO: 657610 - RNA, 64 nt, Homo Sapiens; identical to SEQ ID NO: 140573

SEQ ID NO: 657611 - RNA, 64 nt, Homo Sapiens; identical to SEQ ID NO: 140574

SEQ ID NO: 657612 - RNA, 64 nt, Homo Sapiens; identical to SEQ ID NO: 140575

SEQ ID NO: 657613 - RNA, 64 nt, Homo Sapiens; identical to SEQ ID NO: 140576

SEQ ID NO: 657614 - RNA, 64 nt, Homo Sapiens; identical to SEQ ID NO: 140577

SEQ ID NO: 657615 - RNA, 64 nt, Homo Sapiens; identical to SEQ ID NO: 140578

SEQ ID NO: 657616 - RNA, 64 nt, Homo Sapiens; identical to SEQ ID NO: 140579

SEQ ID NO: 657617 - RNA, 64 nt, Homo Sapiens; identical to SEQ ID NO: 140580

SEQ ID NO: 657618 - RNA, 64 nt, Homo Sapiens; identical to SEQ ID NO: 140581

SEQ ID NO: 657619 - RNA, 64 nt, Homo Sapiens; identical to SEQ ID NO: 140582

SEQ ID NO: 657620 - RNA, 64 nt, Homo Sapiens; identical to SEQ ID NO: 140583

SEQ ID NO: 657621 - RNA, 64 nt, Homo Sapiens; identical to SEQ ID NO: 140584

SEQ ID NO: 657622 - RNA, 64 nt, Homo Sapiens; identical to SEQ ID NO: 140585

SEQ ID NO: 657623 - RNA, 64 nt, Homo Sapiens; identical to SEQ ID NO: 140586

SEQ ID NO: 657624 - RNA, 64 nt, Homo Sapiens; identical to SEQ ID NO: 140587

SEQ ID NO: 657625 - RNA, 64 nt, Homo Sapiens; identical to SEQ ID NO: 140588

SEQ ID NO: 657626 - RNA, 64 nt, Homo Sapiens; identical to SEQ ID NO: 140589

SEQ ID NO: 657627 - RNA, 64 nt, Homo Sapiens; identical to SEQ ID NO: 140590

SEQ ID NO: 657628 - RNA, 64 nt, Homo Sapiens; identical to SEQ ID NO: 140591

SEQ ID NO: 657629 - RNA, 64 nt, Homo Sapiens; identical to SEQ ID NO: 140592

SEQ ID NO: 657630 - RNA, 64 nt, Homo Sapiens; identical to SEQ ID NO: 140593

SEQ ID NO: 657631 - RNA, 64 nt, Homo Sapiens; identical to SEQ ID NO: 140594

SEQ ID NO: 657632 - RNA, 64 nt, Homo Sapiens; identical to SEQ ID NO: 140595

SEQ ID NO: 657633 - RNA, 64 nt, Homo Sapiens; identical to SEQ ID NO: 140596

SEQ ID NO: 657634 - RNA, 64 nt, Homo Sapiens; identical to SEQ ID NO: 481758

SEQ ID NO: 657635 - RNA, 64 nt, Homo Sapiens; identical to SEQ ID NO: 481759

SEQ ID NO: 657636 - RNA, 64 nt, Homo Sapiens; identical to SEQ ID NO: 481760

SEQ ID NO: 657637 - RNA, 64 nt, Homo Sapiens; identical to SEQ ID NO: 481761

SEQ ID NO: 657638 - RNA, 50 nt, Homo Sapiens; identical to SEQ ID NO: 481762

SEQ ID NO: 657639 - RNA, 64 nt, Homo Sapiens; identical to SEQ ID NO: 481763

SEQ ID NO: 657640 - RNA, 64 nt, Homo Sapiens; identical to SEQ ID NO: 481764

SEQ ID NO: 657641 - RNA, 64 nt, Homo Sapiens; identical to SEQ ID NO: 481765

SEQ ID NO: 657642 - RNA, 64 nt, Homo Sapiens; identical to SEQ ID NO: 481766

SEQ ID NO: 657643 - RNA, 64 nt, Homo Sapiens; identical to SEQ ID NO: 481767

SEQ ID NO: 657644 - RNA, 64 nt, Homo Sapiens; identical to SEQ ID NO: 481768

SEQ ID NO: 657645 - RNA, 64 nt, Homo Sapiens; identical to SEQ ID NO: 481769

SEQ ID NO: 657646 - RNA, 64 nt, Homo Sapiens; identical to SEQ ID NO: 481770

SEQ ID NO: 657647 - RNA, 64 nt, Homo Sapiens; identical to SEQ ID NO: 481771

SEQ ID NO: 657648 - RNA, 64 nt, Homo Sapiens; identical to SEQ ID NO: 481772

SEQ ID NO: 657649 - RNA, 64 nt, Homo Sapiens; identical to SEQ ID NO: 481773

SEQ ID NO: 657650 - RNA, 64 nt, Homo Sapiens; identical to SEQ ID NO: 78219

SEQ ID NO: 657651 - RNA, 64 nt, Homo Sapiens; identical to SEQ ID NO: 78220

SEQ ID NO: 657652 - RNA, 64 nt, Homo Sapiens; identical to SEQ ID NO: 78221

SEQ ID NO: 657653 - RNA, 64 nt, Homo Sapiens; identical to SEQ ID NO: 78222

SEQ ID NO: 657654 - RNA, 64 nt, Homo Sapiens; identical to SEQ ID NO: 78223

SEQ ID NO: 657655 - RNA, 64 nt, Homo Sapiens; identical to SEQ ID NO: 78224

SEQ ID NO: 657656 - RNA, 64 nt, Homo Sapiens; identical to SEQ ID NO: 78225

SEQ ID NO: 657657 - RNA, 64 nt, Homo Sapiens; identical to SEQ ID NO: 78226

SEQ ID NO: 657658 - RNA, 64 nt, Homo Sapiens; identical to SEQ ID NO: 78226

SEQ ID NO: 657659 - RNA, 64 nt, Homo Sapiens; identical to SEQ ID NO: 78226

SEQ ID NO: 657660 - RNA, 64 nt, Homo Sapiens; identical to SEQ ID NO: 78229

SEQ ID NO: 657661 - RNA, 62 nt, Homo Sapiens; identical to SEQ ID NO: 292657

SEQ ID NO: 657662 - RNA, 62 nt, Homo Sapiens; identical to SEQ ID NO: 292658

SEQ ID NO: 657663 - RNA, 62 nt, Homo Sapiens; identical to SEQ ID NO: 292659

SEQ ID NO: 657664 - RNA, 62 nt, Homo Sapiens; identical to SEQ ID NO: 292660

SEQ ID NO: 657665 - RNA, 62 nt, Homo Sapiens; identical to SEQ ID NO: 292661

SEQ ID NO: 657666 - RNA, 62 nt, Homo Sapiens; identical to SEQ ID NO: 292662

SEQ ID NO: 657667 - RNA, 62 nt, Homo Sapiens; identical to SEQ ID NO: 292663

SEQ ID NO: 657668 - RNA, 62 nt, Homo Sapiens; identical to SEQ ID NO: 292664

SEQ ID NO: 657669 - RNA, 62 nt, Homo Sapiens; identical to SEQ ID NO: 292665

SEQ ID NO: 657670 - RNA, 62 nt, Homo Sapiens; identical to SEQ ID NO: 292666

SEQ ID NO: 657671 - RNA, 62 nt, Homo Sapiens; identical to SEQ ID NO: 292667

SEQ ID NO: 657672 - RNA, 62 nt, Homo Sapiens; identical to SEQ ID NO: 292668

SEQ ID NO: 657673 - RNA, 62 nt, Homo Sapiens; identical to SEQ ID NO: 292669

SEQ ID NO: 657674 - RNA, 62 nt, Homo Sapiens; identical to SEQ ID NO: 292670

SEQ ID NO: 657675 - RNA, 64 nt, Homo Sapiens
ucacccccauccucuuacuccuuucaugucccauuucagacagaguaaccauuaacaaaaaaga

SEQ ID NO: 657676 - RNA, 64 nt, Homo Sapiens
aaacuggaacuaugaacuucauccauuugcacuguucagacauauauauguauguauguaaaaa

SEQ ID NO: 657677 - RNA, 64 nt, Homo Sapiens
gcugggauuccaugcgacagcuugaaugcugaccuucagacaugagacauagggauuuggaggc

SEQ ID NO: 657678 - RNA, 64 nt, Homo Sapiens
gaccuucugcugggaaagcaacccccaguuucucuucagacacuccgaaucuggucccuggggg

SEQ ID NO: 657679 - RNA, 64 nt, Homo Sapiens
agcugggccagcacuguggaucugcuugggauucuucagacagauggucccaagcgaaggcucc

SEQ ID NO: 657680 - RNA, 64 nt, Homo Sapiens
auguagucuguuagauuuuauauauaaauaguauuucagacacuuacuucaguaaugucuauau

SEQ ID NO: 657681 - RNA, 64 nt, Homo Sapiens
uguaacacacacacacauaccuugguuguugcaguucagacaaaaugggaaauguuuggccaug

SEQ ID NO: 657682 - RNA, 64 nt, Homo Sapiens
cuguauuaaaauagaaccaggaaaggcucaggauuucagacauuucaucagccuuuucacuuuc

SEQ ID NO: 657683 - RNA, 64 nt, Homo Sapiens
guucuugguggugucucccauuccccuggcuaauuucagacagcuguggucaagggauuuuacu

SEQ ID NO: 657684 - RNA, 64 nt, Homo Sapiens
aagcauuaucaaugaaauuacugucaaaagaucuuucagacaauauaagccugcaaagugcagc

SEQ ID NO: 657685 - RNA, 64 nt, Homo Sapiens
gaauucacaauacagauaucuaagauacugacacuucagacauuacacaaaaucagagugcuga

SEQ ID NO: 657686 - RNA, 64 nt, Homo Sapiens
cuugggcaaccacacauagagguuuccuucucacuucagacacauacaucacuuucacaccacu

SEQ ID NO: 657687 - RNA, 64 nt, Homo Sapiens
cugcucaagguuccccucugcucaucccuccucauucagacauccuccaccauaccaguguuua

SEQ ID NO: 657688 - RNA, 64 nt, Homo Sapiens
ccaaagaagacucugcaucaagaaagcaguggcuuucagacacacucggacaaaucccugggag

SEQ ID NO: 657689 - RNA, 64 nt, Homo Sapiens
uuucucuggaagggucuggaccaaguacgaugucuucagacaacaaacucgacugcugcgucua

SEQ ID NO: 657690 - RNA, 64 nt, Homo Sapiens
gagggccaacccggccccucuguccccuuggcucuucagacagggccagcccugcucaggaagu

SEQ ID NO: 657691 - RNA, 64 nt, Homo Sapiens
agggaucuugacucuugucuccuuuguccuuuuguucagacagaguuguaccugcagcagacaa

SEQ ID NO: 657692 - RNA, 64 nt, Homo Sapiens
uguuaccauauuuuaaaaucuugagccacauauuuucagacacuaaaaguaaccgggagacaaa

SEQ ID NO: 657693 - RNA, 64 nt, Homo Sapiens
gaugcauagggaggacaccaucggaagagggaaauucagacacacaauaugacuggaguccuua

SEQ ID NO: 657694 - RNA, 64 nt, Homo Sapiens
accuuuucuccuguguaucuuaauuguguuugguuucagacaaaacaauguuauuuauuagccc

SEQ ID NO: 657695 - RNA, 64 nt, Homo Sapiens
auuaacccuuuucuccuguguaauuguguuugauuucagacaaauguaaguuauuuauuagccc

SEQ ID NO: 657696 - RNA, 64 nt, Homo Sapiens
uguucagugaggaaaaaaaggugaggaaaaaacauucagacaaagagugaggaaaacauguuca

SEQ ID NO: 657697 - RNA, 64 nt, Homo Sapiens
uguucagugugagugaggaaaaagcagccacaguuucagacaaaugcaugcaucuugaagcaac

SEQ ID NO: 657698 - RNA, 64 nt, Homo Sapiens
cugcccagaggggcuggggacggucaggaggagguucagacauuacaaacaaaccucgucacca

SEQ ID NO: 657699 - RNA, 64 nt, Homo Sapiens
ggggaacugaaggcugacaaggggcagugcucaguucagacaaguggcucugggaggacucuga

SEQ ID NO: 657700 - RNA, 64 nt, Homo Sapiens
auuguucuuucagucagacaugauaugcgcaacauucagacaugauaugcgcaucauucagaca

SEQ ID NO: 657701 - RNA, 64 nt, Homo Sapiens
auaugcgcaacauucagacaugauaugcgcaucauucagacaugauaugcggggucaaguucuu

SEQ ID NO: 657702 - RNA, 64 nt, Homo Sapiens
agaagugaucagugacauacauaaauuuauuugucuauacuaguuuacauucaaaauaauguuu

SEQ ID NO: 657703 - RNA, 64 nt, Homo Sapiens
uauucccaaaaaugucaguagcuugacucauaaacuauacuauaguaaaacuuuugguucagaa

SEQ ID NO: 657704 - RNA, 64 nt, Homo Sapiens
acaauccugcuuucucaaguacuauucuaacauugcgcuuuauaagggaugauauuucuaccac

SEQ ID NO: 657705 - RNA, 64 nt, Homo Sapiens
uauaaagcccaggaacuucuagaauaacccagaugcgcuuuaauuuuuuuuaauauguuuugau

SEQ ID NO: 657706 - RNA, 64 nt, Homo Sapiens
ugccuuaauauaucuauggcagacauuuaagaaugcgcuuuaucuagcucaugguaacuuugca

SEQ ID NO: 657707 - RNA, 64 nt, Homo Sapiens
uuacgguaguuaggaugcucaguugcuaaacacugcgcuuuauuuucuuaaccaguuguggugu

SEQ ID NO: 657708 - RNA, 64 nt, Homo Sapiens
gucaugggauaaaaauaaucgauguauguuacgggcgcuuuaaccaucagcugccucucgaaug

SEQ ID NO: 657709 - RNA, 64 nt, Homo Sapiens
ucggagcgcaaugccaucuagagccgccggcgcugcgcuuuauucggguucaccuggguggcug

SEQ ID NO: 657710 - RNA, 64 nt, Homo Sapiens
uuaauuaccaaaacucuccuaagucucuguaccagcgcuuuaugucuguuucccuuaaugauac

SEQ ID NO: 657711 - RNA, 64 nt, Homo Sapiens
cuagaaguggcagaacacuggauuuguguguguggcgcuuuagggugcuggacuguauggcuga

SEQ ID NO: 657712 - RNA, 64 nt, Homo Sapiens
agauuagccugagaaauaauugaaaacacuuugagcgcuuuaagaaucccuccccuugcacuug

SEQ ID NO: 657713 - RNA, 64 nt, Homo Sapiens
caaagugacuguuuggcuuauaaacacauugaaugcgcuuuauugcccaugggauauguggugu

SEQ ID NO: 657714 - RNA, 64 nt, Homo Sapiens
cggaauaacaaguugucccuagcaaaaccgcugagcgcuuuauaauuuugugguguauuuuugu

SEQ ID NO: 657715 - RNA, 64 nt, Homo Sapiens
gaaaaugguuagacugaaaauacuuuuuaaauaagcgcuuuaauuacucaguuuuauaagguga

SEQ ID NO: 657716 - RNA, 64 nt, Homo Sapiens
cagacaucaguuccaugguggaucacauggggaagcgcuuuauauguacauugucaugugacug

SEQ ID NO: 657717 - RNA, 64 nt, Homo Sapiens
aagcauuguuuuaguccaggucaggcugcagaaugcgcuuuagaccucucaccucacaggcaca

SEQ ID NO: 657718 - RNA, 64 nt, Homo Sapiens
auuaguuaaucuuuugcaggggccacagacuugagcgcuuuauucucauugcaugagucaaguc

SEQ ID NO: 657719 - RNA, 64 nt, Homo Sapiens
aaaauuuuuaaacuucuaagugaaaguagucugagcgcuuuauaaaauucauauuauugugugu

SEQ ID NO: 657720 - RNA, 64 nt, Homo Sapiens
ugugggagaagagaggagagccugccacuguucugcgcuuuaaucuaccccagcacacacacuc

SEQ ID NO: 657721 - RNA, 64 nt, Homo Sapiens
cuucaugaugacaacacugccucgcguuucaauagcgcuuuauacuuuuuuaaguguuuucuau

SEQ ID NO: 657722 - RNA, 64 nt, Homo Sapiens
cauauuucuuuaaaaugcaauagugguuuacaaugcgcuuuagauuuuuugcuauuguaaauau

SEQ ID NO: 657723 - RNA, 64 nt, Homo Sapiens
auuugagugauucaauaguucgccaauugugagggcgcuuuagcgcuguagcuaucuucaccug

SEQ ID NO: 657724 - RNA, 64 nt, Homo Sapiens
uugagcgcauggcaagucacguaaguccccggcggcgcuuuagugagggccgaggugggcuuca

SEQ ID NO: 657725 - RNA, 64 nt, Homo Sapiens
caaaagauugaacuuaaaugccccccucccaacagcgcuuuaaaagcgaccucucuugagguag

SEQ ID NO: 657726 - RNA, 64 nt, Homo Sapiens
uuuuuaauagacaaaucacauuucuuuuucacaagcgcuuuauugcuugccgccaucucuuagu

SEQ ID NO: 657727 - RNA, 64 nt, Homo Sapiens
auauuauucacagaugcauugucuucaacacuaugcgcuuuaucgaccuuggauuuaauuuaaa

SEQ ID NO: 657728 - RNA, 64 nt, Homo Sapiens
uccgugugcuuucaguuuuuaauugaauauuaaggcgcuuuacuauccaauccaacuugaaguc

SEQ ID NO: 657729 - RNA, 64 nt, Homo Sapiens
gcucugccucagaaagcucugcgcuuuccagaaagcgcuuuacccugcaggguuuugcuaaccu

SEQ ID NO: 657730 - RNA, 64 nt, Homo Sapiens
gcuucucuuuggcauauccauucacuuaaaggaggcgcuuuauacucuugagaaccuucacccu

SEQ ID NO: 657731 - RNA, 64 nt, Homo Sapiens
uuuucauucucccccucucucccuccugugucuugcgcuuuauguuuucuuccguuugauaauu

SEQ ID NO: 657732 - RNA, 64 nt, Homo Sapiens
gcuccuagagaagccaugugauucccagagccaggcgcuuuacaccuaaaguaguuugacuuuc

SEQ ID NO: 657733 - RNA, 64 nt, Homo Sapiens
uugcuuguguguguagcuucuuguagcuuagaaagcgcuuuaugcccaugaugucauuucaggc

SEQ ID NO: 657734 - RNA, 64 nt, Homo Sapiens
cuggguugacaagcugagaguaccuuccuggugucauugccaucgcuugcucccuugggacagu

SEQ ID NO: 657735 - RNA, 64 nt, Homo Sapiens
aaguagacugguauaugguuuaccacugauuuaccauugccauauuuuaucuuugccaaaucuu

SEQ ID NO: 657736 - RNA, 64 nt, Homo Sapiens
gguguuaaauaagcuuugagugauguagaauuuacauugccaugauaauguucucauuuauuuu

SEQ ID NO: 657737 - RNA, 64 nt, Homo Sapiens
uuagcugcugccucccucugcgaaagagucuaagcauugccacugucgccccuuuguaacaaaa

SEQ ID NO: 657738 - RNA, 64 nt, Homo Sapiens
uugcucuucaaaguaaauguuuuagccuuauagacauugccaaacguaucacagaauaaacaca

SEQ ID NO: 657739 - RNA, 64 nt, Homo Sapiens
ccuccccuccagagguaacaccacuucgagaucacauugccauuugucaaaucuuaacauuuug

SEQ ID NO: 657740 - RNA, 64 nt, Homo Sapiens
uguugaauuuuuaaaaagcacacaaaaauuaaaacauugccauaauuuaguuaccucuugaaag

SEQ ID NO: 657741 - RNA, 64 nt, Homo Sapiens
ccaaggaauucugagaguagucacccuccugguacauugccauuaauuuucaccaacaguucac

SEQ ID NO: 657742 - RNA, 64 nt, Homo Sapiens
cacaagagaucucuuccugccaagguuuuuaguucauugccaguuuagucuuuuugacccaugu

SEQ ID NO: 657743 - RNA, 64 nt, Homo Sapiens
agcugcaggagagcagggccaucugaagcgguagcauugccaccaucucccucucaucuagagc

SEQ ID NO: 657744 - RNA, 64 nt, Homo Sapiens
cccuagauccagccucaggacccaucaucccuuccauugccacaccacccacucaggacucuuc

SEQ ID NO: 657745 - RNA, 64 nt, Homo Sapiens
ccauggccuuuccucaguguacuauugaagacuccauugccaaaugaguuguguagggaugaag

SEQ ID NO: 657746 - RNA, 64 nt, Homo Sapiens
auauuccaccagcgauuugauuuauuggcucuuccauugccacugagcaaugcccaggaagcag

SEQ ID NO: 657747 - RNA, 64 nt, Homo Sapiens
ccauugccacugagcaaugcccaggaagcaggcacauugccaaggacugggggcaucuugacua

SEQ ID NO: 657748 - RNA, 64 nt, Homo Sapiens; identical to SEQ ID NO: 198342

SEQ ID NO: 657749 - RNA, 64 nt, Homo Sapiens; identical to SEQ ID NO: 198343

SEQ ID NO: 657750 - RNA, 64 nt, Homo Sapiens; identical to SEQ ID NO: 198344

SEQ ID NO: 657751 - RNA, 64 nt, Homo Sapiens; identical to SEQ ID NO: 198345

SEQ ID NO: 657752 - RNA, 64 nt, Homo Sapiens; identical to SEQ ID NO: 198346

SEQ ID NO: 657753 - RNA, 64 nt, Homo Sapiens; identical to SEQ ID NO: 198347

SEQ ID NO: 657754 - RNA, 64 nt, Homo Sapiens; identical to SEQ ID NO: 198348

SEQ ID NO: 657755 - RNA, 64 nt, Homo Sapiens; identical to SEQ ID NO: 198349

SEQ ID NO: 657756 - RNA, 64 nt, Homo Sapiens; identical to SEQ ID NO: 198350

SEQ ID NO: 657757 - RNA, 64 nt, Homo Sapiens; identical to SEQ ID NO: 198351

SEQ ID NO: 657758 - RNA, 64 nt, Homo Sapiens; identical to SEQ ID NO: 198352

SEQ ID NO: 657759 - RNA, 64 nt, Homo Sapiens; identical to SEQ ID NO: 198353

SEQ ID NO: 657760 - RNA, 64 nt, Homo Sapiens; identical to SEQ ID NO: 198354

SEQ ID NO: 657761 - RNA, 64 nt, Homo Sapiens; identical to SEQ ID NO: 198355

SEQ ID NO: 657762 - RNA, 64 nt, Homo Sapiens; identical to SEQ ID NO: 198356

SEQ ID NO: 657763 - RNA, 64 nt, Homo Sapiens; identical to SEQ ID NO: 198357

SEQ ID NO: 657764 - RNA, 64 nt, Homo Sapiens; identical to SEQ ID NO: 198358

SEQ ID NO: 657765 - RNA, 64 nt, Homo Sapiens; identical to SEQ ID NO: 198359

SEQ ID NO: 657766 - RNA, 64 nt, Homo Sapiens; identical to SEQ ID NO: 198360

SEQ ID NO: 657767 - RNA, 64 nt, Homo Sapiens; identical to SEQ ID NO: 198361

SEQ ID NO: 657768 - RNA, 64 nt, Homo Sapiens; identical to SEQ ID NO: 198362

SEQ ID NO: 657769 - RNA, 64 nt, Homo Sapiens; identical to SEQ ID NO: 198363

SEQ ID NO: 657770 - RNA, 64 nt, Homo Sapiens; identical to SEQ ID NO: 198364

SEQ ID NO: 657771 - RNA, 64 nt, Homo Sapiens; identical to SEQ ID NO: 198365

SEQ ID NO: 657772 - RNA, 64 nt, Homo Sapiens; identical to SEQ ID NO: 198366

SEQ ID NO: 657773 - RNA, 64 nt, Homo Sapiens; identical to SEQ ID NO: 198367

SEQ ID NO: 657774 - RNA, 64 nt, Homo Sapiens; identical to SEQ ID NO: 198368

SEQ ID NO: 657775 - RNA, 64 nt, Homo Sapiens; identical to SEQ ID NO: 198369

SEQ ID NO: 657776 - RNA, 64 nt, Homo Sapiens; identical to SEQ ID NO: 198370

SEQ ID NO: 657777 - RNA, 64 nt, Homo Sapiens; identical to SEQ ID NO: 198371

SEQ ID NO: 657778 - RNA, 64 nt, Homo Sapiens; identical to SEQ ID NO: 198372

SEQ ID NO: 657779 - RNA, 64 nt, Homo Sapiens; identical to SEQ ID NO: 198373

SEQ ID NO: 657780 - RNA, 64 nt, Homo Sapiens; identical to SEQ ID NO: 198374

SEQ ID NO: 657781 - RNA, 64 nt, Homo Sapiens; identical to SEQ ID NO: 198375

SEQ ID NO: 657782 - RNA, 64 nt, Homo Sapiens; identical to SEQ ID NO: 198376

SEQ ID NO: 657783 - RNA, 64 nt, Homo Sapiens; identical to SEQ ID NO: 198377

SEQ ID NO: 657784 - RNA, 64 nt, Homo Sapiens; identical to SEQ ID NO: 198378

SEQ ID NO: 657785 - RNA, 64 nt, Homo Sapiens; identical to SEQ ID NO: 198379

SEQ ID NO: 657786 - RNA, 64 nt, Homo Sapiens; identical to SEQ ID NO: 198380

SEQ ID NO: 657787 - RNA, 64 nt, Homo Sapiens; identical to SEQ ID NO: 198381

SEQ ID NO: 657788 - RNA, 64 nt, Homo Sapiens; identical to SEQ ID NO: 198382

SEQ ID NO: 657789 - RNA, 64 nt, Homo Sapiens; identical to SEQ ID NO: 198383

SEQ ID NO: 657790 - RNA, 64 nt, Homo Sapiens; identical to SEQ ID NO: 198384

SEQ ID NO: 657791 - RNA, 64 nt, Homo Sapiens; identical to SEQ ID NO: 198385

SEQ ID NO: 657792 - RNA, 64 nt, Homo Sapiens; identical to SEQ ID NO: 198386

SEQ ID NO: 657793 - RNA, 64 nt, Homo Sapiens; identical to SEQ ID NO: 198387

SEQ ID NO: 657794 - RNA, 64 nt, Homo Sapiens; identical to SEQ ID NO: 198388

SEQ ID NO: 657795 - RNA, 64 nt, Homo Sapiens; identical to SEQ ID NO: 198389

SEQ ID NO: 657796 - RNA, 64 nt, Homo Sapiens; identical to SEQ ID NO: 198390

SEQ ID NO: 657797 - RNA, 64 nt, Homo Sapiens; identical to SEQ ID NO: 198391

SEQ ID NO: 657798 - RNA, 64 nt, Homo Sapiens; identical to SEQ ID NO: 198392

SEQ ID NO: 657799 - RNA, 64 nt, Homo Sapiens; identical to SEQ ID NO: 198393

SEQ ID NO: 657800 - RNA, 64 nt, Homo Sapiens; identical to SEQ ID NO: 198394

SEQ ID NO: 657801 - RNA, 64 nt, Homo Sapiens; identical to SEQ ID NO: 198395

SEQ ID NO: 657802 - RNA, 64 nt, Homo Sapiens; identical to SEQ ID NO: 198396

SEQ ID NO: 657803 - RNA, 64 nt, Homo Sapiens; identical to SEQ ID NO: 198397

SEQ ID NO: 657804 - RNA, 64 nt, Homo Sapiens; identical to SEQ ID NO: 198398

SEQ ID NO: 657805 - RNA, 64 nt, Homo Sapiens; identical to SEQ ID NO: 198399

SEQ ID NO: 657806 - RNA, 64 nt, Homo Sapiens; identical to SEQ ID NO: 198400

SEQ ID NO: 657807 - RNA, 64 nt, Homo Sapiens; identical to SEQ ID NO: 198401

SEQ ID NO: 657808 - RNA, 64 nt, Homo Sapiens; identical to SEQ ID NO: 198402

SEQ ID NO: 657809 - RNA, 64 nt, Homo Sapiens; identical to SEQ ID NO: 198403

SEQ ID NO: 657810 - RNA, 64 nt, Homo Sapiens; identical to SEQ ID NO: 198404

SEQ ID NO: 657811 - RNA, 64 nt, Homo Sapiens; identical to SEQ ID NO: 198405

SEQ ID NO: 657812 - RNA, 64 nt, Homo Sapiens; identical to SEQ ID NO: 198406

SEQ ID NO: 657813 - RNA, 64 nt, Homo Sapiens; identical to SEQ ID NO: 198407

SEQ ID NO: 657814 - RNA, 64 nt, Homo Sapiens; identical to SEQ ID NO: 198408

SEQ ID NO: 657815 - RNA, 64 nt, Homo Sapiens; identical to SEQ ID NO: 198409

SEQ ID NO: 657816 - RNA, 64 nt, Homo Sapiens; identical to SEQ ID NO: 198410

SEQ ID NO: 657817 - RNA, 64 nt, Homo Sapiens; identical to SEQ ID NO: 198411

SEQ ID NO: 657818 - RNA, 64 nt, Homo Sapiens; identical to SEQ ID NO: 198412

SEQ ID NO: 657819 - RNA, 64 nt, Homo Sapiens; identical to SEQ ID NO: 198413

SEQ ID NO: 657820 - RNA, 64 nt, Homo Sapiens; identical to SEQ ID NO: 198414

SEQ ID NO: 657821 - RNA, 64 nt, Homo Sapiens; identical to SEQ ID NO: 198415

SEQ ID NO: 657822 - RNA, 64 nt, Homo Sapiens; identical to SEQ ID NO: 198416

SEQ ID NO: 657823 - RNA, 64 nt, Homo Sapiens; identical to SEQ ID NO: 198417

SEQ ID NO: 657824 - RNA, 64 nt, Homo Sapiens; identical to SEQ ID NO: 198418

SEQ ID NO: 657825 - RNA, 64 nt, Homo Sapiens; identical to SEQ ID NO: 198419

SEQ ID NO: 657826 - RNA, 64 nt, Homo Sapiens; identical to SEQ ID NO: 198420

SEQ ID NO: 657827 - RNA, 64 nt, Homo Sapiens; identical to SEQ ID NO: 198421

SEQ ID NO: 657828 - RNA, 64 nt, Homo Sapiens; identical to SEQ ID NO: 198422

SEQ ID NO: 657829 - RNA, 64 nt, Homo Sapiens; identical to SEQ ID NO: 198423

SEQ ID NO: 657830 - RNA, 64 nt, Homo Sapiens; identical to SEQ ID NO: 198424

SEQ ID NO: 657831 - RNA, 64 nt, Homo Sapiens; identical to SEQ ID NO: 198425

SEQ ID NO: 657832 - RNA, 64 nt, Homo Sapiens; identical to SEQ ID NO: 198426

SEQ ID NO: 657833 - RNA, 64 nt, Homo Sapiens
agagucuuuguaaguaaacugcccugucuaggucaguacccaccugagcuuuggacgcacacag

SEQ ID NO: 657834 - RNA, 64 nt, Homo Sapiens
guacccaccugagcuuuggacgcacacagcuuuuaguacccaccugagcuuuggacacacacag

SEQ ID NO: 657835 - RNA, 64 nt, Homo Sapiens
auugaguacacgccggccagcccggccuacgcccaguacccaccggccaccuaugaccaguacc

SEQ ID NO: 657836 - RNA, 64 nt, Homo Sapiens
gccuacgcccaguacccaccggccaccuaugaccaguacccauacgccgccucgccugccacgg

SEQ ID NO: 657837 - RNA, 64 nt, Homo Sapiens
cuacagaaauguuuuaaauacauucucaggcauguuugcaaaaauauggcacauguauacauuu

SEQ ID NO: 657838 - RNA, 64 nt, Homo Sapiens
cguauuuuguaguggaguucauaucacauuauguuuugcaaaauaaaacuuguuuugucacaau

SEQ ID NO: 657839 - RNA, 64 nt, Homo Sapiens
gaugggcuuagagcucucaugaugcuacccgagguuugcaaauccuucaugucuuaaccuaccu

SEQ ID NO: 657840 - RNA, 64 nt, Homo Sapiens
acuaccucccaaccccagugccucagucaauaaauuugcaaauucaugagaauuuuuaggucuc

SEQ ID NO: 657841 - RNA, 64 nt, Homo Sapiens
agggccuagaaacucacccgugcauauguugaccuuugcaaaaugaccuggugacauggcaagu

SEQ ID NO: 657842 - RNA, 64 nt, Homo Sapiens
gaccacaaugagauuccauuuuauauccauaagauuugcaaagguugggucugacaguaccagu

SEQ ID NO: 657843 - RNA, 64 nt, Homo Sapiens
caguguuaacuaaauaaagguauuccuuucuguguuugcaaauuccaaguggagucagguuuuc

SEQ ID NO: 657844 - RNA, 64 nt, Homo Sapiens
uccuuggauguggagacagaccugccacgugucuuuugcaaagccagugcguccagucuccugu

SEQ ID NO: 657845 - RNA, 64 nt, Homo Sapiens
auguuugaaagcauugguaguucucucucuucuguuugcaaaauuucuuugauucuuuaacaug

SEQ ID NO: 657846 - RNA, 64 nt, Homo Sapiens
gcacuuuuuugagaugcagacauaaauugauaauuuugcaaaauauuuuguaucagaggcauau

SEQ ID NO: 657847 - RNA, 64 nt, Homo Sapiens
ugaaguccgcaugaaacacugcaccaggcagggcuuugcaaagugcaagguauccccaguccaa

SEQ ID NO: 657848 - RNA, 64 nt, Homo Sapiens
gaguuuuagaagauuagaccauuaggaacguaucuuugcaaacugcccauucacccaugaagag

SEQ ID NO: 657849 - RNA, 64 nt, Homo Sapiens
uguauaauuaggaauuauuuauuuauagugcuuauuugcaaaauugaagucuuaacauuuuaac

SEQ ID NO: 657850 - RNA, 64 nt, Homo Sapiens
uuuggugaccacacauuugaagcuagagacccuuuuugcaaacaaaugugccaaaaagaaaaaa

SEQ ID NO: 657851 - RNA, 64 nt, Homo Sapiens
uuuauuauugacuauaauaauuaguuuaauuagcuuugcaaacugauggcaucaagguaaauau

SEQ ID NO: 657852 - RNA, 64 nt, Homo Sapiens
auuaaaacugccauaucaauuuuaauguauagauuuugcaaauauuaugcuauauguaauaccu

SEQ ID NO: 657853 - RNA, 64 nt, Homo Sapiens
gaauaacauuuaaaggagauuguuucaaaauauuuuugcaaauugagauaaggacagaaagauu

SEQ ID NO: 657854 - RNA, 64 nt, Homo Sapiens
gauaaggacagaaagauugagaaacauuguauauuuugcaaaaacaagauguuuguagcuguuu

SEQ ID NO: 657855 - RNA, 64 nt, Homo Sapiens
uugcagcccauugaaagaauaaguuuaaagcauguuugcaaauaaauaucuugcaucuuuaugg

SEQ ID NO: 657856 - RNA, 64 nt, Homo Sapiens
cuacaacucugggugucauaguuuauaguccaaauuugcaaaccaagauaaguacggucuucau

SEQ ID NO: 657857 - RNA, 64 nt, Homo Sapiens
ucccauuguuuuaacagcugauuauauauuugcauuugcaaauuaaugugauagcugugcaugc

SEQ ID NO: 657858 - RNA, 64 nt, Homo Sapiens
augaacaaguuaaugaacaaaaaaauucucauuauuugcaaagaauaggacaauuaauggaaaa

SEQ ID NO: 657859 - RNA, 64 nt, Homo Sapiens
gcaaaggccaucuacaagagguauaccacuguauuuugcaaauuagaauuaagguucacuaaac

SEQ ID NO: 657860 - RNA, 64 nt, Homo Sapiens
uaccauuugcauucuuucuguuugguauuaaaaguuugcaaacaaaaauacauugcaugagcca

SEQ ID NO: 657861 - RNA, 64 nt, Homo Sapiens
agccugcuauaaaguuaaagucacacauuucuauuuugcaaacacugugauuacucuuugcuuu

SEQ ID NO: 657862 - RNA, 64 nt, Homo Sapiens
auuuaguggauuaaccaguccagacgcacugaucuuugcaaaggagacuuaauuucaaaucugu

SEQ ID NO: 657863 - RNA, 64 nt, Homo Sapiens
uauuuaaauccaucugaacugucccaaaauguaauuugcaaagagcuucaaacaccaaaaauau

SEQ ID NO: 657864 - RNA, 64 nt, Homo Sapiens
caaugcuauuugccuuaguucauucguuguuuacuuugcaaaauuugugacuuuuaaguacuaa

SEQ ID NO: 657865 - RNA, 64 nt, Homo Sapiens
guauuuguuacauaaucaaauuauuuuuucaucuuuugcaaaaaauccaaaugauuuuacaguu

SEQ ID NO: 657866 - RNA, 64 nt, Homo Sapiens
auggaguagggaagaagauaugauacuuccugcuuuugcaaauaauuaguaauagaguuaaauu

SEQ ID NO: 657867 - RNA, 64 nt, Homo Sapiens
uaacuaauuucaguuguacugugaaugcuaaauauuugcaaacaaguacaucuugaaaguaaag

SEQ ID NO: 657868 - RNA, 64 nt, Homo Sapiens
uuuuuuaaaugucauauugugauaaugcucugcuuuugcaaauuguguuugcaugucauuaguu

SEQ ID NO: 657869 - RNA, 64 nt, Homo Sapiens
caccaacuuaaaaaaaaaaaguacaauucauuguuuugcaaaaguguaugguaggggcuuaaaa

SEQ ID NO: 657870 - RNA, 64 nt, Homo Sapiens
ucuuuuguaagacauuuccuuuuuuaaaaaaauuuuugcaaauaacugaucucaaguauauguc

SEQ ID NO: 657871 - RNA, 64 nt, Homo Sapiens
auuuguggcuuuuuguaguuaagguaagacagaguuugcaaagcuuuugcuuauuuucauauaa

SEQ ID NO: 657872 - RNA, 64 nt, Homo Sapiens
guauguuacaauagauagugcacuguugugcuccuuugcaaaauuuuuaaggcuaacuucuuuu

SEQ ID NO: 657873 - RNA, 64 nt, Homo Sapiens
uguuagaucaaccuccaacagcacaaacaauauguuugcaaacugacacuucccugcauuaacu

SEQ ID NO: 657874 - RNA, 64 nt, Homo Sapiens
agaaaaagauucucaucacuauuauauuagucuguuugcaaagugggaggaaaacucaguaaga

SEQ ID NO: 657875 - RNA, 64 nt, Homo Sapiens
ucccacuccucacacucuucuacagggauaggcuuuugcaaauauaucagauaaauuuuuuguu

SEQ ID NO: 657876 - RNA, 64 nt, Homo Sapiens
aguauugucuauuucagugugaaacuaucuugaauuugcaaauauaguguuauauuuuauaaag

SEQ ID NO: 657877 - RNA, 64 nt, Homo Sapiens
aaggaaaaacacaaauugccucuggagcuccaccuuugcaaagacccgccuaggacaggagcug

SEQ ID NO: 657878 - RNA, 64 nt, Homo Sapiens
accgucgcucagcaacaccaacuugauuggagaauuugcaaacugaugucauauugaggcccaa

SEQ ID NO: 657879 - RNA, 64 nt, Homo Sapiens
ugaaguaaauguaugguagaaauuaagacguuucuuugcaaaacaaggaaaucacacauaugca

SEQ ID NO: 657880 - RNA, 64 nt, Homo Sapiens
aacagaaaaagaaaaaauugucugaaauguuuauuuugcaaaacagugcaauagaaucuaguua

SEQ ID NO: 657881 - RNA, 64 nt, Homo Sapiens
guuuaauggccaccuguucucuccugugaaaggcuuugcaaagucacauuaaguuugcaugacc

SEQ ID NO: 657882 - RNA, 64 nt, Homo Sapiens
ucuuuauaaaaguaaaaggccaacauuuaauuauuuugcaaagcaaccuaagagcuaaagaugu

SEQ ID NO: 657883 - RNA, 64 nt, Homo Sapiens
cuuucuuugccucugcagucucauuucucauaauuuugcaaauuauauuuuguugcuuucuuac

SEQ ID NO: 657884 - RNA, 64 nt, Homo Sapiens
agcaagcuuuugcucaacagcauaugggugggauuuugcaaaaauccuauucugaugaaucuca

SEQ ID NO: 657885 - RNA, 64 nt, Homo Sapiens
gggaccaggaugauacagucaucugagguuaugcuuugcaaaaggcugacgguauggaauaugu

SEQ ID NO: 657886 - RNA, 64 nt, Homo Sapiens
gcacccuuaauucaggcacuguccauuagcuuccuuugcaaaggcuacuuauggccggucacaa

SEQ ID NO: 657887 - RNA, 64 nt, Homo Sapiens
aggaauauuugacaauuaaguuaaucuucacguuuuugcaaacuuugauuuuuauuucaucuga

SEQ ID NO: 657888 - RNA, 64 nt, Homo Sapiens
uuugugaagcaccuugauuccuugauuuugauuuuuugcaaaguuagacaauggcacaaaguca

SEQ ID NO: 657889 - RNA, 64 nt, Homo Sapiens
cagcaagaaguucauucugugcaauauggacauguuugcaaaccauaccaagggucagguuguu

SEQ ID NO: 657890 - RNA, 64 nt, Homo Sapiens
uuauuuuaaaguaaccuuauauuuaaaagaugauuuugcaaaaaauaaaaaauaaaaaauaugc

SEQ ID NO: 657891 - RNA, 64 nt, Homo Sapiens
cacuuagcagcaacugaagagauuauaaaugaaauuugcaaaauuuagguaauuguagggcgag

SEQ ID NO: 657892 - RNA, 64 nt, Homo Sapiens
ucaaccuggcaaaaaugcaagaagagugcccugcuuugcaaacaugguuuuggggaaaugugga

SEQ ID NO: 657893 - RNA, 64 nt, Homo Sapiens
ccuauggaaauauauaucuauuauauauauauuuuuugcaaaucucacaaagugcggcaagccc

SEQ ID NO: 657894 - RNA, 64 nt, Homo Sapiens
aagucugaauacauuuuugaaauaggaacucccuuuugcaaaaaagaaaccugggugucaggga

SEQ ID NO: 657895 - RNA, 64 nt, Homo Sapiens
gcaauaaaacacauuuuagaucaccugcaauucauuugcaaauucaauuggcuuauuuuuuaga

SEQ ID NO: 657896 - RNA, 64 nt, Homo Sapiens
agagcaagagcucuuucucauguuuaucacgccauuugcaaaucgagaugaucacgguuucuuu

SEQ ID NO: 657897 - RNA, 64 nt, Homo Sapiens
augggccuggcugggaguggaagaagggaagccuuuugcaaauaguagaguaucaguugcaggu

SEQ ID NO: 657898 - RNA, 63 nt, Homo Sapiens
uuugaauucuauguuggcauuaacaauaaagcauuuugcaaacacugguuauaacugucuuua

SEQ ID NO: 657899 - RNA, 64 nt, Homo Sapiens
gaauuggaauaggaauugauauuucugaauauauuuugcaaauugaacagucauuucaccuacu

SEQ ID NO: 657900 - RNA, 64 nt, Homo Sapiens
guuaugugaaacaacuucuauuuuccuuggaaauuuugcaaaauuauuacagaacguugccuug

SEQ ID NO: 657901 - RNA, 64 nt, Homo Sapiens
gaaagaucuguagagaguagaguggagaaaggguuuugcaaacuaccccaaagaucucauguua

SEQ ID NO: 657902 - RNA, 64 nt, Homo Sapiens
aggaaaauaacucuccugaacaaacagcuauaauuuugcaaaaaucccuuguauuuuacagaug

SEQ ID NO: 657903 - RNA, 64 nt, Homo Sapiens
uauuuuuuuccuuguaucaagaugcaaaacauaauuugcaaaauuuuauaauugaaauaaaacu

SEQ ID NO: 657904 - RNA, 64 nt, Homo Sapiens
agcguacaauuuaucauaaauauaugagguaaaauuugcaaaacuuuccacaguacuuucuuga

SEQ ID NO: 657905 - RNA, 64 nt, Homo Sapiens
uacauccaauaugucaaguuaaaccauucugggauuugcaaaguuuaauacauccaauauguca

SEQ ID NO: 657906 - RNA, 64 nt, Homo Sapiens; identical to SEQ ID NO: 657905

SEQ ID NO: 657907 - RNA, 64 nt, Homo Sapiens
acuaccuauagccugugaaaaaauuguggccaucuuugcaaaugacauuuaauucaaggaucaa

SEQ ID NO: 657908 - RNA, 64 nt, Homo Sapiens
cagaacauuuuauaccuaaauaagcacuauagaauuugcaaauuaaagccaauauaaauucuca

SEQ ID NO: 657909 - RNA, 64 nt, Homo Sapiens
aguguguugcucuuucaaguucuaucacuuuuuguuugcaaaguucaaagcuguauuguuuggu

SEQ ID NO: 657910 - RNA, 64 nt, Homo Sapiens
cuugcccagcuuuuugaucuguaggauuaugccuuuugcaaaauuuggggaacuuucaacuauu

SEQ ID NO: 657911 - RNA, 64 nt, Homo Sapiens
acucuuugagucccaggagaagccuggcacccucuuugcaaauuggccuuugcucuuucaaugc

SEQ ID NO: 657912 - RNA, 64 nt, Homo Sapiens
aggcagguuucgggccugaagcagaucagagggcuuugcaaaagacagcauagagccaucuucc

SEQ ID NO: 657913 - RNA, 64 nt, Homo Sapiens
uguguucuuuuccugucaauuuucauagaccuaauuugcaaacucaaucggggacuaaaauuuc

SEQ ID NO: 657914 - RNA, 64 nt, Homo Sapiens
aucuugaauguuguguauauauuuuaaaaagcacuuugcaaaauaguuuguacauuuauuuccu

SEQ ID NO: 657915 - RNA, 64 nt, Homo Sapiens
uuucucccuaugauaauguauuuuaaaaguuacauuugcaaauaccauuuaaauuauauccuca

SEQ ID NO: 657916 - RNA, 64 nt, Homo Sapiens
aagcuugaaaaauaugagaauagccuuggguuuauuugcaaagguuuaguucuuacauuucuaa

SEQ ID NO: 657917 - RNA, 64 nt, Homo Sapiens
gauuucaggagagagcagcuauuggucaacaaaauuugcaaagugcauucucuuuuguuugcaa

SEQ ID NO: 657918 - RNA, 64 nt, Homo Sapiens
ggucaacaaaauuugcaaagugcauucucuuuuguuugcaaauuuucuagguuggguaggccac

SEQ ID NO: 657919 - RNA, 64 nt, Homo Sapiens
agaaugacaguguuggaauuuuaaauaauuccuauuugcaaauuucauguccugaaguuggaau

SEQ ID NO: 657920 - RNA, 64 nt, Homo Sapiens
uuggcaaauagcaucaauuauguuauccgagaccuuugcaaacacaugauugcuaucuuauuuu

SEQ ID NO: 657921 - RNA, 64 nt, Homo Sapiens
aguugaaguauuuuucuugccaugccuauuuauuuuugcaaaaaaauuaucugcuauauagaac

SEQ ID NO: 657922 - RNA, 64 nt, Homo Sapiens
uuauacagucauauggcuacacguuuauguaaaguuugcaaaaguuugguguuuugauuuauaa

SEQ ID NO: 657923 - RNA, 64 nt, Homo Sapiens
cuugauauaaguauuaauagcuucaugcugaauguuugcaaagaugcuguaaauacuauguuua

SEQ ID NO: 657924 - RNA, 64 nt, Homo Sapiens
uacuaugaaccaaaaguugaaugguuuguggcuuuuugcaaaaucaccuuuuaaacgacaaagc

SEQ ID NO: 657925 - RNA, 64 nt, Homo Sapiens
uccaggaagaagcccauuuguugaggcugaccuuccugaucauacacacacacagcccagcaaa

SEQ ID NO: 657926 - RNA, 64 nt, Homo Sapiens
ugauugaugacggguucccgccugcuguccccucccugaucacacagcuaacgaggcugccucc

SEQ ID NO: 657927 - RNA, 64 nt, Homo Sapiens; identical to SEQ ID NO: 101903

SEQ ID NO: 657928 - RNA, 64 nt, Homo Sapiens; identical to SEQ ID NO: 101904

SEQ ID NO: 657929 - RNA, 64 nt, Homo Sapiens; identical to SEQ ID NO: 101905

SEQ ID NO: 657930 - RNA, 64 nt, Homo Sapiens; identical to SEQ ID NO: 101906

SEQ ID NO: 657931 - RNA, 64 nt, Homo Sapiens; identical to SEQ ID NO: 101907

SEQ ID NO: 657932 - RNA, 64 nt, Homo Sapiens; identical to SEQ ID NO: 101908

SEQ ID NO: 657933 - RNA, 64 nt, Homo Sapiens; identical to SEQ ID NO: 101909

SEQ ID NO: 657934 - RNA, 64 nt, Homo Sapiens; identical to SEQ ID NO: 101910

SEQ ID NO: 657935 - RNA, 64 nt, Homo Sapiens; identical to SEQ ID NO: 101911

SEQ ID NO: 657936 - RNA, 64 nt, Homo Sapiens; identical to SEQ ID NO: 101912

SEQ ID NO: 657937 - RNA, 64 nt, Homo Sapiens; identical to SEQ ID NO: 101913

SEQ ID NO: 657938 - RNA, 64 nt, Homo Sapiens; identical to SEQ ID NO: 101914

SEQ ID NO: 657939 - RNA, 64 nt, Homo Sapiens; identical to SEQ ID NO: 478298

SEQ ID NO: 657940 - RNA, 64 nt, Homo Sapiens; identical to SEQ ID NO: 478299

SEQ ID NO: 657941 - RNA, 64 nt, Homo Sapiens; identical to SEQ ID NO: 478300

SEQ ID NO: 657942 - RNA, 64 nt, Homo Sapiens; identical to SEQ ID NO: 478301

SEQ ID NO: 657943 - RNA, 64 nt, Homo Sapiens; identical to SEQ ID NO: 478302

SEQ ID NO: 657944 - RNA, 64 nt, Homo Sapiens; identical to SEQ ID NO: 478303

SEQ ID NO: 657945 - RNA, 64 nt, Homo Sapiens
uccacuauuaauaaauugaaagcuugcuguacaaaggcaacagcaacuuaaaaaagaaaaucug

SEQ ID NO: 657946 - RNA, 64 nt, Homo Sapiens
uuauauuuuuuaaaauaaugaauuuucuaucucuaggcaacaugucuuuauuauucaagcugaa

SEQ ID NO: 657947 - RNA, 64 nt, Homo Sapiens
acuaaauuuuucuaguuucuagacuacuuugaguaggcaacauaacacuacuuaacacuccuaa

SEQ ID NO: 657948 - RNA, 64 nt, Homo Sapiens
gcaagacccugucucuuaaacugcacuccagccuaggcaacagaggugagccaugaucguguca

SEQ ID NO: 657949 - RNA, 64 nt, Homo Sapiens
agaaaggaaucaaaccacagaauugggaggguacaggcaacaggaauuugggagggaaaaaaga

SEQ ID NO: 657950 - RNA, 64 nt, Homo Sapiens
accagaaaggauggaauggcuuucauuguuaaauaggcaacauggcaaacaaauuugauuauuu

SEQ ID NO: 657951 - RNA, 64 nt, Homo Sapiens
cuggcagcugucccaagcaauggguaaugaugauggcaaaaaggguguuugggggaacagcugc

SEQ ID NO: 657952 - RNA, 64 nt, Homo Sapiens
agccaaagcaucuuugacagaagguucugcaccaggcaaaaagaucugaaacauuaguuugggg

SEQ ID NO: 657953 - RNA, 64 nt, Homo Sapiens
gaugccccgagauagaaggggugguaugagaacaggcaaaaagaaaauccagccaguguuuuuu

SEQ ID NO: 657954 - RNA, 64 nt, Homo Sapiens
ugguauggggguuagcacugggggcucucuguggggcaaaaaggggcuaaugaugaggguuggu

SEQ ID NO: 657955 - RNA, 64 nt, Homo Sapiens
aauacaaacaagcaaaaaacgcucauuugaaguuggcaaaaacauuguuuggucaguacuguua

SEQ ID NO: 657956 - RNA, 64 nt, Homo Sapiens
aaaauuacauuaugcccuuguaugcuaaguaaggggcaaaaaaacuaaugggcugcugucauuu

SEQ ID NO: 657957 - RNA, 64 nt, Homo Sapiens
uguaacccuguuguuacuuuauauuucauaaucaggcaaaaauacuuacaguuaauaauauaga

SEQ ID NO: 657958 - RNA, 64 nt, Homo Sapiens
guaggaauucaguugggcaaugauaacuuuuaugggcaaaaacauucuauuauagugaacuaau

SEQ ID NO: 657959 - RNA, 64 nt, Homo Sapiens
cagaaagaagagaucacaaacauaugagucagauggcaaaaaucaagcaaacccuucuagacag

SEQ ID NO: 657960 - RNA, 64 nt, Homo Sapiens
uuuuguuaauaaagaacagauuaguuuugaagaaggcaaaaauuucaguuuucugaagacagca

SEQ ID NO: 657961 - RNA, 64 nt, Homo Sapiens
ucucagaaauuuauguguggggaugguaccuuauggcaaaaaucgaugugguuuacaguaaggu

SEQ ID NO: 657962 - RNA, 64 nt, Homo Sapiens
caagaguaaccccaaccccccggcggcaggagagggcaaaaagcgcgaaagaaacuggagcagc

SEQ ID NO: 657963 - RNA, 64 nt, Homo Sapiens
uauggguuuuuucaggugaauacaggucaguugaggcaaaaaacuugauauagguggacuuuuu

SEQ ID NO: 657964 - RNA, 64 nt, Homo Sapiens
auccagcagacuuuaauuuuagaauauggguuaaggcaaaaaccuaguauuuggaaugaaugga

SEQ ID NO: 657965 - RNA, 64 nt, Homo Sapiens
auauucaauauuaaaauaguuuuauauuugggaaggcaaaaaugaaucuauuguuuugcaauau

SEQ ID NO: 657966 - RNA, 64 nt, Homo Sapiens
acaugacuggggaggccucagaaucauggugggaggcaaaaagcacuucuuacauggcggcagc

SEQ ID NO: 657967 - RNA, 64 nt, Homo Sapiens
uucuaauaucacaauaggugcuuucuccuaaaagggcaaaaaacaaucucaaaaagauuagaaa

SEQ ID NO: 657968 - RNA, 64 nt, Homo Sapiens
gagaucaggaguucgaggccagccuggccaagauggcaaaaaccccgacucuacuaaaaauaca

SEQ ID NO: 657969 - RNA, 64 nt, Homo Sapiens
agacaaaugaggucauaaacacugcauaaagcaaggcaaaaauguaugccacaucucaguuauc

SEQ ID NO: 657970 - RNA, 64 nt, Homo Sapiens
acagggaggauugaaaaaaagggcacucugauagggcaaaaacggaacaugggaggggacaaau

SEQ ID NO: 657971 - RNA, 64 nt, Homo Sapiens
guuuauauaguuaguuuucagcucauuuaaaagaggcaaaaauuaaaagcuuggagagauaguu

SEQ ID NO: 657972 - RNA, 64 nt, Homo Sapiens
gaccacuuuauaccuucgcaguguggucucugggggcaaaaaacuaaugaaaacaaucucugua

SEQ ID NO: 657973 - RNA, 64 nt, Homo Sapiens
ccauggccugauauuaguucuuagagcuucuuguggcaaaaauaaaaugauuuaauucugaugu

SEQ ID NO: 657974 - RNA, 64 nt, Homo Sapiens; identical to SEQ ID NO: 351954

SEQ ID NO: 657975 - RNA, 64 nt, Homo Sapiens; identical to SEQ ID NO: 351955

SEQ ID NO: 657976 - RNA, 64 nt, Homo Sapiens; identical to SEQ ID NO: 351956

SEQ ID NO: 657977 - RNA, 64 nt, Homo Sapiens; identical to SEQ ID NO: 351957

SEQ ID NO: 657978 - RNA, 64 nt, Homo Sapiens; identical to SEQ ID NO: 351958

SEQ ID NO: 657979 - RNA, 64 nt, Homo Sapiens; identical to SEQ ID NO: 351959

SEQ ID NO: 657980 - RNA, 64 nt, Homo Sapiens; identical to SEQ ID NO: 351960

SEQ ID NO: 657981 - RNA, 64 nt, Homo Sapiens; identical to SEQ ID NO: 351961

SEQ ID NO: 657982 - RNA, 64 nt, Homo Sapiens; identical to SEQ ID NO: 351962

SEQ ID NO: 657983 - RNA, 64 nt, Homo Sapiens; identical to SEQ ID NO: 351963

SEQ ID NO: 657984 - RNA, 64 nt, Homo Sapiens; identical to SEQ ID NO: 351964

SEQ ID NO: 657985 - RNA, 64 nt, Homo Sapiens; identical to SEQ ID NO: 351965

SEQ ID NO: 657986 - RNA, 64 nt, Homo Sapiens; identical to SEQ ID NO: 351966

SEQ ID NO: 657987 - RNA, 64 nt, Homo Sapiens; identical to SEQ ID NO: 351967

SEQ ID NO: 657988 - RNA, 64 nt, Homo Sapiens; identical to SEQ ID NO: 351968

SEQ ID NO: 657989 - RNA, 64 nt, Homo Sapiens; identical to SEQ ID NO: 351969

SEQ ID NO: 657990 - RNA, 64 nt, Homo Sapiens; identical to SEQ ID NO: 351970

SEQ ID NO: 657991 - RNA, 64 nt, Homo Sapiens; identical to SEQ ID NO: 351971

SEQ ID NO: 657992 - RNA, 64 nt, Homo Sapiens; identical to SEQ ID NO: 351972

SEQ ID NO: 657993 - RNA, 64 nt, Homo Sapiens; identical to SEQ ID NO: 351973

SEQ ID NO: 657994 - RNA, 64 nt, Homo Sapiens; identical to SEQ ID NO: 351974

SEQ ID NO: 657995 - RNA, 64 nt, Homo Sapiens; identical to SEQ ID NO: 351975

SEQ ID NO: 657996 - RNA, 64 nt, Homo Sapiens; identical to SEQ ID NO: 351976

SEQ ID NO: 657997 - RNA, 64 nt, Homo Sapiens; identical to SEQ ID NO: 351977

SEQ ID NO: 657998 - RNA, 64 nt, Homo Sapiens; identical to SEQ ID NO: 351978

SEQ ID NO: 657999 - RNA, 64 nt, Homo Sapiens; identical to SEQ ID NO: 351979

SEQ ID NO: 658000 - RNA, 64 nt, Homo Sapiens; identical to SEQ ID NO: 351980

SEQ ID NO: 658001 - RNA, 64 nt, Homo Sapiens; identical to SEQ ID NO: 351981

SEQ ID NO: 658002 - RNA, 64 nt, Homo Sapiens; identical to SEQ ID NO: 351982

SEQ ID NO: 658003 - RNA, 64 nt, Homo Sapiens; identical to SEQ ID NO: 351983

SEQ ID NO: 658004 - RNA, 64 nt, Homo Sapiens; identical to SEQ ID NO: 351984

SEQ ID NO: 658005 - RNA, 64 nt, Homo Sapiens; identical to SEQ ID NO: 351985

SEQ ID NO: 658006 - RNA, 64 nt, Homo Sapiens; identical to SEQ ID NO: 351986

SEQ ID NO: 658007 - RNA, 64 nt, Homo Sapiens; identical to SEQ ID NO: 351987

SEQ ID NO: 658008 - RNA, 64 nt, Homo Sapiens; identical to SEQ ID NO: 351988

SEQ ID NO: 658009 - RNA, 64 nt, Homo Sapiens; identical to SEQ ID NO: 351989

SEQ ID NO: 658010 - RNA, 64 nt, Homo Sapiens; identical to SEQ ID NO: 351990

SEQ ID NO: 658011 - RNA, 64 nt, Homo Sapiens; identical to SEQ ID NO: 351991

SEQ ID NO: 658012 - RNA, 64 nt, Homo Sapiens; identical to SEQ ID NO: 351992

SEQ ID NO: 658013 - RNA, 64 nt, Homo Sapiens; identical to SEQ ID NO: 351993

SEQ ID NO: 658014 - RNA, 64 nt, Homo Sapiens; identical to SEQ ID NO: 351994

SEQ ID NO: 658015 - RNA, 64 nt, Homo Sapiens; identical to SEQ ID NO: 351995

SEQ ID NO: 658016 - RNA, 64 nt, Homo Sapiens; identical to SEQ ID NO: 351996

SEQ ID NO: 658017 - RNA, 64 nt, Homo Sapiens; identical to SEQ ID NO: 351997

SEQ ID NO: 658018 - RNA, 64 nt, Homo Sapiens; identical to SEQ ID NO: 351998

SEQ ID NO: 658019 - RNA, 64 nt, Homo Sapiens; identical to SEQ ID NO: 351999

SEQ ID NO: 658020 - RNA, 64 nt, Homo Sapiens; identical to SEQ ID NO: 352000

SEQ ID NO: 658021 - RNA, 64 nt, Homo Sapiens; identical to SEQ ID NO: 352001

SEQ ID NO: 658022 - RNA, 64 nt, Homo Sapiens; identical to SEQ ID NO: 352002

SEQ ID NO: 658023 - RNA, 64 nt, Homo Sapiens; identical to SEQ ID NO: 352003

SEQ ID NO: 658024 - RNA, 64 nt, Homo Sapiens; identical to SEQ ID NO: 352004

SEQ ID NO: 658025 - RNA, 64 nt, Homo Sapiens; identical to SEQ ID NO: 352005

SEQ ID NO: 658026 - RNA, 64 nt, Homo Sapiens; identical to SEQ ID NO: 352006

SEQ ID NO: 658027 - RNA, 64 nt, Homo Sapiens; identical to SEQ ID NO: 352007

SEQ ID NO: 658028 - RNA, 64 nt, Homo Sapiens; identical to SEQ ID NO: 352008

SEQ ID NO: 658029 - RNA, 64 nt, Homo Sapiens; identical to SEQ ID NO: 157890

SEQ ID NO: 658030 - RNA, 64 nt, Homo Sapiens; identical to SEQ ID NO: 157891

SEQ ID NO: 658031 - RNA, 64 nt, Homo Sapiens; identical to SEQ ID NO: 157892

SEQ ID NO: 658032 - RNA, 64 nt, Homo Sapiens; identical to SEQ ID NO: 157893

SEQ ID NO: 658033 - RNA, 64 nt, Homo Sapiens; identical to SEQ ID NO: 157894

SEQ ID NO: 658034 - RNA, 64 nt, Homo Sapiens; identical to SEQ ID NO: 157895

SEQ ID NO: 658035 - RNA, 64 nt, Homo Sapiens; identical to SEQ ID NO: 157896

SEQ ID NO: 658036 - RNA, 64 nt, Homo Sapiens; identical to SEQ ID NO: 157897

SEQ ID NO: 658037 - RNA, 64 nt, Homo Sapiens; identical to SEQ ID NO: 157898

SEQ ID NO: 658038 - RNA, 64 nt, Homo Sapiens; identical to SEQ ID NO: 157899

SEQ ID NO: 658039 - RNA, 64 nt, Homo Sapiens; identical to SEQ ID NO: 21544

SEQ ID NO: 658040 - RNA, 55 nt, Homo Sapiens; identical to SEQ ID NO: 21545

SEQ ID NO: 658041 - RNA, 64 nt, Homo Sapiens; identical to SEQ ID NO: 21546

SEQ ID NO: 658042 - RNA, 64 nt, Homo Sapiens; identical to SEQ ID NO: 21547

SEQ ID NO: 658043 - RNA, 64 nt, Homo Sapiens; identical to SEQ ID NO: 21548

SEQ ID NO: 658044 - RNA, 64 nt, Homo Sapiens; identical to SEQ ID NO: 21549

SEQ ID NO: 658045 - RNA, 64 nt, Homo Sapiens; identical to SEQ ID NO: 21550

SEQ ID NO: 658046 - RNA, 64 nt, Homo Sapiens; identical to SEQ ID NO: 21551

SEQ ID NO: 658047 - RNA, 64 nt, Homo Sapiens; identical to SEQ ID NO: 21552

SEQ ID NO: 658048 - RNA, 64 nt, Homo Sapiens; identical to SEQ ID NO: 21553

SEQ ID NO: 658049 - RNA, 64 nt, Homo Sapiens; identical to SEQ ID NO: 21554

SEQ ID NO: 658050 - RNA, 64 nt, Homo Sapiens; identical to SEQ ID NO: 21555

SEQ ID NO: 658051 - RNA, 64 nt, Homo Sapiens; identical to SEQ ID NO: 21556

SEQ ID NO: 658052 - RNA, 64 nt, Homo Sapiens; identical to SEQ ID NO: 21557

SEQ ID NO: 658053 - RNA, 64 nt, Homo Sapiens; identical to SEQ ID NO: 21558

SEQ ID NO: 658054 - RNA, 64 nt, Homo Sapiens; identical to SEQ ID NO: 21559

SEQ ID NO: 658055 - RNA, 64 nt, Homo Sapiens; identical to SEQ ID NO: 132617

SEQ ID NO: 658056 - RNA, 64 nt, Homo Sapiens; identical to SEQ ID NO: 132618

SEQ ID NO: 658057 - RNA, 64 nt, Homo Sapiens; identical to SEQ ID NO: 132619

SEQ ID NO: 658058 - RNA, 64 nt, Homo Sapiens; identical to SEQ ID NO: 132620

SEQ ID NO: 658059 - RNA, 64 nt, Homo Sapiens; identical to SEQ ID NO: 132621

SEQ ID NO: 658060 - RNA, 64 nt, Homo Sapiens; identical to SEQ ID NO: 132622

SEQ ID NO: 658061 - RNA, 64 nt, Homo Sapiens; identical to SEQ ID NO: 132623

SEQ ID NO: 658062 - RNA, 64 nt, Homo Sapiens; identical to SEQ ID NO: 132624

SEQ ID NO: 658063 - RNA, 64 nt, Homo Sapiens; identical to SEQ ID NO: 132625

SEQ ID NO: 658064 - RNA, 64 nt, Homo Sapiens; identical to SEQ ID NO: 132626

SEQ ID NO: 658065 - RNA, 64 nt, Homo Sapiens; identical to SEQ ID NO: 132627

SEQ ID NO: 658066 - RNA, 64 nt, Homo Sapiens; identical to SEQ ID NO: 132628

SEQ ID NO: 658067 - RNA, 64 nt, Homo Sapiens; identical to SEQ ID NO: 132629

SEQ ID NO: 658068 - RNA, 64 nt, Homo Sapiens; identical to SEQ ID NO: 132630

SEQ ID NO: 658069 - RNA, 64 nt, Homo Sapiens; identical to SEQ ID NO: 132631

SEQ ID NO: 658070 - RNA, 64 nt, Homo Sapiens; identical to SEQ ID NO: 132632

SEQ ID NO: 658071 - RNA, 64 nt, Homo Sapiens; identical to SEQ ID NO: 132633

SEQ ID NO: 658072 - RNA, 64 nt, Homo Sapiens; identical to SEQ ID NO: 132634

SEQ ID NO: 658073 - RNA, 64 nt, Homo Sapiens; identical to SEQ ID NO: 132635

SEQ ID NO: 658074 - RNA, 64 nt, Homo Sapiens; identical to SEQ ID NO: 132636

SEQ ID NO: 658075 - RNA, 64 nt, Homo Sapiens; identical to SEQ ID NO: 132637

SEQ ID NO: 658076 - RNA, 64 nt, Homo Sapiens; identical to SEQ ID NO: 132638

SEQ ID NO: 658077 - RNA, 64 nt, Homo Sapiens; identical to SEQ ID NO: 132639

SEQ ID NO: 658078 - RNA, 64 nt, Homo Sapiens; identical to SEQ ID NO: 132640

SEQ ID NO: 658079 - RNA, 64 nt, Homo Sapiens; identical to SEQ ID NO: 132641

SEQ ID NO: 658080 - RNA, 64 nt, Homo Sapiens; identical to SEQ ID NO: 132642

SEQ ID NO: 658081 - RNA, 64 nt, Homo Sapiens; identical to SEQ ID NO: 132643

SEQ ID NO: 658082 - RNA, 64 nt, Homo Sapiens; identical to SEQ ID NO: 132644

SEQ ID NO: 658083 - RNA, 64 nt, Homo Sapiens; identical to SEQ ID NO: 132645

SEQ ID NO: 658084 - RNA, 64 nt, Homo Sapiens; identical to SEQ ID NO: 132646

SEQ ID NO: 658085 - RNA, 64 nt, Homo Sapiens; identical to SEQ ID NO: 132647

SEQ ID NO: 658086 - RNA, 64 nt, Homo Sapiens; identical to SEQ ID NO: 132648

SEQ ID NO: 658087 - RNA, 64 nt, Homo Sapiens; identical to SEQ ID NO: 132649

SEQ ID NO: 658088 - RNA, 64 nt, Homo Sapiens; identical to SEQ ID NO: 132650

SEQ ID NO: 658089 - RNA, 64 nt, Homo Sapiens; identical to SEQ ID NO: 132651

SEQ ID NO: 658090 - RNA, 64 nt, Homo Sapiens; identical to SEQ ID NO: 132652

SEQ ID NO: 658091 - RNA, 64 nt, Homo Sapiens; identical to SEQ ID NO: 132653

SEQ ID NO: 658092 - RNA, 64 nt, Homo Sapiens; identical to SEQ ID NO: 132654

SEQ ID NO: 658093 - RNA, 64 nt, Homo Sapiens; identical to SEQ ID NO: 132655

SEQ ID NO: 658094 - RNA, 64 nt, Homo Sapiens; identical to SEQ ID NO: 132656

SEQ ID NO: 658095 - RNA, 64 nt, Homo Sapiens; identical to SEQ ID NO: 132657

SEQ ID NO: 658096 - RNA, 64 nt, Homo Sapiens; identical to SEQ ID NO: 132658

SEQ ID NO: 658097 - RNA, 64 nt, Homo Sapiens; identical to SEQ ID NO: 132659

SEQ ID NO: 658098 - RNA, 64 nt, Homo Sapiens; identical to SEQ ID NO: 132660

SEQ ID NO: 658099 - RNA, 64 nt, Homo Sapiens; identical to SEQ ID NO: 132661

SEQ ID NO: 658100 - RNA, 64 nt, Homo Sapiens; identical to SEQ ID NO: 132662

SEQ ID NO: 658101 - RNA, 64 nt, Homo Sapiens; identical to SEQ ID NO: 132663

SEQ ID NO: 658102 - RNA, 64 nt, Homo Sapiens; identical to SEQ ID NO: 132664

SEQ ID NO: 658103 - RNA, 64 nt, Homo Sapiens; identical to SEQ ID NO: 132665

SEQ ID NO: 658104 - RNA, 64 nt, Homo Sapiens; identical to SEQ ID NO: 132666

SEQ ID NO: 658105 - RNA, 64 nt, Homo Sapiens; identical to SEQ ID NO: 132667

SEQ ID NO: 658106 - RNA, 64 nt, Homo Sapiens; identical to SEQ ID NO: 132668

SEQ ID NO: 658107 - RNA, 64 nt, Homo Sapiens; identical to SEQ ID NO: 132669

SEQ ID NO: 658108 - RNA, 64 nt, Homo Sapiens; identical to SEQ ID NO: 132670

SEQ ID NO: 658109 - RNA, 64 nt, Homo Sapiens; identical to SEQ ID NO: 132671

SEQ ID NO: 658110 - RNA, 64 nt, Homo Sapiens; identical to SEQ ID NO: 132672

SEQ ID NO: 658111 - RNA, 64 nt, Homo Sapiens; identical to SEQ ID NO: 132673

SEQ ID NO: 658112 - RNA, 64 nt, Homo Sapiens; identical to SEQ ID NO: 132674

SEQ ID NO: 658113 - RNA, 64 nt, Homo Sapiens; identical to SEQ ID NO: 132675

SEQ ID NO: 658114 - RNA, 64 nt, Homo Sapiens; identical to SEQ ID NO: 132676

SEQ ID NO: 658115 - RNA, 64 nt, Homo Sapiens; identical to SEQ ID NO: 132677

SEQ ID NO: 658116 - RNA, 57 nt, Homo Sapiens; identical to SEQ ID NO: 132678

SEQ ID NO: 658117 - RNA, 64 nt, Homo Sapiens; identical to SEQ ID NO: 132679

SEQ ID NO: 658118 - RNA, 64 nt, Homo Sapiens; identical to SEQ ID NO: 132680
